United States Patent 8,461,315 (MICRORNAS AND USES THEREOF) - sequence listing, part 5

SEQ ID NO: 106497 - RNA, 64 nt, Homo Sapiens
acaaacuaggaagacuagcuuuuuuuuuaauuugggaggcaagcauuuuuggcacauaacaacu

SEQ ID NO: 106498 - RNA, 64 nt, Homo Sapiens
uuaaugguaccagccugucauagauauuggucugggaggcaacacauuuauauuuuacaaaugc

SEQ ID NO: 106499 - RNA, 64 nt, Homo Sapiens
gguaccagcuuuucaaugagaucuccccacaaaaggaggcaaaguguucagcuauuuuccagau

SEQ ID NO: 106500 - RNA, 64 nt, Homo Sapiens
aaugaguauaucuuagucaaagucuugaacacuuggaggcaauuugcuugccucaaauccaagc

SEQ ID NO: 106501 - RNA, 64 nt, Homo Sapiens
uuucugguuucugguuccuaccagacaagagcugggaggcaagacacucugagguuucuaucuu

SEQ ID NO: 106502 - RNA, 64 nt, Homo Sapiens
gcuguagcugccaggccagcgauguucugggggaggaggcaaucgugauugggcccuccggcug

SEQ ID NO: 106503 - RNA, 64 nt, Homo Sapiens
ggugauguaguauggccugacagcucuguuuagaggaggcaacacugaucccccagaugcaggg

SEQ ID NO: 106504 - RNA, 64 nt, Homo Sapiens
gggcggagccccggcucuuauagaagcuucagcaggaggcaagcguguucucagcacauauggg

SEQ ID NO: 106505 - RNA, 64 nt, Homo Sapiens
ccagagccuggcuguggggaauggugucuucacaggaggcaaaucccgucagccugugcuaggc

SEQ ID NO: 106506 - RNA, 64 nt, Homo Sapiens
uucgacugcagccgccccgucugguucauaaucuggaggcaaggcgagaauugugcuacuuaua

SEQ ID NO: 106507 - RNA, 64 nt, Homo Sapiens
uccagaauaaaaagaagagacugaucucuucaauuauugucaucuguagccaccagcacaucac

SEQ ID NO: 106508 - RNA, 64 nt, Homo Sapiens
guguuuaauagugaucuguauacagcugugcacauauugucaucacuuauucuagcaucacugu

SEQ ID NO: 106509 - RNA, 64 nt, Homo Sapiens
ccaagaaaaaauauauuaaacauaguaauauuauuauugucaucuagaaauaaguuaauacuau

SEQ ID NO: 106510 - RNA, 64 nt, Homo Sapiens
ccaagaaaaaagauauuuuacauguuaauacuauuauugucaucauaagaaaaauuaauacuau

SEQ ID NO: 106511 - RNA, 64 nt, Homo Sapiens
augggcuacacagcagcuguucaacaagaguaaauauugucacaacacugaaccucuggcuaga

SEQ ID NO: 106512 - RNA, 64 nt, Homo Sapiens
uaauuaaaguaaaauuauucccugaauuguuugauauugucaccuagcagauauguauuacuuu

SEQ ID NO: 106513 - RNA, 64 nt, Homo Sapiens
acaauguaaagcaauaugauuuguuacuauaauuaaccuguauaaaagauacauuuuauggugg

SEQ ID NO: 106514 - RNA, 64 nt, Homo Sapiens
ucaucugagacaaggcaagucccuuccacuuaugaaccuguaaaaucaaaaguaaacuaguuac

SEQ ID NO: 106515 - RNA, 64 nt, Homo Sapiens
uacagauucuuccuguaaaccguuuucuuucugcaaccuguacuugaauguaaauagcacuaaa

SEQ ID NO: 106516 - RNA, 64 nt, Homo Sapiens
aauaugaaagauuuuuauaugcuacuuucaucuaaaccuguaaaugcacagcacuaaagcauga

SEQ ID NO: 106517 - RNA, 64 nt, Homo Sapiens
ccagccuugaaguucuuugaccuccucaauucacaaccuguagcugacuuuagccacccacaag

SEQ ID NO: 106518 - RNA, 64 nt, Homo Sapiens
uucuacaguuuucuuaaucaaaaguggucuagguaaccuguaaagaaaggauuaaaaauuuaag

SEQ ID NO: 106519 - RNA, 64 nt, Homo Sapiens
auccaggccuagucaguagcaguaggguaacgggauugaaaaagauuugauggagaggaaagua

SEQ ID NO: 106520 - RNA, 64 nt, Homo Sapiens
gcaacaccaacacaggaagaaauagaagucaccuauugaaaacuggaauggcccauucagaaag

SEQ ID NO: 106521 - RNA, 64 nt, Homo Sapiens
uucuuucuucuucacaggccuucuuucaaggcaaauugaaaaucacuggcaacaugggucucgc

SEQ ID NO: 106522 - RNA, 64 nt, Homo Sapiens
uuaaaauaaaaauauuuuuaacauggguuuccuuauugaaaaaucaguguauuagucauaaaac

SEQ ID NO: 106523 - RNA, 64 nt, Homo Sapiens
uguguaaugcauuguucucaguuucccugccaacauugaaaaauaaaaacagcagcuuuucucc

SEQ ID NO: 106524 - RNA, 64 nt, Homo Sapiens
gauuaauccuaaaauacagguguguuccaucugaauugaaaaugauauauuugagauauaauuu

SEQ ID NO: 106525 - RNA, 64 nt, Homo Sapiens
cuaugguuguuaucuuacuucuacaguggaagagauugaaaagcauuugucagguuaaugcuaa

SEQ ID NO: 106526 - RNA, 64 nt, Homo Sapiens
auaaaauuugaaacaauaauuucaaauaauaaagauugaaaaugcuuaacccagaaagaaucca

SEQ ID NO: 106527 - RNA, 64 nt, Homo Sapiens
aggggaaggggaagaaaagauugacgugggagaaauugaaaagaaaaacauguuggcuuuucuc

SEQ ID NO: 106528 - RNA, 64 nt, Homo Sapiens
accaagaaguggaagaagacuugacauggaugaaauugaaaaguacagcguauuggcuuggcug

SEQ ID NO: 106529 - RNA, 64 nt, Homo Sapiens
agauuuuuuaaaaaaaaaaacugucacaagucuuauugaaaaguggcuuuuuauuuaaaggauu

SEQ ID NO: 106530 - RNA, 64 nt, Homo Sapiens
ugugugugcaacuuuuggggccguuuuauaugacauugaaaacucacuuauuggucuaguuugu

SEQ ID NO: 106531 - RNA, 64 nt, Homo Sapiens
acaacaacaaaaacaaaaugaguuucaguggaugauugaaaacauauaauucuggugaaguaau

SEQ ID NO: 106532 - RNA, 64 nt, Homo Sapiens
auacuuugauuuuugaagguuacugcauuuucacauugaaaagauugguggcagaaaaagaaga

SEQ ID NO: 106533 - RNA, 64 nt, Homo Sapiens
gaggcaguuaaccaaaguagaaaacaaaagaaauauugaaaacuuucgccauacuagcggaggu

SEQ ID NO: 106534 - RNA, 64 nt, Homo Sapiens
accaauacuuuuugcacauauaacaaauguauaaauugaaaaguugaagccagccacaagauac

SEQ ID NO: 106535 - RNA, 64 nt, Homo Sapiens
ucugauagugcuguaggcucauccauagcuauuaauugaaaacuacugaucgcaggauuuucug

SEQ ID NO: 106536 - RNA, 64 nt, Homo Sapiens
acaacuaacgcaaccaagugguauaauauugaaaauugaaaagugguugaauaauauaugccuu

SEQ ID NO: 106537 - RNA, 64 nt, Homo Sapiens
gaaaaguacaacuaacgcaaaugccuuguauaauauugaaaauuaggaaaagguugaauaauau

SEQ ID NO: 106538 - RNA, 64 nt, Homo Sapiens
uucuuucuaauaaaauaauacucuggcugcugcaauugaaaacuuugguuaaucuacaccuuaa

SEQ ID NO: 106539 - RNA, 64 nt, Homo Sapiens
aggaaggaagaggguugugcauauuuauugacaaauugaaaagcaaacgugcauacaguagcaa

SEQ ID NO: 106540 - RNA, 64 nt, Homo Sapiens
aaaaaggaauaugaaagucuuauuaaaacacuucauugaaaauauacagucuaaauuuauuauu

SEQ ID NO: 106541 - RNA, 64 nt, Homo Sapiens
uacuguuuagugagcaguaugauuuguacaugccauugaaaauuauuaaucagaagaaaauuaa

SEQ ID NO: 106542 - RNA, 64 nt, Homo Sapiens
gcccaugguucauuugguaucccuauuuaauugcauugaaaaugucauccuuucuguuguuaga

SEQ ID NO: 106543 - RNA, 64 nt, Homo Sapiens
uauauauauauauuuuaaauguuuucacugacucauugaaaauguuaauuacacacacaugcau

SEQ ID NO: 106544 - RNA, 64 nt, Homo Sapiens
uuuuacguuggaauccuccuucuagcugaaggugauugaaaaggaaaagagugagugaacagaa

SEQ ID NO: 106545 - RNA, 64 nt, Homo Sapiens
cuugcacaaauuguaaugugauacugugaaacaaauugaaaacauugccucuuugcaucacaua

SEQ ID NO: 106546 - RNA, 64 nt, Homo Sapiens
auguauguagcacuuuccuauauauuugucacacauugaaaacuggacuggguauaacuauguu

SEQ ID NO: 106547 - RNA, 64 nt, Homo Sapiens
uuuuuugcuucugcuuccauuuugucacagauuuauugaaaaacaaagacuuuuguguuuuggc

SEQ ID NO: 106548 - RNA, 64 nt, Homo Sapiens
caagaugaccuuucuaaugaaugaaauguuucauauugaaaacauugggauuggauuuuaccau

SEQ ID NO: 106549 - RNA, 64 nt, Homo Sapiens
gaagacaaguucuuuguaacuccacauauuacuaauugaaaaauuguccauuggguaacuuuua

SEQ ID NO: 106550 - RNA, 64 nt, Homo Sapiens
ucaacaagaauuuaauucuacuuuguaguacaagauugaaaaacaaugaaucuaauccauaagg

SEQ ID NO: 106551 - RNA, 64 nt, Homo Sapiens
ccuccaaaaagagaacuauucaguuuacucaucaauugaaaaguaaguucugaaauaucuaaag

SEQ ID NO: 106552 - RNA, 64 nt, Homo Sapiens
uaauagcugccucaugacaacccuaaaugugguuauugaaaaccaaucaguccuaugaauguau

SEQ ID NO: 106553 - RNA, 64 nt, Homo Sapiens
aagagcuugcuuacuacaagaaaaauauugaaauauugaaaauauugaaaauauuauuauugaa

SEQ ID NO: 106554 - RNA, 64 nt, Homo Sapiens
cuuacuacaagaaaaauauugaaauauugaaaauauugaaaauauuauuauugaaaauaaaauc

SEQ ID NO: 106555 - RNA, 64 nt, Homo Sapiens
auauugaaauauugaaaauauugaaaauauuauuauugaaaauaaaaucuugaucucaacuauc

SEQ ID NO: 106556 - RNA, 64 nt, Homo Sapiens
cacucaucuaccagauucugccuauguaaaaugaauugaaaaacaauuuucuguaaucuuuuau

SEQ ID NO: 106557 - RNA, 64 nt, Homo Sapiens
agauauuauuaauuuuuauuuauuuuucuugggaauugaaaaaaauugaaauaaauaaaaaugc

SEQ ID NO: 106558 - RNA, 64 nt, Homo Sapiens
gugacaacacaggaaaaguugguuuucaggugagauugaaaaugaagcaaagauaggaugaauc

SEQ ID NO: 106559 - RNA, 64 nt, Homo Sapiens
guuaucccuccucaguaugaaaaauaaauuagauauugaaaaaugucuaaacuucagugaugga

SEQ ID NO: 106560 - RNA, 64 nt, Homo Sapiens
aaaucuguagaauuuauuuuaacuaugaccuuuaauugaaaauaaauaauuaaaauaucagaca

SEQ ID NO: 106561 - RNA, 64 nt, Homo Sapiens
agugaugugccauuuguuaauauacaagagaaauauugaaaauauauugaaaagagcaauuuua

SEQ ID NO: 106562 - RNA, 64 nt, Homo Sapiens
auuuguuaauauacaagagaaauauugaaaauauauugaaaagagcaauuuuaaauuauuuuug

SEQ ID NO: 106563 - RNA, 64 nt, Homo Sapiens
gacgauaaacauugaaugaggagguucuaaaggaauugaaaagaauaaauguauguguggggcu

SEQ ID NO: 106564 - RNA, 64 nt, Homo Sapiens
agaacacgacugaaaaaguuuugguugaauaauuauugaaaaaacaauacauaaccuauggcag

SEQ ID NO: 106565 - RNA, 64 nt, Homo Sapiens
uugaaagaacugauauuaaucaacuuuuuauguuauugaaaauauacuaaauuauaacuaaaag

SEQ ID NO: 106566 - RNA, 64 nt, Homo Sapiens
cuaaauuauaacuaaaagcacaauuagugaaaguauugaaaauaaucuugaacauuuaugaugu

SEQ ID NO: 106567 - RNA, 64 nt, Homo Sapiens
ccaaaagauguaucauuuuuccuagaaaagugaaauugaaaauauagguuauucauaauguaua

SEQ ID NO: 106568 - RNA, 64 nt, Homo Sapiens
cacaccacacaucacacacaaccucgcuuaguauauugaaaacaaguugguagaccaaaaggug

SEQ ID NO: 106569 - RNA, 64 nt, Homo Sapiens
uguucauaauguuucugcauucaucuguucuuaaauugaaaaacauauaauuuacuucuuauaa

SEQ ID NO: 106570 - RNA, 64 nt, Homo Sapiens
uuaauuuauaauuuauucauguguuauuacuguaauugaaaauguuauagacacuuuuaaauuc

SEQ ID NO: 106571 - RNA, 64 nt, Homo Sapiens
cagcucauagguagagcaaagaaaggguggauggauugaaaagauuagccucugucucgguggc

SEQ ID NO: 106572 - RNA, 64 nt, Homo Sapiens
gcaaaacauacuuuagaaacaaaugaaaaaggcaauugaaaaucccagcuauuucaccuagaug

SEQ ID NO: 106573 - RNA, 64 nt, Homo Sapiens
aaccauuauuuuucauuuuguuuguucuaagaggauugaaaaucaguuuaguuuaaaugucuuu

SEQ ID NO: 106574 - RNA, 64 nt, Homo Sapiens
augaccaugucucgguuuauuuuuuuuuucuuggauugaaaaguacugaaauucaaugugacau

SEQ ID NO: 106575 - RNA, 64 nt, Homo Sapiens
caucucuuaccucuucucuacugcugcacgccgaauugaaaaucuguuguagccauauucccug

SEQ ID NO: 106576 - RNA, 64 nt, Homo Sapiens
uucacugauuuuuaaauugguuaggagacuaaacauugaaaacugcaaauuuaagcauuauaua

SEQ ID NO: 106577 - RNA, 64 nt, Homo Sapiens
aaugcuugacuucaacuuuuuacucucaagucccauugaaaaugcaaauccucuaauugcauac

SEQ ID NO: 106578 - RNA, 64 nt, Homo Sapiens
uaaauuaaaauuuccacaaggucaacuauucagaauugaaaaugcacagcugaacuauuucagu

SEQ ID NO: 106579 - RNA, 64 nt, Homo Sapiens
uuaugaaaaagccuugaauaaauguuuuucagccauugaaaaugaaauauuaagcucuugguua

SEQ ID NO: 106580 - RNA, 64 nt, Homo Sapiens
uuuuggggcauacacacucacaaucuuugaugacauugaaaacgugauuuacugugaauuugcc

SEQ ID NO: 106581 - RNA, 64 nt, Homo Sapiens
ucaagauggugggggcauuuuuagagcggcaauaauugaaaaaaaaggcgaacucugccuugga

SEQ ID NO: 106582 - RNA, 64 nt, Homo Sapiens
ucccaacuaaagaauggauuuaauuaaacuauguauugaaaaaaaaguagccuaaguguuagag

SEQ ID NO: 106583 - RNA, 64 nt, Homo Sapiens
ugcaguaacaagcauaaaacgcccuuaauucauaauugaaaauaacaggaagacggugauucuu

SEQ ID NO: 106584 - RNA, 64 nt, Homo Sapiens
ucauacucuauuaccaauuuuauauuuuacugcaauugaaaaaaaugauaaauuuuacauuaug

SEQ ID NO: 106585 - RNA, 64 nt, Homo Sapiens
auuggcauuaaaacuuaaccuauauaauuauguuauugaaaaaauuauuguauuuuaguauauu

SEQ ID NO: 106586 - RNA, 64 nt, Homo Sapiens
uaaguaaaugucuguggccuuuauggcgauucccauugaaaauggcagcaggccuguugcuuuu

SEQ ID NO: 106587 - RNA, 64 nt, Homo Sapiens
uacaguucuccaacuucauugugccagugaaucuauugaaaagcuguuaauauuuccguguccu

SEQ ID NO: 106588 - RNA, 64 nt, Homo Sapiens
uagaaauugaugacuuuauaaugcaaccaggaguauugaaaaaaaaguaagcaaugagcucaaa

SEQ ID NO: 106589 - RNA, 64 nt, Homo Sapiens
uugaaucaugugauucuagauuaacauuaaauagauugaaaaagaaacuuugcacgguaugagc

SEQ ID NO: 106590 - RNA, 64 nt, Homo Sapiens
uucuguuuuuuucuuuguuaauucauuuaaacucauugaaaacauaguauacauuacuaaaagg

SEQ ID NO: 106591 - RNA, 64 nt, Homo Sapiens
uuaauuuacaagugcugguagagguauuuuggaaauugaaaaacuauucccuucuguuuuaaag

SEQ ID NO: 106592 - RNA, 64 nt, Homo Sapiens
gcauuguuggaauuuauuccgaaauaaugaaugcauugaaaauacaaauauuccaguaaguuuu

SEQ ID NO: 106593 - RNA, 64 nt, Homo Sapiens
agcaccaagaacaguuuuuauauuuuauuuucacauugaaaaucagucagauuugcuucagccu

SEQ ID NO: 106594 - RNA, 64 nt, Homo Sapiens
cuuagagucagcaucaugggaaagaguaacagcaauugaaaaaagagauucaagagccaaguac

SEQ ID NO: 106595 - RNA, 64 nt, Homo Sapiens
uucaugauuuccuaccauauucaggccuaaagacauugaaaaagcaucuuuucuugagaucaug

SEQ ID NO: 106596 - RNA, 64 nt, Homo Sapiens
cuuggaauuuucauuuugaugcagaaauuuugaaauugaaaaugugcauguuuuggugcacaaa

SEQ ID NO: 106597 - RNA, 64 nt, Homo Sapiens
ccaggcaucgaaaacaagagaacguaugguaaauauugaaaacucagucgaccugauaaaaagc

SEQ ID NO: 106598 - RNA, 64 nt, Homo Sapiens
uaugaauuauuuuuuuuuaaagaacaggcauauaauugaaaacuauuauuucauuacauuacuc

SEQ ID NO: 106599 - RNA, 64 nt, Homo Sapiens
agacgcugcucccacggaggcuguagucacaugaauugaaaaggcacaguucaccaagugccuu

SEQ ID NO: 106600 - RNA, 64 nt, Homo Sapiens
cagaugguucugaggaggaagaggacguagaguuauugaaaaugcguuccuucuagaaggucug

SEQ ID NO: 106601 - RNA, 64 nt, Homo Sapiens
ggaaauuaucgcccacauuuguaauauagucgccauugaaaaguuaauuauccuuuuuuuaggg

SEQ ID NO: 106602 - RNA, 64 nt, Homo Sapiens
cugacuuucuguuacaaaguugauugucucugucauugaaaaguuuuaguauuaaucuuuuucu

SEQ ID NO: 106603 - RNA, 64 nt, Homo Sapiens
auaaaaaaaaaaguuacagaaaaaagaaggaaaaauugaaaaaacagacuagugcuuaaaaaaa

SEQ ID NO: 106604 - RNA, 64 nt, Homo Sapiens
aaaacaaaaacaaaaaauggauaacccuuuuagcauugaaaaaauauaagguugaaaauucuga

SEQ ID NO: 106605 - RNA, 64 nt, Homo Sapiens
uuaaaaaaaaagaaauauauagacauauaucugcauugaaaacaaccuaaauauucaucagugg

SEQ ID NO: 106606 - RNA, 64 nt, Homo Sapiens
augaaaucauuuauaaagaacaacuguuucuauuauugaaaauuguauguaaaacuauuuaaaa

SEQ ID NO: 106607 - RNA, 64 nt, Homo Sapiens
aaacuuagcuguuuuaaaaacuuuguauuugaacauugaaaaguuacaguagucagcucugaua

SEQ ID NO: 106608 - RNA, 64 nt, Homo Sapiens
uaucaauagaggugaaaggaaauuauuaaacuauauugaaaaauaaagaugucaauaaaaggag

SEQ ID NO: 106609 - RNA, 64 nt, Homo Sapiens
ucuuuccaaaggcuguuuuauuugugauugaaaaauugaaaaccaauuaggaagcuugauuugc

SEQ ID NO: 106610 - RNA, 64 nt, Homo Sapiens
ugaaaaccucuuuccaaaggugauuugcuuugugauugaaaaauuuguagcuaauuaggaagcu

SEQ ID NO: 106611 - RNA, 64 nt, Homo Sapiens
uacauuacuuaaauguugcuuuuagcuuugauaaauugaaaauauuuuaauguguuguauuuuu

SEQ ID NO: 106612 - RNA, 64 nt, Homo Sapiens
aauugaaaauauuuuaauguguuguauuuuugaaauugaaaacacuguaaaauagauugaugug

SEQ ID NO: 106613 - RNA, 51 nt, Homo Sapiens
agauaagcaugaaaacuugaacaaugaaaagcagaaugaaaaugagucauu

SEQ ID NO: 106614 - RNA, 64 nt, Homo Sapiens
cuucagucccuccaguguguauauuaccauucuccaaugaaauaauagggcauuuaacaaagau

SEQ ID NO: 106615 - RNA, 64 nt, Homo Sapiens
ugguuuaacuagcaaaagccaaaacaaaaugauccaaugaaaacuuuggucaaaacacacauag

SEQ ID NO: 106616 - RNA, 64 nt, Homo Sapiens
ugguuuuguaugacuugaaucucaguuugaaagacaaugaaaaagcgugcugaauaggauucuu

SEQ ID NO: 106617 - RNA, 64 nt, Homo Sapiens
gucaaauuucaagauuuuaaguauuuuuuaguaacaaugaaauugagcagcucaaaguaaacgu

SEQ ID NO: 106618 - RNA, 64 nt, Homo Sapiens
uauugugaacauuauucucaugcaauuaagaugccaaugaaaagcauuuuccacuucuacauga

SEQ ID NO: 106619 - RNA, 64 nt, Homo Sapiens
gguuuguucuaagucacucugagaggagugauaccaaugaaaaaaggucaguugauuccagugc

SEQ ID NO: 106620 - RNA, 64 nt, Homo Sapiens
cucaggaaucaaaagagaaaaaaguuucugaaaacaaugaaaccauaaaagauaauauucuaaa

SEQ ID NO: 106621 - RNA, 64 nt, Homo Sapiens
ggaaauuacugucaccacuaguuuuaauauaguacaaugaaaaaauaauauauauauauauagu

SEQ ID NO: 106622 - RNA, 64 nt, Homo Sapiens
uaaaaaauaaaagaaacauaagauaaguaccucucaaugaaaaauguaaaaguaccuagaaauu

SEQ ID NO: 106623 - RNA, 64 nt, Homo Sapiens
uuaagugauguaaaauaaaugcuuuuuggauuaucaaugaaagcaauuuuaugugugccugaag

SEQ ID NO: 106624 - RNA, 64 nt, Homo Sapiens
guauuagugugugaagagauaagggcauuuguuucaaugaaaaaguuaguguuaaaggaaguga

SEQ ID NO: 106625 - RNA, 64 nt, Homo Sapiens
ggagggaaaccuuuggcuacauccuucaaagucucaaugaaauaguuguuuaagugacugaacg

SEQ ID NO: 106626 - RNA, 64 nt, Homo Sapiens
gugauugucaccaugaucacaacuuuaccaugcucaaugaaaagcuccuugguuauauuuuuuu

SEQ ID NO: 106627 - RNA, 64 nt, Homo Sapiens
gcuaagaucauugaucuuuaaggaaaaucaauaucaaugaaagugccgggaaguaaagcuuugg

SEQ ID NO: 106628 - RNA, 64 nt, Homo Sapiens
aaggaaugggaaagucaaugcuggaccaguuugacaaugaaagaauaaggaaaagauggaauua

SEQ ID NO: 106629 - RNA, 64 nt, Homo Sapiens
uaccacauuaacugacgcuuauuuguuaaaacaacaaugaaauuauauugaagugguuguaaca

SEQ ID NO: 106630 - RNA, 64 nt, Homo Sapiens
aaacuugguaauaaucuuuuagaagaccuugagacaaugaaaauacagccuagauccagaguuc

SEQ ID NO: 106631 - RNA, 64 nt, Homo Sapiens
uucucaacuugguuaaggaggaagaaaacccagucaaugaaauucaaugaaauucuuggaaacu

SEQ ID NO: 106632 - RNA, 64 nt, Homo Sapiens
gguuaaggaggaagaaaacccagucaaugaaauucaaugaaauucuuggaaacuuccauuaagu

SEQ ID NO: 106633 - RNA, 64 nt, Homo Sapiens
uuugaaagccuuuguaaauaucaauauaauguaccaaugaaauaacaucuggggcaaugaaacc

SEQ ID NO: 106634 - RNA, 64 nt, Homo Sapiens
ucaauauaauguaccaaugaaauaacaucuggggcaaugaaacccugaucauguuguugauggu

SEQ ID NO: 106635 - RNA, 64 nt, Homo Sapiens
ugaugcuacaggauuugaaauuguauuacaaauccaaugaaaugaguuuuucuuuucauuuacc

SEQ ID NO: 106636 - RNA, 64 nt, Homo Sapiens
aagaaaauaacaauaaaagacaaggaaaaaauaacaaugaaaguugauaaguacaugauaagcg

SEQ ID NO: 106637 - RNA, 64 nt, Homo Sapiens
cagcugcugacgggcuuugucuguggaaggagacagaaggaaauugacccacucuccuaucucc

SEQ ID NO: 106638 - RNA, 64 nt, Homo Sapiens
gauagaagcacauggagugcaauaggacauugugagaaggaauuuuucagggauucaucuacua

SEQ ID NO: 106639 - RNA, 64 nt, Homo Sapiens
uuuuaccuuuuggacaguaauuucuaucacaguuagaaggaaaugauagucaaauacacguuua

SEQ ID NO: 106640 - RNA, 64 nt, Homo Sapiens
uugcucucaguauaagauuuuacuuuauuaaugcagaaggaauauggauauauuucuuuaaguc

SEQ ID NO: 106641 - RNA, 64 nt, Homo Sapiens
ugacccaggcugaguccauacugccccugaucccagaaggaaugcugaccccucgucguaugaa

SEQ ID NO: 106642 - RNA, 64 nt, Homo Sapiens
accucccucuauggggauggcuauuuuauuuuugagaaggaaaaaaaaagucauguauauauac

SEQ ID NO: 106643 - RNA, 64 nt, Homo Sapiens
agcuggagucagcacuguccgcagcagcaucccaagaaggaaagagcagagguaagaggaagag

SEQ ID NO: 106644 - RNA, 64 nt, Homo Sapiens
gucucagaugaaagagagggaaaaggcgacaucaagaaggaaagucagaaaaagcaagaagaag

SEQ ID NO: 106645 - RNA, 64 nt, Homo Sapiens
cccuuuuugucaauaacucuauguaagaacaggcagaaggaaaacauuuuucugaaaguggcug

SEQ ID NO: 106646 - RNA, 64 nt, Homo Sapiens
aggcugguucugcacucucagucuacagcccaugagaaggaaugcucuggucaagccccauuug

SEQ ID NO: 106647 - RNA, 64 nt, Homo Sapiens
agacacucugccugccacucgaaggaaggugggaagaaggaauuugagacuuggguggugggaa

SEQ ID NO: 106648 - RNA, 64 nt, Homo Sapiens
ugggaagaaggaauuagacacuuggguggugggaagaaggaagguuuuaauaaguaaagugaga

SEQ ID NO: 106649 - RNA, 64 nt, Homo Sapiens
uccaucccguccggaaaagaaggacccagagggaagaaggaacaguggaggcgggacgcccucc

SEQ ID NO: 106650 - RNA, 64 nt, Homo Sapiens
auuucgggaggaacucuguugcuucgccuggacaagaaggaaaaugcugauuuccuccuugggu

SEQ ID NO: 106651 - RNA, 61 nt, Homo Sapiens
augcuguggaugaacgaugaaugucaaugucagaaggaaaagagaauuuuggccaucaaaa

SEQ ID NO: 106652 - RNA, 64 nt, Homo Sapiens
aauguuguguucauuuguugagccauaucucagaagaaggaaagggagcuacagaaaggagguu

SEQ ID NO: 106653 - RNA, 64 nt, Homo Sapiens
ugccauauugugaaaaacuuuaguggacaagggcagaaggaagagggaagaccuguuaggaagc

SEQ ID NO: 106654 - RNA, 64 nt, Homo Sapiens
aggauuugcugagaguuugaauguggaguguaagagaaggaagaguuaaugaugacauuaaggu

SEQ ID NO: 106655 - RNA, 64 nt, Homo Sapiens
ugaaugcacuugguuuauuguugggggugcucucagaaggaaccugugaaagccuuuaucaguc

SEQ ID NO: 106656 - RNA, 64 nt, Homo Sapiens
aaccaaaacaugggaugaagcuaaaucaaugcuuagaaggaaauuuauagcuucaaauacuuau

SEQ ID NO: 106657 - RNA, 64 nt, Homo Sapiens
aauaauugauaauaacaguccaaagaaagcagaaagaaggaaagccuagaacagaaauaaauga

SEQ ID NO: 106658 - RNA, 64 nt, Homo Sapiens
ucaaggaaauaugaaggcacuuccuuuuuuucuaagaaggaaguugcuagaugauuccuucauc

SEQ ID NO: 106659 - RNA, 64 nt, Homo Sapiens
aucuguaaauaaaaggguuccaaccuuuuaaaaaagaaggaaaaaacuuuuuggugcuccagug

SEQ ID NO: 106660 - RNA, 64 nt, Homo Sapiens
gaauggaggaguuguuuggggagggaaaggagagagaaggaaaggagugagguauuucccgucu

SEQ ID NO: 106661 - RNA, 64 nt, Homo Sapiens
aauuaaauaaaaugcugcugcuuugacaguaaagagaaggaaguauucugauuagcuguaucug

SEQ ID NO: 106662 - RNA, 64 nt, Homo Sapiens
cuccaucuccagugggaacuagcagagcugauggagaaggaaggaagagaucaggaagagaagg

SEQ ID NO: 106663 - RNA, 64 nt, Homo Sapiens
cagggaggaggcagagaagaugacccuccaccgcagaaggaaggcaccccagugagaugucccc

SEQ ID NO: 106664 - RNA, 64 nt, Homo Sapiens
gccaguucaaaagaauaguaaaagcuauguaaauagaaggaaugugccaaccucugagagguga

SEQ ID NO: 106665 - RNA, 64 nt, Homo Sapiens
auaagaauaaauuuaauuuauagacaaaauuaaaagaaggaauggcuauuacuaaaaauauaua

SEQ ID NO: 106666 - RNA, 64 nt, Homo Sapiens
gggaacauuggagcugacugaaagcaaaaggcugagaaggaacaagucuggagaagguauuagc

SEQ ID NO: 106667 - RNA, 64 nt, Homo Sapiens
auuugugaacuggaagaaaggaagaaggagagcaagaaggaaagcugaaaaaaaaaaagaagaa

SEQ ID NO: 106668 - RNA, 64 nt, Homo Sapiens
uaauguuucuuaauaauccuccagucaucuagagagaaggaaaugaagcuaaaaagcuaaagua

SEQ ID NO: 106669 - RNA, 64 nt, Homo Sapiens
cauuuuauugcagaagcuaagaauagaaaugcugagaaggaacgagugauucagggauuccuau

SEQ ID NO: 106670 - RNA, 64 nt, Homo Sapiens
aauaugucugccaaguuguuagaaucuuugaaucagaaggaaaaaaagcagcgcugguugacaa

SEQ ID NO: 106671 - RNA, 64 nt, Homo Sapiens
cccaaccugagauuuguaguccaggauuacaaccagaaggaaaguaugacagauuucuacuuaa

SEQ ID NO: 106672 - RNA, 64 nt, Homo Sapiens
uauugcagcacuuucugaggcuuucacuguagggagaaggaaaccccaaggguagaauagccau

SEQ ID NO: 106673 - RNA, 64 nt, Homo Sapiens
ugggauccaggaaccagugggauuggaugggagaagaaggaaggggguggcccgucacccccgc

SEQ ID NO: 106674 - RNA, 64 nt, Homo Sapiens
ggggagaagccuggggaggagggggaggaagacaagaaggaagaggaggaggagaaggaagacg

SEQ ID NO: 106675 - RNA, 64 nt, Homo Sapiens
gagggggaggaagacaagaaggaagaggaggaggagaaggaagacgaggagcuggacugggccu

SEQ ID NO: 106676 - RNA, 64 nt, Homo Sapiens
ugccugguguggagugacucucugccccaccuggagaaggaagcgaguuguucccccagggggc

SEQ ID NO: 106677 - RNA, 64 nt, Homo Sapiens
aaccgaagagcaaacaaaagagcauaccacuugaagaaggaaaggaauuucuaccaaauaguag

SEQ ID NO: 106678 - RNA, 64 nt, Homo Sapiens
ggaaugaaaggaaaccuuccuucaaaagcaaaagagaaggaacaauuaguauauuuaaaaacug

SEQ ID NO: 106679 - RNA, 64 nt, Homo Sapiens
gugaggggucuguccauggguagcgcugcggcuaagaaggaagaguauaaauauauuuauuaag

SEQ ID NO: 106680 - RNA, 64 nt, Homo Sapiens
auagcuuuuaucaauuuuuugcuuuaagaaauggagaaggaaaauuuuuucauaaaaauuaaau

SEQ ID NO: 106681 - RNA, 64 nt, Homo Sapiens
aaggaaaaacuuguuacugaagagagagaaagaaagaaggaagguuguauugauaauuggacaa

SEQ ID NO: 106682 - RNA, 64 nt, Homo Sapiens
ucauccuuuucuauuucccuagaaccuuaaugguagaaggaauugcaaagaaucaaguccaccc

SEQ ID NO: 106683 - RNA, 64 nt, Homo Sapiens
uucucaugugacagauggggaaacugaggccuugagaaggaaaaaggcuaaucuaaguuccugc

SEQ ID NO: 106684 - RNA, 64 nt, Homo Sapiens
cacugaacaaggucucagggguauugcuaagccaagaaggaacuuucccacacuacugaaugga

SEQ ID NO: 106685 - RNA, 64 nt, Homo Sapiens
uuguaaaagcccagaucacugugggcuggagaggagaaggaaagggucugcgccagcccugucc

SEQ ID NO: 106686 - RNA, 64 nt, Homo Sapiens
accuugcuucaagaauaaaccacaccagugaacaagaaggaaaggccuuuuggagugugucuuu

SEQ ID NO: 106687 - RNA, 64 nt, Homo Sapiens
augcuuauuaaaacaaaugauguauggggagaggagaaggaagggcaaggaaggaauugacaga

SEQ ID NO: 106688 - RNA, 64 nt, Homo Sapiens
gaguaucaaaggcagaaaggaggaugaaagacaaagaaggaaaacaucugugaggugauaggca

SEQ ID NO: 106689 - RNA, 64 nt, Homo Sapiens
ggcuggcaagguggguuccacucugccuugauggagaaggaaaaccuccccacccaccaaaugc

SEQ ID NO: 106690 - RNA, 64 nt, Homo Sapiens
uauggcaugauuagauugcaaagcaaugaacucaagaaggaauugaaauaaggagggacaugau

SEQ ID NO: 106691 - RNA, 64 nt, Homo Sapiens
guuaggcuuuucugccugcuccugcuuaaacacaagaaggaauccuggauuuugcccucuccuu

SEQ ID NO: 106692 - RNA, 64 nt, Homo Sapiens
uuagggcaacaaugaaggaggacccagccaagcuagaaggaauuuuguggaugggagacagcag

SEQ ID NO: 106693 - RNA, 64 nt, Homo Sapiens
accucaacacaucccuucagugacucagagucucagaaggaaacccugacuccuggggccauuu

SEQ ID NO: 106694 - RNA, 64 nt, Homo Sapiens
gauacuuacauuucauggacuaaagcacuagcugagaaggaacuaccuggcaccaguauaacua

SEQ ID NO: 106695 - RNA, 64 nt, Homo Sapiens
acuuucacaaaauaaacuuacauggaauacugggagaaggaauaguccugagaacagcuuuagu

SEQ ID NO: 106696 - RNA, 64 nt, Homo Sapiens
agagcaagaccuuguuucucaaaaauaaauaaauagaaggaaauaaauguaaaaaugcugcaaa

SEQ ID NO: 106697 - RNA, 64 nt, Homo Sapiens
cuucgagucgaguguaagggcccuucacaaaagcagaaggaacacuggcccaaacccccagcac

SEQ ID NO: 106698 - RNA, 64 nt, Homo Sapiens
cccuggguagaaacgcuuggcuucaugggaagagagaaggaagguuaugggagaagggcaaaga

SEQ ID NO: 106699 - RNA, 64 nt, Homo Sapiens
aaaaugagggguggcagggaggcaggugcuucagagaaggaaacuuuggggaacugagcucaga

SEQ ID NO: 106700 - RNA, 64 nt, Homo Sapiens
ccucuuucuccccauggccccacugcagaauuaaagaaggaagaagggaaggcggaggagucua

SEQ ID NO: 106701 - RNA, 64 nt, Homo Sapiens
aaagaaggaagaagggaaggcggaggagucuauaagaaggaaucaugauuucuauuuagcagau

SEQ ID NO: 106702 - RNA, 64 nt, Homo Sapiens
ggcucaguaugcuagcaacaggagaagucuaucaagaaggaaauggccgcauuccccccaaugu

SEQ ID NO: 106703 - RNA, 64 nt, Homo Sapiens
ugacccaucggugaugcgcuaaccuguguguuugagaaggaaaacgcaucacaauuggcaauaa

SEQ ID NO: 106704 - RNA, 64 nt, Homo Sapiens
gccagaauggcauguuuuauaauuaacugaauaaagaaggaagcauuauuauauauuauugugg

SEQ ID NO: 106705 - RNA, 64 nt, Homo Sapiens
cauaacaugaauugauggucaauuucccuucagcagaaggaaaaggugauuuagaucaguagcu

SEQ ID NO: 106706 - RNA, 64 nt, Homo Sapiens
aacauuaauaugugcaaagauuggcucuccaacaagaaggaaagcagggaggaagggagaccac

SEQ ID NO: 106707 - RNA, 64 nt, Homo Sapiens
aacagaacgucgcugauggagaaagggcucccgcagaaggaacggccuguaccgugcgcuccgg

SEQ ID NO: 106708 - RNA, 64 nt, Homo Sapiens
acucauggaagagaugaacgccaugcuggcccggagaaggaaagccacgcaaguuggggagaaa

SEQ ID NO: 106709 - RNA, 64 nt, Homo Sapiens
ccccauuaauuuuaggagcuucuggaagaggugaagaaggaauugcagaaagugaaagaggaaa

SEQ ID NO: 106710 - RNA, 64 nt, Homo Sapiens
gaguaagaggcgcugggcucggagccuguuuccaagaaggaauugguugucaucuggcaguguu

SEQ ID NO: 106711 - RNA, 64 nt, Homo Sapiens
gaggaaaggcaguccuggacagaagacugucagcagaaggaaaguacuggacuacccgugggua

SEQ ID NO: 106712 - RNA, 64 nt, Homo Sapiens
ccacugugcacagguuugagaggacaaguucaucagaaggaaggcaguccuuagaagucacaua

SEQ ID NO: 106713 - RNA, 64 nt, Homo Sapiens
gugaacauguuugugggccuuuugacugaguggcagaaggaaacugcucaggaagagaaacagg

SEQ ID NO: 106714 - RNA, 64 nt, Homo Sapiens
cugacuucuuccuccuccuccuucccugacucacagaaggaaugcaaucacccagcaaguccua

SEQ ID NO: 106715 - RNA, 64 nt, Homo Sapiens
ggcucuugagccucugggaaugggaggggccaagagaaggaaaacccugucuuuagcacccuuu

SEQ ID NO: 106716 - RNA, 64 nt, Homo Sapiens
agguuuuuuaaaggauauuuaacuuuuauggacuagaaggaaucacgagggcuacugcacaaua

SEQ ID NO: 106717 - RNA, 64 nt, Homo Sapiens
uaccccagaagcagguggucugccccaggcauaaagaaggaaaauuggccaucuuucccaccuc

SEQ ID NO: 106718 - RNA, 64 nt, Homo Sapiens
aggcaagcagcuagacuggugaauugggggaaauagaaggaacuaguaacugagacuccuccag

SEQ ID NO: 106719 - RNA, 64 nt, Homo Sapiens
gagagaaaccaacaagagaucucgaacccugucuagaaggaauguauuuguugcuaaauuucgu

SEQ ID NO: 106720 - RNA, 64 nt, Homo Sapiens
gaaacaaaguggaaggaaagaugcucagguacagagaaggaaugucuuugguccucuugccauc

SEQ ID NO: 106721 - RNA, 64 nt, Homo Sapiens
augacaacccugugguuuccaaggagcugagaauagaaggaaacuagcuuacaugagaacagac

SEQ ID NO: 106722 - RNA, 64 nt, Homo Sapiens
guagaaauuuauuauuaaaagcuguaauccagagagaaggaaacgauuuugcccagcacaugga

SEQ ID NO: 106723 - RNA, 64 nt, Homo Sapiens
agagagagaaagaaagucucagggaaggaaagagagaaggaaagcccgcucagcaacauagaag

SEQ ID NO: 106724 - RNA, 64 nt, Homo Sapiens
aaagaaagaugggaggaagugaaagcaaaggaacagaaggaagggaaggaaggagggaagaaaa

SEQ ID NO: 106725 - RNA, 64 nt, Homo Sapiens
agggaagaaaagaaagcaaaaggaagggaagggcagaaggaagggaggcggagaggggagaaga

SEQ ID NO: 106726 - RNA, 64 nt, Homo Sapiens
gaagggcagaaggaaggagggcggagaggggagaagaaggaagggggcuuuuccuuugggggag

SEQ ID NO: 106727 - RNA, 64 nt, Homo Sapiens
gcuuuuacacagcacaugaagcaguaauccagaaagaaggaaaugcagaauuuuauuaucaaag

SEQ ID NO: 106728 - RNA, 64 nt, Homo Sapiens
cucauuuucaggaaaguuuguaguauuacaaggcagaaggaaacacaguagcaaugguugcucu

SEQ ID NO: 106729 - RNA, 64 nt, Homo Sapiens; identical to SEQ ID NO: 85991

SEQ ID NO: 106730 - RNA, 64 nt, Homo Sapiens; identical to SEQ ID NO: 85992

SEQ ID NO: 106731 - RNA, 64 nt, Homo Sapiens; identical to SEQ ID NO: 85993

SEQ ID NO: 106732 - RNA, 64 nt, Homo Sapiens; identical to SEQ ID NO: 85994

SEQ ID NO: 106733 - RNA, 64 nt, Homo Sapiens; identical to SEQ ID NO: 85995

SEQ ID NO: 106734 - RNA, 64 nt, Homo Sapiens; identical to SEQ ID NO: 85996

SEQ ID NO: 106735 - RNA, 64 nt, Homo Sapiens; identical to SEQ ID NO: 85997

SEQ ID NO: 106736 - RNA, 64 nt, Homo Sapiens; identical to SEQ ID NO: 85998

SEQ ID NO: 106737 - RNA, 64 nt, Homo Sapiens; identical to SEQ ID NO: 85999

SEQ ID NO: 106738 - RNA, 64 nt, Homo Sapiens; identical to SEQ ID NO: 86000

SEQ ID NO: 106739 - RNA, 64 nt, Homo Sapiens; identical to SEQ ID NO: 86001

SEQ ID NO: 106740 - RNA, 64 nt, Homo Sapiens; identical to SEQ ID NO: 86002

SEQ ID NO: 106741 - RNA, 64 nt, Homo Sapiens; identical to SEQ ID NO: 86003

SEQ ID NO: 106742 - RNA, 64 nt, Homo Sapiens; identical to SEQ ID NO: 86004

SEQ ID NO: 106743 - RNA, 64 nt, Homo Sapiens; identical to SEQ ID NO: 86005

SEQ ID NO: 106744 - RNA, 64 nt, Homo Sapiens; identical to SEQ ID NO: 86006

SEQ ID NO: 106745 - RNA, 64 nt, Homo Sapiens; identical to SEQ ID NO: 86007

SEQ ID NO: 106746 - RNA, 64 nt, Homo Sapiens; identical to SEQ ID NO: 86008

SEQ ID NO: 106747 - RNA, 64 nt, Homo Sapiens; identical to SEQ ID NO: 86009

SEQ ID NO: 106748 - RNA, 64 nt, Homo Sapiens; identical to SEQ ID NO: 86010

SEQ ID NO: 106749 - RNA, 64 nt, Homo Sapiens; identical to SEQ ID NO: 86011

SEQ ID NO: 106750 - RNA, 64 nt, Homo Sapiens; identical to SEQ ID NO: 86012

SEQ ID NO: 106751 - RNA, 64 nt, Homo Sapiens; identical to SEQ ID NO: 86013

SEQ ID NO: 106752 - RNA, 64 nt, Homo Sapiens; identical to SEQ ID NO: 86014

SEQ ID NO: 106753 - RNA, 64 nt, Homo Sapiens; identical to SEQ ID NO: 86015

SEQ ID NO: 106754 - RNA, 64 nt, Homo Sapiens; identical to SEQ ID NO: 86016

SEQ ID NO: 106755 - RNA, 64 nt, Homo Sapiens; identical to SEQ ID NO: 86017

SEQ ID NO: 106756 - RNA, 64 nt, Homo Sapiens; identical to SEQ ID NO: 86018

SEQ ID NO: 106757 - RNA, 64 nt, Homo Sapiens; identical to SEQ ID NO: 86019

SEQ ID NO: 106758 - RNA, 64 nt, Homo Sapiens; identical to SEQ ID NO: 86020

SEQ ID NO: 106759 - RNA, 64 nt, Homo Sapiens; identical to SEQ ID NO: 86021

SEQ ID NO: 106760 - RNA, 64 nt, Homo Sapiens; identical to SEQ ID NO: 86022

SEQ ID NO: 106761 - RNA, 64 nt, Homo Sapiens; identical to SEQ ID NO: 86023

SEQ ID NO: 106762 - RNA, 64 nt, Homo Sapiens; identical to SEQ ID NO: 86024

SEQ ID NO: 106763 - RNA, 64 nt, Homo Sapiens; identical to SEQ ID NO: 86025

SEQ ID NO: 106764 - RNA, 64 nt, Homo Sapiens; identical to SEQ ID NO: 86026

SEQ ID NO: 106765 - RNA, 64 nt, Homo Sapiens; identical to SEQ ID NO: 86027

SEQ ID NO: 106766 - RNA, 64 nt, Homo Sapiens; identical to SEQ ID NO: 86028

SEQ ID NO: 106767 - RNA, 64 nt, Homo Sapiens; identical to SEQ ID NO: 86029

SEQ ID NO: 106768 - RNA, 64 nt, Homo Sapiens; identical to SEQ ID NO: 86030

SEQ ID NO: 106769 - RNA, 64 nt, Homo Sapiens; identical to SEQ ID NO: 86031

SEQ ID NO: 106770 - RNA, 64 nt, Homo Sapiens
guguaaugcauuguucucaguuucccugccaacauugaaaaauaaaaacagcagcuuuucuccu

SEQ ID NO: 106771 - RNA, 64 nt, Homo Sapiens
acauaguugacauuccuaguaaaauauuugcuuguugaaaaaaacauguuaacagauguguuua

SEQ ID NO: 106772 - RNA, 64 nt, Homo Sapiens
cuaaacuuuauauaaugugugguuucaauucagcuugaaaaauaaucucacuacauguagcagu

SEQ ID NO: 106773 - RNA, 64 nt, Homo Sapiens
gaugacuugaaaugaggccuacucuaaagaauucuugaaaaacuuacaagucaagccuagccug

SEQ ID NO: 106774 - RNA, 64 nt, Homo Sapiens
agucaagccuagccugauaauccuauuacauaguuugaaaaauaguauuuuauuucucagaaca

SEQ ID NO: 106775 - RNA, 64 nt, Homo Sapiens
uugcaaaugucuuaggugaugcauuuuccuaacuuugaaaaauuaugaagccauauuaauaacu

SEQ ID NO: 106776 - RNA, 64 nt, Homo Sapiens
aggcauaaaaaugcaauaaauagaguacguaacauugaaaaauguagaacuuaaaacuccaaac

SEQ ID NO: 106777 - RNA, 64 nt, Homo Sapiens
ucuguuacaaauuuauaauuugaaggcauguauuuugaaaaauaauuuuugcauuuaaguuguu

SEQ ID NO: 106778 - RNA, 64 nt, Homo Sapiens
ccuauuuuuuuccaaaguguauauaucaaguuauuugaaaaauagacuaugaaauacauaaacc

SEQ ID NO: 106779 - RNA, 64 nt, Homo Sapiens
aauucccuugaaaugaucauuuuauaugugacaguugaaaaagaauugguccuguguuaccaag

SEQ ID NO: 106780 - RNA, 64 nt, Homo Sapiens
auuaccuguggaauggcuagcuuucucuugauuguugaaaaaucauguuacaguacaagaauga

SEQ ID NO: 106781 - RNA, 64 nt, Homo Sapiens
cucuugucaguuuccuguuccugguuccaucuuuuugaaaaaggcccuccuuugagcuacaaac

SEQ ID NO: 106782 - RNA, 64 nt, Homo Sapiens
gccgccuacugguuuguaguuaaccuagagaagguugaaaaauuaauccuaccuuuaaagggau

SEQ ID NO: 106783 - RNA, 64 nt, Homo Sapiens
cagugauauuauuuccauaacuuaaaaagugaguuugaaaaagaaaaucuccagcaagcaucuc

SEQ ID NO: 106784 - RNA, 64 nt, Homo Sapiens
uuuaaaaacaucgaguaccucaagucaguuugccuugaaaaauaucaaauauaacucuuagaga

SEQ ID NO: 106785 - RNA, 64 nt, Homo Sapiens
gucucuuggaaauguuaagaaagaagacccuuuguugaaaaauguugcucugggagacuuacug

SEQ ID NO: 106786 - RNA, 64 nt, Homo Sapiens
uaagagaaaccuugcaaacucuauaaagaaacuuuugaaaaaguguacaugaagaauguagccc

SEQ ID NO: 106787 - RNA, 64 nt, Homo Sapiens
cuucugugcuaccacucaguaaauuuuuuauaacuugaaaaacauccugacacuauacauuuca

SEQ ID NO: 106788 - RNA, 64 nt, Homo Sapiens
uuugauugccacauuccuuucaacagaauugagguugaaaaauaaucaaagaauugaaugaaua

SEQ ID NO: 106789 - RNA, 64 nt, Homo Sapiens
aucaugguuuuugcucuacugauguuaauuacuuuugaaaaagguuguguuaagugacugagaa

SEQ ID NO: 106790 - RNA, 64 nt, Homo Sapiens
aagaggauaucccuuccuaccauuuaucuacuauuugaaaaaagaugauaaguuccaaaaauac

SEQ ID NO: 106791 - RNA, 64 nt, Homo Sapiens
acucaaauaugaguacaaaugccuuaaaauggaauugaaaaacucuuuauuuuccccuaucauu

SEQ ID NO: 106792 - RNA, 64 nt, Homo Sapiens
cuuaaguauaucauguaaagaaaugucuuaauuuuugaaaaaaguacauauuuauuuucuuuug

SEQ ID NO: 106793 - RNA, 64 nt, Homo Sapiens
ccaguaaggaagcaacuaaauuuuguuuuguucuuugaaaaaggcuaaccugagcuagguaaag

SEQ ID NO: 106794 - RNA, 64 nt, Homo Sapiens
guaaaauuuuauuuuaauuaaaaucaauucauguuugaaaaaggauuuaaaguagcuucuaaua

SEQ ID NO: 106795 - RNA, 64 nt, Homo Sapiens
uaugugaauauacauaucaagaacuuuggggguuuugaaaaaaaugaauuguauauauacaaau

SEQ ID NO: 106796 - RNA, 64 nt, Homo Sapiens
aauguuuguauauguaaucagauguacauuuauauugaaaaacaaaugagauggacuuaaagag

SEQ ID NO: 106797 - RNA, 64 nt, Homo Sapiens
cucaucucagguaauuuaugaaaucuauguaaacuugaaaaauauuucuuaauuuuuguuuuug

SEQ ID NO: 106798 - RNA, 64 nt, Homo Sapiens
auuucccucuauaaguguuauugauuauuuuaaauugaaaaaaguuucacuuggaugaaaaaag

SEQ ID NO: 106799 - RNA, 64 nt, Homo Sapiens
guuuggcaguaccucaaaaaauggugcaccugcuuugaaaaacaaauuguuggugggaauguaa

SEQ ID NO: 106800 - RNA, 64 nt, Homo Sapiens
acaaaguugguggauucacauauccaaauaagccuugaaaaagagaaaugcaagggacccagaa

SEQ ID NO: 106801 - RNA, 64 nt, Homo Sapiens
aagacaaguucuuuguaacuccacauauuacuaauugaaaaaugguccauuggguaacuuuuau

SEQ ID NO: 106802 - RNA, 64 nt, Homo Sapiens
caacaagaauuuaauucuaauuuguaguacaagauugaaaaacuaugaaucuaauccauaaggc

SEQ ID NO: 106803 - RNA, 64 nt, Homo Sapiens
uccauagaaaaggcgugcaguucauuuagauaauuugaaaaaguguucaccaaaaccaaacuug

SEQ ID NO: 106804 - RNA, 64 nt, Homo Sapiens
aaauguugagaagcguuuuuccuuuuuugucuuauugaaaaaaauaaaccauuguaacuauuaa

SEQ ID NO: 106805 - RNA, 64 nt, Homo Sapiens
gaaagcauuuguacuaagcuauaaauuucucuuuuugaaaaaaacauugaagaccagcuuucuc

SEQ ID NO: 106806 - RNA, 64 nt, Homo Sapiens
uccaagcuccuauuagaaaaaaaagcagauggacuugaaaaagacaguuuugaugaaaggaggg

SEQ ID NO: 106807 - RNA, 64 nt, Homo Sapiens
aaauauguauacacaaauaucaagacagcucuucuugaaaaaaacagaaaacugagcauacuag

SEQ ID NO: 106808 - RNA, 64 nt, Homo Sapiens
gaagaaaaucuguucuuaauauauuucauuaugauugaaaaacauaaaaacuaacauaggaaag

SEQ ID NO: 106809 - RNA, 64 nt, Homo Sapiens
ugccaaauguuguuuucauaaccaugauauuguuuugaaaaaauuuuaucuuaaaauacugaau

SEQ ID NO: 106810 - RNA, 64 nt, Homo Sapiens
aguguuaggucaauaacacuguauuuuaauguacuugaaaaauguuuuuauuuuuguuuuauuu

SEQ ID NO: 106811 - RNA, 64 nt, Homo Sapiens
acucaucuaccagauucugccuauguaaaaugaauugaaaaacaauuuucuguaaucuuuuauu

SEQ ID NO: 106812 - RNA, 64 nt, Homo Sapiens
guaauuuuugcuccaauauccauucuguagacuuuugaaaaaaaaguuuuuaauuugaugccca

SEQ ID NO: 106813 - RNA, 64 nt, Homo Sapiens
gauauuauuaauuuuuauuuauuuuucuugggaauugaaaaaaauugaaauaaauaaaaaugca

SEQ ID NO: 106814 - RNA, 64 nt, Homo Sapiens
aggauguagagauuuggggugguugauuagacuuuugaaaaacucaucaccacaugccuucacu

SEQ ID NO: 106815 - RNA, 64 nt, Homo Sapiens
ucucugaacuugauauaaagauuuuauuugucccuugaaaaaguaacaaaugugcauagaucaa

SEQ ID NO: 106816 - RNA, 64 nt, Homo Sapiens
acauaagguaccaaauaugaugcaauaaauuguuuugaaaaacaguugugugaauauuucaacu

SEQ ID NO: 106817 - RNA, 64 nt, Homo Sapiens
uuucuuuauauucagcuacucuugucauuucucguugaaaaacuaaaaucugacuagguuaguu

SEQ ID NO: 106818 - RNA, 64 nt, Homo Sapiens
cugaaaggcaguuugauuuuuauuuuuaacacacuugaaaaaagguuggaguagccagacuuuc

SEQ ID NO: 106819 - RNA, 64 nt, Homo Sapiens
cugccauuugcuauaaaguugaacuuuguauggcuugaaaaagaaaugacaauauggaacaucc

SEQ ID NO: 106820 - RNA, 64 nt, Homo Sapiens
aaagaacauuauguuccucccauuuacuaauaccuugaaaaaucaaaugccugaaaaaaauaag

SEQ ID NO: 106821 - RNA, 64 nt, Homo Sapiens
cgguagagauacuuagcucuguaauggaucuggcuugaaaaauaaagggacuuuuauuuguaaa

SEQ ID NO: 106822 - RNA, 64 nt, Homo Sapiens
aaauuaauuuguuaucagguagcauuccuuuuuauugaaaaauaggagccaguuaaaaaaccag

SEQ ID NO: 106823 - RNA, 64 nt, Homo Sapiens
cuaaaggggagaguauucuuaucaaaaaaaagcuuugaaaaaauaaugccuuugaaauuuugua

SEQ ID NO: 106824 - RNA, 64 nt, Homo Sapiens
agaauugcaaauuuuaccaaauggauagcuuauuuugaaaaaggacucuuuggugacuccaacu

SEQ ID NO: 106825 - RNA, 64 nt, Homo Sapiens
uuuuauuaguaacauguuguucaaauuucuuuuauugaaaaaaacagcagcaaguuuagcaucu

SEQ ID NO: 106826 - RNA, 64 nt, Homo Sapiens
auuagcauguaacaaagaauaagguuaaaacauuuugaaaaauugaaaaauuaauggcauuuua

SEQ ID NO: 106827 - RNA, 64 nt, Homo Sapiens
uuuuccaggccuggcuccaaagacacaaaauuguuugaaaaacaccagcucaggaugaaaggau

SEQ ID NO: 106828 - RNA, 64 nt, Homo Sapiens
ucaaaauuuuuugccuuccaggcauacuuuccaguugaaaaaaaagcauagccaaggcuagcga

SEQ ID NO: 106829 - RNA, 64 nt, Homo Sapiens
uguaaaauuauagcacuaaccauuguuccacauauugaaaaaacacacagaacuuuuccauaaa

SEQ ID NO: 106830 - RNA, 64 nt, Homo Sapiens
auuugcauaguacugaauguuucauuuugucauauugaaaaaugacccuaaaguguguaaguuu

SEQ ID NO: 106831 - RNA, 64 nt, Homo Sapiens
aauguacuuguuaggaaguauuacaguaaagacuuugaaaaagaaacauuuaaaaauuaaucag

SEQ ID NO: 106832 - RNA, 64 nt, Homo Sapiens
uuuuuacacagguuuucuugucuugacaagaugcuugaaaaaccaagaggauaugaaaaucugu

SEQ ID NO: 106833 - RNA, 64 nt, Homo Sapiens
guucauaauguuucugcauucaucuguucuuaaauugaaaaacauauaauuuacuucuuauaaa

SEQ ID NO: 106834 - RNA, 64 nt, Homo Sapiens
accaacaacauuaugguauuugugugacuuuuauuugaaaaaaugugagcaguaauuuggguua

SEQ ID NO: 106835 - RNA, 64 nt, Homo Sapiens
gggugucuccccaggugaguccauccacacacguuugaaaaacacuauuagucuuucuaacaca

SEQ ID NO: 106836 - RNA, 64 nt, Homo Sapiens
aaugaacucaaucuaaauuaaaaaagaaagaaauuugaaaaaacuuucucuuugccauuucuuc

SEQ ID NO: 106837 - RNA, 64 nt, Homo Sapiens
aaugucaaccuuuguaagaaaaccaaaauaaaaauugaaaaauaaaaaccauaaacauuugcac

SEQ ID NO: 106838 - RNA, 64 nt, Homo Sapiens
uguaauauguaaauuaaaauauuucuacauuuuauugaaaaaaaaaccuuuuuuuuugccuaaa

SEQ ID NO: 106839 - RNA, 64 nt, Homo Sapiens
aacacauuaauguugaauuuuacagacaguauauuugaaaaaaauugauuccauguagucuuca

SEQ ID NO: 106840 - RNA, 64 nt, Homo Sapiens
cuggacacauggcugcuaauucaucagcuuaucauugaaaaaguccauagccaaaaccugacug

SEQ ID NO: 106841 - RNA, 64 nt, Homo Sapiens
uauauuuaaagguaaugagauaaugaugaguguuuugaaaaauguuuaguguucaaauagaaac

SEQ ID NO: 106842 - RNA, 64 nt, Homo Sapiens
aacaucuucuguguaugaagcaaaugucgauguuuugaaaaaagcuaggagaugacuuugaaug

SEQ ID NO: 106843 - RNA, 64 nt, Homo Sapiens
auucccuagagcucaagaaagcugguccaggagguugaaaaagcuauuuuguuguuaaauuauu

SEQ ID NO: 106844 - RNA, 64 nt, Homo Sapiens
guuguauccuuauuuuguaaacuucgaaucauguuugaaaaaacauuacaggaauuguauguuc

SEQ ID NO: 106845 - RNA, 64 nt, Homo Sapiens
aaaaagaaauagaagauuccauacaauagcaaacuugaaaaaaauacuaaaagauauguuucug

SEQ ID NO: 106846 - RNA, 64 nt, Homo Sapiens
cauguugcccuguugcugccuuuaauaaacacucuugaaaaaugauguacugauuacugccuau

SEQ ID NO: 106847 - RNA, 64 nt, Homo Sapiens
gcucauaugauguacauguauggaagugcuaauuuugaaaaacucugagauguagccccucucc

SEQ ID NO: 106848 - RNA, 64 nt, Homo Sapiens
cguuauaaagaaaugugccuauagggagguagauuugaaaaaacaaugaauaugcuuucauuaa

SEQ ID NO: 106849 - RNA, 64 nt, Homo Sapiens
agacaaauccauucucuucuagugaaaacaaauuuugaaaaauauuugaaggguuuaugugcaa

SEQ ID NO: 106850 - RNA, 64 nt, Homo Sapiens
uuacugcaacuuaacuuaaaugcuaauauuuuauuugaaaaaaggauuauuuuaucugguaugg

SEQ ID NO: 106851 - RNA, 64 nt, Homo Sapiens
guuucuauuuaguuauuuaauuaauauuugugcuuugaaaaaaauguagaacugauuuuacaaa

SEQ ID NO: 106852 - RNA, 64 nt, Homo Sapiens
acauauuugcauguaaacaaugauuucaaaauacuugaaaaauaaaauuuuaacccaaaugaau

SEQ ID NO: 106853 - RNA, 64 nt, Homo Sapiens
aauuauaagguaaaauuuuccuguuuuucccccuuugaaaaacucaggaaaaaaggaagauuga

SEQ ID NO: 106854 - RNA, 64 nt, Homo Sapiens
aaaggagguuguucacuuccgcaagaacggcagcuugaaaaauugcacagcagcgaugcagaag

SEQ ID NO: 106855 - RNA, 64 nt, Homo Sapiens
cagaaagaagcucaagaccggcuagaacagcaaguugaaaaacucagcggaaaaggauucauca

SEQ ID NO: 106856 - RNA, 64 nt, Homo Sapiens
agcuccuuuuacagaauauauuaagcuuuuuucuuugaaaaacagcaugauuauuagaaacuau

SEQ ID NO: 106857 - RNA, 64 nt, Homo Sapiens
ucgaacagauuugacaagggaaagcccaaguauuuugaaaaaaccagcaggcugggugcguuaa

SEQ ID NO: 106858 - RNA, 64 nt, Homo Sapiens
auacccucccuuuaguuuguccauucuguuaauuuugaaaaaauuugauguccaguuacaccau

SEQ ID NO: 106859 - RNA, 64 nt, Homo Sapiens
uuucucauauaaguuuaaccgaaugaccaucugguugaaaaauccuuacagcuccaacuuuuuu

SEQ ID NO: 106860 - RNA, 64 nt, Homo Sapiens
aaaaccuagaaguuggauauuggcauauugguuguugaaaaauaaauuucauccucacuuauga

SEQ ID NO: 106861 - RNA, 64 nt, Homo Sapiens
guaaucuuuauucugagggucucgggauugcagguugaaaaacacaaccuuaaucagcaguaaa

SEQ ID NO: 106862 - RNA, 64 nt, Homo Sapiens
uaggaaucaaaguuuauuaaaguuacauagaggauugaaaaauguauaucacucaauuuuuauc

SEQ ID NO: 106863 - RNA, 64 nt, Homo Sapiens
uuucauaacauauggaaugcuuuaagcaauuguuuugaaaaaaaucugcguaucuuugacuuaa

SEQ ID NO: 106864 - RNA, 64 nt, Homo Sapiens
caagauggugggggcauuuuuagagcggcaauaauugaaaaaaaaggcgaacucugccuuggag

SEQ ID NO: 106865 - RNA, 64 nt, Homo Sapiens
cccaacuaaagaauggauuuaauuaaacuauguauugaaaaaaaaguagccuaaguguuagaga

SEQ ID NO: 106866 - RNA, 64 nt, Homo Sapiens
cuacuguucauaaaccaugcccuugaagagaagauugaaaaaguuuauguacucacagucuuuc

SEQ ID NO: 106867 - RNA, 64 nt, Homo Sapiens
cucagcuuuuaguuuuuuucacauuuaguaugcuuugaaaaaaauagaacauuuguaugaaaag

SEQ ID NO: 106868 - RNA, 64 nt, Homo Sapiens
aaucaacaaaagauacaauuuccuguaacuggguuugaaaaaaucaacuggaauaauauaguaa

SEQ ID NO: 106869 - RNA, 54 nt, Homo Sapiens
guuuguaagccuuucaacagaaacuugaaaaacagggaucgagaugagcuuuaa

SEQ ID NO: 106870 - RNA, 64 nt, Homo Sapiens
gacaaaauaucuaaaaaauguuacuauuauuccuuugaaaaaaaugagcucucuuguuuuuuug

SEQ ID NO: 106871 - RNA, 64 nt, Homo Sapiens
aguaguauggaauauuaagacuuggauauauucuuugaaaaaugucugauuccacuuucaaagu

SEQ ID NO: 106872 - RNA, 64 nt, Homo Sapiens
augucaacucauuacuuuuuuccugugaacaguauugaaaaaccccaacggcugauaauuaagu

SEQ ID NO: 106873 - RNA, 64 nt, Homo Sapiens
gaauuucuaaaauggaauuuaaugccaucacaauuugaaaaacuuuuuuuuuuuuuuuacuaua

SEQ ID NO: 106874 - RNA, 60 nt, Homo Sapiens
uuucaagccaaaaaauauaauuccauugcuuugaaaaaguuaaugcuuaagagggaauga

SEQ ID NO: 106875 - RNA, 64 nt, Homo Sapiens
uuauccuagcacaugcuucaauaguucaaggaacuugaaaaauacuuuuccuuaccuuuacccc

SEQ ID NO: 106876 - RNA, 64 nt, Homo Sapiens
agaauucagaaugauacaguuuugaccugcaguauugaaaaagguugggugugacaucagagua

SEQ ID NO: 106877 - RNA, 64 nt, Homo Sapiens
auaugaaaugugugcucaacggcagauuccacuuuugaaaaaaagugcucacucaauguguuua

SEQ ID NO: 106878 - RNA, 64 nt, Homo Sapiens
ggugauaauaaucuccauaguuauuugaaguggcuugaaaaaggcaagauugacuuuuaugaca

SEQ ID NO: 106879 - RNA, 64 nt, Homo Sapiens
ccaagaugcaaaauuaggcuuugauuggcacuuuuugaaaaauaugcaacaaauaugggaugua

SEQ ID NO: 106880 - RNA, 64 nt, Homo Sapiens
ggcccuuugacuaaguugauauggaaauauuuuguugaaaaacuguacagagcagcuuuacaag

SEQ ID NO: 106881 - RNA, 64 nt, Homo Sapiens
uuucauuacagaauuguuuauaaaaguucauuuguugaaaaauaaggauccuuuuuaauaccac

SEQ ID NO: 106882 - RNA, 64 nt, Homo Sapiens
agaaauugaugacuuuauaaugcaaccaggaguauugaaaaaaaaguaagcaaugagcucaaau

SEQ ID NO: 106883 - RNA, 64 nt, Homo Sapiens
aaaaugcugaaaagaagagaaauaccccaaguucuugaaaaaaaauuuuuugauaugacuacuc

SEQ ID NO: 106884 - RNA, 64 nt, Homo Sapiens
auauugcaaguggaugaguuggaaauuaugcacuuugaaaaacauucacuuuguuuaagcuuau

SEQ ID NO: 106885 - RNA, 64 nt, Homo Sapiens
aaauuuuuauaaaauacucuugcaaaaaguuuauuugaaaaauuucuagauggucucaugaguu

SEQ ID NO: 106886 - RNA, 64 nt, Homo Sapiens
auacuauuuauaaguugaagaaauaguuugacacuugaaaaaagcuuugauagaaaggaauuuu

SEQ ID NO: 106887 - RNA, 64 nt, Homo Sapiens
ugggggugaaagggaacaaggaaucuguagcuuguugaaaaagccauuucagaguguuggagaa

SEQ ID NO: 106888 - RNA, 64 nt, Homo Sapiens
caaggccagccccaaccuucuaaaaaaauuuuuuuugaaaaaaaaaauaaauauucuuccugau

SEQ ID NO: 106889 - RNA, 64 nt, Homo Sapiens
uaaaaagcccccguuuacauccggaaagcuugcuuugaaaaacucguggccuauagcuucccuu

SEQ ID NO: 106890 - RNA, 64 nt, Homo Sapiens
aaacacuuaaaaugaucauuggacauuuaccuuuuugaaaaagacacaaugugucuuucuuuuu

SEQ ID NO: 106891 - RNA, 64 nt, Homo Sapiens
gugccauuuugcauuuucaugacacuggaaugaguugaaaaaauagauuuuuugguuaagcuuu

SEQ ID NO: 106892 - RNA, 64 nt, Homo Sapiens
uuagagaagcccaguaguuuuuauuguuggauuuuugaaaaaaccucuaccaagaauguggugu

SEQ ID NO: 106893 - RNA, 64 nt, Homo Sapiens
ucauggugaauauaugugauaacaucuuuauacuuugaaaaauguuccacuuacccuucagaua

SEQ ID NO: 106894 - RNA, 64 nt, Homo Sapiens
aaacacaguaauguguauauagugguauaagaucuugaaaaaaaucucuauaauugugcucuuu

SEQ ID NO: 106895 - RNA, 64 nt, Homo Sapiens
augggaaaagccauuuuuaguaggugacuaccauuugaaaaacucaauuggauguauaucugaa

SEQ ID NO: 106896 - RNA, 64 nt, Homo Sapiens
uuaccacagccuugucugauauuuuuuuuaauaauugaaaaaauuauuccuauuagaagaaaua

SEQ ID NO: 106897 - RNA, 64 nt, Homo Sapiens
aguugcuaugugcuuucuuagucaaaauuuacuguugaaaaagcgguagauauuuaggggaaua

SEQ ID NO: 106898 - RNA, 64 nt, Homo Sapiens
uaccuuuacagaaccacagaucacuuauuauacuuugaaaaauugcuuugaaaaaugcuuuucc

SEQ ID NO: 106899 - RNA, 64 nt, Homo Sapiens
ccacagaucacuuauuauacuuugaaaaauugcuuugaaaaaugcuuuuccaguucuuagaaaa

SEQ ID NO: 106900 - RNA, 64 nt, Homo Sapiens
uaauuauaaugccugcaauguugauuuauggaauuugaaaaagagguuuggccuugcugcuguu

SEQ ID NO: 106901 - RNA, 64 nt, Homo Sapiens
aacugcagaaauuccuuauguggggaggcgugucuugaaaaagcugagcacguguguaaaggac

SEQ ID NO: 106902 - RNA, 64 nt, Homo Sapiens
gugaaucccucagugcugacuuauaucuuguucuuugaaaaaaugcauugacucuuuaagacau

SEQ ID NO: 106903 - RNA, 64 nt, Homo Sapiens
acuccugauaaagaauauaaagugagccugauucuugaaaaaaucagaaccagagccuguuuug

SEQ ID NO: 106904 - RNA, 64 nt, Homo Sapiens
auagacuuauauuuuauaaucagaauauguugcuuugaaaaagccucuaauggacugaccuuaa

SEQ ID NO: 106905 - RNA, 64 nt, Homo Sapiens
gcaggauucuaaaaguagacaaucacagggaggauugaaaaaaagggcacucugauagggcaaa

SEQ ID NO: 106906 - RNA, 64 nt, Homo Sapiens
ucaugauuuccuaccauauucaggccuaaagacauugaaaaagcaucuuuucuugagaucaugg

SEQ ID NO: 106907 - RNA, 64 nt, Homo Sapiens
uugcuugguuauuccccucuugcucuucuuuaguuugaaaaaacaaaaacguggccuuggaauu

SEQ ID NO: 106908 - RNA, 64 nt, Homo Sapiens
guaaaaucaaauuuuauauuucauuuuuugacucuugaaaaaugucuuugcuccuuggcagcua

SEQ ID NO: 106909 - RNA, 64 nt, Homo Sapiens
ccuuaaaugaacaaugaagcagguaaaauuacccuugaaaaaaaucccuuggaccacccauaaa

SEQ ID NO: 106910 - RNA, 64 nt, Homo Sapiens
uaaaaaaaaaaguuacagaaaaaagaaggaaaaauugaaaaaaaagacuagugcuuaaaaaaaa

SEQ ID NO: 106911 - RNA, 64 nt, Homo Sapiens
aaacaaaaacaaaaaauggauaacccuuuuagcauugaaaaaaaauaagguugaaaauucugaa

SEQ ID NO: 106912 - RNA, 64 nt, Homo Sapiens
aaaaaaaggagagguagaaggaugcaguaaaacauugaaaaaaagcuaacuuucccccaccccu

SEQ ID NO: 106913 - RNA, 64 nt, Homo Sapiens
ggaaaacaaagggcauuguugguuuuaaaagcuguugaaaaauaccaggacuuugcacaacuuu

SEQ ID NO: 106914 - RNA, 64 nt, Homo Sapiens
uuuucugacugagccaauagugguuggggaacucuugaaaaaggggagagaauggcugggugcu

SEQ ID NO: 106915 - RNA, 64 nt, Homo Sapiens
accuggcgugaguuucauguaugaaaacauaaaauugaaaaaaaaaaaaaaaccuacacgagca

SEQ ID NO: 106916 - RNA, 64 nt, Homo Sapiens
ugaucaaacuuuguucaacaucagggaauuuauauugaaaaauugugcaaauauaauaaauuug

SEQ ID NO: 106917 - RNA, 64 nt, Homo Sapiens
gaguuauaauuacauucaaaguauacuuuauuucuugaaaaauauuacagauuuuuugaaaauu

SEQ ID NO: 106918 - RNA, 64 nt, Homo Sapiens
aguaugaaucuacccaugaaggaugagagauguuuugaaaaacuagccaggacacacccacagg

SEQ ID NO: 106919 - RNA, 64 nt, Homo Sapiens
auuuauaccaguuauaugaauugacuuaaguaucuugaaaaagaaacuuuagagaaagcaucag

SEQ ID NO: 106920 - RNA, 64 nt, Homo Sapiens
cucucuagauuccuccucucugggcagcgcaucuuugaaaaaagugcagauaaaacccucaucu

SEQ ID NO: 106921 - RNA, 64 nt, Homo Sapiens
cauguucuaacccaaugcaaggaagcuaagaaccuugaaaaaagguuagaggaauugcuaacua

SEQ ID NO: 106922 - RNA, 64 nt, Homo Sapiens
uccaugaucuagaauuuaaaaaaauuuuaaaggguugaaaaaagugaaaagaauauuuucaaca

SEQ ID NO: 106923 - RNA, 64 nt, Homo Sapiens
aucaauagaggugaaaggaaauuauuaaacuauauugaaaaauaaagaugucaauaaaaggaga

SEQ ID NO: 106924 - RNA, 64 nt, Homo Sapiens
cuuuucaauaagaugcaaaaguacagaaacauuuuugaaaaauuuggugcaauuccauucauuu

SEQ ID NO: 106925 - RNA, 64 nt, Homo Sapiens
gaaacacaaaacuuugacuuugacugcccgcggauugaaaaacaaaagccgaagcccagugcca

SEQ ID NO: 106926 - RNA, 64 nt, Homo Sapiens
uagauuuuuugaaaagugagguaugcuuaacuuuuugaaaaaauuugcaguuauugcauucaaa

SEQ ID NO: 106927 - RNA, 64 nt, Homo Sapiens
cugugcgaauguaauaaaguucagggaauuuauauugaaaaaaaugcucaaacuuuguucaaua

SEQ ID NO: 106928 - RNA, 64 nt, Homo Sapiens
ggcaacagacucaugacaaaggauucaagauuguuugaaaaaaaaaaaaggggagcagggaggc

SEQ ID NO: 106929 - RNA, 64 nt, Homo Sapiens
uuuuuuguuguuguucuggagagcuucuaggaacuugaaaaauacauaugccacacucuuaaga

SEQ ID NO: 106930 - RNA, 64 nt, Homo Sapiens
ugauugacuggcuaguggccuggccauugguauuuugaaaaaucccuccaagugauucuuuuac

SEQ ID NO: 106931 - RNA, 64 nt, Homo Sapiens
cuaauucacaaguuuuuuuuugaagugaauucuuuugaaaaaaaaaugcaaaacuagaaaacuu

SEQ ID NO: 106932 - RNA, 64 nt, Homo Sapiens
gucaauauaaaaggcaguacuccacagaaugauguugaaaaacuucuucgaagaacaccuucua

SEQ ID NO: 106933 - RNA, 64 nt, Homo Sapiens
agaaauaaacccauauaaauaugcucagcugauuuugaaaaagugaaaaagcaauucaauggag

SEQ ID NO: 106934 - RNA, 64 nt, Homo Sapiens
cggacuuaaaugugauacauaaaacuagauaacuuugaaaaaagccacaggagaaaaaucuuca

SEQ ID NO: 106935 - RNA, 64 nt, Homo Sapiens
auugcauuaccaagaaacagcaauggauacuuuuuugaaaaauugguggaaggaaacauaguag

SEQ ID NO: 106936 - RNA, 64 nt, Homo Sapiens
uuugacuuguacguguuagcaggagaccacuguuuugaaaaacugugcaugcaagagcauucuu

SEQ ID NO: 106937 - RNA, 64 nt, Homo Sapiens
uucuucaucuuauauuguguauaacauaguauuuuugaaaaaguuuuaccacugagguguuaau

SEQ ID NO: 106938 - RNA, 64 nt, Homo Sapiens
uuagcauacaucuaaugugaugaaguuugacugcuugaaaaagaguaaauaaaacaguguauuu

SEQ ID NO: 106939 - RNA, 64 nt, Homo Sapiens
aaguucaugaaguaccaaugaaacaaauauuugcuugaaaaaaaacugucagaauuguuaacug

SEQ ID NO: 106940 - RNA, 64 nt, Homo Sapiens
uaaaacccugaccuguaaccagauucauacagccuugaaaaaagaaaaucucaagaagugaagc

SEQ ID NO: 106941 - RNA, 63 nt, Homo Sapiens
augaaaaagacucuuccguagaauaaauuaguaaaauuaguaaauacauugguguaugucaaa

SEQ ID NO: 106942 - RNA, 64 nt, Homo Sapiens
auuaguaaaugaaaaagacuuaugucaaagaauaaauuaguaaauucaauaucauacauuggug

SEQ ID NO: 106943 - RNA, 64 nt, Homo Sapiens
aaacaauuuagaaaauaguuauccauugacuagaaauuaguacaugcccacagcuggcucccac

SEQ ID NO: 106944 - RNA, 64 nt, Homo Sapiens
auuauuuuuauaaauuuuauuguuggaaaucaaaaauuaguagauuuuuuaccauguuaaauua

SEQ ID NO: 106945 - RNA, 64 nt, Homo Sapiens
auaucaauuuucugugaugacauuucaggauuuaaauuaguacccaaauuucagcuacauaaaa

SEQ ID NO: 106946 - RNA, 64 nt, Homo Sapiens
ucuaaguuacaccuggccugaacauucuggauuuaauuaguaguugguucaaucuuaguaaauu

SEQ ID NO: 106947 - RNA, 64 nt, Homo Sapiens
gcagagugagacucgucucaaaaaaaagaaagaaaauuaguaauuguaaguaccccugauaagc

SEQ ID NO: 106948 - RNA, 64 nt, Homo Sapiens
gaaaauuaguaauuguaaguaccccugauaagcaaauuaguaauugucaauaccccuguuaagc

SEQ ID NO: 106949 - RNA, 64 nt, Homo Sapiens
uuaacagcuuauaaaaaauuugucuaaauuuaauaauuaguauaaggauaugaccuaauaaaug

SEQ ID NO: 106950 - RNA, 64 nt, Homo Sapiens
aguauuuguagaagauuauguguuguauauaacaaauuaguauuuauagaauaugaccuauuua

SEQ ID NO: 106951 - RNA, 64 nt, Homo Sapiens
ugauuauugugagucaaaacucuaagugguuaaaaauuaguaugaauuuuuuagcuucuuaaug

SEQ ID NO: 106952 - RNA, 64 nt, Homo Sapiens
acccacuuuauagauaauuacagggauggugaaaaauuaguaaauagcuucacaaaagaggcag

SEQ ID NO: 106953 - RNA, 64 nt, Homo Sapiens
cauuuucucaaugcucugauaauuaauuaguaauaauuaguaagccaucuuaauaauuaguaau

SEQ ID NO: 106954 - RNA, 64 nt, Homo Sapiens
aauuaguaagcauuuucucaaauuaguaauaauuaauuaguaauggggaugaagccaucuuaau

SEQ ID NO: 106955 - RNA, 64 nt, Homo Sapiens
aauuaauuaguaauaauuaggaagccaucuuaauaauuaguaaucucuuagaccauuuggggau

SEQ ID NO: 106956 - RNA, 64 nt, Homo Sapiens
agauuuuagaguuagguaguacagguaagggggaaauuguaaagaauuagcagaauuaggcaua

SEQ ID NO: 106957 - RNA, 64 nt, Homo Sapiens
uucauugcucccauaagcaaauuuguuuuaaaauaauuguaaaugagguauauacuuaguucuu

SEQ ID NO: 106958 - RNA, 64 nt, Homo Sapiens
uucacuuaauaauguguacauuagucauucaauaaauuguaauuguaaagaaaacauacaacac

SEQ ID NO: 106959 - RNA, 64 nt, Homo Sapiens
uaauaauguguacauuagucauucaauaaauuguaauuguaaagaaaacauacaacacuugccu

SEQ ID NO: 106960 - RNA, 64 nt, Homo Sapiens
gcugcuguaagaaugugaauuugaauguauuuugaauuguaagagcaaaagaacguuuuuguac

SEQ ID NO: 106961 - RNA, 64 nt, Homo Sapiens
auuggaaugaucuucagguuucuacaaauaggguaauuguaaauuuaaagcauuagcauuuauu

SEQ ID NO: 106962 - RNA, 64 nt, Homo Sapiens
cuacacgguguacauuuccauuguuugaauauagaauuguaacauaacauacugucaauuuucc

SEQ ID NO: 106963 - RNA, 64 nt, Homo Sapiens
ucaaccagaaguaaauuuuuuguuguauauuguaaauuguaauuuuuauggucguagcauauag

SEQ ID NO: 106964 - RNA, 64 nt, Homo Sapiens
ggaaacagucucuaaaugugcaaauagagauauaaauuguaauacacuuuagguaucucuuagg

SEQ ID NO: 106965 - RNA, 64 nt, Homo Sapiens
uucaguugcugaauauaucagacugaauugaaggaauuguaaguacuuuaaaugucucugcucu

SEQ ID NO: 106966 - RNA, 64 nt, Homo Sapiens
gaauauguuuaaauauuuaaauuugucuaguaaaaauuguaauugaaggcauguggauuauaag

SEQ ID NO: 106967 - RNA, 64 nt, Homo Sapiens
guuuuuacagugaguuuuauguaauuuuacacugaauuguaaauauaugcauuuuuacuaagua

SEQ ID NO: 106968 - RNA, 64 nt, Homo Sapiens
gauaagacaugaaaauuauauuauuaaaauguucaauuguaaugguaaucaugaguauacuuaa

SEQ ID NO: 106969 - RNA, 64 nt, Homo Sapiens
augauugguuacaagagaauaauguuacauguuuaauuguaauauuugucuccuaucauuuucu

SEQ ID NO: 106970 - RNA, 64 nt, Homo Sapiens
ugaaaaauaugcuucggaaacugugcauaguucuaauuguaagucagauuguauauucaaauug

SEQ ID NO: 106971 - RNA, 64 nt, Homo Sapiens
cauaguucuaauuguaagucagauuguauauucaaauuguaauuaagagauuuaaauauuagaa

SEQ ID NO: 106972 - RNA, 64 nt, Homo Sapiens
auuaauauagcuauugacaguuucaaagcagguaaauuguaaauguuucuuuaagaaaaagcau

SEQ ID NO: 106973 - RNA, 64 nt, Homo Sapiens
gaguuguuccuuuacuggcugaaagauauauucgaauuguaaagaugcuuuuucucaugcauug

SEQ ID NO: 106974 - RNA, 64 nt, Homo Sapiens
acccccacuccuuuauuucagcaaaagcuaauuaaauuguaauguuucuaugucaacuacuggg

SEQ ID NO: 106975 - RNA, 64 nt, Homo Sapiens
auuuaguaaaguguaucaaaguaggacuuuuuugaauuguaaauaggugguuuuauuaaauaaa

SEQ ID NO: 106976 - RNA, 64 nt, Homo Sapiens
uucuuguuaagacuguuacgcuguucaaauauucaauuguaaacugauaauguguacagauuuu

SEQ ID NO: 106977 - RNA, 64 nt, Homo Sapiens
ggagcuaaguccaagaaaguuuuugcauguuuuaaauuguaaauuuuuauguauagugaguaua

SEQ ID NO: 106978 - RNA, 64 nt, Homo Sapiens
auuuccacacugugaaggcaguauuagaagacuuaauuguaaaagcucucuugucacuguguua

SEQ ID NO: 106979 - RNA, 64 nt, Homo Sapiens
cuaauguuacaucugaggaaguauguaauuugagaauuguaacuucuaagggauucacugcauc

SEQ ID NO: 106980 - RNA, 64 nt, Homo Sapiens
uuuuacggugacuuuuggaggaggggaguuuggaaauuguaaaauguuauagauuguugccuau

SEQ ID NO: 106981 - RNA, 64 nt, Homo Sapiens
ugauaaaaaccaagaugccuccacauuuugucauaauuguaaccaauuucaccucugucuccag

SEQ ID NO: 106982 - RNA, 64 nt, Homo Sapiens
gguaccacucuuccacaguuuggaauaauuuuauaauuguaaagauagaaauuauauugauaag

SEQ ID NO: 106983 - RNA, 64 nt, Homo Sapiens
aagauagaaauuauauugauaaguaaauauguaaaauuguaaauauguaaaaaaaagaauggug

SEQ ID NO: 106984 - RNA, 64 nt, Homo Sapiens
ugcucuuugaugauaaaacuuguaauagagcaauaauuguaaaugguuaccauacuguaagaua

SEQ ID NO: 106985 - RNA, 64 nt, Homo Sapiens
auuuuuaccauauuuuaagaacuuuaagacgauuaauuguaaauaauuuauuugauuggugcag

SEQ ID NO: 106986 - RNA, 64 nt, Homo Sapiens
uuuaagaauaccaugaauguaagaaauugaaagaaauuguaaaauaucacauaauauagaaaug

SEQ ID NO: 106987 - RNA, 64 nt, Homo Sapiens
cucaaugcgauucugagauauuugaauuucauaaaauuguaacugaaauuuaaaauuuuuaguu

SEQ ID NO: 106988 - RNA, 64 nt, Homo Sapiens
auuuuaaggagcucccaaaauguguuaccuauuaaauuguaacucagcaaguagaagaccauuu

SEQ ID NO: 106989 - RNA, 64 nt, Homo Sapiens
gcguuagcagcacccuacagaggguaaguuucagaauuguaauuugagaacuccuucaauuaua

SEQ ID NO: 106990 - RNA, 64 nt, Homo Sapiens
ggacugcuugaauuacauuggcuuuuagaaccgaaauuguaacuauguauuguauuucauggga

SEQ ID NO: 106991 - RNA, 64 nt, Homo Sapiens
uuauuagagguauuuguuguuauggacuuaauuuaauuguaaaaagaccaaaguaguauagaag

SEQ ID NO: 106992 - RNA, 64 nt, Homo Sapiens
uuucaaaauuaauugauguuggaucauguuguuaaauuguaaauaaaugugcuuguuauugaua

SEQ ID NO: 106993 - RNA, 64 nt, Homo Sapiens
aacgaaggagaaaaagguaguuugaaccuugguaaauuguaaacagcuaauaaugaaguuauuc

SEQ ID NO: 106994 - RNA, 64 nt, Homo Sapiens
gagacucgucucaaaaaaaagaaagaaaauuaguaauuguaaguaccccugauaagcaaauuag

SEQ ID NO: 106995 - RNA, 64 nt, Homo Sapiens
uaaaugaaagcuauugagauugaagcuuuuuaaaaauuguaaagauaaaauugaaguacuuaau

SEQ ID NO: 106996 - RNA, 64 nt, Homo Sapiens
cucguaggauguauguuggauggauuuguaauuaaauuguaagcacccuuuuuuccgucaaaau

SEQ ID NO: 106997 - RNA, 64 nt, Homo Sapiens
uaaaaauguguguguguuuagcaauagggguuauaauuguaagaauuguuucuuguuuuguacu

SEQ ID NO: 106998 - RNA, 64 nt, Homo Sapiens
uuugcaucauaaacugagaaguggauaaaugaacaauuguaagugaaaauccucuauugagaau

SEQ ID NO: 106999 - RNA, 64 nt, Homo Sapiens
ugaaauucuagauaagcaugcaauguaccaggcaaauuguaaguuaagaaucagaguaggguaa

SEQ ID NO: 107000 - RNA, 64 nt, Homo Sapiens
gccuguguuaaagaggcagcacugaaggcaaccuaauuguaaauaacuaaacagagguuuccaa

SEQ ID NO: 107001 - RNA, 64 nt, Homo Sapiens
gucaaguauucuguuuuuggcuaauuugauuuugaauuguaaauuguaaauauuuaauauuccg

SEQ ID NO: 107002 - RNA, 64 nt, Homo Sapiens
acuacaaaaugucaaaauaaacguugaucucuuaaauuguaaaccagcuauuuaggggaauguu

SEQ ID NO: 107003 - RNA, 64 nt, Homo Sapiens
uacaguuuuuuuuguuugguuugugggcuguuggaauuguaauuuuuaauugccuucuaaaaaa

SEQ ID NO: 107004 - RNA, 64 nt, Homo Sapiens
ucauugucaaaugcauauuuagauuagauuauugaauuguaauguuuaucugcugcuuuuuuua

SEQ ID NO: 107005 - RNA, 64 nt, Homo Sapiens
cuuguuaacuguuuauauacagacuuguaaguauaauuguaaagacucuuaauacauuucuuua

SEQ ID NO: 107006 - RNA, 64 nt, Homo Sapiens
uugucagugaauuuaucacuauuagugaaauuugaauuguaaacugggagaauuauuucuauau

SEQ ID NO: 107007 - RNA, 64 nt, Homo Sapiens
gugaaaaaauaauuuuaagguguggaaauaggauaauuguaauuguaaccugaaaugccacuau

SEQ ID NO: 107008 - RNA, 64 nt, Homo Sapiens
cuacuacuuuguuuuaguuaaaguauauuauaaaaauuguaaaaacauuuaauuuaguacaauu

SEQ ID NO: 107009 - RNA, 64 nt, Homo Sapiens
caccuguuuguuauguggauauugcucugcuccuggcauagagucauauguaguagaaucagcc

SEQ ID NO: 107010 - RNA, 64 nt, Homo Sapiens
auucuugaaaaaaaaaaaugaugaacuuguagggggcauagaggagaacacuuggaaugaacga

SEQ ID NO: 107011 - RNA, 64 nt, Homo Sapiens
ugcuauaccaauggaccagucaauaaacaguaaccuccaucaaaaucuacagucgcugaauaac

SEQ ID NO: 107012 - RNA, 64 nt, Homo Sapiens
uucuuuccucuuucuucccauuucuuucuacuuucuccaucauccuccauagguuccugaugag

SEQ ID NO: 107013 - RNA, 64 nt, Homo Sapiens
gagagcagccaugccagggaagugccugucucgccuccaucaggugaggauggcagagggacac

SEQ ID NO: 107014 - RNA, 64 nt, Homo Sapiens
uauacuuagaaggagcagaaagaauguguggcaccuccaucaguuguccccuucuccccagcua

SEQ ID NO: 107015 - RNA, 64 nt, Homo Sapiens
acaagagaagcccccaaccugauucucaugacagcuccaucaagaaugugggaugugccgacca

SEQ ID NO: 107016 - RNA, 64 nt, Homo Sapiens
cuggucuuguguuacacauccauggaccgguucacuccaucauauacagcucucugcuccgugu

SEQ ID NO: 107017 - RNA, 64 nt, Homo Sapiens
cugauuagcauguuuauuccuuuugucugauuuucuccaucaucuuuucaagguccuucuauug

SEQ ID NO: 107018 - RNA, 64 nt, Homo Sapiens
uauucccuuuuuucuuuugaugaaaacaacauggcuccaucacaaugagccuuuguuugagauu

SEQ ID NO: 107019 - RNA, 64 nt, Homo Sapiens
aaccagaaugacuggacaaucuuuuucauagcuucuccaucacauucaagcugguuuaugucac

SEQ ID NO: 107020 - RNA, 64 nt, Homo Sapiens
auugugcucagugaacauccagugcugggugcagcuccaucacccucuuguguguuuacauguc

SEQ ID NO: 107021 - RNA, 64 nt, Homo Sapiens
cagagguggggcugcaccagacucagcacuagcacuccaucagcacuagcaccucacuccauca

SEQ ID NO: 107022 - RNA, 64 nt, Homo Sapiens
ucagcacuagcacuccaucagcacuagcaccucacuccaucagcacuagcaccucacuccaucg

SEQ ID NO: 107023 - RNA, 64 nt, Homo Sapiens
cuccaucggcacuaaugccccacucggcgccccacuccaucagcacuaaugcuccacuccauug

SEQ ID NO: 107024 - RNA, 64 nt, Homo Sapiens
acuaaugacccgcuccuuugacauuggugccccacuccaucagcacuaacgcccugcuccaucg

SEQ ID NO: 107025 - RNA, 64 nt, Homo Sapiens
acuaacguccggcuccaucggcacuaccaccccgcuccaucaucacuauguccagcuccgucgg

SEQ ID NO: 107026 - RNA, 64 nt, Homo Sapiens
cacuauguccagcuccgucggcacuaccacccugcuccaucaucacuacguccagcuccaacgg

SEQ ID NO: 107027 - RNA, 64 nt, Homo Sapiens
uccccguugucauagcuauuucauugccaaccaacuccaucacaugguuguugauaucgucaua

SEQ ID NO: 107028 - RNA, 64 nt, Homo Sapiens
uucuuucuuguuccacaaugaauugcacauccaucuccaucagagcugauagccuguuaauaag

SEQ ID NO: 107029 - RNA, 64 nt, Homo Sapiens
cuccaacuuuggggcccaugaaugcuguacucaccuccaucacccacacgcugcguucacugcc

SEQ ID NO: 107030 - RNA, 64 nt, Homo Sapiens
uccaggugccccacgccuggagccgccccacccacuccaucauccgagauugaacuguagcccg

SEQ ID NO: 107031 - RNA, 64 nt, Homo Sapiens
ggccagccugccuccaccucccacccccuuccaccuccaucagucaugugugcagagucagugc

SEQ ID NO: 107032 - RNA, 64 nt, Homo Sapiens
ggcccagggcuacuaaagacuucaggauagaauucuccaucaaauauacagcauaaguaaaacu

SEQ ID NO: 107033 - RNA, 64 nt, Homo Sapiens
cuaggcuacauuucaaaauucagggcuguuuaagauuuaaaaucacaaacauuaacggcaguag

SEQ ID NO: 107034 - RNA, 64 nt, Homo Sapiens
uuucagucauaguacuaauaauuaaauuuucaguauuuaaaaagacaaaguauuuuguccauuu

SEQ ID NO: 107035 - RNA, 64 nt, Homo Sapiens
ugaauacuuuuuucauaguuauuuguuuaaaaagauuuaaaaaucauugcacuuuggucagaaa

SEQ ID NO: 107036 - RNA, 64 nt, Homo Sapiens
aaugcuaagugguauccgagguucuuaauaugagauuuaaaaucuuaaaauguuucuuauuuuc

SEQ ID NO: 107037 - RNA, 64 nt, Homo Sapiens
augcagccacuauaacuugauaagucauugcacuauuuaaaaaguuuuaguaauaucaugaauu

SEQ ID NO: 107038 - RNA, 64 nt, Homo Sapiens
uuuaaaauguauuugaaguaauauuuaaauaggcauuuaaaauuucaaauuagauguuaaauuu

SEQ ID NO: 107039 - RNA, 64 nt, Homo Sapiens
cauucacucuguuucucuucugcuggauuauauaauuuaaaaauaauguguucccguauuuugu

SEQ ID NO: 107040 - RNA, 64 nt, Homo Sapiens
uaaaugcugauauugauuucacugguccaucuauauuuaaaacgugcaagaaaaaaauaaaaua

SEQ ID NO: 107041 - RNA, 64 nt, Homo Sapiens
uuuguguaacaaaggcauaucgucauguuaauaaauuuaaaacaucauucguauaaaauauuuu

SEQ ID NO: 107042 - RNA, 64 nt, Homo Sapiens
caaauucaauguuauacauacuugguaaacauuuauuuaaaauuuaauuuacuauacuuauugu

SEQ ID NO: 107043 - RNA, 64 nt, Homo Sapiens
auuugguguacuaacaucaaaauguauccaagccauuuaaaaaauauuuauauauacauaguag

SEQ ID NO: 107044 - RNA, 64 nt, Homo Sapiens
gccaggaaaggcuagguucaguagaugagacauuauuuaaaagauaaauuuaaaaagaugguaa

SEQ ID NO: 107045 - RNA, 64 nt, Homo Sapiens
agguucaguagaugagacauuauuuaaaagauaaauuuaaaaagaugguaaaugaacacuuguu

SEQ ID NO: 107046 - RNA, 64 nt, Homo Sapiens
uuguguguaauugccauuaaauuuucaaaauguaauuuaaaaggauuaaauacucauuuaauaa

SEQ ID NO: 107047 - RNA, 64 nt, Homo Sapiens
auguaauuuaaaaggauuaaauacucauuuaauaauuuaaaauaauuauuguauaauaucuaca

SEQ ID NO: 107048 - RNA, 64 nt, Homo Sapiens
acuaaaacaaagaaaugguaaaugaauuguuugcauuuaaaaaaaaaaacucuuaagaaaacug

SEQ ID NO: 107049 - RNA, 64 nt, Homo Sapiens
cucuaaaguguauauuuuuguguccaguuauauuauuuaaaaaaguguuacuuuguaaaaauug

SEQ ID NO: 107050 - RNA, 64 nt, Homo Sapiens
aagacaaaguuuuucagaaaagaggaaaaaaagaauuuaaaaaaggaucuccacucuucaugac

SEQ ID NO: 107051 - RNA, 64 nt, Homo Sapiens
aaaaauuuaacugguuuuuacuacugaugacuugauuuaaaaaaaauacaaagaugcuggaugc

SEQ ID NO: 107052 - RNA, 64 nt, Homo Sapiens
cucuagguauauuuccaacuuuauauaucacaguauuuaaaaagacauguuugcauugagaaau

SEQ ID NO: 107053 - RNA, 64 nt, Homo Sapiens
uauauauucaauuuuuuaccauuuuauggaaaauauuuaaaaucuguuuuuacaggguuuuuuu

SEQ ID NO: 107054 - RNA, 64 nt, Homo Sapiens
uuaugaauaauaaagauguuaacaauccaucuguauuuaaaacacuagcagccagaucugcugc

SEQ ID NO: 107055 - RNA, 64 nt, Homo Sapiens
aaaaugagacauugucucuaaaauacauaaguaaauuuaaaaaaaaaagaauaauaauuugaac

SEQ ID NO: 107056 - RNA, 64 nt, Homo Sapiens
aacgcuaauuaaaaacuugcuuuaaagauauugaauuuaaaaaggcauaauaaucaaauacuua

SEQ ID NO: 107057 - RNA, 64 nt, Homo Sapiens
caucagucuuuuucaucauccaaguuuguaguucauuuaaaaauacaacauuaaacacauuuug

SEQ ID NO: 107058 - RNA, 64 nt, Homo Sapiens
guuucacucaugucugucauuuuauaagcauaucauuuaaaaagcuucuaaaaagcuauuucgc

SEQ ID NO: 107059 - RNA, 64 nt, Homo Sapiens
augaaaauauauuucccuguaagcugaauuacucauuuaaaaauuuuaacuucuauaugggacc

SEQ ID NO: 107060 - RNA, 64 nt, Homo Sapiens
acaaaaagaaauugacucaguacauagaacaaauauuuaaaaaagcaacuuuaaggcuuguaaa

SEQ ID NO: 107061 - RNA, 64 nt, Homo Sapiens
ucacaauaguaaucaaaacagcuugcuucagaaaauuuaaaaaaaucuuucugccugccucuca

SEQ ID NO: 107062 - RNA, 64 nt, Homo Sapiens
uuacauucuuuauuuucuauuguauaaagagagaauuuaaaaaauuuguuuaaccuugaugaau

SEQ ID NO: 107063 - RNA, 64 nt, Homo Sapiens
uuaacacguuuagauagcuucaaaucagguccugauuuaaaauuacauuuaauggaaagcaaaa

SEQ ID NO: 107064 - RNA, 64 nt, Homo Sapiens
acagcauaaaaugcuuaaaaauaguagugacuauauuuaaaaaauaacauaaaagcaaguacau

SEQ ID NO: 107065 - RNA, 64 nt, Homo Sapiens
caaaguccucuacacuugauauuauauuuuuaacauuuaaaaacuuagguaccuaucugcucca

SEQ ID NO: 107066 - RNA, 64 nt, Homo Sapiens
aaaaguacguauuuagauaacaagcaauuccuuuauuuaaaaaaacagaaagcacugaguugag

SEQ ID NO: 107067 - RNA, 64 nt, Homo Sapiens
uuggcuguacuaagcaaaugcuugugcuuucuguauuuaaaacucauguuaccauugguuuauu

SEQ ID NO: 107068 - RNA, 64 nt, Homo Sapiens
auuucagcuauaacaaaguacaaccauuugcuucauuuaaaaccguucugucauucauuauuua

SEQ ID NO: 107069 - RNA, 64 nt, Homo Sapiens
cuacacauuguacaaaauaugucacuucuuuacuauuuaaaauauaccuucagcuugaugcaug

SEQ ID NO: 107070 - RNA, 64 nt, Homo Sapiens
uucacacaaccauaaguauauaagaggcuuuaagauuuaaaaguauagauacacaugauuaugu

SEQ ID NO: 107071 - RNA, 64 nt, Homo Sapiens
auauaaaagcuuuggauauggaaaucuuaaaucuauuuaaaaggcugucuucccccaaagaguu

SEQ ID NO: 107072 - RNA, 64 nt, Homo Sapiens
uauaacaucuuauuguugguaaaauggcuguaauauuuaaaacucuuuuuuuagccaaaaugua

SEQ ID NO: 107073 - RNA, 64 nt, Homo Sapiens
gaucauuuguaagaccaaaauuacagaaaaguccauuuaaaaguaauuuuugaguuuuacauuc

SEQ ID NO: 107074 - RNA, 62 nt, Homo Sapiens
cuguuucuguuccucagucuaaagaccucuugacauuuaaaaaacugugcuauuauuucaau

SEQ ID NO: 107075 - RNA, 64 nt, Homo Sapiens
gaagauuuaaacuuugcacuaugucugcaugauaauuuaaaaugauagcauggcuugaaaugcu

SEQ ID NO: 107076 - RNA, 64 nt, Homo Sapiens
aaauguaaaaguguucuguaagccaacaaaugaaauuuaaaagcucuuucuccaagaacuuuca

SEQ ID NO: 107077 - RNA, 64 nt, Homo Sapiens
gagcaguacauccugggaggcuaguacacgcccuauuuaaaaaaacuuacguuaaacuucauuu

SEQ ID NO: 107078 - RNA, 64 nt, Homo Sapiens
ccacuguaauugacagaguaauuauauucaaugcauuuaaaauaaagauacagacauucaauga

SEQ ID NO: 107079 - RNA, 64 nt, Homo Sapiens
aaucuugcuucauuguuacagaggcaaaucuaaaauuuaaaauuaaauaacaacuaacuuguuu

SEQ ID NO: 107080 - RNA, 64 nt, Homo Sapiens
aaauuaauuaaaguagaagaauagaaauaaauaaauuuaaaauguaauaguuaaaaguggaaga

SEQ ID NO: 107081 - RNA, 64 nt, Homo Sapiens
aaaaaagucuuccucuggaacaugcuuuccuagaauuuaaaaauaaaauccaauuugaauaagu

SEQ ID NO: 107082 - RNA, 64 nt, Homo Sapiens
guauuccuacacauauuagacuauauaaucuuacauuuaaaauucuaucuaucuauaucuacau

SEQ ID NO: 107083 - RNA, 64 nt, Homo Sapiens
caaguauuuuauucacauuagaaacaauuuaauuauuuaaaauuuaaacgcuaaaacauuugaa

SEQ ID NO: 107084 - RNA, 64 nt, Homo Sapiens
uugauccuucccuuggaccauaagcaaauauguuauuuaaaauagcagccacuguaugauauuu

SEQ ID NO: 107085 - RNA, 64 nt, Homo Sapiens
aguauauucaguaguugaagugucucacuccaucauuuaaaacccacgucagcaagagccucuu

SEQ ID NO: 107086 - RNA, 64 nt, Homo Sapiens
aaggccugugccucccacccgaaaauugacuuuaauuuaaaacagacacuguggucagucauuu

SEQ ID NO: 107087 - RNA, 64 nt, Homo Sapiens
gcuauuuuucuuauagaagaaaaagauauaaaaaauuuaaaacuuugcauuuaaaugauaacau

SEQ ID NO: 107088 - RNA, 64 nt, Homo Sapiens
aacugcacgggcuuuaggguaaacuaaaacguggauuuaaaaaguaucucacaaauaggaaaua

SEQ ID NO: 107089 - RNA, 64 nt, Homo Sapiens
uugauuuuuuuuaaaugucaaaucuuuagacaauauuuaaaaucuuucuaaaucugggauuuaa

SEQ ID NO: 107090 - RNA, 64 nt, Homo Sapiens
uuuagacaauauuuaaaaucuuucuaaaucugggauuuaaaauccaacaguccuaaacugucau

SEQ ID NO: 107091 - RNA, 64 nt, Homo Sapiens
uguguuugguuauuaauauaagugacaaacugcaauuuaaaaagucucauuucuacaucuuagc

SEQ ID NO: 107092 - RNA, 64 nt, Homo Sapiens
uuaggggauauuguaacccauaccaauaaaaagcauuuaaaaauaagugggaaaugagaaguua

SEQ ID NO: 107093 - RNA, 64 nt, Homo Sapiens
ggucugcauuugggggcuaaaguguauauauuccauuuaaaauggaauuuguuuguauuugggg

SEQ ID NO: 107094 - RNA, 64 nt, Homo Sapiens
agcccaugggcauuaaggcaaaguaguuccagugauuuaaaauacgguuccaaauacgcuaaaa

SEQ ID NO: 107095 - RNA, 64 nt, Homo Sapiens
uagacucccuacaguccuucaauggaaaaguaacauuuaaaaauccuuuggguaauucgaauua

SEQ ID NO: 107096 - RNA, 64 nt, Homo Sapiens
cauuuaaaaauccuuuggguaauucgaauuacagauuuaaaagagcuuaagaucugguguuuug

SEQ ID NO: 107097 - RNA, 64 nt, Homo Sapiens
aaacuauugcuacuuaaauuuccaauaauuaaaaauuuaaaauuuuuaaauuagaauugccaau

SEQ ID NO: 107098 - RNA, 64 nt, Homo Sapiens
ugucucuauuaagaaaaaaaauguuaacauuaugauuuaaaagugcauuaaccuuaaucuagau

SEQ ID NO: 107099 - RNA, 64 nt, Homo Sapiens
ggcaaccuccagaacugugaaaaauaaauuuguuauuuaaaaagaaaaaaaaaaaaacaaaaac

SEQ ID NO: 107100 - RNA, 64 nt, Homo Sapiens
ugccggauggaaagaggcugccccauuugaggucauuuaaaaucugugaagcaaauccagacuc

SEQ ID NO: 107101 - RNA, 64 nt, Homo Sapiens
cauucauauuugcacaggaaaaauaaagaccuggauuuaaaaauaggaaugacucuugcuucag

SEQ ID NO: 107102 - RNA, 64 nt, Homo Sapiens
aaaauaaacguccuggggguuacccagaauacagauuuaaaaguuugccuguagagcaaaauaa

SEQ ID NO: 107103 - RNA, 64 nt, Homo Sapiens
gaaaugacugcugaaauaaggcgauuguaugaauauuuaaaaugccuggaacacuaaaguaaag

SEQ ID NO: 107104 - RNA, 64 nt, Homo Sapiens
uuggaaucgugucuuccaugcuccacuggguucaauuuaaaauaggagaggcuuucucuucuga

SEQ ID NO: 107105 - RNA, 64 nt, Homo Sapiens
aggugugguuuuauugaaugucuauuugaguaucauuuaaaaaguauuugccuuuuacugucau

SEQ ID NO: 107106 - RNA, 64 nt, Homo Sapiens
gucauggaauaguuuuuauauuuacagcuuuuauauuuaaaacuuguaagaguuuuuuuaauga

SEQ ID NO: 107107 - RNA, 64 nt, Homo Sapiens
aaaaaaaaaaaaacuucaguuuucuaaaaauuauauuuaaaauuguaaucaaaauguaccuagu

SEQ ID NO: 107108 - RNA, 64 nt, Homo Sapiens
aaacugcuuuuuccaacucagaaauucaauuuggauuuaaaagccugcucaaucccugaggacu

SEQ ID NO: 107109 - RNA, 64 nt, Homo Sapiens
uacguagccuaaggcuccuguuuugcacagccaaauuuaaaacuguuggaauggauuuuucuuu

SEQ ID NO: 107110 - RNA, 64 nt, Homo Sapiens
uaaucauugcuuucuguagaagaaaaagguuuaaauuuaaaauguguauuuagagcauggagag

SEQ ID NO: 107111 - RNA, 64 nt, Homo Sapiens
ugagucaauaccuuuauaagcaaaaccaugauaaauuuaaaaacaacagaaauguggcaugauu

SEQ ID NO: 107112 - RNA, 64 nt, Homo Sapiens
gggcaugugcuauuaccagaaacaacaaacuuauauuuaaaauacccuucauuugacacaguuu

SEQ ID NO: 107113 - RNA, 64 nt, Homo Sapiens
ucaguauuguguaucuuuggacaauuagauggacauuuaaaauggaacuucuuuuaucugacag

SEQ ID NO: 107114 - RNA, 64 nt, Homo Sapiens
aucacugucucaaagagauauuaaaauuuuauacauuuaaaaucauuguuaaauugauugagga

SEQ ID NO: 107115 - RNA, 64 nt, Homo Sapiens
aaaaucauuguuaaauugauugaggaaaacaaccauuuaaaaaaaaucuauguugaauccuuuu

SEQ ID NO: 107116 - RNA, 64 nt, Homo Sapiens
gaauugguuauuugggggcuuuuuuacuuacuguauuuaaaaauacaaggguauugauaugaaa

SEQ ID NO: 107117 - RNA, 64 nt, Homo Sapiens
gcguguauggaugugugugagucagugguagcuuauuuaaaaagcaccuuauccuuucucccau

SEQ ID NO: 107118 - RNA, 64 nt, Homo Sapiens
aaaaccaagcucccuucccuuauucuucaguccuauuuaaaaacaucuccugauuuuucaaugu

SEQ ID NO: 107119 - RNA, 64 nt, Homo Sapiens
aaaaccacagaggcggaaaugaagagaaaaaggaauuuaaaacagagagaaguaucagcaccca

SEQ ID NO: 107120 - RNA, 64 nt, Homo Sapiens
acugauuuuuuuuuaaccugggaacuaaugcuauauuuaaaaacuggaaacaguauuuguaaau

SEQ ID NO: 107121 - RNA, 64 nt, Homo Sapiens
uauuuuuaaauaucuuccccuccagcagccagcuauuuaaaaaaacuucuuuuuacauuucagc

SEQ ID NO: 107122 - RNA, 64 nt, Homo Sapiens
gguaguggaaauucuaugccaagacuuguuauccauuuaaaaaucauugucuuggugguguuac

SEQ ID NO: 107123 - RNA, 64 nt, Homo Sapiens
agaacagguauauaagcuaaugguacuauuugccauuuaaaacuuaugauuuauuagcacaacg

SEQ ID NO: 107124 - RNA, 64 nt, Homo Sapiens
ucaccccuugaagccuuuuuuauuuaaaaccuugauuuaaaauagcaacacaagacaccuuuug

SEQ ID NO: 107125 - RNA, 64 nt, Homo Sapiens
uugauuuaaaauaucaccccaagacaccuuuuguauuuaaaaccacuguaugauuaagcaacac

SEQ ID NO: 107126 - RNA, 64 nt, Homo Sapiens
uguaauauaaagauguuaaagcauuccugauaugauuuaaaacaguagugugcaguucuaguuu

SEQ ID NO: 107127 - RNA, 64 nt, Homo Sapiens
uucauuuuuaaucaugaaaugauacaauguauuuauuuaaaagaaucagucagugcaaauguca

SEQ ID NO: 107128 - RNA, 64 nt, Homo Sapiens
auaacaaacauuuuuuaaaaaaugaaaagcccccauuuaaaaaauuuccaauggcucaggagac

SEQ ID NO: 107129 - RNA, 64 nt, Homo Sapiens
uguuaaauuggcuugaaauuaucgugaaagguacauuuaaaauaaagugcaccuagcuuauuac

SEQ ID NO: 107130 - RNA, 64 nt, Homo Sapiens
ucacuuacaggaucauguuauuucugauuauuuaauuuaaaagaaagaauaaauuuggacccgg

SEQ ID NO: 107131 - RNA, 64 nt, Homo Sapiens
aaagugaguuuaccaaaauuagagggccagcuuaauuuaaaaaucuguuguaauggaguaaaga

SEQ ID NO: 107132 - RNA, 64 nt, Homo Sapiens
auucuucugaacucaucaaauaguuuucucaaccauuuaaaaauguuauuccaguaaaaggaaa

SEQ ID NO: 107133 - RNA, 64 nt, Homo Sapiens
gaaucuaauuuuuaaagguggcaaacuacuaagcauuuaaaagaacuugcucugaccccucuaa

SEQ ID NO: 107134 - RNA, 64 nt, Homo Sapiens
aagaaacuuuucugaaugccauuauaaauuguguauuuaaaaaaugaaaugaaaucuucccagu

SEQ ID NO: 107135 - RNA, 64 nt, Homo Sapiens
acaaaaaaaauuuuagcucuguuuuuaacuuuuaauuuaaaaacuacuuugaagugcagcucau

SEQ ID NO: 107136 - RNA, 64 nt, Homo Sapiens
aaauguuguggaaaagguagguacuugaaguuuuauuuaaaauauuuuuuguaccuacguaaga

SEQ ID NO: 107137 - RNA, 64 nt, Homo Sapiens
cguuuguaaccacuguguuuugccucagaaauaaauuuaaaagacauuucccucccauuugccu

SEQ ID NO: 107138 - RNA, 64 nt, Homo Sapiens
ucagcaaaauaauccaugaaacagaggcuuuaaaauuuaaaaccaucaaguauaaaauucugaa

SEQ ID NO: 107139 - RNA, 64 nt, Homo Sapiens
ccaccaucacaugagagaaucagaaggaaaaaacauuuaaaaacacaaaaccacaucagguuuu

SEQ ID NO: 107140 - RNA, 64 nt, Homo Sapiens
uaaauccauucaggugacaauuaauggugaaguaauuuaaaauauggacagaggcauuuucacc

SEQ ID NO: 107141 - RNA, 64 nt, Homo Sapiens
uauauauacguaacccaagcgaaagggaaaguggauuuaaaauaugacacagggggccuggaaa

SEQ ID NO: 107142 - RNA, 64 nt, Homo Sapiens
cacuacagguuaaaagaccauaagcaaacugguuauuuaaaauguaaaaaggaauaugaaaguc

SEQ ID NO: 107143 - RNA, 64 nt, Homo Sapiens
aauacauuguacauauuauguuaauauuuacacaauuuaaaauauagauguguuuuauuuugaa

SEQ ID NO: 107144 - RNA, 64 nt, Homo Sapiens
cauccagaauguauagacaggaaaagcaugucuuauuuaaaacuguaauuuaugggcucaggau

SEQ ID NO: 107145 - RNA, 64 nt, Homo Sapiens
caaauugcccacucgugauaagucaacagccaauauuuaaaacuuuguucguuacuggcuuuac

SEQ ID NO: 107146 - RNA, 64 nt, Homo Sapiens
caauaaugagaaauguuggugugcuuuucuaagcauuuaaaacauaauugccaauugaaacccu

SEQ ID NO: 107147 - RNA, 64 nt, Homo Sapiens
uuauuaucuuuaacuguaucuauuuugaauguaaauuuaaaaaaaguaauucucugucaaugga

SEQ ID NO: 107148 - RNA, 64 nt, Homo Sapiens
uaguuugauaugguuacuucuauguugaaauaaaauuuaaaaucacaugcaaaaaaaaaaucag

SEQ ID NO: 107149 - RNA, 64 nt, Homo Sapiens
aaagcaccugauuugcacuugaaccagauuauagauuuaaaaguauaugacauguauuuuguau

SEQ ID NO: 107150 - RNA, 64 nt, Homo Sapiens
uuauagauuuaaaaguauaugacauguauuuuguauuuaaaacuagaauagccaguauuuaugu

SEQ ID NO: 107151 - RNA, 64 nt, Homo Sapiens
uaaauguguuuuuaaccucccgcauucugugcuuauuuaaaacaaggaaacuucuaaccauuuc

SEQ ID NO: 107152 - RNA, 64 nt, Homo Sapiens
ucuuuuguguauucauguuuaaagaaaaaaagugauuuaaaaaugaucuuaccuguaccagaaa

SEQ ID NO: 107153 - RNA, 64 nt, Homo Sapiens
guuguucuuuaaguguacaucguaauuugaccuaauuuaaaaauaauauauuuucgaaguagua

SEQ ID NO: 107154 - RNA, 64 nt, Homo Sapiens
uuuuauaaauaaauaauuccaaaauaauuucuuaauuuaaaaugauagcacuucucuugcacuu

SEQ ID NO: 107155 - RNA, 64 nt, Homo Sapiens
ugcaaauauauuuugaaguuacuuuuaaauauuuauuuaaaaccucuguuucuguaacuguaug

SEQ ID NO: 107156 - RNA, 64 nt, Homo Sapiens
aaugagaauagacuggaacaugugagggaaaaauauuuaaaaaaagauggcagucaucuagaca

SEQ ID NO: 107157 - RNA, 64 nt, Homo Sapiens
aucaggauugcaugaaagaagaaaauccuucaauauuuaaaauguuucuuacaauacccacgga

SEQ ID NO: 107158 - RNA, 64 nt, Homo Sapiens
auggcaccuugaaagugaacuucuagaaaucuacauuuaaaaggcaaagcuuuaaaagcagagc

SEQ ID NO: 107159 - RNA, 64 nt, Homo Sapiens
agaaaggagauuuauuuuccuuaaacauccaauaauuuaaaaugauuuucaauaauaauaauca

SEQ ID NO: 107160 - RNA, 64 nt, Homo Sapiens
aggaagugggcuaagaugggaaaaauauaaaaagauuuaaaauccagcaacaaaauuuacacau

SEQ ID NO: 107161 - RNA, 64 nt, Homo Sapiens
aacagaguaaauagcauucucuaucaauauauaaauuuaaaaaacuaucuuuuugcuuacaguu

SEQ ID NO: 107162 - RNA, 64 nt, Homo Sapiens
caucauguuacuuuaaauauaucuauauuauuguauuuaaaauguguuucuuacagacugcaug

SEQ ID NO: 107163 - RNA, 64 nt, Homo Sapiens
gguuugugguacacaaagagucugccuuauaaacauuuaaaaccuggaaccagcaguucagaga

SEQ ID NO: 107164 - RNA, 64 nt, Homo Sapiens
gaccaaagacaauuaauuccccagcaaguuguucauuuaaaacucagucuauucuaggaaugaa

SEQ ID NO: 107165 - RNA, 64 nt, Homo Sapiens
guaaggguaaaaaagauaaauguuggagugaagcauuuaaaagaagggaauaaauuuuugucuu

SEQ ID NO: 107166 - RNA, 64 nt, Homo Sapiens
gaucuguaguuuuuuuggugcuaugaauuuguccauuuaaaaaucaccucagaaauugaaagca

SEQ ID NO: 107167 - RNA, 64 nt, Homo Sapiens
uaggaaguaagcuacuuagucuguaacuuuauuaauuuaaaagggacucaagcaauguggcuga

SEQ ID NO: 107168 - RNA, 64 nt, Homo Sapiens
ggccauuuguaucuaccuuuggaguaauauuacuauuuaaaauacuuuaagugucugugaacau

SEQ ID NO: 107169 - RNA, 64 nt, Homo Sapiens
auuuuuaaauuaacaguuauuucaauaaacucaaauuuaaaauaauguacaaaaaaauggcaaa

SEQ ID NO: 107170 - RNA, 64 nt, Homo Sapiens
uuggucuagguuuuuuuccuuuuaagaaaccaauauuuaaaaugguuaaugggaauuuaacaua

SEQ ID NO: 107171 - RNA, 64 nt, Homo Sapiens
ucuuguuccaaaguccugucucaaguauuauacaauuuaaaaacauuuauauucauagauccuc

SEQ ID NO: 107172 - RNA, 64 nt, Homo Sapiens
agucuuauucacagauugcaacacaaguagaaauauuuaaaagccauucuauauguaagauagc

SEQ ID NO: 107173 - RNA, 64 nt, Homo Sapiens
gaaagaacaugggugguacaaucugagaggccccauuuaaaaaagugauccgaugugcagccaa

SEQ ID NO: 107174 - RNA, 64 nt, Homo Sapiens
ccagaugcccacaccacaccaaccaccugggagcauuuaaaacucccaccuugcagcgcauucc

SEQ ID NO: 107175 - RNA, 64 nt, Homo Sapiens
aagaaccaaaacucucuucuauuugauuuucuacauuuaaaaugacacaaaucaaaugugaagg

SEQ ID NO: 107176 - RNA, 64 nt, Homo Sapiens
auaaguaaaucuaggcuauuaguuuuuaaugagcauuuaaaaaaauuuuacuacauaguauaca

SEQ ID NO: 107177 - RNA, 64 nt, Homo Sapiens
aaaaccagagguuauauacaaaauuuaugccacaauuuaaaaauuaaaguguauauuaggauuu

SEQ ID NO: 107178 - RNA, 64 nt, Homo Sapiens
ucauauuuuaagugggauuuauucauucauggcaauuuaaaaaguauuuuacuuguuuuuaauu

SEQ ID NO: 107179 - RNA, 64 nt, Homo Sapiens
cugcaccaguuggcuuuucuauuauacauuuugcauuuaaaagguugcauuuugacauuacuuu

SEQ ID NO: 107180 - RNA, 64 nt, Homo Sapiens
guacaguuucauuugcauuuaaugacuguacugaauuuaaaaccuuuaugaauuaauguuuaua

SEQ ID NO: 107181 - RNA, 64 nt, Homo Sapiens
uguuuauuaaccgauucuccacauaauauauugaauuuaaaaugguugcuucccgcucauaaau

SEQ ID NO: 107182 - RNA, 64 nt, Homo Sapiens
ggaaaaacauuucacaaauuauagagacucuuacauuuaaaaaucuguugcuuugugaguggag

SEQ ID NO: 107183 - RNA, 64 nt, Homo Sapiens
uaauugcgaauaucagaaaaauugaguaguugucauuuaaaauaagaguuuaaaaguuuagcuu

SEQ ID NO: 107184 - RNA, 64 nt, Homo Sapiens
ccucaagaaaggauugguacuugcucaaccaugcauuuaaaacucacauccucauacaauuuaa

SEQ ID NO: 107185 - RNA, 64 nt, Homo Sapiens
caauaaaaauuucaaauguuaaacuggauuuuaaauuuaaaaauuucaaacaauuuugugguua

SEQ ID NO: 107186 - RNA, 64 nt, Homo Sapiens
uuuaauuuguccuuccuaagauuuuaaaaguuuaauuuaaaaaaguucuguuagauguuguuau

SEQ ID NO: 107187 - RNA, 64 nt, Homo Sapiens
aagaagcuagaaauuuagcaugacuccugagcauauuuaaaacaauuugcugcagaauuugggu

SEQ ID NO: 107188 - RNA, 64 nt, Homo Sapiens
augccauaacuauuaaacaccugauuuaauaugcauuuaaaaaaugggauacagucuaacucau

SEQ ID NO: 107189 - RNA, 64 nt, Homo Sapiens
aaaucuuguugcugauuuguuggauaauguacagauuuaaaaaccuucuauuguuugggccuug

SEQ ID NO: 107190 - RNA, 64 nt, Homo Sapiens
cuaagaugaaaaaagugcgcgaagagguauacuuauuuaaaaaacuaagaaggcaaagcagaaa

SEQ ID NO: 107191 - RNA, 64 nt, Homo Sapiens
auggaaaaacaacccagacgaaaguauuuuauacauuuaaaaaucaaaaacaaauuuuaaaauu

SEQ ID NO: 107192 - RNA, 64 nt, Homo Sapiens
acuucaacuuuguguuuuuacugaacaaaauauuauuuaaaauuacuucuucacugaaguuaua

SEQ ID NO: 107193 - RNA, 64 nt, Homo Sapiens
auauguaguucugugucaaauauguggauuaccaauuuaaaaauugaagguuuuguguauaucu

SEQ ID NO: 107194 - RNA, 64 nt, Homo Sapiens
aggauuauuggcuuguuuucuaaauuguuuuuuaauuuaaaaaaaaagcauuacucuuuuucaa

SEQ ID NO: 107195 - RNA, 64 nt, Homo Sapiens
ugcuauacuaagggaaagaaagugugguuuuguaauuuaaaaagagugagauagaauacaugua

SEQ ID NO: 107196 - RNA, 64 nt, Homo Sapiens
augccuuaaauuuuaucaauaacagaauuauuguauuuaaaaaaaaacuaauacuuaucuuuaa

SEQ ID NO: 107197 - RNA, 64 nt, Homo Sapiens
ugaucuuuuuguuucguuuuguuucuucuucugcauuuaaaaauuaaaagauugguuugaggau

SEQ ID NO: 107198 - RNA, 64 nt, Homo Sapiens
uuacguguuacauggagugaggguagaugugaagauuuaaaacgauugauggauuuaaggaagu

SEQ ID NO: 107199 - RNA, 64 nt, Homo Sapiens
accaaugcauguguuugaaauauccauuaagaugauuuaaaauuugucuuguauuuugaguuuc

SEQ ID NO: 107200 - RNA, 64 nt, Homo Sapiens
uuuagggagaucauguuuucuuaaucaugcuggaauuuaaaaauuguuuuacuuguaucgaaau

SEQ ID NO: 107201 - RNA, 64 nt, Homo Sapiens
aacuaauuacuaauuuuuaaagaacaaaucacacauuuaaaaaaucuguagaauuuauuuuaac

SEQ ID NO: 107202 - RNA, 64 nt, Homo Sapiens
uucauccaaaugacauuaucugcacguuuuuaaaauuuaaaaacaaaggacuauuuaaaaauac

SEQ ID NO: 107203 - RNA, 64 nt, Homo Sapiens
ucugcacguuuuuaaaauuuaaaaacaaaggacuauuuaaaaauacaguuuauuaacaaacgug

SEQ ID NO: 107204 - RNA, 64 nt, Homo Sapiens
acacaguauacucuagucaauuuauguuaacuuuauuuaaaacacaauuuauuuggccgggcac

SEQ ID NO: 107205 - RNA, 64 nt, Homo Sapiens
uacuuguggcuuuuauuaucuuuaaacuuguugcauuuaaaauauuuuuaaaaccuucuuaaca

SEQ ID NO: 107206 - RNA, 64 nt, Homo Sapiens
ccuucugguuauauugugcaguuucaaaagaacuauuuaaaacucuugaaaacucauguaaaua

SEQ ID NO: 107207 - RNA, 64 nt, Homo Sapiens
gggugaaaauuguauuuguuaaaauaccuuaauaauuuaaaaugaccugauuuccuggaaaauu

SEQ ID NO: 107208 - RNA, 64 nt, Homo Sapiens
ugcauuuuuauauauguguaaaauuuuuauugaaauuuaaaacuugaucaucaaguuaauuggu

SEQ ID NO: 107209 - RNA, 64 nt, Homo Sapiens
cuagggaacaggcuuacaacaacauaagugaccaauuuaaaauguugcccuuaccacucccaga

SEQ ID NO: 107210 - RNA, 64 nt, Homo Sapiens
uaguuuauuaucagauaucaaaaaauuauuaaacauuuaaaaauucuggcauuuuuaaacauuu

SEQ ID NO: 107211 - RNA, 64 nt, Homo Sapiens
uauuaaacauuuaaaaauuauggcauuuuuaaacauuuaaaaauuguuagaaauuaguuuuauc

SEQ ID NO: 107212 - RNA, 64 nt, Homo Sapiens
cuagaaagaugaacaaaggucugacuuuuuaauuauuuaaaacuuguuguuuucacucucugca

SEQ ID NO: 107213 - RNA, 64 nt, Homo Sapiens
guauggcaucagcguuucaugacccacuuaagauauuuaaaaagugguaacucuaauggggaua

SEQ ID NO: 107214 - RNA, 64 nt, Homo Sapiens
uccuaguaauuuauucuuucuuuguauuaucacuauuuaaaagaugauacuaauuaagauuacu

SEQ ID NO: 107215 - RNA, 64 nt, Homo Sapiens
ugguauaugcugaagucugcucaagcugauuuaaauuuaaaauuauuuguauaccccacugaau

SEQ ID NO: 107216 - RNA, 64 nt, Homo Sapiens
auuuucaguuucuucauuuuacauuauuuaaaauauuuaaaaaaaccuauauaaaucaaaguac

SEQ ID NO: 107217 - RNA, 64 nt, Homo Sapiens
uuuaaaaaaauuuucaguuuucaaaguacacauuauuuaaaauaaaagagaugaccuauauaaa

SEQ ID NO: 107218 - RNA, 64 nt, Homo Sapiens
uaucugauuuuuaaaguaaaaaaaauaaaauuuaauuuaaaaaguucaauucuuaugucgcuca

SEQ ID NO: 107219 - RNA, 64 nt, Homo Sapiens
acaguccugagagggauggaguauuauuuuaugcauuuaaaaacuuuuuauuuuaguccuauuu

SEQ ID NO: 107220 - RNA, 64 nt, Homo Sapiens
aaaaauaacacacuuguacaauucuuacuucuggauuuaaaaucuacuuauuccuaaacugaua

SEQ ID NO: 107221 - RNA, 64 nt, Homo Sapiens
cacaaucuuaaggggauagaguauuauuuugugcauuuaaaaaauuuuuauuucagcccuauuu

SEQ ID NO: 107222 - RNA, 64 nt, Homo Sapiens
ccuucagccuaaggcacaagaauaauguacuaauauuuaaaauauuaucacuuucucuuugcau

SEQ ID NO: 107223 - RNA, 64 nt, Homo Sapiens
uaacuuuuuuuuuuugccugcuuuaaacgguuucauuuaaaaaguauuuuuauucagcaguguu

SEQ ID NO: 107224 - RNA, 64 nt, Homo Sapiens
auggucuuuguuuuauaugacuguccaggaucugauuuaaaaauaauuaaaauuuuuguuuaaa

SEQ ID NO: 107225 - RNA, 64 nt, Homo Sapiens
uugguuuuaaaaauauuaagcuaguuucugagguauuuaaaaauuacuaccucuuuugauauaa

SEQ ID NO: 107226 - RNA, 64 nt, Homo Sapiens
uauauaacauacuauauauguauauaaaaguuauauuuaaaaaguucuuuugucuucuuuuuaa

SEQ ID NO: 107227 - RNA, 64 nt, Homo Sapiens
gaacagcucuuagcagcuguuugucuuuaccugcauuuaaaauguugcuauugaaagaucaauu

SEQ ID NO: 107228 - RNA, 64 nt, Homo Sapiens
aauauauacaguaaauauauaaaacaacauauauauuuaaaauaugauaauuauuacacaauuu

SEQ ID NO: 107229 - RNA, 64 nt, Homo Sapiens
acauauauauuuaaaauaaaauaauuauuacacaauuuaaaacagauggguugaagcuuuucug

SEQ ID NO: 107230 - RNA, 64 nt, Homo Sapiens
caguauagaaguguuuuaguauauuuuaaacaauauuuaaaaguuucuguuuuggucucuggug

SEQ ID NO: 107231 - RNA, 64 nt, Homo Sapiens
aaggccuuagacuaauuuucuauagcuuaagcugauuuaaaacaacauacauauauauauauca

SEQ ID NO: 107232 - RNA, 64 nt, Homo Sapiens
aaaagaaauuuauuuucuuccgacagacuggguaauuuaaaaagucugcuacuauaacagaaua

SEQ ID NO: 107233 - RNA, 64 nt, Homo Sapiens
auuugucuaacaguagaacuuauauaagugccauauuuaaaauauuaauaugaaauauuacaua

SEQ ID NO: 107234 - RNA, 64 nt, Homo Sapiens
aauaaauuuuuaaugaccuguaauucuaagugaaauuuaaaauacauguuaauuuucugaaaga

SEQ ID NO: 107235 - RNA, 64 nt, Homo Sapiens
aucuucuuccccaauaacaaaaaaaugauagccuauuuaaaauuucuacauuucuaauauuuac

SEQ ID NO: 107236 - RNA, 64 nt, Homo Sapiens
uuaagaguauuuugcauuagacgagaaauacaacauuuaaaaaaugaacuauuaauauuuaaaa

SEQ ID NO: 107237 - RNA, 64 nt, Homo Sapiens
gagaaauacaacauuuaaaaagugaacuauuaauauuuaaaaacauucaugaaaaacuuagaau

SEQ ID NO: 107238 - RNA, 64 nt, Homo Sapiens
cacaauucagugguuuuaacccauauaaucacacauuuaaaauacaugagauacaauucacaua

SEQ ID NO: 107239 - RNA, 64 nt, Homo Sapiens
aauaacaagagaucguguuauuuccucugugcaaauuuaaaacaaauuguuuagaauauuaagu

SEQ ID NO: 107240 - RNA, 64 nt, Homo Sapiens
auuuucuuauaguauaguuaaccaauaguuugagauuuaaaacuaagcaaauuuugcacaguaa

SEQ ID NO: 107241 - RNA, 64 nt, Homo Sapiens
uuuguugagauuuucaaacaaaaaaucaguugugauuuaaaacgugcauuuuggcagaaagaaa

SEQ ID NO: 107242 - RNA, 64 nt, Homo Sapiens
gucuauguucuucaacuaauguuauucauauuauauuuaaaaaggaaauaaagcuccuaguaaa

SEQ ID NO: 107243 - RNA, 64 nt, Homo Sapiens
ucaguuuacucuaguuaccaaaauccaaugcagaauuuaaaauuuaugcuuauaugucuucuau

SEQ ID NO: 107244 - RNA, 64 nt, Homo Sapiens
ucacaaaacuaaggguaaaauuaaaauuuuaaaaauuuaaaauuaaauuuaaauuuucagucau

SEQ ID NO: 107245 - RNA, 64 nt, Homo Sapiens
uuaaaaauuuaaaauuucacuuaaauuuucagucauuuaaaauuuuguuucagucauuuaaaau

SEQ ID NO: 107246 - RNA, 64 nt, Homo Sapiens
uaaauuuucagucauuuaaaauuuuguuucagucauuuaaaauuuuuugaauaauaauguuuaa

SEQ ID NO: 107247 - RNA, 64 nt, Homo Sapiens
aucauuugaaaguuuaauucguagaaacaaacuuauuuaaaaccuuaguuuaguaaguucagaa

SEQ ID NO: 107248 - RNA, 64 nt, Homo Sapiens
ugaguagcucauucuugugacuuacagugccaacauuuaaaaaaguaugaaaaugauuuauuuu

SEQ ID NO: 107249 - RNA, 64 nt, Homo Sapiens
uaauauauauuguauuuuuauuugauagcuugggauuuaaaacaucucuguugaaggcuuuuga

SEQ ID NO: 107250 - RNA, 64 nt, Homo Sapiens
acccagacugaacuuaccgugagcgacaaagaugauuuaaaagggaagucuagaguuccuaguc

SEQ ID NO: 107251 - RNA, 64 nt, Homo Sapiens
gucacaagguuuaaggugacccaaugauucagcuauuuaaaaaaaaaagaggaaagaaugaaag

SEQ ID NO: 107252 - RNA, 64 nt, Homo Sapiens
guguuuaauuauuuugccauguauuacuaauuguauuuaaaauuucuacuucccuuaggcauuu

SEQ ID NO: 107253 - RNA, 64 nt, Homo Sapiens
uaaaauuucuacuucccuuaggcauuuuauaaaaauuuaaaaauuauuuuucuauuuuguuuaa

SEQ ID NO: 107254 - RNA, 64 nt, Homo Sapiens
auuuuuuguuguuucuuaaauaagaaacuuuuuuauuuaaaaaacuaaaaacuagaggugagaa

SEQ ID NO: 107255 - RNA, 64 nt, Homo Sapiens
aacuuucuuucucacuaaaucuuuuauaggauuuauuuaaaauagcaaaagaagaaguuucauc

SEQ ID NO: 107256 - RNA, 64 nt, Homo Sapiens
ccaaucuaggcaauguagugagacccugucucuaauuuaaaaaagaaaaagaaaaaaacauucc

SEQ ID NO: 107257 - RNA, 64 nt, Homo Sapiens
aagacugucuuaccuuauguuaaggaagucagguauuuaaaauguuacauaugccggcgcagug

SEQ ID NO: 107258 - RNA, 64 nt, Homo Sapiens
cacaaaaauaacuaugaaaaugccaguaacguuuauuuaaaacaaaauauuuuaauuuuuaaau

SEQ ID NO: 107259 - RNA, 64 nt, Homo Sapiens
cccuauuugauacuugacagugcaaguuucuguaauuuaaaaagaugugguggccugacaccug

SEQ ID NO: 107260 - RNA, 64 nt, Homo Sapiens
ccucaccuuucgcuguuuguuguuucauagauuuauuuaaaaaaagagaaagucuauagcuaua

SEQ ID NO: 107261 - RNA, 64 nt, Homo Sapiens
uuaggcauuaauauaaaagagguaggagucuguuauuuaaaaaaagcauuaaauuuaaaaaaaa

SEQ ID NO: 107262 - RNA, 64 nt, Homo Sapiens
gagguaggagucuguuauuuaaaaaaagcauuaaauuuaaaaaaaaacugucuugucuacuuuu

SEQ ID NO: 107263 - RNA, 64 nt, Homo Sapiens
gcguuauguguugaacaguaugcuucagggguaaauuuaaaauagucucuugaagcccuaguca

SEQ ID NO: 107264 - RNA, 64 nt, Homo Sapiens
uguuuugaagaguugaaucuucuguuaaaaggugauuuaaaacuugaaugugaugaauuguggc

SEQ ID NO: 107265 - RNA, 64 nt, Homo Sapiens
uuugcaguguaauucuuuguuuuuaauugcagacauuuaaaaaugucauuuucuacuguuaaga

SEQ ID NO: 107266 - RNA, 64 nt, Homo Sapiens
gcaaacuuucuauugccugucccaugugcaucuuauuuaaaauuucccccauggaaaucacucu

SEQ ID NO: 107267 - RNA, 64 nt, Homo Sapiens
uggauauugaagcuauccaagcuuuugaaauaaaauuuaaaaacccccaagccugggugagugu

SEQ ID NO: 107268 - RNA, 64 nt, Homo Sapiens
ugaaaaaugcuaacacccaacacuaaauagcaugauuuaaaaaauggguuucaaauguuaagaa

SEQ ID NO: 107269 - RNA, 64 nt, Homo Sapiens
auuccacaagaagaaaaauuauauaagaaaggaaauuuaaaaacaaaccuaaggaagaauaaua

SEQ ID NO: 107270 - RNA, 64 nt, Homo Sapiens
acauagcugcaggucuuugguuaaagauauauaaauuuaaaaaaucaagaaaacuauaaaauac

SEQ ID NO: 107271 - RNA, 64 nt, Homo Sapiens
aacuauguucagaacuucauuauugagguauuauauuuaaaaaacuuacuuuuauuauuaaaug

SEQ ID NO: 107272 - RNA, 64 nt, Homo Sapiens
acacaaaauuauuuuuuuccgagguacucuaggaauuuaaaaaguaaauugugauugaagugga

SEQ ID NO: 107273 - RNA, 64 nt, Homo Sapiens
ucuaauuauauuuuuuucuuucaaaaaugcugugauuuaaaauaaacuccuuuucccuaggaag

SEQ ID NO: 107274 - RNA, 64 nt, Homo Sapiens
uuaauuuucuaaacauaguaauauauaaaccaugauuuaaaacugauuaaauguaucauuaucu

SEQ ID NO: 107275 - RNA, 64 nt, Homo Sapiens
uuuaaauuuuaaagaauuaauguaaaacaggacaauuuaaaaauuauauuacaaguauauuaca

SEQ ID NO: 107276 - RNA, 64 nt, Homo Sapiens
agguuuaccauguaauuuguuugaaagccuaugaauuuaaaaccaugauuuccgggaauuauua

SEQ ID NO: 107277 - RNA, 64 nt, Homo Sapiens
aauguuguuucuauccccauuuagaaaaauuuacauuuaaaaaaacaagaaaaaaggcccacaa

SEQ ID NO: 107278 - RNA, 64 nt, Homo Sapiens
auauuguaccaggaugugcuaguuugcuuuagucauuuaaaaaguguacaaugaauugauguuu

SEQ ID NO: 107279 - RNA, 64 nt, Homo Sapiens
caugaaugucauuagauccucaguguaaucaauaauuuaaaaaagccacacagagcugaauggg

SEQ ID NO: 107280 - RNA, 64 nt, Homo Sapiens
caaguaagcuacucuaaaucuuuaaguugcuacaauuuaaaaauuaaauuuaaaaagcuuucuc

SEQ ID NO: 107281 - RNA, 64 nt, Homo Sapiens
cuuucucuuuaaguugcuacauccuauuuauuaaauuuaaaaagaugaagaugaaauauuauuu

SEQ ID NO: 107282 - RNA, 64 nt, Homo Sapiens
aaaaaccucccuuuuuaauuuauuuuccuuucucauuuaaaagcugacaguaguaccaaaaagg

SEQ ID NO: 107283 - RNA, 64 nt, Homo Sapiens
gcacacacacacacacacacacaugcucccuccaauuuaaaagcgagucaauuuaacaauccug

SEQ ID NO: 107284 - RNA, 64 nt, Homo Sapiens
auauagcuugaaagcaguuauauguuuuaauugcauuuaaaaauugaaauuuacugugagacug

SEQ ID NO: 107285 - RNA, 64 nt, Homo Sapiens
gaaaagagagauuggauuuuuucagaacagaggcauuuaaaaugagggacaaagaaaucccccc

SEQ ID NO: 107286 - RNA, 64 nt, Homo Sapiens
uuuuuuaaaaaauaaggucuuaauguuucauuuaauuuaaaauauacugucauguuguguuuug

SEQ ID NO: 107287 - RNA, 64 nt, Homo Sapiens
cauuguacuuaauuucuaaauauauaaaauccacauuuaaaaauuauaaaagcaaggacuuggg

SEQ ID NO: 107288 - RNA, 64 nt, Homo Sapiens
cccauuuuugaagagggugaaguuuggagaacaaauuuaaaaaccaucagucaugugagcagau

SEQ ID NO: 107289 - RNA, 64 nt, Homo Sapiens
cuuuaucaaaaaacccuucaauagcauccuuaagauuuaaaaaaaaaaaaaaaaaaaaggaaaa

SEQ ID NO: 107290 - RNA, 64 nt, Homo Sapiens
uacauugagaaaccaagucaaucaagcaggaaucauuuaaaaaccagauaaagccauguuuuuc

SEQ ID NO: 107291 - RNA, 64 nt, Homo Sapiens
gaauaauuuaaccaagccccucuccacuucuuuuauuuaaaagcacugauucaauugcuaggaa

SEQ ID NO: 107292 - RNA, 64 nt, Homo Sapiens
uuaaagagacuucaaaauauugaguauuuuaaaaauuuaaaaguaggucaguuuauaacgagua

SEQ ID NO: 107293 - RNA, 64 nt, Homo Sapiens
uguuaguaugucauaaaauauaacauuacagcuuauuuaaaaccaaauauaguugaacauauuu

SEQ ID NO: 107294 - RNA, 64 nt, Homo Sapiens
uacagcuuauuuaaaaccaaauauaguugaacauauuuaaaauacauuuucacagaauggauga

SEQ ID NO: 107295 - RNA, 64 nt, Homo Sapiens
uucaacauuuuucaaaaucaggagauuuucguccauuuaaaaaauguauaggugcagauauuga

SEQ ID NO: 107296 - RNA, 64 nt, Homo Sapiens
acugcuuuaagaaauaacaauuacaauguguauuauuuaaaaaugggagaaauaguuuguucua

SEQ ID NO: 107297 - RNA, 64 nt, Homo Sapiens
aaaacugucaaaaucaguauauacuauuaguuauauuuaaaaauauuuuuuuaaauucuuuaca

SEQ ID NO: 107298 - RNA, 64 nt, Homo Sapiens
uauguuauugaaaagcauuauuaauguuuaauuuauuuaaaauuuuggaauuugccauuucuca

SEQ ID NO: 107299 - RNA, 64 nt, Homo Sapiens
uuugaaaacacuauauugauccauuugauccaucauuuaaaaaauaaauacaauuccuaaggca

SEQ ID NO: 107300 - RNA, 64 nt, Homo Sapiens
ggagaaagacacugaaauuuagaaaauuuugucgauuuaaaauauuucuccuaucuaccaagua

SEQ ID NO: 107301 - RNA, 64 nt, Homo Sapiens
uagugcugcauuuuuuuaaaguuggauugcugcuauuuaaaaaaaaaaaaaggacacagaucaa

SEQ ID NO: 107302 - RNA, 64 nt, Homo Sapiens
uauuuuaaagaaccacuugaaaucggaucauuuuauuuaaaaauaaaaaauguuaaugccaguu

SEQ ID NO: 107303 - RNA, 64 nt, Homo Sapiens
ucuggcugauguugguauuggguguaggaacaugauuuaaaaaaaaacucuugccucugcuuuc

SEQ ID NO: 107304 - RNA, 64 nt, Homo Sapiens
ccaauugaauuaaaguguggccucguuuuuagucauuuaaaauuguuuucuaaguaauugcugc

SEQ ID NO: 107305 - RNA, 64 nt, Homo Sapiens
cuuugacaugucuuggggaaaagcuuacauuuuaauuuaaaagaaagaucaauuauauccaugc

SEQ ID NO: 107306 - RNA, 64 nt, Homo Sapiens
uuaucaaaaacagcacaacccccucaaucugcccauuuaaaaauugguggagugaacaaagagc

SEQ ID NO: 107307 - RNA, 64 nt, Homo Sapiens
acuguucacacuuuauuaccuacuaucuuuaagcauuuaaaaauuuuugaagaugagcauauau

SEQ ID NO: 107308 - RNA, 64 nt, Homo Sapiens
acauuuuucucuccaacauauuggaaaguuaaccauuuaaaagaagacgcgucagauggcagau

SEQ ID NO: 107309 - RNA, 64 nt, Homo Sapiens
uucuuucuauguguauuuauuauuguuguaugacauuuaaaaauagaaauauuguuuuuuauau

SEQ ID NO: 107310 - RNA, 64 nt, Homo Sapiens
aauacagcaauaccaaaauaaauaugucauaaauauuuaaaaaucuuugauuaguucuuuauua

SEQ ID NO: 107311 - RNA, 64 nt, Homo Sapiens
uaaccaggcaugguggcucgcucuacaaagaaagauuuaaaaaugcuacauagagagaccccau

SEQ ID NO: 107312 - RNA, 64 nt, Homo Sapiens
uacaaagagauaaaucaccauuucugugaacagaauuuaaaacacuagaagauuuuggucuacu

SEQ ID NO: 107313 - RNA, 64 nt, Homo Sapiens
aauuguauuaauuauuuaaaauggcguauuuuguauuuaaaaguuggaagagaagagaaaggac

SEQ ID NO: 107314 - RNA, 64 nt, Homo Sapiens
caccucccaaucaccccaaagagcugagacccuuauuuaaaacuggagccuguuacccguuaga

SEQ ID NO: 107315 - RNA, 64 nt, Homo Sapiens
cagggcccaaagcuuauuagacacaugccuuaaaauuuaaaaaguguuguuaugguagagaaac

SEQ ID NO: 107316 - RNA, 64 nt, Homo Sapiens
acuguaauccaaacuuuuuuaauugugauucacaauuuaaaaacuuauaacaugauaggugcug

SEQ ID NO: 107317 - RNA, 64 nt, Homo Sapiens
uaacaaacuaaacuguuacaaugguuguuaaauaauuuaaaaguuaaaaauguauuaauaacuu

SEQ ID NO: 107318 - RNA, 64 nt, Homo Sapiens
uacaaaaaugaacccaaguccuaaaauguuuucuauuuaaaaauauuucuucuucaagagaugc

SEQ ID NO: 107319 - RNA, 64 nt, Homo Sapiens
uuauguuccaaguaccucuauauaaccauuuaaaauuuaaaaaacaaaaaauacuauuaaccua

SEQ ID NO: 107320 - RNA, 64 nt, Homo Sapiens
uaaaaaauuauguuccaaguuaaccuauauaaccauuuaaaauuugaaaagcaaaaaauacuau

SEQ ID NO: 107321 - RNA, 64 nt, Homo Sapiens
cacuggauugcuuuauuauauuauuucauaaguaauuuaaaaauuuuacaucuuauuuuugccu

SEQ ID NO: 107322 - RNA, 64 nt, Homo Sapiens
uaaucaguuacaguaaagacuuuugaaaacuaacauuuaaaaauaauaucucaaguagaaaagu

SEQ ID NO: 107323 - RNA, 64 nt, Homo Sapiens
aauuucuauucaaaauacaugcauucucucugacauuuaaaaauuuucaaguuggccaauaaua

SEQ ID NO: 107324 - RNA, 64 nt, Homo Sapiens
augaagacacugaaauacagaguccaguucucucauuuaaaaaauagguacuuauauaaaaucu

SEQ ID NO: 107325 - RNA, 64 nt, Homo Sapiens
auauauuaauagauguuuucucuggaaauauuugauuuaaaaacuaaagggacuuguaagcauu

SEQ ID NO: 107326 - RNA, 64 nt, Homo Sapiens
uuugaaaauaugcaguacuguauucuuuguguuuauuuaaaaguuuauaacauguauaccuaua

SEQ ID NO: 107327 - RNA, 64 nt, Homo Sapiens
aaauuuuguaauuaaaugccgccauugcuuuuuuauuuaaaagaaugauuuuguggugauucgu

SEQ ID NO: 107328 - RNA, 64 nt, Homo Sapiens
gacucucuuaagccuuaaaaaguuguacccaaguauuuaaaaauuggcaggacucauauuauuc

SEQ ID NO: 107329 - RNA, 64 nt, Homo Sapiens
cuauauuugaacauuggucuuuaauguagauuuuauuuaaaaaauaaacuuaauaaauuaucug

SEQ ID NO: 107330 - RNA, 64 nt, Homo Sapiens
ugauggaugagaaaagaaaguuuuauuugggauaauuuaaaaaagaauauugacuuuuucucuu

SEQ ID NO: 107331 - RNA, 64 nt, Homo Sapiens
aaaaauaucuguuucucugcgaaugcacuugauaauuuaaaaaucuuguuuuuuucugucuugu

SEQ ID NO: 107332 - RNA, 64 nt, Homo Sapiens
uaagcagcugacugggcacguugaaauucacuuuauuuaaaagaagaauaugaaguaucuguuu

SEQ ID NO: 107333 - RNA, 64 nt, Homo Sapiens
uauauuaagcuuuucuuuucuacaauugucccucauuuaaaagacaacaaggaagucugcucug

SEQ ID NO: 107334 - RNA, 64 nt, Homo Sapiens
ucuauaaaggugaauauuuuacauugcuuugacaauuuaaaacuuuauugagccaauuaaauug

SEQ ID NO: 107335 - RNA, 64 nt, Homo Sapiens
guuuuuguauuuucuuaaagguuugaaggaucuuauuuaaaauucugagaacaggaugacucgu

SEQ ID NO: 107336 - RNA, 64 nt, Homo Sapiens
accuuucuguacaggauuuuuggcaaauaaaagcauuuaaaaagucaaaaucacccaaaacuuu

SEQ ID NO: 107337 - RNA, 64 nt, Homo Sapiens
augaugggcuguuuuaagacuuuugugcaagcuaauuuaaaaacaaucuaggaaauuaguugua

SEQ ID NO: 107338 - RNA, 64 nt, Homo Sapiens
uacauguuuuaaaaaaccgaguugguuuuauugaauuuaaaaagauagguaacuaaguagcauu

SEQ ID NO: 107339 - RNA, 64 nt, Homo Sapiens
uuauugaauuuaaaaagauagguaacuaaguagcauuuaaaaucaagauagagcauuccuucuu

SEQ ID NO: 107340 - RNA, 64 nt, Homo Sapiens
uaaacauuuuguauucagacgccaaaguuaacugauuuaaaaguugauuuacuuuuuauuaagu

SEQ ID NO: 107341 - RNA, 64 nt, Homo Sapiens
guuaaucagcagugaaucaucuugcagcuaugcaauuuaaaaaaaauacagauuaccaauuuca

SEQ ID NO: 107342 - RNA, 64 nt, Homo Sapiens
acaaauuaaaaagacaaauuaaaccugaaauuauauuuaaaauauauuugagacaugaaauaca

SEQ ID NO: 107343 - RNA, 64 nt, Homo Sapiens
uguaaauauuucuuaugucuccucuauuaagaguauuuaaaaucauauuuaaauaugaaucuau

SEQ ID NO: 107344 - RNA, 64 nt, Homo Sapiens
ucuacauauaagguuuuuauuugaauuguaaaauauuuaaaaguaugaauaaaauauauuuaua

SEQ ID NO: 107345 - RNA, 64 nt, Homo Sapiens
caguuauuuaacaaauaaauaccucauugauuauauuuaaaaguaauacacuuccuguaaacaa

SEQ ID NO: 107346 - RNA, 64 nt, Homo Sapiens
uuuaaaagguuuuaaucauucuucuauaaaauacauuuaaaauggaaaaauacuuaauaucacu

SEQ ID NO: 107347 - RNA, 64 nt, Homo Sapiens
uuuguuguuaaauuauuuucuggcccuucuuaauauuuaaaaauguauuuccccuuguggcuuu

SEQ ID NO: 107348 - RNA, 64 nt, Homo Sapiens
ggccaggucucaguccgcgcuaaacaaugcaauaauuuaaaaucauaaagggccaguguauaaa

SEQ ID NO: 107349 - RNA, 64 nt, Homo Sapiens
uuuuaaaaaggaaaguauaaaaacaaaaguuguaauuuaaaagucugaauaaccaucugcugcu

SEQ ID NO: 107350 - RNA, 64 nt, Homo Sapiens
uuuguaaaauaucacugugagaacccuguguacaauuuaaaauaauauuguauuaacuuaauag

SEQ ID NO: 107351 - RNA, 64 nt, Homo Sapiens
cgaagaaaaagaaaugucuuguuuguguucuuaaauuuaaaacauauuaacuaaaguuguuuau

SEQ ID NO: 107352 - RNA, 64 nt, Homo Sapiens
gcauccuggaaauccuuuaaaguucugguggggaauuuaaaaauauauuugaaguccuagucug

SEQ ID NO: 107353 - RNA, 64 nt, Homo Sapiens
guuucuuuuacuuauugaaauuauaauucccuguauuuaaaaugccuuaacuaugccaaucuaa

SEQ ID NO: 107354 - RNA, 64 nt, Homo Sapiens
aagacuggcuugugguuaaaguugggcaguccugauuuaaaacuaaugacugacagaauauuuu

SEQ ID NO: 107355 - RNA, 64 nt, Homo Sapiens
aauuuccaaauauuugugggugggaacauuuuuaauuuaaaaaagcgagcucaaagcaauuaag

SEQ ID NO: 107356 - RNA, 64 nt, Homo Sapiens
uaauucagaagaacagugugagaacaaaucacucauuuaaaaagaauuuuaauaaaagugaacc

SEQ ID NO: 107357 - RNA, 64 nt, Homo Sapiens
ucuaccuacccuucuggaauauaagaguaauuauauuuaaaaaaagucucuauuucuuccuuuu

SEQ ID NO: 107358 - RNA, 64 nt, Homo Sapiens
uuauuaagggccuugagaugugcagaagugauuaauuuaaaauggccacauugcaaaagaauuu

SEQ ID NO: 107359 - RNA, 64 nt, Homo Sapiens
gugaauuaaauuuucacuagcuuugccaaaaccuauuuaaaacaaauccaauauguuuccauca

SEQ ID NO: 107360 - RNA, 64 nt, Homo Sapiens
ggacgcgaauaaguuugcucucucuugaaggaucauuuaaaaagcaaagauccagugcaguuuu

SEQ ID NO: 107361 - RNA, 64 nt, Homo Sapiens
cuucccucaauucuguaaauauguguauuuugacauuuaaaauauaugcuaaaucacauucagc

SEQ ID NO: 107362 - RNA, 64 nt, Homo Sapiens
uaauuguguuugaccccaaaggcggacugauaacauuuaaaaaauacaaaaguucuuauuacug

SEQ ID NO: 107363 - RNA, 64 nt, Homo Sapiens
aaaucaaaaagaaaaaacuacagaaaaauaaaugauuuaaaaucacugcugacguauuacaaaa

SEQ ID NO: 107364 - RNA, 64 nt, Homo Sapiens
uccaauuggauuauucuuaaaugugcauuuccucauuuaaaaaaaaaaguuuaaucuaaaugau

SEQ ID NO: 107365 - RNA, 64 nt, Homo Sapiens
uuaagauuccuuugacuugcauuuuauaucuuacauuuaaaauaauuaaaauauauaagcuuaa

SEQ ID NO: 107366 - RNA, 64 nt, Homo Sapiens
agaaucauagccauaagccugguaguaaaaggggauuuaaaaauaacacuuucaaacuccugcu

SEQ ID NO: 107367 - RNA, 64 nt, Homo Sapiens
caagaggaacauaugccugagaaccuuugcaugaauuuaaaauuucaauuauccauucuuauaa

SEQ ID NO: 107368 - RNA, 64 nt, Homo Sapiens
auuugagguuuucuacaauuugguauaacuaagaauuuaaaaauguuuuaucauauauauuugu

SEQ ID NO: 107369 - RNA, 64 nt, Homo Sapiens
auauaaaaaaacugacuguggcugaaagaauugcauuuaaaaauauuuaugugcaccuuguuac

SEQ ID NO: 107370 - RNA, 64 nt, Homo Sapiens
gugaaauccuuuguuauuuuucuaaaaaaauaaaauuuaaaaagaaagaaaacuaaggaagaac

SEQ ID NO: 107371 - RNA, 64 nt, Homo Sapiens
uuauauucuuguuuaauaagcuuauuuuuaaacaauuuaaaagcuauuauucuuagcauuaacc

SEQ ID NO: 107372 - RNA, 64 nt, Homo Sapiens
auuaaagugcaauauuguauauuuuuaagaacaaauuuaaaauagaauuuugauguuucucaga

SEQ ID NO: 107373 - RNA, 64 nt, Homo Sapiens
acaauaaguuuauaguuaacgaagauuuuuuucuauuuaaaaccccauuuuccuaaagaacaaa

SEQ ID NO: 107374 - RNA, 64 nt, Homo Sapiens
uuuccuaaagaacaaaguaguaaaauaaaaaaaaauuuaaaaaauuaaaaaauaaaaaaaagag

SEQ ID NO: 107375 - RNA, 64 nt, Homo Sapiens
uauauaaauauguaaauacaugcuuuaauuugcaauuuaaaaugaagggguuaaauaaguuaga

SEQ ID NO: 107376 - RNA, 64 nt, Homo Sapiens
gcaauuuaaaaugaagggguuaaauaaguuagacauuuaaaagaaaugauuguuaccauaaauu

SEQ ID NO: 107377 - RNA, 64 nt, Homo Sapiens
cauuuuuauuauccacgugauggcuaaguggauaauuuaaaagcuuaguaaugucuggucauuc

SEQ ID NO: 107378 - RNA, 64 nt, Homo Sapiens
aaaaaugaagaacaacuuuaucaaggaagcuaguauuuaaaaacaaauucaugagcaagcugca

SEQ ID NO: 107379 - RNA, 64 nt, Homo Sapiens
aacaguuguggaauucuuacuucauuaugaauguauuuaaaaaacaaacaccaaauaauuggaa

SEQ ID NO: 107380 - RNA, 64 nt, Homo Sapiens
acuguuaauguaaaaaauaaauuagagaacugugauuuaaaaguuauuuaaaaauauagaauau

SEQ ID NO: 107381 - RNA, 64 nt, Homo Sapiens
auagaauauauuagagaacuauuguguucaucauauuuaaaaauuauauaaaugaaaacauuua

SEQ ID NO: 107382 - RNA, 64 nt, Homo Sapiens
gcuaaaccuuguaucucacuuguuucuccucauuauuuaaaaauuuucucugagaucuauaguc

SEQ ID NO: 107383 - RNA, 64 nt, Homo Sapiens
cucaguaaucguuuuagcuucguuccauuauuuuauuuaaaaacacacauuuguccuuguguca

SEQ ID NO: 107384 - RNA, 64 nt, Homo Sapiens
aaaaaaagugguuuuaggaugaaacuccaucucaauuuaaaaagaccagccucaucaacacagu

SEQ ID NO: 107385 - RNA, 64 nt, Homo Sapiens
aaucucuuaccaaccuacauauauauuuuauuuaauuuaaaagaaauauuuuaacaaguuuguu

SEQ ID NO: 107386 - RNA, 64 nt, Homo Sapiens
caguuuuaaaaaaugagcuauagaaacgguguuuauuuaaaaauaugaacugucuguucuuagg

SEQ ID NO: 107387 - RNA, 64 nt, Homo Sapiens
uuuaaacaaucauuuacuauauguuuaugucuggauuuaaaaaugauguuaauaaugaagccau

SEQ ID NO: 107388 - RNA, 64 nt, Homo Sapiens
uauuuaugcuuuauagagaacacagauauaagguauuuaaaaucuguaauuugacauucugggu

SEQ ID NO: 107389 - RNA, 64 nt, Homo Sapiens
gggaguaccaggauuuauuauguauucacugcuaauuuaaaaaaagacauuggccuuaguaggc

SEQ ID NO: 107390 - RNA, 64 nt, Homo Sapiens
uuugggaguaguauaauuuggaauauaauacauuauuuaaaauaaaaaaugagugcagauuacu

SEQ ID NO: 107391 - RNA, 64 nt, Homo Sapiens
uguuauaacuucuuccuaaauucagaauugagauauuuaaaacuuuuuuaaaagccuauuguuu

SEQ ID NO: 107392 - RNA, 64 nt, Homo Sapiens
cauaaucaggcuaacaacacauaggagcacagacauuuaaaauuaagaugaaauauccuaaaau

SEQ ID NO: 107393 - RNA, 64 nt, Homo Sapiens
uaaucauuuugcauuuuacaguagcaguuugcauauuuaaaaaugaauugauuauugagaaaau

SEQ ID NO: 107394 - RNA, 64 nt, Homo Sapiens
gauaauaucuguaaugacauuacaaaaacuuaacauuuaaaacuaagauauuuauauauugcca

SEQ ID NO: 107395 - RNA, 64 nt, Homo Sapiens
augugaaauguuuuaaauuuguguauacccaauaauuuaaaauucuuuugaaacucagacuuca

SEQ ID NO: 107396 - RNA, 64 nt, Homo Sapiens
augguguaagucuuugacaaugccugacaguuuaauuuaaaacuggaaaaccugucugagaaaa

SEQ ID NO: 107397 - RNA, 64 nt, Homo Sapiens
gcuuuuaaauaaacauauuccuacuuuuuuuaauauuuaaaauuaguacuguauguguuaauuu

SEQ ID NO: 107398 - RNA, 64 nt, Homo Sapiens
caacccuucacacaguuuccauuauucaagaugaauuuaaaagucaaauuuaaacuuuuaaaag

SEQ ID NO: 107399 - RNA, 64 nt, Homo Sapiens
gauuguguuugaaaauuauauacugagcauacuaauuuaaaaagagaacuuguugaaauuuaaa

SEQ ID NO: 107400 - RNA, 64 nt, Homo Sapiens
ugagcauacuaauuuaaaaagagaacuuguugaaauuuaaaacguguuucuagguugaccuugu

SEQ ID NO: 107401 - RNA, 64 nt, Homo Sapiens
uuuucuuuagucacagaaguugaaucugguuauuauuuaaaaacuagaagcccccaaaccagca

SEQ ID NO: 107402 - RNA, 64 nt, Homo Sapiens
uuucaauggccuugcugugugguguuucaagugcauuuaaaaugugugacacagaaacggcaca

SEQ ID NO: 107403 - RNA, 64 nt, Homo Sapiens
cucuuucuggggaauccaauuauaguugcuuuguauuuaaaaacaagaacagccaaggguuguu

SEQ ID NO: 107404 - RNA, 64 nt, Homo Sapiens
uuaaaaaauaguaugaaugugaauacuagaaaagauuuaaaaaauaguaugagugugaguacua

SEQ ID NO: 107405 - RNA, 64 nt, Homo Sapiens
gaaacuuuacauuuguugacuuuuuuucauucucauuuaaaauauauugugcuaugauaaccaa

SEQ ID NO: 107406 - RNA, 64 nt, Homo Sapiens
gauuauacuauauaauauucucaauuacauuugaauuuaaaaauauugagcucuugauuacaau

SEQ ID NO: 107407 - RNA, 64 nt, Homo Sapiens
cuaauguaauuuaacaaauugcugcauguauuccauuuaaaaauauguuuaaauuguccuaaaa

SEQ ID NO: 107408 - RNA, 64 nt, Homo Sapiens
aguaagacccuaucucuaccccccuaauaaauuaauuuaaaaagccccccaaucugugguauuu

SEQ ID NO: 107409 - RNA, 64 nt, Homo Sapiens
uucaucgaucuuucaagaugccuuuucuucugauauuuaaaaaauggggggaaaauuuuauuuc

SEQ ID NO: 107410 - RNA, 64 nt, Homo Sapiens
uggaaucuaaaggaugguugucgucugagcagccauuuaaaaaugagaaagaacucuauuggug

SEQ ID NO: 107411 - RNA, 64 nt, Homo Sapiens
accuuuccuuuuaaaugugccuuuuucaaauccaauuuaaaauauuauaguauagguaaauuuu

SEQ ID NO: 107412 - RNA, 64 nt, Homo Sapiens
uucacuuuuaaacaguaaccaauuucagauguuuauuuaaaauuacagauucuaauuuauggua

SEQ ID NO: 107413 - RNA, 64 nt, Homo Sapiens
uauauaaauacuaccuuguaacuguagcucagucauuuaaaaaacugaacuagaugacuguugu

SEQ ID NO: 107414 - RNA, 64 nt, Homo Sapiens
cuggaaguaauauaaaagggcaaauaaauauuuuauuuaaaauuacauuguaguuacacaaaca

SEQ ID NO: 107415 - RNA, 64 nt, Homo Sapiens
ugaagugcaaaaaaaauuuuuggcacauuuaaaaauuuaaaaauuuuguaauugauauuaaaag

SEQ ID NO: 107416 - RNA, 64 nt, Homo Sapiens
uuaaaaauugaagugcaaaaauuaaaaguggcacauuuaaaaaugaaaguaguuuguaauugau

SEQ ID NO: 107417 - RNA, 64 nt, Homo Sapiens
uugaaugaauuauaccuaaaggcauauggauggcauuuaaaacucuguguuugucuaaaaaugu

SEQ ID NO: 107418 - RNA, 64 nt, Homo Sapiens
aaaaaucagaggccuaucucaaaaaccugcuaggauuuaaaaauauaguagccucuuaaaaaaa

SEQ ID NO: 107419 - RNA, 64 nt, Homo Sapiens
aaauuggaagaauaaccagggggaaucucccaaaauuuaaaaaccuuccagguggaggagaaag

SEQ ID NO: 107420 - RNA, 64 nt, Homo Sapiens
uaacucauuaguaucauaaaacugggggugggguauuuaaaaauguaagagcagagcaccuccc

SEQ ID NO: 107421 - RNA, 64 nt, Homo Sapiens
ggcccaucccagauguuugugauguccugaaacaauuuaaaaggagacccacagagcuaauguu

SEQ ID NO: 107422 - RNA, 64 nt, Homo Sapiens
uuuaaaaggagacccacagagcuaauguuuauccauuuaaaagguauaaaucaaaauaacaaau

SEQ ID NO: 107423 - RNA, 64 nt, Homo Sapiens
gcucuguuuuugguuuacaguguaauaauaccucauuuaaaaaauaaaaaccacuacuguuaca

SEQ ID NO: 107424 - RNA, 64 nt, Homo Sapiens
aaaaaauaaaaaccacuacuguuacauuuuauuaauuuaaaaagcuagaaaauucauguaguua

SEQ ID NO: 107425 - RNA, 64 nt, Homo Sapiens
uuauuacagacauugguguacuugaagguuuuauauuuaaaaguauuuuugaaaugcaaugugu

SEQ ID NO: 107426 - RNA, 64 nt, Homo Sapiens
gcaugagaugagaaagaaggacaaacucuuaagaauuuaaaaaguguuuugagaaugauuucua

SEQ ID NO: 107427 - RNA, 64 nt, Homo Sapiens
ccugcauuuccagcuaaucucuucugcucuaaauauuuaaaaacaguucuucucaaacauuuuc

SEQ ID NO: 107428 - RNA, 64 nt, Homo Sapiens
gguguuuuccugcuuuguagucucuaacucugaaauuuaaaauauguaaacuaaagugguuuua

SEQ ID NO: 107429 - RNA, 64 nt, Homo Sapiens
gugcuuuguuucauuaaauaauagggaaauauccauuuaaaacagguauaucaguggaaacaca

SEQ ID NO: 107430 - RNA, 64 nt, Homo Sapiens
gguaagaaaacuauuuugaauaaauaaacuauuuauuuaaaaugucuuuguauuuuuccaauuu

SEQ ID NO: 107431 - RNA, 64 nt, Homo Sapiens
ccuauuguaagauagaauaaacuuuagauuugggauuuaaaaugguugagcuauauaaacauua

SEQ ID NO: 107432 - RNA, 64 nt, Homo Sapiens
aaaugacaugccugaacaacuuuuuaaaagcaucauuuaaaaaauguauaaaaccaaagugcua

SEQ ID NO: 107433 - RNA, 64 nt, Homo Sapiens
uuuucugaaaaaacuuuugcgguuuauuaauuacauuuaaaaagcuagaaugacagauucaggu

SEQ ID NO: 107434 - RNA, 64 nt, Homo Sapiens
aauacuguuuguuuaaagcauguuagauucucucauuuaaaaaaggugcuggucagacuuuuuu

SEQ ID NO: 107435 - RNA, 64 nt, Homo Sapiens
uucauacaucaaaucuaugaguauuuuagugugaauuuaaaaauuaauucauuuuaaucguaau

SEQ ID NO: 107436 - RNA, 64 nt, Homo Sapiens
cuuuagguuaaguuuaagcuuaguuuauauuuucauuuaaaaucuuucucauguuuguucauuc

SEQ ID NO: 107437 - RNA, 64 nt, Homo Sapiens
aaguauuccuugaaaauauaucuuaaauguuuuuauuuaaaauaauuguauggucaguaggcaa

SEQ ID NO: 107438 - RNA, 64 nt, Homo Sapiens
gcaucuugggagagaaauuuagaagagaguuaaaauuuaaaaauagauuuuuaacaugucagag

SEQ ID NO: 107439 - RNA, 64 nt, Homo Sapiens
cugagcaaggaccaccacccuuuuaccuagaaccauuuaaaagcugaaacaggacugaagcccu

SEQ ID NO: 107440 - RNA, 64 nt, Homo Sapiens
aagaugagagauucaaaaauuucauuuaauacuuauuuaaaaagagcugaucaacaccuuaaaa

SEQ ID NO: 107441 - RNA, 64 nt, Homo Sapiens
uguuaaauaugaaccauauugagacugucuaguaauuuaaaaugauuaaaauuucuuuugggga

SEQ ID NO: 107442 - RNA, 64 nt, Homo Sapiens
gucucauuuugguaaaauuuaaaagguguaauuuauuuaaaauucuguacaauuaaacauuuuc

SEQ ID NO: 107443 - RNA, 64 nt, Homo Sapiens
auguauuuauuuuugguaaaugugaaaaugccagauuuaaaaugauuauaguguauaugauguu

SEQ ID NO: 107444 - RNA, 64 nt, Homo Sapiens
agagugacugucagguaaagcuauuuaaaauaaaauuuaaaaguagaaaaaaaguaauuuauga

SEQ ID NO: 107445 - RNA, 64 nt, Homo Sapiens
aaauuuaaaaguagagugacaguaauuuaugacuauuuaaaauaauauuuauuaagagaaaaaa

SEQ ID NO: 107446 - RNA, 64 nt, Homo Sapiens
guuucaugaauggaaaccuaaaauguugccuuguauuuaaaagguuguaauuuuccagcuguga

SEQ ID NO: 107447 - RNA, 64 nt, Homo Sapiens
agaucuauuaauacauucaugagacaaguauuauauuuaaaacuaaauuuuuaucuuuaaaucu

SEQ ID NO: 107448 - RNA, 64 nt, Homo Sapiens
augguucaaguacugcucuucauaaauagaacucauuuaaaaguuguauuggggauauguuuua

SEQ ID NO: 107449 - RNA, 64 nt, Homo Sapiens
aaaauucauguccauauggacuaugucuuucugaauuuaaaaugcuauaaaacacugagaguau

SEQ ID NO: 107450 - RNA, 64 nt, Homo Sapiens
uuuucugugacuucaaauugcuucagaauuagccauuuaaaauaaaaauggauucuugucuccu

SEQ ID NO: 107451 - RNA, 64 nt, Homo Sapiens
acuuguuuauucaaugucuaaaaauucuuuuaauauuuaaaauaacaguuaagacuugaaauug

SEQ ID NO: 107452 - RNA, 64 nt, Homo Sapiens
cccaggggaaaaugaagguuaggauuuaacagucauuuaaaaaaaaaauuuguuuugacggaug

SEQ ID NO: 107453 - RNA, 64 nt, Homo Sapiens
aaaaaauuuguuuugacggaugauuggauuauucauuuaaaaugauuagaaggcaaguuucuag

SEQ ID NO: 107454 - RNA, 64 nt, Homo Sapiens
gaagacuuggggcaugggacagcucagacuuuguauuuaaaaguuaaaaaggacaaaaaaaaaa

SEQ ID NO: 107455 - RNA, 64 nt, Homo Sapiens
aaaaguuaaaaaggacaaaaaaaaaaucuaaagcauuuaaaaucuagugaaauaacugaagggc

SEQ ID NO: 107456 - RNA, 64 nt, Homo Sapiens
guacucaagaaaauugaacaaauguaauggaucaauuuaaaauauuuuauuucuuaaaagccuu

SEQ ID NO: 107457 - RNA, 64 nt, Homo Sapiens
aguaacccauucuucacccuccauuuguauggcaauuuaaaagucuuuggcuuugcucugaauu

SEQ ID NO: 107458 - RNA, 64 nt, Homo Sapiens
auacuacuguuaguauuauuuaacuauuuuguagauuuaaaagauuucugguuaagggaggugg

SEQ ID NO: 107459 - RNA, 64 nt, Homo Sapiens
cuauuacauuuuacugauuaacaaauaaauuggaauuuaaaaauaucgauaucaccaugauuua

SEQ ID NO: 107460 - RNA, 64 nt, Homo Sapiens
ugggauuauguagcuaaacauugugaugauuauuauuuaaaaccauuauuuaauaagaguaaaa

SEQ ID NO: 107461 - RNA, 64 nt, Homo Sapiens
uuuaauaagaguaaaaauaugugaaucuggauauauuuaaaaaaagaaauuugaugcccagaua

SEQ ID NO: 107462 - RNA, 64 nt, Homo Sapiens
cuugugcugucguuuuguuuguuuuucuaugauaauuuaaaauacauagguagggcuacugagg

SEQ ID NO: 107463 - RNA, 64 nt, Homo Sapiens
cauuauacuuacuuccugcauuuagagggaguuuauuuaaaagaaauaaaugacaaucaaacca

SEQ ID NO: 107464 - RNA, 64 nt, Homo Sapiens
gaauucacauuaaguuccccuugcacacuuaccuauuuaaaaaacuaaacuugcacugcaacug

SEQ ID NO: 107465 - RNA, 64 nt, Homo Sapiens
cuuuaaccaaagaauuauuuuaaaguaaccuuauauuuaaaagaugauuuugcaaaaaauaaaa

SEQ ID NO: 107466 - RNA, 64 nt, Homo Sapiens
uccuacuuuugccacaaggucccuaacuucuguaauuuaaaagcucuccuuucuggguaacaag

SEQ ID NO: 107467 - RNA, 64 nt, Homo Sapiens
guagaauaaccuuucagaauacagauauguuuuuauuuaaaagaagaaguaccuaauaguuuga

SEQ ID NO: 107468 - RNA, 64 nt, Homo Sapiens
aucccccagcacuucccacacuuuuuuucucugcauuuaaaaaacuugagauauggaaggaugc

SEQ ID NO: 107469 - RNA, 64 nt, Homo Sapiens
auauuuauaaggaaauuuuaucaaugagagcauaauuuaaaaaucaaaugggacacauggucug

SEQ ID NO: 107470 - RNA, 64 nt, Homo Sapiens
ugucaacuuuugaccaaaaagggugggagagggaauuuaaaaggaguaacuuuuuuccagggag

SEQ ID NO: 107471 - RNA, 64 nt, Homo Sapiens
acaaucccaaguaaaaauuucuguaaauacauguauuuaaaaaagcaacugcaguucauccgca

SEQ ID NO: 107472 - RNA, 64 nt, Homo Sapiens
ggcaccauacaauugcuuugucuuaaauaaaacuauuuaaaauuuguaaguggaaaaugcaaug

SEQ ID NO: 107473 - RNA, 64 nt, Homo Sapiens
uuugaaggaccuaaauucgugcauuguuccacacauuuaaaacagccaaccaaguguagaugua

SEQ ID NO: 107474 - RNA, 64 nt, Homo Sapiens
acacuugggagaacagaaauaagaauuaaugaaaauuuaaaagauuaaaugaaugagaagaaau

SEQ ID NO: 107475 - RNA, 64 nt, Homo Sapiens
cuaacaguaauaacuauaaaucucacuuuaaauaauuuaaaacaaauuaaagugauauaugagu

SEQ ID NO: 107476 - RNA, 64 nt, Homo Sapiens
uauaugaagacaauuucuguaaugguuuuaagagauuuaaaaagaaauucacugguucuuuaca

SEQ ID NO: 107477 - RNA, 64 nt, Homo Sapiens
uuaaacaccugcauauuuuuauguaaaucucuaaauuuaaaauauuuuaaguacauuuauuuuu

SEQ ID NO: 107478 - RNA, 64 nt, Homo Sapiens
uguaguuuauuuauuugguucuuuagauggaggaauuuaaaaaaucaaauuuuucucuucaccu

SEQ ID NO: 107479 - RNA, 64 nt, Homo Sapiens
ucugaguaauuuuaauuuugccaaauacacugacauuuaaaauagugauccaucuaaauuuuuu

SEQ ID NO: 107480 - RNA, 64 nt, Homo Sapiens
gaacaaaaagaauguugcuggaacguaaaauaguauuuaaaaguuaaugaacacuucucuaguu

SEQ ID NO: 107481 - RNA, 64 nt, Homo Sapiens
gguuuggguagacuuuuuuuuuauaucaaguauaauuuaaaacaucagauuaaauaauuacacu

SEQ ID NO: 107482 - RNA, 64 nt, Homo Sapiens
uuaacauuaauuuuauuuuuucagacauacuguaauuuaaaaauuaaugugagcguuuguuuua

SEQ ID NO: 107483 - RNA, 64 nt, Homo Sapiens
aaguuuuuugugugugugaaacacuucaaaacugauuuaaaagauguaaauuuaaaauugguug

SEQ ID NO: 107484 - RNA, 64 nt, Homo Sapiens
gugaaacacuucaaaacugauuuaaaagauguaaauuuaaaauugguuguaucuaauaugcccc

SEQ ID NO: 107485 - RNA, 64 nt, Homo Sapiens
aaaugguauuagauacuuauuuccuuuaaacuuuauuuaaaacaaacaacagaguuaaucuguc

SEQ ID NO: 107486 - RNA, 64 nt, Homo Sapiens
uggguaaucaaaacauucacauuuauucugcuggauuuaaaaauauguacuuuuuuuuuuuuuu

SEQ ID NO: 107487 - RNA, 64 nt, Homo Sapiens
aaaaugccacaaauuucauuaaguaagacuaauuauuuaaaauaagagcuaauuuaaaaaagca

SEQ ID NO: 107488 - RNA, 64 nt, Homo Sapiens
gcaaaguaagacuaauuauuugcaugaagagcuaauuuaaaaaagaacugaauucuacaugugc

SEQ ID NO: 107489 - RNA, 64 nt, Homo Sapiens
gaagagaaacuucagccuuugacaaagugaaaacauuuaaaaaguaaaaugauaguggauaaua

SEQ ID NO: 107490 - RNA, 64 nt, Homo Sapiens
ugaauauaauuugaggcacaauauauauauguauauuuaaaaagaaaaauuugaauauacauau

SEQ ID NO: 107491 - RNA, 64 nt, Homo Sapiens
guaauagggaaaauauuuaauggagauaguaaaaauuuaaaaauucaaauguuuuauacauuuu

SEQ ID NO: 107492 - RNA, 64 nt, Homo Sapiens
uaaauaaggaauacauuuucaauucagaucucuuauuuaaaauuuuucaugaaaucuugguaca

SEQ ID NO: 107493 - RNA, 64 nt, Homo Sapiens
gaauauuaauauaaugaaauauaaugucauugguauuuaaaaauuuaucaauaaauuccauaaa

SEQ ID NO: 107494 - RNA, 64 nt, Homo Sapiens
guauucauuucccuggccccggagguucuauuucauuuaaaaaugugguugugggggggguguu

SEQ ID NO: 107495 - RNA, 64 nt, Homo Sapiens
aaaaguuguuacgguuucauuuccaauuuacuggauuuaaaacagcuguccugaugaugaguca

SEQ ID NO: 107496 - RNA, 64 nt, Homo Sapiens
uauauucuucaaaaaugcauuaggcauuauguauauuuaaaaaauaauuucaguuuggagcuuu

SEQ ID NO: 107497 - RNA, 64 nt, Homo Sapiens
ugugacaguguuugucauaucaugucaguuugcuauuuaaaauggaaagcuuuauguaguuaug

SEQ ID NO: 107498 - RNA, 64 nt, Homo Sapiens
aaaugaaaauaagccagguauuuaaugaauugugauuuaaaacauuugcaucaucaucuuccua

SEQ ID NO: 107499 - RNA, 64 nt, Homo Sapiens
auacacacauguauguacacgauacaaaagugauauuuaaaaauguaugcuaaaaagucagagu

SEQ ID NO: 107500 - RNA, 64 nt, Homo Sapiens
uaaagaaaguugcauccagaugcagucucuguguauuuaaaaaguuuauuuugcacaaacuauu

SEQ ID NO: 107501 - RNA, 64 nt, Homo Sapiens
guuuaacauguaccauguacacugucaggcuuuuauuuaaaauuuuguacuguauauuugagua

SEQ ID NO: 107502 - RNA, 64 nt, Homo Sapiens
augcaguugcucuagugaauacuuugcucucaacauuuaaaauauccgaaguuaggaccuaguu

SEQ ID NO: 107503 - RNA, 64 nt, Homo Sapiens
ucuacuucaguaucaugaguacuuuuauuuuuuaauuuaaaaaauuccuccauuuuaaaugacu

SEQ ID NO: 107504 - RNA, 64 nt, Homo Sapiens
guuacaguagccaauugaaaauguauaucccaaaauuuaaaaaaaaaaguaccagcagcaauaa

SEQ ID NO: 107505 - RNA, 64 nt, Homo Sapiens
gcacuaguuuuaucugguacauacaaaaacagccauuuaaaaucugaugauucuguggaauugg

SEQ ID NO: 107506 - RNA, 64 nt, Homo Sapiens
agcaaauauaaugcuaguccuagauuacuuauugauuuaaaaacaaaaaaaagauuacuuaauu

SEQ ID NO: 107507 - RNA, 64 nt, Homo Sapiens
gauuuaaaaacaaaaaaaagauuacuuaauuuugauuuaaaaacaaaaaaucguaaaauacaaa

SEQ ID NO: 107508 - RNA, 64 nt, Homo Sapiens
acacguuugauacuuuguacaucagaugcaucuuauuuaaaagggauacuuuuguaaaaguaaa

SEQ ID NO: 107509 - RNA, 64 nt, Homo Sapiens
uuuucucagaauuuacacucacucgcagucauuuauuuaaaaagauaaaacaagauaauggguu

SEQ ID NO: 107510 - RNA, 64 nt, Homo Sapiens
uucagugaacugguacaauguggucccucucaauauuuaaaaauauaauuuguaacagugcuua

SEQ ID NO: 107511 - RNA, 64 nt, Homo Sapiens
ccaaaaacacaacagucauuaucugugaaccauaauuuaaaaaucuuucuagaauaacaacagc

SEQ ID NO: 107512 - RNA, 64 nt, Homo Sapiens
uuuacuguuuucuuuuuagaaacccacuguuaaaauuuaaaaaggugcuuuaaaauaaaacgcc

SEQ ID NO: 107513 - RNA, 64 nt, Homo Sapiens
cauccauacucaggguguagggagaauacuuugcauuuaaaaacccuguccaccugucaccagc

SEQ ID NO: 107514 - RNA, 64 nt, Homo Sapiens
uauacaagauugaaaaucuuguguaaauccugccauuuaaaaaguuguagcagauuguuuccuc

SEQ ID NO: 107515 - RNA, 64 nt, Homo Sapiens
cuuuauugcuuuuuuguauugguuaaaacuguacauuuaaaauugcuauguuacuauuuucuac

SEQ ID NO: 107516 - RNA, 64 nt, Homo Sapiens
gagcacacuauucucauugccaacguuaaaccuuauuuaaaagccaaacgugcccugagcccuc

SEQ ID NO: 107517 - RNA, 64 nt, Homo Sapiens
aaaaggcauuggcauuuucuugucucuucuguugauuuaaaaaugaucccuccuggugauaacc

SEQ ID NO: 107518 - RNA, 64 nt, Homo Sapiens
guguuuauugguacauugcaguuuuuuuuuugaaauuuaaaaauuucuguaaaacuuugucuuc

SEQ ID NO: 107519 - RNA, 64 nt, Homo Sapiens
ugucuucaaguaaucugacagcauuaaauauugcauuuaaaaauuauacuguagcaaauacauu

SEQ ID NO: 107520 - RNA, 64 nt, Homo Sapiens
auauugcauuuaaaaauuauacuguagcaaauacauuuaaaaauuaaucacaacguuaagauga

SEQ ID NO: 107521 - RNA, 64 nt, Homo Sapiens
cagaaaaaagcaaauauaaauuuuuaaugacuccauuuaaaaauaucacagggugggggcaagg

SEQ ID NO: 107522 - RNA, 64 nt, Homo Sapiens
aaauggaauggcaaauaaugauguacccauaaaaauuuaaaaagcauaaauauauacaccuacc

SEQ ID NO: 107523 - RNA, 64 nt, Homo Sapiens
aaaagaguguaauugggacgcaauaacuuuauacauuuaaaaauaacagggugacuacagucaa

SEQ ID NO: 107524 - RNA, 64 nt, Homo Sapiens
aauaaaaauagauuauuacggaauggucucuuugauuuaaaauauaccuguuuguuaggaaaug

SEQ ID NO: 107525 - RNA, 64 nt, Homo Sapiens
aaaagaauaaguauucuugcauggcaugucuucuauuuaaaaggaauuaacuuucauaaauuuu

SEQ ID NO: 107526 - RNA, 64 nt, Homo Sapiens
gcuauuuuguuuguauuugaucauuuuguaaaaaauuuaaaaguuaccacauuuauuucuauau

SEQ ID NO: 107527 - RNA, 64 nt, Homo Sapiens
caguauuaucacuuuauaaaucuuuuuaauauacauuuaaaauaggugcauuucuccucuguuu

SEQ ID NO: 107528 - RNA, 64 nt, Homo Sapiens
aagguuugcuaaucugauagaaaaaaaacaaaaaauuuaaaaaauuuaaaaguaaaaaaaacaa

SEQ ID NO: 107529 - RNA, 64 nt, Homo Sapiens
aaaaaaaacaaaaaaaaaacacgguucaccaucaauuuaaaaguguggaaguuaucuuaaugcc

SEQ ID NO: 107530 - RNA, 64 nt, Homo Sapiens
ugaauucauuuucuuagaugccuuacuauaaaucauuuaaaaacggaauuguuuuccuguuuuu

SEQ ID NO: 107531 - RNA, 64 nt, Homo Sapiens
uuuucccuuucaauguuguucuugaagaugugagauuuaaaaauauaugcuguagaaaauauuc

SEQ ID NO: 107532 - RNA, 64 nt, Homo Sapiens
uaucauauaguaaaugcaaauugaguauaugcacauuuaaaaaauggaaguuuguaccaucugu

SEQ ID NO: 107533 - RNA, 64 nt, Homo Sapiens
uaauacuuuuaaaaagaaaacaugugccagcugaauuuaaaauacagcauguaacagacuggca

SEQ ID NO: 107534 - RNA, 64 nt, Homo Sapiens
uuaaaauccuuuaaaacaacgcuuaaauuacucaauuuaaaauuaaacagaacuuuuaaaugaa

SEQ ID NO: 107535 - RNA, 64 nt, Homo Sapiens
acauaguaaucuuuuccaguuaugucugauuaagauuuaaaacugaagguuucauuuugggagu

SEQ ID NO: 107536 - RNA, 64 nt, Homo Sapiens
acuuucaaaaccuauuuuaaguacagcaaaauuuauuuaaaacugucauagcaguaaaaaguau

SEQ ID NO: 107537 - RNA, 64 nt, Homo Sapiens
cuuauuaggaagggauugcuucacugguuuaauaauuuaaaaguuauguuuguuaaacacccug

SEQ ID NO: 107538 - RNA, 64 nt, Homo Sapiens
cugagagauccaucaaauugaacaaucuguuguaauuuaaaauuuuggccacuuuuuucagauu

SEQ ID NO: 107539 - RNA, 64 nt, Homo Sapiens
uauacaaguuuucuuuaaagcccucuccuuuagaauuuaaaauauuguaccauugaagaguuug

SEQ ID NO: 107540 - RNA, 64 nt, Homo Sapiens
cauugauggaacuggaguuguuggaaaaacauagauuuaaaaugauuuuugauagcugacauug

SEQ ID NO: 107541 - RNA, 64 nt, Homo Sapiens
ugaauuauguagaaugucaaucaaguuuuuguauauuuaaaaguuggacaucaauuuuuucccc

SEQ ID NO: 107542 - RNA, 64 nt, Homo Sapiens
aaaaauuaauaacuuuuaguaauuacuuuuauuaauuuaaaauagaacgcuugagaggcacuuu

SEQ ID NO: 107543 - RNA, 64 nt, Homo Sapiens
gguuuuuuaaaauuaauauuaauaacuuuuauuaauuuaaaauagaaugcuuaaaauaaaauag

SEQ ID NO: 107544 - RNA, 64 nt, Homo Sapiens
acucuguaauuuauacgguguacuauauaaugggauuuaaaaaaagugcuaucuuuucuauuuc

SEQ ID NO: 107545 - RNA, 64 nt, Homo Sapiens
ggugaucaauguuuggaaaauacaacaaugacuuauuuaaaaauuacccuuccugcuauuuaga

SEQ ID NO: 107546 - RNA, 64 nt, Homo Sapiens
gaaaccagccauuuaauuguucuagaguuuuagcauuuaaaaaucguaugaaagucuacaucag

SEQ ID NO: 107547 - RNA, 64 nt, Homo Sapiens
uacuuuguuuacauuuuagauuguacuugucuuuauuuaaaaugaugaaucuagucugaaucag

SEQ ID NO: 107548 - RNA, 64 nt, Homo Sapiens
uuaaaacuguggaaaauuauaagcacuguaaaauauuuaaaaggaaagcaauauaguugcauaa

SEQ ID NO: 107549 - RNA, 64 nt, Homo Sapiens
aucaaaaagcaauauaguugaaaauaaguuuuaaauuuaaaaugaaguaggaaacaauauuuug

SEQ ID NO: 107550 - RNA, 64 nt, Homo Sapiens
uuuugaauuuaacuuguuuaaaaaaauauaacagauuuaaaauguucauuuguacaucccuuug

SEQ ID NO: 107551 - RNA, 64 nt, Homo Sapiens
aaaagaaguuuucaguucuguuuaaaagcacuuuauuuaaaaaauagggcaacauauauuugaa

SEQ ID NO: 107552 - RNA, 64 nt, Homo Sapiens
acuuuauuuaaaaaaaaaagcaacauauauuugaauuuaaaagcuauuucaguuuucuuuaggg

SEQ ID NO: 107553 - RNA, 64 nt, Homo Sapiens
auauuuuuagcagucguaauaaaccaccagugacauuuaaaaauucacuuuggucauguuuauu

SEQ ID NO: 107554 - RNA, 64 nt, Homo Sapiens
auuucuaggaagucaaauaauugucacuaauuauauuuaaaauuacagaugugaacuuuauucc

SEQ ID NO: 107555 - RNA, 64 nt, Homo Sapiens
uuuugcugcauaauaaagauguuaaaaguuagcaauuuaaaaaaacugaauaauucuacaugaa

SEQ ID NO: 107556 - RNA, 64 nt, Homo Sapiens
uugagauuuuuaaaauuuuuauaaaugauuuuuuauuuaaaaauagccauccauccugaauuuu

SEQ ID NO: 107557 - RNA, 64 nt, Homo Sapiens
guuaacauuaaugcucaauauaagugaauacuuaauuuaaaaguuaggacagugacaaaauucg

SEQ ID NO: 107558 - RNA, 64 nt, Homo Sapiens
aaaaaaaacuuuuuguaacgcuuugugugaauuuauuuaaaagagucgcuuucuauuucucuuu

SEQ ID NO: 107559 - RNA, 64 nt, Homo Sapiens
augcaaaaaacuguuggauuaaaaugaaaaauuaauuuaaaaaauuugguuauuuuauuuuaaa

SEQ ID NO: 107560 - RNA, 64 nt, Homo Sapiens
aucccaaggaaagaugauuugguauuucaagaaaauuuaaaacgaagaagcucuccacccacuu

SEQ ID NO: 107561 - RNA, 64 nt, Homo Sapiens
ugaaaaaccacccaagaugaaacuguuauaauuuauuuaaaagugccacacuuccuuuagaagg

SEQ ID NO: 107562 - RNA, 64 nt, Homo Sapiens
auuugacuuuugaauaauaaauugaggauggaugauuuaaaaacugacgguacauuaaaucaaa

SEQ ID NO: 107563 - RNA, 64 nt, Homo Sapiens
ucaacaguuuuguuaaaucuggaaauagaauggaauuuaaaacucaacugucuugagaauucag

SEQ ID NO: 107564 - RNA, 64 nt, Homo Sapiens
uaguaugaauuuuuuagcuucuuaaugaauauggauuuaaaacucuccaguucuuauuuuauga

SEQ ID NO: 107565 - RNA, 64 nt, Homo Sapiens
caaauacuuucagaauuguauuucaguuuugaagauuuaaaaaaaaugugaaaauaaauauaua

SEQ ID NO: 107566 - RNA, 64 nt, Homo Sapiens
auuaacucuuauuguuguguuucugaaaagugaaauuuaaaaagcagccugaaaaauaaaaauu

SEQ ID NO: 107567 - RNA, 64 nt, Homo Sapiens
uggagauuagggaaggaaaacuacucuagaggccauuuaaaaguauguauuuauuagaacaugc

SEQ ID NO: 107568 - RNA, 64 nt, Homo Sapiens
aaaaugucauguuauuaacaguuauuagguugucauuuaaaaauaaaguuccuuuauauuucug

SEQ ID NO: 107569 - RNA, 64 nt, Homo Sapiens
uugauucaguauucuuuuaucauaaauuuuuagcauuuaaaaauucacugauguacauuaagcc

SEQ ID NO: 107570 - RNA, 64 nt, Homo Sapiens
auaugaagauugggcuugaaguauauauuuuugcauuuaaaaguaucaccuaucauauuuucca

SEQ ID NO: 107571 - RNA, 64 nt, Homo Sapiens
gagccugcauuucuaguuaagauggaucuuguaaauuuaaaauuggauuaacauuggagugcug

SEQ ID NO: 107572 - RNA, 64 nt, Homo Sapiens
uauauaccaacagaacuacuugagccuuuugaguauuuaaaaaauguuuauuacugcuugaggu

SEQ ID NO: 107573 - RNA, 64 nt, Homo Sapiens
uuuuaaaaauauaacgagggaaaaaaaagaaaaaauuuaaaaaaaaaacaaaaaaaaggaagga

SEQ ID NO: 107574 - RNA, 64 nt, Homo Sapiens
aggcgagaggcuaggauguaucuuucucaaaauaauuuaaaaguuuuucucccagcuagugcua

SEQ ID NO: 107575 - RNA, 64 nt, Homo Sapiens
cauuuuuauugaaaggccuguuaaagccuguauuauuuaaaaugggucucuggugaucuuauuu

SEQ ID NO: 107576 - RNA, 64 nt, Homo Sapiens
augacuugaauuucucagaaccuauugugaagucauuuaaaauaaaaauauacaugaugggauu

SEQ ID NO: 107577 - RNA, 64 nt, Homo Sapiens
aaauaaaagagcgaggauggauuacuauaugaugauuuaaaacagaaguuagucuuaaacucaa

SEQ ID NO: 107578 - RNA, 64 nt, Homo Sapiens
acuuuuuaaggccauuuuauaauucaauauuugcauuuaaaaaugucuuaaaggaagcaucaag

SEQ ID NO: 107579 - RNA, 64 nt, Homo Sapiens
aauauauuauuaaagcuuaauuauauguauaucuauuuaaaacuaugaaucauuugaaguauuu

SEQ ID NO: 107580 - RNA, 64 nt, Homo Sapiens
guuuauuuuagacccuucuaugaaaaugcccugcauuuaaaaauuuuucaugaacucuuuuuac

SEQ ID NO: 107581 - RNA, 64 nt, Homo Sapiens
agauuuuccauuuucuuacauaaaucuuugcaugauuuaaaaaccagauagaaaaaugcuuauu

SEQ ID NO: 107582 - RNA, 64 nt, Homo Sapiens
guaagauaagaaacaguuucugaguguuaugaauauuuaaaauuauggccacaaaaaaguaguu

SEQ ID NO: 107583 - RNA, 64 nt, Homo Sapiens
uugaaguucuguauucauuauagauguagcccuuauuuaaaaaagugaauuccauacuaaaacu

SEQ ID NO: 107584 - RNA, 64 nt, Homo Sapiens
ugacuuuuucaguuucuugaacgguuaaggguggauuuaaaaacuagacaguuuaguuuugggg

SEQ ID NO: 107585 - RNA, 64 nt, Homo Sapiens
uuuuuugagaaaaaaaaauguuuacucuuccaucauuuaaaaaaaauguaaaagacaaaaaaaa

SEQ ID NO: 107586 - RNA, 64 nt, Homo Sapiens
aaaaauguaaaagacaaaaaaaaaauggaggaugauuuaaaagaugcuuucuaucucugggaaa

SEQ ID NO: 107587 - RNA, 64 nt, Homo Sapiens
cuaucaacuguaaagcuccuuuucuuccacuuuaauuuaaaaguucaugucauuuaaaaacaag

SEQ ID NO: 107588 - RNA, 64 nt, Homo Sapiens
ccuuuucuuccacuuuaauuuaaaaguucaugucauuuaaaaacaagucaagaaauuaaaauug

SEQ ID NO: 107589 - RNA, 64 nt, Homo Sapiens
agaaaauggacugaagucugaauaaggucauugcauuuaaaaagcauauaacuguacuugacug

SEQ ID NO: 107590 - RNA, 64 nt, Homo Sapiens
ucucuucaucuacaggaugcaauaggcugauuguauuuaaaaaucaaaguacccaaaacugagu

SEQ ID NO: 107591 - RNA, 64 nt, Homo Sapiens
uauuucacuaccgcucccuguuuuagauauucagauuuaaaagguuuucaaagaauuacuuucu

SEQ ID NO: 107592 - RNA, 64 nt, Homo Sapiens
ccaaugaguuucaggaaugaaguagaagguaguuauuuaaaaauaaaaaacacaguccgucccu

SEQ ID NO: 107593 - RNA, 64 nt, Homo Sapiens
agacuugaaacuuccagugugaguugaccccaucauuuaaaaauaaaguccccggguuccuuaa

SEQ ID NO: 107594 - RNA, 64 nt, Homo Sapiens
gauccuucagacacaucuaugagaagauuuguucauuuaaaagucugcccacugaggauaggga

SEQ ID NO: 107595 - RNA, 64 nt, Homo Sapiens
agaaguauuuugcagagcuaucaauguccaaauaauuuaaaaaaaaaaauaaagguauuuaagc

SEQ ID NO: 107596 - RNA, 64 nt, Homo Sapiens
ucagauuccagagauaucuuacgucuuugauucaauuuaaaauuuguacuuauuuucuuuuaga

SEQ ID NO: 107597 - RNA, 64 nt, Homo Sapiens
ugucauccaagacguagagcuugaaugugacguuauuuaaaaacaacaacaaagaaggcagagc

SEQ ID NO: 107598 - RNA, 64 nt, Homo Sapiens
uuuauacuaagggacaauuauuuuaagaccauggauuuaaaaaaaaaaaaaaaaacucuguuuc

SEQ ID NO: 107599 - RNA, 64 nt, Homo Sapiens
guauuuuuguaaaacuuuugauauuucuguauacauuuaaaaaaucaauugccacuacaguagu

SEQ ID NO: 107600 - RNA, 64 nt, Homo Sapiens
uugcuaaucauuuccuggguuccacuuacucuugauuuaaaaaaaaaaaaacaacaaaagaguu

SEQ ID NO: 107601 - RNA, 64 nt, Homo Sapiens
ucuuaauuuuugaauuuuaaaacuaaucuauuuuauuuaaaaaaaaucaaguacuuuggaagug

SEQ ID NO: 107602 - RNA, 64 nt, Homo Sapiens
uacaaaaagaaaaaaaaaauccuguuguauuaacauuuaaaaacagaauuguguuaugugauca

SEQ ID NO: 107603 - RNA, 64 nt, Homo Sapiens
ugcuuuuuaaaaaagacagcaaacuuuuuuuuuuauuuaaaaaaagauauauuaacaguuuuag

SEQ ID NO: 107604 - RNA, 64 nt, Homo Sapiens
auaaaaagaauccaaccccgaaaaaaauuuaaaaauuuaaaaaacagagcgagacucagucuca

SEQ ID NO: 107605 - RNA, 64 nt, Homo Sapiens
uuaaaaaaauaaaaagaauccagucucaaaaaaaauuuaaaaaucuggacgacagagcgagacu

SEQ ID NO: 107606 - RNA, 64 nt, Homo Sapiens
uuuuaaguaaagccauucuuucacuuuuaagggcauuuaaaaauagaaagcauuaugcaaaaag

SEQ ID NO: 107607 - RNA, 64 nt, Homo Sapiens
aucaaaccucaaaaaagucaguuuaucauuuuuuauuuaaaaaauugaucuggauggcaagacc

SEQ ID NO: 107608 - RNA, 64 nt, Homo Sapiens
auuaaagcauguuauuugacaaguuuuaaguaacauuuaaaaaugcugcguaucuugucucaau

SEQ ID NO: 107609 - RNA, 64 nt, Homo Sapiens
acaugggugucgguuuuguacaaucuaccucaucauuuaaaaugucacuuuacugcauaggaaa

SEQ ID NO: 107610 - RNA, 64 nt, Homo Sapiens
aacaucagguauauuuuguauaauuuuaaagaucauuuaaaauuguaauaauuaauaguauguu

SEQ ID NO: 107611 - RNA, 64 nt, Homo Sapiens
uuuuuggaagugguaagaaauauaccuugcuuggauuuaaaacuccaugguauugguuccuuca

SEQ ID NO: 107612 - RNA, 64 nt, Homo Sapiens
gaauuguauuuucucucuccaagaucgauugggaauuuaaaaacuguaugcuauguuaaaugaa

SEQ ID NO: 107613 - RNA, 64 nt, Homo Sapiens
aaaaucaguguuuaaauaaauuuuguguguauauauuuaaaaaaugaagccuugcugaacuaag

SEQ ID NO: 107614 - RNA, 64 nt, Homo Sapiens
gccaaaacuuaccuauaaauggagggggcguuggauuuaaaaaugguuggaacuuuagggggug

SEQ ID NO: 107615 - RNA, 64 nt, Homo Sapiens
gauauucaguacaacucugucauuucuuuguaauauuuaaaaaauauuaguaaaggagugaauu

SEQ ID NO: 107616 - RNA, 64 nt, Homo Sapiens
ucggccucuuaaucccuuaccugagaaugaagggauuuaaaacacugauuuaacauugaaaggc

SEQ ID NO: 107617 - RNA, 64 nt, Homo Sapiens
uuguuaacauucagauuuaauuacuguaaguaaaauuuaaaauguaaauacaucaguucauguu

SEQ ID NO: 107618 - RNA, 64 nt, Homo Sapiens
aaauuucagagaacuaauuuuuaaaaucuuuagcauuuaaaacuuuuuuuguuuuguuuucuga

SEQ ID NO: 107619 - RNA, 64 nt, Homo Sapiens
gaaaaguaugcuuuguguuuuaacuguuaaaauaauuuaaaaauuaauuauuuuacauaauuaa

SEQ ID NO: 107620 - RNA, 64 nt, Homo Sapiens
cuugaacuaaugauagauaguauuuuuuuccucuauuuaaaauuuuugucuugauuaggagauu

SEQ ID NO: 107621 - RNA, 64 nt, Homo Sapiens
acaaucagaucuaugcuguggcauauuuugcuuuauuuaaaaauuuuuuuuuagagaugaguuc

SEQ ID NO: 107622 - RNA, 64 nt, Homo Sapiens
ucagguccuuauuggcaccuaguagggcaugugcauuuaaaaacuuguccuuaaaaauagaaga

SEQ ID NO: 107623 - RNA, 64 nt, Homo Sapiens
auuuuagucugaugcuguuguauuuuuucauuuuauuuaaaacacuacuuacuucuuauucucu

SEQ ID NO: 107624 - RNA, 64 nt, Homo Sapiens
accuuccuuuuuggcuggaacucaguggugcaagauuuaaaauuuuuccacggcgacacacagc

SEQ ID NO: 107625 - RNA, 64 nt, Homo Sapiens
uaugguagacauuuaggacaauaauuuuuuagagauuuaaaauucuuugaagugaacccuugcu

SEQ ID NO: 107626 - RNA, 64 nt, Homo Sapiens
auauauuuuaugauaaagggucaauuugaguaaaauuuaaaaccaagucauagggauuauaaau

SEQ ID NO: 107627 - RNA, 64 nt, Homo Sapiens
uacucguacauuucaccuguacaaggaaagauuuauuuaaaauauuucaaaacuauuuccaauc

SEQ ID NO: 107628 - RNA, 64 nt, Homo Sapiens
cagaaaucaguuuggcaaagagugaauaaauacaauuuaaaagugauuuuucaaauuggugggg

SEQ ID NO: 107629 - RNA, 64 nt, Homo Sapiens
aauaguuuuuaauuguaggcauacauaggaaaacauuuaaaauagugcuugguauuucugucuu

SEQ ID NO: 107630 - RNA, 64 nt, Homo Sapiens
auuuccaaaaaucccuuaggggaugaggggugaaauuuaaaagcuccugaaaaugaguacugcu

SEQ ID NO: 107631 - RNA, 64 nt, Homo Sapiens
auugaaacauuuuaauuucaaauucaaauagaacauuuaaaaugauuucauuauuauuacccau

SEQ ID NO: 107632 - RNA, 64 nt, Homo Sapiens
gauuguuacuuaaauuuuccaccuggaaucauggauuuaaaauuuccccaccucauggggaaaa

SEQ ID NO: 107633 - RNA, 64 nt, Homo Sapiens
aaacacccucacuguaugauauaaaguuauagucauuuaaaaaugugugauauuaguacauuag

SEQ ID NO: 107634 - RNA, 64 nt, Homo Sapiens
acuguuucuauuauugaaaauuguauguaaaacuauuuaaaauagaauagaaggauacacaccc

SEQ ID NO: 107635 - RNA, 64 nt, Homo Sapiens
gaccaugaaugaauaggccagcugggacaaaugaauuuaaaaaaucagaaaaaugcaagauuua

SEQ ID NO: 107636 - RNA, 64 nt, Homo Sapiens
ucacugacuguuuuuguaugguccaugaucuagaauuuaaaaaaauuuuaaaggguugaaaaaa

SEQ ID NO: 107637 - RNA, 64 nt, Homo Sapiens
aaaaaaauagaccaggugcucaacguguuucuuaauuuaaaaaacagccaugagccaccaugac

SEQ ID NO: 107638 - RNA, 64 nt, Homo Sapiens
agucaaaugacuuaauucugaugugagacuuuucauuuaaaaaaggcuugguucaguaauaaau

SEQ ID NO: 107639 - RNA, 64 nt, Homo Sapiens
agagaauguuguaauaaguaaaugccuuaagaguauuuaaaauaugcuuccacauuucaaaaua

SEQ ID NO: 107640 - RNA, 64 nt, Homo Sapiens
cccucauaggccuaggcuuuggucuaaaaggaacauuuaaaaaguugcccuguaaaguuauuug

SEQ ID NO: 107641 - RNA, 64 nt, Homo Sapiens
aaaauacaguaccgugucugaauuaauuauuaauauuuaaaauacuucauuccuuaacucuccc

SEQ ID NO: 107642 - RNA, 64 nt, Homo Sapiens
gggagagcugagccaguuguccuauggacaacuuauuuaaaaauauuucagauaucaaaauucu

SEQ ID NO: 107643 - RNA, 64 nt, Homo Sapiens
uccuaaacucccuucccucucucccauuucaggaauuuaaaauuaaguagaacaaaaaacccag

SEQ ID NO: 107644 - RNA, 64 nt, Homo Sapiens
uuaucaugaauucccuuuuaaucaacuguagguuauuuaaaauaaauuccuacaacuuaaugga

SEQ ID NO: 107645 - RNA, 64 nt, Homo Sapiens
ucccaggagccaaccucccccuuugcagggcugcauuuaaaaauuagguuugggacaguucuug

SEQ ID NO: 107646 - RNA, 64 nt, Homo Sapiens
auuuagcaccugccagaugccagaaauuuauaccauuuaaaacucaguaagucuuuuaaauauc

SEQ ID NO: 107647 - RNA, 64 nt, Homo Sapiens
uuuucacaugcuaaugugcagcugagugcacuuuauuuaaaaagaauggauaaaugcaauauuc

SEQ ID NO: 107648 - RNA, 64 nt, Homo Sapiens
gauauggggaaauaaacuuaaaaaaaaaucaggaauuuaaaaaaacgagcaauuugaagagaau

SEQ ID NO: 107649 - RNA, 64 nt, Homo Sapiens
aagaaucaccaaaucuauuugaauuuaaaccuguauuuaaaaaauaugugauaauagagggcug

SEQ ID NO: 107650 - RNA, 64 nt, Homo Sapiens
uauguuuuuuuuuuuuuaaauauugugcucuuucauuuaaaaugucacuuggagcaguuucugc

SEQ ID NO: 107651 - RNA, 64 nt, Homo Sapiens
auuuuacccaagccuaaguauauuuuaauauguuauuuaaaaugcuggguuguccccccaaaca

SEQ ID NO: 107652 - RNA, 64 nt, Homo Sapiens
uuaaauauauuugccuaguuaccaacauuaugaaauuuaaaagcucccgugccuuuuaaaaaau

SEQ ID NO: 107653 - RNA, 64 nt, Homo Sapiens
aauuauaaaaugaucucuguuuuuccugucagagauuuaaaaaacugaaaagguauaccucaac

SEQ ID NO: 107654 - RNA, 64 nt, Homo Sapiens
auaucaucaagagcuuaagaaucuuggcuuucauauuuaaaaugcuuuuggggagacauauauu

SEQ ID NO: 107655 - RNA, 64 nt, Homo Sapiens
ucuaaguauauuccuauugugcaauaauuucuuaauuuaaaaaaagacuguuuccacaccauag

SEQ ID NO: 107656 - RNA, 64 nt, Homo Sapiens
aaaaaaaucguauuucacuguccuuguguuggaaauuuaaaaggcaagagucuaaaaacuaguu

SEQ ID NO: 107657 - RNA, 64 nt, Homo Sapiens
ccaaaguaaauugcaaauuuuagcaaaauuauuaauuuaaaaccauuuuaaaauugcaugagau

SEQ ID NO: 107658 - RNA, 64 nt, Homo Sapiens
guuguaggagacuuucaauuuggaaaaaaaaaacauuuaaaaauuacugaaacuuaaagaucag

SEQ ID NO: 107659 - RNA, 64 nt, Homo Sapiens
aaauaugaaaaaccccuaaauaauuucuuuguauauuuaaaaauaaauauuucuauuaaugguu

SEQ ID NO: 107660 - RNA, 64 nt, Homo Sapiens
uuagaaagaauuagccaaccaggcuacaguugauauuuaaaagauccauuuaaaacaagcugau

SEQ ID NO: 107661 - RNA, 64 nt, Homo Sapiens
gccaaccaggcuacaguugauauuuaaaagauccauuuaaaacaagcugauaguguuucguuaa

SEQ ID NO: 107662 - RNA, 64 nt, Homo Sapiens
aaucuuccuugagagccuugcuucuauuuaaguuauuuaaaauacuaaacaauaucaucuagga

SEQ ID NO: 107663 - RNA, 64 nt, Homo Sapiens
agagagaaccagacugagucgagacuccgucucaauuuaaaacacuccagccuggcaauagggc

SEQ ID NO: 107664 - RNA, 64 nt, Homo Sapiens
aagaaaauuccugggcauuuauacauuaaagaugauuuaaaaaaaggcaaaaaaauuauuaaaa

SEQ ID NO: 107665 - RNA, 64 nt, Homo Sapiens
auaccgagcagcaaaagggggggguaauuauuuuauuuaaaaaagauagggauggguugggggc

SEQ ID NO: 107666 - RNA, 64 nt, Homo Sapiens
uuaaaaaacggguaacauggaaaaacuauagaaaauuuaaaaaagugugacccugucucuaaag

SEQ ID NO: 107667 - RNA, 64 nt, Homo Sapiens
uagccaaguguggugguguguuucucuacaaaaaauuuaaaaauugggcaguauagugagaucu

SEQ ID NO: 107668 - RNA, 64 nt, Homo Sapiens
ugagugacagguagucagaauucaaaagaagauuauuuaaaacaagccagcuaaggcuuauuau

SEQ ID NO: 107669 - RNA, 64 nt, Homo Sapiens
ugcucagagccacuuagccaacuugcgaugccggauuuaaaacuuaaaucccucuccaaagggu

SEQ ID NO: 107670 - RNA, 64 nt, Homo Sapiens
cuauagcagaguuucucuauuuuauauuucauagauuuaaaaaacccaaauaaagauggauuua

SEQ ID NO: 107671 - RNA, 64 nt, Homo Sapiens
auuucauagauuuaaaaaacccaaauaaagauggauuuaaaauucacuguggaaaagaguauug

SEQ ID NO: 107672 - RNA, 64 nt, Homo Sapiens
gugguggcacguagagaacuagaugguaauaaagauuuaaaacuaugaagaagguuacagugua

SEQ ID NO: 107673 - RNA, 64 nt, Homo Sapiens
auaacacggcaugggaguaagguuauccuuagaaauuuaaaauaacuccacaguaaaauaggua

SEQ ID NO: 107674 - RNA, 64 nt, Homo Sapiens
ugucuuacucaguucagucuuuuuuugcucauaaauuuaaaaguuacauaccugguuugcuuag

SEQ ID NO: 107675 - RNA, 64 nt, Homo Sapiens
uuggagagugagaauuuuugcauuauguaaaacaauuuaaaaaucuuuuaagucuuuuucugug

SEQ ID NO: 107676 - RNA, 64 nt, Homo Sapiens
gaauuucauccaaauguuacccuguaauacuggcauuuaaaauucuuauuuaaccuuccucccu

SEQ ID NO: 107677 - RNA, 64 nt, Homo Sapiens
acaccagguuggguuaauuaaagcuuuugguauaauuuaaaauuaaauuuauaaaugcaguugu

SEQ ID NO: 107678 - RNA, 64 nt, Homo Sapiens
auauguaaaggguauacauuaauugguacguagcauuuaaaaucaggucuuauaauuaaugcuu

SEQ ID NO: 107679 - RNA, 64 nt, Homo Sapiens
aaucacccugguauccaauaucugagcauggcaaauuuaaaaaauaacacaauuucuugccugu

SEQ ID NO: 107680 - RNA, 64 nt, Homo Sapiens
augccuuaucagaaucuaaaugaaaauagcgaacauuuaaaagcuaucaccauuguaguagaau

SEQ ID NO: 107681 - RNA, 64 nt, Homo Sapiens
auaacuauacuugucaaauagcaccuaucuaugcauuuaaaaaugcauuaauaucuaacauaaa

SEQ ID NO: 107682 - RNA, 64 nt, Homo Sapiens
ccaaguaucuguuuauauaguuaguuuucagcucauuuaaaagaggcaaaaauuaaaagcuugg

SEQ ID NO: 107683 - RNA, 64 nt, Homo Sapiens
gauaugacaaaaugaaaaugcuuaaacuacagaaauuuaaaaaugccauaacaaucuugcgaga

SEQ ID NO: 107684 - RNA, 64 nt, Homo Sapiens
auccacagaccaaccuggaguugaaaaucuuauaauuuaaaauaugcucuaaacauguuuaucg

SEQ ID NO: 107685 - RNA, 64 nt, Homo Sapiens
uugagguaaaagcaucacaugaacuuguaaaggaauuuaaaaauccuacuuucauaauaaguug

SEQ ID NO: 107686 - RNA, 64 nt, Homo Sapiens
aaaauauucugcaguugggagauuugguagauaaauuuaaaauuaaaauaaaugucauagucaa

SEQ ID NO: 107687 - RNA, 64 nt, Homo Sapiens
aguacauucugucucaugucgaaauuccuuuuauauuuaaaaauucagcuuaucuaaaccuaau

SEQ ID NO: 107688 - RNA, 64 nt, Homo Sapiens
agggguuacuuuacauccuauuuuuaaaacucagauuuaaaacaaccuuuucuuuacccaagga

SEQ ID NO: 107689 - RNA, 64 nt, Homo Sapiens
aauaaacuuugggaaaagguugccacaagacauaauuuaaaauaaugugggaugaguuuuuaaa

SEQ ID NO: 107690 - RNA, 64 nt, Homo Sapiens
uggaugcuuaagaggccugcaacaaugcaguagaauuuaaaacuugccugcuucauuuugcaau

SEQ ID NO: 107691 - RNA, 64 nt, Homo Sapiens
cuaguauaguguuguguagccacugugguaaaugauuuaaaacagaauguuuucaagaaaugua

SEQ ID NO: 107692 - RNA, 64 nt, Homo Sapiens
aaacuaaagaaauaugucacccuaagaguucauuauuuaaaaauccaacauaguauuuuugcag

SEQ ID NO: 107693 - RNA, 64 nt, Homo Sapiens
gcaaaaagugaaaaaaaaaauuguggaggauuacauuuaaaaaaauaauauaaauuaccauugu

SEQ ID NO: 107694 - RNA, 64 nt, Homo Sapiens
aaauggaacacuuaaauguaugcuuuucugaugcauuuaaaaauggucacagaucuaucauaau

SEQ ID NO: 107695 - RNA, 64 nt, Homo Sapiens
uaguuucaauuuaauaaucacagacugauacuaaauuuaaaaugcuugauuauuuuucagaaag

SEQ ID NO: 107696 - RNA, 64 nt, Homo Sapiens
gacugugagacugagagggcucacgccucuguguucaggauacuuaguucauggcuuuucucuu

SEQ ID NO: 107697 - RNA, 64 nt, Homo Sapiens
uuuaccuuccugauuuucugguuacuaauuagcuucaggauacgcugcucucauacuugggcug

SEQ ID NO: 107698 - RNA, 64 nt, Homo Sapiens
uucagacacauggugagguccauggcucuugucaucaggauaagccugcacaccuagagugucg

SEQ ID NO: 107699 - RNA, 64 nt, Homo Sapiens
acacaguugggguugggucaauaguuucccaauuucaggauauuucgaugucagaaauaacgca

SEQ ID NO: 107700 - RNA, 64 nt, Homo Sapiens
aaauuauucuguuauuggaucugugccuguaauaucaggauacuaccauccaaaucuaucuaga

SEQ ID NO: 107701 - RNA, 64 nt, Homo Sapiens
uccuaaaaccaaaaacaacagugacaauagagucucaggauagcagagucugaaaauaccuugg

SEQ ID NO: 107702 - RNA, 64 nt, Homo Sapiens
cuacaaaaauggcaccucuuagcagugaugaggcucaggauaucggauaucauaacaccaaugu

SEQ ID NO: 107703 - RNA, 64 nt, Homo Sapiens
gaggcucaggauaucggauaucauaacaccaaugucaggauaaauaucucuucuaaagacgaua

SEQ ID NO: 107704 - RNA, 64 nt, Homo Sapiens
ugaauauggaucugccauaaacuaguuuaaaaugaauuucuauauuaucuaaccaaucagaaau

SEQ ID NO: 107705 - RNA, 64 nt, Homo Sapiens
uugccagaauauacuauaaauuuggaucucaacuaauuucuacaacuucaaaagguuuguaaga

SEQ ID NO: 107706 - RNA, 64 nt, Homo Sapiens
auguaaacuuuaaacauaaugccacaaggucacuaauuucuagcagguaaaauuauaaggauau

SEQ ID NO: 107707 - RNA, 64 nt, Homo Sapiens
auuuguacucaguaaaacaaaaauuuauggucaaaauuucuaacuugguucaucacauuauaag

SEQ ID NO: 107708 - RNA, 64 nt, Homo Sapiens
augagacuauuuauaugaagcuugaauuccauggaauuucuaguggaaugcgaguaaggauugg

SEQ ID NO: 107709 - RNA, 64 nt, Homo Sapiens
ugcaaagauguuuacaucaacuauuuuuggcuuuaauuucuaauauuccuuuauauuugcuccc

SEQ ID NO: 107710 - RNA, 64 nt, Homo Sapiens
uccuaaauaagauccacccacaccuaagucacagaauuucuaaguuccccaacuacucucacac

SEQ ID NO: 107711 - RNA, 64 nt, Homo Sapiens
uaucauuguauuuuuuauuaaaaguuuuguaauaaauuucuaaauuaucuucuggugugggacu

SEQ ID NO: 107712 - RNA, 64 nt, Homo Sapiens
aagucaaucauuucucacuguguacauaaugcuuaauuucuaaagauaauauuacuguuuauuu

SEQ ID NO: 107713 - RNA, 64 nt, Homo Sapiens
uucuuauuuuuccuaacaaaagaugaaagcagggaauuucuaucuaaaugaugaguauuaguuc

SEQ ID NO: 107714 - RNA, 64 nt, Homo Sapiens
cucuuugaaacccaaaaugucuucuaaagaaucaaauuucuauuucugccucugacaaaaagaa

SEQ ID NO: 107715 - RNA, 64 nt, Homo Sapiens
uauuaucaguuugguaguucauuauuuuagaacaaauuucuaaauuaauuuauucccauaaccu

SEQ ID NO: 107716 - RNA, 64 nt, Homo Sapiens
uuugcuuuguuuuuaaugaaaauuaaugguugugaauuucuauuuuuaaaugacaaaccuaggu

SEQ ID NO: 107717 - RNA, 64 nt, Homo Sapiens
aguuuaaguucuaugagggcauuuccuuauucagaauuucuaaaaccuuaucuauguagaauau

SEQ ID NO: 107718 - RNA, 64 nt, Homo Sapiens
acugucuuuucaacuuauguuaacaguuugugauaauuucuaaaaguauuucaguuccgugucu

SEQ ID NO: 107719 - RNA, 64 nt, Homo Sapiens
uuuguaagaguagguuuaaaucaaucuaaggugcaauuucuaaaggcccugguucauguuuuca

SEQ ID NO: 107720 - RNA, 64 nt, Homo Sapiens
auauauuaguaaaccuaugaagggaugauucuuuaauuucuaaaguguuguucaaacucaccuu

SEQ ID NO: 107721 - RNA, 64 nt, Homo Sapiens
aauuauuuugccauguauuacuaauuguauuuaaaauuucuacuucccuuaggcauuuuauaaa

SEQ ID NO: 107722 - RNA, 64 nt, Homo Sapiens
ggaaaaauuaccaauuuguacauuuuaauuauucaauuucuacuuuguaaaaauagggaaauua

SEQ ID NO: 107723 - RNA, 64 nt, Homo Sapiens
augcuaaucuuuacuaaauagugagcuaaauuagaauuucuaacucuuauauugugcucuuuua

SEQ ID NO: 107724 - RNA, 64 nt, Homo Sapiens
accuucaccauagucauucuccuaauccuucuauaauuucuauucauuccugaguuuuguaauu

SEQ ID NO: 107725 - RNA, 64 nt, Homo Sapiens
guacagagaucuauaaaaccaguuuuuaauuuuuaauuucuaagcucagaaauaguuauucauu

SEQ ID NO: 107726 - RNA, 64 nt, Homo Sapiens
aaaugaauauuaucaagaguaaguguacgguagaaauuucuacaugaagcauuugaaaaagcca

SEQ ID NO: 107727 - RNA, 64 nt, Homo Sapiens
uuucuuuuaaaaaaauuaaaauaaaacaaaaaaaaauuucuaggacuagacgauguaauaccag

SEQ ID NO: 107728 - RNA, 64 nt, Homo Sapiens
uucaauuuugcacugucuuuugagauucaagaaaaauuucuauucuuuuuuuugcauccaauug

SEQ ID NO: 107729 - RNA, 64 nt, Homo Sapiens
uguuuguuuaauccuuugaaauauuugaaacaucaauuucuauuuucugaccucuaagccuaaa

SEQ ID NO: 107730 - RNA, 64 nt, Homo Sapiens
aaguguuuaggaaggauaaaguuacauuugucuuaauuucuaacauuaucuuugcuuuuauguu

SEQ ID NO: 107731 - RNA, 64 nt, Homo Sapiens
aaagaugaggcagacucgcuacccuuuuugagagaauuucuauuuugacuguaguggucacuaa

SEQ ID NO: 107732 - RNA, 64 nt, Homo Sapiens
aaugagugcagauuacugaacaauguuuaccaagaauuucuaaaccaguuaucacugcagauug

SEQ ID NO: 107733 - RNA, 64 nt, Homo Sapiens
aaauaacauucugaaucaagcagguuaaaauuuuaauuucuacauauaucaacuuauuuuucac

SEQ ID NO: 107734 - RNA, 64 nt, Homo Sapiens
agaugugcuuuuauuuagcucaugcauugccaugaauuucuaccguccaagcacaucuugucaa

SEQ ID NO: 107735 - RNA, 64 nt, Homo Sapiens
acaacgcacacauuuucaacaaccaaaaaaugacaauuucuaguuuaguuaauuucuacaaauc

SEQ ID NO: 107736 - RNA, 64 nt, Homo Sapiens
caacaaccaaaaaaugacaauuucuaguuuaguuaauuucuacaaaucaucuuauguuauuagc

SEQ ID NO: 107737 - RNA, 64 nt, Homo Sapiens
ugaaaaacaaugauuguauggguacucaaaguauaauuucuacugaaugcauaucacuugugca

SEQ ID NO: 107738 - RNA, 64 nt, Homo Sapiens
gaagcccuucuguauuuuaauuucuacuguauuuaauuucuauuuaacuuagcuuuauguagaa

SEQ ID NO: 107739 - RNA, 64 nt, Homo Sapiens
guauuuaauuucuauugaaguuagcuuuauguagaauuucuacucuaguccuccucuaguuaac

SEQ ID NO: 107740 - RNA, 60 nt, Homo Sapiens
cuaucacuauguuguuguaacuaacucaagaauuucuaaacucucccaggucacacugau

SEQ ID NO: 107741 - RNA, 64 nt, Homo Sapiens
uuggagugcuuaaaaaugccaaaaacaaaaugguaauuucuacuuugauaaaguaaaaaaguua

SEQ ID NO: 107742 - RNA, 64 nt, Homo Sapiens
auauccuccaaugugugcauguguucaauggaugaauuucuaaaaauaggugcucaauaaaaau

SEQ ID NO: 107743 - RNA, 64 nt, Homo Sapiens
caauguguucuuaacuggguagauucuugucacaaauuucuaguggagggaaaaggccuuuacu

SEQ ID NO: 107744 - RNA, 64 nt, Homo Sapiens
uuugcaggggauacugaaaauuacacucauuuucaauuucuaaauggaaaagaaacaauaugcu

SEQ ID NO: 107745 - RNA, 64 nt, Homo Sapiens
cauguugggaaaaacuggcuacauuuugcuuuauaauuucuaccuaccaugaagugaaaaugcc

SEQ ID NO: 107746 - RNA, 64 nt, Homo Sapiens
ucuauucuaucaucuaaaacaaaucauuaaaacuaauuucuagcuaauuguuaauuauaauuau

SEQ ID NO: 107747 - RNA, 64 nt, Homo Sapiens
guggaauaauuccacugauugugauaaugguuucaauuucuacacaauauaaauauccaguaua

SEQ ID NO: 107748 - RNA, 64 nt, Homo Sapiens
uauagugcauauuaauuugauuaaauucucauuuaauuucuaguaguauuuaaaugaguaaaug

SEQ ID NO: 107749 - RNA, 64 nt, Homo Sapiens
uaaaugaguaaaugugaguuuuuuucugccuuguaauuucuaaauaauuaauauguuuuaagga

SEQ ID NO: 107750 - RNA, 64 nt, Homo Sapiens
uauacagagagguaacuugauuggaggagaaaguaauuucuaaaagcuuucuguugcaaauacc

SEQ ID NO: 107751 - RNA, 64 nt, Homo Sapiens
guaguuuugaauggguugauuucugccaaaagacaauuucuagauuuaacuuggauaccugcua

SEQ ID NO: 107752 - RNA, 64 nt, Homo Sapiens
uuuuuugguaauaaaaaguuugugacuuuuauuuaauuucuauuaaaaaaaaaaaaauccacau

SEQ ID NO: 107753 - RNA, 64 nt, Homo Sapiens
cacccagaucacaaugacaaaaaacuagauauguaauuucuaaaaacaaaacaaaacaaaacaa

SEQ ID NO: 107754 - RNA, 64 nt, Homo Sapiens
uaaauuuuagauuauuuuuauuauuaauauauuuaauuucuauuaucacuaauauuuucacagu

SEQ ID NO: 107755 - RNA, 64 nt, Homo Sapiens
cuuucuaaaaagagauuuauaugagcucacucagaauuucuauucacaacacuuaggcuuaaaa

SEQ ID NO: 107756 - RNA, 64 nt, Homo Sapiens
ugcaauauaaagucacaauagauaauauauaucaaauuucuaaaagguaaagaauguugugggu

SEQ ID NO: 107757 - RNA, 64 nt, Homo Sapiens
gauguagugaaagaacaaauccuagagucuuugaaauuucuaagggcauucuagaccucuguug

SEQ ID NO: 107758 - RNA, 64 nt, Homo Sapiens
uggcccaagucauuccuaaucuccccauuccuacaauuucuaugcugguggugcuggucuuuuc

SEQ ID NO: 107759 - RNA, 64 nt, Homo Sapiens
cagguggagagagugguaaaguaaucugaggguuaauuucuaggagagguuagaaugaucaucu

SEQ ID NO: 107760 - RNA, 64 nt, Homo Sapiens
uuuuuuaagugcuguaaagaguaguuguaauuggaauuucuacuguauaaauguuuuacauuaa

SEQ ID NO: 107761 - RNA, 64 nt, Homo Sapiens
accuaauacuuuuuuuagaugcaacaaacccuugaauuucuauuuguauucgaagacaagucau

SEQ ID NO: 107762 - RNA, 64 nt, Homo Sapiens
cuguuugcuuauuuguauaagucauacuguguagaauuucuauuuucuuuuuccccauuaaaag

SEQ ID NO: 107763 - RNA, 64 nt, Homo Sapiens
gcauaucuuaaaauaguauuuaaguaaauggucuaauuucuacauaauuauugcacugaacuuu

SEQ ID NO: 107764 - RNA, 64 nt, Homo Sapiens
acuagaaaacuuuauucauuuuagaauagaacauaauuucuaacuguaaaauugucauuuugua

SEQ ID NO: 107765 - RNA, 64 nt, Homo Sapiens
uuguucaauauugccguuacauuuauuagccuguaauuucuaaauuggagauucucuacauuuc

SEQ ID NO: 107766 - RNA, 64 nt, Homo Sapiens
aaauaacuucauauaaaagcuaaagugccuuggaaauuucuaauuuuaauaaaauuuguauugu

SEQ ID NO: 107767 - RNA, 64 nt, Homo Sapiens
auuacaguucccaaagucaguuuuggaaaaacaaaauuucuacaaaccaagguuacuuucuugu

SEQ ID NO: 107768 - RNA, 64 nt, Homo Sapiens
auuacaguucccaaagacacucuuggauaaagaaaauuucuacaaaccaagguuacuuucuugu

SEQ ID NO: 107769 - RNA, 64 nt, Homo Sapiens
ugugacacguucacauaacuugaagacaauggacccacguuaggguggcaaccugugcucaguc

SEQ ID NO: 107770 - RNA, 64 nt, Homo Sapiens
uaaacuuuggcuguugucuauauuguaagcauucccacguuaaacuuuaccccucugcuuuauu

SEQ ID NO: 107771 - RNA, 64 nt, Homo Sapiens
ggaaucuguaaaccuugaggacacuauaauagauccacguuacuaaccaguauaauaagcaaau

SEQ ID NO: 107772 - RNA, 64 nt, Homo Sapiens
guaaaagaguuuaacagcagguuuauacccuuccccacguuauuuggaaauugugcacuuuccu

SEQ ID NO: 107773 - RNA, 64 nt, Homo Sapiens
guuggacgugggcaccacgauucauaagcggacgccacguuaggguugauuacaaccuccaugc

SEQ ID NO: 107774 - RNA, 64 nt, Homo Sapiens
ugccuuccuugagcuccccaaaaccaccuagggaccacguuagcugaaaaguucgcucugccag

SEQ ID NO: 107775 - RNA, 64 nt, Homo Sapiens
auacccugauuuuucaucuuacgugaccaagaaaccacguuaggggaaaugaaaaaagcaagcc

SEQ ID NO: 107776 - RNA, 64 nt, Homo Sapiens
acuuuugccuguaagaauuuccaagcugaaacuuccacguuaaaaaguacaguuggcaagaucu

SEQ ID NO: 107777 - RNA, 64 nt, Homo Sapiens
ugaugucuuucugaagauuuucugcugugcgcuuccacguuacuuuggccuguauuaaagcagu

SEQ ID NO: 107778 - RNA, 64 nt, Homo Sapiens
aguucuugauagcccagggcaucugcugggcugaccacguuacucauccccguuaacauucucu

SEQ ID NO: 107779 - RNA, 64 nt, Homo Sapiens
acgugaauauuuauacaguaagcuauuuuuguuaccacguuauagccucccaaauaugcuaugg

SEQ ID NO: 107780 - RNA, 64 nt, Homo Sapiens
uugaacacuguuuuggaugcaauguugcccuuugccacguuaaaaaagcaguugaauuauguua

SEQ ID NO: 107781 - RNA, 64 nt, Homo Sapiens
ucgguugggagaaacuagcucugauccuaacaggccacguuaaacugcccaucuggagaaucgc

SEQ ID NO: 107782 - RNA, 64 nt, Homo Sapiens
ccaguucuuacccaucaugcacccuguacaguugccacguuacugccuuuuuuaaaaauauauu

SEQ ID NO: 107783 - RNA, 64 nt, Homo Sapiens
uccaaggagaagaagaggcccucagggaccuaagccacguuaagcucugggaggucuuggccga

SEQ ID NO: 107784 - RNA, 64 nt, Homo Sapiens
cugucagcauacacaaacacuuugaguuuaaacuccacguuaagacucugagcuggaaauugaa

SEQ ID NO: 107785 - RNA, 64 nt, Homo Sapiens
cauccuugcucuaccucaacguggggcccugacaccacguuaucaaacaugcagcccccacacc

SEQ ID NO: 107786 - RNA, 64 nt, Homo Sapiens
ugaccuugcaagagaguuucugcccauuuuagagccacguuaccaaaucgauguaggccuaauc

SEQ ID NO: 107787 - RNA, 64 nt, Homo Sapiens
aagaaaauaaaauaauuuaauuuuacauuagauuccacguuagauuugguuugaaaaacuaaaa

SEQ ID NO: 107788 - RNA, 64 nt, Homo Sapiens
uuuguuuugcuucaaguaauaaauaagcaaguucccacguuacuaaaauacauuguggcuuagc

SEQ ID NO: 107789 - RNA, 64 nt, Homo Sapiens
cacuaaaucugaacuuuuaccuguauguguggugccacguuagcucuauaauuuauuugcacac

SEQ ID NO: 107790 - RNA, 64 nt, Homo Sapiens
uuacggcacaaaauuaauuuuccccacuccucugccacguuaugauucucuccccacuccacgc

SEQ ID NO: 107791 - RNA, 64 nt, Homo Sapiens
aucugcuuauuuuacaauauuguucuguuuggcaccacguuauagcuuugaggauagaagcaga

SEQ ID NO: 107792 - RNA, 64 nt, Homo Sapiens
agaaaaaauauaacuauggauguauguauuuaagccacguuaaaauuuuaauagaaagacauga

SEQ ID NO: 107793 - RNA, 64 nt, Homo Sapiens
ccgcagcucacccgaacagaccucugcugccgggccacguuagucacgggacagaagacggugg

SEQ ID NO: 107794 - RNA, 64 nt, Homo Sapiens
gcaauuuuugacauuaauuaugaaacauuuuagcccacguuaguucuacauuauucuucacuua

SEQ ID NO: 107795 - RNA, 64 nt, Homo Sapiens
aagauugaagaaagagaaacuugucaacucauauccacguuaucuagcaaaguacauaagaauc

SEQ ID NO: 107796 - RNA, 64 nt, Homo Sapiens
ucaacagcuagcagcuuaugugauucaccccaugccacguuagugucacaaauuuuaugguuua

SEQ ID NO: 107797 - RNA, 64 nt, Homo Sapiens
uacuuuuuguauuuuuaguagagacaggguuucaccacguuagccaugauggucucaaacuucu

SEQ ID NO: 107798 - RNA, 64 nt, Homo Sapiens
caaaguacagugcuggcacuggggcacagagugcccacguuagccccgggcucugauagagagg

SEQ ID NO: 107799 - RNA, 64 nt, Homo Sapiens
ccccaugcgguuuuuccucuggacaggggcugacccacguuacugccugaaaaugggucccagc

SEQ ID NO: 107800 - RNA, 64 nt, Homo Sapiens
ucagccacuucuuuaaggagcuccagggcugcagccacguuagagggccccuuggggggcaggg

SEQ ID NO: 107801 - RNA, 64 nt, Homo Sapiens
ccaggcucugagagccagcccgacguggcgggcuccacguuagcaggggccucugagugccaag

SEQ ID NO: 107802 - RNA, 64 nt, Homo Sapiens
aaagccaaaagcagcgggugugaauuucuccuugccacguuaauauucgagacauacuuaauuu

SEQ ID NO: 107803 - RNA, 64 nt, Homo Sapiens
aagagagacuugggaacagcguccaagggagcagccacguuaggucuguagcagacacggaaga

SEQ ID NO: 107804 - RNA, 64 nt, Homo Sapiens
uuuaggaucaggcugaauaugaggacaaagugggccacguuagcaucugcagagaucaaucugg

SEQ ID NO: 107805 - RNA, 64 nt, Homo Sapiens
ggugaacauugguucuuucauuugccaacuuuccccacguuaaagguguccuccugggguucuu

SEQ ID NO: 107806 - RNA, 64 nt, Homo Sapiens
uuuggguccugccguauaaucuguucuucuauucccacguuagccaguuguucuugaugaaucu

SEQ ID NO: 107807 - RNA, 64 nt, Homo Sapiens
cuguguaaggugauguucccguugucuuuucuuuccacguuauagagaggagaagugcgccaau

SEQ ID NO: 107808 - RNA, 64 nt, Homo Sapiens
ucuccagcacagagcagagcuacacagaggugacccacguuaguccacugagaguucugagucc

SEQ ID NO: 107809 - RNA, 64 nt, Homo Sapiens
ccccuggcuggaaaugcuuucaugcuggugagugccacguuacucaaguuggcaaaacagacau

SEQ ID NO: 107810 - RNA, 64 nt, Homo Sapiens
cuguaaucguuaaguacccauuguauucugauugccacguuaaucacauagcucugggccuuuu

SEQ ID NO: 107811 - RNA, 64 nt, Homo Sapiens
gugugcuugcuaaaugguguacauuucuuguuaaccacguuauuaaaacuugaucagcacauaa

SEQ ID NO: 107812 - RNA, 64 nt, Homo Sapiens
gaggauugacugaguauagagcuuucguugauguccacguuacucugaagaggcuugcagauuu

SEQ ID NO: 107813 - RNA, 64 nt, Homo Sapiens
gcccucaggccuguugaacuacauggccugucgaccacguuauaugucacugacucccggcuau

SEQ ID NO: 107814 - RNA, 64 nt, Homo Sapiens
guagauggggagaaaacacaguugguuuuuuuuuccacguuaucaaccgugacugcaagagcgu

SEQ ID NO: 107815 - RNA, 64 nt, Homo Sapiens
uugacccaucaagaugcuuggcucaauaagaaaaccacguuaggagcaaccuuuguauauugga

SEQ ID NO: 107816 - RNA, 64 nt, Homo Sapiens
ucagcaaugaagacuuugaaagcaggaccuauagccacguuaugauggaaagggcacccagagc

SEQ ID NO: 107817 - RNA, 64 nt, Homo Sapiens
uuuuguauuuuuuuuuaguagagaugggguuucaccacguuagccaggauggucucgaucuccu

SEQ ID NO: 107818 - RNA, 64 nt, Homo Sapiens
uucgcucuuccuccagccucuggcaaccacuaauccacguuauaugucuagauuugccucuucu

SEQ ID NO: 107819 - RNA, 64 nt, Homo Sapiens
uuuuaauuacuauuuuuuuucugaaucacucuccccacguuauuaaguugcaacugaccuugaa

SEQ ID NO: 107820 - RNA, 64 nt, Homo Sapiens
gcauacugaucccuuucccagaucuggaaccuuaccacguuacuguucuagguccuggcuucua

SEQ ID NO: 107821 - RNA, 64 nt, Homo Sapiens
acagaccuguuuguuucuuaucgauuccucagggccacguuaccagcuccgcagaggcgugggc

SEQ ID NO: 107822 - RNA, 64 nt, Homo Sapiens
uauucccuaccgaaggagacgugacagguuaucaccacguuauaagaguggaugcuucugccua

SEQ ID NO: 107823 - RNA, 64 nt, Homo Sapiens
ugaugggauuuucaauuauacugaagcuaguucaccacguuaacugcauuuuacacauugacaa

SEQ ID NO: 107824 - RNA, 64 nt, Homo Sapiens
ucaaauucaguuuuauauagagaaguuguccgucccacguuacaagugccucacaaagaaauua

SEQ ID NO: 107825 - RNA, 64 nt, Homo Sapiens
acauguguaucacuaugucaguuuuaaaguucauccacguuauacuucuuucacuuagcauagu

SEQ ID NO: 107826 - RNA, 64 nt, Homo Sapiens
ggaccuaaaaaucugauuucaaauauuuuaaaagccacguuauauuuuguuccagaauaaaagg

SEQ ID NO: 107827 - RNA, 64 nt, Homo Sapiens
gucauuuacaugauaaucugagccuuuucucuuauuccucuaccuaaaacugauaaccaaugaa

SEQ ID NO: 107828 - RNA, 64 nt, Homo Sapiens
auguguaucuuuuuaugauuuuuuuggcagauaauuccucuagauaucuuugauaauuguuauu

SEQ ID NO: 107829 - RNA, 64 nt, Homo Sapiens
ccccaagucccccacccccauccugcuccagcguuuccucuaacagggaccagcucuccgcuuu

SEQ ID NO: 107830 - RNA, 64 nt, Homo Sapiens
acagggaccagcucuccgcuuugcccccacgggguuccucuaaccagaaccagcuuccuagccu

SEQ ID NO: 107831 - RNA, 64 nt, Homo Sapiens
ugggaaggaaagaguugaguugguuucuuucugauuccucuacucauguagaaaacacuuguac

SEQ ID NO: 107832 - RNA, 64 nt, Homo Sapiens
aauauuucuagguuuguaagugcagcaguuuuauuuccucuagaacucauccuguuucaaggga

SEQ ID NO: 107833 - RNA, 64 nt, Homo Sapiens
guaaauauuuagagguauuucuauucccucuauuuuccucuaagagaggcuguucauugaucca

SEQ ID NO: 107834 - RNA, 64 nt, Homo Sapiens
cuggacuugcuugcaaaggucuugggguuggccguuccucuaaucuauguggcaaaaggucagc

SEQ ID NO: 107835 - RNA, 64 nt, Homo Sapiens
gaaaagcaucagaaaagcuuuuguacuuugugguuuccucuauuuugaauuuuuugaucaaaaa

SEQ ID NO: 107836 - RNA, 64 nt, Homo Sapiens
cacucccuuuuuugucaaccccaucuguagccucuuccucuacucaggcagucgacccgccacg

SEQ ID NO: 107837 - RNA, 64 nt, Homo Sapiens
gugacauucuaagaaaaacuguaccuuagagauuuuccucuagugcucaaacaaauacaaaaua

SEQ ID NO: 107838 - RNA, 64 nt, Homo Sapiens
ucuucguaucauuagaagaaccccagagauagcauuccucuauuuuauuuuacuuucuuuugga

SEQ ID NO: 107839 - RNA, 64 nt, Homo Sapiens
aggcaugcaguccaaggaaugcuguucuuuaaucuuccucuagcgacguuuagccauuuuggcu

SEQ ID NO: 107840 - RNA, 64 nt, Homo Sapiens
aggcaugcaguccaaggaaugcugcucuuuaauuuuccucuagcgacguuuaaccauuuuggcu

SEQ ID NO: 107841 - RNA, 64 nt, Homo Sapiens
auggguaucaaugcuaauauuucccccauaaguuggaggauaaaucccucacuuuuacuuuccc

SEQ ID NO: 107842 - RNA, 64 nt, Homo Sapiens
uuuuggccguguacccucagccaugggccuugugggaggauauccaguggguggugagaggggg

SEQ ID NO: 107843 - RNA, 64 nt, Homo Sapiens
uguaaucccaacacuuuguugggaggccaaagcaggaggauagcuugaggccaggaguuccaga

SEQ ID NO: 107844 - RNA, 64 nt, Homo Sapiens
gccuguguucccagcuacucaggaggcugaagcaggaggauagcuugagcccaggaguuugagg

SEQ ID NO: 107845 - RNA, 64 nt, Homo Sapiens
uguuuagagaugcgagcuggugggaagguuuuguggaggauauguaaggaagggaggauaacuu

SEQ ID NO: 107846 - RNA, 64 nt, Homo Sapiens
uuugggaagguuuuguggagacaauuuaaggaagggaggauaacaagaugagaggauuaguuau

SEQ ID NO: 107847 - RNA, 64 nt, Homo Sapiens
aguuaucccacuggcuugguguguauacauuaggggaggauaaucugaugcuaacuuuuuuuuu

SEQ ID NO: 107848 - RNA, 64 nt, Homo Sapiens
guaagcaauaucuugaguuuguagcuuagaauugggaggauacuuaacaucuggaagacaaguu

SEQ ID NO: 107849 - RNA, 64 nt, Homo Sapiens
gaaccccaugcacugugaccuccccccuucucccccuucccacugugauuggcacaucgacaag

SEQ ID NO: 107850 - RNA, 64 nt, Homo Sapiens
uauuuugggagauagggaaagugaaccgacuuccccuucccauaccccucagggugguucccua

SEQ ID NO: 107851 - RNA, 64 nt, Homo Sapiens
ccugcuaagggcccuucucugcccuuucugcccuccuucccaucccacaugcugagccgccaca

SEQ ID NO: 107852 - RNA, 64 nt, Homo Sapiens
aucccagcaacacagguggcagcuucucccccuuccuucccaccccagucccucuucccacccc

SEQ ID NO: 107853 - RNA, 64 nt, Homo Sapiens
ccuuuuuuuccccugaauacugcccaaagcauccccuucccaucugccucucaggaguugggga

SEQ ID NO: 107854 - RNA, 64 nt, Homo Sapiens
guucuagcccugagugacagucuuaaggcuagauccuucccauaguaucaucuguccucuggaa

SEQ ID NO: 107855 - RNA, 64 nt, Homo Sapiens
cgcccuuucacuuaguucagugccaguccuuuugccuucccaacccugcuguuaggccugcugu

SEQ ID NO: 107856 - RNA, 64 nt, Homo Sapiens
gucccccgggugcuccccuggcuuuugggggcugccuucccagaccuaugauugaaguccuccu

SEQ ID NO: 107857 - RNA, 64 nt, Homo Sapiens
gaaggugccuuggggugcaggucuuguacugggaccuucccagggaccuggaaggcguuucuga

SEQ ID NO: 107858 - RNA, 64 nt, Homo Sapiens
uguccuugggccacaccaucgaacccugucugccccuucccaccgcuacaaagaggucuccugg

SEQ ID NO: 107859 - RNA, 64 nt, Homo Sapiens
ccaagaggcuggaacauagucugacuggcugcagccuucccacgaccccagucaggagcaauga

SEQ ID NO: 107860 - RNA, 64 nt, Homo Sapiens
cugggcuucgaaggcgacccgcccaccauccugcccuucccagaaccugagaccgucugggggg

SEQ ID NO: 107861 - RNA, 64 nt, Homo Sapiens
auuuuguuccccucccgcuggcccgggggccccaccuucccacggguucccacgcugcugugac

SEQ ID NO: 107862 - RNA, 64 nt, Homo Sapiens
aagcgcccucaccccagccccacucacccacccuccuucccaccagccugcucuccgcaggccc

SEQ ID NO: 107863 - RNA, 64 nt, Homo Sapiens
uaaugacgucucuucucuguggaacuucacgauuccuucccacggucaacucgggaccucccag

SEQ ID NO: 107864 - RNA, 63 nt, Homo Sapiens
uaauaggguuacuuggaugagccaacuccgcuuccuucccauggauaggaagggacucugugu

SEQ ID NO: 107865 - RNA, 64 nt, Homo Sapiens
cugucaaaagaugagugaucuugugugggaaaagccuucccaggcgucuguaccgaaaggagca

SEQ ID NO: 107866 - RNA, 64 nt, Homo Sapiens
uuucccccacucccuuggagaguuuccuuccaacccuucccaccuccuggccuggagaacauuc

SEQ ID NO: 107867 - RNA, 64 nt, Homo Sapiens
ugcccccuggggaguucuggucaagaacuccuagccuucccaaaugacuuuaaaagcagcagca

SEQ ID NO: 107868 - RNA, 64 nt, Homo Sapiens
gcagguugcugagccaguggcugccccgugcccuccuucccagcacuaucaugugucacguuuc

SEQ ID NO: 107869 - RNA, 64 nt, Homo Sapiens
gcuucugaacaggaucccaugccaguguggaacaccuucccaaucuuaguucagaaguggcuug

SEQ ID NO: 107870 - RNA, 64 nt, Homo Sapiens
agcaugucccucguggcucagugucaggccuugcccuucccacccaaagugugccuugugucuu

SEQ ID NO: 107871 - RNA, 64 nt, Homo Sapiens
ucgcaggugucagaaccuagugggugguuaagguccuucccacugggugagcaccuggggcagg

SEQ ID NO: 107872 - RNA, 64 nt, Homo Sapiens
aggucacacagcuaucugcaugucccacaacuccccuucccagccccagccaaacugagccacu

SEQ ID NO: 107873 - RNA, 64 nt, Homo Sapiens
gcaguguuccccuuuagagagggugugugcugucccuucccacagucccuggcaggcggcugga

SEQ ID NO: 107874 - RNA, 64 nt, Homo Sapiens
agaaaacagccagcaggaggagcuucaucuguucccuucccaccuccaaccuagcccuacugcc

SEQ ID NO: 107875 - RNA, 64 nt, Homo Sapiens
aaaauugcccuggggggugcugggugugcugucuccuucccacauccucagccccacaccagcu

SEQ ID NO: 107876 - RNA, 64 nt, Homo Sapiens
uccuuccaggaccuccauugccuuuuucugggucccuucccacucaccucacacccuucacucu

SEQ ID NO: 107877 - RNA, 64 nt, Homo Sapiens
ucacacccuucacucuccuugucuccucauccauccuucccaccauuaaacacuguuccgagug

SEQ ID NO: 107878 - RNA, 64 nt, Homo Sapiens
uggacagugguguguguagagcagcaguggcugcccuucccaccuuccuugggugaaugcagga

SEQ ID NO: 107879 - RNA, 64 nt, Homo Sapiens
aacaaaccauuucugugcacaagcaccuugucucccuucccaagcuuggcaaguuaaauguccc

SEQ ID NO: 107880 - RNA, 64 nt, Homo Sapiens
uucccagcaggggcuucaugcaacacugggugccccuucccaguuccugacuuccucuucugcc

SEQ ID NO: 107881 - RNA, 64 nt, Homo Sapiens
uguuguacagcccggucucccugcgcgcucugcuccuucccaugugcagacagaucagggagga

SEQ ID NO: 107882 - RNA, 64 nt, Homo Sapiens
cauuuccuccaguccugggccccauccuugagggccuucccagccagccagcaggagaggcaag

SEQ ID NO: 107883 - RNA, 64 nt, Homo Sapiens
cugccccaugcccagcagcaacagcaggcucagcccuucccaccuggauucaccuuacgccccu

SEQ ID NO: 107884 - RNA, 64 nt, Homo Sapiens
ucugaggacgggcugcagagccgugccuaggaucccuucccagcucucagaugaagcugaggag

SEQ ID NO: 107885 - RNA, 64 nt, Homo Sapiens
gagaggaaacaucuguuuuauagauuuagcauggccuucccaucaaaaauacacucguaccaug

SEQ ID NO: 107886 - RNA, 64 nt, Homo Sapiens
cccuucccggccucuaaaguuuggucccagcagcccuucccagccucuaaaguuuggucuggua

SEQ ID NO: 107887 - RNA, 64 nt, Homo Sapiens
uccguauuaaacgcauuugcauuuugagaaguguccuucccacuucagcccuccggagagacua

SEQ ID NO: 107888 - RNA, 64 nt, Homo Sapiens
cugcucuaggaaacaguuuaagaaaucauuggccccuucccagcacauugaauggguaagcaga

SEQ ID NO: 107889 - RNA, 64 nt, Homo Sapiens
gccccuccauccaaaacugccaagugacucauugccuucccaacccuuccagaggcuuucugug

SEQ ID NO: 107890 - RNA, 64 nt, Homo Sapiens
gugaggguagggagaggacaaggggucaccgagcccuucccagagagcagggagcuuauaaaug

SEQ ID NO: 107891 - RNA, 64 nt, Homo Sapiens
caucugaccauuucuucucccugucuccuguuccccuucccaguuaaacagguuagauugaagg

SEQ ID NO: 107892 - RNA, 64 nt, Homo Sapiens
uuuucugugacccuuucgcuuuugcauucacccuccuucccaccuaccuguccuggggcuguug

SEQ ID NO: 107893 - RNA, 64 nt, Homo Sapiens
auggcgagcagccuauggcccagggccuguaaucccuucccaagacuagcugcucaggguggug

SEQ ID NO: 107894 - RNA, 64 nt, Homo Sapiens
gcuucuuuuaaaucucugucuucucuaaccucccccuucccauuucaaugcucccuuccuaauu

SEQ ID NO: 107895 - RNA, 64 nt, Homo Sapiens
acccugcaacauccugagaccaaagaccuugugcccuucccaggagccgcggaggaggacagug

SEQ ID NO: 107896 - RNA, 64 nt, Homo Sapiens
caguaaacacgugauguggagugcaagcuccuccccuucccacuagaacauacuuuaacagaaa

SEQ ID NO: 107897 - RNA, 64 nt, Homo Sapiens
ucauaucugcuuggggaagccaauggggcacaauccuucccaauuucaugaucuggggcaucau

SEQ ID NO: 107898 - RNA, 64 nt, Homo Sapiens
acccuuuuacaugcuugggugcagguagaugaggccuucccauggcuacagugugacccuugga

SEQ ID NO: 107899 - RNA, 64 nt, Homo Sapiens
aaucagugucuagggacuaguaauucucuuacauccuucccaaaaaacccuaaaucugagucag

SEQ ID NO: 107900 - RNA, 64 nt, Homo Sapiens
aaucagugucuagggacuggaauucucuaaaaauccuucccaaaagcccuaaaucugagucagu

SEQ ID NO: 107901 - RNA, 64 nt, Homo Sapiens
ucgugcauuaaaauuucuuauuuacccuuuucccccuucccauuucuucccacuuucaucuacc

SEQ ID NO: 107902 - RNA, 64 nt, Homo Sapiens
cuaaacauucaauuccagagaaccaaaaaucccaccuucccaccgaacacuacuaaggggcuug

SEQ ID NO: 107903 - RNA, 64 nt, Homo Sapiens
agccccuuuggagcuuuucucuuguccucucacuccuucccagaaguuuuugcacagaacuuca

SEQ ID NO: 107904 - RNA, 64 nt, Homo Sapiens
cauucuccauaccucccccaagcucuccuccagcccuucccagggcucagcccugcuguccuga

SEQ ID NO: 107905 - RNA, 64 nt, Homo Sapiens
cugccaacuucuaaccgcaacaccugguccucccccuucccauguuaacaacauccccauuccc

SEQ ID NO: 107906 - RNA, 64 nt, Homo Sapiens
cugcuuuugaucuuuugauucuugacgguucuggccuucccaaauuuuccuucucccuccaucc

SEQ ID NO: 107907 - RNA, 64 nt, Homo Sapiens
cagcacugcuucacacaggcacggaaaggggauaccuucccacugccuggagaggacugagccu

SEQ ID NO: 107908 - RNA, 64 nt, Homo Sapiens
uccccucuccccucucccguucuccagagcuggcccuucccaucgcagagcccaggaggcagca

SEQ ID NO: 107909 - RNA, 64 nt, Homo Sapiens
cuucuuucucuuuuuuuuaccuccccuucccuccccuucccaucuucuucuuuccuccgcuccc

SEQ ID NO: 107910 - RNA, 64 nt, Homo Sapiens
aacugccuagggcuuugagucugcuacucccaguccuucccagagaacaaggggugccaggaga

SEQ ID NO: 107911 - RNA, 64 nt, Homo Sapiens
ugcugcgugagcagacaccuaagccucaggccaaccuucccaacuaaaccguucuggguuuuga

SEQ ID NO: 107912 - RNA, 64 nt, Homo Sapiens
accuccucaucagggccugcacauagccccuugaccuucccaucuuuagaggcaguugccccac

SEQ ID NO: 107913 - RNA, 64 nt, Homo Sapiens
ccaguuggagacugucuggccccccugguccccuccuucccaagugagucucucugggccuuag

SEQ ID NO: 107914 - RNA, 64 nt, Homo Sapiens
gccguggcccuugaguccccauugaggcuugguuccuucccaauccaguggacuucgcagucca

SEQ ID NO: 107915 - RNA, 64 nt, Homo Sapiens
ucagcccugaggacagaugccuccuuccucuuuuccuucccaaagcaagcaagaggccguggcu

SEQ ID NO: 107916 - RNA, 64 nt, Homo Sapiens
cccugugaugugucucgacaccaauacacaacccccuucccaccauccuucaugucacuagaua

SEQ ID NO: 107917 - RNA, 64 nt, Homo Sapiens
cccaccauccuucaugucacuagauacacaacccccuucccaccaucccuucagucacuagugg

SEQ ID NO: 107918 - RNA, 64 nt, Homo Sapiens
cugacccggcagaacccaccagacacuucuccugccuucccaccgcuucuucccguccugccac

SEQ ID NO: 107919 - RNA, 64 nt, Homo Sapiens
uucuccccugggagacuccccagagugaguccauccuucccagggagcggaacagcccauccag

SEQ ID NO: 107920 - RNA, 64 nt, Homo Sapiens
aaugugccccucaccccuuggggaguugugagcgccuucccaacgggcccagcuuccaccggca

SEQ ID NO: 107921 - RNA, 64 nt, Homo Sapiens
cucugaaaugggacccugugcacccgcagacccuccuucccaucugcugccuggccaagcccca

SEQ ID NO: 107922 - RNA, 64 nt, Homo Sapiens
acaaaaacaagacugccuccucuccacccaaaccccuucccacgugaugugccuguaaucuuuu

SEQ ID NO: 107923 - RNA, 64 nt, Homo Sapiens
gggcuguguugacugcugcugcugcuugugccucccuucccagucagcacugggaagcuggagu

SEQ ID NO: 107924 - RNA, 64 nt, Homo Sapiens
gaggaccccagcuccucagcuugcauggacucugccuucccagcgcuugucccccgaggaaggc

SEQ ID NO: 107925 - RNA, 64 nt, Homo Sapiens
ggucggggacccucagcagcaggggcucugucucccuucccaaagggcgagaaccacauuggac

SEQ ID NO: 107926 - RNA, 64 nt, Homo Sapiens
gagcugagcacugcccccucacccccccaccaccccuucccauuucaucgguggggacguggag

SEQ ID NO: 107927 - RNA, 64 nt, Homo Sapiens
ggcugugaccauugggugugcgugagcaugugccccuucccagggcccuguuucuuugugucau

SEQ ID NO: 107928 - RNA, 64 nt, Homo Sapiens
ccagcccucccuggggccugggccuggguagcugccuucccagcgggagauuccuuuuccagca

SEQ ID NO: 107929 - RNA, 64 nt, Homo Sapiens
cuguccaacuucucccccuuagcagaccacucucccuucccaaaaggaaagauugagguggcag

SEQ ID NO: 107930 - RNA, 64 nt, Homo Sapiens
gccacuccccuuacacccucauucaggggagaggccuucccagggcuuucccaagaaggccugg

SEQ ID NO: 107931 - RNA, 64 nt, Homo Sapiens
gcugcuuucccaagaaggccgccuugugcgugggccuucccauuccucgcccucaagaacaagg

SEQ ID NO: 107932 - RNA, 64 nt, Homo Sapiens
cagcugcugacagcccuggaugugauccggagucccuucccaccaggggcugaccucccagcug

SEQ ID NO: 107933 - RNA, 64 nt, Homo Sapiens
cucuuugucuuggggaccaggaugcucccccaguccuucccagaugauggcugccugugggacc

SEQ ID NO: 107934 - RNA, 64 nt, Homo Sapiens
aguacacuaaaccuaggucuggucaccaauaggguuuggagagcaaagggccacaacucaucag

SEQ ID NO: 107935 - RNA, 64 nt, Homo Sapiens
aaaguccauuuuccuucuucuuuuuuuuuuuuuuuuuggagacagcaucucacccuguccuggc

SEQ ID NO: 107936 - RNA, 64 nt, Homo Sapiens
cuucacuuugggcuuucugauguuuauucacaccuuuggagaguugcaacuugccacauacgaa

SEQ ID NO: 107937 - RNA, 64 nt, Homo Sapiens
uagacuuaguaccagaaccaaaaauaccuagauuuuuggagaacuuauuacauacauagaaaca

SEQ ID NO: 107938 - RNA, 64 nt, Homo Sapiens
gacugagccuugcuucucacuggcaguguugagcuuuggagaugggaugguugcuaugccaagc

SEQ ID NO: 107939 - RNA, 64 nt, Homo Sapiens
ucaaaaacauaauacuuuuaugcugaugaugguauuuggagaugugaaagccaaaagccccugg

SEQ ID NO: 107940 - RNA, 64 nt, Homo Sapiens
gggaaugugaaagcugucauuuggauccuuuggguuuggagaaauuuucuuggacuacuuuaau

SEQ ID NO: 107941 - RNA, 64 nt, Homo Sapiens
aagauggaugcuuauugaaguuuacucucuucuauuuggagaauauacaagccuuggguccaug

SEQ ID NO: 107942 - RNA, 64 nt, Homo Sapiens
cagaaauguaaaaguguaucugauuauuuauuuguuuggagagaaguaaugcaccuucucuugc

SEQ ID NO: 107943 - RNA, 64 nt, Homo Sapiens
gggaugcucucauccccucuauuuggauucucgcuuuggagagguuauuauuauauuuuuuuua

SEQ ID NO: 107944 - RNA, 64 nt, Homo Sapiens
guaucugaaucacuggggauuaugauucacccucuuuggagaacaugcucucuuuucacccccc

SEQ ID NO: 107945 - RNA, 64 nt, Homo Sapiens
ugcuuauauuuaucgcuuggcucaaguucugcccuuuggagaaauacugagcaagucuuucauu

SEQ ID NO: 107946 - RNA, 64 nt, Homo Sapiens
acaaguuggaugacacuacucccaacuuuuuaaauuuggagaaaaccaucaaggucgaggaagc

SEQ ID NO: 107947 - RNA, 64 nt, Homo Sapiens
cugcauuauaaguauaaagggaaccgagauuuaauuuggagaucaucacuguuaaaacgauacc

SEQ ID NO: 107948 - RNA, 64 nt, Homo Sapiens
ugacugugaaauuccuaacuacucugccaugaaauuuggagacaagucuuauauuguuuuuuaa

SEQ ID NO: 107949 - RNA, 64 nt, Homo Sapiens
ugaacucacaaacugauguuuuuaaaggaaaggauuuggagaauagaugaaauaaacuuauuac

SEQ ID NO: 107950 - RNA, 64 nt, Homo Sapiens
uugacucaaauauauacuugagaguaauuuaugcuuuggagaaugggcccuaaccuaaaaucgg

SEQ ID NO: 107951 - RNA, 64 nt, Homo Sapiens
gaaaaagacaaaagguccagaaugacaaagucaguuuggagacaauguuuacagcaguuucaaa

SEQ ID NO: 107952 - RNA, 64 nt, Homo Sapiens
auuuucuguaaugcugggaaaaguaaugcauguguuuggagauuaacauccuucccugaguaga

SEQ ID NO: 107953 - RNA, 64 nt, Homo Sapiens
ugaagcaaaggugaaugacaaauuaggagcuuguuuuggagaaagcagucucuucagguagcua

SEQ ID NO: 107954 - RNA, 64 nt, Homo Sapiens
augaugugaaaauuggaccucugcuauuuuacuauuuggagaaucuuuucaucaacauguagag

SEQ ID NO: 107955 - RNA, 64 nt, Homo Sapiens
guuugaaugugaccaaauguauuagugaaguguuuuuggagacugucaagaaggaaacauguau

SEQ ID NO: 107956 - RNA, 64 nt, Homo Sapiens
uguucucucuggacucuugccuagcucacaaggcuuuggagaauugucuuccuaaaucggggca

SEQ ID NO: 107957 - RNA, 64 nt, Homo Sapiens
aauuuaaaauacauagguagggcuacugaggaaauuuggagagccacauucugugguuucucau

SEQ ID NO: 107958 - RNA, 64 nt, Homo Sapiens
caggaaacagacuaaaaagaauuccaccaggcuguuuggagauccucaucuuggagcuuuuuca

SEQ ID NO: 107959 - RNA, 64 nt, Homo Sapiens
uucuggugggacaauggguggugaauucugaaguuuuggagagggaaguggagcagccagcaag

SEQ ID NO: 107960 - RNA, 64 nt, Homo Sapiens
uaaagcgcaucuucuccacaugggcuucacgugguuuggagaugggugggggaaaacaaucagg

SEQ ID NO: 107961 - RNA, 64 nt, Homo Sapiens
uuggacaggacccagcccugcaccguucacuguauuuggagaaaaugguaagaguuccauaccg

SEQ ID NO: 107962 - RNA, 64 nt, Homo Sapiens
ggaagggcccccauggcccuagugauuuuauuguuuuggagaauccuuuuagauaggaucuagg

SEQ ID NO: 107963 - RNA, 64 nt, Homo Sapiens
ggcauugccuuuuagauaggacuuuccuuguacauuuggagagucaaggcagaggcucugaagc

SEQ ID NO: 107964 - RNA, 64 nt, Homo Sapiens
cagaugacauuauaccugauaaaaagaacaguuuuuuggagaggugaccauaagaacuguggcc

SEQ ID NO: 107965 - RNA, 64 nt, Homo Sapiens
guuugugcccuguguuuuauaacuauuuucuauauuuggagaaaaaaaugaauugaaccauuuc

SEQ ID NO: 107966 - RNA, 64 nt, Homo Sapiens
aggccauuccugggugagcccuugggcaggcauguuuggagaugagagaggcuucgagagggug

SEQ ID NO: 107967 - RNA, 64 nt, Homo Sapiens
caguguggugaugccaugcccaucaugggaggcuuuuggagaaacagaauguuugggcaggggc

SEQ ID NO: 107968 - RNA, 64 nt, Homo Sapiens
agccucaccuucucccauccugggggggaccugcuuuggagaucuacuuugauagagugugggg

SEQ ID NO: 107969 - RNA, 64 nt, Homo Sapiens
cuggauggccuuaggguuccgggugcagccagcuuuuggagaacggcggccuggccuagaccag

SEQ ID NO: 107970 - RNA, 64 nt, Homo Sapiens
caagacuguggaauggggaauaaggaaggaggaguuuggagaaugacuccaaagguuugagcuu

SEQ ID NO: 107971 - RNA, 64 nt, Homo Sapiens
uugaucaagacugggaauauaagagagaagcagguuuggagagaucaauuuugaacauuuuaga

SEQ ID NO: 107972 - RNA, 64 nt, Homo Sapiens
ggguuuuguccauuauuaauaaguguaauuagcuuuuggagaguuuggagagugggcugacauc

SEQ ID NO: 107973 - RNA, 64 nt, Homo Sapiens
gggcugacaucaaguguaauaaguguaauuagcuuuuggagaguaaucuguuaccucugacauc

SEQ ID NO: 107974 - RNA, 64 nt, Homo Sapiens; identical to SEQ ID NO: 53771

SEQ ID NO: 107975 - RNA, 64 nt, Homo Sapiens; identical to SEQ ID NO: 53772

SEQ ID NO: 107976 - RNA, 64 nt, Homo Sapiens; identical to SEQ ID NO: 53773

SEQ ID NO: 107977 - RNA, 64 nt, Homo Sapiens; identical to SEQ ID NO: 53774

SEQ ID NO: 107978 - RNA, 64 nt, Homo Sapiens; identical to SEQ ID NO: 53775

SEQ ID NO: 107979 - RNA, 64 nt, Homo Sapiens; identical to SEQ ID NO: 53776

SEQ ID NO: 107980 - RNA, 64 nt, Homo Sapiens; identical to SEQ ID NO: 53777

SEQ ID NO: 107981 - RNA, 64 nt, Homo Sapiens; identical to SEQ ID NO: 53778

SEQ ID NO: 107982 - RNA, 64 nt, Homo Sapiens; identical to SEQ ID NO: 53779

SEQ ID NO: 107983 - RNA, 64 nt, Homo Sapiens; identical to SEQ ID NO: 53780

SEQ ID NO: 107984 - RNA, 64 nt, Homo Sapiens; identical to SEQ ID NO: 53781

SEQ ID NO: 107985 - RNA, 64 nt, Homo Sapiens; identical to SEQ ID NO: 53782

SEQ ID NO: 107986 - RNA, 64 nt, Homo Sapiens; identical to SEQ ID NO: 53783

SEQ ID NO: 107987 - RNA, 64 nt, Homo Sapiens; identical to SEQ ID NO: 53784

SEQ ID NO: 107988 - RNA, 64 nt, Homo Sapiens; identical to SEQ ID NO: 53785

SEQ ID NO: 107989 - RNA, 64 nt, Homo Sapiens; identical to SEQ ID NO: 53786

SEQ ID NO: 107990 - RNA, 64 nt, Homo Sapiens; identical to SEQ ID NO: 53787

SEQ ID NO: 107991 - RNA, 64 nt, Homo Sapiens; identical to SEQ ID NO: 53788

SEQ ID NO: 107992 - RNA, 64 nt, Homo Sapiens; identical to SEQ ID NO: 53789

SEQ ID NO: 107993 - RNA, 64 nt, Homo Sapiens; identical to SEQ ID NO: 53790

SEQ ID NO: 107994 - RNA, 64 nt, Homo Sapiens; identical to SEQ ID NO: 53791

SEQ ID NO: 107995 - RNA, 64 nt, Homo Sapiens; identical to SEQ ID NO: 53792

SEQ ID NO: 107996 - RNA, 64 nt, Homo Sapiens; identical to SEQ ID NO: 53793

SEQ ID NO: 107997 - RNA, 64 nt, Homo Sapiens; identical to SEQ ID NO: 53794

SEQ ID NO: 107998 - RNA, 64 nt, Homo Sapiens; identical to SEQ ID NO: 53795

SEQ ID NO: 107999 - RNA, 64 nt, Homo Sapiens; identical to SEQ ID NO: 53796

SEQ ID NO: 108000 - RNA, 64 nt, Homo Sapiens; identical to SEQ ID NO: 53797

SEQ ID NO: 108001 - RNA, 64 nt, Homo Sapiens; identical to SEQ ID NO: 53798

SEQ ID NO: 108002 - RNA, 64 nt, Homo Sapiens; identical to SEQ ID NO: 53799

SEQ ID NO: 108003 - RNA, 64 nt, Homo Sapiens; identical to SEQ ID NO: 53800

SEQ ID NO: 108004 - RNA, 64 nt, Homo Sapiens; identical to SEQ ID NO: 53801

SEQ ID NO: 108005 - RNA, 64 nt, Homo Sapiens; identical to SEQ ID NO: 53802

SEQ ID NO: 108006 - RNA, 64 nt, Homo Sapiens; identical to SEQ ID NO: 53803

SEQ ID NO: 108007 - RNA, 64 nt, Homo Sapiens; identical to SEQ ID NO: 53804

SEQ ID NO: 108008 - RNA, 64 nt, Homo Sapiens; identical to SEQ ID NO: 53805

SEQ ID NO: 108009 - RNA, 64 nt, Homo Sapiens; identical to SEQ ID NO: 53806

SEQ ID NO: 108010 - RNA, 64 nt, Homo Sapiens; identical to SEQ ID NO: 53807

SEQ ID NO: 108011 - RNA, 64 nt, Homo Sapiens; identical to SEQ ID NO: 53808

SEQ ID NO: 108012 - RNA, 64 nt, Homo Sapiens; identical to SEQ ID NO: 53809

SEQ ID NO: 108013 - RNA, 64 nt, Homo Sapiens; identical to SEQ ID NO: 53810

SEQ ID NO: 108014 - RNA, 64 nt, Homo Sapiens; identical to SEQ ID NO: 53811

SEQ ID NO: 108015 - RNA, 64 nt, Homo Sapiens; identical to SEQ ID NO: 53812

SEQ ID NO: 108016 - RNA, 64 nt, Homo Sapiens; identical to SEQ ID NO: 53813

SEQ ID NO: 108017 - RNA, 64 nt, Homo Sapiens; identical to SEQ ID NO: 53814

SEQ ID NO: 108018 - RNA, 64 nt, Homo Sapiens; identical to SEQ ID NO: 53815

SEQ ID NO: 108019 - RNA, 64 nt, Homo Sapiens
gauccugaauggaggaaggauauguccucauuccauagagcauuagaagcugccaccagcccag

SEQ ID NO: 108020 - RNA, 64 nt, Homo Sapiens
ugcugucagccacagcuuccugccguagagaaugauagagcagcugcucacacaggaggccgga

SEQ ID NO: 108021 - RNA, 58 nt, Homo Sapiens
aauaccuuuccaauuaacacugagaaauuaagguuaagauucuccuuuuguacuggga

SEQ ID NO: 108022 - RNA, 58 nt, Homo Sapiens
aauauuuuuaucggcucuagaaaaugcauaagguuaguacaagaucaguagagagaaa

SEQ ID NO: 108023 - RNA, 58 nt, Homo Sapiens
uacuauugauucuuucuaggcuuuaauauaagguuaucauagaaaacuaauauacucc

SEQ ID NO: 108024 - RNA, 58 nt, Homo Sapiens
uuauuuucuuuuucugcuugucucaaaauaagguuauaccuuugagaugaagucgugu

SEQ ID NO: 108025 - RNA, 58 nt, Homo Sapiens
ugaauguucuguuuucucuuugaaaaacuaagguuauucaacuccuugauuguaaaac

SEQ ID NO: 108026 - RNA, 58 nt, Homo Sapiens
ugcauggccauguguuuguagcagaaaguaagguuauguauauucuuuguugcaagug

SEQ ID NO: 108027 - RNA, 58 nt, Homo Sapiens
acuauagacuuuuaccaauggguagcuauaagguuacagcuuauuuuguaacuauuuu

SEQ ID NO: 108028 - RNA, 58 nt, Homo Sapiens
uuagaaaaaaguaaacuugccauuugguuaagguuaccugcuuuuuauuuuauuccag

SEQ ID NO: 108029 - RNA, 64 nt, Homo Sapiens; identical to SEQ ID NO: 21372

SEQ ID NO: 108030 - RNA, 64 nt, Homo Sapiens; identical to SEQ ID NO: 21373

SEQ ID NO: 108031 - RNA, 64 nt, Homo Sapiens; identical to SEQ ID NO: 21374

SEQ ID NO: 108032 - RNA, 64 nt, Homo Sapiens; identical to SEQ ID NO: 21375

SEQ ID NO: 108033 - RNA, 64 nt, Homo Sapiens; identical to SEQ ID NO: 21376

SEQ ID NO: 108034 - RNA, 64 nt, Homo Sapiens; identical to SEQ ID NO: 21377

SEQ ID NO: 108035 - RNA, 64 nt, Homo Sapiens; identical to SEQ ID NO: 21378

SEQ ID NO: 108036 - RNA, 64 nt, Homo Sapiens; identical to SEQ ID NO: 21379

SEQ ID NO: 108037 - RNA, 64 nt, Homo Sapiens; identical to SEQ ID NO: 21380

SEQ ID NO: 108038 - RNA, 64 nt, Homo Sapiens; identical to SEQ ID NO: 21381

SEQ ID NO: 108039 - RNA, 64 nt, Homo Sapiens; identical to SEQ ID NO: 21382

SEQ ID NO: 108040 - RNA, 64 nt, Homo Sapiens; identical to SEQ ID NO: 21383

SEQ ID NO: 108041 - RNA, 64 nt, Homo Sapiens; identical to SEQ ID NO: 21384

SEQ ID NO: 108042 - RNA, 64 nt, Homo Sapiens; identical to SEQ ID NO: 21385

SEQ ID NO: 108043 - RNA, 64 nt, Homo Sapiens; identical to SEQ ID NO: 21386

SEQ ID NO: 108044 - RNA, 64 nt, Homo Sapiens; identical to SEQ ID NO: 21387

SEQ ID NO: 108045 - RNA, 64 nt, Homo Sapiens; identical to SEQ ID NO: 21388

SEQ ID NO: 108046 - RNA, 64 nt, Homo Sapiens; identical to SEQ ID NO: 21389

SEQ ID NO: 108047 - RNA, 64 nt, Homo Sapiens; identical to SEQ ID NO: 21390

SEQ ID NO: 108048 - RNA, 64 nt, Homo Sapiens; identical to SEQ ID NO: 21391

SEQ ID NO: 108049 - RNA, 64 nt, Homo Sapiens; identical to SEQ ID NO: 21392

SEQ ID NO: 108050 - RNA, 64 nt, Homo Sapiens; identical to SEQ ID NO: 21393

SEQ ID NO: 108051 - RNA, 51 nt, Homo Sapiens; identical to SEQ ID NO: 21394

SEQ ID NO: 108052 - RNA, 64 nt, Homo Sapiens; identical to SEQ ID NO: 21395

SEQ ID NO: 108053 - RNA, 64 nt, Homo Sapiens; identical to SEQ ID NO: 21396

SEQ ID NO: 108054 - RNA, 64 nt, Homo Sapiens; identical to SEQ ID NO: 21397

SEQ ID NO: 108055 - RNA, 56 nt, Homo Sapiens; identical to SEQ ID NO: 21398

SEQ ID NO: 108056 - RNA, 64 nt, Homo Sapiens; identical to SEQ ID NO: 21399

SEQ ID NO: 108057 - RNA, 64 nt, Homo Sapiens; identical to SEQ ID NO: 21400

SEQ ID NO: 108058 - RNA, 64 nt, Homo Sapiens; identical to SEQ ID NO: 21401

SEQ ID NO: 108059 - RNA, 64 nt, Homo Sapiens; identical to SEQ ID NO: 21402

SEQ ID NO: 108060 - RNA, 64 nt, Homo Sapiens; identical to SEQ ID NO: 21403

SEQ ID NO: 108061 - RNA, 64 nt, Homo Sapiens; identical to SEQ ID NO: 21404

SEQ ID NO: 108062 - RNA, 64 nt, Homo Sapiens; identical to SEQ ID NO: 21405

SEQ ID NO: 108063 - RNA, 64 nt, Homo Sapiens; identical to SEQ ID NO: 21406

SEQ ID NO: 108064 - RNA, 64 nt, Homo Sapiens; identical to SEQ ID NO: 21407

SEQ ID NO: 108065 - RNA, 64 nt, Homo Sapiens; identical to SEQ ID NO: 21408

SEQ ID NO: 108066 - RNA, 64 nt, Homo Sapiens; identical to SEQ ID NO: 21409

SEQ ID NO: 108067 - RNA, 64 nt, Homo Sapiens; identical to SEQ ID NO: 21410

SEQ ID NO: 108068 - RNA, 64 nt, Homo Sapiens; identical to SEQ ID NO: 21411

SEQ ID NO: 108069 - RNA, 64 nt, Homo Sapiens; identical to SEQ ID NO: 21412

SEQ ID NO: 108070 - RNA, 64 nt, Homo Sapiens; identical to SEQ ID NO: 21413

SEQ ID NO: 108071 - RNA, 64 nt, Homo Sapiens; identical to SEQ ID NO: 21414

SEQ ID NO: 108072 - RNA, 64 nt, Homo Sapiens; identical to SEQ ID NO: 21415

SEQ ID NO: 108073 - RNA, 64 nt, Homo Sapiens; identical to SEQ ID NO: 21416

SEQ ID NO: 108074 - RNA, 64 nt, Homo Sapiens; identical to SEQ ID NO: 21417

SEQ ID NO: 108075 - RNA, 64 nt, Homo Sapiens; identical to SEQ ID NO: 21418

SEQ ID NO: 108076 - RNA, 64 nt, Homo Sapiens; identical to SEQ ID NO: 21419

SEQ ID NO: 108077 - RNA, 64 nt, Homo Sapiens; identical to SEQ ID NO: 21420

SEQ ID NO: 108078 - RNA, 64 nt, Homo Sapiens; identical to SEQ ID NO: 21421

SEQ ID NO: 108079 - RNA, 64 nt, Homo Sapiens; identical to SEQ ID NO: 21422

SEQ ID NO: 108080 - RNA, 64 nt, Homo Sapiens; identical to SEQ ID NO: 21423

SEQ ID NO: 108081 - RNA, 64 nt, Homo Sapiens; identical to SEQ ID NO: 21424

SEQ ID NO: 108082 - RNA, 64 nt, Homo Sapiens; identical to SEQ ID NO: 21425

SEQ ID NO: 108083 - RNA, 64 nt, Homo Sapiens; identical to SEQ ID NO: 21426

SEQ ID NO: 108084 - RNA, 64 nt, Homo Sapiens; identical to SEQ ID NO: 21427

SEQ ID NO: 108085 - RNA, 64 nt, Homo Sapiens; identical to SEQ ID NO: 21428

SEQ ID NO: 108086 - RNA, 64 nt, Homo Sapiens; identical to SEQ ID NO: 21429

SEQ ID NO: 108087 - RNA, 64 nt, Homo Sapiens; identical to SEQ ID NO: 21430

SEQ ID NO: 108088 - RNA, 64 nt, Homo Sapiens; identical to SEQ ID NO: 21431

SEQ ID NO: 108089 - RNA, 64 nt, Homo Sapiens; identical to SEQ ID NO: 21432

SEQ ID NO: 108090 - RNA, 64 nt, Homo Sapiens; identical to SEQ ID NO: 21433

SEQ ID NO: 108091 - RNA, 64 nt, Homo Sapiens; identical to SEQ ID NO: 21434

SEQ ID NO: 108092 - RNA, 64 nt, Homo Sapiens; identical to SEQ ID NO: 21435

SEQ ID NO: 108093 - RNA, 64 nt, Homo Sapiens; identical to SEQ ID NO: 21436

SEQ ID NO: 108094 - RNA, 64 nt, Homo Sapiens; identical to SEQ ID NO: 21437

SEQ ID NO: 108095 - RNA, 64 nt, Homo Sapiens; identical to SEQ ID NO: 21438

SEQ ID NO: 108096 - RNA, 64 nt, Homo Sapiens; identical to SEQ ID NO: 21439

SEQ ID NO: 108097 - RNA, 64 nt, Homo Sapiens; identical to SEQ ID NO: 21440

SEQ ID NO: 108098 - RNA, 64 nt, Homo Sapiens; identical to SEQ ID NO: 21441

SEQ ID NO: 108099 - RNA, 64 nt, Homo Sapiens; identical to SEQ ID NO: 21442

SEQ ID NO: 108100 - RNA, 64 nt, Homo Sapiens; identical to SEQ ID NO: 21443

SEQ ID NO: 108101 - RNA, 64 nt, Homo Sapiens; identical to SEQ ID NO: 21444

SEQ ID NO: 108102 - RNA, 64 nt, Homo Sapiens; identical to SEQ ID NO: 21445

SEQ ID NO: 108103 - RNA, 64 nt, Homo Sapiens; identical to SEQ ID NO: 21446

SEQ ID NO: 108104 - RNA, 64 nt, Homo Sapiens; identical to SEQ ID NO: 21447

SEQ ID NO: 108105 - RNA, 64 nt, Homo Sapiens; identical to SEQ ID NO: 21448

SEQ ID NO: 108106 - RNA, 64 nt, Homo Sapiens; identical to SEQ ID NO: 21449

SEQ ID NO: 108107 - RNA, 64 nt, Homo Sapiens; identical to SEQ ID NO: 21450

SEQ ID NO: 108108 - RNA, 64 nt, Homo Sapiens; identical to SEQ ID NO: 21451

SEQ ID NO: 108109 - RNA, 64 nt, Homo Sapiens; identical to SEQ ID NO: 21452

SEQ ID NO: 108110 - RNA, 64 nt, Homo Sapiens; identical to SEQ ID NO: 21453

SEQ ID NO: 108111 - RNA, 64 nt, Homo Sapiens; identical to SEQ ID NO: 21454

SEQ ID NO: 108112 - RNA, 64 nt, Homo Sapiens; identical to SEQ ID NO: 21455

SEQ ID NO: 108113 - RNA, 64 nt, Homo Sapiens; identical to SEQ ID NO: 21456

SEQ ID NO: 108114 - RNA, 64 nt, Homo Sapiens; identical to SEQ ID NO: 21457

SEQ ID NO: 108115 - RNA, 64 nt, Homo Sapiens; identical to SEQ ID NO: 21458

SEQ ID NO: 108116 - RNA, 64 nt, Homo Sapiens; identical to SEQ ID NO: 21459

SEQ ID NO: 108117 - RNA, 64 nt, Homo Sapiens; identical to SEQ ID NO: 21460

SEQ ID NO: 108118 - RNA, 64 nt, Homo Sapiens; identical to SEQ ID NO: 21461

SEQ ID NO: 108119 - RNA, 64 nt, Homo Sapiens; identical to SEQ ID NO: 21462

SEQ ID NO: 108120 - RNA, 64 nt, Homo Sapiens; identical to SEQ ID NO: 21463

SEQ ID NO: 108121 - RNA, 64 nt, Homo Sapiens; identical to SEQ ID NO: 21464

SEQ ID NO: 108122 - RNA, 64 nt, Homo Sapiens; identical to SEQ ID NO: 21465

SEQ ID NO: 108123 - RNA, 64 nt, Homo Sapiens; identical to SEQ ID NO: 21466

SEQ ID NO: 108124 - RNA, 64 nt, Homo Sapiens; identical to SEQ ID NO: 21467

SEQ ID NO: 108125 - RNA, 64 nt, Homo Sapiens; identical to SEQ ID NO: 21468

SEQ ID NO: 108126 - RNA, 64 nt, Homo Sapiens; identical to SEQ ID NO: 21469

SEQ ID NO: 108127 - RNA, 64 nt, Homo Sapiens; identical to SEQ ID NO: 21470

SEQ ID NO: 108128 - RNA, 64 nt, Homo Sapiens; identical to SEQ ID NO: 21471

SEQ ID NO: 108129 - RNA, 64 nt, Homo Sapiens; identical to SEQ ID NO: 21472

SEQ ID NO: 108130 - RNA, 64 nt, Homo Sapiens; identical to SEQ ID NO: 21473

SEQ ID NO: 108131 - RNA, 64 nt, Homo Sapiens; identical to SEQ ID NO: 21474

SEQ ID NO: 108132 - RNA, 64 nt, Homo Sapiens; identical to SEQ ID NO: 21475

SEQ ID NO: 108133 - RNA, 64 nt, Homo Sapiens; identical to SEQ ID NO: 21476

SEQ ID NO: 108134 - RNA, 64 nt, Homo Sapiens; identical to SEQ ID NO: 21477

SEQ ID NO: 108135 - RNA, 64 nt, Homo Sapiens; identical to SEQ ID NO: 21478

SEQ ID NO: 108136 - RNA, 64 nt, Homo Sapiens; identical to SEQ ID NO: 21479

SEQ ID NO: 108137 - RNA, 64 nt, Homo Sapiens; identical to SEQ ID NO: 21480

SEQ ID NO: 108138 - RNA, 64 nt, Homo Sapiens; identical to SEQ ID NO: 21481

SEQ ID NO: 108139 - RNA, 64 nt, Homo Sapiens; identical to SEQ ID NO: 21482

SEQ ID NO: 108140 - RNA, 64 nt, Homo Sapiens; identical to SEQ ID NO: 21483

SEQ ID NO: 108141 - RNA, 64 nt, Homo Sapiens; identical to SEQ ID NO: 21484

SEQ ID NO: 108142 - RNA, 64 nt, Homo Sapiens; identical to SEQ ID NO: 21485

SEQ ID NO: 108143 - RNA, 64 nt, Homo Sapiens; identical to SEQ ID NO: 21486

SEQ ID NO: 108144 - RNA, 64 nt, Homo Sapiens; identical to SEQ ID NO: 21487

SEQ ID NO: 108145 - RNA, 64 nt, Homo Sapiens; identical to SEQ ID NO: 21488

SEQ ID NO: 108146 - RNA, 64 nt, Homo Sapiens; identical to SEQ ID NO: 21489

SEQ ID NO: 108147 - RNA, 64 nt, Homo Sapiens; identical to SEQ ID NO: 21490

SEQ ID NO: 108148 - RNA, 64 nt, Homo Sapiens; identical to SEQ ID NO: 21491

SEQ ID NO: 108149 - RNA, 64 nt, Homo Sapiens; identical to SEQ ID NO: 21492

SEQ ID NO: 108150 - RNA, 64 nt, Homo Sapiens; identical to SEQ ID NO: 21493

SEQ ID NO: 108151 - RNA, 64 nt, Homo Sapiens; identical to SEQ ID NO: 21494

SEQ ID NO: 108152 - RNA, 64 nt, Homo Sapiens; identical to SEQ ID NO: 21495

SEQ ID NO: 108153 - RNA, 64 nt, Homo Sapiens; identical to SEQ ID NO: 21496

SEQ ID NO: 108154 - RNA, 64 nt, Homo Sapiens; identical to SEQ ID NO: 21497

SEQ ID NO: 108155 - RNA, 64 nt, Homo Sapiens; identical to SEQ ID NO: 21498

SEQ ID NO: 108156 - RNA, 64 nt, Homo Sapiens; identical to SEQ ID NO: 21499

SEQ ID NO: 108157 - RNA, 64 nt, Homo Sapiens; identical to SEQ ID NO: 21500

SEQ ID NO: 108158 - RNA, 64 nt, Homo Sapiens; identical to SEQ ID NO: 21501

SEQ ID NO: 108159 - RNA, 64 nt, Homo Sapiens; identical to SEQ ID NO: 21502

SEQ ID NO: 108160 - RNA, 64 nt, Homo Sapiens; identical to SEQ ID NO: 21503

SEQ ID NO: 108161 - RNA, 64 nt, Homo Sapiens; identical to SEQ ID NO: 21504

SEQ ID NO: 108162 - RNA, 64 nt, Homo Sapiens; identical to SEQ ID NO: 21505

SEQ ID NO: 108163 - RNA, 64 nt, Homo Sapiens; identical to SEQ ID NO: 21506

SEQ ID NO: 108164 - RNA, 64 nt, Homo Sapiens; identical to SEQ ID NO: 21507

SEQ ID NO: 108165 - RNA, 64 nt, Homo Sapiens; identical to SEQ ID NO: 21508

SEQ ID NO: 108166 - RNA, 64 nt, Homo Sapiens; identical to SEQ ID NO: 21509

SEQ ID NO: 108167 - RNA, 64 nt, Homo Sapiens; identical to SEQ ID NO: 21510

SEQ ID NO: 108168 - RNA, 64 nt, Homo Sapiens; identical to SEQ ID NO: 21511

SEQ ID NO: 108169 - RNA, 64 nt, Homo Sapiens; identical to SEQ ID NO: 21512

SEQ ID NO: 108170 - RNA, 64 nt, Homo Sapiens; identical to SEQ ID NO: 21513

SEQ ID NO: 108171 - RNA, 64 nt, Homo Sapiens; identical to SEQ ID NO: 21514

SEQ ID NO: 108172 - RNA, 64 nt, Homo Sapiens; identical to SEQ ID NO: 21515

SEQ ID NO: 108173 - RNA, 64 nt, Homo Sapiens; identical to SEQ ID NO: 21516

SEQ ID NO: 108174 - RNA, 64 nt, Homo Sapiens; identical to SEQ ID NO: 21517

SEQ ID NO: 108175 - RNA, 64 nt, Homo Sapiens; identical to SEQ ID NO: 21518

SEQ ID NO: 108176 - RNA, 64 nt, Homo Sapiens; identical to SEQ ID NO: 21519

SEQ ID NO: 108177 - RNA, 64 nt, Homo Sapiens; identical to SEQ ID NO: 21520

SEQ ID NO: 108178 - RNA, 64 nt, Homo Sapiens; identical to SEQ ID NO: 21521

SEQ ID NO: 108179 - RNA, 64 nt, Homo Sapiens; identical to SEQ ID NO: 21522

SEQ ID NO: 108180 - RNA, 64 nt, Homo Sapiens; identical to SEQ ID NO: 21523

SEQ ID NO: 108181 - RNA, 64 nt, Homo Sapiens; identical to SEQ ID NO: 21524

SEQ ID NO: 108182 - RNA, 64 nt, Homo Sapiens; identical to SEQ ID NO: 21525

SEQ ID NO: 108183 - RNA, 64 nt, Homo Sapiens; identical to SEQ ID NO: 21526

SEQ ID NO: 108184 - RNA, 64 nt, Homo Sapiens; identical to SEQ ID NO: 21527

SEQ ID NO: 108185 - RNA, 64 nt, Homo Sapiens; identical to SEQ ID NO: 21528

SEQ ID NO: 108186 - RNA, 64 nt, Homo Sapiens; identical to SEQ ID NO: 21529

SEQ ID NO: 108187 - RNA, 64 nt, Homo Sapiens; identical to SEQ ID NO: 21530

SEQ ID NO: 108188 - RNA, 64 nt, Homo Sapiens; identical to SEQ ID NO: 21531

SEQ ID NO: 108189 - RNA, 64 nt, Homo Sapiens; identical to SEQ ID NO: 21532

SEQ ID NO: 108190 - RNA, 64 nt, Homo Sapiens; identical to SEQ ID NO: 21533

SEQ ID NO: 108191 - RNA, 64 nt, Homo Sapiens; identical to SEQ ID NO: 21534

SEQ ID NO: 108192 - RNA, 64 nt, Homo Sapiens; identical to SEQ ID NO: 21535

SEQ ID NO: 108193 - RNA, 64 nt, Homo Sapiens; identical to SEQ ID NO: 21536

SEQ ID NO: 108194 - RNA, 64 nt, Homo Sapiens; identical to SEQ ID NO: 21537

SEQ ID NO: 108195 - RNA, 64 nt, Homo Sapiens; identical to SEQ ID NO: 21538

SEQ ID NO: 108196 - RNA, 64 nt, Homo Sapiens; identical to SEQ ID NO: 21539

SEQ ID NO: 108197 - RNA, 64 nt, Homo Sapiens; identical to SEQ ID NO: 21540

SEQ ID NO: 108198 - RNA, 64 nt, Homo Sapiens; identical to SEQ ID NO: 21541

SEQ ID NO: 108199 - RNA, 64 nt, Homo Sapiens; identical to SEQ ID NO: 21542

SEQ ID NO: 108200 - RNA, 64 nt, Homo Sapiens; identical to SEQ ID NO: 21543

SEQ ID NO: 108201 - RNA, 64 nt, Homo Sapiens
uuuuuuuugguuaggacuuuuuuugaaguuccuuuuuacuuaggugugaaagaugguucuuugu

SEQ ID NO: 108202 - RNA, 64 nt, Homo Sapiens
auuaaacaaaacugauaucaauaguaaaagucauuuuacuuaucaauuuucuguuuuuuuuuuu

SEQ ID NO: 108203 - RNA, 64 nt, Homo Sapiens
gcuacauuuuaauuuuaaaauagcuucacauuauuuuacuuauauuggguuuuucuucauuuua

SEQ ID NO: 108204 - RNA, 64 nt, Homo Sapiens
guuuagagaaagaacuaaugucucauaugauguauuuacuuauuuuaaaaaaaagaauaggaau

SEQ ID NO: 108205 - RNA, 64 nt, Homo Sapiens
agcaggauauugauuacaaaucuucuuuuccacuuuuacuuaugcagaugaaagcaaucaaguu

SEQ ID NO: 108206 - RNA, 64 nt, Homo Sapiens
gguguucugcuggugacgguuccugacauuuguuuuuacuuacauguuguucauacuuuuuccu

SEQ ID NO: 108207 - RNA, 64 nt, Homo Sapiens
uugagcugaguuuucauuuugauuuuguuagcuuuuuacuuagcuguaagguaccaaacuauuu

SEQ ID NO: 108208 - RNA, 64 nt, Homo Sapiens
gaaguaaaguguucuauccaggauuaaagucaaguuuacuuaggcaacacaagaauauuucacu

SEQ ID NO: 108209 - RNA, 64 nt, Homo Sapiens
uaauguauguucaucuccucuguuccugcuuauuuuuacuuauauauuucagcagaagguccgu

SEQ ID NO: 108210 - RNA, 64 nt, Homo Sapiens
uguuauuauaauuuugaauuuaaauuuucuuuaauuuacuuauaaauacucacauauuuuuacu

SEQ ID NO: 108211 - RNA, 64 nt, Homo Sapiens
uuuucuuuaauuuacuuauaaauacucacauauuuuuacuuaaaugcaaaauccaguagguuaa

SEQ ID NO: 108212 - RNA, 64 nt, Homo Sapiens
uguagaaaauacaaauguaaauuuaacauuuagauuuacuuaauaauuggauauauguguuaaa

SEQ ID NO: 108213 - RNA, 64 nt, Homo Sapiens
aaaaguauugaaguucaaauccaugguuaagaauuuuacuuaggaucaacaaacauaacuucua

SEQ ID NO: 108214 - RNA, 64 nt, Homo Sapiens
uaguuuuuguuuuaugcaagaucaaauguauuuuuuuacuuaugacaaaauugauguuuuuaua

SEQ ID NO: 108215 - RNA, 64 nt, Homo Sapiens
agaaccacauauuuuagacacuguuugagaaccauuuacuuagcaugagcaggaagagggaagg

SEQ ID NO: 108216 - RNA, 64 nt, Homo Sapiens
aaaagaauuugaugauguagcauuccaacuucaauuuacuuauggcccagccaaguaacugaac

SEQ ID NO: 108217 - RNA, 64 nt, Homo Sapiens
aaugcacauucaaaacacacuauauuuuuuaaaauuuacuuaguuuucuucagagcaagaaggu

SEQ ID NO: 108218 - RNA, 64 nt, Homo Sapiens
gcccuugacgugcuuggaccuagugccaucgguuuuuacuuagauaauggauuauguggaauug

SEQ ID NO: 108219 - RNA, 64 nt, Homo Sapiens
gauaauaaaguagguuuuauauauucuuuaaauuuuuacuuauauaauacuuucuaguuuuucc

SEQ ID NO: 108220 - RNA, 64 nt, Homo Sapiens
uuauuccugacuaguuuugcacacuugaaaauuguuuacuuauuuuacaacuguuuuacugaug

SEQ ID NO: 108221 - RNA, 64 nt, Homo Sapiens
ucuggcauguucacaaaaagggauccuuugacaauuuacuuaacaaauaacacauugucaaccu

SEQ ID NO: 108222 - RNA, 64 nt, Homo Sapiens
aaauuacaaacgcaauacuacagauacuuggucauuuacuuaccaaguucaucacuuuugcauu

SEQ ID NO: 108223 - RNA, 64 nt, Homo Sapiens
uacugagaccaucucuuccuuucuuuccccuucuuuuacuuagaaugucuuuguauucauuugc

SEQ ID NO: 108224 - RNA, 64 nt, Homo Sapiens
ucuuuucacuuacaagcucuaugaucuuaaauaauuuacuuaauguauuuugguguauuuuccu

SEQ ID NO: 108225 - RNA, 64 nt, Homo Sapiens
cauuaguaaguuccugcauauaaaagaaaauuuguuuacuuaccgacucaaaauaacuuguuug

SEQ ID NO: 108226 - RNA, 64 nt, Homo Sapiens
uuuaaauuuucucuuuuuauauauuuuuuuauuuuuuacuuauugcccaggcugcuuuuuaaaa

SEQ ID NO: 108227 - RNA, 64 nt, Homo Sapiens
aauaaauauuuuaugaugugcaggggaaaaucauuuuacuuauucauuuuuuaauaaccaaagg

SEQ ID NO: 108228 - RNA, 64 nt, Homo Sapiens
uaaaaaaagauaacuuuaaguuauuuguguguucuuuacuuauaauuaucaaauucaagugaau

SEQ ID NO: 108229 - RNA, 64 nt, Homo Sapiens
ccuuuuucaggugaggagguuguuuuaauuaguguuuacuuaaggauacaacuaagauccuaaa

SEQ ID NO: 108230 - RNA, 64 nt, Homo Sapiens
uauucaaaaccugguauaucuuuguauuuuaagcuuuacuuagauucuauauuauguuuucgcu

SEQ ID NO: 108231 - RNA, 64 nt, Homo Sapiens
accuguguguuuuccacagugccuugggguguauuuuacuuauaagcugcaauucugccugggu

SEQ ID NO: 108232 - RNA, 64 nt, Homo Sapiens
uucuuucuuuugauuuuuuuggaagaaacaaaaauuuacuuaacaacaaguuaacaugauaaua

SEQ ID NO: 108233 - RNA, 64 nt, Homo Sapiens
aaacacuccuguacauaaucgguuaauuuaaaauuuuacuuaauaagugaacaaguaaugaaga

SEQ ID NO: 108234 - RNA, 64 nt, Homo Sapiens
uuaauaagugaacaaguaaugaagauuucaccuguuuacuuaggguaucuacccagacccaucg

SEQ ID NO: 108235 - RNA, 64 nt, Homo Sapiens
aacugaacauauggaaauagauuuauuguaaguauuuacuuagagcuuuuucuuaaaucugaac

SEQ ID NO: 108236 - RNA, 64 nt, Homo Sapiens
augaacuauuucagucaagcccacucuaccacuuuuuacuuaucugguuaauaauccgaaaugu

SEQ ID NO: 108237 - RNA, 64 nt, Homo Sapiens
aaucacaacagguaauagcauuucaaugaguggcuuuacuuaucgugguguuuggaauuggguu

SEQ ID NO: 108238 - RNA, 64 nt, Homo Sapiens
uaccuuuuaaauaugccccuaaaguacacggcuuuuuacuuauuuguacuuucuuuaaucuuaa

SEQ ID NO: 108239 - RNA, 64 nt, Homo Sapiens
uuaaguuuccuagugauucucaaucucuuugaauuuuacuuacauuuacacacacacgcacaca

SEQ ID NO: 108240 - RNA, 64 nt, Homo Sapiens
auaaguuucccagugauucucaaccucuuugaauuuuacuuauaauuacauacacacacacacu

SEQ ID NO: 108241 - RNA, 64 nt, Homo Sapiens
aauugggaauaagcuuuuugggccaugaaauauuuuuacuuaaagcgugugagccaccacgccc

SEQ ID NO: 108242 - RNA, 64 nt, Homo Sapiens
aauugggaauaagcucgcuuaaccaugaaauauuuuuacuuaaaaggcgugagccaccgugccc

SEQ ID NO: 108243 - RNA, 64 nt, Homo Sapiens
uuucuuuaucuguauggcaacaggucuucauacuuuuacuuaauaaucuguccacuguauuuua

SEQ ID NO: 108244 - RNA, 64 nt, Homo Sapiens
gacauauuagaaagguuuuuauuugugaucagauuuuacuuauucuuacaggagaaaaggcuau

SEQ ID NO: 108245 - RNA, 64 nt, Homo Sapiens
aggaaaggaagacguuuugaaaacacacugauguaggaagcacggcguuaaaguuguacuaggc

SEQ ID NO: 108246 - RNA, 64 nt, Homo Sapiens
uaugaauccauuguccuugucuccaugccuucuuaggaagcagcucccugcacccaaggggccu

SEQ ID NO: 108247 - RNA, 64 nt, Homo Sapiens
gaagcgaaggauauauuaugcuccuaauauggucaggaagcaagauuaaaaauguauaugaaug

SEQ ID NO: 108248 - RNA, 64 nt, Homo Sapiens
uaccuugcaaagcaacuaguucaaguuauaggaaaggaagcagauauacuaagaguaaagcaac

SEQ ID NO: 108249 - RNA, 64 nt, Homo Sapiens
gcauguuuuaguugagugcuagaaaugucuccaaaggaagcaagccagcuuugggggaccugga

SEQ ID NO: 108250 - RNA, 64 nt, Homo Sapiens
ugagaacugcccagucuucauugaguucuccuacaggaagcagaucucagcucacuguuuuucc

SEQ ID NO: 108251 - RNA, 64 nt, Homo Sapiens
agggcaacuauagugaggccgcaagagagagcuuaggaagcaugccagaauuagaguuauuaga

SEQ ID NO: 108252 - RNA, 64 nt, Homo Sapiens
gagcaaaucccaccuuuaccgggagcugcuccuaaggaagcaggauuauuagugguguggcacu

SEQ ID NO: 108253 - RNA, 64 nt, Homo Sapiens
cuguagauuuaagggcacucugcucacagacaugaggaagcaggucaagcauuuauccaaauuc

SEQ ID NO: 108254 - RNA, 64 nt, Homo Sapiens
ugaacuuguuccucccuauagcaccuucuugaaaaggaagcauuuuuuauauaagacguauacg

SEQ ID NO: 108255 - RNA, 64 nt, Homo Sapiens
gaaacaacacaaaacccuaugcugucugagcgggaggaagcacuacaguugugauucagcaccu

SEQ ID NO: 108256 - RNA, 64 nt, Homo Sapiens
cccucaauagccagcacccagcgcugcggaggacaggaagcaccaagcaucuuugaaaaguccu

SEQ ID NO: 108257 - RNA, 64 nt, Homo Sapiens
ucagcugggaaggccgcaagaggcauagagggagaggaagcacacugcagggcugcuguggccc

SEQ ID NO: 108258 - RNA, 64 nt, Homo Sapiens
ugaaugugccuuaaaaaucaagacacuaguucagaggaagcacauaauguccagaucuauggcg

SEQ ID NO: 108259 - RNA, 64 nt, Homo Sapiens
caugaucugagcagcagcauccaggcugaccucaaggaagcauagccacaaaacagaauagcac

SEQ ID NO: 108260 - RNA, 64 nt, Homo Sapiens
caaagcuaaaauaauggcuucacucuuauauuugaggaagcaacugaacaggagucaaugauuu

SEQ ID NO: 108261 - RNA, 64 nt, Homo Sapiens
uaagagagggaacauuuccuugcaggggguugggaggaagcaugugaauaagguguugaaagag

SEQ ID NO: 108262 - RNA, 64 nt, Homo Sapiens
uguggaaggagcauuuccuucucaguggguggagaggaagcauaggaggugguauugaccggca

SEQ ID NO: 108263 - RNA, 64 nt, Homo Sapiens
ugcacacacaaaaugcccaaggcacucacuggggaggaagcaaggaagcaaacagucugagaaa

SEQ ID NO: 108264 - RNA, 64 nt, Homo Sapiens
caaaaugcccaaggcacucacuggggaggaagcaaggaagcaaacagucugagaaaaugaugca

SEQ ID NO: 108265 - RNA, 64 nt, Homo Sapiens
gugacaggcagacacaugcuguuggccucaagcaaggaagcagagcacuguguaaccagcaguc

SEQ ID NO: 108266 - RNA, 64 nt, Homo Sapiens
ucauugacuucaagaugccucuucuaccucuuccaggaagcacaggccaggggaucugggugug

SEQ ID NO: 108267 - RNA, 64 nt, Homo Sapiens
aggcugggggccuccacccagcagcagaccaaccaggaagcagcuugaacuggauggagacuuu

SEQ ID NO: 108268 - RNA, 64 nt, Homo Sapiens
uucagaagaggaacacaaaggaagccacccaggaaggaagcacagagcugggggcucuggaaac

SEQ ID NO: 108269 - RNA, 64 nt, Homo Sapiens
uggcaccaacucaccaaaggcagccugguggcagaggaagcaggagcaccaaagcuccccaccc

SEQ ID NO: 108270 - RNA, 64 nt, Homo Sapiens
cagggcuuagguagcuugguuggaaagggccauaaggaagcaggaguuuccauuuucuauuacc

SEQ ID NO: 108271 - RNA, 64 nt, Homo Sapiens
caggaagugagcaaggggccgauagaaagugaacaggaagcaaacuggcaagggacaggaagcu

SEQ ID NO: 108272 - RNA, 64 nt, Homo Sapiens
caucacacuugaggcuugggggagguagcaccacaggaagcagggggaauacaaagguauccau

SEQ ID NO: 108273 - RNA, 64 nt, Homo Sapiens
uuggacagaaaccacuugcucugacaucccugccaggaagcagguguggaagccaaggcugggu

SEQ ID NO: 108274 - RNA, 64 nt, Homo Sapiens
uucggagggguggagauaaaucuuaauugagggaaggaagcagacucugagaaaaggcaugguu

SEQ ID NO: 108275 - RNA, 64 nt, Homo Sapiens
cuuccuuggagcaguucuucgugggccgagaggcaggaagcagcuaaagaggugccuucagcug

SEQ ID NO: 108276 - RNA, 64 nt, Homo Sapiens
gauggggaugaaggcacagggaggccccacccccaggaagcaugaacggugucauauuuaguca

SEQ ID NO: 108277 - RNA, 64 nt, Homo Sapiens
aaaaccuucaaaacaagacauuugauuaaaauucaggaagcagcuucuuguuucucaugaaaag

SEQ ID NO: 108278 - RNA, 64 nt, Homo Sapiens
ggggagugagacaggcugggaauuguccuuuucuaggaagcacgaaggaugccacuugggaaug

SEQ ID NO: 108279 - RNA, 64 nt, Homo Sapiens
agaauggcauguuuuauaauuaacugaauaaagaaggaagcauuauuauauauuauugugggga

SEQ ID NO: 108280 - RNA, 64 nt, Homo Sapiens
uauuucaucuucauaagaaugagaaaggcucaaaaggaagcacuuuuagaaaucuucucugacc

SEQ ID NO: 108281 - RNA, 64 nt, Homo Sapiens
aaaaaaaaguuuaaaaagcaaaauggggagggggaggaagcagugacuuuuuuuugguaauuau

SEQ ID NO: 108282 - RNA, 64 nt, Homo Sapiens
cuuugaauaaaugacauggcaccuccuagcaggaaggaagcaggguugaaacccugaaguguua

SEQ ID NO: 108283 - RNA, 64 nt, Homo Sapiens
agauagauguugcucuuucauucauuuuuaagaaaggaagcaacaucuucaguauuuucuccac

SEQ ID NO: 108284 - RNA, 64 nt, Homo Sapiens
agacgggaggggaggcauugcuguuagcuuuccaaggaagcagaugggcaccuaacggccugcc

SEQ ID NO: 108285 - RNA, 62 nt, Homo Sapiens
uauuuuuaaaaacaacuuaauuccuaaguuuaagggaaaaguuaaauuagcgaaaucaaccc

SEQ ID NO: 108286 - RNA, 62 nt, Homo Sapiens
ggagccuaccacaaggcucccugaagauacuuagggaaaacaauacagggacagggugucuc

SEQ ID NO: 108287 - RNA, 62 nt, Homo Sapiens
ccuaaauuuaccuuaaauaagaugacauuuaaagggaaaaguaccucuugagauauauuauu

SEQ ID NO: 108288 - RNA, 62 nt, Homo Sapiens
auuaccucuugagauauauucugaaaaucaugagggaaaaugaaaacuuuuaaauucaacac

SEQ ID NO: 108289 - RNA, 62 nt, Homo Sapiens
aaaaaccuggaacuccauaaaaaaaaaaauucagggaaaauucuugccaauuuuguuguuua

SEQ ID NO: 108290 - RNA, 62 nt, Homo Sapiens
cccacagggaccagaauguuuuguugggggugagggaaaaaaguugggguggccauaauggu

SEQ ID NO: 108291 - RNA, 62 nt, Homo Sapiens
uccaugucaguuucuuucacacaucucuugaaagggaaaauaacaguggguaaauauaucau

SEQ ID NO: 108292 - RNA, 62 nt, Homo Sapiens
cagggaaggggagaagaaaggggaugggagaaagggaaaagucauugugggguagguggucg

SEQ ID NO: 108293 - RNA, 62 nt, Homo Sapiens
uuuuguagaguauaggggagaggccuagucccagggaaaacaaauauguaguggccuuuuca

SEQ ID NO: 108294 - RNA, 62 nt, Homo Sapiens
caaccuacucugaaagccuuacaaacagaaggagggaaaaacgcuguaagaagaaaauggag

SEQ ID NO: 108295 - RNA, 62 nt, Homo Sapiens
aaugugugauuaaaugcuuuuuuaaauugcuaagggaaaauaacaaaguguuaguaaucauu

SEQ ID NO: 108296 - RNA, 62 nt, Homo Sapiens
ucaauagauuauucugccauuuuuuaaaggaaagggaaaaugaaaacagcaugucuuuuuaa

SEQ ID NO: 108297 - RNA, 62 nt, Homo Sapiens
guggaaugaagucuuugauggguaggagagagagggaaaaccucaaacuacaucauagaagu

SEQ ID NO: 108298 - RNA, 62 nt, Homo Sapiens
cauggcgagacccuguuucuacaaaaagaaaaagggaaaaaaaaagcagggacugucauucu

SEQ ID NO: 108299 - RNA, 62 nt, Homo Sapiens
augaaaaaaggucaguugauuccagugcuaaaagggaaaaaccugugguccgcccagaagag

SEQ ID NO: 108300 - RNA, 62 nt, Homo Sapiens
agaaaagaaaaaaagguuaagcauaaaaagaaagggaaaaagcagaaacacugcagaagaca

SEQ ID NO: 108301 - RNA, 62 nt, Homo Sapiens
gaacacaccaaaaaagugaaagagaaauugaaagggaaaaaagacaaaaagcauaaggcucc

SEQ ID NO: 108302 - RNA, 62 nt, Homo Sapiens
aagucuguaauuucaguuuuugugucggggagagggaaaaacuauuugucuguaguugcuuu

SEQ ID NO: 108303 - RNA, 62 nt, Homo Sapiens
ucuucuguaaugagaauagacuggaacaugugagggaaaaauauuuaaaaaaagauggcagu

SEQ ID NO: 108304 - RNA, 62 nt, Homo Sapiens
gcuugaaaccuucccacacucccugcuccaggagggaaaaacagauguuguugacagauaga

SEQ ID NO: 108305 - RNA, 62 nt, Homo Sapiens
gccaggauuaaggggaggcaaucaaugcaccuagggaaaaaauuuaaggagguauucacacu

SEQ ID NO: 108306 - RNA, 62 nt, Homo Sapiens
cucuaaggccuuugacugcagaggcaccuguuagggaaaaucagaugucucauauaauaagg

SEQ ID NO: 108307 - RNA, 62 nt, Homo Sapiens
uguagggcuaucuuuuuaaaaaaugucaacaaagggaaaauaaacuaucagcuuggaugguc

SEQ ID NO: 108308 - RNA, 62 nt, Homo Sapiens
ggguccuugaaacagaaaaaaggaaauccaguagggaaaauagaauacuugaaguaggaagu

SEQ ID NO: 108309 - RNA, 62 nt, Homo Sapiens
accaaauuuugaggucuuuuaaagcacaugccagggaaaaaguguggauacagucauuauuu

SEQ ID NO: 108310 - RNA, 62 nt, Homo Sapiens
agaacuggaaaugaaacagaugaaggcaggucagggaaaagaguagaaguuaaaggagaauc

SEQ ID NO: 108311 - RNA, 62 nt, Homo Sapiens
cugucaguagauggaggcaaaugggggagaaaagggaaaaugagcgcuuuuggggguggcuu

SEQ ID NO: 108312 - RNA, 62 nt, Homo Sapiens
gaaaaggguucuggaguguucauucagagugaagggaaaacuuuauccuucuauuucuuaua

SEQ ID NO: 108313 - RNA, 62 nt, Homo Sapiens
gaaugagaacuuugcaguuggaugaauagagaagggaaaaguugcuggagcacggagugaag

SEQ ID NO: 108314 - RNA, 62 nt, Homo Sapiens
auuccauguaaacauuucaaaggucuuucuguagggaaaauuuuugaauuuaaaggguguac

SEQ ID NO: 108315 - RNA, 62 nt, Homo Sapiens
ugcguuguaaacaugaggauaauggaaauacaagggaaaaccaccacugagcuuuaaauaag

SEQ ID NO: 108316 - RNA, 62 nt, Homo Sapiens
ugccacuugcacugugcuugcuccuaagcaaaagggaaaaggagcgcgcgugauagaagaaa

SEQ ID NO: 108317 - RNA, 62 nt, Homo Sapiens
uuuuaauuugggcaucucuagagaacgcuuucagggaaaaauacuuuaauaguaaaaagauu

SEQ ID NO: 108318 - RNA, 62 nt, Homo Sapiens
uuucuagauuauaaacugacuaaacuuacaucagggaaaaauugguauuuaugcaaaaaaaa

SEQ ID NO: 108319 - RNA, 62 nt, Homo Sapiens
agugauaagauucauacacucuguauuuggggagggaaaaccuuuuuaagcaugguggggca

SEQ ID NO: 108320 - RNA, 62 nt, Homo Sapiens
cuguuuauaaaauuuccuuagagacuuuuugaagggaaaauagagcaacagggaaaaaugaa

SEQ ID NO: 108321 - RNA, 62 nt, Homo Sapiens
uuagagacuuuuugaagggaaaauagagcaacagggaaaaaugaaagaaaugucuugguuac

SEQ ID NO: 108322 - RNA, 62 nt, Homo Sapiens
uucaaagcauguuucuuuccauucuguugacaagggaaaaccauacacagcuacagacacac

SEQ ID NO: 108323 - RNA, 62 nt, Homo Sapiens
ccaaaccaguugggagacuuaaaaaccucagaagggaaaacuggucuacgaagaauagggug

SEQ ID NO: 108324 - RNA, 62 nt, Homo Sapiens
gaagugcauuugauuggugugcaggagcucccagggaaaaaccccugcagggcugagaugug

SEQ ID NO: 108325 - RNA, 62 nt, Homo Sapiens
gggugcugaggugaaagcauuucagauaaacuagggaaaacuacaucauauguccaugaaac

SEQ ID NO: 108326 - RNA, 62 nt, Homo Sapiens
cucagacaaggaacucucuccucucuuuuuggagggaaaaaaaaaauaucacuacacaaacc

SEQ ID NO: 108327 - RNA, 62 nt, Homo Sapiens
auggaacuggucagugauucucuaccccaaguagggaaaaccuccaucuuuucccugucuuc

SEQ ID NO: 108328 - RNA, 62 nt, Homo Sapiens
caucaggacugcuucaucgucuuggcugagaaagggaaaagacacacaagucgcguggguug

SEQ ID NO: 108329 - RNA, 62 nt, Homo Sapiens
cgaggcccucugcaagaagcucaaggaagcucagggaaaauggacguauucagagaguguuu

SEQ ID NO: 108330 - RNA, 62 nt, Homo Sapiens
uuccaaaaucaaagauuugaccuuaagagggaagggaaaaaagugugaaaggaugaugaaga

SEQ ID NO: 108331 - RNA, 62 nt, Homo Sapiens
uuuugccuuuaagacgauucauucuugucuagagggaaaaucuggcugauuugggaauaaaa

SEQ ID NO: 108332 - RNA, 62 nt, Homo Sapiens
aacugacuuuuauaaugaaucgaaacacagaaagggaaaauaacugacaaaaagggaaaaua

SEQ ID NO: 108333 - RNA, 62 nt, Homo Sapiens
cgaaacacagaaagggaaaauuacugacaaaaagggaaaauaccaaucaguguauugcucau

SEQ ID NO: 108334 - RNA, 62 nt, Homo Sapiens
aaaaguuguuugcuuaaaaaaaauuucaugugagggaaaaaaaaaaaaccuauuccagaaua

SEQ ID NO: 108335 - RNA, 62 nt, Homo Sapiens
aaacagaaaacaauuccacgaggccaaucuaaagggaaaaaauccuacacuacuuuuacuac

SEQ ID NO: 108336 - RNA, 62 nt, Homo Sapiens
uucaguuuuaacgaguaauuggauaaacccugagggaaaacggagguagauucagcaccuaa

SEQ ID NO: 108337 - RNA, 62 nt, Homo Sapiens
uagcugaugagguuacauggggaaaagucaaaagggaaaaggagacugaacugugugcaaca

SEQ ID NO: 108338 - RNA, 62 nt, Homo Sapiens
acauugcgauccauucaguguaugggaaaccaagggaaaagcagguguuucauuuucguuuu

SEQ ID NO: 108339 - RNA, 62 nt, Homo Sapiens
cucuuguaauccgaaucucucuuccauuugcaagggaaaaguaauaugcauuuaaauacagu

SEQ ID NO: 108340 - RNA, 62 nt, Homo Sapiens
auuugcauaacaauuccucuaguagaaacugcagggaaaauucaugggagaaaauagauaag

SEQ ID NO: 108341 - RNA, 62 nt, Homo Sapiens
cauguugcugcagaaguagguuaacucuucccagggaaaauuacuuuguaagacccauauuu

SEQ ID NO: 108342 - RNA, 62 nt, Homo Sapiens
ucccuggacucccuccugccuugagaugggcaagggaaaaggagauucuucacugacuugaa

SEQ ID NO: 108343 - RNA, 62 nt, Homo Sapiens
caacuugaggcaaccuguccuuuuuaauaaaaagggaaaaagacauaaagugcuugagucua

SEQ ID NO: 108344 - RNA, 62 nt, Homo Sapiens
caaaucccaggcccugggaaggacuugagugcagggaaaacuaccccuauuuguagggaaaa

SEQ ID NO: 108345 - RNA, 62 nt, Homo Sapiens
acuugagugcagggaaaacuaccccuauuuguagggaaaaggcucugaggaugaaguuuccu

SEQ ID NO: 108346 - RNA, 62 nt, Homo Sapiens
ucuccuaucuugauuucacuaccuuaaacuuaagggaaaaguuccuauuuuuuuuuuuaacu

SEQ ID NO: 108347 - RNA, 61 nt, Homo Sapiens
ccuuuacuagauucuugucaugaggagcaggagggaaaaggcaguucuugcauuggcauaa

SEQ ID NO: 108348 - RNA, 62 nt, Homo Sapiens
aagggccaaacauucuuuaucccucccaccccagggaaaacauuuggaaaauaguccuuuuu

SEQ ID NO: 108349 - RNA, 62 nt, Homo Sapiens
ccaaagacagagggagcuucacugagacucagagggaaaaggaaaagagccucaaacauuuu

SEQ ID NO: 108350 - RNA, 62 nt, Homo Sapiens
uuuaauuuuuaagucaaaaauaaaaauguaauagggaaaauauuuuggagauaguaaaaauu

SEQ ID NO: 108351 - RNA, 62 nt, Homo Sapiens
cccaauaggauaacucaagugguggaucugugagggaaaagacugaacagaagggcaagaga

SEQ ID NO: 108352 - RNA, 62 nt, Homo Sapiens
ccaauggaugauuuucugggaaucaagugccuagggaaaauuucuggcuauuuaagguucaa

SEQ ID NO: 108353 - RNA, 62 nt, Homo Sapiens
gugcaaacugaguguuaguaaaaugguuagcuagggaaaacaauuacuuguuuacauccaac

SEQ ID NO: 108354 - RNA, 62 nt, Homo Sapiens
cauuaaagcagcucccugcuaacuugcaauagagggaaaagcugacuguccuuucaaggaaa

SEQ ID NO: 108355 - RNA, 62 nt, Homo Sapiens
aaaauucuguagauagcaaaauagagguuaaaagggaaaaaacaccuccuuccugaacucua

SEQ ID NO: 108356 - RNA, 62 nt, Homo Sapiens
gacaagcagguuuauguguuuaaacagaaagaagggaaaagguacuaugugauaugguacug

SEQ ID NO: 108357 - RNA, 62 nt, Homo Sapiens
uucaugaauuuugugaacuugccaaaaggggaagggaaaaaucuuuguguuacuucacucaa

SEQ ID NO: 108358 - RNA, 62 nt, Homo Sapiens
gauacauaaagacuugagaagggaauuguuuaagggaaaagaaaagaguaauaauuuuuuuu

SEQ ID NO: 108359 - RNA, 62 nt, Homo Sapiens
aauauuaaaauuaggaauuuaggcauuaccucagggaaaagccuugacagugaaaagaaacu

SEQ ID NO: 108360 - RNA, 62 nt, Homo Sapiens
agaaaagcugaugcuggcaagaagguacccaaagggaaaaaggccccugcaaagaagggaga

SEQ ID NO: 108361 - RNA, 62 nt, Homo Sapiens
auuuuugaaaguagggugauauauuuucucucagggaaaauauauuggauaaauaugaauaa

SEQ ID NO: 108362 - RNA, 62 nt, Homo Sapiens
uauuguuaugaaacuguaaggucuacauauaaagggaaaaaguuaauguggaaagcugaucu

SEQ ID NO: 108363 - RNA, 62 nt, Homo Sapiens
ucccggcauaccuauuagugucuuaaaaaggaagggaaaagucuuuuguugcccucuccuau

SEQ ID NO: 108364 - RNA, 62 nt, Homo Sapiens
aaagaagaaaagauuuuugcaguuuuaacagaagggaaaaggaaaaaaaagaaaggacauug

SEQ ID NO: 108365 - RNA, 62 nt, Homo Sapiens
aaaugaaaacccuguugcugggaaacggggggagggaaaaugacagcacuaaauaacuuggg

SEQ ID NO: 108366 - RNA, 62 nt, Homo Sapiens
cuuaugcagagaaaaguuuuugugaauugcuaagggaaaaacucucaccaauuguagauugg

SEQ ID NO: 108367 - RNA, 62 nt, Homo Sapiens
uuucagcaguuauuuagcccaaggaaaagaauagggaaaagcaucuuagaagaaaccccaug

SEQ ID NO: 108368 - RNA, 62 nt, Homo Sapiens
ugcgacguacugucacugaugagagacugggaagggaaaagcauauauauauagauauauag

SEQ ID NO: 108369 - RNA, 62 nt, Homo Sapiens
acuucucugagcucagaaagugccccuugaugagggaaaaugucccacugcacugcgaauuu

SEQ ID NO: 108370 - RNA, 62 nt, Homo Sapiens
cuuuuaucuugcggggucagagcgcccucuagagggaaaagcuagaggcacaggguuucugc

SEQ ID NO: 108371 - RNA, 62 nt, Homo Sapiens
acaaccaccccguggcuuguguggggucucgcagggaaaagggcuggcuucuagguccccga

SEQ ID NO: 108372 - RNA, 62 nt, Homo Sapiens
uuuguaaucaagauuuuauguaacauuuguaaagggaaaauuagcacuuuugugguucuuaa

SEQ ID NO: 108373 - RNA, 62 nt, Homo Sapiens
uaaagggaaaauuagcacuuuugugguucuuaagggaaaagaaacagaccuuguggagauua

SEQ ID NO: 108374 - RNA, 62 nt, Homo Sapiens
ucucagauccauaauccauacucagugaaagcagggaaaaaauauuuucacuuauuuuauuu

SEQ ID NO: 108375 - RNA, 62 nt, Homo Sapiens
cuguguaaguauugugaaaacccuuuucuuccagggaaaaauuauuggaaauuccuuaacug

SEQ ID NO: 108376 - RNA, 62 nt, Homo Sapiens
uagaacacgguuacagcugguucuguagaaagagggaaaagaugauugugacaauucagagc

SEQ ID NO: 108377 - RNA, 62 nt, Homo Sapiens
auucucuggcucagccccagccuuucugaagaagggaaaacuagggacccagaugguuuaag

SEQ ID NO: 108378 - RNA, 62 nt, Homo Sapiens
aauugcaguuauugauucuuauuugauggagaagggaaaauaaacuuccuauucuuucuuaa

SEQ ID NO: 108379 - RNA, 62 nt, Homo Sapiens
uuuacuugugggggugggagauguguuucaaaagggaaaacuaguaggauauccaaaguuca

SEQ ID NO: 108380 - RNA, 62 nt, Homo Sapiens
cccauccucuucuuuuagcaguaaaauagcugagggaaaagggagggaaaaggaaguuaugg

SEQ ID NO: 108381 - RNA, 62 nt, Homo Sapiens
cuuuuagcaguaaaauagcugagggaaaagggagggaaaaggaaguuaugggaauaccugug

SEQ ID NO: 108382 - RNA, 64 nt, Homo Sapiens
aauucuuugggauguucagacagacucaaauccuaaucaggaaaaagacucaucuaguaaugag

SEQ ID NO: 108383 - RNA, 64 nt, Homo Sapiens
caucagauccugcuuugaaaauugauacaaacagaaucaggacagaaaaugguuccauuuugcc

SEQ ID NO: 108384 - RNA, 64 nt, Homo Sapiens
ugauugcauaugcaagcccuccaagaacuaggugaaucaggaauacgaguauuuucucuuccug

SEQ ID NO: 108385 - RNA, 64 nt, Homo Sapiens
caguuucuccaucgguaugguccaaagucuugucaaucaggaugaaugcugacgaaaagcaaua

SEQ ID NO: 108386 - RNA, 64 nt, Homo Sapiens
gauacauagugauucguauauuuuuaaugucaugaaucaggaagacacuucuuuaagcuuuuuu

SEQ ID NO: 108387 - RNA, 64 nt, Homo Sapiens
aaaaucuaugcauauugagguuugaucuuuucuaaaucaggaaauuuuacuaagguuuagcacc

SEQ ID NO: 108388 - RNA, 64 nt, Homo Sapiens
cugcaauaauuuguuguacaacuguuguaucaggaaucaggauuuuuuuguuguuguacuuucc

SEQ ID NO: 108389 - RNA, 64 nt, Homo Sapiens
uccuguguauugcaagguacaauuuucuccaauaaaucaggagaacaggaguuugaugaugcaa

SEQ ID NO: 108390 - RNA, 64 nt, Homo Sapiens
gcaagccuuguucaacauuuuuaaaauguuagcaaaucaggaaugaacacagaugcagaaaucc

SEQ ID NO: 108391 - RNA, 64 nt, Homo Sapiens
uagccucaaguaguucccuucaggauuacaaaggaaucaggauugucugagaucuguacuguuu

SEQ ID NO: 108392 - RNA, 64 nt, Homo Sapiens
cugggcccaguccugcuaguggcaaguuucuuugaaucaggaaggcaggugagguaagggccaa

SEQ ID NO: 108393 - RNA, 64 nt, Homo Sapiens
uuacaauaauuuuuuucagcuauagcugcaguuuaaucaggauggguagagagcuguccucaua

SEQ ID NO: 108394 - RNA, 64 nt, Homo Sapiens
uagcagaugcucguucuugccuccuucaggcaccaaucaggagaaggguucugccucccauccc

SEQ ID NO: 108395 - RNA, 64 nt, Homo Sapiens
ucuccuuagagagagaacugugcuuccaaacagaaaucaggagugaccacaaagccugaaaaca

SEQ ID NO: 108396 - RNA, 62 nt, Homo Sapiens
cagaauaacauuuuaaacuaauauaauucuuuggcagauauugguucuagcuaguaauaaca

SEQ ID NO: 108397 - RNA, 62 nt, Homo Sapiens
uccucuagaauguguaucuuuguuauuuuuuuggcagauaauauuuaaauaucuuugauaau

SEQ ID NO: 108398 - RNA, 62 nt, Homo Sapiens
cuguccccagacccugccaccugacucagguuggcagauaaaauuugcauccaccuucccuu

SEQ ID NO: 108399 - RNA, 62 nt, Homo Sapiens
uaagaaaggaaauggcccuagugccauuucauggcagauauggguuccuaugccuagccugu

SEQ ID NO: 108400 - RNA, 62 nt, Homo Sapiens
cuugcacuggcucuucuaaaggacuuuuggagggcagauaauuucaucuguuaaauccaaca

SEQ ID NO: 108401 - RNA, 62 nt, Homo Sapiens
cacucuccuuagaauuggaacuaugcaguuaaggcagauaaaauguacagauguuucauaua

SEQ ID NO: 108402 - RNA, 64 nt, Homo Sapiens
gggccgugcgcacuguguuccgugcccuggggacccccggaaaagcagcccagucagauguggg

SEQ ID NO: 108403 - RNA, 64 nt, Homo Sapiens
gcuggagugccagucccugagcucagacccccguccccggaacugggccacaccacgugcccuc

SEQ ID NO: 108404 - RNA, 58 nt, Homo Sapiens
cccgcgagacgcuguacuaggcugugcgccccggaacguguccaggaggagccuggcc

SEQ ID NO: 108405 - RNA, 64 nt, Homo Sapiens
cucucagcuggaugagacuguccuggaggauccaccccggaacagacagaauggugucucucag

SEQ ID NO: 108406 - RNA, 64 nt, Homo Sapiens
cguaucacuagcuugcggccaggucaugauguggccccggaagcuggcccugcgugccaugagu

SEQ ID NO: 108407 - RNA, 58 nt, Homo Sapiens
gcucagaggugguuguuggcggagaacgccgccgcaguguuugaccucuagcggugaa

SEQ ID NO: 108408 - RNA, 58 nt, Homo Sapiens
gggcugccccggaaucagcuccccggggccgccgcaacgaagguggauccgcaucuug

SEQ ID NO: 108409 - RNA, 64 nt, Homo Sapiens
uacucuggucagucuccagcuaaccucucaaucaggcaaacauucuucuuggaggaaucaggca

SEQ ID NO: 108410 - RNA, 64 nt, Homo Sapiens
cucaaucaggcaaacauucuucuuggaggaaucaggcaaacaucucaaaaauucucuuuccauc

SEQ ID NO: 108411 - RNA, 64 nt, Homo Sapiens
aggcugcggcuuggauuaacaucucuacacagcuggcaaacaccacaaucagacggaucaccuu

SEQ ID NO: 108412 - RNA, 64 nt, Homo Sapiens
gugggggcugcaguagcaccuuuuuaaguccaauggcaaacauacuuuagagaaaagccaauca

SEQ ID NO: 108413 - RNA, 64 nt, Homo Sapiens
aaauauuaauuauucuuguuuuucucacacaggcauacuccaaaugcuucuuccaguucauuuu

SEQ ID NO: 108414 - RNA, 64 nt, Homo Sapiens
uggacuuuuuuguacauaaauaagaaaaaccaaaauacuccaaagaugacuuccccugccuccu

SEQ ID NO: 108415 - RNA, 64 nt, Homo Sapiens
caaagguaauggcccaucgaugagcauuuuuaacauacuccauagucuuuuccugugguguuag

SEQ ID NO: 108416 - RNA, 64 nt, Homo Sapiens
agugauuuucuuuauaagaaaauuugggcucugaauacuccauucugccucacuuccuugaccu

SEQ ID NO: 108417 - RNA, 64 nt, Homo Sapiens
gggagccugagccccuucagcuuugaggggggugauacuccaggcuguuuggggugggagccaa

SEQ ID NO: 108418 - RNA, 64 nt, Homo Sapiens
cuguuucugauguguuccauacacauuuaccagcauacuccaaauucugacuuccauccccaaa

SEQ ID NO: 108419 - RNA, 64 nt, Homo Sapiens
cccagcagcucaaccuacccaagggccacccaugauacuccacuaagcucuuuucuccugcaga

SEQ ID NO: 108420 - RNA, 64 nt, Homo Sapiens
cuagcucccagaaucuacagcaucugggaaucauauacuccacuacaaagguccccuggcccuu

SEQ ID NO: 108421 - RNA, 52 nt, Homo Sapiens
aagauauguuuuugguagcagcauacuccagcgacuguucaaaaaaucuuga

SEQ ID NO: 108422 - RNA, 64 nt, Homo Sapiens
gcucauauuuuuaucuaauugaauaaaauaaccaauacuccacugcaaauaacugagccaacca

SEQ ID NO: 108423 - RNA, 64 nt, Homo Sapiens
cccugggaugugggcuuguggcaaaugcaugcaaauacuccaggggaccugcguugccgucuau

SEQ ID NO: 108424 - RNA, 64 nt, Homo Sapiens
cugucaugguaugugaggugcauaaggacaacaaauacuccaccgaaaacggugacaagguuaa

SEQ ID NO: 108425 - RNA, 64 nt, Homo Sapiens
uugaccuuauaaauaaaagaacacaugguaacacauacuccagaauccuauaacucacucagag

SEQ ID NO: 108426 - RNA, 64 nt, Homo Sapiens
auguuuacucaguuuagugucuuguauuucuauaauacuccaacaggaaugguagucacacugu

SEQ ID NO: 108427 - RNA, 64 nt, Homo Sapiens
ccagggaggcgucccucccuaggagccacacauuauacuccaagucccugccgggcuccgccuu

SEQ ID NO: 108428 - RNA, 64 nt, Homo Sapiens
gagacugcaggugccgcacauugucaaguuagaaauacuccagguggguguuagcacuguggug

SEQ ID NO: 108429 - RNA, 64 nt, Homo Sapiens
cuuccuguaccuugacaugcaaaaggcucuccuaauacuccacauucaaacugaagaggaaaau

SEQ ID NO: 108430 - RNA, 64 nt, Homo Sapiens
ccguucucuggaaauggcaucagauuuaaggauaauacuccaucauagaaauaagccuuaauaa

SEQ ID NO: 108431 - RNA, 64 nt, Homo Sapiens
ucaaguuaaaaaugcaucuugguuagcugcaaaaauacuccauuuaauggcaaugguagucuuu

SEQ ID NO: 108432 - RNA, 64 nt, Homo Sapiens
uuuuccauaguccuaacuaccucuuugauagcauauacuccaauacaguuggaaaauauaauug

SEQ ID NO: 108433 - RNA, 64 nt, Homo Sapiens
gucuagaugaauaguuuaucuuuagcacugaauaauacuccauuggcuuaauagugcauuuauu

SEQ ID NO: 108434 - RNA, 64 nt, Homo Sapiens
gcagagcuuaauuauccuuuacccugcaagcuaaauacuccacguuuucgaaccuauuugguuu

SEQ ID NO: 108435 - RNA, 64 nt, Homo Sapiens
cauauggauauuagucauagcuuccauagugacgauacuccaacaugcaaacauaacaaaauca

SEQ ID NO: 108436 - RNA, 64 nt, Homo Sapiens
cuucaagugauauauguauugcugcaaagugcaaauacuccaaggcagcccuuuggguacuacu

SEQ ID NO: 108437 - RNA, 64 nt, Homo Sapiens
auuuuauuuuauagucucaaaaaugagcuuguaaauacuccauuuuguaaaaagaaauugugaa

SEQ ID NO: 108438 - RNA, 64 nt, Homo Sapiens
cacaguuaaauuaauuuagacauaagccuuaacaauacuccaaugaaaugaauuagaaagaaac

SEQ ID NO: 108439 - RNA, 64 nt, Homo Sapiens
ugguucaacacaacaaccuaauagauugcaugucauacuccauuccuguaaauuauuauagaca

SEQ ID NO: 108440 - RNA, 64 nt, Homo Sapiens
uugugaacagaccggagaggacaguggauuguuuauacuccaguguacauaguguaauguagcg

SEQ ID NO: 108441 - RNA, 64 nt, Homo Sapiens
ccuugagaugaggucugugccugauguacaacggauacuccauaaauguuugacaaaccaacga

SEQ ID NO: 108442 - RNA, 64 nt, Homo Sapiens
ugcaauguuuguuuuuauuuuuggcuuuaugucuauacuccacagagagcuuuuuaaguaauga

SEQ ID NO: 108443 - RNA, 64 nt, Homo Sapiens
accuagaaaugcuguaggaauacagugguguggaauacuccaaagugguugggaaaaauaaaaa

SEQ ID NO: 108444 - RNA, 64 nt, Homo Sapiens
cuuuagcugaaggaagcaacauaaaagaaauacaauacuccagguagaaccaaacccaauaugc

SEQ ID NO: 108445 - RNA, 64 nt, Homo Sapiens
ucaaaaaaaaaaaaaaaaaaugggugacagagugauacuccauccacgucacuguacuccagcc

SEQ ID NO: 108446 - RNA, 64 nt, Homo Sapiens
acuuucauguuuaugaguauguguuuuaaauuucauacuccagaauaauuuauauccaaaauuu

SEQ ID NO: 108447 - RNA, 64 nt, Homo Sapiens
agaaauguaaaagaugugacaaaaccuuuaagccauacuccaggcuucuuaaacauaaugagaa

SEQ ID NO: 108448 - RNA, 64 nt, Homo Sapiens
ucaauuaguauuaaacuucacuaaaaaguaaaccauacuccaaauuguauauuggauugcauuu

SEQ ID NO: 108449 - RNA, 64 nt, Homo Sapiens
aggaaucugaugcuccuuugcugcccccaagaguauacuccaccgagaaccaccagccacacca

SEQ ID NO: 108450 - RNA, 64 nt, Homo Sapiens
uuuaauuuacugugacuagauuugaagcaaauaaauacuccagauccaugcagcuagaacacac

SEQ ID NO: 108451 - RNA, 64 nt, Homo Sapiens
aguuagggcagcagaguggauuagacucuuuagaauacuccaagguacuuguaaauagcacuag

SEQ ID NO: 108452 - RNA, 64 nt, Homo Sapiens
aauucaugagcaacaguauagauaguuaacuauuauacuccaacauaaauaagacuuaguuaag

SEQ ID NO: 108453 - RNA, 64 nt, Homo Sapiens
ugugugguauuauggaaagcaauguaauuucuaaauacuccaggacugccacaaaaaaagauga

SEQ ID NO: 108454 - RNA, 64 nt, Homo Sapiens
ucaccaaaauguaaaaaaacgauagaaccuuuagauacuccaaccaaauuuucuauagaaucaa

SEQ ID NO: 108455 - RNA, 64 nt, Homo Sapiens
ggucagcucccaucucuccuucucggcccugcccauacuccaagcuccucuuuccgcuccccca

SEQ ID NO: 108456 - RNA, 64 nt, Homo Sapiens
auuuacauguauauuacagcauuuuuuguaugucauacuccacauaaugauauuuaaagcaaua

SEQ ID NO: 108457 - RNA, 64 nt, Homo Sapiens
gccagucugugaagacaacugccagauacuggcaauacuccagccuggugacagagugagacuc

SEQ ID NO: 108458 - RNA, 64 nt, Homo Sapiens
uagacucaaggaagaauaauuuuaacagacauguauacuccauagaaacuaaacuaaaauaguu

SEQ ID NO: 108459 - RNA, 64 nt, Homo Sapiens
aaaaugaaggaguacacaaaagcuguuggagaaaauacuccagcccaugugcccuuuuuaggga

SEQ ID NO: 108460 - RNA, 64 nt, Homo Sapiens
ggaaagggcucagccugugauaggcauucaauaaauacuccaaugcugucauuccuuugucuac

SEQ ID NO: 108461 - RNA, 64 nt, Homo Sapiens
agcugggucugaccguuguaugguuugaccugauauacuccauucuccccugcgccuccuccuc

SEQ ID NO: 108462 - RNA, 64 nt, Homo Sapiens
aaauguaaaggacucaaaguuuaaguaaaaagugauacuccaccuuguguuucaaagaauuuag

SEQ ID NO: 108463 - RNA, 64 nt, Homo Sapiens
uacaaaccauaucccagccauuauuaugauucccauacuccagaaaggcccauaagacaaguga

SEQ ID NO: 108464 - RNA, 52 nt, Homo Sapiens
cuuuggucgucguccucgguuuauacuccauugcuguggcaaggacagcuag

SEQ ID NO: 108465 - RNA, 64 nt, Homo Sapiens
uaaaauaagacaugccugaaaauagauaaaagcuauacuccaucauguuuuuacaagaugaaau

SEQ ID NO: 108466 - RNA, 64 nt, Homo Sapiens
gccguguggguuagucgggugccaggacaaugaaauacuccagcaccuguggcugacgaauuug

SEQ ID NO: 108467 - RNA, 64 nt, Homo Sapiens
auguauauguauauauauauaguaacuacuuuuuauacuccauacauaacuugauauagaaagc

SEQ ID NO: 108468 - RNA, 64 nt, Homo Sapiens
ucuugcuugauugaaaacgacaucaucccuugguauacuccagggauugguuucaggaccccug

SEQ ID NO: 108469 - RNA, 64 nt, Homo Sapiens
gacuuauuucuuuaguucugcacuuuuccacauuauacuccauaugaguauuaauccuauggau

SEQ ID NO: 108470 - RNA, 64 nt, Homo Sapiens
ucacagccagugaacaaucaccaugcucauucacauacuccaguggaaaguaaguuugguguag

SEQ ID NO: 108471 - RNA, 64 nt, Homo Sapiens
uguuacacccuccacugaacccucaaccuucgaaauacuccaguuuuguggguuuggucauuuu

SEQ ID NO: 108472 - RNA, 64 nt, Homo Sapiens
aucugacacuggcaaaauggguaaauugggaaggauacuccagcgaacuggaaauuauacaaaa

SEQ ID NO: 108473 - RNA, 64 nt, Homo Sapiens
ugaaagccugaguuaucuugcuaauucacgugccauacuccaccuguacacaauuacuguaagg

SEQ ID NO: 108474 - RNA, 64 nt, Homo Sapiens
cauaaaaacuuagguaaaugcucuccuacaaagaauacuccacagacuacagcuguuaucuuuc

SEQ ID NO: 108475 - RNA, 64 nt, Homo Sapiens
cugggcaacagacauccugugagaucgcgccacuauacuccagcggcagagauugcacugagcc

SEQ ID NO: 108476 - RNA, 64 nt, Homo Sapiens
agacugcuacuaucuacuauuggcaguuaaacacauacuccaaaugugcuaacccauucauagu

SEQ ID NO: 108477 - RNA, 52 nt, Homo Sapiens
gccuuccuggagauagcuggagauacuccagcaaucucugugcucaugcuga

SEQ ID NO: 108478 - RNA, 64 nt, Homo Sapiens
ugcuuaacuucauuuuauucucaaauacuauccuauacuccagcgcuuugggugaucuugaaaa

SEQ ID NO: 108479 - RNA, 64 nt, Homo Sapiens
aaacauuccuguugaugggaaaagcccccaguuaauacuccagagacagggaaaggucagcccg

SEQ ID NO: 108480 - RNA, 64 nt, Homo Sapiens
uauaucagcucuaaagcagagauguauuauggugauacuccaagguggcauagccauucauuua

SEQ ID NO: 108481 - RNA, 64 nt, Homo Sapiens
uuuauuccugaagcuuaccagauaugaauggcuaauacuccauuguucugcuuguuguaauggu

SEQ ID NO: 108482 - RNA, 64 nt, Homo Sapiens
gaacuccuuggaugaaaguccacuggggccagcaauacuccagagcccaguuucugcuggaucc

SEQ ID NO: 108483 - RNA, 64 nt, Homo Sapiens
ugacaugguuucucccuauguacaugcccaguggauacuccaugucuuguggaugagcucuaag

SEQ ID NO: 108484 - RNA, 64 nt, Homo Sapiens
auucugcucucagcaauugccguuccccuggaucauacuccagaagcucagugguguggggaaa

SEQ ID NO: 108485 - RNA, 64 nt, Homo Sapiens
cccuucccucccagugaaugauuacaagcauugaauacuccaucugauugcugagggugcauca

SEQ ID NO: 108486 - RNA, 64 nt, Homo Sapiens
uguauuuugcccacuuuuuuaaaugguuuuaauuauacuccaugugacagcuuuguauuuggug

SEQ ID NO: 108487 - RNA, 64 nt, Homo Sapiens
ucauaaaccauguuacauuucucagcucuggccaauacuccauuggaaagagcacgaggauguu

SEQ ID NO: 108488 - RNA, 64 nt, Homo Sapiens
gugugaguuccucugaucucugauaaccugcuuaauacuccaaauucugucagucuguaagcuu

SEQ ID NO: 108489 - RNA, 64 nt, Homo Sapiens
gugaaauuuucagaauguuguuuuuuucauguagauacuccaggaagaguuaagcacugcuuuc

SEQ ID NO: 108490 - RNA, 64 nt, Homo Sapiens
uguuaccaaauaauggcuaauguuacaaaaaguuauacuccagagacccaaagcuugacauuua

SEQ ID NO: 108491 - RNA, 64 nt, Homo Sapiens
uccuuucaaaaaagauuuaaucauuuagguuuuuauacuccaccuccucuauuauuuucacuau

SEQ ID NO: 108492 - RNA, 64 nt, Homo Sapiens
uauuuuuagcaaugccuauugcaagugcaauuauauacuccagggaaauucaccacacugaauc

SEQ ID NO: 108493 - RNA, 64 nt, Homo Sapiens
cacucacagaggcaaguguuguagacuaacaaagauacuccaaaauacaauggcuuaaagaaug

SEQ ID NO: 108494 - RNA, 64 nt, Homo Sapiens
uuccuaccucuuauuucucauugagccucaggcuauacuccagcuggccaaggcuggaaaccug

SEQ ID NO: 108495 - RNA, 64 nt, Homo Sapiens
ugggguugggggggaggugagguaccagccuuggauacuccaugggguggggguggaaaaacag

SEQ ID NO: 108496 - RNA, 64 nt, Homo Sapiens
aagauuugucaaaacucaguguuuucuccaucagauacuccaugaaaggucacaauuucucuug

SEQ ID NO: 108497 - RNA, 64 nt, Homo Sapiens
ccacaugccacuaaccacaaucccuuucuuaaagauacuccaaguggugagggccagauguuau

SEQ ID NO: 108498 - RNA, 64 nt, Homo Sapiens
uaauccuaugucacaauauaauccccauggcugaauacuccaaaaaauaagagaccucuaagag

SEQ ID NO: 108499 - RNA, 64 nt, Homo Sapiens
gccuaugaaauguaaaauguuuuaacuccaucugauacuccauuuugauccccagaagaaccau

SEQ ID NO: 108500 - RNA, 64 nt, Homo Sapiens
aaaaagaaaauuuucaaauaggucuagaaacaaaauacuccaagugcuuuaaacuguaguaguu

SEQ ID NO: 108501 - RNA, 64 nt, Homo Sapiens
aaucuauaauauauuagacuuaugucauuuuauuauacuccaucuaugauuugaagacagacua

SEQ ID NO: 108502 - RNA, 64 nt, Homo Sapiens
gaagaaaaagcgccagugaagaaaucuauacgagauacuccagccaaaaaugcacaaaagucaa

SEQ ID NO: 108503 - RNA, 64 nt, Homo Sapiens
aacacauagugguaauuggagguuacuguuaugaauacuccaucugacuacgacuaagagagug

SEQ ID NO: 108504 - RNA, 64 nt, Homo Sapiens
uuuacugccacuguggaaacagguucuagauuucauacuccaucuaaagucauuuuucaguuac

SEQ ID NO: 108505 - RNA, 64 nt, Homo Sapiens
agauauuugaauuaucuugaaaugguuacaaguuauacuccaaauacuuucuuuuucuauugga

SEQ ID NO: 108506 - RNA, 64 nt, Homo Sapiens
caccucaccugauuggcuauuggaaagauaacacauacuccagcaucagucuguauguacuauc

SEQ ID NO: 108507 - RNA, 64 nt, Homo Sapiens
ugauuauuguaaauauuugagaaaaaaaaaucugauacuccauuguauuugugguaucaguuug

SEQ ID NO: 108508 - RNA, 64 nt, Homo Sapiens
caacacaaccaugugcuauugaagguaguacaagauacuccauaacaaauguacauacacucag

SEQ ID NO: 108509 - RNA, 64 nt, Homo Sapiens
gucuucaaagaccaaaaaauugcucuuagaagucauacuccaugacaaaucugauguuaauguu

SEQ ID NO: 108510 - RNA, 64 nt, Homo Sapiens
caguauuuugcuuuuaugcugcuuuuucuuuuugauacuccagguuuauaaacuaucuuuuaaa

SEQ ID NO: 108511 - RNA, 64 nt, Homo Sapiens
cuuucgcagccaucuucccggauugaaauugugcauacuccaaaccucccggggacuguucugg

SEQ ID NO: 108512 - RNA, 64 nt, Homo Sapiens
gaugaguuuagaagugauuauuaaacauggaaagauacuccacuagaagcagccagaaggagac

SEQ ID NO: 108513 - RNA, 64 nt, Homo Sapiens
gaaugccauacacuacugucucuucagaucugaaauacuccaguuuagagccaggaaauuucac

SEQ ID NO: 108514 - RNA, 64 nt, Homo Sapiens
cacuacaguugcugucacugaaguuugucauuucauacuccauaucuaacaguguauuugugua

SEQ ID NO: 108515 - RNA, 64 nt, Homo Sapiens
gaaaggaaaaauaaggaaauacaggaaaaugaauauacuccauuacagaaacugaucucaaaug

SEQ ID NO: 108516 - RNA, 64 nt, Homo Sapiens
uacaucuguguuacacgugagcagaagcguuaucauacuccauugaacuuacagaauuuacuuu

SEQ ID NO: 108517 - RNA, 64 nt, Homo Sapiens
aggggauggggacaugaugcccagagccaccccuauacuccagucucccuggcaucagcuacug

SEQ ID NO: 108518 - RNA, 64 nt, Homo Sapiens
uuucuuucauuagcuaggaucuacuagaugcauuauacuccauaccugcuuuucccauggccgc

SEQ ID NO: 108519 - RNA, 64 nt, Homo Sapiens
cucacaaugcaggauccucuuugcugacucaggaauacuccauauuuuagacuacugccucuac

SEQ ID NO: 108520 - RNA, 64 nt, Homo Sapiens
auauugugccauaugacaacaaagucuuuccuaaauacuccaucuguuuaguacuguauugugg

SEQ ID NO: 108521 - RNA, 64 nt, Homo Sapiens
uuugccuuggaaguugcauggcaucaccuccaccauacuccaucaguuagagcugacacaaacc

SEQ ID NO: 108522 - RNA, 64 nt, Homo Sapiens
ccuuaaaccagaaugggaguuugaaagagagaucauacuccagcugaaguuuguugacccuuuu

SEQ ID NO: 108523 - RNA, 64 nt, Homo Sapiens
uucuuccccgaaucacacagggaaugcuacuaagauacuccauaauuuaggggcaaguaauaau

SEQ ID NO: 108524 - RNA, 64 nt, Homo Sapiens
caacggggacuacuagucccugauguucccagccauacuccaguaauguauccauugccuuuga

SEQ ID NO: 108525 - RNA, 64 nt, Homo Sapiens
cuaagaaaagugguccauccugaauaaacauguaauacuccagcagggauaugaagccucugaa

SEQ ID NO: 108526 - RNA, 64 nt, Homo Sapiens
cauuacuccuggucuugggaguugccuucugaggauacuccacuggggguaccugagccuggau

SEQ ID NO: 108527 - RNA, 64 nt, Homo Sapiens
cagagcgagacuuaucucauaaauaaauagauagauacuccagccugggugacagagcgagacu

SEQ ID NO: 108528 - RNA, 64 nt, Homo Sapiens
ccucucucgggagcccuagcccugcuccaacuccauacuccacuccaagugccccaccacuccc

SEQ ID NO: 108529 - RNA, 64 nt, Homo Sapiens
auuaauguuuauuuagcucugaagcaagagugauauacuccaggacuuagaauagugccuaaag

SEQ ID NO: 108530 - RNA, 64 nt, Homo Sapiens
uccuugaguuuuguuauaucaaugucauuaaccaauacuccaagcaggggucuaauccaaaaga

SEQ ID NO: 108531 - RNA, 64 nt, Homo Sapiens
auuguauuagauuuuugugaccauucuugggcacauacuccaagauuggacccuugcuuugaua

SEQ ID NO: 108532 - RNA, 64 nt, Homo Sapiens
gaguguguuugugaguuuuuaaagcccacaucuuauacuccaauuuuuuuuaaaaaaaaaaaaa

SEQ ID NO: 108533 - RNA, 64 nt, Homo Sapiens
uaauuugugggcagggguggaggaugcauguaugauacuccauaaauucaacauucuuuacuau

SEQ ID NO: 108534 - RNA, 64 nt, Homo Sapiens
gacucacugcacagccgcuuccuagcagggagcuauacuccaacuccuacuugaguuccugcgg

SEQ ID NO: 108535 - RNA, 64 nt, Homo Sapiens
gcuaccaaguuaaccugcucgucuccaucuggucauacuccauagggccggccacaagacccau

SEQ ID NO: 108536 - RNA, 64 nt, Homo Sapiens
ggauacuuaagcccucaucaugcaacaagcucugauacuccagggagcaggaccguggaucacc

SEQ ID NO: 108537 - RNA, 64 nt, Homo Sapiens
agcugagucagaauuaaaggagggaauuguauugauacuccaauaccuaaauuucacaauacca

SEQ ID NO: 108538 - RNA, 64 nt, Homo Sapiens
caguuaggugggaguauaaaacuaucugaacucuauacuccagauuuauaaaacuuccuaagag

SEQ ID NO: 108539 - RNA, 64 nt, Homo Sapiens
augaaauugguauuguuuucuucagggauaguaaauacuccaaagcacccccauuauauuaauu

SEQ ID NO: 108540 - RNA, 64 nt, Homo Sapiens
aacuuaucuuucuguccuuugauuaugguguaagauacuccaguuguauaauucaacaauuuua

SEQ ID NO: 108541 - RNA, 64 nt, Homo Sapiens
guuauuuuaagcuaccuacauuucccuggaguaaauacuccauguagucuauggaguuuucuga

SEQ ID NO: 108542 - RNA, 64 nt, Homo Sapiens
accguccaguuguggcagcuagagagaacuggugauacuccaacauccccuucuuucccaugag

SEQ ID NO: 108543 - RNA, 64 nt, Homo Sapiens
uuuauauuguccuuuuuuacuggaagacguacgcauacuccaucgauguuguauuugcaguggc

SEQ ID NO: 108544 - RNA, 64 nt, Homo Sapiens
ccuggggccucccaccccagccucccugaggcccauacuccacggagaggagccccaugcccag

SEQ ID NO: 108545 - RNA, 64 nt, Homo Sapiens
gugagcgcauugagccaguggugcuaaaugcuacauacuccaacugaaauguuaaggaagaaga

SEQ ID NO: 108546 - RNA, 64 nt, Homo Sapiens
gcccccuagccagccccgcacacacucaacucugauacuccagcccuguggcaccccagacccu

SEQ ID NO: 108547 - RNA, 64 nt, Homo Sapiens
acaaccaccccauauuaugaauuugugucagaaaauacuccagagugggagaauuagagaauuu

SEQ ID NO: 108548 - RNA, 64 nt, Homo Sapiens
acacaauagcaguacaccacccugucucaguaggauacuccauauucugccaacauaguuuuau

SEQ ID NO: 108549 - RNA, 64 nt, Homo Sapiens
cuagagggaaaguuaggaauaggccucccagaggauacuccagacaguugacaagcaucgcagc

SEQ ID NO: 108550 - RNA, 64 nt, Homo Sapiens
agacccgucugaagggguauuagcuuucaucauuauacuccaacuauuuucgggcaauuauguu

SEQ ID NO: 108551 - RNA, 64 nt, Homo Sapiens
uaguuggguucuucagggaaauaggagaggcaacauacuccaaagugcccccagaugccucuug

SEQ ID NO: 108552 - RNA, 64 nt, Homo Sapiens
agagagcuacauuuuaaaggcugucuuggcaaaaauacuccauuugggaacucacugccuuaua

SEQ ID NO: 108553 - RNA, 64 nt, Homo Sapiens
guagccagugacccguuaggagcucucaccguacauacuccagucuaauuuaaaucugaccaca

SEQ ID NO: 108554 - RNA, 64 nt, Homo Sapiens
accaucaccauguaccauguagaucccucauuugauacuccaaaugccggugucccuucucccc

SEQ ID NO: 108555 - RNA, 64 nt, Homo Sapiens
guccgaauugcuuuuauuuucuuauacuuucaguauacuccauagaccaaagagcaaaaucuau

SEQ ID NO: 108556 - RNA, 64 nt, Homo Sapiens
caacacuuauuagugacaguauugacaucugagcauacuccaguuuacuaauacagcaggguaa

SEQ ID NO: 108557 - RNA, 64 nt, Homo Sapiens
uguguguuaaaaugauaacuaacaugugaauaaaauacuccauuugaaacucuucgguuauuug

SEQ ID NO: 108558 - RNA, 64 nt, Homo Sapiens
ucaaaaugagauaugcaauaaauauuauuugaugauacuccaccagugaaaauugaugcuaagu

SEQ ID NO: 108559 - RNA, 64 nt, Homo Sapiens
gcuauucguccuguaaucuguuucuaggugaagcauacuccaguguuuuagggguuuugaaaau

SEQ ID NO: 108560 - RNA, 64 nt, Homo Sapiens
uugcacacgcagucugcagagaaccccaagugaaauacuccacguggaagccgugguaugugag

SEQ ID NO: 108561 - RNA, 64 nt, Homo Sapiens
aaauaagcuuucuuguaagcucucuuccuaacagggcacauauucuuccauaauauaaacacuu

SEQ ID NO: 108562 - RNA, 64 nt, Homo Sapiens
aacccacuguuaccaguguaggaaguuacaagaaggcacauacugaaugcugaaguauacauau

SEQ ID NO: 108563 - RNA, 64 nt, Homo Sapiens
aaacacugcauuaaaaaaguaucuguugcauuaaggcacauagugggauuacaucauaaaccuc

SEQ ID NO: 108564 - RNA, 64 nt, Homo Sapiens
ucuacuaaaaauacaaaaauuagcugggcaugguggcacauaccuguaaucccagcuacucggg

SEQ ID NO: 108565 - RNA, 64 nt, Homo Sapiens
aggcuuaaauauaaggaacagaauuuucacuguuggcacauauguuucauucuuaaaaauaaau

SEQ ID NO: 108566 - RNA, 64 nt, Homo Sapiens
aggaauauuuauauggcuucgauaauuuaguuugggcacauaaaguccgucuaacugguacauu

SEQ ID NO: 108567 - RNA, 64 nt, Homo Sapiens
ucaccacugucacaggaagagacagaguuaucgaggcacauacugcagugcuaccacgguaaug

SEQ ID NO: 108568 - RNA, 64 nt, Homo Sapiens
ucaccaccgucacaggaagcgacagaguuaucgaggcacauacuggagugcuaccauggaaaug

SEQ ID NO: 108569 - RNA, 64 nt, Homo Sapiens
aaaggcucaauaaaaacaaguuggcacaaaaccuggcacauaguauuaaauguauguaagacac

SEQ ID NO: 108570 - RNA, 64 nt, Homo Sapiens
ugugaucacagcagacagggcaggcccugugcugggcacauagcauuagggagacucguaaggc

SEQ ID NO: 108571 - RNA, 59 nt, Homo Sapiens
aaaaugaauaagcuaucaauauauaauuuaaguacaaguuuaggcugggcgugguggcu

SEQ ID NO: 108572 - RNA, 59 nt, Homo Sapiens
aucucaaaaaaagaaagaaagaaaaaagaaaguacaaguuuauaaaguauuauagugaa

SEQ ID NO: 108573 - RNA, 59 nt, Homo Sapiens
uucuuccucuuuaccucuuaaaacagcagaaguacaagaauacagcuguagggucauug

SEQ ID NO: 108574 - RNA, 59 nt, Homo Sapiens
uuguuuuaaaucuauuuuguaaagauauaaaguacaauagaauuucuggaguacagauu

SEQ ID NO: 108575 - RNA, 59 nt, Homo Sapiens
aacauucauuauuuuauuaauauugcccuaaguacaacuaggcaagugauugccaccua

SEQ ID NO: 108576 - RNA, 59 nt, Homo Sapiens
ggaaaccagcagauaguaaaccugguucaaaguacaauucaagaaacugaguauuuaug

SEQ ID NO: 108577 - RNA, 59 nt, Homo Sapiens
auuagccaggcgugguggcgcucuacuaaaaguacaaaaccaacauggugaaacccugu

SEQ ID NO: 108578 - RNA, 59 nt, Homo Sapiens
auauuucagucaguccagagcuuuuguguaaguacaaccgcuggaucugaaccaguguu

SEQ ID NO: 108579 - RNA, 59 nt, Homo Sapiens
uuuggaaugauaccugaagaauugugacuaaguacaacuauuuaaauguuaacuguugu

SEQ ID NO: 108580 - RNA, 59 nt, Homo Sapiens
cccaucauuuggaaaaauaaaggcaucugaaguacaauauuacuuauagaaauaguuua

SEQ ID NO: 108581 - RNA, 59 nt, Homo Sapiens
cuucuucccauagaauuagaaacaugugaaaguacaauaaacuucuuguucaaauuacc

SEQ ID NO: 108582 - RNA, 59 nt, Homo Sapiens
cgaguauuaggcaauuugcagguggcaugaaguacaauuauugaaaauuuaaauaacau

SEQ ID NO: 108583 - RNA, 59 nt, Homo Sapiens
uaacuucaagaaaacaaaauaccuuccuuaaguacaauuaauucagccaaacauaaaua

SEQ ID NO: 108584 - RNA, 59 nt, Homo Sapiens
agaugaguauuuccaggacaacguucuaaaaguacaauuauuucuuauuggggagauua

SEQ ID NO: 108585 - RNA, 59 nt, Homo Sapiens
gagauuacagguaguuuggcaaagcauugaaguacaaagguacauuuucaauuaaaaag

SEQ ID NO: 108586 - RNA, 64 nt, Homo Sapiens
agaacugaaggggaguuuuccaccaccaccuggagcggcucaucgugcggcucacaucacuguc

SEQ ID NO: 108587 - RNA, 64 nt, Homo Sapiens
ucacuguccaccaccaccuguaauguauugcagugcggcucacagcucugcagcaauauucuga

SEQ ID NO: 108588 - RNA, 64 nt, Homo Sapiens
cuggcccccuuguucagccccugccggcacacgggcggcucacccuggacacugugaugcgcau

SEQ ID NO: 108589 - RNA, 64 nt, Homo Sapiens
caucaucccgcuggcccugugcccuggagggugggcggcucauggugccacagccccuggcagg

SEQ ID NO: 108590 - RNA, 57 nt, Homo Sapiens
ugcagacagacaauaauucuggagauacugguggaaguuccaaguccaauaagacac

SEQ ID NO: 108591 - RNA, 57 nt, Homo Sapiens
uugcucauuaauuuugaaaagauguaccugguggauaucuagcuaguaauauauucu

SEQ ID NO: 108592 - RNA, 57 nt, Homo Sapiens
ugccaugaguaggagccccuaguggggcugguggacagcuuuggaagagguguccug

SEQ ID NO: 108593 - RNA, 57 nt, Homo Sapiens
ugcgccugcugcccuuuccuggcagggcugguggagucuucccucaaagcaugccuu

SEQ ID NO: 108594 - RNA, 57 nt, Homo Sapiens
agcugaugucguguuuacaguggggugcugguggagcaugaccuaggacugaugcug

SEQ ID NO: 108595 - RNA, 57 nt, Homo Sapiens
uguguguuuauuauguggaggccccuccugguggaugcaugggggcuugcucauacc

SEQ ID NO: 108596 - RNA, 57 nt, Homo Sapiens
auguuaguuuugguaauuuuuuuucugcugguggauuuacauauuaaauuuuuucug

SEQ ID NO: 108597 - RNA, 57 nt, Homo Sapiens
guggauuuacauauuaaauuuuuucugcugguggauaaacauuaaaauuaaucaugu

SEQ ID NO: 108598 - RNA, 57 nt, Homo Sapiens
uggugcuccaagggucgcugccgcucccugguggagcugacccccauagcagcagug

SEQ ID NO: 108599 - RNA, 57 nt, Homo Sapiens
ugucagagcccagcucaugcacaucagcugguggagcaggccuggccuuggagaacg

SEQ ID NO: 108600 - RNA, 57 nt, Homo Sapiens
uucuccccacuccccaagucggagggucugguggacuagcgaguaaugucaacuucg

SEQ ID NO: 108601 - RNA, 57 nt, Homo Sapiens
cguuaggauaagcaagaauuugaaucacugguggaaaugacuuuucuucuuacaugc

SEQ ID NO: 108602 - RNA, 57 nt, Homo Sapiens
uuguucacccuaggaaggggacucaaacugguggagcaaaauuccaguuauuaacac

SEQ ID NO: 108603 - RNA, 57 nt, Homo Sapiens
gauuuuuuucauuauggagccacuuggcugguggagagguggccaccugggucccag

SEQ ID NO: 108604 - RNA, 57 nt, Homo Sapiens
cuuuuccuuauagugaauuuccuacuacugguggauuucagcaaaaauaaguagcua

SEQ ID NO: 108605 - RNA, 57 nt, Homo Sapiens
ugaaaaccaagagcuacaagaccuguucugguggaaaagggacaggaggaaaaugaa

SEQ ID NO: 108606 - RNA, 57 nt, Homo Sapiens
ugauaccccucuuggugggcagcugcucugguggaguugggaagggauaggaccugg

SEQ ID NO: 108607 - RNA, 57 nt, Homo Sapiens
cagggagccuuccuggucccaggaccucugguggagggccauggcguggaccuucac

SEQ ID NO: 108608 - RNA, 57 nt, Homo Sapiens
auccagccugggagccccuggacugcucugguggaaauaacaggcuccugcccccaa

SEQ ID NO: 108609 - RNA, 57 nt, Homo Sapiens
gccugucugugucacacacuuuuccuccugguggaguugguugacgucugcuguggg

SEQ ID NO: 108610 - RNA, 57 nt, Homo Sapiens
gugcccggcagacgugugagcuuggaccugguggagggagagggauggcucacgagg

SEQ ID NO: 108611 - RNA, 57 nt, Homo Sapiens
gugcccagcagacguggugucuuggaccugguggagggagaggaacggcucacgaga

SEQ ID NO: 108612 - RNA, 57 nt, Homo Sapiens
uaaccccugcucggggccccacggaugcugguggacugugugccccugguggaggug

SEQ ID NO: 108613 - RNA, 57 nt, Homo Sapiens
ugcaggaugcugguggacugugugccccugguggagguggacgacaugaugaucaug

SEQ ID NO: 108614 - RNA, 57 nt, Homo Sapiens
ggcuuccagcuaccccugacuuagagccugguggaggugugguucuucagaagucag

SEQ ID NO: 108615 - RNA, 57 nt, Homo Sapiens
uaaucccagcacuuugggaggccgaggcugguggaucacgaggucaagaguucaaga

SEQ ID NO: 108616 - RNA, 64 nt, Homo Sapiens
caacgucuagcggccccgcgggacuggggacugagcccaggagguuugcacaagccgggcgauu

SEQ ID NO: 108617 - RNA, 64 nt, Homo Sapiens
guuggggaacagauggcugaggcugcagacucaggcccaggacacucaaccccaggaggggagc

SEQ ID NO: 108618 - RNA, 64 nt, Homo Sapiens
gaggggagccgcucggcgaaugagcugggugggugcccaggagccggcccgcagcaccugcaca

SEQ ID NO: 108619 - RNA, 64 nt, Homo Sapiens
ucaaggcugcagugagccaagcaggaucacuugagcccaggaggcugcuugggaggcugagguu

SEQ ID NO: 108620 - RNA, 64 nt, Homo Sapiens
uugagguuguaguaagcuacgaaggaucacuugagcccaggaaucacuuuggaaggcugaggca

SEQ ID NO: 108621 - RNA, 64 nt, Homo Sapiens
uugagaaugcagugagcuugggaggaucacaagagcccaggaggcuaugcagaugucuaagaca

SEQ ID NO: 108622 - RNA, 64 nt, Homo Sapiens
ucaagaccagccuggacaacgaggaucgucuugagcccaggaguacuuugggaggcugaaguag

SEQ ID NO: 108623 - RNA, 64 nt, Homo Sapiens
uggggaagaguagguucucguauuccguucuggggcccaggaagcuuuccacaggccauccucu

SEQ ID NO: 108624 - RNA, 61 nt, Homo Sapiens
ggugggggguccagggcacccacgcuccucagcccaggaguucaccaacggcaucauguga

SEQ ID NO: 108625 - RNA, 64 nt, Homo Sapiens
aucaacacuguucucucugugcagccccuuuguggcccaggauaggggaagugaacuacccagg

SEQ ID NO: 108626 - RNA, 64 nt, Homo Sapiens
auggcacccuuagagugcagagugggcagagguggcccaggaccagacgugagaugaacacugg

SEQ ID NO: 108627 - RNA, 64 nt, Homo Sapiens
acaaaguguggaggccucggcucuuggaggcagggcccaggagacucucugaguucugugcugu

SEQ ID NO: 108628 - RNA, 64 nt, Homo Sapiens
ugggagaaggucacagagcccaaguccagcucaggcccaggagguccccuacuccaccuccuuc

SEQ ID NO: 108629 - RNA, 64 nt, Homo Sapiens
auugcuuuucugugaauucaccaacacauucuuggcccaggagcgagggggugcuggccaagag

SEQ ID NO: 108630 - RNA, 64 nt, Homo Sapiens
ccuuucugccuuggccucggcgggcuuuucuggggcccaggaagcccacacuaugcacagagcc

SEQ ID NO: 108631 - RNA, 64 nt, Homo Sapiens
ucccaagucagacagaugucagcuucccagccaugcccaggacguccuaucucccccaacccac

SEQ ID NO: 108632 - RNA, 64 nt, Homo Sapiens
cccagcacuuagggugccaauguggauuaccugagcccaggaguuugagaccagccuggguaac

SEQ ID NO: 108633 - RNA, 64 nt, Homo Sapiens
acaaaaucuaggcagugaacaagucuucauccuggcccaggaaauagccuauuaaaaaaugcug

SEQ ID NO: 108634 - RNA, 64 nt, Homo Sapiens
agggggaggaugacaagccgcugcccaccuccaagcccaggaaacaguacaagauggcuaagga

SEQ ID NO: 108635 - RNA, 64 nt, Homo Sapiens
ggaaaacuggguuuaucucaaggcagcagccugagcccaggagcagaggacccaguuguuauaa

SEQ ID NO: 108636 - RNA, 64 nt, Homo Sapiens
gagcuacggcagggugugugcacaaucccaccuagcccaggagaacagggaagcaugugacacc

SEQ ID NO: 108637 - RNA, 64 nt, Homo Sapiens
cagagguugcagugagccgaggagaaucacugcagcccaggaggaggagaauuacuugaacgca

SEQ ID NO: 108638 - RNA, 64 nt, Homo Sapiens
uuaauaugaaauuuuuuuucaugcuuuaucaauagcccaggauauauuuuauuuuuagaauuuu

SEQ ID NO: 108639 - RNA, 64 nt, Homo Sapiens
uaagagacaauuucugcagguggcaggugagcaagcccaggagaaugcugcaaucuugggggug

SEQ ID NO: 108640 - RNA, 64 nt, Homo Sapiens
uugaggcuggagugagccauggaggaucacuugagcccaggagguuacucaggaggcugaggca

SEQ ID NO: 108641 - RNA, 64 nt, Homo Sapiens
ucgagaccagccugggcaacgggcggauaguugagcccaggagugcacuuugggaggcugaugu

SEQ ID NO: 108642 - RNA, 64 nt, Homo Sapiens
ucgaggcugcagugugcuguggaaaaucacuugagcccaggaggcuacucaggaggcugaggug

SEQ ID NO: 108643 - RNA, 64 nt, Homo Sapiens
uugagaacaggauuuugagaagcagguuguuugagcccaggaaucacuaugggaggcugaggca

SEQ ID NO: 108644 - RNA, 64 nt, Homo Sapiens
gugccugcacaugagaggaguaggucugcuuccugcccaggaagggccgccacugcaguucugc

SEQ ID NO: 108645 - RNA, 64 nt, Homo Sapiens
agccagcaagagcaaggcauaccucuggcagcuggcccaggaagaggcauccuggugccugcau

SEQ ID NO: 108646 - RNA, 64 nt, Homo Sapiens
gacguggucuuccagcccaucggaggagugaggagcccaggaaccguucuuauaccacguucca

SEQ ID NO: 108647 - RNA, 64 nt, Homo Sapiens
guggucugccauugcaaugcgcaucugcacuccagcccaggacugaagugccaagauuggcuug

SEQ ID NO: 108648 - RNA, 64 nt, Homo Sapiens
uggagccacagagcuggugcguccuuggcaguuggcccaggaacugaaggcuggcacgugcagc

SEQ ID NO: 108649 - RNA, 64 nt, Homo Sapiens
uauuuugggaggccgaggagagaggaucacuuaagcccaggagucugagaccagccugggcaac

SEQ ID NO: 108650 - RNA, 64 nt, Homo Sapiens
cuacaugggaggcugaggugggaggaucacuugagcccaggaaguccagaacguagugagccuu

SEQ ID NO: 108651 - RNA, 64 nt, Homo Sapiens
cuggaagggcccucgaaugccauucacaggaacagcccaggaacccagggacuucagaagggcu

SEQ ID NO: 108652 - RNA, 64 nt, Homo Sapiens
uaaucccagcucuggaagcugaaggauagcuugagcccaggaguucgaggcugcagugagcuau

SEQ ID NO: 108653 - RNA, 64 nt, Homo Sapiens
cagagguugcagugagccaaggaggauugcuugagcccaggaggcuacugaggaggcugaggug

SEQ ID NO: 108654 - RNA, 64 nt, Homo Sapiens
ucaagaccagccugggcaacgguagauuacuugagcccaggaaucacuuugggaggcugaggug

SEQ ID NO: 108655 - RNA, 64 nt, Homo Sapiens
ucgaggcugcagugagccauggaagaucacuugagcccaggaggcuucucaggaggcuggggug

SEQ ID NO: 108656 - RNA, 64 nt, Homo Sapiens
uugagaccagcuaaggcaauggaggauagcgugagcccaggagucacuuugggaggcugagucg

SEQ ID NO: 108657 - RNA, 64 nt, Homo Sapiens
uuggguucguaccagcaaguagacuaggaacugagcccaggaaagggggauguuuuccuggugu

SEQ ID NO: 108658 - RNA, 64 nt, Homo Sapiens
cucacugcccaagucauggcaacaggcuggagcagcccaggagaugggccuaaaauguucugga

SEQ ID NO: 108659 - RNA, 64 nt, Homo Sapiens
ccccucccucgucccacccccacccaggcaggaagcccaggaggagugcgggcagggccugacc

SEQ ID NO: 108660 - RNA, 64 nt, Homo Sapiens
cugaaggggucccccauuguuuugcuuccccagcgcccaggaugagcgguuuaccaucgagcuu

SEQ ID NO: 108661 - RNA, 64 nt, Homo Sapiens
gaugcucucauaagcaccuugaugcucucauaaggcccaggaagcaagagaagggcccaggaag

SEQ ID NO: 108662 - RNA, 64 nt, Homo Sapiens
gaugcucucauaaggcccagcuggcaagagaagggcccaggaagucugccauccacggccuuuu

SEQ ID NO: 108663 - RNA, 64 nt, Homo Sapiens
ucagguucauuuuguuacauguacagcaggcugggcccaggaggacacaaaacaaacagugauu

SEQ ID NO: 108664 - RNA, 64 nt, Homo Sapiens
uuucuuuucuggguaucuugagcuuuuccuggaggcccaggauaaaaggagaaggaauuggagc

SEQ ID NO: 108665 - RNA, 64 nt, Homo Sapiens
uugaggcugcagugagcagaggaggcucacuugagcccaggaggucccagcugcucugauaaga

SEQ ID NO: 108666 - RNA, 64 nt, Homo Sapiens
uggagguugcagugagcugagauggaucgcuugagcccaggaggcugcucagguggcuagggug

SEQ ID NO: 108667 - RNA, 64 nt, Homo Sapiens
gaucuugggaggucgaggcaagcugaucgcuugagcccaggaguuuaagaccggccugaguagc

SEQ ID NO: 108668 - RNA, 64 nt, Homo Sapiens
cuacugggggugcugaggugggaggaucgcuugagcccaggagagugaggcugcagugagcuga

SEQ ID NO: 108669 - RNA, 64 nt, Homo Sapiens
caauagcuaggaaucauguucaauauugaauucugcccaggagcaugaacugauccaugaaugc

SEQ ID NO: 108670 - RNA, 64 nt, Homo Sapiens
guggcugagguggaagaauggaagaaucacuugagcccaggaguuugaggcugcagugagcuau

SEQ ID NO: 108671 - RNA, 64 nt, Homo Sapiens
cagcuccccaccugcccugcacucugcccucuuugcccaggauacugaggagggcuggagcucg

SEQ ID NO: 108672 - RNA, 64 nt, Homo Sapiens
agcuugggccacugccugggacccagcagacacugcccaggacucuuuagugcacucacucuug

SEQ ID NO: 108673 - RNA, 64 nt, Homo Sapiens
uccagauaaauaaccauacacugaccucauacuugcccaggacccauuaaaguugcgguauuua

SEQ ID NO: 108674 - RNA, 64 nt, Homo Sapiens
agacuccuguugggacacaguuggucugcagucggcccaggacggucuacucagcacaacugac

SEQ ID NO: 108675 - RNA, 64 nt, Homo Sapiens
ucgaggcugcagucagucauggaggauugcuugagcccaggaguccacucaggaggcugaggca

SEQ ID NO: 108676 - RNA, 64 nt, Homo Sapiens
cauccguugugcuugccugcggugcuaaauggucgcccaggagagaagcccaagugaaaucaaa

SEQ ID NO: 108677 - RNA, 64 nt, Homo Sapiens
uugaggcugcagugagccauugaggaucacuugagcccaggagaugggcuacucuggaggcccu

SEQ ID NO: 108678 - RNA, 64 nt, Homo Sapiens
ucgacaccagccuggccaacgggcaauggcuugagcccaggaguuaaucccagcacuuugaggu

SEQ ID NO: 108679 - RNA, 64 nt, Homo Sapiens
ggucacuguccuguaaugucucccggucagggcagcccaggacugcccagccuggugggcuggg

SEQ ID NO: 108680 - RNA, 64 nt, Homo Sapiens
caaauccauagaaagacaaacggccaccuugggugcccaggauacuggugccuggccccacgua

SEQ ID NO: 108681 - RNA, 64 nt, Homo Sapiens
cacuuuaggaggcugaggcaggaggacuguuugagcccaggaguuugagaccaaccugaguaag

SEQ ID NO: 108682 - RNA, 64 nt, Homo Sapiens
cuacuuggggugcugaggcgggaggauuacuugagcccaggaggauuacuucaaccugggaggu

SEQ ID NO: 108683 - RNA, 64 nt, Homo Sapiens
gcacuuuggaggccaaggcaggaggacugcuugagcccaggaguuugagaccagccugggcaau

SEQ ID NO: 108684 - RNA, 64 nt, Homo Sapiens
cacuuugggaggccgaggcaggaagacugcuugagcccaggaguucaagaccagccugggcaac

SEQ ID NO: 108685 - RNA, 64 nt, Homo Sapiens
cuacucaggagguugaggugggaagauugcuugagcccaggaguuugagguugcagugagcuga

SEQ ID NO: 108686 - RNA, 64 nt, Homo Sapiens
ugcuuugggaggccauagcaggaggauugcuugagcccaggaguucgagaccagccagagcaac

SEQ ID NO: 108687 - RNA, 64 nt, Homo Sapiens
cuacuugggagguugaggugggaggauugcuugagcccaggauuucaaggcugcagugagccau

SEQ ID NO: 108688 - RNA, 64 nt, Homo Sapiens
uucauaucuuuaaaagcugcaccaaagggguaaggcccaggacacugcagcugcuagcucagac

SEQ ID NO: 108689 - RNA, 64 nt, Homo Sapiens
cugaggaaauacccagucagugaggaucaaacaggcccaggagcgaccugaaccagagcuggag

SEQ ID NO: 108690 - RNA, 64 nt, Homo Sapiens
auuugucugagacauuuccaugagggagggccaagcccaggaggcugccccggcugugccaggg

SEQ ID NO: 108691 - RNA, 64 nt, Homo Sapiens
ccuuucucugccgccugcuggucuccaaauuacagcccaggacauccgggaucccagaacucug

SEQ ID NO: 108692 - RNA, 64 nt, Homo Sapiens
agcaaugucucuucacgggcccugaucaacuggggcccaggaaaggagucuuuuuuuccucugc

SEQ ID NO: 108693 - RNA, 64 nt, Homo Sapiens
ccauguugggcccucguuucggacaugugcccuggcccaggaggccagggcugcaggcaaagcu

SEQ ID NO: 108694 - RNA, 64 nt, Homo Sapiens
gcaaguacagccacuguaaauaacccucgucccugcccaggaacccagacuggacuucagucuc

SEQ ID NO: 108695 - RNA, 64 nt, Homo Sapiens
ccaagaaggucauuuccaaacccauccuggaagggcccaggauccaaaggucaucaguccugcu

SEQ ID NO: 108696 - RNA, 64 nt, Homo Sapiens
cacgaugggaggccaagacaggcagaucacuugagcccaggaguuugaggccagccugggcaac

SEQ ID NO: 108697 - RNA, 64 nt, Homo Sapiens
cuacucaggaggcaaagaugggaggauuacuugagcccaggaggucaaggcuacagugagccau

SEQ ID NO: 108698 - RNA, 64 nt, Homo Sapiens
augcccagagugaccaagcagcaccagcaggccugcccaggaugcugaaagcagauuucuucuu

SEQ ID NO: 108699 - RNA, 64 nt, Homo Sapiens
ucaauaagaaaauaggggugauggagggggagaagcccaggacugggagaaucgcacaugcccc

SEQ ID NO: 108700 - RNA, 64 nt, Homo Sapiens
ugggcccugccacccaggccagcuggguccugccgcccaggagcccagcaggaggaagcccagg

SEQ ID NO: 108701 - RNA, 64 nt, Homo Sapiens
uggguccugccgcccaggagcccagcaggaggaagcccaggagccacacuuccccaagggcgga

SEQ ID NO: 108702 - RNA, 64 nt, Homo Sapiens
uugggugugcugacgagcaguaggagccccaguagcccaggagccccugcugaugagcccacuc

SEQ ID NO: 108703 - RNA, 64 nt, Homo Sapiens
cccaggacugagguccugagaaggggauagcacugcccaggacgugugucccuagccuggaaug

SEQ ID NO: 108704 - RNA, 64 nt, Homo Sapiens
guccagcugcccucuacgaucaggugcaggggcugcccaggacaaagcgggggcaggggaaaga

SEQ ID NO: 108705 - RNA, 64 nt, Homo Sapiens
cacuuugggaggcccaggcagaaggaucgcugcagcccaggaguucgagacuagccugggcaac

SEQ ID NO: 108706 - RNA, 64 nt, Homo Sapiens
guacucaggaggccaaggcaggaggauugcuugagcccaggaguuugagaccagccugggcaac

SEQ ID NO: 108707 - RNA, 64 nt, Homo Sapiens
augaaucaacugcuauccuuccccucaccccucagcccaggagggaaagggcauuuucuuuuuc

SEQ ID NO: 108708 - RNA, 64 nt, Homo Sapiens
ucucagugcugacucacgggcaugcuucauugaggcccaggaagaggcccugguuuggggcugu

SEQ ID NO: 108709 - RNA, 64 nt, Homo Sapiens
uugaggcugcagugagguguuagaggauccuugagcccaggagggcuacucaggaggcugaggc

SEQ ID NO: 108710 - RNA, 64 nt, Homo Sapiens
ucaagacuagccuaggcaacggaggaucacuugagcccaggagucacuuugggaggcugaggca

SEQ ID NO: 108711 - RNA, 64 nt, Homo Sapiens
gcucgggacagcugugugcugaguggcugagagggcccaggagggugccugagcuuagguugug

SEQ ID NO: 108712 - RNA, 64 nt, Homo Sapiens
uuaagugacuuggcuaaaguaaauaaggaaacaggcccaggagaccccauuccucucuugcuac

SEQ ID NO: 108713 - RNA, 64 nt, Homo Sapiens
uucccugccccuuacucaccgucucgggcucugagcccaggacaggcagggacaccccugcagg

SEQ ID NO: 108714 - RNA, 64 nt, Homo Sapiens
ucggacugcugguccuggagccuacugcgcggcggcccaggagccaagggggccacuggcuacc

SEQ ID NO: 108715 - RNA, 64 nt, Homo Sapiens
aagaccacucccaccucaggaagcuaguauucaugcccaggaucggugaguucaggggauccau

SEQ ID NO: 108716 - RNA, 64 nt, Homo Sapiens
aaccacucacaccccagggggaugagcucuccaagcccaggauucuggcaagagaggugaagaa

SEQ ID NO: 108717 - RNA, 64 nt, Homo Sapiens
ccaagcaggugucggacugcucagaguccgcauggcccaggagcagguggucggaggccccugg

SEQ ID NO: 108718 - RNA, 64 nt, Homo Sapiens
ggccagguggcgaaaggggcccagucguucuugggcccaggauggggccucuagacuugcaagg

SEQ ID NO: 108719 - RNA, 64 nt, Homo Sapiens
gccugggcagagacccuguagugcucccggaggggcccaggaagguuggcccaggccccuggca

SEQ ID NO: 108720 - RNA, 64 nt, Homo Sapiens
cagucucuggcuguggcuccagaguucaaggagagcccaggagcggggcugggggcuggcaccg

SEQ ID NO: 108721 - RNA, 64 nt, Homo Sapiens
ugcgccauccuuuaggccgaaaaaauucuuuccugcccaggaccuuacaguuaugugauaaagg

SEQ ID NO: 108722 - RNA, 64 nt, Homo Sapiens
ggagggaggcaagccagucgucuggccucgcuaggcccaggagaacugaccgaccauugccauu

SEQ ID NO: 108723 - RNA, 64 nt, Homo Sapiens
uccccgugguguccccuggcgccucccagagaaagcccaggaagcagauguggccagagcaccg

SEQ ID NO: 108724 - RNA, 64 nt, Homo Sapiens
cucaccgugucacagcuguguggguuugccaucagcccaggauauguggcucagccaucccggc

SEQ ID NO: 108725 - RNA, 64 nt, Homo Sapiens
agaaucgcugccuccucuccggcugaaaacgagggcccaggacccaucagauucaagcccagga

SEQ ID NO: 108726 - RNA, 64 nt, Homo Sapiens
cugaaaacgagggcccaggagccaucagauucaagcccaggaggcauggccaccagccccagcu

SEQ ID NO: 108727 - RNA, 64 nt, Homo Sapiens
cacuuuaagaggccaaggcggauggaucacuugagcccaggaguucaacaccagccugagcaac

SEQ ID NO: 108728 - RNA, 64 nt, Homo Sapiens
uaagcugccuggcauguggcacuuugucagggcagcccaggaaucugaaacaggaucaaacucu

SEQ ID NO: 108729 - RNA, 64 nt, Homo Sapiens
ggcugcauucccuggagacucacugcaaguuccugcccaggaggcugagggcaccccauccuca

SEQ ID NO: 108730 - RNA, 64 nt, Homo Sapiens
agggcucaagacaccacccccuccagcuucuggggcccaggagccucucccugcuacagggggu

SEQ ID NO: 108731 - RNA, 64 nt, Homo Sapiens
cuaacugggaggcugaggcaggaggaucacuugagcccaggagauugaggcugcagugagcaug

SEQ ID NO: 108732 - RNA, 64 nt, Homo Sapiens
cuccagcugcccacucaugggcccuucaccaccugcccaggaucucacccaguacugacagcuc

SEQ ID NO: 108733 - RNA, 64 nt, Homo Sapiens
gagaugagggggucgacagguugaacgucuucaggcccaggaccccaagcuccucagccuggcc

SEQ ID NO: 108734 - RNA, 64 nt, Homo Sapiens
ggggccgacccuccucgggaagccccuccacucugcccaggagagacacacacuccacgagagc

SEQ ID NO: 108735 - RNA, 64 nt, Homo Sapiens
ugaggagcuggaguggaagccacuuccaagaugugcccaggaugugauggcugugggaaucccc

SEQ ID NO: 108736 - RNA, 64 nt, Homo Sapiens
ccccgggccucgggcccggcgccaccgggcgcucgcccaggacuuacgacacgcguccucgggc

SEQ ID NO: 108737 - RNA, 64 nt, Homo Sapiens
gagaggcgggucccaggcccagcagcggccgcucgcccaggaugggccgcccacggggggccac

SEQ ID NO: 108738 - RNA, 64 nt, Homo Sapiens
cgacaagcuggacccccugcccccccccgagggugcccaggacugcgcggcccccggggauucc

SEQ ID NO: 108739 - RNA, 64 nt, Homo Sapiens
ucagagagggcgcggccccccccuccccgagugugcccaggaacggugcggcccuggggacccc

SEQ ID NO: 108740 - RNA, 64 nt, Homo Sapiens
ugagaagccaccgggaaagcagccagcacaaagggcccaggaagccagcccccgagagcugagc

SEQ ID NO: 108741 - RNA, 64 nt, Homo Sapiens
uugacuuggcagcauggagccaaggucuguccccgcccaggagggugccuuccucggggguagg

SEQ ID NO: 108742 - RNA, 64 nt, Homo Sapiens
cguccagaccucacccugugaagcuccagcauuugcccaggacccccccacuccauggggacag

SEQ ID NO: 108743 - RNA, 64 nt, Homo Sapiens
acgggagcuucugaagagcucgucuccauaaaaggcccaggaaccagccaugccuauccaauga

SEQ ID NO: 108744 - RNA, 64 nt, Homo Sapiens
ggagccauggcauaugacaaccugaggggcaucugcccaggacagcuuacugaggccaugagaa

SEQ ID NO: 108745 - RNA, 64 nt, Homo Sapiens
cccauccuugcuucaucucaagcccuugccuggagcccaggaaccucccugcugcagagagcac

SEQ ID NO: 108746 - RNA, 64 nt, Homo Sapiens
uuucuccaccuguguuuaugggaaguaaugagaagcccaggaaaucuguuuggggaagaugcaa

SEQ ID NO: 108747 - RNA, 64 nt, Homo Sapiens
uugaacauuuuccuuuacccgauggggcaccagugcccaggaauauguggcaaggcuuggauga

SEQ ID NO: 108748 - RNA, 64 nt, Homo Sapiens
ggcugccugcagaggacagggugagcaacagcuggcccaggaaacugaucagcuggauccccac

SEQ ID NO: 108749 - RNA, 64 nt, Homo Sapiens
aacacuuacauucuggugccagaagggauuuugggcccaggagacagaaacgacgguacccagg

SEQ ID NO: 108750 - RNA, 64 nt, Homo Sapiens
ggaaaucgauuucacaauccaaaaauggcccacagcccaggaagcuacccugaacaugccaguu

SEQ ID NO: 108751 - RNA, 64 nt, Homo Sapiens
gauuccacugcaaaaguggcugcuuuggaugccagcccaggaugaguaguuccuguucucaggg

SEQ ID NO: 108752 - RNA, 64 nt, Homo Sapiens
caauuugggaggcagaggugagagaaucgcuugagcccaggaauucgagaccagccugggccac

SEQ ID NO: 108753 - RNA, 64 nt, Homo Sapiens
uugggucauucauguccuacgcagcuaaaacagagcccaggagccagggaggaaaagcagucag

SEQ ID NO: 108754 - RNA, 64 nt, Homo Sapiens
ucuuccccaucaggcugggcucuggcagggaccugcccaggauggagaugagagagggugagag

SEQ ID NO: 108755 - RNA, 64 nt, Homo Sapiens
guggcucccuccuccccaucaagcacaagagagggcccaggaaaaaagguuucacauaagugua

SEQ ID NO: 108756 - RNA, 64 nt, Homo Sapiens
ccauucacucccaggcaggggugaggguggccuggcccaggaggccaggaaggagggcccuguc

SEQ ID NO: 108757 - RNA, 64 nt, Homo Sapiens
gacucagucugugaguaaaacugggggcucaaaugcccaggaugaggggaucagugacugucua

SEQ ID NO: 108758 - RNA, 64 nt, Homo Sapiens
cacuuugggaggccgaggugggaggaucacuugagcccaggaguucgagaccagccuaggcaac

SEQ ID NO: 108759 - RNA, 64 nt, Homo Sapiens
uggggcagaaacccagaacucagcauucaaggaugcccaggagagcugucccuguuuuaaagag

SEQ ID NO: 108760 - RNA, 64 nt, Homo Sapiens
acccaugcacagcagcugugcuuaaugccagguggcccaggaguacuggucucaucuccauugc

SEQ ID NO: 108761 - RNA, 64 nt, Homo Sapiens
uuacaacacagcaaguagcagaagagggguuccugcccaggaucgucuugucuaucuugaugga

SEQ ID NO: 108762 - RNA, 64 nt, Homo Sapiens
gaccuguguguaagucccaagcuguccugucgcugcccaggauuaggaagcacagaucucuaga

SEQ ID NO: 108763 - RNA, 64 nt, Homo Sapiens
gagugcaguggcucaaucucagucucgcucuaucgcccaggauguuuuuuuuuuuuugagaugg

SEQ ID NO: 108764 - RNA, 64 nt, Homo Sapiens
cucuuccacugguagaaggccuuuaaugaucugggcccaggaugauuuccugcccuuuuaucau

SEQ ID NO: 108765 - RNA, 64 nt, Homo Sapiens
uggccucaucuuccuuccugcuguaccacagauggcccaggagaggcacuugucuuuuauuaua

SEQ ID NO: 108766 - RNA, 64 nt, Homo Sapiens
auguuaggcucuccagggcuucuuuccaaacccccagcuccacaccccccagacccagcugguu

SEQ ID NO: 108767 - RNA, 64 nt, Homo Sapiens
gcccggccaggcagcugggaccagaaugcaaccccagcuccacuccagccuggcguccagggcc

SEQ ID NO: 108768 - RNA, 64 nt, Homo Sapiens
cauauugcuacagaggacauaugauaauggcuuccagcuccaucguuccuguguuaguuugcuu

SEQ ID NO: 108769 - RNA, 64 nt, Homo Sapiens
auuuuuaauuuuuuuaacuuuaaugagaagagagcagcuccacauaugacuagcucuugccgau

SEQ ID NO: 108770 - RNA, 64 nt, Homo Sapiens
gggucgugguggagaaucugagggcacucucugccagcuccacagggugggaugagccucuccu

SEQ ID NO: 108771 - RNA, 64 nt, Homo Sapiens
cauucccacauaauacauuccaucacagccagcccagcuccacucagggcuggcccggggaguc

SEQ ID NO: 108772 - RNA, 64 nt, Homo Sapiens
ugagcaucauacuggaaagcaaacaccuuuccuccagcuccagaauuccuugucucugaaugac

SEQ ID NO: 108773 - RNA, 64 nt, Homo Sapiens
gagcucacaccgaguugugcuuggcuugcuugugcagcuccaggcacccggugggcacucuggu

SEQ ID NO: 108774 - RNA, 64 nt, Homo Sapiens
ggacuuggccuaggguugucugagccggagccggcagcuccacuggagagcagugcaggcagag

SEQ ID NO: 108775 - RNA, 64 nt, Homo Sapiens
gggcgugugugugguggggcuuggcaugugauggcagcuccaggcaugccgcugcuuguauggc

SEQ ID NO: 108776 - RNA, 64 nt, Homo Sapiens
cuugucccuuuugaucauuauuaacucaggguuucagcuccaaccucgcugaguuggugcagcu

SEQ ID NO: 108777 - RNA, 64 nt, Homo Sapiens
ucaggguuucagcuccaaccucgcugaguuggugcagcuccaggucauuccuggggugggaauc

SEQ ID NO: 108778 - RNA, 64 nt, Homo Sapiens
gcgcugucucgugaauggacaagucccucucacgcagcuccacaaacagcagcuccaccaaaug

SEQ ID NO: 108779 - RNA, 64 nt, Homo Sapiens
aaaugaagucccucucacgcacaccuaagaacagcagcuccacccugagagcugggcggcgucc

SEQ ID NO: 108780 - RNA, 64 nt, Homo Sapiens
gcuccaccuggcuucacuccuuucaaaggcuccacagcuccaccaggccugggcccucaggaug

SEQ ID NO: 108781 - RNA, 64 nt, Homo Sapiens
gaagccccagccccuuccaguuggugccugagcgcagcuccagggagccaugagacccacagac

SEQ ID NO: 108782 - RNA, 64 nt, Homo Sapiens
ggcaggcagugcccagcugguuggaucucagguacagcuccagguguuauauacagauggcagc

SEQ ID NO: 108783 - RNA, 64 nt, Homo Sapiens
uccacacaguggccggcccuagguggucuggaggcagcuccacgcucccgccagccuuguuuuc

SEQ ID NO: 108784 - RNA, 64 nt, Homo Sapiens
cuggcugcuugccuuccauuguguucccagcaaccagcuccaucggcuuuuccaccuccagcaa

SEQ ID NO: 108785 - RNA, 64 nt, Homo Sapiens
gagcagagugucgaggauggcugugauguggacccagcuccaggguggcugagcucugugaucg

SEQ ID NO: 108786 - RNA, 64 nt, Homo Sapiens
uaccuuugugugucaccucacuucacgggacuuccagcuccagccagccaccuuugcgugucac

SEQ ID NO: 108787 - RNA, 64 nt, Homo Sapiens
caccuuugcgugucaccuucagcagguccaagugcagcuccagccccaaggugccugugcuccc

SEQ ID NO: 108788 - RNA, 64 nt, Homo Sapiens
ggugaugggggugauggacuaaugggacgugucccagcuccagguuuuuguauaaauaaaagaa

SEQ ID NO: 108789 - RNA, 64 nt, Homo Sapiens
gugggggggcugucccagggugugacucccuugccagcuccagauucccgcagaccaaagagag

SEQ ID NO: 108790 - RNA, 64 nt, Homo Sapiens
uuccaggcagccucgcccgcccggacagcuccagcagcuccacgcaaagaacuuuccaggucag

SEQ ID NO: 108791 - RNA, 64 nt, Homo Sapiens
agcuccacguuccaggcagcccaggucagccggacagcuccagcccuagaggccaaagaacuuu

SEQ ID NO: 108792 - RNA, 64 nt, Homo Sapiens
aaccaucaugguaagugguagaguucaucagagucagcuccaggaucccauaccaaagcccugu

SEQ ID NO: 108793 - RNA, 64 nt, Homo Sapiens
cagugaaaauaguaaucagacucugaauuuggaucagcuccaaguuugggucagaaccuucucu

SEQ ID NO: 108794 - RNA, 64 nt, Homo Sapiens
gccgucaacuccuguucuccgcaccagggacuggcagcuccacucgcaacacaacaaucagaug

SEQ ID NO: 108795 - RNA, 64 nt, Homo Sapiens
caaaggcccugcuuccuggaaaggacacucagagcagcuccaagacagaggcucuguggcgggg

SEQ ID NO: 108796 - RNA, 64 nt, Homo Sapiens
ccccuuggccagggccaugggagucccgcgcagucagcuccacauuggccucugcagcugggug

SEQ ID NO: 108797 - RNA, 64 nt, Homo Sapiens
cuuauugugcucagugaacauccagugcugggugcagcuccaucacccucuuguguguuuacau

SEQ ID NO: 108798 - RNA, 64 nt, Homo Sapiens
caagugauagucuauaggaguguuuaauuucuugcagcuccaucugguugcugcauuugaagca

SEQ ID NO: 108799 - RNA, 64 nt, Homo Sapiens
gggaaucagaacucaaauggcagggcccagagcccagcuccaagcacaaggauagaugcuggcc

SEQ ID NO: 108800 - RNA, 64 nt, Homo Sapiens
cugcaaagaucuguccucagaaggacuuccuguccagcuccaaccuuugggccagacaugccac

SEQ ID NO: 108801 - RNA, 64 nt, Homo Sapiens
guaaucuuacgggaucaucacaauaggaauuuuucagcuccauuaccauggcuguguccccagg

SEQ ID NO: 108802 - RNA, 64 nt, Homo Sapiens
gucucuccagaauaagacauucauuguugaacuucagcuccaguuugccagguaauaaguguga

SEQ ID NO: 108803 - RNA, 64 nt, Homo Sapiens
uggcguccucccugccucucguucuuaagagucccagcuccaggugugucuuugucauugucug

SEQ ID NO: 108804 - RNA, 64 nt, Homo Sapiens
uccacuaccacuccaagccuaagcccuggaauuccagcuccaccugucaaauggccugcccaug

SEQ ID NO: 108805 - RNA, 64 nt, Homo Sapiens
cggcacuaccacccugcuccaucaucacuacguccagcuccaacggcacuggugccccauucca

SEQ ID NO: 108806 - RNA, 64 nt, Homo Sapiens
ggcaccagugccucgcuccauuggcaccaacgcccagcuccaccgguacuggcucccugcucca

SEQ ID NO: 108807 - RNA, 64 nt, Homo Sapiens
gguaguaccugagugugugcuuaugauaaagguucagcuccaggugacuagcacucagagggac

SEQ ID NO: 108808 - RNA, 64 nt, Homo Sapiens
cucccaagugacaggccauuacaggaagacccagcagcuccaccguuuugcaagacagugguca

SEQ ID NO: 108809 - RNA, 64 nt, Homo Sapiens
gccgcuccugcuuccccuccguccggcccagugccagcuccaguucugauggaaugugccaccu

SEQ ID NO: 108810 - RNA, 64 nt, Homo Sapiens
cauuccagccaggcccaggcacucucucacccaccagcuccacagggagggggaccuguccccc

SEQ ID NO: 108811 - RNA, 64 nt, Homo Sapiens
cccugguaccccucuucauggagucgugggagcccagcuccaggagcacuccgucugaugggag

SEQ ID NO: 108812 - RNA, 64 nt, Homo Sapiens
uccggaggcccagcacuccggguggcaaguggcacagcuccauguaggcaggcucucagaugua

SEQ ID NO: 108813 - RNA, 64 nt, Homo Sapiens
ugacccccggccugcagaacaucuguccccaagccagcuccacugcccaggcccccaagagggc

SEQ ID NO: 108814 - RNA, 64 nt, Homo Sapiens
caagccagcuccacugcccaggcccccaagagggcagcuccagaagcugcccagggcuccggga

SEQ ID NO: 108815 - RNA, 64 nt, Homo Sapiens
caaacgccaccuuacacucugcaggcugcagcggcagcuccagauggccuccugagcuggacga

SEQ ID NO: 108816 - RNA, 64 nt, Homo Sapiens
cccagcgggaagggaggcugaaugggccuuugcucagcuccaggccuagggcuccagaggggug

SEQ ID NO: 108817 - RNA, 64 nt, Homo Sapiens
ugcccucaccucucuagcagcccacucccagccccagcuccagcaguccauggggaucucauca

SEQ ID NO: 108818 - RNA, 64 nt, Homo Sapiens
ggccccaccuuuguccccuagcaaauucaggguacagcuccaccuagaaccaggcugcccucua

SEQ ID NO: 108819 - RNA, 64 nt, Homo Sapiens
ccuuggccccugccugcgucugugcucaaagcagcagcuccaacccugccucuguccccuuccc

SEQ ID NO: 108820 - RNA, 64 nt, Homo Sapiens
cagugccuccccgccccgccgcuggcgucaaguucagcuccacgugugccaucaguggauccga

SEQ ID NO: 108821 - RNA, 64 nt, Homo Sapiens
gucuuccuauuuugaguuugguucagaucuuaagcagcuccaugcaacuguauuuauuuuugau

SEQ ID NO: 108822 - RNA, 64 nt, Homo Sapiens
aaguccccgcaaugucucacugcugugguugcugcagcuccaggaaaauugauuacaaguucuc

SEQ ID NO: 108823 - RNA, 64 nt, Homo Sapiens
cugacaccagcagaguccugucugcagauggaaucagcuccaggacugucagggugcuggcccc

SEQ ID NO: 108824 - RNA, 64 nt, Homo Sapiens
agggagggaggacagaccuccaccacacugacaucagcuccagcucccccagguugggggggag

SEQ ID NO: 108825 - RNA, 64 nt, Homo Sapiens
acacaucccccccaaccuacccccaccccaaaagcagcuccaacagaauggccagagggccuca

SEQ ID NO: 108826 - RNA, 64 nt, Homo Sapiens
acgagcaguggagagggaaagcaacuucuugcuggaagaauaucucugccuucuuaccuuaaau

SEQ ID NO: 108827 - RNA, 64 nt, Homo Sapiens
uuccaaaagauauuuugcucuauuuuaaaguguagaagaauacacugcuaauaaauaauaaaag

SEQ ID NO: 108828 - RNA, 64 nt, Homo Sapiens
gacaauggcaauaucaacaaugaggaaaauuacugaagaauaaguuuccauaagucuccuacau

SEQ ID NO: 108829 - RNA, 64 nt, Homo Sapiens
uguucagguuuagaucauaugacacucgagcacagaagaauaauuucaaggaggucaucuugua

SEQ ID NO: 108830 - RNA, 64 nt, Homo Sapiens
cuaauuaaaaugggguuugcaggcuuuuuauggugaagaauaauauaucucugucuauagcuuu

SEQ ID NO: 108831 - RNA, 64 nt, Homo Sapiens
caggccauuucauugagggaaaacauaauaucuugaagaauauuguuaaaaccuuacuuaaagc

SEQ ID NO: 108832 - RNA, 64 nt, Homo Sapiens
gggaaauucacacugugcguuuuagaguaugcaagaagaauauaaauaaauaaaaauauucucc

SEQ ID NO: 108833 - RNA, 64 nt, Homo Sapiens
gguuuccgcaggucugcuccccaccccugccucggaagaauaaagagaauguaguucccuacuc

SEQ ID NO: 108834 - RNA, 64 nt, Homo Sapiens
ugagaaaaaaugaauguauuccuguuuuugaagagaagaauaauuuuuuuuuucucuagggaga

SEQ ID NO: 108835 - RNA, 64 nt, Homo Sapiens
gcauugcuguauacaccucaugcuuaugcaaugggaagaauaugggggccagggggugugguac

SEQ ID NO: 108836 - RNA, 64 nt, Homo Sapiens
aaaaagcaguaucuucacucaaaagucuugcuuggaagaauaagcagaaauaauuuuauauauu

SEQ ID NO: 108837 - RNA, 64 nt, Homo Sapiens
gaauagaagagagaaaucacggucccucucuguggaagaauacuccuugaagguaaugacuaug

SEQ ID NO: 108838 - RNA, 64 nt, Homo Sapiens
aauaguuccacaacauccugaguggcuacuuauggaagaauagguugguuucagccgugguccu

SEQ ID NO: 108839 - RNA, 64 nt, Homo Sapiens
cauuaaggucauuacucucaaccaccuaggcaaugaagaauauaccauuucaaauauuuacagu

SEQ ID NO: 108840 - RNA, 64 nt, Homo Sapiens
gaagcccuccaagaaaaaaaauagaaaagcacuugaagaauauucccaauauucccggucagca

SEQ ID NO: 108841 - RNA, 64 nt, Homo Sapiens
agggauaugaugacaagguuaagaauaaaagggugaagaauaaauagggacugucauaccagug

SEQ ID NO: 108842 - RNA, 64 nt, Homo Sapiens
agggugaagaauaaaagggaacugucauaccagugaagaauaaaguggcuaagaugguauaggg

SEQ ID NO: 108843 - RNA, 64 nt, Homo Sapiens
aagaaaaauuaaggggggauccauugaaagacuugaagaauacauauacuuauauucggggaua

SEQ ID NO: 108844 - RNA, 64 nt, Homo Sapiens
aggauucaaugaaugaucucuagaaagauuuaaagaagaauauucagauaaggauguugaagau

SEQ ID NO: 108845 - RNA, 64 nt, Homo Sapiens
auuacuugguauuuagaacuccuagcaccacggggaagaauagagguaucaucaaacguggcaa

SEQ ID NO: 108846 - RNA, 64 nt, Homo Sapiens
aaguauauacauuucccuauuacucucaucagcugaagaauauguacuauuguguuacucaaau

SEQ ID NO: 108847 - RNA, 64 nt, Homo Sapiens
uaugaacacugaucaaguaguuguggagagaugagaagaauauaugcagcaaaggugcugugag

SEQ ID NO: 108848 - RNA, 64 nt, Homo Sapiens
gaugaugcuuuuucuugaugcuaagaucacugcagaagaauaaccugaccuuuucuuugcauuu

SEQ ID NO: 108849 - RNA, 64 nt, Homo Sapiens
acugcauuagauguaauucuauauggaaaggugggaagaauauugcuggugcuucuuacauuua

SEQ ID NO: 108850 - RNA, 64 nt, Homo Sapiens
aaauguaguugagaaauaauaaaucuaaaacugcgaagaauacuuuuucgcuuaaaggaaaaaa

SEQ ID NO: 108851 - RNA, 64 nt, Homo Sapiens
cuauugucuuucauuuugccucucaucacagugggaagaauagcuaaccaggaagugcuuauuc

SEQ ID NO: 108852 - RNA, 64 nt, Homo Sapiens
ugcaaacaaacaagcuuacuaggugagcuauagugaagaauaggccuugauuuccucccaaagu

SEQ ID NO: 108853 - RNA, 63 nt, Homo Sapiens
uguuggacucugaauguuauauacaguuguuaaagaagaauaaguuaugcugugaaguaggca

SEQ ID NO: 108854 - RNA, 64 nt, Homo Sapiens
auucaagaaugugauguuuugaaagacuagauuggaagaauaaagaaguucaaucugucucugg

SEQ ID NO: 108855 - RNA, 64 nt, Homo Sapiens
ccucuuuuucuugcaaguuuuaaauuuccaaccuuaagugaauuuguggaccaaauuucaaagg

SEQ ID NO: 108856 - RNA, 64 nt, Homo Sapiens
aaagacuaagguuucgagagcauuccuacucacauaagugaagaaaucugucagauaggaaucu

SEQ ID NO: 108857 - RNA, 64 nt, Homo Sapiens
uuaugaaaaaauauguauaucuguaaucaguuguuaagugaauggcacuaaaaguaucgagaac

SEQ ID NO: 108858 - RNA, 64 nt, Homo Sapiens
gcuuuucccuguccugacccgauggagcagccgguaagugaagagcacagcuggaagcagagac

SEQ ID NO: 108859 - RNA, 64 nt, Homo Sapiens
uuuuuaaaacucaaaauuaaagauaccuaauauuuaagugaauacaucaaaacuucaauaauca

SEQ ID NO: 108860 - RNA, 64 nt, Homo Sapiens
gcauuauguacuugaaaguauacagauuguucuauaagugaaaacaaaauagaugagaauaugg

SEQ ID NO: 108861 - RNA, 64 nt, Homo Sapiens
uaucugcagaggaaguauuaguuaagguuugaacuaagugaauguccugagacuaacuuuguau

SEQ ID NO: 108862 - RNA, 64 nt, Homo Sapiens
ucaagcccucaaggcccaacauguguauaguauuuaagugaaacucccccuugugugauaccac

SEQ ID NO: 108863 - RNA, 64 nt, Homo Sapiens
gaguuugaugaugcaaaguugaucucuguacauuuaagugaaaagucuuuauaacuuuucaccc

SEQ ID NO: 108864 - RNA, 64 nt, Homo Sapiens
acuauugaugacuguguuaagugcaucuguauuguaagugaaauguaauuauuucuguguacca

SEQ ID NO: 108865 - RNA, 64 nt, Homo Sapiens
auucuuucuuucugccaagauuagguuuaagauguaagugaacacuacacuuucucugaaucau

SEQ ID NO: 108866 - RNA, 64 nt, Homo Sapiens
uacuuugaaaaagcauuaugacccugcacugcuuuaagugaacauacagugaccauguuaaccu

SEQ ID NO: 108867 - RNA, 64 nt, Homo Sapiens
aauauggccuugauccauggauuaaaucaguaucuaagugaauguguugauguuuuauugauca

SEQ ID NO: 108868 - RNA, 64 nt, Homo Sapiens
acaucccagugccuuuaaccuggauuucuaaucuuaagugaaaugggugcagcauuccuuugga

SEQ ID NO: 108869 - RNA, 64 nt, Homo Sapiens
caugauuuaaagguugaguaugugaagauauaaguaagugaacuaccaugcuuuguuuacgugu

SEQ ID NO: 108870 - RNA, 64 nt, Homo Sapiens
aaacaaucuuccaaagaacuguauaagguggucauaagugaauauuuuaauuaaaauugguaaa

SEQ ID NO: 108871 - RNA, 64 nt, Homo Sapiens
uauacucucgugagaacuuaguauauacuucauauaagugaauagugaaaucauacacucucgu

SEQ ID NO: 108872 - RNA, 64 nt, Homo Sapiens
cauacacucucguguauauaucuagaacuucauauaagugaaaugccuugccucuucuagagcu

SEQ ID NO: 108873 - RNA, 64 nt, Homo Sapiens
uaaaugauuuaaauucauuuaguaagauuaguaauaagugaaaaaguauuguauuauucucugu

SEQ ID NO: 108874 - RNA, 64 nt, Homo Sapiens
uuaauuuacugaggaugauaucaguaacauuuucuaagugaagaauucuaaauguuguauuuua

SEQ ID NO: 108875 - RNA, 64 nt, Homo Sapiens
gagcccuuguucuaguacaugucauugaucauaauaagugaaauguuauauccacuagguggca

SEQ ID NO: 108876 - RNA, 64 nt, Homo Sapiens
ugcauguuuguauugaaguaaacguauguauaauuaagugaagcuuuugcuuuucuuuaaauaa

SEQ ID NO: 108877 - RNA, 64 nt, Homo Sapiens
uaguggaagaacauagguaugacagaucucuuaauaagugaaucaaacauuacuuccauauaaa

SEQ ID NO: 108878 - RNA, 64 nt, Homo Sapiens
auuuuuauuucuucuuguauguguaggugguuuguaagugaauagucuguugggaaaacaaaau

SEQ ID NO: 108879 - RNA, 64 nt, Homo Sapiens
aaguauaaaauaccuaggaauacagccaaccagguaagugaaagauuucuacaaugagaauuac

SEQ ID NO: 108880 - RNA, 64 nt, Homo Sapiens
uacagcaacauagauggagcugaggcucuuauccuaagugaauuaaugcaggaacagaaaauga

SEQ ID NO: 108881 - RNA, 64 nt, Homo Sapiens
auuuuaaauuuauuuuuuauuuaagaguuaaugguaagugaacaaaaauguagaaauuaaauuu

SEQ ID NO: 108882 - RNA, 64 nt, Homo Sapiens
gacuuuuaugguuaacuuauguaugaugaaaaucuaagugaagaaagacauuaaaauaugagau

SEQ ID NO: 108883 - RNA, 64 nt, Homo Sapiens
acagauagcaaaauuuuacuccucugagggucaguaagugaaguuauugucuucuagccuugag

SEQ ID NO: 108884 - RNA, 64 nt, Homo Sapiens
ccugccuuuugccacucuuaaggcugaaguggaguaagugaaaauagguaaaauucaguauaau

SEQ ID NO: 108885 - RNA, 64 nt, Homo Sapiens
acuuuagcuuuuacaggggaaacagaguuccuguuaagugaauagugacauuugaauaaggaaa

SEQ ID NO: 108886 - RNA, 64 nt, Homo Sapiens
aagagucaaugagauuuugcuggauggcucuccuuaagugaagauuucuuucugugccacacaa

SEQ ID NO: 108887 - RNA, 64 nt, Homo Sapiens
ugggaaauuuguaucuccaaguuggccagggcacugaccagagcuguuucccuaaugaugggca

SEQ ID NO: 108888 - RNA, 64 nt, Homo Sapiens
cuuggcaaauuuaccucuuugugcuacaaaacccugaccagacaccauuuuaaggaaacucuug

SEQ ID NO: 108889 - RNA, 64 nt, Homo Sapiens
ugguuauaugaaguucaucucaaaauggagaccaugaccagaguuuccagaugauacacguucu

SEQ ID NO: 108890 - RNA, 64 nt, Homo Sapiens
gaagccagaucagcaaauggaggaaccucggaggugaccagaaagaucuccaucgguugcccaa

SEQ ID NO: 108891 - RNA, 64 nt, Homo Sapiens
cccccauccuagggaucuugucaggguuccuuacugaccagaggagcccgcagcaaucuccaca

SEQ ID NO: 108892 - RNA, 64 nt, Homo Sapiens
cccaacugcccugcucuccucauacucaccgguuugaccagaaauucuccaaauccagccauag

SEQ ID NO: 108893 - RNA, 62 nt, Homo Sapiens
ggaagcagagaaguugcuguuauguuuuugcauccguuuacccuaugcaaaguugcuguaug

SEQ ID NO: 108894 - RNA, 62 nt, Homo Sapiens
ucaccuugauuuuggcccgguucuuucaguguuccguuuacccuuuuuacugaaaguaagug

SEQ ID NO: 108895 - RNA, 62 nt, Homo Sapiens
gcauugauagccaguguguuuucuuauuuaacuccguuuacuacauucuacaugguguuuac

SEQ ID NO: 108896 - RNA, 62 nt, Homo Sapiens
ugggauuugauucucauuuugaagugcugcucuccguuuauuugcguggccuuaaacauuga

SEQ ID NO: 108897 - RNA, 62 nt, Homo Sapiens
ggccuugcuuugggcuuugccuuaccguagccuccguuuaugaaacugcacacacagcuccu

SEQ ID NO: 108898 - RNA, 62 nt, Homo Sapiens
acaagcaaguacuauuauuuaauguuaaccuuuccguuuauucaaagauuaugaaucuuaug

SEQ ID NO: 108899 - RNA, 62 nt, Homo Sapiens
cugccauugcuuugaaaagcuauuugaaagauuccguuuaucauuaccaacacaaggcaauu

SEQ ID NO: 108900 - RNA, 62 nt, Homo Sapiens
gagcaaaccauauugugccugggauuuuuaaguccguuuagaggaaaggaggaaagguauca

SEQ ID NO: 108901 - RNA, 62 nt, Homo Sapiens
uucauggugcuguugcccccgccaaggucacuuccguuuaccgcguuuuguuugguaguuuu

SEQ ID NO: 108902 - RNA, 62 nt, Homo Sapiens
cucaaaucuguuaucccaaucauuguugccucuccguuuauuauaaacuguaugcucacaac

SEQ ID NO: 108903 - RNA, 62 nt, Homo Sapiens
guagagaaauugaaaacagaucuauagaaaaguccguuuaguauuuugucuggccaaugggu

SEQ ID NO: 108904 - RNA, 62 nt, Homo Sapiens
ccuuauacauuucaaucccuuuuaugcuggauuccguuuaaagaagacauuauuagagcagg

SEQ ID NO: 108905 - RNA, 62 nt, Homo Sapiens
uguuucagaguuuguauuguugaguuuuauuguccguuuacuaaacucauuuuaggcaaaua

SEQ ID NO: 108906 - RNA, 62 nt, Homo Sapiens
caucucuucauaccacguguuugaaaacagucuccguuuacacugucccagcuuggaaggca

SEQ ID NO: 108907 - RNA, 62 nt, Homo Sapiens
ugauauugcacugggauuugaauguguguguuuccguuuaacuuguggugaaggaagugugu

SEQ ID NO: 108908 - RNA, 62 nt, Homo Sapiens
uaaacaguaggguuuuuccucuccugaccuuauccguuuacaguucaaugaaauaaguguau

SEQ ID NO: 108909 - RNA, 62 nt, Homo Sapiens
ucgauagaaagcgcaggggggauauugugggguccguuuaaccagaagcaugagaggaagga

SEQ ID NO: 108910 - RNA, 62 nt, Homo Sapiens
uucaugugcuacuuuaacaugaauggagaaaauccguuuauggaaguacagugacaauugac

SEQ ID NO: 108911 - RNA, 62 nt, Homo Sapiens
aacaguaucaauguugaaucugugaaugguuuuccguuuacugugaugugcuacuguaaaua

SEQ ID NO: 108912 - RNA, 62 nt, Homo Sapiens
acauugggcugcugaacccacaaaaaucuaaauccguuuagaaucaucuauuuaacuccuca

SEQ ID NO: 108913 - RNA, 62 nt, Homo Sapiens
caaaccggggagacaagaugauuggcagguauuccguuuaucacaguccacuuaaaaaauga

SEQ ID NO: 108914 - RNA, 62 nt, Homo Sapiens
uucuuagaacuuguuuuaauuuuugugguccuuccguuuauuauaauaggcguccaccaaug

SEQ ID NO: 108915 - RNA, 62 nt, Homo Sapiens
accacagggagacagagggagcugugggggacuccguuuacuccucagguggccucuggcug

SEQ ID NO: 108916 - RNA, 62 nt, Homo Sapiens
acauucagacccagguguuaugcaggauuacauccguuuauuaucaagggcaaccuugguga

SEQ ID NO: 108917 - RNA, 62 nt, Homo Sapiens
uagacaugcugcaaggaaagaagauucuaaaguccguuuauggaggcaauuccauauccuuu

SEQ ID NO: 108918 - RNA, 62 nt, Homo Sapiens
uuuuagacaguaaguaucuugaaccaaaacauuccguuuacacacacacacaacaaaaauuu

SEQ ID NO: 108919 - RNA, 62 nt, Homo Sapiens
ccaagguggggucuuugugagggaagcgucuguccguuuacugccagcccagcccagcuggu

SEQ ID NO: 108920 - RNA, 62 nt, Homo Sapiens
cuguuuacacauuuugcacugcacuuuucuguuccguuuacugagagaaaaccacuuagacu

SEQ ID NO: 108921 - RNA, 62 nt, Homo Sapiens
aaugucuuaaaaaguagaauuuucuucuuuaauccguuuaguaguuaccucccuuuuacuuu

SEQ ID NO: 108922 - RNA, 62 nt, Homo Sapiens
uuuauuuaaaugguuuccuaccacuaagauuguccguuuauggguauacacagggccaaaac

SEQ ID NO: 108923 - RNA, 62 nt, Homo Sapiens
uucccugcccaagacuuuauuuaacccuggacuccguuuacacagacaaagugacaucagaa

SEQ ID NO: 108924 - RNA, 62 nt, Homo Sapiens
uucccuaauaaucaaaacaccgcguaggcuccuccguuuaucaguauuaaugguguaacuuu

SEQ ID NO: 108925 - RNA, 62 nt, Homo Sapiens
aggaacagcucagcuaaagcccucggguuccauccguuuaaaucuguggcauuuucagagcc

SEQ ID NO: 108926 - RNA, 62 nt, Homo Sapiens
uuccagaagcagcagccacuuuguuguaagacuccguuuaauaagcaauccuaagauccugc

SEQ ID NO: 108927 - RNA, 62 nt, Homo Sapiens
gccgcagccccuccugguucuccuguuccucguccguuuacucccaggugcugccccuucuc

SEQ ID NO: 108928 - RNA, 62 nt, Homo Sapiens
cauuucguccuccugguacauuguaauguuuauccguuuaaacaggcuugaggagcuggcgc

SEQ ID NO: 108929 - RNA, 62 nt, Homo Sapiens
uuaaaaugcagcagagguacucuucugucccuuccguuuauaguucucugagagaguucuau

SEQ ID NO: 108930 - RNA, 62 nt, Homo Sapiens
gucgucuucuuuuaauguaaccggccuuguuuuccguuuaaaacaggcaugacccaccgcuc

SEQ ID NO: 108931 - RNA, 62 nt, Homo Sapiens
cauauuuuguauauaugugaaaugcuuuuauuuccguuuaaaucuauaauuuaauucaagag

SEQ ID NO: 108932 - RNA, 62 nt, Homo Sapiens
agaugcuaaugcuaucgguaaucucuggggaguccguuuaaggcuuuccuugguauuuggca

SEQ ID NO: 108933 - RNA, 62 nt, Homo Sapiens
aggacacgggccccaccugucuuuuguuccuguccguuuaucgggucccagaccuugcguuc

SEQ ID NO: 108934 - RNA, 62 nt, Homo Sapiens
gcccagggcccauucuugcuucucaggcaccuuccguuuauuaauugccauugcuccugaca

SEQ ID NO: 108935 - RNA, 62 nt, Homo Sapiens
cagagcuugcccauugccugucucucgccaauuccguuuauccaaaaagguacauguuuuug

SEQ ID NO: 108936 - RNA, 62 nt, Homo Sapiens
aacgucuugucugugaucuucuacugcagggguccguuuaguaugauucugcaauucgggac

SEQ ID NO: 108937 - RNA, 62 nt, Homo Sapiens
cccuuucuucuuuuggcaccugauagguggucuccguuuauaugauccuagguucugaugag

SEQ ID NO: 108938 - RNA, 62 nt, Homo Sapiens
aaaaagaaacacagacgcccaggugucagcucuccguuuaaagaaugaaaaauguaacucau

SEQ ID NO: 108939 - RNA, 62 nt, Homo Sapiens
gaccaacccaaaagacugcauacuuuuggcaauccguuuaaacaagauaagaagguaggaua

SEQ ID NO: 108940 - RNA, 62 nt, Homo Sapiens
uuagcacuguaucccuuguguagcuuaaacaauccguuuauagacaguuuauguuaagcacu

SEQ ID NO: 108941 - RNA, 62 nt, Homo Sapiens
cuuuguuuuaaugcuuguacguuuguuguacuuccguuuagauucccuucuuaguggcuguu

SEQ ID NO: 108942 - RNA, 64 nt, Homo Sapiens
cauuuagcauuuaaguugggguauuuagagccuguaaucuaaaugcuggcucaaauuuauuccc

SEQ ID NO: 108943 - RNA, 64 nt, Homo Sapiens
ugcauaaucauaagcaccucaacacuugaauacauaaucuaaaaauuauauaguaaagcuggua

SEQ ID NO: 108944 - RNA, 64 nt, Homo Sapiens
uguguuuagcucauuuaaaucaaaauguguacuuuaaucuaaaauguuuuaauaaucuguauuu

SEQ ID NO: 108945 - RNA, 64 nt, Homo Sapiens
aacuuguuuguuugucuuuguauauaacuacuucuaaucuaaucacuagaguuauuauauucug

SEQ ID NO: 108946 - RNA, 64 nt, Homo Sapiens
gauauaugcaugugugugaugguauguauggauuuaaucuaaucuaauaauugugccccgcagu

SEQ ID NO: 108947 - RNA, 64 nt, Homo Sapiens
augcaugugugugaugguauguauggauuuaaucuaaucuaauaauugugccccgcaguugugc

SEQ ID NO: 108948 - RNA, 64 nt, Homo Sapiens
uuguacacuauauuacaugaucagaucauacaaauaaucuaagauuauacagucuagugauccu

SEQ ID NO: 108949 - RNA, 64 nt, Homo Sapiens
gauuauacagucuagugauccuagauuacacaaguaaucuaagcuuccacuuuaggaaacuaga

SEQ ID NO: 108950 - RNA, 64 nt, Homo Sapiens
uuccacuuuggaaaacuagacuagauuacacaaguaaucuaagcgauuuuacagucuggugacc

SEQ ID NO: 108951 - RNA, 64 nt, Homo Sapiens
uuuuacagucuggugacccuucagaucauacaaauaaucuaagauuguacacuacauuacauga

SEQ ID NO: 108952 - RNA, 64 nt, Homo Sapiens
cuaauccuuuuccuuauuugccuucuacuccccuuaaucuaaucuaaaagcucuguuccaugca

SEQ ID NO: 108953 - RNA, 64 nt, Homo Sapiens
ccuuuuccuuauuugccuucuacuccccuuaaucuaaucuaaaagcucuguuccaugcaacugg

SEQ ID NO: 108954 - RNA, 64 nt, Homo Sapiens
gcuugacaagauugagaggcccaugccaacagucuaaucuaagagauuagucuuucaaacucac

SEQ ID NO: 108955 - RNA, 64 nt, Homo Sapiens
uugaguuuagucacugcaaauuugacugugacuuuaaucuaaauuacuauguaaacaaaaagua

SEQ ID NO: 108956 - RNA, 64 nt, Homo Sapiens
auaccaaaauuauuucagaaauguacaacuuuuuaccuaguacaaggcaacauauagguuguaa

SEQ ID NO: 108957 - RNA, 64 nt, Homo Sapiens
cagcucacacaugagaucuaggugaggauugauuaccuaguagucauuucauggguuguuggga

SEQ ID NO: 108958 - RNA, 64 nt, Homo Sapiens
ccuuuuuuuaguugcuucucuuuuuauuuacuuuaccuaguauguuucuuuucuuuuuuuuuag

SEQ ID NO: 108959 - RNA, 64 nt, Homo Sapiens
ucaucaaaaugagaucauaaucagggggcugauaaccuaguaaacaugcaagcuugauucaccu

SEQ ID NO: 108960 - RNA, 64 nt, Homo Sapiens
auguguaggaaggagaaaacagaauuugguggauaccuaguagucucugccauacccuugacca

SEQ ID NO: 108961 - RNA, 64 nt, Homo Sapiens
cuuuuccugggguuuugcauucacugguuguguuaccuaguauugccuaugauaaucguuaguc

SEQ ID NO: 108962 - RNA, 64 nt, Homo Sapiens
acaugccuguauuacugaaagcuaaauccucaaaaccuaguaaggggacuaaugauucauuaaa

SEQ ID NO: 108963 - RNA, 64 nt, Homo Sapiens
uggauaaauaacauaucccgggcagaugagcucaaccuaguagguaagaguuugguuuggucac

SEQ ID NO: 108964 - RNA, 64 nt, Homo Sapiens
cugcauaacuuuuugucuuuugauuauuccagauacuguauaacucagagaaucuggaguugaa

SEQ ID NO: 108965 - RNA, 64 nt, Homo Sapiens
aaacaguauccuuuuuucucuuaaugcuacaguuacuguauagccagggccagugcagggucag

SEQ ID NO: 108966 - RNA, 64 nt, Homo Sapiens
uaacacuaguagcuguuuugaguuguugguuuauacuguauaaguuaaaaaaugcccuauugua

SEQ ID NO: 108967 - RNA, 64 nt, Homo Sapiens
uuaaagggaggauugaaagggcccagaaaaaaggacuguauaguaccaauaauaagagcccuga

SEQ ID NO: 108968 - RNA, 64 nt, Homo Sapiens
gggaaaauuaguucccauucuuucaacccccuuaacuguauagcucuuuuccuagaauagugac

SEQ ID NO: 108969 - RNA, 64 nt, Homo Sapiens
uggaugcagcaauaauuucuguaugguccauagcacuguauauuauggaucgauauuaauguau

SEQ ID NO: 108970 - RNA, 64 nt, Homo Sapiens
gcuuaaaaauacuucuaugacucucugcuaucccacuguauagauccacagggagcaaacacuu

SEQ ID NO: 108971 - RNA, 64 nt, Homo Sapiens
cuaguuuauucuaaucuauuguuaaguauugugcacuguauaccaaguucuuagggcacaugaa

SEQ ID NO: 108972 - RNA, 64 nt, Homo Sapiens
guagauauauauuuccaaauauucuaaaaaagauacuguauaugucaaaaauauuuuuauguga

SEQ ID NO: 108973 - RNA, 64 nt, Homo Sapiens
aaaaugggaagcauuaguuggagcuagaaaaugaacuguauauuauugcuauauuugcuaauac

SEQ ID NO: 108974 - RNA, 64 nt, Homo Sapiens
uguggaaagccaggucagccgaguauuagaaaccacuguauauacccaucgucagacaacuuug

SEQ ID NO: 108975 - RNA, 64 nt, Homo Sapiens
aaaaaaguaucuacguuuuuuuaagucuugugaaacuguauaggcccuguuguuuacagcauau

SEQ ID NO: 108976 - RNA, 64 nt, Homo Sapiens
aagagaaacaaucuuauuuugccacugaauuaauacuguauagcacuuugcaccaggugguuug

SEQ ID NO: 108977 - RNA, 64 nt, Homo Sapiens
aaaagaaaaaaggcuggguuugcauucuugccuuacuguauagaaacguuuuugcauuacaggc

SEQ ID NO: 108978 - RNA, 64 nt, Homo Sapiens
uuuucaucugcauuccuuagaugggggagaagacacuguauacauccaugaacauuucaagcuu

SEQ ID NO: 108979 - RNA, 64 nt, Homo Sapiens
augaaaggcuucuauuuggaucaguauucguaacacuguauaugauucccagugagaaauauuu

SEQ ID NO: 108980 - RNA, 64 nt, Homo Sapiens
aauguucauuuuacacaauauuuucagauauuuaacuguauaaagauuguuuuaucuguacauu

SEQ ID NO: 108981 - RNA, 64 nt, Homo Sapiens
auugcauucuuaggcuacugcaacuuuugcuagcacuguauacuugugaucugcaacauuuuuu

SEQ ID NO: 108982 - RNA, 64 nt, Homo Sapiens
uauuucagugauaauguucauuuugaaaauauguacuguauaacauuaagaaaauauuuaacuc

SEQ ID NO: 108983 - RNA, 64 nt, Homo Sapiens
ugcagugcaacaggaggcuuuuucagugaucuucacuguauauguaaauuacaaauguggcugu

SEQ ID NO: 108984 - RNA, 64 nt, Homo Sapiens
acaucuaauauauauauauugacuugguaagucuacuguauauagcuugauugcuuaaacuauu

SEQ ID NO: 108985 - RNA, 64 nt, Homo Sapiens
acaucuaauauauauauuacgacuugguaagucuacuguauauagcuugauugcuuaaacuauu

SEQ ID NO: 108986 - RNA, 64 nt, Homo Sapiens
uguuuucaagcauccucuaaaaaaaaagaugcuuacuguauacuauuaucauacuauucuuuga

SEQ ID NO: 108987 - RNA, 64 nt, Homo Sapiens
cacuggaagauagucaagacuuacgugguucaugacuguauauuugucuuugacagaaacaugg

SEQ ID NO: 108988 - RNA, 64 nt, Homo Sapiens
aaguauuaguaauuguauauguacugaaauaugaacuguauaaaguaaauaaaauaguguugau

SEQ ID NO: 108989 - RNA, 64 nt, Homo Sapiens
acuuguugacaaugcacugaucaccuuguaaaugacuguauaaaaaauuaacuauuaaccacau

SEQ ID NO: 108990 - RNA, 64 nt, Homo Sapiens
uggcaguuaagcagugccacaagguuuuugaaugacuguauauugacauuuucaauguuuccuu

SEQ ID NO: 108991 - RNA, 64 nt, Homo Sapiens
auguaauuccugaaggggaauucagcauuuaaucacuguauacuaauuguuuuucuuuauuuuc

SEQ ID NO: 108992 - RNA, 64 nt, Homo Sapiens
agacugaguggggucucucugcccaagaucccugacauagcaguagcuugucuuuuccacauga

SEQ ID NO: 108993 - RNA, 64 nt, Homo Sapiens
gucuaaaauacaccuggaucugucuagucaaucaacauagcagagacagucuuaaaccuaccau

SEQ ID NO: 108994 - RNA, 64 nt, Homo Sapiens
ucucccaccugucugcauagaaaggcagaauuagacauagcaugcuuuggaaaagcaaauagga

SEQ ID NO: 108995 - RNA, 64 nt, Homo Sapiens
uagauuagagcaaggauguaagggagaggaagggacauagcaguauuucaggugagagucaagg

SEQ ID NO: 108996 - RNA, 64 nt, Homo Sapiens
uuuggcauugguuccagaugagcuuuuaaagcaaacauagcaguuguuugccauuucuugcacu

SEQ ID NO: 108997 - RNA, 64 nt, Homo Sapiens
ucuuuacagagccauccaaaaauuuuuugucccuacauagcaauuuucuguggcacugagaaac

SEQ ID NO: 108998 - RNA, 64 nt, Homo Sapiens
uccucuaugguagaaguaaaaaaaaaaaaaaaggacauagcaacauuaaaguaguggauuuuuc

SEQ ID NO: 108999 - RNA, 64 nt, Homo Sapiens
ccacuuccuuuuucucuuacuuccagcacacuagacauagcaaaaguguuugccuacucaaaaa

SEQ ID NO: 109000 - RNA, 64 nt, Homo Sapiens
gaugcgcagggcgcccccuucuguuccagggugaacauagcacacgcccuccuggcugggccuc

SEQ ID NO: 109001 - RNA, 64 nt, Homo Sapiens
guucacuuggaccuagugcugccuccuguuuauuacauagcauggcccuuaugucuugaguuga

SEQ ID NO: 109002 - RNA, 64 nt, Homo Sapiens
auuaauauuaauauuaacaauauugauguuaauuacauagcauacuauuucaauaaauuauaug

SEQ ID NO: 109003 - RNA, 64 nt, Homo Sapiens
uugcucuuaguuacauguaaauggucuaaaacccacauagcacuaggagagcaaacaaacaguc

SEQ ID NO: 109004 - RNA, 64 nt, Homo Sapiens
agcgggaagugugccaaggaccagacaggaucccacauagcagcccugcagaauccuaagcgag

SEQ ID NO: 109005 - RNA, 64 nt, Homo Sapiens
uuaaucaaguaaucauuaauauaguugucaguucacauagcaauucuauugcauugauuuauaa

SEQ ID NO: 109006 - RNA, 64 nt, Homo Sapiens
uacuuaaaaaauggaauccugcaaauggccuagcacauagcaagacuuuaaugagacaguguua

SEQ ID NO: 109007 - RNA, 64 nt, Homo Sapiens
acuccgucucauaaaaauuaaaucagccugggcaacauagcaaugcuugagcccaggaguucag

SEQ ID NO: 109008 - RNA, 64 nt, Homo Sapiens
uccagggcuaagcaagaaauguccaggguggguuacauagcacaagaaagaugaggagacagag

SEQ ID NO: 109009 - RNA, 64 nt, Homo Sapiens
aucugguauguugcaagcuuugucgugagagacaacauagcaauuucucagugucauccauugc

SEQ ID NO: 109010 - RNA, 64 nt, Homo Sapiens
gguaucauuguuaauuauguuaguccucuucaacacauagcaauuggaagagaacaucauuuac

SEQ ID NO: 109011 - RNA, 64 nt, Homo Sapiens
uauaucuacaaauaaucuaucuaagguccaagaaacauagcaauaauauaauuuaagcaauggg

SEQ ID NO: 109012 - RNA, 64 nt, Homo Sapiens
gggcuguuugaaugccuuuuggggaaggauguugacauagcacuccgcgucucccccaugcaca

SEQ ID NO: 109013 - RNA, 64 nt, Homo Sapiens
aucucauccuuacaaaaaaugacaagccugggaaacauagcaagacuugagcccaggaguucua

SEQ ID NO: 109014 - RNA, 64 nt, Homo Sapiens
ugucuucaucucacuaagaaauguugacaauacaacauagcauacuuuacuauuuauuucagaa

SEQ ID NO: 109015 - RNA, 64 nt, Homo Sapiens
gguuccugucauguguucauguguauguuacuuuacauagcagcuaucauuguucuugggagca

SEQ ID NO: 109016 - RNA, 64 nt, Homo Sapiens
ggcaccuuccgacaucccagguccuagcucuuacacauagcaggaugauuccuggacaucacca

SEQ ID NO: 109017 - RNA, 64 nt, Homo Sapiens
uuuuuaaucucugaauguaauuucgauacuguguacauagcagggagugaucggggugaaauaa

SEQ ID NO: 109018 - RNA, 64 nt, Homo Sapiens
auacaguaaaauauuucgugggaaccuaacacucacauagcauaugguuuauuaauaaugcaua

SEQ ID NO: 109019 - RNA, 64 nt, Homo Sapiens
ccagggaauggcuccuuauaccaaagaugcuggcacauagcagaacccagugcacguccucccc

SEQ ID NO: 109020 - RNA, 64 nt, Homo Sapiens
gcauagcacuugcagaccugccugaacgcacaugacauagcacuugccgaucugcgugugucca

SEQ ID NO: 109021 - RNA, 64 nt, Homo Sapiens
guguugcugaauuaaaauucugcuggacuuuuuaacauagcaaauccgauguuuauaaacuggu

SEQ ID NO: 109022 - RNA, 64 nt, Homo Sapiens
aaauuacugaagaauaaguuuccauaagucuccuacauagcaguguuauuuauguacagauaag

SEQ ID NO: 109023 - RNA, 64 nt, Homo Sapiens
augacaagaaaacaagggaaagaguuaaccugucacauagcagguuaacuuuuucaggguuugc

SEQ ID NO: 109024 - RNA, 64 nt, Homo Sapiens
acuugaggccaggagauugagaccaguguggccaacauagcaaaaacccgucucgacgaaaaau

SEQ ID NO: 109025 - RNA, 64 nt, Homo Sapiens
gaugggugaugucuuuccuuauguugcuuuuucaacauagcagaauuaauguagggagcuaaau

SEQ ID NO: 109026 - RNA, 64 nt, Homo Sapiens
gaaaaaauucaaacugccuaccaauugaacuuucacauagcacaucuucauuuauucuucuuuu

SEQ ID NO: 109027 - RNA, 64 nt, Homo Sapiens
augcaccuuucaacuuuacaaggcagccuuuaaaacauagcaaucuuugcugcuucuacuguaa

SEQ ID NO: 109028 - RNA, 64 nt, Homo Sapiens
acugcuuaaacaucccauuucuaaaagauguauaacauagcaaauauaauuuugaaaauaacaa

SEQ ID NO: 109029 - RNA, 64 nt, Homo Sapiens
ucuguuuugugguuuggaauuaaaaaagucuacaacauagcagauuaaaucucaaauaggcuau

SEQ ID NO: 109030 - RNA, 64 nt, Homo Sapiens
auccugucucuccaaaaaaagaccagccugggcaacauagcaagucuugagaauaggaguucaa

SEQ ID NO: 109031 - RNA, 64 nt, Homo Sapiens
aauauaaccgaaaguuggccauuuaggugguagaacauagcaaaaccuuguaagcaauaguuau

SEQ ID NO: 109032 - RNA, 64 nt, Homo Sapiens
guauuuacugugcuaaugggucuuaacuuggcuaacauagcacagugcuaggauaaaccaauca

SEQ ID NO: 109033 - RNA, 64 nt, Homo Sapiens
ucaacuuuugacuaagaauuaauuuauaugcuucacauagcauguuuaagacugauaauuuuac

SEQ ID NO: 109034 - RNA, 64 nt, Homo Sapiens
aucucaucucuacaaaaagugaccagccugggcaacauagcaaaauuugagcucaggaguucca

SEQ ID NO: 109035 - RNA, 64 nt, Homo Sapiens
aaaaagguaggaaaucccuaaaacuuccagccucacauagcacgguucucaccugucacuguuu

SEQ ID NO: 109036 - RNA, 64 nt, Homo Sapiens
ugagauuggcuucagaauccauuacaguuaccuuacauagcacuugauacguguuaaaugaaca

SEQ ID NO: 109037 - RNA, 64 nt, Homo Sapiens
caggccuuaccuaguguuucccaucccucugaucacauagcacuuguaugugauuuaaaaugga

SEQ ID NO: 109038 - RNA, 64 nt, Homo Sapiens
guccaguugcagccuaauggugaacgggauuacaacauagcaaauacuguuugacuuucagaag

SEQ ID NO: 109039 - RNA, 64 nt, Homo Sapiens
acuugaggucgggaguucgagaccagccuggccaacauagcaaaacccugucucuacuaaaaau

SEQ ID NO: 109040 - RNA, 64 nt, Homo Sapiens
uucauaaguuuccaaaaaggauuugcagaagcucacauagcaaguuaaaugugcuuuugaacca

SEQ ID NO: 109041 - RNA, 64 nt, Homo Sapiens
ccuugauuuagcuccaagaauguuuuuacuggaaacauagcaaaauggacuccggaaagcuuuc

SEQ ID NO: 109042 - RNA, 64 nt, Homo Sapiens
acccugucucuacaaaaaaugaccagccugggcaacauagcaaaguuugaggccagaaauuuga

SEQ ID NO: 109043 - RNA, 64 nt, Homo Sapiens
uaacuucuccuauaucucuauuaucaaugagaagacauagcauguguaugcagauuuauggaua

SEQ ID NO: 109044 - RNA, 64 nt, Homo Sapiens
accccgucucuacaaagcacgacuagacugggcaacauagcaaggcuugaggccaggaguuuga

SEQ ID NO: 109045 - RNA, 64 nt, Homo Sapiens
aucaaauaccgaaauugaacuuucuaaaaccuacacauagcaugcguuuaaauucuauuauaua

SEQ ID NO: 109046 - RNA, 64 nt, Homo Sapiens
cccccgccauccucgcagagaacccccgcaaaccacauagcagacagcucccgcauaccaggau

SEQ ID NO: 109047 - RNA, 64 nt, Homo Sapiens
aauuagucugaaauuuccuguuaucuaccagggaacauagcauauggggaagguaccacaaaca

SEQ ID NO: 109048 - RNA, 64 nt, Homo Sapiens
ccuuguccugacuauguuucgucaugcaguacagacauagcaagggcaucagucaacaguguau

SEQ ID NO: 109049 - RNA, 64 nt, Homo Sapiens
cccugcauauugauggacaagcaugaagcccggcacauagcaggaucacacauaguguaucgug

SEQ ID NO: 109050 - RNA, 64 nt, Homo Sapiens
uaaugguaucuuaaagugugacuuuuguaaauacacauagcauguuuuucuuacuagaccugua

SEQ ID NO: 109051 - RNA, 64 nt, Homo Sapiens
acuuaagcccaggagucugagaccagccugggcaacauagcaagacccccaucucugcaaaaaa

SEQ ID NO: 109052 - RNA, 64 nt, Homo Sapiens
cuggggauugaaaucuuuaguccuuggagcugucacauagcaggggcaaccucacacugaaaca

SEQ ID NO: 109053 - RNA, 64 nt, Homo Sapiens
gcuugaguucaggaguucaagaccagccugggcaacauagcaaaaccuuaucucuacaaaaaaa

SEQ ID NO: 109054 - RNA, 64 nt, Homo Sapiens
aauucauaccauauaaaacuuguuagguuuuuaaacauagcaaucaaggcuacaaaaacaaacc

SEQ ID NO: 109055 - RNA, 64 nt, Homo Sapiens
gagcuuacucaggacuuuucaaacaucaggacacacauagcaauuuggauguuguaaaacuacg

SEQ ID NO: 109056 - RNA, 64 nt, Homo Sapiens
uuuauaguaaaauucuagcaccacuagaauaaucacauagcauguacaauauauuuaugcuggc

SEQ ID NO: 109057 - RNA, 64 nt, Homo Sapiens
caucuguuguucuguggucacagugaccuuagcuacauagcagacuuucccaaauguauugauu

SEQ ID NO: 109058 - RNA, 64 nt, Homo Sapiens
gccaaaaauaacuuucugaacaguugacuuuuugacauagcaaguuaacacguagaucuuugua

SEQ ID NO: 109059 - RNA, 64 nt, Homo Sapiens
guuccauagacuuggguaugauggccagucaaacacauagcaguuguagugacauuaggcagaa

SEQ ID NO: 109060 - RNA, 64 nt, Homo Sapiens
aaucuguuaccaguaggaggaugucaagaacaggacauagcacguaauggacgaagcaacaaau

SEQ ID NO: 109061 - RNA, 64 nt, Homo Sapiens
ggcccacguggugagggcacgccagcagcugagaacauagcacaccucuuuggugcucuuaaaa

SEQ ID NO: 109062 - RNA, 64 nt, Homo Sapiens
ucugugggcaggccucgaaaaccaucacaugaccacauagcaugaggccacugcugcuucucca

SEQ ID NO: 109063 - RNA, 64 nt, Homo Sapiens
gcuugaggucaggaguuuuagaccagccuggacaacauagcaagaccucaucucuucuaaaaau

SEQ ID NO: 109064 - RNA, 64 nt, Homo Sapiens
augacuuuuauaucccauuuugguaauuauucauacauagcacauaugaccaugauguucaggg

SEQ ID NO: 109065 - RNA, 64 nt, Homo Sapiens
ucaauuccugugcauuagugugaugauuucugucacauagcagcauuccgauucuauguaacug

SEQ ID NO: 109066 - RNA, 64 nt, Homo Sapiens
agaccuuaauuuuuauauuuuuuuaaaguagcuaacauagcaguaggcacuuaagcauuuaguc

SEQ ID NO: 109067 - RNA, 64 nt, Homo Sapiens
uacagaucauggcggugcgucagccucacaggagacauagcaggucucagaaaccuucuaugac

SEQ ID NO: 109068 - RNA, 64 nt, Homo Sapiens
ucaguaaagcagaggcuagaauuacaguauuuauacauagcaacuuuucauaaaguagaaaaau

SEQ ID NO: 109069 - RNA, 64 nt, Homo Sapiens
ugcuuucuucuucuuaaagagagcugcuuaccauacauagcacccacagugucucccuucucuu

SEQ ID NO: 109070 - RNA, 64 nt, Homo Sapiens
ugucaagccaucaaaauuaucugaauggaauuaaacauagcaaucuaacaaaauggaauguuaa

SEQ ID NO: 109071 - RNA, 64 nt, Homo Sapiens
ggcuggggacacaggauccucuccagcccugggcacauagcauagccuucccuuuacagcucuc

SEQ ID NO: 109072 - RNA, 64 nt, Homo Sapiens
gaugaaccaaaaauguauuuggauuucuauauggacauagcacagguagacugaauaucugacg

SEQ ID NO: 109073 - RNA, 64 nt, Homo Sapiens
ugaugagauaucaagguaauauuuuauuugaccaacauagcacaagaucuagauaacucaugac

SEQ ID NO: 109074 - RNA, 64 nt, Homo Sapiens
agcauucaggguuauacacauaaaaucaaagaaaacauagcacuguauuugauacguguuccua

SEQ ID NO: 109075 - RNA, 64 nt, Homo Sapiens
uuagguccccauaauccucaauauuuuguauaaaacauagcagugaaggauucaaguacaagua

SEQ ID NO: 109076 - RNA, 64 nt, Homo Sapiens
aaacaccaaauaaaauguuuauuuguuuaaaucaacauagcaugcuguucaacaaacuuguuua

SEQ ID NO: 109077 - RNA, 64 nt, Homo Sapiens
guaaaaaauauuucccaaaguacuucccauaugcacauagcacuuuguacaauuauuuucuggg

SEQ ID NO: 109078 - RNA, 64 nt, Homo Sapiens
uugcagcacuacuuuaaauauuagauuaugucucacauagcacugcucauuuuacuuuuauuuu

SEQ ID NO: 109079 - RNA, 64 nt, Homo Sapiens
accugagggcaggagucugagaccagccuggccaacauagcaaaaccccaucucuauuaaaaau

SEQ ID NO: 109080 - RNA, 64 nt, Homo Sapiens
uaggauauuggacucugcuuagcauuuucaagccacauagcaugacuguuuuuugaauagguug

SEQ ID NO: 109081 - RNA, 64 nt, Homo Sapiens
ucucucugcugcuguugagguuauauuaaguuccacauagcaauuacaguaugccaguuccacu

SEQ ID NO: 109082 - RNA, 64 nt, Homo Sapiens
accccccaugucuacaaaaagaccaaccugggcaacauagcaacgcuugaagucaggaguucaa

SEQ ID NO: 109083 - RNA, 64 nt, Homo Sapiens
gaauucuuaaaagauacaugauaagcagguuaucacauagcauauuuugguauugggacagugg

SEQ ID NO: 109084 - RNA, 64 nt, Homo Sapiens
ggcuccgggcucacuccuucgcacaccgccuugcacauagcagaaaaagcugcagccggugcuu

SEQ ID NO: 109085 - RNA, 64 nt, Homo Sapiens
ggcuccgggcugacuccuucgcacaccgccuugcacauagcagaaagagccgcagccggugcuu

SEQ ID NO: 109086 - RNA, 64 nt, Homo Sapiens
guaucggaaaguauguaccaacuuuaaaaaauacacauagcagauugauauaccauguauucac

SEQ ID NO: 109087 - RNA, 64 nt, Homo Sapiens
uaaguagaugauuaguugcaaagcaaauagauuaacauagcaacucagugauaauuugcugaag

SEQ ID NO: 109088 - RNA, 64 nt, Homo Sapiens
accuagucccuaaaauuaaaggccagccugggcaacauagcaaaccuugaggccaggaguuuaa

SEQ ID NO: 109089 - RNA, 64 nt, Homo Sapiens
ucuugcucuaucaaauuagccaugcuuauuauaaacauagcaauaaugaugaaauucaguccaa

SEQ ID NO: 109090 - RNA, 64 nt, Homo Sapiens
cuacagcaggguuaaucuaugguuuuuaaaggcaacauagcauuuuguggauaauaauugaauu

SEQ ID NO: 109091 - RNA, 64 nt, Homo Sapiens
gggugcauuaacuuaaaagauucacuaaagcagcacauagcacugggaacucuggcuccgaaaa

SEQ ID NO: 109092 - RNA, 64 nt, Homo Sapiens
aacucauuuauaaagcuaaaauaaccggauauauacauagcaugacauuucuuugugcuuuggc

SEQ ID NO: 109093 - RNA, 64 nt, Homo Sapiens
guuucauuucuuuggauggacucuuaucuagaauacauagcagcucugcaaaggaacaguuuuu

SEQ ID NO: 109094 - RNA, 64 nt, Homo Sapiens
agcaugugaauuuuggaaaacacaaaaauucagaacauagcaaauaccuuugaaguauaaaaga

SEQ ID NO: 109095 - RNA, 64 nt, Homo Sapiens
uugauacucauguugcauguuuuacauguacacuacauagcaagagaggugaauauuuggguca

SEQ ID NO: 109096 - RNA, 64 nt, Homo Sapiens
uucuccuucccaccaucauggucuucucucaauuacauagcaauaccagccacuccagcuuugu

SEQ ID NO: 109097 - RNA, 64 nt, Homo Sapiens
aaaucccaaauccuauuuaauuuccuuuaaaaauacauagcauuaaacuagcaacucuuauuuc

SEQ ID NO: 109098 - RNA, 64 nt, Homo Sapiens
uuuauaucugcaaaaaaccuauaaauaucauuguacauagcaugcuauaaaaaauaaaauaauu

SEQ ID NO: 109099 - RNA, 64 nt, Homo Sapiens
ugaagauauguagagauuccuuauccaugccuguacauagcauguccuccuccccucagcuuug

SEQ ID NO: 109100 - RNA, 64 nt, Homo Sapiens
uauucauucaagaaaccuugggccaccgcuuuguacauagcaccgugcuaggcucugggauccc

SEQ ID NO: 109101 - RNA, 64 nt, Homo Sapiens
uagaaugauauuuuugauuucccccuagcucaccacauagcacacucaccauuaugacauccau

SEQ ID NO: 109102 - RNA, 64 nt, Homo Sapiens
gaugguauucgaucugugcccauauauguaagaaacauagcagcacccccaccuaauuauccag

SEQ ID NO: 109103 - RNA, 64 nt, Homo Sapiens
gcuccuugcaacgucuuaagcaagcgaccccccgacauagcaaaagguggcaacccauggaggc

SEQ ID NO: 109104 - RNA, 64 nt, Homo Sapiens
gcaugugaauagccacugcacuccagccugggcaacauagcaagacuccaucucuaaguaaaaa

SEQ ID NO: 109105 - RNA, 64 nt, Homo Sapiens
uuuugaaacaaauauuugaaaaccagguauccacacauagcacuuuuauuccugacuaguuuug

SEQ ID NO: 109106 - RNA, 64 nt, Homo Sapiens
auuucucagauauuauuucucugggaaacauucuacauagcacaggagcuuaagaguggcauua

SEQ ID NO: 109107 - RNA, 64 nt, Homo Sapiens
ucccauguaaaaccugcuacaaauggcagcuuauacauagcaaugguaaaaucaucaucuggau

SEQ ID NO: 109108 - RNA, 64 nt, Homo Sapiens
cuccugauggaaugguaaagcaaucuuucuuggaacauagcaaguaguaaccgaucaaauugcu

SEQ ID NO: 109109 - RNA, 64 nt, Homo Sapiens
agcugccuaccuaaugaggacuucaagccccaccacauagcaugcuuccuuucucuccuggcuc

SEQ ID NO: 109110 - RNA, 64 nt, Homo Sapiens
ggcauuacccguagucguguuuaaaggugcuuucacauagcacaucucuugccgcauaggcuuu

SEQ ID NO: 109111 - RNA, 64 nt, Homo Sapiens
uacccaaaaucacugaagaauguugcaacuuacuacauagcauaauacaaaugagcaagguauu

SEQ ID NO: 109112 - RNA, 64 nt, Homo Sapiens
acuuugcugugagcaggucauucaauucuugcuaacauagcaguuauaauuacguaaacacaua

SEQ ID NO: 109113 - RNA, 64 nt, Homo Sapiens
auuccaucucuaaaaaaaauauccaucguggacaacauagcaagucuugagcccaggauuuuga

SEQ ID NO: 109114 - RNA, 64 nt, Homo Sapiens
aucugcuccuuuucgaguugaugugaugggaggaacauagcaauacucagagaacagaagugca

SEQ ID NO: 109115 - RNA, 64 nt, Homo Sapiens
uauuaugaauacauuaaaguccaucuucuaauaaacauagcaaggaaccauggauuuuuuuuga

SEQ ID NO: 109116 - RNA, 64 nt, Homo Sapiens
acccugucucuaaagaaaaagaccagccugggcaacauagcaagacuugagcccaggaguuuaa

SEQ ID NO: 109117 - RNA, 64 nt, Homo Sapiens
cucaauguuucauaugaagcccuuggugaugaggacauagcaucugcccuggaaaucguuauuc

SEQ ID NO: 109118 - RNA, 64 nt, Homo Sapiens
agagugucugggacgcugcuguauucugaaagucacauagcacacaguaauguuaucuggaagc

SEQ ID NO: 109119 - RNA, 64 nt, Homo Sapiens
uuuguuguuccuucauuuuuuucuuuuuaauaagacauagcagaauuccuuagguaugggauuu

SEQ ID NO: 109120 - RNA, 64 nt, Homo Sapiens
uucuaccuagaaugcaaaauuggguauaugaauuacauagcauguuguugggauuuuuuuuaau

SEQ ID NO: 109121 - RNA, 64 nt, Homo Sapiens
uuaguuuuuaaaaauugcgcuacuugccugggaaacauagcagaccucguuucuacuaaaaauu

SEQ ID NO: 109122 - RNA, 64 nt, Homo Sapiens
uuauauuaauaauaaauguagcuccuguacauuuacauagcaugaguagauugucauuugucag

SEQ ID NO: 109123 - RNA, 64 nt, Homo Sapiens
caaguggcauaauucagggguauuggguaucaagacauagcauccuuaggggaugguagaccuu

SEQ ID NO: 109124 - RNA, 64 nt, Homo Sapiens
ggcugcccaaauccccaaacucuuccuaaaugucacauagcaaaaauucaaaagcugguauuuu

SEQ ID NO: 109125 - RNA, 64 nt, Homo Sapiens
uauuaucacuguggaucucuuuaagucauuuuagacauagcauugcacucuggaauuguuucag

SEQ ID NO: 109126 - RNA, 64 nt, Homo Sapiens
uacagagggugauaaaucucuaaggaaagugaugacauagcaguaaugcgauucaguucaccgc

SEQ ID NO: 109127 - RNA, 64 nt, Homo Sapiens
gacauaaaaacugcuauggacaguuguuucagaaacauagcaauuucuccaccuuucaguuucu

SEQ ID NO: 109128 - RNA, 64 nt, Homo Sapiens
cacccacaccccaaagcuggaaggaucugguucaacauagcacaaacccuuaggaaaaaugaaa

SEQ ID NO: 109129 - RNA, 64 nt, Homo Sapiens
gucuaggacagauugcuuccacuagaaccuggagacauagcaucuuugauagcauaagccagau

SEQ ID NO: 109130 - RNA, 64 nt, Homo Sapiens
uuucauccagaggaacaaaaaaauuaaaaauagaacauagcaaagcaaagacagaaugcccccc

SEQ ID NO: 109131 - RNA, 64 nt, Homo Sapiens
acuugagcccagaauuagagauaagccuauggaaacauagcaagacacugucucuacaggggaa

SEQ ID NO: 109132 - RNA, 64 nt, Homo Sapiens
gguauguaaacuuguaaaaauagagauuugacagacauagcaaucuagucaauguguaaggggu

SEQ ID NO: 109133 - RNA, 64 nt, Homo Sapiens
uggcauuuaacuaaagauggagcaugaucuaaguacauagcacaugugaauaaaagaaaagcug

SEQ ID NO: 109134 - RNA, 64 nt, Homo Sapiens
guaaucucugaaauuuccuuaaauuauauacuuaacauagcagagaaacuggauuguuuuugua

SEQ ID NO: 109135 - RNA, 64 nt, Homo Sapiens
ccuugagcccuggaguuugaguccagccugggugacauagcaagacccugucuuaaaagaaaaa

SEQ ID NO: 109136 - RNA, 64 nt, Homo Sapiens
guuuucuguauguuguugggggaucaacuuucacacauagcaagcacauggccucccugauguc

SEQ ID NO: 109137 - RNA, 64 nt, Homo Sapiens
aagaugcaccuugaucucacccucacuccaaggcacauagcaggaucacucccuagcuucucug

SEQ ID NO: 109138 - RNA, 64 nt, Homo Sapiens
cugaacuguccuaaggcaggcugccuggacaagcacauagcaagacuuggcacuccugugcccu

SEQ ID NO: 109139 - RNA, 64 nt, Homo Sapiens
uagacaggacuuucaugaccgggaucaaggacagacauagcacuuaaaccagaaaacaauugug

SEQ ID NO: 109140 - RNA, 64 nt, Homo Sapiens
uggagauaaucaucugaaaggccuauuuugguuaacauagcacaaaugguuucguaaauaauuu

SEQ ID NO: 109141 - RNA, 64 nt, Homo Sapiens
ucaggagauuucaugccuggugacccugaugaaaacauagcauccagaacuugaaugugucagg

SEQ ID NO: 109142 - RNA, 64 nt, Homo Sapiens
uggcaucacuguguuugacuacuagcaaaauaaaacauagcaaacauguuauguuuaauaagcu

SEQ ID NO: 109143 - RNA, 64 nt, Homo Sapiens
gagcaaauuuccacaaaguguguaaggaaaaaacacauagcaagucuuacugguggaaagucuu

SEQ ID NO: 109144 - RNA, 64 nt, Homo Sapiens
aauguacuuuauuauuaaauuuuuaaaaccacaaacauagcagaaggauguuuacagugaauaa

SEQ ID NO: 109145 - RNA, 64 nt, Homo Sapiens
uuguggcuuugcaaccauuuacagacuaggccagacauagcaucaaaaugaucauuaggacaua

SEQ ID NO: 109146 - RNA, 64 nt, Homo Sapiens
ugcucaguaaauguuuguugagaagaggaccugcacauagcaggcuguuauauacccaaugccu

SEQ ID NO: 109147 - RNA, 64 nt, Homo Sapiens
caguauuuacuguguaauacuuaagugccacuaaacauagcaaauugugcugcacaugaggaaa

SEQ ID NO: 109148 - RNA, 64 nt, Homo Sapiens
aaaguaauccacuuucuuguuuaauauaccagauacauagcaaaagcagcuuggaauaauuaua

SEQ ID NO: 109149 - RNA, 64 nt, Homo Sapiens
ggcuaggaguuccaguucgaaaccagcuucguaaacauagcaagacccagucucuaccaaaaaa

SEQ ID NO: 109150 - RNA, 64 nt, Homo Sapiens
cuucccugaauugcagugauuucuguuauaaggcacauagcaagccuguaccacucuacaguaa

SEQ ID NO: 109151 - RNA, 64 nt, Homo Sapiens
accccaucucuacaaaaauagaccagccugggcaacauagcaaagcuucagcccaggaguuuga

SEQ ID NO: 109152 - RNA, 64 nt, Homo Sapiens
ugugcauucauuacaaauaucacugauaaacaacacauagcaggugaaucagcugggguguuuu

SEQ ID NO: 109153 - RNA, 64 nt, Homo Sapiens
aaaaugugaccugaggcccuagucuagcaagaggacauagcacccucaucugggaauagggaag

SEQ ID NO: 109154 - RNA, 64 nt, Homo Sapiens
uguuguuuguuuccuauaagaugcuuugcugaacacauagcaaaauucaugugacggaugauaa

SEQ ID NO: 109155 - RNA, 64 nt, Homo Sapiens
cauacagcuguugaaaaauauuuaagauuguaccacauagcaaaaaacuaugaaucagcaaauu

SEQ ID NO: 109156 - RNA, 64 nt, Homo Sapiens
accucaucucuauuuaaaaagaccagccugggcaacauagcaaagagauugcuugaguccagga

SEQ ID NO: 109157 - RNA, 64 nt, Homo Sapiens
gaagaauauauuucacuguguuuaguccaaaauuacauagcauucaugugccuuaaacagacuu

SEQ ID NO: 109158 - RNA, 64 nt, Homo Sapiens
aaugcaaaggugaacaggaaugcagcagcagguuacauagcaaauagaugcacuaagaauucac

SEQ ID NO: 109159 - RNA, 64 nt, Homo Sapiens
aaagcuacuguaguaccuaaaaagucaguguuguacauagcauaaaaacucugcagagaaguau

SEQ ID NO: 109160 - RNA, 64 nt, Homo Sapiens
cucuuugucuauggaguuauacuuccaucaaauuacauagcaaugcugaauuaggcaaaaccaa

SEQ ID NO: 109161 - RNA, 64 nt, Homo Sapiens
guacauuuccacaaaucuaagaauugcccuauaaacauagcaggauuuugagagcuugaaaauu

SEQ ID NO: 109162 - RNA, 64 nt, Homo Sapiens
uuaaguuaaaggcugccuagcaauggugccucaaacauagcacccuaugaccccaaaucauagu

SEQ ID NO: 109163 - RNA, 64 nt, Homo Sapiens
aaggacgugccauggugcuuaaagcacacuuaucacauagcacaugggguugcuucauugagau

SEQ ID NO: 109164 - RNA, 64 nt, Homo Sapiens
uucauuguguucaguagugaauuucuacaguuuaacauagcacagggccuucugaaaaucgcac

SEQ ID NO: 109165 - RNA, 64 nt, Homo Sapiens
caucgccaggauuucuaaugcacucaguuucccuacauagcagggauucuuagcuagguguccc

SEQ ID NO: 109166 - RNA, 64 nt, Homo Sapiens
uuaacuauggcaauacauuugugcuuuaacuguuacauagcaguaucaccacuuaccaggaucc

SEQ ID NO: 109167 - RNA, 64 nt, Homo Sapiens
aaacgaaaacagacucgaacuauuguguaccaccacauagcacaugcacgucugucccagacuu

SEQ ID NO: 109168 - RNA, 64 nt, Homo Sapiens
cucccacaccaagugcaugucaguuguggagaaaacauagcaaaaagagccguacgcucuuuac

SEQ ID NO: 109169 - RNA, 64 nt, Homo Sapiens
ggagcugcagauuuccugcuaaguguucugaggcacauagcagagcauugaccagaaaaauuga

SEQ ID NO: 109170 - RNA, 64 nt, Homo Sapiens
auuaaaaugaaguugaauuguuuauugugaacuuacauagcaaccaauuugaacuuccagggau

SEQ ID NO: 109171 - RNA, 64 nt, Homo Sapiens
ccuugcccugugucuguggacauguacaaagcauacauagcacccccaggagggacccuugaua

SEQ ID NO: 109172 - RNA, 64 nt, Homo Sapiens
ccuucagauaaucacaaccauuaauacuucaucuacauagcagcaaaccuugccuacgacaugu

SEQ ID NO: 109173 - RNA, 63 nt, Homo Sapiens
aaaaaccugucauuuuccaaaaagccacugcaaacauagcaauggacauucuuacugugcuaa

SEQ ID NO: 109174 - RNA, 64 nt, Homo Sapiens
cauuccuguucagaaugcgaagcucgggcuggagacauagcauuagaucgucacgaguuaaagc

SEQ ID NO: 109175 - RNA, 64 nt, Homo Sapiens
uuaguagcagagccgggacuacuuggcuaaagucacauagcaaacaggcccaggagauuaagug

SEQ ID NO: 109176 - RNA, 64 nt, Homo Sapiens
gcuugagcccaagaguucauaucuagccuggucaacauagcaagaccccugucucuauuuuuuu

SEQ ID NO: 109177 - RNA, 64 nt, Homo Sapiens
auccuuuccucucuccccguucaugcccugcacuacauagcacagccgggaugcuuggaacaga

SEQ ID NO: 109178 - RNA, 64 nt, Homo Sapiens
acaugauccggauaauauauuuguaaagaccuguacauagcacaguuuuaaccuucaggaagaa

SEQ ID NO: 109179 - RNA, 64 nt, Homo Sapiens
cuugugcacugagaggagggugccccauuucucaacauagcacagcaaggacuguuuguucuuu

SEQ ID NO: 109180 - RNA, 64 nt, Homo Sapiens
agaggacugguguaagggagagaagaauggggccacauagcagcgagcuagugagucgagacuu

SEQ ID NO: 109181 - RNA, 64 nt, Homo Sapiens
auuuagcuaauagcuacaggcugagagaauuguaacauagcaugacaaauuuuguguugacuug

SEQ ID NO: 109182 - RNA, 64 nt, Homo Sapiens
caugcucgcaucuuuguuuuuaaucuggcuucgaacauagcacaaguaacuugaauagcacauc

SEQ ID NO: 109183 - RNA, 64 nt, Homo Sapiens
acuugaggucaggaguuugagaccagugugcaaaacauagcaagaccucaucucagaaaaaaaa

SEQ ID NO: 109184 - RNA, 64 nt, Homo Sapiens
acuugaggucaggaguucaagaccagccugggaaacauagcaagaccccaucucuuaaaaaaaa

SEQ ID NO: 109185 - RNA, 64 nt, Homo Sapiens
gcuugagcccaggaauucaagaccaguccgagcaacauagcaaaagcccuuaucugcaaaaaau

SEQ ID NO: 109186 - RNA, 64 nt, Homo Sapiens
acccugggguuaugaagaugguugaacaccccacacauagcaccggagauaugagaucaacagu

SEQ ID NO: 109187 - RNA, 64 nt, Homo Sapiens
aagcacugcagcgauuucucaaagacauaaaagaacauagcauucaacccagcaucccauuacu

SEQ ID NO: 109188 - RNA, 64 nt, Homo Sapiens
ucauuaggauuaguaguauccaaacucaagacauacauagcaucgucauuagggaaauacaaau

SEQ ID NO: 109189 - RNA, 64 nt, Homo Sapiens
acucuguuucaaaaaaaaagcgccaaccugggucacauagcaaggucacagugaacuaugauua

SEQ ID NO: 109190 - RNA, 64 nt, Homo Sapiens
accccaucucuuaaaaaaaagaccaaccuggacaacauagcaaggcuuaagcccaggaguucaa

SEQ ID NO: 109191 - RNA, 64 nt, Homo Sapiens
acccccaccaucucugaaaagaccagccugggcaacauagcaaggcuuaagcucaggaguuuga

SEQ ID NO: 109192 - RNA, 64 nt, Homo Sapiens
gaagacuaauuuuaaggauuuacauagcuaaaauacauagcauuacuguugacacaguacaagu

SEQ ID NO: 109193 - RNA, 64 nt, Homo Sapiens
ccuugaggccaggguucgagaccaaccuugggcaacauagcaagaccccauuucuuaaaaaaaa

SEQ ID NO: 109194 - RNA, 64 nt, Homo Sapiens
acugacaugucuauuuccuugggagcaugugagaacauagcaguagggaccaaaagucucagca

SEQ ID NO: 109195 - RNA, 64 nt, Homo Sapiens
ggaggaucccaggaguucaaauccugccugggcaacauagcaagacccugucucuuaaaaaaac

SEQ ID NO: 109196 - RNA, 64 nt, Homo Sapiens
uucuaccagguccccauccugcugccagcucucaacauagcaggccauaggacccagagaagaa

SEQ ID NO: 109197 - RNA, 64 nt, Homo Sapiens
gauguuuaugaggaugauugcugguuucccuuacacauagcagagcucacucaguucucacagu

SEQ ID NO: 109198 - RNA, 64 nt, Homo Sapiens
cuccacgaggugaaaaauauucaguaacuuguuuacauagcauuuguguaaagacuaugaucuc

SEQ ID NO: 109199 - RNA, 64 nt, Homo Sapiens
uaaacaugucuguagcacauguacagaggaguacacauagcauauacaugugguauaagcacau

SEQ ID NO: 109200 - RNA, 64 nt, Homo Sapiens
gcaucgucuuggaaccggagaauaauuaauggcuacauagcaagucaggguuuaccaggagcuu

SEQ ID NO: 109201 - RNA, 64 nt, Homo Sapiens
agcccagcucuugggagcauggagaccaacuaccacauagcaagcuggagggugagagaauugu

SEQ ID NO: 109202 - RNA, 64 nt, Homo Sapiens
uguucaguaaauauuugcuggaacaauuuccagcacauagcaagugcuguaacuccaguuccua

SEQ ID NO: 109203 - RNA, 64 nt, Homo Sapiens
caugugcacugaccacaccucaugcacacagaccacauagcacauacacaugcacgcuugcaca

SEQ ID NO: 109204 - RNA, 64 nt, Homo Sapiens
ugaacagaccuucuuuuaacuucuaaucucaagcacauagcagcuguuguuuucauauuaaaga

SEQ ID NO: 109205 - RNA, 64 nt, Homo Sapiens
cuuuauauucucaauuucccgcacagugccuagcacauagcaaggacucaacaaauuucauuga

SEQ ID NO: 109206 - RNA, 64 nt, Homo Sapiens
cacaacacacaccacaccugggacuguuuuuaauacauagcaacagacuggguuauuuauuuaa

SEQ ID NO: 109207 - RNA, 64 nt, Homo Sapiens
auguacauagaugaguguaaguaauuucuccacgacauagcauugacugcauuauuuuacuacu

SEQ ID NO: 109208 - RNA, 64 nt, Homo Sapiens
uaccccauggcauugugacugcaaaugggaaaucacauagcagucugaauuaauaugcuuccuu

SEQ ID NO: 109209 - RNA, 64 nt, Homo Sapiens
gggguggcagguccuuuugagggcagagagggacacauagcacuccaggggaaggaguggcucu

SEQ ID NO: 109210 - RNA, 64 nt, Homo Sapiens
accccgucucuacaaaaaaugaccagccugggucacauagcaagacuugagcucaggaauucga

SEQ ID NO: 109211 - RNA, 64 nt, Homo Sapiens
gguauauacgugugguucauccaucaucugcugcacauagcagacuagaauucugggaacccug

SEQ ID NO: 109212 - RNA, 64 nt, Homo Sapiens
gcugagaucgcaccacugcacuccagccugggcaacauagcaaaauccugucucaaaaaaaaag

SEQ ID NO: 109213 - RNA, 64 nt, Homo Sapiens
accugaggucaggaguucaagaccagucuggccaacauagcaaaacccugucucuacuaaaaau

SEQ ID NO: 109214 - RNA, 64 nt, Homo Sapiens
acuugagcccaggaguucgagaccagccuaggcaacauagcaagacccugucuguacacaaaau

SEQ ID NO: 109215 - RNA, 64 nt, Homo Sapiens
aagucuuagugaccaaacgugaccuugaaagcagacauagcaugacagaccuuccuagaguguu

SEQ ID NO: 109216 - RNA, 64 nt, Homo Sapiens
gccucaggacaccucccagccagaaggcucugagacauagcagcaguauccucuccggaucugu

SEQ ID NO: 109217 - RNA, 64 nt, Homo Sapiens
uuaugucauagaaacuguaugaacaaccagauuuacauagcagagaaaucauacauugaaugcu

SEQ ID NO: 109218 - RNA, 64 nt, Homo Sapiens
ccuaauaaucuggaauauucuacauggcuugauuacauagcaaacaagaccaagauuuagggcu

SEQ ID NO: 109219 - RNA, 64 nt, Homo Sapiens
gugccauccaaauuaauccugcauuugcagaugcacauagcaaucuggcuuccauucauaaggu

SEQ ID NO: 109220 - RNA, 64 nt, Homo Sapiens
caaaugcacacacaugcacacacacauuuaagggacauagcaguaacacuguuuuuuaacaaca

SEQ ID NO: 109221 - RNA, 64 nt, Homo Sapiens
cuaaggcuaguccuuuuauaaacaacuuuuucugacauagcauuuauguauaauaaaccagaca

SEQ ID NO: 109222 - RNA, 64 nt, Homo Sapiens
cuuuuagcucaaaauguugagucauuuacauaugacauagcaugaaucacucuuuacagaaaau

SEQ ID NO: 109223 - RNA, 64 nt, Homo Sapiens
ugcaaugucugucccuaaacauagugguauuuuaacauagcagcugguuaaccgggacuacaga

SEQ ID NO: 109224 - RNA, 64 nt, Homo Sapiens
aaaucccuguuauuuugugaauugggacaagauaacauagcagaggaauuaauaauuuuuuuga

SEQ ID NO: 109225 - RNA, 64 nt, Homo Sapiens
cagaggauuaagguuuuuuuagaaaugugaaacaacauagcaguaaaauacaugagauaaagac

SEQ ID NO: 109226 - RNA, 64 nt, Homo Sapiens
uuagcuucagguugucuuguuucuguauauagugacauagcauucugcugccaucuuagcugug

SEQ ID NO: 109227 - RNA, 64 nt, Homo Sapiens
uggaaaagcagcuaacauuucuugaggcucuaccacauagcaggcacugucacagaguaauggc

SEQ ID NO: 109228 - RNA, 64 nt, Homo Sapiens
ggggacauucuacugugcuaaaaagccacugcagacauagcaauaaaaacaugucauuuuccaa

SEQ ID NO: 109229 - RNA, 64 nt, Homo Sapiens
acccugucuccaaaaaaaaacuccagccugggccacauagcaagauaauuauugcaccacugaa

SEQ ID NO: 109230 - RNA, 64 nt, Homo Sapiens
cauacuuagaauuuggcauagcacuucuaaucuuacauagcaucuaauuaaggaaguaguccuu

SEQ ID NO: 109231 - RNA, 64 nt, Homo Sapiens
accucaucucuacuaaaauaaacuggccuggccaacauagcaaacuugagguuaggaguuugag

SEQ ID NO: 109232 - RNA, 64 nt, Homo Sapiens
guccuccuccccauguccucaaaaauauauauacacauagcaauuuugcuuccucgguuuuuuc

SEQ ID NO: 109233 - RNA, 64 nt, Homo Sapiens
uaaaauaaaugaaaucugaaggugucaguuuuguacauagcaaaaccuccugaguaauaagcau

SEQ ID NO: 109234 - RNA, 64 nt, Homo Sapiens
uacaggcaguuuucuguccuuguuccaaaaguggacauagcaugucauaauuguuaaaaaucug

SEQ ID NO: 109235 - RNA, 64 nt, Homo Sapiens
acuucucuaaucaugcccucccccuccuccaucagcaaaggagcauccaccuucuuccuuaggu

SEQ ID NO: 109236 - RNA, 64 nt, Homo Sapiens
cuggguggggaggaucaauuuagaaggaagagaggcaaaggaaagaguaaaaaacaugaccugg

SEQ ID NO: 109237 - RNA, 64 nt, Homo Sapiens
aguuuaaauagcuuaauaucggaagaguugguuugcaaaggaaaaauugaaaguuuaaagaggg

SEQ ID NO: 109238 - RNA, 64 nt, Homo Sapiens
aagugauagaauaauauucaaacuguggaaacaugcaaaggaaacugaggaugagaaguaagca

SEQ ID NO: 109239 - RNA, 64 nt, Homo Sapiens
cacucugugaagccagcaucuaggggcuaaagaugcaaaggaaagcagcaugcauugucuguac

SEQ ID NO: 109240 - RNA, 64 nt, Homo Sapiens
cuuagaauggggcuaagggaagugcugaaauagagcaaaggauggaagauaauauagacuacca

SEQ ID NO: 109241 - RNA, 64 nt, Homo Sapiens
ggaccaggucuucuugcugaccucgucuacaaaggcaaaggaaggcaaaggaagcugucucggg

SEQ ID NO: 109242 - RNA, 64 nt, Homo Sapiens
uucuugcugaccucgucuacaaaggcaaaggaaggcaaaggaagcugucucggguguuucugaa

SEQ ID NO: 109243 - RNA, 64 nt, Homo Sapiens
ugaaggcagaaagcaaaauuauguuugccacuuugcaaaggagcucacuguggugucuguguuc

SEQ ID NO: 109244 - RNA, 64 nt, Homo Sapiens
uaggcgaaucauuuguucaaagcuguuggccucugcaaaggaaauaccaguucugggcaaucag

SEQ ID NO: 109245 - RNA, 64 nt, Homo Sapiens
accuguaaauugauucaagugagccaggaaagcagcaaaggaaagagaaaccugagugacgacg

SEQ ID NO: 109246 - RNA, 64 nt, Homo Sapiens
caagucauaccuacauucaaggagaggggaccaugcaaaggauaaacugcaggugaagaacuug

SEQ ID NO: 109247 - RNA, 64 nt, Homo Sapiens
caacagacccuaugcugggguguggguguggccugcaaaggaaccuuuuagugcuggcccucuc

SEQ ID NO: 109248 - RNA, 64 nt, Homo Sapiens
cccacgaugaacuugcucuucaaagcaaaggcaagcaaaggaacagguucaaaaggaagugccu

SEQ ID NO: 109249 - RNA, 64 nt, Homo Sapiens
ggacagugcagaauuaaaccagcuacugugacaugcaaaggaaaauaauauuuaaugugugaac

SEQ ID NO: 109250 - RNA, 64 nt, Homo Sapiens
uuaccaguuuagacuaaguuaccauaagagaggagcaaaggaaaugaucuuuaaauuuucccac

SEQ ID NO: 109251 - RNA, 64 nt, Homo Sapiens
augcuggaucucauagaaaauucacagccagacaaucuucuaaucuggagucuuugagaucuuc

SEQ ID NO: 109252 - RNA, 64 nt, Homo Sapiens
cagccagacaaucuucuaaucuggagucuuugagaucuucuaccccaacucaucauuuuccuau

SEQ ID NO: 109253 - RNA, 64 nt, Homo Sapiens
gauuuuuuuuauauuguguaauuaggagauaggcaucuucuaaauucccaccauucacugacuc

SEQ ID NO: 109254 - RNA, 64 nt, Homo Sapiens
ggcuacuuaauuagacauuaucuaauaauuucugaucuucuaguuuuucauagcuguaguccau

SEQ ID NO: 109255 - RNA, 64 nt, Homo Sapiens
uugagaauuggcuauguuaauaggagauucauaaaucuucuauaaguuuauaaaguggaaguau

SEQ ID NO: 109256 - RNA, 64 nt, Homo Sapiens
uuuguauuuaaauggauuaacagaucagagucugaucuucuauguaaaaauauagaaauaaugu

SEQ ID NO: 109257 - RNA, 64 nt, Homo Sapiens
cuugggacucucgucugcacugcguguccucugaagcagugaagucugugccuaugccgagcgc

SEQ ID NO: 109258 - RNA, 64 nt, Homo Sapiens
guaacuggcaaguuaccaagguuguuccugaaacagcagugaucaugacuucuccuuuccagag

SEQ ID NO: 109259 - RNA, 64 nt, Homo Sapiens
gaacuguacagaucagcagagcaggacaguuggcagcagugaccucaguagggaacauguccgu

SEQ ID NO: 109260 - RNA, 64 nt, Homo Sapiens
ugugccuggggcauggacuuuguuaagcagagucagcagugagguccucauucuccagccagcc

SEQ ID NO: 109261 - RNA, 64 nt, Homo Sapiens
gugugggaauauccuaagugguagccuuccaaguagcagugaguugacauucagcugcuuuuaa

SEQ ID NO: 109262 - RNA, 64 nt, Homo Sapiens
aggucuaaaaaugagggcaaaacacuaaggcucuagcagugacuuguucacuaaaaagagagag

SEQ ID NO: 109263 - RNA, 64 nt, Homo Sapiens
ggcgugcggccgggcggggaaagugugucagacgagcagugacggacgacacggccucgcagca

SEQ ID NO: 109264 - RNA, 64 nt, Homo Sapiens
caucuguacucaugugagugaucugagccgucagagcagugacccuuggucgcccuuucuuacc

SEQ ID NO: 109265 - RNA, 64 nt, Homo Sapiens
agcuuccuggcucugggggacccaggugggacuuagcagugaguauuggaagacuuggguugau

SEQ ID NO: 109266 - RNA, 64 nt, Homo Sapiens
cguuugaaagauaauuaagaucccccguggagaaagcagugacacauucacacagcuguucccu

SEQ ID NO: 109267 - RNA, 64 nt, Homo Sapiens
aucaagauccuguucugagucagaugaugaugacagcagugaaacuccuccucacuggaaagag

SEQ ID NO: 109268 - RNA, 64 nt, Homo Sapiens
acaguguaguagaucaucuucauauacuucuauuagcagugaugauggaaggcgagcuaagagg

SEQ ID NO: 109269 - RNA, 64 nt, Homo Sapiens
ggauuccaucauugaaaauuuugacccaaggcacagcagugaaauuuauaguucucaauuuagu

SEQ ID NO: 109270 - RNA, 64 nt, Homo Sapiens
auucacugugguacauuuuaaaauaaaauauuuuagcagugaauauggauuaagguguuuuggg

SEQ ID NO: 109271 - RNA, 64 nt, Homo Sapiens
ccaaggagcucacggucccuugcuguggagacagagcagugaccacauguuagguaccgugcuc

SEQ ID NO: 109272 - RNA, 64 nt, Homo Sapiens
ugccuuuauuuucagcauagauauauucuugccuagcagugaagagaaaacuguucagucacag

SEQ ID NO: 109273 - RNA, 64 nt, Homo Sapiens
aggacgccucuggcccagugcagugaccagguggagcagugaccccucucagcaugagguggag

SEQ ID NO: 109274 - RNA, 64 nt, Homo Sapiens
agguggagcagugaccaggaucagcaugagguggagcagugaccguuugacacacaggcuccuc

SEQ ID NO: 109275 - RNA, 64 nt, Homo Sapiens
aauaagaccucucugaauuauucuuuaaaaugcaagcagugagaacaaugcgcuuuagacauau

SEQ ID NO: 109276 - RNA, 64 nt, Homo Sapiens
uuuaccucccucacagagucccccaccaacggggagcagugacaaccacucuggccucuguuuc

SEQ ID NO: 109277 - RNA, 64 nt, Homo Sapiens
uaugugccaguuccuguaacagguguggggacacagcagugaguaaucaauacagacaagguuc

SEQ ID NO: 109278 - RNA, 64 nt, Homo Sapiens
uccccuauugcgcucucaagaccagagacccaacagcagugaucucagggcagacagcccucca

SEQ ID NO: 109279 - RNA, 64 nt, Homo Sapiens
cucuuaugacauuauaucuugugccuuucuccucagcagugagcagugagcuacuccuggccca

SEQ ID NO: 109280 - RNA, 64 nt, Homo Sapiens
gacauuauaucuugugccuuucuccucagcagugagcagugagcuacuccuggcccaggcccua

SEQ ID NO: 109281 - RNA, 64 nt, Homo Sapiens
ccccaugaacauuuguccuaacucagauuuugugagcagugaaguuuaacagagcagugacauu

SEQ ID NO: 109282 - RNA, 64 nt, Homo Sapiens
uaacucagauuuugugagcagugaaguuuaacagagcagugacauuuaacaaagcagugaaguu

SEQ ID NO: 109283 - RNA, 64 nt, Homo Sapiens
cagugaaguuuaacagagcagugacauuuaacaaagcagugaaguuuaacagaguucugagaau

SEQ ID NO: 109284 - RNA, 64 nt, Homo Sapiens
gguaguggcgugcaucugaucugagaggcaguaaagcagugaugaagacagugcagcagaacau

SEQ ID NO: 109285 - RNA, 64 nt, Homo Sapiens
agacagugcagcagaacauugaaguccugauugcagcagugacucugcaaccuuggauaaauua

SEQ ID NO: 109286 - RNA, 64 nt, Homo Sapiens
gagcucccugcggccacuccugaacaaggacaugagcagugaggagcagucccucuacuacagg

SEQ ID NO: 109287 - RNA, 64 nt, Homo Sapiens
ugaugaggaggagaucaacaccgaucacaaugaaagcagugaagugagccagucagagggagag

SEQ ID NO: 109288 - RNA, 64 nt, Homo Sapiens
aaaguuguuuguuggacuccauaagugaauuucaagcagugaggauuuuguggugccugagaug

SEQ ID NO: 109289 - RNA, 64 nt, Homo Sapiens
ucccugcaguagccacggccaggcccuuaggaggagcagugaccggggguguccagaaauaucc

SEQ ID NO: 109290 - RNA, 64 nt, Homo Sapiens
cauuagaugcugguaaaagcuacaauggaaaaaaagcagugaaguauucaagugcauuaaaguc

SEQ ID NO: 109291 - RNA, 64 nt, Homo Sapiens
uagcauaauaaagccccgggauuauuaaccucugagcagugauaugauaggauaguuagugagg

SEQ ID NO: 109292 - RNA, 64 nt, Homo Sapiens
aaauugagugagaaggaaacacuuguuuuauucacagagguaaagugucuuuucaauauaacca

SEQ ID NO: 109293 - RNA, 64 nt, Homo Sapiens
aguuuugaaaucaaagacuauuaaaggagcuguacagagguaaaaaaauaaauguggaacauua

SEQ ID NO: 109294 - RNA, 64 nt, Homo Sapiens
ccugcuucauuguccauccccugggggagugggucagagguacuggagggugcugagccgaagg

SEQ ID NO: 109295 - RNA, 64 nt, Homo Sapiens
ggaaaaccggaggagcaauuggggauccaggugucagagguaggggaaccaggggcaagcuggg

SEQ ID NO: 109296 - RNA, 64 nt, Homo Sapiens
gcugccgaaagugucagagaggaggugcggcuuccagagguacagugccagagauggcugugcc

SEQ ID NO: 109297 - RNA, 64 nt, Homo Sapiens
gcugcugaaagugucggagaggaggugcggcuuccagagguacagugccagagauggcugugcc

SEQ ID NO: 109298 - RNA, 64 nt, Homo Sapiens
gcugcccaaagugucagagaggaggugcggcuuccagagguagagugccagagauggcugugcc

SEQ ID NO: 109299 - RNA, 64 nt, Homo Sapiens
gauggcaggaugggcacugccgagaacagcauuggucccagagcccugggcaucagaccuuaac

SEQ ID NO: 109300 - RNA, 64 nt, Homo Sapiens
uccccaccaauccccgccacagcaggcgccucgggucccagaugucugcagcccucagcagcug

SEQ ID NO: 109301 - RNA, 64 nt, Homo Sapiens
ccuauucucccacgaggaucgauuguauccugaggucccagaacagcagcuuucugguucuugu

SEQ ID NO: 109302 - RNA, 64 nt, Homo Sapiens
uggucccagggagccauccuuccuggucgccucugucccagagacugagcugccggucuuggcu

SEQ ID NO: 109303 - RNA, 64 nt, Homo Sapiens
acacaucccucgggaacucuuuaaggaccacacagucccagaggcauuuuaggauaccuuuacu

SEQ ID NO: 109304 - RNA, 64 nt, Homo Sapiens
agggcuccagggacagaugacccaugccucacuggucccagauccugaugggagcugcuucucc

SEQ ID NO: 109305 - RNA, 64 nt, Homo Sapiens
cagucacaacugccauuuccagucucugcugagugucccagacccucgaggcugccacuccguc

SEQ ID NO: 109306 - RNA, 64 nt, Homo Sapiens
ggugagcuuaaagaacaaccaaacucugccaggggucccagaaagcccaggguccagcagucuc

SEQ ID NO: 109307 - RNA, 64 nt, Homo Sapiens
uuugggcgucauucacccacuaccccuagugcuagucccagaggaugcugcggagggggcagcc

SEQ ID NO: 109308 - RNA, 64 nt, Homo Sapiens
gcuggcugggcuuccuguuuccagaugcauuccugucccagagucaccacagagacuguuugga

SEQ ID NO: 109309 - RNA, 64 nt, Homo Sapiens
cggggaaccagcucaccucucgggcacugggcaggucccagagcggcugacacaugggguaugc

SEQ ID NO: 109310 - RNA, 64 nt, Homo Sapiens
gggagcccaccugcugccugcugaguggugucgggucccagagagugggccugaugaaagcuuc

SEQ ID NO: 109311 - RNA, 64 nt, Homo Sapiens
uacuagcauuuugcaacuaugagaaaguugaagagucccagaccgagucuacuuggcccuagaa

SEQ ID NO: 109312 - RNA, 64 nt, Homo Sapiens
gaauucgugggcugagggcaugauucuguaaauagucccagagaaguuccguggguuuccccuu

SEQ ID NO: 109313 - RNA, 64 nt, Homo Sapiens
agaguccugugcgaccugaguugacucgacugcugucccagagggaggaaagccgucucccugc

SEQ ID NO: 109314 - RNA, 64 nt, Homo Sapiens
auccauagucgucaaagcuuuucuaaggguccaagucccagagauuuacucgcaacaacuuaau

SEQ ID NO: 109315 - RNA, 64 nt, Homo Sapiens
gauguguccugauaagcugagcuccuuagccuuugucccagaaugccuccugcagggauucuuc

SEQ ID NO: 109316 - RNA, 64 nt, Homo Sapiens
uggaccuuuccugaggaagagggacuguucuuuugucccagaaaagcaguggcuccauuggugu

SEQ ID NO: 109317 - RNA, 64 nt, Homo Sapiens
ggggcagcagcaggcugggauccagaaaauuagggucccagaaggggcagcccauuucucaaag

SEQ ID NO: 109318 - RNA, 64 nt, Homo Sapiens
aacgcuggagccaagagaaguguaucugcagagggucccagagggcuggggguccagcacaggc

SEQ ID NO: 109319 - RNA, 64 nt, Homo Sapiens
gcgggcagggggugaccccuggagcuaguugcgugucccagaauggaggguguucugacacccc

SEQ ID NO: 109320 - RNA, 64 nt, Homo Sapiens
cccccgugcuggcggagcggacgccgcgcucugggucccagaggggccggguggcucagacgac

SEQ ID NO: 109321 - RNA, 64 nt, Homo Sapiens
cugcacugcuacccucuauuucccacucagggcugucccagagagaaggcagccgaacugagga

SEQ ID NO: 109322 - RNA, 64 nt, Homo Sapiens
gagacagagacuuuguggaaguaucucugagggagucccagacacaggcagagagggccacaua

SEQ ID NO: 109323 - RNA, 64 nt, Homo Sapiens
ugaaacucccuaaaaugccuugcagcucccgaaagucccagagacgaugugcaccucccggaag

SEQ ID NO: 109324 - RNA, 64 nt, Homo Sapiens
ugaagcucccugagaugaaaugcagcuuccaaaagucccagagacgaugugcaccucccagaag

SEQ ID NO: 109325 - RNA, 64 nt, Homo Sapiens
ucgaaugcccaccuuugggcggccagggugaaaggucccagacuguagccaaggucagcccuga

SEQ ID NO: 109326 - RNA, 64 nt, Homo Sapiens
accaaugcuacaagccagcaagaggagaccgagggucccagaggaauccgggcaggacccucga

SEQ ID NO: 109327 - RNA, 64 nt, Homo Sapiens
cucagaacccacccucccugccacuucaccccaugucccagagcuuccccuagugacccccccc

SEQ ID NO: 109328 - RNA, 64 nt, Homo Sapiens
gauuuucuuacagcgaagacuugaguuccuccaagucccagaaccccaagaaugggcaagaagg

SEQ ID NO: 109329 - RNA, 64 nt, Homo Sapiens
gugcagcugugaagcucgggcugauucccccucugucccagaagguuggccagagggugugacc

SEQ ID NO: 109330 - RNA, 64 nt, Homo Sapiens
ugggaccggggccccgcugggaaugaggguguuggucccagaauagggucuguguucuccagga

SEQ ID NO: 109331 - RNA, 64 nt, Homo Sapiens
gccggggguaggggccacccgcuggguaguuggggucccagaaagguguugacccagggauggg

SEQ ID NO: 109332 - RNA, 64 nt, Homo Sapiens
accagguaccccguaggaauuuccaguuucccuugaucuagaugggauucuuauaaaaauucaa

SEQ ID NO: 109333 - RNA, 64 nt, Homo Sapiens
gaagggccacaggcccgcuaagccccaaaggcaggaucuagaugaugaugaacaugauuaugaa

SEQ ID NO: 109334 - RNA, 64 nt, Homo Sapiens
cccuuuaaaaacuaacccacugaauauuccgugugaucuagaacaguguggcagcuuucacagc

SEQ ID NO: 109335 - RNA, 64 nt, Homo Sapiens
ggcugaguguacuaguaguuaagagaauaaacuagaucuagaaucagagcuggauucaauuccu

SEQ ID NO: 109336 - RNA, 64 nt, Homo Sapiens
guggguuuuggcauauuagauagagaaaaugacagaucuagaugaagggagcuuuuggaugugu

SEQ ID NO: 109337 - RNA, 64 nt, Homo Sapiens
ugccuucuuucacccuguccugauagacuucccugaucuagauauccuucgucaugacacuucu

SEQ ID NO: 109338 - RNA, 64 nt, Homo Sapiens
gagagagguucuggggaggaagggccaggagagagaucuagaaaguggguucacuagagcuggg

SEQ ID NO: 109339 - RNA, 64 nt, Homo Sapiens
ugaggagaaaauauauagcuuuggacacgaggaagaucuagaaaauuaucauugaacauauuaa

SEQ ID NO: 109340 - RNA, 64 nt, Homo Sapiens
uuuuuuucauaauauucucauagaguuucugcuagaucuagagcucugcucagugccucuuaua

SEQ ID NO: 109341 - RNA, 64 nt, Homo Sapiens
uuuuguccucuuugcuuccccaaggcuaaagucagaucuagaguucugccacaggucuaacaau

SEQ ID NO: 109342 - RNA, 64 nt, Homo Sapiens
acuuuggauuuuugaaguaacgugagaugggaaugaucuagaaaugaacugaccucuaaagcag

SEQ ID NO: 109343 - RNA, 64 nt, Homo Sapiens
ccagcagcuacuggcucaaagaugcugauaguuugaucuagaaaccgcagagggagcaggaaga

SEQ ID NO: 109344 - RNA, 64 nt, Homo Sapiens
uuugccuuuuuuuuuuuuuuacucuuccaguuaggaucuagaacucuucuuccuucuuggccua

SEQ ID NO: 109345 - RNA, 64 nt, Homo Sapiens
agcuguuuuucugcuccuuuggguuuaguguacugaucuagaaaauuuuugcagauucuuggcu

SEQ ID NO: 109346 - RNA, 64 nt, Homo Sapiens
cuacauguuaccauugguuuuaaauugccccgacgaucuagauucuuuuugaaagucuaccuuc

SEQ ID NO: 109347 - RNA, 64 nt, Homo Sapiens
cuuauauuuuccauaggaagccaucuuauacagagaucuagaauggaucucaagcuaaagcaaa

SEQ ID NO: 109348 - RNA, 64 nt, Homo Sapiens
cucuuuauguucuccagaggccaccuuauacagagaucuagaauugauuucaagcuaaagcaaa

SEQ ID NO: 109349 - RNA, 64 nt, Homo Sapiens
uuuuccuuagacucuuuaguuaaugcagguacaagaucuagaguagauugcaucuguguagaag

SEQ ID NO: 109350 - RNA, 64 nt, Homo Sapiens
cauucacuugaagagcaaggagguagugaugguggaucuagagaggacuuagcuuccugauacu

SEQ ID NO: 109351 - RNA, 64 nt, Homo Sapiens
uuuuguaugaagcaugccucaguuuccucauuuugaucuagauauaaaauuaaaauuguccauu

SEQ ID NO: 109352 - RNA, 64 nt, Homo Sapiens
caaaaugucacugccagaaagagcuguuccagcugaucuagagcauacugcccuagaguguccc

SEQ ID NO: 109353 - RNA, 64 nt, Homo Sapiens
gcaacuuggaaguguaaagauuuuguaaugaaaggaucuagaaaaagauuauuugaucagaaua

SEQ ID NO: 109354 - RNA, 64 nt, Homo Sapiens
cugaguuguggagcugacucauaaugaagaaaaagaucuagaaaaucucaucauccugaagccu

SEQ ID NO: 109355 - RNA, 64 nt, Homo Sapiens
ugccuuuauccacucgaauucauccucacacauugaucuagaucugggugugugucugcaccca

SEQ ID NO: 109356 - RNA, 64 nt, Homo Sapiens
uuagagacauacuuguuaacggcuguaaaaaucagaucuagaguuacgucauugucucaagugu

SEQ ID NO: 109357 - RNA, 64 nt, Homo Sapiens
uucaucucagcuuuugaugguacugaugagucuugaucuagauacaggacugguuccuuccuua

SEQ ID NO: 109358 - RNA, 64 nt, Homo Sapiens
gccugauaacccaugccaggucuuauagauuccugaucuagaaccuuuccaggcaaucucagac

SEQ ID NO: 109359 - RNA, 64 nt, Homo Sapiens
ggcagauuugcauauuucauacccagguaucugggaucuagacaucugaauuugaucucaaugg

SEQ ID NO: 109360 - RNA, 64 nt, Homo Sapiens
gauuuauuuuguuuguaauuaguuauuauaagaagaucuagauccuagauauuagaauaaaauu

SEQ ID NO: 109361 - RNA, 64 nt, Homo Sapiens
acacgucuucuaaaaggggcaguuuuagaaaugagaucuagagauagaaaugagaaaaauacag

SEQ ID NO: 109362 - RNA, 64 nt, Homo Sapiens
agccucaagugagggucaaauucaacauuauccugaucuagacagcccccauucucaauccacc

SEQ ID NO: 109363 - RNA, 64 nt, Homo Sapiens
uucugagaggggaaaaugugaaauaugugacaaggaucuagaaauuuauauagaccuauccucu

SEQ ID NO: 109364 - RNA, 64 nt, Homo Sapiens
uuagcuagugaaaugcuaaacuuuccccaagauagaucuagauaagcacaggcuuuuucaggug

SEQ ID NO: 109365 - RNA, 64 nt, Homo Sapiens
cguuguuuucugccauuuaucccaaacuuuuucagaucuagaauucgagagugucauggacaaa

SEQ ID NO: 109366 - RNA, 64 nt, Homo Sapiens
ggguguguuacuauauuaaaauacacacacaacugaucuagacaucaagaggaagaaaaaugau

SEQ ID NO: 109367 - RNA, 64 nt, Homo Sapiens
uugcucuccauuuugacguuaaaaaacaacaacagaucuagagauaccucaaggauaucauuuu

SEQ ID NO: 109368 - RNA, 64 nt, Homo Sapiens
auguugaagaagauggacaugaagccaaaagaaugaucuagaguuccacugugagaucuacagg

SEQ ID NO: 109369 - RNA, 64 nt, Homo Sapiens
auuaaauccgcccugcaaguauacaggcugacuugaucuagaacauucacauacacauauguau

SEQ ID NO: 109370 - RNA, 64 nt, Homo Sapiens
cagaucuugaaaucugaaugagcuggauuauuuagaucuagaaaaucuggucauguuggucaaa

SEQ ID NO: 109371 - RNA, 64 nt, Homo Sapiens
cuugucuccuuaaagaaaaaguuugccagcuccugaucuagaccaagagggagauauugaccuu

SEQ ID NO: 109372 - RNA, 64 nt, Homo Sapiens
augggcacccaugugcuggcacagaacaguuccagaucuagacuggagagguccacagccuugu

SEQ ID NO: 109373 - RNA, 64 nt, Homo Sapiens
aaaggcuguaaucagcagacuggaagcugaggaagaucuagaaguaaaagaaaaaauuagaugc

SEQ ID NO: 109374 - RNA, 64 nt, Homo Sapiens
gggaggccaaggcgagcggaucaugaggucagaagaucuagaacagccuggucaacauggugaa

SEQ ID NO: 109375 - RNA, 64 nt, Homo Sapiens
uucucuguucauacagcaaguauggaaaaaagaugaucuagaagucaacuaucucaaccuccau

SEQ ID NO: 109376 - RNA, 64 nt, Homo Sapiens
cauccuucaaaggacaguguuguuuugaccgggagaucuagagagugcucagaauuagggccug

SEQ ID NO: 109377 - RNA, 64 nt, Homo Sapiens
uuucuacuuugucuuugaacugaaaauaaacauggaucuagaaaaccaaccagcaaguuuucag

SEQ ID NO: 109378 - RNA, 64 nt, Homo Sapiens
ccauaauucucuuuggugcaggucuugggagcgugaucuagauuacacugcaccauucccaagu

SEQ ID NO: 109379 - RNA, 64 nt, Homo Sapiens
aacguccauuaagcugagagugcuaugaagacaggaucuagaauaaucuugcucacagcugugc

SEQ ID NO: 109380 - RNA, 64 nt, Homo Sapiens
uuuccuccuugacaucaccugauugacaugaugggaucuagaucguccuggguuaggcaccuga

SEQ ID NO: 109381 - RNA, 64 nt, Homo Sapiens
acucaugacauuuuauuugacucuuuaauccucagaucuagauacaaguaaaggcugaggacuc

SEQ ID NO: 109382 - RNA, 64 nt, Homo Sapiens
ugaaaguaaauuuuaugaaguugagugaacuucugaucuagauugucaggccuuugcaguaggc

SEQ ID NO: 109383 - RNA, 64 nt, Homo Sapiens
gaaacucagcuaccuuucuugaguuuacauaaaugaucuagauuacaccguugacaagaaggcu

SEQ ID NO: 109384 - RNA, 64 nt, Homo Sapiens
uuguagguagcccuuacuacacucaacugauugggaucuagaauguaacuaaauugcuuauaaa

SEQ ID NO: 109385 - RNA, 64 nt, Homo Sapiens
cagggguggggaauguuugggcagaagggagaaggaucuagaauguguuuucugaauaacauuu

SEQ ID NO: 109386 - RNA, 64 nt, Homo Sapiens
accuugucuuucaaaagaacucagaauccuccaggaucuagaagaaggaagaaaguguguaaau

SEQ ID NO: 109387 - RNA, 64 nt, Homo Sapiens
ugccuuagguaacugcagaaauuuuuaauugugugaucuagacauggaaaguuaccauaugaua

SEQ ID NO: 109388 - RNA, 64 nt, Homo Sapiens
caguaauuuuguguuugggguaaauaaaugacaugaucuagaaugauacauacuaaaguauuug

SEQ ID NO: 109389 - RNA, 64 nt, Homo Sapiens
ugguccagccgacgaagaguauuggcaucacauugaucuagaacccccaaggagccuggcacug

SEQ ID NO: 109390 - RNA, 64 nt, Homo Sapiens
aguccaaaauguuggaaauaaaauauaagacauugaucuagauaugagguuuuucuccuucauu

SEQ ID NO: 109391 - RNA, 64 nt, Homo Sapiens
gguaaaaggcuaacuaaccccuagaugaggagcugaucuagacagcccucagagagguuccagu

SEQ ID NO: 109392 - RNA, 64 nt, Homo Sapiens
ucuguuuguuguauggaaauuagcuugcuggguugaucuagauguggacugcacacuuccacca

SEQ ID NO: 109393 - RNA, 64 nt, Homo Sapiens
cugguaaaaaugacaauaucagccugaaaguuuagaucuagaagucaucaauguucaguucaaa

SEQ ID NO: 109394 - RNA, 64 nt, Homo Sapiens
uagaucuuuguauuuuuaauauucuagguccuaggaucuagaauauuuccuuaaaauaauugug

SEQ ID NO: 109395 - RNA, 64 nt, Homo Sapiens
ccaaauaaaugauuaaucuuuuuucagauauauggaucuagaucugagaaacuuuauacuucag

SEQ ID NO: 109396 - RNA, 64 nt, Homo Sapiens
cauuuccugcuucuuaaauuaauugagaaauacugaucuagaguaaaaugucuuacacggcugu

SEQ ID NO: 109397 - RNA, 64 nt, Homo Sapiens
gaaguucagccgaacccacagccuuuuaauuagugaucuagaaaccauuccccagcaugaaugu

SEQ ID NO: 109398 - RNA, 64 nt, Homo Sapiens
ggugggccuaauuccaagggaccacugaggagaggaucuagacacugguuucagcccaggaccc

SEQ ID NO: 109399 - RNA, 64 nt, Homo Sapiens
uauuccuacauucugaauggugauacaacuccccgaucuagauuuuaucuaggguuguagcuuu

SEQ ID NO: 109400 - RNA, 64 nt, Homo Sapiens
ggaauguauguaacuagguaggguuccuuucuuagaucuagaggaaguacagccacccacugac

SEQ ID NO: 109401 - RNA, 64 nt, Homo Sapiens
cuucuacuaaacagagaaaucugguggccuuagggaucuagaaaucugguuaaaauuauauuga

SEQ ID NO: 109402 - RNA, 64 nt, Homo Sapiens
aguuauaaaugguauuugacucuagggacugguugaucuagaugauccuucccaaaaaucagug

SEQ ID NO: 109403 - RNA, 64 nt, Homo Sapiens
caguuacuuuguguuucagccuuaauugcuacaugaucuagagccuggauucacagcucuguca

SEQ ID NO: 109404 - RNA, 64 nt, Homo Sapiens
aaaguauuguacguuugaauaagguuuuaauucagaucuagaagauggaugaauugggguaaau

SEQ ID NO: 109405 - RNA, 64 nt, Homo Sapiens
ugcauauauuuagcggguauaaaaaaaugcugcagaucuagaaaugguuuguguuuugagguac

SEQ ID NO: 109406 - RNA, 64 nt, Homo Sapiens
acagucuccucaugagacauagccuaaucaauuagaucuagaauuggaaaaauugucccgucug

SEQ ID NO: 109407 - RNA, 64 nt, Homo Sapiens
gguauguuuuucuuuuuuaaaaaagcugcuguuggaucuagaaggugaagaauuuuuuuaugua

SEQ ID NO: 109408 - RNA, 64 nt, Homo Sapiens
acugaggugcaaagcaguuaagcaacugguccaagaucuagaccagguacucaaccaccccacu

SEQ ID NO: 109409 - RNA, 64 nt, Homo Sapiens
aauccuguuauccuguguauuuacuaguccucaugaucuagacuuaaccccuuuucuguguuac

SEQ ID NO: 109410 - RNA, 64 nt, Homo Sapiens
uuuuccucuuuuucugaagcauguauaaauaaaugaucuagauauuuuauuaaaaaauauauau

SEQ ID NO: 109411 - RNA, 64 nt, Homo Sapiens
ggaccauaagaggaguaggcccucuuagccucuggaucuagaagccuugggccuggccagucuu

SEQ ID NO: 109412 - RNA, 64 nt, Homo Sapiens
gacugcaugcuacugucuagagcuugucucaauggaucuagaacuucaucgcccucugaucgcc

SEQ ID NO: 109413 - RNA, 64 nt, Homo Sapiens
uagaauucuuuauugguggcccuacuauggugaugaucuagaacugacuuacuucaggacagaa

SEQ ID NO: 109414 - RNA, 64 nt, Homo Sapiens
gaauuauuuaaguuuuaucacaaugauuuuaauugaucuagacacuuccauucauaaggagacu

SEQ ID NO: 109415 - RNA, 64 nt, Homo Sapiens
uagaaaaaucccuacuaaguuuuccgaaggccaugaucuagagauucuuuuuugguuucuuggc

SEQ ID NO: 109416 - RNA, 64 nt, Homo Sapiens
ugagacauacuggcauggagugaaaguucuaugggaucuagaaaccuugguuauuacuuucaau

SEQ ID NO: 109417 - RNA, 64 nt, Homo Sapiens
uuuuacuuuuauaaagauggguaguacauuucaggaucuagaaguguaaacuauagacucuacu

SEQ ID NO: 109418 - RNA, 64 nt, Homo Sapiens
gcagauaggaacuuucuuguuaguucaggcucuugaucuagaugguucuuguuugaaaauacug

SEQ ID NO: 109419 - RNA, 64 nt, Homo Sapiens
uaauuuuccuuuugagguugugggcauaagugcugaucuagaauacagucugggucccacacug

SEQ ID NO: 109420 - RNA, 64 nt, Homo Sapiens
uuauauuuauguuuuauuucuauuuggacucagagaucuagacccaauaauuaguaggcuccug

SEQ ID NO: 109421 - RNA, 64 nt, Homo Sapiens
cuguccuuuuccacugaagaaggaaagacguuuugaucuagaaauagcguugugauuuccuugc

SEQ ID NO: 109422 - RNA, 64 nt, Homo Sapiens
gaauuccugucuucuuuaggaguaaugauucauagaucuagauagguggaaauaucauucaaaa

SEQ ID NO: 109423 - RNA, 64 nt, Homo Sapiens
ucgaaaauugacauaguagcauugaggauacucugaucuagaaagccaaguauuugagcaacau

SEQ ID NO: 109424 - RNA, 64 nt, Homo Sapiens
cagaggaaucccagcgccuuucuagcccagcauugaucuagaaggauagaacagacuuuacuuu

SEQ ID NO: 109425 - RNA, 64 nt, Homo Sapiens
gggugagggggacggggauggagcaagggggagagaucuagauuaacagcuuuuucuaagggga

SEQ ID NO: 109426 - RNA, 64 nt, Homo Sapiens
aguuugguugcuggcuguaggaguuuuugugguugaucuagacagaugcuagauaaugaauaaa

SEQ ID NO: 109427 - RNA, 64 nt, Homo Sapiens
uuguuaacuugcagauaaccagaugcaacgugaagaucuagacuggacccugguuugaugaacc

SEQ ID NO: 109428 - RNA, 64 nt, Homo Sapiens
ugcuccuugguggccauuagcaaguguccccuuagaucuagaacggauuugaccccuuggcucu

SEQ ID NO: 109429 - RNA, 64 nt, Homo Sapiens
ggaagacacaauguuguuauuuauuacuccuugagaucuagauacacauaugguauaauucauc

SEQ ID NO: 109430 - RNA, 64 nt, Homo Sapiens
uaaacucaacaaaugucaucaaauauguugaauugaucuagaaauuauuucauauauaaaucag

SEQ ID NO: 109431 - RNA, 64 nt, Homo Sapiens
agcauggagcuguugguagauuuuccuucaggaugaucuagagcccagcauccuuugcauuacu

SEQ ID NO: 109432 - RNA, 64 nt, Homo Sapiens
uagagaaauaggggugguuaccuaaaauaaugcugaucuagagaacauguuuuaguuugcuuca

SEQ ID NO: 109433 - RNA, 64 nt, Homo Sapiens
gcaaauaccaaaggaauguaaaaaaaacucaggugaucuagaaguguuuauuuucuucccuucc

SEQ ID NO: 109434 - RNA, 64 nt, Homo Sapiens
ccacagucucacugacuguuuuuguaugguccaugaucuagaauuuaaaaaaauuuuaaagggu

SEQ ID NO: 109435 - RNA, 64 nt, Homo Sapiens
agcuuuggcuccggcugugauaccacgacuuugggaucuagaggucuacuaccugaucuccucc

SEQ ID NO: 109436 - RNA, 64 nt, Homo Sapiens
ucuuggguccccgucccuacaaaucccggaucaggaucuagaaguagaaugaggauguugggga

SEQ ID NO: 109437 - RNA, 64 nt, Homo Sapiens
gucugaggaggcugugacgcccuaugaccgcagagaucuagacagucguaacaguccccaggcu

SEQ ID NO: 109438 - RNA, 64 nt, Homo Sapiens
cccccaaauccuugagauguucucccuuagaugagaucuagacgugaggaccagaaaaguugug

SEQ ID NO: 109439 - RNA, 64 nt, Homo Sapiens
accuagcugcgccaagaccuggccccuggccugagaucuagacagagagaaagaaaaucugaag

SEQ ID NO: 109440 - RNA, 64 nt, Homo Sapiens
ggaagagggaugaugggauggaaugggagggugggaucuagaugaccucuugaaauugucccag

SEQ ID NO: 109441 - RNA, 64 nt, Homo Sapiens
cccugcucuaugcugacccuugucacugaacccugaucuagacuuauaugaauaaaugaaauua

SEQ ID NO: 109442 - RNA, 64 nt, Homo Sapiens
gagggcuugcucuaaaucguuuagaggauaacaggaucuagagaugcucucugcuugacaacaa

SEQ ID NO: 109443 - RNA, 64 nt, Homo Sapiens
ugcauuuucauuauuuggguaggugaccugcuuggaucuagacagcaucuguucaaaguuguag

SEQ ID NO: 109444 - RNA, 64 nt, Homo Sapiens
aaacaauuuaaaaaucuuuuaagucuuuuucugugaucuagaacaagauaauauggcauuggaa

SEQ ID NO: 109445 - RNA, 64 nt, Homo Sapiens
caugaccgcugacaccacucagagcuggaaccaagaucuagauaguccguagauagcacuuagg

SEQ ID NO: 109446 - RNA, 64 nt, Homo Sapiens
acauuuucaauaaagaauauguauaaacuguacagaucuagaucuacaaccuauuucucuacuc

SEQ ID NO: 109447 - RNA, 64 nt, Homo Sapiens
auuuucaaaauucaugacuugaagugcaaggacagaucuagauguuuguuuaccaagcuaugug

SEQ ID NO: 109448 - RNA, 64 nt, Homo Sapiens; identical to SEQ ID NO: 109446

SEQ ID NO: 109449 - RNA, 64 nt, Homo Sapiens
caacccacaaguagcuacgacugcaagcaccugccaccauaaagggcugcauuuugccaccaua

SEQ ID NO: 109450 - RNA, 64 nt, Homo Sapiens
caagcaccugccaccauaaagggcugcauuuugccaccauaaagggcugcauuuuuuuaaaaag

SEQ ID NO: 109451 - RNA, 64 nt, Homo Sapiens
cugaaaggcaggaguguuagcaucucgcuuuauccaccauaacguaaagaacugcggugugaua

SEQ ID NO: 109452 - RNA, 64 nt, Homo Sapiens
uuagcaccuaaagaucugcaccccaaaccaaugucaccauaaagagggcacgaagaagaguggg

SEQ ID NO: 109453 - RNA, 63 nt, Homo Sapiens
ccaggagagagggacagguugacagguucuaucaugggugacagggugacacgaggacacagg

SEQ ID NO: 109454 - RNA, 63 nt, Homo Sapiens
cgaggacacagggacagguugacagguucugucaugggugacagggugacaccaggacacagg

SEQ ID NO: 109455 - RNA, 63 nt, Homo Sapiens
caggaauccccucacaguggccacagagaggcaaugggugagaaaaacaaguccaaaaagcac

SEQ ID NO: 109456 - RNA, 63 nt, Homo Sapiens
auacaacuagaagccagcagauguccuacuucaaugggugaggccacacuccucauggauguc

SEQ ID NO: 109457 - RNA, 63 nt, Homo Sapiens
caguuggguuuuguaaauacacccagguucuagaugggugaauauguugagaaguggaaaaaa

SEQ ID NO: 109458 - RNA, 63 nt, Homo Sapiens
gccgggcaggagcaggcaugugauacgaggcgaaugggugacgucucaagggccuagcuauca

SEQ ID NO: 109459 - RNA, 63 nt, Homo Sapiens
gcuuugaagagcacacagaaggacagaggcccaaugggugaaggguccccaggcuggaaagau

SEQ ID NO: 109460 - RNA, 63 nt, Homo Sapiens
cagcaaggcagugucagagcagcguuagggcugaugggugacuucugcuugucucguccagga

SEQ ID NO: 109461 - RNA, 64 nt, Homo Sapiens
ucucaaugcaggucauuacucuauguugaugauucauaucaaauguauauacauaucaacauaa

SEQ ID NO: 109462 - RNA, 64 nt, Homo Sapiens
uaacuauguugaugauucaucaacauaguauauacauaucaacaaugaguuugacaugaaucau

SEQ ID NO: 109463 - RNA, 64 nt, Homo Sapiens
acaauccaaaagggugcugcuggucauaagaacacauaucaacacauuuauuuauacuaaauaa

SEQ ID NO: 109464 - RNA, 64 nt, Homo Sapiens
acuaaucccccauucucuaaucaccauuauuaaucauaucaagucaauuaguuugguuucacac

SEQ ID NO: 109465 - RNA, 64 nt, Homo Sapiens
ugaaaaugucaccacuaucuuucagucacguuaccauaucaagcauauucaugcugucugaaga

SEQ ID NO: 109466 - RNA, 64 nt, Homo Sapiens
auccuuuuuauaaccucuugauaaguggcacuugcauaucaacaaaccauuuugcaucccagaa

SEQ ID NO: 109467 - RNA, 64 nt, Homo Sapiens
aaaagaauacacacuagagaaaaaccuuacaaaugugaagcaucugauaaauccugugaagcgu

SEQ ID NO: 109468 - RNA, 64 nt, Homo Sapiens
uugauguugcuggucuggugucuuauuuccuaaagugaagcaucuuuuuuuaaaaaagaauuug

SEQ ID NO: 109469 - RNA, 64 nt, Homo Sapiens
cgguugacccuacuguggauugguggguuucggggugaagcaaguucacuacagcaucaauaga

SEQ ID NO: 109470 - RNA, 64 nt, Homo Sapiens
acucuuuggcuuuguuuguuuguuuucuucuucagugaagcagccuuacuauucauagaagggc

SEQ ID NO: 109471 - RNA, 64 nt, Homo Sapiens
gaagugugggcaaccaaauguagguaaggaugaagaagaacaggaacucucacugguggcugau

SEQ ID NO: 109472 - RNA, 64 nt, Homo Sapiens
uaugacauucuggaaaaggcaaaacuauagggaugaagaacagaucaguuguugucagguuuga

SEQ ID NO: 109473 - RNA, 64 nt, Homo Sapiens
ggucauauuugaggcaagcuaggaaauuuuucuagaagaacaaagcuacugcuacugauuuugg

SEQ ID NO: 109474 - RNA, 64 nt, Homo Sapiens
cuauuucgcucccagaaaaauucuuguuauauaagaagaacaacuguuugcugggaauuccuga

SEQ ID NO: 109475 - RNA, 64 nt, Homo Sapiens
agaaucguacucauaaucagcucugcauacaucugaagaacaaaaacaucaacgucuuuugucc

SEQ ID NO: 109476 - RNA, 64 nt, Homo Sapiens
acgggcgcuuuaaccaucagcugccucucgaauggaagaacagugguaauggauuaacauccua

SEQ ID NO: 109477 - RNA, 64 nt, Homo Sapiens
guggcaugaucagacuucuauaaaaaguaauucagaagaacaguaccagaacaaaucacucauu

SEQ ID NO: 109478 - RNA, 64 nt, Homo Sapiens
cacaaauaaagugagaguaaauccccaugaaaaggaagaacaauuggcuuuggggaaaacucau

SEQ ID NO: 109479 - RNA, 64 nt, Homo Sapiens
gagcucagaugaugaugauguuaguaguuuggaagaagaacaagaauuccacaugagaaguaaa

SEQ ID NO: 109480 - RNA, 64 nt, Homo Sapiens
gaugucaauaggauggcaccuuggaaagaaaaaugaagaacaacuuuaucaaggaagcuaguau

SEQ ID NO: 109481 - RNA, 64 nt, Homo Sapiens
auaacucaguuuuuuuucucggauugacaaucaggaagaacagaaauggauaaaguaguguaau

SEQ ID NO: 109482 - RNA, 64 nt, Homo Sapiens
guugaguccccagaaccaaaugcaagaccagacugaagaacacgucucagcugggaagagagga

SEQ ID NO: 109483 - RNA, 64 nt, Homo Sapiens
ggucaggggaaggcaugggggggaccagaaaccagaagaacaaucaagacugcaaugaaaaaaa

SEQ ID NO: 109484 - RNA, 64 nt, Homo Sapiens
auacaucuauggugaccacuuuugacaaaggaaugaagaacauacacuggggaaaagauaaugu

SEQ ID NO: 109485 - RNA, 64 nt, Homo Sapiens
gagacccccgcccccgcaccuuccagacuuagcagaagaacaaacugaagaacagacccagcca

SEQ ID NO: 109486 - RNA, 64 nt, Homo Sapiens
cccgcaccuuccagacuuagcagaagaacaaacugaagaacagacccagccagagaagcaggga

SEQ ID NO: 109487 - RNA, 64 nt, Homo Sapiens
aauauuuaaguaaaaacaaaaugaugcauuuugagaagaacaaagugugcacucagcggcugga

SEQ ID NO: 109488 - RNA, 64 nt, Homo Sapiens
uacucauucaaagcacauuguagauauucagagagaagaacaaauggcuggcuuggcaaauccc

SEQ ID NO: 109489 - RNA, 62 nt, Homo Sapiens
cuuaauauuuuuauaaaguaaaaugaauaaugguagccuaaagccuucuagcacacuuuuuu

SEQ ID NO: 109490 - RNA, 55 nt, Homo Sapiens
uuauaugcacaaaucugccauucaaguagccuauuagccaggagaaaauuuauaa

SEQ ID NO: 109491 - RNA, 64 nt, Homo Sapiens
gauagaucgggggaaaauggggccuucgaccccagcgggcuaccugaaccaaggcgucucuuua

SEQ ID NO: 109492 - RNA, 64 nt, Homo Sapiens
gucaagagccugugguccagcaugccuggccugggcgggcuaccucugagaacggcugaaaugg

SEQ ID NO: 109493 - RNA, 64 nt, Homo Sapiens
uggcuguccccguuccagaacuugcauacacugagcgggcuacagagcuagaaggcccugcagc

SEQ ID NO: 109494 - RNA, 64 nt, Homo Sapiens
gacaaggaagaauaguggcaagcgcacugugucagcgggcuaugucuaagaacucaccuccguu

SEQ ID NO: 109495 - RNA, 64 nt, Homo Sapiens
aggaggggguaggugauggguccgaggagcuggggcgggcuaggccccgggaccgcgcuagggc

SEQ ID NO: 109496 - RNA, 64 nt, Homo Sapiens
aagugucgggaguccuuacgcaaccuugacaugugcgggcuacugggguccaucggcagcggga

SEQ ID NO: 109497 - RNA, 64 nt, Homo Sapiens
acuuuucucaucuguaaaaccaggcugaugccgugcgggcuaaugagccaauaaagcucacacu

SEQ ID NO: 109498 - RNA, 64 nt, Homo Sapiens
gggaggcugggcacagaggucuuaccggcaagcagcgggcuaacaaaccaccaggcauccggcc

SEQ ID NO: 109499 - RNA, 64 nt, Homo Sapiens
ccugcaggaaagccggggcgugggguccuaaagcgcgggcuaagccaggccaucugccugcuca

SEQ ID NO: 109500 - RNA, 64 nt, Homo Sapiens
cuggacaaaguaaagguggagaacugagagcacagcgggcuacccauaagaaagcaucuaaacu

SEQ ID NO: 109501 - RNA, 55 nt, Homo Sapiens
cacagcggaccauccaguagccaacgcgggcuaaaaccgaccggacaucuagcgg

SEQ ID NO: 109502 - RNA, 64 nt, Homo Sapiens
caggagcugaggggugagggcuggggaccaugccgcgggcuaggucgggcccgugcaggccggc

SEQ ID NO: 109503 - RNA, 64 nt, Homo Sapiens
agggcugcgggggccuuguagggauggagcaggagcgggcuaaguacuaucuugggagggagaa

SEQ ID NO: 109504 - RNA, 64 nt, Homo Sapiens
gugcugccuuuaauaaaauugaaucaaaaaaugagcgggcuauuuggaaguccaguuuauuucu

SEQ ID NO: 109505 - RNA, 64 nt, Homo Sapiens
caggcugccccucccugugggcucagggucuccugcgggcuaggcagccaggagcucuguccgc

SEQ ID NO: 109506 - RNA, 64 nt, Homo Sapiens
cucccccggggacccccaggcugaggguucugccgcgggcuaccggccucugagugccuccagc

SEQ ID NO: 109507 - RNA, 64 nt, Homo Sapiens
gggagguucucccagccugaggugccgcccucgcgcgggcuaggcgccccccgggaccuccgcg

SEQ ID NO: 109508 - RNA, 64 nt, Homo Sapiens
gacgaggagaacugagggcacguggggugcggcagcgggcuagggcccagggcagcuugcccgu

SEQ ID NO: 109509 - RNA, 64 nt, Homo Sapiens
gacuaggcgggggagaaaggaagccuuucugagagcgggcuaggccggcacuggagaggccgga

SEQ ID NO: 109510 - RNA, 64 nt, Homo Sapiens
guuuagcauggccuucuugaggcagaacagccuggcgggcuacaucccucacaccugugggcag

SEQ ID NO: 109511 - RNA, 64 nt, Homo Sapiens
augggaaugaggggcucugcaacugagcgaagcugcgggcuaggaggcuggaaagccauuuauc

SEQ ID NO: 109512 - RNA, 64 nt, Homo Sapiens
aggccaaaagaaggaugaggcuggagaagggagggcgggcuagaauuauucugagcuuuuuggc

SEQ ID NO: 109513 - RNA, 64 nt, Homo Sapiens
cccagggcauggcccagcggcacaccagggaccagcgggcuagucacuggagcacugauucgga

SEQ ID NO: 109514 - RNA, 64 nt, Homo Sapiens
caggugcgaccccagcaagacggaaaccagcccugcgggcuaagcccccugaacccacccccca

SEQ ID NO: 109515 - RNA, 64 nt, Homo Sapiens
cauguuuccagugugauuccagccacucugcacugcgggcuaaaccagaaccucucccuucugg

SEQ ID NO: 109516 - RNA, 61 nt, Homo Sapiens
ugaggacauaauguguaagagaggugagaagugcucccaagcagacacaacagcagcacag

SEQ ID NO: 109517 - RNA, 61 nt, Homo Sapiens
caaauccuacucccucagccucaggcaguggugcucccaucuuccuccccacaacugugcu

SEQ ID NO: 109518 - RNA, 61 nt, Homo Sapiens
gugcucaggcuggugccagccuuucagacccugcucccagggacuuggguggaugcgcuga

SEQ ID NO: 109519 - RNA, 61 nt, Homo Sapiens
auuggggacagggacagagggaacucacacaugcucccaggacugugguagaaggaagaca

SEQ ID NO: 109520 - RNA, 61 nt, Homo Sapiens
cuccucccagcagcagacacccagcagagccugcucccaccaaggccuggagacugggggc

SEQ ID NO: 109521 - RNA, 61 nt, Homo Sapiens
ggauuguacagugaugacuuaucuugaucuuugcucccaguuaugauauccaucacaucuu

SEQ ID NO: 109522 - RNA, 61 nt, Homo Sapiens
ccagggcccagcacaucucccaguggcaaggugcucccacugacuggcagguuuuuuaauc

SEQ ID NO: 109523 - RNA, 61 nt, Homo Sapiens
ccugcagguccuggugggucagcccagcaccugcucccagugggagcuucccgggauaaac

SEQ ID NO: 109524 - RNA, 61 nt, Homo Sapiens
cagucccacaccgcuggucccugcccuccccugcucccagguugaggugcgcucaccucag

SEQ ID NO: 109525 - RNA, 61 nt, Homo Sapiens
acggcccuccuucuuuuccuaacaugcaccuugcucccaauggugcuuggagggggaagag

SEQ ID NO: 109526 - RNA, 61 nt, Homo Sapiens
agggggcaagcuuugcuccuucaguucugcuugcucccaagccccugacccgcucggacuu

SEQ ID NO: 109527 - RNA, 61 nt, Homo Sapiens
gcccccuuuauugcugcaccaggguuggcauugcucccacugagcccuacuccacccuguc

SEQ ID NO: 109528 - RNA, 61 nt, Homo Sapiens
ucuccuuccaggucagcucauucacaagaguugcucccaagccuggaugaguugcaccuug

SEQ ID NO: 109529 - RNA, 61 nt, Homo Sapiens
aaggggguggcgugacaggcgcacugcucgcugcucccaggugcuccaacucgggccuggg

SEQ ID NO: 109530 - RNA, 61 nt, Homo Sapiens
agguccaagugcagcuccagcaaggugccugugcucccagcgugaggacacacacuaggcc

SEQ ID NO: 109531 - RNA, 61 nt, Homo Sapiens
uccguccugggaaagagcauccucuggcaggugcucccaccaggucagacccaguccugga

SEQ ID NO: 109532 - RNA, 61 nt, Homo Sapiens
ccugcacccacuggcugggaagaucucuuccugcucccacgccccugucuggauccccucc

SEQ ID NO: 109533 - RNA, 61 nt, Homo Sapiens
ugagguaggaggcggaggugauggaagacagugcucccagcaggagagaaguggaagcccc

SEQ ID NO: 109534 - RNA, 61 nt, Homo Sapiens
uucucccucccucccauuguuuuuauucacaugcucccaugugguucaguauuuaaugcca

SEQ ID NO: 109535 - RNA, 61 nt, Homo Sapiens
gcaggagaggggagaaccccauccucagagcugcucccagccagcgagucaggagcggggg

SEQ ID NO: 109536 - RNA, 61 nt, Homo Sapiens
gagacagggcuccagggaugaggccgcauucugcucccacagcgccuuuuccagaaaguuc

SEQ ID NO: 109537 - RNA, 61 nt, Homo Sapiens
ccauucacuacaggugaagguuauagacacuugcucccaacuucucucccuuccucucucc

SEQ ID NO: 109538 - RNA, 61 nt, Homo Sapiens
ccucccuccggccauacugcaacucuaccccugcucccauuggggggccaagguccugcuc

SEQ ID NO: 109539 - RNA, 61 nt, Homo Sapiens
aggcagcuccagcuguuaccaggaaaagaugugcucccaccucauuagugaauuacacuca

SEQ ID NO: 109540 - RNA, 61 nt, Homo Sapiens
ucaccucguuacucucaccucaggcuuugucugcucccaaucaaaguuuucuuuccaaaau

SEQ ID NO: 109541 - RNA, 61 nt, Homo Sapiens
cacggccuccacccgggacgccuuccuccucugcucccaaacaggguuuccguggccuguu

SEQ ID NO: 109542 - RNA, 61 nt, Homo Sapiens
gggugggcaggccaggacugcuuuuuuuuaaugcucccauuucacagaggauaccaccgag

SEQ ID NO: 109543 - RNA, 61 nt, Homo Sapiens
cccucccacaguauuuugugcaaugaagcccugcucccagccuuucagagacagggacaca

SEQ ID NO: 109544 - RNA, 61 nt, Homo Sapiens
ccuucucagggucuccccagcccaguccccuugcucccaucccacucggugcuguugggua

SEQ ID NO: 109545 - RNA, 64 nt, Homo Sapiens
gaacagugacugagguucuuccauucaguuugcuuaucccuacacauucugccaauuccaccac

SEQ ID NO: 109546 - RNA, 64 nt, Homo Sapiens
aggaaccuuguuucccaccguccgcccuuaacucuaucccuauuauccucauccugcuguugcc

SEQ ID NO: 109547 - RNA, 64 nt, Homo Sapiens
uuuuggguggugacuguuuuuuucugacuuugcauaucccuagacacuagaacuaaaggauugg

SEQ ID NO: 109548 - RNA, 64 nt, Homo Sapiens
ucuuaaggaauuuuuagacuuaaguucacugugauaucccuaguaccuagaagaguaccuagca

SEQ ID NO: 109549 - RNA, 64 nt, Homo Sapiens
ccaugugaauguuguauacgauuguaaggcuuaugucacuaaagauuuuuauucugauuuuuuc

SEQ ID NO: 109550 - RNA, 64 nt, Homo Sapiens
guuucuuaggagaaaaugauucuguaauuccagugucacuaauuuauauuguucuuuccucuga

SEQ ID NO: 109551 - RNA, 64 nt, Homo Sapiens
uauauaagguaugugcuauucucauaucaugguagucacuaacaagcacuuguccacgucuuuu

SEQ ID NO: 109552 - RNA, 64 nt, Homo Sapiens
gcuuucugguuugaaagauguuacuguugcuuuagucacuaauuuacuucagugcaccuacugc

SEQ ID NO: 109553 - RNA, 64 nt, Homo Sapiens; identical to SEQ ID NO: 74593

SEQ ID NO: 109554 - RNA, 64 nt, Homo Sapiens; identical to SEQ ID NO: 74594

SEQ ID NO: 109555 - RNA, 64 nt, Homo Sapiens; identical to SEQ ID NO: 74595

SEQ ID NO: 109556 - RNA, 64 nt, Homo Sapiens; identical to SEQ ID NO: 74596

SEQ ID NO: 109557 - RNA, 64 nt, Homo Sapiens; identical to SEQ ID NO: 74597

SEQ ID NO: 109558 - RNA, 64 nt, Homo Sapiens; identical to SEQ ID NO: 74598

SEQ ID NO: 109559 - RNA, 64 nt, Homo Sapiens; identical to SEQ ID NO: 74599

SEQ ID NO: 109560 - RNA, 64 nt, Homo Sapiens; identical to SEQ ID NO: 74600

SEQ ID NO: 109561 - RNA, 64 nt, Homo Sapiens; identical to SEQ ID NO: 74601

SEQ ID NO: 109562 - RNA, 64 nt, Homo Sapiens; identical to SEQ ID NO: 74602

SEQ ID NO: 109563 - RNA, 64 nt, Homo Sapiens; identical to SEQ ID NO: 74603

SEQ ID NO: 109564 - RNA, 64 nt, Homo Sapiens; identical to SEQ ID NO: 74604

SEQ ID NO: 109565 - RNA, 64 nt, Homo Sapiens; identical to SEQ ID NO: 74605

SEQ ID NO: 109566 - RNA, 64 nt, Homo Sapiens; identical to SEQ ID NO: 74606

SEQ ID NO: 109567 - RNA, 61 nt, Homo Sapiens
ucacgggcuaugcccggggagcugucgggaguggcgggaaucggggccaugcccggggagc

SEQ ID NO: 109568 - RNA, 61 nt, Homo Sapiens
aucggggccaugcccggggagcugucgggaguggcgggaaucggggccaugcccggggagc

SEQ ID NO: 109569 - RNA, 61 nt, Homo Sapiens
aucggggccaugcccggggagcugucgggaguggcgggaaauggggggcaucaccaugccu

SEQ ID NO: 109570 - RNA, 61 nt, Homo Sapiens
gauggcagcagguauuggguccucagccuucuggcgggagcccugaggcugcggacaaagc

SEQ ID NO: 109571 - RNA, 61 nt, Homo Sapiens
agguggaguucuuccaugcaggagcacggcauggcgggagcggggcugcagaguauccgag

SEQ ID NO: 109572 - RNA, 64 nt, Homo Sapiens
acaucagcuuugcccuugacuguuuuacucauuugaggaacagcauuccagcacuacagaagug

SEQ ID NO: 109573 - RNA, 64 nt, Homo Sapiens
accuuggcuuggcucuugaccuguuuacucauuggaggaacaguaggccagcccuacagaagug

SEQ ID NO: 109574 - RNA, 64 nt, Homo Sapiens
ucucacuauccaccucaacacacauccaucucaagaggaacauuuauaccaggcagucagagcu

SEQ ID NO: 109575 - RNA, 64 nt, Homo Sapiens
uucagguccugcccugcuguucuuugcuggagaugaggaacaggugcuggggcuaaaguuuggg

SEQ ID NO: 109576 - RNA, 64 nt, Homo Sapiens
uggagauuuuuaugcagaaaagaaaaaacccaaugaggaacaaugaguugauguguguuuuaaa

SEQ ID NO: 109577 - RNA, 64 nt, Homo Sapiens
gcucugggggaauggugucaguuuuguugccaacgaggaacacauccuaggguuuuuugguuuu

SEQ ID NO: 109578 - RNA, 64 nt, Homo Sapiens
gggcuccccacucccugcccaccaauacccaggugaggaacagacccucuggccucucacccca

SEQ ID NO: 109579 - RNA, 64 nt, Homo Sapiens
gacuuacgccuuuggaauugcucuucauucagaagaggaacacaaaggaagccacccaggaagg

SEQ ID NO: 109580 - RNA, 64 nt, Homo Sapiens
gaaacaccuaaccuugcaaguuuuaccgccuuuugaggaacacaaaucggagaacaaacccagg

SEQ ID NO: 109581 - RNA, 64 nt, Homo Sapiens
uuguccccgucuuucccaucgccuagcguuuggggaggaacagggagagagcuucggggcgucu

SEQ ID NO: 109582 - RNA, 64 nt, Homo Sapiens
gaaauguccccgcaguggaugcagcucacaugcugaggaacacccagcucuggacagaguucuu

SEQ ID NO: 109583 - RNA, 64 nt, Homo Sapiens
ccaagcucaucuucauugaaugucucauuuggccgaggaacaacugaacuuugugguuugcugu

SEQ ID NO: 109584 - RNA, 64 nt, Homo Sapiens
gguuuguguauuaguccauuuuugaucaggacuggaggaacaaagcaacucaugguuaaagacc

SEQ ID NO: 109585 - RNA, 64 nt, Homo Sapiens
gaaaauggagggccaccacuucuuuggguaaauugaggaacaugaaaaauggaggaggauaggu

SEQ ID NO: 109586 - RNA, 64 nt, Homo Sapiens
cuaggcagaccccagccagacccccgccagacagacucccaaccagacugaccccuuacuauuc

SEQ ID NO: 109587 - RNA, 64 nt, Homo Sapiens
ugaguuuuugccauguugcccagacuggucuugaacucccaaccucaagcaauccuccugccuc

SEQ ID NO: 109588 - RNA, 64 nt, Homo Sapiens
uuugcaagcucccugccccagccagcgcuucucaacucccaagggagcccccacaccuggccga

SEQ ID NO: 109589 - RNA, 64 nt, Homo Sapiens
uaacggccugaguccacgcagagagagcgaacccacucccaagacagagugacaggagugaggg

SEQ ID NO: 109590 - RNA, 64 nt, Homo Sapiens
agaacuuuuuaccagauuuucaaagacaucugugacucccaaaaguuaacaaucacugaugugg

SEQ ID NO: 109591 - RNA, 64 nt, Homo Sapiens
guuauagcugcuuucagauuguuccauuaucuguacucccaacaacccugccggauauauuugu

SEQ ID NO: 109592 - RNA, 64 nt, Homo Sapiens
agaauucagcugcccccgcucaugggccccucugacucccaaagagcugccuaagaggcaauga

SEQ ID NO: 109593 - RNA, 64 nt, Homo Sapiens
agaggcaaugaguguguuggcuugugaucugggaacucccaagaacagcaggcccaccuaccuu

SEQ ID NO: 109594 - RNA, 64 nt, Homo Sapiens
gugccagagauggcugugccgugucggagaugaaacucccaaagcagagguacagcugcugaaa

SEQ ID NO: 109595 - RNA, 64 nt, Homo Sapiens
gugccagagauggcugugccgugucagagaugaaacucccaaagcagagguagagcugcccaaa

SEQ ID NO: 109596 - RNA, 64 nt, Homo Sapiens
gugccagagauggcugugccgugucagagaugaaacucccaaagcagagguggagcuccccaag

SEQ ID NO: 109597 - RNA, 64 nt, Homo Sapiens
cccgagcugggaccaguaccgguaccaaugcagaacucccaagauagugcagcagggcaguagc

SEQ ID NO: 109598 - RNA, 64 nt, Homo Sapiens
acguugggacagggaggugucccccaccucccccacucccaaccgucuacagcucccccagcuc

SEQ ID NO: 109599 - RNA, 59 nt, Homo Sapiens
ggcuggagccaggggccacuucugaacugcaccagcaccaggcccacccucgucucugc

SEQ ID NO: 109600 - RNA, 59 nt, Homo Sapiens
ccauagccagcacagcuaucccgcggggacaccagcacugagcccccucucccuccugc

SEQ ID NO: 109601 - RNA, 59 nt, Homo Sapiens
caagguugagccagaaccagccuggaucucaccagcagcucagccccucuuucccaggc

SEQ ID NO: 109602 - RNA, 59 nt, Homo Sapiens
cccccgcacgcugggcaccaccacagggccaccagcacagcauggguugcccuacaggc

SEQ ID NO: 109603 - RNA, 59 nt, Homo Sapiens
gaaucaggaccagcaugugcagagcuggccaccagcacaggcuuagggcaguucagaac

SEQ ID NO: 109604 - RNA, 59 nt, Homo Sapiens
ugaguacucauaauuggccagcaucucaccaccagcaaguaguagggccaggucaaucc

SEQ ID NO: 109605 - RNA, 59 nt, Homo Sapiens
caugcggccucacugggggccaucagccucaccagcaaagcagagaugagagcguggga

SEQ ID NO: 109606 - RNA, 59 nt, Homo Sapiens
gaggggccuaugccuuuacuccuuuuaaacaccagcacccgucuuuuccccaaccuaaa

SEQ ID NO: 109607 - RNA, 59 nt, Homo Sapiens
acccgucuuuuccccaaccuaaaaccaaccaccagcauuucacuacaggaccaaaugga

SEQ ID NO: 109608 - RNA, 59 nt, Homo Sapiens
ucaucuuuaagcuaaguuaccucugaggccaccagcagaacucucuggcuaaaaacaaa

SEQ ID NO: 109609 - RNA, 59 nt, Homo Sapiens
accaaagugacucugagauaugucacacccaccagcaucgcuggguucugauugcuaga

SEQ ID NO: 109610 - RNA, 59 nt, Homo Sapiens
uuccugggcucgccuggagagugaagagucaccagcagacaguucucaaacuuuagcau

SEQ ID NO: 109611 - RNA, 59 nt, Homo Sapiens
auggccagcagagcggugagcagcacucccaccagcagcccggucagacugaaguguuc

SEQ ID NO: 109612 - RNA, 59 nt, Homo Sapiens
uucagccaaugcccagagugaccaagcagcaccagcaggccugcccaggaugcugaaag

SEQ ID NO: 109613 - RNA, 59 nt, Homo Sapiens
ucuugggaaggacuugcuggcuggagagucaccagcagcgaaaaccugccauuguggcc

SEQ ID NO: 109614 - RNA, 59 nt, Homo Sapiens
cugcggucccagcgggugcggagccuguccaccagcaggcuguuugucuccucgacagg

SEQ ID NO: 109615 - RNA, 59 nt, Homo Sapiens
ccccucugcccagcucaccacaucuucaucaccagcaaacgccaggacuuggcuccccc

SEQ ID NO: 109616 - RNA, 59 nt, Homo Sapiens
cccgagcugcccccacccccggccucagccaccagcacccccauagggcccccagacac

SEQ ID NO: 109617 - RNA, 59 nt, Homo Sapiens
cccuuggaaggggucucgguggagcugugcaccagcagccaagcagaaagaaacacgcg

SEQ ID NO: 109618 - RNA, 59 nt, Homo Sapiens
uucuuugagccagacgccaacuugacccucaccagcauuaucaggagcgcgcucagcaa

SEQ ID NO: 109619 - RNA, 59 nt, Homo Sapiens
ccucccgggagauccgugcgcccgaccagcaccagcaucgcggaccgcaaaggccgccc

SEQ ID NO: 109620 - RNA, 59 nt, Homo Sapiens
agacaacuaacccuuuccccaacagagcccaccagcagugguggagaugucgguccaug

SEQ ID NO: 109621 - RNA, 59 nt, Homo Sapiens
uuuuuuaaaaaaagaaguggagguguuuacaccagcaaaauacucauuuuuuaagugua

SEQ ID NO: 109622 - RNA, 59 nt, Homo Sapiens
ugauguugccuccucuccugcccagggcccaccagcagcccccccaaaacuugggcugg

SEQ ID NO: 109623 - RNA, 59 nt, Homo Sapiens
auccgagggcgccccggacagggagccagcaccagcaggcccguggggggacagccgau

SEQ ID NO: 109624 - RNA, 64 nt, Homo Sapiens
agggucuuuucccaagccaguuaguggcauaaaaaaguagcaucauauuuaaucaguaaguuaa

SEQ ID NO: 109625 - RNA, 64 nt, Homo Sapiens
uuaagaaauaggaaagucauaaugcaauuuacucaaguagcaauaucagugaauaauaaacaua

SEQ ID NO: 109626 - RNA, 64 nt, Homo Sapiens
aauauuuucuauuaacaugggaggaagauaaggaaaguagcauaaaagccagcauucacaaaau

SEQ ID NO: 109627 - RNA, 64 nt, Homo Sapiens
gucauggauuguauugacuuugacaacuuacuuaaaguagcaaaacuagacagauuuaaguaau

SEQ ID NO: 109628 - RNA, 64 nt, Homo Sapiens
aaugggaaucuucuugguauuuuauguguauuguaaguagcaguuaaauuauuuuuuuaaaagc

SEQ ID NO: 109629 - RNA, 64 nt, Homo Sapiens
uagcauuccuuuucaugaugugcuuuugugcaguaaguagcauuuucggcuacuuaacuuuaca

SEQ ID NO: 109630 - RNA, 64 nt, Homo Sapiens
aauuacaagauauauuuaaaaaguaaccagauaaaaguagcacaugugcuuuuguuaaaaauaa

SEQ ID NO: 109631 - RNA, 64 nt, Homo Sapiens
uaaauaggaaaccaugaaugggaaggauggcaauaaguagcaacuauacuuuccaaugacuaaa

SEQ ID NO: 109632 - RNA, 64 nt, Homo Sapiens
auaugucaacauaugucacuaacagcaaaagcaaaaguagcaacuaauugacuuggaaaaaaaa

SEQ ID NO: 109633 - RNA, 64 nt, Homo Sapiens
aacuucuguguucaccuguauuauugcuuccagcaaguagcaugaguuccacaaaauuugaucc

SEQ ID NO: 109634 - RNA, 64 nt, Homo Sapiens
cauaucaaauauuuuggguacuaggcaguuuccaaaguagcaugguaguauuacuuguuaaaag

SEQ ID NO: 109635 - RNA, 64 nt, Homo Sapiens
acuucugcuauucauauggucugauuagugacauaaguagcagccguuuuucaacuucaguuuc

SEQ ID NO: 109636 - RNA, 64 nt, Homo Sapiens
agaggugaccaggcccggacagaaauggccugggaaguagcagaagcagugcagcaggaacugg

SEQ ID NO: 109637 - RNA, 64 nt, Homo Sapiens
agcaggaacuggaagugccuucauccaggacaggaaguagcacuucugaaacaggaaguggucu

SEQ ID NO: 109638 - RNA, 63 nt, Homo Sapiens
acacuguccauccccaagugacauguggcuucagaaguagagucugaaagagcagugggaugg

SEQ ID NO: 109639 - RNA, 63 nt, Homo Sapiens
aaaacaaauguguggcuaaggaguuaccugggggaaguagaaugagaggucuguugggaauaa

SEQ ID NO: 109640 - RNA, 63 nt, Homo Sapiens
cuguucgugucuuucugcaguuuucggcaauaagaaguagaagauuugcuguccugcugucca

SEQ ID NO: 109641 - RNA, 63 nt, Homo Sapiens
acugucuuuggcagugaguaaauagcauauuuugaaguagaguuguauacuuuuucauaagau

SEQ ID NO: 109642 - RNA, 63 nt, Homo Sapiens
accaaauuggucuuaaaaaugauguuaacccaagaaguagacaucaaaaauuaaaaaaaaaaa

SEQ ID NO: 109643 - RNA, 63 nt, Homo Sapiens
gagccaaauuaggaaacagacaguaacgucaaggaaguagauacuggcuggcauugucagugu

SEQ ID NO: 109644 - RNA, 63 nt, Homo Sapiens
uguuuuucuuuagggcucuuccuacaaccuugagaaguagauaggcaucagaguaugguacua

SEQ ID NO: 109645 - RNA, 63 nt, Homo Sapiens
gcauucucuuugaauucucacagaauucagcaagaaguagaaaccuguuauuuacuacauugu

SEQ ID NO: 109646 - RNA, 63 nt, Homo Sapiens
gguaguuaagaaagguguagauauaaugagguagaaguagaaaggaagaaaaacucaaagaau

SEQ ID NO: 109647 - RNA, 63 nt, Homo Sapiens
uugcuaugccaagccuuguuucucugcucagaagaaguagagaagcuauuaucaauuaaaagc

SEQ ID NO: 109648 - RNA, 63 nt, Homo Sapiens
uaaaugagaugcguaguuuguuuucuuucaugggaaguagagauaaaaauauauacauuucuc

SEQ ID NO: 109649 - RNA, 63 nt, Homo Sapiens
uggggcuuauaugagacaugaagcauuggcucagaaguagagggagaagaggaacccaguucc

SEQ ID NO: 109650 - RNA, 63 nt, Homo Sapiens
uuuuuuuaccaccaucuuuuucuacucuguauggaaguagaucuuuauggggaaaagagaauu

SEQ ID NO: 109651 - RNA, 63 nt, Homo Sapiens
cuauugcccucagaaugagaaggcuaccuuuaugaaguagacaaagaagggauccucuuucaa

SEQ ID NO: 109652 - RNA, 63 nt, Homo Sapiens
aguccuugugucagaacacacauguuucuuaaggaaguagaguuugagcaaagcauuuuugcu

SEQ ID NO: 109653 - RNA, 63 nt, Homo Sapiens
aaauugaguauuuucugacaguuuuaaauaagugaaguagaaguaccuuucaguccugucugg

SEQ ID NO: 109654 - RNA, 63 nt, Homo Sapiens
auaagacugucauguaagagcugaccuuccccugaaguagaucuaaaaccugggaaggauuuu

SEQ ID NO: 109655 - RNA, 63 nt, Homo Sapiens
ucuaggaaugaaguggggcaaacaggugccauagaaguagauuugagaugaauuaagacaaag

SEQ ID NO: 109656 - RNA, 63 nt, Homo Sapiens
uuauaacagguuagcuaaaauacuuugaucagagaaguagaaucagagacccuguauuuaauc

SEQ ID NO: 109657 - RNA, 63 nt, Homo Sapiens
guggaagugaguagucucccacagguagacgaggaaguagacagguccauuagauuccgaaaa

SEQ ID NO: 109658 - RNA, 63 nt, Homo Sapiens
uaacuuauuuuccagcgaaacucuugauauacggaaguagacgugacguuuccaugcuguggu

SEQ ID NO: 109659 - RNA, 63 nt, Homo Sapiens
guaaggaguuuaggaaaauauuauauccacauggaaguagaagauuuaauauuuggguacuga

SEQ ID NO: 109660 - RNA, 63 nt, Homo Sapiens
ugacuggguuaagccaucuuucuuaagauuccugaaguagaaauagcaauuaagaaauuaauu

SEQ ID NO: 109661 - RNA, 63 nt, Homo Sapiens
uguucuucuguguucucucauuauggacuuugugaaguagaaacauaauuuuuuuuccuccaa

SEQ ID NO: 109662 - RNA, 63 nt, Homo Sapiens
auuuuuacuauuaaaauauucaguuuuuuaaaugaaguagaacuugaguucauguuuuauaug

SEQ ID NO: 109663 - RNA, 63 nt, Homo Sapiens
gaugagguaaagacucagcuaaggguuuuacaggaaguagauuaauugauccugucaccaacc

SEQ ID NO: 109664 - RNA, 63 nt, Homo Sapiens
caaauagaguuuuuauauuuguuaugauaaaaggaaguagaugugaaaaagccuaagaaaaag

SEQ ID NO: 109665 - RNA, 63 nt, Homo Sapiens
ugugccuuugucuccuugugucuccuuucccccgaaguagaugaaacagucucacauacccaa

SEQ ID NO: 109666 - RNA, 63 nt, Homo Sapiens
uagaauugcucuguaauucuaaauuuaaaauuagaaguagagagagauaagccaucgccccuu

SEQ ID NO: 109667 - RNA, 63 nt, Homo Sapiens
cuugaaacuaggagguaacaagaaagcuucuaggaaguagauguuccauaucuucaaaaugcc

SEQ ID NO: 109668 - RNA, 63 nt, Homo Sapiens
uuuugugguugcuggcuggguacuguauuuaaugaaguagagaauagcacuugcaaaaauaca

SEQ ID NO: 109669 - RNA, 63 nt, Homo Sapiens
agaaaucggaugguugccgugucuguguagaaagaaguagacaugggagacuuuucauuuugu

SEQ ID NO: 109670 - RNA, 63 nt, Homo Sapiens
ucuugcacugugauguuuuuacgugaauauguugaaguagaagucuaccauauuauuuuauaa

SEQ ID NO: 109671 - RNA, 63 nt, Homo Sapiens
guuuuaacccugcuuaauaauguugguguuuuagaaguagauacaggcacugcucugaaaacc

SEQ ID NO: 109672 - RNA, 63 nt, Homo Sapiens
ucagugucaaugcagcccccauuguggucacaggaaguagaggaggccacguucuuacuaguu

SEQ ID NO: 109673 - RNA, 63 nt, Homo Sapiens
uuuuuuuaaaaaaaauugucuuugaauguauuggaaguagacaugcauuaacugugacauuau

SEQ ID NO: 109674 - RNA, 63 nt, Homo Sapiens
uaauuuauuacugcccagcauuccuuccaacgggaaguagaugggcgacugcuuuguucacac

SEQ ID NO: 109675 - RNA, 63 nt, Homo Sapiens
auaccaaaugcauaaacuuuccaaauuaaaaaugaaguagaguuauuuuuaacaugugcuuuu

SEQ ID NO: 109676 - RNA, 63 nt, Homo Sapiens
aauguguuuccucucauugucaugacuuaucccgaaguagagccucugaaauugagucucggu

SEQ ID NO: 109677 - RNA, 63 nt, Homo Sapiens
ccuuuuauacuuugguuccuugcccaugggguagaaguagaaugaagcugaaaaauuguagag

SEQ ID NO: 109678 - RNA, 63 nt, Homo Sapiens
agaaagacuguaugugacaaagagaaugaagcagaaguagagacacauacuaaagugacacaa

SEQ ID NO: 109679 - RNA, 63 nt, Homo Sapiens
uguuuuuucucaauguugcuuaagaaauggaaagaaguagaucauucagcaguugacacaggc

SEQ ID NO: 109680 - RNA, 63 nt, Homo Sapiens
guaacucuuugcacauaaauagacuauuuauaugaaguagaaguccauggaauuucuaguaug

SEQ ID NO: 109681 - RNA, 63 nt, Homo Sapiens
aagcuccuugagaaaccuagcaguggccauagagaaguagacuggguauggggaaccuaaguc

SEQ ID NO: 109682 - RNA, 63 nt, Homo Sapiens
aucuugugccuaaaaguuuuuuugcuuaauuaugaaguagacaugcauguuuacauuuaugua

SEQ ID NO: 109683 - RNA, 63 nt, Homo Sapiens
aauauuuucuuauagauauugugcaauaaagcugaaguagaaugugugguuuuugcaaaugcu

SEQ ID NO: 109684 - RNA, 63 nt, Homo Sapiens
gauauggacaucuugggauaucucuuuaccacugaaguagaauugauuguucagcuggagccc

SEQ ID NO: 109685 - RNA, 63 nt, Homo Sapiens
caaggacugcgucaaaguccucaucacauucucgaaguagaucaaaguccagaucuaguucca

SEQ ID NO: 109686 - RNA, 63 nt, Homo Sapiens
ccuacgauagcuacuauagcaggagucggagucgaaguagaagccagagaagugacaguuacc

SEQ ID NO: 109687 - RNA, 63 nt, Homo Sapiens
aagaaucauacucuacuucuaagaaaauaauuagaaguagacaaagauuaaugaaagggaugu

SEQ ID NO: 109688 - RNA, 63 nt, Homo Sapiens
uguuuugccugccaauugaaugauuucguagcugaaguagaaacauuuagguuucuguagcau

SEQ ID NO: 109689 - RNA, 63 nt, Homo Sapiens
ccaaaccuguaccauuuccguauuucugcuguagaaguagaaauaaauuuucuuaaauaauga

SEQ ID NO: 109690 - RNA, 63 nt, Homo Sapiens
uaguuguggguggaguguguucucagaagguaugaaguagauguuuuccuagguguuggaaaa

SEQ ID NO: 109691 - RNA, 63 nt, Homo Sapiens
agaaaacucaugcucuguuucucugaaucaaaugaaguagaaguuuacaaagcuaacuuucuu

SEQ ID NO: 109692 - RNA, 63 nt, Homo Sapiens
aaaccaagaaaauagugaguuaaaaaaauaauagaaguagaaaugcccacauccacacuuagc

SEQ ID NO: 109693 - RNA, 63 nt, Homo Sapiens
aaacagaaagcuauauguagcagcuggucuugagaaguagaagcaucuuaacugucauaagag

SEQ ID NO: 109694 - RNA, 63 nt, Homo Sapiens
agaaucgccacaggacuguuugcuggaaugcaggaaguagaacugggagcccagugucaaguc

SEQ ID NO: 109695 - RNA, 63 nt, Homo Sapiens
uuaagagaggggccaaguguaggacccccaccugaaguagaacguggcagaaggaaccugagc

SEQ ID NO: 109696 - RNA, 63 nt, Homo Sapiens
gcucugggugcccauuucuucccuuguuccccagaaguagagggccccuccacgcccacucuu

SEQ ID NO: 109697 - RNA, 63 nt, Homo Sapiens
cuagaaaauugucucguuuaucuaaauaucugugaaguagaccaucagauuuuauucaagcuu

SEQ ID NO: 109698 - RNA, 63 nt, Homo Sapiens
gguugaaauauucuuaguaucuggaccauuguggaaguagacuuagaauuuuucacauggcca

SEQ ID NO: 109699 - RNA, 63 nt, Homo Sapiens
aauucuguuaacuggaaaauaauaauuaucuuugaaguagaacugguuauuuugauauaugau

SEQ ID NO: 109700 - RNA, 63 nt, Homo Sapiens
uuguccaauaacaggucaaccaaagugcugcuggaaguagaauauauacauauauaugucagg

SEQ ID NO: 109701 - RNA, 63 nt, Homo Sapiens
accaaguauaauaguuacauugggggcgugggggaaguagaauucuauagcaucaaaaacuuc

SEQ ID NO: 109702 - RNA, 63 nt, Homo Sapiens
ccuggugguuuaacagccgagcuggauucuacugaaguagaggugggaaaagucacauucuag

SEQ ID NO: 109703 - RNA, 63 nt, Homo Sapiens
ucuugccauuuuuucccuuggaauuuuauuugagaaguagagcuacaccuggcccucuucauc

SEQ ID NO: 109704 - RNA, 63 nt, Homo Sapiens
caugguuuuggccuuuuguguauauuaguaccagaaguagauacuauaaaucuuguuauuuuu

SEQ ID NO: 109705 - RNA, 63 nt, Homo Sapiens
uauacaacccuggcauuauguccacuguguauagaaguagauuaagagccauauaaguuugaa

SEQ ID NO: 109706 - RNA, 63 nt, Homo Sapiens
uuuuuaaaagccaauucuuuuuuaucccuuuuagaaguagaauuugcacacuuacuacaauug

SEQ ID NO: 109707 - RNA, 63 nt, Homo Sapiens
cuuuaaauaucauucuuuguaucuuaaaucugugaaguagaacaauuuggucuuagcuuuaca

SEQ ID NO: 109708 - RNA, 63 nt, Homo Sapiens
ggcuaagugcuggugucagggaaauuccauaaugaaguagaaugcugcuccugcauuaagauu

SEQ ID NO: 109709 - RNA, 63 nt, Homo Sapiens
cagaauggugaaagaguccaacaauggcugagggaaguagagguuaagauauagcucaacagu

SEQ ID NO: 109710 - RNA, 63 nt, Homo Sapiens
ugucuaggcacuaagggaguagggcagucgccagaaguagaccacauaaaagucaauucuaau

SEQ ID NO: 109711 - RNA, 63 nt, Homo Sapiens
uuugguaccacuucacuacguggugcuuuuuaggaaguagaucuuuauuacugcauuuuuauu

SEQ ID NO: 109712 - RNA, 63 nt, Homo Sapiens
aaauguucugucuuuuugaauuuuauauuuacggaaguagaaagguggugauuuuucaauuuc

SEQ ID NO: 109713 - RNA, 63 nt, Homo Sapiens
ggguuuaaguuugcuuguauuacccccagcucagaaguagaaaccaauccaagugugugcccc

SEQ ID NO: 109714 - RNA, 63 nt, Homo Sapiens
gaguagugagguuucauugcaaaauggacuccugaaguagacaucaauuucaggagguuucac

SEQ ID NO: 109715 - RNA, 63 nt, Homo Sapiens
augaauuaagcaacuggucuacucaauauuggagaaguagauagugccccuaaagacacauuu

SEQ ID NO: 109716 - RNA, 63 nt, Homo Sapiens
aaaacuagagagcugguuuagagaaggccagcagaaguagauuguuuuguuuuaagaggaaau

SEQ ID NO: 109717 - RNA, 63 nt, Homo Sapiens
caaacuuauuuaaaaccaucuuuaguaaguucagaaguagaaaaauacuuaguuuagcuuuag

SEQ ID NO: 109718 - RNA, 63 nt, Homo Sapiens
uuucuuuuuauaacucauggcaggcaucuguaagaaguagagaacccagaugaucucuuagga

SEQ ID NO: 109719 - RNA, 63 nt, Homo Sapiens
uugguugaugccaaaaaaaaauacaugcuaagagaaguagaaaucauagcugguucacacuga

SEQ ID NO: 109720 - RNA, 63 nt, Homo Sapiens
cacugaugccuuaaaaauuaacaaggucauucagaaguagauuacauugccuaaaguagaaug

SEQ ID NO: 109721 - RNA, 63 nt, Homo Sapiens
ggggcgguggucaggcuaaggccaaguguuuaagaaguagaguguagcugccagcguagaaac

SEQ ID NO: 109722 - RNA, 63 nt, Homo Sapiens
aguauaguaaccacaagugauuggcuuauaaaugaaguagaaaugcuuuuuaauauuccaaaa

SEQ ID NO: 109723 - RNA, 63 nt, Homo Sapiens
aagcaagcuguguguugcuuagucacuuacuuagaaguagauggugggggacagcggcguggg

SEQ ID NO: 109724 - RNA, 63 nt, Homo Sapiens
uauuaccugguucugcuaucuaggguaacuuuugaaguagauaauucuaaugccagguugcug

SEQ ID NO: 109725 - RNA, 63 nt, Homo Sapiens
gaaaauaaaagaaaaaccaguugagaaaugaaugaaguagagaccagggaguuucagaugccu

SEQ ID NO: 109726 - RNA, 63 nt, Homo Sapiens
guuugcuuucuucuucuugguaccuuauccuuagaaguagaauuacuaaagauuguaaugagu

SEQ ID NO: 109727 - RNA, 63 nt, Homo Sapiens
uucauguaugcugaagacugcuugccagggugggaaguagaauuuuacucaaaucuucaauuu

SEQ ID NO: 109728 - RNA, 63 nt, Homo Sapiens
uggucccucagcuggggggcgcaacuccagguggaaguagagcggcccccagccugagacugu

SEQ ID NO: 109729 - RNA, 63 nt, Homo Sapiens
agucauaggauuugaaagcuccacacaccuugagaaguagaagugacucaagccaguggaaga

SEQ ID NO: 109730 - RNA, 63 nt, Homo Sapiens
ugccaauggggagggaugagaauaggaggcauggaaguagaugacucaaagaucccaacaaug

SEQ ID NO: 109731 - RNA, 63 nt, Homo Sapiens
cuuuucaucaucacagaaagauugaauaggucagaaguagaaugcaugauuagugguuacccu

SEQ ID NO: 109732 - RNA, 63 nt, Homo Sapiens
cagcuuugaggaacaugcauaagaaauguagcugaaguagaggggacgugagagaagggccag

SEQ ID NO: 109733 - RNA, 63 nt, Homo Sapiens
cccucaggggauauuucacugaagaaccaguuagaaguagaaacagcuguggggcuugggccc

SEQ ID NO: 109734 - RNA, 63 nt, Homo Sapiens
ggaguaccaggagggagccagcauuucagaucugaaguagacgauaggaauguggaagaacac

SEQ ID NO: 109735 - RNA, 63 nt, Homo Sapiens
ugaaauuuugucauguuucaaauaaagagaacugaaguagaaaauagaaaugccaguaaacaa

SEQ ID NO: 109736 - RNA, 63 nt, Homo Sapiens
uucagugggaagaaaugcauaaaaugccuauaagaaguagaaagucauugaacugacaguguu

SEQ ID NO: 109737 - RNA, 63 nt, Homo Sapiens
uagaaggaaauacgugauuuuuaagguaaggaggaaguagagacaacauccuuauucucaucu

SEQ ID NO: 109738 - RNA, 63 nt, Homo Sapiens
agcucugcugauuugaaauuuauagucaacauggaaguagacccucacacuuauauuguggca

SEQ ID NO: 109739 - RNA, 63 nt, Homo Sapiens
gggaaggaggguuagauagauaggauaguauaggaaguagaaggggguacugcuggccagggg

SEQ ID NO: 109740 - RNA, 63 nt, Homo Sapiens
augcagugacauacaaagaccaauccuugugaugaaguagauccugauacuaugaggcugaaa

SEQ ID NO: 109741 - RNA, 63 nt, Homo Sapiens
gaauugcagaggaaaguuuuugcauugauaugugaaguagaauuuuguuauuuucuuaccaag

SEQ ID NO: 109742 - RNA, 63 nt, Homo Sapiens
agcucucaaaguguugagugguugaaauaaucggaaguagacagggguggcaccacccggcua

SEQ ID NO: 109743 - RNA, 63 nt, Homo Sapiens
aauguuaaauauuuuaugagguaaauaagaaaugaaguagagaaagagaugagccucuguacu

SEQ ID NO: 109744 - RNA, 63 nt, Homo Sapiens
gugaggauaauaacaaaguuauacaguuuguuugaaguagacacuacaagaauuguaaacugc

SEQ ID NO: 109745 - RNA, 63 nt, Homo Sapiens
uccugucuuuuugagaagaguuuaacacuagacgaaguagacuaaagggcugagaucaauaaa

SEQ ID NO: 109746 - RNA, 63 nt, Homo Sapiens
ugguagguaaauaauguguauauaacuuuaaaagaaguagaauuuuuuuguagauguauaauu

SEQ ID NO: 109747 - RNA, 63 nt, Homo Sapiens
uguuagguaaguuauuuauauauaacuuuaaaagaaguagaagauuuuuuggagauuuauaau

SEQ ID NO: 109748 - RNA, 63 nt, Homo Sapiens
agugggcuuugccuucugacgaggggugaccaugaaguagagcccacugaucuuccuggacag

SEQ ID NO: 109749 - RNA, 63 nt, Homo Sapiens
cgaaacaagauuaguccugaggguggugaaagggaaguagaacauuuuguguuuggggugugg

SEQ ID NO: 109750 - RNA, 63 nt, Homo Sapiens
uggcuucucugcuucucauaaaucagugcuggggaaguagauuuaauauagaggagaugacca

SEQ ID NO: 109751 - RNA, 63 nt, Homo Sapiens
auuuugagaauggaagcaggucugaggucagaagaaguagagaaugaaggaaaaggugaaugc

SEQ ID NO: 109752 - RNA, 63 nt, Homo Sapiens
ggcaucacugauagaauuucugaaagagaaagagaaguagauggucaaccagucacuaguugg

SEQ ID NO: 109753 - RNA, 63 nt, Homo Sapiens
caaaugagaauguguuauaugccaaggaacaaugaaguagaauauaauguauacuaagggauu

SEQ ID NO: 109754 - RNA, 63 nt, Homo Sapiens
ccuuauagaaacaggaccagugaaaccauggcagaaguagaauuuguuugccuacugaagaga

SEQ ID NO: 109755 - RNA, 63 nt, Homo Sapiens
uaaucagaaaaaucagaaaugaccugacuaugagaaguagaaaaagggaaugauuguggcuug

SEQ ID NO: 109756 - RNA, 63 nt, Homo Sapiens
ugacagggcauauuaguugaaugggauacuuuagaaguagaaugguaugacauuggauagaac

SEQ ID NO: 109757 - RNA, 63 nt, Homo Sapiens
gagucccaucaggagggaaggaaaaggaaccaagaaguagaagcguaagagcuacaaaggagg

SEQ ID NO: 109758 - RNA, 63 nt, Homo Sapiens
gaaauacgaagauuaugauaaagcuucuuuuaagaaguagauaugaaauacugauaggcuuuu

SEQ ID NO: 109759 - RNA, 63 nt, Homo Sapiens
ccaugagccccagagcaguagcaggagacuugagaaguagagugacaaaaacaagcacuuaau

SEQ ID NO: 109760 - RNA, 63 nt, Homo Sapiens
uccuuucauucccccuaaaaacagagugaccuggaaguagauguucuuugcuccuugucagag

SEQ ID NO: 109761 - RNA, 63 nt, Homo Sapiens
ccccucccucccuauaaggcuguggaaccugaggaaguagauacuugaagagauucuguuuag

SEQ ID NO: 109762 - RNA, 63 nt, Homo Sapiens
uaauaggaugaaucauauaaaucucugcuuucagaaguagacauuuaaaugagggccaguauu

SEQ ID NO: 109763 - RNA, 63 nt, Homo Sapiens
agaauguauuaguguauuuuuugucgguggagggaaguagauacuuuuaauuuagcaaaauau

SEQ ID NO: 109764 - RNA, 63 nt, Homo Sapiens
uccuauuuugaucuuuuucaagucuucugaaaggaaguagacaguauuacacccugaauaaau

SEQ ID NO: 109765 - RNA, 63 nt, Homo Sapiens
aacaaaaaacaagaaugaaaaacagaaauaaaagaaguagaaaagacaaagaaagaaagccca

SEQ ID NO: 109766 - RNA, 63 nt, Homo Sapiens
uaaaccucaaauaguuguguaucuguccuguuagaaguagaugacuucaauuaaacaaauuua

SEQ ID NO: 109767 - RNA, 63 nt, Homo Sapiens
auaauaaaucagaugcccugaggcucuguugaggaaguagaaucccaaugggacuccagacag

SEQ ID NO: 109768 - RNA, 63 nt, Homo Sapiens
ugaguugaucuagcuauuauuuaaguauuuauugaaguagaggggccuucaaacuacuuuaua

SEQ ID NO: 109769 - RNA, 63 nt, Homo Sapiens
cucuagcagagggaggggacccaccccagugaggaaguagauugcugccucuagccagagacc

SEQ ID NO: 109770 - RNA, 63 nt, Homo Sapiens
caguccccuguguuugccagagauacugugcucgaaguagagguuuuacucuacucaucacug

SEQ ID NO: 109771 - RNA, 63 nt, Homo Sapiens
agaaggggugugcaugcgccuacucgcuugcuagaaguagauucuggacagucagcucuucau

SEQ ID NO: 109772 - RNA, 63 nt, Homo Sapiens
gauugugcuauguuucaguggaagaaauucuuugaaguagaugugagugaaaaacugcaugcc

SEQ ID NO: 109773 - RNA, 63 nt, Homo Sapiens
acagcacauguugauuacgacuuucugguaccggaaguagaaauccugaaguuuaugcuuuuc

SEQ ID NO: 109774 - RNA, 63 nt, Homo Sapiens
cuuauuacucagucauacuguuuuuuuucuuuugaaguagauuugcacuauacugauuaauuu

SEQ ID NO: 109775 - RNA, 63 nt, Homo Sapiens
gugugguggaaucaguuuaagacuagacugauugaaguagacaucucuuuaagugcuccucua

SEQ ID NO: 109776 - RNA, 63 nt, Homo Sapiens
auauggaagaaaauuaaguggauacacgaggaugaaguagagggaaauggugagagccuugaa

SEQ ID NO: 109777 - RNA, 63 nt, Homo Sapiens
cacuuuuuuuuucuggguacugugugcaagcaugaaguagaaaguuuuugcuuuagugcauug

SEQ ID NO: 109778 - RNA, 63 nt, Homo Sapiens
uagcuuuaaaacgggguucaaaaguuuuauuuggaaguagaacgaugcuggcuaaaccgcuuu

SEQ ID NO: 109779 - RNA, 63 nt, Homo Sapiens
gcagccaaauccgaggaagagaaacugaagggagaaguagauggcaaugguuaugauaaaaag

SEQ ID NO: 109780 - RNA, 63 nt, Homo Sapiens
uauagcauacuaauauccaccugauuuauugacgaaguagacauuaggcaaagccaaacaaua

SEQ ID NO: 109781 - RNA, 63 nt, Homo Sapiens
uauuuguguaggcccauggaaaucacuacuugugaaguagagaugccuuuuugucuaaugguu

SEQ ID NO: 109782 - RNA, 63 nt, Homo Sapiens
uaauaaaagaaagcaugguauuaaacuaucauagaaguagacagaaaaagaaaaaaggacuca

SEQ ID NO: 109783 - RNA, 63 nt, Homo Sapiens
aaaggcaaugucugacauuuuuggucucuguuagaaguagacucuguugaaaagaaagaagcu

SEQ ID NO: 109784 - RNA, 63 nt, Homo Sapiens
ggcugucuggaaagggagggacaaaaggacccagaaguagaagaauggggauggaguggugag

SEQ ID NO: 109785 - RNA, 63 nt, Homo Sapiens
cagucuucaggacaccauuacagugaggaugaugaaguagauaguccggugucacaguucagu

SEQ ID NO: 109786 - RNA, 63 nt, Homo Sapiens
uuaacuggacaacuuugaguuguuuuucaagaggaaguagauuaucuuccuucaguguauuuu

SEQ ID NO: 109787 - RNA, 63 nt, Homo Sapiens
cugaggugugcagaggagcuuuagaaguucguggaaguagacggccauuguaccuuuugaugu

SEQ ID NO: 109788 - RNA, 63 nt, Homo Sapiens
aacauaagauguauuucugauacugaguacuuagaaguagaagaaaaugaguccuaaagaaca

SEQ ID NO: 109789 - RNA, 63 nt, Homo Sapiens
aggaggagggauucuggucugauucaagaaacagaaguagaagacuguuguuuacuuguugcu

SEQ ID NO: 109790 - RNA, 63 nt, Homo Sapiens
auauauuauuuuacugcuuaaauuccaaguccugaaguagaugguugagauaugaguucuucg

SEQ ID NO: 109791 - RNA, 63 nt, Homo Sapiens
cucuaggaaaaaauacuugggauaucacaugaagaaguagacugaaauaucagauuugucauc

SEQ ID NO: 109792 - RNA, 63 nt, Homo Sapiens
aauauuuaugcuuaguguaaacauucugugaaugaaguagacucuucgguggaauauauuaau

SEQ ID NO: 109793 - RNA, 63 nt, Homo Sapiens
ugaaccucuuucugguucucagcagaaguaacugaaguagaucaggaaggggcugccucagga

SEQ ID NO: 109794 - RNA, 63 nt, Homo Sapiens
uuuuguugguugcacuaacugcaagguugcugggaaguagaguccauuugguugaugagcuuu

SEQ ID NO: 109795 - RNA, 63 nt, Homo Sapiens
aauguggaggcuuucuauagcauucuaagcugagaaguagauuguuacccaguaaugaaauaa

SEQ ID NO: 109796 - RNA, 63 nt, Homo Sapiens
guuuauuuuuacuuuuagaauugguccuaugaagaaguagaaagugagucaugcacuagacag

SEQ ID NO: 109797 - RNA, 63 nt, Homo Sapiens
cacaagcccagcucagauucaagaaaagggugugaaguagaggugcaguuaaguggggggcca

SEQ ID NO: 109798 - RNA, 63 nt, Homo Sapiens
aaauacauugagguaacaucuaagaaacuuuuugaaguagaggcuuccuuacacuugguggaa

SEQ ID NO: 109799 - RNA, 63 nt, Homo Sapiens
ccagcugcacgaugaggaaccggcuuaaucuaggaaguagauucugucucugcaggaaggcuc

SEQ ID NO: 109800 - RNA, 63 nt, Homo Sapiens
ucuuuuucuuaccagucuccaagggauggauaggaaguagaccgugaaacucuacccugaaga

SEQ ID NO: 109801 - RNA, 63 nt, Homo Sapiens
ccuaccuugaauuaaggguuaccaauucagguagaaguagaggagauaaugucuuaauuuugu

SEQ ID NO: 109802 - RNA, 63 nt, Homo Sapiens
ugaauaggcuaccggagccuucgucuuauucuggaaguagaucuuaugguuuugauucaagaa

SEQ ID NO: 109803 - RNA, 63 nt, Homo Sapiens
agagaauggaaagcagcacacuccccagugacagaaguagagaaccugugauccguguaucuu

SEQ ID NO: 109804 - RNA, 63 nt, Homo Sapiens
aaacauaauuuacaucacaggcucaaaugaccugaaguagaauuacccccacauauucaagaa

SEQ ID NO: 109805 - RNA, 63 nt, Homo Sapiens
gcaugcauauuuuaauaucuguuuggauagucagaaguagaaucauaaagguaaaauaugagu

SEQ ID NO: 109806 - RNA, 63 nt, Homo Sapiens
uuuuuguucuaaggugcaucuagugcagauagugaaguagauuagcaucuacugcccuaagug

SEQ ID NO: 109807 - RNA, 63 nt, Homo Sapiens
uuuguauuauuguucucacuuauuauuaauaaugaaguagaaguuacuuaauugccagcaaau

SEQ ID NO: 109808 - RNA, 63 nt, Homo Sapiens
uuguauaaucuuuuaccuauaaaauauuuauuugaaguagaggguaaaucagcgguaagaaca

SEQ ID NO: 109809 - RNA, 63 nt, Homo Sapiens
ucaaaaggagauagagguucuuaccuuugcacugaaguagaauccaacauucuccuaagccag

SEQ ID NO: 109810 - RNA, 63 nt, Homo Sapiens
ccaccucaccucuuuguucuuccugucuccuuugaaguagacucauucuucacacgauugacc

SEQ ID NO: 109811 - RNA, 63 nt, Homo Sapiens
aaaauagaacacaauagagaagcuaaugacacagaaguagaucagucauaaugacccaggaau

SEQ ID NO: 109812 - RNA, 63 nt, Homo Sapiens
cacaguguuuuauuuauuuugaguagaaggggagaaguagaacagcuuagauuugugaaggga

SEQ ID NO: 109813 - RNA, 63 nt, Homo Sapiens
aaaugaaaauuacuugacaauggucaaccuuuugaaguagaagcccaauacaggcaaacaacc

SEQ ID NO: 109814 - RNA, 63 nt, Homo Sapiens
guaacucauauucuaucaaucugauauuugguggaaguagagauuuucauaagaguuuaaaug

SEQ ID NO: 109815 - RNA, 63 nt, Homo Sapiens
ugcaggggccgugcugucccucuucggcccugagaaguagaaaguggagggucagaggucggg

SEQ ID NO: 109816 - RNA, 63 nt, Homo Sapiens
acauauuaaacuuuucuuccccuuccuaguucugaaguagauauauauauauauauaucuacu

SEQ ID NO: 109817 - RNA, 63 nt, Homo Sapiens
cccccuuuuccugcaccuaguggccuuucuugggaaguagagauguggcggcuuucccacccu

SEQ ID NO: 109818 - RNA, 63 nt, Homo Sapiens
cugaagcagacagggaaugggagaggaggaugggaaguagacaguggcugguauggcucugag

SEQ ID NO: 109819 - RNA, 63 nt, Homo Sapiens
auaaaauugaauaguacccaaaguagauuaggugaaguagaacuugaaagaugggguugggua

SEQ ID NO: 109820 - RNA, 63 nt, Homo Sapiens
agguccucgaucaugguguucgugauuggaugugaaguagaagcauuggaggugguuucuggc

SEQ ID NO: 109821 - RNA, 63 nt, Homo Sapiens
cugggaacucuucuggucccgugucagggccaggaaguagagguuccuaggcccuuucugccu

SEQ ID NO: 109822 - RNA, 63 nt, Homo Sapiens
guaacagugacuucuagauuuucuugugaaggagaaguagaaagaaaauaguaacauugauau

SEQ ID NO: 109823 - RNA, 63 nt, Homo Sapiens
uuuugccaaaauacuucuuccagaccugggagggaaguagauguuagaggucccucuuuaccc

SEQ ID NO: 109824 - RNA, 63 nt, Homo Sapiens
aacucauagaagaugaacccuucaagaaaacgugaaguagaacgggugggccagaaaugaaaa

SEQ ID NO: 109825 - RNA, 63 nt, Homo Sapiens
ugaugcuguguccaaaauuaugcacuguuuguugaaguagaaccagaaauccugaccuccugu

SEQ ID NO: 109826 - RNA, 63 nt, Homo Sapiens
acaggccccgacaucaccccaaggacaacggcagaaguagagagaaacuaccuaccucacuuc

SEQ ID NO: 109827 - RNA, 63 nt, Homo Sapiens
uuugcacuugugcuuucaguuagccuucuguaggaaguagaagucauauguugucuuuguugu

SEQ ID NO: 109828 - RNA, 63 nt, Homo Sapiens
ccuuuugagcaagcgccaaugaguuucaggaaugaaguagaagguaguuauuuaaaaauaaaa

SEQ ID NO: 109829 - RNA, 63 nt, Homo Sapiens
aucagagggaaguuuucauugugaacuaccugugaaguagaaagugccagcugacuuaaggga

SEQ ID NO: 109830 - RNA, 63 nt, Homo Sapiens
ugacucucucugugguacacgaguugcuggaaugaaguagagguguuaucaaacuuugaaauu

SEQ ID NO: 109831 - RNA, 63 nt, Homo Sapiens
auuaggauccucaagcaucuugacauguuggcagaaguagaauaacauugugagcuuccuacc

SEQ ID NO: 109832 - RNA, 63 nt, Homo Sapiens
cugaaugagcaaaagcuggagcauuacucuugagaaguagaacaaggcacuucaguccuauuc

SEQ ID NO: 109833 - RNA, 63 nt, Homo Sapiens
agaaauuggaugguugccgugucuguguagaaagaaguagacaugggagacuuuucauuuugu

SEQ ID NO: 109834 - RNA, 63 nt, Homo Sapiens
accuugcacugauuuugucugagugcccugggagaaguagaaaaugauugaaagugacuuccg

SEQ ID NO: 109835 - RNA, 63 nt, Homo Sapiens
caaugucacaagcacugugcuaaacacuguggugaaguagaacaauugcuaaucauuuccugg

SEQ ID NO: 109836 - RNA, 63 nt, Homo Sapiens
ccuuaagcuuuuuugguuaagucuuccuuuucagaaguagaugucauuauaugccaaaagucu

SEQ ID NO: 109837 - RNA, 63 nt, Homo Sapiens
aaaccacucaguaaaagcaaaagcuuguccugagaaguagagugaguucuuuuucacucugug

SEQ ID NO: 109838 - RNA, 63 nt, Homo Sapiens
uaagggaaggggagacuguaagugagaaaaggagaaguagagaauauugauuaccuugagggg

SEQ ID NO: 109839 - RNA, 63 nt, Homo Sapiens
cugggagcaaaugccccauggaaggccuugagggaaguagaggcacugagccccagcugcuga

SEQ ID NO: 109840 - RNA, 63 nt, Homo Sapiens
uacaucggcugagugacgguuggcucauguguagaaguagauguccuauguggugaucaugaa

SEQ ID NO: 109841 - RNA, 63 nt, Homo Sapiens
gccauuggaugucaaauggagcuccaaaaaacagaaguagaauaucucacacuuuuacccacu

SEQ ID NO: 109842 - RNA, 63 nt, Homo Sapiens
uuucugcucugcuccuggaagauguagcaccccgaaguagagcgcagcucuuucuccaggugg

SEQ ID NO: 109843 - RNA, 63 nt, Homo Sapiens
uaggcuggaggaugaguuggguugguagaaacggaaguagaaguuuuuuaaugugccuuuugg

SEQ ID NO: 109844 - RNA, 63 nt, Homo Sapiens
acuuugaaaacagaaaugguaaauauacuuuuggaaguagaugauaaaaucacugaagcauca

SEQ ID NO: 109845 - RNA, 63 nt, Homo Sapiens
uauaauucuuuaacagcuauagguuaucuggcugaaguagaccuaauuuuaugugacuugugg

SEQ ID NO: 109846 - RNA, 63 nt, Homo Sapiens
gugguaaagaauugaggcuuuugauggaaggaggaaguagaaagauuuuucucuuuccuaucu

SEQ ID NO: 109847 - RNA, 63 nt, Homo Sapiens
gacagguuacuugguguaucuuucuggguaacagaaguagacacagcccuucaaguucuuuua

SEQ ID NO: 109848 - RNA, 63 nt, Homo Sapiens
cuccacagacacugacuguuuuuguccuauuaagaaguagaccacugagaagggagaagguga

SEQ ID NO: 109849 - RNA, 63 nt, Homo Sapiens
uucugggaaguaauaaugaccauugacaacuaagaaguagacaccaugcuaaagacuuacaua

SEQ ID NO: 109850 - RNA, 63 nt, Homo Sapiens
aauauuuugagugagggggagugggucaaagaggaaguagagguguaauccuguauuaacccu

SEQ ID NO: 109851 - RNA, 63 nt, Homo Sapiens
ccucugagggaaagcccagaaaaggacagaaacgaaguagaaaggggcccaguccuggccugg

SEQ ID NO: 109852 - RNA, 63 nt, Homo Sapiens
aaaauacuucugugcccccugauuugaggguaagaaguagauaaugaggccacuguggguguu

SEQ ID NO: 109853 - RNA, 63 nt, Homo Sapiens
cagcaguaccugcuguuuagcaaagacugaugagaaguagacuuuuuuuuuuuuggagauaga

SEQ ID NO: 109854 - RNA, 63 nt, Homo Sapiens
cauuaaacgauuccaguuggauuaugcguggaagaaguagacaucgauucuuauucuuuuaua

SEQ ID NO: 109855 - RNA, 63 nt, Homo Sapiens
aaaaugucgaaagcauuauaaaaaagcaucacagaaguagaaaggagggggaagcuuaucuug

SEQ ID NO: 109856 - RNA, 63 nt, Homo Sapiens
ugugauggccagaauaaaagcuguguugucuuagaaguagaugggggaugggguacugccggu

SEQ ID NO: 109857 - RNA, 63 nt, Homo Sapiens
aacauauucuuuaguagaacaguuuaaucaacagaaguagagugaguaguugucagagugaag

SEQ ID NO: 109858 - RNA, 63 nt, Homo Sapiens
aagaaauaauugauggagccauugaugcaaaccgaaguagauuuagaacuuauaugaauuuga

SEQ ID NO: 109859 - RNA, 63 nt, Homo Sapiens
uuagggaagaagaaaacauuuuaaagaauaccagaaguagaaucacauguaacagucucugca

SEQ ID NO: 109860 - RNA, 63 nt, Homo Sapiens
aaagcaagaacagaaaacgaagccacaggaagggaaguagacauuguaugcuuaugguuucuc

SEQ ID NO: 109861 - RNA, 63 nt, Homo Sapiens
aauaccgucagugugaaaacauuccguaguuuagaaguagacguugccaaugcugugacucaa

SEQ ID NO: 109862 - RNA, 63 nt, Homo Sapiens
gaaaagaaaaagaaaaucuuccaggacuauguagaaguagaaagacagauuguauuaauuuaa

SEQ ID NO: 109863 - RNA, 63 nt, Homo Sapiens
ugugggugaccgcccgaaggccuucacaggauggaaguagaaugauuucaguagauacucauu

SEQ ID NO: 109864 - RNA, 63 nt, Homo Sapiens
auuuaguuuagggaaagcccgauagaugguuaagaaguagaaagguguuugaagaggcucugg

SEQ ID NO: 109865 - RNA, 63 nt, Homo Sapiens
ggcacuuaacucuucauguuccaguucaucccagaaguagacaucccaggacccauucugugu

SEQ ID NO: 109866 - RNA, 63 nt, Homo Sapiens
caaaauacaauuuuuuugguagcagguuucaaggaaguagaaaacuuaaaaauuaaauuggaa

SEQ ID NO: 109867 - RNA, 63 nt, Homo Sapiens
uggaauuuaugaaugguucuagacaaaugucuugaaguagacacuuauuauguaagggucauu

SEQ ID NO: 109868 - RNA, 63 nt, Homo Sapiens
auccuacagauccucccauuucuagggaggucugaaguagaauuuucacuuuauguuagaaga

SEQ ID NO: 109869 - RNA, 63 nt, Homo Sapiens
gaaauuaccuugcaauaaaguuggugggaccaggaaguagagaaaaaaaaaguaaaauguggu

SEQ ID NO: 109870 - RNA, 63 nt, Homo Sapiens
cuuuugaauucacaccuuauugaaaucaguguagaaguagaguuaccuaaaccuuuaucgcca

SEQ ID NO: 109871 - RNA, 63 nt, Homo Sapiens
gagaagguucuucguccaaaggaggaaggagaagaaguagaaagugcgaagagcugaguuccc

SEQ ID NO: 109872 - RNA, 63 nt, Homo Sapiens
gaauuuccagauauuggaaauuagccaguugaggaaguagaagucuugagggacggguaggaa

SEQ ID NO: 109873 - RNA, 63 nt, Homo Sapiens
ggugggugcguaaggauguguuuuccugggccagaaguagagggaaaugagaaugacagccuu

SEQ ID NO: 109874 - RNA, 63 nt, Homo Sapiens
gcccucccuugucaggguuaugggaaccucugugaaguagagagucccaucugauaguggcuu

SEQ ID NO: 109875 - RNA, 63 nt, Homo Sapiens
acuaaccauguguuauguuucuccuccagccaugaaguagagguuuuuuguuauccuguauac

SEQ ID NO: 109876 - RNA, 63 nt, Homo Sapiens
uuaugcaaugagaaugaauaaauacaauaguaugaaguagaaggaacuuugugaauggauuua

SEQ ID NO: 109877 - RNA, 63 nt, Homo Sapiens
gucucuuggagauuguugaaugcagccagugaagaaguagauuccuaaauuuuauuggggacc

SEQ ID NO: 109878 - RNA, 64 nt, Homo Sapiens; identical to SEQ ID NO: 47001

SEQ ID NO: 109879 - RNA, 64 nt, Homo Sapiens; identical to SEQ ID NO: 47002

SEQ ID NO: 109880 - RNA, 64 nt, Homo Sapiens; identical to SEQ ID NO: 47003

SEQ ID NO: 109881 - RNA, 64 nt, Homo Sapiens; identical to SEQ ID NO: 47004

SEQ ID NO: 109882 - RNA, 64 nt, Homo Sapiens; identical to SEQ ID NO: 47005

SEQ ID NO: 109883 - RNA, 64 nt, Homo Sapiens; identical to SEQ ID NO: 47006

SEQ ID NO: 109884 - RNA, 58 nt, Homo Sapiens; identical to SEQ ID NO: 47007

SEQ ID NO: 109885 - RNA, 64 nt, Homo Sapiens; identical to SEQ ID NO: 47008

SEQ ID NO: 109886 - RNA, 64 nt, Homo Sapiens; identical to SEQ ID NO: 47009

SEQ ID NO: 109887 - RNA, 64 nt, Homo Sapiens; identical to SEQ ID NO: 47010

SEQ ID NO: 109888 - RNA, 64 nt, Homo Sapiens; identical to SEQ ID NO: 47011

SEQ ID NO: 109889 - RNA, 64 nt, Homo Sapiens; identical to SEQ ID NO: 47012

SEQ ID NO: 109890 - RNA, 64 nt, Homo Sapiens; identical to SEQ ID NO: 47013

SEQ ID NO: 109891 - RNA, 64 nt, Homo Sapiens; identical to SEQ ID NO: 47014

SEQ ID NO: 109892 - RNA, 64 nt, Homo Sapiens; identical to SEQ ID NO: 47015

SEQ ID NO: 109893 - RNA, 64 nt, Homo Sapiens
ggcgcggggccacacccgugaaccaugcagacggccgaagaagucuuaggcagggcgcccuggg

SEQ ID NO: 109894 - RNA, 64 nt, Homo Sapiens
cuacuguugcugggaacuuaggcuuaacauaaagccgaagaagguaccuagaaauuugaaacuu

SEQ ID NO: 109895 - RNA, 64 nt, Homo Sapiens
agaacuggaccaaucaaaccucaggcgaucaaaaccgaagaaacaaaaucuuaaaggcuauggu

SEQ ID NO: 109896 - RNA, 64 nt, Homo Sapiens
caccagggaaaguuuagagauuugcggcaauggaccgaagaacgggccaggaaguccuccaauu

SEQ ID NO: 109897 - RNA, 64 nt, Homo Sapiens
aagaggcagcaacaggaggagcugacccaugcagccgaagaaagagguagagagcagggcauau

SEQ ID NO: 109898 - RNA, 64 nt, Homo Sapiens
acguccugucacuccaccucgaacagcuaauccgccgaagaaaaggugaagaaaggaauucugu

SEQ ID NO: 109899 - RNA, 64 nt, Homo Sapiens
acuccauuugaccagauuguuuggcuaacacaucccgaagaaugauuuugucaggaauuauugu

SEQ ID NO: 109900 - RNA, 64 nt, Homo Sapiens
ggagaacaggggggaugauggggccaccgagaggccgaagaaggccaaggaggagcggcgcaug

SEQ ID NO: 109901 - RNA, 64 nt, Homo Sapiens
cgacagauucaugccacggauaaaugaggcaaauccgaagaaaaggaaaaucgaauaaaaaaua

SEQ ID NO: 109902 - RNA, 64 nt, Homo Sapiens
ccaggcguggacucugcccucagcuucacagucaccgaagaaaugaaguuacaggaggggcaca

SEQ ID NO: 109903 - RNA, 64 nt, Homo Sapiens
aggccagauaagugaaguaaguuuuuuauuaccgccgaagaaacuguaggagauagguacuguu

SEQ ID NO: 109904 - RNA, 64 nt, Homo Sapiens
acacuuaaguacaacuguagugugcaagcaaaaaccgaagaaaauccuucaaugacaugaaaac

SEQ ID NO: 109905 - RNA, 64 nt, Homo Sapiens
agaggcugagggcaggcaaaugcaggcaagguacccgaagaagcaaacccugccccaaugcacc

SEQ ID NO: 109906 - RNA, 64 nt, Homo Sapiens
auggcccauuagauacaacagcaagcccaagauuccgaagaagacagacaacucccccuaguac

SEQ ID NO: 109907 - RNA, 64 nt, Homo Sapiens
uuaucuaguuuaaaaacacuuuuuuucaaggaaaccgaagaaaccaucauccacuuuucucucu

SEQ ID NO: 109908 - RNA, 64 nt, Homo Sapiens
gaaaugcuuuaaacucugaagacaggauaccucaccgaagaagccacacugauccaagauggga

SEQ ID NO: 109909 - RNA, 64 nt, Homo Sapiens
ucauagacacucacaagguuuugcaccaauggaaccgaagaacugcuuaacucgccuaguagau

SEQ ID NO: 109910 - RNA, 52 nt, Homo Sapiens
uggcccagcuccccaagaaaaaccgaagaagagugaauuccucaggaaguaa

SEQ ID NO: 109911 - RNA, 64 nt, Homo Sapiens
gagaggaacacaggcgcugaaugucugauggaucccgaagaaugauggggguacucaauggagu

SEQ ID NO: 109912 - RNA, 64 nt, Homo Sapiens
aaaaguacacacccauggaaagggcggaggcaccccgaagaaugccccaaccauuugcacuaca

SEQ ID NO: 109913 - RNA, 64 nt, Homo Sapiens
ucuuucuagcccucagccacugggaguuucuucaccgaagaauaaucagucugauggaaccugu

SEQ ID NO: 109914 - RNA, 64 nt, Homo Sapiens
aauuucccauaggaagacuucaccuccuacaacuccgaagaaaacccuuacuguccaagaccgu

SEQ ID NO: 109915 - RNA, 64 nt, Homo Sapiens
cuuauacacaauucauucuuugcagcuaauuaagccgaagaagccugggaaucaaguuugaaac

SEQ ID NO: 109916 - RNA, 64 nt, Homo Sapiens
aacuccuacaaaugagaauuacagauuuaccaucccgaagaaccugcuaggcccagcacaauga

SEQ ID NO: 109917 - RNA, 64 nt, Homo Sapiens
ccuugcuucagaggccugauggcgucggacuauuccgaagaaguggccaccuccgaaaaauucc

SEQ ID NO: 109918 - RNA, 64 nt, Homo Sapiens
cgagaacacauuuggugcacguucaucugcugucccgaagaaacuucagucagccuguggcacu

SEQ ID NO: 109919 - RNA, 56 nt, Homo Sapiens
ccauaguggaccacuuggaaaacauuccgaagaauucuagcuacagccaaucuuaa

SEQ ID NO: 109920 - RNA, 64 nt, Homo Sapiens
gucauuuuaauccaaauuuucacagagaagaaucccgaagaauguaacaagaagcaaagccuuc

SEQ ID NO: 109921 - RNA, 64 nt, Homo Sapiens
ugccaagaaauauauauuugucacuagggcauaaccgaagaaucaagugauuucuugccauccu

SEQ ID NO: 109922 - RNA, 64 nt, Homo Sapiens
acaaaacuggagaugcaucgggaaagaagaaacuccgaagaaaagaauuuuaguguuaaugacu

SEQ ID NO: 109923 - RNA, 51 nt, Homo Sapiens
gcaugagcaguggaagauaaaccgaagaauuaaagguaaauaugaaaugau

SEQ ID NO: 109924 - RNA, 64 nt, Homo Sapiens
uggaauugugcuccaaaugucuacugaagcuuaaccgaagaacuaauaaauggacuacaguagc

SEQ ID NO: 109925 - RNA, 59 nt, Homo Sapiens
auuuuucaggaagcuacuaaagugcuguuccgaagaauaggcugaaacaaaaauauaag

SEQ ID NO: 109926 - RNA, 64 nt, Homo Sapiens
gauauguauucuaauuggcagugagaucccgucuccgaagaaaaagaccagccuggacagcuua

SEQ ID NO: 109927 - RNA, 64 nt, Homo Sapiens
auaucuaaacaucgaaaaacaaacuugugcuucaccgaagaaaaugaucagggaccaugaaaag

SEQ ID NO: 109928 - RNA, 64 nt, Homo Sapiens
auauaaguguuccacaaguuaaguuucuuaaaucccgaagaaaauagucuuucaguacgagaca

SEQ ID NO: 109929 - RNA, 64 nt, Homo Sapiens
uuguggaaucccuuugcuuagugugagauucguaccgaagaacccccgaugaccccagaaaacc

SEQ ID NO: 109930 - RNA, 64 nt, Homo Sapiens
ugcuccagcaacacagccuggugucccccagguuccgaagaagaccagcaccucagccugcaca

SEQ ID NO: 109931 - RNA, 64 nt, Homo Sapiens
guugauuuuguuuuuagcuuacugcugccuuuguccgaagaaacuguuccuccauuauuugaau

SEQ ID NO: 109932 - RNA, 64 nt, Homo Sapiens
agaccuaugucuuucgauaugcagccaaguuuuaccgaagaaaaggcucuguggauaaagcucu

SEQ ID NO: 109933 - RNA, 64 nt, Homo Sapiens
ggugauuucugccaggggcuguagcauuccuucgccgaagaaaucugccaaaggauuuuggaaa

SEQ ID NO: 109934 - RNA, 64 nt, Homo Sapiens
aaacauuugaauuuaccuucgcucuguuuuaaagccgaagaagaggcugugcuuaagaauuuaa

SEQ ID NO: 109935 - RNA, 64 nt, Homo Sapiens
aggauucuuuacugugccagcacggggauuggauccgaagaaacuggcuacugggguuuggccc

SEQ ID NO: 109936 - RNA, 64 nt, Homo Sapiens
ccacuugcuguuuccagccguucuucccuuucauccgaagaaacccuccugcaguuggacugaa

SEQ ID NO: 109937 - RNA, 64 nt, Homo Sapiens
cggagcauuuauuuuguuaaauuuaccuuuuauuccgaagaacugaggacaggcuguaugucag

SEQ ID NO: 109938 - RNA, 64 nt, Homo Sapiens
ggauuugugacgucacuuagcugggcuggucacuccgaagaagaccacacgagagcuccaggcu

SEQ ID NO: 109939 - RNA, 64 nt, Homo Sapiens
caagaucccguccuccaggcuucccagccaucuuccgaagaauauacguaauggagggaagaau

SEQ ID NO: 109940 - RNA, 64 nt, Homo Sapiens
aaaauauccaguaccaugcucuuagcaguuuggcccgaagaagggaugucuuugugaugugaug

SEQ ID NO: 109941 - RNA, 64 nt, Homo Sapiens
ugaucagagaccacgaaaagaaauuugugcuucaccgaagaaaaauaucuaaacaucgagaaac

SEQ ID NO: 109942 - RNA, 64 nt, Homo Sapiens
uggauuaaacuuacaaaaaguaucuauaacuggaccgaagaauauggaagguaugaacagcagu

SEQ ID NO: 109943 - RNA, 64 nt, Homo Sapiens
gcuuuacacagucaccuugcccuuccuuccaccaccgaagaaaaaagauggucauacuaacagg

SEQ ID NO: 109944 - RNA, 64 nt, Homo Sapiens
gucuugcaaguuaaggcuucuguuguacauacugccgaagaauuuuccauggaaauaaaaagua

SEQ ID NO: 109945 - RNA, 64 nt, Homo Sapiens
cugcugcucaccaggacccagcugccuaaggagcccgaagaauugaccauccggccaugaggaa

SEQ ID NO: 109946 - RNA, 64 nt, Homo Sapiens
ccuucuuccacugucucauccacauaagcacuccccgaagaauuaaggggguucuguuuucaag

SEQ ID NO: 109947 - RNA, 64 nt, Homo Sapiens
aacccaagagcaagggcuugggccccuggggcucccgaagaaugcacucccuuccccauagaua

SEQ ID NO: 109948 - RNA, 64 nt, Homo Sapiens
ugucauaggcauagagaguugcacauaaaaaauaccgaagaaaacccaaaauucaaucaacaau

SEQ ID NO: 109949 - RNA, 64 nt, Homo Sapiens
auauacaaaggggaccagugccacagaaggguacccgaagaaaugagaagucaaggacucucuu

SEQ ID NO: 109950 - RNA, 64 nt, Homo Sapiens
ggugguugugacaauaccuccuggucuuccaauaccgaagaaagcaggugugacugucaguuug

SEQ ID NO: 109951 - RNA, 64 nt, Homo Sapiens
acagggcugcaagugcccugccaggcucuaaggcccgaagaacaggugauaucgggggcgcugc

SEQ ID NO: 109952 - RNA, 64 nt, Homo Sapiens
agggcgaagauggccgagaugauccuaaaaauaaccgaagaaagagaggaccaaccagaauucc

SEQ ID NO: 109953 - RNA, 64 nt, Homo Sapiens
acacuuuggcugugucuauacaaaucaucagaggccgaagaaaagcucauguucuucaucuucu

SEQ ID NO: 109954 - RNA, 64 nt, Homo Sapiens
guccuucccucuccccaagaucuccccucuaaggccgaagaaggggcccacuucaggguucucc

SEQ ID NO: 109955 - RNA, 64 nt, Homo Sapiens
accagugaagacgucagggggggagcgaacucccccgaagaagguggacgugcugcgcauguuc

SEQ ID NO: 109956 - RNA, 64 nt, Homo Sapiens
aagcaauacugaacaaaacauuuguaccuguuuuccgaagaaaaagugaguuuguguguaugaa

SEQ ID NO: 109957 - RNA, 64 nt, Homo Sapiens
cuucacuaaagugucauccaccaguguguugaauccgaagaaugacaauuuucuaccacuggug

SEQ ID NO: 109958 - RNA, 64 nt, Homo Sapiens
aaagaaaaacaugcucauccacccagccaaugugccgaagaaagaauaggcauggagccgccac

SEQ ID NO: 109959 - RNA, 64 nt, Homo Sapiens
uccacuacagacccagccccagguucaauguccuccgaagaaugaagucuuucccuggugaugg

SEQ ID NO: 109960 - RNA, 64 nt, Homo Sapiens
cguggggccggcaagcaggcgccuuaugccacagccgaagaauccuuccugcagaacacacagu

SEQ ID NO: 109961 - RNA, 64 nt, Homo Sapiens
gaacccacacccauagcucugggugaaguggcccccgaagaaugggagugugggggcauuuggg

SEQ ID NO: 109962 - RNA, 64 nt, Homo Sapiens
agagagcuuugugugauucauguuuuaaaaagaaccgaagaagccacaggcagggccugaggga

SEQ ID NO: 109963 - RNA, 64 nt, Homo Sapiens
cccucugaaucaugcagggaagggucugccccugcccuggcacacacaggcacccauucccucc

SEQ ID NO: 109964 - RNA, 64 nt, Homo Sapiens
gcagucacucugcuaagagucccucccugccacgcccuggcaggacacaggcacuuuuccaaug

SEQ ID NO: 109965 - RNA, 64 nt, Homo Sapiens
acccccuuguguaauugcuugcucugcaagagcucccuggcaaugggggguacagagggagaag

SEQ ID NO: 109966 - RNA, 64 nt, Homo Sapiens
acaaucugcuugugucucccgcccucccgccccucccuggcaggggccccuguggccugggugg

SEQ ID NO: 109967 - RNA, 64 nt, Homo Sapiens
uugggguauccacccagucacuauuaaccuggggcccuggcagaaaucccaguuuugcagucaa

SEQ ID NO: 109968 - RNA, 64 nt, Homo Sapiens
gugggcuucuauccacccaugucugaagaccucacccuggcagggaggcaggaaaaacgcgagu

SEQ ID NO: 109969 - RNA, 64 nt, Homo Sapiens
cuacacagaucacucugggcccucccgacccccacccuggcauagagcuuuggcuauacucucu

SEQ ID NO: 109970 - RNA, 64 nt, Homo Sapiens
ucuguggcuaguuguccuaccuuggauggcacuucccuggcaccuggcugaucaccccuugcuu

SEQ ID NO: 109971 - RNA, 64 nt, Homo Sapiens
guccggagcggcucuagacaccugucaguagcaacccuggcagucuuucucuggggaccccauu

SEQ ID NO: 109972 - RNA, 64 nt, Homo Sapiens
acugaagagcggcaccgggcugccgccucagcagcccuggcagaguuccucccucucuggccug

SEQ ID NO: 109973 - RNA, 64 nt, Homo Sapiens
cccaggcagcaccaggccagcaaggggugcgaaacccuggcaguuuggaaauugcauuuguaac

SEQ ID NO: 109974 - RNA, 64 nt, Homo Sapiens
ugggcugagucugcccugagagccaggacuuguccccuggcagcacccagcuccagcucccguu

SEQ ID NO: 109975 - RNA, 64 nt, Homo Sapiens
auugugggaggcuucacaaccacaucuccacugucccuggcagggcuuaguagccuugaagcag

SEQ ID NO: 109976 - RNA, 64 nt, Homo Sapiens
cuguagauucugagcagguuaggcagguggccugcccuggcaucgauugacuggcugcucacuc

SEQ ID NO: 109977 - RNA, 64 nt, Homo Sapiens
ggugagcuggaguugggggugucucgggcccaggcccuggcagagaaacagggaggccugggga

SEQ ID NO: 109978 - RNA, 64 nt, Homo Sapiens
caggcccagggccgcaugugugcacucuacgccucccuggcacugcuaucaggacugagccagg

SEQ ID NO: 109979 - RNA, 64 nt, Homo Sapiens
ggggcccucuggaguugauacaagccugccugagcccuggcacacccguuugggguugguccuu

SEQ ID NO: 109980 - RNA, 64 nt, Homo Sapiens
gcgcagcugcaagguugccaggacccacccucaucccuggcaccgucaugggaguuugcucuug

SEQ ID NO: 109981 - RNA, 64 nt, Homo Sapiens
gcuaaagcaucucacucccagggcagccccagcacccuggcauugcgggaggugcucugcugca

SEQ ID NO: 109982 - RNA, 64 nt, Homo Sapiens
agucaaacuuuuuuguagaaccuucuuucccuuacccuggcaaauugcuucuuuacuugcuggu

SEQ ID NO: 109983 - RNA, 64 nt, Homo Sapiens
caaggauagcuacugacagccuccugcugcccuacccuggcaggcacaggcgcagcuggcuggg

SEQ ID NO: 109984 - RNA, 64 nt, Homo Sapiens
cucccauuccagguacuagcuguguguucugcaccccuggcaccuuccucuccucccacacagg

SEQ ID NO: 109985 - RNA, 64 nt, Homo Sapiens
aguaccagcaccuaguuggccacagccaugaacccccuggcacuagaacacagagagggacaaa

SEQ ID NO: 109986 - RNA, 64 nt, Homo Sapiens
gacuggcacagagguguucucguccuggucucugcccuggcaugcagaggggcaguugaagucu

SEQ ID NO: 109987 - RNA, 64 nt, Homo Sapiens
aaggucuucugcugcuuaugugccgcgccuccaccccuggcaccaagguacauaccaccccuuc

SEQ ID NO: 109988 - RNA, 64 nt, Homo Sapiens
ucaagagggagugaggagagagcgcccgcagacacccuggcaucgcccuucccgcaccgccgcc

SEQ ID NO: 109989 - RNA, 64 nt, Homo Sapiens
auugaaaaaagagauucaagagccaaguacucagcccuggcaggggauggggacaugaugccca

SEQ ID NO: 109990 - RNA, 64 nt, Homo Sapiens
caugaugcccagagccaccccuauacuccagucucccuggcaucagcuacugcaguacuggggu

SEQ ID NO: 109991 - RNA, 64 nt, Homo Sapiens
ccagcuuugcaggugacccuggcaccgcccacuccccuggcauuccuggcccccaggagcugga

SEQ ID NO: 109992 - RNA, 52 nt, Homo Sapiens
aggcucuggcgcucugcugggucccuggcaccacgucagcagucggcacuga

SEQ ID NO: 109993 - RNA, 64 nt, Homo Sapiens
gcguuccugccgcagcucugaccuggugcugucgcccuggcaucuuaauaaaaccugcuuauac

SEQ ID NO: 109994 - RNA, 64 nt, Homo Sapiens
cgcccuggcaucuuaauaaaaccugcuuauacuucccuggcaggggagauaccaugaucgcgga

SEQ ID NO: 109995 - RNA, 64 nt, Homo Sapiens
cuuugagccuuuggccacauccaccucgaggggacccuggcaccccgggcacacaaaccucugu

SEQ ID NO: 109996 - RNA, 64 nt, Homo Sapiens
ggugccaggccuuagagcagacaagggcucucagcccuggcaugcccccuaaagggaccaaggu

SEQ ID NO: 109997 - RNA, 64 nt, Homo Sapiens
gccuucgggugguuggcaaguugugauaggcagucccuggcagggugggucccuggcaaguguc

SEQ ID NO: 109998 - RNA, 64 nt, Homo Sapiens
ugucuugugauaggcaguccguggcacugugggucccuggcaagggugugccuuggcucccaag

SEQ ID NO: 109999 - RNA, 64 nt, Homo Sapiens
gccgccuggaaugcaggacuggagguacccccaccccuggcacauuugugguggggggugcgga

SEQ ID NO: 110000 - RNA, 64 nt, Homo Sapiens
gugcacuuguuuucugguuuuugccccagcccaccccuggcaagugcugugugaugggcaggcu

SEQ ID NO: 110001 - RNA, 64 nt, Homo Sapiens
ucuguggcucaccuuuauucuugaaacugagguuuaccuggaucuggcuacugaggcuagagcc

SEQ ID NO: 110002 - RNA, 64 nt, Homo Sapiens
augggggcuguguuugcacaaguuauuuucauguuaccuggagaguguccagaggcugcucuga

SEQ ID NO: 110003 - RNA, 64 nt, Homo Sapiens
aucuuguggaagacugucuuggauggggaaguacuaccuggagauuucaaauucacuuggccug

SEQ ID NO: 110004 - RNA, 64 nt, Homo Sapiens
auguuugaaguuguaaucugucccaucauaaacuuaccuggagcucauguggaggaacagaagg

SEQ ID NO: 110005 - RNA, 64 nt, Homo Sapiens
uuuuuauuacuuuuuauaccuuuuaguauguauguaccuggaaaaacuuaccuuuccagguuug

SEQ ID NO: 110006 - RNA, 64 nt, Homo Sapiens
ucuggacaguuauacuguaaaaaguauucagugguaccuggaggauuggccucuuuguacugga

SEQ ID NO: 110007 - RNA, 64 nt, Homo Sapiens
ccgugucagcguguggugucgccugcaugggucguaccuggaugguguguccaccaucgacacg

SEQ ID NO: 110008 - RNA, 64 nt, Homo Sapiens
guacauuucuuaugagcuuuguuuauauacccauuaccuggauguuuuuguccacugggagagg

SEQ ID NO: 110009 - RNA, 64 nt, Homo Sapiens
cccuggugcugccaccugccccuacucaagugucuaccuggagccccuggggcggugcuggcca

SEQ ID NO: 110010 - RNA, 64 nt, Homo Sapiens
cugagauuccagaaaucugcugcauuucacaugguaccuggaacccaacaguucauggauaucc

SEQ ID NO: 110011 - RNA, 64 nt, Homo Sapiens
auucagaucauuuaggaauucauacaguauugcuuaccuggaggucauaagaauacaaaguaua

SEQ ID NO: 110012 - RNA, 64 nt, Homo Sapiens
cauagcuauuaccaucucauguaaucaaauuagguaccuggaaauuacaggcaucagaaaauaa

SEQ ID NO: 110013 - RNA, 64 nt, Homo Sapiens
uucauucuuauguauuaggacgccuacucucugcuaccuggacgaaugcgcucauuaugcaagu

SEQ ID NO: 110014 - RNA, 64 nt, Homo Sapiens
ggagagaguauuccugcugaccaaaacaaagaaguaccuggaguggaaaucaugccaaaaaaau

SEQ ID NO: 110015 - RNA, 64 nt, Homo Sapiens
uccuuggcuucuuugagaauuuaaaaaaugugcauaccuggauuucuacucgguaaaauuuuuu

SEQ ID NO: 110016 - RNA, 64 nt, Homo Sapiens
accggcaggugcccagcaguuggugcaggaaaacuaccuggagugaagcugcucacccaagauu

SEQ ID NO: 110017 - RNA, 64 nt, Homo Sapiens
caucuuccugcugcuguaacgcaguaccugggaaaggacccaccaguggaaugcagggaagagg

SEQ ID NO: 110018 - RNA, 64 nt, Homo Sapiens
cccuccaugggcuagugugagggagggggcgcucaggacccaggacucagagcagagcaaauga

SEQ ID NO: 110019 - RNA, 64 nt, Homo Sapiens
aacucagaguugauggugagggagugccuaagccaggacccagauuccgggccugcucuaguga

SEQ ID NO: 110020 - RNA, 64 nt, Homo Sapiens
gccacacugcagccuccgccuguuggccuuggcuaggacccagaguccucucagccaggugccg

SEQ ID NO: 110021 - RNA, 64 nt, Homo Sapiens
cucuccuuaccgagaaggacaaaucccaccagccaggacccaaacuacuucccugacuggagcu

SEQ ID NO: 110022 - RNA, 64 nt, Homo Sapiens
ugugaggacccugaccuggcggagagggacuuggaggacccaccagugaaagguagggaaagug

SEQ ID NO: 110023 - RNA, 64 nt, Homo Sapiens
uuucuggacuacuucagaaucugauucuaaauguaggacccaaggggauuucugugcuauaaac

SEQ ID NO: 110024 - RNA, 64 nt, Homo Sapiens
cacccuaugccggcuucuguaauauuuagcauucaggacccaccgaggggaggcgaggaagagu

SEQ ID NO: 110025 - RNA, 64 nt, Homo Sapiens
ugcuugccuagggccucugugauggacaucucguaggacccagccagucucauccagcagguug

SEQ ID NO: 110026 - RNA, 64 nt, Homo Sapiens
ugacuuccccagggugcacagcgaguaacagaucaggacccaaacuugggcagucugggcuggg

SEQ ID NO: 110027 - RNA, 64 nt, Homo Sapiens
cugcucacagguggcuuccuagccaugaggccucaggacccacugccgacucugcucccaucuc

SEQ ID NO: 110028 - RNA, 64 nt, Homo Sapiens
uuccucccagaccugaacccagucaucacugugcaggacccagggcucccaagccggaguucac

SEQ ID NO: 110029 - RNA, 64 nt, Homo Sapiens
ccaggagccccggcggcgcagcugcaagguugccaggacccacccucaucccuggcaccgucau

SEQ ID NO: 110030 - RNA, 64 nt, Homo Sapiens
gagcucaagaagcugcugcacgggcugggccuucaggacccagagggcuuccuauucaaggaga

SEQ ID NO: 110031 - RNA, 64 nt, Homo Sapiens
ggggcauauaaaaaagucaagagcucccaagaccaggacccacuauccuuucggcuucccaguu

SEQ ID NO: 110032 - RNA, 64 nt, Homo Sapiens
ggggcauauaaaaucucugcgagcucccaagaccaggacccacuguccuuucggcuucccaguu

SEQ ID NO: 110033 - RNA, 64 nt, Homo Sapiens
gucauccauuucccaguuagggcaacaaugaaggaggacccagccaagcuagaaggaauuuugu

SEQ ID NO: 110034 - RNA, 64 nt, Homo Sapiens
cagcagguucucugcccucccuagggguuggggaaggacccaccccggucagcacagugccuuu

SEQ ID NO: 110035 - RNA, 64 nt, Homo Sapiens
gccccuccccacaccaguugaacugcaggaagagaggacccauccugccacaggacccagaaaa

SEQ ID NO: 110036 - RNA, 64 nt, Homo Sapiens
uugaacugcaggaagagaggacccauccugccacaggacccagaaaaaaagcccaacacacacu

SEQ ID NO: 110037 - RNA, 64 nt, Homo Sapiens
augcagaagugucaauaaacaaggcagucucccaaggacccaccacaagucccaagaugccaga

SEQ ID NO: 110038 - RNA, 64 nt, Homo Sapiens
agguggcaggcaguggacagcccucagaagccucaggacccaacucccauccuuguccuucucu

SEQ ID NO: 110039 - RNA, 61 nt, Homo Sapiens
cucaacacacaaagugccaccuguucuucuaccaacccaguuaccagagauguggugagcu

SEQ ID NO: 110040 - RNA, 61 nt, Homo Sapiens
gacuuugccuccauuuucagcaucuagguccccaacccaugcugagcuacuugaagggggc

SEQ ID NO: 110041 - RNA, 61 nt, Homo Sapiens
ccagcccagcucagcucagccccaacccggcccaacccagccacggccuagcccaacccag

SEQ ID NO: 110042 - RNA, 51 nt, Homo Sapiens
ccaacccggcccaacccagccccaacccagcccagcagcagcacggccuag

SEQ ID NO: 110043 - RNA, 61 nt, Homo Sapiens
uaauagugaaccacaccaggagaacaaauacccaacccaguggcaucagcagucacagagc

SEQ ID NO: 110044 - RNA, 61 nt, Homo Sapiens
cuagacaucaaagcagcguuccaaccugaggccaacccaucucaccugacacugaauacug

SEQ ID NO: 110045 - RNA, 61 nt, Homo Sapiens
gccaggcgcagccaucgggaaggucauucagccaacccagaggauguagacccuguccuca

SEQ ID NO: 110046 - RNA, 61 nt, Homo Sapiens
cuccucacagggccuggccauauagccagcuccaacccaaagcccugcacagugccucacc

SEQ ID NO: 110047 - RNA, 61 nt, Homo Sapiens
agcccccuuagcgcccccgccgcugcugcagccaacccaguugcaccuuccucucccaggu

SEQ ID NO: 110048 - RNA, 61 nt, Homo Sapiens
uaccuccauuccacuugugagcccacccuccccaacccacacuuaagccauguccucaucu

SEQ ID NO: 110049 - RNA, 61 nt, Homo Sapiens
ugggucccagccugguuugcaaagaccaccuccaacccaacccaaucccucuccacucuuc

SEQ ID NO: 110050 - RNA, 61 nt, Homo Sapiens
cccagccugguuugcaaagaccaccuccaacccaacccaaucccucuccacucuucucucc

SEQ ID NO: 110051 - RNA, 61 nt, Homo Sapiens
ucccagccgccagccaaagcgcggacccaccccaacccaacgaggcucugcucagaguucg

SEQ ID NO: 110052 - RNA, 61 nt, Homo Sapiens
cccgcuagaaaccugcugcggcugcugccucccaacccauggaguccugggucccagucca

SEQ ID NO: 110053 - RNA, 61 nt, Homo Sapiens
accccacaucccaccacauccaccuccauccccaacccauccucauccccaacuacagccc

SEQ ID NO: 110054 - RNA, 61 nt, Homo Sapiens
cucauccucauccccaacugcagccccaaacccaacccagggccauccccaaacccauccc

SEQ ID NO: 110055 - RNA, 61 nt, Homo Sapiens
uugagacagcagccuaucuggggccacacagccaacccagcccuggucccugaggucugcc

SEQ ID NO: 110056 - RNA, 61 nt, Homo Sapiens
uugggccccuuccucugacccucguuggaccccaacccagacccccuuuucuccauguacc

SEQ ID NO: 110057 - RNA, 61 nt, Homo Sapiens
ggccaccccaagcccucugcgccaacacuccccaacccaucgagaaauccugcacccauca

SEQ ID NO: 110058 - RNA, 61 nt, Homo Sapiens
aucuuucuagucccuaugcuuuauuuuauauccaacccagcuugaugcuuugggggcucaa

SEQ ID NO: 110059 - RNA, 64 nt, Homo Sapiens
gaaagucauauguaggaaaccccauuugagagacaccaauaaaaaugaauuuucuacuucuaca

SEQ ID NO: 110060 - RNA, 64 nt, Homo Sapiens
cuuagccaauuuauaagggaaaucacuuuaaucaaccaauaaucacacaacguaaguuauuuag

SEQ ID NO: 110061 - RNA, 64 nt, Homo Sapiens
aaacugcccaugucauuuguuuccagaaacgaggaccaauaauucucucacacuggcauuugug

SEQ ID NO: 110062 - RNA, 64 nt, Homo Sapiens
ccugcaaauugcuguaauuuuauaccauguucuaaccaauaaacagaacuauuucuuacacucu

SEQ ID NO: 110063 - RNA, 64 nt, Homo Sapiens
ccgagugaugguguuuguaugcuaauauaacaaaaccaauaaaaaauaauugccugcuucagag

SEQ ID NO: 110064 - RNA, 64 nt, Homo Sapiens
gccugcuucagaggcuaauaagauguauguucacaccaauaauuccauaauaugaugcuuuuua

SEQ ID NO: 110065 - RNA, 64 nt, Homo Sapiens
aauaauaaaaagacaaagcagucacauugguaggaccaauaaagacagugggccuggguaaaga

SEQ ID NO: 110066 - RNA, 64 nt, Homo Sapiens
uuccaaauuggaauuguuuuuuuuauacaacuguaccaauaaaaagcaugacugauuaacagaa

SEQ ID NO: 110067 - RNA, 64 nt, Homo Sapiens
acugaugguguguuugucucguuugggacagcugaccaauaaaccaaagccccagggcuggccc

SEQ ID NO: 110068 - RNA, 64 nt, Homo Sapiens
aauuaaggaaagaaacaaacagugcccgguaaauaccaauaagacuauagcaggcaccaaagca

SEQ ID NO: 110069 - RNA, 64 nt, Homo Sapiens
gguaccucaauacauguucuacuuacguucuuauaccaauaaaaaaugacaugguuaaucugga

SEQ ID NO: 110070 - RNA, 64 nt, Homo Sapiens
gcccauagggaagagagagacagggacuucagagaccaauaaaagagcuggcacugaagaucuc

SEQ ID NO: 110071 - RNA, 64 nt, Homo Sapiens
augugcuccuuuuuauuauauuaguuacagugcuauuaaagaaugaguauuauuugcaauuuua

SEQ ID NO: 110072 - RNA, 64 nt, Homo Sapiens
gcaucuccaauccuuaggccgauuuuuuugauguauuaaagaauuuaggugugauauaguguua

SEQ ID NO: 110073 - RNA, 64 nt, Homo Sapiens
uuggcauguguguucccuaaaaaaaauaaaaucaauuaaagaacuuuacugaacuuuuuaugua

SEQ ID NO: 110074 - RNA, 64 nt, Homo Sapiens
gcaauaaacuuucuacagagaaaagaaaguacgaauuaaagaccauaugauacaccaacuucua

SEQ ID NO: 110075 - RNA, 64 nt, Homo Sapiens
acagaaaaguugaaaccacaacaaaaugaauucuauuaaagaauagccccagauauaaauucuc

SEQ ID NO: 110076 - RNA, 64 nt, Homo Sapiens
cucuugaaagcaauguucauaaauauuuaagcaaauuaaagacaauguuaacaaauuuucuauu

SEQ ID NO: 110077 - RNA, 64 nt, Homo Sapiens
aaucucgcauugcucccuaagcacccugggccuuauuaaagagcaacuucuauuuccagucggg

SEQ ID NO: 110078 - RNA, 64 nt, Homo Sapiens
uauaaacugcucuugcaguccaaagggauaccugauuaaagaaguuucuuauuuaaacaucuca

SEQ ID NO: 110079 - RNA, 64 nt, Homo Sapiens
guacuaccuuauacccuuccccaaaaacaaagggauuaaagaccuaaauaugaagacaaaacuu

SEQ ID NO: 110080 - RNA, 64 nt, Homo Sapiens
cauggaacugucaaaggauucguaucuggaauacauuaaagaagcaaaagaaccucauacaaaa

SEQ ID NO: 110081 - RNA, 64 nt, Homo Sapiens
ucaauacuaagugacaguauaugauguaaaaaauauuaaagauauaagaucauaacaaugucuc

SEQ ID NO: 110082 - RNA, 64 nt, Homo Sapiens
ggaauguguuguaaguuucuaacauuuuugagauauuaaagauuuuuaauaauguugccuugga

SEQ ID NO: 110083 - RNA, 64 nt, Homo Sapiens
uguaacgacacaaucagcacaacuggagagaggcauuaaagaaccagggaagguaguuugauuu

SEQ ID NO: 110084 - RNA, 64 nt, Homo Sapiens
cucaaaaaaagagacuuguuacaugaaaguuuucauuaaagagcugaaaacaagaauuuagaga

SEQ ID NO: 110085 - RNA, 64 nt, Homo Sapiens
uaaaaaagagaggagauucccuugagaggugacaauuaaagaucucucaaaauguauagccaga

SEQ ID NO: 110086 - RNA, 64 nt, Homo Sapiens
uugggagaacaaauaggaaagauuaacuuauuucauuaaagaagagcuacuggaugcacuguca

SEQ ID NO: 110087 - RNA, 64 nt, Homo Sapiens
ucaggcaaguuuguggaaugaugacacugacauuauuaaagaguguguguguggugugucuuuc

SEQ ID NO: 110088 - RNA, 64 nt, Homo Sapiens
aacuaaaugacucugauuuuuuaaaguaauaaugauuaaagaauuaagaauguauuaguguauu

SEQ ID NO: 110089 - RNA, 64 nt, Homo Sapiens
gggagucguggcugucucuaaguguuuguucuuuauuaaagacagcguugggcaugauuacugc

SEQ ID NO: 110090 - RNA, 64 nt, Homo Sapiens
ggcauuauuuauacacccugaggacauuauugucauuaaagagacacaugucaugcuagccaag

SEQ ID NO: 110091 - RNA, 64 nt, Homo Sapiens
auccaccccaggguuauuuuugucuuuccaccuaauuaaagagguaauuuacuuagccucucug

SEQ ID NO: 110092 - RNA, 64 nt, Homo Sapiens
aaggccuuaaucuguuuagaaauuacucaccuggauuaaagauuaugcuuuuuacuacaaacaa

SEQ ID NO: 110093 - RNA, 64 nt, Homo Sapiens
aaaguaauguacauauggcuguugaauguuuauuauuaaagaaaugaaauugccccaguucaga

SEQ ID NO: 110094 - RNA, 64 nt, Homo Sapiens
aaauuucacauuaaaggaagagaauucauaacacauuaaagagaccuaaaugguuauauuugau

SEQ ID NO: 110095 - RNA, 64 nt, Homo Sapiens
auacuccuauuggaugaaaaucaaauacaguucuauuaaagaguuauuuguauggaauucuuau

SEQ ID NO: 110096 - RNA, 64 nt, Homo Sapiens
uugaguaugcuagcuaaaaaauaucaagugccugauuaaagaauugcuaaaugguugucaauac

SEQ ID NO: 110097 - RNA, 64 nt, Homo Sapiens
auuacagaaaguuaaguguauacuacaaacucuaauuaaagauaaaaaucuuuucuacuuuucu

SEQ ID NO: 110098 - RNA, 64 nt, Homo Sapiens
ggaaggcauauuuuguauguauaaauucaccacaauuaaagauuauucuugucaguccuugcua

SEQ ID NO: 110099 - RNA, 64 nt, Homo Sapiens
guaaguuuggcuuugugggaauagguguggagaaauuaaagagugaaggccauauuucauuuuu

SEQ ID NO: 110100 - RNA, 64 nt, Homo Sapiens
aaagcuaucagcuguauguuaaauuuuagcaaggauuaaagaaaguuugauuugaaauaaaagg

SEQ ID NO: 110101 - RNA, 64 nt, Homo Sapiens
auaauguugcuucuuauucauagugguauguagaauuaaagauaauguuuucauuccaaacugg

SEQ ID NO: 110102 - RNA, 64 nt, Homo Sapiens
gaaaaccuuccuuuucagauucccugucugcucaauuaaagauguuugaauccaaaggaaguca

SEQ ID NO: 110103 - RNA, 64 nt, Homo Sapiens
gcaaaagucaggaaagagguugugagcugauuggauuaaagaccuggcacuucaguaacucagc

SEQ ID NO: 110104 - RNA, 64 nt, Homo Sapiens
cucauggcaaguugaauggugagcuagcuuauaaauuaaagagcucugaacuguauucagaccg

SEQ ID NO: 110105 - RNA, 64 nt, Homo Sapiens
caagccaagugaggagccagagcuaacaccugacauuaaagaagcucuaaggaaaggaugcaug

SEQ ID NO: 110106 - RNA, 64 nt, Homo Sapiens
aagagaagauuuuaaagacuagaaauacucucccauuaaagaggagaugggaaaauuagugucu

SEQ ID NO: 110107 - RNA, 64 nt, Homo Sapiens
uauuuuaggauauuuuccucaacaucauguacguuaccuccaucucauguauuauaugugcugu

SEQ ID NO: 110108 - RNA, 64 nt, Homo Sapiens
uauauuauuggccauaguuacuugaacuacaaauuaccuccauguggggaaaaaagaugaaaaa

SEQ ID NO: 110109 - RNA, 64 nt, Homo Sapiens
gauauucuagacuuguuuuaguaauggaaacucuuaccuccacauauuauccuacagauguuuc

SEQ ID NO: 110110 - RNA, 64 nt, Homo Sapiens
cuagauuuguuucuguuuuauagauuuaauucaauaccuccacauagauguuuuuauauuacau

SEQ ID NO: 110111 - RNA, 63 nt, Homo Sapiens
cuugauauuaauaguugagagucccugaugcucagaucuuagcgcacucagaaaaaauaggca

SEQ ID NO: 110112 - RNA, 63 nt, Homo Sapiens
uccauacgcauuucaugaagucauguauguagaagaucuuaagacccugcccaugauuaaaca

SEQ ID NO: 110113 - RNA, 63 nt, Homo Sapiens
aguaugugaagaaaaucuacuuguaaaaggcucagaucuuaauuaaaagguaauuguagcaca

SEQ ID NO: 110114 - RNA, 63 nt, Homo Sapiens
agcaaugaauugugccuaguggagaaccucuauagaucuuaaaaaaugaauuauucuuuagca

SEQ ID NO: 110115 - RNA, 63 nt, Homo Sapiens
ggcuauauaggaagaaauauucaaaacuuccagagaucuuaauagugguuugaauaaaguaga

SEQ ID NO: 110116 - RNA, 63 nt, Homo Sapiens
ugcaguuauaaaaccgccacagucuuacauuuaagaucuuacacuuaauguagguaggcccag

SEQ ID NO: 110117 - RNA, 64 nt, Homo Sapiens; identical to SEQ ID NO: 102277

SEQ ID NO: 110118 - RNA, 64 nt, Homo Sapiens; identical to SEQ ID NO: 102278

SEQ ID NO: 110119 - RNA, 64 nt, Homo Sapiens; identical to SEQ ID NO: 102279

SEQ ID NO: 110120 - RNA, 64 nt, Homo Sapiens; identical to SEQ ID NO: 102280

SEQ ID NO: 110121 - RNA, 56 nt, Homo Sapiens; identical to SEQ ID NO: 102281

SEQ ID NO: 110122 - RNA, 64 nt, Homo Sapiens; identical to SEQ ID NO: 102282

SEQ ID NO: 110123 - RNA, 64 nt, Homo Sapiens; identical to SEQ ID NO: 102283

SEQ ID NO: 110124 - RNA, 64 nt, Homo Sapiens; identical to SEQ ID NO: 102284

SEQ ID NO: 110125 - RNA, 64 nt, Homo Sapiens; identical to SEQ ID NO: 102285

SEQ ID NO: 110126 - RNA, 64 nt, Homo Sapiens; identical to SEQ ID NO: 102286

SEQ ID NO: 110127 - RNA, 64 nt, Homo Sapiens; identical to SEQ ID NO: 102287

SEQ ID NO: 110128 - RNA, 64 nt, Homo Sapiens; identical to SEQ ID NO: 102288

SEQ ID NO: 110129 - RNA, 64 nt, Homo Sapiens; identical to SEQ ID NO: 102289

SEQ ID NO: 110130 - RNA, 64 nt, Homo Sapiens; identical to SEQ ID NO: 102290

SEQ ID NO: 110131 - RNA, 64 nt, Homo Sapiens; identical to SEQ ID NO: 102291

SEQ ID NO: 110132 - RNA, 64 nt, Homo Sapiens
acguuugaggaacaggagugggcacugauagaaaggacuucaacgccagugacuguguaccucc

SEQ ID NO: 110133 - RNA, 64 nt, Homo Sapiens
gcucacuucuagagagaagaaaaaggcuggguuuggacuucaugccuccucacuggugaaaccc

SEQ ID NO: 110134 - RNA, 64 nt, Homo Sapiens
acccugcugguacccagacccccaccuucggaggggacuucauguuccguguacguuugcaucu

SEQ ID NO: 110135 - RNA, 64 nt, Homo Sapiens
uaacuggccuccagccacauucucauagcagguaggacuucagccuuccagacacugcccuuag

SEQ ID NO: 110136 - RNA, 64 nt, Homo Sapiens
cccaggucagccaagaaagauacauaaucucaugggacuucagugggaguuacacaggaauguu

SEQ ID NO: 110137 - RNA, 64 nt, Homo Sapiens
acuugggguccaucaccccaggggguccauaguuggacuucagagggucuaugaaaccccuaaa

SEQ ID NO: 110138 - RNA, 64 nt, Homo Sapiens
guaccugucugaagagugacauuaaacuuugaaaggacuucacugcuccuuuacgauauuccaa

SEQ ID NO: 110139 - RNA, 64 nt, Homo Sapiens
agguuuauaaacuaucuuuuaaaauuuuaagccaggacuucaaaaauuguagaguacuuguuug

SEQ ID NO: 110140 - RNA, 64 nt, Homo Sapiens
ugaaugccggggacagagaggggcagguugaccgggacuucaaagccgugaucgugaauaucga

SEQ ID NO: 110141 - RNA, 64 nt, Homo Sapiens
aauaaauaaauccuccagucuggaucguuugacgggacuucagguucuuucugaaaucgccgug

SEQ ID NO: 110142 - RNA, 64 nt, Homo Sapiens
uccuugcaggagauggcgucuaccagaaggggauggacuucauuuuggagaagcucaaccaugg

SEQ ID NO: 110143 - RNA, 64 nt, Homo Sapiens
cuuucccucagguggagaugcggaaagcccugacggacuucauucaagaggaauuccagcaucu

SEQ ID NO: 110144 - RNA, 64 nt, Homo Sapiens
acuaagcuuccauagaaauacacuuuguaucuggaccucaaaauuaugggaacauuuacuuaaa

SEQ ID NO: 110145 - RNA, 64 nt, Homo Sapiens
caauuaugauaaaggacaaaauaagcuguuugccaccucaaaacuuuaugaacuucaccaccac

SEQ ID NO: 110146 - RNA, 64 nt, Homo Sapiens
guuaaacguagagugaccauaacaguuuggcaguaccucaaaaaauggugcaccugcuuugaaa

SEQ ID NO: 110147 - RNA, 64 nt, Homo Sapiens
guauuugccuuuaagcgaaccuaagauccuccugaccucaaagucucagaugggaaggguggug

SEQ ID NO: 110148 - RNA, 64 nt, Homo Sapiens
caaauuaguaugccauuuuccugucucuucauuuaccucaaacuccuucuuagauggccuaaau

SEQ ID NO: 110149 - RNA, 64 nt, Homo Sapiens
aaaguuucaaggauuaaagguggcccaauucucuaccucaaaggcuugcuuuucagcaguaguc

SEQ ID NO: 110150 - RNA, 64 nt, Homo Sapiens
aucgaaaauacugguugaaagguucagaugauagaccucaaaaaucguauuguuugccacugag

SEQ ID NO: 110151 - RNA, 64 nt, Homo Sapiens
guccaguagagggcaguccaccugcuggcugaauaccucaaauauaccuuuuuagucacauuga

SEQ ID NO: 110152 - RNA, 64 nt, Homo Sapiens
uuagcaucucuguggagcugucucugacacuuagaccucaaacucucauaaaaauugucagcuc

SEQ ID NO: 110153 - RNA, 64 nt, Homo Sapiens
gccuucuguauuguguaagcuuauuuaucauguaaccucaaagucugccucuauuaauguauuu

SEQ ID NO: 110154 - RNA, 64 nt, Homo Sapiens
cucucacuaccguggaccacgcuagucuucccuuaccucaaaggaaugguaguuagcaacuagg

SEQ ID NO: 110155 - RNA, 64 nt, Homo Sapiens
aaaaaaaaagaauccaauacaagagugagacuccaccucaaaaacggcacuccagccuggcgac

SEQ ID NO: 110156 - RNA, 64 nt, Homo Sapiens
uuucaguaggaauguugcuauucuacguaggccaaccucaaaacugugaggcauaaaugcuucc

SEQ ID NO: 110157 - RNA, 64 nt, Homo Sapiens
ggcuccuaaucuccagcuuuugugggccaucacgaccucaaacuggaaucucagggucccaggc

SEQ ID NO: 110158 - RNA, 64 nt, Homo Sapiens
cucugcuguccaguaggcugcuucucugagggucaccucaaagguaugcuaugccguguggcuc

SEQ ID NO: 110159 - RNA, 64 nt, Homo Sapiens
cacagagggcaccacugagaacugcgugcauaggaccucaaaauacaaaauuagcagggccuca

SEQ ID NO: 110160 - RNA, 64 nt, Homo Sapiens
auauaggaagaacgcgguguguaacacuguguacaccucaaauaccaccccaacccacucccug

SEQ ID NO: 110161 - RNA, 64 nt, Homo Sapiens
guaucaguuuccaugaaagaccugaauaccacuuaccucaaauuaagcauauguguuacuucaa

SEQ ID NO: 110162 - RNA, 64 nt, Homo Sapiens
acuguaauauuuaaauauuacccuccaagucuguaccucaaaugaauucuuuaaggagauggac

SEQ ID NO: 110163 - RNA, 64 nt, Homo Sapiens
auccgcugucuuguccucccgucucgaacuccugaccucaaaugucaccauguuggccagacug

SEQ ID NO: 110164 - RNA, 64 nt, Homo Sapiens
uaauuuaguuacauucuuaaauguauuaugaaauaccucaaaaguacuauuuaaaauacccaac

SEQ ID NO: 110165 - RNA, 64 nt, Homo Sapiens
guuuuuuuaacgucagccagauauuuagaaaauaaccucaaaaguguuuauauggucagugagc

SEQ ID NO: 110166 - RNA, 64 nt, Homo Sapiens
ucccacuggaaaguaaacaaaaccaucccucccaaccucaaagcuaggccacacucuauuucaa

SEQ ID NO: 110167 - RNA, 64 nt, Homo Sapiens
aaccaccaggcacacggggccagguacgacgaccagguaccagacccagccuggguagagccac

SEQ ID NO: 110168 - RNA, 64 nt, Homo Sapiens
cugggcacugguggccgccucuggcaccugcggcagguaccagccagaucagaagaggugcagg

SEQ ID NO: 110169 - RNA, 64 nt, Homo Sapiens
uauagacuuaaucugcuuuuugucccauuugacaagguaccaggaggaaauuuuuuaagggauc

SEQ ID NO: 110170 - RNA, 64 nt, Homo Sapiens
acagacuuuugaguuuauaugcaaugccuucauuagguaccaccggcacuuacaaaaugugcgg

SEQ ID NO: 110171 - RNA, 64 nt, Homo Sapiens
uacagauguaauuuccuuuuuguugucaaacauaagguaccaaauaugaugcaauaaauuguuu

SEQ ID NO: 110172 - RNA, 64 nt, Homo Sapiens
guccuaccucugccacuaaugagguguuuggaggagguaccagccauauaauaggggguguaug

SEQ ID NO: 110173 - RNA, 64 nt, Homo Sapiens
acccuaaaaccagaccacuccacgcaggacaggcaggagagauucuuccuaaagccucccccau

SEQ ID NO: 110174 - RNA, 64 nt, Homo Sapiens
uugcuucauuggcccugggacuucucucugcaggaggagagaacgcugccucuccucuggauug

SEQ ID NO: 110175 - RNA, 64 nt, Homo Sapiens
ucccuuuucuccaugcuuaauggugugaggcgucaggagagaggccaaguacauaaaaaaaaaa

SEQ ID NO: 110176 - RNA, 64 nt, Homo Sapiens
ccggccugaaagcccucccugcaagaaggugugcaggagagaagaggccccggcauggggaucu

SEQ ID NO: 110177 - RNA, 64 nt, Homo Sapiens
aggagaggagagcaucugcucugagacggauggaaggagagagguugaggaugcacuggccugu

SEQ ID NO: 110178 - RNA, 64 nt, Homo Sapiens
ggagagagguugaggaugcacuggccuguucuguaggagagacuggccagaggcagcuaagggg

SEQ ID NO: 110179 - RNA, 64 nt, Homo Sapiens
augguuuuuuuucuuguguucuaguuuccauaauaggagagaaaauauagaaauauaugcaaaa

SEQ ID NO: 110180 - RNA, 64 nt, Homo Sapiens
gcuguuaggccugcuguucccuuugcucuugauuaggagagauggaaggagaugagcucccaua

SEQ ID NO: 110181 - RNA, 64 nt, Homo Sapiens
gcagagaagaggagggguguaggagagagggcacaggagagaggccuggaaccaacaggggcug

SEQ ID NO: 110182 - RNA, 64 nt, Homo Sapiens
gcacaggagagagggcagagaccaacaggggcugaggagagagggggacgcaucucagccugga

SEQ ID NO: 110183 - RNA, 64 nt, Homo Sapiens
gaggcuguugugugcgcggaugaggggagguggcaggagagaauucuacauuuaggggguuagg

SEQ ID NO: 110184 - RNA, 64 nt, Homo Sapiens
accucuagcggugaagggggaaggggaagaggaaaggagagaaguggucggugucuguuuccuu

SEQ ID NO: 110185 - RNA, 64 nt, Homo Sapiens
acugagccccgcagaccuccccagccccuagcccaggagagagaaagccaggcagguagccagg

SEQ ID NO: 110186 - RNA, 64 nt, Homo Sapiens
cgaaggugcuggaggugggagcaggagauugagaaggagagaaagugggugagaugcuggagaa

SEQ ID NO: 110187 - RNA, 64 nt, Homo Sapiens
gagaaagugggugagaugcuggagaagagaggagaggagagaggcagagagcggucucaggcug

SEQ ID NO: 110188 - RNA, 64 nt, Homo Sapiens
ccagggucuguaagcugguuggaggacacaucauaggagagaauagcgauugaguugggcuuua

SEQ ID NO: 110189 - RNA, 64 nt, Homo Sapiens
ucuucugcaccgccuggcuacacgcaggugugagaggagagaccagguccugaugucaucacug

SEQ ID NO: 110190 - RNA, 64 nt, Homo Sapiens
aagguaauuacaacacucagccuuaaaucguggcaggagagauuaaguguugaagcugugcucc

SEQ ID NO: 110191 - RNA, 64 nt, Homo Sapiens
aaagguaguuacuguuuucacauagaaugauccaaggagagaaaaaggugucuugguuugaugu

SEQ ID NO: 110192 - RNA, 64 nt, Homo Sapiens
ccuuccaaauccugguucagauggaagaaauagcaggagagaggacccauuagcuggcagaccc

SEQ ID NO: 110193 - RNA, 64 nt, Homo Sapiens
gggccuuauguggagcagagguugucucugaaccaggagagaagguacuauaccuuucaaaucc

SEQ ID NO: 110194 - RNA, 64 nt, Homo Sapiens
auucucaccaacccgcugccuucuucuucucuuaaggagagauuaaacuccuuccgccccaggu

SEQ ID NO: 110195 - RNA, 64 nt, Homo Sapiens
aggcccgucagagucaagaggucccagggaaucuaggagagauguuuguagcuuuucacccucu

SEQ ID NO: 110196 - RNA, 59 nt, Homo Sapiens
ccgagcccacgggcgacugacagcucugcaggagagauugcaacaccaucccacacugu

SEQ ID NO: 110197 - RNA, 64 nt, Homo Sapiens
caggccuuaacugagagggacagaagacgcuggaaggagagaaggaagcgggaagugugcuucu

SEQ ID NO: 110198 - RNA, 64 nt, Homo Sapiens
aguugcggggggcaucucuuaauccugggguaaaaggagagauugccauacuuagacucacugu

SEQ ID NO: 110199 - RNA, 64 nt, Homo Sapiens
gaagugagagaguaugguggcaauaucacaagggaggagagaggaaaacaauuaucuucucuac

SEQ ID NO: 110200 - RNA, 64 nt, Homo Sapiens
uaauuuagcauucugagaugagugucagguuuucaggagagaaugaguuggggugagcccagag

SEQ ID NO: 110201 - RNA, 62 nt, Homo Sapiens
cuucaauaauguucaacugaaucucacagaugaggagagagaagaaacggaagaggaaguuu

SEQ ID NO: 110202 - RNA, 64 nt, Homo Sapiens
gcugguggaauggaggaguuguuuggggagggaaaggagagagaaggaaaggagugagguauuu

SEQ ID NO: 110203 - RNA, 64 nt, Homo Sapiens
gacagguucuguugggggugucaggggugacaccaggagagaggggagagagggacagguucug

SEQ ID NO: 110204 - RNA, 64 nt, Homo Sapiens
gacagguucugucaggggugucgggggugacaccaggagagaggggagacagggacagguucug

SEQ ID NO: 110205 - RNA, 64 nt, Homo Sapiens
gacagguucuguugggggugucaugggugacaccaggagagaggggacacagggacagguucua

SEQ ID NO: 110206 - RNA, 64 nt, Homo Sapiens
gacagguucugucaggggugacaaccugcaaaccaggagagaggauuugugaauaacaaacugc

SEQ ID NO: 110207 - RNA, 64 nt, Homo Sapiens
auguaccucuucuacuggaagcaagaagacaaaaaggagagaaauuauuauggugauuauacag

SEQ ID NO: 110208 - RNA, 64 nt, Homo Sapiens
cagaaaacauagauccgaggauuggaguggggcgaggagagagcugggguugggggcuaaauua

SEQ ID NO: 110209 - RNA, 64 nt, Homo Sapiens
aaaaccagggcgguagaacucaggcaccauguugaggagagaugcuaccuggacauugagccuc

SEQ ID NO: 110210 - RNA, 64 nt, Homo Sapiens
uugggaaagggagauggagagugggagaggggagaggagagaguuuccggggaacaaugacggg

SEQ ID NO: 110211 - RNA, 64 nt, Homo Sapiens
gcauaaaaauauagcauauaaaucauagacuuugaggagagaaaaugcauaagugccauccuuu

SEQ ID NO: 110212 - RNA, 64 nt, Homo Sapiens
cuuaaaauuaaaauaguauuuaaacacaucauggaggagagaaacuuacuuguaacagcguaau

SEQ ID NO: 110213 - RNA, 64 nt, Homo Sapiens
ucucuauggcuucccugagaaaggugaggcccaaaggagagaggccuucaaacugucccagguc

SEQ ID NO: 110214 - RNA, 64 nt, Homo Sapiens
agcucugugaucagaaggaaauuggguccaguguaggagagagcugguccugggccuggcaggc

SEQ ID NO: 110215 - RNA, 64 nt, Homo Sapiens
aggcuaaauagagaggaguuggaucucaggacuaaggagagagaccaguugcucaacuacugca

SEQ ID NO: 110216 - RNA, 64 nt, Homo Sapiens
caaagagaacuuccagguaacaagagcuucucucaggagagaaucggggagugguggugcuggc

SEQ ID NO: 110217 - RNA, 64 nt, Homo Sapiens
cuuaucucugcccuccuuuagaacuccuuuccccaggagagagcucugaggucauuuuugugua

SEQ ID NO: 110218 - RNA, 64 nt, Homo Sapiens
guucuuauuuggaagcagcucugacaggauuuaaaggagagaauaagcagcaaccucugcaggg

SEQ ID NO: 110219 - RNA, 64 nt, Homo Sapiens
gcuuagacagaguugaucuguagaauaucuuuaaaggagagaugucaacuuucugcacuauucc

SEQ ID NO: 110220 - RNA, 64 nt, Homo Sapiens
caacauucauucaauacuguuauaucagaggaguaggagagaggaaacauuugacuuaucugga

SEQ ID NO: 110221 - RNA, 64 nt, Homo Sapiens
cugggucaaguaagcuuaucuucugauauggacuaggagagagaaaaaccuguuugaaucuugg

SEQ ID NO: 110222 - RNA, 62 nt, Homo Sapiens
gcuuguccccugcccugaagcccuuuccuaucaggagagaugagacucuacucaaccccuga

SEQ ID NO: 110223 - RNA, 64 nt, Homo Sapiens
aaacuuagugcuuccagcccuuuccuucccccucaggagagagauccuccugcaucuccccuuc

SEQ ID NO: 110224 - RNA, 64 nt, Homo Sapiens
ucuuggaacgcucaucccccugcagacaccuagaaggagagacugcccagcaccaugaguuggg

SEQ ID NO: 110225 - RNA, 64 nt, Homo Sapiens
uaguagggcaagaucaaagcaagcuuuggagaaaaggagagaaugucaaaacuggaauuuucua

SEQ ID NO: 110226 - RNA, 64 nt, Homo Sapiens
gaagugcuggcuaggaggucagcccaagcuggucaggagagacaaacaggauaaauucagugau

SEQ ID NO: 110227 - RNA, 64 nt, Homo Sapiens
ucaggcucacugcccuuauugugauaaggguaagaggagagauggccgugccagcugugcccua

SEQ ID NO: 110228 - RNA, 64 nt, Homo Sapiens
aacuguucuuucuuuuuuuucccagagggaugagaggagagagcauagaucucucccacuagag

SEQ ID NO: 110229 - RNA, 64 nt, Homo Sapiens
aggagaccagucaguacuucuuggagggggcaggaggagagaggaaaagggagggcgagaauga

SEQ ID NO: 110230 - RNA, 64 nt, Homo Sapiens
gcacaaccucgaguucuuggggcgcagagaacuuaggagagaagcacggaggagcccccggcag

SEQ ID NO: 110231 - RNA, 64 nt, Homo Sapiens
gcuggggagggcugggcagcgugggaaagguaggaggagagaagagccuggaaggaggcaauaa

SEQ ID NO: 110232 - RNA, 64 nt, Homo Sapiens
uuuugcucugggucuccaguaggaggaugaagggaggagagagcucugaaaucacauggugaga

SEQ ID NO: 110233 - RNA, 64 nt, Homo Sapiens
ugagauauuuuaaaauauugccuccguuuuaucgaggagagaaauaauaacuaaaaaauauacc

SEQ ID NO: 110234 - RNA, 64 nt, Homo Sapiens
gguuguggacucagcuccugugaggggucugguuaggagagagccauuuuuaaggacagggagu

SEQ ID NO: 110235 - RNA, 64 nt, Homo Sapiens
ugaugcgcugggaucugauugaggauaaaaaggaaggagagaugaccccuacccccucaucccc

SEQ ID NO: 110236 - RNA, 64 nt, Homo Sapiens
uccccucagagcccaugguaacgaaccccuagaaaggagagaacgggcgucaggggugcacagu

SEQ ID NO: 110237 - RNA, 64 nt, Homo Sapiens
cagagagggagagaggcagagagacaggcagagaaggagagagggaaagaggcagagaaggaaa

SEQ ID NO: 110238 - RNA, 64 nt, Homo Sapiens
gacagaggaggcagagaggggggagagagauaugaggagagagaagaaagagagguggggagag

SEQ ID NO: 110239 - RNA, 64 nt, Homo Sapiens
aggggcugcuggacccaaggcggcaguucccugcaggagagaggcacccagaggaggagagagc

SEQ ID NO: 110240 - RNA, 64 nt, Homo Sapiens
cggcaguucccugcaggagaucagcacccagaggaggagagagcggcguccccucccucugucu

SEQ ID NO: 110241 - RNA, 64 nt, Homo Sapiens
ggggauguauccaugggggcgaagaugcugaaacaggagagaaaaggaagugacucauccucuu

SEQ ID NO: 110242 - RNA, 64 nt, Homo Sapiens
gggaggagggcggggggcacuagaaugaggaggaaggagagaaggcauggccagcagcuugcgu

SEQ ID NO: 110243 - RNA, 64 nt, Homo Sapiens
ugggauugugggugacuuuuugucuccaggucaaaggagagagggccaaaauguugacaaugac

SEQ ID NO: 110244 - RNA, 64 nt, Homo Sapiens
cuugcuugggauauagaaagauucagggaggcuaaggagagaggcgcccggagcagggacuguc

SEQ ID NO: 110245 - RNA, 64 nt, Homo Sapiens
gggccaaucuguagggguaggaacucccuuuuguaggagagaaaagaaagauuguuaauccuau

SEQ ID NO: 110246 - RNA, 64 nt, Homo Sapiens
agcuuugaggaauguggaaaugcaaagugauuucaggagagagcgcaaauuggucaacaaaauu

SEQ ID NO: 110247 - RNA, 64 nt, Homo Sapiens
uacugacuuguuaucaucucuccuuagaacccccaggagagagcccauaggacauuucacacag

SEQ ID NO: 110248 - RNA, 64 nt, Homo Sapiens
ggugagccugaagauggucccaugccacugagcaaggagagaugaagcucccacccugggacag

SEQ ID NO: 110249 - RNA, 64 nt, Homo Sapiens
caccuaagcccagagcaaggaacagguauaauaaguggaaaaucuuggaauaaguauaauuauc

SEQ ID NO: 110250 - RNA, 64 nt, Homo Sapiens
cauacaggagaaaggcccuauccaugucaagcuuguggaaaaagauuuagcaggcuagaccauc

SEQ ID NO: 110251 - RNA, 64 nt, Homo Sapiens
acucaccuggcaucuuacauagcuuaagaaauuuguggaaaauaaauuuuuuuuuccaguaaug

SEQ ID NO: 110252 - RNA, 64 nt, Homo Sapiens
guugcuucagaaaagacuucagcccuaagcaugaguggaaaauccuccaaaugcuacaguacaa

SEQ ID NO: 110253 - RNA, 64 nt, Homo Sapiens
ucaagucagacucaguggcagauuuuugcauuugguggaaaaccggguguucaaggucaggagu

SEQ ID NO: 110254 - RNA, 64 nt, Homo Sapiens
aaggauuucccuggccccgcgauguuuccaccauguggaaaagcugcacuguaaauccggcauu

SEQ ID NO: 110255 - RNA, 64 nt, Homo Sapiens
gugcuuuuauuuuaugggccuuuagguucuguaaguggaaaaaugaacucuuacuaaaaugagu

SEQ ID NO: 110256 - RNA, 64 nt, Homo Sapiens
aaucgugucaaucuggaugaaaggcacugaagagguggaaaaaugaauguauguugcguauccc

SEQ ID NO: 110257 - RNA, 64 nt, Homo Sapiens
uuagaaacuacagaguuugcuuagaaacuucuauguggaaaauauugguacuauguggaaaaua

SEQ ID NO: 110258 - RNA, 64 nt, Homo Sapiens
uuagaaacuucuauguggaagcuguugguacuauguggaaaauauuucauaucuuggauuugca

SEQ ID NO: 110259 - RNA, 64 nt, Homo Sapiens
aguguggggugccagaaagugucugcugauauuuguggaaaaaaaaucuauuuuguuuaccuac

SEQ ID NO: 110260 - RNA, 64 nt, Homo Sapiens
aagaaauguauauacugacagaagauauuugaaaguggaaaauuggaaaugaaauauguugcug

SEQ ID NO: 110261 - RNA, 64 nt, Homo Sapiens
cuucuuaguugucuugucuuaacaagaguaaaugguggaaaaugagaguugaacuauuuuugau

SEQ ID NO: 110262 - RNA, 64 nt, Homo Sapiens
agccauuaguucaggaaacugugcuaauuuuuuuguggaaaagucuagucaguccauaaagauu

SEQ ID NO: 110263 - RNA, 64 nt, Homo Sapiens
cuauuauuaagagaacaagcuaauguacacauuuguggaaaaugaugcaacuugucuauguaaa

SEQ ID NO: 110264 - RNA, 64 nt, Homo Sapiens
agguucagaugcagaagaauugcauuauagcaugguggaaaauacugugaaguuguguauuuaa

SEQ ID NO: 110265 - RNA, 64 nt, Homo Sapiens
gguugaaauaucuugguauccaggauaaggguauguggaaaaacaggcuuuaggcaaguggaaa

SEQ ID NO: 110266 - RNA, 64 nt, Homo Sapiens
gauaaggguauguggaaaaacaggcuuuaggcaaguggaaaauucaaaaugugcugugaaagga

SEQ ID NO: 110267 - RNA, 64 nt, Homo Sapiens
gaggagacuggccccacuucuaugggucugagcuguggaaaagggagagcagagaggaacugag

SEQ ID NO: 110268 - RNA, 64 nt, Homo Sapiens
uugcuggcugugcugccagggacccgcagcccugguggaaaagccaguagcacauacgcagggc

SEQ ID NO: 110269 - RNA, 64 nt, Homo Sapiens
aaaaucauuuucuuuuuuuuuuuuuuuuucuguuguggaaaagcgugaauuuguuauuaagcau

SEQ ID NO: 110270 - RNA, 64 nt, Homo Sapiens
cauuuucagacauuuuuggaaauuuccauuaaagguggaaaaucuauuuuuuuccuccuuugca

SEQ ID NO: 110271 - RNA, 64 nt, Homo Sapiens
guguguugcugucagaauauucuuuuuauauucuguggaaaaauaaaggaaauucagauuguuu

SEQ ID NO: 110272 - RNA, 64 nt, Homo Sapiens
ugacucugugugucugcaacgagaugaugcugcaguggaaaacccagcaaugacucaggcauca

SEQ ID NO: 110273 - RNA, 64 nt, Homo Sapiens
ggugacagugagaauauaaaugagguuugccuuuguggaaaacugacaguucugugcuucacca

SEQ ID NO: 110274 - RNA, 64 nt, Homo Sapiens
cauuucagagaaaagcccuauacguguagugaauguggaaaagacuucagauugaauucacauc

SEQ ID NO: 110275 - RNA, 64 nt, Homo Sapiens
cacacaggagagaaagcacaugaauguaaugaauguggaaaagcuuucagucaaaccucaugcc

SEQ ID NO: 110276 - RNA, 64 nt, Homo Sapiens
aacauacuacaggaauauuaugucuguaaucaguguggaaaagccuuuauuuauauuuaccacu

SEQ ID NO: 110277 - RNA, 64 nt, Homo Sapiens
auuuuuccagugagaaaacuaucuugacaggauaguggaaaaaccuucaggcagcuuuuauguc

SEQ ID NO: 110278 - RNA, 64 nt, Homo Sapiens
uuuauuuuuuaucacaagcaccuuugaaauguacguggaaaacgucggcugcucgugagaauca

SEQ ID NO: 110279 - RNA, 64 nt, Homo Sapiens
ccucagugcagagccugaaguuggggguuuagggguggaaaaggcuucgugaaauguuaaugau

SEQ ID NO: 110280 - RNA, 64 nt, Homo Sapiens
agcaauuuugugugggucauuguucugucaauuuguggaaaaaauuacuucagucucauauaaa

SEQ ID NO: 110281 - RNA, 64 nt, Homo Sapiens
aaaaguucuaaugguuuuuaaaaaccaguguugaguggaaaaguguuucuuuaguuuggaaaga

SEQ ID NO: 110282 - RNA, 64 nt, Homo Sapiens
aauuuggaccauacacuauguuacaaaacuaaaaguggaaaaaacuuauuggugaaugaauaua

SEQ ID NO: 110283 - RNA, 64 nt, Homo Sapiens
cauauaagacagaaacccuauggguguaaugaauguggaaaaucauucugugugaagucaagag

SEQ ID NO: 110284 - RNA, 64 nt, Homo Sapiens
uugaguugcaggauaucuagcaauuuaagaaaauguggaaaaaauauuuuuauugagaaauagc

SEQ ID NO: 110285 - RNA, 64 nt, Homo Sapiens
cccaaauguuuauuaaguagcuagaaauaauuauguggaaaaaaaugaauaauggaaaauagug

SEQ ID NO: 110286 - RNA, 64 nt, Homo Sapiens
accgacuacacaauuauguaccaucacaguauuaguggaaaaguaccaugugauuuaauucucc

SEQ ID NO: 110287 - RNA, 64 nt, Homo Sapiens
acuaucggaauaacucugcaugugaugugccaugguggaaaaguaugcaguuaauuuuaacaug

SEQ ID NO: 110288 - RNA, 64 nt, Homo Sapiens
guaagguuauuuuguguuuuucugaucauuguugguggaaaaaccaagucagaggagugggagg

SEQ ID NO: 110289 - RNA, 64 nt, Homo Sapiens
uaugcugauuuauuuaaggguauuguuacauuauguggaaaacuuuugcaaggugcauuuuuac

SEQ ID NO: 110290 - RNA, 64 nt, Homo Sapiens
agcauguacggauuuucaguaggucagagcagagguggaaaaacugucgcucucaguucucgau

SEQ ID NO: 110291 - RNA, 64 nt, Homo Sapiens
cuggaagugugacggagcaggcgggcugaggagaguggaaaaggaagcgacccagaaauggcag

SEQ ID NO: 110292 - RNA, 64 nt, Homo Sapiens
gcuugggauuagcuugggagcgcagcgcugcaaaguggaaaauaugaaaagaccacacaggccc

SEQ ID NO: 110293 - RNA, 64 nt, Homo Sapiens
aauccaaaccuuccugaacgcuaugacaccaugaguggaaaauuccacaccuaacaaacacauu

SEQ ID NO: 110294 - RNA, 64 nt, Homo Sapiens
ugugucuuugacagcuagugucuaguguaugaaaguggaaaaggacauuucuguaguagcuguu

SEQ ID NO: 110295 - RNA, 64 nt, Homo Sapiens
gcaguaaaguguauauauuaugcaguuucucuaaguggaaaaacuugacaugacuuuaauagug

SEQ ID NO: 110296 - RNA, 64 nt, Homo Sapiens
cacauggcucuuucuucuccagacuccauuccagguggaaaaaguucccagcucagcaugacag

SEQ ID NO: 110297 - RNA, 64 nt, Homo Sapiens
aaagguguagcacuuucagauaacaaguuuacuuguggaaaagauuuguaacaacaaucagcca

SEQ ID NO: 110298 - RNA, 64 nt, Homo Sapiens
agauucaggcccugagaggugcaucauuuaucuuguggaaaagauuccuguguguguggccuuu

SEQ ID NO: 110299 - RNA, 64 nt, Homo Sapiens
guguucauuuuuuuugggggguguguguguauguguggaaaaugccacaggaaacaaacuuuau

SEQ ID NO: 110300 - RNA, 64 nt, Homo Sapiens
cauacagcugagaaacccuaugaauguaaggaauguggaaaagccuucagcaggaaagaaaauc

SEQ ID NO: 110301 - RNA, 64 nt, Homo Sapiens
cauacgggugagaaacccuaugcauguacaguauguggaaaagccuuuagucagaaaucaaacc

SEQ ID NO: 110302 - RNA, 64 nt, Homo Sapiens
cacacaggagaaaggccuuaugaaugcguugaguguggaaaaucauuucgccgaagcucuucac

SEQ ID NO: 110303 - RNA, 64 nt, Homo Sapiens
cacacuggagaaaggccauaugaaugcauugauuguggaaaaucauuucgccacaguucuucgu

SEQ ID NO: 110304 - RNA, 64 nt, Homo Sapiens
cuucaguuuccuuacaggcuugaauguaaagaauguggaaaacccauacuggagagaaacccua

SEQ ID NO: 110305 - RNA, 64 nt, Homo Sapiens
auuuagauacuacuacucagugaguguaaaaaauguggaaaagccacacuggagauaaacccuu

SEQ ID NO: 110306 - RNA, 64 nt, Homo Sapiens
cuacauaucuucuguagguuugaauguaaacaauguggaaaaaccacacuguacagaaacgcua

SEQ ID NO: 110307 - RNA, 64 nt, Homo Sapiens
auuccgauaccaccaaucuguaaguguaaagaauguggaaaagccacacuggagauaaacccuu

SEQ ID NO: 110308 - RNA, 64 nt, Homo Sapiens
cuugagccaucauucaucccggaaagcaguguauguggaaaaguccuucuggaggaaagcuuug

SEQ ID NO: 110309 - RNA, 64 nt, Homo Sapiens
acuuuccauacaccagguucuuucuacaauccugguggaaaagccacagaaccuucuuccugcc

SEQ ID NO: 110310 - RNA, 64 nt, Homo Sapiens
ugccaccucuccacccaggaggccauguagcauaguggaaaaagucccugagggcgguuaggag

SEQ ID NO: 110311 - RNA, 64 nt, Homo Sapiens
gaaaugcaagguaauuuuguucggguguucugauguggaaaaaauacaauuuauagaaauagua

SEQ ID NO: 110312 - RNA, 64 nt, Homo Sapiens
ugauucuuccuaaacuaacauacuaccuaccauuguggaaaaggagaugauguagauguugccc

SEQ ID NO: 110313 - RNA, 64 nt, Homo Sapiens
aaacagucuauaauaaacuuuucuaguucugaaaguggaaaauguugcaguguauuuuugcauu

SEQ ID NO: 110314 - RNA, 64 nt, Homo Sapiens
aguuaccucauugcuuaccaguauuucacaaguaguggaaaaccgaccuauucaggaccauaua

SEQ ID NO: 110315 - RNA, 64 nt, Homo Sapiens
aagcacgggagaaauccacggccgguuuaagucuguggaaaaggauguuauccuuacguccuga

SEQ ID NO: 110316 - RNA, 64 nt, Homo Sapiens
gaaagagauuugagaagugauugacaccuagaagguggaaaaagucagagaccauccacugucu

SEQ ID NO: 110317 - RNA, 64 nt, Homo Sapiens
gaacccggcuguugccuuaaaugugugagagggacuuggccaaggcaaaagcuggggagaugcc

SEQ ID NO: 110318 - RNA, 64 nt, Homo Sapiens
agcacagcucucaggcccagcccugggcgaccuccuuggccaagucugccuuucacccuggggu

SEQ ID NO: 110319 - RNA, 64 nt, Homo Sapiens
uugaugugcaguauugcaccacagcucugcggaccuuggccauugccgcagucgcagcuuccuu

SEQ ID NO: 110320 - RNA, 64 nt, Homo Sapiens
uuucccuugagagagaguggugaucuagggguuucuuggccacaccucuuccucccacugcagc

SEQ ID NO: 110321 - RNA, 64 nt, Homo Sapiens
ggucacuuccaagccuggugcuuuuaugucagcucuuggccaguuuccuguuuggggaaguugg

SEQ ID NO: 110322 - RNA, 64 nt, Homo Sapiens
gcagaacuuggcaucugaaccaccucugacucagcuuggccaaucccacaugggagucucccag

SEQ ID NO: 110323 - RNA, 51 nt, Homo Sapiens
ccagcugcaaaccuggccaggcuuggccaaggccugcauccuacagaguga

SEQ ID NO: 110324 - RNA, 64 nt, Homo Sapiens
cccaguagccaggauaccugauggccacgugugccuuggccacgggaggcugcugagauuggcc

SEQ ID NO: 110325 - RNA, 64 nt, Homo Sapiens
gcccagcguuuaccacugcugucaagccacagcccuuggccaccauacgggccauccucaguga

SEQ ID NO: 110326 - RNA, 64 nt, Homo Sapiens
cuggcucagcucucaauuuaaauugcuucacagccuuggccaucaaaugaccaaauccauggau

SEQ ID NO: 110327 - RNA, 64 nt, Homo Sapiens
uagaggaaaagauauggaguguugcacugaaacucuuggccaugauccgugacagcacuuuccu

SEQ ID NO: 110328 - RNA, 64 nt, Homo Sapiens
gggggccugcgucccugcacacugcgaggacugccuuggccacaggcccacucccuacgacacg

SEQ ID NO: 110329 - RNA, 64 nt, Homo Sapiens
cuucuguuuacucugcaaauguaagaaagaaccacuuggccagaagugucccccagaugcuuuu

SEQ ID NO: 110330 - RNA, 64 nt, Homo Sapiens
caagacacagcagaggucaaaggcaguggagagccuuggccaguucagugacagcuucuggcug

SEQ ID NO: 110331 - RNA, 64 nt, Homo Sapiens
gcuauuuacuugggaaaguauuuuucuuacaguucuuggccacaguuuuuuugcugaggguuuc

SEQ ID NO: 110332 - RNA, 64 nt, Homo Sapiens
aaacucccagcagccccuacagagguggcacaugcuuggccacacaucuacucccugcccacac

SEQ ID NO: 110333 - RNA, 64 nt, Homo Sapiens
uuuagggcuuugguuuucauuccuuuuuguuuggcuuggccaaaccagaauucagcuuaucuga

SEQ ID NO: 110334 - RNA, 64 nt, Homo Sapiens
acucuuggcugugcuggccaggugacuccuaguucuuggccacaucaucagaaagucaaagguc

SEQ ID NO: 110335 - RNA, 64 nt, Homo Sapiens
ccuuccuuccacuccccucccugccagagucugucuuggccagugccagccucgaugcuuuggu

SEQ ID NO: 110336 - RNA, 64 nt, Homo Sapiens
cuuuuuucuuuuuuuccccuccaaacuccuuuuccuuggccaagccuucaugcuucccccuuuc

SEQ ID NO: 110337 - RNA, 64 nt, Homo Sapiens
cuccaccacggcuucccucuuggcucauuccaagcuuggccaaauuggggaagugggauggagg

SEQ ID NO: 110338 - RNA, 64 nt, Homo Sapiens
ccugggguuuucagaugcacauucaguguugcuucuuggccauguucgacagaugcugagacca

SEQ ID NO: 110339 - RNA, 64 nt, Homo Sapiens
uccaugcucccagggacuugcagacgaugcauuucuuggccaaaguggcuuccucaagaaagca

SEQ ID NO: 110340 - RNA, 64 nt, Homo Sapiens
gcagauaagacagcauaggugauggcugcuuggucuuggccacagugcucucagccagcacuaa

SEQ ID NO: 110341 - RNA, 64 nt, Homo Sapiens
accuggccaggacccccuucggcacccaguugcccuuggccaccaccuguggcaggacucaagc

SEQ ID NO: 110342 - RNA, 64 nt, Homo Sapiens
aacccagccugccugggcucugaccacuaacacucuuggccauggacagccugcacaggaccgc

SEQ ID NO: 110343 - RNA, 64 nt, Homo Sapiens
ccauggacagccugcacaggaccgccucccugcucuuggccacugugcucccauuucuguccuu

SEQ ID NO: 110344 - RNA, 64 nt, Homo Sapiens
gcuuuuaaacaucugguuugggagagaccaucgacuuggccagugagacugagaauggauuccg

SEQ ID NO: 110345 - RNA, 64 nt, Homo Sapiens
aaguaugcaggcaggucugguccgagggggcuggcuuggccaugccuuucugugccuuuaauga

SEQ ID NO: 110346 - RNA, 64 nt, Homo Sapiens
ucgucucccuugucugcccugugugacccucagucuuggccagccaugcaugcgcccgaagcuc

SEQ ID NO: 110347 - RNA, 64 nt, Homo Sapiens
cucuccucccugccaccaugcucaucacucuggccuuggccaugcucccuggucaccccacuuc

SEQ ID NO: 110348 - RNA, 64 nt, Homo Sapiens
acaggcuacucagagcugaggggccccugggacccuuggccaucaggcgaggggcugggccugu

SEQ ID NO: 110349 - RNA, 64 nt, Homo Sapiens
aucaggcgaggggcugggccugugcagcugggcccuuggccagaguccacucccuuccuggcug

SEQ ID NO: 110350 - RNA, 64 nt, Homo Sapiens
acaggcucaggccaaagaccucauucuggaugggcuuggccaaacuagccuucuuuuguacuuu

SEQ ID NO: 110351 - RNA, 64 nt, Homo Sapiens
cuggucuugaacuccugacccggggcuucaccaucuuggccaggguuuguauuuuuaguagaga

SEQ ID NO: 110352 - RNA, 64 nt, Homo Sapiens
auguuucaaaggaagaaccagucaccuuucacuucuuggccaaauuuuauccugagaaugcuga

SEQ ID NO: 110353 - RNA, 64 nt, Homo Sapiens
caaguagcugggacuacaggcaugcaccaccacacuuggccaauguucuguauuuuuaauaggg

SEQ ID NO: 110354 - RNA, 64 nt, Homo Sapiens
caccauccagugagcgagggaugcuggggcggggcuuggccagugccuucagggagguggcccc

SEQ ID NO: 110355 - RNA, 64 nt, Homo Sapiens
aaucauuguacuguaaaagccuagugacucccuccuuggccaggcccucacccaguucagaucc

SEQ ID NO: 110356 - RNA, 64 nt, Homo Sapiens
ucaguuacacaaaggaccucagcugcuucucccacuuggccaagcagggaggaagaagcuuagg

SEQ ID NO: 110357 - RNA, 64 nt, Homo Sapiens
ggccucaggugggccgcaggcgggaaaagcagcccuuggccagaagucaagcccagccacgugg

SEQ ID NO: 110358 - RNA, 64 nt, Homo Sapiens
ugucugccauauacguacaccaccccaaaaugaccuuggccaccugggauagggauaaaauacc

SEQ ID NO: 110359 - RNA, 64 nt, Homo Sapiens
gucaaggacucgugacuccuagccaugaaaaucacuuggccagguuacagaauaguaaacuaag

SEQ ID NO: 110360 - RNA, 64 nt, Homo Sapiens
gucaggaaaugacauguuaaugcuuugcucccugaagggggaaaaaaucuguccuuuaacaagc

SEQ ID NO: 110361 - RNA, 64 nt, Homo Sapiens
aaacguccagaugcauuacugcuaucuuaguuuaaagggggaaagaaaagggaagaagaaagga

SEQ ID NO: 110362 - RNA, 64 nt, Homo Sapiens
uugucauggggaagggccagaaaauacagccccaaagggggaauggcugaucuguagagguaug

SEQ ID NO: 110363 - RNA, 64 nt, Homo Sapiens
aaguuuaaaaugggggaaaauuaggucacucgggaagggggaaaggcaucagucuaacaaguca

SEQ ID NO: 110364 - RNA, 64 nt, Homo Sapiens
cacgccagccucucugagccaaagcugcuugcagaagggggagaucccaguucgaagacucccg

SEQ ID NO: 110365 - RNA, 64 nt, Homo Sapiens
cgccucucugugccagggaggcugggagagcagcaagggggaccaggugcgccaucaggaggag

SEQ ID NO: 110366 - RNA, 64 nt, Homo Sapiens
accaguggugugagcaguuggacucaguuuggacaagggggaaagggggacuucccugggaagg

SEQ ID NO: 110367 - RNA, 64 nt, Homo Sapiens
ugugagcaguuggacucaguuuggacaagggggaaagggggacuucccugggaagguccagcua

SEQ ID NO: 110368 - RNA, 64 nt, Homo Sapiens
cagcaucaagucccaaguaaggacagugagagaaaagggggagaaggauuggagcaaaagagaa

SEQ ID NO: 110369 - RNA, 64 nt, Homo Sapiens
gcccuaggaaaugaaagaauuguguauagaauggaagggggaucaucaaggacauguaucucaa

SEQ ID NO: 110370 - RNA, 64 nt, Homo Sapiens
ucgagcagggugcugugggugauauggacagcagaagggggagaccaagguuccagcucaacca

SEQ ID NO: 110371 - RNA, 64 nt, Homo Sapiens
ugcugagaccccccaccaccagccgguaccugggaagggggagagugcaggccugcucagggac

SEQ ID NO: 110372 - RNA, 64 nt, Homo Sapiens
agugaucuauggaagucgugucuuacuccaggugaagggggaaaaaaaaagccuauacuuuggc

SEQ ID NO: 110373 - RNA, 64 nt, Homo Sapiens
aagaaucugcaggcugcuuguaggacuguucaccaagggggauaccagcagcaagagagugcac

SEQ ID NO: 110374 - RNA, 64 nt, Homo Sapiens
caacauuuggaggggauggaccuuccuccguuuuaagggggaagggugccugagagcccagggc

SEQ ID NO: 110375 - RNA, 64 nt, Homo Sapiens
accaccugagucuccagcuuaauguguuggagggaagggggaguaauguggcaggcggaccugg

SEQ ID NO: 110376 - RNA, 64 nt, Homo Sapiens
aaaaaagcaaaaugcugugauaaaccaaacagggaagggggaaaaacccuccuccuugggauuu

SEQ ID NO: 110377 - RNA, 64 nt, Homo Sapiens
cauaacccgacacggacuuauuuuugucauuagcaagggggaaaaggccaaaggacaagggccu

SEQ ID NO: 110378 - RNA, 64 nt, Homo Sapiens
guccagcacacaccugggaaagggaugcugccccaagggggaccaaaagggccggacguuacag

SEQ ID NO: 110379 - RNA, 64 nt, Homo Sapiens
uagaguuaugucucagcuacgaaagacaaggaguaagggggauuuccuuccagccagaaagaaa

SEQ ID NO: 110380 - RNA, 64 nt, Homo Sapiens
gagccaccccaaaacggugguuggccaauuuggaaagggggaagugcagugcuuuuucuuaaac

SEQ ID NO: 110381 - RNA, 64 nt, Homo Sapiens
cggcuucacugaccagcggcgccgggagccaacgaagccggacacacagcccugagugucccaa

SEQ ID NO: 110382 - RNA, 64 nt, Homo Sapiens
gcugcccagacacaugggcuacagacuugcacugaagccggacacuuggaaccucauugcuacc

SEQ ID NO: 110383 - RNA, 64 nt, Homo Sapiens
uuaaucccgugcuccuccucuuaaugacagaucuccccacuacauuccaaaaucccacagcuag

SEQ ID NO: 110384 - RNA, 64 nt, Homo Sapiens
ggcagaggggggacccggcugaagcagccauuguccccacuaugccuuacguaugaagcaugga

SEQ ID NO: 110385 - RNA, 64 nt, Homo Sapiens
aggcccgugguaauucuccccaccuccccggaugccccacuaguccaacuucauggcugcacgu

SEQ ID NO: 110386 - RNA, 64 nt, Homo Sapiens
uggucuccagccccacuucccaaauaugccucagccccacuagcuggcaccaacuuaauuccac

SEQ ID NO: 110387 - RNA, 64 nt, Homo Sapiens
ccccugagcugaguucugcagagacccacucugaccccacuaaaaugaccccugauucaucaaa

SEQ ID NO: 110388 - RNA, 64 nt, Homo Sapiens
auuacacagccauaaaaaggaaugaagcagugauccccacuacacuguggaugaaccuugaaug

SEQ ID NO: 110389 - RNA, 64 nt, Homo Sapiens
gggauguaggcgcuggagcuccaguucccaggagcaggggcagguguuccuagauguuaguguu

SEQ ID NO: 110390 - RNA, 64 nt, Homo Sapiens
agcugucgccuuucugaccagcaggccuggagggcaggggcacagagcagagaggagggcacug

SEQ ID NO: 110391 - RNA, 64 nt, Homo Sapiens
cagaucugugccugggaucgugcauuugaggggccaggggcaggcagggcugcagagggagacg

SEQ ID NO: 110392 - RNA, 64 nt, Homo Sapiens
gagguggcaggaauacuucaccuuuccucucccucaggggcaggugguggaggggcgcccaggg

SEQ ID NO: 110393 - RNA, 64 nt, Homo Sapiens
guccugaggcaggaacucgagcaggcgaggccuccaggggcagggagccugcggagcugcaggg

SEQ ID NO: 110394 - RNA, 63 nt, Homo Sapiens
cgaggccuccaggggcaggggccugcggagcugcaggggcaggagcuggagaccaaugucuga

SEQ ID NO: 110395 - RNA, 60 nt, Homo Sapiens
aggagugcggcugcgccugacagugcaaggcaggggcacggugguggggcacggagggca

SEQ ID NO: 110396 - RNA, 64 nt, Homo Sapiens
ccagaaaggacacaacccgucagagaccugggagcaggggcaaugaccguuugacuguuugugg

SEQ ID NO: 110397 - RNA, 64 nt, Homo Sapiens
cuggggugggacagggagggccggcggcucugagcaggggcaggcgcagaggucccagccccag

SEQ ID NO: 110398 - RNA, 64 nt, Homo Sapiens
cagugugcccaaaagccauguauuucagggaccucaggggcaccuccggcugccuagcccuccc

SEQ ID NO: 110399 - RNA, 64 nt, Homo Sapiens
aagagcagcaugacauuggcaucagcugaauaaccaggggcacaugggggaacguggaugggaa

SEQ ID NO: 110400 - RNA, 64 nt, Homo Sapiens
ugacaucguucccuggggacauugggaaggugggcaggggcaagugaacucagcacucugcagu

SEQ ID NO: 110401 - RNA, 64 nt, Homo Sapiens
cagaccuccagagcauccagcgcugccgcugcugcaggggcacccucacugcgucucaugaggc

SEQ ID NO: 110402 - RNA, 58 nt, Homo Sapiens
cccaacccacccgggccaggcguggugccaggggcagcgcgacaaggccggccuguga

SEQ ID NO: 110403 - RNA, 64 nt, Homo Sapiens
ggccucuaacccucagugggcccccaggucagggcaggggcacugaguggccuggcucugagga

SEQ ID NO: 110404 - RNA, 64 nt, Homo Sapiens
ucuucuucuuccaucuccuuggugacacccagcccaggggcacccccuuccccagcccccaccu

SEQ ID NO: 110405 - RNA, 64 nt, Homo Sapiens
acguagugcacagaauacgugagaguugcucuggcaggggcagaauccucacaggaucgccugg

SEQ ID NO: 110406 - RNA, 64 nt, Homo Sapiens
accaccuguccccuuuugagugaucccauuaucccaggggcaaaggcuucccaguaaggcccag

SEQ ID NO: 110407 - RNA, 64 nt, Homo Sapiens
cucuuggccugccccaggccuugcugcccaggcccaggggcaggcucuguccuuggcagagacc

SEQ ID NO: 110408 - RNA, 64 nt, Homo Sapiens
cuuggugguugugaguccaugugccaccugggcacaggggcaagcuccuggcccuucagucuug

SEQ ID NO: 110409 - RNA, 64 nt, Homo Sapiens
cugugucacgcuggccauuuuuccgaggcuuucccaggggcagucucugucccaauccgagaag

SEQ ID NO: 110410 - RNA, 64 nt, Homo Sapiens
gaaggaggaggggcuuauaguucccuucuccacccaggggcaguaagcacugucuaguugaaag

SEQ ID NO: 110411 - RNA, 64 nt, Homo Sapiens
gccggcccgccagggaggggccagcuggggugcccaggggcaggguaccaaagacugacccccg

SEQ ID NO: 110412 - RNA, 64 nt, Homo Sapiens
ucugcaggccgcuugcccuccuguccccuccccgcaggggcacaguggagacgcaggggcucug

SEQ ID NO: 110413 - RNA, 64 nt, Homo Sapiens
cccagcccucgaggcucgaugccugugccaaggccaggggcagccagagggcagcuggauggcc

SEQ ID NO: 110414 - RNA, 64 nt, Homo Sapiens
agaaggggucuggcccgggcauccacguagggggcaggggcaggggcgggcggagggaggggag

SEQ ID NO: 110415 - RNA, 64 nt, Homo Sapiens
ggcugcucuuuccacuugcccuguguucuuuccccaggggcaugacugucgccacacgccucug

SEQ ID NO: 110416 - RNA, 64 nt, Homo Sapiens
cagccaaggcaccccugcccugggacuggcagggcaggggcaggggcagggacaguggccaggc

SEQ ID NO: 110417 - RNA, 64 nt, Homo Sapiens
aggcaccccugcccugggacuggcagggcaggggcaggggcagggacaguggccaggcggcccg

SEQ ID NO: 110418 - RNA, 64 nt, Homo Sapiens
ccuuuaaaugcaguaaacuccaccuaaccagauucaggggcacuaugcccacugccuccucuuc

SEQ ID NO: 110419 - RNA, 64 nt, Homo Sapiens
uucuauccucccagucaccuuugcagacaaagaccaggggcagcucccgagggcacugugaagg

SEQ ID NO: 110420 - RNA, 64 nt, Homo Sapiens
ugcccccugccgggcagcuuuaaggacagacccccaggggcaguuuagccucaggcacaggcau

SEQ ID NO: 110421 - RNA, 64 nt, Homo Sapiens
ggcuggggcaggcuugggcucaauccugggcacccaggggcagcccaccccuaaccuggcuccu

SEQ ID NO: 110422 - RNA, 64 nt, Homo Sapiens
ggccaaccggacccaggccuuccaggagcaggagcaggggcaggggcaggggcagggagagccc

SEQ ID NO: 110423 - RNA, 64 nt, Homo Sapiens
ccggacccaggccuuccaggagcaggagcaggggcaggggcaggggcagggagagcccugcauu

SEQ ID NO: 110424 - RNA, 64 nt, Homo Sapiens
ccaggccuuccaggagcaggagcaggggcaggggcaggggcagggagagcccugcauuuccucu

SEQ ID NO: 110425 - RNA, 64 nt, Homo Sapiens
cuggcuauccucacaggcaccguagagguggggacaggggcaggggcaggggcggagccccuga

SEQ ID NO: 110426 - RNA, 64 nt, Homo Sapiens
auccucacaggcaccguagagguggggacaggggcaggggcaggggcggagccccugaagaagg

SEQ ID NO: 110427 - RNA, 64 nt, Homo Sapiens
auguauuugaaggaaggucuaaccaggggguuuucaggggcauugucugaccacauucuuuuug

SEQ ID NO: 110428 - RNA, 64 nt, Homo Sapiens
aauaguggaacuucacacuuacaucaauucagugcaggggcauagaauaaaauauuaaauauug

SEQ ID NO: 110429 - RNA, 64 nt, Homo Sapiens
gacuuuauagcacuuuuucaaagcuuuaacuuagcaggggcaugccucgcaucuuuuuuuuuuu

SEQ ID NO: 110430 - RNA, 64 nt, Homo Sapiens
ggcagugugcaaagaauugauggugggugaggggcaggggcagucguagagugaugugcacucc

SEQ ID NO: 110431 - RNA, 64 nt, Homo Sapiens
cagguugucagagcuauguggagucuguggguggcaggggcagccgcuccagccuuugaagacu

SEQ ID NO: 110432 - RNA, 64 nt, Homo Sapiens
aggcuuggacuuccugggagcuccuccaaguacccaggggcaucagagcugccuggguguuaca

SEQ ID NO: 110433 - RNA, 64 nt, Homo Sapiens
cuggaacugaauggcgcuucgggauucugaguagcaggggcagcaugcccagugggccuggggu

SEQ ID NO: 110434 - RNA, 64 nt, Homo Sapiens
uccggaauugaggggcacgcaggauucugagcaccaggggcagaggcggccagacaaccucagg

SEQ ID NO: 110435 - RNA, 64 nt, Homo Sapiens
caagagggcaccugaggagacuuuggggacagggcaggggcagggagggaaacugaggaaaucu

SEQ ID NO: 110436 - RNA, 64 nt, Homo Sapiens
cauuccucccaacagcucaaaauuaggccuugggcaggggcagggagagcugcugagccuaaag

SEQ ID NO: 110437 - RNA, 64 nt, Homo Sapiens
aaagguauuuguugguuuauguuacuuaauaguccaggggcaccuggcuucagguagguuugau

SEQ ID NO: 110438 - RNA, 64 nt, Homo Sapiens
gucaucucaaaggcccaaccauggccagcagggacaggggcauuaaggggugucugggaccugg

SEQ ID NO: 110439 - RNA, 64 nt, Homo Sapiens
ggucagaaggggugucugggaccccccggggaggcaggggcagaccgaaggacacccagcaggc

SEQ ID NO: 110440 - RNA, 64 nt, Homo Sapiens
gaccguucgcauggcagccaucaaagaguccuggacgcacaauauccagcgagagaaagaguuu

SEQ ID NO: 110441 - RNA, 64 nt, Homo Sapiens
ugcuuguacaguaaacugucgguguuuguuuuuaacgcacaacucuuugcacuaucguuugcuu

SEQ ID NO: 110442 - RNA, 64 nt, Homo Sapiens
gaccgcacguucucugccccgguagaaauacccaacgcacaaaucagauggggccuuuggggcu

SEQ ID NO: 110443 - RNA, 64 nt, Homo Sapiens
aaauacagaacugcaggggaauaaaauuuuaacaacgcacaaaauguauuuuuccaagcacagu

SEQ ID NO: 110444 - RNA, 64 nt, Homo Sapiens
gucugccugaaucaccuuucuuugugugccuccuacgcacaaagccagcucugcaguggaaucu

SEQ ID NO: 110445 - RNA, 64 nt, Homo Sapiens
gcucuggauucuggaucucuccugcuguaaccccacgcacaagccugcaacccccagagcucuu

SEQ ID NO: 110446 - RNA, 64 nt, Homo Sapiens
cucgaccacagaauaaugccagucaccacccugaacgcacaaucuccagugcaggaucuaauga

SEQ ID NO: 110447 - RNA, 64 nt, Homo Sapiens
uuaaaucaagggcuacaauugaagccguauuuguacgcacaacacaguaaugauuuccuuagca

SEQ ID NO: 110448 - RNA, 64 nt, Homo Sapiens
uuguagagaaaaaaaaauauguguacacauaugaacgcacaacaugcacauucauccucacaug

SEQ ID NO: 110449 - RNA, 64 nt, Homo Sapiens
ccaagcucagucuaaaugaaaccgaaacgugaccacgcacaaaggcagucacugccucgagggg

SEQ ID NO: 110450 - RNA, 64 nt, Homo Sapiens
aaaccauuuugaucucccugugguuaucaauauaacgcacaaucacaaguguaugaggacuuag

SEQ ID NO: 110451 - RNA, 64 nt, Homo Sapiens
ugguuuuaauuacccucagauuucacccauaaaaacgcacaauuguauuauuuuacagagaugu

SEQ ID NO: 110452 - RNA, 64 nt, Homo Sapiens
gcacgugaagucauugaggccugcaugugcugucacgcacaaggccaaggaugcugucaagcac

SEQ ID NO: 110453 - RNA, 64 nt, Homo Sapiens
acacacacuaugggguggggaccccacugggcacacgcacaaacacuggacucacauucgacau

SEQ ID NO: 110454 - RNA, 64 nt, Homo Sapiens
ccuuugaaaauagcaaaacaugguaaaaugugauacgcacaaacgguaaaauugggguaaaaug

SEQ ID NO: 110455 - RNA, 64 nt, Homo Sapiens
uuacacuuaucauuucuaaccaggagccgcagagacgcacaacuuucauaauaaucuucaaguu

SEQ ID NO: 110456 - RNA, 64 nt, Homo Sapiens
cuaaugagaguuuuuacagcucaucauucaaauaacgcacaaaaaacaaaagccgcuaugaccg

SEQ ID NO: 110457 - RNA, 64 nt, Homo Sapiens
cuugauuucucaggagcgucugggggggcucagcacgcacaaacuccuucuccuucuaccacuc

SEQ ID NO: 110458 - RNA, 64 nt, Homo Sapiens
agaagaauggcccaaguuucauucgcccucagccacgcacaagggaaagggaacuuuggguuau

SEQ ID NO: 110459 - RNA, 64 nt, Homo Sapiens
gcacuccagccugggugacggcagugagcugagaacgcacaacuaucccaggaaggcagaggug

SEQ ID NO: 110460 - RNA, 64 nt, Homo Sapiens
gccagugcgcacguguacacgcacacacacauacacgcacaagcguagcaaaugacacaugcac

SEQ ID NO: 110461 - RNA, 64 nt, Homo Sapiens
ugaaaaaaaaaaaacaaaaacugauucaagugacacgcacaaacuuuuuacauguguuugguuu

SEQ ID NO: 110462 - RNA, 64 nt, Homo Sapiens
gguagaagacuucucauuggggagcaacuuuuugacgcacaacuuuuggugcguuuuucuaguu

SEQ ID NO: 110463 - RNA, 64 nt, Homo Sapiens
aagccgcuuccucuccacugaagagcuaugagauacgcacaauacuugcuguucacguuaugac

SEQ ID NO: 110464 - RNA, 64 nt, Homo Sapiens
gguagcagagagguguuuaguauagcgcugaccaacgcacaacagaucuugggaccuccaaacu

SEQ ID NO: 110465 - RNA, 64 nt, Homo Sapiens
cgggagcugugcacggcuucaaucagaauucuaaacgcacaacuucaaacacagcauuucaugu

SEQ ID NO: 110466 - RNA, 64 nt, Homo Sapiens
ucuuacguuuucugggaauuuuguaacaaguuacacgcacaaguguuagaaacuuuggcauaac

SEQ ID NO: 110467 - RNA, 64 nt, Homo Sapiens
gcacgugugcgcuuauugucacuuguucuuguguacgcacaaugaaucuuuguugagacguucg

SEQ ID NO: 110468 - RNA, 64 nt, Homo Sapiens
uauuccuucuuuuuuccuccuuucauuucccacuacgcacaaagaguuuauaaacacuguucuc

SEQ ID NO: 110469 - RNA, 64 nt, Homo Sapiens
ugaaaacagacuuccaccucaguggccugugggcacgcacaagugaggucuguuuuucuagaca

SEQ ID NO: 110470 - RNA, 64 nt, Homo Sapiens
gccccugcccugcccuagcucugggucugaaaaaacgcacaagaacacuguugcucuugaaaau

SEQ ID NO: 110471 - RNA, 64 nt, Homo Sapiens
ggggcuauuccuacgcuuagaggaacuuagugucacgcacaaaucgcucaguuuggaccauugg

SEQ ID NO: 110472 - RNA, 64 nt, Homo Sapiens
uacauucuuuucuaugagcagcaggggauagacuacgcacaauuucugccaaagauugauggca

SEQ ID NO: 110473 - RNA, 64 nt, Homo Sapiens
uucacagacaucuguugcugcugagccacuguuaacgcacaauggagcugugaaucuagaggcu

SEQ ID NO: 110474 - RNA, 64 nt, Homo Sapiens
cagaaaaugaagguggaacacguucauucaggcaacgcacaaaaaaauaccaaccugaagacac

SEQ ID NO: 110475 - RNA, 64 nt, Homo Sapiens
ucccaccacuaaaaaaccaacaaugugauuuauaacgcacaacuucgugcucaggucaucuagg

SEQ ID NO: 110476 - RNA, 64 nt, Homo Sapiens
aaugacaaaccacacaauuguuguugaguaaaccacgcacaauggcaugucuuucuuuuucugc

SEQ ID NO: 110477 - RNA, 64 nt, Homo Sapiens
gcccacaggaggcaugcacaaucugguaggagaaacgcacaaguacagauagcuugcucucuga

SEQ ID NO: 110478 - RNA, 64 nt, Homo Sapiens
gucugcaugauuuugagaaaccauaauuuuugggacgcacaaauugcacaguguggcugcuuuu

SEQ ID NO: 110479 - RNA, 64 nt, Homo Sapiens
aggacauucuccccucuccuaggagacggaugucacgcacaaauggggagagaaguguuuauuu

SEQ ID NO: 110480 - RNA, 64 nt, Homo Sapiens
gccuucacuggaucagccgcaaaugugacagcacacgcacaaacgaucacagaguucaggggga

SEQ ID NO: 110481 - RNA, 64 nt, Homo Sapiens
agaaaacaauuuuuuaaaaauucucauuacauagacgcacaagaauaugucacauaaagaaaau

SEQ ID NO: 110482 - RNA, 64 nt, Homo Sapiens
ccuaaucgcccugagcuacuccccaagcauggaaacgcacaaccgguggcagcgcccagccugg

SEQ ID NO: 110483 - RNA, 64 nt, Homo Sapiens
cacauuucagugaucagaauagauauccuuuuacacgcacaaaagcaauagauucauucagugg

SEQ ID NO: 110484 - RNA, 64 nt, Homo Sapiens
ccagcugaccagaaugagauccaaucugcugaaaacgcacaaguuuauuguuggacaagaugaa

SEQ ID NO: 110485 - RNA, 64 nt, Homo Sapiens
acacacacgcacgcacacagaugugugggcacacacgcacaaaccugugaauuaaaauaugcuc

SEQ ID NO: 110486 - RNA, 64 nt, Homo Sapiens
aaugcuuuuuaaagcacaugucucauuuuaaaugacgcacaaacugaagauguuaauaaaauuu

SEQ ID NO: 110487 - RNA, 64 nt, Homo Sapiens
uggaggggaaaaagaugacagagaaguggacuccaaaccucauuuuaguuguagaagaaaauuu

SEQ ID NO: 110488 - RNA, 64 nt, Homo Sapiens
ccccaccucugcagaagaaaauuuugcucuuauaaaaccucauguuuucaucauucccaucuuu

SEQ ID NO: 110489 - RNA, 64 nt, Homo Sapiens
gauuugggcaaacugaauguuuuuacaauugugaaaaccucaugauuuccaaaaauguaagaaa

SEQ ID NO: 110490 - RNA, 64 nt, Homo Sapiens
gauuacaauugaggaaaaaguagcaguuacagcaaaaccucagugaggacuuggugaaaggaaa

SEQ ID NO: 110491 - RNA, 64 nt, Homo Sapiens
ugcuucaacacuuaaguagcauacacugcccuacaaaccucagagagcacuuuuccccaaguuc

SEQ ID NO: 110492 - RNA, 64 nt, Homo Sapiens
uuuugucuuguacuacuuugacccaccccugaauaaaccucaauugcuggagugggguguaguu

SEQ ID NO: 110493 - RNA, 64 nt, Homo Sapiens
ggccauaucuucaccaggccagagauucaguuuuaaaccucagcagccaucaguuuggccaagu

SEQ ID NO: 110494 - RNA, 64 nt, Homo Sapiens
gaaugaagucuuugauggguaggagagagagggaaaaccucaaacuacaucauagaaguauguu

SEQ ID NO: 110495 - RNA, 64 nt, Homo Sapiens
guggauucacuuucugauagccuucucauuuuauaaaccucaaaauacagccccaccaucaucc

SEQ ID NO: 110496 - RNA, 64 nt, Homo Sapiens
gaagauggaugcuuaccccucccgaugggacauaaaaccucacccaggaggcaguggcgggcuc

SEQ ID NO: 110497 - RNA, 64 nt, Homo Sapiens
ggauuuagugcccugucuccgccaucucuaaaacaaaccucaaguuuuuuuuaagggccuugga

SEQ ID NO: 110498 - RNA, 64 nt, Homo Sapiens
gcaaggcugaggcugagcuuuuguuugcucuugaaaaccucacuucccauccugccaugagcaa

SEQ ID NO: 110499 - RNA, 64 nt, Homo Sapiens
cacuuuucuguaaauauacauaaacuuaaaaagaaaaccucauggagucaucuugcacacacuu

SEQ ID NO: 110500 - RNA, 64 nt, Homo Sapiens
uaugucuuguucuugagauuuuguauauuuaggaaaaccucaagcaguaauuaauaucuccugg

SEQ ID NO: 110501 - RNA, 64 nt, Homo Sapiens
cacacauuuggacucauuugaucagaaaacagguaaaccucacuacccauuuuuauagaucaga

SEQ ID NO: 110502 - RNA, 64 nt, Homo Sapiens
gcccaaguaacagugauagaccuauuuuaauagaaaaccucaggaauauugaaauauuucaugu

SEQ ID NO: 110503 - RNA, 56 nt, Homo Sapiens
uuaguuccuucuucugcuaauccccaaaaccucagaaaccucauaauucuuaacac

SEQ ID NO: 110504 - RNA, 64 nt, Homo Sapiens
uaguuccuucuucugcuaauccccaaaaccucagaaaccucauaauucuuaacaccuggcauuu

SEQ ID NO: 110505 - RNA, 64 nt, Homo Sapiens
uuaaaaaggugugguguucgccaaaauaaauaugaaaccucauaaaauacucauauguuuauga

SEQ ID NO: 110506 - RNA, 64 nt, Homo Sapiens
aaucguuuuagcuucuuuccauuauuuuauuuaaaaaccucaguuuguccuugugucacguucc

SEQ ID NO: 110507 - RNA, 64 nt, Homo Sapiens
caaaguucuauacagcauuuccuuuauagcauucaaaccucacauccucccuucaguuuaaugc

SEQ ID NO: 110508 - RNA, 64 nt, Homo Sapiens
auuaaacuuucuguauauagucaauaagcaauaaaaaccucauuuuucagaguucacaguuuaa

SEQ ID NO: 110509 - RNA, 64 nt, Homo Sapiens
augucucccugaucugaacugcuuuucuuuauuaaaaccucagcaguguucuggacaaggccaa

SEQ ID NO: 110510 - RNA, 64 nt, Homo Sapiens
gaucaauuuuauguauuugagcagaaauauuagaaaaccucauuucaucggcuuucauuauugu

SEQ ID NO: 110511 - RNA, 64 nt, Homo Sapiens
aagagaaauagaauguuugaauucaguuaagaucaaaccucacaaaaauuauuacauccuuuac

SEQ ID NO: 110512 - RNA, 64 nt, Homo Sapiens
auucugcaauauguaaccaauucacuagaagcccaaaccucagcuuuuugaaaaucauuacacu

SEQ ID NO: 110513 - RNA, 64 nt, Homo Sapiens
gacacaccaugugccaggaaaugaccucagcaagaaaccucaggccgugugaagagcagcaaag

SEQ ID NO: 110514 - RNA, 64 nt, Homo Sapiens
agaaggaaauaaauguaaaaaugcugcaaauuaaaaaccucaaagaagggaaauaauugcaaca

SEQ ID NO: 110515 - RNA, 64 nt, Homo Sapiens
gcagugaaugugggaaagcuuuuauucagaugucaaaccucauucgacaccagagaauucauac

SEQ ID NO: 110516 - RNA, 64 nt, Homo Sapiens
guacaguauguggaaaagccuuuagucagaaaucaaaccucacugaacaugagaaaauucauac

SEQ ID NO: 110517 - RNA, 64 nt, Homo Sapiens
ccauauacauagauggaaaaacccaguauuauaaaaaccucaauucugaaaaucuauagacuga

SEQ ID NO: 110518 - RNA, 64 nt, Homo Sapiens
ucuugaaggcagauccugaugucccucaauguugaaaccucaucguccccaaucccucugccca

SEQ ID NO: 110519 - RNA, 64 nt, Homo Sapiens
acuggauccugacaaccacauucuggaugucaacaaaccucacccuccaagcucagcugcugga

SEQ ID NO: 110520 - RNA, 64 nt, Homo Sapiens
uuuuauguuuauuccuaaauagauuucaagguacaaaccucacuucauuuugaucaauguuuau

SEQ ID NO: 110521 - RNA, 64 nt, Homo Sapiens
agugugaugauuguggcaaauucauacaggagagaaaccucacacuaugcaaaacauaggagga

SEQ ID NO: 110522 - RNA, 64 nt, Homo Sapiens
uucuguggugcaauuuuaaucaaacagaucuuugaaaccucagauuaaugaaaugaagauauuu

SEQ ID NO: 110523 - RNA, 64 nt, Homo Sapiens
ggugaacguucaccuuaauguuuuccaaagcuguaaaccucacugucaggacuuccugucacug

SEQ ID NO: 110524 - RNA, 64 nt, Homo Sapiens
cuauuaugcguaaugcucagcuuuuuguaaagaaauauuuaauuguauuuuguguuuauacagg

SEQ ID NO: 110525 - RNA, 64 nt, Homo Sapiens
caaguuuguugagcuuuaaaauguauuugaaguaauauuuaaauaggcauuuaaaauuucaaau

SEQ ID NO: 110526 - RNA, 64 nt, Homo Sapiens
uggcuugauuuuuggaaacaauauagagguauucauauuuaaaugaggguuuacauuuguuuug

SEQ ID NO: 110527 - RNA, 64 nt, Homo Sapiens
uguaaaugcugauauugauuucacugguccaucuauauuuaaaacgugcaagaaaaaaauaaaa

SEQ ID NO: 110528 - RNA, 64 nt, Homo Sapiens
guauucuuaauacagugcucacugcauuuaauaaauauuuaauaaaugaugaaugauagaaguu

SEQ ID NO: 110529 - RNA, 64 nt, Homo Sapiens
uucagggagguaggaaagguaacagaaaaccagcauauuuaaucaaagcaagaaguaaucgcug

SEQ ID NO: 110530 - RNA, 64 nt, Homo Sapiens
ggucucauuuaauggcccuguuuuuuucauuauuauauuuaaugauagggcaggauuucguaug

SEQ ID NO: 110531 - RNA, 64 nt, Homo Sapiens
ccacuuuuccuucuuguagacucagcucaccuguauauuuaaacuguucuuggcaucuugaaac

SEQ ID NO: 110532 - RNA, 64 nt, Homo Sapiens
gugcuuucucagguuacuguauaacuguuauaauauauuuaauauauaaaauuaagacuuuugc

SEQ ID NO: 110533 - RNA, 64 nt, Homo Sapiens
cauaaauucaggaagcacaauauauaccaaacauauauuuaaauaaaauccaggccuagacuca

SEQ ID NO: 110534 - RNA, 64 nt, Homo Sapiens
uuguagaaggguuauauuuuacuacuguggaaaaauauuuaagauaguuuugccagaacaguuu

SEQ ID NO: 110535 - RNA, 64 nt, Homo Sapiens
uuucaauuuugcaugcucgauuauucccuguacaauauuuaaaauuuauugcuugauacuuuug

SEQ ID NO: 110536 - RNA, 64 nt, Homo Sapiens
aaggcccaaccgauuuccauuuaaaaauacuacaauauuuaacuucuuuuucaauauacaaauu

SEQ ID NO: 110537 - RNA, 64 nt, Homo Sapiens
ggcauaaccaaaaaagcaaaaaguaaaaagacagauauuuaagagacaauuauuuuuauagaca

SEQ ID NO: 110538 - RNA, 64 nt, Homo Sapiens
gaaaggcccaauuuguaaacuacauuagauaccuauauuuaaauaguaguauguauuacucuua

SEQ ID NO: 110539 - RNA, 64 nt, Homo Sapiens
uucuuguuuuauauauuuugaugccaguuccuuuauauuuaaauauuucgggugguuuacguuu

SEQ ID NO: 110540 - RNA, 64 nt, Homo Sapiens
cauagaugugcuccuagucagaguaguuuugucuauauuuaaucucuauauuuaagguuucugg

SEQ ID NO: 110541 - RNA, 64 nt, Homo Sapiens
uuucugggaguaguuuugucaauaaagucugucuauauuuaagguuuggcuuccuacauaaauu

SEQ ID NO: 110542 - RNA, 64 nt, Homo Sapiens
aaaugcaugguucauuuuuauaugacuauagguaauauuuaagauauccgaaaaaguaaacguu

SEQ ID NO: 110543 - RNA, 64 nt, Homo Sapiens
cuuauuuuauauaccaguuacccaccccucagggauauuuaaaacagauccuggcccucccgcc

SEQ ID NO: 110544 - RNA, 64 nt, Homo Sapiens
uugaauguuuguccuuaggaauuggcauauugagauauuuaaggaauaaauuuuuagaaaucug

SEQ ID NO: 110545 - RNA, 64 nt, Homo Sapiens
uagacauuaccaguaauuucgcauuauuaaaugaauauuuaaauaaacaaaaacagguaucagu

SEQ ID NO: 110546 - RNA, 64 nt, Homo Sapiens
cuaagcuuuaaaaagaaaccgggaaagauauuuaauauuuaauaaguaauguaaaauuuaaaug

SEQ ID NO: 110547 - RNA, 64 nt, Homo Sapiens
uuuaauacuaagcuuuaaaauuaaauggggaaagauauuuaauauuggcagaguaauguaaaau

SEQ ID NO: 110548 - RNA, 64 nt, Homo Sapiens
aaacaucacauuuggagaagauacacucuaucacauauuuaagcuaagaacauguuuuaaaaag

SEQ ID NO: 110549 - RNA, 64 nt, Homo Sapiens
aaaagcaaaagaaauucaaugugcaaaucagaauauauuuaaaaaagugugcauuauuuuacau

SEQ ID NO: 110550 - RNA, 64 nt, Homo Sapiens
aauuaaaauguuuaucuguaaucuugaaaguaauauauuuaaucacaagugcgauuucaaaaag

SEQ ID NO: 110551 - RNA, 64 nt, Homo Sapiens
ucuccaaaauaaaacaccccgagcuacauguuaaauauuuaaagaguggaugcugaaguuacau

SEQ ID NO: 110552 - RNA, 64 nt, Homo Sapiens
gguugcuucuucauagaauuauguguauaguuagauauuuaaauaugaaguuguaaaaacuuga

SEQ ID NO: 110553 - RNA, 64 nt, Homo Sapiens
uauuggaaaguaucagauuucucuuuagcugugcauauuuaaaacagaucaaccccuuuauuuu

SEQ ID NO: 110554 - RNA, 64 nt, Homo Sapiens
ucuugauuuuuuuuaaauguaaaaucuuuagacaauauuuaaaaauuuucuaaaucugggauuu

SEQ ID NO: 110555 - RNA, 64 nt, Homo Sapiens
gauuacuucuugauaaaauuaaaacacugcagaaauauuuaacaugucaguuacuuuuagaaag

SEQ ID NO: 110556 - RNA, 64 nt, Homo Sapiens
uuugguuugcugagucuuguuuuaaguggccuugauauuuaaaacuauuccugccaccauuucu

SEQ ID NO: 110557 - RNA, 64 nt, Homo Sapiens
uuauuugcuucucccuccccaaccaccucaugguauauuuaagagugaaagggacaaacuagua

SEQ ID NO: 110558 - RNA, 64 nt, Homo Sapiens
auuuaaauuauuuuuuuccagauuggcacaugaaauauuuaaacuuuuuugugugccuuucugu

SEQ ID NO: 110559 - RNA, 64 nt, Homo Sapiens
uaauuuuuuaaauauggauuaugcuugaauuacuauauuuaaaaugaaaauguauagauuacac

SEQ ID NO: 110560 - RNA, 64 nt, Homo Sapiens
aagucauggaauaguuuuuauauuuacagcuuuuauauuuaaaacuuguaagaguuuuuuuaau

SEQ ID NO: 110561 - RNA, 64 nt, Homo Sapiens
auaaaaaaaaaaaaacuucaguuuucuaaaaauuauauuuaaaauuguaaucaaaauguaccua

SEQ ID NO: 110562 - RNA, 64 nt, Homo Sapiens
uuuuugaucuaccuagguggaguugguggugcugauauuuaaauucaggcuacugcuucaaucu

SEQ ID NO: 110563 - RNA, 64 nt, Homo Sapiens
uuaauuuaauauuuacucuauaaccaaaugaaauauauuuaaaauauauugaauauuuuauauu

SEQ ID NO: 110564 - RNA, 64 nt, Homo Sapiens
acaucaucuggccaggcaugcagaguuugguaugauauuuaaauucucucuuuauauaaauaca

SEQ ID NO: 110565 - RNA, 64 nt, Homo Sapiens
augauccucagacaugcagcuagaugcauuuuaaauauuuaaauaagaaaacuaagacagacug

SEQ ID NO: 110566 - RNA, 64 nt, Homo Sapiens
aauaucuaguugauauuucugcuggaucuaguugauauuuaaacuuccagguagauccuaaguu

SEQ ID NO: 110567 - RNA, 64 nt, Homo Sapiens
aaauaagugucgaaugucuucuuucucuauagccauauuuaauuaauuguaauaaugaaaugag

SEQ ID NO: 110568 - RNA, 64 nt, Homo Sapiens
uaggucaaaugcuuuccaaaaguuucagagcucuauauuuaauucaagugcaaauuuuauucua

SEQ ID NO: 110569 - RNA, 64 nt, Homo Sapiens
gauuauuuuuaugcaaaguauaaagucuccucuaauauuuaaagucugaacaguuaugugccug

SEQ ID NO: 110570 - RNA, 64 nt, Homo Sapiens
ccugggaaaacaggacagcuuucccaguuaaaugauauuuaacaaauuuuuuuauugcuuucau

SEQ ID NO: 110571 - RNA, 64 nt, Homo Sapiens
cagccccucugaaaagcacaguuggcagcugguuauauuuaauucaaguaugucagagcacaaa

SEQ ID NO: 110572 - RNA, 64 nt, Homo Sapiens
uauuuguugagcuccuauuugcccagagauggucauauuuaaacagaaguauacguuuuucagu

SEQ ID NO: 110573 - RNA, 64 nt, Homo Sapiens
ugcaaauugcccacucgugauaagucaacagccaauauuuaaaacuuuguucguuacuggcuuu

SEQ ID NO: 110574 - RNA, 64 nt, Homo Sapiens
uuguuggaggaaacugguugcuagucaauguucuauauuuaaugaaugugugauaaaucauccu

SEQ ID NO: 110575 - RNA, 64 nt, Homo Sapiens
aaguauuuuuuguuuauucucuuaaaagaucacuauauuuaaauaaaagugaaggucagcaaca

SEQ ID NO: 110576 - RNA, 64 nt, Homo Sapiens
uauuccaaaugauuuacugcuuuuggaaucacaaauauuuaauucauuucucuaauuugauucu

SEQ ID NO: 110577 - RNA, 64 nt, Homo Sapiens
cauauaauaaauccaauuaaacauuauuugauacauauuuaacuuuuuuggcuguauguaauuc

SEQ ID NO: 110578 - RNA, 64 nt, Homo Sapiens
ggaucaggauugcaugaaagaagaaaauccuucaauauuuaaaauguuucuuacaauacccacg

SEQ ID NO: 110579 - RNA, 64 nt, Homo Sapiens
gaaacccaggaauauuuaccugguguuacauuuaauauuuaauguaacuggucuagcaacauua

SEQ ID NO: 110580 - RNA, 64 nt, Homo Sapiens
uuucaauuuauugcucaguguaccuguuaacauuauauuuaacaauugcuuaaauuuuuguuuu

SEQ ID NO: 110581 - RNA, 64 nt, Homo Sapiens
guugacgcucaucucuuuugucuuacgcuuagccauauuuaaaucuugaauuuaauagagucua

SEQ ID NO: 110582 - RNA, 64 nt, Homo Sapiens
uguuggucuagguuuuuuucuauuuaagaaaccaauauuuaaaacuguuaaugggaauuuaaca

SEQ ID NO: 110583 - RNA, 64 nt, Homo Sapiens
aaccaauauuuaaaauguugaaugggaauuuaacauauuuaagaugcuuagauuauguucuguu

SEQ ID NO: 110584 - RNA, 64 nt, Homo Sapiens
cagaaaaaaaguuacauguccuguccuguuauacauauuuaagguugaaucagauuuaagggcu

SEQ ID NO: 110585 - RNA, 64 nt, Homo Sapiens
gcagucuuauucacagauuggcacacaaguagaaauauuuaaaacacauucuauauguaagaua

SEQ ID NO: 110586 - RNA, 64 nt, Homo Sapiens
auggaauaucugcauuaauagaguauuccaaaauauauuuaauacauauguuugaaaaauccgu

SEQ ID NO: 110587 - RNA, 64 nt, Homo Sapiens
uauuaauuacuaaaaaggcaacucagacaagauuauauuuaauagaaaaacagaccauuuaaaa

SEQ ID NO: 110588 - RNA, 64 nt, Homo Sapiens
uucaauuuuuuagcaacagcaacuucaauuuuuuauauuuaaacaauuuucacauuuauauuua

SEQ ID NO: 110589 - RNA, 64 nt, Homo Sapiens
uucaauuuuuuauauuuaaagaauuuucacauuuauauuuaaacuaucuggggaaaaaaggucc

SEQ ID NO: 110590 - RNA, 64 nt, Homo Sapiens
cauaaagagauagucacuauuggccaagaaacugauauuuaaccuaggggcagaucuugaauuc

SEQ ID NO: 110591 - RNA, 64 nt, Homo Sapiens
agacgguuucuuuuaauuuugccaaaaaacuuggauauuuaaaacaaguaguagagccaaguug

SEQ ID NO: 110592 - RNA, 64 nt, Homo Sapiens
cucccccugacacagagaaggggccuugguauuuauauuuaagaaaugaagauaauauuaauaa

SEQ ID NO: 110593 - RNA, 64 nt, Homo Sapiens
guaauuuuauguagaguuugagcugaagccccguauauuuaauuuauuuuguuaaacaugaaag

SEQ ID NO: 110594 - RNA, 64 nt, Homo Sapiens
accagucaccaaauguaagacccauaagaaacccauauuuaaaaaucugaauuuuuuagaagaa

SEQ ID NO: 110595 - RNA, 64 nt, Homo Sapiens
agaaaucaguaguuuugcaauguuaauuauuuagauauuuaauuucgcagauuuuuaaacuuua

SEQ ID NO: 110596 - RNA, 64 nt, Homo Sapiens
cuguacuaaaugccuaauuuguauggaagagugcauauuuaaucucuuuucuauacugcuccuu

SEQ ID NO: 110597 - RNA, 64 nt, Homo Sapiens
uuugaguagccuuuguuuaaaaaaaagacuaaauauauuuaaaaggccacauuuauauuuuuuu

SEQ ID NO: 110598 - RNA, 64 nt, Homo Sapiens
aaauggaguuuauauuuguuauuucuauuuuguuauauuuaauaauagaauuagauugaaauaa

SEQ ID NO: 110599 - RNA, 64 nt, Homo Sapiens
aggauugcauucuauuuucuauaugacccucuugauauuuaaaaaacacuauggauaacaauuc

SEQ ID NO: 110600 - RNA, 64 nt, Homo Sapiens
uacaaguucuauauauguagaaaugaauaaauauauauuuaaguacaguuuucaugaggaaguu

SEQ ID NO: 110601 - RNA, 64 nt, Homo Sapiens
auuucagaaaauucuucauagugguauuggccuuauauuuaacuuuuuuuuuauuuuuuuuuug

SEQ ID NO: 110602 - RNA, 64 nt, Homo Sapiens
gaauauuuuuaaaacucaaaaaucaagauaccuaauauuuaaguggggacaucaaaacuucaau

SEQ ID NO: 110603 - RNA, 64 nt, Homo Sapiens
aagaguacuuguacaaaaaacuguauauauguauauauuuaauaaaaauuagguccaguaacac

SEQ ID NO: 110604 - RNA, 64 nt, Homo Sapiens
auauaaaauguuuguuuuauaacaggaaaauaaaauauuuaaaauuauugauguuuucacaaag

SEQ ID NO: 110605 - RNA, 64 nt, Homo Sapiens
ugaagauagaagguuugcaguucaauccugauucauauuuaauuuuaggucaaacccaaguuag

SEQ ID NO: 110606 - RNA, 64 nt, Homo Sapiens
guuaauaaauuugugauuucaaggacugauugauauauuuaagauauuucuugccauaauggua

SEQ ID NO: 110607 - RNA, 64 nt, Homo Sapiens
uaaauauauacaguaaauauuuaaaacaacauauauauuuaaaaucugauaauuauuacacaau

SEQ ID NO: 110608 - RNA, 64 nt, Homo Sapiens
acgagaaauacaacauuuaaauagugaacuauuaauauuuaaaauuauucaugaaaaacuuaga

SEQ ID NO: 110609 - RNA, 64 nt, Homo Sapiens
acaugugcaaucauccccccucagugguuuuaacauauuuaaauacacauuuaaaauacacaau

SEQ ID NO: 110610 - RNA, 64 nt, Homo Sapiens
auuuuuuauuuaauuuccuauuuucacauaaguuauauuuaagggaggagggaauuuuuuuuaa

SEQ ID NO: 110611 - RNA, 64 nt, Homo Sapiens
gucugcaguucucgaugaccgaaaguuaucaaaaauauuuaaaauauuuaaauugugaaccuau

SEQ ID NO: 110612 - RNA, 64 nt, Homo Sapiens
ucucgaugaccgaaaguuaucaaaaauauuuaaaauauuuaaauugugaaccuauugauaaaga

SEQ ID NO: 110613 - RNA, 64 nt, Homo Sapiens
acaaauauguuuauguauuaaaucaccauccaaaauauuuaaggaauauauaaaaagauuuuua

SEQ ID NO: 110614 - RNA, 64 nt, Homo Sapiens
caagaagucacugcuuuuuagguguguugcaucaauauuuaaauaaaaucccagaaauguauuu

SEQ ID NO: 110615 - RNA, 64 nt, Homo Sapiens
uaggcaggaaugaucuuuucaaaucauuagcacaauauuuaaauaucuaaaaauuuaagagauc

SEQ ID NO: 110616 - RNA, 64 nt, Homo Sapiens
aauaauugcgggugcuucaggacuuuuugcuucuauauuuaaguauauuguuuuuauagcaaga

SEQ ID NO: 110617 - RNA, 64 nt, Homo Sapiens
cuaaauaaaauuuuaacaaauuaaacuaaacaauauauuuaaagaugauauauaacuacucagu

SEQ ID NO: 110618 - RNA, 64 nt, Homo Sapiens
gugugguuugucccacaaaugcagaguugguuuaauauuuaaauaucaaccaguguaauucagc

SEQ ID NO: 110619 - RNA, 64 nt, Homo Sapiens
caaaaguacuugaaaauuuuuauuuuaccuuuucauauuuaaggcugcccucagguugccuaug

SEQ ID NO: 110620 - RNA, 64 nt, Homo Sapiens
uuuacacuucuaagacuagaaguugguugcccuaauauuuaaaaaugcuugcuuccauuauuuc

SEQ ID NO: 110621 - RNA, 64 nt, Homo Sapiens
auauaauuucagcuuccuugauuuugaccagaguauauuuaaguaauauuugugguucauguau

SEQ ID NO: 110622 - RNA, 64 nt, Homo Sapiens
auugcacuucuauaaauaguguuuuauuuugaaaauauuuaaauugauucauuuuaguuacugu

SEQ ID NO: 110623 - RNA, 64 nt, Homo Sapiens
uucugaaguuaacuccaaaucaucuaaucaagccauauuuaaauaaguaauaauuccccaauau

SEQ ID NO: 110624 - RNA, 64 nt, Homo Sapiens
ggagaaaaguaacuagaaaaauucaaauauuuaaauauuuaagacauuaguagauauaaacaua

SEQ ID NO: 110625 - RNA, 64 nt, Homo Sapiens
auuuaagaggagaaaaguaauaaacauaauucaaauauuuaaauaucuccuacauuaguagaua

SEQ ID NO: 110626 - RNA, 64 nt, Homo Sapiens
cuaaauuccagauuuuaagguuugggauuuucaaauauuuaauuacugcaagcuuuccugccaa

SEQ ID NO: 110627 - RNA, 64 nt, Homo Sapiens
auaacauacugugauucaucaaaaaagaguggauauauuuaacccauccuggugccaggaauau

SEQ ID NO: 110628 - RNA, 64 nt, Homo Sapiens
auuuuuuuuuucauccugguccuacauaagagguauauuuaaaggauaugcaaagaagcuauua

SEQ ID NO: 110629 - RNA, 64 nt, Homo Sapiens
ucuguacuuauaucuguaaacaucacaagcuugaauauuuaaaugcgaccaccuugccgcuuuu

SEQ ID NO: 110630 - RNA, 64 nt, Homo Sapiens
auuaugcugcacuguacuacgagaaaauauuuuuauauuuaaggggucuauuaucccaacagaa

SEQ ID NO: 110631 - RNA, 64 nt, Homo Sapiens
cuuacuugggaaaaaaucagacauuuuguuuuggauauuuaaucguaucaacaaguguaguuau

SEQ ID NO: 110632 - RNA, 64 nt, Homo Sapiens
uaaaacauuggcuuuauuucccaggcagauuuacauauuuaauuggucggauauuaaauaaguc

SEQ ID NO: 110633 - RNA, 64 nt, Homo Sapiens
guagaucuaugugguauucuuaauaugaaugcugauauuuaaaguaacauuuucuuauuucuua

SEQ ID NO: 110634 - RNA, 64 nt, Homo Sapiens
augcuauauauaguauaugcaauuauauauaaauauauuuaaaaucuaaauuucaugugcaaau

SEQ ID NO: 110635 - RNA, 64 nt, Homo Sapiens
uugaaaguuguaagcacugagcaagugucccuuuauauuuaaauugaaguugucuugcggcuuu

SEQ ID NO: 110636 - RNA, 64 nt, Homo Sapiens
cuuuucugcuguuuuuuuuuucaaaauuauauagauauuuaaagcugauagaauacaagaugau

SEQ ID NO: 110637 - RNA, 64 nt, Homo Sapiens
aauaaaaauauguugaauuuuuaauuauauucauauauuuaacaaguuuacugaaggaauauau

SEQ ID NO: 110638 - RNA, 64 nt, Homo Sapiens
auauucauauauuuaacaaauuuacugaaggaauauauuuaauuucuaguuuuguccaguucag

SEQ ID NO: 110639 - RNA, 64 nt, Homo Sapiens
cacuguuucuggcacgccucgugggcauuuugaaauauuuaacguuuccucaugauuugccuuu

SEQ ID NO: 110640 - RNA, 64 nt, Homo Sapiens
acauagugcugaaaaaucugcaacuucuuggaucauauuuaaugaauuauaguauaaugcuugc

SEQ ID NO: 110641 - RNA, 64 nt, Homo Sapiens
auuacagcuuauuuaaaaccaaauauaguugaacauauuuaaaauacauuuucacagaauggau

SEQ ID NO: 110642 - RNA, 64 nt, Homo Sapiens
uaauuucuauuacuaaaguucauaucacaaaaugauauuuaauaauaaccuugggguaaaucau

SEQ ID NO: 110643 - RNA, 64 nt, Homo Sapiens
cacugaauugucaguuuccuucauuugguauuacauauuuaauucuuaaauauugaggccccau

SEQ ID NO: 110644 - RNA, 64 nt, Homo Sapiens
uaaaaacauuucuauaaauauaaagcuuuucuuuauauuuaagacaaaauauaaaggcuagaau

SEQ ID NO: 110645 - RNA, 64 nt, Homo Sapiens
uagcugggaucauuuuugauccauugucauauuuauauuuaauuauuaaauguaucugaugaua

SEQ ID NO: 110646 - RNA, 64 nt, Homo Sapiens
acuuaauuccugaucaguauagacaggacuauauauauuuaaucagagaauuacauuauaucug

SEQ ID NO: 110647 - RNA, 64 nt, Homo Sapiens
ccaagaaagugaaaacuaauggucugcugauaaaauauuuaacccuuucucaagugugugauaa

SEQ ID NO: 110648 - RNA, 64 nt, Homo Sapiens
acauaccuauuuuguagacuaaaaaaggcuuuucauauuuaagcucccaaugucuuuacuuuuu

SEQ ID NO: 110649 - RNA, 64 nt, Homo Sapiens
ggacacuaauuuauauaggagugaaguuuuauaaauauuuaauauuuauuuuggauucaaauug

SEQ ID NO: 110650 - RNA, 64 nt, Homo Sapiens
auguauuaagacaggacauauuguuggugagauaauauuuaauagguauaaaaugguaaaauac

SEQ ID NO: 110651 - RNA, 64 nt, Homo Sapiens
acacaaauuaaaaagacaaauuaaaccugaaauuauauuuaaaauauauuugagacaugaaaua

SEQ ID NO: 110652 - RNA, 64 nt, Homo Sapiens
ucuuaugucuccucuauuaagaguauuuaaaaucauauuuaaauaugaaucuauucaugcuaac

SEQ ID NO: 110653 - RNA, 64 nt, Homo Sapiens
ugucuacauauaagguuuuuauuugaauuguaaaauauuuaaaaguaugaauaaaauauauuua

SEQ ID NO: 110654 - RNA, 64 nt, Homo Sapiens
caguuuccccccaaaaaagagauuuauuuaugaaauauuuaaaguuucuaaugugguauuuuaa

SEQ ID NO: 110655 - RNA, 64 nt, Homo Sapiens
cccaguuauuuaacaaauaaauaccucauugauuauauuuaaaaguaauacacuuccuguaaac

SEQ ID NO: 110656 - RNA, 64 nt, Homo Sapiens
auuuuguuguuaaauuauuuucuggcccuucuuaauauuuaaaaauguauuuccccuuguggcu

SEQ ID NO: 110657 - RNA, 64 nt, Homo Sapiens
auagauucuuccagauguuugggacacacuauuaauauuuaagccuauuauccuaccacuuugc

SEQ ID NO: 110658 - RNA, 64 nt, Homo Sapiens
uuaauauuuuauuugacacucacgggagcgugugauauuuaacauuaagaauguugguuauuuu

SEQ ID NO: 110659 - RNA, 64 nt, Homo Sapiens
cauuuuaacuucuauagguuacuauuuuaugucuauauuuaaauuauugaacaccuucaugcuu

SEQ ID NO: 110660 - RNA, 64 nt, Homo Sapiens
gauuaagaauauugcccaaaaauccauuuaaucaauauuuaagauuauuaccuuguuccuguaa

SEQ ID NO: 110661 - RNA, 64 nt, Homo Sapiens
cauuucacucuguacuauauuaugugccuaaauuauauuuaaauuaaucuauuuucauaaucaa

SEQ ID NO: 110662 - RNA, 64 nt, Homo Sapiens
uguuaaaacuuuaugaaaacuagaugcaguauggauauuuaaauaauuauauuuauugaauucc

SEQ ID NO: 110663 - RNA, 64 nt, Homo Sapiens
auacuuaaaucgugggaauuaaguguuucaguucauauuuaaugugauaauucuuugagaugcu

SEQ ID NO: 110664 - RNA, 64 nt, Homo Sapiens
aauaaaacaacaaaggggaaccuuaguagaauguauauuuaagagcuguucacaugaaaauauu

SEQ ID NO: 110665 - RNA, 64 nt, Homo Sapiens
cuauaucucagugauagggacagcugaagacaccauauuuaacaauuuaacccuuuuuuauaag

SEQ ID NO: 110666 - RNA, 64 nt, Homo Sapiens
uugcaguaugaccuggcucuguguuugaguuggaauauuuaaaauaccccucugaucauuuccu

SEQ ID NO: 110667 - RNA, 64 nt, Homo Sapiens
auuuuuguuucuccuuaggauagaaaaaauaaacauauuuaauaaguggcuacauuugacacuu

SEQ ID NO: 110668 - RNA, 64 nt, Homo Sapiens
cucucacagcuuuguguuuauaaaucuaguguccauauuuaauaugaauuucuuguuggaaaug

SEQ ID NO: 110669 - RNA, 64 nt, Homo Sapiens
uguauuuauuguuacaaguccaauguguauauuuauauuuaaagcuuuuauaugugugggauau

SEQ ID NO: 110670 - RNA, 64 nt, Homo Sapiens
aaugcucauucuuuguagaauuucacuguuuguaauauuuaagaucuguaagcuaguauauuug

SEQ ID NO: 110671 - RNA, 64 nt, Homo Sapiens
aaauauugcuuugaagauggggcagaauaaguuaauauuuaauugcauagcaguuuuugaccca

SEQ ID NO: 110672 - RNA, 64 nt, Homo Sapiens
uauuguaucaaauugugaauaggugauaagggguauauuuaaugcaaaauaauaaauguuaaua

SEQ ID NO: 110673 - RNA, 64 nt, Homo Sapiens
auuguuauuuuuaaaaaccaaauauuuauaauggauauuuaaugaauucuuuuaaaauaaaauu

SEQ ID NO: 110674 - RNA, 64 nt, Homo Sapiens
uuuuuucauuauaaaaugguacagaauaaggaacauauuuaacuuaguuguauaaaucaaaaac

SEQ ID NO: 110675 - RNA, 64 nt, Homo Sapiens
ggacccauugaggauaacuauaaaauuacagaaaauauuuaaaugcaacuuauugcuauagaag

SEQ ID NO: 110676 - RNA, 64 nt, Homo Sapiens
cuaggaacagauggcuucacugaaguuauuccaaauauuuaagaaauaauaccaggcuuuuaua

SEQ ID NO: 110677 - RNA, 64 nt, Homo Sapiens
ugaauuuaaucgggcccuugguggaaacauuuauauauuuaaugcagaugcauaguguuuuuca

SEQ ID NO: 110678 - RNA, 64 nt, Homo Sapiens
uauaauaucaacuauucuaaauacagguaaugguauauuuaaggcuaccauaacauccuauuua

SEQ ID NO: 110679 - RNA, 64 nt, Homo Sapiens
guuaacagaaugaaaaaaaauugccuucgaaugcauauuuaagacaguauagaaaccuccauuu

SEQ ID NO: 110680 - RNA, 64 nt, Homo Sapiens
uuguacaguauagaaaccucccaugacauuguagauauuuaauaacacuccuaaaaauaaggaa

SEQ ID NO: 110681 - RNA, 64 nt, Homo Sapiens
gaaacaaguuuuaccaaacagcacggacacguacauauuuaacuaggauauuuaaucaugacau

SEQ ID NO: 110682 - RNA, 64 nt, Homo Sapiens
augacaugcacggacacguacugugguaagaaggauauuuaaucgcuuugguucuuuaggguga

SEQ ID NO: 110683 - RNA, 64 nt, Homo Sapiens
agagguauagaagcucuucaaagcauuuucugauauauuuaauaagcuaauuaaucugcauaug

SEQ ID NO: 110684 - RNA, 64 nt, Homo Sapiens
cuagaucuauuaauacauuccugagacaaguauuauauuuaaaacaaaauuuuuaucuuuaaau

SEQ ID NO: 110685 - RNA, 64 nt, Homo Sapiens
aaaguauuucuugucugugaguucauuuuacacaauauuuaauuauauuuaacuguauaaaaau

SEQ ID NO: 110686 - RNA, 64 nt, Homo Sapiens
guauaaaaauguucauuuuaguacauuuuuucagauauuuaacuacaauaagauuguuuuaucu

SEQ ID NO: 110687 - RNA, 64 nt, Homo Sapiens
cugauaguccaaggaaccaccuuucucccuugauauauuuaacuccgucuuuggccugacaaca

SEQ ID NO: 110688 - RNA, 64 nt, Homo Sapiens
gcugcuauacaacugcuuugcaacaguugcugguauauuuaaaucauuaaauuucagcauuuac

SEQ ID NO: 110689 - RNA, 64 nt, Homo Sapiens
ggauaacauuuuaauuugaagguuuggaauauauauauuuaagcuuuauuuccagaacagugag

SEQ ID NO: 110690 - RNA, 64 nt, Homo Sapiens
uuuacuaccuuugcaaaaacaaaauaccccaaagauauuuaaacaagguuauaauuuagcaucu

SEQ ID NO: 110691 - RNA, 64 nt, Homo Sapiens
guguuuguaugguguuaugaaaccucuuuccugaauauuuaaaugacuaagcaauaaucuuaac

SEQ ID NO: 110692 - RNA, 64 nt, Homo Sapiens
aagagaugaagcucugcaguuacaguacuugaaaauauuuaagguuuucauggauuuguguucu

SEQ ID NO: 110693 - RNA, 64 nt, Homo Sapiens
uggaaugucaaugccaggauuaaaguauagaaauauauuuaauguggucaguugaaccuuacag

SEQ ID NO: 110694 - RNA, 51 nt, Homo Sapiens
gcacugagaaacaugcaagauauauuuaauguaagaagaaauagaagauaa

SEQ ID NO: 110695 - RNA, 64 nt, Homo Sapiens
uuuaucauuauauucuaaucuugaauauucuaccauauuuaaaaauaucucaagguuucuguuc

SEQ ID NO: 110696 - RNA, 64 nt, Homo Sapiens
auuaaauaguuuaagcucaauuuaauuuugcuagauauuuaacaaaacauacggcucaaccuca

SEQ ID NO: 110697 - RNA, 64 nt, Homo Sapiens
auacuacaguucggagaacugcuuauuuccaaguauauuuaacuuauaaaguuaauaaauaguu

SEQ ID NO: 110698 - RNA, 64 nt, Homo Sapiens
uagacuucauuuauauuuuccuuacuaauaucuaauauuuaaugaauaaugaucaauuuuuuau

SEQ ID NO: 110699 - RNA, 64 nt, Homo Sapiens
caagaugggagacuaggucauacuagaauuucucauauuuaaacuuagcucuauccccacuauc

SEQ ID NO: 110700 - RNA, 64 nt, Homo Sapiens
aagggaugggagggguuauuuucaggcuguuuguauauuuaauuaccaauuuaaauuguauguu

SEQ ID NO: 110701 - RNA, 64 nt, Homo Sapiens
agugaauauaauuugaggcaauauauauauauguauauuuaaaagaaaaaauuugaauauacau

SEQ ID NO: 110702 - RNA, 64 nt, Homo Sapiens
uuuaagucaaaaacuaugcuauguaauagggaaaauauuuaauugagauaguaaaaauuuaaaa

SEQ ID NO: 110703 - RNA, 64 nt, Homo Sapiens
aucaauaaaaucaaacucuugugaaauauuuaauauauuuaaauauggugaaccauguauuuca

SEQ ID NO: 110704 - RNA, 64 nt, Homo Sapiens
uauuuaaauaucaauaaaauuguauuucagugaaauauuuaauaugggggaggauggugaacca

SEQ ID NO: 110705 - RNA, 64 nt, Homo Sapiens
uacuuuuuguuacucuuuacugugugaguuuaguauauuuaauuuuucauuuuauucuaccugu

SEQ ID NO: 110706 - RNA, 64 nt, Homo Sapiens
aauaauacuaucuuuuauaguauauagcuauaguauauuuaaacucuguguguuacuuucuuuu

SEQ ID NO: 110707 - RNA, 64 nt, Homo Sapiens
uuuuuggcuuuucaucuaaguuucgaguuuuucgauauuuaaaucauuuuuugaugugccacag

SEQ ID NO: 110708 - RNA, 64 nt, Homo Sapiens
aguaagccuuaguuguacaucagauaugccucagauauuuaaccauaaggaaaguguucaaggc

SEQ ID NO: 110709 - RNA, 64 nt, Homo Sapiens
cucauucucaucagacucuccuuguuuuguuugcauauuuaauuuuaaauuaaaccaaagaaua

SEQ ID NO: 110710 - RNA, 64 nt, Homo Sapiens
aguucagugaacugguacaauguggucccucucaauauuuaaaaauauaauuuguaacagugcu

SEQ ID NO: 110711 - RNA, 64 nt, Homo Sapiens
uaaauuauauuugugcuauaguauuugauucaaaauauuuaaaaaugucuugcuguugacauau

SEQ ID NO: 110712 - RNA, 64 nt, Homo Sapiens
gauucaaaauauuuaaaaaugucuugcuguugacauauuuaauguuuuaaauguacagacauau

SEQ ID NO: 110713 - RNA, 64 nt, Homo Sapiens
cuguugacauauuuaauguuuuaaauguacagacauauuuaacuggugcacuuuguaaauuccc

SEQ ID NO: 110714 - RNA, 64 nt, Homo Sapiens
acugggaauggaaacuuaauccaauccugcuuccauauuuaagcaaaauauaguaugugauuaa

SEQ ID NO: 110715 - RNA, 64 nt, Homo Sapiens
uuaaagugccaugaaaaauauuugccuuuuagugauauuuaaugaacuaugaauauuuacauau

SEQ ID NO: 110716 - RNA, 64 nt, Homo Sapiens
ugguuaauuuguggacagucccaauguaucuuugauauuuaaccuguuguuuuggggaguauuc

SEQ ID NO: 110717 - RNA, 64 nt, Homo Sapiens
aaagacuuauaaaauaccuaaauauguguagaauauauuuaauaucuuccuggaugaaauuaca

SEQ ID NO: 110718 - RNA, 64 nt, Homo Sapiens
cgcccucuauccguagaguacaguguauugacgcauauuuaacuaauauggacccugcugaaag

SEQ ID NO: 110719 - RNA, 64 nt, Homo Sapiens
gcaaugcaaaagucuuccugaaugucuuaaaaauauauuuaaugagaggaagaccaaaaaauuc

SEQ ID NO: 110720 - RNA, 64 nt, Homo Sapiens
ucaagacaaugcaccuagcuuggugugccucaguauauuuaaacuuuugaauccuuugccugcc

SEQ ID NO: 110721 - RNA, 64 nt, Homo Sapiens
cauuaaaccugucuccacuggaaugauucauguuauauuuaaugaacacgaaacuuguuauugu

SEQ ID NO: 110722 - RNA, 64 nt, Homo Sapiens
gaauugaauuccugaugggagaagaagaaaaaaaauauuuaaauguauucauuuugaguagguu

SEQ ID NO: 110723 - RNA, 64 nt, Homo Sapiens
cuuauuuauuaaucucuugcuuuuguaaaacagaauauuuaaucauauuggccauucuguaugu

SEQ ID NO: 110724 - RNA, 64 nt, Homo Sapiens
caucaggugccuauggauuaaaucacauacuggcauauuuaagcugaaugucaaucuggaaaau

SEQ ID NO: 110725 - RNA, 64 nt, Homo Sapiens
cagaaauaccacucuuuguguagauauuugucauauauuuaagaaaaagcuaaaaagaauggaa

SEQ ID NO: 110726 - RNA, 64 nt, Homo Sapiens
ugaaagcaguuuuauguauaaauaacaaauguuuauauuuaacuaaauguaagguacgaauuau

SEQ ID NO: 110727 - RNA, 64 nt, Homo Sapiens
auauauaucuacugucacauuccauauauuuugaauauuuaacucaucuaguuaauaauguuuu

SEQ ID NO: 110728 - RNA, 64 nt, Homo Sapiens
uuguguuggaacauuugaacaugaacucuugcauauauuuaaaauaucaaaucagaauguaaac

SEQ ID NO: 110729 - RNA, 64 nt, Homo Sapiens
auagagccaguuuuuuuuuucaggguuaggcuccauauuuaaaggagggacgguauuuaugaau

SEQ ID NO: 110730 - RNA, 64 nt, Homo Sapiens
aauuauaucauacugauacuugacaaugucccauauauuuaagauucauaugaaucacagcugu

SEQ ID NO: 110731 - RNA, 64 nt, Homo Sapiens
aaagccuuacugaagaauaaaggucaauaggcuuauauuuaauuauauuaaaauugugaagcaa

SEQ ID NO: 110732 - RNA, 64 nt, Homo Sapiens
uauucggaaauauauuccacuauuguaugucuuaauauuuaacuaaaguaggacauuauugcca

SEQ ID NO: 110733 - RNA, 64 nt, Homo Sapiens
ugugcuuaugugguguuuggaaaauauuuugacaauauuuaauuauggucuucaauuuaauuua

SEQ ID NO: 110734 - RNA, 64 nt, Homo Sapiens
auauagaauuauuacaauuuccugggagagauggauauuuaaaccucuauuauuuuagacaaga

SEQ ID NO: 110735 - RNA, 64 nt, Homo Sapiens
gucaucauauguauaugucauaugacuuuauaaaauauuuaaugugacaaaaaguggaaagaau

SEQ ID NO: 110736 - RNA, 64 nt, Homo Sapiens
uaauuuuaugaaaauuaugcucaauaagaguuguauauuuaauauauuugcagugaacacagaa

SEQ ID NO: 110737 - RNA, 64 nt, Homo Sapiens
cugacaagguagagguccagguucaccuuuauauauauuuaaaacaauuaguacugaauuggac

SEQ ID NO: 110738 - RNA, 64 nt, Homo Sapiens
auuaaaaaaggauuuguauuaaaucuuauucuguauauuuaauguagcauuuuuguauuuaaau

SEQ ID NO: 110739 - RNA, 64 nt, Homo Sapiens
gaaagaaacugcaggcgccuuuguaaaaugcaaaauauuuaauuaaaagagauuuuaacauaau

SEQ ID NO: 110740 - RNA, 64 nt, Homo Sapiens
uuucuucuuuuuccuugacaguuuucuugccauuauauuuaacuuaaauaaaauugguaggaau

SEQ ID NO: 110741 - RNA, 64 nt, Homo Sapiens
caugccuggauaaauaaaauuguaacaaacagccauauuuaagaaugucugcagaaucacugua

SEQ ID NO: 110742 - RNA, 64 nt, Homo Sapiens
uuucuucuuuuuccuugacaguuuucuugccauuauauuuaacguaaauaaaauugguaggaau

SEQ ID NO: 110743 - RNA, 64 nt, Homo Sapiens; identical to SEQ ID NO: 110741

SEQ ID NO: 110744 - RNA, 64 nt, Homo Sapiens
acccaaauuaucaaaccauuauauuuaauauuuaauauuuaaaacauuccuuccgaaaccccug

SEQ ID NO: 110745 - RNA, 64 nt, Homo Sapiens
uuuaaaaacccaaauuaucaaccccugauauuuaauauuuaauaaauucaucauuccuuccgaa

SEQ ID NO: 110746 - RNA, 64 nt, Homo Sapiens
uuuaauauuuaaaaacccaauuccgaaaccccugauauuuaauagagacggaauucaucauucc

SEQ ID NO: 110747 - RNA, 64 nt, Homo Sapiens
aucucuauuuaauauuuaugucuauuuaagccucauauuuaaagacagggaagagcagaacgga

SEQ ID NO: 110748 - RNA, 64 nt, Homo Sapiens
gucucccacgugggagacaagaaaucccuguuuaauauuuaaacagcaguguuccccaucuggg

SEQ ID NO: 110749 - RNA, 64 nt, Homo Sapiens
augauauucaguacaacucugucauuucuuuguaauauuuaaaaaauauuaguaaaggagugaa

SEQ ID NO: 110750 - RNA, 64 nt, Homo Sapiens
cuguaaaguucugaccuugauaacaaagcuauaaauauuuaaguuugcuaauaugcguaaguau

SEQ ID NO: 110751 - RNA, 64 nt, Homo Sapiens
uuaaaacaguauuugaguuuaaaagaguuuguauauauuuaaaugaauaacuuuuuauacucuu

SEQ ID NO: 110752 - RNA, 64 nt, Homo Sapiens
gccacccggguuuaguucagccauuucaagaaguauauuuaacgucgguaguucugcuuuauua

SEQ ID NO: 110753 - RNA, 64 nt, Homo Sapiens
ggaaguaugauuucaaggaccuuuauuuugcucaauauuuaauaauaaauaauuuucuuuuaau

SEQ ID NO: 110754 - RNA, 64 nt, Homo Sapiens
auuagcugagacauauuuuuaacuuugguuaucuauauuuaaacaaacuggggauuuuguuugu

SEQ ID NO: 110755 - RNA, 64 nt, Homo Sapiens
acauuucagcgagacaaaguuuggugcucagacaauauuuaagggauccuugcuuuugcagaau

SEQ ID NO: 110756 - RNA, 64 nt, Homo Sapiens
uggucagucagguagaagaugauucuugggcagaauauuuaaauauucugugacaaaaaguuaa

SEQ ID NO: 110757 - RNA, 64 nt, Homo Sapiens
aauaaaaggaauuccaaauggacaagcaguaaugauauuuaaauauuuugagugagggggagug

SEQ ID NO: 110758 - RNA, 64 nt, Homo Sapiens
uuuuuuuuucuuucuuucuaaucucauuuuggugauauuuaaacaaacauaaaugauuguaacu

SEQ ID NO: 110759 - RNA, 64 nt, Homo Sapiens
acagcaaggugcucuaaguaauauucgauaaaauauauuuaauagaaauuugcguuugauauuc

SEQ ID NO: 110760 - RNA, 64 nt, Homo Sapiens
uuuacuucucccccaauuuuaaagaaguauguguauauuuaauaggggaagguaguuuauggaa

SEQ ID NO: 110761 - RNA, 64 nt, Homo Sapiens
guuuugugguccugaugggcccacaaguuuuucuauauuuaacuggaaauaugcuuugauuuug

SEQ ID NO: 110762 - RNA, 64 nt, Homo Sapiens
caacaacucauuuuuacagaguuugugaagcuaaauauuuaacauuguugauuucaguaagcug

SEQ ID NO: 110763 - RNA, 64 nt, Homo Sapiens
uauauggaguuucgaagaauaaaauaugagagcaauauuuaaauucucaggaauugacuuauac

SEQ ID NO: 110764 - RNA, 64 nt, Homo Sapiens
uguauauauuuuauuuaaauauauguuacauauuauauuuaaacauacauauuuaacauuuuuu

SEQ ID NO: 110765 - RNA, 64 nt, Homo Sapiens
uuaaauauauguuacauauuauauuuaaacauacauauuuaacauuuuuuacauaucuaucaau

SEQ ID NO: 110766 - RNA, 64 nt, Homo Sapiens
ccuuguuuagcugauggucauuucugggauuggaauauuuaauaagcccaauucuaaguugaua

SEQ ID NO: 110767 - RNA, 64 nt, Homo Sapiens
auuuccuaauuuauacaugauuuuugguguuaauauauuuaaugauuaauaacagaauguuuau

SEQ ID NO: 110768 - RNA, 64 nt, Homo Sapiens
aauuuaaaaagcuaaugacauuaaugagaugaaaauauuuaacguuuaaaggaagaaaccauuu

SEQ ID NO: 110769 - RNA, 64 nt, Homo Sapiens
gcaaaguuacaugaggggaacaguuucccagaauauauuuaaaugugugagccacugugcccag

SEQ ID NO: 110770 - RNA, 64 nt, Homo Sapiens
cuugccugguuucuaaacccuauugugcaaacuuauauuuaaaaugauguauauuuaauguuaa

SEQ ID NO: 110771 - RNA, 64 nt, Homo Sapiens
uuaauauugugcaaacuuaucuuauuuaugauguauauuuaaugucaguuuuauauuuauaagc

SEQ ID NO: 110772 - RNA, 64 nt, Homo Sapiens
cugaguuuaauuuaauauguguaauuauacaagcauauuuaaugcugcuaucaucauuaacagc

SEQ ID NO: 110773 - RNA, 64 nt, Homo Sapiens
caaauuuaaagggccuguuauuuaaaucuucaaaauauuuaaaaauuacaaacuuuaaacacuu

SEQ ID NO: 110774 - RNA, 64 nt, Homo Sapiens
aaauaccuuccaaugaaaccaagaauuucucaaaauauuuaaugucacauauuauaagaaguua

SEQ ID NO: 110775 - RNA, 64 nt, Homo Sapiens
gaagauuuauaaauguuugaaauuguacacauugauauuuaaugacaaauuuacuuaaaauaaa

SEQ ID NO: 110776 - RNA, 64 nt, Homo Sapiens
cacuaauaagcaucaguuuguuguuuuuaaaaggauauuuaagugagcauuuucuaguucauau

SEQ ID NO: 110777 - RNA, 64 nt, Homo Sapiens
gcauacuccaguguuuuagggguuuugaaaauaaauauuuaaauuucacaguccucaauguuug

SEQ ID NO: 110778 - RNA, 64 nt, Homo Sapiens
ggaaauugagcugcuuuuuuaaauaucuaguaauauauuuaaagacaacauauacaacaccaaa

SEQ ID NO: 110779 - RNA, 64 nt, Homo Sapiens
uugaacaaaauaaauuggaguuuuguaaagaaaaauauuuaauguuagccuaagauauacuugu

SEQ ID NO: 110780 - RNA, 64 nt, Homo Sapiens
uuaauugcaucuucauuaggaguaguucaaggugccaucuuaaauauuuauuauauauaucaac

SEQ ID NO: 110781 - RNA, 64 nt, Homo Sapiens
uuuuccuacacuaguaucuucagaaauagugaugccaucuuagacgugcuucaagugaagagug

SEQ ID NO: 110782 - RNA, 64 nt, Homo Sapiens
uucucauguccugcuggaagaguuccgguaguggccaucuuacauucuucuuuuggcaccugua

SEQ ID NO: 110783 - RNA, 64 nt, Homo Sapiens
gacgagaaaaccagcacacacugccuguccgaccccaucuuacaacagcgccuaccaugugcag

SEQ ID NO: 110784 - RNA, 64 nt, Homo Sapiens
caaaauuuuccuucuguuaaaggaaaauauugugaauaaccacugguguguucuuagaucagca

SEQ ID NO: 110785 - RNA, 64 nt, Homo Sapiens
caugcuaaauauugcaugcauauugacuaauuggaauaaccauuuacucaauuauggacagcuu

SEQ ID NO: 110786 - RNA, 64 nt, Homo Sapiens
aauuaaacuuuuuucuacaauucaagauucaaacaauaaccagcucaucagugaagaauuguau

SEQ ID NO: 110787 - RNA, 64 nt, Homo Sapiens
auuuuauaccaguaucaucaugcuagcaugaauuaauaaccaccuguuaaauuaguuuugguug

SEQ ID NO: 110788 - RNA, 64 nt, Homo Sapiens
ugucuuucccauuuugugcauaaaauaaccaacuaauaaccauuaguuuuaaauauuguguuua

SEQ ID NO: 110789 - RNA, 64 nt, Homo Sapiens
uaauaaccauuugucuuuccuauuguguuuauaaaauaaccaacguacuaauuuaaguuuuaaa

SEQ ID NO: 110790 - RNA, 64 nt, Homo Sapiens
acagccaagugaagcagccaaaacaaauuggaagaauaaccagggggaaucucccaaaauuuaa

SEQ ID NO: 110791 - RNA, 64 nt, Homo Sapiens
uaaccccagcugccguuaacgcgagagaucugugaauaaccagauagucaggaguaagcucugu

SEQ ID NO: 110792 - RNA, 64 nt, Homo Sapiens
caacccugaggaacaucuuguaaauaaauaaguaaauaaccaacaaaaaaugaaguguauuaag

SEQ ID NO: 110793 - RNA, 64 nt, Homo Sapiens
cccuuucugcaucccuguccucccuuguuguauuaauaaccacaaggauuuagccucaaguagu

SEQ ID NO: 110794 - RNA, 64 nt, Homo Sapiens
uuaagucauaauuuguccuuaauaugccuucauaaauaaccauuuacuuugcaugauaugccuu

SEQ ID NO: 110795 - RNA, 64 nt, Homo Sapiens
auuguaugugccuguuuuuuuuaagggugagaagaauaaccacauuucaacaggccacucacuc

SEQ ID NO: 110796 - RNA, 64 nt, Homo Sapiens
ugaguugacagaagcaacuauuguacaaauuaaaaauaaccauaagggagaaaccagaagaauu

SEQ ID NO: 110797 - RNA, 64 nt, Homo Sapiens
uagcagagcuuuauugcaggcauuuuaaaaauugaauaaccaugugaaauaauuugggcuuaaa

SEQ ID NO: 110798 - RNA, 64 nt, Homo Sapiens
aacaugagaaagcucaugggcaagaaacucuaugaauaaccaagauggagccgggugcaguugc

SEQ ID NO: 110799 - RNA, 64 nt, Homo Sapiens
ugccuugugagagauugagacacucuaaauaaauaauaaccaagaugggaaauuucccugccag

SEQ ID NO: 110800 - RNA, 64 nt, Homo Sapiens
gagugcuuccguugcaggcagaagggacaaguuagauaaggacuaguuagcauguuggggccag

SEQ ID NO: 110801 - RNA, 64 nt, Homo Sapiens
aaugcuagcaucucugucuccaggaauacuuagggauaaggaagcuccaauugggacuccccag

SEQ ID NO: 110802 - RNA, 64 nt, Homo Sapiens
guacuugcauauggugaauugauuauucucgcaugauaaggauguacauuucuacagaaccugu

SEQ ID NO: 110803 - RNA, 64 nt, Homo Sapiens
agcuucucgaaguguccaucuuaaaauguuucuggauaaggauuuugcuuuguuuuuuaagaga

SEQ ID NO: 110804 - RNA, 64 nt, Homo Sapiens
ugaguuugguaccaucuuauuuuccccuuauacagauaaggaaacuggggugcagaaaagugaa

SEQ ID NO: 110805 - RNA, 64 nt, Homo Sapiens
uagcccugagguucuuuucccaggauggcuccaggauaaggaucacuguaggugguuguggagu

SEQ ID NO: 110806 - RNA, 64 nt, Homo Sapiens
ucacuuuuaucuuuuagguaagagaaaagaaaaagauaaggaaagaagagagaagagagacaaa

SEQ ID NO: 110807 - RNA, 64 nt, Homo Sapiens
ugcaggucagagguggagugcaaaauaucguuaugauaaggagugguugaauaaugggagaaug

SEQ ID NO: 110808 - RNA, 64 nt, Homo Sapiens
cuuuggggauuaaccaaccuuuccucauuucacagauaaggaauuucacauucuuauuguaacc

SEQ ID NO: 110809 - RNA, 64 nt, Homo Sapiens
gaauauaaagauugcuauuuucaugugcaaaggagauaaggaauauuaaaaccaacaaggaguu

SEQ ID NO: 110810 - RNA, 64 nt, Homo Sapiens
cuuaaaauggaaaucauucucaucccaagaagaggauaaggaugugagcaguaaaucaauggaa

SEQ ID NO: 110811 - RNA, 64 nt, Homo Sapiens
gugccauuggaaauuucauuuaugugcugcuguagauaaggacuuuugcccaaugugugcaggu

SEQ ID NO: 110812 - RNA, 64 nt, Homo Sapiens
accccuggagaggaagggagucaagcagcgauuggagcccaagcguguguguguccugaacucc

SEQ ID NO: 110813 - RNA, 64 nt, Homo Sapiens
ugccagucugcgauuggaaaucgggcaugaacgcgagcccaaagugcugguagaaucagggucc

SEQ ID NO: 110814 - RNA, 64 nt, Homo Sapiens
ggaagccccgcccagacgguguucagggaacccggagcccaagcgcuccggcggagcccaaaag

SEQ ID NO: 110815 - RNA, 64 nt, Homo Sapiens
uguucagggaacccggagcccaagcgcuccggcggagcccaaaagggugggggugggaggggca

SEQ ID NO: 110816 - RNA, 64 nt, Homo Sapiens
ugcauuuuacuuugcugacuuuguuguaauagaucccauucauuguccccuuugggguauuucc

SEQ ID NO: 110817 - RNA, 64 nt, Homo Sapiens
gcgcuggccuggccuugaaagaaccgaagucuuucccauucacuucucuagaaagcugccaaga

SEQ ID NO: 110818 - RNA, 64 nt, Homo Sapiens
acccaucucccccaucccccacugccacacccuccccauucagacacuucauggaccaagaaug

SEQ ID NO: 110819 - RNA, 64 nt, Homo Sapiens
agaagucauggcccaaauccagugugcaccccuccccauucacagagccuuuuucacaauucca

SEQ ID NO: 110820 - RNA, 64 nt, Homo Sapiens
ccauccugugagaccacgccagacugugcccggccccauucacucccacucacaacaucuugua

SEQ ID NO: 110821 - RNA, 64 nt, Homo Sapiens
ccauccugugagucccacucagacuaugcccagccccauucacucccacucacuccaucuugua

SEQ ID NO: 110822 - RNA, 64 nt, Homo Sapiens
ggaguagaaguccauccuccccccaaccuccugacccauucauaaaugcugagaaugucucuca

SEQ ID NO: 110823 - RNA, 64 nt, Homo Sapiens
gcaagacucugaugauaauucuguuucucaucugcccauucaguauuuuguuuuccuuccguca

SEQ ID NO: 110824 - RNA, 64 nt, Homo Sapiens
uggggaggcagucauaccuguucagagaaccaggaagacucaauaucuaucucagaggaaauau

SEQ ID NO: 110825 - RNA, 64 nt, Homo Sapiens
guuacccaggaaagaaauggucugcuagagugauaagacucagaacaggaagccugcaugugac

SEQ ID NO: 110826 - RNA, 64 nt, Homo Sapiens
cccuccagccacagcaguccacagcagcaggguuaagacucagcacagggccagcagcagcaca

SEQ ID NO: 110827 - RNA, 64 nt, Homo Sapiens
caggaaaagggaugagagaaaggaggugguauggaagacucagcaggaacaagguaggcuucaa

SEQ ID NO: 110828 - RNA, 64 nt, Homo Sapiens
agagaaggagccaucuccaucuugaaggaacucaaagacucaagugggaacgacugggcacugc

SEQ ID NO: 110829 - RNA, 64 nt, Homo Sapiens
guagaugcccugauaaagaacaucuguccugugaaagacucaaugagcuguuauguuguaaaca

SEQ ID NO: 110830 - RNA, 64 nt, Homo Sapiens
cucacccacuggccccgagggggguguagacgccaagacucacgcaugugugacauccggaguc

SEQ ID NO: 110831 - RNA, 64 nt, Homo Sapiens
ccccacccuggggcccugccucaccaaggaaauaaagacucaagccauuuugggguguccaggc

SEQ ID NO: 110832 - RNA, 64 nt, Homo Sapiens
gggccaugucuuacucucaguaucuacaacacacaagacucaguaggcccugacugaugucucu

SEQ ID NO: 110833 - RNA, 64 nt, Homo Sapiens
agagacugaugagaaacguucauaacaugaagguaagacucagggagacagagacuuuguggaa

SEQ ID NO: 110834 - RNA, 64 nt, Homo Sapiens
cgcgagacgcuguacuaggcugugcgccccggaacguguccaggaggagccuggccaugggucc

SEQ ID NO: 110835 - RNA, 64 nt, Homo Sapiens
gcuccuaucugugcacuuaccguagguagggacacguguccacgcaccacagacacacccacga

SEQ ID NO: 110836 - RNA, 64 nt, Homo Sapiens
ucagacaaagguaaaucagccagccaggcacccacagccucagcuccugugcaguuccugggca

SEQ ID NO: 110837 - RNA, 64 nt, Homo Sapiens
cagaggguccccucugggagaaacagcuucaccccagccucagggcccugggccaucacugcag

SEQ ID NO: 110838 - RNA, 64 nt, Homo Sapiens
cccucgaggcagggaaaagccaucuauucuucugcagccucaggagcgagacuucaaggacuca

SEQ ID NO: 110839 - RNA, 64 nt, Homo Sapiens
auaagagccccuucugcaucuuauucacagcuugcagccucagccccuuugaugaggcccucag

SEQ ID NO: 110840 - RNA, 64 nt, Homo Sapiens
gcagaggcaaggucagaaagauagccaagaauggcagccucagcacucagccucaggaugggga

SEQ ID NO: 110841 - RNA, 64 nt, Homo Sapiens
auggggaauagccaagaauguccuggacuccacucagccucaggaacagccacuuagugcuuug

SEQ ID NO: 110842 - RNA, 64 nt, Homo Sapiens
ugaaaacccgaaucugagaaucuuaagaacugcccagccucagcugguuguuuaugcaacucua

SEQ ID NO: 110843 - RNA, 64 nt, Homo Sapiens
cugggacaccuagguggagaguugaaucuugucccagccucagcccuggagaaggcauuccagg

SEQ ID NO: 110844 - RNA, 64 nt, Homo Sapiens
ggccucagucuucagauagacaguaagaagaaagcagccucauugauccgcagauguaggggcc

SEQ ID NO: 110845 - RNA, 64 nt, Homo Sapiens
gcuguguaguccauagcccagccagaugagcuugcagccucauaggaggucagcaccuugcaaa

SEQ ID NO: 110846 - RNA, 64 nt, Homo Sapiens
uguugcaacucuguguaccaagaaccccuagcaucagccucauuccuaagccaauaacgccugu

SEQ ID NO: 110847 - RNA, 64 nt, Homo Sapiens
uucaucuucuggugcccacggccauuggcauugccagccucauuccaugccacuaugagucaac

SEQ ID NO: 110848 - RNA, 64 nt, Homo Sapiens
gcagcccccuccugaccccaccagggggaagcaccagccucaguccucaucugaaaggcccaaa

SEQ ID NO: 110849 - RNA, 64 nt, Homo Sapiens
ggccccuugcugcuggcuccgccucucacucuggcagccucagauggggccauacccauguguc

SEQ ID NO: 110850 - RNA, 64 nt, Homo Sapiens
ggaaagaugguggaagacauaggcuaaauuucuccagccucacaauggucuucacuuggucuga

SEQ ID NO: 110851 - RNA, 64 nt, Homo Sapiens
ccuagaagauuccuggauggagaccccauugguucagccucaagucuggcccgucuucgaaaaa

SEQ ID NO: 110852 - RNA, 64 nt, Homo Sapiens
agcagcgcuuucagcuggaccacucaggccuggacagccucaucuccaugaggcuggugcuucg

SEQ ID NO: 110853 - RNA, 64 nt, Homo Sapiens
ccuuggccucuucuugcuuugaccuggcagauaucagccucaacauugaguaugcaccucucug

SEQ ID NO: 110854 - RNA, 64 nt, Homo Sapiens
agagccgugagccaaguaaaccucuuuaauuacccagccucaggugcuccgggaacgccuuccg

SEQ ID NO: 110855 - RNA, 64 nt, Homo Sapiens
ccucgaagauguuguacuccaccgccugcaccaacagccucaguguuacuucccaggauuugcu

SEQ ID NO: 110856 - RNA, 64 nt, Homo Sapiens
ucccucauugguuaaaagggucugagcucuucuucagccucagugcuguaauuaccgagcaagg

SEQ ID NO: 110857 - RNA, 64 nt, Homo Sapiens
ugcuguccgccugaucugucuggcccccucuccccagccucagcggcauggguguccacagcac

SEQ ID NO: 110858 - RNA, 50 nt, Homo Sapiens
agcucguggggauggagugacagccucagucccccucagcacagacaaaa

SEQ ID NO: 110859 - RNA, 64 nt, Homo Sapiens
gguuucaggccaaaaccagggaagauucuagcuucagccucauguccauuuccagucugucagc

SEQ ID NO: 110860 - RNA, 64 nt, Homo Sapiens
guuuaugccuucaucagcgugaccccugugccugcagccucauagguguuaaucuguaauuuua

SEQ ID NO: 110861 - RNA, 64 nt, Homo Sapiens
gcuggagugcaguggugcagucuguagcucacugcagccucaaacuccuaggcucaggcgaucc

SEQ ID NO: 110862 - RNA, 64 nt, Homo Sapiens
guccucucauccucccgccgcccgucaggccggccagccucacaucagucucuccgccccgggg

SEQ ID NO: 110863 - RNA, 64 nt, Homo Sapiens
uuccagccaaaguccccccaccccuucagagaagcagccucaaauuccagaaguggaggcucca

SEQ ID NO: 110864 - RNA, 64 nt, Homo Sapiens
cuugccaccaaccgaaccgugaauguagggcccccagccucaccucugccccaggaccaacaac

SEQ ID NO: 110865 - RNA, 64 nt, Homo Sapiens
gucauaucacuuugcucuuaccauuccuuuugaucagccucaauucagccucauuguguaguau

SEQ ID NO: 110866 - RNA, 64 nt, Homo Sapiens
uugcucuuaccauuccuuuugaucagccucaauucagccucauuguguaguauguuuuuucuuu

SEQ ID NO: 110867 - RNA, 64 nt, Homo Sapiens
acuccucccuggaccugcaggccucaccuuccuccagccucacccuccugaaccuccuccucca

SEQ ID NO: 110868 - RNA, 61 nt, Homo Sapiens
uuccuccagccucaccacucaccuccuccuccagccucaccuuuaccucagagccuccuga

SEQ ID NO: 110869 - RNA, 64 nt, Homo Sapiens
cuccagggcuuaagcaauccaucauggcucacugcagccucaacggcuggagugcaguggcaug

SEQ ID NO: 110870 - RNA, 64 nt, Homo Sapiens
caugcuaagggcacaugcacagacucacuuagcucagccucaccagcuuuuaaaaaggaagggu

SEQ ID NO: 110871 - RNA, 64 nt, Homo Sapiens
caagagggccaucagaaggaagccaaagaguucacagccucagcaccaacaacucaacaugguc

SEQ ID NO: 110872 - RNA, 64 nt, Homo Sapiens
uuuuuauguuuccuaaaggaaauuguuuauucuacagccucaguagguagacacaaacauaaag

SEQ ID NO: 110873 - RNA, 64 nt, Homo Sapiens
uugcuguccucugacacugccagccucacuuccccagccucaccuagggccucucugggcccua

SEQ ID NO: 110874 - RNA, 64 nt, Homo Sapiens
uccccagccucaccuugcugcucucugggcccuacagccucacuacuguuggaggcacuagggc

SEQ ID NO: 110875 - RNA, 64 nt, Homo Sapiens
cauuccucucagcuccgccccauacccgucacuacagccucaccucccaccccugucacuacgg

SEQ ID NO: 110876 - RNA, 64 nt, Homo Sapiens
gucacuacggccucaccucccaccccugucacuacagccucaccuccuacagccuuaaguccca

SEQ ID NO: 110877 - RNA, 64 nt, Homo Sapiens
cucucaaagugcugggauuacucaagcaaucugccagccucagcgcugaucuugaacuccuggg

SEQ ID NO: 110878 - RNA, 64 nt, Homo Sapiens
ugccccagguuuaagcaaucaucucagcucacugcagccucaacggcuagagugcaguggugca

SEQ ID NO: 110879 - RNA, 64 nt, Homo Sapiens
cucucucucuuugcucucuuucucccuccccuaccagccucauucuuccuccgguagccucucc

SEQ ID NO: 110880 - RNA, 64 nt, Homo Sapiens
ccgguagccucucccaccuaaccucugcaucccccagccucauguccugccccaucccuauccu

SEQ ID NO: 110881 - RNA, 64 nt, Homo Sapiens
caccaucccccucuuuccacaauuggagaagcugcagccucacgucccagcaaagcugagacaa

SEQ ID NO: 110882 - RNA, 55 nt, Homo Sapiens
ugcccuggaaccccggcaccgcugucagccucaccagccuauagcccugcuuuga

SEQ ID NO: 110883 - RNA, 64 nt, Homo Sapiens
aaaacaagaccucugugcacagggaacccucuaucagccucagguuauuuggagccgggucuag

SEQ ID NO: 110884 - RNA, 64 nt, Homo Sapiens
ggagcaguuugugggcugguaugggcuggccccacagccucacaucaccuguuugcauggagaa

SEQ ID NO: 110885 - RNA, 64 nt, Homo Sapiens
gcccuuuccugcuucucugaaagcacaggucacccagccucagaaucacaccucccggcugcug

SEQ ID NO: 110886 - RNA, 64 nt, Homo Sapiens
uuagaccucucaacacaguaugccaaguggauuccagccucauggccuagcaaaagaacagacu

SEQ ID NO: 110887 - RNA, 64 nt, Homo Sapiens
ccucccugcccccaggccccggcauugccaucagcagccucagcgucuccccggccaugugugc

SEQ ID NO: 110888 - RNA, 64 nt, Homo Sapiens
ccuggggcggcugaugccagggcggcccgcggggcagccucacggaagggcccggugggacgug

SEQ ID NO: 110889 - RNA, 64 nt, Homo Sapiens
caaggccaggagcgcuggguucugcagcagggcucagccucaggggcguuaagacccuggauga

SEQ ID NO: 110890 - RNA, 64 nt, Homo Sapiens
gggguggaggugcuccccacaguccgggccaggacagccucaggggagagugaaggccugcagg

SEQ ID NO: 110891 - RNA, 61 nt, Homo Sapiens
gugacuuacaugggaagugaugccaccagggcagccucaccuccuccccaucaucuugucc

SEQ ID NO: 110892 - RNA, 64 nt, Homo Sapiens
uccccuucucccagugcguuugacuuugucaggucagccucacuugucccuuucacaguuggcc

SEQ ID NO: 110893 - RNA, 64 nt, Homo Sapiens
ccaaggugaaacuuagauaucauggacuguuguccagccucaaugcuucauuuuccccuugcau

SEQ ID NO: 110894 - RNA, 64 nt, Homo Sapiens
acaggagcacuggaggaggagugggcucucugugcagccucacagggcuuugccacggagccac

SEQ ID NO: 110895 - RNA, 64 nt, Homo Sapiens
gcauccaugucccggagaggggucccucaacagucagccucaccugucagaccgggguucuccc

SEQ ID NO: 110896 - RNA, 64 nt, Homo Sapiens
aucccuacccccuccaaggggcagguuuccaguccagccucagagaucaggcucugggaccccu

SEQ ID NO: 110897 - RNA, 64 nt, Homo Sapiens
gugccgaguccuugucccuaccuccagcuuccuccagccucaaaccgccucuggaucuagcugu

SEQ ID NO: 110898 - RNA, 64 nt, Homo Sapiens
gagccccacagccccaagcugcaccuucgcgucucagccucaggugagucacggcccagacugg

SEQ ID NO: 110899 - RNA, 64 nt, Homo Sapiens
accgcaucccaccuccugcccggcugcccagccccagccucaccugugccaccuuguacaaagc

SEQ ID NO: 110900 - RNA, 64 nt, Homo Sapiens
uggaaggggaaaagucagggagcgccguguucuucagccucagcagagagcgaugauggacuug

SEQ ID NO: 110901 - RNA, 64 nt, Homo Sapiens
gccucuuggcccagggccagcugucucuggcccccagccucagucuacagccuuccucaggccc

SEQ ID NO: 110902 - RNA, 64 nt, Homo Sapiens
uaauuuuaugagggccacgggucuguguucgacucagccucagggacgacucugaccucuuggc

SEQ ID NO: 110903 - RNA, 64 nt, Homo Sapiens
gacucacuugcccacaccgagggcgaccccgucacagccucaagucacucccaagcccccuccu

SEQ ID NO: 110904 - RNA, 64 nt, Homo Sapiens
uuccugggcucaagcgauccaucauggcucacugcagccucaaaggcugaagugcgguggugca

SEQ ID NO: 110905 - RNA, 64 nt, Homo Sapiens
auuucuggcuggauuuccacggagacaaucuuuucagccucagccccuggcuaccaggaaacuc

SEQ ID NO: 110906 - RNA, 64 nt, Homo Sapiens
gucaacguauuuccccucucaagauacaucugaccagccucaaccccggccacacacagcaaga

SEQ ID NO: 110907 - RNA, 64 nt, Homo Sapiens
ugccaggacaccacaugggagggggcucaggccucagccucaagaucuucagcuguggccucuc

SEQ ID NO: 110908 - RNA, 64 nt, Homo Sapiens
cugaacgaggaccuggacucagagccagacagggcagccucagacccuucucuggggcuccugg

SEQ ID NO: 110909 - RNA, 64 nt, Homo Sapiens
uucccccacagcagcacgggucugcugaggcucccagccucaguagagacucuugacaccgguc

SEQ ID NO: 110910 - RNA, 64 nt, Homo Sapiens
aacugugcagagaccuacagcaggcagucagcaccagccucagcaaggccuugagaggacccug

SEQ ID NO: 110911 - RNA, 64 nt, Homo Sapiens
acccaggauaggaaaugggucccagaggcagucccagccucagaggagggcagucccucagaau

SEQ ID NO: 110912 - RNA, 64 nt, Homo Sapiens
guaugggaaacccuuuccccacuggaagaucucgcagccucaguauacccuagccugaggcucc

SEQ ID NO: 110913 - RNA, 64 nt, Homo Sapiens
ggagauggggagguuagagaccugaggaaaugcucagccucaguugcugugcccccggccaggc

SEQ ID NO: 110914 - RNA, 64 nt, Homo Sapiens
ccugcagaagguuugugacgcccugcuauccccacagccucauucuucuguugggcccaguggc

SEQ ID NO: 110915 - RNA, 64 nt, Homo Sapiens
cucuauggcaaggcccugcucccgaagaugaggccagccucagcaggaauccuacuccuaugac

SEQ ID NO: 110916 - RNA, 64 nt, Homo Sapiens
cugguggacuucgaguacagccagaaaaugcugacagccucaugacaucuugcugcucucagag

SEQ ID NO: 110917 - RNA, 64 nt, Homo Sapiens
ccuggcuuggucuggaugggacacugucagaguuuggccacagccuguccuuuacuucauccac

SEQ ID NO: 110918 - RNA, 64 nt, Homo Sapiens
gggagaggggaagucuuggcagggaaaucccuuuuggccacacaguuuacaaacccaguaucau

SEQ ID NO: 110919 - RNA, 64 nt, Homo Sapiens
uucccuuuccaaaaaggcuaagcuccccuguuuguggccacaccagguguaggguugugagcaa

SEQ ID NO: 110920 - RNA, 64 nt, Homo Sapiens
uuggugcuugugcacgggacguucauugucauuauggccacagucccccaggaaggaguuugag

SEQ ID NO: 110921 - RNA, 64 nt, Homo Sapiens
cagguuuucccuaagaagaucaggaggugcccgcuggccacagccucugcagcaagcagggcuu

SEQ ID NO: 110922 - RNA, 64 nt, Homo Sapiens
gcuaucuggaggcuuugcagguccccagcucccguggccacacaagcgcacugggcugccgucu

SEQ ID NO: 110923 - RNA, 64 nt, Homo Sapiens
gggcugguggggaaggagcgaguuccagcuguucuggccacacuggggugggucauuugagagg

SEQ ID NO: 110924 - RNA, 64 nt, Homo Sapiens
caucacuuucuccuccuccugucugaagccuuccuggccacaggggcccauugacagaugagag

SEQ ID NO: 110925 - RNA, 64 nt, Homo Sapiens
cuuuuucuauccuguuuucaggccccgggcucccuggccacaagaugacacaaugccucacuca

SEQ ID NO: 110926 - RNA, 64 nt, Homo Sapiens
aaugccauaaugccuguuggaagaccccagacucuggccacaaagagauggcucuuguucaguc

SEQ ID NO: 110927 - RNA, 64 nt, Homo Sapiens
gugagccaaugcucaccagccccagagucagagcuggccacaggcuggcagccuccaggggcuu

SEQ ID NO: 110928 - RNA, 64 nt, Homo Sapiens
gcuaagccauguggcagggaccgucuugcccugcuggccacacucuggagaagcacuucucagc

SEQ ID NO: 110929 - RNA, 61 nt, Homo Sapiens
uucuugugccuggcagcuaacacgcccgggguggccacagcgccagccucagacuggaggg

SEQ ID NO: 110930 - RNA, 64 nt, Homo Sapiens
cagccucucagugcccuccagccccgcgaccauguggccacaauccacgcuucuccggaucgcg

SEQ ID NO: 110931 - RNA, 64 nt, Homo Sapiens
aacaaagaugcgaguugaaguucugcacucucuguggccacagggcaguggccacaaggcugcu

SEQ ID NO: 110932 - RNA, 64 nt, Homo Sapiens
gcugcuuucugcacucucugcuguuggucagcaguggccacaagcuaaguuagcuuugguagcu

SEQ ID NO: 110933 - RNA, 64 nt, Homo Sapiens
uaccagcaacuugaacuucaccugcaaagcucuguggccacauuuucagccaaagggaaauaug

SEQ ID NO: 110934 - RNA, 64 nt, Homo Sapiens
uucauccuggcuggagaauguggagaacuaaagguggccacaaauucuuugacacucaaguccc

SEQ ID NO: 110935 - RNA, 64 nt, Homo Sapiens
caggaaggucaauauaugccuaacauuucuaaacuggccacauaaccuuagauuuuuaaaggaa

SEQ ID NO: 110936 - RNA, 64 nt, Homo Sapiens
ucuuccuacaugaucuuuaccuguuguuagacuguggccacagccaguaaaucaggccagagug

SEQ ID NO: 110937 - RNA, 64 nt, Homo Sapiens
cacacuggaaggaagagccaucguggucuuugucuggccacaggccaggcugcugggcauccuc

SEQ ID NO: 110938 - RNA, 64 nt, Homo Sapiens
guccaucaccccucccaggccagccucuguaaguuggccacacuuggggagugaguguggguau

SEQ ID NO: 110939 - RNA, 64 nt, Homo Sapiens
ucccucucuuuggaaaguuuagccuggaagcaguuggccacacuguguggagggcaccucucug

SEQ ID NO: 110940 - RNA, 64 nt, Homo Sapiens
gggccugcgucccugcacacugcgaggacugccuuggccacaggcccacucccuacgacacgug

SEQ ID NO: 110941 - RNA, 64 nt, Homo Sapiens
caucaggcacccagguuccuacugucuugccauguggccacaguuagcaacaaaggaggcugua

SEQ ID NO: 110942 - RNA, 64 nt, Homo Sapiens
uccucuuggaucagucacuguggccaugcauguuuggccacaugauuaauccagucugggucau

SEQ ID NO: 110943 - RNA, 64 nt, Homo Sapiens
ccacagaugugcuguugguccaggugucccagucuggccacagcccugccuccgcccucaccua

SEQ ID NO: 110944 - RNA, 64 nt, Homo Sapiens
guagggggugggagcagagccucggugagggucuuggccacagggcagugccuuccugaacgug

SEQ ID NO: 110945 - RNA, 64 nt, Homo Sapiens
ugcagagcacugcagcucccagagugagagcuaguggccacagcucuugaaggcuggaggaguc

SEQ ID NO: 110946 - RNA, 64 nt, Homo Sapiens
caccccauuccuggacuccuguucuccucuggacuggccacaccccaccccuccccagucacca

SEQ ID NO: 110947 - RNA, 64 nt, Homo Sapiens
gcuauggccaagcguucccuggagucacuguggguggccacagggguggcauuacagggaugag

SEQ ID NO: 110948 - RNA, 64 nt, Homo Sapiens
cucgcgggcugggaaggauuccuccacucccgaguggccacaggcagugagggucccaguguuc

SEQ ID NO: 110949 - RNA, 64 nt, Homo Sapiens
gggcucacauucccaaggguaaacuugguauaucuggccacacuaaauguccagcuucucuuga

SEQ ID NO: 110950 - RNA, 64 nt, Homo Sapiens
aaggccacucaggauguccugucaaagcggaugcuggccacagacauggcccgggccuuaucca

SEQ ID NO: 110951 - RNA, 64 nt, Homo Sapiens
ugcagcucaccuguggguuuucccuuugagccuuuggccacauccaccucgaggggacccuggc

SEQ ID NO: 110952 - RNA, 64 nt, Homo Sapiens
accagcuagccuacgcggggauggccgucaguucuggccacaggacccgagucugggcuugggu

SEQ ID NO: 110953 - RNA, 64 nt, Homo Sapiens
aguccccuacuggcugcagauaacaaggaaguccuggccacaggcuuggagaagggcugcuacu

SEQ ID NO: 110954 - RNA, 64 nt, Homo Sapiens
ugaugcguuuuuggugggcugguacugugggccauggccacaccuagaggcagggaaugaagaa

SEQ ID NO: 110955 - RNA, 64 nt, Homo Sapiens
gaccccccagccaaguggcagacgcugguuuugguggccacaggggguggcccgugcgacagag

SEQ ID NO: 110956 - RNA, 64 nt, Homo Sapiens
ggagguaguaccuuugaagaugcuguugaccaccuggccacagccagucaggggccugguggug

SEQ ID NO: 110957 - RNA, 64 nt, Homo Sapiens
uugcccugcuucucucaggggguucugaauccuuuggccacauugggauaauguuggaaagaaa

SEQ ID NO: 110958 - RNA, 64 nt, Homo Sapiens
gagcugcuuucuggggaacacugccgugagcgucuggccacaugauuuggacugcacagagcag

SEQ ID NO: 110959 - RNA, 64 nt, Homo Sapiens
uggaggguuugggagaggagagcauaagugucuucauucccaccgaaacuggagaugucuuguu

SEQ ID NO: 110960 - RNA, 64 nt, Homo Sapiens
gaccaucuggucccaggagccccagccagacacucauucccauuaccgcugcuccgucccuuuc

SEQ ID NO: 110961 - RNA, 64 nt, Homo Sapiens
uucuucuaaagaauuuaauucuaaaaguuauagacauucccaaagauauaccugcaagcaucac

SEQ ID NO: 110962 - RNA, 64 nt, Homo Sapiens
auuggcacaugauucugugccuguuucugggggucauucccaugagaagagcagguagaacuua

SEQ ID NO: 110963 - RNA, 64 nt, Homo Sapiens
uuuucucuuugcuagaaaaucagcccauagagugcauucccaaauucuaaauagcugacccuaa

SEQ ID NO: 110964 - RNA, 64 nt, Homo Sapiens
aauauucccucaaaaccuagucaagaaagugccacauucccaccuucuaacagguaauuauuag

SEQ ID NO: 110965 - RNA, 64 nt, Homo Sapiens
guacugagguacuagagacccccacuguaacuggcauucccauagaaaugcugcuucuucccua

SEQ ID NO: 110966 - RNA, 64 nt, Homo Sapiens
cauuguuccuggaaaggugaccuucagagggaaacauucccaucguugccuuucuuucacagag

SEQ ID NO: 110967 - RNA, 64 nt, Homo Sapiens
caugaaauguagaagacuggcacauucccaaagacauucccaguaccugagaguucgaagaggg

SEQ ID NO: 110968 - RNA, 64 nt, Homo Sapiens
gacauucccagucaugaaauguucgaagagggcacauucccaaauuuacauguaagaccugaga

SEQ ID NO: 110969 - RNA, 64 nt, Homo Sapiens
cugugacaauuuaccgaaaugaugaaguaaccaccauucccaccuuucacugccuaggcuccaa

SEQ ID NO: 110970 - RNA, 64 nt, Homo Sapiens
cucaggauccagccugggcucacccuguguggcucauucccacccaggaaacugaagauaaaag

SEQ ID NO: 110971 - RNA, 64 nt, Homo Sapiens
cucugacgcuugugacagugccucuuccagugaacauucccagcccagccccgccccgccccgc

SEQ ID NO: 110972 - RNA, 64 nt, Homo Sapiens
auuugaucauaccuaagagguuaggaaauggugccauucccaccuuagagugcuacauaggugc

SEQ ID NO: 110973 - RNA, 64 nt, Homo Sapiens
cgaagguuauggucaaucccaaaagucaccacuccauucccaacuagacauuaccaaagugacc

SEQ ID NO: 110974 - RNA, 64 nt, Homo Sapiens
agauugcuucucauccccagucccaaugcacauccauucccaagaaaugcuuugucuucagccu

SEQ ID NO: 110975 - RNA, 64 nt, Homo Sapiens
uuggcauuacacucacuccuguucccuuauucuucauucccaguaauucccuaccaaauggugg

SEQ ID NO: 110976 - RNA, 64 nt, Homo Sapiens
cucacagccaagcugaagcuuggagaaaacucugcauucccaugagggcaaaggcagcugcccu

SEQ ID NO: 110977 - RNA, 64 nt, Homo Sapiens
uaucuugugaauuuguaauccugugugauuggaacauucccaaacaggcagagggaccuugcug

SEQ ID NO: 110978 - RNA, 64 nt, Homo Sapiens
cccuugggccuggcuggaucggcccaucugccugcauucccaccugggcaucccgggugaccuu

SEQ ID NO: 110979 - RNA, 64 nt, Homo Sapiens
cccguguccaccuggaacauuaguaaugaauuaucauucccaaagcaggaaaacagagaugguu

SEQ ID NO: 110980 - RNA, 64 nt, Homo Sapiens
ucuucucccugcugacaucgcgaacugcgagccccauucccagcuucuggauauccuccguggg

SEQ ID NO: 110981 - RNA, 64 nt, Homo Sapiens; identical to SEQ ID NO: 110917

SEQ ID NO: 110982 - RNA, 64 nt, Homo Sapiens; identical to SEQ ID NO: 110918

SEQ ID NO: 110983 - RNA, 64 nt, Homo Sapiens; identical to SEQ ID NO: 110919

SEQ ID NO: 110984 - RNA, 64 nt, Homo Sapiens; identical to SEQ ID NO: 110920

SEQ ID NO: 110985 - RNA, 64 nt, Homo Sapiens; identical to SEQ ID NO: 110921

SEQ ID NO: 110986 - RNA, 64 nt, Homo Sapiens; identical to SEQ ID NO: 110922

SEQ ID NO: 110987 - RNA, 64 nt, Homo Sapiens; identical to SEQ ID NO: 110923

SEQ ID NO: 110988 - RNA, 64 nt, Homo Sapiens; identical to SEQ ID NO: 110924

SEQ ID NO: 110989 - RNA, 64 nt, Homo Sapiens; identical to SEQ ID NO: 110925

SEQ ID NO: 110990 - RNA, 64 nt, Homo Sapiens; identical to SEQ ID NO: 110926

SEQ ID NO: 110991 - RNA, 64 nt, Homo Sapiens; identical to SEQ ID NO: 110927

SEQ ID NO: 110992 - RNA, 64 nt, Homo Sapiens; identical to SEQ ID NO: 110928

SEQ ID NO: 110993 - RNA, 61 nt, Homo Sapiens; identical to SEQ ID NO: 110929

SEQ ID NO: 110994 - RNA, 64 nt, Homo Sapiens; identical to SEQ ID NO: 110930

SEQ ID NO: 110995 - RNA, 64 nt, Homo Sapiens; identical to SEQ ID NO: 110931

SEQ ID NO: 110996 - RNA, 64 nt, Homo Sapiens; identical to SEQ ID NO: 110932

SEQ ID NO: 110997 - RNA, 64 nt, Homo Sapiens; identical to SEQ ID NO: 110933

SEQ ID NO: 110998 - RNA, 64 nt, Homo Sapiens; identical to SEQ ID NO: 110934

SEQ ID NO: 110999 - RNA, 64 nt, Homo Sapiens; identical to SEQ ID NO: 110935

SEQ ID NO: 111000 - RNA, 64 nt, Homo Sapiens; identical to SEQ ID NO: 110936

SEQ ID NO: 111001 - RNA, 64 nt, Homo Sapiens; identical to SEQ ID NO: 110937

SEQ ID NO: 111002 - RNA, 64 nt, Homo Sapiens; identical to SEQ ID NO: 110938

SEQ ID NO: 111003 - RNA, 64 nt, Homo Sapiens; identical to SEQ ID NO: 110939

SEQ ID NO: 111004 - RNA, 64 nt, Homo Sapiens; identical to SEQ ID NO: 110940

SEQ ID NO: 111005 - RNA, 64 nt, Homo Sapiens; identical to SEQ ID NO: 110941

SEQ ID NO: 111006 - RNA, 64 nt, Homo Sapiens; identical to SEQ ID NO: 110942

SEQ ID NO: 111007 - RNA, 64 nt, Homo Sapiens; identical to SEQ ID NO: 110943

SEQ ID NO: 111008 - RNA, 64 nt, Homo Sapiens; identical to SEQ ID NO: 110944

SEQ ID NO: 111009 - RNA, 64 nt, Homo Sapiens; identical to SEQ ID NO: 110945

SEQ ID NO: 111010 - RNA, 64 nt, Homo Sapiens; identical to SEQ ID NO: 110946

SEQ ID NO: 111011 - RNA, 64 nt, Homo Sapiens; identical to SEQ ID NO: 110947

SEQ ID NO: 111012 - RNA, 64 nt, Homo Sapiens; identical to SEQ ID NO: 110948

SEQ ID NO: 111013 - RNA, 64 nt, Homo Sapiens; identical to SEQ ID NO: 110949

SEQ ID NO: 111014 - RNA, 64 nt, Homo Sapiens; identical to SEQ ID NO: 110950

SEQ ID NO: 111015 - RNA, 64 nt, Homo Sapiens; identical to SEQ ID NO: 110951

SEQ ID NO: 111016 - RNA, 64 nt, Homo Sapiens; identical to SEQ ID NO: 110952

SEQ ID NO: 111017 - RNA, 64 nt, Homo Sapiens; identical to SEQ ID NO: 110953

SEQ ID NO: 111018 - RNA, 64 nt, Homo Sapiens; identical to SEQ ID NO: 110954

SEQ ID NO: 111019 - RNA, 64 nt, Homo Sapiens; identical to SEQ ID NO: 110955

SEQ ID NO: 111020 - RNA, 64 nt, Homo Sapiens; identical to SEQ ID NO: 110956

SEQ ID NO: 111021 - RNA, 64 nt, Homo Sapiens; identical to SEQ ID NO: 110957

SEQ ID NO: 111022 - RNA, 64 nt, Homo Sapiens; identical to SEQ ID NO: 110958

SEQ ID NO: 111023 - RNA, 64 nt, Homo Sapiens; identical to SEQ ID NO: 110959

SEQ ID NO: 111024 - RNA, 64 nt, Homo Sapiens; identical to SEQ ID NO: 110960

SEQ ID NO: 111025 - RNA, 64 nt, Homo Sapiens; identical to SEQ ID NO: 110961

SEQ ID NO: 111026 - RNA, 64 nt, Homo Sapiens; identical to SEQ ID NO: 110962

SEQ ID NO: 111027 - RNA, 64 nt, Homo Sapiens; identical to SEQ ID NO: 110963

SEQ ID NO: 111028 - RNA, 64 nt, Homo Sapiens; identical to SEQ ID NO: 110964

SEQ ID NO: 111029 - RNA, 64 nt, Homo Sapiens; identical to SEQ ID NO: 110965

SEQ ID NO: 111030 - RNA, 64 nt, Homo Sapiens; identical to SEQ ID NO: 110966

SEQ ID NO: 111031 - RNA, 64 nt, Homo Sapiens; identical to SEQ ID NO: 110967

SEQ ID NO: 111032 - RNA, 64 nt, Homo Sapiens; identical to SEQ ID NO: 110968

SEQ ID NO: 111033 - RNA, 64 nt, Homo Sapiens; identical to SEQ ID NO: 110969

SEQ ID NO: 111034 - RNA, 64 nt, Homo Sapiens; identical to SEQ ID NO: 110970

SEQ ID NO: 111035 - RNA, 64 nt, Homo Sapiens; identical to SEQ ID NO: 110971

SEQ ID NO: 111036 - RNA, 64 nt, Homo Sapiens; identical to SEQ ID NO: 110972

SEQ ID NO: 111037 - RNA, 64 nt, Homo Sapiens; identical to SEQ ID NO: 110973

SEQ ID NO: 111038 - RNA, 64 nt, Homo Sapiens; identical to SEQ ID NO: 110974

SEQ ID NO: 111039 - RNA, 64 nt, Homo Sapiens; identical to SEQ ID NO: 110975

SEQ ID NO: 111040 - RNA, 64 nt, Homo Sapiens; identical to SEQ ID NO: 110976

SEQ ID NO: 111041 - RNA, 64 nt, Homo Sapiens; identical to SEQ ID NO: 110977

SEQ ID NO: 111042 - RNA, 64 nt, Homo Sapiens; identical to SEQ ID NO: 110978

SEQ ID NO: 111043 - RNA, 64 nt, Homo Sapiens; identical to SEQ ID NO: 110979

SEQ ID NO: 111044 - RNA, 64 nt, Homo Sapiens; identical to SEQ ID NO: 110980

SEQ ID NO: 111045 - RNA, 64 nt, Homo Sapiens
ucuucuggagccucugggcagaacccuccaucagaguggaaaucagacgggacccccugcagcu

SEQ ID NO: 111046 - RNA, 64 nt, Homo Sapiens
cacccucaccucucucccugccuguuuuccccaaaguggaaaggaaggccuuucaaaccagagu

SEQ ID NO: 111047 - RNA, 64 nt, Homo Sapiens
ccuuggagcaguagaguaccugguagaccauaauaguggaaaagggucuaguuuuccccuuguu

SEQ ID NO: 111048 - RNA, 64 nt, Homo Sapiens
ugagggucagcuuuuggcuccuucuuccugagacaguggaaacaaugccagcucuguggcuucu

SEQ ID NO: 111049 - RNA, 64 nt, Homo Sapiens
uaguacauggggagauggggagccaugccaguguaguggaaaagcaugaacaaacucccauggg

SEQ ID NO: 111050 - RNA, 64 nt, Homo Sapiens
aaacaguguuggcacuauuuauaaacauuucucaaguggaaaguauuauuccuacugggaaaac

SEQ ID NO: 111051 - RNA, 64 nt, Homo Sapiens
aaaaagacaggcugccacagguaccuuuuuugguaguggaaaaauucucuuaaaagguaucaau

SEQ ID NO: 111052 - RNA, 64 nt, Homo Sapiens
cuaugccuuggauacacacccauuuaaaaaugguaguggaaauuguguuacaagacuuguuauc

SEQ ID NO: 111053 - RNA, 64 nt, Homo Sapiens
ugauggguuuaaguaccuugguagggcuggcaccaguggaaacacauacugaagcugccaccac

SEQ ID NO: 111054 - RNA, 64 nt, Homo Sapiens
aagucccugugcuaaugggauuacaaauacaaaaaguggaaaaaaauuuucguaaacuuuguuu

SEQ ID NO: 111055 - RNA, 64 nt, Homo Sapiens
cuuguaggguuucaccaggucagagcgcguauggaguggaaacggacaucacaaucccauuauu

SEQ ID NO: 111056 - RNA, 64 nt, Homo Sapiens; identical to SEQ ID NO: 111055

SEQ ID NO: 111057 - RNA, 64 nt, Homo Sapiens
uuguguugacuuuauaaauuucgcuucuuagaacaguggaaacuauguguuuuucucauauuug

SEQ ID NO: 111058 - RNA, 64 nt, Homo Sapiens
uacucucuuccacauguuacuggauaaauuguuuaguggaaaauaggcuuuuuaaucaugaaua

SEQ ID NO: 111059 - RNA, 64 nt, Homo Sapiens
aaccgaggacaggaaaggaucccaggguggagacaguggaaaagcuccuguguugaugccacuu

SEQ ID NO: 111060 - RNA, 64 nt, Homo Sapiens
ggcuauauguguaugaauagcaccgacacugagcaguggaaaggguggcccuucugagucacau

SEQ ID NO: 111061 - RNA, 64 nt, Homo Sapiens
aaaucuaaaaauucugguuuuaaauaugagaaucaguggaaaauaaggguauaauuuuguaggu

SEQ ID NO: 111062 - RNA, 64 nt, Homo Sapiens
uggcggcagcaagagaaaaugagaaagaagcaaaaguggaaaccccuaauaaaccuaucagauc

SEQ ID NO: 111063 - RNA, 64 nt, Homo Sapiens
uggugguggcaagagaaaaugaagaagaagcaaaaguggaaaccccugauaaacccaucagauc

SEQ ID NO: 111064 - RNA, 64 nt, Homo Sapiens
uucugaguucuggugagacggagaccccgguggcaguggaaaaaucagaagcacaaaggaaaac

SEQ ID NO: 111065 - RNA, 64 nt, Homo Sapiens
uuacgacagguuugguuuuuaaauuuuccaaccaaguggaaaggcaaguuggucuuauagaaag

SEQ ID NO: 111066 - RNA, 64 nt, Homo Sapiens
ugcucucccacaaguccagcugcaacccagagauaguggaaacugaaauuaggaaggaaaucau

SEQ ID NO: 111067 - RNA, 64 nt, Homo Sapiens
uggugcaaaauuuaaaaagcgcaaauagguaucuaguggaaaaccuaagccucccucucuccuc

SEQ ID NO: 111068 - RNA, 64 nt, Homo Sapiens
gcuggaagugugacggagcaggcgggcugaggagaguggaaaaggaagcgacccagaaauggca

SEQ ID NO: 111069 - RNA, 64 nt, Homo Sapiens
agcuugggauuagcuugggagcgcagcgcugcaaaguggaaaauaugaaaagaccacacaggcc

SEQ ID NO: 111070 - RNA, 64 nt, Homo Sapiens
aaauccaaaccuuccugaacgcuaugacaccaugaguggaaaauuccacaccuaacaaacacau

SEQ ID NO: 111071 - RNA, 64 nt, Homo Sapiens
cauggagcaucagguagaaucagaguggaaacagaguggaaacauaguuuauguucucagcagc

SEQ ID NO: 111072 - RNA, 64 nt, Homo Sapiens
gaguggaaacacauggagcauucucagcagccagaguggaaacaagggcugggaauaguuuaug

SEQ ID NO: 111073 - RNA, 64 nt, Homo Sapiens
agacugagaugguaaguuaaccucauccucugaaaguggaaaccuuggggaagggaacauuuuc

SEQ ID NO: 111074 - RNA, 64 nt, Homo Sapiens
gaaugcuucccauagaaagccuuggaacugaaucaguggaaagacgguuaaugggucaguucuc

SEQ ID NO: 111075 - RNA, 64 nt, Homo Sapiens
augugucuuugacagcuagugucuaguguaugaaaguggaaaaggacauuucuguaguagcugu

SEQ ID NO: 111076 - RNA, 64 nt, Homo Sapiens
ugcaguaaaguguauauauuaugcaguuucucuaaguggaaaaacuugacaugacuuuaauagu

SEQ ID NO: 111077 - RNA, 64 nt, Homo Sapiens
aagaggacagugaaccugccaccauauugccauuaguggaaaaauuagugaugaaacagccacc

SEQ ID NO: 111078 - RNA, 64 nt, Homo Sapiens
guuugaucugcagcacccagcagaggacauucucaguggaaagaauucagagagaacauggguc

SEQ ID NO: 111079 - RNA, 64 nt, Homo Sapiens
uuguggugggugcugugaagaguaaacauuacucaguggaaagcuaaguucagaagguacuuug

SEQ ID NO: 111080 - RNA, 64 nt, Homo Sapiens
ucacuuuugauugaggcaaagggguccuacuguaaguggaaaagacucacuccccuaacauaag

SEQ ID NO: 111081 - RNA, 64 nt, Homo Sapiens
ugccaauacuaauugguggaugacuucuacauauaguggaaaucauuuuuacagucugaucuuu

SEQ ID NO: 111082 - RNA, 64 nt, Homo Sapiens
ggaaagccaguugcauuuaguggaguguugaguaaguggaaaaucauguagcaaguguacuuug

SEQ ID NO: 111083 - RNA, 64 nt, Homo Sapiens
gaaacagucuauaauaaacuuuucuaguucugaaaguggaaaauuuugcaguguauuuuugcau

SEQ ID NO: 111084 - RNA, 64 nt, Homo Sapiens
caguuaccucauugcuuaccaguauuucacaaguaguggaaaacagaccuauucaggaccauau

SEQ ID NO: 111085 - RNA, 64 nt, Homo Sapiens
caguuaccucaguggcuaccuaccauauuucaccaguggaaagccccagaccuaccaacgacca

SEQ ID NO: 111086 - RNA, 62 nt, Homo Sapiens
ggcuguuucuuuggaucccucugucccagagccacccagaacccugacucuugagaaucaag

SEQ ID NO: 111087 - RNA, 62 nt, Homo Sapiens
cccagaacccugacucuugagaaucaagaaaacacccagaaaggccuuaaugaccucauagg

SEQ ID NO: 111088 - RNA, 62 nt, Homo Sapiens
uuguuggaguucagcggggcggcugcugagcccacccagaggcucucgcuuaacuuccuagg

SEQ ID NO: 111089 - RNA, 62 nt, Homo Sapiens
agugggacaugagcaggggucuccagaggcugcacccagaacaaacaccucagagggcugcc

SEQ ID NO: 111090 - RNA, 62 nt, Homo Sapiens
ccaccgucccucugcagauacacugcucuccccacccagaccugccugucucccacccuuuc

SEQ ID NO: 111091 - RNA, 62 nt, Homo Sapiens
ggcugaagugcaugggucagggugugaggccacacccagaguagccaugaggaggcagagag

SEQ ID NO: 111092 - RNA, 62 nt, Homo Sapiens
acucuuucggggagcucagcauuaaggcccaacacccagacugcagugagaugagggcugug

SEQ ID NO: 111093 - RNA, 62 nt, Homo Sapiens
aaacagagcaugagcccacacccaucuucauucacccagaaggagcugcauauuuuuauggc

SEQ ID NO: 111094 - RNA, 62 nt, Homo Sapiens
aggggaaaaugugaagcugaacccccuccagacacccagaauguagcaucugagaaggcccu

SEQ ID NO: 111095 - RNA, 62 nt, Homo Sapiens
agcagggcugugaugggcgagucccggagccccacccagaccugaaugcuucugagagcaaa

SEQ ID NO: 111096 - RNA, 62 nt, Homo Sapiens
cgccuuugcugaagucuccccgcagcccucuccacccagaggucucccuauaccgagaccca

SEQ ID NO: 111097 - RNA, 62 nt, Homo Sapiens
gacagccuccuaggcucccugagguaccuuuccacccagacccuccuuccccaccccauaag

SEQ ID NO: 111098 - RNA, 62 nt, Homo Sapiens
gaguccccagacagcagaguaugaacugcugacacccagauuccauuaaaaauucugcuaau

SEQ ID NO: 111099 - RNA, 62 nt, Homo Sapiens
ucagggcagaacuccuguaucagccucauggacacccagaauugguaucucauggcuggaga

SEQ ID NO: 111100 - RNA, 62 nt, Homo Sapiens
ucuggccaaaaauggcucucccccaagucucccacccagaaccagagucugggucucacugg

SEQ ID NO: 111101 - RNA, 62 nt, Homo Sapiens
gggacaagauaggacauggcuguuuccauuaucacccagagaugacugcuacuuccugucuc

SEQ ID NO: 111102 - RNA, 62 nt, Homo Sapiens
caggggaagauuuagaaacaagcgugaacccucacccagaguaggccagaauacuggagacc

SEQ ID NO: 111103 - RNA, 62 nt, Homo Sapiens
uccauuugagucugcuccuuucccuccuuuaccacccagaaagagagcuuucuuguuuguuu

SEQ ID NO: 111104 - RNA, 62 nt, Homo Sapiens
ugggccagggacucaacaaucgcuccacugaccacccagagcgagcugggccagggaggaca

SEQ ID NO: 111105 - RNA, 51 nt, Homo Sapiens
ugggccagggaggacacgcuccacccagagcacacggacacgcucugcuga

SEQ ID NO: 111106 - RNA, 62 nt, Homo Sapiens
ugugcagaugaaaugucaauuuaaugaauuaucacccagacagucccuacguuuuacauuga

SEQ ID NO: 111107 - RNA, 62 nt, Homo Sapiens
aauuuugugagcaugcauguguugguuucacucacccagaguucaugggugugugugcacau

SEQ ID NO: 111108 - RNA, 62 nt, Homo Sapiens
ugagaugacuaggacagucuguacccagaggccacccagaagcccucagauguacauacaca

SEQ ID NO: 111109 - RNA, 62 nt, Homo Sapiens
gaucccacuguuccucuuugccacagagaaagcacccagacgccacaggcucugucgcauuu

SEQ ID NO: 111110 - RNA, 62 nt, Homo Sapiens
ccagccacucccgggaccacggcaaaaggaaccacccagacccaccacccguacacccucag

SEQ ID NO: 111111 - RNA, 62 nt, Homo Sapiens
uuguaaugauguuucuuuggauacugucuagucacccagaaaaauguauggaugaauuuuuu

SEQ ID NO: 111112 - RNA, 62 nt, Homo Sapiens
cagggguuuggucacaaaggauggacucuucccacccagaggaugcagggaaagcacacugu

SEQ ID NO: 111113 - RNA, 62 nt, Homo Sapiens
ccucacugcccucaaggacaacagcagggugucacccagagcccgaugaggggugccagcag

SEQ ID NO: 111114 - RNA, 62 nt, Homo Sapiens
uagacauuguuuuuguagaaaagagaucaguccacccagagucccugcccugggcuguugag

SEQ ID NO: 111115 - RNA, 62 nt, Homo Sapiens
agcugggucuccaggcugccugagcuaaggcucacccagagcgucccaggaaccacaggaag

SEQ ID NO: 111116 - RNA, 62 nt, Homo Sapiens
cccccaccauaaaucacaucauuagcaugaaccacccagaguggcccaagacucccagauca

SEQ ID NO: 111117 - RNA, 62 nt, Homo Sapiens
ugguggcacguaagcuccuugucugucuccagcacccagaaucucauuaaagcuuauuuauu

SEQ ID NO: 111118 - RNA, 62 nt, Homo Sapiens
uggagcagguggcuuaggggcucacucuuuuacacccagagggguucuccaacagcccagag

SEQ ID NO: 111119 - RNA, 62 nt, Homo Sapiens
ccugccacucuuuaccuaguuccccugggaggcacccagaagagaagcacauuucugccacc

SEQ ID NO: 111120 - RNA, 62 nt, Homo Sapiens
ccaucucaagagcucgcccaaaccucuccugccacccagaucgcagcuuuccucugaaaagc

SEQ ID NO: 111121 - RNA, 62 nt, Homo Sapiens
ggacucagcuucaaagcugcgaacccaguaugcacccagaggaagccaaggaucauccccug

SEQ ID NO: 111122 - RNA, 64 nt, Homo Sapiens
aaaucgucugggcacaguggcucacgccuguagucccagcuacuugggaggcugaggcaggaga

SEQ ID NO: 111123 - RNA, 64 nt, Homo Sapiens
aaauuagccaggcauggugccgcauaacuauaaucccagcuacuugggaggcugaggcaggaga

SEQ ID NO: 111124 - RNA, 64 nt, Homo Sapiens
aaauuagcugagcaugguggugggcuccuguagucccagcuacuugggaggcugaggcaggaga

SEQ ID NO: 111125 - RNA, 64 nt, Homo Sapiens
uugugaacccccagcauguguuucugacuuuucucccagcuaccuucucaggugccagcugcug

SEQ ID NO: 111126 - RNA, 64 nt, Homo Sapiens
aaauuagcugggcgugguggcauaugccuguggucccagcuacucagaaggcaaguggugaugg

SEQ ID NO: 111127 - RNA, 64 nt, Homo Sapiens
acuuugccauggaggacugagcguugccuuuucucccagcuaccucccaaagcagccugaccug

SEQ ID NO: 111128 - RNA, 64 nt, Homo Sapiens
uuauuuaaacucacuuaauuaaggaaaauauuuucccagcuagaaaaguauacucauucucauu

SEQ ID NO: 111129 - RNA, 64 nt, Homo Sapiens
aaauuagccaggcauaguggcgcgcgccuauaaucccagcuacugggaggcugaggcgggagaa

SEQ ID NO: 111130 - RNA, 64 nt, Homo Sapiens
aaauuggcugggugcggugguacaugccuguagucccagcuacuugggaggcugaggcaggaga

SEQ ID NO: 111131 - RNA, 64 nt, Homo Sapiens
ggauguucaguggauaucggucacaugccagguccccagcuacgcauucaaggauggauaauau

SEQ ID NO: 111132 - RNA, 64 nt, Homo Sapiens
cgggaggcugaggcaggagacaggagccuguagucccagcuacuaaacuagcugggcguggugg

SEQ ID NO: 111133 - RNA, 64 nt, Homo Sapiens
ugggaggcugaggcaggagacgggcgccuguaaucccagcuacuaaauuagccagccauggugg

SEQ ID NO: 111134 - RNA, 64 nt, Homo Sapiens
cagggggcugaggcaggagaugggcaccuguagucccagcuacuaaauuagccaggcguggucg

SEQ ID NO: 111135 - RNA, 64 nt, Homo Sapiens
caggagacugaggcuagaaggcacgcacuguagucccagcuacuaaaaaaaaaaaggcauggug

SEQ ID NO: 111136 - RNA, 64 nt, Homo Sapiens
ugggaggcugaggcaggaggcuugugccuguagucccagcuacuguuggagcugggugcagugg

SEQ ID NO: 111137 - RNA, 64 nt, Homo Sapiens
agggaggcugagacacacgaccggcgccuguaaucccagcuacucaauuagcugggcauggugg

SEQ ID NO: 111138 - RNA, 64 nt, Homo Sapiens
uuuuuuauuuuuaguagagacacccaccacuaugcccagcuaauugaguagcugggauuacagg

SEQ ID NO: 111139 - RNA, 64 nt, Homo Sapiens
caggaagcugagacaagaggugugcaccuauagucccagcuacucaaaaagccaaguguggugg

SEQ ID NO: 111140 - RNA, 64 nt, Homo Sapiens
ugggaggcugaggcaggagacacacgccuguagucccagcuacuaaauuaccugggccuggugg

SEQ ID NO: 111141 - RNA, 64 nt, Homo Sapiens
caggaggcugaggugggaggugcucaugcauagucccagcuaccuuuaauuagcugugcgcaau

SEQ ID NO: 111142 - RNA, 64 nt, Homo Sapiens
caggaggcugaggcaggagacaugugccuauagucccagcuacuaaauuagcugggcauggugg

SEQ ID NO: 111143 - RNA, 64 nt, Homo Sapiens
uuuuguauuuuuaguaaagacgugcaccaccacgcccagcuaaucgaguagcuggaauuauagg

SEQ ID NO: 111144 - RNA, 64 nt, Homo Sapiens
ugggaggcugaggcacgagaugcaugccuguaaucccagcuacuaaauuagccgagcacggugg

SEQ ID NO: 111145 - RNA, 64 nt, Homo Sapiens
caggaggcugaggcaggagacguacgccuguagucccagcuacuaaauuauccaggcauggugg

SEQ ID NO: 111146 - RNA, 64 nt, Homo Sapiens
caggaggcugaggcaggagaugggcgccuguaaucccagcuacugaauuagucaggcguggugg

SEQ ID NO: 111147 - RNA, 64 nt, Homo Sapiens
ugggagacugaggcaggagacgggcaccuguaaucccagcuacuaaauuagcugggcguggugg

SEQ ID NO: 111148 - RNA, 64 nt, Homo Sapiens
cuggagacugaggugggagacacgugucuguaaucccagcuacuaaauuagccaggcgugaugg

SEQ ID NO: 111149 - RNA, 64 nt, Homo Sapiens
uuuuguauuuuuaguagagacaugcaccaccaugcccagcuaaucaaguagcugggauuacagg

SEQ ID NO: 111150 - RNA, 64 nt, Homo Sapiens
uuuguauuuucaguagagaccaugcgucaccacucccagcuaaucgaguagcugggauuacagg

SEQ ID NO: 111151 - RNA, 64 nt, Homo Sapiens
aaauuggcuggacaugguggcgcaugucuguaaucccagcuacuguaaucucagcuacuuggga

SEQ ID NO: 111152 - RNA, 64 nt, Homo Sapiens
aaauuagccaggcaugguggcgugugccaguaaucccagcuacuugggaggcugaggcgcgaga

SEQ ID NO: 111153 - RNA, 64 nt, Homo Sapiens
aauaaaaagccagacuggugguauguaucugugucccagcuaauugggagggugaguugggagg

SEQ ID NO: 111154 - RNA, 64 nt, Homo Sapiens
uaauuaguugggcguaguggugcaugccuguaaucccagcuacucuggagacagguggagggga

SEQ ID NO: 111155 - RNA, 64 nt, Homo Sapiens
ugggauuacaggcgugagccaccgcgccuggccacccagcuaaguuuguauuuuuguuggagac

SEQ ID NO: 111156 - RNA, 64 nt, Homo Sapiens
cgagcagcugggauuauaggcguccaccaccacgcccagcuaauuuuuguauuuuuaguagaaa

SEQ ID NO: 111157 - RNA, 64 nt, Homo Sapiens
uuggagacugaggugggaguugcaugccuguagucccagcuacuagaauacccaggugugguag

SEQ ID NO: 111158 - RNA, 64 nt, Homo Sapiens
caggaggcugaggcaggagacgggugccuguaaucccagcuacuaaauuaguuggguguggugg

SEQ ID NO: 111159 - RNA, 64 nt, Homo Sapiens
caggaggcugaggcagaagauacaugccuguaaucccagcuacuaaauuagccagguguggagg

SEQ ID NO: 111160 - RNA, 64 nt, Homo Sapiens
ccggaggcugaggcaggagacacgugccuguagucccagcuacuaaauuagccaggcguggugg

SEQ ID NO: 111161 - RNA, 64 nt, Homo Sapiens
cagggggcugaggcaggggacaggugccuguaaucccagcuacuaaauuagccgggcauggugg

SEQ ID NO: 111162 - RNA, 64 nt, Homo Sapiens
ugggaggcugaggcaggagaugcgugccuguagucccagcuacuaaauuagccgggaguggugg

SEQ ID NO: 111163 - RNA, 64 nt, Homo Sapiens
cgaauagcugggauuacaggcacgccucaccacgcccagcuaauuucuguauuuuuagaagaga

SEQ ID NO: 111164 - RNA, 64 nt, Homo Sapiens
ugccucagccuccugaguagugugugccaccacgcccagcuaauuuuuuaauuuuuaguagaga

SEQ ID NO: 111165 - RNA, 64 nt, Homo Sapiens
aaauuagccggguguggugucgggcaccuguagucccagcuacucaggaggcugaggcaggaga

SEQ ID NO: 111166 - RNA, 64 nt, Homo Sapiens
ucuuuugaccaagaccucaagagagccagaacuacccagcuaagccuuuuacuaaauuucugaa

SEQ ID NO: 111167 - RNA, 64 nt, Homo Sapiens
aaaaaagccaggcaugguggcacacaccuguaaucccagcuacucgggaggcugaggaaggaga

SEQ ID NO: 111168 - RNA, 64 nt, Homo Sapiens
aaauuagcugggcaugguggcacacaccuguagucccagcuacuugggaggcugaggcaggaga

SEQ ID NO: 111169 - RNA, 64 nt, Homo Sapiens
aaauuagcugggcaugacggccagagcccauggucccagcuacucgagaggcugagguaagagc

SEQ ID NO: 111170 - RNA, 64 nt, Homo Sapiens
caaguagcugggacuacagguguacgccaccacacccagcuaauuuuuguauuuuuaguaggga

SEQ ID NO: 111171 - RNA, 64 nt, Homo Sapiens
caggaggcugaggcaggagaugggcacccguaaucccagcuacuaaaaaauuagccgggcgugg

SEQ ID NO: 111172 - RNA, 64 nt, Homo Sapiens
caggaggcugaggugggaaacaugugccuguggucccagcuacuaaauuagccagguguggugg

SEQ ID NO: 111173 - RNA, 64 nt, Homo Sapiens
guuaaaugaggacaaaucacgugguuugacuuaccccagcuaccagucuuuguaagggcucucu

SEQ ID NO: 111174 - RNA, 64 nt, Homo Sapiens
uucuaucagagacccaaauuuccaaguagcuuagcccagcuaagcucacuauccuguaagguua

SEQ ID NO: 111175 - RNA, 64 nt, Homo Sapiens
uuaacucccucagcuaaaacuggcauuacugacucccagcuauauuucuccagacuugcauuuu

SEQ ID NO: 111176 - RNA, 64 nt, Homo Sapiens
aaaguagccagccgugaugacaggcaccuguaaucccagcuacucgggaggcugaggcaugaga

SEQ ID NO: 111177 - RNA, 64 nt, Homo Sapiens
caaguagcugggacuacaggcaugagccaucacacccagcuaguuuuuuguauuuuuaguaaag

SEQ ID NO: 111178 - RNA, 64 nt, Homo Sapiens
aaauuagccgggugugguggcgggcgccuguagucccagcuacucuggaggcugaggcaggaga

SEQ ID NO: 111179 - RNA, 64 nt, Homo Sapiens
uuuuguauuuuuaguagagacaccugccaccacgcccagcuaaucaauuuacugggauuacagg

SEQ ID NO: 111180 - RNA, 64 nt, Homo Sapiens
uuuguuuuuuuuuuagucgacaugugccaccaugcccagcuaaucaaguagcugggauuacagg

SEQ ID NO: 111181 - RNA, 64 nt, Homo Sapiens
aaaauuagccaggcacguuccaggcaccugugaucccagcuacuuagaggcugaggcagaagaa

SEQ ID NO: 111182 - RNA, 64 nt, Homo Sapiens
aaauuauccaggcgugguggugcacgccuguaaucccagcuacucaggaggcuaaggcaggaga

SEQ ID NO: 111183 - RNA, 64 nt, Homo Sapiens
ugaguaguugggauuacaggcgcccaccaccaugcccagcuaauuuuuguguuuuuauuggagg

SEQ ID NO: 111184 - RNA, 64 nt, Homo Sapiens
ugaguagcugggacuacaggugugcaccaacaugcccagcuaauuuuuuauauuuuuaguagag

SEQ ID NO: 111185 - RNA, 64 nt, Homo Sapiens
ugggaggcugaggcaggagacacgugccuguaaucccagcuacuaaauuagccaggcguggugg

SEQ ID NO: 111186 - RNA, 64 nt, Homo Sapiens
uuuuuguauuuuuaguagagugugcgccaccacgcccagcuaauugaguagcugggauuacagg

SEQ ID NO: 111187 - RNA, 64 nt, Homo Sapiens
cagaaggcugaggugggagguacauaccuguagucccagcuacuaaauuagcuggguguggugg

SEQ ID NO: 111188 - RNA, 64 nt, Homo Sapiens
uuuuuuguauuuuuaguagacaccugccaccgcgcccagcuaaucgaguagcugggacuacagg

SEQ ID NO: 111189 - RNA, 64 nt, Homo Sapiens
cgggaggcugagacaggagauguaccccuguaaucccagcuacuaaauuagcugggcguggugg

SEQ ID NO: 111190 - RNA, 64 nt, Homo Sapiens
cuucaucuaaucuuaaaacugauguaccaccacacccagcuaaucuaguagcugggacuacagg

SEQ ID NO: 111191 - RNA, 64 nt, Homo Sapiens
ugggaggcugaggcaggagacaggcaucuauaaucccagcuacuaaauuaaccgggcguggugg

SEQ ID NO: 111192 - RNA, 64 nt, Homo Sapiens
uuuuguauuuuuaguagagaugcucaccaccacacccagcuaaucgaguagcugggauuacagg

SEQ ID NO: 111193 - RNA, 64 nt, Homo Sapiens
uuuuguaauuuuaguagagaugugcgccaccacgcccagcuaauugaguagcuggaacuacagg

SEQ ID NO: 111194 - RNA, 64 nt, Homo Sapiens
aacuuagcuggcauugguggcgcaugccuauagucccagcuacuugggagguugagguaggagg

SEQ ID NO: 111195 - RNA, 64 nt, Homo Sapiens
aaauuagcugggugugguugcacacgccuguaaucccagcuacucaggaggcugagggaggaga

SEQ ID NO: 111196 - RNA, 64 nt, Homo Sapiens
caauuagcagggcaugguggugcacgucuguagucccagcuacucaggaggcugaggcagaaga

SEQ ID NO: 111197 - RNA, 64 nt, Homo Sapiens
uuccaggccuggugugguggcucacgccuguagccccagcuauugcaccacugcucuccaagcu

SEQ ID NO: 111198 - RNA, 64 nt, Homo Sapiens
aaauuaguuggguguuauggugcaugccuguaaucccagcuacucgggaggcugaggcaggaga

SEQ ID NO: 111199 - RNA, 64 nt, Homo Sapiens
cgggaggcugagacaggagaugcacaccuguagucccagcuacuaaauuagccaggcguggugg

SEQ ID NO: 111200 - RNA, 64 nt, Homo Sapiens
caggaaggcugaggcggcagugcgugccuguaaucccagcuaccaaaguagccgggcgugguga

SEQ ID NO: 111201 - RNA, 64 nt, Homo Sapiens
aagucagacaccaagguuuauuucuuggaacugucccagcuaccaaccacugucuagagcaacu

SEQ ID NO: 111202 - RNA, 64 nt, Homo Sapiens
ggggaggcugaggcaggagacaggcgccuauaaucccagcuacuaaauuagccgggcauggugg

SEQ ID NO: 111203 - RNA, 64 nt, Homo Sapiens
caggaggcugagacaggagacgggugcccguaaucccagcuacuaaauuagccgagcguaguga

SEQ ID NO: 111204 - RNA, 64 nt, Homo Sapiens
cagaagggugaggcagaauuggcaugccuguagucccagcuacuaaauuagcugggcauggugg

SEQ ID NO: 111205 - RNA, 64 nt, Homo Sapiens
ugggaggcugaggcauaagacgcgugccuguaaucccagcuacuaaaucagcuggguguggugc

SEQ ID NO: 111206 - RNA, 64 nt, Homo Sapiens
uggcaggcugaggugggagacacaugccuguaaucccagcuacucacuuggcugggcacagugg

SEQ ID NO: 111207 - RNA, 64 nt, Homo Sapiens
cgggaggccaagacagaaggugcacaccucuagucccagcuacucuugaagcugggugugacgg

SEQ ID NO: 111208 - RNA, 64 nt, Homo Sapiens
ucuuguauuuuuaguagagacgugugccaccaugcccagcuaaucgaguagcugggacuaaagg

SEQ ID NO: 111209 - RNA, 64 nt, Homo Sapiens
aaauuagccgggugucguggcacacaccuguaaucccagcuauuugggaggccaaggcaggaga

SEQ ID NO: 111210 - RNA, 64 nt, Homo Sapiens
aaacuagcugggggugguggugcaugccuguggucccagcuacuugggaggcuaagguagaaga

SEQ ID NO: 111211 - RNA, 64 nt, Homo Sapiens
aaauuggcagggugugguggcacaugccuauaaucccagcuacuugggaggcuaaggcaggaga

SEQ ID NO: 111212 - RNA, 64 nt, Homo Sapiens
aaauuagccagacaugguggcacaugccuuuagucccagcuacucuggaggcugaaguuggagg

SEQ ID NO: 111213 - RNA, 64 nt, Homo Sapiens
aaauuagcugggcgugguggugggcaccuguagucccagcuacucaggaggcugaggcaggaga

SEQ ID NO: 111214 - RNA, 64 nt, Homo Sapiens
ccuucugccacgauuguaaguuuccugaggccuucccagcuauguggaacugugaguuaauuaa

SEQ ID NO: 111215 - RNA, 64 nt, Homo Sapiens
aaauuagcugggcaugguggugcaugccuguaaucccagcuacucgggaggcugaggcaggaga

SEQ ID NO: 111216 - RNA, 64 nt, Homo Sapiens
aaauuaguugcgugugguggcacaucccuauagucccagcuacuugggaggcugagguggaagg

SEQ ID NO: 111217 - RNA, 64 nt, Homo Sapiens
aaauuagccgggcaugguggugggcgccuguaaucccagcuacucagaaggcugaggcaggaga

SEQ ID NO: 111218 - RNA, 64 nt, Homo Sapiens
aaauuagcugggcgugguggugcaugccuguaaucccagcuacucgggaggcugaggcaggaga

SEQ ID NO: 111219 - RNA, 64 nt, Homo Sapiens
ccuaguagcugggacuacagcacccaccaccacacccagcuaauuuuuguauuuuuaguagaga

SEQ ID NO: 111220 - RNA, 64 nt, Homo Sapiens
ugaaaagcugggauuacagggcccugccaccaagcccagcuaauuguauuuuuaguagagacag

SEQ ID NO: 111221 - RNA, 64 nt, Homo Sapiens
caaguagcugggauuacaggcacccgccaccacacccagcuaauuuuuuguauauuuaguagag

SEQ ID NO: 111222 - RNA, 64 nt, Homo Sapiens
aaauuagcucagugugguggcacacacuuguaaucccagcuacucaggaggcugaggcaugaga

SEQ ID NO: 111223 - RNA, 64 nt, Homo Sapiens
aaauuagccaggcgugguggcgggcgccuguaaucccagcuacucaggaggcugaggcagcaga

SEQ ID NO: 111224 - RNA, 64 nt, Homo Sapiens
uaaagaaugcaaaggaaaaugaagcuguggaaugcccagcuaguucacagaugauaccaacagu

SEQ ID NO: 111225 - RNA, 64 nt, Homo Sapiens
caggaggcugaggcaggagaugggcgccuguagucccagcuacuaaauuagccaggcauggugg

SEQ ID NO: 111226 - RNA, 64 nt, Homo Sapiens
ugagaggcugaggcacgagaugcaugccuggaaucccagcuacuaaaaauagccaggugugggg

SEQ ID NO: 111227 - RNA, 64 nt, Homo Sapiens
cugggggccaaggcaggagacaggugcuuauaaucccagcuacuaaauuaccugggcauggugg

SEQ ID NO: 111228 - RNA, 64 nt, Homo Sapiens
uuuuuuguauuuuuaguagaugcccaccaccacacccagcuaauggaguagcugggacuacagg

SEQ ID NO: 111229 - RNA, 64 nt, Homo Sapiens
uuuuuuuuuuuuuuugagagcaugcaccaccacacccagcuaauaguagccggggagcuacaag

SEQ ID NO: 111230 - RNA, 64 nt, Homo Sapiens
aaauuaaccaggcaugguggcaugcaccuguagucccagcuacuuggggugcugaggcgggagg

SEQ ID NO: 111231 - RNA, 64 nt, Homo Sapiens
aaaauagcugggcaugguggcacgcaccucuacucccagcuacuaggaggcugaggcaggagaa

SEQ ID NO: 111232 - RNA, 64 nt, Homo Sapiens
aaaacagccaagcuuggugguaugugccuguggucccagcuacuggggaggcugaggugggagg

SEQ ID NO: 111233 - RNA, 64 nt, Homo Sapiens
aaauuagccaggcgugguggugggcaccuguagucccagcuacucaggaggcugaggcaggaga

SEQ ID NO: 111234 - RNA, 64 nt, Homo Sapiens
gaacuagcugggcaugguggcgcaugcauguagucccagcuacuccugaggcucagucaggaga

SEQ ID NO: 111235 - RNA, 64 nt, Homo Sapiens
aaauuagccaggcgugguggcgcaugccuguaaucccagcuacucgggaggcugaggcaggaga

SEQ ID NO: 111236 - RNA, 64 nt, Homo Sapiens
ugguuagccuggugugguggugcacaccuguaaucccagcuacuugggagacugagacaugaga

SEQ ID NO: 111237 - RNA, 64 nt, Homo Sapiens
caaguaggugggauuacaggcgcccgccaccacgcccagcuaauuuuuguauuuuuaguagaga

SEQ ID NO: 111238 - RNA, 64 nt, Homo Sapiens
aaauuagccaggcaugguggcgugcgccugcagucccagcuacuugggaggcugaguugggagg

SEQ ID NO: 111239 - RNA, 64 nt, Homo Sapiens
ugggaggcugaggcaggagacaggcaccuguaaucccagcuacuaaauuagccgggcguggugg

SEQ ID NO: 111240 - RNA, 64 nt, Homo Sapiens
ggggaggcugaggcaggagaugcaugccuguaaucccagcuacuaaauuagucgggcguggugg

SEQ ID NO: 111241 - RNA, 64 nt, Homo Sapiens
uugugcuaauuaagagaccucuuucccucccucucccagcuagugaucucaggucuaaggcuuc

SEQ ID NO: 111242 - RNA, 64 nt, Homo Sapiens
uuuuuguguuuucuuuuuagcaugggccaccacacccagcuaaucgaguagcugggauuacagg

SEQ ID NO: 111243 - RNA, 64 nt, Homo Sapiens
aaauuagcuggguauguuggugcaggcuugcaaucccagcuacuugggacgcugaggugggagg

SEQ ID NO: 111244 - RNA, 64 nt, Homo Sapiens
auuuuggcagggugcuguggugcuugcauguagucccagcuauucaggaauauugcuugagucc

SEQ ID NO: 111245 - RNA, 64 nt, Homo Sapiens
aaaauuagccgggugcaguggugaggccuguaaucccagcuacucaggaggcugaggcaggaga

SEQ ID NO: 111246 - RNA, 64 nt, Homo Sapiens
aaauuggccgggcaugguggcaugugccuguagucccagcuacuugggaggcugaggcaggaga

SEQ ID NO: 111247 - RNA, 64 nt, Homo Sapiens
acaaaaauuaggcauaguggugcacgccugcagucccagcuacucaggagguugaggcagaaga

SEQ ID NO: 111248 - RNA, 64 nt, Homo Sapiens
uaaaaaaauuuuuuguguggugcaugccaccacacccagcuaaucauguggcugggacuauagg

SEQ ID NO: 111249 - RNA, 64 nt, Homo Sapiens
caggaagcugaggcgagagacaugcgccuguaaucccagcuacuaaauuagccagacguggugg

SEQ ID NO: 111250 - RNA, 64 nt, Homo Sapiens
auggagguugaggugggaggugugugccuguagucccagcuacuaaauuagcugagcauggugg

SEQ ID NO: 111251 - RNA, 64 nt, Homo Sapiens
cuggaggcugaggcaggagacaagcgccuguagucccagcuacuaaauuagccaggcauggugg

SEQ ID NO: 111252 - RNA, 64 nt, Homo Sapiens
aaauuagcugggcaugguggcgcacaccuguagucccagcuacucuggaggcugaggcagggga

SEQ ID NO: 111253 - RNA, 64 nt, Homo Sapiens
aaauuagcugggugcaguggcgcaugcuuguaaucccagcuacucaggaggcagaggcaggaga

SEQ ID NO: 111254 - RNA, 64 nt, Homo Sapiens
aauuuacucaggcaugauggcccauacuuguaaucccagcuauugggaaggaugagaugggagg

SEQ ID NO: 111255 - RNA, 64 nt, Homo Sapiens
ucagacgggcacagugguggugcccaccugugaucccagcuacucaggaggcugaggcaggaga

SEQ ID NO: 111256 - RNA, 64 nt, Homo Sapiens
caggauccugaggcaugagacgugcaccuguagucccagcuacuaaauuagcugggcguggugg

SEQ ID NO: 111257 - RNA, 64 nt, Homo Sapiens
uaggaggcugaggggcaagggcuggacguguagucccagcuacuuuacaaaaauacaaaaauua

SEQ ID NO: 111258 - RNA, 64 nt, Homo Sapiens
uuuuaaacuauaauuuuuuucacgcgccacuacacccagcuaauugaauaccugggacuucagg

SEQ ID NO: 111259 - RNA, 64 nt, Homo Sapiens
aaauuagucggacaugguggcaggcaccuguagucccagcuacucgggaggcugaggcaggaga

SEQ ID NO: 111260 - RNA, 64 nt, Homo Sapiens
aaauuagcuaggcgggguagugcaugccuguaaucccagcuacucaggaggcugaggccggaga

SEQ ID NO: 111261 - RNA, 64 nt, Homo Sapiens
acaugccguuucaugucaccugcuacagcucucccccagcuaguaugaugauccuguuuuacaa

SEQ ID NO: 111262 - RNA, 64 nt, Homo Sapiens
gcauuagccgagccugguggugcgugccuguaaucccagcuacucaggaggcugaggcaggaga

SEQ ID NO: 111263 - RNA, 64 nt, Homo Sapiens
cgggaggcuaaggcaggaaacccacgccuguaaucccagcuacuaaauuagccgggcguggugg

SEQ ID NO: 111264 - RNA, 64 nt, Homo Sapiens
cgggaggcugaggcaggagacgggcgccuguagucccagcuacuaaauuagccgggcgugguag

SEQ ID NO: 111265 - RNA, 64 nt, Homo Sapiens
agggaggcugagccaggaggggugcaccuguagucccagcuacuaaaaaugccagguguggugg

SEQ ID NO: 111266 - RNA, 64 nt, Homo Sapiens
caggaagcugagacacgagaacgcuugccuguaucccagcuacuaaaauuagcuggguguggug

SEQ ID NO: 111267 - RNA, 64 nt, Homo Sapiens
cgggaggcugaggcaggagacuucaagggcccuccccagcuacuaucagggcucagggccuuca

SEQ ID NO: 111268 - RNA, 64 nt, Homo Sapiens
ugggaggcugaggcaggagacaggcgccuguagucccagcuacuaaauuagcugggcaugguug

SEQ ID NO: 111269 - RNA, 64 nt, Homo Sapiens
ggggcuccccaggcccagggcucaacuucauggccccagcuauauccccccaguuccacacuaa

SEQ ID NO: 111270 - RNA, 64 nt, Homo Sapiens
aacacaucuucaaggcggcagagcugugcgcccacccagcuauugaaaaggacuuucugugggc

SEQ ID NO: 111271 - RNA, 64 nt, Homo Sapiens
aaauuagccaggcgugguggcaggugccuguaaucccagcuacuugggaggcugaggcaugaga

SEQ ID NO: 111272 - RNA, 64 nt, Homo Sapiens
aaauuagccgggcaugguggugcaugccuguaaucccagcuacucgggaggcugaggcaggaga

SEQ ID NO: 111273 - RNA, 64 nt, Homo Sapiens
aaauuagccgggcgugguggcgggcaccuguagucccagcuacucgggaggcugaggcaggaga

SEQ ID NO: 111274 - RNA, 64 nt, Homo Sapiens
aaaucagcuggguacgguggcacgugccugugaucccagcuacuugggaggcugaggcaggagg

SEQ ID NO: 111275 - RNA, 64 nt, Homo Sapiens
aaauuagcugggcuugguggcuggcgccuguaaucccagcuacucaggagacugaggcagaagg

SEQ ID NO: 111276 - RNA, 64 nt, Homo Sapiens
gugguggugggcaccuguacuggggaggugcccacccagcuacuggggaggcugagucaggaga

SEQ ID NO: 111277 - RNA, 64 nt, Homo Sapiens
acccuccuggggacuacaggugcgugcuaccauacccagcuaauuuaaacaaauuuuuuuuuug

SEQ ID NO: 111278 - RNA, 64 nt, Homo Sapiens
caaagcgcuaggauuccaggugugagcuacugugcccagcuaaaauagggauuuuuauauuaaa

SEQ ID NO: 111279 - RNA, 64 nt, Homo Sapiens
agcucugaaaugcgaugugaucuguaccaggucacccagcuaugcugcaaaguggguuggccaa

SEQ ID NO: 111280 - RNA, 64 nt, Homo Sapiens
ugauuggccgagcaugguggugcacaccaguauucccagcuacucuggaggcugaggcggaggc

SEQ ID NO: 111281 - RNA, 64 nt, Homo Sapiens
aaauuagccaggcgugguggugcacaccuguaaucccagcuacucgggaggcugaggcaagaga

SEQ ID NO: 111282 - RNA, 64 nt, Homo Sapiens
cgaguagcuaggauuacaggugcgugccaccacgcccagcuaauuuuuauauguuuaguggaaa

SEQ ID NO: 111283 - RNA, 64 nt, Homo Sapiens
caccagugugcauacagucauggaguuggguauucccagcuaccagggaggcugaggugggagg

SEQ ID NO: 111284 - RNA, 64 nt, Homo Sapiens
cgucuuccuuuuuuuuuuuucgugagccaucgugcccagcuagacaaagugcuaggauuccagg

SEQ ID NO: 111285 - RNA, 64 nt, Homo Sapiens
uuuuuguauuugguagagaucaugcgccaccacacccagcuaauaaaguagcugggauuacagg

SEQ ID NO: 111286 - RNA, 64 nt, Homo Sapiens
caggaggcugaggcaggauacacaugccuguaaucccagcuacuaaauuacccggaugugaugg

SEQ ID NO: 111287 - RNA, 64 nt, Homo Sapiens
ugggaggcugaggugggaaguaugccccuguagucccagcuacuaaaaguagcagguguggugg

SEQ ID NO: 111288 - RNA, 64 nt, Homo Sapiens
ggggaggcugaggcaggagacgggugccuguaaucccagcuacuaaauuggcugggcauggugg

SEQ ID NO: 111289 - RNA, 64 nt, Homo Sapiens
cagaagguugagacaaaggggugcaccugagaaucccagcuacuaauuagccaggcaugguggu

SEQ ID NO: 111290 - RNA, 64 nt, Homo Sapiens
uaugcagcacagcccaucucuuauuauguguauccccagcuaugaucuucagauuucucuguau

SEQ ID NO: 111291 - RNA, 64 nt, Homo Sapiens
uuuuguauuuuaguagagaccacccaccaccaugcccagcuaauuaaguagcugggauuacagg

SEQ ID NO: 111292 - RNA, 64 nt, Homo Sapiens
cgggaggcugaggcaggagacgggcaccuguagucccagcuacuaaauuagccgggugcggugg

SEQ ID NO: 111293 - RNA, 64 nt, Homo Sapiens
caggaagcugaggcagaaagcacaugccugugaucccagcuacuaaauuagcugaguguggugg

SEQ ID NO: 111294 - RNA, 64 nt, Homo Sapiens
caggagggugaggcagaagacgagugccuguaaucccagcuauuaaauuagccugguguggugg

SEQ ID NO: 111295 - RNA, 64 nt, Homo Sapiens
caggaggcugaggcaggagaugggcgccuguagucccagcuacuaaauuagccaggcgugguug

SEQ ID NO: 111296 - RNA, 64 nt, Homo Sapiens
gccaaucagccgauuuccuggccuguucuaaaggcccagcuacaagacccagcuaaagucaccu

SEQ ID NO: 111297 - RNA, 64 nt, Homo Sapiens
gucaccugccuguucuaaagacuguuuccagagacccagcuaaagacccagcuuuauucaccug

SEQ ID NO: 111298 - RNA, 64 nt, Homo Sapiens
guucccuggcuguuucuagaguuauuuccagagacccagcuacacuuggacagacuguuucuca

SEQ ID NO: 111299 - RNA, 64 nt, Homo Sapiens
uguauccugagguuccuagaucucacugaacuggcccagcuaaggagaccuggacucugggugu

SEQ ID NO: 111300 - RNA, 64 nt, Homo Sapiens
aagaugguggcuuuaaccugacugucuaaaaauucccagcuaagccuuuuccucuacucucuuc

SEQ ID NO: 111301 - RNA, 64 nt, Homo Sapiens
aaauuaguuggacaugauggugugcaccuauagucccagcuacucgggaggcugaagcagaagg

SEQ ID NO: 111302 - RNA, 64 nt, Homo Sapiens
aaauuagccaggcaggguggcaugugccuuuaaucccagcuacagggaggcugaggcaggagaa

SEQ ID NO: 111303 - RNA, 64 nt, Homo Sapiens
aaauuagccgggugugguggcacaugccuguaaucccagcuacucgggaagcugaggcaggaga

SEQ ID NO: 111304 - RNA, 64 nt, Homo Sapiens
aaauuaguucaucgggguggcacacaucaguagucccagcuacucugcaggcugaggugggagg

SEQ ID NO: 111305 - RNA, 64 nt, Homo Sapiens
cgggacuccucccuggggguggggcuccuaccugggggcagaacuccuaccugaaggcagggcu

SEQ ID NO: 111306 - RNA, 64 nt, Homo Sapiens
gggguuuuaugguggaugaggcuucuuccuggauggggcagagcuucuccugaccagggcaagg

SEQ ID NO: 111307 - RNA, 64 nt, Homo Sapiens
auaauaaauauucugagugacugcaaggccccauggggcagaauuauagcuugggucccuuuuc

SEQ ID NO: 111308 - RNA, 64 nt, Homo Sapiens
ccugggacucuguauuucuaggaucuggggaggaggggcagagauugucucuacucccucucuu

SEQ ID NO: 111309 - RNA, 64 nt, Homo Sapiens
uaaacauuagccacaauggcgccuugcugaaggaggggcagaguagggcugcuggggcuaaagu

SEQ ID NO: 111310 - RNA, 64 nt, Homo Sapiens
agccaaccagaggguuccugguggcccucuaggaggggcagaagcacucaacacaccuaagcca

SEQ ID NO: 111311 - RNA, 64 nt, Homo Sapiens
ucaaaucagcccaaggauaucagucugucgggugggggcagaaauggggaagggggacaagggu

SEQ ID NO: 111312 - RNA, 64 nt, Homo Sapiens
cauacguguggccaggaaguagagcagaaaguaaggggcagaguuuccuguauucaggcagcuc

SEQ ID NO: 111313 - RNA, 64 nt, Homo Sapiens
uguguugaguauuuguguggaauacaagggaguaggggcagaccgaaauaaacacauuucuaac

SEQ ID NO: 111314 - RNA, 64 nt, Homo Sapiens
gagaauguuuuacacaugcuauaauccauucagaggggcagauuugaguacauacugaucuuuc

SEQ ID NO: 111315 - RNA, 64 nt, Homo Sapiens
aggucauacugccaaucuuuagacaaauggccauggggcagaggacaggggagcugagguuggu

SEQ ID NO: 111316 - RNA, 64 nt, Homo Sapiens
uacuuuugcacuucuccaagugcaggucacaccaggggcagacccugucgcugcguuucugaac

SEQ ID NO: 111317 - RNA, 64 nt, Homo Sapiens
uuuuuagguguaaaagauggagucccacggaggaggggcagagccaggaggcaguggggcugug

SEQ ID NO: 111318 - RNA, 64 nt, Homo Sapiens
accuggguacccugguggggaugcagggaaggccggggcagagaaagugaaggucgacccaggg

SEQ ID NO: 111319 - RNA, 64 nt, Homo Sapiens
gaggaagguccaugaugcucagugggagcucaacggggcagaggugcuucucaguuuugcuaac

SEQ ID NO: 111320 - RNA, 64 nt, Homo Sapiens
caggguccaccaacuccccaaacacuccuuguaaggggcagagaggugcucugguuuccucagc

SEQ ID NO: 111321 - RNA, 64 nt, Homo Sapiens
ccuaauuucgcacaaugcaugaggugcuggggcuggggcagauguuagcaggcagcugggcaug

SEQ ID NO: 111322 - RNA, 64 nt, Homo Sapiens
cuccccguccucguggagcucugagcauccucucggggcagaccacagccuacagccagaacuu

SEQ ID NO: 111323 - RNA, 64 nt, Homo Sapiens
gcgauguggaccacgggauugucauggccuccugggggcagaagagcagcagccuggcugccuu

SEQ ID NO: 111324 - RNA, 64 nt, Homo Sapiens
ccacaggccuggaacccuggugcccacccagcaaggggcagaggaccuuaggccacccuccuca

SEQ ID NO: 111325 - RNA, 64 nt, Homo Sapiens
auagggaaucucuuauuaaagguuagguuuuacuggggcagaggauaaccugucaggcuggcuu

SEQ ID NO: 111326 - RNA, 64 nt, Homo Sapiens
cuuccagucacugagucucccucaccaagagugaggggcagagaccagcugcugaaauuagcua

SEQ ID NO: 111327 - RNA, 64 nt, Homo Sapiens
uugcagugagccgagauugcuugcuugaacccagggggcagaggcucaggagguuggggcagaa

SEQ ID NO: 111328 - RNA, 64 nt, Homo Sapiens
ugcuugaacccagggggcagcuacucaggagguuggggcagaaugccugugccuguaaacccag

SEQ ID NO: 111329 - RNA, 64 nt, Homo Sapiens
ggcauugcucuaccucucccugacauuuugcuccggggcagauccaaccuuaccuggggcagca

SEQ ID NO: 111330 - RNA, 64 nt, Homo Sapiens
aucuggaccaguagcccaucccgcaguuuucuugggggcagaggaaaacgcuucuuucuccucc

SEQ ID NO: 111331 - RNA, 64 nt, Homo Sapiens
uuagccgugcaugcacuuuguggccccuuugcaaggggcagaggguacuggaagugggaggagg

SEQ ID NO: 111332 - RNA, 64 nt, Homo Sapiens
aaaauauucuucugggcucaaaagcuagcuugagggggcagaugccccaggugucccagcucca

SEQ ID NO: 111333 - RNA, 64 nt, Homo Sapiens
cuuuuccucuuuugugagaagaugggggcuggagggggcagaguggccugugagcaagagccag

SEQ ID NO: 111334 - RNA, 64 nt, Homo Sapiens
agcaagagccaggggugucccagucccagccucuggggcagagcuuguagcccuggauggccuc

SEQ ID NO: 111335 - RNA, 57 nt, Homo Sapiens
gcugcugcuccuucaugugaaucccagggggcagagaggaggcucuggaggcacaca

SEQ ID NO: 111336 - RNA, 64 nt, Homo Sapiens
gauaagagauauggagaugggagggggaggacaaggggcagagaguagggucuagcuggcuauc

SEQ ID NO: 111337 - RNA, 64 nt, Homo Sapiens
gagaggcagguccuaaaggagggggggucuccugggggcagaccgagggucucggaggauagaa

SEQ ID NO: 111338 - RNA, 64 nt, Homo Sapiens
cacuuggcaagcggcugggccugacggaggccgaggggcagaccggggcuccagccagaccccu

SEQ ID NO: 111339 - RNA, 64 nt, Homo Sapiens
cccuccaaucccaccggacccaggcccugggcuaggggcagagcaggccccgccccagggcaau

SEQ ID NO: 111340 - RNA, 64 nt, Homo Sapiens
guauuuauuccccuuuagguuugcagaggggguaggggcagagucaggggcuggccagaggguc

SEQ ID NO: 111341 - RNA, 64 nt, Homo Sapiens
gcccaagauuccgagagcccugcgcucuagggcaggggcagaguuuuggaaacagugcaggcuc

SEQ ID NO: 111342 - RNA, 64 nt, Homo Sapiens
gaagucacuugcucaaggucaggcagcuuaggaaggggcagaucgggggcuugaacccaggugg

SEQ ID NO: 111343 - RNA, 64 nt, Homo Sapiens
cccauuucuguccuuggccuugggaguagcugagggggcagacuagggaguagggcuggcaggg

SEQ ID NO: 111344 - RNA, 64 nt, Homo Sapiens
gggggcagacuagggaguagggcuggcaggggagggggcagacagccucgccucgcacccuuca

SEQ ID NO: 111345 - RNA, 64 nt, Homo Sapiens
agaggcggauacagaaacuuuuggggguggggugggggcagaggcuaguuuuuagcccuuuuug

SEQ ID NO: 111346 - RNA, 64 nt, Homo Sapiens
caugcuccuggcaucgagugagacauuuuugguuggggcagaggggacaucaggcaaggucugg

SEQ ID NO: 111347 - RNA, 57 nt, Homo Sapiens
cccagacaaacagcagaugaguugaguggggcagagggacagggcagccagaccaag

SEQ ID NO: 111348 - RNA, 64 nt, Homo Sapiens
ccagcaggugccagggcuggugaggaagagcuggggggcagagguaaagcccugcaggggaggc

SEQ ID NO: 111349 - RNA, 64 nt, Homo Sapiens
ugguggggucuccucaggacuugcucccugacugggggcagacaucuccgaaaugcugucuuuc

SEQ ID NO: 111350 - RNA, 64 nt, Homo Sapiens
agaacuugcugccucggaucgggaggcuggaguuggggcagaggucccucuccagcaggcccau

SEQ ID NO: 111351 - RNA, 64 nt, Homo Sapiens
ccuagcuuucaguuuucucuucugugaaacaggaagacugaaccacguaauuaauauccaaggu

SEQ ID NO: 111352 - RNA, 64 nt, Homo Sapiens
auuagauuggaucucccaaguuuuaauugaaaggagacugaacgaaaaccuuucugcuuucugu

SEQ ID NO: 111353 - RNA, 64 nt, Homo Sapiens
gggcaucaacauggccaacagcauugccaaccugagacugaaggccaaggaauauaguuuacag

SEQ ID NO: 111354 - RNA, 64 nt, Homo Sapiens
auuaucaaguuuugaaggaacuguacaucccaacagacugaaacauucuaagugaaaugaguau

SEQ ID NO: 111355 - RNA, 64 nt, Homo Sapiens
gcacaaaucucuacuccucaugacaugaagaaaaagacugaaugugaagggaguuucuguacug

SEQ ID NO: 111356 - RNA, 64 nt, Homo Sapiens
aaagccggggucaaaaaaaguaguuuaagucuuaagacugaauaugcauuaaaguaugcaggua

SEQ ID NO: 111357 - RNA, 64 nt, Homo Sapiens
caagaagucuugggauuggauuaaaagugugugaagacugaaucucaguaccaaauagucacgc

SEQ ID NO: 111358 - RNA, 60 nt, Homo Sapiens
guauucaguaccaaauagucugucuuauauagacugaacuuccacauaauuuugaaguga

SEQ ID NO: 111359 - RNA, 64 nt, Homo Sapiens
aauaauucucucuuuccucucaaggaaacaggagagacugaauuucauuucauuauguuucuuc

SEQ ID NO: 111360 - RNA, 64 nt, Homo Sapiens
acacuagaaaucagccagaaugguagcccuggcuagacugaauuugaagaaccacugcugcagg

SEQ ID NO: 111361 - RNA, 64 nt, Homo Sapiens
uucuugccuaaugauguuaucuaggcaccauuggagacugaaaaaaaaaaaucccugcucugua

SEQ ID NO: 111362 - RNA, 64 nt, Homo Sapiens
gaccaauacaaaauaacaaaaauguaauggaaucagacugaauuaaaguaaggcuguauauuga

SEQ ID NO: 111363 - RNA, 64 nt, Homo Sapiens
gaacagauuacuuaaagcuauuucauuucaaagcagacugaaugugacuucaucuaaaggcagc

SEQ ID NO: 111364 - RNA, 64 nt, Homo Sapiens
acggcuuaaccccagucuugaugguauauugaacagacugaauauauuuuaccauuacagggcu

SEQ ID NO: 111365 - RNA, 64 nt, Homo Sapiens
uuucgccagaagcuguccuuucccucccucccacagacugaaccgaacuggugcagcuucucuc

SEQ ID NO: 111366 - RNA, 64 nt, Homo Sapiens
gaagguuacauguuuuaggauuguuuuaaagcaaagacugaauuuacuagccuaacagauuggc

SEQ ID NO: 111367 - RNA, 64 nt, Homo Sapiens
uuuuuagacaagaauaagaaauaacuauuuucugagacugaagucuccuucucagcucacuuca

SEQ ID NO: 111368 - RNA, 64 nt, Homo Sapiens
ucugacgggauuucuauaugcugaauuacccgguagacugaauacagucagacacgaaauccaa

SEQ ID NO: 111369 - RNA, 64 nt, Homo Sapiens
gacaaaguuuaucuuggccuuuuuuguacucugcagacugaaaauuuaaccuuuucauuuuaug

SEQ ID NO: 111370 - RNA, 64 nt, Homo Sapiens
guguuuccugaauaccaguguaauugcacaacagagacugaaaucuucuccaauacagcaaacc

SEQ ID NO: 111371 - RNA, 64 nt, Homo Sapiens
cugagaaguuaacccuuaaacaguuuucuggaagagacugaauuucuggguccuugcagcugug

SEQ ID NO: 111372 - RNA, 64 nt, Homo Sapiens
uagauuccucuagaaaggcaucaaaaggcucaacagacugaauggccucuuggucugcgaaaau

SEQ ID NO: 111373 - RNA, 64 nt, Homo Sapiens
uucaugauuuuauuucccagcagugcugaugacaagacugaauguuaccuuuucuuucugacag

SEQ ID NO: 111374 - RNA, 64 nt, Homo Sapiens
ccucucauaguagguauauaugaguuuucacagaagacugaaaaauaaugcaugauauuuguuu

SEQ ID NO: 111375 - RNA, 64 nt, Homo Sapiens
agcaauucugccacuaccagcaaggcuucucuucagacugaagcugaaucugaguacacccugg

SEQ ID NO: 111376 - RNA, 52 nt, Homo Sapiens
ccauggagauuauuuuuauugaagacugaaaauaaaaccuuuguaucuauaa

SEQ ID NO: 111377 - RNA, 64 nt, Homo Sapiens
gguaaaugggcgaaauccaggccaggagccucagagacugaagcagaacagaguaagacucaug

SEQ ID NO: 111378 - RNA, 64 nt, Homo Sapiens
caaccucgucaucauccccacuuuaaaccccaggagacugaaacucaaacaacccugggcaagu

SEQ ID NO: 111379 - RNA, 61 nt, Homo Sapiens
gcuuucuuacaugguuauagagcccucaggcagacugaauucuaaaucugugaaggaucua

SEQ ID NO: 111380 - RNA, 64 nt, Homo Sapiens
uaaauacaugccuucuauauggaacauggcagaaagacugaaaaauaacaguaauuaauugugu

SEQ ID NO: 111381 - RNA, 64 nt, Homo Sapiens
cugucccauauuuggguuaugaugacucaaguguagacugaaguugagguagugccuuaugcca

SEQ ID NO: 111382 - RNA, 64 nt, Homo Sapiens
uucugagcugcugcuuuugauauagucagacuuaagacugaaccccaguagacaggcaauagau

SEQ ID NO: 111383 - RNA, 64 nt, Homo Sapiens
ugaaacucauuuaacuggguuaauuucauuucuuagacugaauauauuauuguuaagauacgug

SEQ ID NO: 111384 - RNA, 64 nt, Homo Sapiens
agaucaaguuguucuccccacuuuacugcaagguagacugaaguucagaagaaauacugaauuu

SEQ ID NO: 111385 - RNA, 64 nt, Homo Sapiens
ccugccauuuccacccuccagucauuucucuaugagacugaagcaggaaggcagagcaucaucu

SEQ ID NO: 111386 - RNA, 64 nt, Homo Sapiens
aaagcccacaccuaacauuauacuucauggugauagacugaaggcugaauguuuuccccuuaag

SEQ ID NO: 111387 - RNA, 64 nt, Homo Sapiens
aagcuugugcuaagauggaacauuucaaaaaaaaagacugaaacugggugacagagcgagacuc

SEQ ID NO: 111388 - RNA, 64 nt, Homo Sapiens
aagcaggccagaugugguggagucguuccucuuaagacugaaacuaccugugaaugaacaauga

SEQ ID NO: 111389 - RNA, 64 nt, Homo Sapiens
uugaaggaaaauacugacuuuaagauguauuuuaagacugaaauuuuguucuuuaguacuuuuc

SEQ ID NO: 111390 - RNA, 64 nt, Homo Sapiens
cuaucacagacaauggaauucgucaguggugguaagacugaaauccugaugcuuuucacacuuc

SEQ ID NO: 111391 - RNA, 64 nt, Homo Sapiens
uuucuagaaugucauggaagaggaacgugcaacuacuauucaaauuccuacaguuucuggcugg

SEQ ID NO: 111392 - RNA, 64 nt, Homo Sapiens
gugcuguuucaaaguucucuguggcaaagcagcaacuauucacaaaauaucaccaaaaaccuau

SEQ ID NO: 111393 - RNA, 64 nt, Homo Sapiens
agugaauuagaaauuucagcucaguuucuauuuuacuauucaaguuguguacuuuaaacaaaua

SEQ ID NO: 111394 - RNA, 64 nt, Homo Sapiens
aacuuuaauugaaauaauauagauuuaguugaauacuauucaggaaguaauaaauuuuaauaua

SEQ ID NO: 111395 - RNA, 64 nt, Homo Sapiens
auagccaagauauaggagcaauguuuacugcagcacuauucacauaaagagacauuugaacccu

SEQ ID NO: 111396 - RNA, 64 nt, Homo Sapiens
cagaaaugcaaaucaaaaccaaugcucaacauuaacuauucauagucaauaaguauauuuuuaa

SEQ ID NO: 111397 - RNA, 64 nt, Homo Sapiens
uuuagcuuuugucuccagugcuuucuuuguuauaacuauucauuuuaaucuuuuggaauauugu

SEQ ID NO: 111398 - RNA, 64 nt, Homo Sapiens
cacaaaguguaaaggcacuguucaaaucugauacacuauucaaccguguagaaacuagccacug

SEQ ID NO: 111399 - RNA, 64 nt, Homo Sapiens
auugaaaauguaaauuaaaacuauuucagugucaacuauucagaaagacuguaacacagcugaa

SEQ ID NO: 111400 - RNA, 64 nt, Homo Sapiens
guucaaagauccagugcagugauuggugaaugggacuauucauuuauuuaaccccaaacauuug

SEQ ID NO: 111401 - RNA, 64 nt, Homo Sapiens
acccacgcggauguugcaccucauucucccgaugacuauucaaaucagcaucuagaggcugaau

SEQ ID NO: 111402 - RNA, 64 nt, Homo Sapiens
cauuaaucucuuuauccauugcugaacgacugugacuauucaguaacgaaguaauaguaauuaa

SEQ ID NO: 111403 - RNA, 61 nt, Homo Sapiens
cacccagaucaccaaaguaaaaaacaacaaaacuauucaaaaacuucacucucuucccauu

SEQ ID NO: 111404 - RNA, 64 nt, Homo Sapiens
gacaugguauacuacuauauuuacucaguuugaaacuauucauuucuacacacuauuuuuaaaa

SEQ ID NO: 111405 - RNA, 64 nt, Homo Sapiens
uugcuucuaguuuuauuuuaccgacugucuugaaacuauucauugcauuugguuuguugguuag

SEQ ID NO: 111406 - RNA, 64 nt, Homo Sapiens
uaucuuuuuauuucugauaguuguacuguucuauacuauucaggugaugaaagccaaaaccugu

SEQ ID NO: 111407 - RNA, 64 nt, Homo Sapiens
ggagaguuuacccauacauuacaguaacauuuggacuauucauuaugaauaucggaauaugugc

SEQ ID NO: 111408 - RNA, 64 nt, Homo Sapiens
aaggcauuauuugagauuccauuuuucugucaagacuauucaaguggaguuugcuaagggcagu

SEQ ID NO: 111409 - RNA, 64 nt, Homo Sapiens
agaggugcuguaauuuuaaaaaaugauccauuuaacuauucaucacaguuuaucccuguaggau

SEQ ID NO: 111410 - RNA, 64 nt, Homo Sapiens
aaaaaccauagagccauggagaaaaucuacacaaacuauucauuagaucagggguguuucaugg

SEQ ID NO: 111411 - RNA, 64 nt, Homo Sapiens
caggaaagguuuugaaaaaggaugggucccacccucccuccagagccaccaguguuagagcgga

SEQ ID NO: 111412 - RNA, 64 nt, Homo Sapiens
cagccccuggggaaaagcagccucccuucuccucucccuccacucccucgcucccucccucagc

SEQ ID NO: 111413 - RNA, 64 nt, Homo Sapiens
uggugccagcuggcaaaugagggcuggacucucuucccuccagagaccaccccgcuccuugcug

SEQ ID NO: 111414 - RNA, 64 nt, Homo Sapiens
guggagggacuucccucccccucuuuuccauuucucccuccaucaccaccugcccucacauccu

SEQ ID NO: 111415 - RNA, 64 nt, Homo Sapiens
ugccucuucaucugggaaugcacuuucagggacuucccuccagccccucugcuggguagagagg

SEQ ID NO: 111416 - RNA, 64 nt, Homo Sapiens
ccuuccucugacccuugcugccuuuacucucuucucccuccagagccuccugcccacccagggc

SEQ ID NO: 111417 - RNA, 64 nt, Homo Sapiens
cccaucucaaaucacaaggacaauaucguaccugucccuccaggcacuuuccaucucugccugu

SEQ ID NO: 111418 - RNA, 64 nt, Homo Sapiens
ccagacauugauggggacaugcccuguucuccugucccuccaucgccucccuucuccuuucuaa

SEQ ID NO: 111419 - RNA, 64 nt, Homo Sapiens
ucuacccagaccuccaggccgaccauauuuucucucccuccauuaccugcccuagaccuccaga

SEQ ID NO: 111420 - RNA, 64 nt, Homo Sapiens
ucuccuuaccaagcacccaauccucacauucccuucccuccaccuuauuucccuaaacgacccu

SEQ ID NO: 111421 - RNA, 64 nt, Homo Sapiens
agccugaguggugaggggccacugggccccauucucccuccauggcaggaaggcgggggauuuc

SEQ ID NO: 111422 - RNA, 64 nt, Homo Sapiens
gguggggcuguacacacccuccagcacagacuguucccuccaagguccucuuaggucccgggag

SEQ ID NO: 111423 - RNA, 64 nt, Homo Sapiens
cuggggcuugggacugcuuacuccaauguguaggucccuccaggcuuuucgagcucuugaccac

SEQ ID NO: 111424 - RNA, 64 nt, Homo Sapiens
cccuggaggggcuucuaguaccauccccuucauuucccuccaguuucuucccacagccaaagcc

SEQ ID NO: 111425 - RNA, 64 nt, Homo Sapiens
aucaagguaguaauaauaauuuuuccuccacaggucccuccacucauauggccucucccucccc

SEQ ID NO: 111426 - RNA, 64 nt, Homo Sapiens
uccugccucugugccuucucucauucuccuucucucccuccauaccccacuuuugagguucugu

SEQ ID NO: 111427 - RNA, 64 nt, Homo Sapiens
ggccagaguagaguguagagugugccccgugacaucccuccaucuucuccuccauuaucaucua

SEQ ID NO: 111428 - RNA, 64 nt, Homo Sapiens
acauguuacagcaaaucuggagccacagacagguucccuccauuggcagcccauuguguuugaa

SEQ ID NO: 111429 - RNA, 64 nt, Homo Sapiens
uccagguggugcugggcucagcagcgacccagcuucccuccacugucagccucccucccuucca

SEQ ID NO: 111430 - RNA, 64 nt, Homo Sapiens
agcccugaucacaccaugaggugccccuccacccucccuccagcaaccuugguuccuggagagu

SEQ ID NO: 111431 - RNA, 64 nt, Homo Sapiens
ggcuauuccugucuuaggcgaacuugcauuucccucccuccaggcacaaccccgaggcagcccc

SEQ ID NO: 111432 - RNA, 64 nt, Homo Sapiens
aagauucaguagaagaaauaauucugguuuggagucccuccaccagcaaguuaucuuuuaguuu

SEQ ID NO: 111433 - RNA, 64 nt, Homo Sapiens
gccccuccccgcacccaccuccugucucccucccucccuccauaggaguggggggccccuagaa

SEQ ID NO: 111434 - RNA, 64 nt, Homo Sapiens
gucaccguaguggcuaccaccucagggcagccccucccuccagcuggcggggccucagcuuccc

SEQ ID NO: 111435 - RNA, 58 nt, Homo Sapiens
acuacguggaggcuaucuagaggcccccucccuccauacucccgucacuccuccccac

SEQ ID NO: 111436 - RNA, 64 nt, Homo Sapiens
gaggagaucaucuuguuccccuggccccccacucucccuccauguccauccaaaaaccauaaaa

SEQ ID NO: 111437 - RNA, 64 nt, Homo Sapiens
ccgcacccaaccuguguuguugccgcccggcccuucccuccacagcucuccuuccucccgcccg

SEQ ID NO: 111438 - RNA, 64 nt, Homo Sapiens
accugcucaucucugcccugaggucaccccguggucccuccacgugcccaucucucugcagugc

SEQ ID NO: 111439 - RNA, 64 nt, Homo Sapiens
caaguauggccaccuguuuggaauagcagcgguaucccuccaccuccaccaaaucuucaucugg

SEQ ID NO: 111440 - RNA, 64 nt, Homo Sapiens
cucagccaagcaacauggggccccaccauguuugucccuccagccccagugccuuccaguaugg

SEQ ID NO: 111441 - RNA, 64 nt, Homo Sapiens
gugaacaagcuuuugcagcuacaccuggagacagucccuccacuaggcaaaacuucgagaauca

SEQ ID NO: 111442 - RNA, 64 nt, Homo Sapiens
uugagaacaacugagggccacccggucggggccaucccuccacacucugcauccuaccccaccu

SEQ ID NO: 111443 - RNA, 64 nt, Homo Sapiens
guaacccugccucccugcuuccugguccagagccucccuccagugacuguggagccugagaagg

SEQ ID NO: 111444 - RNA, 64 nt, Homo Sapiens
uccugcucacucaagcaaaagcagccucuggccuucccuccaccgcuuugcuccaucuggcuua

SEQ ID NO: 111445 - RNA, 64 nt, Homo Sapiens
aguuuaauugucucaacgccucccccucccccauucccuccauuuuucucccaagaaaccugac

SEQ ID NO: 111446 - RNA, 64 nt, Homo Sapiens
gaguuacagggaaguggucuccccaauucuccccucccuccaguauugcccccucucacuuuag

SEQ ID NO: 111447 - RNA, 64 nt, Homo Sapiens
guacccaguagauaaugaaccaaauuaaguucccucccuccagccagaaguuaaacaucuggga

SEQ ID NO: 111448 - RNA, 64 nt, Homo Sapiens
ggcucaacaccaaacuggacaguagacaucaugaucccuccaguuagcucuaauuacagacccc

SEQ ID NO: 111449 - RNA, 64 nt, Homo Sapiens
aaggcugaggaggacaggagaagggcccagacacucccuccagugaguguccugcagcccuuau

SEQ ID NO: 111450 - RNA, 64 nt, Homo Sapiens
acacucccuccagugaguguccugcagcccuuauucccuccauagaaagcauccucagagcacc

SEQ ID NO: 111451 - RNA, 64 nt, Homo Sapiens
cagggccaaggucugggggugcuggaggccaugcucccuccaggcuugcggggagaacuucccu

SEQ ID NO: 111452 - RNA, 64 nt, Homo Sapiens
ucacuggucccggggcuaaggaccuugcuccaagucccuccacccaugaugcugugccuuccag

SEQ ID NO: 111453 - RNA, 64 nt, Homo Sapiens
ccucugucgccucccccucucuugccucccccuuucccuccauuauccucuccuguuucucucu

SEQ ID NO: 111454 - RNA, 64 nt, Homo Sapiens
aauaauguggcauacacaguuuguuuuaaaguggucccuccaagugguaaauuauccaucacuu

SEQ ID NO: 111455 - RNA, 64 nt, Homo Sapiens
ucugcuccagcuugcuggauguuaccuguccucuucccuccacaagucuuggcccuuaaccuuu

SEQ ID NO: 111456 - RNA, 64 nt, Homo Sapiens
gaugacugacuaaagaugcuaggcgugacaccguucccuccaaaagcagaccucggaaucacug

SEQ ID NO: 111457 - RNA, 64 nt, Homo Sapiens
cuaggucagagguggggacagggcagaagggcccucccuccagccauguguaccaagagcagca

SEQ ID NO: 111458 - RNA, 64 nt, Homo Sapiens
ccuuggcuuuuaugacccugccggaagccuggggucccuccacaccagccgaaccagcacucuc

SEQ ID NO: 111459 - RNA, 64 nt, Homo Sapiens
aaaccugauucugcugcccacauccuacccccaaucccuccaaucucaagccccaugccgugcu

SEQ ID NO: 111460 - RNA, 52 nt, Homo Sapiens
caccucaagccccaugccgugcucccuccacaggggcuucugggccugcuga

SEQ ID NO: 111461 - RNA, 64 nt, Homo Sapiens
gaauccgccugcagaggacacuaaaucugagaucucccuccaggccagauccuacucuuccuuu

SEQ ID NO: 111462 - RNA, 64 nt, Homo Sapiens
cggcuccugucauccccuaccucugccuggaggaucccuccaucccuggcaugucagagccagg

SEQ ID NO: 111463 - RNA, 64 nt, Homo Sapiens
cuccuuugucgcucucauggcugucagauccuggucccuccacacugggugcuggggagggagg

SEQ ID NO: 111464 - RNA, 64 nt, Homo Sapiens
acgcuugcagacacuguuguuuuggaaaugugcuucccuccaucugaaaucucaucccuccacc

SEQ ID NO: 111465 - RNA, 64 nt, Homo Sapiens
uuuggaaaugugcuucccuccaucugaaaucucaucccuccacccgcccacucgggcagcugug

SEQ ID NO: 111466 - RNA, 64 nt, Homo Sapiens
ccuccacccguccuggggugcccugcgcccucccucccuccacacccaccccucuucccccuuc

SEQ ID NO: 111467 - RNA, 64 nt, Homo Sapiens
ccucccaacucuggccuuggcucucuccucucucucccuccacuagggugggcgugacuucaga

SEQ ID NO: 111468 - RNA, 64 nt, Homo Sapiens; identical to SEQ ID NO: 45231

SEQ ID NO: 111469 - RNA, 64 nt, Homo Sapiens; identical to SEQ ID NO: 45232

SEQ ID NO: 111470 - RNA, 64 nt, Homo Sapiens; identical to SEQ ID NO: 45233

SEQ ID NO: 111471 - RNA, 64 nt, Homo Sapiens; identical to SEQ ID NO: 45234

SEQ ID NO: 111472 - RNA, 64 nt, Homo Sapiens; identical to SEQ ID NO: 45235

SEQ ID NO: 111473 - RNA, 64 nt, Homo Sapiens; identical to SEQ ID NO: 45236

SEQ ID NO: 111474 - RNA, 64 nt, Homo Sapiens; identical to SEQ ID NO: 45237

SEQ ID NO: 111475 - RNA, 64 nt, Homo Sapiens; identical to SEQ ID NO: 45238

SEQ ID NO: 111476 - RNA, 64 nt, Homo Sapiens; identical to SEQ ID NO: 45239

SEQ ID NO: 111477 - RNA, 64 nt, Homo Sapiens; identical to SEQ ID NO: 45240

SEQ ID NO: 111478 - RNA, 64 nt, Homo Sapiens; identical to SEQ ID NO: 45241

SEQ ID NO: 111479 - RNA, 64 nt, Homo Sapiens; identical to SEQ ID NO: 45242

SEQ ID NO: 111480 - RNA, 64 nt, Homo Sapiens; identical to SEQ ID NO: 45243

SEQ ID NO: 111481 - RNA, 64 nt, Homo Sapiens; identical to SEQ ID NO: 45244

SEQ ID NO: 111482 - RNA, 64 nt, Homo Sapiens; identical to SEQ ID NO: 45245

SEQ ID NO: 111483 - RNA, 64 nt, Homo Sapiens; identical to SEQ ID NO: 45246

SEQ ID NO: 111484 - RNA, 64 nt, Homo Sapiens; identical to SEQ ID NO: 45247

SEQ ID NO: 111485 - RNA, 64 nt, Homo Sapiens; identical to SEQ ID NO: 45248

SEQ ID NO: 111486 - RNA, 64 nt, Homo Sapiens; identical to SEQ ID NO: 45249

SEQ ID NO: 111487 - RNA, 64 nt, Homo Sapiens; identical to SEQ ID NO: 45250

SEQ ID NO: 111488 - RNA, 64 nt, Homo Sapiens; identical to SEQ ID NO: 45251

SEQ ID NO: 111489 - RNA, 64 nt, Homo Sapiens; identical to SEQ ID NO: 45252

SEQ ID NO: 111490 - RNA, 64 nt, Homo Sapiens; identical to SEQ ID NO: 45253

SEQ ID NO: 111491 - RNA, 64 nt, Homo Sapiens; identical to SEQ ID NO: 45254

SEQ ID NO: 111492 - RNA, 64 nt, Homo Sapiens; identical to SEQ ID NO: 45255

SEQ ID NO: 111493 - RNA, 64 nt, Homo Sapiens; identical to SEQ ID NO: 45256

SEQ ID NO: 111494 - RNA, 64 nt, Homo Sapiens; identical to SEQ ID NO: 45257

SEQ ID NO: 111495 - RNA, 64 nt, Homo Sapiens; identical to SEQ ID NO: 45258

SEQ ID NO: 111496 - RNA, 64 nt, Homo Sapiens; identical to SEQ ID NO: 45259

SEQ ID NO: 111497 - RNA, 64 nt, Homo Sapiens; identical to SEQ ID NO: 45260

SEQ ID NO: 111498 - RNA, 64 nt, Homo Sapiens; identical to SEQ ID NO: 45261

SEQ ID NO: 111499 - RNA, 64 nt, Homo Sapiens; identical to SEQ ID NO: 45262

SEQ ID NO: 111500 - RNA, 64 nt, Homo Sapiens; identical to SEQ ID NO: 45263

SEQ ID NO: 111501 - RNA, 64 nt, Homo Sapiens; identical to SEQ ID NO: 45264

SEQ ID NO: 111502 - RNA, 64 nt, Homo Sapiens; identical to SEQ ID NO: 45265

SEQ ID NO: 111503 - RNA, 64 nt, Homo Sapiens; identical to SEQ ID NO: 45266

SEQ ID NO: 111504 - RNA, 64 nt, Homo Sapiens; identical to SEQ ID NO: 45267

SEQ ID NO: 111505 - RNA, 64 nt, Homo Sapiens; identical to SEQ ID NO: 45268

SEQ ID NO: 111506 - RNA, 64 nt, Homo Sapiens; identical to SEQ ID NO: 45269

SEQ ID NO: 111507 - RNA, 64 nt, Homo Sapiens; identical to SEQ ID NO: 45270

SEQ ID NO: 111508 - RNA, 64 nt, Homo Sapiens; identical to SEQ ID NO: 45271

SEQ ID NO: 111509 - RNA, 64 nt, Homo Sapiens; identical to SEQ ID NO: 45272

SEQ ID NO: 111510 - RNA, 64 nt, Homo Sapiens; identical to SEQ ID NO: 45273

SEQ ID NO: 111511 - RNA, 64 nt, Homo Sapiens; identical to SEQ ID NO: 45274

SEQ ID NO: 111512 - RNA, 64 nt, Homo Sapiens; identical to SEQ ID NO: 45275

SEQ ID NO: 111513 - RNA, 64 nt, Homo Sapiens; identical to SEQ ID NO: 45276

SEQ ID NO: 111514 - RNA, 64 nt, Homo Sapiens; identical to SEQ ID NO: 45277

SEQ ID NO: 111515 - RNA, 64 nt, Homo Sapiens; identical to SEQ ID NO: 45278

SEQ ID NO: 111516 - RNA, 64 nt, Homo Sapiens; identical to SEQ ID NO: 45279

SEQ ID NO: 111517 - RNA, 64 nt, Homo Sapiens; identical to SEQ ID NO: 45280

SEQ ID NO: 111518 - RNA, 64 nt, Homo Sapiens
agaugggugaaggacaagaagugaguugugucaauuauuguagauacaauuuucugauuaaauc

SEQ ID NO: 111519 - RNA, 64 nt, Homo Sapiens
uggaaaaauaaaaggcagccuguuuuuucugcuuuuauuguauuaacagcugagguagcuaaag

SEQ ID NO: 111520 - RNA, 64 nt, Homo Sapiens
cuaaaaacuuauguuagcuucaguaaaaguacuuuuauuguaaauaaacaaucaugaacucaac

SEQ ID NO: 111521 - RNA, 64 nt, Homo Sapiens
gaagcauuugaaugucauaucuuuuuaaaguauuuuauuguauacuguaucauagaaguuggag

SEQ ID NO: 111522 - RNA, 64 nt, Homo Sapiens
ucuuggguaaggacaggccaagcagucaugaauuuuauuguauugcuugccuauuagucugcug

SEQ ID NO: 111523 - RNA, 64 nt, Homo Sapiens
uucagaagugaggcgauggcgucgaaugucuucuuuauuguauuccauauuuaauuaaauaagu

SEQ ID NO: 111524 - RNA, 64 nt, Homo Sapiens
cuaauauaauugaaauaaauuauuuauuguauauuuauuguauuauacccaaaagaaauucagu

SEQ ID NO: 111525 - RNA, 64 nt, Homo Sapiens
uuuauuguauucuaauauaaagaaauucaguuauuuauuguauacuacuucuuacauacccaaa

SEQ ID NO: 111526 - RNA, 64 nt, Homo Sapiens
uauguggaaacaguguuuuaaccaauaauagaguuuauuguauuuuaucuagcacuugugacau

SEQ ID NO: 111527 - RNA, 64 nt, Homo Sapiens
aaaaauaaaaaggacuacuuagaaauuguacuuuuuauuguaagucuuauugaacuuauucuua

SEQ ID NO: 111528 - RNA, 64 nt, Homo Sapiens
uaugucuuucaauuuaaauucacuucaguuuuuguuauuguaauauauuuacuuuuacaugguu

SEQ ID NO: 111529 - RNA, 64 nt, Homo Sapiens
guucccucuuuggggcaaauucuuauaaaaauguuuauuguaaaguuauauauuuugucuacga

SEQ ID NO: 111530 - RNA, 64 nt, Homo Sapiens
cucuuuguuacuugucuguuuccauuugaauuucuuauuguaaaaaucuguuuaaauccauuua

SEQ ID NO: 111531 - RNA, 64 nt, Homo Sapiens
ccauaagaggguguaaacaauuaacuccaggguuuuauuguauccugcaauauuuaguauuaac

SEQ ID NO: 111532 - RNA, 64 nt, Homo Sapiens
aauauugcacuucuuucaagauguuaucaauugguuauuguacuguauaguuuuaauaauuuug

SEQ ID NO: 111533 - RNA, 64 nt, Homo Sapiens
uagaagaaaugugcuguauuuugauaaaauucacuuauuguauguguguuguaaucuaaaaaaa

SEQ ID NO: 111534 - RNA, 64 nt, Homo Sapiens
gcuguuuaagaugggcagcuauuuuuuauucaaguuauuguacaugcucauuuuuucuuacaua

SEQ ID NO: 111535 - RNA, 64 nt, Homo Sapiens
aacuaucaguuuguccuguacgaauuaauagcuuuuauuguauaaugguugccuuaaagaaagu

SEQ ID NO: 111536 - RNA, 64 nt, Homo Sapiens
ucugaaaaauggauuucuugagcaaaagaucuguuuauuguauguaaggaaaaauuuuaccuga

SEQ ID NO: 111537 - RNA, 64 nt, Homo Sapiens
caucacgauauuggcugaaaaguucuacauucuauuauuguauuguaacacacauguauugaug

SEQ ID NO: 111538 - RNA, 64 nt, Homo Sapiens
aaguuuguaagaugcaaaaauaagucauguguacuuauuguagaauugcuuuucucuguuuaua

SEQ ID NO: 111539 - RNA, 64 nt, Homo Sapiens
agacaauuuuaguuguauuuagauaauuacgcccuuauuguauagccaagcuucuuguuauaug

SEQ ID NO: 111540 - RNA, 64 nt, Homo Sapiens
auuugaaaauuaugucgggacaaaguuguuuguguuauuguacacaaauaaaacauggccuuaa

SEQ ID NO: 111541 - RNA, 64 nt, Homo Sapiens
gaugugugggguuuguguuuguaauacauaauguuuauuguacauggguguguguuguguguau

SEQ ID NO: 111542 - RNA, 64 nt, Homo Sapiens
auuaaucagggugcauuuuaaguucuaacuucguuuauuguauaaugcaucauuugaaaauacc

SEQ ID NO: 111543 - RNA, 64 nt, Homo Sapiens
ugcaagaguggacguaaugcuaguuggcaguauuuuauuguaagaaaucaauaaaguaauugug

SEQ ID NO: 111544 - RNA, 64 nt, Homo Sapiens
uugguuguauuuaaagcucaguuuccuuuuuguuuuauuguaugcguuggguuugcagcaugaa

SEQ ID NO: 111545 - RNA, 64 nt, Homo Sapiens
cuaaaacauauuucauguaaacauuguacauuuauuauuguaauauauacuauuaugcagcuua

SEQ ID NO: 111546 - RNA, 64 nt, Homo Sapiens
cuccagauaacuucgcuucuuugauacuuguagcuuauuguaauuuuuuuuaagaaauucaagg

SEQ ID NO: 111547 - RNA, 64 nt, Homo Sapiens
auuguaauuuuuuuuaagaaauucaaggucauuauuauuguacaaaauaagcgcuuugauuaac

SEQ ID NO: 111548 - RNA, 64 nt, Homo Sapiens
cauaaauacugcuguauaagcauuuuuguauguuuuauuguaauguauuauauuaauauaaaaa

SEQ ID NO: 111549 - RNA, 64 nt, Homo Sapiens
uaaguaaauuuucuuuaagucaauuacuacuuuguuauuguaccauuuuaguuaacuaugauuc

SEQ ID NO: 111550 - RNA, 64 nt, Homo Sapiens
ucaacagcuauagagagaaaaucgaaugugcuuuuuauuguaaucuuuagccaacugcuaaugg

SEQ ID NO: 111551 - RNA, 64 nt, Homo Sapiens
gaugaagcgaauugacuccccccaaccuuauuuauuauuguacacaagcuaccuaugcauuuga

SEQ ID NO: 111552 - RNA, 64 nt, Homo Sapiens
uaauuuucuuuuccuuuucaaaccacguuuacuguuauuguauugagccugguuucaaugugag

SEQ ID NO: 111553 - RNA, 64 nt, Homo Sapiens
ucuguaacuuaauuuuuucccaauucaugaaauguuauuguaagcuaacauguuguaaauauua

SEQ ID NO: 111554 - RNA, 64 nt, Homo Sapiens
ugcuucacaaaaugcacuucuauuuagccagcguuuauuguaguaaacuauucuuaauaaaacu

SEQ ID NO: 111555 - RNA, 64 nt, Homo Sapiens
gacuugugugcauggaaguaauuaagguacaucauuauuguaguuugaaaguuguacaugauaa

SEQ ID NO: 111556 - RNA, 64 nt, Homo Sapiens
uuuuuccauuauauuuuuauuuuacacaauuuuguuauuguaguuucuaauuuucuucacuugu

SEQ ID NO: 111557 - RNA, 64 nt, Homo Sapiens
uuguucugcuguugaucucuggugucuacuguucuuauuguauuccuuuucacaacauaauuua

SEQ ID NO: 111558 - RNA, 64 nt, Homo Sapiens
augauaaguacuacauaccucaucucuuggguuauuauuguagucuugcauucaugguuaugaa

SEQ ID NO: 111559 - RNA, 64 nt, Homo Sapiens
cuacuguggcaaaugccaacuguuggaauucacuuuauuguagaaaaacccaaacugagacucu

SEQ ID NO: 111560 - RNA, 64 nt, Homo Sapiens
ucucucuuugaucucaggggguccuuuuuggaguuuauuguauuuuauuguacuugguggggug

SEQ ID NO: 111561 - RNA, 64 nt, Homo Sapiens
aucucaggggguccuuuuuggaguuuauuguauuuuauuguacuuggugggguguuuggggugg

SEQ ID NO: 111562 - RNA, 64 nt, Homo Sapiens
agggcgggagagcgaugcuuggauuuuuguuuccuauuagaaaccaacaguuuuguucuaauuu

SEQ ID NO: 111563 - RNA, 64 nt, Homo Sapiens
uuuuuuuuuuucuuuuuuuaggcauauguaguaauauuagaaacauuuaauuugggaaacuuug

SEQ ID NO: 111564 - RNA, 64 nt, Homo Sapiens
ucuguuuugugucaauugguucguggcaggaagcuauuagaagucaaacguccagaugcauuac

SEQ ID NO: 111565 - RNA, 64 nt, Homo Sapiens
uacucugaucgcaacuaaacauuugucuuuguuuuauuagaaacuagugaaacaaagcagguug

SEQ ID NO: 111566 - RNA, 64 nt, Homo Sapiens
uuauuuguaugucaguauuuuucauuugauucccuauuagaauuaauuuuaaaacuugaagacu

SEQ ID NO: 111567 - RNA, 64 nt, Homo Sapiens
uguuaaauaaauguguaaaguaaccaccaaauguuauuagaauuuuucuucuagcauuuauaau

SEQ ID NO: 111568 - RNA, 64 nt, Homo Sapiens
uacagaguuugcgauauuuauucuauguggaaaauauuagaaacauguggaaaauauuagaaac

SEQ ID NO: 111569 - RNA, 64 nt, Homo Sapiens
uucuauguggaaaauauuaguacuauguggaaaauauuagaaaccuuggauuugcagcuguugg

SEQ ID NO: 111570 - RNA, 64 nt, Homo Sapiens
cuuuuaaggaggguggauacaaauuuuggugauuuauuagaagauccauccuguuggugcagag

SEQ ID NO: 111571 - RNA, 64 nt, Homo Sapiens
uaugucucagaagaugguuuacuguugauacauuuauuagaaugacccuucguugacuaucagu

SEQ ID NO: 111572 - RNA, 64 nt, Homo Sapiens
aauaagcaaguuccgcaaggcacacgcacacagcuauuagaacucacacacacacacacacaca

SEQ ID NO: 111573 - RNA, 64 nt, Homo Sapiens
uggguuaaaaauguuuaagauggcgcaguggaccuauuagaacugauuaccuuguaagaccauc

SEQ ID NO: 111574 - RNA, 64 nt, Homo Sapiens
uguuagggucuuucccaggaucaguaggauacauuauuagaaacaccgccaccucaaugcauug

SEQ ID NO: 111575 - RNA, 64 nt, Homo Sapiens
uguuaaggucuuucccgggaucaguagaauacauuauuagaaacaccgccaccucaaugcauug

SEQ ID NO: 111576 - RNA, 64 nt, Homo Sapiens
aauauuucaguuggaaggcuucuugaagcuaauuuauuagaaaaaaaauuaucuuugaaacacc

SEQ ID NO: 111577 - RNA, 64 nt, Homo Sapiens
acauuuccuaugaaugucuaauuaugucuggcuguauuagaauggggugaaagcuaugccauuc

SEQ ID NO: 111578 - RNA, 64 nt, Homo Sapiens
cuccuacaaaagcucaagccugaagauacaagacuauuagaagaaacaugacuacccucagugu

SEQ ID NO: 111579 - RNA, 64 nt, Homo Sapiens
aagacuauuagaagaaacaugacuacccucaguguauuagaaaagaggucaugcagcuuucuaa

SEQ ID NO: 111580 - RNA, 64 nt, Homo Sapiens
uagucuacacauuaaagauucuaaaaaaugaaaauauuagaaaguauguuuucuccuuuuggug

SEQ ID NO: 111581 - RNA, 64 nt, Homo Sapiens
uuuauuauuuggcuuccuuuuaaguuauggcauuuauuagaaguguacaaauagagguaauagu

SEQ ID NO: 111582 - RNA, 64 nt, Homo Sapiens
aggauuauaauaugguucaacaaauguugaugaguauuagaaauguacauuagaaauauuagaa

SEQ ID NO: 111583 - RNA, 64 nt, Homo Sapiens
aauguugaugaguauuagaaauguacauuagaaauauuagaaauguuuaugacuauuagaaaag

SEQ ID NO: 111584 - RNA, 64 nt, Homo Sapiens
aauguacauuagaaauauuagaaauguuuaugacuauuagaaaaguacaggguauugggcguuc

SEQ ID NO: 111585 - RNA, 64 nt, Homo Sapiens
ucaaacaacagucugcaaaacuuugacuauggcguauuagaagacuuguauuuuuugaaacucu

SEQ ID NO: 111586 - RNA, 64 nt, Homo Sapiens
cugaagaauacaaaggauggucugugggaaaauauauuagaaguuacuaugaagaaugccccaa

SEQ ID NO: 111587 - RNA, 64 nt, Homo Sapiens
uaaaggcaguucugcaagauguacuaaauauguauauuagaaauuauagaaaaucauguugucc

SEQ ID NO: 111588 - RNA, 64 nt, Homo Sapiens
aauacaguugucauuaauccugcacauuagaaauuauuagaaacauauuacuuuuuaacuuuaa

SEQ ID NO: 111589 - RNA, 64 nt, Homo Sapiens
guuuuuucuaaaguuauguucaggaguuaacuuguauuagaauuuguccauuugcucaaccaga

SEQ ID NO: 111590 - RNA, 64 nt, Homo Sapiens
guuuuuuucuaaaguuauguuaagguuacacuuguauuagaauuuugaaacagaguuaacagga

SEQ ID NO: 111591 - RNA, 64 nt, Homo Sapiens
uuacugugacagucuuaaugauaccauaaaucaauauuagaaagcuaguugacuuaaagccuga

SEQ ID NO: 111592 - RNA, 64 nt, Homo Sapiens
aaagccugaaauaaugggaguuuucuccuccacuuauuagaauaaggacccucagugacuaauu

SEQ ID NO: 111593 - RNA, 64 nt, Homo Sapiens
aucuuggaauugaagauauacuucauauugauuguauuagaauuauaguuaguuuaggaaauca

SEQ ID NO: 111594 - RNA, 64 nt, Homo Sapiens
ugugauugauucugacaguguuaugaaaccucuuuauuagaauuguaccuucuuuguuucuaua

SEQ ID NO: 111595 - RNA, 64 nt, Homo Sapiens
ugagaaauuuauuaaaauauaaauaaaaauuaaauauuagaaugagcagguaauaaaauuuaaa

SEQ ID NO: 111596 - RNA, 64 nt, Homo Sapiens
acugaauuaacaaugagaaaauuauaacagacaguauuagaauuugugcuguaccaaaauggua

SEQ ID NO: 111597 - RNA, 64 nt, Homo Sapiens
ucuauuucugaauuacgaaugaaauccgaguaccuauuagaaaugaguuaugcaaauuuagaug

SEQ ID NO: 111598 - RNA, 64 nt, Homo Sapiens
agggcucaaacugagaaacauugaguuauauggcuauuagaaauccacauucuuacacaagaaa

SEQ ID NO: 111599 - RNA, 64 nt, Homo Sapiens
auuagaaauccacauucuuacacaagaaagaccauauuagaaucuaaggaaaacaugcauauuc

SEQ ID NO: 111600 - RNA, 64 nt, Homo Sapiens
gugaaagcuuguuguaaagauauuuucuuuuuguuauuagaaggaaauacaaagagaaaaauuu

SEQ ID NO: 111601 - RNA, 64 nt, Homo Sapiens
agccaguauuucugauuaacuaaguugaaacucuuauuagaaacuuucaguuggugauauugua

SEQ ID NO: 111602 - RNA, 64 nt, Homo Sapiens
acuauuguguaacacauaauauaauagaaaauuauauuagaaaaggcuaaugaaugcagaaaga

SEQ ID NO: 111603 - RNA, 64 nt, Homo Sapiens
uuccaggcuaaugaaugcagguaaaguucuucuuuauuagaaaaggcaaccagaaguuaaggag

SEQ ID NO: 111604 - RNA, 54 nt, Homo Sapiens
cuuccuuugcgaauuuuauguaauuauuagaacugaauucauaauguaacuuaa

SEQ ID NO: 111605 - RNA, 64 nt, Homo Sapiens
uugggguugccaaaaccccagcaaguugaggcuucacgcucagggaaacuucugggucagaggu

SEQ ID NO: 111606 - RNA, 64 nt, Homo Sapiens
ugaccacugcccaagcccugcccgccucuccccccacgcucaaccugcccacuuguccaggccu

SEQ ID NO: 111607 - RNA, 64 nt, Homo Sapiens
guccgucuccagccagccagcucauuucacuuuacacgcucauggacugaguuuauacucaccu

SEQ ID NO: 111608 - RNA, 64 nt, Homo Sapiens
cguuccaccacacuguccgcccuuggccucggcacacgcucaccuuuucuguugguuacgggac

SEQ ID NO: 111609 - RNA, 64 nt, Homo Sapiens
aguuugccuccguccccugcccaugcugggagcccacgcucacccccucaccccuccaagcuca

SEQ ID NO: 111610 - RNA, 64 nt, Homo Sapiens
gccucgugaguggccuggaccugcugcuuaacuccacgcucacuucuaccgaaucaggaccacc

SEQ ID NO: 111611 - RNA, 64 nt, Homo Sapiens
ccccuguccacauauacaacagacacaagacacacacgcucaaacaauccauccaugcauacau

SEQ ID NO: 111612 - RNA, 64 nt, Homo Sapiens
cucaggucuucacgcgggggggagaacagaaauccacgcucaaugcccuugcugcagaguuggu

SEQ ID NO: 111613 - RNA, 64 nt, Homo Sapiens
gaaggaugccuuaucucuucguccaggccugggucacgcucaagcccuauucugccaugggaga

SEQ ID NO: 111614 - RNA, 64 nt, Homo Sapiens
ucaagggcagcuuacggagaugucacuggagcagcacgcucagagacagugaacuagcauuuga

SEQ ID NO: 111615 - RNA, 64 nt, Homo Sapiens
gagacuggucaugcaagcauccuucaccccugagcacgcucagugcaaaaaaauuggugcuaaa

SEQ ID NO: 111616 - RNA, 64 nt, Homo Sapiens
aaacuccggacugaagaugcgucaggccuggucucacgcucaauaaaaccuggccccugcagga

SEQ ID NO: 111617 - RNA, 64 nt, Homo Sapiens
uuuugggaguugaccccagcaaugaccuugguggcacgcucacucccucauucucucguuuccc

SEQ ID NO: 111618 - RNA, 64 nt, Homo Sapiens
uguguuuacucuguaagucucacacacacacacacacgcucauacuuuugguuuuggcuaaaua

SEQ ID NO: 111619 - RNA, 64 nt, Homo Sapiens
gacagcugcaccgacuuggagaggaugccaacuucacgcucagauucaguacaccagcaaugcu

SEQ ID NO: 111620 - RNA, 64 nt, Homo Sapiens
aggcccccauuuuauuagucgguguguucaguaucacgcucaagacaagggccaaccuauuacu

SEQ ID NO: 111621 - RNA, 64 nt, Homo Sapiens
cuuccuucggggccagucucggccgaagucuggucacgcucagacagagcugaccagaccagac

SEQ ID NO: 111622 - RNA, 64 nt, Homo Sapiens
cgcuacacacgcgcgcgcaccucgcacucucgcucacgcucagaugugggcagaaacacacaca

SEQ ID NO: 111623 - RNA, 64 nt, Homo Sapiens
guaacagacucaagaguuauuguacauuacugaccacgcucauuuguucaaaaguuagaacauc

SEQ ID NO: 111624 - RNA, 64 nt, Homo Sapiens
ucguucuuccacaguaucuuuacggugaauaauucacgcucacgagauguccacggacgaaaca

SEQ ID NO: 111625 - RNA, 64 nt, Homo Sapiens
acacaugcauccuccccucucugcucugugcacucacgcucagcggcucacaugcuccuugccu

SEQ ID NO: 111626 - RNA, 64 nt, Homo Sapiens
acugauccuguguuuaccccaagcccggcggggacacgcucacagaugucaccacagcccugcc

SEQ ID NO: 111627 - RNA, 64 nt, Homo Sapiens
caugaccguguggguggcggcguuugcugugaaccacgcucaggccacacagagacacauacuu

SEQ ID NO: 111628 - RNA, 64 nt, Homo Sapiens
ccugaguuaguuucuaguaucagucgugugccaccacgcucagccuccugaguaacugggauua

SEQ ID NO: 111629 - RNA, 64 nt, Homo Sapiens
gguggucucaaagauguagaacgcagcgugugcccacgcucagcaggugugccauccuuccacc

SEQ ID NO: 111630 - RNA, 64 nt, Homo Sapiens
aggagaaucccuacuggaaggcugcacugguacacacgcucaucgcuguucccaacugugccca

SEQ ID NO: 111631 - RNA, 64 nt, Homo Sapiens
gcccaguaaaauuucaggauaggccuuuccucugcacgcucaauuuucuuugucauucaguucu

SEQ ID NO: 111632 - RNA, 64 nt, Homo Sapiens
agaggcuggggccaacuggaaccauuggcagcugcacgcucauuacuacccuccgcuccugcgc

SEQ ID NO: 111633 - RNA, 64 nt, Homo Sapiens
cccauccuagcuggacucaugguuccuaaauaaccacgcucagaagcucugcuaggacuuaccc

SEQ ID NO: 111634 - RNA, 64 nt, Homo Sapiens
ggccccggccagacccuggcgcucccuuccuucccacgcucagcgcagaugggcugcaugcggc

SEQ ID NO: 111635 - RNA, 64 nt, Homo Sapiens
cacaaaccugcucacgcagcaccaggccccgccacacgcucacauacgccuuaggaaggggaca

SEQ ID NO: 111636 - RNA, 64 nt, Homo Sapiens
uggccccuucguaccugcaauaugucaggagccucacgcucacccaagauccugcaggggccag

SEQ ID NO: 111637 - RNA, 64 nt, Homo Sapiens
uugugcauauggcagacccuugaggcucagccuacacgcucauaggccuuucucggcccuggac

SEQ ID NO: 111638 - RNA, 64 nt, Homo Sapiens
cugguguguggcccgccaccccuccagcgaaguccacgcucaucugaucaaggagcaccuuccu

SEQ ID NO: 111639 - RNA, 64 nt, Homo Sapiens
cuuuggcccagccaucgccgucccuagucccacccacgcucaaccacuccuggcccucggcccc

SEQ ID NO: 111640 - RNA, 64 nt, Homo Sapiens
uguuuuaucaggauaauugucucaugaccaaauccacgcucaauuagagccauucaaaauuccu

SEQ ID NO: 111641 - RNA, 64 nt, Homo Sapiens
aguacuacagagaccuggcuggcaacgagcagcgcacgcucaucaaggccuauggcauccgcuu

SEQ ID NO: 111642 - RNA, 64 nt, Homo Sapiens
guucuagcugcuugggagguugcgaaccguggcacacgcucauaacaaaacagaaugauaaagc

SEQ ID NO: 111643 - RNA, 64 nt, Homo Sapiens
ugacagccgagggacacgagcugauucacaaacccacgcucaccagaaaugauccuauccaaag

SEQ ID NO: 111644 - RNA, 64 nt, Homo Sapiens
aauuugcagcacacagcguuccacugcgggguuucacgcucaccugaaaacaccuguucccaac

SEQ ID NO: 111645 - RNA, 64 nt, Homo Sapiens
gccugcugcaugcguguuaccuggcuuuuggcuccacgcucacucauagccauguccacauggg

SEQ ID NO: 111646 - RNA, 64 nt, Homo Sapiens
cucccaaagugcugggcuuacaggccugagccaccacgcucagcucagcuucacccugucugca

SEQ ID NO: 111647 - RNA, 64 nt, Homo Sapiens
ccaacagcuguucuguucuaucuaccccucauuucacgcucaaggagucauaccuagaauaguu

SEQ ID NO: 111648 - RNA, 64 nt, Homo Sapiens
ggaggggcugguuuccuuccacucuccacggccgcacgcucagaggcuggucuccgcaugagag

SEQ ID NO: 111649 - RNA, 64 nt, Homo Sapiens
cacaugcucacgcacauguucacacaugcacacucacgcucacacaugcugucacgcauacaca

SEQ ID NO: 111650 - RNA, 64 nt, Homo Sapiens
gacgccaccuggcggcccuaagccacucccgccacacgcucacuccagguucguauagaaaaag

SEQ ID NO: 111651 - RNA, 64 nt, Homo Sapiens
ucagcugagccuccugcccucccccaggaacaugcacgcucacucugcuuccuuguggguggcc

SEQ ID NO: 111652 - RNA, 64 nt, Homo Sapiens
ugaaauaacaacagacaauaggaccuccagcugacacgcucaguccauaccaucugguacugca

SEQ ID NO: 111653 - RNA, 64 nt, Homo Sapiens
uuggaccauuggaggaacuuguuggauagucauccacgcucagugaugugcauuugugugugau

SEQ ID NO: 111654 - RNA, 64 nt, Homo Sapiens
caguguguggaggggcaggaucgaaagaaaagugcacgcucagaaaugccucauaaauuagccu

SEQ ID NO: 111655 - RNA, 64 nt, Homo Sapiens
uccuguccugguccugaugccccgcucucccugucacgcucaugacucccggccuaggcaccuc

SEQ ID NO: 111656 - RNA, 64 nt, Homo Sapiens
accuugugugucugugaucuccucugucuuaauccacgcucaggcuaaagauggggauaaugug

SEQ ID NO: 111657 - RNA, 56 nt, Homo Sapiens
uggugcaguaccugacaugagccagccacgcucaguggcugaacagcauucccaca

SEQ ID NO: 111658 - RNA, 64 nt, Homo Sapiens
ucaccaagaagaaucuucugacuacaucuucucucacgcucaagugacaugaacacuguacuga

SEQ ID NO: 111659 - RNA, 64 nt, Homo Sapiens
ucucacccauuucuaauuucauugucuuucuucccacgcucauuucuaucauucucccccauga

SEQ ID NO: 111660 - RNA, 64 nt, Homo Sapiens
ggggcagaggcaguaccugguccugccccuuggacacgcucagugcagucccaagcggugucuc

SEQ ID NO: 111661 - RNA, 64 nt, Homo Sapiens
gccuucacccacggaucugcccaggcugaaggcacacgcucaaugccccacgugccuucuccag

SEQ ID NO: 111662 - RNA, 64 nt, Homo Sapiens
aacucugcuucccaagggcaaccguugcuguucacacgcucagccugucugggggagcgggccu

SEQ ID NO: 111663 - RNA, 64 nt, Homo Sapiens
ugcaguuguuuuccggagucugucccacggcccacacgcucacuugacucaugcugcuaagaug

SEQ ID NO: 111664 - RNA, 64 nt, Homo Sapiens
ucagagaggcagauuccuuccccucccguccccucacgcucaaacccccacuuccugccccagg

SEQ ID NO: 111665 - RNA, 64 nt, Homo Sapiens
cccggcaugcgggccaccaacauacagagcaggccacgcucaggguggcuuacaaauucuacag

SEQ ID NO: 111666 - RNA, 63 nt, Homo Sapiens
aagugguucuguauggcuaggaccacccuacuacacgcucagcugccaacaguggauugaguu

SEQ ID NO: 111667 - RNA, 64 nt, Homo Sapiens
ucccaaauaucuugguucagacagcucugaaccccacgcucacaguggucgaccuugccucccg

SEQ ID NO: 111668 - RNA, 64 nt, Homo Sapiens
auggagauugccucaaaauuguguccacauaauccacgcucaucuugcaaagcgcuauuucagg

SEQ ID NO: 111669 - RNA, 64 nt, Homo Sapiens
cugcagcgggcagagugggaguuggcucacucagcacgcucacuaacccagcaugccacuucca

SEQ ID NO: 111670 - RNA, 64 nt, Homo Sapiens
gcccguuuuaccaauaaacucgcccagcgcucgccacgcucagugcccccgccccaggcuuccg

SEQ ID NO: 111671 - RNA, 64 nt, Homo Sapiens
cgcuucagugcggcucuguccuguauguuucucgcacgcucaccguucggggcagccugcucgg

SEQ ID NO: 111672 - RNA, 64 nt, Homo Sapiens
ccucucgcggccccuccucuugcggggccagggccacgcucaccuguguccggugggucuccac

SEQ ID NO: 111673 - RNA, 64 nt, Homo Sapiens
ggggcacccggggggcccugccuggcaacgauuccacgcucaaaucgauagcagggagccauga

SEQ ID NO: 111674 - RNA, 64 nt, Homo Sapiens
uucccacccuaacccacuuccuuugucugacuugcacgcucagcuaggagcugccuacaucagg

SEQ ID NO: 111675 - RNA, 64 nt, Homo Sapiens
acccgcccuuagaccaggcaacgcuaguuccauccacgcucaagggggaacucgccaccugccc

SEQ ID NO: 111676 - RNA, 64 nt, Homo Sapiens
cccaaguccuuuaugcuuugcuugagcccacacacacgcucaacugacagcacuugcaugguca

SEQ ID NO: 111677 - RNA, 64 nt, Homo Sapiens
cagucaccuccccacaucgcccccacgcccuguucacgcucaccacggccacccgccccgcgca

SEQ ID NO: 111678 - RNA, 64 nt, Homo Sapiens
ugugugagugugcgugucucugugugugcacgugcacgcucauggccaaaugugcgcacucuac

SEQ ID NO: 111679 - RNA, 64 nt, Homo Sapiens
cuuccaccucgugcacagcgcucugcacagacaacacgcucaauaaaaguucagccauagcagc

SEQ ID NO: 111680 - RNA, 62 nt, Homo Sapiens
caaacaggccucucaguuucgggacacaaagaggaaucuaaauccuuaccuccaaaagcaca

SEQ ID NO: 111681 - RNA, 62 nt, Homo Sapiens
uauaucgaaauacaguuauuuaggauuacaaaggaaucuaauuuuuaaaugcauaaaauaua

SEQ ID NO: 111682 - RNA, 62 nt, Homo Sapiens
agagaugaggcccgucagagccucugucccagggaaucuaggugcacuuuguagcuuuucac

SEQ ID NO: 111683 - RNA, 62 nt, Homo Sapiens
gucuuucuaaugugguaaaaacgaaguguaacggaaucuaguaugagauccuuuaauugaaa

SEQ ID NO: 111684 - RNA, 62 nt, Homo Sapiens
ggaaaauucugaguuccagcacaauuuucuuuggaaucuaacaggaaucuagccugaggaag

SEQ ID NO: 111685 - RNA, 62 nt, Homo Sapiens
aguuccagcacaauuuucuuuggaaucuaacaggaaucuagccugaggaagaagggaggucu

SEQ ID NO: 111686 - RNA, 62 nt, Homo Sapiens
guuugguuuuguuuucuuuuuuuaaugucagaggaaucuauccaugugaaucgaaaggcaca

SEQ ID NO: 111687 - RNA, 62 nt, Homo Sapiens
gaggaaucuauccaugugaaucgaaaggcacaggaaucuaggaacucugaggaauuuauugu

SEQ ID NO: 111688 - RNA, 62 nt, Homo Sapiens
ucccucugugacugcuucgccuguuguauacaggaaucuacagagguggaaucuacaucccu

SEQ ID NO: 111689 - RNA, 62 nt, Homo Sapiens
ucccucuguuguauacaggacaaucaagagguggaaucuacagcagcaguuugacacacuuu

SEQ ID NO: 111690 - RNA, 62 nt, Homo Sapiens
uugggggaauauuucacauccauccagagcucggaaucuacagcguccagccauuuccagca

SEQ ID NO: 111691 - RNA, 62 nt, Homo Sapiens
cgcggcggggccagcuugccugccgguuuucaggaaucuaaacucucaucuugugcaauuua

SEQ ID NO: 111692 - RNA, 64 nt, Homo Sapiens
cucauucaugcaguuagaauugcaacacguucagguacuuaaaaauuuuuauuccauuuuguuc

SEQ ID NO: 111693 - RNA, 64 nt, Homo Sapiens
uuuuacaucaugucuucagcuguuacaaaaccaaguacuuaaucgugacuuuaauugguaaaua

SEQ ID NO: 111694 - RNA, 64 nt, Homo Sapiens
guagccuuaagaacaauaauggccaucuuuuuuuguacuuaaaaagaaaaaaaaagguuuggca

SEQ ID NO: 111695 - RNA, 64 nt, Homo Sapiens
aaaaaaaaaucauggggguggcuuugaacagucaguacuuaaaagaucugcaugguuugccuga

SEQ ID NO: 111696 - RNA, 64 nt, Homo Sapiens
uaaguagugcuuuguuuaaaucuugguacuuaaaguacuuaaaaaacugaauauuauagucagu

SEQ ID NO: 111697 - RNA, 64 nt, Homo Sapiens
uacuuaaaauaaguagugcuauagucaguucuugguacuuaaaguaaauuaugaacugaauauu

SEQ ID NO: 111698 - RNA, 64 nt, Homo Sapiens
uauuauaucaguugacauguaacuaguaccaugcguacuuaaauagaugguaauuuucugagcc

SEQ ID NO: 111699 - RNA, 64 nt, Homo Sapiens
agacugaguaguauucuuggauacaggcugauguguacuuaaccacuuccagauuuauacaguc

SEQ ID NO: 111700 - RNA, 64 nt, Homo Sapiens
guacuuacuaugauaggaaauuuuuaaauaugaaguacuuaaauuauucuguacagcuuugucu

SEQ ID NO: 111701 - RNA, 64 nt, Homo Sapiens
guuuguuuguuuguuuuugcguuuuggaacuacuguacuuaaaguuucauaacuuuagcagugu

SEQ ID NO: 111702 - RNA, 64 nt, Homo Sapiens
ucgaguacuauugaacucucuccugaugagaagauguuuagauaaguacaaguuaagaaaguag

SEQ ID NO: 111703 - RNA, 64 nt, Homo Sapiens
auaccaguuaucaagauauauuaaauagcuguauuguuuagaaucuuaauaugguauaaauuag

SEQ ID NO: 111704 - RNA, 64 nt, Homo Sapiens
agaaaguggagaaaaauguacauacauuuuuguauguuuagauauuaccguaaauacucaggau

SEQ ID NO: 111705 - RNA, 64 nt, Homo Sapiens
caucugacuucugaucaagcauuagauuuuaacuuguuuagauuuugucuuaaacaccaguaau

SEQ ID NO: 111706 - RNA, 64 nt, Homo Sapiens
caguuucuugcuuggggaacuugugucccuaauguguuuagauugcuagauugcuaaggagcug

SEQ ID NO: 111707 - RNA, 64 nt, Homo Sapiens
agggugguucaacaaagaaacaaagauguuaugguguuuagauuuaugguuguuaaaaauguca

SEQ ID NO: 111708 - RNA, 64 nt, Homo Sapiens
ggccacgguucagacaaugggguucaaucuuuuguguuuagagagguguaauaagguucucacg

SEQ ID NO: 111709 - RNA, 64 nt, Homo Sapiens
aaaaagacaaaaaaguaaaaccaacuuagugacuuguuuagaaagaagagauggggggccucaa

SEQ ID NO: 111710 - RNA, 64 nt, Homo Sapiens
cucuuguuuaaaaauaauagagaaucuaaagauguguuuagaaccuuguaauuucuuucugcuu

SEQ ID NO: 111711 - RNA, 64 nt, Homo Sapiens
aaaucaaagaccaugauuuaauuuguaauagcucuguuuagaaauauguuucaaguuuguauua

SEQ ID NO: 111712 - RNA, 64 nt, Homo Sapiens
gugagaauugauguuuguagauuaauaaucauuuuguuuagaauuacaaaauaguuuuuaaaua

SEQ ID NO: 111713 - RNA, 64 nt, Homo Sapiens
guauuaguuaaaacuuuaggguuugcuuuuuugcuguuuagaucaaaguuuuuucugauucuuc

SEQ ID NO: 111714 - RNA, 64 nt, Homo Sapiens
uugguggaagaugaaucaaguagugaaaaccuccuguuuagacugcuuuacuaagauuuuuaaa

SEQ ID NO: 111715 - RNA, 64 nt, Homo Sapiens
aaaaagcaaagacugagguacgaaagggugagucuguuuagaaguuguuaaagcaaaaacuaug

SEQ ID NO: 111716 - RNA, 64 nt, Homo Sapiens
ugccauagaguacacugccuuccaguaagaucacuguuuagauuaauacuugaaccauaaaaug

SEQ ID NO: 111717 - RNA, 64 nt, Homo Sapiens
ugaagguuuuugauagcauuuauuuauauguauguguuuagaaucuuaaaacaucauuccuuuu

SEQ ID NO: 111718 - RNA, 64 nt, Homo Sapiens
gccgcacuucauuaaaauucuucuaaaacuuguauguuuagaguuaagcaagacuuuuuuucuu

SEQ ID NO: 111719 - RNA, 64 nt, Homo Sapiens
acgcugauguggcuaacaaguuuauuuuaagaauuguuuagaaaugcuguugcuucagguucuu

SEQ ID NO: 111720 - RNA, 64 nt, Homo Sapiens
uucuaacucugauuuuauaaucagacuuagauuguguuuagaauauuaaaugacugggcacccu

SEQ ID NO: 111721 - RNA, 64 nt, Homo Sapiens
uauacucccuaauacacauuuaugaaaaucuacuuguuuagacuuuuauuuauacucuucugau

SEQ ID NO: 111722 - RNA, 64 nt, Homo Sapiens
ucucaggagcccucaccauuguguccauucacuguguauagauggcagaacuuuugaggugcaa

SEQ ID NO: 111723 - RNA, 64 nt, Homo Sapiens
ggucaccaauuuucucauuucaccccauuuaccuuguauagaggauuguucauuccuuugggac

SEQ ID NO: 111724 - RNA, 64 nt, Homo Sapiens
ugaagguuucauaaugaucaaaaauaagaaauuuuguauagaaaaauaguaauuauggauauaa

SEQ ID NO: 111725 - RNA, 64 nt, Homo Sapiens
auaucaucugauagugucuuguauauucuugcucuguauagagacucuuuugagauauccaaga

SEQ ID NO: 111726 - RNA, 64 nt, Homo Sapiens
uguauauaugguucacauaugucuaaauaaugguuguauagauaguauagauagguuugugaaa

SEQ ID NO: 111727 - RNA, 64 nt, Homo Sapiens
gguuugugaaagucuaaauauagauaaauuagaauguauagauauacuuaagggauaguguuga

SEQ ID NO: 111728 - RNA, 64 nt, Homo Sapiens
guguuuuucuuuuuuugucuuauguuguaaucauuguauagagcuaaaaaaauugaaaacaaac

SEQ ID NO: 111729 - RNA, 64 nt, Homo Sapiens
gauuaugcuugaauuacuauauuuaaaaugaaaauguauagauuacacagccaggaaugcuagu

SEQ ID NO: 111730 - RNA, 64 nt, Homo Sapiens
augcaaaauauaucucugcuguuuuauagccuguuguauagaaaucuggacugugauaagugac

SEQ ID NO: 111731 - RNA, 64 nt, Homo Sapiens
uagucuucauuuuaucugagcuuaaauggacacuuguauagaaaauuaugucugaucccaagau

SEQ ID NO: 111732 - RNA, 64 nt, Homo Sapiens
ucagaaaaggaaagcaauggucugguacaagucuuguauagaacaagaaguuuagacuuuugaa

SEQ ID NO: 111733 - RNA, 64 nt, Homo Sapiens
guuagauauguuucuuucuaaggacaagcaacuauguauagacuuguuguuugaauuuuuuuuc

SEQ ID NO: 111734 - RNA, 64 nt, Homo Sapiens
gcacuacccuaagccaugaacaaaaaggacuuuuuguauagaaauaaacaguccuguaaaaaac

SEQ ID NO: 111735 - RNA, 64 nt, Homo Sapiens
cuuggacagacccgguaaugaacauauagaaaaauguauagaugagagagagcagcuguuaugc

SEQ ID NO: 111736 - RNA, 64 nt, Homo Sapiens
cccugccuuuuuuuuuuuuuuuuuuuuuuuuuuuuguauagaaacagauccauuucuugguaau

SEQ ID NO: 111737 - RNA, 64 nt, Homo Sapiens
auuguaauuauauuaacagagcacacuaauaauuuguauagauuauauauauuagaucuugggu

SEQ ID NO: 111738 - RNA, 64 nt, Homo Sapiens
agagaguguugaaacggaugauagauuagaauucuguauagauuuuauaucugaggaauucugu

SEQ ID NO: 111739 - RNA, 64 nt, Homo Sapiens
agaauucuguauagauuagauaucugaggaauucuguauagauuacgcguugaaauuguaauua

SEQ ID NO: 111740 - RNA, 64 nt, Homo Sapiens
cucuuugucuacaccauuauacggugaauggcuuuguauagaacuacccaggaauggagccugc

SEQ ID NO: 111741 - RNA, 64 nt, Homo Sapiens
aauaacaacaguuguacuucccugaucucauacuuguauagagucuuugucuuuuuuuccuaac

SEQ ID NO: 111742 - RNA, 64 nt, Homo Sapiens
guggaaccugaggaugggauuugcaugguuuguguguauagacacuccuuucucuuccuccucu

SEQ ID NO: 111743 - RNA, 64 nt, Homo Sapiens
augccuugccucucaagagacuuuuccucaccccuguauagaaauuacuguauagaaaguuuaa

SEQ ID NO: 111744 - RNA, 64 nt, Homo Sapiens
guuuaacuuuuccucacccccauugcuaacuuacuguauagaaauuucucaguugggauuuggg

SEQ ID NO: 111745 - RNA, 64 nt, Homo Sapiens
auuuugaacaaguaauuuucuugacaagaaagaauguauagaagucucccugcaauuaauuucc

SEQ ID NO: 111746 - RNA, 64 nt, Homo Sapiens
aacaacuguaauacaaccuuuugaauuaguuccguguauagauaauuaaauucuucauacaaaa

SEQ ID NO: 111747 - RNA, 64 nt, Homo Sapiens
acugauaaugccuauggacauuuggguaaaacccuguauagaauuaauuauccuuuuacuuugg

SEQ ID NO: 111748 - RNA, 64 nt, Homo Sapiens
cauuucagcuaagauuaaauuuaaagccuaagaauguauagagcuaguuuuaaaauaaugaucu

SEQ ID NO: 111749 - RNA, 64 nt, Homo Sapiens; identical to SEQ ID NO: 97841

SEQ ID NO: 111750 - RNA, 64 nt, Homo Sapiens; identical to SEQ ID NO: 97842

SEQ ID NO: 111751 - RNA, 64 nt, Homo Sapiens; identical to SEQ ID NO: 97843

SEQ ID NO: 111752 - RNA, 64 nt, Homo Sapiens; identical to SEQ ID NO: 97844

SEQ ID NO: 111753 - RNA, 64 nt, Homo Sapiens; identical to SEQ ID NO: 97845

SEQ ID NO: 111754 - RNA, 64 nt, Homo Sapiens; identical to SEQ ID NO: 97846

SEQ ID NO: 111755 - RNA, 64 nt, Homo Sapiens; identical to SEQ ID NO: 97847

SEQ ID NO: 111756 - RNA, 64 nt, Homo Sapiens; identical to SEQ ID NO: 97848

SEQ ID NO: 111757 - RNA, 64 nt, Homo Sapiens; identical to SEQ ID NO: 38988

SEQ ID NO: 111758 - RNA, 64 nt, Homo Sapiens; identical to SEQ ID NO: 38989

SEQ ID NO: 111759 - RNA, 64 nt, Homo Sapiens; identical to SEQ ID NO: 38990

SEQ ID NO: 111760 - RNA, 64 nt, Homo Sapiens; identical to SEQ ID NO: 38991

SEQ ID NO: 111761 - RNA, 64 nt, Homo Sapiens; identical to SEQ ID NO: 38992

SEQ ID NO: 111762 - RNA, 64 nt, Homo Sapiens; identical to SEQ ID NO: 38993

SEQ ID NO: 111763 - RNA, 64 nt, Homo Sapiens; identical to SEQ ID NO: 38994

SEQ ID NO: 111764 - RNA, 64 nt, Homo Sapiens; identical to SEQ ID NO: 38995

SEQ ID NO: 111765 - RNA, 64 nt, Homo Sapiens; identical to SEQ ID NO: 38996

SEQ ID NO: 111766 - RNA, 64 nt, Homo Sapiens; identical to SEQ ID NO: 38997

SEQ ID NO: 111767 - RNA, 64 nt, Homo Sapiens; identical to SEQ ID NO: 38998

SEQ ID NO: 111768 - RNA, 64 nt, Homo Sapiens; identical to SEQ ID NO: 38999

SEQ ID NO: 111769 - RNA, 64 nt, Homo Sapiens; identical to SEQ ID NO: 39000

SEQ ID NO: 111770 - RNA, 64 nt, Homo Sapiens; identical to SEQ ID NO: 39001

SEQ ID NO: 111771 - RNA, 64 nt, Homo Sapiens; identical to SEQ ID NO: 39002

SEQ ID NO: 111772 - RNA, 64 nt, Homo Sapiens; identical to SEQ ID NO: 39003

SEQ ID NO: 111773 - RNA, 64 nt, Homo Sapiens; identical to SEQ ID NO: 39004

SEQ ID NO: 111774 - RNA, 64 nt, Homo Sapiens; identical to SEQ ID NO: 39005

SEQ ID NO: 111775 - RNA, 64 nt, Homo Sapiens; identical to SEQ ID NO: 39006

SEQ ID NO: 111776 - RNA, 64 nt, Homo Sapiens; identical to SEQ ID NO: 39007

SEQ ID NO: 111777 - RNA, 64 nt, Homo Sapiens; identical to SEQ ID NO: 39008

SEQ ID NO: 111778 - RNA, 64 nt, Homo Sapiens; identical to SEQ ID NO: 39009

SEQ ID NO: 111779 - RNA, 64 nt, Homo Sapiens; identical to SEQ ID NO: 39010

SEQ ID NO: 111780 - RNA, 64 nt, Homo Sapiens; identical to SEQ ID NO: 39011

SEQ ID NO: 111781 - RNA, 64 nt, Homo Sapiens; identical to SEQ ID NO: 39012

SEQ ID NO: 111782 - RNA, 64 nt, Homo Sapiens; identical to SEQ ID NO: 39013

SEQ ID NO: 111783 - RNA, 64 nt, Homo Sapiens; identical to SEQ ID NO: 39014

SEQ ID NO: 111784 - RNA, 64 nt, Homo Sapiens; identical to SEQ ID NO: 39015

SEQ ID NO: 111785 - RNA, 64 nt, Homo Sapiens; identical to SEQ ID NO: 39016

SEQ ID NO: 111786 - RNA, 64 nt, Homo Sapiens; identical to SEQ ID NO: 39017

SEQ ID NO: 111787 - RNA, 64 nt, Homo Sapiens; identical to SEQ ID NO: 39018

SEQ ID NO: 111788 - RNA, 64 nt, Homo Sapiens; identical to SEQ ID NO: 39019

SEQ ID NO: 111789 - RNA, 64 nt, Homo Sapiens; identical to SEQ ID NO: 39020

SEQ ID NO: 111790 - RNA, 64 nt, Homo Sapiens; identical to SEQ ID NO: 39021

SEQ ID NO: 111791 - RNA, 64 nt, Homo Sapiens; identical to SEQ ID NO: 39022

SEQ ID NO: 111792 - RNA, 64 nt, Homo Sapiens; identical to SEQ ID NO: 39023

SEQ ID NO: 111793 - RNA, 64 nt, Homo Sapiens; identical to SEQ ID NO: 39024

SEQ ID NO: 111794 - RNA, 64 nt, Homo Sapiens; identical to SEQ ID NO: 39025

SEQ ID NO: 111795 - RNA, 64 nt, Homo Sapiens; identical to SEQ ID NO: 39026

SEQ ID NO: 111796 - RNA, 64 nt, Homo Sapiens; identical to SEQ ID NO: 39027

SEQ ID NO: 111797 - RNA, 64 nt, Homo Sapiens; identical to SEQ ID NO: 39028

SEQ ID NO: 111798 - RNA, 64 nt, Homo Sapiens; identical to SEQ ID NO: 39029

SEQ ID NO: 111799 - RNA, 64 nt, Homo Sapiens; identical to SEQ ID NO: 39030

SEQ ID NO: 111800 - RNA, 64 nt, Homo Sapiens; identical to SEQ ID NO: 39031

SEQ ID NO: 111801 - RNA, 64 nt, Homo Sapiens; identical to SEQ ID NO: 39032

SEQ ID NO: 111802 - RNA, 64 nt, Homo Sapiens; identical to SEQ ID NO: 39033

SEQ ID NO: 111803 - RNA, 64 nt, Homo Sapiens; identical to SEQ ID NO: 39034

SEQ ID NO: 111804 - RNA, 64 nt, Homo Sapiens; identical to SEQ ID NO: 39035

SEQ ID NO: 111805 - RNA, 64 nt, Homo Sapiens; identical to SEQ ID NO: 39036

SEQ ID NO: 111806 - RNA, 64 nt, Homo Sapiens; identical to SEQ ID NO: 39037

SEQ ID NO: 111807 - RNA, 64 nt, Homo Sapiens; identical to SEQ ID NO: 39038

SEQ ID NO: 111808 - RNA, 64 nt, Homo Sapiens; identical to SEQ ID NO: 39039

SEQ ID NO: 111809 - RNA, 64 nt, Homo Sapiens; identical to SEQ ID NO: 39040

SEQ ID NO: 111810 - RNA, 64 nt, Homo Sapiens; identical to SEQ ID NO: 39041

SEQ ID NO: 111811 - RNA, 64 nt, Homo Sapiens; identical to SEQ ID NO: 39042

SEQ ID NO: 111812 - RNA, 64 nt, Homo Sapiens; identical to SEQ ID NO: 39043

SEQ ID NO: 111813 - RNA, 64 nt, Homo Sapiens; identical to SEQ ID NO: 39044

SEQ ID NO: 111814 - RNA, 64 nt, Homo Sapiens; identical to SEQ ID NO: 39045

SEQ ID NO: 111815 - RNA, 64 nt, Homo Sapiens
auuacauuguaaaauuccagcuuuuaauacuugcagauucuaagucaguuuuacucuaaaugua

SEQ ID NO: 111816 - RNA, 64 nt, Homo Sapiens
gaaagcaaaacauaguaguugagcugaaucaguaagauucuagagacaaaguaaguauauuuua

SEQ ID NO: 111817 - RNA, 64 nt, Homo Sapiens
agaauacgcugaagagggaaaauuucagugauggagauucuagauuaaauaucaggacugauuu

SEQ ID NO: 111818 - RNA, 64 nt, Homo Sapiens
uuaacuuauguggacuguaaauguuuuauuuguaagauucuauaaauaaagcuauauucuguaa

SEQ ID NO: 111819 - RNA, 64 nt, Homo Sapiens
ucuagaguucagaguccuuaaaauguaagauuauagauucuaaagauucuauaguucuagacau

SEQ ID NO: 111820 - RNA, 64 nt, Homo Sapiens
cagaguccuuaaaauguaagauuauagauucuaaagauucuauaguucuagacauggagguucu

SEQ ID NO: 111821 - RNA, 64 nt, Homo Sapiens
auaaggcuucaaaauguuaucuucucaaguucuaagauucuaaugaugaucaauuauaguuucu

SEQ ID NO: 111822 - RNA, 64 nt, Homo Sapiens
gacuuacucuaagaucuuagauucucugugucuaagauucuagaucagaugcuccaagauucua

SEQ ID NO: 111823 - RNA, 64 nt, Homo Sapiens
ucucugugucuaagauucuagaucagaugcuccaagauucuagaugauuaaauaagauucuaac

SEQ ID NO: 111824 - RNA, 64 nt, Homo Sapiens
gaucagaugcuccaagauucuagaugauuaaauaagauucuaacggucuguucuguuucaaggc

SEQ ID NO: 111825 - RNA, 64 nt, Homo Sapiens
uguaguucuaagacucaaauguucuaaguuucuaagauucuaaagguccacaggucuagacuau

SEQ ID NO: 111826 - RNA, 64 nt, Homo Sapiens
ccugagcuugaucuuuuucugccaugaaguuuaaagauucuaugcccauuuccuugauugaaau

SEQ ID NO: 111827 - RNA, 64 nt, Homo Sapiens
uugccucugaaacgucugguuaguggggacccaaagauucuagugagucaacauccauaacucu

SEQ ID NO: 111828 - RNA, 64 nt, Homo Sapiens
uccauuuuggauguauuuguuggauuuagaggagagauucuaaagaaacauuuuuuggaaagga

SEQ ID NO: 111829 - RNA, 64 nt, Homo Sapiens
gccuagucagcagauuuaucagcauuuaaguuucagauucuacaugccuucuaucacugauagu

SEQ ID NO: 111830 - RNA, 64 nt, Homo Sapiens
cauuuacaagaaaaauguuuuaaagaugccagggguacugaaucugcaaagcaaaugagcagcc

SEQ ID NO: 111831 - RNA, 64 nt, Homo Sapiens
uuaagcauguguaaugcuggauguguacaguacaguacugaacuuguaauuugaaucuaguaug

SEQ ID NO: 111832 - RNA, 64 nt, Homo Sapiens
ugucuugcggcuuugcaagucaauuuggguuuuuguacugaaguuuaagauuuugcagauuuau

SEQ ID NO: 111833 - RNA, 64 nt, Homo Sapiens
acuuaauauuggcaacauuucuaauuaauuuuagguacugaagacacuguaauauugcuguccu

SEQ ID NO: 111834 - RNA, 64 nt, Homo Sapiens
uaaaaauuuuaaaaaaggcuugaguaaauuuaauguacugaaaaacauuuuuagaauguuuuua

SEQ ID NO: 111835 - RNA, 64 nt, Homo Sapiens
uggacaccuuguguacucgaaagagaaggcuuugguacugaaacgugagucuuacgugcacaaa

SEQ ID NO: 111836 - RNA, 64 nt, Homo Sapiens
aagccaaagucuuucugaagaaucugugcuggacagacauaauucccuuucucauugucuccau

SEQ ID NO: 111837 - RNA, 64 nt, Homo Sapiens
uugucaguggagguccucagggcugcaaaugucaagacauaacccuguuccucaccaucaugau

SEQ ID NO: 111838 - RNA, 64 nt, Homo Sapiens
agaccaauugaagcaugaacguggauuguauuuaagacauaaacaaagacauugacagcaauuc

SEQ ID NO: 111839 - RNA, 64 nt, Homo Sapiens
acucccaaacugacaauuuuaccuauucugaaaaagacauaaaacagaauuugguagcacuuac

SEQ ID NO: 111840 - RNA, 64 nt, Homo Sapiens
caaaggauauaccugacagacagggcccaauucuagacauaaaacaguugauuuacagugguca

SEQ ID NO: 111841 - RNA, 64 nt, Homo Sapiens
cuuuggaaacuguuaauacuauaaggaauguggaagacauaaucccaaggggaaaucuaucagu

SEQ ID NO: 111842 - RNA, 64 nt, Homo Sapiens
aggggaaagggaaaucaaauuaauuuuucucguuagacauaaggaaauuuaaggaaaaacagcu

SEQ ID NO: 111843 - RNA, 64 nt, Homo Sapiens
cucuggaguuguaguuugacagaaccaucaguaaagacauaagcaaauaaauggucuuggugca

SEQ ID NO: 111844 - RNA, 64 nt, Homo Sapiens
cuguggcuggagccccaaagguaauaugaacagaugaacagacagaggagcucucgacuuagag

SEQ ID NO: 111845 - RNA, 64 nt, Homo Sapiens
aacagacacuguggcuggagacuuagagguaauaugaacagauguuaaaagagaggagcucucg

SEQ ID NO: 111846 - RNA, 62 nt, Homo Sapiens
aaaauuaaaaaaaaaaaaaauucaucuuaaaagcugaacagaagguuucaaguggaaagcca

SEQ ID NO: 111847 - RNA, 64 nt, Homo Sapiens
auaacuaggaaaggaggaaaccuuaacuuagggaugaacagacuaagguuuuccucugugcuac

SEQ ID NO: 111848 - RNA, 64 nt, Homo Sapiens
gugcauuuuuggaagccucccuuuuccuuucaucugaacagaauuccaccagucccaccccagc

SEQ ID NO: 111849 - RNA, 64 nt, Homo Sapiens
agggaagagaggaagaacgaugaggcaaguuggaugaacagagaccuuuaaaugguuuucuuuu

SEQ ID NO: 111850 - RNA, 64 nt, Homo Sapiens
guuggaccagccugucaugaacauuuuuucagacugaacagacucaaucugaacagagcacaga

SEQ ID NO: 111851 - RNA, 64 nt, Homo Sapiens
acagaacauuuuuucagacuacauuuugucaaucugaacagagcacugcgcccggccaaaaaga

SEQ ID NO: 111852 - RNA, 64 nt, Homo Sapiens
ggagauaggagaugaaaaguagauauaucuccuaugaacagauuccuuauaauaaaagaucaaa

SEQ ID NO: 111853 - RNA, 64 nt, Homo Sapiens
uggaggccagagcucauuugacuucauaaaauuaugaacagauacuaaugaaugacauuuagau

SEQ ID NO: 111854 - RNA, 64 nt, Homo Sapiens
ccuuaggaaugaauagagagguaaacauuaggaaugaacagaggccuucagaguagagaaccau

SEQ ID NO: 111855 - RNA, 64 nt, Homo Sapiens
aguggaagggcuguaccagggaagacagggcucuugaacagacagucucuuccgagggccuucu

SEQ ID NO: 111856 - RNA, 64 nt, Homo Sapiens
ugaaauuuucuuuguaucuagggguauccgucacugaacagaaauucuuaauuuuggcuaggcg

SEQ ID NO: 111857 - RNA, 64 nt, Homo Sapiens
agaaucacuugaacccgggagguggaggcugcagugaacagagacagugccacugcacaucagc

SEQ ID NO: 111858 - RNA, 64 nt, Homo Sapiens
aguucuguccaagccaucagcuccuugggacugaugaacagagucagaagcccaaaggaauugc

SEQ ID NO: 111859 - RNA, 64 nt, Homo Sapiens
guugacuuugaaucccagguacucacagaaauggugaacagacuuaguuguuacccaggcaccc

SEQ ID NO: 111860 - RNA, 64 nt, Homo Sapiens
ggcuggaaauaauccaauuauuccugcuuggauucuuccacagggccuguguaagaauggguuc

SEQ ID NO: 111861 - RNA, 64 nt, Homo Sapiens
uguuagacagccacaguccugucuggguuagggucuuccacauuugaggauccuuccuaucucu

SEQ ID NO: 111862 - RNA, 64 nt, Homo Sapiens
uuuguuguugguuccuuuuagaccacggcugccccuuccacaccccaucuugcucuaaugauca

SEQ ID NO: 111863 - RNA, 64 nt, Homo Sapiens
cuucuguggcugucuuguuucugaaguacuuaaacuuccacaagagugaauuugaccuaggcaa

SEQ ID NO: 111864 - RNA, 64 nt, Homo Sapiens
cagauuaguauucggacaugcagauaauacauuucuuccacauuuuuuccagugugguuuuuaa

SEQ ID NO: 111865 - RNA, 64 nt, Homo Sapiens
guacagaaugagcagucaugccuaaauaaccaggcuuccacauucuuuaggaaacgaaauauuu

SEQ ID NO: 111866 - RNA, 64 nt, Homo Sapiens
gcaugcccacaggccaggcccagucacagcugggcuuccacaggucagaauaugggacaggaca

SEQ ID NO: 111867 - RNA, 64 nt, Homo Sapiens
aagggugggagucuggagccagacagccaagccccuuccacaucuacagggucacugucauccu

SEQ ID NO: 111868 - RNA, 64 nt, Homo Sapiens
uggggcaccauuucaguguaaaagcaguccuacucuuccacacuaggaaggcuuuacuuuuuuu

SEQ ID NO: 111869 - RNA, 64 nt, Homo Sapiens
aacgaugaugguuacccuucauggacgucuuaaucuuccacacacauccccuuuuuuuggaaua

SEQ ID NO: 111870 - RNA, 64 nt, Homo Sapiens
aguugggugaccagcuguccaucucaauuccccucuuccacaagugccagauauucaguacucg

SEQ ID NO: 111871 - RNA, 64 nt, Homo Sapiens
aucgaugcguugcuuugguaacaucucuaauugacuuccacaaacuugucuccgauagcucccc

SEQ ID NO: 111872 - RNA, 64 nt, Homo Sapiens
cugggaucucugguaccgucacucuugcuugugccuuccacaccuucucggugcagaucccuau

SEQ ID NO: 111873 - RNA, 64 nt, Homo Sapiens
ccccuggcaugcaugcuggcggcggcaugccucccuuccacaagcccaugcugcugcagaggga

SEQ ID NO: 111874 - RNA, 64 nt, Homo Sapiens
cuggagcugcccuacccccacggcacaaccugggcuuccacaguauguaaccccucucucaccc

SEQ ID NO: 111875 - RNA, 64 nt, Homo Sapiens
gucuuccccagcgucccccgaaacccacgacucacuuccacaccaacuuuucuccccaaccccc

SEQ ID NO: 111876 - RNA, 64 nt, Homo Sapiens
cgacagagugagacuccaucugugccacugcacuccagccuaggagguugcagugagccgagau

SEQ ID NO: 111877 - RNA, 64 nt, Homo Sapiens
caacauggugaaaccccaucucaggaguucgcgaccagccuaccggugggcagaucacuugagg

SEQ ID NO: 111878 - RNA, 64 nt, Homo Sapiens
aaugaaagaaaaugagagcagaaaguaagcauuuccagccuaucuaauuucuuuaguuuucuau

SEQ ID NO: 111879 - RNA, 64 nt, Homo Sapiens
uuugccuccagugcaguccauuuccuaauguauaccagccuacuguacuauuuaaaaugcucaa

SEQ ID NO: 111880 - RNA, 64 nt, Homo Sapiens
cauuauuugcugucggguuucuuguggaccagagccagccuaguaaaccuagccagggucuguu

SEQ ID NO: 111881 - RNA, 64 nt, Homo Sapiens
gcgcaugcuuucugccucugguucuugccauuugccagccuaauugggcugagggggaaugagu

SEQ ID NO: 111882 - RNA, 62 nt, Homo Sapiens
uccagacucacaaugucccauaacaguuccagagacuaaaugacaacagaaauuuauucucu

SEQ ID NO: 111883 - RNA, 62 nt, Homo Sapiens
auuuuauaaggcuguugcuaauugaauuuugcagacuaaauuuaaguuacuucaauuauaaa

SEQ ID NO: 111884 - RNA, 62 nt, Homo Sapiens
cauaauaagcaaauuauuggcuucuuucuucuagacuaaaagaaauuaaagagaugaaacaa

SEQ ID NO: 111885 - RNA, 62 nt, Homo Sapiens
uaucauuaauuuuauaucaggauucauguaagagacuaaaaaugauccauagugguuaguac

SEQ ID NO: 111886 - RNA, 62 nt, Homo Sapiens
ugaacaagauguugcaugcuguuuuacaaugaagacuaaaacaauuuaacuaaaggguaguu

SEQ ID NO: 111887 - RNA, 62 nt, Homo Sapiens
uaggacagguacaauuuugggauuaaauuuucagacuaaauauauaagaaagaguaguuguu

SEQ ID NO: 111888 - RNA, 62 nt, Homo Sapiens
guaauauaucgugggaaggagaauuaaagcuuagacuaaauaauucgucauucucaaccuuu

SEQ ID NO: 111889 - RNA, 62 nt, Homo Sapiens
ccacgaaacugacauuguuaguccuggaacagagacuaaaucuuaccauaauguaagagaag

SEQ ID NO: 111890 - RNA, 62 nt, Homo Sapiens
guucuuucaaaagaggcauccucaguuuaaaaagacuaaaaccauuguuauuuuuuuuuaaa

SEQ ID NO: 111891 - RNA, 62 nt, Homo Sapiens
ggugcagugugaucugagccauacaaguuggaagacuaaagagacacuuugguaugaugcau

SEQ ID NO: 111892 - RNA, 62 nt, Homo Sapiens
ucuuucucaauuaugucagacuuuuaaccugcagacuaaauuacuccuggauuucagcuuca

SEQ ID NO: 111893 - RNA, 62 nt, Homo Sapiens
gcaaaaagcaauacuuaauauuaaaguacuaaagacuaaaauaauauuuuucuuaugaauuc

SEQ ID NO: 111894 - RNA, 64 nt, Homo Sapiens
aagcgaggagaguucuccauagggauuccccgggagagaggacgagguaacgcagugcgggguu

SEQ ID NO: 111895 - RNA, 64 nt, Homo Sapiens
gaagauccggaacucgccaagcccgagccccgggagagaggagcacagcccgguaggcugcguc

SEQ ID NO: 111896 - RNA, 64 nt, Homo Sapiens
aguuguagcuaaauguugauugaugcuggacccaagagaggaaauucaugaauaucaaaucuuu

SEQ ID NO: 111897 - RNA, 64 nt, Homo Sapiens
auuuuaccucucaaaggguggguaccuguuuaggagagaggaagcaguucccaaaucaauuaua

SEQ ID NO: 111898 - RNA, 64 nt, Homo Sapiens
aggaaugugugaaaaacagccaugagcccagcugagagaggagcuuggaaugaaacggagugaa

SEQ ID NO: 111899 - RNA, 64 nt, Homo Sapiens
cacauaugcauaucuugacauugcucuguaggugagagaggaccaugacgcccauguuugcagc

SEQ ID NO: 111900 - RNA, 64 nt, Homo Sapiens
cgaccuucugaaacucacagaagucacgugauggagagaggauucaaagccagggccucagacc

SEQ ID NO: 111901 - RNA, 64 nt, Homo Sapiens
ugucuggcuuccaagagaaaaaccccauagcgucagagaggauagaagagcucuaaggagaaga

SEQ ID NO: 111902 - RNA, 64 nt, Homo Sapiens
augggggaauggguugcaaaggauuugagaggaaagagaggaaacccaccauauguauuuucua

SEQ ID NO: 111903 - RNA, 64 nt, Homo Sapiens
aacgagaggaagagaagggagaacagagaagggaagagaggaagcuuuuugaggcaaguuggau

SEQ ID NO: 111904 - RNA, 64 nt, Homo Sapiens
acuuggaaugaggccaacaggguucaccaggaugagagaggagagaggaauccacaggaccacc

SEQ ID NO: 111905 - RNA, 64 nt, Homo Sapiens
augaggccaacaggguucaccaggaugagagaggagagaggaauccacaggaccaccagaaggg

SEQ ID NO: 111906 - RNA, 64 nt, Homo Sapiens
augaggccuacaggguucaccaggauguaagaggagagaggaauccacaggaccaccagagagg

SEQ ID NO: 111907 - RNA, 64 nt, Homo Sapiens
gauguaagaggagagaggaauccacaggaccaccagagaggagagggaaccagauaugcagauc

SEQ ID NO: 111908 - RNA, 64 nt, Homo Sapiens
uugaguggauuccuggguacaaaacgacaauugaagagaggacguauauaggcuuuguugauga

SEQ ID NO: 111909 - RNA, 64 nt, Homo Sapiens
ucaugauuaaagauuccuaaauauuuugaaauuuagagaggaauguuuccuuagaagucauaaa

SEQ ID NO: 111910 - RNA, 64 nt, Homo Sapiens
uggagcucuucuuaccagccaccguggcucagccagagaggagcugagcccuguggagcagaac

SEQ ID NO: 111911 - RNA, 64 nt, Homo Sapiens
gagaauggagcaggaggaaaagcagaguuggucuagagaggaggagggcggggcuggaggaaug

SEQ ID NO: 111912 - RNA, 64 nt, Homo Sapiens
gugaaauauagaaguguuugaugacaaaagcuacagagaggagacaaaagaagggaaaacuggc

SEQ ID NO: 111913 - RNA, 64 nt, Homo Sapiens
caagaccagacugaagaacacuucucagcugggaagagaggauggaucuacucggggccucagg

SEQ ID NO: 111914 - RNA, 64 nt, Homo Sapiens
aaaagcaggcagggaaggggguaguaaaggacugagagaggagggagguggcuggagaaggaaa

SEQ ID NO: 111915 - RNA, 64 nt, Homo Sapiens
gcuuccugugugauccuggcccuccggccgcuagagagaggauugggaaaccccacugucagcu

SEQ ID NO: 111916 - RNA, 64 nt, Homo Sapiens
uugggcucacagaaagagaacauucccaaggaaaagagaggagccuguggccucugccgggcuc

SEQ ID NO: 111917 - RNA, 64 nt, Homo Sapiens
auuuggccuccugcuuccuuccagagccccagugagagaggagcacaacucaccaaccuccaac

SEQ ID NO: 111918 - RNA, 64 nt, Homo Sapiens
ccuggaccgagaugugagucggacuuguauagugagagaggaggcaggguccuaaaacuuggau

SEQ ID NO: 111919 - RNA, 64 nt, Homo Sapiens
uggucugucuguuaccauaaugccggggaggggcagagaggaagcagaugcugcugaagagagg

SEQ ID NO: 111920 - RNA, 64 nt, Homo Sapiens
guugacauccaagcuuccuuaggacgugggcggcagagaggacuacacagcugcagagacagag

SEQ ID NO: 111921 - RNA, 64 nt, Homo Sapiens
ugggcggcagagaggacuguacagcugcagagacagagaggacgggucacugccauggaggcac

SEQ ID NO: 111922 - RNA, 64 nt, Homo Sapiens
cagcccccuccacaccagugagacugaggcuuagagagaggagggcgcugcuuccaggauaagg

SEQ ID NO: 111923 - RNA, 64 nt, Homo Sapiens
gaccuacauucccucuccugcuggggcuggggugagagaggaaaggagcccugaccuuggcuga

SEQ ID NO: 111924 - RNA, 64 nt, Homo Sapiens
accuucucaaccacguacaggccagccaguacucagagaggaggucccaguucugcgccuuggg

SEQ ID NO: 111925 - RNA, 64 nt, Homo Sapiens
cgccaaaacaaaucacgagagucugcagaaccaaagagaggaauucgggcaggugggucacgug

SEQ ID NO: 111926 - RNA, 64 nt, Homo Sapiens
ccagggucucucagggauggagggaagaccugaaagagaggacugguucugaggccagaaaggu

SEQ ID NO: 111927 - RNA, 64 nt, Homo Sapiens
agaggacugguucugaggccagaaaggugugaggagagaggaggaaaagucuuccuaauugugc

SEQ ID NO: 111928 - RNA, 64 nt, Homo Sapiens; identical to SEQ ID NO: 21574

SEQ ID NO: 111929 - RNA, 64 nt, Homo Sapiens; identical to SEQ ID NO: 21575

SEQ ID NO: 111930 - RNA, 64 nt, Homo Sapiens; identical to SEQ ID NO: 21576

SEQ ID NO: 111931 - RNA, 64 nt, Homo Sapiens; identical to SEQ ID NO: 21577

SEQ ID NO: 111932 - RNA, 64 nt, Homo Sapiens; identical to SEQ ID NO: 21578

SEQ ID NO: 111933 - RNA, 64 nt, Homo Sapiens; identical to SEQ ID NO: 21579

SEQ ID NO: 111934 - RNA, 64 nt, Homo Sapiens; identical to SEQ ID NO: 21580

SEQ ID NO: 111935 - RNA, 64 nt, Homo Sapiens; identical to SEQ ID NO: 21581

SEQ ID NO: 111936 - RNA, 64 nt, Homo Sapiens; identical to SEQ ID NO: 21582

SEQ ID NO: 111937 - RNA, 64 nt, Homo Sapiens; identical to SEQ ID NO: 21583

SEQ ID NO: 111938 - RNA, 64 nt, Homo Sapiens; identical to SEQ ID NO: 21584

SEQ ID NO: 111939 - RNA, 64 nt, Homo Sapiens; identical to SEQ ID NO: 21585

SEQ ID NO: 111940 - RNA, 64 nt, Homo Sapiens; identical to SEQ ID NO: 21586

SEQ ID NO: 111941 - RNA, 64 nt, Homo Sapiens; identical to SEQ ID NO: 21587

SEQ ID NO: 111942 - RNA, 64 nt, Homo Sapiens; identical to SEQ ID NO: 21588

SEQ ID NO: 111943 - RNA, 64 nt, Homo Sapiens; identical to SEQ ID NO: 21589

SEQ ID NO: 111944 - RNA, 64 nt, Homo Sapiens; identical to SEQ ID NO: 21590

SEQ ID NO: 111945 - RNA, 64 nt, Homo Sapiens; identical to SEQ ID NO: 21591

SEQ ID NO: 111946 - RNA, 64 nt, Homo Sapiens; identical to SEQ ID NO: 21592

SEQ ID NO: 111947 - RNA, 64 nt, Homo Sapiens; identical to SEQ ID NO: 21593

SEQ ID NO: 111948 - RNA, 64 nt, Homo Sapiens; identical to SEQ ID NO: 21594

SEQ ID NO: 111949 - RNA, 64 nt, Homo Sapiens; identical to SEQ ID NO: 21595

SEQ ID NO: 111950 - RNA, 64 nt, Homo Sapiens; identical to SEQ ID NO: 21596

SEQ ID NO: 111951 - RNA, 64 nt, Homo Sapiens; identical to SEQ ID NO: 21597

SEQ ID NO: 111952 - RNA, 64 nt, Homo Sapiens; identical to SEQ ID NO: 21598

SEQ ID NO: 111953 - RNA, 64 nt, Homo Sapiens; identical to SEQ ID NO: 21599

SEQ ID NO: 111954 - RNA, 64 nt, Homo Sapiens; identical to SEQ ID NO: 21600

SEQ ID NO: 111955 - RNA, 64 nt, Homo Sapiens; identical to SEQ ID NO: 21601

SEQ ID NO: 111956 - RNA, 64 nt, Homo Sapiens; identical to SEQ ID NO: 21602

SEQ ID NO: 111957 - RNA, 64 nt, Homo Sapiens; identical to SEQ ID NO: 21603

SEQ ID NO: 111958 - RNA, 64 nt, Homo Sapiens; identical to SEQ ID NO: 21604

SEQ ID NO: 111959 - RNA, 64 nt, Homo Sapiens; identical to SEQ ID NO: 21605

SEQ ID NO: 111960 - RNA, 64 nt, Homo Sapiens; identical to SEQ ID NO: 21606

SEQ ID NO: 111961 - RNA, 64 nt, Homo Sapiens; identical to SEQ ID NO: 21607

SEQ ID NO: 111962 - RNA, 64 nt, Homo Sapiens; identical to SEQ ID NO: 21608

SEQ ID NO: 111963 - RNA, 64 nt, Homo Sapiens; identical to SEQ ID NO: 21609

SEQ ID NO: 111964 - RNA, 64 nt, Homo Sapiens; identical to SEQ ID NO: 21610

SEQ ID NO: 111965 - RNA, 64 nt, Homo Sapiens; identical to SEQ ID NO: 21611

SEQ ID NO: 111966 - RNA, 64 nt, Homo Sapiens; identical to SEQ ID NO: 21612

SEQ ID NO: 111967 - RNA, 64 nt, Homo Sapiens; identical to SEQ ID NO: 21613

SEQ ID NO: 111968 - RNA, 64 nt, Homo Sapiens; identical to SEQ ID NO: 21614

SEQ ID NO: 111969 - RNA, 64 nt, Homo Sapiens; identical to SEQ ID NO: 21615

SEQ ID NO: 111970 - RNA, 64 nt, Homo Sapiens; identical to SEQ ID NO: 21616

SEQ ID NO: 111971 - RNA, 64 nt, Homo Sapiens; identical to SEQ ID NO: 21617

SEQ ID NO: 111972 - RNA, 64 nt, Homo Sapiens; identical to SEQ ID NO: 21618

SEQ ID NO: 111973 - RNA, 64 nt, Homo Sapiens; identical to SEQ ID NO: 21619

SEQ ID NO: 111974 - RNA, 64 nt, Homo Sapiens; identical to SEQ ID NO: 21620

SEQ ID NO: 111975 - RNA, 64 nt, Homo Sapiens; identical to SEQ ID NO: 21621

SEQ ID NO: 111976 - RNA, 64 nt, Homo Sapiens; identical to SEQ ID NO: 21622

SEQ ID NO: 111977 - RNA, 64 nt, Homo Sapiens; identical to SEQ ID NO: 21623

SEQ ID NO: 111978 - RNA, 64 nt, Homo Sapiens; identical to SEQ ID NO: 21624

SEQ ID NO: 111979 - RNA, 64 nt, Homo Sapiens; identical to SEQ ID NO: 21625

SEQ ID NO: 111980 - RNA, 64 nt, Homo Sapiens; identical to SEQ ID NO: 21626

SEQ ID NO: 111981 - RNA, 64 nt, Homo Sapiens; identical to SEQ ID NO: 21627

SEQ ID NO: 111982 - RNA, 64 nt, Homo Sapiens; identical to SEQ ID NO: 21628

SEQ ID NO: 111983 - RNA, 64 nt, Homo Sapiens; identical to SEQ ID NO: 21629

SEQ ID NO: 111984 - RNA, 64 nt, Homo Sapiens; identical to SEQ ID NO: 21630

SEQ ID NO: 111985 - RNA, 57 nt, Homo Sapiens; identical to SEQ ID NO: 21631

SEQ ID NO: 111986 - RNA, 64 nt, Homo Sapiens; identical to SEQ ID NO: 21632

SEQ ID NO: 111987 - RNA, 64 nt, Homo Sapiens; identical to SEQ ID NO: 21633

SEQ ID NO: 111988 - RNA, 64 nt, Homo Sapiens; identical to SEQ ID NO: 21634

SEQ ID NO: 111989 - RNA, 64 nt, Homo Sapiens; identical to SEQ ID NO: 21635

SEQ ID NO: 111990 - RNA, 64 nt, Homo Sapiens; identical to SEQ ID NO: 21636

SEQ ID NO: 111991 - RNA, 64 nt, Homo Sapiens; identical to SEQ ID NO: 21637

SEQ ID NO: 111992 - RNA, 64 nt, Homo Sapiens; identical to SEQ ID NO: 21638

SEQ ID NO: 111993 - RNA, 64 nt, Homo Sapiens; identical to SEQ ID NO: 21639

SEQ ID NO: 111994 - RNA, 64 nt, Homo Sapiens; identical to SEQ ID NO: 21640

SEQ ID NO: 111995 - RNA, 64 nt, Homo Sapiens; identical to SEQ ID NO: 21641

SEQ ID NO: 111996 - RNA, 64 nt, Homo Sapiens; identical to SEQ ID NO: 21642

SEQ ID NO: 111997 - RNA, 64 nt, Homo Sapiens; identical to SEQ ID NO: 21643

SEQ ID NO: 111998 - RNA, 64 nt, Homo Sapiens; identical to SEQ ID NO: 21644

SEQ ID NO: 111999 - RNA, 64 nt, Homo Sapiens; identical to SEQ ID NO: 21645

SEQ ID NO: 112000 - RNA, 64 nt, Homo Sapiens; identical to SEQ ID NO: 21646

SEQ ID NO: 112001 - RNA, 64 nt, Homo Sapiens; identical to SEQ ID NO: 21647

SEQ ID NO: 112002 - RNA, 64 nt, Homo Sapiens; identical to SEQ ID NO: 21648

SEQ ID NO: 112003 - RNA, 64 nt, Homo Sapiens; identical to SEQ ID NO: 21649

SEQ ID NO: 112004 - RNA, 64 nt, Homo Sapiens; identical to SEQ ID NO: 21650

SEQ ID NO: 112005 - RNA, 64 nt, Homo Sapiens; identical to SEQ ID NO: 21651

SEQ ID NO: 112006 - RNA, 64 nt, Homo Sapiens; identical to SEQ ID NO: 21652

SEQ ID NO: 112007 - RNA, 64 nt, Homo Sapiens; identical to SEQ ID NO: 21653

SEQ ID NO: 112008 - RNA, 64 nt, Homo Sapiens; identical to SEQ ID NO: 21654

SEQ ID NO: 112009 - RNA, 64 nt, Homo Sapiens; identical to SEQ ID NO: 21655

SEQ ID NO: 112010 - RNA, 64 nt, Homo Sapiens; identical to SEQ ID NO: 21656

SEQ ID NO: 112011 - RNA, 64 nt, Homo Sapiens; identical to SEQ ID NO: 21657

SEQ ID NO: 112012 - RNA, 64 nt, Homo Sapiens; identical to SEQ ID NO: 21658

SEQ ID NO: 112013 - RNA, 64 nt, Homo Sapiens; identical to SEQ ID NO: 21659

SEQ ID NO: 112014 - RNA, 64 nt, Homo Sapiens; identical to SEQ ID NO: 21660

SEQ ID NO: 112015 - RNA, 64 nt, Homo Sapiens; identical to SEQ ID NO: 21661

SEQ ID NO: 112016 - RNA, 64 nt, Homo Sapiens; identical to SEQ ID NO: 21662

SEQ ID NO: 112017 - RNA, 64 nt, Homo Sapiens; identical to SEQ ID NO: 21663

SEQ ID NO: 112018 - RNA, 64 nt, Homo Sapiens; identical to SEQ ID NO: 21664

SEQ ID NO: 112019 - RNA, 64 nt, Homo Sapiens; identical to SEQ ID NO: 21665

SEQ ID NO: 112020 - RNA, 64 nt, Homo Sapiens; identical to SEQ ID NO: 21666

SEQ ID NO: 112021 - RNA, 64 nt, Homo Sapiens; identical to SEQ ID NO: 21667

SEQ ID NO: 112022 - RNA, 64 nt, Homo Sapiens; identical to SEQ ID NO: 21668

SEQ ID NO: 112023 - RNA, 64 nt, Homo Sapiens; identical to SEQ ID NO: 21669

SEQ ID NO: 112024 - RNA, 64 nt, Homo Sapiens; identical to SEQ ID NO: 21670

SEQ ID NO: 112025 - RNA, 64 nt, Homo Sapiens; identical to SEQ ID NO: 21671

SEQ ID NO: 112026 - RNA, 64 nt, Homo Sapiens; identical to SEQ ID NO: 21672

SEQ ID NO: 112027 - RNA, 64 nt, Homo Sapiens; identical to SEQ ID NO: 21673

SEQ ID NO: 112028 - RNA, 64 nt, Homo Sapiens; identical to SEQ ID NO: 21674

SEQ ID NO: 112029 - RNA, 64 nt, Homo Sapiens; identical to SEQ ID NO: 21675

SEQ ID NO: 112030 - RNA, 64 nt, Homo Sapiens; identical to SEQ ID NO: 21676

SEQ ID NO: 112031 - RNA, 64 nt, Homo Sapiens; identical to SEQ ID NO: 21677

SEQ ID NO: 112032 - RNA, 64 nt, Homo Sapiens; identical to SEQ ID NO: 21678

SEQ ID NO: 112033 - RNA, 64 nt, Homo Sapiens; identical to SEQ ID NO: 21679

SEQ ID NO: 112034 - RNA, 64 nt, Homo Sapiens; identical to SEQ ID NO: 21680

SEQ ID NO: 112035 - RNA, 64 nt, Homo Sapiens; identical to SEQ ID NO: 21681

SEQ ID NO: 112036 - RNA, 64 nt, Homo Sapiens; identical to SEQ ID NO: 21682

SEQ ID NO: 112037 - RNA, 64 nt, Homo Sapiens
uaacucccuuaagcccagacaucuguugagaccugaccccuagucauugguuaccaguguguca

SEQ ID NO: 112038 - RNA, 64 nt, Homo Sapiens
cccacaucucuuuuccggauacauuauaauucuggaccccuauuuaucucaaaacucuuaauau

SEQ ID NO: 112039 - RNA, 64 nt, Homo Sapiens
uuuuuuuuuuaaugggggacaaaagagagggaaagaccccuauaaaucuauauauaacaaugua

SEQ ID NO: 112040 - RNA, 64 nt, Homo Sapiens
ggcugcacacccugccccagcccagcugccuccagaccccuaagcaucuccuguccuggccucu

SEQ ID NO: 112041 - RNA, 64 nt, Homo Sapiens
gcagggacuagaagccucagggcagugagugagggaccccuaaucucugaguggggagagguug

SEQ ID NO: 112042 - RNA, 64 nt, Homo Sapiens
agccuuuuguaacuugauggcuuugucuuuuuaagaccccuaauuuauuguuuuauuguauacu

SEQ ID NO: 112043 - RNA, 64 nt, Homo Sapiens
ccuuugugugcucuccauucaaaaaaauuuuaaagaccccuaacuuaauaaaagaaaauuacaa

SEQ ID NO: 112044 - RNA, 64 nt, Homo Sapiens
agauucgcaaaccacagauaaguauauguucuaagaccccuaguguaguuccccuuaucugagc

SEQ ID NO: 112045 - RNA, 64 nt, Homo Sapiens
uccacugcacauggcccuccuagagcacccuugggaccccuaguacgcccuuagccuuuggagc

SEQ ID NO: 112046 - RNA, 64 nt, Homo Sapiens
gcugcauauguuacaauucuagaaugagugccuugaccccuaaucuuuugucaauugcaccaaa

SEQ ID NO: 112047 - RNA, 64 nt, Homo Sapiens
ccgucacaccacacccuccacauauuguuucccugaccccuagggguguagggccugacaagaa

SEQ ID NO: 112048 - RNA, 64 nt, Homo Sapiens
cugugcagugcugaccacagcuuucuccuuuccagaccccuacucaagccagauucuucugccu

SEQ ID NO: 112049 - RNA, 64 nt, Homo Sapiens
gggagagacucuggagguggugggucucucgggagaccccuaaugaggaaguugagguaaugcu

SEQ ID NO: 112050 - RNA, 64 nt, Homo Sapiens
uuccucuaggacugguuuggggacgggugggaaugaccccuaggcaaggggaugagaccgcagg

SEQ ID NO: 112051 - RNA, 64 nt, Homo Sapiens
cugauccccaacugaagcuuccuacccuuccagggaccccuaucgugucugcuuagaguuuacu

SEQ ID NO: 112052 - RNA, 64 nt, Homo Sapiens
aaguaaagaacugcacaugauucauuccaaaggggaccccuaugcacacauuccacuaggccuu

SEQ ID NO: 112053 - RNA, 64 nt, Homo Sapiens
ugccccaugccugcccugcgugcugguuccuucagaccccuaacccuacuaaccagcaggcuca

SEQ ID NO: 112054 - RNA, 64 nt, Homo Sapiens
aacucagccaaggagaccugccaguuggaccacggaccccuagauuuaauuauaaagugaagga

SEQ ID NO: 112055 - RNA, 64 nt, Homo Sapiens
ggcagccagccucuguuucuccagggucggguaggaccccuacucagcccugguuuuucaaucc

SEQ ID NO: 112056 - RNA, 64 nt, Homo Sapiens
cugcugugcggugggacuccuauugcacuucauagaccccuagggauggaaggccuuggauuua

SEQ ID NO: 112057 - RNA, 64 nt, Homo Sapiens
agugccuguugcuuugugagagauguuagccuaagaccccuagcaugcagacuggugggguggc

SEQ ID NO: 112058 - RNA, 64 nt, Homo Sapiens
ugccuacacaauaucuuuaauccuccuccagaucgaccccuagacgccccuccaugcgcugcgu

SEQ ID NO: 112059 - RNA, 59 nt, Homo Sapiens
gguaauacccuuuccuuuaccaggugaaagaccccuacaucagcuucuuccgaggguga

SEQ ID NO: 112060 - RNA, 64 nt, Homo Sapiens
uggaguuuuuaaucuggacucucuggcuugcugugaccccuaaggcaaugcuucucuucccugg

SEQ ID NO: 112061 - RNA, 64 nt, Homo Sapiens
ugccccagcacugcuguggaaccaccuggcuuaugaccccuauggaugaucuuuaggaaaagca

SEQ ID NO: 112062 - RNA, 64 nt, Homo Sapiens
ucccucugcucagccaagcuuaauccuuucugccgaccccuagugagccaauguuuuccaccca

SEQ ID NO: 112063 - RNA, 64 nt, Homo Sapiens
gcuacauguaaaguucuuguaggggcuugagcaugaccccuaaaaccuauacacuauuuuaaga

SEQ ID NO: 112064 - RNA, 64 nt, Homo Sapiens
aggccagauggggcaggaaggcuccgcaggaccggaccccuagaccacccugccccaccugccc

SEQ ID NO: 112065 - RNA, 64 nt, Homo Sapiens
cccuucucuucuaccccaaccccugaaacacacugaccccuauucuccagaugacagcacagcu

SEQ ID NO: 112066 - RNA, 54 nt, Homo Sapiens
cugcucgcuaguggaacacgggaggaccccuagauucaagagucacccuucuaa

SEQ ID NO: 112067 - RNA, 64 nt, Homo Sapiens
uggggccgucuuggaaaguaucuguggacccucagaccccuaaauccagcagaacuggacuaau

SEQ ID NO: 112068 - RNA, 64 nt, Homo Sapiens
gcaaagguagccuuuugggcuuuuuaaugaauaugaccccuauagaaaagucaagaaaaaaaaa

SEQ ID NO: 112069 - RNA, 64 nt, Homo Sapiens
gcuuugagcugagcugaagcugaugcuggggucagaccccuacagagaaccagugcuuccuucg

SEQ ID NO: 112070 - RNA, 64 nt, Homo Sapiens
gccucuucuucaugcucauuaacacuuuuguuaagaccccuauucuaagcacguuucaaagaug

SEQ ID NO: 112071 - RNA, 64 nt, Homo Sapiens
ugcugaagacaggccgcuuuacaagaagaagcaggaccccuacugugggacacagauguggaau

SEQ ID NO: 112072 - RNA, 64 nt, Homo Sapiens
cuggagccccauccuguguuaucugugguuuuuggaccccuaaugucagcuuggcuguaggacu

SEQ ID NO: 112073 - RNA, 64 nt, Homo Sapiens
gcugugucuaagcucaggagccccacccuguccagaccccuacagugcccucacccagcccggc

SEQ ID NO: 112074 - RNA, 64 nt, Homo Sapiens
cagcucgagcaugcccugagcccuccugcagccugaccccuaggucucagaguccagucaaguu

SEQ ID NO: 112075 - RNA, 64 nt, Homo Sapiens
ugaaaacaccauuugucaaagaggccuuugaagagaccccuaagaaacacagagaguguuuagu

SEQ ID NO: 112076 - RNA, 64 nt, Homo Sapiens
guugauuccauuuacucaugcuugcaaaacuagagaccccuaaggcagaacugagaauaaacau

SEQ ID NO: 112077 - RNA, 64 nt, Homo Sapiens
ggagacaguuuugaccucuugacaguuuugaccugaccccuagacuggaggagaccuauggagg

SEQ ID NO: 112078 - RNA, 64 nt, Homo Sapiens
ucauaacuuguuuccgaacuagaaaagucugugagaccccuacaucauucugguuuuuuugcuu

SEQ ID NO: 112079 - RNA, 64 nt, Homo Sapiens
ccuucagccucagaguggaaucuuuuaaagacaggaccccuauguccaggaaaggggaaaagga

SEQ ID NO: 112080 - RNA, 64 nt, Homo Sapiens
auggggcucuacccugugacuuucaucuaccucagaccccuaucgccccuggcuacccuguugu

SEQ ID NO: 112081 - RNA, 64 nt, Homo Sapiens
gcaggcagccgaccugaggccugggggcaccguggaccccuaugcccgggucagcgucuccacc

SEQ ID NO: 112082 - RNA, 64 nt, Homo Sapiens
caagggaggguaagggggcacccugagcccacaggaccccuacuucacagcucacaggggcagg

SEQ ID NO: 112083 - RNA, 64 nt, Homo Sapiens
cuccagcauugcucuuccuaugucagccuggccugaccccuaccagucagcucccucuguccuc

SEQ ID NO: 112084 - RNA, 64 nt, Homo Sapiens
gagaaacaggggacccccucaccuccugggcagugaccccuacuaggcucccauuccagguacu

SEQ ID NO: 112085 - RNA, 64 nt, Homo Sapiens
gcaucaggugcugguccuccucccuccuggccucgaccccuaagggcuucgccccucccagggg

SEQ ID NO: 112086 - RNA, 64 nt, Homo Sapiens
auagaggaugccucccccacagacccuaccccaagaccccuagcccugcccccauccccccaag

SEQ ID NO: 112087 - RNA, 64 nt, Homo Sapiens
caacccaacaaccaccuggcaauaugacucacuugaccccuaugggacccaaaugggcacuuuc

SEQ ID NO: 112088 - RNA, 64 nt, Homo Sapiens
gaagggggaccaaugccagaagaaaggggcuguagaccccuauuccccaccccauggccacagg

SEQ ID NO: 112089 - RNA, 64 nt, Homo Sapiens
uggugggcuccagucagucuuacacugcccuucugaccccuacaaauggguccuuugcuaucca

SEQ ID NO: 112090 - RNA, 64 nt, Homo Sapiens
uucuccuccucccccauuuucucuuagggacccagaccccuaaauggaagagauguccuaauau

SEQ ID NO: 112091 - RNA, 64 nt, Homo Sapiens
cauuuugccuauccguaggcucuuccucuuucaagaccccuaccggccccuuguauuuuccuua

SEQ ID NO: 112092 - RNA, 64 nt, Homo Sapiens
aguggugggcugagcccagguggguccugugcaggaccccuagcgaucccgugcaggagccaca

SEQ ID NO: 112093 - RNA, 64 nt, Homo Sapiens
accaagugacaacugggagagccacgggcaccaggaccccuaagcacuguggcuggacugccgc

SEQ ID NO: 112094 - RNA, 64 nt, Homo Sapiens
gccuuuuuauacacuguccuccuccaccuugauggaccccuagugaugcauccugccuaggcug

SEQ ID NO: 112095 - RNA, 64 nt, Homo Sapiens
ccuuggauagcacgggaggagaaguugacuuugugaccccuaguuuaggacccacuucagcugu

SEQ ID NO: 112096 - RNA, 64 nt, Homo Sapiens
ggaugccugaaaccucagaugagauacauuccaagaccccuaguuagucuccccuuaucuguaa

SEQ ID NO: 112097 - RNA, 64 nt, Homo Sapiens
uagugagggagacaggugcacaguagcaaaauaagaccccuauccaguuaccccuuuacccuua

SEQ ID NO: 112098 - RNA, 64 nt, Homo Sapiens
ugagagcaccuugcaguuccacugagaaggaaccgaccccuaguggagaugagucagugccaug

SEQ ID NO: 112099 - RNA, 64 nt, Homo Sapiens
gauuuaaagggacaccccuaacaccuuuaacacagaccccuaggugcccuacugggagacuggg

SEQ ID NO: 112100 - RNA, 64 nt, Homo Sapiens
ugaccuggggguugccuggggaccucucccacccgaccccuacagagcuugagagccacagacg

SEQ ID NO: 112101 - RNA, 64 nt, Homo Sapiens
caagaguucaagaccagccugggcaacauagcgagaccccuaucuguauuaaaaaaaaaucuga

SEQ ID NO: 112102 - RNA, 64 nt, Homo Sapiens
ccccgagccgccugccgacugccggccggcccuggaccccuagacugcucacacaagcgacugg

SEQ ID NO: 112103 - RNA, 64 nt, Homo Sapiens
ccuuguuccgagcacgaagaaucuguugggcccagaccccuauguguggccccgcugccaggac

SEQ ID NO: 112104 - RNA, 64 nt, Homo Sapiens
aggggaguuguagccccauguuucucuccccucugaccccuagacaguggagacggcaguccag

SEQ ID NO: 112105 - RNA, 64 nt, Homo Sapiens
acuggggucaugagagcuaguuaguacucagccugaccccuaggucugguccugccagccuggg

SEQ ID NO: 112106 - RNA, 64 nt, Homo Sapiens
ccucuccagcccuauggaagucucaaggucacgggaccccuaaucagaguggccaaucccugug

SEQ ID NO: 112107 - RNA, 64 nt, Homo Sapiens
gaagagcuggaaaccaagaaguuugucaacagaggaccccuacuccaugcaggacagggucucc

SEQ ID NO: 112108 - RNA, 64 nt, Homo Sapiens
gggaucugauugaggauaaaaaggaaggagagaugaccccuacccccucaucccccaguuuuga

SEQ ID NO: 112109 - RNA, 64 nt, Homo Sapiens
ggcuguucucaggaacaggugggcagcuugccuggaccccuaacaggggaggggaagaauugga

SEQ ID NO: 112110 - RNA, 64 nt, Homo Sapiens
ccgagcugguggaaggccccagcaagcagccguggaccccuaagggcgcccuccucacgucagg

SEQ ID NO: 112111 - RNA, 64 nt, Homo Sapiens
uaaauguuucuugucccagcuugcugauuccccagaccccuaauugcaugaugggucuggggcc

SEQ ID NO: 112112 - RNA, 64 nt, Homo Sapiens
gggcaguuugcaaaaugugaucugaggguacggugaccccuagugugacuucugcacccucggu

SEQ ID NO: 112113 - RNA, 50 nt, Homo Sapiens
uccaccccccucccuggcaggaccccuaacugcccucuucggggccguag

SEQ ID NO: 112114 - RNA, 64 nt, Homo Sapiens
acacagguuggaauaaaauauucaaggaggaggagaccccuauuaccccagccaaucgggacag

SEQ ID NO: 112115 - RNA, 64 nt, Homo Sapiens
gguuucagccacaaaacugucauucacucuaggggaccccuacuaaaggguaacuucaggugug

SEQ ID NO: 112116 - RNA, 64 nt, Homo Sapiens
cggcgggcgggugggaggugggaguggcugcagggaccccuagugucccuggucuaucucucca

SEQ ID NO: 112117 - RNA, 64 nt, Homo Sapiens
uaccccuucagccugcccuacagcgacuucccccgaccccuaccccacgcuacccagggcccag

SEQ ID NO: 112118 - RNA, 64 nt, Homo Sapiens
uggcccugccccaaggacucacugcauguacccggaccccuaggccuggccuuugcagcauagu

SEQ ID NO: 112119 - RNA, 64 nt, Homo Sapiens
gcugucaggacaccagccuggugcccauccucccgaccccuacccacuuccauucccguggucu

SEQ ID NO: 112120 - RNA, 64 nt, Homo Sapiens
gaggacacccagccaggcagagcugggauugaaggaccccuauagagaagggcuuggcccccau

SEQ ID NO: 112121 - RNA, 64 nt, Homo Sapiens
cucggacugcgggugacggcccugcccgccaccagaccccuaaaucuuggccaucguguggccg

SEQ ID NO: 112122 - RNA, 64 nt, Homo Sapiens
ugaugggggcccagggacucugaacccuccugaugaccccuauggccaacaucaacccggcacc

SEQ ID NO: 112123 - RNA, 64 nt, Homo Sapiens
caccuggguccccugcaaccucccaucaaaggaugaccccuaaacacagaggagcggggcaggc

SEQ ID NO: 112124 - RNA, 64 nt, Homo Sapiens
uaacuggcuagccauaugcaggauauugaaacuggaccccuauccuucacgauauacaaaaauc

SEQ ID NO: 112125 - RNA, 64 nt, Homo Sapiens
uuauugcccgcucaccucuccccagcccuucccugaccccuaagauauaugcaauucucccucc

SEQ ID NO: 112126 - RNA, 64 nt, Homo Sapiens
cccacccccuuugauccuuuugaucccaggcugggaccccuaccguuaagcacuggaugucucc

SEQ ID NO: 112127 - RNA, 64 nt, Homo Sapiens
uauuuuguaucuuuuuucauugguacucaugauagaccccuaauaaauucuguuuauacuugcc

SEQ ID NO: 112128 - RNA, 64 nt, Homo Sapiens
acagaccaugaggagacgcuccccagucagccuggaccccuaacccccaguggacaccagugaa

SEQ ID NO: 112129 - RNA, 64 nt, Homo Sapiens
aaagaccaccaggacauccuccccagccagccuggaccccuaacccccaguggacaccaaugaa

SEQ ID NO: 112130 - RNA, 64 nt, Homo Sapiens
aaagaccaugaggagaugcuccccagucagccuggaccccuaacccccaguggacaccaaugaa

SEQ ID NO: 112131 - RNA, 64 nt, Homo Sapiens
uuaggaacagggugcugguugagggcccccagcugaccccuacugcagauccgcauguggacca

SEQ ID NO: 112132 - RNA, 64 nt, Homo Sapiens
ugccucgcuccaugggauuggggggccuggcacagaccccuaggaaaggaaaggaggaggugcc

SEQ ID NO: 112133 - RNA, 64 nt, Homo Sapiens
ucucugcugcccccacccugccugcucaagucuagaccccuacugccagaagaggcuggaaccu

SEQ ID NO: 112134 - RNA, 64 nt, Homo Sapiens
aggcagguccgccugugcgggugccccugacuucgaccccuagcuuaugucacagcccgaacca

SEQ ID NO: 112135 - RNA, 64 nt, Homo Sapiens
cuucaacccggagcacugcagccccaauggcaccgaccccuacaagccuaagugccccgagagc

SEQ ID NO: 112136 - RNA, 64 nt, Homo Sapiens
uguaacugagacacccugccuguuagcccugggagaccccuaaccuuggcccaagaccccuuug

SEQ ID NO: 112137 - RNA, 64 nt, Homo Sapiens
gcuuccuuugcccuugcuuugccccagucacgaugaccccuaaauccuugcacucacuuccccu

SEQ ID NO: 112138 - RNA, 64 nt, Homo Sapiens
uggggcagaaaaaacccaucuccauccuacccaugaccccuacucuaagaggcuucuggcagcu

SEQ ID NO: 112139 - RNA, 64 nt, Homo Sapiens
cuuucccaaacccuucgguaccuucuccccuccagaccccuaccuuugucuggcuguggccccu

SEQ ID NO: 112140 - RNA, 64 nt, Homo Sapiens
ugcagaggaagcugcuaaaguaaaaauucucaaagaccccuacccuucaaggauagcaggaaua

SEQ ID NO: 112141 - RNA, 57 nt, Homo Sapiens
acccaccgagacagcgccuucauauuccucagccagagccuggaguaugccaagaac

SEQ ID NO: 112142 - RNA, 57 nt, Homo Sapiens
gccgcacgggaacucauggguguguuacucagccaccacccaccgcuggagccccag

SEQ ID NO: 112143 - RNA, 57 nt, Homo Sapiens
cugggccuuaaaggaugcggacucauccucagccagcgcccauguugugauacaggg

SEQ ID NO: 112144 - RNA, 57 nt, Homo Sapiens
gcagcugccagcacuuggucagucacucucagccauagcacuuuguucacuguccug

SEQ ID NO: 112145 - RNA, 57 nt, Homo Sapiens
ggaaccccaucuucagcccagaggccccucagccacugggcccuuccuuguuucuca

SEQ ID NO: 112146 - RNA, 57 nt, Homo Sapiens
cugggggagccggacauggcccguggacucagccagggagggcugggcagggaggcg

SEQ ID NO: 112147 - RNA, 57 nt, Homo Sapiens
agcgggugacugacuguuccgcaugcccucagccacauaauguaguucucauccucc

SEQ ID NO: 112148 - RNA, 57 nt, Homo Sapiens
gaguaagaaagcccaaaucugugugcccucagccagacaaccugcucacucacaaau

SEQ ID NO: 112149 - RNA, 57 nt, Homo Sapiens
uguuacaagcuacagaauauagguggucucagccaauauaagucaaguugcaguuua

SEQ ID NO: 112150 - RNA, 57 nt, Homo Sapiens
ccugagacuugguauaaaauggcuucccucagccauuccuucugaucaaauaaccau

SEQ ID NO: 112151 - RNA, 57 nt, Homo Sapiens
cuuggauacucacauuaggaagaaggccucagccaugggauuaggcugaaguggcuu

SEQ ID NO: 112152 - RNA, 57 nt, Homo Sapiens
uuugugaguccuucaagagccaucuuccucagccaucuuuuuuucuggacaagcuua

SEQ ID NO: 112153 - RNA, 57 nt, Homo Sapiens
ugggaugugacaagaagcagcucccagcucagccacguucauugcaagugaaggagc

SEQ ID NO: 112154 - RNA, 57 nt, Homo Sapiens
cuucuucaaacaguaguacaagcuccccucagccagccugccugcccagcgaggccc

SEQ ID NO: 112155 - RNA, 57 nt, Homo Sapiens
ccgccccguguggccgcccggguguggcucagccauguccccuccccagguccuuca

SEQ ID NO: 112156 - RNA, 57 nt, Homo Sapiens
uguccccccuucucuuccugagugauucucagccaaguccagacagugcucggcggg

SEQ ID NO: 112157 - RNA, 57 nt, Homo Sapiens
ugugggguccccaggaaagggcaagggcucagccacaucuuggggucugggaggccc

SEQ ID NO: 112158 - RNA, 57 nt, Homo Sapiens
ugcuggccacacucuggagaagcacuucucagccaaggcaccccugcccugggacug

SEQ ID NO: 112159 - RNA, 57 nt, Homo Sapiens
caacauggggugaaccucagcuccagccucagccaagcugcuugcccccccaggucc

SEQ ID NO: 112160 - RNA, 57 nt, Homo Sapiens
gcagagccaaucacagacccacaccagcucagccacacauccccugcacccgcuacc

SEQ ID NO: 112161 - RNA, 57 nt, Homo Sapiens
uucuccacggcagcgaccucaccaguccucagccaccuguggagagcgccucuuccc

SEQ ID NO: 112162 - RNA, 57 nt, Homo Sapiens
gcagggcugcuguggcccagucguccgcucagccaaggagucagauggcaaugggua

SEQ ID NO: 112163 - RNA, 57 nt, Homo Sapiens
ucuagccuaaguguggagaaggauagccucagccacaaaacucugucaggcauugaa

SEQ ID NO: 112164 - RNA, 57 nt, Homo Sapiens
guggguccugggggaaauacgcugagccucagccagcuuuguuuuuguuccuuaacu

SEQ ID NO: 112165 - RNA, 57 nt, Homo Sapiens
aucugccuaagauuaugauuuauccugcucagccaagcacucacccuccccuuguag

SEQ ID NO: 112166 - RNA, 57 nt, Homo Sapiens
cucuggcucagcggggcccaccacgugcucagccaccgcugauggggacccaagcgc

SEQ ID NO: 112167 - RNA, 52 nt, Homo Sapiens
aaaaccaacuccucaucuugaucucagccagagggaccagucuucaguauaa

SEQ ID NO: 112168 - RNA, 57 nt, Homo Sapiens
gccaccauuucagacugagucugcacccucagccacaugaacaaucuccccuaccuc

SEQ ID NO: 112169 - RNA, 57 nt, Homo Sapiens
uuucuuacacccccuccccagcgugcccucagccaagugcuuuggcccggugcuucc

SEQ ID NO: 112170 - RNA, 57 nt, Homo Sapiens
ugggugugcgcagagcuguccccucuccucagccaguagccaaaucugucugcugcu

SEQ ID NO: 112171 - RNA, 57 nt, Homo Sapiens
ucugucugcugcucccucucagagucacucagccaaaugccuuuagagugacccugc

SEQ ID NO: 112172 - RNA, 57 nt, Homo Sapiens
auuguuuacauuccaggagacuuguagcucagccacacacgcaguaaugaccugugc

SEQ ID NO: 112173 - RNA, 57 nt, Homo Sapiens
uaugaauaucuaguccuuucugugguucucagccaagacauaaaaacuaggacucag

SEQ ID NO: 112174 - RNA, 57 nt, Homo Sapiens
acaaaaauacaaaaugcuuguccaggacucagccaugcacaccuugagcagcgccgg

SEQ ID NO: 112175 - RNA, 57 nt, Homo Sapiens
cccccagcaccuugcacauagaagguccucagccaugagggucacucugggcaaaga

SEQ ID NO: 112176 - RNA, 57 nt, Homo Sapiens
cagacaugagacauggcggagaagugacucagccaggggugccagcacgggaucccu

SEQ ID NO: 112177 - RNA, 57 nt, Homo Sapiens
gccccccaucccugaccucacuccuuucucagccaugccccaugcagaggugcucuc

SEQ ID NO: 112178 - RNA, 57 nt, Homo Sapiens
cucuucagccaaaugccccagaaguuccucagccagacucccguccaccccagaggg

SEQ ID NO: 112179 - RNA, 57 nt, Homo Sapiens
uauccagacuguuucagcccagcccaucucagccaacccuccuuagacugagcuguc

SEQ ID NO: 112180 - RNA, 57 nt, Homo Sapiens
gcccauggcaugggcacugcccacaggcucagccagaaccucuugguguacccgaua

SEQ ID NO: 112181 - RNA, 57 nt, Homo Sapiens
ccguguguaggcuuagccucccuguuacucagccacgcgaucucccuauucccuuac

SEQ ID NO: 112182 - RNA, 57 nt, Homo Sapiens
cacgugggcauccacuccuucaggagccucagccagcggggacggaggcggcgggcc

SEQ ID NO: 112183 - RNA, 64 nt, Homo Sapiens
auugagacagcugcaaaacaggcugauuucaauuaggcagcacuucccaaagugcacugaggaa

SEQ ID NO: 112184 - RNA, 64 nt, Homo Sapiens
augugaaguaauagugaaccuaacagucagagacaggcagcaugcucuuaacuagugcucuucc

SEQ ID NO: 112185 - RNA, 64 nt, Homo Sapiens
ccaccagccugcaccacaggcuacacuccccaucaggcagcauccucaauacuuucucaagggg

SEQ ID NO: 112186 - RNA, 64 nt, Homo Sapiens
ggcccacaggauaagccucaucucuuccagagagaggcagcauucuccugggacagaggccauc

SEQ ID NO: 112187 - RNA, 64 nt, Homo Sapiens
aucccaagaaggaaagagcugagguaagaggaagaggcagcagcacacacuggcucaagcagca

SEQ ID NO: 112188 - RNA, 64 nt, Homo Sapiens
aggaggaggaggacuugaacgccgaagaaagaagaggcagcaacggcauaugcugacccaugca

SEQ ID NO: 112189 - RNA, 64 nt, Homo Sapiens
ggaagaacguguacgacgagcuggggggcagcccaggcagcaccagcgcggccacgugcacgcg

SEQ ID NO: 112190 - RNA, 64 nt, Homo Sapiens
agaagaaggcagugggaaaacuggguuuaucucaaggcagcagccugagcccaggagcagagga

SEQ ID NO: 112191 - RNA, 64 nt, Homo Sapiens
cccugcccaaucccagugcagucaaggccaaccuaggcagcagccaccuucucaggaaacaagg

SEQ ID NO: 112192 - RNA, 64 nt, Homo Sapiens
accucaguguccacccuuccugccucaugucucaaggcagcagcuccucucugguaaccugaug

SEQ ID NO: 112193 - RNA, 64 nt, Homo Sapiens
aacuacugggauaagcuucuccuugacaauggaaaggcagcagucuucaacauuugguugcaaa

SEQ ID NO: 112194 - RNA, 64 nt, Homo Sapiens
acaaaccgccccguggccugcaggccugcaggggaggcagcaaagggaccuggcaguugcaaca

SEQ ID NO: 112195 - RNA, 64 nt, Homo Sapiens
gacaauaguuaugccuguaccuaccugagcauucaggcagcacuaaaaugcacaccucaugagu

SEQ ID NO: 112196 - RNA, 64 nt, Homo Sapiens
ccaugaccagaaacagggacaugccagguuaggaaggcagcauuaauauuagcaaagaagcuuc

SEQ ID NO: 112197 - RNA, 64 nt, Homo Sapiens
ggaacccaaaggcaguaaauuuagcaagagaaacaggcagcagauaaagucucagucugaauau

SEQ ID NO: 112198 - RNA, 64 nt, Homo Sapiens
cauaugcuacaagaauuguacacaaagugcuuguaggcagcaacuguggcuguuugccaaggca

SEQ ID NO: 112199 - RNA, 64 nt, Homo Sapiens
ugcagaaacagcccuagacaaggacaaagggagcaggcagcagccuccagcaagagccccaggc

SEQ ID NO: 112200 - RNA, 64 nt, Homo Sapiens
agacccaucucgcggcggggcaccuacucagaugaggcagcagcgcaccucuccuccccucuua

SEQ ID NO: 112201 - RNA, 64 nt, Homo Sapiens
gugccacagccugguucggccuggcggccccaggaggcagcagcaaccuugggcuuccugcggg

SEQ ID NO: 112202 - RNA, 64 nt, Homo Sapiens
cccccccccuaaggugcucguuugggggcucuucaggcagcaccucagccuggcacccccacuc

SEQ ID NO: 112203 - RNA, 64 nt, Homo Sapiens
uaauguguaaguucuagaucuggggcaugugcaaaggcagcacgaagaaaaagggcauuccagc

SEQ ID NO: 112204 - RNA, 64 nt, Homo Sapiens
gaacauguagguuauagaucgggggcauguguggaggcagcacgaagagaaagggcaccccagc

SEQ ID NO: 112205 - RNA, 64 nt, Homo Sapiens
guagagugggcagaccuugugucccgacauugagaggcagcaugagaacaccuguaaauagaug

SEQ ID NO: 112206 - RNA, 64 nt, Homo Sapiens
ggaaaggaauaugggucaguagcauaucaaguuuaggcagcaagugcuuaggugucacuuucuc

SEQ ID NO: 112207 - RNA, 64 nt, Homo Sapiens
ggcauuaaaaaugcauaccacggaaacagaagacaggcagcagaaggggaggggaugugguaag

SEQ ID NO: 112208 - RNA, 64 nt, Homo Sapiens
ugagcagugcccaggggcucgagcagcagggcccaggcagcacacugggagcccuugguguucu

SEQ ID NO: 112209 - RNA, 64 nt, Homo Sapiens
ugcagcaagcgcacccucucagaggagccuccuaaggcagcagcggaggcagaagccuggccac

SEQ ID NO: 112210 - RNA, 64 nt, Homo Sapiens
gcuugaacccgggagguggauacuugggaggcugaggcagcauucacacacccguaguuccagc

SEQ ID NO: 112211 - RNA, 64 nt, Homo Sapiens
caucccugccaccagccagaacccugggaccaagaggcagcaguuguguuggcuacaaaccugc

SEQ ID NO: 112212 - RNA, 64 nt, Homo Sapiens
acagaauauuuaaaaauauauccaggugcuaaauaggcagcagaucucaauucacacaugacua

SEQ ID NO: 112213 - RNA, 64 nt, Homo Sapiens
ucccagagaaagcagacuggcuccaauagauaucaggcagcaaucccaauaaauucugacaugu

SEQ ID NO: 112214 - RNA, 64 nt, Homo Sapiens
uuaacuuaaacuaaaauuuuggguauaugaaagaaggcagcaauucagaaguaaagaagauacu

SEQ ID NO: 112215 - RNA, 64 nt, Homo Sapiens
auaguaauaaaucugaccagcagagggagggaucaggcagcaguguuuagagcacaccacacug

SEQ ID NO: 112216 - RNA, 64 nt, Homo Sapiens
ccauccaucacccaucucacucuccccaguccucaggcagcagcuuuuccaccccaggaaucuc

SEQ ID NO: 112217 - RNA, 64 nt, Homo Sapiens
cuggcaccugaguguccuugcucuagagguucaaaggcagcaaggcagugagcuaugagcccag

SEQ ID NO: 112218 - RNA, 64 nt, Homo Sapiens
ggaucucuuggauaggaguuggugaauagaaggcaggcagcaucacacuggggucacugacaga

SEQ ID NO: 112219 - RNA, 64 nt, Homo Sapiens
caccucagggaacccaugcaucugccuggcauuuaggcagcagagccccugaccgucccccaca

SEQ ID NO: 112220 - RNA, 64 nt, Homo Sapiens
ccucugccagccgggccccggauuugcaggcagcaggcagcacccaaacccuugacucuggcag

SEQ ID NO: 112221 - RNA, 64 nt, Homo Sapiens
cagcaccccucugccagccgcuggcaggauuugcaggcagcaggaggaaagcaaacccuugacu

SEQ ID NO: 112222 - RNA, 64 nt, Homo Sapiens
auugcuugaacccgggagguuacucgagaggcugaggcagcagaaaugugccuguaaucccacc

SEQ ID NO: 112223 - RNA, 64 nt, Homo Sapiens
aaucagucuugucgaacagggggcccuuaaaggaaggcagcaggggacuucgcguuucagggga

SEQ ID NO: 112224 - RNA, 64 nt, Homo Sapiens
aggagcuucuguuuggcauuccagauggaaggacaggcagcacgggagccaggcgcuguggaca

SEQ ID NO: 112225 - RNA, 64 nt, Homo Sapiens
ucauuggccaagggcacuguggauguuuugugggaggcagcauggcaccguggaaagggcagua

SEQ ID NO: 112226 - RNA, 64 nt, Homo Sapiens
cacaguguuaguccaaaggggaaaccagcaggccaggcagcaucggaaggggcuuugggaucug

SEQ ID NO: 112227 - RNA, 64 nt, Homo Sapiens
agucacuuugggggaccaauggugaggaagggggaggcagcaaggggcaaggugucggcgggac

SEQ ID NO: 112228 - RNA, 64 nt, Homo Sapiens
uaggcaccgaccuugggcugcuguuagagaacucaggcagcagcgccagugacacggggcacua

SEQ ID NO: 112229 - RNA, 64 nt, Homo Sapiens
agcgggggugggugguagcgcugggggugauuuuaggcagcaagaauuggagaacucacacugc

SEQ ID NO: 112230 - RNA, 64 nt, Homo Sapiens
caugcacuuuuucuccucugaggauuguacacgcugaugagaauuuacuuuugacccaugugca

SEQ ID NO: 112231 - RNA, 64 nt, Homo Sapiens
uguaugucauguuagcaaacuauuuauuuuuuagugaugagaauuuuuguuuauauugcaguag

SEQ ID NO: 112232 - RNA, 64 nt, Homo Sapiens
cuucucagaaacaaccagccuugaaggcuacaacugaugagaaagauucuguuucgaacauagc

SEQ ID NO: 112233 - RNA, 64 nt, Homo Sapiens
cuucucggaaaaaaccagccuugaaggcuacaagugaugagaaggauucuuuuucgaauauaac

SEQ ID NO: 112234 - RNA, 64 nt, Homo Sapiens
cuucucggaaaaaaccauccuuggaggccacaagugaugagaaggauucuuuuucgaauauaac

SEQ ID NO: 112235 - RNA, 64 nt, Homo Sapiens
cuucugagaaaccaccaggcuugaaggcuacaagugaugagaaagauucuguuuugaauauagc

SEQ ID NO: 112236 - RNA, 64 nt, Homo Sapiens
agaugccacuuacccaagcucauuaaaugaacauugaugagagauguugguuuauuucacuuuu

SEQ ID NO: 112237 - RNA, 64 nt, Homo Sapiens
ugaauacauggaagaguuuugcauguagaccaagugaugagaaggaauccugaccuuagguucg

SEQ ID NO: 112238 - RNA, 64 nt, Homo Sapiens
uaaaauguaagucucuuacagacaucaaguaguuugaugagacagucugugacuucaugauagg

SEQ ID NO: 112239 - RNA, 64 nt, Homo Sapiens
agcuugaacugccagugcaccagcaguuuaggugugaugagagaauucagauauacuuuaucuu

SEQ ID NO: 112240 - RNA, 64 nt, Homo Sapiens
cuucagugaagcggaagaccuuggaaccccuguuugaugagacauuugaauuuuuuguucccau

SEQ ID NO: 112241 - RNA, 64 nt, Homo Sapiens
ugagcugacuccaaauggacagcccagaagcugaugaugagaauucuuaucacucaccuuuaua

SEQ ID NO: 112242 - RNA, 64 nt, Homo Sapiens
aucugugcagcaaagcaccagcuucauaccugggugaugagauggaauagcuaauggaugcugg

SEQ ID NO: 112243 - RNA, 64 nt, Homo Sapiens
acauggacacaugauggggauucugggagcuaaaugaugagaacuuuugucuauguugaaaauu

SEQ ID NO: 112244 - RNA, 64 nt, Homo Sapiens
auauuuugaaucccccaaguucccuuggaccuacugaugagagauaguuuuauguauggggaaa

SEQ ID NO: 112245 - RNA, 64 nt, Homo Sapiens
aaucaguuguaaacaauggcaucuuugaacagugugaugagaauaggaaugugguguuuuaaag

SEQ ID NO: 112246 - RNA, 64 nt, Homo Sapiens
aaugagcagagcauugauguaaauugcccuuguuugaugagaggacugcccauugaaacugaca

SEQ ID NO: 112247 - RNA, 64 nt, Homo Sapiens
acuuaaugauuuccaauuaacacuguaaaaagguugaugagauucccuccauagcccugccacc

SEQ ID NO: 112248 - RNA, 64 nt, Homo Sapiens
ccacacuuuacacucguggucgugggugcaaaagugaugagaccggagaaaccaacaggcaaaa

SEQ ID NO: 112249 - RNA, 64 nt, Homo Sapiens
gcuuuggcauagccucaauauaugggagucacugugaugagaugugccuaauguuaauuugaua

SEQ ID NO: 112250 - RNA, 64 nt, Homo Sapiens
aaguccuuuuuggaaguugcagaauuauuagcuuugaugagaacaacuuuugucauagauuuga

SEQ ID NO: 112251 - RNA, 64 nt, Homo Sapiens
uuugaugaggucggcggagcaguucacuagccaaugaugagagcagaaaggccuagaccugcag

SEQ ID NO: 112252 - RNA, 64 nt, Homo Sapiens
ggaugagugauucacccucuuacuuggcgaccacugaugagaucaacaacaggugaacuauaaa

SEQ ID NO: 112253 - RNA, 64 nt, Homo Sapiens
cuuuuggcaacugaaggaccaagaagggaaacggugaugagagagacugcucauuguaacuuuc

SEQ ID NO: 112254 - RNA, 64 nt, Homo Sapiens
cuuacaaggaguugaaaagauuaaugucccaaccugaugagauuacggccuugagacaauaagg

SEQ ID NO: 112255 - RNA, 64 nt, Homo Sapiens
caaaguggaaugaagcucugaggaagaugggagcugaugagaauguucugaaacucuguggagg

SEQ ID NO: 112256 - RNA, 64 nt, Homo Sapiens
aucuugagguucuuggaauuucagguucugccgaugaugagaggugaaggaggucuaccccgac

SEQ ID NO: 112257 - RNA, 64 nt, Homo Sapiens
gggaaaacauacuaaugggggucuuucugugaugugaugagacauacauguaaguguauauaug

SEQ ID NO: 112258 - RNA, 64 nt, Homo Sapiens
ucuugaauaucuccugcgguguauauuaacaucuugaugagacagauuuccaggcaacaaaaua

SEQ ID NO: 112259 - RNA, 64 nt, Homo Sapiens
gugccaaguaaugugaaugcuaauacugcuuaagaaaauuaaguuacuuuugcaaaacagauaa

SEQ ID NO: 112260 - RNA, 64 nt, Homo Sapiens
gaauucccaagugccaggaguaggauuucauuauaaaauuaauagcuaaucuuauucuaucucc

SEQ ID NO: 112261 - RNA, 64 nt, Homo Sapiens
acuucagacuuucaagauuauucuaaaucaccagaaaauuaauuucaguuucuauugggaguuu

SEQ ID NO: 112262 - RNA, 64 nt, Homo Sapiens
acuuuuaaauuucucuucuaccagcaacuugggaaaaauuaaauaugggugggggagaccuaaa

SEQ ID NO: 112263 - RNA, 64 nt, Homo Sapiens
uuaauaggacaguaaaucuguguggggcuagaacaaaauuaagacauguuuggcaauauuucag

SEQ ID NO: 112264 - RNA, 64 nt, Homo Sapiens
gaguucuuugcuuucauuaacuuggauucauuuaaaaauuaaucuucccuguuaggcugauuuc

SEQ ID NO: 112265 - RNA, 64 nt, Homo Sapiens
uuaaaaaugauguuaacccaagaaguagacaucaaaaauuaaaaaaaaaaaaaggaauguguuu

SEQ ID NO: 112266 - RNA, 64 nt, Homo Sapiens
ggucuagauucaguuaugaauguaggcauuaguuaaaauuaacaagaugcagaguauuaauuuc

SEQ ID NO: 112267 - RNA, 64 nt, Homo Sapiens
uaaaauucaguauaguuugaaagcggcacaauuaaaaauuaauuuucuaacaaaguugggaggu

SEQ ID NO: 112268 - RNA, 64 nt, Homo Sapiens
caugcacauagaugagaugaaucugcauuguaaaaaaauuaaaucacauuuagugcuguauaau

SEQ ID NO: 112269 - RNA, 64 nt, Homo Sapiens
agugcuguauaauuugcaugcaauaaaauucaauaaaauuaaauguaaaauuaaaugaguuuug

SEQ ID NO: 112270 - RNA, 64 nt, Homo Sapiens
acaugacgaaacuccaucucuaucaaaaauacaaaaaauuaacuagguguggugcugcacgccu

SEQ ID NO: 112271 - RNA, 64 nt, Homo Sapiens
ucugggcuggguaacagagugagauccugucucaaaaauuaauuaauuaauuaauuaaaauaaa

SEQ ID NO: 112272 - RNA, 64 nt, Homo Sapiens
acauuuccuauauuuugacagagauacugcuggaaaaauuaaaauuaaaaugccauaauagcua

SEQ ID NO: 112273 - RNA, 64 nt, Homo Sapiens
ccuauauuuugacagagauacugcuggaaaaauuaaaauuaaaaugccauaauagcuaccuaac

SEQ ID NO: 112274 - RNA, 64 nt, Homo Sapiens
ggcacuuaaaacauaaaauucauuauccuauuaaaaaauuaaauucagcuuugcuaauccagaa

SEQ ID NO: 112275 - RNA, 64 nt, Homo Sapiens
ggcucucaagucuucccaaggccagaaucgaaagaaaauuaaaauuugaaugcugaauauucug

SEQ ID NO: 112276 - RNA, 64 nt, Homo Sapiens
uaaugcaauaagguuauacauaguuaugaacuguaaaauuaaagucaguaugaacuauaauaaa

SEQ ID NO: 112277 - RNA, 64 nt, Homo Sapiens
gugauguagcuuucuucuguaacaguuauguuuuaaaauuaagugaguuuuuuuuuugccuuag

SEQ ID NO: 112278 - RNA, 64 nt, Homo Sapiens
cuucuuacacauaaugguguuguaauuuuaugguaaaauuaaucgucaagacauggaggguguu

SEQ ID NO: 112279 - RNA, 64 nt, Homo Sapiens
gugagguaaaauaaguuuauaaguguaggauuuuaaaauuaaauuuuucucuaacccuuaacua

SEQ ID NO: 112280 - RNA, 64 nt, Homo Sapiens
cuucacuuucugugcaaguaauaauuuuaaugugaaaauuaaguuauaaaaguaggaaacaggu

SEQ ID NO: 112281 - RNA, 64 nt, Homo Sapiens
cacacaugaacugcacaccuaagaaggcacuuuuaaaauuaacauaaaauuaaguaauuuuuua

SEQ ID NO: 112282 - RNA, 64 nt, Homo Sapiens
aauuuuuuaaagaaggcacucacuuuuauuuuuuaaaauuaagugucaccugaggaaguuuccc

SEQ ID NO: 112283 - RNA, 64 nt, Homo Sapiens
agaauacaaauauuccagccauaaaugaaguaaaaaaauuaaaaacauauuagaaacucuucua

SEQ ID NO: 112284 - RNA, 64 nt, Homo Sapiens
ugauuacagguagaggccuuaaauugucuuuagaaaaauuaaugacauuuaucuucaaaacacc

SEQ ID NO: 112285 - RNA, 64 nt, Homo Sapiens
ggauaucuugaaauauacagaauucaaggauugaaaaauuaacuacauuuguugacuuaaauuu

SEQ ID NO: 112286 - RNA, 64 nt, Homo Sapiens
gugucauauuauauucuuuaugcugcuccucuuaaaaauuaaauucacaauggacacagaaugc

SEQ ID NO: 112287 - RNA, 64 nt, Homo Sapiens
auuaacagcugagguagcuaaaguuauuuaaaauaaaauuaaauuuaugauccaaguagcuuau

SEQ ID NO: 112288 - RNA, 64 nt, Homo Sapiens
ugaacagaagugcacaggcuacuuguacagagaaaaaauuaauacucaaaggaaaucuucauuu

SEQ ID NO: 112289 - RNA, 64 nt, Homo Sapiens
uggaguuaggaauuucaugaaccucacuaugaccaaaauuaauuuuuugauucaguuugucugu

SEQ ID NO: 112290 - RNA, 64 nt, Homo Sapiens
cuauuuuuuguauaccuuguucuuugugaucuauaaaauuaaacuggauaaaauguuaauuggg

SEQ ID NO: 112291 - RNA, 64 nt, Homo Sapiens
gacaaauuuuaccuuaaaaccaaaaugaaacacaaaaauuaauccuuaauaaugauagcaagug

SEQ ID NO: 112292 - RNA, 64 nt, Homo Sapiens
ucugugugaaagccuuuuucuucuuugauuuaaaaaaauuaacuauacaguuaaugguuuagaa

SEQ ID NO: 112293 - RNA, 64 nt, Homo Sapiens
uuaucugugugucugacgugccaucuuuaauguuaaaauuaagguguuaaaauuaagccuaguu

SEQ ID NO: 112294 - RNA, 64 nt, Homo Sapiens
gacgugccaucuuuaauguuaaaauuaagguguuaaaauuaagccuaguuauauagacgaaaua

SEQ ID NO: 112295 - RNA, 64 nt, Homo Sapiens
caguuccuuucauaauaucucagcaccagaaacaaaaauuaagauuaucaaagcauuuugaaua

SEQ ID NO: 112296 - RNA, 64 nt, Homo Sapiens
ucagaaccauucacauuuaauucaauucuuggaaaaaauuaaagcuuuuugcccacaauuugca

SEQ ID NO: 112297 - RNA, 64 nt, Homo Sapiens
gcuuuagugucuggggcaaguccucucaauggcuaaaauuaacuuuagagauccauguguucag

SEQ ID NO: 112298 - RNA, 64 nt, Homo Sapiens
uuuaauauugggaaaauuaugauaaaaugcuuuaaaaauuaauaugccagauuaaaauaacuga

SEQ ID NO: 112299 - RNA, 64 nt, Homo Sapiens
ggugaaaccccgucucuauuaaaaauauuuuuuaaaaauuaacugagcgugguggugggcgccu

SEQ ID NO: 112300 - RNA, 64 nt, Homo Sapiens
agucuuuauccaagucaccacuuagaacaaaguuaaaauuaaaauugaaaucaugacaagcagu

SEQ ID NO: 112301 - RNA, 64 nt, Homo Sapiens
cuuuauaauaaaacacuuuuaaguauagaacauuaaaauuaauaugagaccagugguucccacu

SEQ ID NO: 112302 - RNA, 64 nt, Homo Sapiens
uuucauuuuaggcuauuggcuuaugugaacaagcaaaauuaaaaaggggaaaaaaaacccaaaa

SEQ ID NO: 112303 - RNA, 64 nt, Homo Sapiens
acccaagcauugaucuguguagcuucuccaggauaaaauuaaaagcuucguugcgaacuugauc

SEQ ID NO: 112304 - RNA, 64 nt, Homo Sapiens
auuugcaugaacacagaugaaauuaaaaauauguaaaauuaauaaugagaauuuugaggaaaaa

SEQ ID NO: 112305 - RNA, 64 nt, Homo Sapiens
auauguaaaauuaauaauuugaauuuugaggaaaaaaauuaaaagauugccaaccaauagauga

SEQ ID NO: 112306 - RNA, 64 nt, Homo Sapiens
acaacguauuccuuuguaguccuuugaauuuguuaaaauuaaaaaaugcugcugauaugacaca

SEQ ID NO: 112307 - RNA, 64 nt, Homo Sapiens
ccacuuauuugaaaacaaaguuucuauaagaagaaaaauuaagauaauaaacugauuuaaacuu

SEQ ID NO: 112308 - RNA, 64 nt, Homo Sapiens
guuuagauauauuuauaauaaccugaaagcugcaaaaauuaauguaaaugaagugcuggacuuu

SEQ ID NO: 112309 - RNA, 64 nt, Homo Sapiens
aaugaaauuaaaaauaaaaucucuacaaaaaguaaaaauuaaaagcaacauagcaaaaucucau

SEQ ID NO: 112310 - RNA, 59 nt, Homo Sapiens
ugaaaaaggaaauauucuuuguguuccuuaaaauuaaguuacuuagccaaaaugauuaa

SEQ ID NO: 112311 - RNA, 64 nt, Homo Sapiens
aauuuuguuuguuauuguugaaaauucugucucaaaaauuaaagggugacugaccacaaagaag

SEQ ID NO: 112312 - RNA, 64 nt, Homo Sapiens
uacuguguacccccccccccuuuuuauuuguuuuaaaauuaaaaaaucuuugacaaacaaauua

SEQ ID NO: 112313 - RNA, 64 nt, Homo Sapiens
uuucugaaaaccaaugcgaccaucugauuuuuaaaaaauuaaaaaacauacaacuuccaaaagg

SEQ ID NO: 112314 - RNA, 64 nt, Homo Sapiens
cgauagguaacauguuuguaaaaaggggauuaguaaaauuaaugaagaaauauggaggaagguu

SEQ ID NO: 112315 - RNA, 64 nt, Homo Sapiens
gcaaguuauaucagugaaguauauacuggguauuaaaauuaaaauuugaacaucucaaaguuau

SEQ ID NO: 112316 - RNA, 64 nt, Homo Sapiens
cuauauugaaagcauuuuuauguuuucuaauuuaaaaauuaauauuuucuuauagauauugugc

SEQ ID NO: 112317 - RNA, 64 nt, Homo Sapiens
augcuuuaacagcugauaaaaauuuuacauuuguaaaauuaauauauuguacugguacaaaaua

SEQ ID NO: 112318 - RNA, 64 nt, Homo Sapiens
uuugaauaaauucuuccuguagguaaugggaaacaaaauuaauaguucauaugucacucauagc

SEQ ID NO: 112319 - RNA, 64 nt, Homo Sapiens
uuugaaaguagcccaauauaaaacuuuugauucuaaaauuaaaccagcagccuauuacaagcac

SEQ ID NO: 112320 - RNA, 64 nt, Homo Sapiens
auaacuuaaaaaaugcuuuacuacuaaaauguaaaaaauuaaugugcucaccucggcagcacau

SEQ ID NO: 112321 - RNA, 64 nt, Homo Sapiens
aauuaaugugcucaccucggcagcacauauacuaaaaauuaauaagacccagcuugaaaauuga

SEQ ID NO: 112322 - RNA, 64 nt, Homo Sapiens
guuagcauauuuuccagccacaugaucaaccuacaaaauuaauaccauuucugaacaccaguaa

SEQ ID NO: 112323 - RNA, 64 nt, Homo Sapiens
augaaaaauguaaaaguaccuagaaauucacaaaaaaauuaauaccucuguggagaaaacuuca

SEQ ID NO: 112324 - RNA, 64 nt, Homo Sapiens
cauauaccaaaaauauaugaggcaaauuuuagcaaaaauuaaaauucuuaagaaaacuucacua

SEQ ID NO: 112325 - RNA, 64 nt, Homo Sapiens
aagauuguguaugagagccuuuucuuacaaggugaaaauuaagaccugaaggacauuguaauca

SEQ ID NO: 112326 - RNA, 64 nt, Homo Sapiens
guuuuucuccugaaauguuuugaugguuaucuuuaaaauuaauggugcuaggauaccugaaacc

SEQ ID NO: 112327 - RNA, 64 nt, Homo Sapiens
uauaagcagaucacauguaacuguuauaaaguauaaaauuaagaaagcuuuuagguauuagaag

SEQ ID NO: 112328 - RNA, 64 nt, Homo Sapiens
uuuuagguauuagaagcuguaagaauaauuguuaaaaauuaagccucugggaaacuaccacuca

SEQ ID NO: 112329 - RNA, 64 nt, Homo Sapiens
uguaaucaaccuucuagguuccaucucaguaauaaaaauuaagcaacacgauaaguuuacuccu

SEQ ID NO: 112330 - RNA, 64 nt, Homo Sapiens
uucugacaguugugaucgccauccugguuagaagaaaauuaaugaaacaaaacccacauuuccu

SEQ ID NO: 112331 - RNA, 64 nt, Homo Sapiens
aggagcacaaagucagggauauacuucaguuggaaaaauuaaacucccuguuuucauaaagcua

SEQ ID NO: 112332 - RNA, 64 nt, Homo Sapiens
gauuauaaaauaugugcuacuaucuucuuugagaaaaauuaauuauucaggucuucugcuacau

SEQ ID NO: 112333 - RNA, 64 nt, Homo Sapiens
ccuuuagcuucuugaagauuuagaaguuauauaaaaaauuaauuuaaaagcaaaccaaaagagg

SEQ ID NO: 112334 - RNA, 64 nt, Homo Sapiens
aggauuaaacaguuacaagccuccaaauucaaauaaaauuaaaucacaguucagaugaaacuga

SEQ ID NO: 112335 - RNA, 64 nt, Homo Sapiens
uguuacuccaaaggacaugaaaaagcucaagaguaaaauuaaaauucucaaaaaaaaaccccac

SEQ ID NO: 112336 - RNA, 64 nt, Homo Sapiens
auggaucuuugggccuuuccucaguguucaugcaaaaauuaaaugucuuuuuucagcauacuga

SEQ ID NO: 112337 - RNA, 64 nt, Homo Sapiens
uccaaaaccaaaaaaagugccuguggauguauauaaaauuaagaugauaagaaagugcuccuga

SEQ ID NO: 112338 - RNA, 64 nt, Homo Sapiens
gaaauauucaauugagacuugaggggaauaauagaaaauuaagguagauccccaauauuuugga

SEQ ID NO: 112339 - RNA, 64 nt, Homo Sapiens
gaaaacuuaauaaauugcuacuguuuuauaucauaaaauuaaaauaccaugguaauauuugcaa

SEQ ID NO: 112340 - RNA, 64 nt, Homo Sapiens
uuauauaggucccugcacagauuggacuugaaccaaaauuaaguccaaagaacauauguuuaga

SEQ ID NO: 112341 - RNA, 64 nt, Homo Sapiens
cauuuacaaguuccaguuauguguguaaaacagaaaaauuaaguaccaaaccuauuaggaaauu

SEQ ID NO: 112342 - RNA, 64 nt, Homo Sapiens
guauagauuaaaaacacucaguagaaaagaaucuaaaauuaaaugaauuuguuuugccauuaaa

SEQ ID NO: 112343 - RNA, 64 nt, Homo Sapiens
gaguugcaauagccaaguauagagagaauagugaaaaauuaaucuugcccuuucaagccuuaua

SEQ ID NO: 112344 - RNA, 64 nt, Homo Sapiens
uuguaucuugacacaggaaaugggaaaaaacuuaaaaauuaauaugguguauuuuuccaaauga

SEQ ID NO: 112345 - RNA, 64 nt, Homo Sapiens
uaaguucuauaacuaguacucaagguuuaaccuuaaaauuaagauuuccuuaaccuuaaccuua

SEQ ID NO: 112346 - RNA, 64 nt, Homo Sapiens
ucaggagaagagaaggaauuugaagagaaaaaggaaaauuaaaauuacuaauuaauuuuuagau

SEQ ID NO: 112347 - RNA, 64 nt, Homo Sapiens
uuuuuguuucguuuuguuucuucuucugcauuuaaaaauuaaaagauugguuugaggaugugau

SEQ ID NO: 112348 - RNA, 64 nt, Homo Sapiens
augaauuuucugcuuuaaaggcauguguguuuuuaaaauuaaugaauguagaugugugauuguc

SEQ ID NO: 112349 - RNA, 64 nt, Homo Sapiens
auagagauguugucauaacuaggucuucaacgugaaaauuaauuuuuauuguaucaugucaagu

SEQ ID NO: 112350 - RNA, 64 nt, Homo Sapiens
caaaagauuuaugaugaacauauuuuuaaaacucaaaauuaaugauaccuaauauuuaagugaa

SEQ ID NO: 112351 - RNA, 64 nt, Homo Sapiens
gagcagcaaaugaaaggaguaaggggaauauuuuaaaauuaagauuuuuuaagguuuaauaacu

SEQ ID NO: 112352 - RNA, 64 nt, Homo Sapiens
uugcccagguuucugacaggcaguucuaguucuuaaaauuaaauacgacugccaccaggagaug

SEQ ID NO: 112353 - RNA, 64 nt, Homo Sapiens
gcuucacuugaauuuaaaccuccagacugguaagaaaauuaauggaagugacaugucagaacag

SEQ ID NO: 112354 - RNA, 64 nt, Homo Sapiens
acuguauuugaauauuuugugggaaaaauagaaaaaaauuaauguuguugguugccacagcuug

SEQ ID NO: 112355 - RNA, 64 nt, Homo Sapiens
uauauucaaauguauuacaagaaguaauauguggaaaauuaaaauguuuuaauuuuuaaauuga

SEQ ID NO: 112356 - RNA, 64 nt, Homo Sapiens
uaaaguugcuggucagucuuaauauauaaaacacaaaauuaaaaaacugacaaaauauuuuaaa

SEQ ID NO: 112357 - RNA, 64 nt, Homo Sapiens
cacauuccuuggaacagagccuuuuaucugggcaaaaauuaaaagugugugcaaagcuuauuuu

SEQ ID NO: 112358 - RNA, 64 nt, Homo Sapiens
uaaguugagaaaaauuuauaagccaaagguucagaaaauuaaacuacagaauauuaaauauuau

SEQ ID NO: 112359 - RNA, 64 nt, Homo Sapiens
aauauuauaaugugcccaaagcucugaauaguuaaaaauuaaauauuuauuuucuuccccaagc

SEQ ID NO: 112360 - RNA, 64 nt, Homo Sapiens
aguauuuuuuaacaugugugaaggacauuacuagaaaauuaaaccaauguaucagcuuuuuuua

SEQ ID NO: 112361 - RNA, 64 nt, Homo Sapiens
ugcauagcugcuuugcaguguauaugaguacugaaaaauuaagugcuuuuccuccauuaauaca

SEQ ID NO: 112362 - RNA, 64 nt, Homo Sapiens
aguaaauuuaacuccaaguucacugacagauucuaaaauuaaguaauuuauagaaccauaucaa

SEQ ID NO: 112363 - RNA, 64 nt, Homo Sapiens
auuuauagaaccauaucaacaaauuuaaauuaaaaaaauuaaaauaaagaauuaaaaauuuuaa

SEQ ID NO: 112364 - RNA, 64 nt, Homo Sapiens
aauaccauauuaguauuauagaauaacuuccaacaaaauuaauguuuaguauuuuaggaccugu

SEQ ID NO: 112365 - RNA, 64 nt, Homo Sapiens
gaggcaguagaaacuuaaucagauuagguuagcuaaaauuaauaaaaaagaaaaacugaugauu

SEQ ID NO: 112366 - RNA, 64 nt, Homo Sapiens
gcauuuuaaagguuaaaacauaucuacagagagaaaaauuaauguuuuugccacugcaaacaua

SEQ ID NO: 112367 - RNA, 64 nt, Homo Sapiens
uuuaaaauguuuuuguaacaugaaaauacuagauaaaauuaaugaucuugaaauaguaauagua

SEQ ID NO: 112368 - RNA, 64 nt, Homo Sapiens
gaaggaaugauaagaauaaaaaauauauauagacaaaauuaaaagaacuagaagcuauuacuaa

SEQ ID NO: 112369 - RNA, 64 nt, Homo Sapiens
aacauaucuacuuauauguuucucuuuuagaccuaaaauuaauuauacuauuauaucugggacc

SEQ ID NO: 112370 - RNA, 64 nt, Homo Sapiens
uuucuuuuugaaauuaccaugcauuagaaaaauuaaaauuaauugcaaguauggucuugauaau

SEQ ID NO: 112371 - RNA, 64 nt, Homo Sapiens
uuaauuuuucuuuuugaaaugauaaugcauuagaaaaauuaaaauguuaagcaaguauggucuu

SEQ ID NO: 112372 - RNA, 64 nt, Homo Sapiens
ggcugguuacuaaggugccugcuagccauuguauaaaauuaaaacaugaagaauauuuuuuuuu

SEQ ID NO: 112373 - RNA, 64 nt, Homo Sapiens
uguaacuuuauucuuuuuucuccugcugaaaaaaaaaauuaaaccaaucguaugaaaguuuggu

SEQ ID NO: 112374 - RNA, 64 nt, Homo Sapiens
acaugcauuuaucaucauugagauugguuugcuuaaaauuaacuuauuuuguagaagacaaaau

SEQ ID NO: 112375 - RNA, 64 nt, Homo Sapiens
uuuguguguauauaugugccucacaccugaauugaaaauuaaagacugguuuaaaagugguuua

SEQ ID NO: 112376 - RNA, 64 nt, Homo Sapiens
gcauacccuuauagaauuggaauaugauuucucaaaaauuaauuugauaauuucauguaugaug

SEQ ID NO: 112377 - RNA, 64 nt, Homo Sapiens
ucugaguaaaagguauuuucauauauguugggggaaaauuaacucaucuaaaaagaaucuuauu

SEQ ID NO: 112378 - RNA, 64 nt, Homo Sapiens
cacuauuaauuacauuaaaauauuugcuccuuugaaaauuaaauuguuuucucuuguuuguaau

SEQ ID NO: 112379 - RNA, 64 nt, Homo Sapiens
gugauaaccuuugaaccuugggugauaaguguugaaaauuaaauauaaauugagagaagaagaa

SEQ ID NO: 112380 - RNA, 64 nt, Homo Sapiens
acuuuuuccccaaaggcaugauuuauugugcauuaaaauuaaauuauuuuguaagcuauaacau

SEQ ID NO: 112381 - RNA, 64 nt, Homo Sapiens
aaauuuuaauuaaaaaaucauggaaagaacauuuaaaauuaaauaauauaccuaccucuuccgu

SEQ ID NO: 112382 - RNA, 64 nt, Homo Sapiens
uuauugucugauugaaacauagaaauauauuaugaaaauuaagaugaauacuccuguuaguagc

SEQ ID NO: 112383 - RNA, 64 nt, Homo Sapiens
ugagcacaucaagauuuuuuuccaguguuaucuaaaaauuaaucagucucugaaagcagaacua

SEQ ID NO: 112384 - RNA, 64 nt, Homo Sapiens
aaauauuuuccuuaaauaugaugaucuuauuguuaaaauuaauguauauuugucaaauaaaauc

SEQ ID NO: 112385 - RNA, 64 nt, Homo Sapiens
uucggaugcuuuauuuauaguuaccauuagcucuaaaauuaagaauuuaggaauuauuuaaaag

SEQ ID NO: 112386 - RNA, 64 nt, Homo Sapiens
uguauuuuaccacguuucuuuuuauaaugaagguaaaauuaaaauuucuuacgccucauuuuaa

SEQ ID NO: 112387 - RNA, 64 nt, Homo Sapiens
uccaguuccuuguugcauggauauuaaauuuauuaaaauuaaaaaaguaucaguuuaaaaauuu

SEQ ID NO: 112388 - RNA, 64 nt, Homo Sapiens
gagccuuuccaucaauuguuggguaaucuacucuaaaauuaauacaaugcugauggggaguagg

SEQ ID NO: 112389 - RNA, 64 nt, Homo Sapiens
cauuuucaggaaaaucagauugcauuuacaucauaaaauuaaacaaguuuuuacuucuaagauu

SEQ ID NO: 112390 - RNA, 64 nt, Homo Sapiens
gauaacaaacuaaguuacuucuaaucuuuuccuuaaaauuaauauuauuauuuuuuuccuuuuu

SEQ ID NO: 112391 - RNA, 64 nt, Homo Sapiens
cacaguucugucaccuaaagauauagggaagaauaaaauuaaccaaauuuggaaaauacagaaa

SEQ ID NO: 112392 - RNA, 64 nt, Homo Sapiens
cuaaaauuagcugcaaagaauuagaugagagagaaaaauuaaagaaugugcaauugauauguuu

SEQ ID NO: 112393 - RNA, 64 nt, Homo Sapiens
agacucucaacauacuguuuucauauuuacucuaaaaauuaaaguucuaaagcuauccauugug

SEQ ID NO: 112394 - RNA, 64 nt, Homo Sapiens
cagagcugaucuucuuggggcgauggaaauucuaaaaauuaauacuguugcucaaucuaaucuu

SEQ ID NO: 112395 - RNA, 64 nt, Homo Sapiens
cuauguguucaguuuucuugauuguucuuauuuuaaaauuaacaaaaguuggcucuacauaaac

SEQ ID NO: 112396 - RNA, 64 nt, Homo Sapiens
cagaggcuucuacaacauggagccugguuugugcaaaauuaaauauaggcguuuuguucauaug

SEQ ID NO: 112397 - RNA, 64 nt, Homo Sapiens
gaacgggaaaagcuuuuugcuuauuugucuuuugaaaauuaaggcugggcgcgguggcucacac

SEQ ID NO: 112398 - RNA, 64 nt, Homo Sapiens
caacagagacucugucucaaaaaaaaaaaaaaaaaaaauuaaccucaaccaaacgccuauuuuu

SEQ ID NO: 112399 - RNA, 64 nt, Homo Sapiens
aaaaaagcuaagaaaacugagaacuaacauuaaaaaaauuaaauuuagaauaagaaugauuucu

SEQ ID NO: 112400 - RNA, 64 nt, Homo Sapiens
ucauauuauuuuuagaugauguaacauagccaucaaaauuaauauuauguaaugccuaauacuu

SEQ ID NO: 112401 - RNA, 64 nt, Homo Sapiens
ugcaagugaaguaaauauaaaaauaauuuaauccaaaauuaagucuauauaaauaucagagaau

SEQ ID NO: 112402 - RNA, 64 nt, Homo Sapiens
uuauaguaagagaaaaccauuuuuaaucuuaguuaaaauuaaagugaauuaguaguauaucauu

SEQ ID NO: 112403 - RNA, 64 nt, Homo Sapiens
gcauuauuuaugccccuuucuguggaagaguaagaaaauuaaaauacaagaugcaugaggaaaa

SEQ ID NO: 112404 - RNA, 64 nt, Homo Sapiens
auucuuuugcaguauagugagaaaaaaacauuuuaaaauuaauuaucauuuuguugauugugcu

SEQ ID NO: 112405 - RNA, 64 nt, Homo Sapiens
auaaacaaaucauuguuuauuacuggucacuuagaaaauuaaaagggauagggccaggcacagu

SEQ ID NO: 112406 - RNA, 64 nt, Homo Sapiens
acagagcaagacuccgucucaaagaaacaaacaaaaaauuaaaagggauagaauauaaugaaau

SEQ ID NO: 112407 - RNA, 64 nt, Homo Sapiens
ugcuaucaagaauaaaccauuuuugcuugcacugaaaauuaaauuacagugggcagguauuugc

SEQ ID NO: 112408 - RNA, 64 nt, Homo Sapiens
ugcuaucaagagcaaacuauuuuugcuugcacugaaaauuaaaugugagcagguauguguuugc

SEQ ID NO: 112409 - RNA, 64 nt, Homo Sapiens
agaagagcacccugaaaaacuacacuuaauaaaaaaaauuaaacauaaaaaucauuggcacagu

SEQ ID NO: 112410 - RNA, 64 nt, Homo Sapiens
cauauuuguuacguaaaguuuugaaaguuguaaaaaaauuaaagaguacagcuauaauaguauc

SEQ ID NO: 112411 - RNA, 64 nt, Homo Sapiens
auggauggaucuucucugaaaugcccaggcuuuaaaaauuaaaauucagaaucuguugugagaa

SEQ ID NO: 112412 - RNA, 64 nt, Homo Sapiens
aggcagauaagacauaaauauguaucugaauuuuaaaauuaaaaaagaaagcaggauuuucucc

SEQ ID NO: 112413 - RNA, 64 nt, Homo Sapiens
aauuuuuuaaauaaaugcaugauaaacuuuacauaaaauuaacuucuacauacucauuugacug

SEQ ID NO: 112414 - RNA, 64 nt, Homo Sapiens
auauuucuacagagaaaauguagcgcacccagagaaaauuaauuauuuguuaugguuacauauu

SEQ ID NO: 112415 - RNA, 64 nt, Homo Sapiens
gcuccaaauuuaaccauaaaaaacaggaggggaaaaaauuaacucuuguuucuuguuauuacca

SEQ ID NO: 112416 - RNA, 64 nt, Homo Sapiens
uguuuugguuuuuuuuuuucuugcaguugucuuaaaaauuaaaguaauccauuguuugaggugc

SEQ ID NO: 112417 - RNA, 64 nt, Homo Sapiens
guagacuccaggauacaaacuuaugcauuuccuuaaaauuaauucagguugcacacaguuuugu

SEQ ID NO: 112418 - RNA, 64 nt, Homo Sapiens
gugguuuuaaaaguuccucucagauuugguauuaaaaauuaaauucacuucuguaauagugcaa

SEQ ID NO: 112419 - RNA, 64 nt, Homo Sapiens
uuaaaacuaaguuauuccaaugucaacaugcuagaaaauuaauuauuacauucaguaagaaaga

SEQ ID NO: 112420 - RNA, 64 nt, Homo Sapiens
ugauaagcaaaaugaaagaaauaaugauuaagggaaaauuaagugacuguguuacacugcuucu

SEQ ID NO: 112421 - RNA, 64 nt, Homo Sapiens
uaaccuguauugauacugacuugaauuauuuucuaaaauuaagagccguauaccuaccuguaag

SEQ ID NO: 112422 - RNA, 64 nt, Homo Sapiens
uugcguacauggcaaauccugcaaauauagauuaaaaauuaaauuagcccauugaaauccuuua

SEQ ID NO: 112423 - RNA, 64 nt, Homo Sapiens
ugucaguguuuccuucuauaaacuguucuuuggaaaaauuaaguuauacauaaaauucauauua

SEQ ID NO: 112424 - RNA, 64 nt, Homo Sapiens
ggagccccaccccccgucucuacaaaaaaauuuaaaaauuaacugggcaugguggcugaggugg

SEQ ID NO: 112425 - RNA, 64 nt, Homo Sapiens
caacuuuuuuagagacagccugucucuuaaaaaaaaaauuaauuugguagugagagcuuguguc

SEQ ID NO: 112426 - RNA, 64 nt, Homo Sapiens
aaagaacaaaguaguaaaauaaaaaaaaauuuaaaaaauuaaaaaauaaaaaaaagaggucacu

SEQ ID NO: 112427 - RNA, 64 nt, Homo Sapiens
ucucauuuuuagagaagucaaauagccaaccaucaaaauuaagaauaaauugaauugucacagu

SEQ ID NO: 112428 - RNA, 64 nt, Homo Sapiens
acuuuaaagugaguuugagaaacaaguugaaacuaaaauuaaaauaccagccauuuaggugcuu

SEQ ID NO: 112429 - RNA, 64 nt, Homo Sapiens
cuauaaugcuuauuaugguaaaauaaaauuggaaaaaauuaaaacugaccuauaagaguguuaa

SEQ ID NO: 112430 - RNA, 64 nt, Homo Sapiens
ucaccaauaaaggguggauguugacuagguuaucaaaauuaaccggaaaaaaauggacaaccuc

SEQ ID NO: 112431 - RNA, 64 nt, Homo Sapiens
gauaauuuauagacaguuaaccagccaacauuuuaaaauuaauguaaaagggguagccucuacu

SEQ ID NO: 112432 - RNA, 64 nt, Homo Sapiens
auuuugcauuuuacauuuaaaguuugcauauuuaaaaauuaaucgauuauugagaaaauguagc

SEQ ID NO: 112433 - RNA, 64 nt, Homo Sapiens
guguguuuacaacuguuuucugcagauaaagaaaaaaauuaagaaucuuuuaaaaauauuaucu

SEQ ID NO: 112434 - RNA, 64 nt, Homo Sapiens
ugauuuuuuuuauugccuuguuuaauauguaucaaaaauuaaaaggaggaacugacuaagaugu

SEQ ID NO: 112435 - RNA, 64 nt, Homo Sapiens
aaucauucagaucaucccccuacacucucaaaagaaaauuaagaauuccugggggggaucaugc

SEQ ID NO: 112436 - RNA, 64 nt, Homo Sapiens; identical to SEQ ID NO: 112293

SEQ ID NO: 112437 - RNA, 64 nt, Homo Sapiens; identical to SEQ ID NO: 112294

SEQ ID NO: 112438 - RNA, 64 nt, Homo Sapiens
gaugguuaauuguugcugcuucaaaaauaaguauaaaauuaauauguaaggaagcccauucuuu

SEQ ID NO: 112439 - RNA, 64 nt, Homo Sapiens
cuuuuaaaaaacccacaaaaugcugauucaguucaaaauuaaugcaaauguuucaaaacugggu

SEQ ID NO: 112440 - RNA, 64 nt, Homo Sapiens
cuaguuauauagacgaaauaaaaauuaagguguuaaaauuaagcgacgugccaucuuuaauguu

SEQ ID NO: 112441 - RNA, 64 nt, Homo Sapiens
uguuaaaauuaagccuaguuccaucuuuaauguuaaaauuaagguuaucugugugucugacgug

SEQ ID NO: 112442 - RNA, 64 nt, Homo Sapiens
auaccuguuaaguucguaucauuguggaauacagaaaauuaaauugaguccugcuucuagcucc

SEQ ID NO: 112443 - RNA, 64 nt, Homo Sapiens
ccauuuucgaagccaccuggaucaaugccauguaaaaauuaauuuuguauugaaauaguaacuu

SEQ ID NO: 112444 - RNA, 64 nt, Homo Sapiens
acaaaguguauacauguauuuacuuaugccauagaaaauuaaacagcaauucauaaaaacugcu

SEQ ID NO: 112445 - RNA, 64 nt, Homo Sapiens
aaaguaaaaaauaaaaauagucuguauuaaaaauaaaauuaauaaaaaugccccuuacugaaaa

SEQ ID NO: 112446 - RNA, 64 nt, Homo Sapiens
cuaaauuauaaucauuuuaguagagcagcaggagaaaauuaauaauaguaagaauuuaucagau

SEQ ID NO: 112447 - RNA, 64 nt, Homo Sapiens
ccuuuugucauauuucuaguuaauuccaccaaccaaaauuaaucguuaagacuuaaaagccaua

SEQ ID NO: 112448 - RNA, 64 nt, Homo Sapiens
uaaucucuaauccuacuaccgaagcaaaaauaagaaaauuaaaagaggaaaacugaccaaaaca

SEQ ID NO: 112449 - RNA, 64 nt, Homo Sapiens
auuggcaccucaaugauaaagaaauuuaagguauaaaauuaaauguaaaaauuaauuucagcuu

SEQ ID NO: 112450 - RNA, 64 nt, Homo Sapiens
ugauaaagaaauuuaagguauaaaauuaaauguaaaaauuaauuucagcuucauuucguauuuc

SEQ ID NO: 112451 - RNA, 64 nt, Homo Sapiens
cacucuacaucguucacgagucuggggagcggacaaaauuaaaagacugcgaguacccgcugau

SEQ ID NO: 112452 - RNA, 64 nt, Homo Sapiens
aguuugaaaugccggugcuggacaguuuuguugaaaaauuaaaagaagaggaagaaagagaaau

SEQ ID NO: 112453 - RNA, 64 nt, Homo Sapiens
aaaccaguuaggucucaauaccugaagcuaucguaaaauuaagaaaggauaaaguugguaaacc

SEQ ID NO: 112454 - RNA, 64 nt, Homo Sapiens
aaauguuuuuuuuuaaagacuuuuaugauacuugaaaauuaacaugaauauuuaguguucauaa

SEQ ID NO: 112455 - RNA, 64 nt, Homo Sapiens
uguucagcaaccugaaugguuauuuuuguuaauuaaaauuaaauuuuuaagagauauuuucaaa

SEQ ID NO: 112456 - RNA, 64 nt, Homo Sapiens
cauuacaugauuaugaaaugacugugaagaauauaaaauuaaacuuagugacuuaauuagucac

SEQ ID NO: 112457 - RNA, 64 nt, Homo Sapiens
aaaaacaaacauuauuggaguuucaguguaaaauaaaauuaaaauuggaggguugguuagauug

SEQ ID NO: 112458 - RNA, 64 nt, Homo Sapiens
guagcccaggauugcuacaaaaagguccuuugagaaaauuaauuugugcuugcuuuuauccccu

SEQ ID NO: 112459 - RNA, 64 nt, Homo Sapiens
ugugggagcugcacguuuacgaggaaagaagaaaaaaauuaauggugugcagauaccaaaagag

SEQ ID NO: 112460 - RNA, 64 nt, Homo Sapiens
ggggccaagaggaagacauuaaauaaaaacauaaaaaauuaagaugcugccaaagauuaaaaau

SEQ ID NO: 112461 - RNA, 64 nt, Homo Sapiens
agaggugaacacaauuauuuaauacgugugcauaaaaauuaaauucaaaaggaagcuuguuugu

SEQ ID NO: 112462 - RNA, 64 nt, Homo Sapiens
cagcaagaaagcauuaguaagaaagacuuaaccuaaaauuaaacgccuuugcuguuguggauag

SEQ ID NO: 112463 - RNA, 64 nt, Homo Sapiens
cacaguucguuucuucucaccaugaaagaaaugcaaaauuaaauguuauacaugauaaacuuuu

SEQ ID NO: 112464 - RNA, 64 nt, Homo Sapiens
aaaaaucucaguccccuccguugguuucaaaagcaaaauuaaaccauuuugacuauaacugugc

SEQ ID NO: 112465 - RNA, 64 nt, Homo Sapiens
aaauuauuauaaccuuucagcucugucucaaaaaaaaauuaaaugccugggugacagagugaga

SEQ ID NO: 112466 - RNA, 64 nt, Homo Sapiens
uaaauuuaaauacaaaaaaacucugccucaaaaaaaaauuaaaagccugggcaacagagcaaga

SEQ ID NO: 112467 - RNA, 64 nt, Homo Sapiens
guucuccuuagaugugagagaaagagaaaucagaaaaauuaauucucuugggggaagggcuuga

SEQ ID NO: 112468 - RNA, 64 nt, Homo Sapiens
aaauaagaaagcccuaaaauacuauuggagagaaaaaauuaacuagguugcuacuuuauuugcc

SEQ ID NO: 112469 - RNA, 64 nt, Homo Sapiens
aauaaaaauacuucuauuauaauuaaaauguaaaaaaauuaaaguaaguucugaaaauugaaaa

SEQ ID NO: 112470 - RNA, 64 nt, Homo Sapiens
uguaaaaaaauuaaagaauauucugaaaauugaaaaaauuaaaacaauaguucaaaaaauuaag

SEQ ID NO: 112471 - RNA, 64 nt, Homo Sapiens
ucugaaaauugaaaaaauuauagcaauaguucaaaaaauuaaguaaauccuugcuuuuaagugu

SEQ ID NO: 112472 - RNA, 64 nt, Homo Sapiens
uccagcaucccaagaucauuacuuucuugcuucaaaaauuaaaaaggaaauaugucccccccua

SEQ ID NO: 112473 - RNA, 64 nt, Homo Sapiens
aguacaauaagcagagguggcagguauaaaaccuaaaauuaagauaauagagucacagcuuucc

SEQ ID NO: 112474 - RNA, 64 nt, Homo Sapiens
aauauauuuuuuaauaaacaaugcagcagguguaaaaauuaauaaguguuaauagucuugugcu

SEQ ID NO: 112475 - RNA, 64 nt, Homo Sapiens
ugugauggccacuucuaauaucacacuuagggaaaaaauuaaaauuuuaauaagacggucaacu

SEQ ID NO: 112476 - RNA, 64 nt, Homo Sapiens
ugaugaaacaaaaguuugacgccugcugaauaacaaaauuaaaaucaguaauuuaacaaaggga

SEQ ID NO: 112477 - RNA, 64 nt, Homo Sapiens
cgaauccauccgcuuguaggggaaaaaaaggaaaaaaauuaaccagagagggucuguaaucucg

SEQ ID NO: 112478 - RNA, 64 nt, Homo Sapiens
guaacaucucagaaauuucauccagaggaacaaaaaaauuaaaaauagaacauagcaaagcaaa

SEQ ID NO: 112479 - RNA, 64 nt, Homo Sapiens
aauuagccaggcaugguggccccaucucuacaaaaaaauuaaaacaugggcaacaugacaagac

SEQ ID NO: 112480 - RNA, 64 nt, Homo Sapiens
acugauucuucugcagagcaauagauacauuaaaaaaauuaaaaugaucaacuuauuccauuaa

SEQ ID NO: 112481 - RNA, 64 nt, Homo Sapiens
auuagaaugugagaaauuuaaaauuuaaaaaauaaaaauuaaauaucauaccuagcagguaaua

SEQ ID NO: 112482 - RNA, 64 nt, Homo Sapiens
ggguagacacaguugagagugggaagaaagaaaaaaaauuaaaacgguuaacuguaaaguuagg

SEQ ID NO: 112483 - RNA, 64 nt, Homo Sapiens
ccucuaaaaucagauccccucaguccaugaacagaaaauuaaggaaguuugguuuuacuuuuaa

SEQ ID NO: 112484 - RNA, 64 nt, Homo Sapiens
caacuguuaaacuaaaaaccauguuuuuaacaauaaaauuaaaaucuccaacuacauccuuaug

SEQ ID NO: 112485 - RNA, 64 nt, Homo Sapiens
uuucuucaauacaauaauaguaaugagucagagaaaaauuaauucuuaccacacugccacauuu

SEQ ID NO: 112486 - RNA, 64 nt, Homo Sapiens
cccccaccaacccccuucuacugccuacuuuaaaaaaauuaauaguuuucuauggaacugaucu

SEQ ID NO: 112487 - RNA, 64 nt, Homo Sapiens
uaauaguuuucuauggaacugaucuaagauuagaaaaauuaauuuucuuuaauuucauuaugaa

SEQ ID NO: 112488 - RNA, 64 nt, Homo Sapiens
uuuuauuaauuuguugcuagaaacuauuuguauaaaaauuaagcaagaauucaaauuuguaaua

SEQ ID NO: 112489 - RNA, 64 nt, Homo Sapiens
auauauauauauuaguaauuuccaaaaauagucaaaaauuaaauuuccuguggaauaaagaugg

SEQ ID NO: 112490 - RNA, 64 nt, Homo Sapiens
gcaauuaucuuucagaugcaaagugaaaauuuagaaaauuaaaaaaucugccuuuauguugcau

SEQ ID NO: 112491 - RNA, 64 nt, Homo Sapiens
ugaaacaaaaugucccaacuuguuaacauaaccaaaaauuaaauuccucuuuagagguaauuuu

SEQ ID NO: 112492 - RNA, 64 nt, Homo Sapiens
caaucauuaauggaucauacacaauagguuuuuaaaaauuaauaacuuuuaguaauuacuuuua

SEQ ID NO: 112493 - RNA, 64 nt, Homo Sapiens
caaccauuaaugaaucauacacaauagguuuuuuaaaauuaauauuaauaacuuuuauuaauuu

SEQ ID NO: 112494 - RNA, 64 nt, Homo Sapiens
agcaaaucaguauauuuucuguauuuaauuauaaaaaauuaacuuaguuuuuaaaauuuauuug

SEQ ID NO: 112495 - RNA, 64 nt, Homo Sapiens
uguauuuuggaggugcuugaucuaucuacaaagaaaaauuaauuaggaauuacuuuauuauaaa

SEQ ID NO: 112496 - RNA, 64 nt, Homo Sapiens
auacuagccuagaaauauagagcauuaacaaaguaaaauuaauauauuaaguuauaauuggaau

SEQ ID NO: 112497 - RNA, 64 nt, Homo Sapiens
uaugucagaaguuucuuuuuacauucauaucuuaaaaauuaaagaaacugauuuuagcucaugu

SEQ ID NO: 112498 - RNA, 64 nt, Homo Sapiens
aguaaacacucuguaguaacguucugguuaacuaaaaauuaaccaauuaucuaugggaugugug

SEQ ID NO: 112499 - RNA, 64 nt, Homo Sapiens
agcugacuuuauauuugguguaacuaaauuucagaaaauuaagaagaauucuuauuaacucaaa

SEQ ID NO: 112500 - RNA, 64 nt, Homo Sapiens
aaauugcaaguuaagaaauagguaagaguacugaaaaauuaauauuucuuaguaguauauaaaa

SEQ ID NO: 112501 - RNA, 64 nt, Homo Sapiens
cguacuuaagccaggagaauuuuuuuucugugaaaaaauuaaaauuuuauuugccugaaauaua

SEQ ID NO: 112502 - RNA, 64 nt, Homo Sapiens
gacauguugggcugcaugauaaaaguuaauuauaaaaauuaaaagauuuuuuuuuuugagaugg

SEQ ID NO: 112503 - RNA, 64 nt, Homo Sapiens
ugggauuauaggcguaagccaccaugccuggccaaaaauuaaaagauuuuaugaaacgaaaugg

SEQ ID NO: 112504 - RNA, 64 nt, Homo Sapiens
augguuauuucuguuuuaguaggauggucuccaaaaaauuaauggaacuuuugagagagaugaa

SEQ ID NO: 112505 - RNA, 64 nt, Homo Sapiens
gaucuuuugcuagcuauuggucauggaucuggcaaaaauuaagaagugagaugaaacuuccccu

SEQ ID NO: 112506 - RNA, 64 nt, Homo Sapiens
uuaacuggucacaaauguuagcagauuuauuuugaaaauuaaaguuacuaacaugcaaaauacu

SEQ ID NO: 112507 - RNA, 64 nt, Homo Sapiens
aaaccaagaugcugugauuuauugcguuaaaaaaaaaauuaacuccacgcauuguuuuuaaagc

SEQ ID NO: 112508 - RNA, 64 nt, Homo Sapiens
acagaauguuuuugguaauauuaauuuccacuaaaaaauuaaaugucuuuuaagaaacauucuu

SEQ ID NO: 112509 - RNA, 64 nt, Homo Sapiens
gucuuuuaagaaacauucuuuuccacuuguuaaaaaaauuaaauauauuuuaaagcacuuuaag

SEQ ID NO: 112510 - RNA, 64 nt, Homo Sapiens
augaaaugaagugagaagggaaguuuagagaaaaaaaauuaaaaagaaacaaagucuccaagaa

SEQ ID NO: 112511 - RNA, 64 nt, Homo Sapiens
acuaaaugcccacaagagaaagcaggaaagauccaaaauuaacacccuaacaucacaauuaaaa

SEQ ID NO: 112512 - RNA, 64 nt, Homo Sapiens
acucaaggaaauagagacacaaaaaaaccuucaaaaaauuaauguauccaggagcugguuuuuu

SEQ ID NO: 112513 - RNA, 64 nt, Homo Sapiens
gcugaaacuggaucccuuccuuacaccuuauacaaaaauuaauucaagauggauuaaagacuua

SEQ ID NO: 112514 - RNA, 64 nt, Homo Sapiens
ugcagauacauuaaauaugaaagauauucaauccaaaauuaagucuauguaaauaucagggaau

SEQ ID NO: 112515 - RNA, 64 nt, Homo Sapiens
uuauuaugaaugaaaagcauucuuaauuuuaguuaaaauuaaguuagucauauguuauuuuauu

SEQ ID NO: 112516 - RNA, 64 nt, Homo Sapiens
uuuaucaccucaauuaucucuuuuuuguguugagaaaauuaaaaauucauuguuccagcaguuu

SEQ ID NO: 112517 - RNA, 64 nt, Homo Sapiens
agggcaacagagugagacccugucuccaaaaaaaaaaauuaaauaaauaccuuucuuuguuucu

SEQ ID NO: 112518 - RNA, 64 nt, Homo Sapiens
acaccuguaugcacacaaacuagaaaaccuagaaaaaauuaauaaauuccuugaaagauauaac

SEQ ID NO: 112519 - RNA, 64 nt, Homo Sapiens
ugccuguuggguacuaugcugauuaccuggggacaaaauuaacuguacaccaaacuccugcaac

SEQ ID NO: 112520 - RNA, 64 nt, Homo Sapiens
acaaauaauccugccuuuuaaaaaaauuaaaauuaaaauuaaaagacagagcaagacugucuca

SEQ ID NO: 112521 - RNA, 64 nt, Homo Sapiens
uuaaaaacaaauaauccugcgucucaaaaaaauuaaaauuaaaacugggcgacagagcaagacu

SEQ ID NO: 112522 - RNA, 64 nt, Homo Sapiens
uuaaaauuaaaaacaaauaaaagacugucucaaaaaaauuaaaaucuagccugggcgacagagc

SEQ ID NO: 112523 - RNA, 64 nt, Homo Sapiens
guuaugaugaauguuacauuauauuuuuccagagaaaauuaaauuuauauuacauaaagucuuu

SEQ ID NO: 112524 - RNA, 64 nt, Homo Sapiens
uuuuuguuguaaauggacuauguccaauucuuuuaaaauuaaugcaauuuagcccauaacacug

SEQ ID NO: 112525 - RNA, 64 nt, Homo Sapiens
gauuuuuacaaguugguaaacacagccauuauaaaaaauuaaaugauuuaaauuuauaauuaag

SEQ ID NO: 112526 - RNA, 64 nt, Homo Sapiens
cauacccuuuaucucuguaaaauuuauacacacaaaaauuaacaaaagauucuguaagaauuaa

SEQ ID NO: 112527 - RNA, 64 nt, Homo Sapiens
aaucauuaauaguuaaaaugaaguaccuuuaaggaaaauuaauauaugugacacacacacuccu

SEQ ID NO: 112528 - RNA, 64 nt, Homo Sapiens
cuuuucuccuguguaucuuuguuugauuucagacaaaauuaaccuauuuauuagcccuaauugu

SEQ ID NO: 112529 - RNA, 64 nt, Homo Sapiens
uagugaguucuuucaggagcccugcaaccaaaugaaaauuaauaagcuugagucaauuucugug

SEQ ID NO: 112530 - RNA, 64 nt, Homo Sapiens
gaauggugccugguacuagcggugaaauagcaauaaaauuaauagucauguaucauugguuuga

SEQ ID NO: 112531 - RNA, 64 nt, Homo Sapiens
aacggguaacaugguaaauuuauagaaaauuuaaaaaauuaaaacccugucucuaaagaaaaac

SEQ ID NO: 112532 - RNA, 64 nt, Homo Sapiens
uauaaaguauuuuaaguuaggguacuacaaauuaaaaauuaaaguugaugcauuauaacuuaaa

SEQ ID NO: 112533 - RNA, 64 nt, Homo Sapiens
uuuuuuuuuugguugaccacucccccacacuuccaaaauuaaacaguguuuucuuagcaucuug

SEQ ID NO: 112534 - RNA, 64 nt, Homo Sapiens
guaugugugggguuuuuuucuuuauuuuuaaaugaaaauuaagacaccuuuuguguggacaugu

SEQ ID NO: 112535 - RNA, 64 nt, Homo Sapiens
cugguuuuauaaacugaguuucuuagcauucguuaaaauuaagggguuuguuuggaauaauaua

SEQ ID NO: 112536 - RNA, 64 nt, Homo Sapiens
cagguuggguuaauuaaagcuuuugguauaauuuaaaauuaaauuuauaaaugcaguugucuug

SEQ ID NO: 112537 - RNA, 64 nt, Homo Sapiens
aauucaagccagcauauuccuaguagauggaagcaaaauuaaguugucuuuguagaaaaugaag

SEQ ID NO: 112538 - RNA, 64 nt, Homo Sapiens
aagcauauugguguuuucucaauuagucacugagaaaauuaacacuuuaggcaguggcuauuua

SEQ ID NO: 112539 - RNA, 64 nt, Homo Sapiens
accaauaugguuuucuuuaugucuuggcugcuugaaaauuaaaaaaaaaaaagguuuguucaau

SEQ ID NO: 112540 - RNA, 64 nt, Homo Sapiens
cuuuacuucugggaauuuguauguaacagccuagaaaauuaaaaggagguggaugcauccaaag

SEQ ID NO: 112541 - RNA, 64 nt, Homo Sapiens
cuucuuaacuuuuaacuaucagaguuugauuaauaaaauuaauuaauguuuuuucuccuucgug

SEQ ID NO: 112542 - RNA, 64 nt, Homo Sapiens
gucacacacacaaaaaauccuuuucaauccugagaaaauuaaaggcguuuuacucacauggcua

SEQ ID NO: 112543 - RNA, 64 nt, Homo Sapiens
aucugcucagaaaaauguaugugcacaaauaaaaaaaauuaauggcaauuguuuagugauugua

SEQ ID NO: 112544 - RNA, 64 nt, Homo Sapiens
uggaaaagauguucaugguacauuguaaaaaaauaaaauuaaaauuaaaaaaaguuugcagaac

SEQ ID NO: 112545 - RNA, 64 nt, Homo Sapiens
agauguucaugguacauuguaaaaaaauaaaauuaaaauuaaaaaaaguuugcagaaccgcaua

SEQ ID NO: 112546 - RNA, 64 nt, Homo Sapiens
cuuuuagaaacuuaucuuacaaaguguauuuuauaaaauuaaagaaaauaaaauuaagaauguu

SEQ ID NO: 112547 - RNA, 64 nt, Homo Sapiens
cuuacaaaguguauuuuauaaaauuaaagaaaauaaaauuaagaauguucucaaucaaacaucg

SEQ ID NO: 112548 - RNA, 64 nt, Homo Sapiens
uauccaugagcaccaggcuuugcucacuuaaaaaaaaauuaagccacauuaaggagugagucuu

SEQ ID NO: 112549 - RNA, 64 nt, Homo Sapiens
uuaaggagugagucuucuuuuuuacaauaauguaaaaauuaaacuguuuacauuuuuuuaaagc

SEQ ID NO: 112550 - RNA, 64 nt, Homo Sapiens
cuguuuacauuuuuuuaaagcauuguaguuuuuaaaaauuaagcuguuuuguuuuguguuguug

SEQ ID NO: 112551 - RNA, 64 nt, Homo Sapiens
ugaucauguuguugaugguuagcauauguuucugaaaauuaaauauguauuauuaaaaguuggu

SEQ ID NO: 112552 - RNA, 64 nt, Homo Sapiens
auauaguuaguuuucagcucauuuaaaagaggcaaaaauuaaaagcuuggagagauaguuuccu

SEQ ID NO: 112553 - RNA, 64 nt, Homo Sapiens
uaucuucuggaguuuuugggaggagagaaacuggaaaauuaaauuguauuuuugccagaagacu

SEQ ID NO: 112554 - RNA, 64 nt, Homo Sapiens
uuuuucauuauuagcuauccuucuuaaaauuucaaaaauuaaaaaccagcaucugaauuucaag

SEQ ID NO: 112555 - RNA, 64 nt, Homo Sapiens
acuguaaaagaaagguguccaagagcaauuuaucaaaauuaaacaucaaugcugauucugagaa

SEQ ID NO: 112556 - RNA, 64 nt, Homo Sapiens
aaaaaaaaucugccacuuauauucaaaaaaauuaaaaauuaaaauuugugaugcagcuaccaug

SEQ ID NO: 112557 - RNA, 64 nt, Homo Sapiens
auuaaaaaaaaaaaaucugcuaccaugauucaaaaaaauuaaaauggagcuuuugugaugcagc

SEQ ID NO: 112558 - RNA, 64 nt, Homo Sapiens
auucucuguaagcacuguagaugguguuaaucugaaaauuaauggccuaagaauaaaaauugaa

SEQ ID NO: 112559 - RNA, 64 nt, Homo Sapiens
uuuacucuagugaagugguuugccuaucacacguaaaauuaauaccuaacccuccacauacauu

SEQ ID NO: 112560 - RNA, 64 nt, Homo Sapiens
cauccaauaccccuuuacuagcaauuauuaaaucaaaauuaauuuuuuuaguuuagauugugag

SEQ ID NO: 112561 - RNA, 64 nt, Homo Sapiens
aauuuaggaaagaauaaagacauaaaauugucauaaaauuaauauuaugccugcuuuuagcaac

SEQ ID NO: 112562 - RNA, 64 nt, Homo Sapiens; identical to SEQ ID NO: 112540

SEQ ID NO: 112563 - RNA, 64 nt, Homo Sapiens
cuucuuaacuauuaacuaucagaguuugauuaauaaaauuaauuaauuuuuuuucuccuucgug

SEQ ID NO: 112564 - RNA, 64 nt, Homo Sapiens
ucacacacacaaaaaaauccuuuucaauccugagaaaauuaaagguguuuuacucacauggaua

SEQ ID NO: 112565 - RNA, 64 nt, Homo Sapiens
aucugcucagaaaaauguaugugcacaaauaaaaaaaauuaauggcaauuguuuagugacugua

SEQ ID NO: 112566 - RNA, 64 nt, Homo Sapiens
aauauucuaucuggaauagggacaggggaucuuuuauuuauaaucucaucagaugagugaguug

SEQ ID NO: 112567 - RNA, 64 nt, Homo Sapiens
agauauuuuauguuuuuuuaauuuucuccaagaauauuuauagaauuccaaagaaucagaauag

SEQ ID NO: 112568 - RNA, 64 nt, Homo Sapiens
auagugagaugcacacuuauauauauacuguauauauuuauauauuuauauauauauuucauau

SEQ ID NO: 112569 - RNA, 64 nt, Homo Sapiens
augcacacuuauauauauacuguauauauuuauauauuuauauauauauuucauauauauauau

SEQ ID NO: 112570 - RNA, 64 nt, Homo Sapiens
gucuuguaauauauuuauuuacaaaacacuucauuauuuauaaagaauuuacuaacaguuuauc

SEQ ID NO: 112571 - RNA, 64 nt, Homo Sapiens
cauuauuuauaaagaauuuacuaacaguuuaucuuauuuauacccauacaucugcuacuuuggg

SEQ ID NO: 112572 - RNA, 64 nt, Homo Sapiens
gcauucuuuuugccaaauaugaccaaauuacuuuuauuuauaauuuuugauuuauauuucagcu

SEQ ID NO: 112573 - RNA, 64 nt, Homo Sapiens
aauguucugguaucuuugaaaaauguaaauaguuuauuuauagagaacccuaccucugagguug

SEQ ID NO: 112574 - RNA, 64 nt, Homo Sapiens
aggacacugagccauccgugggucaggaugcaauuauuuauaaaagucuccaggugaacauggc

SEQ ID NO: 112575 - RNA, 64 nt, Homo Sapiens
uuggcauuuuuauguuuuaagaaaaacaguauuuuauuuauaauaaaaucugaauauuuguaac

SEQ ID NO: 112576 - RNA, 64 nt, Homo Sapiens
guguuguguuaugccuacaugugauauaaauuaauauuuauauucauuuauauuuauauuuuug

SEQ ID NO: 112577 - RNA, 64 nt, Homo Sapiens
acaugugauauaaauuaauauuuauauucauuuauauuuauauuuuugaacuuauuuauuuaaa

SEQ ID NO: 112578 - RNA, 64 nt, Homo Sapiens
agaaaguuaauaacauugacuccauauuuuggccuauuuauauaugaagacucaaugaauacuu

SEQ ID NO: 112579 - RNA, 64 nt, Homo Sapiens
auucaucgauaccauuauucaaaaauguauaauguauuuauaauagaaaaguuuaauuacaguu

SEQ ID NO: 112580 - RNA, 64 nt, Homo Sapiens
auguaucucuaaggaccuaagaucauaagccgcuuauuuauaucccuauguauuuaucguucuu

SEQ ID NO: 112581 - RNA, 64 nt, Homo Sapiens
aauuccuacagcuuuccccugcucccucuacagauauuuauaucuugaaauugcugauuguucu

SEQ ID NO: 112582 - RNA, 64 nt, Homo Sapiens
augcugaacucaaugugcaauugguauguggccauauuuauagagacaagaauauguucacauc

SEQ ID NO: 112583 - RNA, 64 nt, Homo Sapiens
uuuuauauuaauuuguuuuuaauaauuucaucccuauuuauaguaaaaugaaaaaucuuuuuuu

SEQ ID NO: 112584 - RNA, 64 nt, Homo Sapiens
aauaauugaaaaaaauuuucauuacagauaauaguauuuauauauauuuuuaaaucaaacgcug

SEQ ID NO: 112585 - RNA, 64 nt, Homo Sapiens
uaauuuuagcuaucuguaacaaagcagagaauuuuauuuauagcuauacacuuauuuuaaguga

SEQ ID NO: 112586 - RNA, 64 nt, Homo Sapiens
aaacuccuuauguuacuuaauaauuauuuaauaauauuuauauuaugaaccaugucuauuaauu

SEQ ID NO: 112587 - RNA, 64 nt, Homo Sapiens
aaccaugucuauuaauuuaaugaucauauuuauuuauuuauaugacugaacuguagaagucuaa

SEQ ID NO: 112588 - RNA, 64 nt, Homo Sapiens
aaguuguauuagcauacucuuuauauauuauuuauauuuauauuuauauaugcagagagagagc

SEQ ID NO: 112589 - RNA, 64 nt, Homo Sapiens
uauauuaaguuguauuagcagagagcuuauauauuauuuauauuuauguguauauaugcagaga

SEQ ID NO: 112590 - RNA, 64 nt, Homo Sapiens
gcuuuugaaugaguguaaauuguuuucuuuuguguauuuauacuuguauguaugauuugcaugu

SEQ ID NO: 112591 - RNA, 64 nt, Homo Sapiens
aaaagaaaagauuacugacugugcauuguaccuguauuuauaguuuaugguuaucaggaagcuc

SEQ ID NO: 112592 - RNA, 64 nt, Homo Sapiens
gauuguuuaauuguaggucaaugaaauauuugcuuauuuauauucagagauguaccauguuaaa

SEQ ID NO: 112593 - RNA, 64 nt, Homo Sapiens
cgucuuguauuuucuucccauuuguaauguaucuuauuuauauaugaaguaaguucugaaaacu

SEQ ID NO: 112594 - RNA, 64 nt, Homo Sapiens
gccaaagagaaaagauuaaaauuagugagauuuguauuuauauuagagugcccuuaaaauaaug

SEQ ID NO: 112595 - RNA, 64 nt, Homo Sapiens
aaacaaaacuuugagagcagcacaugcauccagguauuuauagauuauugccagugucuuuucu

SEQ ID NO: 112596 - RNA, 64 nt, Homo Sapiens
gauaucuaucuaucuagauuucugaaccaagauauauuuauaguucacuuuuggguuuuuauac

SEQ ID NO: 112597 - RNA, 64 nt, Homo Sapiens
uuuucaccagacugaguuagugguggcuuauaccuauuuauauuuguauuaauugcuuacagau

SEQ ID NO: 112598 - RNA, 64 nt, Homo Sapiens
uggauuucuguugcuugacuauuuucuuagugaauauuuauacuaagguagugacugagauuug

SEQ ID NO: 112599 - RNA, 64 nt, Homo Sapiens
gaagauaacuuaaacagaaaagaaaacuugccucuauuuauaauacacuuucauaugauugugc

SEQ ID NO: 112600 - RNA, 64 nt, Homo Sapiens
ugaauuuuugcacaaaauauaaaaucagccucauuauuuauaguauuucugugaguuuuguaug

SEQ ID NO: 112601 - RNA, 64 nt, Homo Sapiens
auugcuauaaaucgacaaaagugacaaaguuauauauuuauaaauauuuugcuucaggauccaa

SEQ ID NO: 112602 - RNA, 64 nt, Homo Sapiens
auaaaucaaucuuauuacugguuucuuuugauaguauuuauaaucaauggaaacuuuaggucua

SEQ ID NO: 112603 - RNA, 64 nt, Homo Sapiens
uaugaauauauccagggacuggagucuguaacuuuauuuauacuaauuacauuuuuguaacaaa

SEQ ID NO: 112604 - RNA, 64 nt, Homo Sapiens
uagauauauguagcuuucuauauacauauguaaauauuuauauaauaacaagaaaguaucuaua

SEQ ID NO: 112605 - RNA, 64 nt, Homo Sapiens
uauauuuaagauaauuauaaauuauuuauauauguauuuauaaacgaaauguuauuuuuuaauu

SEQ ID NO: 112606 - RNA, 64 nt, Homo Sapiens
uguauuuauaaauauauuuauauuuuuuaauuauuauuuauauagaaggcaaagcacgaaaugu

SEQ ID NO: 112607 - RNA, 64 nt, Homo Sapiens
uauaaaaugaugauauauaaugaauucugagcauuauuuauaaguuucugcacuugacccuauu

SEQ ID NO: 112608 - RNA, 64 nt, Homo Sapiens
cuuacugaugucaguuauugugccuucaacuggauauuuauagugaguaguaaaugcuuccacg

SEQ ID NO: 112609 - RNA, 64 nt, Homo Sapiens
auuagagaauaaacuuuuuaaucugccuucuugauauuuauagauguaaaauaaaauaaaacac

SEQ ID NO: 112610 - RNA, 64 nt, Homo Sapiens
uguaaacuuuuuuuguaagauagggaauguuguauauuuauauagaagugcaaucaauaggaau

SEQ ID NO: 112611 - RNA, 64 nt, Homo Sapiens
accccuuauaguucauggagaccaaaauuugggguauuuauaauagucagcgcaggaaugcaca

SEQ ID NO: 112612 - RNA, 64 nt, Homo Sapiens
uauacaaaaguguuuuccacuaauuuugcaugcguauuuauaagaaaaaugugaauuugguggu

SEQ ID NO: 112613 - RNA, 64 nt, Homo Sapiens
uuuucugguuugcaccaugaauuugucaaauggauauuuauaggaauauauucacuacuuugua

SEQ ID NO: 112614 - RNA, 64 nt, Homo Sapiens
uaccauagucaagguaccgccuugcugaaguauuuauuuauaaagaauauucuguagaaccucu

SEQ ID NO: 112615 - RNA, 64 nt, Homo Sapiens
agguguuuuucauucacuuuaauagaagggcaaauauuuauaagcuauuucuguaccaaagugu

SEQ ID NO: 112616 - RNA, 64 nt, Homo Sapiens
acaaacauguaagcauaacuuauuuuaaaauauuuauuuauauaacuugguaaucaugaaagca

SEQ ID NO: 112617 - RNA, 64 nt, Homo Sapiens
ugagauaaucaauuuuaacccaaagucauuggauuauuuauaugaaguccauaauguucgagua

SEQ ID NO: 112618 - RNA, 64 nt, Homo Sapiens
ucauggggaaacaaacauuauuuuguuuuugguuuauuuauacuauauucugcauacaguacuu

SEQ ID NO: 112619 - RNA, 64 nt, Homo Sapiens
uaucuguuuacaaagucugucacccuaguuuauuuauuuauagaccucaggauauucuuuucuc

SEQ ID NO: 112620 - RNA, 64 nt, Homo Sapiens
uuaaaaggaaauuagacauuauaaagcacugccauauuuauauuauagauuuuacaucuuugau

SEQ ID NO: 112621 - RNA, 64 nt, Homo Sapiens
uuaaaguggaaaucagaaaccugguuuaauguuguauuuauaaucuagcuuuugaguuugcuau

SEQ ID NO: 112622 - RNA, 64 nt, Homo Sapiens
auuuuguuaagcaaaaaugguuucuucuuaagaguauuuauauuucuauuugcucuccuuuuuc

SEQ ID NO: 112623 - RNA, 64 nt, Homo Sapiens
guuauuuguuucaccuucaauuuuagaagugcaauauuuauagugugaagaugucaaaaaaaga

SEQ ID NO: 112624 - RNA, 64 nt, Homo Sapiens
ucucuguaaaaggauauuuuagcuuggaagcguuuauuuauacauaaaagugucaagcguugac

SEQ ID NO: 112625 - RNA, 64 nt, Homo Sapiens
ccaaguucauagcagcauuaguauaaaaugccacuauuuauacagaggauggauuuguacaaau

SEQ ID NO: 112626 - RNA, 64 nt, Homo Sapiens
acaaaaauacaugaggauggugccuccaaaaguuuauuuauagauugaccucuaaauuguaaaa

SEQ ID NO: 112627 - RNA, 64 nt, Homo Sapiens
acccaauuagguaggaaacaugaaaaaccuuugauauuuauaaaaucauuuuuacgugcaaaau

SEQ ID NO: 112628 - RNA, 64 nt, Homo Sapiens
agaguauccaaucgguauugguggagcggcucccuauuuauacaauaggaagcaugggugcuua

SEQ ID NO: 112629 - RNA, 64 nt, Homo Sapiens
uuuauucuauuacuauuguuaaaaacuugaaugguauuuauauuggcugauauuuauauacuua

SEQ ID NO: 112630 - RNA, 64 nt, Homo Sapiens
uguuaaaaacuugaaugguauuuauauuggcugauauuuauauacuuaauagauugaguucugu

SEQ ID NO: 112631 - RNA, 64 nt, Homo Sapiens
gaguuaaauaucuuggacauuuauugguaaagcuuauuuauaaacugcagucagagcuaguuaa

SEQ ID NO: 112632 - RNA, 64 nt, Homo Sapiens
acagucucuuaucaggaaauagagaugauguggauauuuauauauuacauauauaaccaccaga

SEQ ID NO: 112633 - RNA, 64 nt, Homo Sapiens
agagaggcuauauuuuucugcuacaaauauuuuauauuuauagcaaaacuagacuuucagaguc

SEQ ID NO: 112634 - RNA, 64 nt, Homo Sapiens
auuuuccuauuaguggaggagggagaaccauauuuauuuauaaugaagacaucuaagaucccua

SEQ ID NO: 112635 - RNA, 64 nt, Homo Sapiens
auaacccccagaaaguaacaaugacaaaguauuauauuuauauauauuauuguagagaauuugu

SEQ ID NO: 112636 - RNA, 64 nt, Homo Sapiens
auauuuuuaaagaugucuuaagauaucuuaauuuuauuuauaaguuuugguguuuaccuguuuu

SEQ ID NO: 112637 - RNA, 64 nt, Homo Sapiens
uaaaccauuaugagccugaaggacauuuucagcauauuuauacaugagaaacagccuucaacaa

SEQ ID NO: 112638 - RNA, 64 nt, Homo Sapiens
uauguuugaaaagauguuugaaacuugauuauacuauuuauaauuggcacaguacuuugaauua

SEQ ID NO: 112639 - RNA, 64 nt, Homo Sapiens
uguauuccuuaugcaaaacacauguaucuuucauuauuuauaaguggccucucuuagcucaguu

SEQ ID NO: 112640 - RNA, 64 nt, Homo Sapiens
gauuaacuagcauuauuuugccaccuuuauauuguauuuauaaaaaaaaaaguacuaucaauca

SEQ ID NO: 112641 - RNA, 64 nt, Homo Sapiens
uuuaugaaauaaagagguaucuauuucuaauaaauauuuauauuaaaaacuaaucuuaaacaua

SEQ ID NO: 112642 - RNA, 64 nt, Homo Sapiens
guuagaaaaccagccacauugccacucuuauuaauauuuauaguagauguaaauaauagcacua

SEQ ID NO: 112643 - RNA, 64 nt, Homo Sapiens
ccucaagccaguugauuuuuuaucccauuguaauuauuuauaacaucucugcuccuaauauuac

SEQ ID NO: 112644 - RNA, 64 nt, Homo Sapiens
cucagcacucggggcaacaccagaguugccaagauauuuauaccacuggaguaacaauacauaa

SEQ ID NO: 112645 - RNA, 64 nt, Homo Sapiens
caaacauaaaaauguaaauaauaaucuauucaucuauuuauauguauuacaauaaaaauauaac

SEQ ID NO: 112646 - RNA, 64 nt, Homo Sapiens
agcuauguacugccacaaaaguaagauaccauuauauuuauaugauuuaacauuuuuuaaauag

SEQ ID NO: 112647 - RNA, 64 nt, Homo Sapiens
uaauauauauuauauauuuaauuuauauauuauauauuuauauauucuugguaaaaacguaugu

SEQ ID NO: 112648 - RNA, 64 nt, Homo Sapiens
uuauauauuuauauauaauagguaaaaacguauguauuuauauaagaaaaauaaaacauuucuu

SEQ ID NO: 112649 - RNA, 64 nt, Homo Sapiens
aaugggaauauuuuauacugacagaaaucaguaauauuuauauauuuauauuuuuaaaauauuu

SEQ ID NO: 112650 - RNA, 64 nt, Homo Sapiens
uauuuuauacugacagaaaucaguaauauuuauauauuuauauuuuuaaaauauuuauuuauuu

SEQ ID NO: 112651 - RNA, 64 nt, Homo Sapiens
aauuuaugaguuuuugauagcuuuauuuuuuaaguauuuauauauuuauaacucaucauaaaau

SEQ ID NO: 112652 - RNA, 64 nt, Homo Sapiens
aguuuuugauagcuuuauuuuuuaaguauuuauauauuuauaacucaucauaaaauaaaguaua

SEQ ID NO: 112653 - RNA, 64 nt, Homo Sapiens
acacauuucauuuuauuuaaaugaaauaaacuaguauuuauaaaauuuauauuuuuguauuuuu

SEQ ID NO: 112654 - RNA, 64 nt, Homo Sapiens
uuuguauuuuuaugaaauaauuuuuauaaauguauauuuauauuuuuguguuaauucauucaua

SEQ ID NO: 112655 - RNA, 64 nt, Homo Sapiens
ugaaaucagauuucuauaaccaugacaauuuuuguauuuauauugcuguuguaacguguaaggu

SEQ ID NO: 112656 - RNA, 64 nt, Homo Sapiens
guagccucuucaggcuuugucguuauaacgugaauauuuauacauggagcuauuuuuguuacca

SEQ ID NO: 112657 - RNA, 64 nt, Homo Sapiens
guuaauacuuaaucacuggagaaguaauuuuuauuauuuauauugucaaaauguaagacauuua

SEQ ID NO: 112658 - RNA, 64 nt, Homo Sapiens
aagugcaauuuuucaaaacaccugcugaaggauuuauuuauaaauuuauuaggaaauauuuaaa

SEQ ID NO: 112659 - RNA, 64 nt, Homo Sapiens
ccgucuccuuuuuucauucuuguauuucucugaguauuuauaucgcagaguuacaucuuauucg

SEQ ID NO: 112660 - RNA, 64 nt, Homo Sapiens
gcuucccaaaugcagaguuagcacauaaaaggaauauuuauaugacauugauaauuuaguuugg

SEQ ID NO: 112661 - RNA, 64 nt, Homo Sapiens
uguugguguucaaaguguagcaaaaaaugauguauauuuauaaaucuauuuauaccacuauauc

SEQ ID NO: 112662 - RNA, 64 nt, Homo Sapiens
aaguguagcaaaaaaugauguauauuuauaaaucuauuuauaccacuauaucauauguauauau

SEQ ID NO: 112663 - RNA, 64 nt, Homo Sapiens
aaaucuauuuauaccacuauaucauauguauauauauuuauaaccacuuaaauugugagccaag

SEQ ID NO: 112664 - RNA, 64 nt, Homo Sapiens
uaaacuagcugggaucauuuuugauccauugucauauuuauauuuaauuauuaaauguaucuga

SEQ ID NO: 112665 - RNA, 64 nt, Homo Sapiens
ucauuugcaacuucauuuuguuuuuuauaaauguuauuuauacagaaaguggcuauugacuuuc

SEQ ID NO: 112666 - RNA, 64 nt, Homo Sapiens
auuucuaauccugacuuggugacaguaucauguguauuuauaaaacaaggcuagccauauuuag

SEQ ID NO: 112667 - RNA, 64 nt, Homo Sapiens
uuagcuggguaaacuaucuuuguaacagauaaguuauuuauaaaaauuaaaaaacuuauauucu

SEQ ID NO: 112668 - RNA, 64 nt, Homo Sapiens
uacaaguuggaucauggaguucuauguguauuuauauuuauacaaugacauuuaaaaauuucuu

SEQ ID NO: 112669 - RNA, 64 nt, Homo Sapiens
uauacauacaaguuggaucauuucuuucuauguguauuuauauuuguuguaugacauuuaaaaa

SEQ ID NO: 112670 - RNA, 64 nt, Homo Sapiens
uacuaaacuaauagcauagaaaagcccucauaaauauuuauauuaugucauuuaaaauauuuug

SEQ ID NO: 112671 - RNA, 64 nt, Homo Sapiens
agaauguauaugucauuuaaaaucuggaguguaauauuuauauuaacaucaacucaguuguaug

SEQ ID NO: 112672 - RNA, 64 nt, Homo Sapiens
uuauauuuugauauucuauuuauauuuuuauaauuauuuauaaucaauaaaaaucuuguacaga

SEQ ID NO: 112673 - RNA, 64 nt, Homo Sapiens
cucauauuuaggcauuuaugugaauauuuugcuguauuuauagcaauugagauaacauaguucu

SEQ ID NO: 112674 - RNA, 64 nt, Homo Sapiens
aaauaugugaagcugaguuaauuuauguaagucauauuuauauuuuuaagaaguaccacuugaa

SEQ ID NO: 112675 - RNA, 64 nt, Homo Sapiens
auaaauggcuaacuuauacauauuuuuaaagaaauauuuauauuguauuuauauaauguauaaa

SEQ ID NO: 112676 - RNA, 64 nt, Homo Sapiens
acuuauacauauuuuuaaagaaauauuuauauuguauuuauauaauguauaaaugguuuuuaua

SEQ ID NO: 112677 - RNA, 64 nt, Homo Sapiens
aauuuuuguauagacauuccuuugguuggaagaauauuuauaggcaauacagucaaaguuucaa

SEQ ID NO: 112678 - RNA, 64 nt, Homo Sapiens
cuugagaacacugcaaugugaaaaucacguuugcuauuuauaaacuuguccuuagauuaaugug

SEQ ID NO: 112679 - RNA, 64 nt, Homo Sapiens
aaagaauucuguacccugauuccccauccguucguauuuauauuuaaguuuuaaauauuauuua

SEQ ID NO: 112680 - RNA, 64 nt, Homo Sapiens
uuuuugcaagcauugaauaaugaacagucagauuuauuuauauuuuuccguguguguaugcugg

SEQ ID NO: 112681 - RNA, 64 nt, Homo Sapiens
uaauaaucuaugaugaagguucauauaaacauuuuauuuauaguccauguaccuaauccaaaua

SEQ ID NO: 112682 - RNA, 64 nt, Homo Sapiens
uuuauucaccuuuucuucaacuuaacccagauuuuauuuauaucgugcauauaaauauauuuaa

SEQ ID NO: 112683 - RNA, 64 nt, Homo Sapiens
auacaaauggaaaucaaaacuuguauuucauauuuauuuauauagauuuucuuaaacuuaaaug

SEQ ID NO: 112684 - RNA, 64 nt, Homo Sapiens
uauuuuuaaagauaaagaauacauagaguacacauauuuauaugauuucacacaauaaaaaaca

SEQ ID NO: 112685 - RNA, 64 nt, Homo Sapiens
caaugauauuucaguauauaaagaguagacauuuuauuuauaacuucuucugaagaaucauagg

SEQ ID NO: 112686 - RNA, 64 nt, Homo Sapiens
guauuucugaaccacuuggcuuuuuuaacuagguuauuuauaaucaagaugguucacaguuucu

SEQ ID NO: 112687 - RNA, 64 nt, Homo Sapiens
aucuuaaguuuuggaagucuaaacugacuaguuuuauuuauaaaauuucaugucucuuuagaua

SEQ ID NO: 112688 - RNA, 64 nt, Homo Sapiens
uagauguuuacauaugcccaaauauuuauuuauuuauuuauaaggccauauuuauuuauaaaua

SEQ ID NO: 112689 - RNA, 64 nt, Homo Sapiens
uaaauauuuauuuauuuauuuauauagccauauuuauuuauaaauuacuuguuaauuuuagagg

SEQ ID NO: 112690 - RNA, 64 nt, Homo Sapiens
aauccauguuaguuuuuacuacuaggcuucagcauauuuauagcagaauuguaucauuugaaca

SEQ ID NO: 112691 - RNA, 64 nt, Homo Sapiens
cacaagagcccagcagggccagaaauagacaguauauuuauagucaggaaagacggauugcauu

SEQ ID NO: 112692 - RNA, 64 nt, Homo Sapiens
uuacuuuuuuuuacuuuuauaccacuauuauuuauauuuauaauaaaaucuguuaauuagguaa

SEQ ID NO: 112693 - RNA, 64 nt, Homo Sapiens
uauaauuuacuuuuuuuuacagguaaaccacuauuauuuauauuaagaaaaaaaucuguuaauu

SEQ ID NO: 112694 - RNA, 64 nt, Homo Sapiens
agcaauaaaccuaacuggaucuuaaugugaagcuuauuuauaauucauagguaaugacagaugc

SEQ ID NO: 112695 - RNA, 64 nt, Homo Sapiens
uugccauacaaaaacuuaacaauauguuuaaagauauuuauauacauuugaacuguauucaggu

SEQ ID NO: 112696 - RNA, 64 nt, Homo Sapiens
aaaucaguauaaaauguuuuauauuguuuccaauuauuuauaaugucuggguuugagaaaugaa

SEQ ID NO: 112697 - RNA, 64 nt, Homo Sapiens
cugaguaaaguuaaaagaauaugauauauaaauauauuuauagcuuacucuaaaaacugauuga

SEQ ID NO: 112698 - RNA, 64 nt, Homo Sapiens
agcaaaacuauauuugguuuaguuuucccacugguauuuauaguuuacuuugaauauuuauauu

SEQ ID NO: 112699 - RNA, 64 nt, Homo Sapiens
aguuuucccacugguauuuauaguuuacuuugaauauuuauauuaauaauuagcucauaauuuu

SEQ ID NO: 112700 - RNA, 64 nt, Homo Sapiens
guaaaucuguuuuuuaaggaaucauaaucauuuguauuuauacuuaaaaacacacaauguuaaa

SEQ ID NO: 112701 - RNA, 64 nt, Homo Sapiens
ucucuggaguguuguauauaguguagcaaaagaguauuuauacaucccaccaaucaaaacacag

SEQ ID NO: 112702 - RNA, 64 nt, Homo Sapiens
gcuuagugaaacacaaaauuaaauagaagaaauauauuuauaaagaaaagagacguaguaaauu

SEQ ID NO: 112703 - RNA, 64 nt, Homo Sapiens
aagcuacuacuaaaaaaaguucauauagaaauuuuauuuauaggguuuauauauauuggccaac

SEQ ID NO: 112704 - RNA, 64 nt, Homo Sapiens
cuuauauaacaaauguuugcuaucauauuuauacuauuuauauuauuuauuuauucuuacauuu

SEQ ID NO: 112705 - RNA, 64 nt, Homo Sapiens
auuuauauucuuauauaacacuuacauuuuaucauauuuauacuuuuuuacucauuuauuuauu

SEQ ID NO: 112706 - RNA, 64 nt, Homo Sapiens
auuaagacgugaaugaaacaacagaguuauccuuuauuuauaucauacaaacaauacuucuuac

SEQ ID NO: 112707 - RNA, 64 nt, Homo Sapiens
acaagaaaugcuucuuggacugguccucugcugauauuuauaaaauaucugggaucccuuuuuu

SEQ ID NO: 112708 - RNA, 64 nt, Homo Sapiens
aauaauuagcucauaauuuuuaguuuacuuugaauauuuauauuaguuuucccacugguauuua

SEQ ID NO: 112709 - RNA, 64 nt, Homo Sapiens
uuacuuugaauauuuauauuaguuuucccacugguauuuauaguagcaaaacuauauuugguuu

SEQ ID NO: 112710 - RNA, 64 nt, Homo Sapiens
cuggguggggugaggaccacuccuguacacugaauauuuauauuucacuauuuuuauuuauauu

SEQ ID NO: 112711 - RNA, 64 nt, Homo Sapiens
uccuguacacugaauauuuauauuucacuauuuuuauuuauauuuuuguaauuuuaaauaaaag

SEQ ID NO: 112712 - RNA, 64 nt, Homo Sapiens
cacgauaaaugcaugagaagccagcuuucuucuauauuuauaaaugucccaacagcccuguaag

SEQ ID NO: 112713 - RNA, 60 nt, Homo Sapiens
gaagaucuuaauaacagauguuugucuaaguauuuauaaggcucuccuucacuaaauuaa

SEQ ID NO: 112714 - RNA, 64 nt, Homo Sapiens
guauguguaauauacauaaugucuauauaaauuuuauuuauaauuuguuuggaagaaacuguag

SEQ ID NO: 112715 - RNA, 64 nt, Homo Sapiens
ugcuguggaugaaaauaacucaccuguguuugcauauuuauauagguaguaaagugauuuuuac

SEQ ID NO: 112716 - RNA, 64 nt, Homo Sapiens
auuuugcuaugaguggccuucucugcaguauuuauauuuauacuauaccauauaagaauauuuu

SEQ ID NO: 112717 - RNA, 64 nt, Homo Sapiens
uauacuauuuugcuaugaguuauuuucucugcaguauuuauauuacuagaauaccauauaagaa

SEQ ID NO: 112718 - RNA, 64 nt, Homo Sapiens
aaugccucagcagaaucuguaaaauaauaacugcuauuuauaaaagugcucagcaguugaaagc

SEQ ID NO: 112719 - RNA, 64 nt, Homo Sapiens
aaguaaaucacuugacaacuagaucaagaaauuauauuuauauguaauaauuuuaugaaaguua

SEQ ID NO: 112720 - RNA, 64 nt, Homo Sapiens
caacauuuguuuuaggagcauuuccucccucugcuauuuauacacggaaagacuuacuacagcg

SEQ ID NO: 112721 - RNA, 64 nt, Homo Sapiens
caauuuuuuauaguaauauguacuucuaauuuauuauuuauacuuaaauugugaccugaaagau

SEQ ID NO: 112722 - RNA, 64 nt, Homo Sapiens
gaaauaaauauucucuuaguuauccuugaaaucauauuuauacuauuaauuugcucagugcacu

SEQ ID NO: 112723 - RNA, 64 nt, Homo Sapiens
ucucccaggucacacugauucauucuuaacaagauauuuauauguuauuaaacaggugguucuu

SEQ ID NO: 112724 - RNA, 64 nt, Homo Sapiens
aguuauuuuuauuauugagucuguccagauaaguuauuuauaaugggcauuacugaauuuuuaa

SEQ ID NO: 112725 - RNA, 64 nt, Homo Sapiens
gggggaaauuuuagauaauuuuuaaauucaaaguuauuuauaaaaugcuagaauuuguuuuaau

SEQ ID NO: 112726 - RNA, 64 nt, Homo Sapiens
uuaagcuauggauguuuuuauuuuauauuuucuuuauuuauaacugugccaaguauuauuuugc

SEQ ID NO: 112727 - RNA, 64 nt, Homo Sapiens
cuuuuaaucuguaauuuuaaaauacaagucugaauauuuauaguugauucuuaacugcauaaac

SEQ ID NO: 112728 - RNA, 64 nt, Homo Sapiens
auaugauagggaaggaacugaauuucuccauucauauuuauaaccauucuaguuuuaucuuccu

SEQ ID NO: 112729 - RNA, 64 nt, Homo Sapiens
ugaaguaaaugggguugggggaggggacauuucauauuuauaaugugcugaagguaccauauuu

SEQ ID NO: 112730 - RNA, 64 nt, Homo Sapiens
aaagccaggguguuuucauucaugcggauacuaguauuuauagaugucugacuaccuaacuuaa

SEQ ID NO: 112731 - RNA, 64 nt, Homo Sapiens
aauguaaccccuuuuuccuuucuauauuuauagauauuuauaaauuuggaaguuugccuauccu

SEQ ID NO: 112732 - RNA, 64 nt, Homo Sapiens
uauuuauaaaaauguaacccugccuauccuucuauauuuauagauauuuauuuauuuggaaguu

SEQ ID NO: 112733 - RNA, 64 nt, Homo Sapiens
uccuauauccugugacugucauuaauauauguauuauuuauaauuguaaugaaaaugaauaucu

SEQ ID NO: 112734 - RNA, 64 nt, Homo Sapiens
agcaacuuuuguguaaugaaaucaaucaaauaaguauuuauaaugggaauauauuuuuagacuc

SEQ ID NO: 112735 - RNA, 64 nt, Homo Sapiens
gggaauauauuuuuagacucuuaauauuuaacauuauuuauauguuuaaaucuaaaucuauuua

SEQ ID NO: 112736 - RNA, 64 nt, Homo Sapiens
aacaucauucgauauugcuauauuaauauggauuuauuuauagagcauuuuauuuauaucauuu

SEQ ID NO: 112737 - RNA, 64 nt, Homo Sapiens
auuuuauuaauauggauuuaauaagacugcauuuuauuuauaucuaaauguauuuauuauuauu

SEQ ID NO: 112738 - RNA, 64 nt, Homo Sapiens
uguauuuauuauuauuauaauaaucaguacuuuauauuuauaaauaaauagcuucauguuucca

SEQ ID NO: 112739 - RNA, 64 nt, Homo Sapiens
ugccaucuccaacuacauccaagcauuguaaauuuauuuauaacgugauccugaaauguuuacu

SEQ ID NO: 112740 - RNA, 64 nt, Homo Sapiens
auaaucaccauuaucuguuucaggaaacuuuaguuauuuauaguuuacuuauaaugcaaggaau

SEQ ID NO: 112741 - RNA, 64 nt, Homo Sapiens
acauauuguagagacuuguaugcaaagguuggcauauuuauaugaaaauuaguugcuauagaaa

SEQ ID NO: 112742 - RNA, 64 nt, Homo Sapiens
cucugccugagcuuagaagguuauagaaaaaggguauuuauaaacauaaaugaccuuuuacuug

SEQ ID NO: 112743 - RNA, 64 nt, Homo Sapiens
uuguagucuugguagaaccaguauuuuuguuguuuauuuauaagguaauuguguguggggaaaa

SEQ ID NO: 112744 - RNA, 64 nt, Homo Sapiens
agaacucuguguuugaauucauucugcauauaauuauuuauaaguauagauugugaauuuuucc

SEQ ID NO: 112745 - RNA, 64 nt, Homo Sapiens
aaaauugcauucaguggcuuaagcauacuugcauuauuuauaauauuuugaaacuacacacaaa

SEQ ID NO: 112746 - RNA, 64 nt, Homo Sapiens
ucacccacaaacuuguucuucaccauauggauucuauuuauaaagcaauaauaauuaauucaca

SEQ ID NO: 112747 - RNA, 64 nt, Homo Sapiens
aaagcuaguagaaaaguacagaaaauuugacuauuauuuauagauuucagguauauuuauaugu

SEQ ID NO: 112748 - RNA, 64 nt, Homo Sapiens
agaaaauuugacuauuauuuauagauuucagguauauuuauauguguaaaagaaauugacaaag

SEQ ID NO: 112749 - RNA, 64 nt, Homo Sapiens
gaacaucacccuauauauaauuugaguguauauauauuuauauauaugauguggacauauguau

SEQ ID NO: 112750 - RNA, 64 nt, Homo Sapiens
aagccugagcagggcgaggaccaauaauuuuaauuauuuauauuuccuguauugcuuuaguaug

SEQ ID NO: 112751 - RNA, 64 nt, Homo Sapiens
aaaaggugcuaaaaugauuccaucagugcauuucuauuuauaucucuaagauuuuuuaccucug

SEQ ID NO: 112752 - RNA, 64 nt, Homo Sapiens
uucccaacaaaaguucuaaggggaaaggaccaauuauuuauagugaagccaaugcagaacugau

SEQ ID NO: 112753 - RNA, 64 nt, Homo Sapiens
acaaaguuggcauacagggugauucuuauuguaguauuuauauuuuaaucguugcuuccaauau

SEQ ID NO: 112754 - RNA, 64 nt, Homo Sapiens
caucacaaaauuuugcccaauuuaaguguuuucauauuuauagccauucuuuguauucugauuu

SEQ ID NO: 112755 - RNA, 64 nt, Homo Sapiens
uaccuugcauugaaaauuaucuaaauaaacuuuauauuuauacauuauuuuucuaaacacuaug

SEQ ID NO: 112756 - RNA, 64 nt, Homo Sapiens
aaugaaaagacuuuuuaaauuuauaucucauguauauuuauaguagcaccuguguuguacugcu

SEQ ID NO: 112757 - RNA, 64 nt, Homo Sapiens
guauuccagcaaaagaggauuacuuuuuaauauguauuuauaaaacuguuuggaguuguugccu

SEQ ID NO: 112758 - RNA, 64 nt, Homo Sapiens
aaaggaagaaaaaaagacuguaagcuguuaaauguauuuauaguaauuuagcuugucuuucugc

SEQ ID NO: 112759 - RNA, 64 nt, Homo Sapiens
auauauaaaagucugaguucauaaaucuaugauauauuuauaucaucuauuuauauaucauagu

SEQ ID NO: 112760 - RNA, 64 nt, Homo Sapiens
ucauaguauaaaucuaugaugggaaauguguaucuauuuauauauuguaguucuuagucccaca

SEQ ID NO: 112761 - RNA, 64 nt, Homo Sapiens
ccaaguagcagacgucauguugcaugguuuuugauauuuauauguaaguuuuucaaauuuugcu

SEQ ID NO: 112762 - RNA, 64 nt, Homo Sapiens
cuuaauuuuaaaauuuauuauuuugaucuugaauuauuuauaaacuggaaagugguuugauuau

SEQ ID NO: 112763 - RNA, 64 nt, Homo Sapiens
uaguggagcuaucacacacucaaaugagcuuguauauuuauaauacaauauaguauuauaguaa

SEQ ID NO: 112764 - RNA, 64 nt, Homo Sapiens
uauaucuauaccugcauauauauauugaccugaguauuuauaacugugugguguucaucuagca

SEQ ID NO: 112765 - RNA, 64 nt, Homo Sapiens
cuccuucuuucccaaucccucucaaccauguauuuauuuauauauguauguauuuuuuuauuua

SEQ ID NO: 112766 - RNA, 64 nt, Homo Sapiens
aucuaaaucgguaaauaaggacaugaguuaaauauauuuauauguacauacauauauauauccc

SEQ ID NO: 112767 - RNA, 64 nt, Homo Sapiens
uauucacuacuuuugaacacauucugcuaugaauuauuuauauaagccaaagcuauauguugua

SEQ ID NO: 112768 - RNA, 64 nt, Homo Sapiens
gcugaaguuauuccauauaauuguuuuggguuuuuauuuauaauaacucaaauuuaaauggugu

SEQ ID NO: 112769 - RNA, 64 nt, Homo Sapiens
ucauacuuauauuguuucaugugugccaagacuguauuuauauuagcacaccugcaaagauaaa

SEQ ID NO: 112770 - RNA, 64 nt, Homo Sapiens
uauuauuaauuggcuuucuguauucuaugccuuuuauuuauaaagacacuaagaaaacccaugu

SEQ ID NO: 112771 - RNA, 64 nt, Homo Sapiens
aaaacccgauuuuuauucucauaaauuuugugguuauuuauacaagggcugugcuaugcuacca

SEQ ID NO: 112772 - RNA, 64 nt, Homo Sapiens
gacuagugcuucccaguacuugcaugggguucacuauuuauaguuuucuugggaguaucacagg

SEQ ID NO: 112773 - RNA, 64 nt, Homo Sapiens
aggggugaccuauaucccaugugaguggucacuuuauuuauaggaucuuuaaaacauuuuuaau

SEQ ID NO: 112774 - RNA, 64 nt, Homo Sapiens
cuuauuugcaucaugaugaucuccaguguuuguguauuuauaauuguggaauguguugcaugua

SEQ ID NO: 112775 - RNA, 64 nt, Homo Sapiens
ugauguaucccaugguaauugggagauuaaauauuauuuauaaaauucuggcuugaaaaaauag

SEQ ID NO: 112776 - RNA, 64 nt, Homo Sapiens
auuauccuuaaagauauugcauuuucauauucuuuauuuauaaaggaucaaugcugcuguaaau

SEQ ID NO: 112777 - RNA, 64 nt, Homo Sapiens
gucaucguaaaagcugaaaaaaucccuuuguuucuauuuauaaaaaaagugcuuuucuauaugu

SEQ ID NO: 112778 - RNA, 64 nt, Homo Sapiens
ccugccugugguuuucagcucagagcuggacuucuauuuauaaguuaccuguauuuauauuuau

SEQ ID NO: 112779 - RNA, 64 nt, Homo Sapiens
gcucagagcuggacuucuauuuauaaguuaccuguauuuauauuuauaugcccgcucucauggu

SEQ ID NO: 112780 - RNA, 64 nt, Homo Sapiens
agcuggacuucuauuuauaaguuaccuguauuuauauuuauaugcccgcucucauggugaaggc

SEQ ID NO: 112781 - RNA, 64 nt, Homo Sapiens
gauacuguagaaagcaugugauaaaggaaccuuuuauuuauaaauuucagguguuguuuggugg

SEQ ID NO: 112782 - RNA, 64 nt, Homo Sapiens
ggcucuagaaaaaacgaguuuaacugggggauuuuauuuauaagcuagcugauaaugcaaacac

SEQ ID NO: 112783 - RNA, 64 nt, Homo Sapiens
cagaaaagaaacauuucaguuuugcacauauuuauauuuauauuaaucccaauccaagucaaac

SEQ ID NO: 112784 - RNA, 64 nt, Homo Sapiens
uauauucagaaaagaaacauucaaacuuugcacauauuuauauucaacaaaaucccaauccaag

SEQ ID NO: 112785 - RNA, 64 nt, Homo Sapiens
acuuaguuuaaaaaaaagacgaguuaucagacauuauuuauaaaguuuaguuuuuauauacaca

SEQ ID NO: 112786 - RNA, 64 nt, Homo Sapiens
acugucuuuuagaaaaaaaaaaagagcugcagaguauuuauaaaauguuuaaaaguuaaagaaa

SEQ ID NO: 112787 - RNA, 64 nt, Homo Sapiens
aucucaaucuuaaagcaugaaucuaaaacauaaauauuuauauuacagacucaauuuuacaaaa

SEQ ID NO: 112788 - RNA, 64 nt, Homo Sapiens
gcaaaauugauaagauguuagaaauuuggaccauuauuuauaaucaggguagcauuaaaaugga

SEQ ID NO: 112789 - RNA, 64 nt, Homo Sapiens
auaugacuauucuaaaggcucauuguuauugccauauuuauauauuuuggagacauuuucagug

SEQ ID NO: 112790 - RNA, 64 nt, Homo Sapiens
aaacauauggacauuuuaaagucaaugaauuuucuauuuauacuauguuucaugacuuauuuua

SEQ ID NO: 112791 - RNA, 64 nt, Homo Sapiens
guaaagaaugguacaagacagguuguuacucgauuauuuauaguaaaauaugugggaaauuaua

SEQ ID NO: 112792 - RNA, 64 nt, Homo Sapiens
cuaauuguuuuuauaaaaauuauucccuauugaauauuuauauaaugagguuguaucaacaaug

SEQ ID NO: 112793 - RNA, 64 nt, Homo Sapiens
uugauuuaugaguaauuguuauuuauucuuuauuuauuuauauuaauuaugaagauuaugauau

SEQ ID NO: 112794 - RNA, 64 nt, Homo Sapiens
cuuuucuacauacauuauuuucuuaauuguuagcuauuuauagaaagcuucaauagaacuguuu

SEQ ID NO: 112795 - RNA, 64 nt, Homo Sapiens
uauguguuuagaauugaaggacaucauuccuuuuuauuuauauguaauaaucaagagccuuaaa

SEQ ID NO: 112796 - RNA, 64 nt, Homo Sapiens
uauugacucuugaguuguuuuuagaucauaguuuuauuuauauuguccuaauggugaugcaguc

SEQ ID NO: 112797 - RNA, 64 nt, Homo Sapiens
caaggaaaucuauuuuaugugagcguauguaaguuauuuauauacuuugagaauuuacuuuaug

SEQ ID NO: 112798 - RNA, 64 nt, Homo Sapiens
uugugcaucaacucuguuggauauuggacuugaguauuuauauagucaagugccuaaguuuuua

SEQ ID NO: 112799 - RNA, 64 nt, Homo Sapiens
uauaaacuuuauagaaguacuauguggcauacaauauuuauaacuauguaagaauuuuauugcu

SEQ ID NO: 112800 - RNA, 64 nt, Homo Sapiens
aguaaucuucucuguuaacauuaucaaaauacuauauuuauagauuuuucuaaaugcucaaaug

SEQ ID NO: 112801 - RNA, 64 nt, Homo Sapiens
auauauucuuucacaaggcauccauacuguuuaauauuuauagaguucauagaaauacaucaau

SEQ ID NO: 112802 - RNA, 64 nt, Homo Sapiens
agccauggugaacugauaauuuuuguuuuuaaauuauuuauauuacugaauuggcaaaauuaca

SEQ ID NO: 112803 - RNA, 64 nt, Homo Sapiens
aaaaugcuuugaaaauguuuuuaagugcuaugcauauuuauagaguuauuauaguuauucaaau

SEQ ID NO: 112804 - RNA, 64 nt, Homo Sapiens
uuguuuuauaccuguagguuaugguacuuuaccauauuuauauauguauguguuuauucuucau

SEQ ID NO: 112805 - RNA, 64 nt, Homo Sapiens
acgaggguuguuuggauggauuuuaugcaggagauauuuauacuauuauaggauagaauuguca

SEQ ID NO: 112806 - RNA, 64 nt, Homo Sapiens
cagguguugcuuguguacaucguacccauccauucggcuucaccugcagccaacggccuggaau

SEQ ID NO: 112807 - RNA, 64 nt, Homo Sapiens
agcaguacgagcgcgauucucucuuuguccucgccggcuucaaguggcaggacuuuaagugguu

SEQ ID NO: 112808 - RNA, 64 nt, Homo Sapiens
cuccaggagacaguggucacugccaugcucugcucggcuucagugcugggaccccucacuugcc

SEQ ID NO: 112809 - RNA, 64 nt, Homo Sapiens
ucccuaugugaacuguagaccccugcuucucccacggcuucacccccccccuuuuuuuuuuuac

SEQ ID NO: 112810 - RNA, 64 nt, Homo Sapiens
cagcaggagcccuguccucacguucccaggagggcggcuucacccuucguaaccaggagacaag

SEQ ID NO: 112811 - RNA, 64 nt, Homo Sapiens
cagggcagaacaaggcagaaugagguguggugugcggcuucaccgggccugggccccugggagg

SEQ ID NO: 112812 - RNA, 64 nt, Homo Sapiens
ucuccaaucccugccaccacccacaaaccuguggcggcuucagaagcugacacagagccaucug

SEQ ID NO: 112813 - RNA, 64 nt, Homo Sapiens
aaaaugggauaaaaaaauaagauugugaagaggccggcuucaacauuuccuagcaaaaucagaa

SEQ ID NO: 112814 - RNA, 64 nt, Homo Sapiens
guccugcccaacacuguaugguuuuucucuagcacggcuucaauuuuguucucugcacaaagcc

SEQ ID NO: 112815 - RNA, 64 nt, Homo Sapiens
gagguguagguggguuuuucccuccuuaccaucacggcuucacuucccugcccucuggugccag

SEQ ID NO: 112816 - RNA, 64 nt, Homo Sapiens
gagcucuggcuggcauugacuggggggucccauccggcuucagaagaacuugcugccuugccug

SEQ ID NO: 112817 - RNA, 64 nt, Homo Sapiens
ugcguguccccgugcaguaguacagcccccagagcggcuucaccacaagggcuacgaccugguc

SEQ ID NO: 112818 - RNA, 64 nt, Homo Sapiens
cagccucugcucacacccgccccagcuucugccacggcuucagucagggccaggaggaacacgu

SEQ ID NO: 112819 - RNA, 64 nt, Homo Sapiens
gcugggaggaacaugcgucgcucaccuucaaccgcggcuucaagggaccuccaucagagccagu

SEQ ID NO: 112820 - RNA, 64 nt, Homo Sapiens
uagaacagaagcccguuuccgaccuuagcuuccccggcuucaagcggcucuccuuugagaagga

SEQ ID NO: 112821 - RNA, 64 nt, Homo Sapiens
ucuccuuuuccucucucccggagguugggugggccggcuucaugccagcuacuuccuccucccc

SEQ ID NO: 112822 - RNA, 64 nt, Homo Sapiens
gaccugacauacaggcggcuccagcccugggcagcggcuucaagagccagagugggaagucagg

SEQ ID NO: 112823 - RNA, 64 nt, Homo Sapiens
acauaaagcauugaaaauuccggugcuugggcuucggcuucagaguaacgucaguggcuuaggg

SEQ ID NO: 112824 - RNA, 64 nt, Homo Sapiens
aacuccacugggagcacugcugcugggucugaaucggcuucauaagggaagaaaacuuuggauu

SEQ ID NO: 112825 - RNA, 64 nt, Homo Sapiens
ccugcaagggccgacaacgcaggggacaccgugccggcuucagacacucccagcgcccacucuu

SEQ ID NO: 112826 - RNA, 61 nt, Homo Sapiens
ggggacaccgggucuccugaggccaguugggcggcuucagccccgggccuccaaccauguc

SEQ ID NO: 112827 - RNA, 64 nt, Homo Sapiens
uacaauuugccauuguuucuccuggguuaggccccggcuucacugguugaguguugcucucuag

SEQ ID NO: 112828 - RNA, 64 nt, Homo Sapiens
guuuaauucuucauagcugaaagcacaaauuuaacggcuucacuggacaguuuuccuuagaagg

SEQ ID NO: 112829 - RNA, 64 nt, Homo Sapiens
uauuccugcugauggcugagcaaagcuuggcugccggcuucauuaagggccuuuggauccugga

SEQ ID NO: 112830 - RNA, 64 nt, Homo Sapiens
auagaaagcuguuucccaccuugggcaguuaaaacggcuucagguguuuauaguaaucuaaggg

SEQ ID NO: 112831 - RNA, 64 nt, Homo Sapiens
auagaaagcuguuucccaccuugaacaguuaaaacggcuucagguguuuauaguaaucuaaggg

SEQ ID NO: 112832 - RNA, 64 nt, Homo Sapiens
auggaacuccaggacggcuaaaggccaaugcccacggcuucaucuggugguggaggccgcacag

SEQ ID NO: 112833 - RNA, 64 nt, Homo Sapiens
acgaggacgacugacguccuccccacuucagauucggcuucaggaaaacguuuagcgaaaagaa

SEQ ID NO: 112834 - RNA, 64 nt, Homo Sapiens
acauugggagguucagagcacccgccucggcuuucggcuucaucugcccgggaggccugcuggc

SEQ ID NO: 112835 - RNA, 64 nt, Homo Sapiens
cugccucuucuaccugcgggacuggacugcucuccggcuucagaagcugcuacaggucagaggu

SEQ ID NO: 112836 - RNA, 64 nt, Homo Sapiens
uuguggauugcauguugacauugaccgugagauucggcuucaaaccaauacugccuuuggaaua

SEQ ID NO: 112837 - RNA, 64 nt, Homo Sapiens
accauccugcaccugcugcucugcuguacaaagacggcuucagcaagcagagggucccaaccgc

SEQ ID NO: 112838 - RNA, 64 nt, Homo Sapiens
acccucccccggacucgacaggagccuggaccuccggcuucauuucaccccugcugggaggcca

SEQ ID NO: 112839 - RNA, 64 nt, Homo Sapiens
ccauaaucuuccacucaaggggcucuuuugcacacggcuucaugauuuuguuguuguuguuguu

SEQ ID NO: 112840 - RNA, 64 nt, Homo Sapiens
gaccagcggcugcucaagccaacgaagccggacacggcuucacuagugucccaagccgggagcc

SEQ ID NO: 112841 - RNA, 64 nt, Homo Sapiens
uggcgggaagacccucugcaauccaggccugugccggcuucacgcccgagcaagggucgucggc

SEQ ID NO: 112842 - RNA, 64 nt, Homo Sapiens
caggaccugcugggcuugugauuuggagggcccacggcuucacugagguugcuauaaaacgagc

SEQ ID NO: 112843 - RNA, 64 nt, Homo Sapiens
gccaauaaauuucaugcacugccugguauacaugcggcuucauuaggugguggggacuagggga

SEQ ID NO: 112844 - RNA, 64 nt, Homo Sapiens
gcagaagccguuccgugucucuugcaggcugggccggcuucaugccagugcgagggcgucccgu

SEQ ID NO: 112845 - RNA, 64 nt, Homo Sapiens
aagugaugggauuacaggcaugagccaccgugcccggcuucacacccauuucuuuaaaaaggau

SEQ ID NO: 112846 - RNA, 64 nt, Homo Sapiens
agucuucuguuuuggccaguugucuggucaaaaucggcuucagugauugugggaggggcaagaa

SEQ ID NO: 112847 - RNA, 64 nt, Homo Sapiens
aggaggccgacagucacagcacugcacuguggugcggcuucaugugauaugacaguggaugcua

SEQ ID NO: 112848 - RNA, 64 nt, Homo Sapiens
ccuuccccugcugcauguggugcucucuggccaacggcuucacauaggaaccguacaucccauc

SEQ ID NO: 112849 - RNA, 64 nt, Homo Sapiens
gaccccagaagugccuuccauccccucaaccccccggcuucaggagaagggacagggagucaga

SEQ ID NO: 112850 - RNA, 58 nt, Homo Sapiens
cccggcuaacucuggcacccgaagacgacggcuucaggccauuaugaacuccucuuaa

SEQ ID NO: 112851 - RNA, 64 nt, Homo Sapiens
aggguucugaccgggucugcaggacaugugcucucggcuucaccggcagccgccucccuuaugc

SEQ ID NO: 112852 - RNA, 64 nt, Homo Sapiens
cccugcacuggaucgugaggacgcugcgggccagcggcuucagcucggaggcggacguccccac

SEQ ID NO: 112853 - RNA, 64 nt, Homo Sapiens
auaaagggcgcccgcgguccuccggcagcacauucggcuucagaauuucuaggucacuggggac

SEQ ID NO: 112854 - RNA, 51 nt, Homo Sapiens
ccaccaucgugaaagaguagccggcuucagugccugccuuggggugaggaa

SEQ ID NO: 112855 - RNA, 64 nt, Homo Sapiens
auuucucuugaggaaacuuaccaccuugguugagcggcuucauggcagacagcagcgagccagc

SEQ ID NO: 112856 - RNA, 64 nt, Homo Sapiens
aacuugccucgcccugcaacagcccagaccucuucggcuucaggcccuuucuccaguaggcccc

SEQ ID NO: 112857 - RNA, 64 nt, Homo Sapiens
cacuaggucuggccuuggaaaucuguuacuucuacggcuucagaucugaugauaucuuuuucau

SEQ ID NO: 112858 - RNA, 64 nt, Homo Sapiens; identical to SEQ ID NO: 70892

SEQ ID NO: 112859 - RNA, 64 nt, Homo Sapiens; identical to SEQ ID NO: 70893

SEQ ID NO: 112860 - RNA, 64 nt, Homo Sapiens; identical to SEQ ID NO: 70894

SEQ ID NO: 112861 - RNA, 64 nt, Homo Sapiens; identical to SEQ ID NO: 70895

SEQ ID NO: 112862 - RNA, 64 nt, Homo Sapiens; identical to SEQ ID NO: 70896

SEQ ID NO: 112863 - RNA, 64 nt, Homo Sapiens; identical to SEQ ID NO: 70897

SEQ ID NO: 112864 - RNA, 64 nt, Homo Sapiens; identical to SEQ ID NO: 70898

SEQ ID NO: 112865 - RNA, 64 nt, Homo Sapiens; identical to SEQ ID NO: 70899

SEQ ID NO: 112866 - RNA, 64 nt, Homo Sapiens; identical to SEQ ID NO: 70900

SEQ ID NO: 112867 - RNA, 64 nt, Homo Sapiens; identical to SEQ ID NO: 70901

SEQ ID NO: 112868 - RNA, 64 nt, Homo Sapiens; identical to SEQ ID NO: 70902

SEQ ID NO: 112869 - RNA, 64 nt, Homo Sapiens; identical to SEQ ID NO: 70903

SEQ ID NO: 112870 - RNA, 64 nt, Homo Sapiens; identical to SEQ ID NO: 70904

SEQ ID NO: 112871 - RNA, 64 nt, Homo Sapiens; identical to SEQ ID NO: 70905

SEQ ID NO: 112872 - RNA, 64 nt, Homo Sapiens; identical to SEQ ID NO: 70906

SEQ ID NO: 112873 - RNA, 64 nt, Homo Sapiens; identical to SEQ ID NO: 70907

SEQ ID NO: 112874 - RNA, 64 nt, Homo Sapiens
acagacguccaugaggaaaacacugugugcgcagcggcagcagcgugaguccauguggagagag

SEQ ID NO: 112875 - RNA, 64 nt, Homo Sapiens
ugaagagauccaauauuugauagcucauaucugccggcagcaaugaaccacuacuaucauucac

SEQ ID NO: 112876 - RNA, 64 nt, Homo Sapiens
ccacugaagaggucuguacagugacaacccgggccggcagcaaggacacagaugcagccacagu

SEQ ID NO: 112877 - RNA, 64 nt, Homo Sapiens
agucccagggaaugaaugguggucuccccacucccggcagcacuuuaggcagcccauaagcuau

SEQ ID NO: 112878 - RNA, 64 nt, Homo Sapiens
gcccugggcaucacugagcagaggggugcggcagcuucaggaggcagaaacgagagggguggga

SEQ ID NO: 112879 - RNA, 64 nt, Homo Sapiens
aggcagggaggugagggcaggugccccucagacacuucaggaagguaguuugcauucuauuuaa

SEQ ID NO: 112880 - RNA, 64 nt, Homo Sapiens
caaguccauaacaugacauaacugcugauaucaucuucaggaagaguguggauucuuucuauca

SEQ ID NO: 112881 - RNA, 56 nt, Homo Sapiens
ccaaauccugaacauuuggaagaagccuucaggaauaagaauuaguuaaaugcuga

SEQ ID NO: 112882 - RNA, 64 nt, Homo Sapiens
uuugcaguucaaugagaagaucccaggucucauccuucaggaauuguacaguuugcauuaaaca

SEQ ID NO: 112883 - RNA, 64 nt, Homo Sapiens
gcaaauaucuaucugcuauuuuuuuuuuuugguacuucaggauauuuuauuugugauuuuuuuu

SEQ ID NO: 112884 - RNA, 64 nt, Homo Sapiens
uuucccaugaacuugugauaagguguuuauuaggcuucaggaucggcagggcuagcaacaucgu

SEQ ID NO: 112885 - RNA, 64 nt, Homo Sapiens
ugcuccauuuauuuuccaugaugucuguccuccucuucaggacacuugcucuuccuuaugucca

SEQ ID NO: 112886 - RNA, 64 nt, Homo Sapiens
caacccauggagaacaagccucaacuaacaaacccuucaggaagcauauaccggggaaugugua

SEQ ID NO: 112887 - RNA, 64 nt, Homo Sapiens
cccuucaggaagcauauaccggggaauguguagccuucaggaaaaaaaugccaauugacacaaa

SEQ ID NO: 112888 - RNA, 64 nt, Homo Sapiens
uaauuuugauuguuuuaucuaccuguuaaacuagcuucaggaagauuuuuguuuagcauuuaga

SEQ ID NO: 112889 - RNA, 64 nt, Homo Sapiens
aaauuuuuacaaucuuaucaggcugccaaaauagcuucaggaaggggaauuucacaucccuaga

SEQ ID NO: 112890 - RNA, 64 nt, Homo Sapiens
acgggucuguagagggucugcuucaggacucugccuucaggaaccugccacagggguauucugc

SEQ ID NO: 112891 - RNA, 64 nt, Homo Sapiens
cugccuucaggaacacgggucagggguauucugccuucaggacuucugagcugugccacugcca

SEQ ID NO: 112892 - RNA, 64 nt, Homo Sapiens
gccagagcucaagaagcugcugcacgggcugggccuucaggacccagagggcuuccuauucaag

SEQ ID NO: 112893 - RNA, 64 nt, Homo Sapiens
cugccaccagaaacuggaggacaugauccaggagcuucaggagaccccaucgcagacgucagug

SEQ ID NO: 112894 - RNA, 64 nt, Homo Sapiens
agacgcaauuggaaggucgggagguuuuccaaagcuucaggagagaauaaagcugaaggcagcu

SEQ ID NO: 112895 - RNA, 64 nt, Homo Sapiens
agaauacuccuuucauccaucacucagccagagucuucaggacagacuccgcaugggacuuguc

SEQ ID NO: 112896 - RNA, 64 nt, Homo Sapiens
gcuauuuaaaaaaacuugaauacagucagugucacuucaggaaaugaagaaaaggagagguaga

SEQ ID NO: 112897 - RNA, 64 nt, Homo Sapiens
cuuagguuuuuuuuguauaauacagucagugucacuucaggacaugaagaaaaggagagguaga

SEQ ID NO: 112898 - RNA, 64 nt, Homo Sapiens
uaacaugcugauccagcugucagugcugccucugcuucaggacuguaugucaagcaacuggaca

SEQ ID NO: 112899 - RNA, 64 nt, Homo Sapiens
uuucugcaccacugguuuugagauuauuucugcucuucaggaaaaguuccaugaauauuaaaug

SEQ ID NO: 112900 - RNA, 64 nt, Homo Sapiens
ggacacagccaaaccauaucauucuaccccuggcaccuccaaaucucauguccucacauuucaa

SEQ ID NO: 112901 - RNA, 64 nt, Homo Sapiens
aaguccaaaauucagcagggcagucaaauuuuaaaccuccaaaaugaucaccuuugacuccacg

SEQ ID NO: 112902 - RNA, 64 nt, Homo Sapiens
gggauuaguuccggagacugagacuguuggcuccaccuccaagcugagcuaggguggagggcag

SEQ ID NO: 112903 - RNA, 64 nt, Homo Sapiens
acgugcccuauaauggcugcaucccuuuugagcaaccuccaaaaucuacauuuacacaguaggu

SEQ ID NO: 112904 - RNA, 64 nt, Homo Sapiens
guuuuggaugggaagggaagagauaaaaauccaguuggcugagguggguccccuaguuaggccc

SEQ ID NO: 112905 - RNA, 64 nt, Homo Sapiens
aggggccaggccaagggccggguccucuggcuauuuggcugagacuccuccugggacagggcug

SEQ ID NO: 112906 - RNA, 64 nt, Homo Sapiens
uugccucuuuguccuggccucaucuugcaguggcuuggcugacaugaaauacaggggugcauac

SEQ ID NO: 112907 - RNA, 64 nt, Homo Sapiens
uacaggggugcauaccaucuuggauugccugcccuuggcugaaaaggaaagcaguguguaauuu

SEQ ID NO: 112908 - RNA, 64 nt, Homo Sapiens
guuagaacaucuggucucgcugguuagugccucguuggcugaggacuaggugugcauuucuccu

SEQ ID NO: 112909 - RNA, 64 nt, Homo Sapiens
auaaaaccaauucauuauuuguccagaaggaagcuuggcugagcuggccuuuuaacauaggaau

SEQ ID NO: 112910 - RNA, 64 nt, Homo Sapiens
cgcgcguucaaagcacuuuuugcgcucccuuguguuggcugacaauaaggcuaaaaauaacugg

SEQ ID NO: 112911 - RNA, 64 nt, Homo Sapiens
agacggacuugcuugccucuauuugguggaucuguuggcugaaagccucccguguuggguagaa

SEQ ID NO: 112912 - RNA, 64 nt, Homo Sapiens
auugaggaugcaaacauuccggauggcaccuauauuggcugauaccauaucaggaagggcuuug

SEQ ID NO: 112913 - RNA, 64 nt, Homo Sapiens
gaagauaaucauagguugugagcugaaguucaacuuggcugaguguuuauauaagaauugcuaa

SEQ ID NO: 112914 - RNA, 64 nt, Homo Sapiens
gucugcugucucagaggccuuggucaggaugaaguuggcugacacagcuuagcuugguuuugcu

SEQ ID NO: 112915 - RNA, 62 nt, Homo Sapiens
gagauaaaaacugauuaaaccuuuguggcugugguuggcugacauggggucuguguuucacu

SEQ ID NO: 112916 - RNA, 64 nt, Homo Sapiens
ccacacccaggaccacugucacagccccaucugcuuggcugaccggccaggaucccgcagggca

SEQ ID NO: 112917 - RNA, 64 nt, Homo Sapiens
gggcuaccugcccagccccucagauggccugccuuuggcugagaauuggcaggacaagugggag

SEQ ID NO: 112918 - RNA, 64 nt, Homo Sapiens
aagacccagguacccagccauaaagccacauugaguagucuaucccauaggauugacuacugca

SEQ ID NO: 112919 - RNA, 64 nt, Homo Sapiens
uagaacugugaagaaagcaggaaaguagugcacaguagucuaagauuauuaccuucauuaauac

SEQ ID NO: 112920 - RNA, 64 nt, Homo Sapiens
gcccaugacuugaacaacuguguuuuaaaguacuguagucuaguagguaacuuuguggcaaaaa

SEQ ID NO: 112921 - RNA, 64 nt, Homo Sapiens
aaaauaaugagaacaagcuguugcaagcucuuuuguagucuauugaauauuuuauagauauuca

SEQ ID NO: 112922 - RNA, 64 nt, Homo Sapiens
caaagcugacaugaaccuuuaacuuuaguuuguucacagggaggucucauuccauuucugccuu

SEQ ID NO: 112923 - RNA, 64 nt, Homo Sapiens
gcaggaggugaauguucacuccucuuccauuuugcacagggagucagacaucugcuccaucaga

SEQ ID NO: 112924 - RNA, 64 nt, Homo Sapiens
cauucauggagcuggagaaaacuguccagggccucacagggaggcaggagaagaagagggagaa

SEQ ID NO: 112925 - RNA, 64 nt, Homo Sapiens
cugggauguucacgcagcacacagcacagcuauccacagggagaauuccagccaguuggaucuc

SEQ ID NO: 112926 - RNA, 64 nt, Homo Sapiens
auuaacccuucgauauacauuaagucauguccuucacagggagaugugugugucucagucccug

SEQ ID NO: 112927 - RNA, 64 nt, Homo Sapiens
uuucugcuaugcaccagccuggccucugcaaccacacagggauauggccugcucuucccauguu

SEQ ID NO: 112928 - RNA, 64 nt, Homo Sapiens
cugcccagagagcuuuaccucaagcucucagccccacagggaacucaucuggcacacaacuguc

SEQ ID NO: 112929 - RNA, 64 nt, Homo Sapiens
cuguguagggaagcaccacuacugcccauccagucacagggauuaggaggauuccaccaugguc

SEQ ID NO: 112930 - RNA, 64 nt, Homo Sapiens
gguucuaucaugggugacacgggugacacgaggacacagggacaacagggacagguucugucau

SEQ ID NO: 112931 - RNA, 64 nt, Homo Sapiens
gguucugucaugggugacacgggugacaccaggacacagggacaacagggacagguucugucgg

SEQ ID NO: 112932 - RNA, 64 nt, Homo Sapiens
gguucugucgggggugacacgggugacaccaggacacagggacaagagggacagguucugucag

SEQ ID NO: 112933 - RNA, 64 nt, Homo Sapiens
uugcuuugagucaggcugugggcaaguuccugaccacagggaguaaauuggccucuuugauaca

SEQ ID NO: 112934 - RNA, 64 nt, Homo Sapiens
auagggaaggagcagggaugagacuggcaauggucacagggaaagauguggccuuuugugaugg

SEQ ID NO: 112935 - RNA, 64 nt, Homo Sapiens
agaggucuggcauguggaaaccuuggaucucggucacagggaggaaggcagcuagaaaugggag

SEQ ID NO: 112936 - RNA, 64 nt, Homo Sapiens
guccuuggcugcugccgucagaggcagcccccugcacagggaggggcugauccugccucagcug

SEQ ID NO: 112937 - RNA, 64 nt, Homo Sapiens
agccggauuuaaagcagucacuucagacaggagccacagggagccugugagggaguagugcggu

SEQ ID NO: 112938 - RNA, 64 nt, Homo Sapiens
gaaaccgcuucugagcggggcacuucggcugcuccacagggaaggcgacacugaaagcugaguc

SEQ ID NO: 112939 - RNA, 64 nt, Homo Sapiens
gcccucuccuugaccuugagaugaaggucaagagcacagggaccaggccuugguuaggcugagc

SEQ ID NO: 112940 - RNA, 64 nt, Homo Sapiens
agagccgugccacccacccucccacacagccggccacagggagaacuggugcuaaccagggugc

SEQ ID NO: 112941 - RNA, 64 nt, Homo Sapiens
cuuuggucacguucaacgcacuacagagcuacgacacagggaaaccuuaggagcaaauaaaccg

SEQ ID NO: 112942 - RNA, 64 nt, Homo Sapiens
ggaaacuugggucuugcugcccauccuuccucagcacagggaacccggaagcccguugcacuga

SEQ ID NO: 112943 - RNA, 64 nt, Homo Sapiens
uucgugcauacaugcggggaccccagacugucagcacagggaagauggaucccauccuaauuuu

SEQ ID NO: 112944 - RNA, 64 nt, Homo Sapiens
cagugcaagggagaaccugccagcccagccccaccacagggagagugcgucagcagaccugucc

SEQ ID NO: 112945 - RNA, 64 nt, Homo Sapiens
cccucggagggccaggcaacaggcuagcaaggcccacagggagggagcagaauggagagggcau

SEQ ID NO: 112946 - RNA, 64 nt, Homo Sapiens
gccuguggguggcacgagcaaggacugacauccgcacagggaggauugucuguuuggcugacac

SEQ ID NO: 112947 - RNA, 64 nt, Homo Sapiens
acagcagcagcccuucccacccagccaccuuccucacagggacuaggaggcucaguccccaacg

SEQ ID NO: 112948 - RNA, 64 nt, Homo Sapiens
ggaacaccacacccuggggcugagaauacauggacacagggaggcauaagugggaauugaacaa

SEQ ID NO: 112949 - RNA, 64 nt, Homo Sapiens
uggaugaagcuggaaaccaugaguucauauucuucacagggacaaugcagccauagaaaaggau

SEQ ID NO: 112950 - RNA, 64 nt, Homo Sapiens
ugcaugcaccacaggggcaaaacucacucucagccacagggagcagagaugcacuccgcucugg

SEQ ID NO: 112951 - RNA, 64 nt, Homo Sapiens
aucugcauguggggacacuguugugaucacacaccacagggagaaggauguaugggcaaagcuu

SEQ ID NO: 112952 - RNA, 64 nt, Homo Sapiens
aggacaucgaccacccucugcaugacuuuuuagacacagggacuccuguuguacucuguccccu

SEQ ID NO: 112953 - RNA, 64 nt, Homo Sapiens
gaagcccuacccuuucaacuucuguaggccuucacacagggaagcgcuaacauguggggugccc

SEQ ID NO: 112954 - RNA, 64 nt, Homo Sapiens
uggcaaugcccuaccugccucaguggcccccacucacagggagcccagggccaucuccucccac

SEQ ID NO: 112955 - RNA, 50 nt, Homo Sapiens
agauggauccacgugcucgccacagggagcgcuaccgcauccgcccauga

SEQ ID NO: 112956 - RNA, 64 nt, Homo Sapiens
gugaaauaaagccuugaaccgagacaaaugaagccacagggaaacgaugucaucuuuucuaaaa

SEQ ID NO: 112957 - RNA, 64 nt, Homo Sapiens
agaggagcggggcaggcagcguaugucaggaggccacagggagcagcugugaauggccggugau

SEQ ID NO: 112958 - RNA, 64 nt, Homo Sapiens
gauacaaacacuacagacaauaaauauuaggagacacagggaaguggggagagguggggaguaa

SEQ ID NO: 112959 - RNA, 64 nt, Homo Sapiens
agggaaguggggagagguggggaguaauaguaaacacagggaagagcuccccuacggaccaggu

SEQ ID NO: 112960 - RNA, 64 nt, Homo Sapiens
gggauuuuguuuuuaagggacuccguggaucagccacagggauacuccaaggguguguguaugu

SEQ ID NO: 112961 - RNA, 64 nt, Homo Sapiens
uuacuacccuauaugugaauggcugcauucccuacacagggaaucuaccuggcucuaucucacu

SEQ ID NO: 112962 - RNA, 64 nt, Homo Sapiens
ccuggccccaaagguuucucggccucagccccgucuacccuaagguagacgggcugucuugcca

SEQ ID NO: 112963 - RNA, 64 nt, Homo Sapiens
ccaccacaccccaucccagaacccacccccaccccuacccuaccagugucucagugccuucaaa

SEQ ID NO: 112964 - RNA, 61 nt, Homo Sapiens
aucccugcuggucauaggaaaacacacgguucuaauuaagugugaagguauagcuauugca

SEQ ID NO: 112965 - RNA, 61 nt, Homo Sapiens
cuguuauguauaugcuaaauguugguaaauacuaauuaauuuccaucauuuguagacuugu

SEQ ID NO: 112966 - RNA, 61 nt, Homo Sapiens
ucaccccauauuguucuuaaauaaguauagacuaauuaaccuaagcuaccuuuaacaacgu

SEQ ID NO: 112967 - RNA, 61 nt, Homo Sapiens
uaggcaugagccaccgugcccagccuacuuucuaauuaauuaaaaaaaaaaaaaaaaaaaa

SEQ ID NO: 112968 - RNA, 61 nt, Homo Sapiens
ugcuucuguugcacuuuagugugaguacacucuaauuaacuauuaaaagcauaguguauaa

SEQ ID NO: 112969 - RNA, 61 nt, Homo Sapiens
gcauaguguauaagugaguauuuuguguuaacuaauuaaaaauaaauuaucaauuacacau

SEQ ID NO: 112970 - RNA, 61 nt, Homo Sapiens
gcaccacuguucuguucauuuccuagcuguucuaauuaagaaaacuauuaagaugagcaac

SEQ ID NO: 112971 - RNA, 61 nt, Homo Sapiens
uuauugacaggucuuuucaaauaaugcuuuucuaauuaauagccaaagauuucauaucuaa

SEQ ID NO: 112972 - RNA, 61 nt, Homo Sapiens
uggaauaugcaacauuguccaaaccuaauagcuaauuaaucagcauguuuauaucugcaaa

SEQ ID NO: 112973 - RNA, 61 nt, Homo Sapiens
gaaacaugcuuaccagauucuuuaaauuuugcuaauuaacuacccuguuaugucuugcuaa

SEQ ID NO: 112974 - RNA, 61 nt, Homo Sapiens
cuuuuaucuugauaacuccuagugagggaaucuaauuaagauuucaugcuguucuuuguaa

SEQ ID NO: 112975 - RNA, 61 nt, Homo Sapiens
guuuauuuccaaggcauguauuauucaauuucuaauuaaaauauaucagggcuuauauuuu

SEQ ID NO: 112976 - RNA, 61 nt, Homo Sapiens
ggaucauuauuauggcauuuaaaauugaccucuaauuaagucagccuaauuaaggacauag

SEQ ID NO: 112977 - RNA, 61 nt, Homo Sapiens
acauagaaaauugaccucuauagguuccagccuaauuaagguacuuuuuauguaucauugc

SEQ ID NO: 112978 - RNA, 61 nt, Homo Sapiens
gcagaugagcuuacaaguauugaaauaauuacuaauuaaucacaaaugugaaguuaugcau

SEQ ID NO: 112979 - RNA, 61 nt, Homo Sapiens
aguuaugcaugauguaaaaaauacaaacauucuaauuaaaggcuuugcaacacaugccuug

SEQ ID NO: 112980 - RNA, 61 nt, Homo Sapiens
uugucuccauacauaucugaugccuccuguucuaauuaauuccccuccauuuuuuguguuu

SEQ ID NO: 112981 - RNA, 61 nt, Homo Sapiens
aaauccgccacuuucaugacaucggaaauaacuaauuaaacuuccccgagaguguaaagag

SEQ ID NO: 112982 - RNA, 61 nt, Homo Sapiens
cagaccaauaaugaguuccaaaauuuaaucacuaauuaaaaaucuaucaaacaaaacucug

SEQ ID NO: 112983 - RNA, 61 nt, Homo Sapiens
ugcaacaaaaacaaaaauugacaagugggaccuaauuaaacuaaauaacuucugcacagca

SEQ ID NO: 112984 - RNA, 61 nt, Homo Sapiens
cuguaauauaaaacuuagaaguaaaccacugcuaauuaaucauuuuaaacuuucaaaaacu

SEQ ID NO: 112985 - RNA, 61 nt, Homo Sapiens
aauuaauuacaaucugguuguuuagccuaugcuaauuaagcccucuuaguaguaguauuca

SEQ ID NO: 112986 - RNA, 61 nt, Homo Sapiens
accauguuaauacaucauuuuuuguuucuuccuaauuaacaaaagggcucuauaaugauua

SEQ ID NO: 112987 - RNA, 61 nt, Homo Sapiens
auuucaauuuuuaaauuucuuggugcuuugucuaauuaauuacaucccauaacuugucagg

SEQ ID NO: 112988 - RNA, 64 nt, Homo Sapiens
ucuaggccuuacuggaagccacugauaggggacacuucacuaccagaugugugcagugcaacag

SEQ ID NO: 112989 - RNA, 64 nt, Homo Sapiens
augugaauauuuaaggucugugacuauaguuaaacuucacuaagaauuugcagaauuguuuuga

SEQ ID NO: 112990 - RNA, 64 nt, Homo Sapiens
gaucacauucuuuccaaaagauuucacucucaaacuucacuaauagcagcaagacaaauuagcc

SEQ ID NO: 112991 - RNA, 64 nt, Homo Sapiens
ggaucuucugugcccagcacuuugguuuuguuuucuucacuaugaaacacagauuguguuuuuc

SEQ ID NO: 112992 - RNA, 64 nt, Homo Sapiens
cauugaaauaaaguuguaaauucuguuugcagugcuucacuaaaacuaaaaugcauuccugcaa

SEQ ID NO: 112993 - RNA, 64 nt, Homo Sapiens
cacuauaauuauuuuuggcuaauuacaaauaucacuucacuaaccuucuguguauuaaacuacg

SEQ ID NO: 112994 - RNA, 64 nt, Homo Sapiens
auuuggguagcuucaaacucaaauugaagagagucuucacuacaaucuucacuacaaccuuugg

SEQ ID NO: 112995 - RNA, 64 nt, Homo Sapiens
ucaaacucaaauugaagagagucuucacuacaaucuucacuacaaccuuuggccuuccucucua

SEQ ID NO: 112996 - RNA, 64 nt, Homo Sapiens
cuuguuuuccuuugauugauuaaaaauucauauucuucacuauugcaugaguuaggacaaacuc

SEQ ID NO: 112997 - RNA, 64 nt, Homo Sapiens
aauacuauuuagaaauaagcuugugcuuaacugucuucacuauuguucucuuuuugaaaugaau

SEQ ID NO: 112998 - RNA, 64 nt, Homo Sapiens
ucagaucuaaucaauuagucgaaccuggcuccuucuucacuaccuguaucccagcauacuuugu

SEQ ID NO: 112999 - RNA, 64 nt, Homo Sapiens
uaucagagauuuuuauauuuauacaaaagauuacuaaaugaaggauugcuaaauguuuuugguu

SEQ ID NO: 113000 - RNA, 64 nt, Homo Sapiens
aucaagcauauacuguauacaguuagaaaguuauuaaaugaacauuuuacucauugaucuguaa

SEQ ID NO: 113001 - RNA, 64 nt, Homo Sapiens
auuuauucauuucucuccucugauuagaaauaauuaaaugaauugaccugacauuaaauccucu

SEQ ID NO: 113002 - RNA, 64 nt, Homo Sapiens
aaagucucucucaacaccuccuagggcaaaugucuaaaugaagauucucuugcucccucauuca

SEQ ID NO: 113003 - RNA, 64 nt, Homo Sapiens
gcauuuuuuuccuuagccucagguuauucugaucuaaaugaacagugguuuccagauuggagcg

SEQ ID NO: 113004 - RNA, 64 nt, Homo Sapiens
aagacaaaagccaagguguaaaugaauaaauaaauaaaugaauaucccagaagggcacaaaaug

SEQ ID NO: 113005 - RNA, 64 nt, Homo Sapiens
agagaaguaauaaaccuauugauuucucugcuuauaaaugaaagauugaaacuauccaaugaca

SEQ ID NO: 113006 - RNA, 64 nt, Homo Sapiens
guaucuguaaccucccacugcaucagaagcagguuaaaugaagucuugugaauuuguaauagau

SEQ ID NO: 113007 - RNA, 64 nt, Homo Sapiens
uacuuuagcauugaagccacuuugaaaccugagauaaaugaaugugagguaucuuuucugcuuu

SEQ ID NO: 113008 - RNA, 64 nt, Homo Sapiens
uguaauucuuguaauauguugauucaguguuuuguaaaugaagucguauguauuuucagaguau

SEQ ID NO: 113009 - RNA, 64 nt, Homo Sapiens
uggaacaugccucugcauuucugaguguagaaauuaaaugaagccacucacaguccuuugauuu

SEQ ID NO: 113010 - RNA, 64 nt, Homo Sapiens
caggcuuaggacucugugccaaaaaucucuauuuuaaaugaaaauauuuauauaaaaauacauu

SEQ ID NO: 113011 - RNA, 64 nt, Homo Sapiens
guugguuguaacaaaauuugauuugaacuaccuauaaaugaaaagucgggguuuauuacuuuau

SEQ ID NO: 113012 - RNA, 64 nt, Homo Sapiens
uuuuagaauccuuugaaucuaaguauuuguuuccuaaaugaaacauuuguacaacauuugaugu

SEQ ID NO: 113013 - RNA, 64 nt, Homo Sapiens
uuccauacauacugcaaaugauugacuuguugcauaaaugaagaucuucuguugugugcuuuuc

SEQ ID NO: 113014 - RNA, 64 nt, Homo Sapiens
cuuugcucuuacaagguaaugaaagcagagucuauaaaugaacucguucuucccccuuaacugu

SEQ ID NO: 113015 - RNA, 64 nt, Homo Sapiens
gauugauauauguuauuucuucaaaacaacuuuuuaaaugaacucacuuuucaucuugguaaua

SEQ ID NO: 113016 - RNA, 64 nt, Homo Sapiens
uugaugagagaagaugccacauuucacuuuucauuaaaugaacaaucugauaaucuguugguuu

SEQ ID NO: 113017 - RNA, 64 nt, Homo Sapiens
gcacagccaaagucauguauaaaaaggugaagucuaaaugaaguuguaaaaaacaacagcaaac

SEQ ID NO: 113018 - RNA, 64 nt, Homo Sapiens
gacuuuggcaagggaggaaauucuugauuugacauaaaugaauaagaaaauguugugcuguaug

SEQ ID NO: 113019 - RNA, 64 nt, Homo Sapiens
ggccaugaguguucagaggggcaaauugaaaguauaaaugaauggcccuaauggaggaagucgg

SEQ ID NO: 113020 - RNA, 64 nt, Homo Sapiens
caugccacaaauauuuauuuggaaaaguagucauuaaaugaacccacugccuuaaaugucuuga

SEQ ID NO: 113021 - RNA, 64 nt, Homo Sapiens
uaucuauaucuauauauuuuuaaucaucuacauguaaaugaagcaauagaauucuaacauaagg

SEQ ID NO: 113022 - RNA, 64 nt, Homo Sapiens
guuuagcagugaucacaucuaaacaaaguuuagguaaaugaauuaucgcagagaaaaaccacau

SEQ ID NO: 113023 - RNA, 64 nt, Homo Sapiens
uuagugucaauauuuauauuuagauuaauuuuuauaaaugaaaauauuuuaaugguuuaagaaa

SEQ ID NO: 113024 - RNA, 64 nt, Homo Sapiens
aucauccagcucaguguggggcguggcagggggguaaaugaagccagccaauguguuaaccugu

SEQ ID NO: 113025 - RNA, 64 nt, Homo Sapiens
ggguaauuaguuuaaaaaucugugauuacauuuuuaaaugaaauuuucaaaguggccuagauug

SEQ ID NO: 113026 - RNA, 64 nt, Homo Sapiens
agaaagcagaaagaaggaaagccuagaacagaaauaaaugaaauagagaauagaaaagcaauac

SEQ ID NO: 113027 - RNA, 64 nt, Homo Sapiens
aauacuaugaacaauugaaugccaacaaauuagauaaaugaaauggacaaauuccuaggaagac

SEQ ID NO: 113028 - RNA, 64 nt, Homo Sapiens
cuuauauaaaaucucaagauaaaaaaacacuucuuaaaugaaguauagaauuugacucauacuu

SEQ ID NO: 113029 - RNA, 64 nt, Homo Sapiens
ugauaaauuauuaagauuaagauuauuuaugugauaaaugaaaucuccuaccaauccauccagc

SEQ ID NO: 113030 - RNA, 64 nt, Homo Sapiens
uauuuaaggguuaugcugcauguaacuuuaaaaauaaaugaaauauguuaauuucucuguaggu

SEQ ID NO: 113031 - RNA, 64 nt, Homo Sapiens
agaaagaaaacccacacacauaucccacgauaucuaaaugaaaauggagauguccucuccacuu

SEQ ID NO: 113032 - RNA, 64 nt, Homo Sapiens
gcuuauugcagacauuuuuuucaaaacuugccaauaaaugaauauuugcaugcuaaaugaaaau

SEQ ID NO: 113033 - RNA, 64 nt, Homo Sapiens
uucaaaacuugccaauaaaugcucuuuugcaugcuaaaugaaaauaugugguuuaucacaugua

SEQ ID NO: 113034 - RNA, 64 nt, Homo Sapiens
agaagcacugagauuaaccucuuugaccauguaauaaaugaaccaauagucccuccguucuccc

SEQ ID NO: 113035 - RNA, 64 nt, Homo Sapiens
guuguucccagccugcacaugggaggaggaggacuaaaugaaaaucaggcuggggagcacagag

SEQ ID NO: 113036 - RNA, 64 nt, Homo Sapiens
uugaacuaauuuauacuuuaaaguauuucuggguuaaaugaaacaaugaaauuuuuuaguaugu

SEQ ID NO: 113037 - RNA, 64 nt, Homo Sapiens
uuagugaagcauaaaguuaccuacaucaauuaauuaaaugaacuuauguacagaaaacauguau

SEQ ID NO: 113038 - RNA, 64 nt, Homo Sapiens
uaaagcuauaaaauucaauaacuuuuuagaauguuaaaugaagacacuguuuccuaacaucagu

SEQ ID NO: 113039 - RNA, 64 nt, Homo Sapiens
aagugcugcugauaugauacaaguagacaaaauuuaaaugaaauuuugucacauucuauggaaa

SEQ ID NO: 113040 - RNA, 64 nt, Homo Sapiens
gcugacuucgccucuuccugauaguauuuuucuguaaaugaaaucaacucauugucuccaccag

SEQ ID NO: 113041 - RNA, 64 nt, Homo Sapiens
gaaugagauuuauaaccacucugagcgcuguuuuuaaaugaaaagauugacuuacuaccuaaca

SEQ ID NO: 113042 - RNA, 64 nt, Homo Sapiens
aauacaagaaaauuauuucuaagcacaaccauauuaaaugaaucuugaccuucugauugaauau

SEQ ID NO: 113043 - RNA, 64 nt, Homo Sapiens
auaaggcaacuauauaaguaaguuaaacugaaauuaaaugaacagaaaagggcaaaaucgcuuc

SEQ ID NO: 113044 - RNA, 64 nt, Homo Sapiens
ccagaugacccuugaaguagucauuauguagcaauaaaugaagccugaaacagguuuuuuuacu

SEQ ID NO: 113045 - RNA, 64 nt, Homo Sapiens
uauuuucauugacaccaguguauaaguauaaauuuaaaugaacuaauuacuuuugcauauuuua

SEQ ID NO: 113046 - RNA, 64 nt, Homo Sapiens
auuaaugagacaugaauugugucucaacagaaacuaaaugaacauuucagaauaaauuauugcu

SEQ ID NO: 113047 - RNA, 64 nt, Homo Sapiens
gugacugaugauacaugcauacauauuuguugaauaaaugaaaauuuauuuuuagugauaagau

SEQ ID NO: 113048 - RNA, 64 nt, Homo Sapiens
uuuuucaaagaaacuuaaaguaaugcccaauuauuaaaugaacacaagagcugagaugucacau

SEQ ID NO: 113049 - RNA, 64 nt, Homo Sapiens
cuuuuauguauaacuuuaaugauuuauaagaugcuaaaugaauuguuuuuguaccuaaccauug

SEQ ID NO: 113050 - RNA, 64 nt, Homo Sapiens
guggcaguugcugucugcaguuuacaauguauuguaaaugaagauuuuuuaaauucuaucuugc

SEQ ID NO: 113051 - RNA, 64 nt, Homo Sapiens
ccccucucauaccaaaggaugacuguauauuucuuaaaugaagagacuuucauucuuuaaauau

SEQ ID NO: 113052 - RNA, 64 nt, Homo Sapiens
uugggccccaaggauaaggcuacugauuugauacuaaaugaaucagcaguggauguagggauag

SEQ ID NO: 113053 - RNA, 64 nt, Homo Sapiens
uccuaaaaguugucaacuccccacccuuggacuuuaaaugaaaauuuuauucaguccagcuauu

SEQ ID NO: 113054 - RNA, 64 nt, Homo Sapiens
gcuuuuacagauagguuaauaaaauaugcauuuuuaaaugaaugaccacaaaugagucauuuuu

SEQ ID NO: 113055 - RNA, 64 nt, Homo Sapiens
cauuuuaaagacaaaacuuguuaaucugaauauguaaaugaauacuuugauuaauaaacuuagu

SEQ ID NO: 113056 - RNA, 64 nt, Homo Sapiens
uuuuaauuuuucaugauauauuuccuuagaugaauaaaugaaagauuuacuucuuugagaaauc

SEQ ID NO: 113057 - RNA, 64 nt, Homo Sapiens
aauuugaaaugaauguuuuuuuacauuguucuuuuaaaugaagacagaauaauagauaaaugau

SEQ ID NO: 113058 - RNA, 64 nt, Homo Sapiens
aaugcucacauuaauuugcacauauuuuaaguguuaaaugaaucuuuaauuuuuuaaaugaaac

SEQ ID NO: 113059 - RNA, 64 nt, Homo Sapiens
cauauuuuaaguguuaaauguauuuuuaauuuuuuaaaugaaacuaguuuuugaaguguugaag

SEQ ID NO: 113060 - RNA, 64 nt, Homo Sapiens
aagggaggcccagccgcaggaucuccauguagaauaaaugaagaggguaacuuagaaggauggc

SEQ ID NO: 113061 - RNA, 64 nt, Homo Sapiens
guguuaaggggucggcuaagugcaaaaguggggcuaaaugaaguuugcaggcugagucccucca

SEQ ID NO: 113062 - RNA, 64 nt, Homo Sapiens
gcuuguauuuugcgaugaagaugugauacaucuuuaaaugaaaauauaccaaaauuuaguaggc

SEQ ID NO: 113063 - RNA, 64 nt, Homo Sapiens
gaggguuuuacuuccuuguuaacauauaaaguuauaaaugaaggacaaggaggagauggaaaau

SEQ ID NO: 113064 - RNA, 64 nt, Homo Sapiens
ugaaaccaauuuuuauccaccaucuaguccuuauuaaaugaaaccucacggauccuuuguuccg

SEQ ID NO: 113065 - RNA, 64 nt, Homo Sapiens
ccaagaugcacaucgcuauuaacagccagagucauaaaugaaaugaaauugaagaauucauuca

SEQ ID NO: 113066 - RNA, 64 nt, Homo Sapiens
auagagcucaugaaauacuguaacuuggggauuguaaaugaauggauacaauagguuaaggccc

SEQ ID NO: 113067 - RNA, 64 nt, Homo Sapiens
acugugccuuaacguguuucuuaaacuuuuguaguaaaugaacauuugaaauccauuuugauaa

SEQ ID NO: 113068 - RNA, 64 nt, Homo Sapiens
ggacucucuuagaaugagugauucaccugcuauuuaaaugaauuauuuagauuuuugacaaaga

SEQ ID NO: 113069 - RNA, 64 nt, Homo Sapiens
agucuucuuauguaaaucacaugacucauguccguaaaugaacuaugaaagauaucgaucaguu

SEQ ID NO: 113070 - RNA, 64 nt, Homo Sapiens
aaguuucaaaauagcaucacacaaaacauguuuauaaaugaacaggauguaauguacauagaug

SEQ ID NO: 113071 - RNA, 64 nt, Homo Sapiens
augugaacauguagauguuuuguguguauuuuuuuaaaugaaaacucaaaauaagacaaguaau

SEQ ID NO: 113072 - RNA, 64 nt, Homo Sapiens
gcaaaaaaaaaaaaaucccugaaauauucuucuauaaaugaauccuauuuccccagaguguuca

SEQ ID NO: 113073 - RNA, 64 nt, Homo Sapiens
uauuuccccagaguguucaaggcauuuuucuaccuaaaugaauaccuaaaucuugaguagugua

SEQ ID NO: 113074 - RNA, 64 nt, Homo Sapiens
uagccuucucuagcaacaucauuuucagacuaacuaaaugaaugcaguauacucuuuucuuugu

SEQ ID NO: 113075 - RNA, 64 nt, Homo Sapiens
uagaauaauucaagauaggcaagaaggacagcaguaaaugaagaccauggaagaaaagaaggaa

SEQ ID NO: 113076 - RNA, 64 nt, Homo Sapiens
gaagaguaaacuuuuccuaaaacacuuuauauuauaaaugaaaauaaauugcuaguuuauauuu

SEQ ID NO: 113077 - RNA, 64 nt, Homo Sapiens
uuuucaucuacauguaauguguuauuaauuuuauuaaaugaaaacuaaucaccuucauguggaa

SEQ ID NO: 113078 - RNA, 64 nt, Homo Sapiens
aaaauuuguucuuuugucaugaauuuauaauuccuaaaugaagaccagaaaguacaaauugcug

SEQ ID NO: 113079 - RNA, 64 nt, Homo Sapiens
uuaugaugugcauuaggcugccccaucguguauauaaaugaagcagauuugauuuuuguauucu

SEQ ID NO: 113080 - RNA, 64 nt, Homo Sapiens
aaaauaaccuauuguuagaaaauauguguuuuuauaaaugaauguaaaauaauuaaaugaauug

SEQ ID NO: 113081 - RNA, 64 nt, Homo Sapiens
aaauauguguuuuuauaaaugaauguaaaauaauuaaaugaauugugaaauggauguuuaagaa

SEQ ID NO: 113082 - RNA, 64 nt, Homo Sapiens
gaucuuggaaaugaauaagcuuugauaauauuuguaaaugaaccaaauuauuacugcuaccacu

SEQ ID NO: 113083 - RNA, 64 nt, Homo Sapiens
aguacagcauuuucaacauauuggcaacauauuuuaaaugaaaacacuaaaacaauucuuagua

SEQ ID NO: 113084 - RNA, 64 nt, Homo Sapiens
cugcauauucuggaucauaguugcuauuaauaguuaaaugaaauguuugugugcaacugcuuca

SEQ ID NO: 113085 - RNA, 64 nt, Homo Sapiens
auaacacuuacuaguuuagagacauuaacuuucauaaaugaagcaugagcccugaaauacuguu

SEQ ID NO: 113086 - RNA, 64 nt, Homo Sapiens
aacgacuaagucuugcucaagaaaccccacuuaauaaaugaauggccagccuaugcaacaucau

SEQ ID NO: 113087 - RNA, 64 nt, Homo Sapiens
agcuggacauggugggaugguagagacacaaaaauaaaugaagaguauuuaaaagguagccaug

SEQ ID NO: 113088 - RNA, 64 nt, Homo Sapiens
aguggucagacuccuuaaugaacaaugcaaaaucuaaaugaauaaaauaucuucccuauaucua

SEQ ID NO: 113089 - RNA, 64 nt, Homo Sapiens
uacuaaaauagucauguauaaaugauuucauuuauaaaugaacaccauguauuuuggaaaagaa

SEQ ID NO: 113090 - RNA, 64 nt, Homo Sapiens
acagguuuggugucauuauaagagaaaucauuauuaaaugaagcaaguuaacacucuaagagaa

SEQ ID NO: 113091 - RNA, 64 nt, Homo Sapiens
gcugagaaauuccacacaugaguauugugaugaguaaaugaauaaaacauuugcaaagaccuuu

SEQ ID NO: 113092 - RNA, 64 nt, Homo Sapiens
cucuguugucucuucauauucuucuuccuuuuccuaaaugaaauuauauuauuucaacuacuaa

SEQ ID NO: 113093 - RNA, 64 nt, Homo Sapiens
ugccuggcaguguuuguucaaaacuuguauuuaauaaaugaacaucugacuuacaaccuuuguu

SEQ ID NO: 113094 - RNA, 64 nt, Homo Sapiens
cagcauuagagcuuuauauauuguaguguuugaauaaaugaaacguccagcauaugguagauac

SEQ ID NO: 113095 - RNA, 64 nt, Homo Sapiens
guuuagaauaaaauaguuaaaguugccuuauauguaaaugaaguaaucacaaccuuggggccac

SEQ ID NO: 113096 - RNA, 64 nt, Homo Sapiens
gaaauuuuucaugaugcuacgaaagcuauuuuuuuaaaugaauuaacguaauuauuauuuaaau

SEQ ID NO: 113097 - RNA, 64 nt, Homo Sapiens
cuauuuuuuuaaaugaauugacguaauuauuauuuaaaugaaagauauacagagauaaagcuaa

SEQ ID NO: 113098 - RNA, 64 nt, Homo Sapiens
aaaguaguauuuuguauauuuuuguaacaaaauauaaaugaagauauuuuaccaugaagagauu

SEQ ID NO: 113099 - RNA, 64 nt, Homo Sapiens
gagauugcacuuauccuugagaacagucuaaauauaaaugaagauauuuuaccaugaagagauu

SEQ ID NO: 113100 - RNA, 64 nt, Homo Sapiens
cuuaccccauuacugcgguuaauucuuggugcauuaaaugaagcugggucucaauccccuugga

SEQ ID NO: 113101 - RNA, 64 nt, Homo Sapiens
ggcaucaaggacucagggggcguguccuuuucucuaaaugaaguuuuucuguggacugaaaaau

SEQ ID NO: 113102 - RNA, 64 nt, Homo Sapiens
auuaaaauuuguguuuauuauucuuuaguguuguuaaaugaaaauaaaacauuuauauaccuca

SEQ ID NO: 113103 - RNA, 64 nt, Homo Sapiens
uaaaaauagaauguggaugcagacuucugaauuguaaaugaacuaauauauaucuaccuaaagg

SEQ ID NO: 113104 - RNA, 64 nt, Homo Sapiens
ugaaacacuacaaauuuauucuuccugauuccuuuaaaugaauacagaaauuaaaugaauuuuu

SEQ ID NO: 113105 - RNA, 64 nt, Homo Sapiens
uuucuuccugauuccuuuaacaggcagcagaaauuaaaugaauugaauuuuugaagugacuggg

SEQ ID NO: 113106 - RNA, 64 nt, Homo Sapiens
auuuaagcaguaccaagacugaaaaaaaagguaauaaaugaaauguuuugaaauauacuuaaac

SEQ ID NO: 113107 - RNA, 64 nt, Homo Sapiens
acuucaggaaaugaauauaaaauagguucacaguuaaaugaauaagcuuuuguuuauuuguggg

SEQ ID NO: 113108 - RNA, 64 nt, Homo Sapiens
cauggacuccuggacuacuuggcuuauggguuaauaaaugaauuguuagcauacacauuuuaua

SEQ ID NO: 113109 - RNA, 64 nt, Homo Sapiens
cuauugagaucuuuuugucuuaaaaauuguaaaguaaaugaaagaguacuuaauugaagcuuuu

SEQ ID NO: 113110 - RNA, 64 nt, Homo Sapiens
ugauuuuuguaauguuugguuuuaaaggcuuaaauaaaugaaaaauauuaaaugaauauuuuau

SEQ ID NO: 113111 - RNA, 64 nt, Homo Sapiens
uuuuauuuuaaaggcuuaaaucugaguaucauauuaaaugaauaaaauuauguauuuuauugcc

SEQ ID NO: 113112 - RNA, 64 nt, Homo Sapiens
ugaaaagucgauuaaauuauuagcucucuauuuuuaaaugaauuagcugagcuuucuaaaauga

SEQ ID NO: 113113 - RNA, 64 nt, Homo Sapiens
aagaauauuccuuaucugguugaaaauuuagacauaaaugaaccuugaaagggaaaaaguaugu

SEQ ID NO: 113114 - RNA, 64 nt, Homo Sapiens
uuucucauuuguauauuuggggauuuuuuugagguaaaugaaacguugucuguuuguauagccu

SEQ ID NO: 113115 - RNA, 64 nt, Homo Sapiens
aauggauuuuucucucugccuuuaaaauuugauuuaaaugaagaagauucuaagguucaagauu

SEQ ID NO: 113116 - RNA, 64 nt, Homo Sapiens
guuauacuguuuuuaaugaacuggucauucaguuuaaaugaauggguuuuuaaagacagcaagu

SEQ ID NO: 113117 - RNA, 64 nt, Homo Sapiens
ggcaaugacagcauuucucacagaggcauucugguaaaugaagcugaaagggguguuuuacauc

SEQ ID NO: 113118 - RNA, 64 nt, Homo Sapiens
cuguuacuuuuugccuugucuggcauguuuguuuuaaaugaauacauuaaugggguuuuuaucc

SEQ ID NO: 113119 - RNA, 64 nt, Homo Sapiens
agaaaguauguuuguguugguuuuuuaagaagucuaaaugaaguuauuaauaccugaagcuuua

SEQ ID NO: 113120 - RNA, 64 nt, Homo Sapiens
aaaaauugacuaccuggaggaaugauuaggaaucuaaaugaagccagcccucgguaucugcagg

SEQ ID NO: 113121 - RNA, 64 nt, Homo Sapiens
uucuaaauguuguauuuuauaaaauuuguauuuuuaaaugaaaaaaaauucuuaauauuuucau

SEQ ID NO: 113122 - RNA, 64 nt, Homo Sapiens
cacccuguguuuuaaaauauauucaccaaaagauuaaaugaaacaauguaggacuuaugaucca

SEQ ID NO: 113123 - RNA, 64 nt, Homo Sapiens
gaucgauugggaauuuaaaaaauguaugcuauguuaaaugaaaaccuuugauuguugaaaauau

SEQ ID NO: 113124 - RNA, 64 nt, Homo Sapiens
cuuuaugaaacuggaaggacuuccaugucaacucuaaaugaaguggagugacagguuaugacau

SEQ ID NO: 113125 - RNA, 64 nt, Homo Sapiens
acauuuaauucaaggaucaaauaauucucugaaauaaaugaaagagcaguagcuuuugaaacuc

SEQ ID NO: 113126 - RNA, 64 nt, Homo Sapiens
auacccagccaugaaacaauaaacugggaagacauaaaugaauugagaagagaucagagaggaa

SEQ ID NO: 113127 - RNA, 64 nt, Homo Sapiens
ccucaguucucugcuacccuugugauguuguuuauaaaugaauguaugaucuucguuuauauuc

SEQ ID NO: 113128 - RNA, 64 nt, Homo Sapiens
accuuaauaggaaaaaaagauugaucauuaccuguaaaugaaagauuuacauauuuuugucuug

SEQ ID NO: 113129 - RNA, 64 nt, Homo Sapiens
uucuccauaguacguagaccuucuaauacucugcuaaaugaaaccacacuuguuaucugaaagu

SEQ ID NO: 113130 - RNA, 64 nt, Homo Sapiens
gaaaguuguaaauaauuaaaagcuucccaagaguuaaaugaagguuaugaugacucuugauaac

SEQ ID NO: 113131 - RNA, 64 nt, Homo Sapiens
aucauggcuauguuuuaauagcuauagacaaucauaaaugaauguccauugugauaugaaaaca

SEQ ID NO: 113132 - RNA, 64 nt, Homo Sapiens
aucauggcuauguuuuaauagcuauagacaaucauaaaugaaugaccacugugguaugaaaaca

SEQ ID NO: 113133 - RNA, 64 nt, Homo Sapiens
gcacuguguacgauacauaauauuugguagcuuguaaaugaaauaaagaauaaaguuuuauuua

SEQ ID NO: 113134 - RNA, 64 nt, Homo Sapiens
guauauuguauauuaguguauuaguaauacuagauaaaugaauuuugucuggggauuaagauug

SEQ ID NO: 113135 - RNA, 64 nt, Homo Sapiens
ccaaaaauagccaguaguaucugaaaaugaaaaauaaaugaaguaucucuaggaaacagucugg

SEQ ID NO: 113136 - RNA, 64 nt, Homo Sapiens
aauaaaauuuaugcuauucuuugcuuuguuuuuauaaaugaauuuuucauagaauuuacaguau

SEQ ID NO: 113137 - RNA, 64 nt, Homo Sapiens
ccuucuuaaaacagaaaauuuaaguaaagucuuuuaaaugaaaccuguaaaaguauugacucuu

SEQ ID NO: 113138 - RNA, 64 nt, Homo Sapiens
gucuggagauaauuuugcaacucauguuauggguuaaaugaauauuuuuguaaaaguaaaagca

SEQ ID NO: 113139 - RNA, 64 nt, Homo Sapiens
uaaguuuuucauccuuuuuuucaagugaugauguuaaaugaagguguguuuuguaucuucccuu

SEQ ID NO: 113140 - RNA, 64 nt, Homo Sapiens
aauauauaggagggauaucaguaaguuuagcuucuaaaugaaauuuacugcauagaaaucaaau

SEQ ID NO: 113141 - RNA, 64 nt, Homo Sapiens; identical to SEQ ID NO: 43695

SEQ ID NO: 113142 - RNA, 64 nt, Homo Sapiens; identical to SEQ ID NO: 43696

SEQ ID NO: 113143 - RNA, 64 nt, Homo Sapiens; identical to SEQ ID NO: 43697

SEQ ID NO: 113144 - RNA, 64 nt, Homo Sapiens; identical to SEQ ID NO: 43698

SEQ ID NO: 113145 - RNA, 64 nt, Homo Sapiens; identical to SEQ ID NO: 43699

SEQ ID NO: 113146 - RNA, 64 nt, Homo Sapiens; identical to SEQ ID NO: 43700

SEQ ID NO: 113147 - RNA, 64 nt, Homo Sapiens; identical to SEQ ID NO: 43701

SEQ ID NO: 113148 - RNA, 64 nt, Homo Sapiens; identical to SEQ ID NO: 43702

SEQ ID NO: 113149 - RNA, 64 nt, Homo Sapiens; identical to SEQ ID NO: 43703

SEQ ID NO: 113150 - RNA, 64 nt, Homo Sapiens; identical to SEQ ID NO: 43704

SEQ ID NO: 113151 - RNA, 64 nt, Homo Sapiens; identical to SEQ ID NO: 43705

SEQ ID NO: 113152 - RNA, 64 nt, Homo Sapiens; identical to SEQ ID NO: 43706

SEQ ID NO: 113153 - RNA, 64 nt, Homo Sapiens; identical to SEQ ID NO: 43707

SEQ ID NO: 113154 - RNA, 64 nt, Homo Sapiens; identical to SEQ ID NO: 43708

SEQ ID NO: 113155 - RNA, 64 nt, Homo Sapiens; identical to SEQ ID NO: 43709

SEQ ID NO: 113156 - RNA, 64 nt, Homo Sapiens; identical to SEQ ID NO: 43710

SEQ ID NO: 113157 - RNA, 64 nt, Homo Sapiens; identical to SEQ ID NO: 43711

SEQ ID NO: 113158 - RNA, 64 nt, Homo Sapiens; identical to SEQ ID NO: 43712

SEQ ID NO: 113159 - RNA, 64 nt, Homo Sapiens; identical to SEQ ID NO: 43713

SEQ ID NO: 113160 - RNA, 64 nt, Homo Sapiens; identical to SEQ ID NO: 43714

SEQ ID NO: 113161 - RNA, 64 nt, Homo Sapiens; identical to SEQ ID NO: 43715

SEQ ID NO: 113162 - RNA, 64 nt, Homo Sapiens; identical to SEQ ID NO: 43716

SEQ ID NO: 113163 - RNA, 64 nt, Homo Sapiens
uccaguuuacccugugcuguccagcuucucccuugggaaaaagucucuccuguuucucucuccu

SEQ ID NO: 113164 - RNA, 64 nt, Homo Sapiens
uuaaccaaaguuacuguuguuuacagugaguuuggggaaaaaaaauaaaauaaaaauggcuuuc

SEQ ID NO: 113165 - RNA, 64 nt, Homo Sapiens
ggaagaagcaaaauaucacaucucuagaaguguugggaaaaauauaauuucuuucuuuacuuau

SEQ ID NO: 113166 - RNA, 64 nt, Homo Sapiens
auccucucguaucucaccccaaaccccaaacugggggaaaaaaaguuaacucuuugugaaugga

SEQ ID NO: 113167 - RNA, 64 nt, Homo Sapiens
uuugacaagcuuuauuaaguugagagagagagaggggaaaaaaaaaagccuuucguaguucagu

SEQ ID NO: 113168 - RNA, 64 nt, Homo Sapiens
ugaaaauacaaaauacccaagauuuaagaccggggggaaaaaaccacaaauugguaaauaaagg

SEQ ID NO: 113169 - RNA, 64 nt, Homo Sapiens
uccaguguuacuaguaauuuaaacuuagaaaagagggaaaaaaaacacuucugaaaguuuuugg

SEQ ID NO: 113170 - RNA, 64 nt, Homo Sapiens
ccaggggauguugcuuacucagugauacccacaugggaaaaaucuucccacagcagcuuugcuc

SEQ ID NO: 113171 - RNA, 64 nt, Homo Sapiens
agcuuuugaagaaaggccagugauccagcaaagggggaaaaauaugcauuucaccccacaugac

SEQ ID NO: 113172 - RNA, 64 nt, Homo Sapiens
cagccagcacaaugugacccaacuuaaaauuugggggaaaaagaaugcaggagugaaauaacca

SEQ ID NO: 113173 - RNA, 64 nt, Homo Sapiens
gauaguguuuucuucaaugcgaguuuuuuucucugggaaaaaucuugguuauuggacauuuuug

SEQ ID NO: 113174 - RNA, 64 nt, Homo Sapiens
aaugaaaauuuucuuuauguugaaguauaucugagggaaaaauaucugugucuacauguuauuu

SEQ ID NO: 113175 - RNA, 64 nt, Homo Sapiens
auuuccacuuagauauuuuacuagcuauagaguugggaaaaaauuuuuacugggacuuuuaaau

SEQ ID NO: 113176 - RNA, 64 nt, Homo Sapiens
ucaggaaaauauaucaaaucaggcuugguaggaggggaaaaaaggaggcugggagagacuagga

SEQ ID NO: 113177 - RNA, 64 nt, Homo Sapiens
aggaaaaaaaauagauucugauaacaucaaaucagggaaaaaugcguggccauuuauauaagcu

SEQ ID NO: 113178 - RNA, 64 nt, Homo Sapiens
aguccuaggagaaagcgacggguucauaccaugggggaaaaaaaagcuguggcuuuuagggcuu

SEQ ID NO: 113179 - RNA, 64 nt, Homo Sapiens
aaagauuaaccuuccccacuauucagguuucugugggaaaaaugucuuuucugaaauuucccuu

SEQ ID NO: 113180 - RNA, 64 nt, Homo Sapiens
ucuacaguagauaaagcaaaaacuugagugaguagggaaaaaaaauaaagcuuuacuuagauau

SEQ ID NO: 113181 - RNA, 64 nt, Homo Sapiens
aaugaaaaaaggucaguugauuccagugcuaaaagggaaaaaccugugguccgcccagaagaga

SEQ ID NO: 113182 - RNA, 64 nt, Homo Sapiens
cagaaaagaaaaaaagguuaagcauaaaaagaaagggaaaaagcagaaacacugcagaagacac

SEQ ID NO: 113183 - RNA, 64 nt, Homo Sapiens
uggaaggcgagcuaagaggagacuuagauccagugggaaaaaaaauagcguuucacauaaaaag

SEQ ID NO: 113184 - RNA, 64 nt, Homo Sapiens
agaacacaccaaaaaagugaaagagaaauugaaagggaaaaaagacaaaaagcauaaggcucca

SEQ ID NO: 113185 - RNA, 64 nt, Homo Sapiens
aaagucuguaauuucaguuuuugugucggggagagggaaaaacuauuugucuguaguugcuuuu

SEQ ID NO: 113186 - RNA, 64 nt, Homo Sapiens
uucuucuguaaugagaauagacuggaacaugugagggaaaaauauuuaaaaaaagauggcaguc

SEQ ID NO: 113187 - RNA, 64 nt, Homo Sapiens
cgcuugaaaccuucccacacucccugcuccaggagggaaaaacagauguuguugacagauagag

SEQ ID NO: 113188 - RNA, 64 nt, Homo Sapiens
ggccaggauuaaggggaggcaaucaaugcaccuagggaaaaaauuuaaggagguauucacacuc

SEQ ID NO: 113189 - RNA, 64 nt, Homo Sapiens
caaguucauucccacccaaaaacugaggaauaaagggaaaaacccagagcuguauauaccuguc

SEQ ID NO: 113190 - RNA, 64 nt, Homo Sapiens
aaaagaaaaaaccucauuacgauuccagggcugggggaaaaaaaagaaugaaccagaacuagug

SEQ ID NO: 113191 - RNA, 64 nt, Homo Sapiens
cacacccacaccguagaacaaaaauaagaugacugggaaaaagacccuguucaauaguauggga

SEQ ID NO: 113192 - RNA, 64 nt, Homo Sapiens
agaugacugggaaaaagacacuguucaauaguaugggaaaaauauacguuaucagcaacuuccc

SEQ ID NO: 113193 - RNA, 64 nt, Homo Sapiens
cauguauugggccaccggaaucauucaguguagagggaaaaaagaugguuuucuuuuuguacuu

SEQ ID NO: 113194 - RNA, 64 nt, Homo Sapiens
gaaaagaaaugguuuucuuuuugcaugaugcugggggaaaaagaauuugugguguugccuugcc

SEQ ID NO: 113195 - RNA, 64 nt, Homo Sapiens
aauuuauaagaaagaaugccauugaauuuuuuaggggaaaaacuacaaauuucuaauuuagcug

SEQ ID NO: 113196 - RNA, 64 nt, Homo Sapiens
accugggcagcagagcaagacucugucucaaaaggggaaaaaaaaaauugcugaugugacccau

SEQ ID NO: 113197 - RNA, 64 nt, Homo Sapiens
uaaaauuuuccuuuaugauuccacaaauagucgggggaaaaaauccuucaauuauuucccaucu

SEQ ID NO: 113198 - RNA, 64 nt, Homo Sapiens
cccauagugccuugauuuuacaggguuauuugaggggaaaaaacucuuuuagucagaaaugauu

SEQ ID NO: 113199 - RNA, 64 nt, Homo Sapiens
aggagggaggauugccucauaauguggaggaaaagggaaaaaucaacucucuaucaaaaggaaa

SEQ ID NO: 113200 - RNA, 64 nt, Homo Sapiens
cuuguuuuguuagaggggcauuaugauuuauaaggggaaaaaaacccauuuugccaucugucuc

SEQ ID NO: 113201 - RNA, 64 nt, Homo Sapiens
guugaggggugaaagagaugaugccaauuucagagggaaaaaugauguuuuuggagagcuguga

SEQ ID NO: 113202 - RNA, 64 nt, Homo Sapiens
guuucuucagugauuacaaugugggugggaaaaggggaaaaacuugaagggaauagggcuggua

SEQ ID NO: 113203 - RNA, 64 nt, Homo Sapiens
caacuuggugaacucccagcuaaaugucaugggggggaaaaaccauuugauaccaagggcuuuu

SEQ ID NO: 113204 - RNA, 64 nt, Homo Sapiens
cuucuucuggaaauacauaucuacuuuucuugaggggaaaaaguagaugcuuauccuuuaaauu

SEQ ID NO: 113205 - RNA, 64 nt, Homo Sapiens
acgaaaaggacagacgaagaguuuaaagagaaaagggaaaaaagaaagaaaaaguaagcagggc

SEQ ID NO: 113206 - RNA, 64 nt, Homo Sapiens
ucuuaaaauucaaggccacaaaaacaauguuugggggaaaaaaaagaaaaaaucaugccagcua

SEQ ID NO: 113207 - RNA, 64 nt, Homo Sapiens
gccaucuuuuuaaacaaaaaaaaguuuaaaaugggggaaaaaaaggucacucgggaagggggaa

SEQ ID NO: 113208 - RNA, 64 nt, Homo Sapiens
uuaaaaugggggaaaaaaaggucacucgggaagggggaaaaaguucagucuaacaagucauuag

SEQ ID NO: 113209 - RNA, 64 nt, Homo Sapiens
auacagaagaaaagcaaaugacuaguaaacaugugggaaaaaauauuacauuuuaagggggaaa

SEQ ID NO: 113210 - RNA, 64 nt, Homo Sapiens
guaaacaugugggaaaaaauauuacauuuuaagggggaaaaaaaaacccaccauucucuucucc

SEQ ID NO: 113211 - RNA, 64 nt, Homo Sapiens
cuugguuauucugccauaacaaaaucuuucuuuggggaaaaauucuuuuauauuugaaaaaauu

SEQ ID NO: 113212 - RNA, 64 nt, Homo Sapiens
aaaaaucaaacaaccuucagugaugcaaccaaaagggaaaaaauuuauaugaaaacacucaaaa

SEQ ID NO: 113213 - RNA, 64 nt, Homo Sapiens
aaaaaguuguuugcuuaaaaaaaauuucaugugagggaaaaaaaaaaaaccuauuccagaauaa

SEQ ID NO: 113214 - RNA, 64 nt, Homo Sapiens
aaaacagaaaacaauuccacgaggccaaucuaaagggaaaaaauccuacacuacuuuuacuacu

SEQ ID NO: 113215 - RNA, 64 nt, Homo Sapiens
uaaaauaaccccuauuuuucuuguuuuuaauaaggggaaaaagaagaccuugguuugguaguuc

SEQ ID NO: 113216 - RNA, 64 nt, Homo Sapiens
ugucaucuccccccaccucaucuuuuauugcaaggggaaaaaaauuuccguuucaagaccuuuu

SEQ ID NO: 113217 - RNA, 64 nt, Homo Sapiens
aacacauuccagagcuuuccgacccauuuugggggggaaaaaccagucacuuuacccuccuuag

SEQ ID NO: 113218 - RNA, 64 nt, Homo Sapiens
uuaggugcuaaccaccugccuuggggggaagugagggaaaaacgggaccaaaggacuuaagaau

SEQ ID NO: 113219 - RNA, 64 nt, Homo Sapiens
cuuuucaagucuccucagucaucaauaguuccuggggaaaaacagagcugguagacuugaagag

SEQ ID NO: 113220 - RNA, 64 nt, Homo Sapiens
agaaacacaagauuuaauuauuuuucuacuuggggggaaaaaaguccucauguagaagcaccca

SEQ ID NO: 113221 - RNA, 64 nt, Homo Sapiens
cuccugaccccagauucaacuuugcaaacaacaggggaaaaaaauggggaaaagaaaaaccacg

SEQ ID NO: 113222 - RNA, 64 nt, Homo Sapiens
ggaaaaaaauggggaaaagaaaaaccacgagagagggaaaaaaaauuauucugcaccuguaaaa

SEQ ID NO: 113223 - RNA, 64 nt, Homo Sapiens
aggugagaauuuguaaauaccauugaauguaaaggggaaaaauagaugaauccccacacuuagc

SEQ ID NO: 113224 - RNA, 64 nt, Homo Sapiens
agcccaugggccuuuagaaucagcucugaaauuugggaaaaagugauccccugcuggggacucc

SEQ ID NO: 113225 - RNA, 64 nt, Homo Sapiens
aguuuugagugucuuuagaugaaagggaugggcagggaaaaacuacacauaaaguugcaguuag

SEQ ID NO: 113226 - RNA, 64 nt, Homo Sapiens
aacuagugugaaguuuacaguauuaauacuaacugggaaaaaaaagaauuaaaaauuuucuaaa

SEQ ID NO: 113227 - RNA, 64 nt, Homo Sapiens
cuuuucuauuuuucaguaacugcaaauaagggaagggaaaaaugacugucuggacaaacacaau

SEQ ID NO: 113228 - RNA, 64 nt, Homo Sapiens
acaaacuguguuuuuaacucuccaauguauuguugggaaaaagcuuuaacagaaacagcuaauu

SEQ ID NO: 113229 - RNA, 64 nt, Homo Sapiens
uugagaccagaugguggagcgcuguuuccucagagggaaaaaucaacugggcuaccucucuaca

SEQ ID NO: 113230 - RNA, 64 nt, Homo Sapiens
gacaacuaacaaaaccagcaagaaaacaaagaaggggaaaaacuaguggaaguuaagaggggug

SEQ ID NO: 113231 - RNA, 64 nt, Homo Sapiens
agcuggauaaccacccaaagagaacagccuacaggggaaaaacacauuugauugguuugagccc

SEQ ID NO: 113232 - RNA, 64 nt, Homo Sapiens
aaauucuguagauagcaaauaauagagguuaaaagggaaaaaaaccaccuccuuccugaacucu

SEQ ID NO: 113233 - RNA, 64 nt, Homo Sapiens
ugggaugggauaucagaggaagaagcauacaagugggaaaaacugugauuagaaagggaaaaau

SEQ ID NO: 113234 - RNA, 64 nt, Homo Sapiens
gaagcauacaagugggaaaaacugugauuagaaagggaaaaauaggcauuuccacaguacuauu

SEQ ID NO: 113235 - RNA, 64 nt, Homo Sapiens
uacaaaaugcuacaguguuuaagaugauugucaggggaaaaacuaagcuuaagugggaaaaagg

SEQ ID NO: 113236 - RNA, 64 nt, Homo Sapiens
aagaugauugucaggggaaauugaaagcuuaagugggaaaaaggaaugagcacuuuucauucac

SEQ ID NO: 113237 - RNA, 64 nt, Homo Sapiens
cuuucuuagacacacuggcauuacaaggaaccaggggaaaaaaauuccugccccuaguauuuga

SEQ ID NO: 113238 - RNA, 64 nt, Homo Sapiens
ggaaauagucugauuuuaauagaggggcgagaaggggaaaaaugaguuacuuuuaggauggggg

SEQ ID NO: 113239 - RNA, 64 nt, Homo Sapiens
auguagcgacagcauuuuaauuucugaauuggaagggaaaaaaauuacuaugguaacacuuugc

SEQ ID NO: 113240 - RNA, 64 nt, Homo Sapiens
acaucauuccaaaaagaacaggacagcuacuucugggaaaaacaagcgcuuaaaaaaacaaauu

SEQ ID NO: 113241 - RNA, 64 nt, Homo Sapiens
uaaaaaaaacaguuuagaugccuucuccuuuugagggaaaaagggugcuuuuuauuguauaaag

SEQ ID NO: 113242 - RNA, 64 nt, Homo Sapiens
gagagguuucugggaagacucucuuuuugcccucgggaaaaagcaaaauaucaauguuugggug

SEQ ID NO: 113243 - RNA, 64 nt, Homo Sapiens
ucaauaugagaaauaccauaccacuuaugagauugggaaaaagagcuuaauuucucauuuuauc

SEQ ID NO: 113244 - RNA, 64 nt, Homo Sapiens
gccuugauuuuaggguuaaaauuuaauauucugggggaaaaaaguauuucuacguuuuuaguaa

SEQ ID NO: 113245 - RNA, 64 nt, Homo Sapiens
gugcguguucagcagaaccugcacacaggacagcgggaaaaaucgaugagcgccaccucuuuaa

SEQ ID NO: 113246 - RNA, 64 nt, Homo Sapiens
aucuauggaagucgugucuuacuccaggugaagggggaaaaaaaaagccuauacuuuggcaggu

SEQ ID NO: 113247 - RNA, 64 nt, Homo Sapiens
gaugucucuaauuacuggcuugcuuucuaguccugggaaaaaaauaugcagucauguggaaccu

SEQ ID NO: 113248 - RNA, 64 nt, Homo Sapiens
cacaguucaccauguggaguuguugucaaaccaagggaaaaaaccaugaauuuaauguauaaaa

SEQ ID NO: 113249 - RNA, 64 nt, Homo Sapiens
ugguaauguuuuugaucagaauaaagaggguaaagggaaaaaguuacuacacaugcuaggcuuu

SEQ ID NO: 113250 - RNA, 64 nt, Homo Sapiens
aaaaaguuacuacacaugcuaggcuuucucaguggggaaaaaaauggcuggauagaacugggac

SEQ ID NO: 113251 - RNA, 64 nt, Homo Sapiens
aaaaacaaaaaacuauaguuuuuuuuuaacaacugggaaaaaacauugaaacugugaguuguuu

SEQ ID NO: 113252 - RNA, 64 nt, Homo Sapiens
gaacagauuucagagauuaauuuuuauaaauggagggaaaaaaugcaaaugauaaauugacccc

SEQ ID NO: 113253 - RNA, 64 nt, Homo Sapiens
guauuauaugccaaaaagauccuacauuuugguagggaaaaaacaacacuguguuugacguauu

SEQ ID NO: 113254 - RNA, 64 nt, Homo Sapiens
cuauacaguauaaacuaccucacuugccuuucuugggaaaaaaaaaaugaauggacuuuaacaa

SEQ ID NO: 113255 - RNA, 64 nt, Homo Sapiens
aggaagugauuauaaaucgaagcucuggcccagugggaaaaauuugcuuaucaucuaaagaugu

SEQ ID NO: 113256 - RNA, 64 nt, Homo Sapiens
cccuuaaaucauaggaaagucgaaggacagcgaugggaaaaaugacccacugagauuuccacgc

SEQ ID NO: 113257 - RNA, 64 nt, Homo Sapiens
auucaacacuccuuaugcauauggaguuaggacagggaaaaaucucaucauugcuucauacgac

SEQ ID NO: 113258 - RNA, 64 nt, Homo Sapiens
gucuugugauugacuuucgcaugccuagauaauggggaaaaaaauuaucauaaaauuuucauau

SEQ ID NO: 113259 - RNA, 64 nt, Homo Sapiens
ucuuuuaaaacuuggcuguucauuauaguaagaggggaaaaaaacagcagaaggucacuacuca

SEQ ID NO: 113260 - RNA, 64 nt, Homo Sapiens
augucugccuagaccucaaaaagaguuaguuuuagggaaaaagauuaucuagccaggagguccc

SEQ ID NO: 113261 - RNA, 64 nt, Homo Sapiens
cucucagauccauaauccauacucagugaaagcagggaaaaaauauuuucacuuauuuuauuug

SEQ ID NO: 113262 - RNA, 64 nt, Homo Sapiens
ccuguguaaguauugugaaaacccuuuucuuccagggaaaaauuauuggaaauuccuuaacuga

SEQ ID NO: 113263 - RNA, 64 nt, Homo Sapiens
gauacuuggauuaggggguguuuuguaguuaauugggaaaaaguucuuagugccucccagaaca

SEQ ID NO: 113264 - RNA, 64 nt, Homo Sapiens
aaacucauuggcagauccaauaaaauguuugugugggaaaaaaacuguuuacauauacagcacu

SEQ ID NO: 113265 - RNA, 55 nt, Homo Sapiens
acacuuccacuacucucuaagaccuccugccuaagugcagccccgugggguuccu

SEQ ID NO: 113266 - RNA, 64 nt, Homo Sapiens
aucaccaaggcugauuaaaccaaggcuagaaccaccugccuauauuuuuuguuaaaugauuuca

SEQ ID NO: 113267 - RNA, 64 nt, Homo Sapiens
uuucugcaaaaaugagauguuauaauucuuucugccugccuacuuccuuuuggaaacuuuuaug

SEQ ID NO: 113268 - RNA, 64 nt, Homo Sapiens
uggaguuuaaaugcguaauaacuugguuccaguuccugccuaucaauuaagcaaauugcuuaac

SEQ ID NO: 113269 - RNA, 64 nt, Homo Sapiens
caucaggaauuccuuccugucaucuaaccucaguccugccuacugcaguuccagccaaccugcu

SEQ ID NO: 113270 - RNA, 64 nt, Homo Sapiens
aagcagcacaccggcugcagaugggacagccagcccugccuaucuggacaggccccugcagccu

SEQ ID NO: 113271 - RNA, 64 nt, Homo Sapiens
ucccagggacuauuuucuccucguaagccagcgaccugccuaaagcuugggcugugccugcaaa

SEQ ID NO: 113272 - RNA, 64 nt, Homo Sapiens
ugcuugucacuucccagagauugcagagguguguccugccuaccaucugccuguccagcuuggu

SEQ ID NO: 113273 - RNA, 64 nt, Homo Sapiens
gcaacucuccauacuggacacucaagccuccaaaccugccuacgcagcucccugcagcccaagu

SEQ ID NO: 113274 - RNA, 64 nt, Homo Sapiens
cggugaguguauggcggaacccggaggacugcuuccugccuacccaaccaguaccucguagguc

SEQ ID NO: 113275 - RNA, 64 nt, Homo Sapiens
gucugugaacgaggccugucugaauuuuuuauucccugccuaggcaagacuucugugaaugacu

SEQ ID NO: 113276 - RNA, 64 nt, Homo Sapiens
uggcugggucguuucuuccagcauugacucaaggccugccuaacggugauuucggucacuucag

SEQ ID NO: 113277 - RNA, 64 nt, Homo Sapiens
aggacggcagaggccuccuggccucagggcaugcccugccuaccuucugaaauguuuaccccau

SEQ ID NO: 113278 - RNA, 64 nt, Homo Sapiens
caagagauauugccccuugaugagagucaaacacccugccuacaaggagauguuuugaaaugga

SEQ ID NO: 113279 - RNA, 64 nt, Homo Sapiens
ugacgcuggugcuggaaccuaaccauuaguccugaugagugagcccagcuccccaguccaggac

SEQ ID NO: 113280 - RNA, 64 nt, Homo Sapiens
uuucguacaugcagcuauuugacgguaauugagaaugagugaggaggugugcagggccaauccu

SEQ ID NO: 113281 - RNA, 64 nt, Homo Sapiens
aggugaaaagucaaaugaaacaguacaauucuugaugagugaggugucaucuuccaaccacaca

SEQ ID NO: 113282 - RNA, 64 nt, Homo Sapiens
uggcuaugaucaucugauggcaagugaaggagaaaugagugauagggcuuugcguuuucaucca

SEQ ID NO: 113283 - RNA, 64 nt, Homo Sapiens
gguagucagaagagaacaaaagauuauuuaaaacaugagugacaaggcuuauuauuucaaaaga

SEQ ID NO: 113284 - RNA, 64 nt, Homo Sapiens
gguggucuccguuuauacccgauccuagguucugaugagugauauccauuuaaaggaaugugau

SEQ ID NO: 113285 - RNA, 64 nt, Homo Sapiens
uagcucuaggagcaccauccugccauggguuuguccagcucagggccagacuuucuguucuguc

SEQ ID NO: 113286 - RNA, 64 nt, Homo Sapiens
aaugaaaacgucagccucugauuccgaagauacaccagcucacaugguuuuaaaauuaaaaaua

SEQ ID NO: 113287 - RNA, 64 nt, Homo Sapiens
ccaaacauggccugcugggcccaagugaggagugccagcucaaguuggaguugacugcucauac

SEQ ID NO: 113288 - RNA, 64 nt, Homo Sapiens
gcucagcggugccacugaggacccgugugacucgccagcucauucucaccaaucgcuccccaau

SEQ ID NO: 113289 - RNA, 64 nt, Homo Sapiens
gcaccuccacaacgaaugaagaauucgcauuuugccagcucagcuguaaaugaagguguucuua

SEQ ID NO: 113290 - RNA, 64 nt, Homo Sapiens
gucuuuuucagucaucccaggugcccauggggcaccagcucaugccacgguuuucccuccuugu

SEQ ID NO: 113291 - RNA, 64 nt, Homo Sapiens
gccugggauuggcugugaggucccuccgcaucacccagcucacgucccccaaaacgugcauggu

SEQ ID NO: 113292 - RNA, 64 nt, Homo Sapiens
ucucaugccauccucaggugggaggugucagagcccagcucaugcacaucagcugguggagcag

SEQ ID NO: 113293 - RNA, 64 nt, Homo Sapiens
gccaugcacaggccacaggcccuccaccucaccuccagcucaggggccgcaccccgccgcuggc

SEQ ID NO: 113294 - RNA, 64 nt, Homo Sapiens
ggacagccagaugcagagcgaguggaugcacuucccagcucaucucuggaagccuuugcuacuc

SEQ ID NO: 113295 - RNA, 64 nt, Homo Sapiens
gucggggagcugugcuucucucuccgguacgugcccagcucaggccggcugaccgugguggugc

SEQ ID NO: 113296 - RNA, 64 nt, Homo Sapiens
gcaaccuugcccucccagagcccuacgugaagguccagcucaugcugaaccagaggaaguggaa

SEQ ID NO: 113297 - RNA, 64 nt, Homo Sapiens
agggagcagccccaggccagagaggccucccgguccagcucagggaugcuccugccagcacagg

SEQ ID NO: 113298 - RNA, 64 nt, Homo Sapiens
ggagcaggcacauagugagcccgggcagcccugcccagcucaggccccuuuccuuccccauuga

SEQ ID NO: 113299 - RNA, 64 nt, Homo Sapiens
ugagaugcugguuuucuacccaacggcccugcagccagcucacguccagguucaacccacagcu

SEQ ID NO: 113300 - RNA, 64 nt, Homo Sapiens
ugcuaauuuaaagagacuccaaaucucaaugaagccagcucacagugcugugugccccggucac

SEQ ID NO: 113301 - RNA, 64 nt, Homo Sapiens
gagacaaagggagccgagacccuggauggggcuuccagcucagaacccaucccucuggugggua

SEQ ID NO: 113302 - RNA, 64 nt, Homo Sapiens
acucagcccuuugggcggccucugggcuugggcaccagcucaugccagccccagagggucaggg

SEQ ID NO: 113303 - RNA, 64 nt, Homo Sapiens
uuguucacagauuuggaauggagcccucccacugccagcucagggugugugugugugugagaga

SEQ ID NO: 113304 - RNA, 64 nt, Homo Sapiens
uuugaucuacaccucuugccagcagccuuuugucccagcucagcgcucacccagagaggcucaa

SEQ ID NO: 113305 - RNA, 64 nt, Homo Sapiens
uaaaaccugcaauucugcauugguaccaguguuaccagcucaacuuggaagggaaaaaagaaag

SEQ ID NO: 113306 - RNA, 64 nt, Homo Sapiens
guaaaggagaauguugcuaaguggcugagucuacccagcucaaguaaagagacaguaggacauu

SEQ ID NO: 113307 - RNA, 64 nt, Homo Sapiens
uguccagcuuccuccaggguuccccagccaccucccagcucagggcacaguguaucgacaaucu

SEQ ID NO: 113308 - RNA, 64 nt, Homo Sapiens
gaggcagaggacaccuccccaucacucagcauucccagcucagggcacaggcaggcuggggucc

SEQ ID NO: 113309 - RNA, 64 nt, Homo Sapiens
ucgaauuauauauccauauauuuucuucucagucccagcucagagcuuugaguugcaauugcua

SEQ ID NO: 113310 - RNA, 64 nt, Homo Sapiens
accacgggggucugugccggcucccugccgggguccagcucagaccugccacccacgggggcuc

SEQ ID NO: 113311 - RNA, 64 nt, Homo Sapiens
ccccacccuccacagagcccccuugcugggacagccagcucaccuccaaggacauccccuccug

SEQ ID NO: 113312 - RNA, 64 nt, Homo Sapiens
acuuuucaggcacuguagggucacccauaugccuccagcucaguugacgcuuaaaaacaggugc

SEQ ID NO: 113313 - RNA, 64 nt, Homo Sapiens
gggggccuuauggggaaggcucugacacuccaccccagcucaggccaugggcagcagggcucca

SEQ ID NO: 113314 - RNA, 64 nt, Homo Sapiens
cuagugugcaauuggguguugccucaguuuccucccagcucaguuuuauuagaucaaagcuguu

SEQ ID NO: 113315 - RNA, 64 nt, Homo Sapiens
caauauuaaugaaguagguuuguuuuuaaagaagccagcucaagcguaauaacauuagagaaaa

SEQ ID NO: 113316 - RNA, 64 nt, Homo Sapiens
acagcaugagaacagcaguucacaaauacucaugccagcucauuuugcauguggagccaugugg

SEQ ID NO: 113317 - RNA, 64 nt, Homo Sapiens
ggguggucacagcaugugucgaccaggggaaaggccagcucagacagcccucugauggugguga

SEQ ID NO: 113318 - RNA, 64 nt, Homo Sapiens
cagggguggagccuggccuguacugacgcccuucccagcucaucggguuggggugggguggggg

SEQ ID NO: 113319 - RNA, 64 nt, Homo Sapiens
gaguagcugggauuacaggugggugucaccacacccagcucaguauuguauuuuuagcagagau

SEQ ID NO: 113320 - RNA, 64 nt, Homo Sapiens
auccuauccccaagagugaugcccggcagcauucccagcucagggcuaaugguucacggaagcc

SEQ ID NO: 113321 - RNA, 64 nt, Homo Sapiens
auggcagcagugcggaggccccugccuagaaacaccagcucagccugcaaugcaugggacaggc

SEQ ID NO: 113322 - RNA, 64 nt, Homo Sapiens
ccagaagcugacuuuggccgccacccggugcugcccagcucaagcuggugucuccccuccccca

SEQ ID NO: 113323 - RNA, 64 nt, Homo Sapiens
gaggcagaggaguugcucagucccaucucucagaccagcucacuccuuugacggcguguguugg

SEQ ID NO: 113324 - RNA, 64 nt, Homo Sapiens
cuccccaguuuaccacuuugcacccgagucagucccagcucaucgccgugcggaugaacuucag

SEQ ID NO: 113325 - RNA, 64 nt, Homo Sapiens
ccgucagguacuccugccagggaacuggccugcugcgccccaggccccgcccgucucugcucug

SEQ ID NO: 113326 - RNA, 64 nt, Homo Sapiens
cucaaggugcggggagaagaagcggccaggcggggcgccccaagagcccaaaagagggcacacc

SEQ ID NO: 113327 - RNA, 64 nt, Homo Sapiens
ugguucgggcugugacgggguggccagcagggacgcgccccaggugggcagcuguggcagagca

SEQ ID NO: 113328 - RNA, 64 nt, Homo Sapiens
ugguucgggccgugacggggcggccagcagggacgcgccccaggugggcagcuguggcagagca

SEQ ID NO: 113329 - RNA, 64 nt, Homo Sapiens
ccuggccgggcagggacagggcagaggacucugagcgccccacccaugccugccuggccuggua

SEQ ID NO: 113330 - RNA, 64 nt, Homo Sapiens
ccuggccugguagagaagauggcacaggauggaggcgccccaagacggacaguguacauaagag

SEQ ID NO: 113331 - RNA, 64 nt, Homo Sapiens
gcgcccugcuccaucggcacuaaugcuccacucggcgccccacuccaucggccccgcuccaucg

SEQ ID NO: 113332 - RNA, 64 nt, Homo Sapiens
cggccccgcuccaucggcacuaaugccccacucggcgccccacuccaucagcacuaaugcucca

SEQ ID NO: 113333 - RNA, 64 nt, Homo Sapiens
uucccccacggcucaagagagccccugcgccccagcgccccaccguguccccagcgcccgcugc

SEQ ID NO: 113334 - RNA, 64 nt, Homo Sapiens
gccccaccuucccccacggccccgcugcgccccugcgccccagccagcagguguguccccagcg

SEQ ID NO: 113335 - RNA, 64 nt, Homo Sapiens
auggauuuauuuuuuuuccuuucaaacacgguaaggaaacaaucuauuacuuuuuuccuuaaaa

SEQ ID NO: 113336 - RNA, 64 nt, Homo Sapiens
uggcguuuuuuuauacauaaccauggauguagugggaaacaauguuguuugguaaaaauaaugu

SEQ ID NO: 113337 - RNA, 64 nt, Homo Sapiens
uuuaguuuauugcuuuggaguaccuccccgucuuggaaacaaguauuguuuuauaagccugcuu

SEQ ID NO: 113338 - RNA, 64 nt, Homo Sapiens
gggccacuuggcuuucuuuuauggcaaacacacuggaaacaauuaaaguaacaaccaugcuaag

SEQ ID NO: 113339 - RNA, 64 nt, Homo Sapiens
caggugcaacuguguguacaccagggaucuguuuggaaacaaccccuugagcugccaggcucaa

SEQ ID NO: 113340 - RNA, 64 nt, Homo Sapiens
uagagcauguugcugauacucuucuguuuucaagggaaacaaucacauuguuugauuccaaaug

SEQ ID NO: 113341 - RNA, 64 nt, Homo Sapiens
guacaagaugugguuagaaacauuucuuuguucuggaaacaaaguacuguugaaaccagcuugg

SEQ ID NO: 113342 - RNA, 64 nt, Homo Sapiens
aaaaguuuucuuaucuucugugcuuuuggucccuggaaacaaauccgccuauguaugaagcuag

SEQ ID NO: 113343 - RNA, 64 nt, Homo Sapiens
cagugcucaacuauuugaacuguugagugauaaaggaaacaaauauaacuguaaaugaaucuug

SEQ ID NO: 113344 - RNA, 64 nt, Homo Sapiens
aaggacucuaauaaaaaaucacuucauuguauuuggaaacaaaaacaucauucauuaauuacuu

SEQ ID NO: 113345 - RNA, 64 nt, Homo Sapiens
guuugauggaaugaaucaccuggguggggaccuuggaaacaaguuuguccguccacucuacaaa

SEQ ID NO: 113346 - RNA, 64 nt, Homo Sapiens
uggaaaucuaugaauuauugcaaauuguaaugcuggaaacaaaaaauaaauccuugguuaaagg

SEQ ID NO: 113347 - RNA, 64 nt, Homo Sapiens
ggcuuccaggcaaggaaguucuaucuugugauacggaaacaauaaauuccugagauacauucuu

SEQ ID NO: 113348 - RNA, 64 nt, Homo Sapiens
agaugauauuucagaagaguuggcugccuucucuggaaacaaggaaaacccaauaauuccgagg

SEQ ID NO: 113349 - RNA, 64 nt, Homo Sapiens
cugaguccgcucgcacccgccgcugcaguucacgggaaacaagcccuugcuguucugggaucuu

SEQ ID NO: 113350 - RNA, 64 nt, Homo Sapiens
cuuagugcuugggagggaggagaggggacucacaggaaacaaguucccaguaaggaguuuccca

SEQ ID NO: 113351 - RNA, 64 nt, Homo Sapiens
uguucugcuagcuuguuuuccaucaccuuagugaggaaacaaaauggcaaaggcaucucaggaa

SEQ ID NO: 113352 - RNA, 64 nt, Homo Sapiens
auagaaauggaagaaagugaguuaaccacagucgggaaacaagcaguauccauugggacaugaa

SEQ ID NO: 113353 - RNA, 64 nt, Homo Sapiens
aauguggucugcuuuauaagcuacagguauauauggaaacaaauauuugaggggagagaaauau

SEQ ID NO: 113354 - RNA, 64 nt, Homo Sapiens
agaagccaucaccuggcccacacauuagccuucuggaaacaaguuacuaagaaaggguguagga

SEQ ID NO: 113355 - RNA, 61 nt, Homo Sapiens
ugggcacccuuguucauaccaugacagaaggagcaaccacauuuaguagcacuuucucugg

SEQ ID NO: 113356 - RNA, 61 nt, Homo Sapiens
uucuucauggaacucagcccuacauccgaaaagcaaccaacuuuacauccgaacaaaauuu

SEQ ID NO: 113357 - RNA, 61 nt, Homo Sapiens
ucaaauguaaaguuuaauugaaagaauguaaagcaaccaaaaagaaaaaaaaaaagaaaga

SEQ ID NO: 113358 - RNA, 61 nt, Homo Sapiens
accuacggccacgggaacaggaccaugguuaagcaaccauauagaaagcuuuguugaaaga

SEQ ID NO: 113359 - RNA, 61 nt, Homo Sapiens
ucuccugagucgaggaaucuguauuauuaauagcaaccagggccgggugucguggcucacg

SEQ ID NO: 113360 - RNA, 61 nt, Homo Sapiens
gagacuccuucucaaaaguaaauaaauaaauagcaaccaguacuccaggugauuccagcau

SEQ ID NO: 113361 - RNA, 61 nt, Homo Sapiens
acgaaguugagaaggaaaacaaacuccauguagcaaccagggugauuuucuuuucuaaaug

SEQ ID NO: 113362 - RNA, 61 nt, Homo Sapiens
gucuguuaaucauuucucuaggacucagucaagcaaccacaaggcauuuggcauauuuugu

SEQ ID NO: 113363 - RNA, 64 nt, Homo Sapiens; identical to SEQ ID NO: 44425

SEQ ID NO: 113364 - RNA, 64 nt, Homo Sapiens; identical to SEQ ID NO: 44426

SEQ ID NO: 113365 - RNA, 64 nt, Homo Sapiens; identical to SEQ ID NO: 44427

SEQ ID NO: 113366 - RNA, 64 nt, Homo Sapiens; identical to SEQ ID NO: 44428

SEQ ID NO: 113367 - RNA, 64 nt, Homo Sapiens; identical to SEQ ID NO: 44429

SEQ ID NO: 113368 - RNA, 64 nt, Homo Sapiens; identical to SEQ ID NO: 44430

SEQ ID NO: 113369 - RNA, 64 nt, Homo Sapiens; identical to SEQ ID NO: 44431

SEQ ID NO: 113370 - RNA, 64 nt, Homo Sapiens; identical to SEQ ID NO: 44432

SEQ ID NO: 113371 - RNA, 64 nt, Homo Sapiens; identical to SEQ ID NO: 44433

SEQ ID NO: 113372 - RNA, 64 nt, Homo Sapiens; identical to SEQ ID NO: 44434

SEQ ID NO: 113373 - RNA, 64 nt, Homo Sapiens; identical to SEQ ID NO: 44435

SEQ ID NO: 113374 - RNA, 64 nt, Homo Sapiens; identical to SEQ ID NO: 44436

SEQ ID NO: 113375 - RNA, 64 nt, Homo Sapiens; identical to SEQ ID NO: 74844

SEQ ID NO: 113376 - RNA, 64 nt, Homo Sapiens; identical to SEQ ID NO: 74845

SEQ ID NO: 113377 - RNA, 64 nt, Homo Sapiens; identical to SEQ ID NO: 74846

SEQ ID NO: 113378 - RNA, 64 nt, Homo Sapiens; identical to SEQ ID NO: 74847

SEQ ID NO: 113379 - RNA, 64 nt, Homo Sapiens; identical to SEQ ID NO: 74848

SEQ ID NO: 113380 - RNA, 64 nt, Homo Sapiens; identical to SEQ ID NO: 74849

SEQ ID NO: 113381 - RNA, 64 nt, Homo Sapiens; identical to SEQ ID NO: 74850

SEQ ID NO: 113382 - RNA, 64 nt, Homo Sapiens; identical to SEQ ID NO: 74851

SEQ ID NO: 113383 - RNA, 64 nt, Homo Sapiens; identical to SEQ ID NO: 74852

SEQ ID NO: 113384 - RNA, 64 nt, Homo Sapiens; identical to SEQ ID NO: 74853

SEQ ID NO: 113385 - RNA, 64 nt, Homo Sapiens; identical to SEQ ID NO: 51621

SEQ ID NO: 113386 - RNA, 64 nt, Homo Sapiens; identical to SEQ ID NO: 51622

SEQ ID NO: 113387 - RNA, 64 nt, Homo Sapiens; identical to SEQ ID NO: 51623

SEQ ID NO: 113388 - RNA, 64 nt, Homo Sapiens; identical to SEQ ID NO: 51624

SEQ ID NO: 113389 - RNA, 64 nt, Homo Sapiens; identical to SEQ ID NO: 51625

SEQ ID NO: 113390 - RNA, 64 nt, Homo Sapiens; identical to SEQ ID NO: 51626

SEQ ID NO: 113391 - RNA, 64 nt, Homo Sapiens; identical to SEQ ID NO: 51627

SEQ ID NO: 113392 - RNA, 64 nt, Homo Sapiens; identical to SEQ ID NO: 51628

SEQ ID NO: 113393 - RNA, 64 nt, Homo Sapiens
auccuggauauguacuaacgaauauuaccaccagagaagagagcuuucuacaaaagucacuaca

SEQ ID NO: 113394 - RNA, 64 nt, Homo Sapiens
uuuucucaagaccuuccucaagcauuuuaucuuuagaagagaaacugaugggcaccugauacuc

SEQ ID NO: 113395 - RNA, 64 nt, Homo Sapiens
caagucucccuuucccugucuggcuucucccuuaagaagagagagauacuuguagaauugggug

SEQ ID NO: 113396 - RNA, 64 nt, Homo Sapiens
gagaauaaggagccuuucuuauggaagaaaugggagaagagagacaggguucuuuucagcagag

SEQ ID NO: 113397 - RNA, 64 nt, Homo Sapiens
gguaggaaaaucugaguuuucuuaucuuugaccuagaagagauucuuuuuggaccaaccugcga

SEQ ID NO: 113398 - RNA, 64 nt, Homo Sapiens
acuggaagggcuggugcagaucuacuucccaugcagaagagaagucacaucuuccagggaaucg

SEQ ID NO: 113399 - RNA, 64 nt, Homo Sapiens
acaagucuguggcccagacagucaacugacaaagagaagagaaggcccaaggucaagucuggcu

SEQ ID NO: 113400 - RNA, 64 nt, Homo Sapiens
aagagggggagguacggucauguuccccacacagagaagagaugaugaaggaugcuucaugccc

SEQ ID NO: 113401 - RNA, 64 nt, Homo Sapiens
cugccauuuaaccccuugguaauuuggcuuugggagaagagaugaaauggaauauauugguuag

SEQ ID NO: 113402 - RNA, 64 nt, Homo Sapiens
aacuaacuagacuaagaagauuuuuuaacuuucuagaagagaaaauacacugauucuagguaca

SEQ ID NO: 113403 - RNA, 64 nt, Homo Sapiens
uccuauaacugugaaaggaggauuucuggaauucagaagagagcuauugaguuugcuguguuga

SEQ ID NO: 113404 - RNA, 64 nt, Homo Sapiens
gauaugcauaugcaacuuauaaucaaauagaacuagaagagacuuugaagucaccugacucagc

SEQ ID NO: 113405 - RNA, 64 nt, Homo Sapiens
aauuagcgcuuauaaaauaaaaauguuuaguucaagaagagacccaagcuggguaugguggugu

SEQ ID NO: 113406 - RNA, 64 nt, Homo Sapiens
uagagugagaucccaucucuaaaaaaugaaaaaaagaagagagguagcuuuaaagugguuuuuc

SEQ ID NO: 113407 - RNA, 64 nt, Homo Sapiens
ugggacaucuaauagucccuaagagaaaugaaagagaagagaaaacacuggggugagaagagau

SEQ ID NO: 113408 - RNA, 64 nt, Homo Sapiens
agagaaaugaaagagaagagguuacacuggggugagaagagauaguaaaaaccuguagcgauuc

SEQ ID NO: 113409 - RNA, 64 nt, Homo Sapiens
cucugaaagaaaggaggggauaaacauagcccagagaagagagggacaaaaaguccagaaccca

SEQ ID NO: 113410 - RNA, 64 nt, Homo Sapiens
gcuucaugaagaacuuucuagaaggacaagucuaagaagagaaaaacaacagugauucugaaga

SEQ ID NO: 113411 - RNA, 64 nt, Homo Sapiens
ccagugcuaaaagggaaaaaccugugguccgcccagaagagauuccuccagugccugagaaccg

SEQ ID NO: 113412 - RNA, 64 nt, Homo Sapiens
gauuccuccagugccugagaaccgauuuuuacugagaagagauaugccuguuguuacugcagaa

SEQ ID NO: 113413 - RNA, 64 nt, Homo Sapiens
aagcagaaacacugcagaagacacaaacaaacaaagaagagaaggauucuuauaccgucugaca

SEQ ID NO: 113414 - RNA, 64 nt, Homo Sapiens
uccaggaacagucccucaggagaggcaguggaccagaagagauggcgaaacgugagcucgccgg

SEQ ID NO: 113415 - RNA, 64 nt, Homo Sapiens
caaggauucuguccucauugcuggguaagcagggagaagagaaguuuuccccaugucuaauuuu

SEQ ID NO: 113416 - RNA, 64 nt, Homo Sapiens
gggaaagagacccuacacauggccuagaaaugagagaagagagagguauuuacccagaggauuu

SEQ ID NO: 113417 - RNA, 64 nt, Homo Sapiens
uauuaagucuuuguaucucucgacugauuaauaaagaagagaaacacguaucugucuuaguucc

SEQ ID NO: 113418 - RNA, 64 nt, Homo Sapiens
ugugugaggauuucccaguacuggauggagaaugagaagagaaagucagccuuucuggggcuuu

SEQ ID NO: 113419 - RNA, 64 nt, Homo Sapiens
agauaaaggcaacccaaugaaaccacagagaggcagaagagaacgggcagaaguacagaacaga

SEQ ID NO: 113420 - RNA, 64 nt, Homo Sapiens
agaaagaggaaguguucacuuucuaguuaaauguagaagagagaucaguuuuuuuuaaacauga

SEQ ID NO: 113421 - RNA, 64 nt, Homo Sapiens
aaaauauacauuauaaaagcuggauaugaaaaacagaagagagaaaaauagcauuuagaaguuu

SEQ ID NO: 113422 - RNA, 58 nt, Homo Sapiens
cauguacccacucacagugaugccagcaagaagagacugauugaggauacugaagacu

SEQ ID NO: 113423 - RNA, 64 nt, Homo Sapiens
cauucugugaauuuuugaaagucaacaguucaggagaagagaaggaauuugaagagaaaaagga

SEQ ID NO: 113424 - RNA, 64 nt, Homo Sapiens
gaacuaaaaauacgaggaaaaaauaaaggcagagagaagagacaggagaggaguccaaggggac

SEQ ID NO: 113425 - RNA, 64 nt, Homo Sapiens
gaagacuacuuaguaauuccggaugggaaaggaaagaagagaauccuggcuucuccaugugagg

SEQ ID NO: 113426 - RNA, 64 nt, Homo Sapiens
cuguuuccccuccucuccccccaggcccccagacagaagagacccugcagcugcugcccuucuc

SEQ ID NO: 113427 - RNA, 64 nt, Homo Sapiens
ucccgcuucugugauuugguacuuggagaaaggcagaagagacgauuuucuggggugaggcuug

SEQ ID NO: 113428 - RNA, 64 nt, Homo Sapiens
acuucagcugaagauuuuauauaggacuuuaaaaagaagagaagagaaagaagaaacaaugcau

SEQ ID NO: 113429 - RNA, 64 nt, Homo Sapiens
agcugaagauuuuauauaggacuuuaaaaagaagagaagagaaagaagaaacaaugcauuucca

SEQ ID NO: 113430 - RNA, 64 nt, Homo Sapiens
augccugaugaccuauaagaagaaaguauugaaaagaagagagauuagaacuguuagaaggagu

SEQ ID NO: 113431 - RNA, 64 nt, Homo Sapiens
acuauuacauauuuuucuagaaaaucuaaaguucagaagagaauguaucacugcugacuuuuau

SEQ ID NO: 113432 - RNA, 64 nt, Homo Sapiens
gugccucagguuacuugaacggaaggcaccuucuagaagagagccugcgagaagagagagaugu

SEQ ID NO: 113433 - RNA, 64 nt, Homo Sapiens
gauguggaaggcaccuucuauggcagcuucugcgagaagagagagaaucucuggacggagcugc

SEQ ID NO: 113434 - RNA, 64 nt, Homo Sapiens
ucuuuuagguaagagaaaagaaaaagauaaggaaagaagagagaagagagacaaagaucacuac

SEQ ID NO: 113435 - RNA, 64 nt, Homo Sapiens
gguaagagaaaagaaaaagauaaggaaagaagagagaagagagacaaagaucacuacagaccaa

SEQ ID NO: 113436 - RNA, 64 nt, Homo Sapiens
aacaccuuugcccugaagucaguucucacaguauagaagagaacuuaaagagggaaaaaacaau

SEQ ID NO: 113437 - RNA, 64 nt, Homo Sapiens
caauuugccuuguaugcaacuuaugaggauuaguagaagagaguggguccagauuucugguggu

SEQ ID NO: 113438 - RNA, 64 nt, Homo Sapiens
aucaagacugugucuacacuaucuuggcugaacgagaagagauguaaaugcuggguggucccgu

SEQ ID NO: 113439 - RNA, 64 nt, Homo Sapiens
aauuccaaacccaaagccuuuguuugacugaaggagaagagagggaaguaagcuucuguucagc

SEQ ID NO: 113440 - RNA, 64 nt, Homo Sapiens
agacucacaggugcuggugcuugggagccagcugagaagagagcaggcaaagcuacagguuuac

SEQ ID NO: 113441 - RNA, 64 nt, Homo Sapiens
cgggucuggcaccgucgggacgcaccagccagucagaagagaccucgacgggcagggucggccu

SEQ ID NO: 113442 - RNA, 64 nt, Homo Sapiens
cucaaacuaggaggaaaagauuuuagacacugggagaagagaacuacucuaggcauauugauca

SEQ ID NO: 113443 - RNA, 64 nt, Homo Sapiens
auccuauauuccuaucaguaaccaaauaggcuuuagaagagauuaguaucuaacucuucuggaa

SEQ ID NO: 113444 - RNA, 64 nt, Homo Sapiens
cguguaagaaugguuugcagggaaagaagaauaaagaagagaaaggaaagaaaaaagaaaagaa

SEQ ID NO: 113445 - RNA, 64 nt, Homo Sapiens
cuuguucaauaugaucuugguuaaaccaggaacaagaagagaccauuuccuaguaccggacuac

SEQ ID NO: 113446 - RNA, 64 nt, Homo Sapiens
agaaaucauccuguuuucucugugaccugauuucagaagagacugauccaaaaauuauaacggc

SEQ ID NO: 113447 - RNA, 64 nt, Homo Sapiens
gggaaaaugugaaaucucagaauuuaucucccuuagaagagagccaguaacuuauguacaagga

SEQ ID NO: 113448 - RNA, 64 nt, Homo Sapiens
gccugagaacuauacaaccuuucccagacucccaagaagagaagagauuggcaaauggggcucc

SEQ ID NO: 113449 - RNA, 64 nt, Homo Sapiens
agaacuauacaaccuuucccagacucccaagaagagaagagauuggcaaauggggcuccugggc

SEQ ID NO: 113450 - RNA, 64 nt, Homo Sapiens
cagcccaagauaaauacuuuaauuguuaaaagucagaagagacagaauauguaggaaauguuuu

SEQ ID NO: 113451 - RNA, 64 nt, Homo Sapiens
aaucaucuccuauuaagggauagaaauuguuacuagaagagaaucacauguucuguguucauua

SEQ ID NO: 113452 - RNA, 64 nt, Homo Sapiens
uccuaaaggcaauucagauauucuccaagacaaaagaagagagauucacugcaaacaugcauga

SEQ ID NO: 113453 - RNA, 64 nt, Homo Sapiens
acaccagcgguaacacugccaaagccaggaacagagaagagauugaugaucaaccaucucaaua

SEQ ID NO: 113454 - RNA, 64 nt, Homo Sapiens
uccaaccagugagaucuuuaaccugaggcaggagagaagagauguugauuaucuuuggcuuugu

SEQ ID NO: 113455 - RNA, 64 nt, Homo Sapiens
ggacaaaaauaggaauggugaagacccgccaaauagaagagaugcuuguguauccuucugcagg

SEQ ID NO: 113456 - RNA, 64 nt, Homo Sapiens
cgugagucccuggccuuuccuuuuguaauaagaaagaagagagagaacuugaugcaaaguccac

SEQ ID NO: 113457 - RNA, 64 nt, Homo Sapiens
gagagagaguggaauauuugguagggaccuugacagaagagagcccugggugcuuguggugcaa

SEQ ID NO: 113458 - RNA, 64 nt, Homo Sapiens
gcaucagauuggcagcugcaccaaccagaggaacagaagagaagagagaugccacugggcacug

SEQ ID NO: 113459 - RNA, 64 nt, Homo Sapiens
agauuggcagcugcaccaaccagaggaacagaagagaagagagaugccacugggcacugcccug

SEQ ID NO: 113460 - RNA, 64 nt, Homo Sapiens
gaaaaacuuacuuguaaugaucaugucagccuucagaagagaauccccaccaacuucugugccu

SEQ ID NO: 113461 - RNA, 64 nt, Homo Sapiens
ccccagaugggcugcucuccuguaacuuucuaggagaagagacauuuucuucuuucccuuuccu

SEQ ID NO: 113462 - RNA, 64 nt, Homo Sapiens
gggucauuuacaucaggaaaauuccagcggugacagaagagaaauaaccaaacaaugacuccuc

SEQ ID NO: 113463 - RNA, 64 nt, Homo Sapiens
ccaaacucggugucauucuggaucugcagcacccagaagagaagauucucaguggaaagaguuu

SEQ ID NO: 113464 - RNA, 64 nt, Homo Sapiens
gugucuuucuuuauuccuuaauugguugguggaaagaagagaugcuugggaaccuuggguucuu

SEQ ID NO: 113465 - RNA, 64 nt, Homo Sapiens
agaacuucuggaucuaacucacaaacaagcuuccagaagagacuagagaccuuaggccaggaga

SEQ ID NO: 113466 - RNA, 64 nt, Homo Sapiens
caaaucucuaccucccauguagagaagaagaagaagaagagacaaaaaaaaaaaagagagagag

SEQ ID NO: 113467 - RNA, 64 nt, Homo Sapiens
gguaaaccuaugaaaacaggaagcccuuguuuacagaagagaggugaugaccaggcuuuagugg

SEQ ID NO: 113468 - RNA, 64 nt, Homo Sapiens
uuaucuagugaggaugaagaaaauuagaguccucagaagagaacguuaccgaagaggggccaag

SEQ ID NO: 113469 - RNA, 64 nt, Homo Sapiens
cuagaaacaguuaaagugucccaagagaagaaaaagaagagaaaaauuugucaauccuagccuu

SEQ ID NO: 113470 - RNA, 64 nt, Homo Sapiens
cacagcugaccucuuggcagaaacucuauaagccagaagagagugggggccaauauucaacauu

SEQ ID NO: 113471 - RNA, 64 nt, Homo Sapiens
gccauuauauaaugguaaauggaucaauucaacaagaagagauaacuauccuaaauauauaugc

SEQ ID NO: 113472 - RNA, 64 nt, Homo Sapiens
uucagagcagccggaguuugcuggaccacaaggaagaagagaagagacuugcagugaacuguuu

SEQ ID NO: 113473 - RNA, 64 nt, Homo Sapiens
agcagccggaguuugcuggaccacaaggaagaagagaagagacuugcagugaacuguuuuugug

SEQ ID NO: 113474 - RNA, 64 nt, Homo Sapiens
cuuaauuuugguuuccaccauuuccuuuuaguggagaagagaggaagucagaggguagggaccu

SEQ ID NO: 113475 - RNA, 64 nt, Homo Sapiens
gccguuugcugccacugacaaggauuucacaugcagaagagaaaaggccccccuccaccccccg

SEQ ID NO: 113476 - RNA, 64 nt, Homo Sapiens
gucguuggaauuuguaaauuuacauuuuuuuuaaagaagagacugauguguagauagaaaaccc

SEQ ID NO: 113477 - RNA, 64 nt, Homo Sapiens
cuaaucacuucacagugaccacuacagaguacuaagaagagaagaucaagggcaugaaauuggg

SEQ ID NO: 113478 - RNA, 64 nt, Homo Sapiens
uggcauagcuggacuugauuaaguauugacucauagaagagacauguauguuucccggggcuac

SEQ ID NO: 113479 - RNA, 64 nt, Homo Sapiens
auguuuacuuucucccaaucacaucaccugagguagaagagauuuuucaguugcuauuucucuu

SEQ ID NO: 113480 - RNA, 64 nt, Homo Sapiens
gugauuugggaugagucuacacucaagaaaagacagaagagacacuuaagagaaaaagaaaccu

SEQ ID NO: 113481 - RNA, 64 nt, Homo Sapiens
acgacaccuagaagaaggcauaaacagaaacaucagaagagaaagcugaccaucaagcagguca

SEQ ID NO: 113482 - RNA, 64 nt, Homo Sapiens
aaacuauuugugggcuauaggaaacuuucugaugccuccggauuguguuaguaguagccaucag

SEQ ID NO: 113483 - RNA, 64 nt, Homo Sapiens
ccccgcggccuggcgcuccgacugcccucugaggccuccggacuccucucguacuugaacucac

SEQ ID NO: 113484 - RNA, 64 nt, Homo Sapiens
agagccuggaguaugccaagaacucacgggccucccuccggaagugcucagucauguucauagg

SEQ ID NO: 113485 - RNA, 64 nt, Homo Sapiens
cagggaagccugggagucccuucucaccccucaaccuccggaguccaggagaacccguaccccc

SEQ ID NO: 113486 - RNA, 64 nt, Homo Sapiens
aaaauccaucaggaacucuccguccccccggggcccuccggagggagagagagaggaacugcug

SEQ ID NO: 113487 - RNA, 64 nt, Homo Sapiens
uggaaccgggcugccccugggccuacccugcccaccuccggaggccugcccugugcccugggau

SEQ ID NO: 113488 - RNA, 64 nt, Homo Sapiens
uacccaggucuccaccaucaucuccugugucuguccuccggacccugcgcuugggauugugccc

SEQ ID NO: 113489 - RNA, 64 nt, Homo Sapiens
uccucuuugcccgucuucucccaccuuccucuguccuccggaugacccuccucuggcgguccuu

SEQ ID NO: 113490 - RNA, 64 nt, Homo Sapiens
acaccaccuuucccuucagcagauguacugugugccuccggaagcugcccguguguaaccugua

SEQ ID NO: 113491 - RNA, 64 nt, Homo Sapiens
auucagggagcucucccuuccuccuccuccuccuccuccggaggugggaucccagagccugcca

SEQ ID NO: 113492 - RNA, 64 nt, Homo Sapiens
acccccuaagccccguuccuccgcagacccaggcccuccggaaggggugaguggggaggggcuu

SEQ ID NO: 113493 - RNA, 64 nt, Homo Sapiens
uuagcuuggacuucaguccucccucggggacucaccuccggaguaaacggcucuucauuagcuu

SEQ ID NO: 113494 - RNA, 64 nt, Homo Sapiens
ugagacugaguuuugucuuuacuguuuucugagcccuccggaccccagaccccugcccaccuag

SEQ ID NO: 113495 - RNA, 64 nt, Homo Sapiens
caugguacuggcaucugcuugguuucuggggaggccuccggaagcuuauagucaugacagaagg

SEQ ID NO: 113496 - RNA, 64 nt, Homo Sapiens
cccuccuccuaaacuccccaacccaccucucuucccuccggacucuaaacaggaacuugaauac

SEQ ID NO: 113497 - RNA, 64 nt, Homo Sapiens
auuaacucuauuacguuuguauuaauuauccgagccuccggagaucuucauaucuaaaugcuuc

SEQ ID NO: 113498 - RNA, 64 nt, Homo Sapiens
cccugugccuggggaagcagucccggcccccaccccuccggaaucucccaccccccacccuccu

SEQ ID NO: 113499 - RNA, 64 nt, Homo Sapiens
gauggcucaauauguaagguuuucaguaguuuacccuccggaacccaaguuguauguauguaua

SEQ ID NO: 113500 - RNA, 64 nt, Homo Sapiens
agcugggacugcaggcgccuuucuccugccucagccuccggagucgccucccaaguucacucca

SEQ ID NO: 113501 - RNA, 64 nt, Homo Sapiens
gaaacacacagucacauucgaauucggguggcauccuccggagagagagagaggaaggagauuc

SEQ ID NO: 113502 - RNA, 64 nt, Homo Sapiens
ccagccccuaaacaagauacuucuugguuaaggcccuccggaagggaaaggcuacggggcaugu

SEQ ID NO: 113503 - RNA, 64 nt, Homo Sapiens
caggugucagaacugggcaccaggacuggagcccccuccggagaccaaacucaccaucccucag

SEQ ID NO: 113504 - RNA, 64 nt, Homo Sapiens
gcuuacuuaccucauacgcauccccacccccgccccuccggacgaugggccacgcccccaugca

SEQ ID NO: 113505 - RNA, 64 nt, Homo Sapiens
agcugggauuacaggcacauuucuguggcuucagccuccggagucgccuccuggguucaagcaa

SEQ ID NO: 113506 - RNA, 64 nt, Homo Sapiens
acacaaauaccagagcacagacaggcguucucagccuccggaugagccaucugcgacaccacca

SEQ ID NO: 113507 - RNA, 64 nt, Homo Sapiens
cuuuggcuccuaagaaucugggcucugcuacccaccuccggagacacaagcccacguaucuacu

SEQ ID NO: 113508 - RNA, 64 nt, Homo Sapiens
cucaggaaguccagccacuugacuggcacacaccccuccggacauccagcgugacggagcccac

SEQ ID NO: 113509 - RNA, 64 nt, Homo Sapiens
uaggaaccagugaccuuggcaccccucauucuguccuccggacugaauugagagggaauagcuc

SEQ ID NO: 113510 - RNA, 64 nt, Homo Sapiens
gacauggagccuggcuggggcuaagcagcccccuccuccggauggcacaggcucugcuagguuc

SEQ ID NO: 113511 - RNA, 64 nt, Homo Sapiens
ccagcaggugcuguccuggagugccugguguuguccuccggaaugcuggugccggaacucgcua

SEQ ID NO: 113512 - RNA, 64 nt, Homo Sapiens
gacccucaacuguacacaggucccuccccggcuuccuccggaggcccggcccggccggaggaug

SEQ ID NO: 113513 - RNA, 64 nt, Homo Sapiens
agcugggauugcaggcacccuucucgugccucagccuccggagucgccuccuggguucaagcga

SEQ ID NO: 113514 - RNA, 64 nt, Homo Sapiens
uuugcauuuugagaaguguccuucccacuucagcccuccggagagacuacccuagucuuucugg

SEQ ID NO: 113515 - RNA, 64 nt, Homo Sapiens
cugucgacuucaugacaagcugcgagccucgcagccuccggaagacauucaugugggcauuucu

SEQ ID NO: 113516 - RNA, 64 nt, Homo Sapiens
ccugccaccugugacugucuggggggccagaccaccuccggaauguucccuugcccugguggug

SEQ ID NO: 113517 - RNA, 52 nt, Homo Sapiens
cccacccccgcccuucccagcaccuccggagcagagcaaggaggcgcccuga

SEQ ID NO: 113518 - RNA, 64 nt, Homo Sapiens
ccugcuagacggccagccccacacuucgcuucagccuccggaccauuccggagcagccucacau

SEQ ID NO: 113519 - RNA, 64 nt, Homo Sapiens
agcugggacuacagacaccucuguccugccucagccuccggaguucccggguuuacuuacacca

SEQ ID NO: 113520 - RNA, 64 nt, Homo Sapiens
cccaagauccauggggcagucugcagaagcaggaccuccggaggucuguuccaggauggacuca

SEQ ID NO: 113521 - RNA, 64 nt, Homo Sapiens
uuucuggaaggcccuagcucagguggcuucagggccuccggacccccccugggagggguggcca

SEQ ID NO: 113522 - RNA, 64 nt, Homo Sapiens
uggagaaugaagcucuggaaauccucaccaaagcccuccggagcuaccaguuagggaucggcag

SEQ ID NO: 113523 - RNA, 64 nt, Homo Sapiens
gaacccagacucuugucuucuucaagagcaagggccuccggagauccaaacugugauugaacca

SEQ ID NO: 113524 - RNA, 64 nt, Homo Sapiens
aacagcauugagauugcuccaccccgcagacuguccuccggauaccuuucuuucagucgucacg

SEQ ID NO: 113525 - RNA, 64 nt, Homo Sapiens
gcacaggcgagucccugcccaccaggcacagccgccuccggaauuaaggcugugccucacugcc

SEQ ID NO: 113526 - RNA, 64 nt, Homo Sapiens
aggaauuuaucuagauaaguuuguuuacuuaugcccuccggaaaucaugcaagacugcucccug

SEQ ID NO: 113527 - RNA, 64 nt, Homo Sapiens
gccccacugcccaccugaaggggugguuuccagcccuccggagagugggcuuggcccuaggccc

SEQ ID NO: 113528 - RNA, 57 nt, Homo Sapiens
cucccagcccuagcccgugacugccucccuccggaccgacacucccucagccucuca

SEQ ID NO: 113529 - RNA, 64 nt, Homo Sapiens
aaggaugcaaauagccgucugcgauuuuggcggcccuccggauuguggugacaauauguuguac

SEQ ID NO: 113530 - RNA, 64 nt, Homo Sapiens
cgugccagcaaugaguuggcaaggagcuggaaggccuccggauguggugcugcaggcccauagg

SEQ ID NO: 113531 - RNA, 52 nt, Homo Sapiens
uggaggccgaccuggagugaggccuccggacucuggcacgcuccagcagccc

SEQ ID NO: 113532 - RNA, 64 nt, Homo Sapiens
acugugguuggguggaggucugcagccagcagguccuccggaucucccagcaucacaccagcca

SEQ ID NO: 113533 - RNA, 64 nt, Homo Sapiens
ccacaaccuggacacagcucuuucacuccucgguccuccggagccuucagauguaccuccagcc

SEQ ID NO: 113534 - RNA, 64 nt, Homo Sapiens
ugggcuuugggccucuccuggagggccucgggggccuccggagccccucagccugggggaagaa

SEQ ID NO: 113535 - RNA, 62 nt, Homo Sapiens
accgucucaaggccuccuaauagcugcccuccccuccggacuggugcccuccucacucccac

SEQ ID NO: 113536 - RNA, 64 nt, Homo Sapiens
gcuuuuccaagcugccacuggucggccaguacagccuccggaagcagcccuacaacaaccugaa

SEQ ID NO: 113537 - RNA, 64 nt, Homo Sapiens
uucugaccucuguuuccucccaaaggacugcccaccuccggaacaaaaacaaaugaucuguuaa

SEQ ID NO: 113538 - RNA, 64 nt, Homo Sapiens
cucaccuucaggaccuuaauuguuuuacccagcaccuccggacacccauuucuuaccugugaug

SEQ ID NO: 113539 - RNA, 64 nt, Homo Sapiens
cuccuugacgcgcucccgggccucaggguccugcccuccggaggagcagccucgaggcuggugg

SEQ ID NO: 113540 - RNA, 64 nt, Homo Sapiens
auguucacucccgacccuggaaacccggauuucgccuccggacagcggcgucugggcaggguuc

SEQ ID NO: 113541 - RNA, 64 nt, Homo Sapiens
ggccugcgccugcgccggacgcuccgcggccccgccuccggacccggggcugggcggggcgccg

SEQ ID NO: 113542 - RNA, 64 nt, Homo Sapiens
cucauguucucuucccaggcaggcccccggcuuuccuccggagcgcugucuggugagguggccc

SEQ ID NO: 113543 - RNA, 64 nt, Homo Sapiens
ccugccugccccugcuccccaucuuccgcugugaccuccggagccccgcgccccacauaccugc

SEQ ID NO: 113544 - RNA, 64 nt, Homo Sapiens
ccauccaggcgcaaagaggagccaagccuagagcccuccggauccucaucugguggccacagca

SEQ ID NO: 113545 - RNA, 64 nt, Homo Sapiens
agcugggaccacagguucaucaguccugccucagccuccggagucuuugccuccccggcucgag

SEQ ID NO: 113546 - RNA, 64 nt, Homo Sapiens
gcagauuagaacaugaugauccuuaccuguuccuccuccggaggguaucgucaggugggauaau

SEQ ID NO: 113547 - RNA, 64 nt, Homo Sapiens
cgauccugcagcucuuucugcuccagccaaggguccuccggaccacccgacucagcuugagaca

SEQ ID NO: 113548 - RNA, 64 nt, Homo Sapiens
cgcccugcggcggggucccuaggacauaaaagcgccuccggagcguccuuagcgccugggaacc

SEQ ID NO: 113549 - RNA, 64 nt, Homo Sapiens
cucuuuugaucugcccaggagaccagcuccucuuccuccggauccaggugcuucaaagccaaca

SEQ ID NO: 113550 - RNA, 64 nt, Homo Sapiens
caguuuugauguccaucuucgggugcagacugcaccuccggauggcggagauccccuuccuucu

SEQ ID NO: 113551 - RNA, 64 nt, Homo Sapiens
gccgccaugcuucugugccgaccacgccccaggaccuccggagcgcccugcagggccgggcagg

SEQ ID NO: 113552 - RNA, 64 nt, Homo Sapiens
gcauguacgggccucguacugccucauggaaaauccuccggagccgcccuccauuguggguucc

SEQ ID NO: 113553 - RNA, 64 nt, Homo Sapiens
ggcuggaccccgacacguaggcgccgcccuccugccuccggacccuucccgcucccggccgugg

SEQ ID NO: 113554 - RNA, 64 nt, Homo Sapiens
acccccauccuggccgcaccccccuuuccaggguccuccggaccccaccuuccacacucugauc

SEQ ID NO: 113555 - RNA, 64 nt, Homo Sapiens
accacccggccuuucccugcgccgugcccacccuccuccggaaucucccuucccuuccuggcca

SEQ ID NO: 113556 - RNA, 64 nt, Homo Sapiens
ccgguggacagacuuaacgauccuugcugcagucccuccggagaggaucuggacuggcugggag

SEQ ID NO: 113557 - RNA, 64 nt, Homo Sapiens
cugucuucccgcuagagcccagggagcccaccggccuccggacaccccagggucugccgucuag

SEQ ID NO: 113558 - RNA, 64 nt, Homo Sapiens
ccaggcucugcucugcccuggugguccagugaagccuccggaccauucacauuccccucccccu

SEQ ID NO: 113559 - RNA, 64 nt, Homo Sapiens
augaguccccccucuugucucccuccagagccucccuccggacaggguugacccagggcugucu

SEQ ID NO: 113560 - RNA, 64 nt, Homo Sapiens
cgggggcugggccuguaucugugugcccccuuagccuccggaggcagacuccuccuacccccag

SEQ ID NO: 113561 - RNA, 64 nt, Homo Sapiens
gggaggggagcagaguccccuagccccccugggaccuccggacugggaagucucagagaagcca

SEQ ID NO: 113562 - RNA, 64 nt, Homo Sapiens
acacacaaaucucaggaacaaacggucccagaguccuccggaccccugcccagggucucugcag

SEQ ID NO: 113563 - RNA, 64 nt, Homo Sapiens
uccuggccgagggcggggggcagcggggggucucccuccggaccuaccucagggagcugagcgu

SEQ ID NO: 113564 - RNA, 64 nt, Homo Sapiens
cuugguccuccugucccugcugcaggggcuggggccuccggagcugcugcgggcuccccucagg

SEQ ID NO: 113565 - RNA, 64 nt, Homo Sapiens
aacuugggggugaggggaagccaggccccuggggccuccggacaaggauugaagcggugcucag

SEQ ID NO: 113566 - RNA, 64 nt, Homo Sapiens
ucacguauccccacgccucggggcccccgccgccccuccggacccgcagagcuggggacauggc

SEQ ID NO: 113567 - RNA, 64 nt, Homo Sapiens
uacuggccacuuacccucuggggccucagcuuucccuccggaaggcugggaggaggugggcuag

SEQ ID NO: 113568 - RNA, 64 nt, Homo Sapiens
guguaguccugcccuaaccccaccaccaucaucaccuccggaaaccaccaccaccaccaccacu

SEQ ID NO: 113569 - RNA, 64 nt, Homo Sapiens
uggcagccuugaaguugggggaggaggacacucccaucagaacuggggcugggagauguuccug

SEQ ID NO: 113570 - RNA, 64 nt, Homo Sapiens
uggcagccccaaaacuggggcuggaggacacucccaucagaacccugggggccugaagacauuc

SEQ ID NO: 113571 - RNA, 64 nt, Homo Sapiens
auaaguuagaacaagcccaaauuuaauuugcaaccaucagaauucagaaucuauagugaccagu

SEQ ID NO: 113572 - RNA, 64 nt, Homo Sapiens
gauuucuaguuuuuuuucuaguuuuuaauuuuaacaucagaacugaaauaaaaaauuauggaua

SEQ ID NO: 113573 - RNA, 64 nt, Homo Sapiens
augagcaccauggcugcaguacaugaaggugugacaucagaaucgggugaucauacauacauca

SEQ ID NO: 113574 - RNA, 64 nt, Homo Sapiens
acgaggugcuguuggcaauugcagagcaagaggccaucagaaggcucugugcccucagggacug

SEQ ID NO: 113575 - RNA, 64 nt, Homo Sapiens
auauucuauugauuuaaugugaccuguuuggucucaucagaagucuuaccauugggcauuugaa

SEQ ID NO: 113576 - RNA, 64 nt, Homo Sapiens
caaaugagcaaaacuaaggaugaaauguaauauucaucagaacaaggaucacugagaaaaaaua

SEQ ID NO: 113577 - RNA, 64 nt, Homo Sapiens
ugccaugcaaccaccaccacgacagcccuuccuccaucagaagacaggagugagggccccgggc

SEQ ID NO: 113578 - RNA, 64 nt, Homo Sapiens
ccaaaaaccuucuuagcaggacagcugugagaggcaucagaaccucacguucggacugccuuca

SEQ ID NO: 113579 - RNA, 64 nt, Homo Sapiens
gagcuuugguuuuuacagauggauauuuguccugcaucagaaaccuugcaguuuuaaauauugu

SEQ ID NO: 113580 - RNA, 64 nt, Homo Sapiens
caacuuugucuuggggcacauuccgggcauuuugcaucagaaaaagaaaaaaaaaaagaaaaag

SEQ ID NO: 113581 - RNA, 64 nt, Homo Sapiens
caucccgcauccagacuccaucccccacucccuacaucagaaugggcuucuugaugcugcgcgg

SEQ ID NO: 113582 - RNA, 64 nt, Homo Sapiens
caucccucaucuggacuccaucccccacucccuacaucagaacgcaagucuugaugcugcgccg

SEQ ID NO: 113583 - RNA, 64 nt, Homo Sapiens
cucucaaauguaugucucuuacguaacauacucuaagaaugaaacugucaccacagguaaaucc

SEQ ID NO: 113584 - RNA, 64 nt, Homo Sapiens
agucauuacaugucaaauucaauuuuucugccuuaagaaugaauguccuucauaaaauauugga

SEQ ID NO: 113585 - RNA, 64 nt, Homo Sapiens
cccucccaacacuuucacucccacugaucuggccaagaaugaggauagacugccugcguccuua

SEQ ID NO: 113586 - RNA, 64 nt, Homo Sapiens
uguuguuugaaaccuuuguaguuuccuuagccuaaagaaugaucgaaguuggugcuuguauggu

SEQ ID NO: 113587 - RNA, 64 nt, Homo Sapiens
agaaguuuaauauuuugcccuguucucagcagagaagaaugaggccagagugcacuggggggaa

SEQ ID NO: 113588 - RNA, 64 nt, Homo Sapiens
ggaaagagccuggggaggagugaaguugggcucuaagaaugagguggguggcaguguuugguac

SEQ ID NO: 113589 - RNA, 64 nt, Homo Sapiens
cuaauuauuuuaccguuuuguugaccuuguacacaagaaugagauuaaucuguauuauauaaga

SEQ ID NO: 113590 - RNA, 64 nt, Homo Sapiens
gcuguacuuuaugacuuguuucccuauggugguaaagaaugaugccauagucaguuuuauugac

SEQ ID NO: 113591 - RNA, 64 nt, Homo Sapiens
guacauugaauggguauaauugaaacaucauuaaaagaaugacacugugacauuuucuuuguuc

SEQ ID NO: 113592 - RNA, 64 nt, Homo Sapiens
uuugcaaauauuuguaaguauacaugaguacuauaagaaugaauugucaauucaaguacaaaac

SEQ ID NO: 113593 - RNA, 64 nt, Homo Sapiens
ggaagagggauuuugaagagguaucucuccaagcaagaaugacuuguuuuuccauaagggacau

SEQ ID NO: 113594 - RNA, 64 nt, Homo Sapiens
cacuuguaaauaaaaagguuagaaucuaaggacaaagaaugauccaaaaauacuaaggaaaaag

SEQ ID NO: 113595 - RNA, 64 nt, Homo Sapiens
aggggcacccaaaguucugguuagaaaaucucagaagaaugauugagccagucacuuuucccuc

SEQ ID NO: 113596 - RNA, 64 nt, Homo Sapiens
aaggacagaauuaaccaaggacaucauguggccaaagaaugagaacauaugaagguuuaaaaau

SEQ ID NO: 113597 - RNA, 64 nt, Homo Sapiens
gaugccuuauuugaaacugggcuuaaacugcaaaaagaaugaaguuggauuuaggaagcuguua

SEQ ID NO: 113598 - RNA, 64 nt, Homo Sapiens
ccugaaugcaaucauuaacuugguugcuaauuacaagaaugaaaauuauaauggaaaaggacaa

SEQ ID NO: 113599 - RNA, 64 nt, Homo Sapiens
auaucaaaaauaguaguugaagaaugauuuugccaagaaugauuccugcucguuuccaccuuua

SEQ ID NO: 113600 - RNA, 64 nt, Homo Sapiens
uugccaagaaugauuauaucucguuuccaccuuuaagaaugauuuugcuguacuaucagccugc

SEQ ID NO: 113601 - RNA, 64 nt, Homo Sapiens
cugcuugucauaauugucagggcugaauaguuguaagaaugacuuuucuuugaaucaguauuuu

SEQ ID NO: 113602 - RNA, 64 nt, Homo Sapiens
aucuuuacuauaauuaccaaaaacauguauauaaaagaaugaaauugaaaaauaaaauauauaa

SEQ ID NO: 113603 - RNA, 64 nt, Homo Sapiens
accaaaacauacccugaugaagauccugaacuucaagaaugaagaaagaauuccucaccauuca

SEQ ID NO: 113604 - RNA, 64 nt, Homo Sapiens
ugggggaguauuuccgaaguucugaguaggaaaaaagaaugacucaaauguauuauugccaacc

SEQ ID NO: 113605 - RNA, 64 nt, Homo Sapiens
uuccaauuacccugaugugagugaggaugcgaaaaagaaugaguauaagaauagucuucuagaa

SEQ ID NO: 113606 - RNA, 64 nt, Homo Sapiens
acugcugacguauuacaaaaaaggaaaaaagaauaagaaugaaaaaugaaaaaaugaaaaaaag

SEQ ID NO: 113607 - RNA, 64 nt, Homo Sapiens
guaaagaaaagucucauaagguagccaaaugaaaaagaaugaaagggaaagugaaaaauuaagg

SEQ ID NO: 113608 - RNA, 64 nt, Homo Sapiens
uuugcuaaugccucuauuuacuugcuuuggcauaaagaaugagccaaugaaccucuguguccug

SEQ ID NO: 113609 - RNA, 64 nt, Homo Sapiens
augcaaccuuuggaugcacuugcccaagaaugagaagaaugacucacagguugaccaauaacca

SEQ ID NO: 113610 - RNA, 64 nt, Homo Sapiens
agaaugacuaugcaaccuuucaauaaccaugcccaagaaugagauagaagcaucacagguugac

SEQ ID NO: 113611 - RNA, 64 nt, Homo Sapiens
cauucugaagguauguuuauacagaauuuucaaaaagaaugauagacagggcuaaaacugggcu

SEQ ID NO: 113612 - RNA, 64 nt, Homo Sapiens
cagcuggugaugugcuugguuuagcagcuaaaagaagaaugaguggaaaaacaacuuagaggau

SEQ ID NO: 113613 - RNA, 64 nt, Homo Sapiens
accaguaguacguuuuagucuuggaucaccuccaaagaaugaaaccuuugcuugaauaaacauu

SEQ ID NO: 113614 - RNA, 64 nt, Homo Sapiens
ucuuaugguuuauuuugaugucugacuaaagucaaagaaugauuuuuuuuauaauaagaaaaca

SEQ ID NO: 113615 - RNA, 64 nt, Homo Sapiens
cuaccauguuuauuugcugacugaauuaagauuuaagaaugauuaaaaauaagcuuuuacuuuu

SEQ ID NO: 113616 - RNA, 64 nt, Homo Sapiens
uaugucuuuucagccuguaauucuuugggccccaaagaaugacaaaggaggcacucguucucuu

SEQ ID NO: 113617 - RNA, 64 nt, Homo Sapiens
aauggaaauggaaaaggguggucaacagcccaauaagaaugaagcugaccaaaaaugucucaaa

SEQ ID NO: 113618 - RNA, 64 nt, Homo Sapiens
ugacccucagcauucccgugagcgccuccggcagaagaaugaggugugaagaaagaggaggagg

SEQ ID NO: 113619 - RNA, 64 nt, Homo Sapiens
uagagugaaggaaagcuguguacaggcucuagucaagaaugaauaaaugucucugaaacaggca

SEQ ID NO: 113620 - RNA, 64 nt, Homo Sapiens
aguguacuguggcaguucccucuguuccggugccaagaaugagcgcaggauacaguguguuuca

SEQ ID NO: 113621 - RNA, 64 nt, Homo Sapiens
uggcccacugcagcccuggccccaggcugacgccaagaaugaagcuggagcagaggggcacuaa

SEQ ID NO: 113622 - RNA, 64 nt, Homo Sapiens
ggacagaugugagccaucuguucagugacccuagaagaaugauucacccccguagcuugcaccc

SEQ ID NO: 113623 - RNA, 64 nt, Homo Sapiens
gacccugccaaaucccccucugcgagaaacacccaagaaugaucaauuaaaaaaaaaauaauau

SEQ ID NO: 113624 - RNA, 64 nt, Homo Sapiens
acacugggguuaacuguauugcuggaaaaacaucaagaaugacagucuuauauuuaaggcacca

SEQ ID NO: 113625 - RNA, 64 nt, Homo Sapiens
cuaauaucaagccuguacagaagaaaaucaaggaaagaaugaguuuuugaaugugaacaaaagg

SEQ ID NO: 113626 - RNA, 64 nt, Homo Sapiens
uaaccaaaagguauauaauuaguguccuuuauguaagaaugauaccagaagaaagggccuucac

SEQ ID NO: 113627 - RNA, 64 nt, Homo Sapiens
ugucugugacagaugaacuuuugcauguguauauaagaaugaguugggaccucugucuuuaaaa

SEQ ID NO: 113628 - RNA, 64 nt, Homo Sapiens
ccaguuuuuagauguagauguagugaaaaacuucaagaaugaagcagagcaauugaguauucuu

SEQ ID NO: 113629 - RNA, 64 nt, Homo Sapiens
aacauagccagaccuccucucuacaaaaagaaaaaagaaugacaugcuucuuguuuuugucugu

SEQ ID NO: 113630 - RNA, 64 nt, Homo Sapiens
guacaacuuuuuaagcaaugccaaacuaugacuuaagaaugaaauuauugcucauuuguauauc

SEQ ID NO: 113631 - RNA, 64 nt, Homo Sapiens
auggaaaugagugacuggaaaucccauaggccacaagaaugacuuucacaagggcaggaacauu

SEQ ID NO: 113632 - RNA, 64 nt, Homo Sapiens
uguuugguaaccccuauaaacuggggcagaggaaaagaaugaugguucaaggccauacuucccu

SEQ ID NO: 113633 - RNA, 64 nt, Homo Sapiens
uaggagacaggagaucaccacaaaccaugacgugaagaaugagauuucagugucuuacagcggc

SEQ ID NO: 113634 - RNA, 64 nt, Homo Sapiens
ccucaucuugcuacugaguguggagaugcauuccaagaaugaagaguugcccucaccuugugug

SEQ ID NO: 113635 - RNA, 64 nt, Homo Sapiens
aaacacagacgcccaggugucagcucuccguuuaaagaaugaaaaauguaacucaugaugaucu

SEQ ID NO: 113636 - RNA, 64 nt, Homo Sapiens
aucuucaagaaguugauuccaaaacugaguuaugaagaaugauauaacaguuccuucaaaauug

SEQ ID NO: 113637 - RNA, 64 nt, Homo Sapiens
uucuuagacuuuuccaauaugcuguuuaucccuuaagaaugaguucagcuuuuauuccugcccu

SEQ ID NO: 113638 - RNA, 64 nt, Homo Sapiens
guuuuuguaaagauuucugucaaguauuauaaacaagaaugaagggugguaauaagggaaaaau

SEQ ID NO: 113639 - RNA, 64 nt, Homo Sapiens
gugagcucagauccagcaccagaauccuucaccuuugcugaaaaggucucaaaugcgugaucag

SEQ ID NO: 113640 - RNA, 64 nt, Homo Sapiens
caagagcacaauucccauuguuuuccuucacuuauugcugaaaccuucaaaagggcaagaucuu

SEQ ID NO: 113641 - RNA, 64 nt, Homo Sapiens
caggccucccuccccagcaccccacccacagcuguugcugaagucaagcugcgccggccuccag

SEQ ID NO: 113642 - RNA, 64 nt, Homo Sapiens
auuacugcuugaaucuggagaugaccaccuccucuugcugaaaucucugcugugcuggcuuccc

SEQ ID NO: 113643 - RNA, 64 nt, Homo Sapiens
uuuucaaaggaguaguuacuugcaaauuacauccuugcugaauucaggagguaugaaacccuau

SEQ ID NO: 113644 - RNA, 64 nt, Homo Sapiens
ugugucccaguaagagagucacagcuucagguguuugcugaauccaggucugagaucacaaucc

SEQ ID NO: 113645 - RNA, 64 nt, Homo Sapiens
agaugcugggacauagaaccacuguggccacacuuugcugaaaggacugagcauugcucagauc

SEQ ID NO: 113646 - RNA, 64 nt, Homo Sapiens
gauuugcgaauugacuuuccauuuucugaccuguuugcugaagucaacugguuugauaguuacu

SEQ ID NO: 113647 - RNA, 64 nt, Homo Sapiens
guauuugacuuugaauuuuaauguauuuccacuuuugcugaagcuuuuaaucagauguguaaaa

SEQ ID NO: 113648 - RNA, 64 nt, Homo Sapiens
aaacaugaguagauccaugauggauuaauaaagcuugcugaaaaaaaaaaucuguguaucaauu

SEQ ID NO: 113649 - RNA, 64 nt, Homo Sapiens
cuaccccugauucuaugacauuggggcccuucuuuugcugaaacugccuuacguaaugguuuua

SEQ ID NO: 113650 - RNA, 64 nt, Homo Sapiens
uguguguguggugggggaguggguauuacaugcauugcugaagagucauccugguguuccucau

SEQ ID NO: 113651 - RNA, 64 nt, Homo Sapiens
uuuuacuuuuuugauauaaaaucaagauauuucuuugcugaaguauuuaaaucuuauccuugua

SEQ ID NO: 113652 - RNA, 64 nt, Homo Sapiens
uuuguagaauucauuucggcagcucacuaggauuuugcugaacauuaaaaagugugauagcgau

SEQ ID NO: 113653 - RNA, 64 nt, Homo Sapiens
gcuggagaucaucuuuaagggcaaaggaguuggauugcugaauuacaaugaaacaugucuuauu

SEQ ID NO: 113654 - RNA, 64 nt, Homo Sapiens
cacuucugugucuuucuaauggaaaugaguagaauugcugaaagucucuauguuaaaaccuaua

SEQ ID NO: 113655 - RNA, 64 nt, Homo Sapiens
gaaagaugacucugggggagaauaugcugcaccauugcugaaaugaccuauuucuaaacuguug

SEQ ID NO: 113656 - RNA, 64 nt, Homo Sapiens
uguuaucuucauucaauuucaaaauaauuguguuuugcugaacuucccuuuccucagugaugug

SEQ ID NO: 113657 - RNA, 64 nt, Homo Sapiens
augucagcaccuuuucucacucuaaccagaaaucuugcugaaguaaaauccuuuagaguucagc

SEQ ID NO: 113658 - RNA, 64 nt, Homo Sapiens
aaugcagaaaucagcgguacgacaucauaaauacuugcugaaugugucuggcggggagccaggu

SEQ ID NO: 113659 - RNA, 64 nt, Homo Sapiens
uucagaaagaaagacccuucaguuuugaugcauuuugcugaacacuuggguagugagugggauc

SEQ ID NO: 113660 - RNA, 64 nt, Homo Sapiens
gcuuuaucuuugguaacuuuuacuugaaugggauuugcugaauuaaugacuauugaauuuaaaa

SEQ ID NO: 113661 - RNA, 64 nt, Homo Sapiens
guucucauuuccuguuugcugcuugcuugaaaucuugcugaaauacaaugacccaucaucucuu

SEQ ID NO: 113662 - RNA, 64 nt, Homo Sapiens
ugcaguuauguugucguguaaguaagacuaaguauugcugaauuuuauggucuauacauaaaaa

SEQ ID NO: 113663 - RNA, 64 nt, Homo Sapiens
uaaauaaacaucuaugccuuuucucagaaaugauuugcugaacuauguccauauuuuacagcuu

SEQ ID NO: 113664 - RNA, 64 nt, Homo Sapiens
agacacauguauacaaggcacuauuguacacacuuugcugaauauuuugucaguuguauuuaca

SEQ ID NO: 113665 - RNA, 64 nt, Homo Sapiens
uauucuugaucagauagaauugugucuaaaaauauugcugaaguaagaaacuugaacaggauaa

SEQ ID NO: 113666 - RNA, 64 nt, Homo Sapiens
uauugugguauauaauccugaucuaaaugguguguugcugaaguguauagaaucuuucuucauc

SEQ ID NO: 113667 - RNA, 64 nt, Homo Sapiens
uuucugcccuuccucacccccacgccccaccccacucccccagaguacuccccacugugaaaag

SEQ ID NO: 113668 - RNA, 64 nt, Homo Sapiens
augaggcauugucacccuagaccccucuuccucucucccccaccauagugugcaauaaaguguc

SEQ ID NO: 113669 - RNA, 64 nt, Homo Sapiens
augugucuaaagacuugguguccccuucucucuccucccccacccgccacuccuggguacaucu

SEQ ID NO: 113670 - RNA, 64 nt, Homo Sapiens
ccuugcaguaauuuauuuucuguauggacugucccucccccagaggcuuccccacccuccauug

SEQ ID NO: 113671 - RNA, 64 nt, Homo Sapiens
gaccagccacugugggaccaacaccccucccacacucccccagacugcucgucuaucaccagga

SEQ ID NO: 113672 - RNA, 64 nt, Homo Sapiens
cacccagcccugccccucaccugccugcccuccccucccccacucuauacuagggacuggaucu

SEQ ID NO: 113673 - RNA, 64 nt, Homo Sapiens
auugugcaauagucagaguguugucccuggggcacucccccaggcccacacacacuccuucccc

SEQ ID NO: 113674 - RNA, 64 nt, Homo Sapiens
ucucucugccugcugggcucugucuguccaaccccucccccacguacccuuccucaucugugcc

SEQ ID NO: 113675 - RNA, 64 nt, Homo Sapiens
uagauacacuacuguauuagugauacucccccaccucccccauuaguaacuaauauuaggcagu

SEQ ID NO: 113676 - RNA, 64 nt, Homo Sapiens
ucccccauuuagauacacuauuaggcaguugauacucccccaccugaaaauucaguaacuaaua

SEQ ID NO: 113677 - RNA, 64 nt, Homo Sapiens
ggcccccucuaaggaggguguuaaaacucacugccucccccaagugauuccugggcucccagcc

SEQ ID NO: 113678 - RNA, 64 nt, Homo Sapiens
agugggccuguucuacccgugcguuuguacuugccucccccaacugacaggccuucuguaccca

SEQ ID NO: 113679 - RNA, 64 nt, Homo Sapiens
acuuuagcagaugugguuucaaaguaaaggccuccucccccaccccuuaggccccguggugaca

SEQ ID NO: 113680 - RNA, 64 nt, Homo Sapiens
ugucagcuucccagccaugcccaggacguccuaucucccccaacccaccucuggcccuguguag

SEQ ID NO: 113681 - RNA, 64 nt, Homo Sapiens
gccgccacacucagugccauggggaagcgggcgucucccccaccagccccaccaggcgguguag

SEQ ID NO: 113682 - RNA, 64 nt, Homo Sapiens
ucagacuucugccuuaaccagccccggggcuuggcucccccagcucugagcgugggggcauagg

SEQ ID NO: 113683 - RNA, 64 nt, Homo Sapiens
gggggaugucaaguggugaugucguugugcuccccucccccagagcgggugggcggggggugaa

SEQ ID NO: 113684 - RNA, 64 nt, Homo Sapiens
ucccgggucccuucugucggucugcccaccucuucucccccaccagaguguguuuccuuucgug

SEQ ID NO: 113685 - RNA, 64 nt, Homo Sapiens
gccucgcugcccccgcccagaauuauuuuauccccucccccaccauaauuauuauaauuauuau

SEQ ID NO: 113686 - RNA, 64 nt, Homo Sapiens
agcgcucccucagcucucucuuacccccaccgcgcucccccaggcggagcccccaucccuuauc

SEQ ID NO: 113687 - RNA, 64 nt, Homo Sapiens
uggccccuugacccgggcggcccgccugcccgcccucccccacggcaguuauugaccucccggu

SEQ ID NO: 113688 - RNA, 64 nt, Homo Sapiens
cgccggagguacaguuuuuccaggugcuuaagcccucccccacugugccacccuugugaccuuc

SEQ ID NO: 113689 - RNA, 64 nt, Homo Sapiens
uguucagaaaggcacaauguggagccuggggugucucccccaccccaggaccgucagguuuacc

SEQ ID NO: 113690 - RNA, 62 nt, Homo Sapiens
gcaugguucagucucccugaguguccggugaccucccccagggccuccuugcccagcccagu

SEQ ID NO: 113691 - RNA, 64 nt, Homo Sapiens
ccaucuguuggccaccugcaggccagucucaacccucccccaggugggcaggcacuugauggcu

SEQ ID NO: 113692 - RNA, 59 nt, Homo Sapiens
ucuuuguggaugugaugugagcagggccccucccccagcuccauuccgcucccacccca

SEQ ID NO: 113693 - RNA, 64 nt, Homo Sapiens
ccaggccugaaacauuucuuuucuuucuuuuuuccucccccaauuuacccugggccuggagcag

SEQ ID NO: 113694 - RNA, 64 nt, Homo Sapiens
agccacccuccuccacagguccaggugccgcucccucccccaccacacaucagugucuccuccc

SEQ ID NO: 113695 - RNA, 64 nt, Homo Sapiens
ggagugggaggguugguugccccucaccucagagcucccccaaaggccaguaauggauccccgg

SEQ ID NO: 113696 - RNA, 64 nt, Homo Sapiens
gauggaugcacguucacuacugugacggccgcaccucccccaugcaccccacccucccccaaag

SEQ ID NO: 113697 - RNA, 64 nt, Homo Sapiens
cugugacggccgcaccucccccaugcaccccacccucccccaaagcccggaucccgagaaagau

SEQ ID NO: 113698 - RNA, 64 nt, Homo Sapiens
ucccagagcggggugagggggcuuaugccccccccucccccaguguguugggugggguggaauu

SEQ ID NO: 113699 - RNA, 64 nt, Homo Sapiens
ggggggaacuuacucuaggaaaagccaugucucucucccccaggguggggggaccuguguugga

SEQ ID NO: 113700 - RNA, 64 nt, Homo Sapiens
gugagaccccucccuuccagaauccaggccccaucucccccaacuccacagccccucccgagcc

SEQ ID NO: 113701 - RNA, 64 nt, Homo Sapiens
ccuccccccaaccaccagcagcagcagggcccuccucccccaccagcucuccccacagggcccc

SEQ ID NO: 113702 - RNA, 64 nt, Homo Sapiens
gccaagcugcuaagccaaagauggccccugacaccucccccagccccagcacaccagccugcac

SEQ ID NO: 113703 - RNA, 64 nt, Homo Sapiens
aacgggggcuggggguaagagaaaucuaacugcgcucccccaaccccucgcccugccaucuucc

SEQ ID NO: 113704 - RNA, 64 nt, Homo Sapiens
cuccggcagcucagggaguguuuuccugugaggccucccccaucaguggaccagagggagaagc

SEQ ID NO: 113705 - RNA, 64 nt, Homo Sapiens
cgucuucuuccucugucccagcuagccagaucaacucccccaccauggcacuguccagcucugg

SEQ ID NO: 113706 - RNA, 64 nt, Homo Sapiens
cccucacuggcccaucccucugugauuuuuuuuucucccccauccaaggcuuuggugguaaucc

SEQ ID NO: 113707 - RNA, 64 nt, Homo Sapiens
ucagcacuccagucccaucaccugaaccuucagucucccccaucuguuacacuagagggcugca

SEQ ID NO: 113708 - RNA, 64 nt, Homo Sapiens
ccauccccagcacccccugcuacaccucagcagccucccccaugcaaaaaggaaagagaaaaau

SEQ ID NO: 113709 - RNA, 64 nt, Homo Sapiens
caaggguggcaggucacugucacugccgacaucccucccccagcagaauggaggcaggggacaa

SEQ ID NO: 113710 - RNA, 64 nt, Homo Sapiens
ucacacaucugggugcccugaaagggcccuuccccucccccacuccucuaagacaaaguagauu

SEQ ID NO: 113711 - RNA, 64 nt, Homo Sapiens
agcaccacggggucgggggaggagcacccccagccucccccaggcugcgccugcccgcccgccg

SEQ ID NO: 113712 - RNA, 64 nt, Homo Sapiens
ccccuugaccccacacgccggggcuggcccugcccucccccacggccgucccugacuucccagc

SEQ ID NO: 113713 - RNA, 64 nt, Homo Sapiens
ggguguccguucuuaauuccaaaaaacacagccucucccccaaaacacuuuuuuaaaggggauu

SEQ ID NO: 113714 - RNA, 64 nt, Homo Sapiens
augacacccaccgucgucaguccccggcaccucacucccccaaagcgggaggagcagcugugug

SEQ ID NO: 113715 - RNA, 64 nt, Homo Sapiens
cacaacuccuggccuucgaccucuaccccauuaccucccccagcauaagugcucuugggggugg

SEQ ID NO: 113716 - RNA, 64 nt, Homo Sapiens
ccccuccuugccaggggcaccaagacuucccugacucccccacuucugcagccacucuggcucc

SEQ ID NO: 113717 - RNA, 64 nt, Homo Sapiens
uucaccccaacuugugacugcucacuuaugacgucucccccaguacccuccaucucaaauaggc

SEQ ID NO: 113718 - RNA, 64 nt, Homo Sapiens
agccccuauuuuuuccaagcacgaagccaccagucucccccagggagcaucaggaagggacaug

SEQ ID NO: 113719 - RNA, 64 nt, Homo Sapiens
cacagauaaguggcucuuacccagcucucagugacucccccacaaaacagcaacagccuccacc

SEQ ID NO: 113720 - RNA, 64 nt, Homo Sapiens
cugcugcuggagcaggcaccuugggcugggccugcucccccagggcccagggccccccagcuua

SEQ ID NO: 113721 - RNA, 64 nt, Homo Sapiens
ucuguguccuuuauuguagcuagggcucccccaccucccccauuguuugacuuuguuauaaaaa

SEQ ID NO: 113722 - RNA, 64 nt, Homo Sapiens
ucccccauuucuguguccuuuuauaaaaauagggcucccccacccacagaucuguuugacuuug

SEQ ID NO: 113723 - RNA, 64 nt, Homo Sapiens
guugucucaugccaguaacacugugacauacccccucccccaccaggagcuuugacucaggagc

SEQ ID NO: 113724 - RNA, 64 nt, Homo Sapiens
agcuggacccugaccagcucauucccucacucgucucccccaacggcacccccgucaagaguga

SEQ ID NO: 113725 - RNA, 64 nt, Homo Sapiens
gaucuucuauuuaaguggcugggcaggauaucuucucccccaggcuacacucuguaaggaccug

SEQ ID NO: 113726 - RNA, 64 nt, Homo Sapiens
aguuccaggagaacucagcccagugugagucaugcucccccaggcccucacagcccccugucuc

SEQ ID NO: 113727 - RNA, 64 nt, Homo Sapiens
cuggaauccugguccccagcaggagagccuaguccucccccagccccuccagccaccagggugu

SEQ ID NO: 113728 - RNA, 64 nt, Homo Sapiens
uucauuuugaaaguguuuuucucauucuccauaccucccccaagcucuccuccagcccuuccca

SEQ ID NO: 113729 - RNA, 64 nt, Homo Sapiens
uggaggggaccccuugggcccucuggggcuuccccucccccaccugguugggguagagcaaaag

SEQ ID NO: 113730 - RNA, 64 nt, Homo Sapiens
acucuuccgaggucucccugaaaugaauguauuucucccccaaaagagcugauauuuaauguuu

SEQ ID NO: 113731 - RNA, 64 nt, Homo Sapiens
cuccgacccgaggcagaauacacuggaggucucgcucccccagccucucccccagccgcacggg

SEQ ID NO: 113732 - RNA, 64 nt, Homo Sapiens
cgcacgggcacuggaggucuggccccuccacccucucccccagcgaugacuccuacaucuaagu

SEQ ID NO: 113733 - RNA, 64 nt, Homo Sapiens
cccuucugcuccugucuccuaggacaggucaggucucccccagcgaaucuggggggagagagga

SEQ ID NO: 113734 - RNA, 64 nt, Homo Sapiens
ccucccaauuccuauggagccaccaggacugccccucccccacugggguugguuccauuucggc

SEQ ID NO: 113735 - RNA, 64 nt, Homo Sapiens
guuugaugucaucagcaccauccaucaggacuggcucccccaucugcuccaagggagcgugguc

SEQ ID NO: 113736 - RNA, 64 nt, Homo Sapiens
uggggaagggucagagaugccagcccccugggaccucccccauccuuuuugccuccaaguuucu

SEQ ID NO: 113737 - RNA, 64 nt, Homo Sapiens
uuuuuaaauuuuaacuuauaucagucacuugccacucccccacccuccuguccacaacuccuuu

SEQ ID NO: 113738 - RNA, 64 nt, Homo Sapiens
ccuaaaaaacuuucuccucuuuguccuccuuuuucucccccacucugagguuuccccaagagaa

SEQ ID NO: 113739 - RNA, 64 nt, Homo Sapiens
uugauguuaagguggagaggccuaaauucuccuccucccccauuaucucuuagggacccagacc

SEQ ID NO: 113740 - RNA, 64 nt, Homo Sapiens
gcuaaccugggaggugcugagacccagcccucaccucccccagacccuuguugcccuagagugg

SEQ ID NO: 113741 - RNA, 64 nt, Homo Sapiens
cugaaagagccgcccucccuuccccaaggauccacucccccagcuccuuuagagaauggcuacu

SEQ ID NO: 113742 - RNA, 64 nt, Homo Sapiens
acaucccaacauuugacaccccagcaaugugugacucccccaacauuccacuaugccauccugc

SEQ ID NO: 113743 - RNA, 64 nt, Homo Sapiens
aggaaggacaugucccacuccaucccccuuccugcucccccauuuccuaacucccccaguguga

SEQ ID NO: 113744 - RNA, 64 nt, Homo Sapiens
acuccaucccccuuccugcucccccauuuccuaacucccccagugugaauucucagggucacuu

SEQ ID NO: 113745 - RNA, 64 nt, Homo Sapiens
gggaagugggcccuucccugggucucugcacugacucccccacuccugacccuggugauggucg

SEQ ID NO: 113746 - RNA, 64 nt, Homo Sapiens
gaccagguccugugaggaagccuggagcaagggucucccccagcaggauggguggggccugcuc

SEQ ID NO: 113747 - RNA, 64 nt, Homo Sapiens
acuccaugggcagggagcuggggggacaucucaccucccccauggcacagagcccuccacaccc

SEQ ID NO: 113748 - RNA, 64 nt, Homo Sapiens
ugggccccuuuuauuuuuaccugccacccagcaucucccccaccugccccuucugggugacaca

SEQ ID NO: 113749 - RNA, 64 nt, Homo Sapiens
gcagacggccccucucuucccagcacuucccugccucccccaggccucaggcccagcacccagu

SEQ ID NO: 113750 - RNA, 64 nt, Homo Sapiens
gggcucccgccugugccccuucuccucaccaugucucccccacccugccucaguucuccguucc

SEQ ID NO: 113751 - RNA, 64 nt, Homo Sapiens
ggcauccucauccuguaccuauagaguucgugcacucccccauccaugcuaccuaccuccccgu

SEQ ID NO: 113752 - RNA, 64 nt, Homo Sapiens
uuucucagccccuuaggacgcgggucuccuugggcucccccaaggguucugcgaagaggcagug

SEQ ID NO: 113753 - RNA, 64 nt, Homo Sapiens
auacuacugacguccucccugaucccacccccuccucccccaguguccccuuucuuccuauuua

SEQ ID NO: 113754 - RNA, 64 nt, Homo Sapiens
uccuuggcuuucagagccagccuggcucugcccccucccccaugggcuguguccuaaggcccau

SEQ ID NO: 113755 - RNA, 64 nt, Homo Sapiens
cacagcagcaagugacccuucuccggccugcagccucccccaggguggaagccguggggucccu

SEQ ID NO: 113756 - RNA, 64 nt, Homo Sapiens
gccaaauguccccacuaccccagggaucccccagcucccccagccccuggcuuccugacccugc

SEQ ID NO: 113757 - RNA, 64 nt, Homo Sapiens
ugguauguaagugucuugaaguacccuccucucccucccccagcccucauuuuccaaaccucuu

SEQ ID NO: 113758 - RNA, 64 nt, Homo Sapiens
ccucagccguuccuccaccucuagagaagggccucucccccaacccccgaggagucugcccugc

SEQ ID NO: 113759 - RNA, 64 nt, Homo Sapiens
aagcggggucucaagccacaccccugccccacuucucccccacacagacccucguacccaaagg

SEQ ID NO: 113760 - RNA, 64 nt, Homo Sapiens
cucagauccuccucuuaugccggugccaaccucccucccccaagcuuaauacagcugcuuuucu

SEQ ID NO: 113761 - RNA, 64 nt, Homo Sapiens
acccuccccuggcccucugauuaaaccacucugucucccccacaaacuuccccuccuccccuau

SEQ ID NO: 113762 - RNA, 64 nt, Homo Sapiens
accgaacuuccccuccucccaaauaccugccucccucccccaucggcccccugagccuucuugu

SEQ ID NO: 113763 - RNA, 64 nt, Homo Sapiens
uucuuucuuucuuuaaaaaacuugccccccuggccucccccacuuucucccccauguucugucc

SEQ ID NO: 113764 - RNA, 64 nt, Homo Sapiens
uucugucccuugccccccuggaccaccuuuguuucucccccaugaggagcuccccuccccaacu

SEQ ID NO: 113765 - RNA, 61 nt, Homo Sapiens
ccccucccccaaccaacugagaagcugcucccucccccagcaagcccagcgccaggugcuc

SEQ ID NO: 113766 - RNA, 64 nt, Homo Sapiens
gcucuuuuguacugccccccgcucauuaaacagccucccccagcccugagugcacugauguccg

SEQ ID NO: 113767 - RNA, 64 nt, Homo Sapiens
ccauuccccagccacuucccuuccgcacuuaccacucccccagccacgccccuccccgcugacc

SEQ ID NO: 113768 - RNA, 64 nt, Homo Sapiens
caucaccucugucuaguuacagaacgguuucuuucucccccaaagaaaccccaucgccaucagc

SEQ ID NO: 113769 - RNA, 64 nt, Homo Sapiens
aagaaaccccaucgccaucagcacucacuccccacucccccagccccuggcaaccacaaaucuu

SEQ ID NO: 113770 - RNA, 64 nt, Homo Sapiens
uugggguucucucacccucuuucucuuuccuucccucccccauucuccagaucucccucugucu

SEQ ID NO: 113771 - RNA, 64 nt, Homo Sapiens
uggccccugucucucuccauguuggggguccuaacucccccaccccauaucuacguguccuccg

SEQ ID NO: 113772 - RNA, 64 nt, Homo Sapiens
cugucccgggaccugcugggagggacaagaggcccucccccaggcagaagagcaugcccuuugc

SEQ ID NO: 113773 - RNA, 64 nt, Homo Sapiens
ugccucuucccucgcccaccugccugcccccauacucccccagcggagagcaugauccgugccc

SEQ ID NO: 113774 - RNA, 64 nt, Homo Sapiens
gcugcaggugccgccaggacacgggguucagcggcucccccaguggcucccccagcgcugaagc

SEQ ID NO: 113775 - RNA, 64 nt, Homo Sapiens
gcugaagcacgggguucagcacggggcccagcggcucccccagcugcaugguuuguggcggaag

SEQ ID NO: 113776 - RNA, 64 nt, Homo Sapiens
cagauacggaauaaaacuacccucggagaccacccucccccagccuccacccucacuccaucca

SEQ ID NO: 113777 - RNA, 64 nt, Homo Sapiens
gcucgggaugucuccagcagacccacaccucugucucccccaggcuggaagaugaagcccaaac

SEQ ID NO: 113778 - RNA, 64 nt, Homo Sapiens
guggggucuguguagccuucugugggugcccccacucccccauccugcccccucuccccccgca

SEQ ID NO: 113779 - RNA, 64 nt, Homo Sapiens
accgacacccuccucggccucugacccccgcugccucccccaaccugcccgccgcccaccccca

SEQ ID NO: 113780 - RNA, 64 nt, Homo Sapiens
ccccuccccaucaauaaaacucucuggaguuugccucccccagcgcuggcuggguccucugccc

SEQ ID NO: 113781 - RNA, 64 nt, Homo Sapiens
ccuggaaaggucccuccccaugcagaccuaagcccucccccaccggggaauggggggccacagc

SEQ ID NO: 113782 - RNA, 64 nt, Homo Sapiens
ccucccgguguuguuauuaacuguccagcucucucucccccaccgcuauggcgcccccaucuga

SEQ ID NO: 113783 - RNA, 64 nt, Homo Sapiens
aggacugggccuccccggcagcccagcccugagccucccccacccccacacagcugagggagag

SEQ ID NO: 113784 - RNA, 64 nt, Homo Sapiens
uucucauuugugcuuuuuucgcuguccaucaccucucccccacucuccuccagcuuagcuguca

SEQ ID NO: 113785 - RNA, 64 nt, Homo Sapiens
cugggcgccccuccuccagcccaccagcuuccgccucccccaucgggcugccuguuuuacucac

SEQ ID NO: 113786 - RNA, 64 nt, Homo Sapiens
ucaucaucagucgcugucuccccacuacccuucucucccccagcccaacaucccagacccguua

SEQ ID NO: 113787 - RNA, 64 nt, Homo Sapiens
cgcccuccacuaccucugaguucagacauuccagcucccccacugcacauuuugaaccugcaac

SEQ ID NO: 113788 - RNA, 64 nt, Homo Sapiens
cugcggacgaucgcaucuugugucgcugaagcgccucccccagggaccggcggaccccagccau

SEQ ID NO: 113789 - RNA, 64 nt, Homo Sapiens
ccagggggcaagaggaauuacgugcucugugggucucccccaacgcgccucgccggaucugagg

SEQ ID NO: 113790 - RNA, 64 nt, Homo Sapiens
gucucccgggccuguccccaacuccuccccaccccucccccaucuccucuuugaaagccagaac

SEQ ID NO: 113791 - RNA, 64 nt, Homo Sapiens
acgugcagacccugccaugcagacccaugccccccucccccaggcagcuccaagaaagcucccu

SEQ ID NO: 113792 - RNA, 64 nt, Homo Sapiens
cccagggaaacagggccagcacagaggggccuuccucccccacagagcccccaugacauagucu

SEQ ID NO: 113793 - RNA, 64 nt, Homo Sapiens
ccccacacccaugcagaacuauccuguccggugccucccccaacggugcccccaguguccucug

SEQ ID NO: 113794 - RNA, 64 nt, Homo Sapiens
aguauggccccaccugcucuccgccugcucuuuccucccccacccucccccgccagguguggcc

SEQ ID NO: 113795 - RNA, 64 nt, Homo Sapiens
gaaaagaugcagguuuauauggaacccccacccccucccccacucucccacucuguucguucug

SEQ ID NO: 113796 - RNA, 64 nt, Homo Sapiens
gaaugucuucacgagcgugcaucagggcgccuggcucccccaccucagccagugagucagacac

SEQ ID NO: 113797 - RNA, 64 nt, Homo Sapiens
guggggcaggcucuuugucuuggggaccaggaugcucccccaguccuucccagaugauggcugc

SEQ ID NO: 113798 - RNA, 64 nt, Homo Sapiens
ucccagaugauggcugccugugggaccccagcuacucccccagacccaaguucugcagaacuaa

SEQ ID NO: 113799 - RNA, 64 nt, Homo Sapiens
cguccuggccccgggcuguggcgagacagcccaacucccccagcccagcucccccagcccagag

SEQ ID NO: 113800 - RNA, 64 nt, Homo Sapiens
gcuguggcgagacagcccaacucccccagcccagcucccccagcccagagccagggaagaggaa

SEQ ID NO: 113801 - RNA, 64 nt, Homo Sapiens
uccugggccucucugaccuccucacugggccugccucccccacccaagaccaggagagggccac

SEQ ID NO: 113802 - RNA, 64 nt, Homo Sapiens
ucucccugaguucucccaccgcuuccucccucugcucccccauggccccgggcuguugggcucu

SEQ ID NO: 113803 - RNA, 64 nt, Homo Sapiens
gaauguaccugcacucaaacguuccugaggugcccucccccaaacaggaaggguauaaaugcau

SEQ ID NO: 113804 - RNA, 64 nt, Homo Sapiens
agugucugcucaggccugacugugaacuuucucucucccccagcgaccgugcuuggugggggga

SEQ ID NO: 113805 - RNA, 64 nt, Homo Sapiens
cagacugacugagggggccugaagcuacaugcaccucccccacugcugcccuccugucgagaau

SEQ ID NO: 113806 - RNA, 64 nt, Homo Sapiens
aaggcgaagguucugauggcugccuugcuccuugcucccccacccccugugaggacuucucuag

SEQ ID NO: 113807 - RNA, 64 nt, Homo Sapiens
ccaaguguuuauuuuugauaaaucuuccugccgccucccccacuaaggaagggauuuggggggg

SEQ ID NO: 113808 - RNA, 64 nt, Homo Sapiens
uccccacuuuuuuccccaagggugguuaggacaucucccccaccagccugaccuaaccuuuuag

SEQ ID NO: 113809 - RNA, 64 nt, Homo Sapiens
cuuguuccaguuguuaguuagccacauccacagucucccccacccauggggcuaggucauuaag

SEQ ID NO: 113810 - RNA, 64 nt, Homo Sapiens
cccaaccacguugggacaggccagcuccccccaccucccccacugugccccgucuacagcuccc

SEQ ID NO: 113811 - RNA, 64 nt, Homo Sapiens
uccccccaccucccccacucugccccgucuacagcucccccagccccguuuucggugccaucag

SEQ ID NO: 113812 - RNA, 64 nt, Homo Sapiens
gacuauagaucauaaggcaaugcaugaaccacagaagcugcaugguuaaaauagcggccugugc

SEQ ID NO: 113813 - RNA, 64 nt, Homo Sapiens
aauaaucaucuaaauaaaaauuauauuggcagcuaagcugcacugaauacucaacagaaauagu

SEQ ID NO: 113814 - RNA, 64 nt, Homo Sapiens
ggaaacauuucaagagucuaguaugccaucaugcaagcugcaaacagcgcccucuacugacaaa

SEQ ID NO: 113815 - RNA, 64 nt, Homo Sapiens
cuacaggcaaccagcacugcagaaaugcuggagaaagcugcaccaaagcuagagaagcaagugg

SEQ ID NO: 113816 - RNA, 64 nt, Homo Sapiens
gcccucuggagggcugguggccacgagguuaaagaagcugcauguuaagugccauuacuacugu

SEQ ID NO: 113817 - RNA, 64 nt, Homo Sapiens
cugugaaaccuuuaccuuuuuuguuguuguuggcaagcugcagguuuguaaugcaaaaggcuga

SEQ ID NO: 113818 - RNA, 64 nt, Homo Sapiens
agaccauaagcuuuucaugccagaugucaacauuaagcugcaacauccuaaccaccauaagccg

SEQ ID NO: 113819 - RNA, 64 nt, Homo Sapiens
auaugggcugguaaauuuuugguacauuaauugcaagcugcaugacaaaauuuguuuuucuggc

SEQ ID NO: 113820 - RNA, 64 nt, Homo Sapiens
cuggccuuugguguugaaauccuuaagacaucugaagcugcaacaaacgggcuucaggucaaac

SEQ ID NO: 113821 - RNA, 64 nt, Homo Sapiens
aagauacgacugaggcgccuggagcugagaacggaagcugcagagcgcuaccucccccauguga

SEQ ID NO: 113822 - RNA, 64 nt, Homo Sapiens
aacacauauuuaauaugugcccagauuauucuaaaaucuuaaaaaaagaugcauauagugaaau

SEQ ID NO: 113823 - RNA, 64 nt, Homo Sapiens
uguuuucauauugauagcaucuaauucuuuugacaaucuuaauauguagguucauuuaaauuuu

SEQ ID NO: 113824 - RNA, 64 nt, Homo Sapiens
caaaaccuacauugacaaguuuaacauugagaagaaucuuaacaaaaauauggauaugaauuca

SEQ ID NO: 113825 - RNA, 64 nt, Homo Sapiens
uuuuucaugauaacuuauuuuaagaugccuuaaaaaucuuaaagucacaaaaggaaaaagguuu

SEQ ID NO: 113826 - RNA, 64 nt, Homo Sapiens
ugauucgaucgucaagacaucacuuggauuucuuaaucuuaaaugcuuauggaagaugugaagu

SEQ ID NO: 113827 - RNA, 64 nt, Homo Sapiens
cuuuauuugcaaaagaaucuuuauuaaaacaaacaaucuuaacuaugcacaugaugugaccaga

SEQ ID NO: 113828 - RNA, 64 nt, Homo Sapiens
uucauuauguaaaacuaauucaccaugaaaaggcaaucuuaaagguaauuuccaaacuucuguu

SEQ ID NO: 113829 - RNA, 64 nt, Homo Sapiens
guugccaguuaguaauucuuuaugguaaguauagaaucuuaaugcagcuugccuauuaaaggac

SEQ ID NO: 113830 - RNA, 64 nt, Homo Sapiens
auauaguguuagugugaugcguacagaaguuuucaaucuuaacuuggagguguagugaacgugu

SEQ ID NO: 113831 - RNA, 64 nt, Homo Sapiens
ucuuugaaauucaaguuaaagagcuuuaauaaaaaaucuuaaauacagcuggaaacuuggacua

SEQ ID NO: 113832 - RNA, 64 nt, Homo Sapiens
auaacauuugguuuacuaaugcuauaacuaaaaaaaucuuaagguuugaaaaaaggauaaaaaa

SEQ ID NO: 113833 - RNA, 64 nt, Homo Sapiens
uaggaacauaauaaaagaucaaaaaaauaaaaagaaucuuaaaaagagcgagacuccaucucaa

SEQ ID NO: 113834 - RNA, 64 nt, Homo Sapiens
auuaugaauuuuucagaacucauccaguccuuguaaucuuaaacagaugcaaauccuaccccug

SEQ ID NO: 113835 - RNA, 64 nt, Homo Sapiens
ggcguugccucucacuuugaaagaaagacuccguaaucuuaaacagaugcaaauccaauuaggc

SEQ ID NO: 113836 - RNA, 64 nt, Homo Sapiens
uuaucugccauuuuuuccuacuauaauaaugcugaaucuuaauuuagaggguacaaggguaugg

SEQ ID NO: 113837 - RNA, 64 nt, Homo Sapiens
augcaauuuaauauaauagauuuuuuaaugaauuaaucuuaacauaguaaucuuuagcuuuuua

SEQ ID NO: 113838 - RNA, 64 nt, Homo Sapiens
uaugccuuaaaggccaccugcuauacaguuguuaaaucuuaaauaugcuuuuuaaaaauuggaa

SEQ ID NO: 113839 - RNA, 64 nt, Homo Sapiens
uuaauuucacauauucaacaccuuuaaauguuguaaucuuaauaugcgaagugugccucugcaa

SEQ ID NO: 113840 - RNA, 64 nt, Homo Sapiens
auguaaacuggcccuauuacacugcugccagagcaaucuuaaaacccuuccaaccacccuccac

SEQ ID NO: 113841 - RNA, 64 nt, Homo Sapiens
uaauuccaagcugagucuucugcaaauaacauaaaaucuuaaaaaacuuacuuuuccauaauau

SEQ ID NO: 113842 - RNA, 64 nt, Homo Sapiens
acaugguuaaaauaaaacuuuugugguucuucugaaucuuaauauuucaaagccaggugaaaau

SEQ ID NO: 113843 - RNA, 64 nt, Homo Sapiens
ucuuugcacuguaacagagauuccuuuuuucaauaaucuuaauucaaaagcauuauuagacuug

SEQ ID NO: 113844 - RNA, 64 nt, Homo Sapiens
ugucuacaucuguguauauaucauaggauuugagaaucuuaacacauguauaaauaaguauaua

SEQ ID NO: 113845 - RNA, 64 nt, Homo Sapiens
auguauaaauaaguauauauaaacuccaauuuuaaaucuuaaaauugcugaauuuacccucaua

SEQ ID NO: 113846 - RNA, 64 nt, Homo Sapiens
ucuggcucuaucagaguuguguaagccauaagcgaaucuuaauuugacuuggcauuuaccuugg

SEQ ID NO: 113847 - RNA, 64 nt, Homo Sapiens
aagaaauugaagggagaggcgcuuggccaacuguaaucuuaaccaugcagaaaauguuuagaga

SEQ ID NO: 113848 - RNA, 64 nt, Homo Sapiens
cccuucagcaacuuauuuugcuuuaauugcuuuaaaucuuaagcaauauuuuuuauucaguaaa

SEQ ID NO: 113849 - RNA, 64 nt, Homo Sapiens
ucccuucucuucacuagucuaaaaacuucuuuuuaaucuuaagauucuuugugaugagggugag

SEQ ID NO: 113850 - RNA, 64 nt, Homo Sapiens
uuuuugcugucuuuaauuuaggaaauugaaguucaaucuuaaguaaccucuucaaaguacccuu

SEQ ID NO: 113851 - RNA, 64 nt, Homo Sapiens
guuggcugggcacaguggcuuagaacacaauuaaaaucuuaauuaaucaaguaucaauacaaaa

SEQ ID NO: 113852 - RNA, 64 nt, Homo Sapiens
cuaccuggaggggaucagcccacugacagaccuuaaucuuaauuacugcuguggcuagagaguu

SEQ ID NO: 113853 - RNA, 64 nt, Homo Sapiens
gauauauuaacaguuuuagaagucaguagaauaaaaucuuaaagcacucauaauauggcauccu

SEQ ID NO: 113854 - RNA, 64 nt, Homo Sapiens
guuaccaagaugauuccaauuauaacuguuguagaaucuuaaauccaccucugaaucgucgcau

SEQ ID NO: 113855 - RNA, 64 nt, Homo Sapiens
agaauucucuaaaagguuugaauugagaaaaagaaaucuuaagucaaaaggagugggggaaagg

SEQ ID NO: 113856 - RNA, 64 nt, Homo Sapiens
augagaaaagccaccccaucaaaaaaauaauaauaaucuuaaagacagagcaagacuccaucuc

SEQ ID NO: 113857 - RNA, 64 nt, Homo Sapiens
gcugagaggccgggcacggucaagagagugucagaaucuuaagaugagucaucaccagcuuccc

SEQ ID NO: 113858 - RNA, 64 nt, Homo Sapiens
aauaaauccacccauguuauuaaguuugcacucaaaucuuaagagcuuuguuuguucuuguuuu

SEQ ID NO: 113859 - RNA, 64 nt, Homo Sapiens
cuguuauucuuugcacuuuuuguaaaaugcaaaaaaucuuaauacacacuugaaccauaguuac

SEQ ID NO: 113860 - RNA, 64 nt, Homo Sapiens
cacaagaucuguaauguuauuuccacuuauaaaggaaauaaaaaaugaaaaacauuauuuggau

SEQ ID NO: 113861 - RNA, 64 nt, Homo Sapiens
agauaugugaagaaaaauguauuuuuccuaaauagaaauaaaugaucccauuuuuugguaucau

SEQ ID NO: 113862 - RNA, 64 nt, Homo Sapiens
ucaaguuggagcaauugucuguguuugaaaagaugaaauaaaaauaauaaucaagggcaaagcu

SEQ ID NO: 113863 - RNA, 64 nt, Homo Sapiens
auccccauuccaagaaauauaagugagugaaguugaaauaaaaucuuuaaaauuuacuauauug

SEQ ID NO: 113864 - RNA, 64 nt, Homo Sapiens
uuaauuaugaagaugaaacacuagagucauauaagaaauaaaaauugggcaauaaaauaaaaug

SEQ ID NO: 113865 - RNA, 64 nt, Homo Sapiens
aaguuaauguaauuguuaucccauuauuuagagcgaaauaaauguugaauauauggacuuucuc

SEQ ID NO: 113866 - RNA, 64 nt, Homo Sapiens
ucuguuuauuuuuguacuauaaaagauaagucuggaaauaaaugaauguguauuuaacuuaugu

SEQ ID NO: 113867 - RNA, 64 nt, Homo Sapiens
ucauuaaagauaacucaggaaagagggagaaaaugaaauaaauagaaaaaaauuuucuuuuggg

SEQ ID NO: 113868 - RNA, 64 nt, Homo Sapiens
uaaaacguggauuuaaaaaguaucucacaaauaggaaauaaaaccagcauuacaaaagaguaag

SEQ ID NO: 113869 - RNA, 64 nt, Homo Sapiens
uuugaauauuucaagaauaucaauguauagcuuagaaauaaaacaaugguuuauuauagaauac

SEQ ID NO: 113870 - RNA, 64 nt, Homo Sapiens
guucuuuacaaauauuugcuuggcaacacgacuugaaauaaauaaaacuuuguuucuuaggaga

SEQ ID NO: 113871 - RNA, 64 nt, Homo Sapiens
aacauacuuuacgcaaugaacaguaguuaaauaggaaauaaacuaguuccauauaaguauacac

SEQ ID NO: 113872 - RNA, 64 nt, Homo Sapiens
ugacgacaaagauucuguuucaaauauagccacagaaauaaaggagggaccaauaucugggaca

SEQ ID NO: 113873 - RNA, 64 nt, Homo Sapiens
ugacgagaaagauucuguuucaaauauagccacagaaauaaagaagggacaacaaucugggaca

SEQ ID NO: 113874 - RNA, 64 nt, Homo Sapiens
ugacaagacagauucugcuuugaauauagcuacagaaauaaaggauggacuacagugugggaca

SEQ ID NO: 113875 - RNA, 64 nt, Homo Sapiens
ugacgaggaagacucuguuucgaauauagccacagaaauaaaggauggagaaaaaucugggaca

SEQ ID NO: 113876 - RNA, 64 nt, Homo Sapiens
ugaugagaaagauucuguuucgaacauagccacagaaauaaaggauggagaaaaaucugggaca

SEQ ID NO: 113877 - RNA, 64 nt, Homo Sapiens
uuuuuaauguguuauaauugaccuugcauggugugaaauaaaaguuuaaacacugguguauuuc

SEQ ID NO: 113878 - RNA, 64 nt, Homo Sapiens
guugcaguaccuuuuucugguaaauuuuguagcagaaauaaaaugacaauuccuaagagccacu

SEQ ID NO: 113879 - RNA, 64 nt, Homo Sapiens
uaaagcauacauaguagagggaaaggagagaauggaaauaaaacugaauauuaugcagauuuau

SEQ ID NO: 113880 - RNA, 64 nt, Homo Sapiens
ugacucuuuguuuuauuuugacauggcauguccugaaauaaauauugauucacuauggcagaug

SEQ ID NO: 113881 - RNA, 64 nt, Homo Sapiens
aaucagauguauuuauuaugcuuguguaauuauagaaauaaagaaaugggugacaggcuuaacc

SEQ ID NO: 113882 - RNA, 64 nt, Homo Sapiens
gccugcuguuuuggaaaugcacaguugacauguugaaauaaaaaugaauaccauuuuuaaaugu

SEQ ID NO: 113883 - RNA, 64 nt, Homo Sapiens
aucugguuguuccuccagggauacugcucauuuagaaauaaaucgcaugaguauaacaauuuug

SEQ ID NO: 113884 - RNA, 62 nt, Homo Sapiens
ggugauagucugguguuacagggcagggaggagaaauaaaguauaaaaaauucaguaguuag

SEQ ID NO: 113885 - RNA, 64 nt, Homo Sapiens
ugagaaucucauacaucugugaaaaagauaaugugaaauaaacaguaaaaaaaaaaaguauguu

SEQ ID NO: 113886 - RNA, 64 nt, Homo Sapiens
uuuaugaauuauaaauaugaauuuaauuacuaaagaaauaaaaauaaugguguaaagccaacuc

SEQ ID NO: 113887 - RNA, 64 nt, Homo Sapiens
aaucugaauaagcuuccaaaauuuuuuuuuuuaagaaauaaagggagcuguguagugggucagu

SEQ ID NO: 113888 - RNA, 64 nt, Homo Sapiens
gacauaauaagagguguaaaaacuaucacaggaagaaauaaaaacagauuuuugaaggugagau

SEQ ID NO: 113889 - RNA, 64 nt, Homo Sapiens
ccaaagaaagcagaaagaaggaaagccuagaacagaaauaaaugaaauagagaauagaaaagca

SEQ ID NO: 113890 - RNA, 64 nt, Homo Sapiens
aaacaaaagucaagauuuuauuaccaaacuuauagaaauaaaaauuauuagaaagaaauacuau

SEQ ID NO: 113891 - RNA, 64 nt, Homo Sapiens
uaaaucaaggggcuuuucagaaggucauucugaagaaauaaagaggcaaagggucacagaagug

SEQ ID NO: 113892 - RNA, 64 nt, Homo Sapiens
agcucagaauuauucuggaaagaaagccugccaggaaauaaauucaaauacaguaugagcugcg

SEQ ID NO: 113893 - RNA, 64 nt, Homo Sapiens
guggucuguccacgcaauggcaacugaugaaugggaaauaaaaugaaacaacccaaaugucuac

SEQ ID NO: 113894 - RNA, 64 nt, Homo Sapiens
uauccagauaggaaaagaaguugggaaagaaaaagaaauaaaugagcuaauguuuaagaagcau

SEQ ID NO: 113895 - RNA, 64 nt, Homo Sapiens
uggcuucacauggaaauuuauggaaauaaagaaggaaauaaagaauucuaaguggccaauuauu

SEQ ID NO: 113896 - RNA, 64 nt, Homo Sapiens
aggaaauaaagauggcuucauggccaauuauuuggaaauaaagaauguccacacuuauucuaag

SEQ ID NO: 113897 - RNA, 64 nt, Homo Sapiens
caucuuagguuauaccaucuauugaaaauauaaugaaauaaaaguuguuauaaugcguaaagau

SEQ ID NO: 113898 - RNA, 64 nt, Homo Sapiens
uuacacaauuugcauuggaauaaaaaucaaggaagaaauaaauguaagaauacuaaaguauuuu

SEQ ID NO: 113899 - RNA, 64 nt, Homo Sapiens
uauuacuuuaaaggaaaggaacauuaauaaagaugaaauaaacugaaggcuaauuguaaugaag

SEQ ID NO: 113900 - RNA, 64 nt, Homo Sapiens
ccugcaucuuggagggaggcaggaaauuucuuuugaaauaaagugcuggagcugaauucugcau

SEQ ID NO: 113901 - RNA, 64 nt, Homo Sapiens
gcuuuauaucuguuccuaaaacaguuaauccugugaaauaaauauugaacauaauccagaagaa

SEQ ID NO: 113902 - RNA, 64 nt, Homo Sapiens
uuuuguucacaugaccaaagaaagccuuuuuuaagaaauaaauucuugaaaaacaaagaccuaa

SEQ ID NO: 113903 - RNA, 64 nt, Homo Sapiens
guaaagccagaggccauuacaacgcagggaaggagaaauaaagaacaguggaacgcaggcugag

SEQ ID NO: 113904 - RNA, 64 nt, Homo Sapiens
gguauguggaaauuaauauuauuuauauuuuuaugaaauaaagaacauacuauuucuaauaaau

SEQ ID NO: 113905 - RNA, 50 nt, Homo Sapiens
gaauugcuccccagauuauugaaauaaaauaugagcagauuuugaaguag

SEQ ID NO: 113906 - RNA, 64 nt, Homo Sapiens
accaguauuuaaguaaaugugauuuuaguagauugaaauaaauaagaggagcuuuaaauaagau

SEQ ID NO: 113907 - RNA, 64 nt, Homo Sapiens
uuguaaauauaugaaagaugaauauuuacaaguggaaauaaaauacuugguuuuaaauguugac

SEQ ID NO: 113908 - RNA, 64 nt, Homo Sapiens
uguagcauauucacuaaacagauuuucaaacauagaaauaaagcugauuuaaaacguuuguuga

SEQ ID NO: 113909 - RNA, 64 nt, Homo Sapiens
uccuaguaaaguuauucauauuuuggauuggaaagaaauaaagcagucacuaucuuauguuuuc

SEQ ID NO: 113910 - RNA, 64 nt, Homo Sapiens
caaacauuaaaucgcacuuuuaaagugagucauugaaauaaauaguacugaaaugauucucuau

SEQ ID NO: 113911 - RNA, 64 nt, Homo Sapiens
cuucuuuggugauacacuguagccacuagaaagagaaauaaacccaauggcauguguuuacagg

SEQ ID NO: 113912 - RNA, 64 nt, Homo Sapiens
accuaacuuuaguagcaaaucuugauuaauugaagaaauaaaauauuucggauaagguuucaua

SEQ ID NO: 113913 - RNA, 64 nt, Homo Sapiens
uuugaucacuucaaauacauacucuucaagucaagaaauaaauuucuuuacauagaaaaggaua

SEQ ID NO: 113914 - RNA, 64 nt, Homo Sapiens
uaucguauucauacuacuguucaaucuuuauuuagaaauaaacuuuaucuaugauuucauuuuc

SEQ ID NO: 113915 - RNA, 64 nt, Homo Sapiens
uucuaauaaaugcacggcuuuaccuuuccugucagaaauaaaccaaggcucuaaaagaugauuu

SEQ ID NO: 113916 - RNA, 64 nt, Homo Sapiens
uuauauaaaaacaaugauaaagaugugaaacugugaaauaaauauaccauauuagcuacccacc

SEQ ID NO: 113917 - RNA, 64 nt, Homo Sapiens
uguucuuacacaaggggcaauaaaauauaguuuggaaauaaaaaauucuacucuaaagcuucua

SEQ ID NO: 113918 - RNA, 64 nt, Homo Sapiens
cacacugcuuaguauucuugacuauguguucaaugaaauaaaaguuuuugcuguuaguuauaaa

SEQ ID NO: 113919 - RNA, 64 nt, Homo Sapiens
gugagcaaguaauagauuuuaauguuaaguugcugaaauaaaaaauucagccugugcuguaguu

SEQ ID NO: 113920 - RNA, 64 nt, Homo Sapiens
uuaaguaauuauuuuuaaagugcauaugagugaggaaauaaacucuuagaaauccuuucugaga

SEQ ID NO: 113921 - RNA, 64 nt, Homo Sapiens
aaggcacugauaaaaccgcaacaaaaacauguaagaaauaaaauagaaaugcuuuauauaauuu

SEQ ID NO: 113922 - RNA, 64 nt, Homo Sapiens
cuuuuuguguuuggaguguaguccauuugcaauagaaauaaaaaaauccgucaccaaauuguaa

SEQ ID NO: 113923 - RNA, 64 nt, Homo Sapiens
gaggaugauaagggaucccggacucuguaugauugaaauaaagagaaauaaacaaaucuagcag

SEQ ID NO: 113924 - RNA, 63 nt, Homo Sapiens
agggaucccggacucuguaugauugaaauaaagagaaauaaacaaaucuagcagcucugaguc

SEQ ID NO: 113925 - RNA, 64 nt, Homo Sapiens
acgacuuacauggucacaguauauuuugcugcaagaaauaaagaggauaugauagaagguuuuu

SEQ ID NO: 113926 - RNA, 64 nt, Homo Sapiens
aauuuuauuuuuaucugaaaauaacaguugaucugaaauaaaaaggggagaccuauuagaauga

SEQ ID NO: 113927 - RNA, 64 nt, Homo Sapiens
uucagcuuaaaacuguucugauuucaaaagagaggaaauaaaaggucaaaaccugaaucagaau

SEQ ID NO: 113928 - RNA, 64 nt, Homo Sapiens
guuauggaggggcuguuuuuccaaaucuuaucuggaaauaaauuuaugauuuccuuuaaaggca

SEQ ID NO: 113929 - RNA, 64 nt, Homo Sapiens
ucuauuguuuaagucacccacuccaaaacuaugagaaauaaauucuugaucuuggacuuccagc

SEQ ID NO: 113930 - RNA, 64 nt, Homo Sapiens
cuacggguagaaaacauaagucuuuuacgcagaagaaauaaaaauaucaaauaaguaucacaaa

SEQ ID NO: 113931 - RNA, 64 nt, Homo Sapiens
guuggcaugaaaguggcuacgauuuucuauuauggaaauaaagacacuaaagguggaaauaaaa

SEQ ID NO: 113932 - RNA, 64 nt, Homo Sapiens
auuuucuauuauggaaauaagaacacuaaagguggaaauaaaaguggucaucuauucuagcagg

SEQ ID NO: 113933 - RNA, 64 nt, Homo Sapiens
acauguuaauccuuguaucaagaaacaaauaacugaaauaaaaagauacaucaaguucauuugc

SEQ ID NO: 113934 - RNA, 64 nt, Homo Sapiens
cuaagguaacuucucagaaauuucacucacuguggaaauaaaaauuuauaacacagucuuuaau

SEQ ID NO: 113935 - RNA, 64 nt, Homo Sapiens
agaagccaagcucuucaagccugcaacaagaucugaaauaaaugaaauaagauugacuuugaau

SEQ ID NO: 113936 - RNA, 64 nt, Homo Sapiens
aggaaccuaugaaacuauuguuacucaugaccuugaaauaaaauuucaacugcaucuccaaaca

SEQ ID NO: 113937 - RNA, 64 nt, Homo Sapiens
uacuaugcaagaaaauguacaaauaaccuuuauugaaauaaagauguauauaagagaaagaacg

SEQ ID NO: 113938 - RNA, 64 nt, Homo Sapiens
guaccuaacuugggcacagcaugaacauaaagaggaaauaaaagaaaaauuaaauaaaacuaau

SEQ ID NO: 113939 - RNA, 64 nt, Homo Sapiens
aaaaauuaaauaaaacuaauuacacacaauuuuagaaauaaauucagagguaauaugcuccacc

SEQ ID NO: 113940 - RNA, 64 nt, Homo Sapiens
aacaaaggggaacuauaucagaauguauauuuaagaaauaaaaccaugaaaauauuccuuagua

SEQ ID NO: 113941 - RNA, 64 nt, Homo Sapiens
uguaaauuuuuucuucaguacuucacuaaacauugaaauaaagucugcaauucuguuugcagug

SEQ ID NO: 113942 - RNA, 64 nt, Homo Sapiens
augguaucuucaucauuuuguggcuuaguauguugaaauaaacuuaguuguuuucuuauuuuuu

SEQ ID NO: 113943 - RNA, 64 nt, Homo Sapiens
auggcauuaugugguuaagauuugucuugucacugaaauaaaagaagagugugaccuaaaugcu

SEQ ID NO: 113944 - RNA, 64 nt, Homo Sapiens
uuuuuuaaugacacugguuucauguaguuuucaagaaauaaaagaauucauucaagugaagcca

SEQ ID NO: 113945 - RNA, 64 nt, Homo Sapiens
aaauucauuguucuacuuaguugcagcuguaccugaaauaaaaauguuauugaugacugaauuu

SEQ ID NO: 113946 - RNA, 64 nt, Homo Sapiens
ugccagacagagaucagaauugaaccgucaaugugaaauaaagaguucuccuuguacuugaaua

SEQ ID NO: 113947 - RNA, 64 nt, Homo Sapiens
aauuuuaaaaugcaaauauugcuauuguuuauaggaaauaaaucuaaauauaaaugaaauugaa

SEQ ID NO: 113948 - RNA, 64 nt, Homo Sapiens
uuuguuuuuugaaaucgauugggaucgaaagccugaaauaaauauucauacuuuccauagaacu

SEQ ID NO: 113949 - RNA, 64 nt, Homo Sapiens
ucuuuuucugcccaucugucuacuaauaaaaugugaaauaaaauaccuguauugcuacuucccc

SEQ ID NO: 113950 - RNA, 64 nt, Homo Sapiens
caucuaccuucaggauugcugacagacagaauuugaaauaaaauaugcaaguuagcuaauacaa

SEQ ID NO: 113951 - RNA, 64 nt, Homo Sapiens
augcagccuuuccucuguacuuuucuccaugguugaaauaaaacagggugacugggaguuacuu

SEQ ID NO: 113952 - RNA, 64 nt, Homo Sapiens
uauuccuccuuaaaaaaaaggaguggauggaggagaaauaaacucugguguuaagauauauuuu

SEQ ID NO: 113953 - RNA, 64 nt, Homo Sapiens
gcaugacuauuuccaccaucauuccuagagagcagaaauaaaaaugaccugcugugcaccuuac

SEQ ID NO: 113954 - RNA, 64 nt, Homo Sapiens
gccaguuccucuuugauaaauauauaguuaauucgaaauaaaauccauugcaauucauuuauga

SEQ ID NO: 113955 - RNA, 64 nt, Homo Sapiens
auagagcaaccauagccuuaacuuacagaccugugaaauaaagggcauuuugaccuaauacaau

SEQ ID NO: 113956 - RNA, 64 nt, Homo Sapiens
uccuguuauauguauaucaggaauacaaggaugugaaauaaaacuguaaauuugcauaacugga

SEQ ID NO: 113957 - RNA, 64 nt, Homo Sapiens
uaaauuugcauaacuggauguacuuagauaaugugaaauaaacauuaaagacaaggucuauuuu

SEQ ID NO: 113958 - RNA, 64 nt, Homo Sapiens
aaaacauacaagccaggaugaaugaagccaauaggaaauaaaaaacaggcacacaacauuauuu

SEQ ID NO: 113959 - RNA, 64 nt, Homo Sapiens
guagacaaagauguuauuucccagugcaaauaaagaaauaaagauagcaagcugauucucucca

SEQ ID NO: 113960 - RNA, 64 nt, Homo Sapiens
gcacauaaauuuggaaggaguaccaaaaaaaaaggaaauaaaauagugcuaucuaaugcaguga

SEQ ID NO: 113961 - RNA, 64 nt, Homo Sapiens
augacaaguucuguuuugaggaaaauuuugcuuagaaauaaaaucaauuuaagaaaucuaaagu

SEQ ID NO: 113962 - RNA, 64 nt, Homo Sapiens
ggcuuuuaaaauuuuguuugcaauaauggugaaggaaauaaaaagugauauuuguauuguaaaa

SEQ ID NO: 113963 - RNA, 64 nt, Homo Sapiens
guauuauuuucuugggaaaauccagucacaucuggaaauaaagcauaucauaaguucuggucuu

SEQ ID NO: 113964 - RNA, 64 nt, Homo Sapiens
uuugaauuggccaauaacauuucaauagcauaaugaaauaaaauuuaauuuuuauuugagcugu

SEQ ID NO: 113965 - RNA, 64 nt, Homo Sapiens
gccuguccaaagucuagcuuccucgugggcuugagaaauaaaaaaaguauuuuguaauuagacu

SEQ ID NO: 113966 - RNA, 64 nt, Homo Sapiens
aacguaaguaacaauuuuuaguuuauuuguagcugaaauaaagcauuacauuacaucaaauaaa

SEQ ID NO: 113967 - RNA, 64 nt, Homo Sapiens
aggcaaaauagagguggaaaagaacaauggagaugaaauaaacacaugauucaugauugaaagc

SEQ ID NO: 113968 - RNA, 64 nt, Homo Sapiens
aauggaaagacauagggaagaacuauuuguugaagaaauaaauggccuagaguaguaguaugaa

SEQ ID NO: 113969 - RNA, 64 nt, Homo Sapiens
ugauuuuaacuggaaggagaauagaaauguuugugaaauaaaacauuuccacucucacaguaga

SEQ ID NO: 113970 - RNA, 64 nt, Homo Sapiens
cugaauuaagaguggccuaagaggcugcugcacugaaauaaacugauuucacuccagacuggug

SEQ ID NO: 113971 - RNA, 64 nt, Homo Sapiens
auguacacauaagugugugugucucaggaaguaggaaauaaaaauggaagcuauuaugaccuca

SEQ ID NO: 113972 - RNA, 64 nt, Homo Sapiens
aaaucaagaagacaucaggaaaucagaugcacaggaaauaaaggaaagcugugcuuugucauug

SEQ ID NO: 113973 - RNA, 64 nt, Homo Sapiens
uauuccugcucgugcuuaagauugaugauuucgugaaauaaagaacaucauuucauuuaagaga

SEQ ID NO: 113974 - RNA, 64 nt, Homo Sapiens
uuacuuccugcauuuagagggaguuuauuuaaaagaaauaaaugacaaucaaaccaaaucauca

SEQ ID NO: 113975 - RNA, 64 nt, Homo Sapiens
cagaggaauuuuguuuuaauguagaaaguuauuugaaauaaacuaggugaaaugaaauuaacua

SEQ ID NO: 113976 - RNA, 64 nt, Homo Sapiens
caugagucacagcuuuuguuuuauaauaguuuaugaaauaaaaaaaaaaucuauucacuuuaac

SEQ ID NO: 113977 - RNA, 64 nt, Homo Sapiens
auuccagucaauuauuccucauaacuacuuuaaagaaauaaaaauggucuuaacuugaccuggg

SEQ ID NO: 113978 - RNA, 64 nt, Homo Sapiens
uugauucaauauggcagaugacauggcauguccugaaauaaauaugacucuuuguuuuauuuug

SEQ ID NO: 113979 - RNA, 64 nt, Homo Sapiens
ucaauauuaugcagauuuaugaaaggagagaauggaaauaaaacuaaagcauacauaguagagg

SEQ ID NO: 113980 - RNA, 64 nt, Homo Sapiens
ggaagaaaauguagauuagagaagagguagagcagaaauaaaaaagaaucaugugagaacucag

SEQ ID NO: 113981 - RNA, 64 nt, Homo Sapiens
guagaaauaagcaaacaauacaaagcauacauuggaaauaaacagagaauuaguagggcaagau

SEQ ID NO: 113982 - RNA, 64 nt, Homo Sapiens
auaucuuauaaaguggaagugacuuguauagcaugaaauaaaauuauauaggcuauuuucuaaa

SEQ ID NO: 113983 - RNA, 64 nt, Homo Sapiens
aaaggaaaaugucuguaauaagccauacauaaaagaaauaaaccugaaaauggaaauuugggag

SEQ ID NO: 113984 - RNA, 64 nt, Homo Sapiens
ugccuauacuaucugagaauaugcuucuaccauagaaauaaauuuuuuucuauaucugaaauaa

SEQ ID NO: 113985 - RNA, 64 nt, Homo Sapiens
cuucuaccauagaaauaaauauuuuucuauaucugaaauaaaugucugacuuugaaauaguguu

SEQ ID NO: 113986 - RNA, 64 nt, Homo Sapiens
ugccuuugagccuauacuauacuguguauguguggaaauaaaaauguauuguacuuuuggagaa

SEQ ID NO: 113987 - RNA, 64 nt, Homo Sapiens
agcaauuaugguggaccuauuacccuauggguaagaaauaaauggaaauaugacaucggauguu

SEQ ID NO: 113988 - RNA, 64 nt, Homo Sapiens
gugaucuaguguaauggaagugaucuaguguaaugaaauaaaauaaaaugcaguaaucaaaaug

SEQ ID NO: 113989 - RNA, 64 nt, Homo Sapiens
aacuaauuuugagguaccaaagauauuucugugggaaauaaaauauuagaauggaagauaaugc

SEQ ID NO: 113990 - RNA, 52 nt, Homo Sapiens
augaggcugauacaacauaagagaaauaaagcucuguuagggaaugggguuu

SEQ ID NO: 113991 - RNA, 64 nt, Homo Sapiens
uuuuuucauacuuugacccaaaauaugccauuuugaaauaaaauuuaagcuuugauacacucuc

SEQ ID NO: 113992 - RNA, 64 nt, Homo Sapiens
cauuauuuuaaguugaauuugaauaaagauuccagaaauaaacauggagcucaguauucaggaa

SEQ ID NO: 113993 - RNA, 64 nt, Homo Sapiens
aacugcgcuuugggaaucauccugggcuaaucaggaaauaaacuugacuuuucuauuuuucucu

SEQ ID NO: 113994 - RNA, 64 nt, Homo Sapiens
gaaaaaaaaaacaaaaacaauguuagugaauuuggaaauaaaaaagggauuuaauguaccuuuu

SEQ ID NO: 113995 - RNA, 64 nt, Homo Sapiens
cagcacaaccuuggacaucccccaaucaaaugaagaaauaaaccggauaugaaaugccauaaga

SEQ ID NO: 113996 - RNA, 64 nt, Homo Sapiens
guggcaugcaguuuuuuuuucuuuuuuuuguccugaaauaaaaaguuuacuuuuucauuccuuc

SEQ ID NO: 113997 - RNA, 64 nt, Homo Sapiens
guccaagcugacaaguauuauuagcaugauacuggaaauaaaauaucacacaacaaggagauuu

SEQ ID NO: 113998 - RNA, 64 nt, Homo Sapiens
aaucacacaacaaggagauuugugugcaugucaagaaauaaaagcauacuuuuugauccauaua

SEQ ID NO: 113999 - RNA, 64 nt, Homo Sapiens
acaauacuuuuacuugaaaugguggugaaauaaagaaauaaaaccauaguucauacauauaaau

SEQ ID NO: 114000 - RNA, 64 nt, Homo Sapiens
aauaaaacacaauacuuuuaauauaaaugguggugaaauaaagagccuugaucauaguucauac

SEQ ID NO: 114001 - RNA, 64 nt, Homo Sapiens
ccggccacuccugggagacagacccuuuggugaugaaauaaaccagugacuucagagccuaugg

SEQ ID NO: 114002 - RNA, 64 nt, Homo Sapiens
guucagcaugcaauggaaucaugcuuguccaugugaaauaaauauggcucucucguguccuuaa

SEQ ID NO: 114003 - RNA, 64 nt, Homo Sapiens
ggaaguccucgccacagcaaucaggcaagagaaagaaauaaaaggcaaccaaaaagaaaggaag

SEQ ID NO: 114004 - RNA, 64 nt, Homo Sapiens
acacauagaucaauggaacagaauagagggcccagaaauaaagcuacacaccuacaaccaucua

SEQ ID NO: 114005 - RNA, 64 nt, Homo Sapiens
ugcacugaaaccugagaugguaaaauauaaaacugaaauaaaccuaauaagcacuugccuggaa

SEQ ID NO: 114006 - RNA, 64 nt, Homo Sapiens
auccuuagaugccuaaaaauauagauuuucucuggaaauaaagagaggucagcaaaggucuuga

SEQ ID NO: 114007 - RNA, 64 nt, Homo Sapiens
aagauacuaguuuugcugaauguuagaugauggugaaauaaagguucugagacaccugaugacc

SEQ ID NO: 114008 - RNA, 64 nt, Homo Sapiens
agcaagaauaugaagaaguaauuguaagcauccugaaauaaaaaacaaagucuuccuggaagua

SEQ ID NO: 114009 - RNA, 64 nt, Homo Sapiens
uuugguuucuugugaccagcacagagugacaauagaaauaaaugugugaauaucugugugcugu

SEQ ID NO: 114010 - RNA, 64 nt, Homo Sapiens
gugccccucccagucugggagaaugugaaacuaggaaauaaaaucucucuccuagacugaaaau

SEQ ID NO: 114011 - RNA, 64 nt, Homo Sapiens
ucaaucaacacacuaccuuaauuuuuuguuugcugaaauaaagccuaugcaaguucuuagaaau

SEQ ID NO: 114012 - RNA, 64 nt, Homo Sapiens
acucaacuuggucccuaucuugcuguagacagaagaaauaaaauuuaauuagaacuaugcugga

SEQ ID NO: 114013 - RNA, 64 nt, Homo Sapiens
auauccagccaaacuaagcuucauaagugaaggagaaauaaaauacuuuacagacaagcaaaug

SEQ ID NO: 114014 - RNA, 64 nt, Homo Sapiens
ccucuucaaggagaacuacaaaccacugcuuaacgaaauaaaagaggaugcaaagaaauggaag

SEQ ID NO: 114015 - RNA, 64 nt, Homo Sapiens
uuuuucaguuccaagugcaucccuuauucuauaggaaauaaacuggagacaaaucucauuuaag

SEQ ID NO: 114016 - RNA, 64 nt, Homo Sapiens
aaauguuauaauguuaaaaauuaaagcugcaaaagaaauaaaaugguguuaauaaaaauuuggc

SEQ ID NO: 114017 - RNA, 64 nt, Homo Sapiens
cuaugaauguaaaccaugugaaaaaaaagaaaaagaaauaaacuacuccaucucaaaaaaaaua

SEQ ID NO: 114018 - RNA, 64 nt, Homo Sapiens
cuauggcuugggcacgguggaacaaaucacauuggaaauaaacuuauuuuaccugagaaaauua

SEQ ID NO: 114019 - RNA, 64 nt, Homo Sapiens
gccaaagaacacacauugucuuugcugcaauuuugaaauaaaauuugauuuuuuuuucucuguc

SEQ ID NO: 114020 - RNA, 64 nt, Homo Sapiens
gccagcgggcggcgucugggcugaagugcaauacgaaauaaaagccucccuaccaaugacucac

SEQ ID NO: 114021 - RNA, 64 nt, Homo Sapiens
aauaaauaaaacagcagcagcaaacaaauaaaaugaaauaaaagaaacaaaugaaauaaauauu

SEQ ID NO: 114022 - RNA, 64 nt, Homo Sapiens
agcaaacaaauaaaaugaaauaaaagaaacaaaugaaauaaauauuguguugugcagcauuaaa

SEQ ID NO: 114023 - RNA, 64 nt, Homo Sapiens
aauguuuacugaguacugcagcaccugcuggcaggaaauaaaugcuccccaguggggccccacu

SEQ ID NO: 114024 - RNA, 64 nt, Homo Sapiens
guucacgguccacuggccgcuucuuuauaguuuggaaauaaaugucuuuucucagagagcaggu

SEQ ID NO: 114025 - RNA, 64 nt, Homo Sapiens
uaauguaacaacagcuagauuuuaauggaggugagaaauaaauuaacuccaaagcaaaaacccu

SEQ ID NO: 114026 - RNA, 64 nt, Homo Sapiens
aaagcguaagccucugcaaucacuaugcauauuugaaauaaaagaauccuuauuccugguuaau

SEQ ID NO: 114027 - RNA, 64 nt, Homo Sapiens
uuuuuacuuuaauaguuuaguguaaaguacaucagaaauaaagcuguaucugccauuuuaagcc

SEQ ID NO: 114028 - RNA, 64 nt, Homo Sapiens
cacacagaacaaaaaccaucaaaaucucauauaugaaauaaaauauauucuucuaagcaaagaa

SEQ ID NO: 114029 - RNA, 64 nt, Homo Sapiens
guuuucuuggcuaguaauaguaguagauacuucugaaauaaauguucucucaagauccuuaaaa

SEQ ID NO: 114030 - RNA, 64 nt, Homo Sapiens
ugggauguauauauaucauugcuguuagagaaaugaaauaaaauggggcugggcucaguggcuc

SEQ ID NO: 114031 - RNA, 64 nt, Homo Sapiens
uauagcuucauucacuugccguacuaagaguaaugaaauaaaauagguggaaauaguuguggau

SEQ ID NO: 114032 - RNA, 64 nt, Homo Sapiens
ggaauugauguaaaguuccauguuaucuacauaggaaauaaaauauaugccaucuguccucaag

SEQ ID NO: 114033 - RNA, 64 nt, Homo Sapiens
uuuuuacuuuaauaguuuaguguaaaguacaucagaaauaaaacuguaucugacauuuuaagcc

SEQ ID NO: 114034 - RNA, 64 nt, Homo Sapiens; identical to SEQ ID NO: 114028

SEQ ID NO: 114035 - RNA, 64 nt, Homo Sapiens
cacaauaguguuuacaaaucuuauacaucuuacuuugacagaagacuuauaauaccuugugguc

SEQ ID NO: 114036 - RNA, 64 nt, Homo Sapiens
uaccugaucuuaagguuugguauucuaaccaaaguugacagacugugcgucugucuuaauggau

SEQ ID NO: 114037 - RNA, 64 nt, Homo Sapiens
acaauauuggguguuugggagccagaaagcuuuguugacagaucagaaauaagauugacuuggg

SEQ ID NO: 114038 - RNA, 64 nt, Homo Sapiens
cugucuagucauuguaaauauuuaucugucaguuuugacagauuggggccagcuugauguuuua

SEQ ID NO: 114039 - RNA, 64 nt, Homo Sapiens
auucaauauugggguuggaacauuucaguugccauugacagaacacccaauucaaauugacuga

SEQ ID NO: 114040 - RNA, 63 nt, Homo Sapiens
auaucucugauugucauguggauuugaauguagcuugacagagggaaugucuaaucuauauug

SEQ ID NO: 114041 - RNA, 64 nt, Homo Sapiens
ucauagguguggguguagagguuuaacuaagaaauugacagaauuagguuucuaggagaguuuu

SEQ ID NO: 114042 - RNA, 64 nt, Homo Sapiens
aauacagguucuauuaauaaugaaagcacaauaauugacagaaaauaauucaaagcacaauaau

SEQ ID NO: 114043 - RNA, 64 nt, Homo Sapiens
aaaaaaauccuaggaauacaguuaauaguagucuuugacagaucaucuuggacuucaggaaaug

SEQ ID NO: 114044 - RNA, 64 nt, Homo Sapiens
gacauggguaccaaaaauacccaauucuaagugguugacagauguucacuuugaagugugaagu

SEQ ID NO: 114045 - RNA, 64 nt, Homo Sapiens
cauaauuuaaauggucaauuaaaaaaacccaaaaauaaugcaugcauaucauuuuuaaaaauaa

SEQ ID NO: 114046 - RNA, 64 nt, Homo Sapiens
uuauuuauaaaaauacagacaaaauuucagccaaauaaugcauucuagugaaaaaaauauuuuu

SEQ ID NO: 114047 - RNA, 64 nt, Homo Sapiens
acuacaugcaaggcacucugcuaguuauauucuaauaaugcagagauaauuagacaugguuccc

SEQ ID NO: 114048 - RNA, 64 nt, Homo Sapiens
ccgcccucaagaagcucacaaaaguauucaggaaauaaugcagacuagugauuuugcuauaaaa

SEQ ID NO: 114049 - RNA, 64 nt, Homo Sapiens
aguuauguguaauuaaucuauaaugccauaaaugauaaugcaaaaccuaaauaauaugguggcc

SEQ ID NO: 114050 - RNA, 64 nt, Homo Sapiens
agggugcauuuuaaguucuaacuucguuuauuguauaaugcaucauuugaaaauaccaaggagg

SEQ ID NO: 114051 - RNA, 64 nt, Homo Sapiens
uccucuuuguaauuuaaugaaaagguacaacagaauaaugcaugaugaacucaccuaauuauga

SEQ ID NO: 114052 - RNA, 64 nt, Homo Sapiens
uuuguaggugagaugcaacaagcccugcuuuugcauaaugcaaucaaaaauauguguuuuuaag

SEQ ID NO: 114053 - RNA, 64 nt, Homo Sapiens
agccacaccaaaaccagacucacaaguaauccacauaaugcauaauacacagcaaugaauggca

SEQ ID NO: 114054 - RNA, 64 nt, Homo Sapiens
acuuucacuuugacucugguaaaaugcuugccucauaaugcauauucaaccuuucucccuucuc

SEQ ID NO: 114055 - RNA, 64 nt, Homo Sapiens
cauccacuaagggccuuuaaucaauuauuuggaaauaaugcaagcuacugaggaagauucaugu

SEQ ID NO: 114056 - RNA, 64 nt, Homo Sapiens
cauucaucaaggcaugauuuuuguuucacuacaaauaaugcaaacuguuuucaauaaaaagagg

SEQ ID NO: 114057 - RNA, 64 nt, Homo Sapiens
gccuacugaagauagguucucuauguauucaacaauaaugcaacuuuagaaguauuccacacug

SEQ ID NO: 114058 - RNA, 64 nt, Homo Sapiens; identical to SEQ ID NO: 39289

SEQ ID NO: 114059 - RNA, 64 nt, Homo Sapiens; identical to SEQ ID NO: 39290

SEQ ID NO: 114060 - RNA, 64 nt, Homo Sapiens; identical to SEQ ID NO: 39291

SEQ ID NO: 114061 - RNA, 64 nt, Homo Sapiens; identical to SEQ ID NO: 39292

SEQ ID NO: 114062 - RNA, 64 nt, Homo Sapiens; identical to SEQ ID NO: 39293

SEQ ID NO: 114063 - RNA, 64 nt, Homo Sapiens; identical to SEQ ID NO: 39294

SEQ ID NO: 114064 - RNA, 64 nt, Homo Sapiens; identical to SEQ ID NO: 39295

SEQ ID NO: 114065 - RNA, 64 nt, Homo Sapiens; identical to SEQ ID NO: 39296

SEQ ID NO: 114066 - RNA, 64 nt, Homo Sapiens; identical to SEQ ID NO: 39297

SEQ ID NO: 114067 - RNA, 64 nt, Homo Sapiens; identical to SEQ ID NO: 39298

SEQ ID NO: 114068 - RNA, 64 nt, Homo Sapiens; identical to SEQ ID NO: 39299

SEQ ID NO: 114069 - RNA, 64 nt, Homo Sapiens; identical to SEQ ID NO: 39300

SEQ ID NO: 114070 - RNA, 64 nt, Homo Sapiens; identical to SEQ ID NO: 39301

SEQ ID NO: 114071 - RNA, 64 nt, Homo Sapiens; identical to SEQ ID NO: 39302

SEQ ID NO: 114072 - RNA, 64 nt, Homo Sapiens; identical to SEQ ID NO: 39303

SEQ ID NO: 114073 - RNA, 64 nt, Homo Sapiens; identical to SEQ ID NO: 39304

SEQ ID NO: 114074 - RNA, 64 nt, Homo Sapiens; identical to SEQ ID NO: 39305

SEQ ID NO: 114075 - RNA, 64 nt, Homo Sapiens; identical to SEQ ID NO: 39306

SEQ ID NO: 114076 - RNA, 64 nt, Homo Sapiens; identical to SEQ ID NO: 39307

SEQ ID NO: 114077 - RNA, 64 nt, Homo Sapiens; identical to SEQ ID NO: 39308

SEQ ID NO: 114078 - RNA, 64 nt, Homo Sapiens; identical to SEQ ID NO: 39309

SEQ ID NO: 114079 - RNA, 64 nt, Homo Sapiens; identical to SEQ ID NO: 39310

SEQ ID NO: 114080 - RNA, 64 nt, Homo Sapiens; identical to SEQ ID NO: 39311

SEQ ID NO: 114081 - RNA, 64 nt, Homo Sapiens; identical to SEQ ID NO: 39312

SEQ ID NO: 114082 - RNA, 64 nt, Homo Sapiens; identical to SEQ ID NO: 39313

SEQ ID NO: 114083 - RNA, 64 nt, Homo Sapiens; identical to SEQ ID NO: 39314

SEQ ID NO: 114084 - RNA, 64 nt, Homo Sapiens; identical to SEQ ID NO: 39315

SEQ ID NO: 114085 - RNA, 64 nt, Homo Sapiens; identical to SEQ ID NO: 39316

SEQ ID NO: 114086 - RNA, 64 nt, Homo Sapiens; identical to SEQ ID NO: 39317

SEQ ID NO: 114087 - RNA, 64 nt, Homo Sapiens; identical to SEQ ID NO: 39318

SEQ ID NO: 114088 - RNA, 64 nt, Homo Sapiens; identical to SEQ ID NO: 39319

SEQ ID NO: 114089 - RNA, 64 nt, Homo Sapiens; identical to SEQ ID NO: 39320

SEQ ID NO: 114090 - RNA, 64 nt, Homo Sapiens; identical to SEQ ID NO: 39321

SEQ ID NO: 114091 - RNA, 64 nt, Homo Sapiens; identical to SEQ ID NO: 39322

SEQ ID NO: 114092 - RNA, 64 nt, Homo Sapiens; identical to SEQ ID NO: 39323

SEQ ID NO: 114093 - RNA, 64 nt, Homo Sapiens; identical to SEQ ID NO: 39324

SEQ ID NO: 114094 - RNA, 64 nt, Homo Sapiens; identical to SEQ ID NO: 39325

SEQ ID NO: 114095 - RNA, 64 nt, Homo Sapiens; identical to SEQ ID NO: 39326

SEQ ID NO: 114096 - RNA, 64 nt, Homo Sapiens; identical to SEQ ID NO: 39327

SEQ ID NO: 114097 - RNA, 64 nt, Homo Sapiens; identical to SEQ ID NO: 39328

SEQ ID NO: 114098 - RNA, 64 nt, Homo Sapiens; identical to SEQ ID NO: 39329

SEQ ID NO: 114099 - RNA, 64 nt, Homo Sapiens; identical to SEQ ID NO: 39330

SEQ ID NO: 114100 - RNA, 64 nt, Homo Sapiens; identical to SEQ ID NO: 39331

SEQ ID NO: 114101 - RNA, 64 nt, Homo Sapiens; identical to SEQ ID NO: 39332

SEQ ID NO: 114102 - RNA, 61 nt, Homo Sapiens; identical to SEQ ID NO: 39333

SEQ ID NO: 114103 - RNA, 64 nt, Homo Sapiens; identical to SEQ ID NO: 39334

SEQ ID NO: 114104 - RNA, 64 nt, Homo Sapiens; identical to SEQ ID NO: 39335

SEQ ID NO: 114105 - RNA, 64 nt, Homo Sapiens; identical to SEQ ID NO: 39336

SEQ ID NO: 114106 - RNA, 64 nt, Homo Sapiens; identical to SEQ ID NO: 39337

SEQ ID NO: 114107 - RNA, 64 nt, Homo Sapiens; identical to SEQ ID NO: 39338

SEQ ID NO: 114108 - RNA, 64 nt, Homo Sapiens; identical to SEQ ID NO: 39339

SEQ ID NO: 114109 - RNA, 64 nt, Homo Sapiens; identical to SEQ ID NO: 39340

SEQ ID NO: 114110 - RNA, 64 nt, Homo Sapiens; identical to SEQ ID NO: 39341

SEQ ID NO: 114111 - RNA, 64 nt, Homo Sapiens; identical to SEQ ID NO: 39342

SEQ ID NO: 114112 - RNA, 64 nt, Homo Sapiens; identical to SEQ ID NO: 39343

SEQ ID NO: 114113 - RNA, 64 nt, Homo Sapiens; identical to SEQ ID NO: 39344

SEQ ID NO: 114114 - RNA, 64 nt, Homo Sapiens; identical to SEQ ID NO: 39345

SEQ ID NO: 114115 - RNA, 64 nt, Homo Sapiens; identical to SEQ ID NO: 39346

SEQ ID NO: 114116 - RNA, 62 nt, Homo Sapiens
gagguggagagcaagacugaagaaagaauagagaacaggaacugaacaggagaaagacaaac

SEQ ID NO: 114117 - RNA, 62 nt, Homo Sapiens
aagacaaacagaaagaauaggaaagagaagcugaacaggagaggugcccguggaaagaggga

SEQ ID NO: 114118 - RNA, 62 nt, Homo Sapiens
acaucaucuuauuauaucuuucccaggcaucugaacaggaugcuguucaaccuguuuugacc

SEQ ID NO: 114119 - RNA, 62 nt, Homo Sapiens
guguuagugauugggugauucucauauaaaaugaacaggaaauaacuaacaauuuugaaaua

SEQ ID NO: 114120 - RNA, 62 nt, Homo Sapiens
ugcaagguacaauuuucuccaauaaaucaggagaacaggaguuugaugaugcaaaguugauc

SEQ ID NO: 114121 - RNA, 61 nt, Homo Sapiens
ggagaauacuuaaauaaaacaugugcaugcuugaacaggacaaaauguugacuguugcccu

SEQ ID NO: 114122 - RNA, 62 nt, Homo Sapiens
gaagaugggaaacaaaauaggaggaugggagagaacaggaggguuaauauaaaacaucuuug

SEQ ID NO: 114123 - RNA, 62 nt, Homo Sapiens
uagaaagccugaaagcugugaucauguaucuagaacaggagucuuuccagaaaaauccucag

SEQ ID NO: 114124 - RNA, 62 nt, Homo Sapiens
guuacuuuuaagccuaccucuucugagagggugaacaggauuggaucuucuauuuaaguggc

SEQ ID NO: 114125 - RNA, 62 nt, Homo Sapiens
gcagcagggcacuaaccuccggaacucgcauggaacaggaggcucucucugcagacaugcug

SEQ ID NO: 114126 - RNA, 62 nt, Homo Sapiens
agaaaccccaaacucaggccuaagggaaaagggaacaggaaauaucuuuugagaacuuuugg

SEQ ID NO: 114127 - RNA, 62 nt, Homo Sapiens
ccacauugccagugacaugaacaccuagaucagaacaggaauagcccuguaucaacccagaa

SEQ ID NO: 114128 - RNA, 62 nt, Homo Sapiens
augugucuaaaaauauugcuaucaagaaacuugaacaggauaauuuguguagugagguccua

SEQ ID NO: 114129 - RNA, 62 nt, Homo Sapiens
cauaucuugauauuuaagaguuggcuuuucaagaacaggacugguaguuuuaugucaaaaua

SEQ ID NO: 114130 - RNA, 64 nt, Homo Sapiens
aguuccaggaguacuuacuauuggucaugcaauaggagaacagagacccgagggcugcuuuggg

SEQ ID NO: 114131 - RNA, 64 nt, Homo Sapiens
gauuuuagcagagacuuuagucuuuggggcaagaggagaacaggaaugcugggcuguuuacuuu

SEQ ID NO: 114132 - RNA, 64 nt, Homo Sapiens
uuggaggugaaaucuaauuauuggugagagucuuggagaacaggcuguuuccagucucaaagca

SEQ ID NO: 114133 - RNA, 64 nt, Homo Sapiens
uuucagagugagacauuuguacuguggcuauguaggagaacauucuuguucuuagcaaacauac

SEQ ID NO: 114134 - RNA, 64 nt, Homo Sapiens
gcuuuugcucaaaggaggauucuggagccgagaaggagaacaccucuguccugcagcagaaccc

SEQ ID NO: 114135 - RNA, 64 nt, Homo Sapiens
agaaccccuccuugucggguagccggaauggggaggagaacaucaucgauaacccuuaucugcg

SEQ ID NO: 114136 - RNA, 64 nt, Homo Sapiens
ugggagucccggaggccaggcugcacaccuggugggagaacacacucuggaauucucuauucuc

SEQ ID NO: 114137 - RNA, 64 nt, Homo Sapiens
ccccauuuccuccuucauccuguggagucugugaggagaacaggugggcgugcuggugaccccg

SEQ ID NO: 114138 - RNA, 64 nt, Homo Sapiens
ucaucugagucagugcaccuuuaucaaagaagggggagaacaguaggcugcugccaccuacuuc

SEQ ID NO: 114139 - RNA, 64 nt, Homo Sapiens
ugugcacgugcauguguguugcugagugauucagggagaacaugagggcggcagccugucugcu

SEQ ID NO: 114140 - RNA, 64 nt, Homo Sapiens
gcaagccuuccuccauggcccaucacucggcuguggagaacaaagaccaaugugaagacacuac

SEQ ID NO: 114141 - RNA, 64 nt, Homo Sapiens
auucccagagguggggaagagagccugcccggccggagaacaucugccuugcugcaccugaggc

SEQ ID NO: 114142 - RNA, 64 nt, Homo Sapiens
ucaagacagaauuggacaugcaaaagauugacugggagaacacaccucugauggacaaagguga

SEQ ID NO: 114143 - RNA, 64 nt, Homo Sapiens
ccagggguucagacuuuggcugagaacagccccuggagaacauggggugacugcuaccauaggu

SEQ ID NO: 114144 - RNA, 64 nt, Homo Sapiens
aagauucauuucucucccacgcuauucucuaacaggagaacauaugaaagcuggaaggaaaaaa

SEQ ID NO: 114145 - RNA, 64 nt, Homo Sapiens
aucuuaauagccuuuggcuccuagugagugagcaggagaacauccuucucgaguagaggucugc

SEQ ID NO: 114146 - RNA, 64 nt, Homo Sapiens
gaugagauuugacaaaaaaauucugugaaaacuaggagaacagaaccuuuauuccuguaaauau

SEQ ID NO: 114147 - RNA, 64 nt, Homo Sapiens
cagaggaaaugugucucccuaccaccacugugcaggagaacagaaugucuccugugggcuuuuu

SEQ ID NO: 114148 - RNA, 64 nt, Homo Sapiens
aaacaggccagauaagugaauguuguuuuuuauuaccgccgaagcuacuguaggagauagguac

SEQ ID NO: 114149 - RNA, 64 nt, Homo Sapiens
uucugaggggcagcggggccuggcgggaugggccaccgccgacuuuguaccccccaaccccuga

SEQ ID NO: 114150 - RNA, 64 nt, Homo Sapiens
guccucugugcccacggucugagcuagcuagcgcaccgccgaguuaaagaggagaaggaaaaca

SEQ ID NO: 114151 - RNA, 64 nt, Homo Sapiens
gaagcaaaagaaacgugagagaucugguuccagaaccgccgaaucucaacgagacccaagugaa

SEQ ID NO: 114152 - RNA, 64 nt, Homo Sapiens
gcccagugggggcugggcaggcccauugagggccaccgccgagguuucuccuagggcuguuccu

SEQ ID NO: 114153 - RNA, 64 nt, Homo Sapiens
ggagcugggaccuccucugcgccucccggaccggaccgccgaggcuagcgcucgaaagcccaac

SEQ ID NO: 114154 - RNA, 64 nt, Homo Sapiens
agcuggcugggcuggacccggucccuaggcugugaccgccgaacuccacugcaacagacgggcg

SEQ ID NO: 114155 - RNA, 64 nt, Homo Sapiens
ccgccucguucguccggcccccaccaccccccgcaccgccgacgccagcgagccggggacccac

SEQ ID NO: 114156 - RNA, 64 nt, Homo Sapiens
cugcaggaccaggugccagccacuaagggggggcaccgccgaugccagggguuuugcccacccg

SEQ ID NO: 114157 - RNA, 64 nt, Homo Sapiens
ccaggugcgugugucucugucugccccuguccggaccgccgaucaaguagggcgugugguuucc

SEQ ID NO: 114158 - RNA, 64 nt, Homo Sapiens
cgccuacucccagcugguggccgugcuggucuacaccgccgagcgggccaaguucgccaccggg

SEQ ID NO: 114159 - RNA, 64 nt, Homo Sapiens
cugaggaugacaauuccacauccccccaggccccaccgccgauuguccccaucauucagucacc

SEQ ID NO: 114160 - RNA, 64 nt, Homo Sapiens; identical to SEQ ID NO: 90763

SEQ ID NO: 114161 - RNA, 64 nt, Homo Sapiens; identical to SEQ ID NO: 90764

SEQ ID NO: 114162 - RNA, 64 nt, Homo Sapiens; identical to SEQ ID NO: 90765

SEQ ID NO: 114163 - RNA, 64 nt, Homo Sapiens; identical to SEQ ID NO: 90766

SEQ ID NO: 114164 - RNA, 64 nt, Homo Sapiens; identical to SEQ ID NO: 90767

SEQ ID NO: 114165 - RNA, 64 nt, Homo Sapiens; identical to SEQ ID NO: 90768

SEQ ID NO: 114166 - RNA, 64 nt, Homo Sapiens; identical to SEQ ID NO: 90769

SEQ ID NO: 114167 - RNA, 64 nt, Homo Sapiens; identical to SEQ ID NO: 90770

SEQ ID NO: 114168 - RNA, 64 nt, Homo Sapiens; identical to SEQ ID NO: 90771

SEQ ID NO: 114169 - RNA, 64 nt, Homo Sapiens; identical to SEQ ID NO: 90772

SEQ ID NO: 114170 - RNA, 64 nt, Homo Sapiens; identical to SEQ ID NO: 90773

SEQ ID NO: 114171 - RNA, 64 nt, Homo Sapiens; identical to SEQ ID NO: 90774

SEQ ID NO: 114172 - RNA, 64 nt, Homo Sapiens; identical to SEQ ID NO: 90775

SEQ ID NO: 114173 - RNA, 64 nt, Homo Sapiens; identical to SEQ ID NO: 90776

SEQ ID NO: 114174 - RNA, 64 nt, Homo Sapiens; identical to SEQ ID NO: 90777

SEQ ID NO: 114175 - RNA, 64 nt, Homo Sapiens; identical to SEQ ID NO: 90778

SEQ ID NO: 114176 - RNA, 64 nt, Homo Sapiens; identical to SEQ ID NO: 90779

SEQ ID NO: 114177 - RNA, 64 nt, Homo Sapiens; identical to SEQ ID NO: 90780

SEQ ID NO: 114178 - RNA, 64 nt, Homo Sapiens; identical to SEQ ID NO: 90781

SEQ ID NO: 114179 - RNA, 64 nt, Homo Sapiens; identical to SEQ ID NO: 90782

SEQ ID NO: 114180 - RNA, 64 nt, Homo Sapiens; identical to SEQ ID NO: 90783

SEQ ID NO: 114181 - RNA, 64 nt, Homo Sapiens; identical to SEQ ID NO: 90784

SEQ ID NO: 114182 - RNA, 64 nt, Homo Sapiens; identical to SEQ ID NO: 90785

SEQ ID NO: 114183 - RNA, 64 nt, Homo Sapiens; identical to SEQ ID NO: 90786

SEQ ID NO: 114184 - RNA, 64 nt, Homo Sapiens; identical to SEQ ID NO: 90787

SEQ ID NO: 114185 - RNA, 64 nt, Homo Sapiens; identical to SEQ ID NO: 90788

SEQ ID NO: 114186 - RNA, 64 nt, Homo Sapiens; identical to SEQ ID NO: 90789

SEQ ID NO: 114187 - RNA, 64 nt, Homo Sapiens; identical to SEQ ID NO: 90790

SEQ ID NO: 114188 - RNA, 64 nt, Homo Sapiens; identical to SEQ ID NO: 90791

SEQ ID NO: 114189 - RNA, 64 nt, Homo Sapiens; identical to SEQ ID NO: 90792

SEQ ID NO: 114190 - RNA, 64 nt, Homo Sapiens; identical to SEQ ID NO: 90793

SEQ ID NO: 114191 - RNA, 64 nt, Homo Sapiens; identical to SEQ ID NO: 90794

SEQ ID NO: 114192 - RNA, 64 nt, Homo Sapiens; identical to SEQ ID NO: 90795

SEQ ID NO: 114193 - RNA, 64 nt, Homo Sapiens; identical to SEQ ID NO: 90796

SEQ ID NO: 114194 - RNA, 64 nt, Homo Sapiens; identical to SEQ ID NO: 90797

SEQ ID NO: 114195 - RNA, 64 nt, Homo Sapiens; identical to SEQ ID NO: 90798

SEQ ID NO: 114196 - RNA, 64 nt, Homo Sapiens; identical to SEQ ID NO: 90799

SEQ ID NO: 114197 - RNA, 64 nt, Homo Sapiens; identical to SEQ ID NO: 90800

SEQ ID NO: 114198 - RNA, 64 nt, Homo Sapiens; identical to SEQ ID NO: 90801

SEQ ID NO: 114199 - RNA, 64 nt, Homo Sapiens; identical to SEQ ID NO: 90802

SEQ ID NO: 114200 - RNA, 64 nt, Homo Sapiens; identical to SEQ ID NO: 90803

SEQ ID NO: 114201 - RNA, 64 nt, Homo Sapiens; identical to SEQ ID NO: 90804

SEQ ID NO: 114202 - RNA, 64 nt, Homo Sapiens; identical to SEQ ID NO: 90805

SEQ ID NO: 114203 - RNA, 64 nt, Homo Sapiens; identical to SEQ ID NO: 90806

SEQ ID NO: 114204 - RNA, 64 nt, Homo Sapiens; identical to SEQ ID NO: 90807

SEQ ID NO: 114205 - RNA, 64 nt, Homo Sapiens; identical to SEQ ID NO: 90808

SEQ ID NO: 114206 - RNA, 64 nt, Homo Sapiens; identical to SEQ ID NO: 90809

SEQ ID NO: 114207 - RNA, 64 nt, Homo Sapiens; identical to SEQ ID NO: 90810

SEQ ID NO: 114208 - RNA, 64 nt, Homo Sapiens; identical to SEQ ID NO: 90811

SEQ ID NO: 114209 - RNA, 64 nt, Homo Sapiens; identical to SEQ ID NO: 90812

SEQ ID NO: 114210 - RNA, 64 nt, Homo Sapiens; identical to SEQ ID NO: 90813

SEQ ID NO: 114211 - RNA, 64 nt, Homo Sapiens; identical to SEQ ID NO: 90814

SEQ ID NO: 114212 - RNA, 64 nt, Homo Sapiens; identical to SEQ ID NO: 90815

SEQ ID NO: 114213 - RNA, 64 nt, Homo Sapiens; identical to SEQ ID NO: 90816

SEQ ID NO: 114214 - RNA, 64 nt, Homo Sapiens; identical to SEQ ID NO: 90817

SEQ ID NO: 114215 - RNA, 64 nt, Homo Sapiens; identical to SEQ ID NO: 90818

SEQ ID NO: 114216 - RNA, 64 nt, Homo Sapiens; identical to SEQ ID NO: 90819

SEQ ID NO: 114217 - RNA, 64 nt, Homo Sapiens; identical to SEQ ID NO: 90820

SEQ ID NO: 114218 - RNA, 64 nt, Homo Sapiens; identical to SEQ ID NO: 90821

SEQ ID NO: 114219 - RNA, 64 nt, Homo Sapiens; identical to SEQ ID NO: 90822

SEQ ID NO: 114220 - RNA, 64 nt, Homo Sapiens; identical to SEQ ID NO: 90823

SEQ ID NO: 114221 - RNA, 64 nt, Homo Sapiens; identical to SEQ ID NO: 90824

SEQ ID NO: 114222 - RNA, 64 nt, Homo Sapiens; identical to SEQ ID NO: 90825

SEQ ID NO: 114223 - RNA, 64 nt, Homo Sapiens; identical to SEQ ID NO: 90826

SEQ ID NO: 114224 - RNA, 64 nt, Homo Sapiens; identical to SEQ ID NO: 90827

SEQ ID NO: 114225 - RNA, 64 nt, Homo Sapiens; identical to SEQ ID NO: 90828

SEQ ID NO: 114226 - RNA, 64 nt, Homo Sapiens; identical to SEQ ID NO: 90829

SEQ ID NO: 114227 - RNA, 64 nt, Homo Sapiens; identical to SEQ ID NO: 90830

SEQ ID NO: 114228 - RNA, 64 nt, Homo Sapiens; identical to SEQ ID NO: 90831

SEQ ID NO: 114229 - RNA, 64 nt, Homo Sapiens; identical to SEQ ID NO: 90832

SEQ ID NO: 114230 - RNA, 64 nt, Homo Sapiens; identical to SEQ ID NO: 90833

SEQ ID NO: 114231 - RNA, 64 nt, Homo Sapiens; identical to SEQ ID NO: 90834

SEQ ID NO: 114232 - RNA, 64 nt, Homo Sapiens; identical to SEQ ID NO: 90835

SEQ ID NO: 114233 - RNA, 64 nt, Homo Sapiens; identical to SEQ ID NO: 90836

SEQ ID NO: 114234 - RNA, 64 nt, Homo Sapiens; identical to SEQ ID NO: 90837

SEQ ID NO: 114235 - RNA, 64 nt, Homo Sapiens; identical to SEQ ID NO: 90838

SEQ ID NO: 114236 - RNA, 64 nt, Homo Sapiens; identical to SEQ ID NO: 90839

SEQ ID NO: 114237 - RNA, 64 nt, Homo Sapiens; identical to SEQ ID NO: 90840

SEQ ID NO: 114238 - RNA, 64 nt, Homo Sapiens; identical to SEQ ID NO: 90841

SEQ ID NO: 114239 - RNA, 64 nt, Homo Sapiens; identical to SEQ ID NO: 90842

SEQ ID NO: 114240 - RNA, 64 nt, Homo Sapiens; identical to SEQ ID NO: 90843

SEQ ID NO: 114241 - RNA, 64 nt, Homo Sapiens; identical to SEQ ID NO: 90844

SEQ ID NO: 114242 - RNA, 64 nt, Homo Sapiens; identical to SEQ ID NO: 90845

SEQ ID NO: 114243 - RNA, 64 nt, Homo Sapiens; identical to SEQ ID NO: 90846

SEQ ID NO: 114244 - RNA, 64 nt, Homo Sapiens; identical to SEQ ID NO: 90847

SEQ ID NO: 114245 - RNA, 64 nt, Homo Sapiens; identical to SEQ ID NO: 90848

SEQ ID NO: 114246 - RNA, 64 nt, Homo Sapiens; identical to SEQ ID NO: 90849

SEQ ID NO: 114247 - RNA, 64 nt, Homo Sapiens; identical to SEQ ID NO: 90850

SEQ ID NO: 114248 - RNA, 64 nt, Homo Sapiens; identical to SEQ ID NO: 90851

SEQ ID NO: 114249 - RNA, 64 nt, Homo Sapiens; identical to SEQ ID NO: 90852

SEQ ID NO: 114250 - RNA, 64 nt, Homo Sapiens; identical to SEQ ID NO: 90853

SEQ ID NO: 114251 - RNA, 64 nt, Homo Sapiens; identical to SEQ ID NO: 90854

SEQ ID NO: 114252 - RNA, 64 nt, Homo Sapiens; identical to SEQ ID NO: 90855

SEQ ID NO: 114253 - RNA, 64 nt, Homo Sapiens; identical to SEQ ID NO: 90856

SEQ ID NO: 114254 - RNA, 64 nt, Homo Sapiens; identical to SEQ ID NO: 90857

SEQ ID NO: 114255 - RNA, 64 nt, Homo Sapiens; identical to SEQ ID NO: 90858

SEQ ID NO: 114256 - RNA, 64 nt, Homo Sapiens; identical to SEQ ID NO: 90859

SEQ ID NO: 114257 - RNA, 64 nt, Homo Sapiens; identical to SEQ ID NO: 90860

SEQ ID NO: 114258 - RNA, 64 nt, Homo Sapiens; identical to SEQ ID NO: 90861

SEQ ID NO: 114259 - RNA, 64 nt, Homo Sapiens; identical to SEQ ID NO: 90862

SEQ ID NO: 114260 - RNA, 64 nt, Homo Sapiens; identical to SEQ ID NO: 90863

SEQ ID NO: 114261 - RNA, 64 nt, Homo Sapiens; identical to SEQ ID NO: 90864

SEQ ID NO: 114262 - RNA, 64 nt, Homo Sapiens; identical to SEQ ID NO: 90865

SEQ ID NO: 114263 - RNA, 64 nt, Homo Sapiens; identical to SEQ ID NO: 90866

SEQ ID NO: 114264 - RNA, 64 nt, Homo Sapiens; identical to SEQ ID NO: 90867

SEQ ID NO: 114265 - RNA, 64 nt, Homo Sapiens; identical to SEQ ID NO: 90868

SEQ ID NO: 114266 - RNA, 64 nt, Homo Sapiens; identical to SEQ ID NO: 90869

SEQ ID NO: 114267 - RNA, 64 nt, Homo Sapiens; identical to SEQ ID NO: 90870

SEQ ID NO: 114268 - RNA, 64 nt, Homo Sapiens; identical to SEQ ID NO: 90871

SEQ ID NO: 114269 - RNA, 64 nt, Homo Sapiens; identical to SEQ ID NO: 90872

SEQ ID NO: 114270 - RNA, 64 nt, Homo Sapiens; identical to SEQ ID NO: 90873

SEQ ID NO: 114271 - RNA, 64 nt, Homo Sapiens; identical to SEQ ID NO: 90874

SEQ ID NO: 114272 - RNA, 64 nt, Homo Sapiens; identical to SEQ ID NO: 90875

SEQ ID NO: 114273 - RNA, 64 nt, Homo Sapiens; identical to SEQ ID NO: 90876

SEQ ID NO: 114274 - RNA, 64 nt, Homo Sapiens; identical to SEQ ID NO: 90877

SEQ ID NO: 114275 - RNA, 64 nt, Homo Sapiens; identical to SEQ ID NO: 90878

SEQ ID NO: 114276 - RNA, 64 nt, Homo Sapiens; identical to SEQ ID NO: 90879

SEQ ID NO: 114277 - RNA, 64 nt, Homo Sapiens; identical to SEQ ID NO: 90880

SEQ ID NO: 114278 - RNA, 64 nt, Homo Sapiens; identical to SEQ ID NO: 90881

SEQ ID NO: 114279 - RNA, 64 nt, Homo Sapiens; identical to SEQ ID NO: 90882

SEQ ID NO: 114280 - RNA, 64 nt, Homo Sapiens; identical to SEQ ID NO: 90883

SEQ ID NO: 114281 - RNA, 64 nt, Homo Sapiens; identical to SEQ ID NO: 90884

SEQ ID NO: 114282 - RNA, 64 nt, Homo Sapiens; identical to SEQ ID NO: 90885

SEQ ID NO: 114283 - RNA, 64 nt, Homo Sapiens; identical to SEQ ID NO: 90886

SEQ ID NO: 114284 - RNA, 64 nt, Homo Sapiens; identical to SEQ ID NO: 90887

SEQ ID NO: 114285 - RNA, 64 nt, Homo Sapiens; identical to SEQ ID NO: 90888

SEQ ID NO: 114286 - RNA, 64 nt, Homo Sapiens; identical to SEQ ID NO: 90889

SEQ ID NO: 114287 - RNA, 64 nt, Homo Sapiens; identical to SEQ ID NO: 90890

SEQ ID NO: 114288 - RNA, 64 nt, Homo Sapiens; identical to SEQ ID NO: 90891

SEQ ID NO: 114289 - RNA, 64 nt, Homo Sapiens; identical to SEQ ID NO: 90892

SEQ ID NO: 114290 - RNA, 64 nt, Homo Sapiens; identical to SEQ ID NO: 90893

SEQ ID NO: 114291 - RNA, 64 nt, Homo Sapiens; identical to SEQ ID NO: 90894

SEQ ID NO: 114292 - RNA, 64 nt, Homo Sapiens; identical to SEQ ID NO: 90895

SEQ ID NO: 114293 - RNA, 64 nt, Homo Sapiens; identical to SEQ ID NO: 90896

SEQ ID NO: 114294 - RNA, 64 nt, Homo Sapiens; identical to SEQ ID NO: 90897

SEQ ID NO: 114295 - RNA, 64 nt, Homo Sapiens; identical to SEQ ID NO: 90898

SEQ ID NO: 114296 - RNA, 64 nt, Homo Sapiens; identical to SEQ ID NO: 90899

SEQ ID NO: 114297 - RNA, 54 nt, Homo Sapiens; identical to SEQ ID NO: 90900

SEQ ID NO: 114298 - RNA, 64 nt, Homo Sapiens; identical to SEQ ID NO: 90901

SEQ ID NO: 114299 - RNA, 64 nt, Homo Sapiens; identical to SEQ ID NO: 90902

SEQ ID NO: 114300 - RNA, 64 nt, Homo Sapiens; identical to SEQ ID NO: 90903

SEQ ID NO: 114301 - RNA, 64 nt, Homo Sapiens; identical to SEQ ID NO: 90904

SEQ ID NO: 114302 - RNA, 64 nt, Homo Sapiens; identical to SEQ ID NO: 90905

SEQ ID NO: 114303 - RNA, 64 nt, Homo Sapiens; identical to SEQ ID NO: 90906

SEQ ID NO: 114304 - RNA, 64 nt, Homo Sapiens; identical to SEQ ID NO: 90907

SEQ ID NO: 114305 - RNA, 64 nt, Homo Sapiens; identical to SEQ ID NO: 90908

SEQ ID NO: 114306 - RNA, 64 nt, Homo Sapiens; identical to SEQ ID NO: 90909

SEQ ID NO: 114307 - RNA, 64 nt, Homo Sapiens; identical to SEQ ID NO: 90910

SEQ ID NO: 114308 - RNA, 64 nt, Homo Sapiens; identical to SEQ ID NO: 90911

SEQ ID NO: 114309 - RNA, 64 nt, Homo Sapiens; identical to SEQ ID NO: 90912

SEQ ID NO: 114310 - RNA, 64 nt, Homo Sapiens; identical to SEQ ID NO: 90913

SEQ ID NO: 114311 - RNA, 64 nt, Homo Sapiens; identical to SEQ ID NO: 90914

SEQ ID NO: 114312 - RNA, 64 nt, Homo Sapiens; identical to SEQ ID NO: 90915

SEQ ID NO: 114313 - RNA, 64 nt, Homo Sapiens; identical to SEQ ID NO: 90916

SEQ ID NO: 114314 - RNA, 64 nt, Homo Sapiens; identical to SEQ ID NO: 90917

SEQ ID NO: 114315 - RNA, 64 nt, Homo Sapiens; identical to SEQ ID NO: 90918

SEQ ID NO: 114316 - RNA, 64 nt, Homo Sapiens; identical to SEQ ID NO: 90919

SEQ ID NO: 114317 - RNA, 64 nt, Homo Sapiens; identical to SEQ ID NO: 90920

SEQ ID NO: 114318 - RNA, 64 nt, Homo Sapiens; identical to SEQ ID NO: 90921

SEQ ID NO: 114319 - RNA, 64 nt, Homo Sapiens; identical to SEQ ID NO: 90922

SEQ ID NO: 114320 - RNA, 64 nt, Homo Sapiens; identical to SEQ ID NO: 90923

SEQ ID NO: 114321 - RNA, 64 nt, Homo Sapiens; identical to SEQ ID NO: 90924

SEQ ID NO: 114322 - RNA, 64 nt, Homo Sapiens; identical to SEQ ID NO: 90925

SEQ ID NO: 114323 - RNA, 64 nt, Homo Sapiens; identical to SEQ ID NO: 90926

SEQ ID NO: 114324 - RNA, 64 nt, Homo Sapiens; identical to SEQ ID NO: 90927

SEQ ID NO: 114325 - RNA, 64 nt, Homo Sapiens; identical to SEQ ID NO: 90928

SEQ ID NO: 114326 - RNA, 64 nt, Homo Sapiens; identical to SEQ ID NO: 90929

SEQ ID NO: 114327 - RNA, 64 nt, Homo Sapiens; identical to SEQ ID NO: 90811

SEQ ID NO: 114328 - RNA, 64 nt, Homo Sapiens; identical to SEQ ID NO: 90931

SEQ ID NO: 114329 - RNA, 64 nt, Homo Sapiens; identical to SEQ ID NO: 90932

SEQ ID NO: 114330 - RNA, 64 nt, Homo Sapiens; identical to SEQ ID NO: 90933

SEQ ID NO: 114331 - RNA, 64 nt, Homo Sapiens; identical to SEQ ID NO: 90934

SEQ ID NO: 114332 - RNA, 64 nt, Homo Sapiens; identical to SEQ ID NO: 90935

SEQ ID NO: 114333 - RNA, 64 nt, Homo Sapiens; identical to SEQ ID NO: 90936

SEQ ID NO: 114334 - RNA, 64 nt, Homo Sapiens; identical to SEQ ID NO: 90937

SEQ ID NO: 114335 - RNA, 64 nt, Homo Sapiens; identical to SEQ ID NO: 90938

SEQ ID NO: 114336 - RNA, 64 nt, Homo Sapiens; identical to SEQ ID NO: 90939

SEQ ID NO: 114337 - RNA, 64 nt, Homo Sapiens; identical to SEQ ID NO: 90940

SEQ ID NO: 114338 - RNA, 64 nt, Homo Sapiens; identical to SEQ ID NO: 90941

SEQ ID NO: 114339 - RNA, 64 nt, Homo Sapiens; identical to SEQ ID NO: 90942

SEQ ID NO: 114340 - RNA, 64 nt, Homo Sapiens; identical to SEQ ID NO: 90943

SEQ ID NO: 114341 - RNA, 64 nt, Homo Sapiens; identical to SEQ ID NO: 90944

SEQ ID NO: 114342 - RNA, 64 nt, Homo Sapiens; identical to SEQ ID NO: 90945

SEQ ID NO: 114343 - RNA, 64 nt, Homo Sapiens; identical to SEQ ID NO: 90946

SEQ ID NO: 114344 - RNA, 64 nt, Homo Sapiens; identical to SEQ ID NO: 90947

SEQ ID NO: 114345 - RNA, 64 nt, Homo Sapiens; identical to SEQ ID NO: 90948

SEQ ID NO: 114346 - RNA, 64 nt, Homo Sapiens; identical to SEQ ID NO: 90949

SEQ ID NO: 114347 - RNA, 64 nt, Homo Sapiens; identical to SEQ ID NO: 90950

SEQ ID NO: 114348 - RNA, 64 nt, Homo Sapiens; identical to SEQ ID NO: 90951

SEQ ID NO: 114349 - RNA, 64 nt, Homo Sapiens; identical to SEQ ID NO: 90952

SEQ ID NO: 114350 - RNA, 64 nt, Homo Sapiens; identical to SEQ ID NO: 90953

SEQ ID NO: 114351 - RNA, 64 nt, Homo Sapiens; identical to SEQ ID NO: 90954

SEQ ID NO: 114352 - RNA, 64 nt, Homo Sapiens; identical to SEQ ID NO: 90955

SEQ ID NO: 114353 - RNA, 64 nt, Homo Sapiens; identical to SEQ ID NO: 90956

SEQ ID NO: 114354 - RNA, 64 nt, Homo Sapiens; identical to SEQ ID NO: 90957

SEQ ID NO: 114355 - RNA, 64 nt, Homo Sapiens; identical to SEQ ID NO: 90958

SEQ ID NO: 114356 - RNA, 64 nt, Homo Sapiens; identical to SEQ ID NO: 90959

SEQ ID NO: 114357 - RNA, 64 nt, Homo Sapiens; identical to SEQ ID NO: 90960

SEQ ID NO: 114358 - RNA, 64 nt, Homo Sapiens; identical to SEQ ID NO: 90961

SEQ ID NO: 114359 - RNA, 64 nt, Homo Sapiens; identical to SEQ ID NO: 90962

SEQ ID NO: 114360 - RNA, 64 nt, Homo Sapiens; identical to SEQ ID NO: 90963

SEQ ID NO: 114361 - RNA, 64 nt, Homo Sapiens; identical to SEQ ID NO: 90964

SEQ ID NO: 114362 - RNA, 64 nt, Homo Sapiens; identical to SEQ ID NO: 90965

SEQ ID NO: 114363 - RNA, 64 nt, Homo Sapiens; identical to SEQ ID NO: 90966

SEQ ID NO: 114364 - RNA, 64 nt, Homo Sapiens; identical to SEQ ID NO: 90967

SEQ ID NO: 114365 - RNA, 64 nt, Homo Sapiens; identical to SEQ ID NO: 90968

SEQ ID NO: 114366 - RNA, 64 nt, Homo Sapiens; identical to SEQ ID NO: 90969

SEQ ID NO: 114367 - RNA, 64 nt, Homo Sapiens; identical to SEQ ID NO: 90970

SEQ ID NO: 114368 - RNA, 64 nt, Homo Sapiens; identical to SEQ ID NO: 90971

SEQ ID NO: 114369 - RNA, 64 nt, Homo Sapiens; identical to SEQ ID NO: 90972

SEQ ID NO: 114370 - RNA, 64 nt, Homo Sapiens; identical to SEQ ID NO: 90973

SEQ ID NO: 114371 - RNA, 64 nt, Homo Sapiens; identical to SEQ ID NO: 90974

SEQ ID NO: 114372 - RNA, 64 nt, Homo Sapiens; identical to SEQ ID NO: 90975

SEQ ID NO: 114373 - RNA, 64 nt, Homo Sapiens; identical to SEQ ID NO: 90976

SEQ ID NO: 114374 - RNA, 64 nt, Homo Sapiens; identical to SEQ ID NO: 90977

SEQ ID NO: 114375 - RNA, 64 nt, Homo Sapiens; identical to SEQ ID NO: 90978

SEQ ID NO: 114376 - RNA, 64 nt, Homo Sapiens; identical to SEQ ID NO: 90979

SEQ ID NO: 114377 - RNA, 64 nt, Homo Sapiens; identical to SEQ ID NO: 90980

SEQ ID NO: 114378 - RNA, 64 nt, Homo Sapiens; identical to SEQ ID NO: 90981

SEQ ID NO: 114379 - RNA, 64 nt, Homo Sapiens; identical to SEQ ID NO: 90982

SEQ ID NO: 114380 - RNA, 64 nt, Homo Sapiens; identical to SEQ ID NO: 90983

SEQ ID NO: 114381 - RNA, 64 nt, Homo Sapiens; identical to SEQ ID NO: 90984

SEQ ID NO: 114382 - RNA, 64 nt, Homo Sapiens; identical to SEQ ID NO: 90985

SEQ ID NO: 114383 - RNA, 64 nt, Homo Sapiens; identical to SEQ ID NO: 90986

SEQ ID NO: 114384 - RNA, 64 nt, Homo Sapiens; identical to SEQ ID NO: 90987

SEQ ID NO: 114385 - RNA, 64 nt, Homo Sapiens; identical to SEQ ID NO: 90988

SEQ ID NO: 114386 - RNA, 64 nt, Homo Sapiens; identical to SEQ ID NO: 90989

SEQ ID NO: 114387 - RNA, 64 nt, Homo Sapiens; identical to SEQ ID NO: 90990

SEQ ID NO: 114388 - RNA, 64 nt, Homo Sapiens; identical to SEQ ID NO: 90991

SEQ ID NO: 114389 - RNA, 64 nt, Homo Sapiens; identical to SEQ ID NO: 90992

SEQ ID NO: 114390 - RNA, 64 nt, Homo Sapiens; identical to SEQ ID NO: 90993

SEQ ID NO: 114391 - RNA, 64 nt, Homo Sapiens; identical to SEQ ID NO: 90994

SEQ ID NO: 114392 - RNA, 64 nt, Homo Sapiens; identical to SEQ ID NO: 90995

SEQ ID NO: 114393 - RNA, 64 nt, Homo Sapiens; identical to SEQ ID NO: 90996

SEQ ID NO: 114394 - RNA, 64 nt, Homo Sapiens; identical to SEQ ID NO: 90997

SEQ ID NO: 114395 - RNA, 64 nt, Homo Sapiens; identical to SEQ ID NO: 90998

SEQ ID NO: 114396 - RNA, 64 nt, Homo Sapiens; identical to SEQ ID NO: 90999

SEQ ID NO: 114397 - RNA, 64 nt, Homo Sapiens; identical to SEQ ID NO: 91000

SEQ ID NO: 114398 - RNA, 64 nt, Homo Sapiens; identical to SEQ ID NO: 91001

SEQ ID NO: 114399 - RNA, 64 nt, Homo Sapiens; identical to SEQ ID NO: 91002

SEQ ID NO: 114400 - RNA, 64 nt, Homo Sapiens; identical to SEQ ID NO: 91003

SEQ ID NO: 114401 - RNA, 64 nt, Homo Sapiens; identical to SEQ ID NO: 91004

SEQ ID NO: 114402 - RNA, 64 nt, Homo Sapiens; identical to SEQ ID NO: 91005

SEQ ID NO: 114403 - RNA, 64 nt, Homo Sapiens; identical to SEQ ID NO: 91006

SEQ ID NO: 114404 - RNA, 64 nt, Homo Sapiens; identical to SEQ ID NO: 91007

SEQ ID NO: 114405 - RNA, 64 nt, Homo Sapiens; identical to SEQ ID NO: 91008

SEQ ID NO: 114406 - RNA, 64 nt, Homo Sapiens; identical to SEQ ID NO: 91009

SEQ ID NO: 114407 - RNA, 64 nt, Homo Sapiens; identical to SEQ ID NO: 91010

SEQ ID NO: 114408 - RNA, 64 nt, Homo Sapiens; identical to SEQ ID NO: 91011

SEQ ID NO: 114409 - RNA, 64 nt, Homo Sapiens; identical to SEQ ID NO: 91012

SEQ ID NO: 114410 - RNA, 64 nt, Homo Sapiens; identical to SEQ ID NO: 91013

SEQ ID NO: 114411 - RNA, 64 nt, Homo Sapiens; identical to SEQ ID NO: 91014

SEQ ID NO: 114412 - RNA, 64 nt, Homo Sapiens; identical to SEQ ID NO: 91015

SEQ ID NO: 114413 - RNA, 64 nt, Homo Sapiens; identical to SEQ ID NO: 91016

SEQ ID NO: 114414 - RNA, 64 nt, Homo Sapiens; identical to SEQ ID NO: 91017

SEQ ID NO: 114415 - RNA, 64 nt, Homo Sapiens; identical to SEQ ID NO: 91018

SEQ ID NO: 114416 - RNA, 64 nt, Homo Sapiens; identical to SEQ ID NO: 91019

SEQ ID NO: 114417 - RNA, 64 nt, Homo Sapiens; identical to SEQ ID NO: 91020

SEQ ID NO: 114418 - RNA, 64 nt, Homo Sapiens; identical to SEQ ID NO: 91021

SEQ ID NO: 114419 - RNA, 64 nt, Homo Sapiens; identical to SEQ ID NO: 91022

SEQ ID NO: 114420 - RNA, 64 nt, Homo Sapiens; identical to SEQ ID NO: 91023

SEQ ID NO: 114421 - RNA, 64 nt, Homo Sapiens; identical to SEQ ID NO: 91024

SEQ ID NO: 114422 - RNA, 64 nt, Homo Sapiens; identical to SEQ ID NO: 91025

SEQ ID NO: 114423 - RNA, 64 nt, Homo Sapiens; identical to SEQ ID NO: 91026

SEQ ID NO: 114424 - RNA, 64 nt, Homo Sapiens; identical to SEQ ID NO: 91027

SEQ ID NO: 114425 - RNA, 64 nt, Homo Sapiens; identical to SEQ ID NO: 91028

SEQ ID NO: 114426 - RNA, 64 nt, Homo Sapiens; identical to SEQ ID NO: 91029

SEQ ID NO: 114427 - RNA, 64 nt, Homo Sapiens; identical to SEQ ID NO: 55166

SEQ ID NO: 114428 - RNA, 64 nt, Homo Sapiens; identical to SEQ ID NO: 55167

SEQ ID NO: 114429 - RNA, 64 nt, Homo Sapiens; identical to SEQ ID NO: 55168

SEQ ID NO: 114430 - RNA, 64 nt, Homo Sapiens; identical to SEQ ID NO: 55169

SEQ ID NO: 114431 - RNA, 64 nt, Homo Sapiens; identical to SEQ ID NO: 55170

SEQ ID NO: 114432 - RNA, 64 nt, Homo Sapiens; identical to SEQ ID NO: 55171

SEQ ID NO: 114433 - RNA, 64 nt, Homo Sapiens; identical to SEQ ID NO: 55172

SEQ ID NO: 114434 - RNA, 64 nt, Homo Sapiens; identical to SEQ ID NO: 55173

SEQ ID NO: 114435 - RNA, 64 nt, Homo Sapiens; identical to SEQ ID NO: 55174

SEQ ID NO: 114436 - RNA, 64 nt, Homo Sapiens; identical to SEQ ID NO: 55175

SEQ ID NO: 114437 - RNA, 64 nt, Homo Sapiens; identical to SEQ ID NO: 55176

SEQ ID NO: 114438 - RNA, 64 nt, Homo Sapiens; identical to SEQ ID NO: 55177

SEQ ID NO: 114439 - RNA, 64 nt, Homo Sapiens
uguucuuagauaacccacauuagaugaauguguuaagugaaaugauacuuguacucccccuacc

SEQ ID NO: 114440 - RNA, 64 nt, Homo Sapiens
cagacuuaauugguauuuguucuugcauuggccaaagugaaaauuuuuuuuuuucuuuugaaau

SEQ ID NO: 114441 - RNA, 64 nt, Homo Sapiens
aauacuucuaauuuuuuucccuaaacauuuuuaaaagugaaauaugggaagagcuuuacagaca

SEQ ID NO: 114442 - RNA, 64 nt, Homo Sapiens
cuagaguuuuaauuaccuuuauaauguuucuuaaaagugaaacuuagauacaauugugauugga

SEQ ID NO: 114443 - RNA, 64 nt, Homo Sapiens
cuuagauacaauugugauuggauacuuagauacuaagugaaacuuaguguaacaauuuugaucu

SEQ ID NO: 114444 - RNA, 64 nt, Homo Sapiens
cugccccugagcccauggcacucuauguucuaagaagugaaaaucuacacuccagugagacagc

SEQ ID NO: 114445 - RNA, 64 nt, Homo Sapiens
uuacaacacggacgaaccuugaaaacuuuaugcuaagugaaauaagccagacaucaacagauaa

SEQ ID NO: 114446 - RNA, 64 nt, Homo Sapiens
caucaaaaucaccaagaaaaacagcuucucaguuaagugaaaauaaaccaguuaaaacagaacc

SEQ ID NO: 114447 - RNA, 64 nt, Homo Sapiens
ucaaaggaaaaucuuaaaagagaacacaccaaaaaagugaaagagaaauugaaagggaaaaaag

SEQ ID NO: 114448 - RNA, 64 nt, Homo Sapiens
ccaggucacugguaguuauaguauggaaugggagaagugaaaguucaguuauagaacuuuccau

SEQ ID NO: 114449 - RNA, 64 nt, Homo Sapiens
acugcaguaguugacuuugcuguauggaaaaauaaagugaaauugcccuaauaaaacuucucuu

SEQ ID NO: 114450 - RNA, 64 nt, Homo Sapiens
uuuuacuuuucacuggagaauuuguuuaugcuugaagugaaaugguaagcaugccaacauuucg

SEQ ID NO: 114451 - RNA, 64 nt, Homo Sapiens
guugaaaagugaguaaccuccuuuaaguuugugcaagugaaaauuuuuaggggugcaaguauag

SEQ ID NO: 114452 - RNA, 64 nt, Homo Sapiens
uauccugaugaggcauuucuuacuagaaucccauaagugaaauauaauauuuuucaaaguugau

SEQ ID NO: 114453 - RNA, 64 nt, Homo Sapiens
guuacuuuaaagcuaauacaagaaaaacaaagacaagugaaaguaaggaaacagaaauugcaaa

SEQ ID NO: 114454 - RNA, 64 nt, Homo Sapiens
uuaauaaacuucuguaauuauuuaauguaaaagcaagugaaauuaguuuaauuuuuucaguuuu

SEQ ID NO: 114455 - RNA, 64 nt, Homo Sapiens
uaugcugcaucgaauuguaaacaaauucuuccuuaagugaaaguugauguuaaaugacauguau

SEQ ID NO: 114456 - RNA, 64 nt, Homo Sapiens
ugucaaauaaauccuccuuuagguauauugcgcuaagugaaacuuuguauugugauuuccuuuu

SEQ ID NO: 114457 - RNA, 64 nt, Homo Sapiens
uuuuggcauguuuguuaauugugucuacuauuaaaagugaaacauguaaaacaauauaggagcu

SEQ ID NO: 114458 - RNA, 64 nt, Homo Sapiens
aguuugaugaugcaaaguugaucucuguacauuuaagugaaaagucuuuauaacuuuucacccu

SEQ ID NO: 114459 - RNA, 64 nt, Homo Sapiens
cuauugaugacuguguuaagugcaucuguauuguaagugaaauguaauuauuucuguguaccau

SEQ ID NO: 114460 - RNA, 64 nt, Homo Sapiens
gcucuccucauccuauuccuaaauuaggcuaauaaagugaaauugguauacuuuccaguuaaau

SEQ ID NO: 114461 - RNA, 64 nt, Homo Sapiens
uagugugaauucuggcacuuuaaaaagauuaagcaagugaaauucugcugcccuccaccauuua

SEQ ID NO: 114462 - RNA, 64 nt, Homo Sapiens
uggaugaaacucuguuagaaauuuccaaaaaucuaagugaaacaaguucugucagaaacucuaa

SEQ ID NO: 114463 - RNA, 64 nt, Homo Sapiens
gaggguuuacuuaccuacugcaucccucuggggaaagugaaagaaauuucaacacugccugaga

SEQ ID NO: 114464 - RNA, 64 nt, Homo Sapiens
caauguuuuuuuuaaaugugcaaauacuguauucaagugaaaaaaauacaguauuuguagauaa

SEQ ID NO: 114465 - RNA, 64 nt, Homo Sapiens
caucccagugccuuuaaccuggauuucuaaucuuaagugaaaugggugcagcauuccuuuggaa

SEQ ID NO: 114466 - RNA, 64 nt, Homo Sapiens
ggacaugcacaauugugcaguccuuugggauuggaagugaaacagucugugauccccuaccuuc

SEQ ID NO: 114467 - RNA, 64 nt, Homo Sapiens
cuuuucucucucccaugucuagccuccaaaaguuaagugaaaauuagucaacugcacguggaag

SEQ ID NO: 114468 - RNA, 64 nt, Homo Sapiens
ccuuggacauggugauggugauggguugccauccaagugaaagucuuuuccuugaccaaggggg

SEQ ID NO: 114469 - RNA, 64 nt, Homo Sapiens
uaauugggauaauuuaauuaacaagauugacuagaagugaaacugcaacacuaacuuccccgug

SEQ ID NO: 114470 - RNA, 64 nt, Homo Sapiens
caaucugaaaaggcuuucuaaaaugcuuauuguuaagugaaaacaaaagacauauaggaacccu

SEQ ID NO: 114471 - RNA, 64 nt, Homo Sapiens
ggccaucauagcugauccuaacugcuaauaccaaaagugaaagaagaaaaaacagaagacaaau

SEQ ID NO: 114472 - RNA, 64 nt, Homo Sapiens
uuugcuuagaaauaaaauauauuuaagaaaucuaaagugaaaaucacugaggagaaaauuguca

SEQ ID NO: 114473 - RNA, 64 nt, Homo Sapiens
uggagcagccaggugaaaggccuggcggggaggaaagugaaacgccugaaucaaaagcaguuuu

SEQ ID NO: 114474 - RNA, 64 nt, Homo Sapiens
gugccaugggaaccaggucugaaaaaguagagagaagugaaaguagagucugggaaguagcugc

SEQ ID NO: 114475 - RNA, 64 nt, Homo Sapiens
gcaaggcugggguagcccccuccaguacaccccaaagugaaagggauaagagugcagccccaga

SEQ ID NO: 114476 - RNA, 64 nt, Homo Sapiens
cuacgccaaaacagacgggaaagggaacaaaauaaagugaaauccaauacacgccugugugaga

SEQ ID NO: 114477 - RNA, 64 nt, Homo Sapiens
auuuaaaaaggaagagaaacguggauaauagacaaagugaaaacaaugcuuuccuaaaaugaua

SEQ ID NO: 114478 - RNA, 64 nt, Homo Sapiens
gaaacaacuagcaaaaagaaguagaaaaagaaaaaagugaaaagagaaagagaaaaaagauaaa

SEQ ID NO: 114479 - RNA, 64 nt, Homo Sapiens
uuuuugacaauuuuggguucccaacuuaucuuacaagugaaaacuuaaauuguaaaacauguug

SEQ ID NO: 114480 - RNA, 64 nt, Homo Sapiens
uaagagaauuuauuuacuaaaugcacuauguauaaagugaaagauaguuuacuuaucugacuuu

SEQ ID NO: 114481 - RNA, 64 nt, Homo Sapiens
auagcuaauaacaugugaaagccuccaauuuuuuaagugaaaauuuuguuugcuuaccccuuca

SEQ ID NO: 114482 - RNA, 64 nt, Homo Sapiens
uuuguaguaugauagguuauguuacacuuuuuggaagugaaaacuuaccagugccuuaaacucu

SEQ ID NO: 114483 - RNA, 64 nt, Homo Sapiens
aguuaaaaaagaaaugggggcuaacaguuuuagaaagugaaaaaauacaggggucaaaaccaga

SEQ ID NO: 114484 - RNA, 64 nt, Homo Sapiens
auuaaaacaauagggcuuuucauaaaacaauuggaagugaaacuauaucuggagaaaucgcauu

SEQ ID NO: 114485 - RNA, 64 nt, Homo Sapiens
caaaaaugaaaauauuuauauaaauugagacucaaagugaaauauugaaaggaaguuaucuugg

SEQ ID NO: 114486 - RNA, 64 nt, Homo Sapiens
aaaaaaaaaacuagaaagcuaaacuauuugauccaagugaaaaaagaucuuuuucugucuauca

SEQ ID NO: 114487 - RNA, 64 nt, Homo Sapiens
caaccaaguccaggaaauuacuucuuaacugcccaagugaaaagauggggaaaacaagcugugu

SEQ ID NO: 114488 - RNA, 64 nt, Homo Sapiens
cagaauguaauggaaguccugaugguuacagaguaagugaaagggugccugcgcugacgugaga

SEQ ID NO: 114489 - RNA, 64 nt, Homo Sapiens
auuagauaaaucaugaagugucccugugaaauugaagugaaacuaucucuguaggacuuaagag

SEQ ID NO: 114490 - RNA, 64 nt, Homo Sapiens
uuuuugcuucaaaggagcucugccuugaggagacaagugaaaaaauaaugaacaaaggugaagc

SEQ ID NO: 114491 - RNA, 64 nt, Homo Sapiens
auuuuccuuuaaucuuuuaugaaaagaucaccuuaagugaaauucuuuucauuauaguuuauau

SEQ ID NO: 114492 - RNA, 64 nt, Homo Sapiens
auuuguauacaaauguuuucuuccagucuucccaaagugaaaagaguuacccagcuguuuaaua

SEQ ID NO: 114493 - RNA, 64 nt, Homo Sapiens
uaucuuucaacuguuuaguucuuguuucuauuuaaagugaaaugauaagugugacaacuuaaaa

SEQ ID NO: 114494 - RNA, 64 nt, Homo Sapiens
aauccuagugaaccaaaaugcaaacaacucacacaagugaaaagcucccugcuuugaaaacagg

SEQ ID NO: 114495 - RNA, 64 nt, Homo Sapiens
agagaacucaauucugaugucguaaguucucuguaagugaaaugggguagacuguaugauuuuc

SEQ ID NO: 114496 - RNA, 64 nt, Homo Sapiens
ugauuuuccaguuuuauggaauugggagucugacaagugaaaccaauuuaauguaaaguauuug

SEQ ID NO: 114497 - RNA, 64 nt, Homo Sapiens
uuugguuuuguuggagagugucagacugaucuggaagugaaacacaguuuauguacagggaaaa

SEQ ID NO: 114498 - RNA, 64 nt, Homo Sapiens
ggugggucccucauaggcuaagccccggagaagcaagugaaaagacugcacuuacccucaaucc

SEQ ID NO: 114499 - RNA, 64 nt, Homo Sapiens
gccauccucuaaacuggguaagauaaacccaccuaagugaaaugagauagugaaaaaggugucc

SEQ ID NO: 114500 - RNA, 64 nt, Homo Sapiens
ucccaggcacacacccugccgaagacaagcagggaagugaaagggccucucagaaacgcggcca

SEQ ID NO: 114501 - RNA, 64 nt, Homo Sapiens
aauucauccuagcaaauucuaccuuauuuuacagaagugaaagugagguaucagaaguguuaag

SEQ ID NO: 114502 - RNA, 64 nt, Homo Sapiens
agcuaauaaagaaaagagguuuauacugcaaaagaagugaaacuauauguauucacaguugaua

SEQ ID NO: 114503 - RNA, 64 nt, Homo Sapiens
uacaaaauaagacuaauuuuacccuaaagugcaaaagugaaacagugaaaaggggacaguuuuu

SEQ ID NO: 114504 - RNA, 64 nt, Homo Sapiens
uuuacaaguuagagggauggaauacgagaaaagaaagugaaaguaggaaaauguauuuaaaaga

SEQ ID NO: 114505 - RNA, 64 nt, Homo Sapiens
auagcuauuuugcuuaaauuucuacaguauguaaaagugaaaaaaugaugaagacgggugcacc

SEQ ID NO: 114506 - RNA, 64 nt, Homo Sapiens
ggacugguuuuguuuuuauauauauaaaaaaaaaaagugaaaacaccaaugugugaaaugccuu

SEQ ID NO: 114507 - RNA, 64 nt, Homo Sapiens
uuuccccuuugcccugcaauaaauugucuuuauuaagugaaaaccgucccaggaaauagaagug

SEQ ID NO: 114508 - RNA, 64 nt, Homo Sapiens
gucuuuauuaagugaaaacugucccaggaaauagaagugaaauucaggguucuagggguuauuc

SEQ ID NO: 114509 - RNA, 64 nt, Homo Sapiens
aaaacucaaauauaggagcugugucuacgauucaaagugaaaacauuuggcauguuuguuaauu

SEQ ID NO: 114510 - RNA, 64 nt, Homo Sapiens
uuguauugugauuuccauuuagauguauuguacuaagugaaacuuguuaaauaaaucuuccuuu

SEQ ID NO: 114511 - RNA, 64 nt, Homo Sapiens
guggggaagaaaccuccccaggaaauuggaauuaaagugaaaaaucauucuggagguggcaugu

SEQ ID NO: 114512 - RNA, 64 nt, Homo Sapiens
gaagcagaugaguuuguagcagggccacaaaacaaagugaaacguccaggggaacccaacaguc

SEQ ID NO: 114513 - RNA, 64 nt, Homo Sapiens
ugggaggaguaaagaaaacuuggauuuaggcaggaagugaaauaggaaauuguauaauuuaacu

SEQ ID NO: 114514 - RNA, 64 nt, Homo Sapiens
aaaucacauucauuuguuuagccuaugcuuguguaagugaaaaaucuuguggaaauauuaaaaa

SEQ ID NO: 114515 - RNA, 64 nt, Homo Sapiens
uccagugguauuggcauugguucuuggcuuaugaaagugaaaaguuuaaucaguuaacggaaau

SEQ ID NO: 114516 - RNA, 64 nt, Homo Sapiens
acauuaaaggugaaugugagauugauuuuggaaaaagugaaauauguuuguguggugccaggaa

SEQ ID NO: 114517 - RNA, 59 nt, Homo Sapiens
agcaaaacuuguaaacagaguaagaggcauaaccaaaaaaaaguaaaaagacagauauu

SEQ ID NO: 114518 - RNA, 59 nt, Homo Sapiens
cauuucaguguaacauauuaagauuuuuauaaccaaauagaaauacaauuagguuuuug

SEQ ID NO: 114519 - RNA, 59 nt, Homo Sapiens
gaacaugcuguuauuuagguauuuuucuuuaaccaaacaauauugcuccaugaugacuu

SEQ ID NO: 114520 - RNA, 59 nt, Homo Sapiens
cgacuaaacuuaauuuaauauuuacucuauaaccaaaugaaauauauuuaaaauauauu

SEQ ID NO: 114521 - RNA, 59 nt, Homo Sapiens
aaguuguucuuauaauguaaauaaauguuuaaccaaagauuaucagggacacauuaaau

SEQ ID NO: 114522 - RNA, 59 nt, Homo Sapiens
uaaauaacuuuccuauguaaucucaaaguuaaccaaagcauguuuaguuacuguuuucu

SEQ ID NO: 114523 - RNA, 59 nt, Homo Sapiens
guucuuaaacuuucagauguguccuuugauaaccaaauucugucacucaagacacagac

SEQ ID NO: 114524 - RNA, 59 nt, Homo Sapiens
aaguaccacacugaaaauuagacauuuauuaaccaaauuuaacgugguauuuaaaggua

SEQ ID NO: 114525 - RNA, 59 nt, Homo Sapiens
gucauuacuuucaaaggaacagaaguaguuaaccaaacuaacaagcaaaaccugagguu

SEQ ID NO: 114526 - RNA, 59 nt, Homo Sapiens
gaguaaccuguauuuuaauuguugaaacuuaaccaaaauaagauacugucucagcuagg

SEQ ID NO: 114527 - RNA, 59 nt, Homo Sapiens
aggguggaaaaguacucgguaaacaguaguaaccaaauauuuucacuccagauuugugu

SEQ ID NO: 114528 - RNA, 59 nt, Homo Sapiens
gccuuuagccuugaggugccuucugaaauuaaccaaauuucauccauauauccucuuuu

SEQ ID NO: 114529 - RNA, 59 nt, Homo Sapiens
guuaaucaaaaauggggaaggggaaaugguaaccaaaaaguaaccccaugguaagguuu

SEQ ID NO: 114530 - RNA, 59 nt, Homo Sapiens
ccagacauagggagucauuuauaaaauucuaaccaaacccaaguuugguuuaugugggc

SEQ ID NO: 114531 - RNA, 59 nt, Homo Sapiens
ggcuuuuuuuuuuucuaguguguucaauuuaaccaaacucauuggcaguuaccacauuc

SEQ ID NO: 114532 - RNA, 59 nt, Homo Sapiens
ugaauuuugaaaagagucagagcauuucuuaaccaaaguucuuaaccaaaguuguacuc

SEQ ID NO: 114533 - RNA, 59 nt, Homo Sapiens
uguacucagcauuucuuaacaguguuucuuaaccaaagugacucuuuauccaugaccuc

SEQ ID NO: 114534 - RNA, 59 nt, Homo Sapiens
aaaauaacauuaaaggagacaagaugaguuaaccaaaggcaugcccugaugccuaacca

SEQ ID NO: 114535 - RNA, 59 nt, Homo Sapiens
ugaguuaaccaaaggaaaauccugaugccuaaccaaagaacaccaaggugugaacaugc

SEQ ID NO: 114536 - RNA, 59 nt, Homo Sapiens
gaaguacauaaagaccauguaucuuccuuuaaccaaacuggcaaaaugcuacaguucau

SEQ ID NO: 114537 - RNA, 59 nt, Homo Sapiens
guuguuauaaugcauaauuuuguuuaaaauaaccaaagaaguaaaaaaaccaaauaauu

SEQ ID NO: 114538 - RNA, 59 nt, Homo Sapiens
cuugacuuaaaauuuuccggauaguuuuauaaccaaaauucuguaguguuuuuacugcc

SEQ ID NO: 114539 - RNA, 59 nt, Homo Sapiens
gagcagaauggucaagugauucagggaacuaaccaaacgaagacuccugaaaugauaaa

SEQ ID NO: 114540 - RNA, 59 nt, Homo Sapiens
guauauaauuugguaaugauagaaugauauaaccaaaaguucacaguguccuuuaugua

SEQ ID NO: 114541 - RNA, 59 nt, Homo Sapiens
auacagugauauagccauguaguggcacuuaaccaaaaguuuucaucuuaauauguacc

SEQ ID NO: 114542 - RNA, 59 nt, Homo Sapiens
ccaagugauaaccagacccagcauauguauaaccaaacuccccaaacagcaauagaaag

SEQ ID NO: 114543 - RNA, 59 nt, Homo Sapiens
agccaucagccuggcagcugcccaucccauaaccaaagagcucaaugggcuggagggug

SEQ ID NO: 114544 - RNA, 59 nt, Homo Sapiens
aauuucuuuauaaaguucaccucugagaguaaccaaaucgguuucaucccauaucaaaa

SEQ ID NO: 114545 - RNA, 59 nt, Homo Sapiens
cuugauagguuaugcuacuccuuauuuucuaaccaaauauuuaucacacaaauaguaca

SEQ ID NO: 114546 - RNA, 59 nt, Homo Sapiens
cuugcucuuccauaaucuuauaagggauuuaaccaaaauagaucuccugguuuccauug

SEQ ID NO: 114547 - RNA, 59 nt, Homo Sapiens
ucuggcuguuugcuuuuugauggcaaagauaaccaaauguucagaaugacacauuguag

SEQ ID NO: 114548 - RNA, 59 nt, Homo Sapiens
ucugugaagaauguuuucaucauaugugcuaaccaaauuuuucugucaguagaaauaac

SEQ ID NO: 114549 - RNA, 59 nt, Homo Sapiens
agauguguagugccuuaacauuaaucauuuaaccaaagauuuucaagugauuuaaauag

SEQ ID NO: 114550 - RNA, 64 nt, Homo Sapiens
ucauggacaagguucucagggaaguuuuggaguuugcaaccacaguauuccuuugucugucgag

SEQ ID NO: 114551 - RNA, 64 nt, Homo Sapiens
aaaaucuugauauaacuccuaguuauaauuuugaugcaaccaaguuauuuuuuauauauuuugu

SEQ ID NO: 114552 - RNA, 64 nt, Homo Sapiens
aaucgacugucucuguagaucaccccaagcccucugcaaccacgacacuccccaacccaucggc

SEQ ID NO: 114553 - RNA, 64 nt, Homo Sapiens
aucacuagaucaauuuuagauauauucagaguugugcaaccauuuacaauuugaugacuuuugg

SEQ ID NO: 114554 - RNA, 64 nt, Homo Sapiens
agaaguauauuuaugaaucagcaaauguggugccugauuauagaaauuugugauccuauauaca

SEQ ID NO: 114555 - RNA, 64 nt, Homo Sapiens
ggacauuuuuucuuaauuuauguauaaauccauaugauuauacauaaaguucugaugcauuaau

SEQ ID NO: 114556 - RNA, 64 nt, Homo Sapiens
ugucuauggauuaccuggacaaaugcagguguaaugauuauacaaggccuguaccuguaaaaca

SEQ ID NO: 114557 - RNA, 64 nt, Homo Sapiens
auaugugcuacuucacuuacugagaaaaauuaauugauuauaaauucugcuacauuaucuucuu

SEQ ID NO: 114558 - RNA, 64 nt, Homo Sapiens
auuauugaauaacucuuuuaauauuuuugagcaaugauuauacugcuuuaccuugugucacuuu

SEQ ID NO: 114559 - RNA, 64 nt, Homo Sapiens
aauuaguauuuuuuuuaauauuauauggaccaucugauuauauuuuauuuauucaucuauuuau

SEQ ID NO: 114560 - RNA, 64 nt, Homo Sapiens
auacaggagaaaggaagcauuuaaauuuuuauagugauuauagagaaugauuauaugauguuug

SEQ ID NO: 114561 - RNA, 64 nt, Homo Sapiens
gaagcauuuaaauuuuuauagugauuauagagaaugauuauaugauguuuguaaugaauaaaau

SEQ ID NO: 114562 - RNA, 64 nt, Homo Sapiens
aauauuguaauaaaccacuuuacacauaaaauacugauuauaaaucacuuguauagugaccaag

SEQ ID NO: 114563 - RNA, 64 nt, Homo Sapiens
ggcagcugaccaaucccccaguucagccaaaacaugauuauaguuaaacucaagcaagaaauau

SEQ ID NO: 114564 - RNA, 64 nt, Homo Sapiens
uccagugugaugcaggugacuacucugaaaguauugauuauacuugaaugccaaagaacuuguc

SEQ ID NO: 114565 - RNA, 64 nt, Homo Sapiens
gacguuuaaaacugugacaacagauauucacauuugauuauagaaacuuaaugucuauuaauaa

SEQ ID NO: 114566 - RNA, 64 nt, Homo Sapiens
aacuacugguuugugugcaaacaugacuguucuaugauuauaaauguauuauaauaaaaugcaa

SEQ ID NO: 114567 - RNA, 64 nt, Homo Sapiens
ugagugaauaggagaaaacauauauuggauuuugugauuauauuacugccuuuauucucuccug

SEQ ID NO: 114568 - RNA, 64 nt, Homo Sapiens
aaagugcuuauuaugugcaacauuaugauuaaucugauuauacaccauuuuugagcagaucuug

SEQ ID NO: 114569 - RNA, 64 nt, Homo Sapiens
agagaaucaaguuuauuuuauguauauauuuuucugauuauaagaguaauauauguucauugua

SEQ ID NO: 114570 - RNA, 64 nt, Homo Sapiens
gcuauuuuaaaaaauauauagucccuauaguauaugauuauaaucugagguuuaguaaucuaaa

SEQ ID NO: 114571 - RNA, 55 nt, Homo Sapiens
agagcuuauuguuuuaaaaaagguaugauuauaagaaacuagauuagcugguuaa

SEQ ID NO: 114572 - RNA, 64 nt, Homo Sapiens
uaaaaauucugugaguguucuuucuaauuuugaaugauuauaaaguugauggacguuuggguug

SEQ ID NO: 114573 - RNA, 64 nt, Homo Sapiens
uccaccuguuuaucaacggcauugcagugcaugaugauuauaaggcaggagacuauguucuaca

SEQ ID NO: 114574 - RNA, 64 nt, Homo Sapiens
cuauuugacuuuuuaaaaucaacacaauucauuuugauuauaaauccauauaaguaucaaguua

SEQ ID NO: 114575 - RNA, 64 nt, Homo Sapiens
gaaaaugcucuuaaaaagauuccuuauauuggaaugauuauauauucauacuuauauuguuuca

SEQ ID NO: 114576 - RNA, 64 nt, Homo Sapiens
ucugaacaagguucagaaaaaaaauaauuugcagugauuauauuuuuuuuagaacaacacuugg

SEQ ID NO: 114577 - RNA, 64 nt, Homo Sapiens
acuuaauuuucauuuuccucagcucugccacucaugauuauauacagacuugaguucauuuccc

SEQ ID NO: 114578 - RNA, 64 nt, Homo Sapiens
caauauaguggauaaaccugucuaucagacguauugauuauagcaguacuauaguuauucugcu

SEQ ID NO: 114579 - RNA, 64 nt, Homo Sapiens
aguacuauaguuauucugcugucauuauuaaagaugauuauauucauucaaagcuuuagaugug

SEQ ID NO: 114580 - RNA, 64 nt, Homo Sapiens
ugaauacacaaauuuuacugcagaagggcaguuuugauuauaugauaaauacaaauguuuauuu

SEQ ID NO: 114581 - RNA, 64 nt, Homo Sapiens
aguggaauacauagaaaaaaaucuauaaauuuugugauuauaguguuucuaacaugaaacauuu

SEQ ID NO: 114582 - RNA, 64 nt, Homo Sapiens
acgugugagugagugugcguauguaucccuucugugauuauauauauucacacaucucuauaua

SEQ ID NO: 114583 - RNA, 64 nt, Homo Sapiens
aagauuuguuagagcuguuaacauucaaccuuauugauuauauugagagcgcucuucugauuca

SEQ ID NO: 114584 - RNA, 64 nt, Homo Sapiens; identical to SEQ ID NO: 21150

SEQ ID NO: 114585 - RNA, 64 nt, Homo Sapiens; identical to SEQ ID NO: 21151

SEQ ID NO: 114586 - RNA, 60 nt, Homo Sapiens; identical to SEQ ID NO: 21152

SEQ ID NO: 114587 - RNA, 64 nt, Homo Sapiens; identical to SEQ ID NO: 21153

SEQ ID NO: 114588 - RNA, 64 nt, Homo Sapiens; identical to SEQ ID NO: 21154

SEQ ID NO: 114589 - RNA, 64 nt, Homo Sapiens; identical to SEQ ID NO: 21155

SEQ ID NO: 114590 - RNA, 64 nt, Homo Sapiens; identical to SEQ ID NO: 21156

SEQ ID NO: 114591 - RNA, 64 nt, Homo Sapiens; identical to SEQ ID NO: 21157

SEQ ID NO: 114592 - RNA, 64 nt, Homo Sapiens; identical to SEQ ID NO: 21158

SEQ ID NO: 114593 - RNA, 64 nt, Homo Sapiens; identical to SEQ ID NO: 21159

SEQ ID NO: 114594 - RNA, 64 nt, Homo Sapiens; identical to SEQ ID NO: 21160

SEQ ID NO: 114595 - RNA, 64 nt, Homo Sapiens; identical to SEQ ID NO: 21161

SEQ ID NO: 114596 - RNA, 64 nt, Homo Sapiens; identical to SEQ ID NO: 21162

SEQ ID NO: 114597 - RNA, 64 nt, Homo Sapiens; identical to SEQ ID NO: 21163

SEQ ID NO: 114598 - RNA, 64 nt, Homo Sapiens; identical to SEQ ID NO: 21164

SEQ ID NO: 114599 - RNA, 64 nt, Homo Sapiens; identical to SEQ ID NO: 21165

SEQ ID NO: 114600 - RNA, 64 nt, Homo Sapiens; identical to SEQ ID NO: 21166

SEQ ID NO: 114601 - RNA, 64 nt, Homo Sapiens; identical to SEQ ID NO: 21167

SEQ ID NO: 114602 - RNA, 64 nt, Homo Sapiens
guaguuggcgcccaauggggggucccugagacuugcauguaaaacuagucuagaugucuucuuu

SEQ ID NO: 114603 - RNA, 64 nt, Homo Sapiens
cuucuuuuuuuguaaguuuuauuuuuguaauugugcauguaaagcaucauugaaucaauggauc

SEQ ID NO: 114604 - RNA, 64 nt, Homo Sapiens
guagaaucaaaggugcagcugacugagacgacaugcauguaagauccacaaaaugagacaaugc

SEQ ID NO: 114605 - RNA, 64 nt, Homo Sapiens
cgacaugcauguaagauccacaaaaugagacaaugcauguaaauccaugcucauguucuaaaca

SEQ ID NO: 114606 - RNA, 64 nt, Homo Sapiens
ggaguggcacauuuugcagccuuuuugcuugauugcauguaauggaaaugcccuauauuuuccu

SEQ ID NO: 114607 - RNA, 64 nt, Homo Sapiens
ccauuucuuacacacacugccagagauacucuaggcauguaaagcacaaacauacauauaaaau

SEQ ID NO: 114608 - RNA, 64 nt, Homo Sapiens
uaacacuauuugucuaaagaaggguugcauaacagcauguaacaacaaauuaaggggaaaaggg

SEQ ID NO: 114609 - RNA, 64 nt, Homo Sapiens
auauucuuucacucauaauauaagucacucuuacgcauguaaaaauguuuucagcagacaaaaa

SEQ ID NO: 114610 - RNA, 64 nt, Homo Sapiens
ugcauagagaagguccucuguuuaagguguauuggcauguaauuucacuuuugucuuauuuucu

SEQ ID NO: 114611 - RNA, 64 nt, Homo Sapiens
ucucagaaucaacauucuuuuuuucuucccugcugcauguaaugguuauuuugggcauuugcag

SEQ ID NO: 114612 - RNA, 64 nt, Homo Sapiens
auuucuuaaaauuuagcauuacuuuaaauagccagcauguaauacaaguaacuacacuaccuca

SEQ ID NO: 114613 - RNA, 64 nt, Homo Sapiens
uugaaucuguaaauauuuuaaauguuuuauuaaggcauguaauaaacuauucuuugaaacuugu

SEQ ID NO: 114614 - RNA, 64 nt, Homo Sapiens
agucuugacuugaagugaacucauuuaaauuugucugaaucauuguucaugaaaccguuugggu

SEQ ID NO: 114615 - RNA, 64 nt, Homo Sapiens
cagaaacugcuucuagaauuuuggguuggggaaccugaaucaaucugaucaaacguugaguucc

SEQ ID NO: 114616 - RNA, 64 nt, Homo Sapiens
gguuuuguaaaacuuuugaaccaucaagcuuacucugaaucaaaaccuccuuugccacuguacc

SEQ ID NO: 114617 - RNA, 64 nt, Homo Sapiens
uuuuuaaaaaaaagaaaaaaagccacugcaagcucugaaucagugauagccagaguaaguaagc

SEQ ID NO: 114618 - RNA, 64 nt, Homo Sapiens
uucauugacugauggugaaauggcuggagugauucugaaucaaggugauugugauuauagugac

SEQ ID NO: 114619 - RNA, 64 nt, Homo Sapiens
ugcuuaucaguaguaucaaugauuuacucaauaucugaaucaccuugauucagaaccauuucag

SEQ ID NO: 114620 - RNA, 64 nt, Homo Sapiens
aaccccuucuuuaggguccagaaggaauuguggacugaaucacuagccuuaggucuuucagcaa

SEQ ID NO: 114621 - RNA, 64 nt, Homo Sapiens
aaacauucagaacuuguugaaagaaaaauuauaucugaaucaagauucauguuuuuuauuuuua

SEQ ID NO: 114622 - RNA, 64 nt, Homo Sapiens
uucuaauuucccucuaaaaucccaauacaaacuacugaaucaucaaaaaaucaagacaaguagg

SEQ ID NO: 114623 - RNA, 64 nt, Homo Sapiens
augaaaugaacucuacuucuaguaucugaagauacugaaucaucuuauggcaagugucaaaaau

SEQ ID NO: 114624 - RNA, 64 nt, Homo Sapiens
augaaagugugugucugcuggggcagcugugccccugaaucaugggcacggagggccgcccgcc

SEQ ID NO: 114625 - RNA, 64 nt, Homo Sapiens
ccgcgcucaacugcucccguggaagauuaaagggcugaaucauggugcugaccuggcucuuugu

SEQ ID NO: 114626 - RNA, 64 nt, Homo Sapiens
agauuucaguguuacucuggggaauggcuagacacugaaucaagaaagguauucagcaagaggu

SEQ ID NO: 114627 - RNA, 64 nt, Homo Sapiens
ccauguaaaacagagcucuaaguccauccgacaccugaaucauuuggcuuugucauaucuacuu

SEQ ID NO: 114628 - RNA, 64 nt, Homo Sapiens
acgcuggcuuuuauuuauuucuuaaaaucuuugccugaaucagacauuuuucuuucuucgguuu

SEQ ID NO: 114629 - RNA, 64 nt, Homo Sapiens
agauccaagggaaugaacaacuucgccagugucacugaaucaacuccuccgccucuaccaagag

SEQ ID NO: 114630 - RNA, 64 nt, Homo Sapiens
cuuuuuuaaguguaaucagaagacacugccuggccugaaucaacguguugggauuacaggcaug

SEQ ID NO: 114631 - RNA, 64 nt, Homo Sapiens
uuuuuuuuuuuuuucggacauacguaagcaaacacugaaucaacaguagggaguuuccaccuug

SEQ ID NO: 114632 - RNA, 64 nt, Homo Sapiens
cccagcuggcagugcugaucgaucccacauccugaauaaagaauaaagaucucucagaaaauuc

SEQ ID NO: 114633 - RNA, 64 nt, Homo Sapiens
ggcagugcugaucgaucccacauccugaauaaagaauaaagaucucucagaaaauuccaaguug

SEQ ID NO: 114634 - RNA, 64 nt, Homo Sapiens; identical to SEQ ID NO: 114632

SEQ ID NO: 114635 - RNA, 64 nt, Homo Sapiens; identical to SEQ ID NO: 114633

SEQ ID NO: 114636 - RNA, 64 nt, Homo Sapiens
uuucacuuuuggaggauucuuuuuguauaacuucaauaaagauuguaagcaaagguugaggcuu

SEQ ID NO: 114637 - RNA, 64 nt, Homo Sapiens
ggaauuguuacccaucugcagaauugacuucucaaauaaagaugcuaaaaaucuccuugucugg

SEQ ID NO: 114638 - RNA, 64 nt, Homo Sapiens
uuaggcugugcuuuacugauaaaaccaaguauugaauaaagagaguuaauuaucuuuuuaaagu

SEQ ID NO: 114639 - RNA, 64 nt, Homo Sapiens
cuauugugugaguauauugugcuaaaaucauagaaauaaagauuagauuucuucaucaaaauug

SEQ ID NO: 114640 - RNA, 64 nt, Homo Sapiens
aagcuaaauauggcacacuuguucuuuacagaaaaauaaagauauuuuaaacaaaauacuaggg

SEQ ID NO: 114641 - RNA, 64 nt, Homo Sapiens
guauguaauaaaauuugaaacaauaauuucaaauaauaaagauugaaaaugcuuaacccagaaa

SEQ ID NO: 114642 - RNA, 64 nt, Homo Sapiens
cauucuugagugaaaucccacuuacaaauucuucaauaaagacacagaggguacauccuuuuuu

SEQ ID NO: 114643 - RNA, 64 nt, Homo Sapiens
agacugcgauauaguccauuccauucuccauucaaauaaagagcuauauucuuauaaccuguuu

SEQ ID NO: 114644 - RNA, 64 nt, Homo Sapiens
uauuaaauaagcucaaauauauauauuugguguaaauaaagaguccaugguaaaugguuuacuu

SEQ ID NO: 114645 - RNA, 64 nt, Homo Sapiens
acauuuuaaaaaacguauuuaacagaagagagcaaauaaagauauaucaggaaggauguauuag

SEQ ID NO: 114646 - RNA, 64 nt, Homo Sapiens
acuccuuucauaucaagacaaguuauuuguaaaaaauaaagaagggguuuuaauacaaaccuuc

SEQ ID NO: 114647 - RNA, 64 nt, Homo Sapiens
cgcaacaggcauucugucauguugaacaauuuuaaauaaagagaauaucugguguuaggagcuu

SEQ ID NO: 114648 - RNA, 64 nt, Homo Sapiens
ugaaggugagaugauaaacuugcaaaacucacaaaauaaagagucaaacuuuuagaaugacaag

SEQ ID NO: 114649 - RNA, 64 nt, Homo Sapiens
accuacaaaauuaauaccauuucugaacaccaguaauaaagaaacauaagggcuggggguggug

SEQ ID NO: 114650 - RNA, 64 nt, Homo Sapiens
gcuucacauggaaauuuaaggaaauaaagaaggaaauaaagaugucuaaguggccaauuauuug

SEQ ID NO: 114651 - RNA, 64 nt, Homo Sapiens
gaaauaaagauggcuucacagccaauuauuuggaaauaaagaagguccacacuuauucuaagug

SEQ ID NO: 114652 - RNA, 64 nt, Homo Sapiens
uuauuauacuauauuguuaucugugcauaccuugaauaaagagcuccucucuuccuauagaaca

SEQ ID NO: 114653 - RNA, 64 nt, Homo Sapiens
uuacaaauucucacuuucuaugaauguaauguuuaauaaagaaagaugguuaaagccuuuacac

SEQ ID NO: 114654 - RNA, 64 nt, Homo Sapiens
uuuaaauuuucuaaaaaugguuuggaaaguaacaaauaaagacaauauuuguuuaaccaaaaua

SEQ ID NO: 114655 - RNA, 64 nt, Homo Sapiens
aaauaaacuuauuacuuuaaguaaugaagacauuaauaaagauguuauuaguagaaggcuaauu

SEQ ID NO: 114656 - RNA, 64 nt, Homo Sapiens
uccauugccuuauagcuaugcaccaggcuaagcaaauaaagaagaggcagaguaugaaauuucc

SEQ ID NO: 114657 - RNA, 64 nt, Homo Sapiens
aacauugaccugcagacuauuuuaugacauugaaaauaaagaggaacucagugguaacucauga

SEQ ID NO: 114658 - RNA, 64 nt, Homo Sapiens
ggcucuuuuuuuuucuuccauuuauaacugcacuaauaaagagaagaccugaaaggguaaaggg

SEQ ID NO: 114659 - RNA, 64 nt, Homo Sapiens
uauguuugaccaaguaguuuucaaauaagaaaaaaauaaagacgaaagaucagaugguaaucuu

SEQ ID NO: 114660 - RNA, 64 nt, Homo Sapiens
cuuuuuuuuuuucucuugguaccauugguauuauaauaaagagcaauuuguaacugaguggcac

SEQ ID NO: 114661 - RNA, 64 nt, Homo Sapiens
augcacugguaaaaacaaaauaaauagaugaauaaauaaagagugagagaagagagaaucaggu

SEQ ID NO: 114662 - RNA, 64 nt, Homo Sapiens
ugaaccuguaaauguguguguacaauuuuaaaacaauaaagauuauuguauuguaaaagaacug

SEQ ID NO: 114663 - RNA, 64 nt, Homo Sapiens
aguguuauugcaugcugauaucagaacuauuuaaaauaaagagguuauaaaauguauaaauuau

SEQ ID NO: 114664 - RNA, 64 nt, Homo Sapiens
ugcuuauaucauuguauaauguguuuaaaugaaaaauaaagauguaauguuuuguaaauauuaa

SEQ ID NO: 114665 - RNA, 64 nt, Homo Sapiens
acacuaauugucacaccuggggaggcaagccaguaauaaagaagugcagugucagggacccuau

SEQ ID NO: 114666 - RNA, 64 nt, Homo Sapiens
ccagacagagaucagaauugaaccgucaaugugaaauaaagaguucuccuuguacuugaauaau

SEQ ID NO: 114667 - RNA, 64 nt, Homo Sapiens
uaacaguggcaagcuaccaacuaaguuguauuuuaauaaagauuccauggguugaacaagccac

SEQ ID NO: 114668 - RNA, 64 nt, Homo Sapiens
gaaauaguagacaaagauguuauuucccagugcaaauaaagaaauaaagauagcaagcugauuc

SEQ ID NO: 114669 - RNA, 64 nt, Homo Sapiens
agacaaagauguuauuucccagugcaaauaaagaaauaaagauagcaagcugauucucuccauc

SEQ ID NO: 114670 - RNA, 64 nt, Homo Sapiens
uuauacauauagaucacucagggagcuuuggaaaaauaaagauuugucagcccuaucucaaacu

SEQ ID NO: 114671 - RNA, 64 nt, Homo Sapiens
gcuuauauaauacauggggaggauuaaauaaaggaauaaagaugaauggacaacuccugggugc

SEQ ID NO: 114672 - RNA, 64 nt, Homo Sapiens
guuugacucuggagaggagagaaaaaguucaaggaauaaagauuuuagaaaauaagacuucuga

SEQ ID NO: 114673 - RNA, 64 nt, Homo Sapiens
uuaauaaaagcaagcuuaauaucuuaggaauauaaauaaagaucgugaguuugcugauuuuaaa

SEQ ID NO: 114674 - RNA, 64 nt, Homo Sapiens
ugaauucccuguuaguugauuuaaauccuuucugaauaaagaucagauaaacaguaacugaagg

SEQ ID NO: 114675 - RNA, 64 nt, Homo Sapiens
uguuuucagucucuauguguacagcaguauuuuuaauaaagaauuacagagauaaauuuguccu

SEQ ID NO: 114676 - RNA, 64 nt, Homo Sapiens
ugcuguuuaucagaggagggugacaggggcuggaaauaaagagaggggacauggugaugaaaca

SEQ ID NO: 114677 - RNA, 64 nt, Homo Sapiens
gauuuuuuuuuucacaguugaguuaguuugugaaaauaaagaacucuguagcucaccaaggugg

SEQ ID NO: 114678 - RNA, 64 nt, Homo Sapiens
ugacuuuuggagcacuauuccauugucaguuauuaauaaagaauuccauugcuuagcuaaccaa

SEQ ID NO: 114679 - RNA, 64 nt, Homo Sapiens
uugucacuuucucaaucaaauuggccacuuaagaaauaaagagcugguagaauugcauccucag

SEQ ID NO: 114680 - RNA, 64 nt, Homo Sapiens
cacugccccccuuuccugcccccuccucaucuuuaauaaagaccuggcuucucaucuuuaauaa

SEQ ID NO: 114681 - RNA, 64 nt, Homo Sapiens
cucaucuuuaauaaagaccuggcuucucaucuuuaauaaagaccuguuuguaacagaaguuugg

SEQ ID NO: 114682 - RNA, 64 nt, Homo Sapiens
ugagaagcuucggugcugugagcugugccuuuccaauaaagauggcuguaucaagggugggcuu

SEQ ID NO: 114683 - RNA, 64 nt, Homo Sapiens
aggguacuaaaguugucuugcccuccccuucccaaauaaagaugggugggcgacccaggauucc

SEQ ID NO: 114684 - RNA, 64 nt, Homo Sapiens
ugucuauauggaauuuaggauaaagaauauuuacaauaaagaauauuuacaauaaagaguuuau

SEQ ID NO: 114685 - RNA, 64 nt, Homo Sapiens
aggauaaagaauauuuacaauaaagaauauuuacaauaaagaguuuauuauuauuuguaaguug

SEQ ID NO: 114686 - RNA, 64 nt, Homo Sapiens
auuggcuauauggaauuuaggauagaauauuuacaauaaagaguauuuacaauaaagaguuugu

SEQ ID NO: 114687 - RNA, 64 nt, Homo Sapiens
uuaggauagaauauuuacaauaaagaguauuuacaauaaagaguuuguuauuauuuguaaauug

SEQ ID NO: 114688 - RNA, 64 nt, Homo Sapiens
cucuauuuuauauuucauagauuuaaaaaacccaaauaaagauggauuuaaaauucacugugga

SEQ ID NO: 114689 - RNA, 64 nt, Homo Sapiens
ugcugcagugguggcacguagagaacuagaugguaauaaagauuuaaaacuaugaagaagguua

SEQ ID NO: 114690 - RNA, 64 nt, Homo Sapiens
caacaugaugccagauuugagaaaggaucugcaaaauaaagauaccacaauucaucuuaaaacu

SEQ ID NO: 114691 - RNA, 64 nt, Homo Sapiens
ccauuugugugugcccucuacccuuaaauucagaaauaaagacaauaaaaaauuaaaauaauug

SEQ ID NO: 114692 - RNA, 64 nt, Homo Sapiens
uuccggcucauggguugccauagagucuaggaacaaggaguauaguuucuuuaucuuccaagag

SEQ ID NO: 114693 - RNA, 64 nt, Homo Sapiens
cgauagccccauccaagccagcugagaaccuaggaaggaguaguaggaauaugguugauuagau

SEQ ID NO: 114694 - RNA, 64 nt, Homo Sapiens
auucuucagguguugauuuaggaguguuauuuggaaggaguauuauuugcucuuccccugagaa

SEQ ID NO: 114695 - RNA, 64 nt, Homo Sapiens
uauuugcucuuccccugagaacugaaagaggggaaaggaguacauuugagggcacuuaauacaa

SEQ ID NO: 114696 - RNA, 64 nt, Homo Sapiens
uuuggaaucuaacaucguggcuguggagagggucaaggaguacuccaagacagagacagaggug

SEQ ID NO: 114697 - RNA, 64 nt, Homo Sapiens
cucucuuuuuugacuaggguccugguccuggacaaaggaguaguagcugaauuugauucuccag

SEQ ID NO: 114698 - RNA, 64 nt, Homo Sapiens
aaugcauuaccauuuguuuaguuagaaaugaaauaaggaguaaaaaagaagugacauuggguau

SEQ ID NO: 114699 - RNA, 64 nt, Homo Sapiens
aaaaacaauucuggcuuuauaguuuucuagaaaaaaggaguagauuucuucaaucuuuggucuu

SEQ ID NO: 114700 - RNA, 64 nt, Homo Sapiens; identical to SEQ ID NO: 76114

SEQ ID NO: 114701 - RNA, 64 nt, Homo Sapiens; identical to SEQ ID NO: 76115

SEQ ID NO: 114702 - RNA, 64 nt, Homo Sapiens; identical to SEQ ID NO: 76116

SEQ ID NO: 114703 - RNA, 64 nt, Homo Sapiens; identical to SEQ ID NO: 76117

SEQ ID NO: 114704 - RNA, 64 nt, Homo Sapiens; identical to SEQ ID NO: 76118

SEQ ID NO: 114705 - RNA, 64 nt, Homo Sapiens; identical to SEQ ID NO: 76119

SEQ ID NO: 114706 - RNA, 64 nt, Homo Sapiens; identical to SEQ ID NO: 76120

SEQ ID NO: 114707 - RNA, 64 nt, Homo Sapiens; identical to SEQ ID NO: 76121

SEQ ID NO: 114708 - RNA, 64 nt, Homo Sapiens; identical to SEQ ID NO: 76122

SEQ ID NO: 114709 - RNA, 64 nt, Homo Sapiens; identical to SEQ ID NO: 76123

SEQ ID NO: 114710 - RNA, 64 nt, Homo Sapiens; identical to SEQ ID NO: 76124

SEQ ID NO: 114711 - RNA, 64 nt, Homo Sapiens; identical to SEQ ID NO: 76125

SEQ ID NO: 114712 - RNA, 64 nt, Homo Sapiens; identical to SEQ ID NO: 76126

SEQ ID NO: 114713 - RNA, 64 nt, Homo Sapiens; identical to SEQ ID NO: 76127

SEQ ID NO: 114714 - RNA, 64 nt, Homo Sapiens; identical to SEQ ID NO: 76128

SEQ ID NO: 114715 - RNA, 64 nt, Homo Sapiens; identical to SEQ ID NO: 76129

SEQ ID NO: 114716 - RNA, 64 nt, Homo Sapiens; identical to SEQ ID NO: 76130

SEQ ID NO: 114717 - RNA, 64 nt, Homo Sapiens; identical to SEQ ID NO: 76131

SEQ ID NO: 114718 - RNA, 64 nt, Homo Sapiens; identical to SEQ ID NO: 76132

SEQ ID NO: 114719 - RNA, 64 nt, Homo Sapiens; identical to SEQ ID NO: 76133

SEQ ID NO: 114720 - RNA, 64 nt, Homo Sapiens; identical to SEQ ID NO: 76134

SEQ ID NO: 114721 - RNA, 64 nt, Homo Sapiens; identical to SEQ ID NO: 76135

SEQ ID NO: 114722 - RNA, 64 nt, Homo Sapiens; identical to SEQ ID NO: 76136

SEQ ID NO: 114723 - RNA, 64 nt, Homo Sapiens; identical to SEQ ID NO: 76137

SEQ ID NO: 114724 - RNA, 64 nt, Homo Sapiens; identical to SEQ ID NO: 76138

SEQ ID NO: 114725 - RNA, 64 nt, Homo Sapiens; identical to SEQ ID NO: 76139

SEQ ID NO: 114726 - RNA, 64 nt, Homo Sapiens; identical to SEQ ID NO: 76140

SEQ ID NO: 114727 - RNA, 64 nt, Homo Sapiens; identical to SEQ ID NO: 76141

SEQ ID NO: 114728 - RNA, 64 nt, Homo Sapiens; identical to SEQ ID NO: 76142

SEQ ID NO: 114729 - RNA, 64 nt, Homo Sapiens; identical to SEQ ID NO: 76143

SEQ ID NO: 114730 - RNA, 64 nt, Homo Sapiens; identical to SEQ ID NO: 76144

SEQ ID NO: 114731 - RNA, 64 nt, Homo Sapiens; identical to SEQ ID NO: 76145

SEQ ID NO: 114732 - RNA, 64 nt, Homo Sapiens; identical to SEQ ID NO: 76146

SEQ ID NO: 114733 - RNA, 64 nt, Homo Sapiens; identical to SEQ ID NO: 76147

SEQ ID NO: 114734 - RNA, 64 nt, Homo Sapiens; identical to SEQ ID NO: 76148

SEQ ID NO: 114735 - RNA, 64 nt, Homo Sapiens; identical to SEQ ID NO: 76149

SEQ ID NO: 114736 - RNA, 64 nt, Homo Sapiens; identical to SEQ ID NO: 76150

SEQ ID NO: 114737 - RNA, 64 nt, Homo Sapiens; identical to SEQ ID NO: 76151

SEQ ID NO: 114738 - RNA, 64 nt, Homo Sapiens; identical to SEQ ID NO: 76152

SEQ ID NO: 114739 - RNA, 64 nt, Homo Sapiens; identical to SEQ ID NO: 76153

SEQ ID NO: 114740 - RNA, 64 nt, Homo Sapiens; identical to SEQ ID NO: 76154

SEQ ID NO: 114741 - RNA, 64 nt, Homo Sapiens
agcaaccaacuucuucauggccgaacaaaauuuuacauccgaaagaugaccugaaauuuuacau

SEQ ID NO: 114742 - RNA, 64 nt, Homo Sapiens
aaaauuuuacauccgaaaagugaccugaaauuuuacauccgaacuuuuggcauaauuuuuauga

SEQ ID NO: 114743 - RNA, 62 nt, Homo Sapiens
acuuauuacauggcuuacuuuguaucucuaaugcauuugaagucauuucaaauauguuuuaa

SEQ ID NO: 114744 - RNA, 62 nt, Homo Sapiens
caauauuguaauaauccauggcaauuuuuuuugcauuugacacugguuuagauacauuagcu

SEQ ID NO: 114745 - RNA, 62 nt, Homo Sapiens
auuuccuuuuuuuuuuuuuucuucagcuacuugcauuugauucaucuguugaucaggaacua

SEQ ID NO: 114746 - RNA, 62 nt, Homo Sapiens
gguaacaguggagcuagggcuucuguuuugcugcauuugaaauaacuuuaaccaauauuuuc

SEQ ID NO: 114747 - RNA, 62 nt, Homo Sapiens
gaaggacccuuuagcucuguuuaguuucaccagcauuugagacaaagaaugcuugcauuuga

SEQ ID NO: 114748 - RNA, 62 nt, Homo Sapiens
aguuucaccagcauuugagacaaagaaugcuugcauuugauugaaaaauuauuagcauguaa

SEQ ID NO: 114749 - RNA, 62 nt, Homo Sapiens
aaagagauuguucugaagaccgugcucuaagggcauuugaaagacugccagguagugcgagc

SEQ ID NO: 114750 - RNA, 62 nt, Homo Sapiens
caggggugggagaaacuccuuuccuucagcuggcauuugaauguuuccaaaucuauuuuauc

SEQ ID NO: 114751 - RNA, 62 nt, Homo Sapiens
aaaauauuugguucccuuuuaggcucuaaaaagcauuugaggauauuuguaucucuacagaa

SEQ ID NO: 114752 - RNA, 62 nt, Homo Sapiens
ggaggauuauugcuaugaauuuuuuuuaaagggcauuugaggcuauuguacgguuucaugca

SEQ ID NO: 114753 - RNA, 62 nt, Homo Sapiens
ugccacucuuggagcacauuuguaaacacagagcauuugagcaaaggauaagccaagauggc

SEQ ID NO: 114754 - RNA, 62 nt, Homo Sapiens
gggaguagggggcuagaugugaggugguugcugcauuugagauccggcggucugaggccaug

SEQ ID NO: 114755 - RNA, 62 nt, Homo Sapiens
auuuugauguuuuaaggaugcuuucuggcuaugcauuugaaaggcaguggugguuuucuguu

SEQ ID NO: 114756 - RNA, 62 nt, Homo Sapiens
ucuguucuuuccaaaguacaguaaaugggggugcauuugagguuccguuaaaauaccagcca

SEQ ID NO: 114757 - RNA, 62 nt, Homo Sapiens
uuuaaauuaggauugcaaaccaaggaaagaacgcauuugagauuuuaagaugucacuuauaa

SEQ ID NO: 114758 - RNA, 62 nt, Homo Sapiens
cagauuuugaagaaauccuguaagaugauaaagcauuugaaugguacaguagauguaaaaaa

SEQ ID NO: 114759 - RNA, 64 nt, Homo Sapiens
augauggcuccaggucagugucuggaguuucauuccaucccagggcuuggaugucaggauuaua

SEQ ID NO: 114760 - RNA, 64 nt, Homo Sapiens
aagaaaagucuagguuuuaaggcugugccagaacccaucccaauaaagagaccgagucugaagu

SEQ ID NO: 114761 - RNA, 64 nt, Homo Sapiens
aggaaaaaaaaaaaaguaaaccauauacccaucaccaucccaugcccuucacccaccaucuacg

SEQ ID NO: 114762 - RNA, 64 nt, Homo Sapiens
ugugaggacauggugacucgaauaugccccccgcccaucccaugguacggucagcuuucaaaac

SEQ ID NO: 114763 - RNA, 64 nt, Homo Sapiens
cucuucacuuuccuuuccaccuuaaagccccuaaccaucccacauccuauuuuccugggaaguc

SEQ ID NO: 114764 - RNA, 64 nt, Homo Sapiens
auccuauuuuccugggaagucacccccagcaaccccaucccagaaugacaguuggcuccccccc

SEQ ID NO: 114765 - RNA, 64 nt, Homo Sapiens
aggcugucaugugucucgaaaucagcagcccuccccaucccaaucccaggcagcuuguguguac

SEQ ID NO: 114766 - RNA, 64 nt, Homo Sapiens
aaguaaggaaaauuggagaugcuaacauccucccccaucccaacugcaccuuaaaauaugcaug

SEQ ID NO: 114767 - RNA, 64 nt, Homo Sapiens
agucuggaaagugaggagcgucucugcccggccgccaucccaucuaggaagugaggagcgccuc

SEQ ID NO: 114768 - RNA, 64 nt, Homo Sapiens
caucuaggaagugaggagcgccucuucccacccgccaucccaucuaggaagugaggagcuucuc

SEQ ID NO: 114769 - RNA, 64 nt, Homo Sapiens
ccgcucuuuuccuacuuuuccaucccaucccaucccaucccauccuuccuaucccaucccaucc

SEQ ID NO: 114770 - RNA, 64 nt, Homo Sapiens
ccaucccgcucuuuuccuaccaucccaucccaucccaucccaucccucucuuccuaucccaucc

SEQ ID NO: 114771 - RNA, 64 nt, Homo Sapiens
ccaucccaucccgcucuuuucaucccaucccaucccaucccauccccagccucucuuccuaucc

SEQ ID NO: 114772 - RNA, 64 nt, Homo Sapiens
ccaucccaucccaucccgcuuaucccaucccaucccaucccauccauuccccagccucucuucc

SEQ ID NO: 114773 - RNA, 64 nt, Homo Sapiens
ccaucccaucccaucccauccuuccuaucccaucccaucccauccugcccauuccccagccucu

SEQ ID NO: 114774 - RNA, 64 nt, Homo Sapiens
ccaucccaucccaucccaucccucucuuccuaucccaucccauccuucucugcccauuccccag

SEQ ID NO: 114775 - RNA, 64 nt, Homo Sapiens
uugaaaaucacugcucugaaaacuccaccccaucccaucccacccuacaugcaucucuccacuc

SEQ ID NO: 114776 - RNA, 64 nt, Homo Sapiens
ccaccuugaaaaucacugcucacucaacuccaccccaucccaucucuaacuacaugcaucucuc

SEQ ID NO: 114777 - RNA, 64 nt, Homo Sapiens
cccucagcagagggcagcacuugaaugcuuagcuccaucccauaguucucuacuucauauaaau

SEQ ID NO: 114778 - RNA, 64 nt, Homo Sapiens
auggggaagggucuguuccagccucucccuacucccaucccauuuccaccaacuggggaacugu

SEQ ID NO: 114779 - RNA, 64 nt, Homo Sapiens
ggagucucuucuuuuuuugaccccaggcucuacuccaucccauugcccacacaaagcuggacac

SEQ ID NO: 114780 - RNA, 64 nt, Homo Sapiens
cuguucacccaggcugcggaccuuccaggaggcuccaucccacacaugaccagcucucugccuc

SEQ ID NO: 114781 - RNA, 64 nt, Homo Sapiens
cgcgaugccucccggccaccgccccagccucaccccaucccacgacccccgcaacccuucacau

SEQ ID NO: 114782 - RNA, 64 nt, Homo Sapiens
ggcggcgagggcggcgagggcgccgagguccggcccaucccaguccuguggggcuggccgggca

SEQ ID NO: 114783 - RNA, 64 nt, Homo Sapiens
gccucuccuagcaggcagaaacuguuuuaaagagccaucccaaguuuuaccaccaacuuagggg

SEQ ID NO: 114784 - RNA, 64 nt, Homo Sapiens
caccccugccucugccccaguacagaaacauaccccaucccacccuuucuugcagacaagucac

SEQ ID NO: 114785 - RNA, 64 nt, Homo Sapiens
ggccuugccugggcaacccuuaccccaccacaccccaucccagaacccacccccaccccuaccc

SEQ ID NO: 114786 - RNA, 64 nt, Homo Sapiens
gcuggaagguaggggauggggcccccuguccaagccaucccacagaaugggugaccucaaagau

SEQ ID NO: 114787 - RNA, 64 nt, Homo Sapiens
uuugcaggcaggaauaugcugaccuuucacccugccaucccaucccaaccccagcucacuagcc

SEQ ID NO: 114788 - RNA, 64 nt, Homo Sapiens
aggcaggaauaugcugaccuuucacccugccaucccaucccaaccccagcucacuagccuucau

SEQ ID NO: 114789 - RNA, 64 nt, Homo Sapiens
ucuggauaauuuugcauaaaccgacuuaugcccaccaucccaccacuggaggaccacacucaag

SEQ ID NO: 114790 - RNA, 64 nt, Homo Sapiens
gucuagguggagguggggcagaauuucugaguggccaucccaagauuuaccggcagugcgggag

SEQ ID NO: 114791 - RNA, 64 nt, Homo Sapiens
cugggcucucuagguggcccuggucuugccccauccaucccaccugccacuaccuugggugucc

SEQ ID NO: 114792 - RNA, 64 nt, Homo Sapiens
acacuggugaagucuguguacccauacugcagccccaucccauggggccccugaagacccacug

SEQ ID NO: 114793 - RNA, 64 nt, Homo Sapiens
cgucuggaaagugaggagcgccucugcccggccgccaucccaucuaggaagugaggagcgccuc

SEQ ID NO: 114794 - RNA, 64 nt, Homo Sapiens
caucuaggaagugaggagcgccucuucccagccgccaucccaucuaggaagugaggagcgucuc

SEQ ID NO: 114795 - RNA, 64 nt, Homo Sapiens
ccauggagguccgugagcuggaacugggcacacgccaucccagagggcucaggaugccccagga

SEQ ID NO: 114796 - RNA, 64 nt, Homo Sapiens
cagccugauggcagccucagaggcuuacucuaacccaucccagaauaaauggagacuucaugug

SEQ ID NO: 114797 - RNA, 64 nt, Homo Sapiens
aggaguucucaggccuggggcucauaacuucuccccaucccaggucauccccguauuucccccu

SEQ ID NO: 114798 - RNA, 64 nt, Homo Sapiens
caaccacaggccccacuugcccccacccacacccccaucccaccggcucacgcuuaacuccagc

SEQ ID NO: 114799 - RNA, 64 nt, Homo Sapiens
uaguuuuuauguagcaauuuguuuauaaaaauucccaucccauaaugcaugaccuuccuaaaaa

SEQ ID NO: 114800 - RNA, 64 nt, Homo Sapiens
ccaccucagggauucugauccaugucauuaacgaccaucccagggugugagggccugauuaaag

SEQ ID NO: 114801 - RNA, 64 nt, Homo Sapiens
cuauggcugagguggggccgggccacaccccugcccaucccagccagggugcugugcccccguc

SEQ ID NO: 114802 - RNA, 64 nt, Homo Sapiens
aauuuacaaauguuugcuagggucacccucucggccaucccacgagggucgccaugaucacccc

SEQ ID NO: 114803 - RNA, 64 nt, Homo Sapiens
agcaagacgaggauguggcuaguuguccaucuguccaucccaacggguggagggugcggcccgg

SEQ ID NO: 114804 - RNA, 64 nt, Homo Sapiens
cccacccaugucugggcucccuccugcuccacccccaucccacuagaccaggaagcugugggcc

SEQ ID NO: 114805 - RNA, 64 nt, Homo Sapiens
cgaucacauggagcaguaauggagcaaagaccagccaucccaguugagauacccuacaccaacc

SEQ ID NO: 114806 - RNA, 64 nt, Homo Sapiens
aauacacuggcccagauuaggaagguucugccauccaucccagccaucccaaacaacuaccaga

SEQ ID NO: 114807 - RNA, 64 nt, Homo Sapiens
gcccagauuaggaagguucugccauccaucccagccaucccaaacaacuaccagaauaauggau

SEQ ID NO: 114808 - RNA, 64 nt, Homo Sapiens
ccacggaaacagaacucgaugcacugaccugcuccgccaggaaagugagcguguagcguccuga

SEQ ID NO: 114809 - RNA, 64 nt, Homo Sapiens
ugggggagggcaaggcucuccucccagccagggacgccaggacauagcugcuccuggucagugg

SEQ ID NO: 114810 - RNA, 64 nt, Homo Sapiens
acugccgcccagaaaaggggcagggcucugcagccgccaggacagacgagcaccccaugccuau

SEQ ID NO: 114811 - RNA, 64 nt, Homo Sapiens
uccuggugcucuauccacugcagggccagccacucgccaggaggccacgggccacgggaagaac

SEQ ID NO: 114812 - RNA, 64 nt, Homo Sapiens
uggaauacacugugaccccaguuaagugucccuucgccaggaagcugccgcaacguccagaccu

SEQ ID NO: 114813 - RNA, 64 nt, Homo Sapiens
cugcgugggaugcacacggaugacagaaucaaggcgccaggaugggcacucugcccuggauaca

SEQ ID NO: 114814 - RNA, 64 nt, Homo Sapiens
gcugcacgcugggcagucccgguuguguuugccacgccaggaaugcugacaacccaggaccgau

SEQ ID NO: 114815 - RNA, 64 nt, Homo Sapiens
cccagccaggguggccccggcugggugcaaggcgcgccaggaguggcaaagggagggcccuggg

SEQ ID NO: 114816 - RNA, 64 nt, Homo Sapiens
uguggcccuguaacauuccccgcacagaggugcccgccaggaucccauccgagcuugagcuggg

SEQ ID NO: 114817 - RNA, 64 nt, Homo Sapiens
ugccuggcaucugucugcugacgccucuggcuugcgccaggacuuggcgugggcaccgggcgcc

SEQ ID NO: 114818 - RNA, 64 nt, Homo Sapiens
guguguggagauggcgcccuguccugccaaggggcgccaggagcagagccagggccuggcgagc

SEQ ID NO: 114819 - RNA, 64 nt, Homo Sapiens
ccugccuccacuucuccccucaagaaauuuucaacgccaggaaucaugaagagacuucugcuuu

SEQ ID NO: 114820 - RNA, 64 nt, Homo Sapiens
ggugggcuggggacucuggcacagugaugccgggcgccaggacagcagcacucccgcugcacac

SEQ ID NO: 114821 - RNA, 64 nt, Homo Sapiens
gcuuucuuugcaacuuguguaucaugucagugaacgccaggaguuuauauucuuuccauuugcu

SEQ ID NO: 114822 - RNA, 52 nt, Homo Sapiens
ugggccaagcugcucaaugaaccgccaggaacugaccugcugacugcacucu

SEQ ID NO: 114823 - RNA, 64 nt, Homo Sapiens
cugugagcgcagccgaggcgcaggccgagugggccgccaggaccaagcgagguggaccccgaaa

SEQ ID NO: 114824 - RNA, 64 nt, Homo Sapiens
uggggaugcggggagauuugagaggggaaaaccccgccaggagggagagagaggcaccccucug

SEQ ID NO: 114825 - RNA, 64 nt, Homo Sapiens
agcaccccggugcggaccacagagcagacccuggcgccaggaaggagcauguguuagcgucucg

SEQ ID NO: 114826 - RNA, 64 nt, Homo Sapiens
ggagagaaacuuccagaccagccccucacaccaccgccaggagaggccuuucccaccgggagag

SEQ ID NO: 114827 - RNA, 64 nt, Homo Sapiens
uggcugcucaaguacuagccccggccccagcacccgccaggauguggagaccgaggcccaucuc

SEQ ID NO: 114828 - RNA, 64 nt, Homo Sapiens
cacauggggccacguguuggaccaaaggaacccccgccaggaccccuuccucucccaguacuuu

SEQ ID NO: 114829 - RNA, 64 nt, Homo Sapiens
cuccugccucaaagugcuccgggagaagagcauacgccaggagcccaaccgcacugaaggagug

SEQ ID NO: 114830 - RNA, 64 nt, Homo Sapiens
gcgcaggaacucaauaaaguugcggccagcuccgcgccaggaugauugugucccauucccccag

SEQ ID NO: 114831 - RNA, 64 nt, Homo Sapiens
uggguacucgcaccucuuggcuuuguugaugcuccgccaggaaggccacuugugugugcguguc

SEQ ID NO: 114832 - RNA, 64 nt, Homo Sapiens
guuuucaugcugccugugccggccugucgaugcccgccaggacuagcagaaguucuucggcccg

SEQ ID NO: 114833 - RNA, 64 nt, Homo Sapiens
guacucugacugcaacaucuuucaccccauugaucgccaggauugauuugguugaucuggcuga

SEQ ID NO: 114834 - RNA, 64 nt, Homo Sapiens
agugacaaauaagauuaauaagauuuuucaaaaucgccaggacuggugaauauaaaugaugauu

SEQ ID NO: 114835 - RNA, 64 nt, Homo Sapiens
cgacgagaaggccgaggaaucucuccggccaccccgccaggaaaaaggagggucucuugcccau

SEQ ID NO: 114836 - RNA, 64 nt, Homo Sapiens
gucuccccccacccaccuuuggcuuggggcuacgcgccaggagacucacccaccugugauagug

SEQ ID NO: 114837 - RNA, 64 nt, Homo Sapiens
aagaucugauaaaccuagguaauugucacagcgucgccaggaagccaugagcagcaguucauuu

SEQ ID NO: 114838 - RNA, 64 nt, Homo Sapiens
uccaaauuauugcuucaacccuaaugcaauaaaucgccaggauuugcuuuaaugguuuuguuuu

SEQ ID NO: 114839 - RNA, 64 nt, Homo Sapiens
gcacguucgcgccgcgccgccucugggguggguucgccaggaggcgccagcgucgccgcgaggc

SEQ ID NO: 114840 - RNA, 64 nt, Homo Sapiens
cgcugcacggucugcaggacaugucgcccuccgucgccaggaugcgccggccucguccagcucc

SEQ ID NO: 114841 - RNA, 64 nt, Homo Sapiens
aagcugacagaagcagcguuuuagguuaaagcagcgccaggaggguucugauuuccucaguccu

SEQ ID NO: 114842 - RNA, 64 nt, Homo Sapiens
gaacucuccccauuggcaaaccggacccggccgccgccaggacuguguuuccaaagguuccccg

SEQ ID NO: 114843 - RNA, 64 nt, Homo Sapiens
cccagcagcccagcccccacccuccuggcagcagcgccaggaaggcuuugacaauuaccuccgu

SEQ ID NO: 114844 - RNA, 64 nt, Homo Sapiens
ccagagccccaagcaggacgacggcuccucagagcgccaggaagcuggguuucuagaggucagg

SEQ ID NO: 114845 - RNA, 64 nt, Homo Sapiens
cgggcgcugagggccacucagcgugguacgugugcgccaggacugcugcagagcuggagggugg

SEQ ID NO: 114846 - RNA, 64 nt, Homo Sapiens
uggacuacugagcccugaagcuggugaaggugcgcgccaggaugcuccucuaccccgcccuggg

SEQ ID NO: 114847 - RNA, 64 nt, Homo Sapiens
ucagcauggagagccccugcuaauggaguacagccgccaggagcuacucaggaaggugggagag

SEQ ID NO: 114848 - RNA, 64 nt, Homo Sapiens
aaggaaggacaagaaguugucaaagaauucccaacgccaggacccacaucccuuugguauugau

SEQ ID NO: 114849 - RNA, 64 nt, Homo Sapiens
agaagacccagcuggaguucaugucgcaacagugcgccaggaccgacggccagccgcugcgcuc

SEQ ID NO: 114850 - RNA, 64 nt, Homo Sapiens
ucuagagauugaggugaaagcuucguccgagaaacgccaggacagacgauggcagaggagaggg

SEQ ID NO: 114851 - RNA, 64 nt, Homo Sapiens
ccacuggaaacgcccaccaccuggcugccaggcucgccaggagcgggccgaagacccuucuucc

SEQ ID NO: 114852 - RNA, 64 nt, Homo Sapiens
ucuaaccaaggaacaagaaucgcaggcuuaccugcgccaggaaguuucaccugucucagucuuc

SEQ ID NO: 114853 - RNA, 64 nt, Homo Sapiens
gccgguucccccgggcccggggacgaugggcucacgccaggaaccggccccacucuccggaucu

SEQ ID NO: 114854 - RNA, 64 nt, Homo Sapiens
uuuggcacaaagagcagcccaggcugccugcccgcgccaggaugugcccgccgugauggccuug

SEQ ID NO: 114855 - RNA, 64 nt, Homo Sapiens
cguggugucuccaggcuguguucugcacacaggccgccaggacuuuccagggccguaggugccu

SEQ ID NO: 114856 - RNA, 64 nt, Homo Sapiens
ugcccaggccaggggggcugcagcccucagcccccgccaggauucccgcaggcuccuggacugg

SEQ ID NO: 114857 - RNA, 64 nt, Homo Sapiens
uuuccagaauccugcaugggccaugugagaagaucgccaggaucuuccugauggaagcugacuu

SEQ ID NO: 114858 - RNA, 64 nt, Homo Sapiens
ggacucaggggcgaggaggaugacuggguccggucgccaggacugucucugaggcagaaacgcc

SEQ ID NO: 114859 - RNA, 64 nt, Homo Sapiens
gcccagccccgggcacccgccucggacgcucgggcgccaggaggcuucgcuggaggggcugggc

SEQ ID NO: 114860 - RNA, 64 nt, Homo Sapiens
uccuucccucuagcaauuucccaaguagaauguacgccaggagcugugcuaucuucucuucuau

SEQ ID NO: 114861 - RNA, 64 nt, Homo Sapiens
gccagggcuguuuuugcuaccagagggcucugagcgccaggaugacagcccguucgaaggugug

SEQ ID NO: 114862 - RNA, 64 nt, Homo Sapiens
ugacaacagucuucugcccaugucugggaacacacgccaggaggaaugucugauacccucugca

SEQ ID NO: 114863 - RNA, 64 nt, Homo Sapiens
uuggucuuuguucaucugaguugugcuggggcaacgccaggaagugcccuggguaccucugcug

SEQ ID NO: 114864 - RNA, 64 nt, Homo Sapiens
ggggaaggccaggguggaagggcggcuugagggacgccaggagaagacugaaugccaggcuagg

SEQ ID NO: 114865 - RNA, 64 nt, Homo Sapiens
ugggaaggaaggcagugccugcucugcugugagccgccaggaacccuccuccugucaauggggg

SEQ ID NO: 114866 - RNA, 64 nt, Homo Sapiens
gagaaauacuaugcauagcaaggagaugcagagccgccaggaaaauucugaguuccagcacaau

SEQ ID NO: 114867 - RNA, 64 nt, Homo Sapiens
cuuggcuguuggcagcucaguccucucccggccucgccaggagucccuccuucccucucacccc

SEQ ID NO: 114868 - RNA, 64 nt, Homo Sapiens
ccuccccgcggcggcgaugguccccaaaccgggccgccaggauccacccaacucccuuugccuc

SEQ ID NO: 114869 - RNA, 64 nt, Homo Sapiens
cccuggguuccauuccuaacuccacucuggacagcgccaggagguugcagggguccuaagaaac

SEQ ID NO: 114870 - RNA, 64 nt, Homo Sapiens
ccugcagcagauggacgcugcgggugggcuaagccgccaggaugcaaucaacacacugccaaug

SEQ ID NO: 114871 - RNA, 50 nt, Homo Sapiens
cacgucccuucucccuuccccgccaggagcgcccgcccucccgaauguag

SEQ ID NO: 114872 - RNA, 64 nt, Homo Sapiens
uccagcccgugauugacaagcuggccgaguaugucgccaggaacggccugaaguucgagaccag

SEQ ID NO: 114873 - RNA, 64 nt, Homo Sapiens
agcuuccgugccagugauucguucucuggaaacgcgccaggaaagggacauuguaguucgcaug

SEQ ID NO: 114874 - RNA, 64 nt, Homo Sapiens
ccuggccugggcacacgcacaggguggccagccccgccaggaggggucuccauggugcuaggcc

SEQ ID NO: 114875 - RNA, 64 nt, Homo Sapiens
ggcucaggccugggagucagugaggaagccaagacgccaggagagcuguaccugacaggccuuc

SEQ ID NO: 114876 - RNA, 64 nt, Homo Sapiens
cgcuuccucccgcaagcagcccggguccgcacugcgccaggagccgccugcgaccgcccgggcg

SEQ ID NO: 114877 - RNA, 64 nt, Homo Sapiens
aaauucuccugcuaacuuuuuacuggacuggcaccgccaggagaugaucagguuauuggugacu

SEQ ID NO: 114878 - RNA, 64 nt, Homo Sapiens
ucuucaccaucuuucugauuccgcacccugccuacgccaggagaaguugaggggagcaugcuuc

SEQ ID NO: 114879 - RNA, 64 nt, Homo Sapiens
gcggaguuugguggagcugcgggaaauguugaagcgccaggagagacuuuugcgcaacgaguaa

SEQ ID NO: 114880 - RNA, 64 nt, Homo Sapiens
gaguaccgagagacacggucuggacagcccaaggcgccaggaugcaaccugcuuucaccagacu

SEQ ID NO: 114881 - RNA, 53 nt, Homo Sapiens
cacagaccgaccgacagacccugcgccaggaugagcggguugcccgccgcuga

SEQ ID NO: 114882 - RNA, 64 nt, Homo Sapiens
ccccccagcgacacuaugcaaauccuggagugcccgccaggaucgaagccaugacugggugcag

SEQ ID NO: 114883 - RNA, 64 nt, Homo Sapiens
ucaccaaacccacccgcgcccugggacgcagccacgccaggaggaggacacggccgccgagagc

SEQ ID NO: 114884 - RNA, 64 nt, Homo Sapiens
gaagacuuaaccgguggccucaucaccagagcaucgccaggauuucuaaugcacucaguuuccc

SEQ ID NO: 114885 - RNA, 64 nt, Homo Sapiens
caugauggaccggugauggcggagccuugugcgucgccaggacuucucugggcuguguuuaaac

SEQ ID NO: 114886 - RNA, 64 nt, Homo Sapiens
cgccgaggaacagugcugggcaccccgccuggcccgccaggacccacccugccaacaucaaguu

SEQ ID NO: 114887 - RNA, 64 nt, Homo Sapiens
ggaccaugcagaucacuguccgaggcccccaggccgccaggaauccagccagguugaacuguag

SEQ ID NO: 114888 - RNA, 64 nt, Homo Sapiens
cccggagguagaggcgagagugucccugcugcagcgccaggaccaagcugggcccucacuggcc

SEQ ID NO: 114889 - RNA, 64 nt, Homo Sapiens
cugcccagcucaccacaucuucaucaccagcaaacgccaggacuuggcucccccauccucagaa

SEQ ID NO: 114890 - RNA, 64 nt, Homo Sapiens
gaacagcaggcccaccuaccuucaaagcugaagccgccaggaccgccaaagaaugccuugaaga

SEQ ID NO: 114891 - RNA, 64 nt, Homo Sapiens
ggugccauaucacguacaccauaugcaaguuucccgccaggagguccuccucucucuacuugaa

SEQ ID NO: 114892 - RNA, 64 nt, Homo Sapiens
aggugguuacaaaucauaacuuccugcaaaucaacgccaggagagcaacuuaccuucauuucuu

SEQ ID NO: 114893 - RNA, 64 nt, Homo Sapiens
cuggggucugggggggagcuacugggcuccugaacgccaggaacauguauccccgcaccccaga

SEQ ID NO: 114894 - RNA, 58 nt, Homo Sapiens
gcgcccuggcccuggccugagcccacgccgccaggaggcagggagggcuccgccgcgg

SEQ ID NO: 114895 - RNA, 54 nt, Homo Sapiens
cggcgggagacgagcugugagccccgccaggacuaugcucccaggccccucugc

SEQ ID NO: 114896 - RNA, 64 nt, Homo Sapiens
caacagcucccaaacccugagcaaggcaaccgaucgccaggaccaggaagcaucacccaggaga

SEQ ID NO: 114897 - RNA, 64 nt, Homo Sapiens
cuggcaugucauccucagggcgcuuccucgcucacgccaggagggacuuggaguggcgagcugg

SEQ ID NO: 114898 - RNA, 64 nt, Homo Sapiens
auggaccacaaagcagaaguggcuucuuagcuuccgccaggagcugcuccuguggguugaugga

SEQ ID NO: 114899 - RNA, 64 nt, Homo Sapiens
acuccacgccggcagccaacgcacaggaugggggcgccaggagaggggccccucucuccucuau

SEQ ID NO: 114900 - RNA, 64 nt, Homo Sapiens
ggccacgugggcccccagccagugcugcaggugccgccaggacgcgggguucagcggcuccccc

SEQ ID NO: 114901 - RNA, 64 nt, Homo Sapiens
cuucugccauccaggggugucagcccacccugaccgccaggaugaggccuguagggcccucgug

SEQ ID NO: 114902 - RNA, 64 nt, Homo Sapiens
ugcgccuucccacaggugccccacgugcugcugccgccaggauaaacuggccuggcaccuggug

SEQ ID NO: 114903 - RNA, 64 nt, Homo Sapiens
gcuccugggggugcuccugcgguucccgguggggcgccaggauggagaaaggagaucggacugg

SEQ ID NO: 114904 - RNA, 64 nt, Homo Sapiens
ucaaugcugggagagguccaguggccaaacaccccgccaggaguucccuaccucccaccaccua

SEQ ID NO: 114905 - RNA, 64 nt, Homo Sapiens
gagaagggacgggguggcugggcuagggccucgccgccaggacacuugguccccagaagauggc

SEQ ID NO: 114906 - RNA, 64 nt, Homo Sapiens
caaagauccaggaggcacuucuggcaucguuuuccgccaggaccccuuguggcaauuugagagu

SEQ ID NO: 114907 - RNA, 64 nt, Homo Sapiens
ucuaagcaaagugccccugcaggccggguucugccgccaggacugcccccuucccagagcccug

SEQ ID NO: 114908 - RNA, 64 nt, Homo Sapiens
uucuucguuccugcgcauauggccaucauccucccgccaggagcacaagacagaggggagcagu

SEQ ID NO: 114909 - RNA, 64 nt, Homo Sapiens
agagcaacgaggaaaggagacggagaguaguccgcgccaggaaggggacagcugcuuugcugcc

SEQ ID NO: 114910 - RNA, 64 nt, Homo Sapiens
agaagaaacaacaaaggcaggagaaaaacccagacgccaggaaacaaaccacccaccccauugg

SEQ ID NO: 114911 - RNA, 64 nt, Homo Sapiens
caucaccaacgggaggugacccgcuggccgcccgcgccaggagccuggacccggccucccgggg

SEQ ID NO: 114912 - RNA, 64 nt, Homo Sapiens
ggaaagugacgcgcauggacggggcccagcuaggcgccaggacuuggccucacccucuggcuga

SEQ ID NO: 114913 - RNA, 64 nt, Homo Sapiens
gggacguggcucagccagcacuuguccagcugagcgccaggauggaacacggccacaucaaaga

SEQ ID NO: 114914 - RNA, 64 nt, Homo Sapiens
aucgggggguggcucuccugccacccauggggagcgccaggagaggagggucauggaggauguu

SEQ ID NO: 114915 - RNA, 64 nt, Homo Sapiens
guuggggcagauguuacugaaccugugaaucagacgccaggagugagggcuggggagggaccua

SEQ ID NO: 114916 - RNA, 64 nt, Homo Sapiens
cuguggcugcugugggcccuugugccuggugucacgccaggagggcaaccugugcagccggcag

SEQ ID NO: 114917 - RNA, 64 nt, Homo Sapiens
cacugcucucccccuugccccgcagcccucaccccgccaggagcgcacgccgccacccccuccc

SEQ ID NO: 114918 - RNA, 64 nt, Homo Sapiens; identical to SEQ ID NO: 102816

SEQ ID NO: 114919 - RNA, 64 nt, Homo Sapiens; identical to SEQ ID NO: 102817

SEQ ID NO: 114920 - RNA, 64 nt, Homo Sapiens; identical to SEQ ID NO: 102818

SEQ ID NO: 114921 - RNA, 64 nt, Homo Sapiens; identical to SEQ ID NO: 102819

SEQ ID NO: 114922 - RNA, 64 nt, Homo Sapiens; identical to SEQ ID NO: 102820

SEQ ID NO: 114923 - RNA, 64 nt, Homo Sapiens; identical to SEQ ID NO: 102821

SEQ ID NO: 114924 - RNA, 64 nt, Homo Sapiens; identical to SEQ ID NO: 102822

SEQ ID NO: 114925 - RNA, 64 nt, Homo Sapiens; identical to SEQ ID NO: 102823

SEQ ID NO: 114926 - RNA, 64 nt, Homo Sapiens
ccuuaauauuuaucaauggauacgguguuugaagaccagcuacuuuuucaacccuuuaacuuuu

SEQ ID NO: 114927 - RNA, 64 nt, Homo Sapiens
cuauuuuuucauaaaggcaugguuuauaauuuaaaccagcuaugugucagacuuuuguuuuugg

SEQ ID NO: 114928 - RNA, 64 nt, Homo Sapiens
gagcauguuacuaaaaugcugaggauuuuguaggcuugcauaguaguuguuuuuuaacuagcug

SEQ ID NO: 114929 - RNA, 64 nt, Homo Sapiens
uaguuuguaguauuaguuuccuuuuauugguauucuugcauauacuauucauucaauaaaugac

SEQ ID NO: 114930 - RNA, 65 nt, Homo Sapiens
cugagagcggcugagggcugccucacugcaaauccuccccacagcgucagugaaagucguccuug

SEQ ID NO: 114931 - RNA, 65 nt, Homo Sapiens
uaaacaugcccgggcuucgaugugccuggaggauuuccccacagggacccacgcaccucccugua

SEQ ID NO: 114932 - RNA, 65 nt, Homo Sapiens
caacagcaccauccucuguagcagacaggccucccuccccacaggcccgcugcugcggccucuau

SEQ ID NO: 114933 - RNA, 65 nt, Homo Sapiens
uggagccuuuugaggggggccuucccucagcuguuuccccacacuggggggcugggcccugccuc

SEQ ID NO: 114934 - RNA, 65 nt, Homo Sapiens
gcauccccccacccuacaacugagcacaaccucuuuccccacagugcaauucagaauaugcucag

SEQ ID NO: 114935 - RNA, 65 nt, Homo Sapiens
uauauaugacguuguacauugcacauacccuuggauccccacaguuugguccuccucccagcuac

SEQ ID NO: 114936 - RNA, 65 nt, Homo Sapiens
ccugacuccugagcaggaccugggcccgguucagcuccccacaaggacuucucugucuggagaca

SEQ ID NO: 114937 - RNA, 65 nt, Homo Sapiens
cugccacagcugcagacugagagggugggucugaguccccacaaugucugaagcugccccuggga

SEQ ID NO: 114938 - RNA, 65 nt, Homo Sapiens
uucuagagcaaggaauugacuuuuaggagccguucuccccacaagacaccacaugacaaggggua

SEQ ID NO: 114939 - RNA, 65 nt, Homo Sapiens
gugccucucggcucagugacagccaaccugcccccuccccacaccaaucagccaggcugagcccc

SEQ ID NO: 114940 - RNA, 65 nt, Homo Sapiens
ucccucagccucaggcaguggugcucccaucuuccuccccacaacugugcucaggcuggugccag

SEQ ID NO: 114941 - RNA, 65 nt, Homo Sapiens
ucaguccaucucccucaucuccauucucaguuucuuccccacaaaauuuggaaucaaagcuuuua

SEQ ID NO: 114942 - RNA, 65 nt, Homo Sapiens
uggcaguuuuaaccaccaacguagaagcuuuuuuuuccccacaagaccauuguacugcaauacuu

SEQ ID NO: 114943 - RNA, 65 nt, Homo Sapiens
uuugaugucaaacgccuugaaaacaagccuccacuuccccacacuucccauuuacucuugagacu

SEQ ID NO: 114944 - RNA, 65 nt, Homo Sapiens
ugacaugugauggugauagucucugguucuccccauccccacaaaggcuguugaaccacagcacc

SEQ ID NO: 114945 - RNA, 65 nt, Homo Sapiens
uugucaguaucugcucugaggaaccaggucccaccuccccacaaggcaaaucuagacccauuaaa

SEQ ID NO: 114946 - RNA, 65 nt, Homo Sapiens
ucaaauagaugaucuuugacacgauuagacacuccuccccacaaaggcuuugaaaucauaaggau

SEQ ID NO: 114947 - RNA, 65 nt, Homo Sapiens
agggccccuggacugucguggcuccccucaucagcuccccacaccagucaaggcuucucagcugg

SEQ ID NO: 114948 - RNA, 65 nt, Homo Sapiens
aggugaccugcucucuuuccugggcccugccccucuccccacauguaucccucggucugaauuag

SEQ ID NO: 114949 - RNA, 65 nt, Homo Sapiens
ggaagcauuguaaggauuucuucccaucguacccuuccccacacauaccaccuuggcuucuucua

SEQ ID NO: 114950 - RNA, 65 nt, Homo Sapiens
uggauugcaguccccagucaccucuucugccagccuccccacauauggcacaacugucuaaugac

SEQ ID NO: 114951 - RNA, 65 nt, Homo Sapiens
gccuguacauccaucccaggacacagcccagccccuccccacaccauacaagguaucagaaaagu

SEQ ID NO: 114952 - RNA, 65 nt, Homo Sapiens
ucugccuuugaaaaugcuuccaaaaguagacccuguccccacacaggucaagacuacagagaagg

SEQ ID NO: 114953 - RNA, 65 nt, Homo Sapiens
aaaaauauaucugaaguuucuuguguuuuuuuuuuuccccacaaaguguguuuccacuuggagca

SEQ ID NO: 114954 - RNA, 65 nt, Homo Sapiens
uccucuugucaagguuugggaaugucaaagcccccuccccacacagggccuuuccugucccuugu

SEQ ID NO: 114955 - RNA, 65 nt, Homo Sapiens
aucuucaccccacuuccucuacccccagguucuccuccccacagccaguccccuuuccuggauuu

SEQ ID NO: 114956 - RNA, 65 nt, Homo Sapiens
aaggucuccaugcagggggaggaggccugcuucuuuccccacagcucucacgucucccuucuccc

SEQ ID NO: 114957 - RNA, 65 nt, Homo Sapiens
aggaccaccuccuuccugccucauuguaauaaaauuccccacacugaggccuucuugucuucaac

SEQ ID NO: 114958 - RNA, 65 nt, Homo Sapiens
cuaugguuucuguagaucaucgucaucuuguauauuccccacaaagccguucgcagcuuccggga

SEQ ID NO: 114959 - RNA, 65 nt, Homo Sapiens
aaaacuuggguaugagauuuaaaugaaaacauaucuccccacaaauguggguauguagccaagag

SEQ ID NO: 114960 - RNA, 65 nt, Homo Sapiens
cucugggccaagacuccuguggaggcuuuuggugguccccacagccacaguguuccagcugccug

SEQ ID NO: 114961 - RNA, 65 nt, Homo Sapiens
gagaagagaugaagagggggugcuucaugcccuguuccccacacacuagaagugcgcaugaagga

SEQ ID NO: 114962 - RNA, 65 nt, Homo Sapiens
ccaaauaagcugaaagugcagaccuggggcgcugcuccccacaguuuccccagcggccaccaacu

SEQ ID NO: 114963 - RNA, 65 nt, Homo Sapiens
uggacuccagaauucacccuaugagucaagcccccuccccacaccugggcucuuacagagccucc

SEQ ID NO: 114964 - RNA, 65 nt, Homo Sapiens
uucaagcacucaguguucugggagcuugguugaaguccccacauuguggucuuccaaaaaaaaua

SEQ ID NO: 114965 - RNA, 65 nt, Homo Sapiens
ugcucuacagggaccacggcggacuggcccuccccuccccacagcuguggucaggacugagcagg

SEQ ID NO: 114966 - RNA, 65 nt, Homo Sapiens
acuugcauagaaaaauaagacaaggcucuguuuauuccccacaaguuuugcaguguuaccagaau

SEQ ID NO: 114967 - RNA, 65 nt, Homo Sapiens
caaagccuuuauucuauauagugggccacugaaaguccccacacauuuuuucaugaaaauuauug

SEQ ID NO: 114968 - RNA, 65 nt, Homo Sapiens
uaagaccagauucuuauaucuuaauggaagaguacuccccacaccuacaguaggccuuuuguuua

SEQ ID NO: 114969 - RNA, 65 nt, Homo Sapiens
agggguuucuuggaagcuggcucaccccagccucuuccccacauuccacacacucccagcucacc

SEQ ID NO: 114970 - RNA, 65 nt, Homo Sapiens
ucaucuugccuuguggcauguuuuuaaaaauguuuuccccacaaguuccacaaaauuggaagcuu

SEQ ID NO: 114971 - RNA, 65 nt, Homo Sapiens
ccagugccacugugggugacuacucuggccucuacuccccacaccaaaaucaggcucaguucccc

SEQ ID NO: 114972 - RNA, 65 nt, Homo Sapiens
ccaucuguagaguuggaacuuaaagcaguagacaauccccacauagaaaaggggcauugagacua

SEQ ID NO: 114973 - RNA, 65 nt, Homo Sapiens
ccagguaaugccaguuugccacacuugcccccccauccccacaaauaaccaggccgagaggccac

SEQ ID NO: 114974 - RNA, 65 nt, Homo Sapiens
uacccaacuuccuguacuguacagucucucuguuguccccacaucucugcaguccugccucugcc

SEQ ID NO: 114975 - RNA, 65 nt, Homo Sapiens
cucucuugauguugaaagcagcuuuccaucacagcuccccacauuucuugacuuuccugguuaua

SEQ ID NO: 114976 - RNA, 65 nt, Homo Sapiens
agcuuucuuuccugucaacuuauuuaucccuccuuuccccacagcuguuuaguaaaucccuucag

SEQ ID NO: 114977 - RNA, 58 nt, Homo Sapiens
cagaagcacagaggggucaccacccuuguccccacaagaugucaucuuugccuacuga

SEQ ID NO: 114978 - RNA, 65 nt, Homo Sapiens
ccuguucucuaaaugucaaaucuuaauaagaauauuccccacaauguaguacauuguaccaaagu

SEQ ID NO: 114979 - RNA, 65 nt, Homo Sapiens
aucugaaguuugguauuuuuuacaaaucuuuuauuuccccacaaguaggaauaaauguaagauuu

SEQ ID NO: 114980 - RNA, 65 nt, Homo Sapiens
cccccuccaacccccacccccaggccuacccuccuuccccacaagggaacugccacauacagggc

SEQ ID NO: 114981 - RNA, 65 nt, Homo Sapiens
ucucugggcugggcagccggcgaagugagucauacuccccacaaguuagccacaauggccccccg

SEQ ID NO: 114982 - RNA, 65 nt, Homo Sapiens
gugcccgguccccacggcgcuguugcucccaccuuuccccacaggagagcccuugggagaccagc

SEQ ID NO: 114983 - RNA, 65 nt, Homo Sapiens
cccgcaccaaaggggaaacauaugcaccuggggaguccccacacaugggggucgaggguccugca

SEQ ID NO: 114984 - RNA, 65 nt, Homo Sapiens
ucgccccacagagcucuguugagagcaggccccucuccccacaccucaguguuuugggucuaggu

SEQ ID NO: 114985 - RNA, 65 nt, Homo Sapiens
cuauagccauaaaccugaagugccaauuuuuguuuuccccacauucuuaccuuuuccuauucugu

SEQ ID NO: 114986 - RNA, 65 nt, Homo Sapiens
aacuggccuuuaaugugguacaaagauaaaccuacuccccacaaggggguacucagcuccaucuc

SEQ ID NO: 114987 - RNA, 65 nt, Homo Sapiens
ccagaaacaaggaauuucuggggcagaucugaccauccccacagaagccucggugccagaguggu

SEQ ID NO: 114988 - RNA, 65 nt, Homo Sapiens
auauauuauacagcagucauucuucuuuuuuuuuuuccccacagugcccaggcuagucuuuucuu

SEQ ID NO: 114989 - RNA, 65 nt, Homo Sapiens
ugguggggaggggaggcagguguggguagcgcacauccccacagaucaaucucugcagaugacag

SEQ ID NO: 114990 - RNA, 65 nt, Homo Sapiens
caagcuguggggaggacucugccuguguccuguguuccccacagggagaggcucuggggggaugg

SEQ ID NO: 114991 - RNA, 65 nt, Homo Sapiens
ucaggcaguaguuuauucaucauuugguaagccccuccccacacuccucuaauuuaaacaaguag

SEQ ID NO: 114992 - RNA, 65 nt, Homo Sapiens
cccccacuuuuagacauaccccagagcccuguggcuccccacacccugccauaggggcaguccug

SEQ ID NO: 114993 - RNA, 65 nt, Homo Sapiens
ugaggugggauggccccaucuggauguucugcagauccccacaugggaggagauucccaaguaga

SEQ ID NO: 114994 - RNA, 65 nt, Homo Sapiens
aggagaguagcugccuguugcaccugcuccacaccuccccacagccucccugcaggugcugugug

SEQ ID NO: 114995 - RNA, 65 nt, Homo Sapiens
aaacuuacacugguuugacaguggucaguuacauguccccacaguuccaaugugccuguucacuc

SEQ ID NO: 114996 - RNA, 65 nt, Homo Sapiens
uuuggggcaagucauguaaauacuguugguggucuuccccacacgccccaauuuucagguaguac

SEQ ID NO: 114997 - RNA, 65 nt, Homo Sapiens
cagccagccccucacagcucuuccccagcuccgccuccccacacuccuccuugcgcacccacuca

SEQ ID NO: 114998 - RNA, 65 nt, Homo Sapiens
acuucccuccuuguuugucagccuccuguucauguuccccacacaccugaaggugguagaaucuu

SEQ ID NO: 114999 - RNA, 65 nt, Homo Sapiens
cuccaugaugacuuaguacaaaguuucaauuuguuuccccacaaaacaaagcaauucuuucaagu

SEQ ID NO: 115000 - RNA, 65 nt, Homo Sapiens
uugugacgcguuggugacggugcccagccugcgguuccccacagcaucgcaggcgcucggaaauc

SEQ ID NO: 115001 - RNA, 65 nt, Homo Sapiens
gugccagucgacuauuugcacuuacagggucauuguccccacaauauauuuuuagcagaacagga

SEQ ID NO: 115002 - RNA, 65 nt, Homo Sapiens
cuuuuuuaaacaaaaaacaacacagaugucuuuccuccccacaaaaucaauauuuugaagugaua

SEQ ID NO: 115003 - RNA, 65 nt, Homo Sapiens
ucagccuggggccugggcagacugggucauagcuuuccccacagcgucauugcagcucucagcaa

SEQ ID NO: 115004 - RNA, 65 nt, Homo Sapiens
gcccucgcucugucuaugcaucaguaggggcccccuccccacauggugccuaugccugggggagg

SEQ ID NO: 115005 - RNA, 65 nt, Homo Sapiens
agaauucugcccaacacagguuuuaaugggccaccuccccacaacauuccaggcuauauauuucu

SEQ ID NO: 115006 - RNA, 65 nt, Homo Sapiens
cucuggcuccacaccuccacgcuuuuuccaucuucuccccacagcguuuugacacugagcuuggg

SEQ ID NO: 115007 - RNA, 65 nt, Homo Sapiens
cccagguuggguggguuuuuuguucacacgcaugguccccacaccaaauaguuauguuggcacug

SEQ ID NO: 115008 - RNA, 65 nt, Homo Sapiens
cccaggagaaacucccgguggcccccuuccuccuguccccacacuaccguccuccgugacacacg

SEQ ID NO: 115009 - RNA, 65 nt, Homo Sapiens
ugcaugcugccaguuccuguucuguguucaccacauccccacaccccauugccacuuauuuauuc

SEQ ID NO: 115010 - RNA, 65 nt, Homo Sapiens
augugcaccagguugguguucaccagcucaugucuuccccacaucucuucuugccaguaagcagc

SEQ ID NO: 115011 - RNA, 65 nt, Homo Sapiens
agugccucugcacaccgcccauuccacuuccuccuuccccacagggcagguggggaagcaguuug

SEQ ID NO: 115012 - RNA, 65 nt, Homo Sapiens
uaccuuauuuucucuuggaacauaucugaaaaccuuccccacaaauaacuugucacaccuuuugu

SEQ ID NO: 115013 - RNA, 65 nt, Homo Sapiens
uccagcaggagcagauccaggagcagcucauaugauccccacagucgauccagguaugaacaggg

SEQ ID NO: 115014 - RNA, 65 nt, Homo Sapiens
cccugccccagccuagcugagugugcuggcaaaguuccccacaggacucagccuucucgucuuuc

SEQ ID NO: 115015 - RNA, 65 nt, Homo Sapiens
agccauggcugaacuaucagggacaaaggcccauguccccacaucccugcucccuccuuccucau

SEQ ID NO: 115016 - RNA, 65 nt, Homo Sapiens
auaacuauguaaauuguuuuugaaaauaauuuguuuccccacaacuuuugaagguuuuauuuguu

SEQ ID NO: 115017 - RNA, 65 nt, Homo Sapiens
aacauaucauaacugcacugugaugaagaagcuguuccccacagaggagaagcucugcuuucuuu

SEQ ID NO: 115018 - RNA, 65 nt, Homo Sapiens
aucuggaaaaacccaucauucuaaucuagcuuguauccccacaucaugagaaagagggaagaaga

SEQ ID NO: 115019 - RNA, 65 nt, Homo Sapiens
cagugcuguaugcggcugcagccgucucaccuguuuccccacaaagggaauuucucacucugguu

SEQ ID NO: 115020 - RNA, 65 nt, Homo Sapiens
gaauuucucugauuugugggcacaguuaugaaguuuccccacaugugaagacagguacaaaauag

SEQ ID NO: 115021 - RNA, 56 nt, Homo Sapiens
aagaagacacauacaaguaagaccuguccccacaacaaggacccuguguggagcca

SEQ ID NO: 115022 - RNA, 65 nt, Homo Sapiens
uugagcuccagcuucucugagcauccccucugcuguccccacauccugauagccccucugggagc

SEQ ID NO: 115023 - RNA, 65 nt, Homo Sapiens
agcugugcuguagccuguaauuacugacaugaagguccccacacagagucuggauggaggcugcc

SEQ ID NO: 115024 - RNA, 65 nt, Homo Sapiens
uacaaaauucucauuuaauuuucuggucagcaaguuccccacacagaaaucacucugagguuuac

SEQ ID NO: 115025 - RNA, 65 nt, Homo Sapiens
acugguaauauuuuuauuuccuauuggagagugaauccccacaguugcuuuuugugacuugauuc

SEQ ID NO: 115026 - RNA, 65 nt, Homo Sapiens
ucagggcccagaccuuccugcucuccagcaggggauccccacaaccucacacuugucuguucuuc

SEQ ID NO: 115027 - RNA, 65 nt, Homo Sapiens
caucucccuuagggacuacccauagacaugaaagguccccacagagcaagagauaagucuuucau

SEQ ID NO: 115028 - RNA, 65 nt, Homo Sapiens
ucccucaccgcgcaggacccguagagccgcgaaccuccccacaccugcccacaagccuggcagcu

SEQ ID NO: 115029 - RNA, 65 nt, Homo Sapiens
ccccaugcucaaggcccagcguguguccugcucccuccccacauuggaagccauuugcagugcug

SEQ ID NO: 115030 - RNA, 65 nt, Homo Sapiens
uuauuuuuuaaaaaccauccagagaaaaaaaaaaguccccacauuguaaaauggcugagcauugc

SEQ ID NO: 115031 - RNA, 65 nt, Homo Sapiens
guuuaucuuccgucacauugggccucaguuucucuuccccacacagggcagcuuuauuccuguug

SEQ ID NO: 115032 - RNA, 65 nt, Homo Sapiens
ugagaggcacgcaacaccuauuauuaaauaauacuuccccacagaguuauccuguaacauaaauu

SEQ ID NO: 115033 - RNA, 65 nt, Homo Sapiens
guauaagcugugccuuuacuuaaaauguacauuccuccccacaguauacuguuuuccagagguug

SEQ ID NO: 115034 - RNA, 65 nt, Homo Sapiens
gcaccuucuguagcuccagccugacccggcccaaguccccacagaggcaggugggggcuugguug

SEQ ID NO: 115035 - RNA, 52 nt, Homo Sapiens
guuuuacagaguucugaaauacuccccacacaccagaacacuagcaccauga

SEQ ID NO: 115036 - RNA, 65 nt, Homo Sapiens
uccuaagggccacuguguacuuccucccagaguccuccccacaguucauuugccuucccuaccuc

SEQ ID NO: 115037 - RNA, 65 nt, Homo Sapiens
gagaagcauucggaguguauuuaacuucucauacuuccccacauugccagacacuaggagaauua

SEQ ID NO: 115038 - RNA, 65 nt, Homo Sapiens
cuacuuuuacaaacgccuguauuaguguaacauacuccccacaguauucauuuguaaaacuuugu

SEQ ID NO: 115039 - RNA, 65 nt, Homo Sapiens
agcuaauccuaacaacuuuucuucgucuagaaccuuccccacaguuucuuuaccuggucuccuuc

SEQ ID NO: 115040 - RNA, 65 nt, Homo Sapiens
uaaauuaucagguuaaacuucaaaacuagcuuuuuuccccacaaaaggacugaacuuuuucucau

SEQ ID NO: 115041 - RNA, 65 nt, Homo Sapiens
cucucagagccucagcuucugggggagacaugcucuccccacaggggggaggcacuaagucaugg

SEQ ID NO: 115042 - RNA, 65 nt, Homo Sapiens
cacugccuucguuuauauuuuuuuaacugugauaauccccacaggcacauuaacuguugcacuuu

SEQ ID NO: 115043 - RNA, 65 nt, Homo Sapiens
agcuacuuucuguaugcacaagcuucccagcuuuguccccacaguguaccuuuuugcuaaaacac

SEQ ID NO: 115044 - RNA, 65 nt, Homo Sapiens
ugcaaugggauacuuauuaaucuggugccucaguuuccccacauguuaaaaaaaaauaauaauaa

SEQ ID NO: 115045 - RNA, 65 nt, Homo Sapiens
ggcuuuuaaaauacccaucuuuaucauuggauguuuccccacauuauaaaguaaaauaaugggca

SEQ ID NO: 115046 - RNA, 65 nt, Homo Sapiens
ucaugggaggaacccagugguuguaguuccaauaauccccacaugcacucaaaucucaucuugaa

SEQ ID NO: 115047 - RNA, 65 nt, Homo Sapiens
uacauguugguuucaucuucgcugucucucucauuuccccacaaaguguugucucacuuucugcc

SEQ ID NO: 115048 - RNA, 65 nt, Homo Sapiens
gaacagaacauagacagaagaaacaagguuuucaguccccacagauaacugaaaauuauuuaaac

SEQ ID NO: 115049 - RNA, 65 nt, Homo Sapiens
auucugcccuuguaaucggugucccuguaaaacaauccccacagauuacuuucagaaauagaugu

SEQ ID NO: 115050 - RNA, 65 nt, Homo Sapiens
ccaggacucacccucauaccaucugcugccccgcuuccccacagaacugcuuacuagcccugcgg

SEQ ID NO: 115051 - RNA, 65 nt, Homo Sapiens
gacaaagcccaucccaggagacggggugaagcuauuccccacacucuccugugaacacuggaguc

SEQ ID NO: 115052 - RNA, 65 nt, Homo Sapiens
uagagacaugcucccugcccucuccacagugcugcuccccacaccuagccuuuguucuggaaacc

SEQ ID NO: 115053 - RNA, 65 nt, Homo Sapiens
ggcagaauuucugaccccuuuggcucagcugcccuuccccacaaauaaaaaccaacaaagaggac

SEQ ID NO: 115054 - RNA, 65 nt, Homo Sapiens
agggccuacaccccucccuuuuuggggggagccuguccccacacaccuuagcacaaccagaaucu

SEQ ID NO: 115055 - RNA, 65 nt, Homo Sapiens
gucugccaguaacauguucccauguacagacacgguccccacacccucccagccucaggcccagg

SEQ ID NO: 115056 - RNA, 65 nt, Homo Sapiens
gugagcagacuuaaccccuccgugccucagcuuuuuccccacagacaccuaccucacaggggcau

SEQ ID NO: 115057 - RNA, 65 nt, Homo Sapiens
ccaccaaggacaggcagaagccggacaggggcccuuccccacaccggggagagcugcucggacag

SEQ ID NO: 115058 - RNA, 65 nt, Homo Sapiens
uaccagcaggagguucugggccucugaacccccuuuccccacaccucccccugcugcugcugccc

SEQ ID NO: 115059 - RNA, 65 nt, Homo Sapiens
cacggccaagccacgcagaaccgugggcagcccaguccccacagugcugcguuucuccuuucugu

SEQ ID NO: 115060 - RNA, 65 nt, Homo Sapiens
ggaauaguccauccccagaugagcccggcuuccacuccccacauaggccagcuuuuccucaccag

SEQ ID NO: 115061 - RNA, 65 nt, Homo Sapiens
cuggcgcucggcuccaccccccugccgucuucacuuccccacaggagggcugaguguccagcaca

SEQ ID NO: 115062 - RNA, 65 nt, Homo Sapiens
ucgcgacccuccucccgcgccuccgguccccucuuuccccacacuccccucgcccgccgccuccc

SEQ ID NO: 115063 - RNA, 65 nt, Homo Sapiens
caggcugaauuagaagccccgcacagcgcccuacuuccccacagaagcugauuuaacagcauaga

SEQ ID NO: 115064 - RNA, 65 nt, Homo Sapiens
cuggcuuagugccacccaccgcccuccacuccucauccccacaauguuacuuuggcaauuuccug

SEQ ID NO: 115065 - RNA, 61 nt, Homo Sapiens
ccacaggauggaccaaagggcaggggccugguccccacagcccuaccuuggccuugaguag

SEQ ID NO: 115066 - RNA, 65 nt, Homo Sapiens
uuccguucauugcucuccagucacaugcccccacuuccccacaggugaaaguuuuucugaaagug

SEQ ID NO: 115067 - RNA, 65 nt, Homo Sapiens
gaugcccugggaagauccuuggcugccgcuuucucuccccacagccucaaggccacccuaccguc

SEQ ID NO: 115068 - RNA, 65 nt, Homo Sapiens
ggcggcaaggggggaaugggaguugucuccccuucuccccacaccugaucugcucucggcugguc

SEQ ID NO: 115069 - RNA, 65 nt, Homo Sapiens
gagcagcacuccauaucccuuacugucaccuucacuccccacacagcucaugagaugugugaccc

SEQ ID NO: 115070 - RNA, 65 nt, Homo Sapiens
acaaaauggcguagaaugaaaugccucucacccuuuccccacagcgacuacuucccacucagagg

SEQ ID NO: 115071 - RNA, 65 nt, Homo Sapiens
gaggacacggaggguucagaccccuccucagacccuccccacaucugaaacugccuccccccaac

SEQ ID NO: 115072 - RNA, 65 nt, Homo Sapiens
ccagcagcagcagggcccuccucccccaccagcucuccccacagggccccucagcaucauggaga

SEQ ID NO: 115073 - RNA, 65 nt, Homo Sapiens
gaguauuagcuuacccaaugggaccgugccccaccuccccacacacaggccuucuguggggcugg

SEQ ID NO: 115074 - RNA, 65 nt, Homo Sapiens
ccuuccugccauugcugcaccaggacugcaaggaguccccacaccuuggcagcucagggucccca

SEQ ID NO: 115075 - RNA, 65 nt, Homo Sapiens
cacaguguaauauuucuccaaguaucauccaaaauuccccacagacaaggcuuucguccucauua

SEQ ID NO: 115076 - RNA, 65 nt, Homo Sapiens
agcaccaaauuuuguuguuuuuuuuuuuucuccccuccccacagaucccaucucaaaucauucug

SEQ ID NO: 115077 - RNA, 65 nt, Homo Sapiens
gucgcccaacuagaguguaguggcacaaucucggcuccccacaaccucugacuccaggguucagg

SEQ ID NO: 115078 - RNA, 65 nt, Homo Sapiens
acacauugguuuugagaggucugacugacaguucauccccacaaaucuauacucccugcacccuu

SEQ ID NO: 115079 - RNA, 65 nt, Homo Sapiens
uggugaaugagagagccccagcaggcucaagccccuccccacaccccugggaauuugcuggaaau

SEQ ID NO: 115080 - RNA, 65 nt, Homo Sapiens
agaaauuuaaauaaagaauuuaaagaaaaauauuuuccccacaagaauuacuuuuaagugugcuu

SEQ ID NO: 115081 - RNA, 65 nt, Homo Sapiens
ucuaaggacugggcuacccuaagggcucagggccuuccccacagacuugccacuccuagcuccag

SEQ ID NO: 115082 - RNA, 65 nt, Homo Sapiens
cacacagaacucugacacagcccuucuauugcggguccccacauguauccuggcgaacaccccua

SEQ ID NO: 115083 - RNA, 65 nt, Homo Sapiens
gaccuguguucccuccccgaccaccgugaccccuguccccacacugagacagcccacccccgugu

SEQ ID NO: 115084 - RNA, 65 nt, Homo Sapiens
uacccacccagugggcccugcuguccccaucuuccuccccacaccgcucugagcucuccucccau

SEQ ID NO: 115085 - RNA, 65 nt, Homo Sapiens
cauugggcauccuaggugaauugacccuguggagauccccacagcguucauuuggguuugcuuac

SEQ ID NO: 115086 - RNA, 65 nt, Homo Sapiens
aucuucagcugcugcccaggcagcugagcagccccuccccacauccuguccucaccuuccagccc

SEQ ID NO: 115087 - RNA, 65 nt, Homo Sapiens
cugguggacgcagagcacuuaguuacccuggacgcuccccacauccuuccagaaggagacgagcu

SEQ ID NO: 115088 - RNA, 65 nt, Homo Sapiens
ugugccuuaggaaggugugagaccggcuucccccauccccacagcaaaacacggccugucccaag

SEQ ID NO: 115089 - RNA, 65 nt, Homo Sapiens
ccacagcagugaugccagcugggcacgucaggaccuccccacacacccacacgaugccacagguc

SEQ ID NO: 115090 - RNA, 65 nt, Homo Sapiens
acaugucacuuuucuguuaagaaaacugagcccccuccccacagguuaaaaaacuuuaguaacuu

SEQ ID NO: 115091 - RNA, 65 nt, Homo Sapiens
ggaggcugucccaucucccaguccccaucucuuuuuccccacacugucccuggccaagcccugcc

SEQ ID NO: 115092 - RNA, 65 nt, Homo Sapiens
ggucuccccuaaugcgggggcuggaccaggcugaguccccacaggguccuaguggaggaugugga

SEQ ID NO: 115093 - RNA, 65 nt, Homo Sapiens
uguccccuccccagguccuucauucaccccuccccuccccacaguggaauuguugaaguguggcg

SEQ ID NO: 115094 - RNA, 65 nt, Homo Sapiens
acucggcagcccuuccaaacucuucccucucucacuccccacaucccaucgucucggccuucaca

SEQ ID NO: 115095 - RNA, 65 nt, Homo Sapiens
gcagcacagccaucacaggacccaggaggcagcucuccccacacacugaaucacugcauggaugu

SEQ ID NO: 115096 - RNA, 65 nt, Homo Sapiens
ugcucgcagccuggcggggcuccauggggaagugcuccccacacgcagccccacagcacccaggc

SEQ ID NO: 115097 - RNA, 65 nt, Homo Sapiens
guccuuuauccaccuggauuauuuauuugguacuuuccccacacaugacccuuccuuuuuaccuc

SEQ ID NO: 115098 - RNA, 65 nt, Homo Sapiens
cagagcccugaggggugggguguccucuccagcuguccccacaagcgccuccagcugaccugccc

SEQ ID NO: 115099 - RNA, 65 nt, Homo Sapiens
uuauuucaaaaaaaaucuguggcauuuuucuauuuuccccacaaaagagagggaagcagaaggca

SEQ ID NO: 115100 - RNA, 59 nt, Homo Sapiens
ccugcucccaagcucagauguggcacuccuccccacacauggagcgaaagugccccuga

SEQ ID NO: 115101 - RNA, 65 nt, Homo Sapiens
cuguccuuauuagacaccuggucuucuaccuuccuuccccacaccaccugugaaauacugacaau

SEQ ID NO: 115102 - RNA, 65 nt, Homo Sapiens
uccauaguucugccuccccacucccacaaccugguuccccacacacaucuugucgcuuuuaggac

SEQ ID NO: 115103 - RNA, 65 nt, Homo Sapiens
augaugguuuaaggugccugaugacuucucaucucuccccacaccccaugcaagcuguugaccag

SEQ ID NO: 115104 - RNA, 65 nt, Homo Sapiens
cgcaccugcuguucccacucccuccuccuuucuucuccccacaucccuauggccgcucuccagac

SEQ ID NO: 115105 - RNA, 65 nt, Homo Sapiens
ccaccgucgcccagccuggcagugcuaguggggccuccccacaggaaggcucuucuccggggcac

SEQ ID NO: 115106 - RNA, 65 nt, Homo Sapiens
gcgcccuccagagcugcggugucucccugccucauuccccacaucccacugagcaugggaccauu

SEQ ID NO: 115107 - RNA, 54 nt, Homo Sapiens
caguggguauuaaaaaauaauuucuccccacauggugggccuuugagguuccag

SEQ ID NO: 115108 - RNA, 65 nt, Homo Sapiens
agcagagcuguagcugacuguggcauuacuacgccuccccacacgcccagaccccucacuccaaa

SEQ ID NO: 115109 - RNA, 65 nt, Homo Sapiens
accagcagaagccagcagagaggcaugggacagguuccccacaagccuuagaaggaagcauggcc

SEQ ID NO: 115110 - RNA, 65 nt, Homo Sapiens
agccuggcucuaucuuccuccuugugaucgucccauccccacaucccgugcaccccccaggaccc

SEQ ID NO: 115111 - RNA, 65 nt, Homo Sapiens
acugggccuggagcccugggcggaguccccgggguuccccacacagggcacugacugauagcuua

SEQ ID NO: 115112 - RNA, 65 nt, Homo Sapiens
ugugaacuuuuuauucuuccaaagaauuguaauccuccccacacugaagucuagggguugcgaau

SEQ ID NO: 115113 - RNA, 65 nt, Homo Sapiens
uacagcaaacaaccaugugguuggauuacauggaguccccacauacucagucaguuaucaaagua

SEQ ID NO: 115114 - RNA, 65 nt, Homo Sapiens
uuuuaaacacccccaucccucgggaagcagccagcuccccacaccuuccagggcccuaggccccu

SEQ ID NO: 115115 - RNA, 65 nt, Homo Sapiens
ucagcacugcagcccaaacagugccaacagcccuguccccacaggaccugggagcccugggccag

SEQ ID NO: 115116 - RNA, 65 nt, Homo Sapiens
gcaggagaggcacagagugcccuuaagaagugcccuccccacaauagguccugaauuuuacuuug

SEQ ID NO: 115117 - RNA, 65 nt, Homo Sapiens
uaccccgagucaccggaaaaggggagcuuucuaaguccccacauucuucuacuuuugccuucuag

SEQ ID NO: 115118 - RNA, 65 nt, Homo Sapiens
gccucuaagcgugcugacauacauugcugccuuuguccccacacacagcagcagcagcagcacaa

SEQ ID NO: 115119 - RNA, 65 nt, Homo Sapiens
acuuggacagagggcccacaguagcaaagccacgcuccccacaggugaaauccaguugccauuga

SEQ ID NO: 115120 - RNA, 65 nt, Homo Sapiens
uuccggaaccuacauguauaugucagauugacauauccccacaauaggaaggcagacucuacaca

SEQ ID NO: 115121 - RNA, 65 nt, Homo Sapiens
gaaaaagugaacugcaguugaaaucuugauauuaguccccacacgauuauacuauaauucauaug

SEQ ID NO: 115122 - RNA, 65 nt, Homo Sapiens
cuuuuguagaugcauuguagacucuucuuuuuuuuuccccacaagaaaaggauuuacuauacuuc

SEQ ID NO: 115123 - RNA, 65 nt, Homo Sapiens
cuggaguggcaugguccugucacuggcccuguuucuccccacacccuucucugcccugcccuggc

SEQ ID NO: 115124 - RNA, 65 nt, Homo Sapiens
aaaaugugauuggaucgugucuucaggucccgaccuccccacaaugcccaucgugccugccgccc

SEQ ID NO: 115125 - RNA, 65 nt, Homo Sapiens
agcccccugcgcguguccacggcccggcgcuuugcuccccacaccggaaaccagggucccgggca

SEQ ID NO: 115126 - RNA, 65 nt, Homo Sapiens
aaagaugcucuccgaccuucugggggccgggccccuccccacaauugucuuuggugucagaacuu

SEQ ID NO: 115127 - RNA, 65 nt, Homo Sapiens
cacccaaaucucauguugaauuguaguucccauaauccccacauguugugggagggacccagugg

SEQ ID NO: 115128 - RNA, 65 nt, Homo Sapiens
uauuccccaccaagagauucagggucacagguuuuuccccacaccucugaacucagggccuagcc

SEQ ID NO: 115129 - RNA, 65 nt, Homo Sapiens
aaauugaccacuaggugacagaauguuugccaguauccccacaaaacaaguuaaaacuuaaguga

SEQ ID NO: 115130 - RNA, 65 nt, Homo Sapiens
ggaaaaaaaaaucuuguggauugauugcuuugccauccccacagcagcuuuugcaaauugcuuuc

SEQ ID NO: 115131 - RNA, 65 nt, Homo Sapiens
ggcccguggagacugagaucacugacucugacucauccccacagcuggcucugacaagauggucc

SEQ ID NO: 115132 - RNA, 65 nt, Homo Sapiens
ccuucuugcuggggaggggacgaguucuacccaccuccccacacuggcacucagccagcugccuc

SEQ ID NO: 115133 - RNA, 65 nt, Homo Sapiens
ccagcccgaacaccauugagggagcugggagacccuccccacagugccacccaugcagcugcucc

SEQ ID NO: 115134 - RNA, 65 nt, Homo Sapiens
cuuccccagauucucaagcagaugcccaagggagguccccacagagccagagugccugaggcuuc

SEQ ID NO: 115135 - RNA, 65 nt, Homo Sapiens
uggacauggcccggccccacugcugagugcccguguccccacagccccaugugccccaccccgcg

SEQ ID NO: 115136 - RNA, 65 nt, Homo Sapiens
agaaacacuuaacagaggcaauuaauauaauauuuuccccacaaacucugcaugcaacaguaaaa

SEQ ID NO: 115137 - RNA, 65 nt, Homo Sapiens
auuugucagagagaaaugaaucaguguuuuguguuuccccacacgaaagcaggaucucucaaugu

SEQ ID NO: 115138 - RNA, 65 nt, Homo Sapiens
cucaucagcucucuucaccggcagcuuccggccaguccccacagccagcccacuccacccugcca

SEQ ID NO: 115139 - RNA, 65 nt, Homo Sapiens
ucugaggacacacaaccacugugggggauggauccuccccacacaucggugugaggcugcagugg

SEQ ID NO: 115140 - RNA, 65 nt, Homo Sapiens
cuuccucacccuuggcuggccuuggccaccuccccuccccacagcagguggagggggaagccuga

SEQ ID NO: 115141 - RNA, 65 nt, Homo Sapiens
gcauccagaaaucgcugugcagauugcagccccauuccccacaauaucccaucuuuuccuucggc

SEQ ID NO: 115142 - RNA, 65 nt, Homo Sapiens
cccgcagagauccucuuugagccuuggcccugacauccccacaugaacucuagcccugaagucac

SEQ ID NO: 115143 - RNA, 65 nt, Homo Sapiens
agacagcuacuugggcaugaggggagggugaacaguccccacagcgugacggaggaaacagacau

SEQ ID NO: 115144 - RNA, 65 nt, Homo Sapiens
ggcuucugagaccacaaaauucccuacacuagaaguccccacaaaagcucccagagagacugccu

SEQ ID NO: 115145 - RNA, 65 nt, Homo Sapiens
uccacaaugggcucccccgcuggugaguguggcaguccccacagcccugcaaaccaacaggugca

SEQ ID NO: 115146 - RNA, 65 nt, Homo Sapiens
cuuucaucucguuuccuccacaggccagauagucuuccccacacaugaaaagagggugcagaguc

SEQ ID NO: 115147 - RNA, 65 nt, Homo Sapiens
uucccuccccuuccuccaaaacccucccucccaccuccccacacccauugagucauucacaggca

SEQ ID NO: 115148 - RNA, 65 nt, Homo Sapiens
cucucaucauauuugcaacucuucucucucuuucuuccccacacccaagaggaggauugguggua

SEQ ID NO: 115149 - RNA, 65 nt, Homo Sapiens
aauugaaguuggguuggcucuuugugaaccucucauccccacagcagaaucaccaacacucuccg

SEQ ID NO: 115150 - RNA, 65 nt, Homo Sapiens
acugugcuguauugcugcugaacuaaaugcacuuuuccccacauauggggcacuggcuucaaaca

SEQ ID NO: 115151 - RNA, 65 nt, Homo Sapiens
acucugaccacacagaaccagggcugccccuguaauccccacaguaagaaaguuguauggcauau

SEQ ID NO: 115152 - RNA, 65 nt, Homo Sapiens
uuucucgaaggugcuuggcggucuugccuucccccuccccacaggcucuccuuguggggucccag

SEQ ID NO: 115153 - RNA, 65 nt, Homo Sapiens
uuuauccaagccuccaaggugaccaugaggcugucuccccacagccaggcggacuagccuggcug

SEQ ID NO: 115154 - RNA, 65 nt, Homo Sapiens
uagcacugaguuucuuaggagcccuggcuuuguauuccccacaagaugggucuuugugggggaag

SEQ ID NO: 115155 - RNA, 65 nt, Homo Sapiens
cugcaauguuuaggaauuguggaaauuauccgagauccccacaaauuucuaggaauguauccuga

SEQ ID NO: 115156 - RNA, 65 nt, Homo Sapiens
ccaaaaccacacagcccugggcccauggcccacccuccccacaguucccacauugugucaagucu

SEQ ID NO: 115157 - RNA, 65 nt, Homo Sapiens
ccacccaaagcauacaccgcggagccugcucucccuccccacaccgccagccuggaggaggaaag

SEQ ID NO: 115158 - RNA, 65 nt, Homo Sapiens
gauagucaugcugagugugggggcguugacaccauuccccacagauuuaaaacaacaaaaaggga

SEQ ID NO: 115159 - RNA, 65 nt, Homo Sapiens
uggauuaggguuucccuccuaagcugacuucuguauccccacacugcauggagaaugggugcaaa

SEQ ID NO: 115160 - RNA, 65 nt, Homo Sapiens
aucaaugggacuauucuguuuuuuucuauuucuccuccccacacccguagccucuaucucguauu

SEQ ID NO: 115161 - RNA, 65 nt, Homo Sapiens
uaacaaauuggcggggugggcgucagcucugucauuccccacaguugggaauggggagcaaguca

SEQ ID NO: 115162 - RNA, 65 nt, Homo Sapiens
gaguugagugggagaaagaguagaagggucagauauccccacauggagucuuaucguuguacuga

SEQ ID NO: 115163 - RNA, 65 nt, Homo Sapiens
aagggagagaucagguggaguuguaaucccuauaauccccacaucaccuaaaauaucaucuugaa

SEQ ID NO: 115164 - RNA, 64 nt, Homo Sapiens
gccagaccgcagagaggcucgugcugccuggcccuccccacaaugggcccccgagccccgauag

SEQ ID NO: 115165 - RNA, 65 nt, Homo Sapiens
ggaugccuuagaagggagagcuuggggccuaucacuccccacaguagacuugggaccuuccugaa

SEQ ID NO: 115166 - RNA, 65 nt, Homo Sapiens
uauuccacuuacuccaccuuccauuccucgcccuguccccacagccgaguccugcaucagcccuu

SEQ ID NO: 115167 - RNA, 65 nt, Homo Sapiens
ggugaagggguaggaggagggcccucagcuggcccuccccacacacaggacggcaggggcacugu

SEQ ID NO: 115168 - RNA, 65 nt, Homo Sapiens
cggcguggcugugcuuccuggggaaaugaacccccuccccacagacaccacccuggguggaucga

SEQ ID NO: 115169 - RNA, 65 nt, Homo Sapiens
ccuccaugauuugggaaccagcuuaggcaaaagaguccccacaagaugaaaauaaagauccuagu

SEQ ID NO: 115170 - RNA, 65 nt, Homo Sapiens
cagguaggaaacauucacagaugaagacagcagauuccccacauucucaucuuuggccuguucaa

SEQ ID NO: 115171 - RNA, 65 nt, Homo Sapiens
caucaggguucucuuagcaacucagagaaaaaugcuccccacagcgucccuggcgcaggugggcu

SEQ ID NO: 115172 - RNA, 65 nt, Homo Sapiens
auuccaugacuucccaccgcgcccucgcuccuaccuccccacaccucucucugaguccccaggaa

SEQ ID NO: 115173 - RNA, 65 nt, Homo Sapiens
aaagcaaugugagucccagagcccgcuuuuguucuuccccacaauuccauuacuaagaaacacau

SEQ ID NO: 115174 - RNA, 65 nt, Homo Sapiens
uuuccagggccccacacucacaaaggcuccaggccuccccacagaggacccugccugagcaaggg

SEQ ID NO: 115175 - RNA, 65 nt, Homo Sapiens
aaauccccuggacuuucacuaacccucugacauacuccccacacccaguugauggcuuuccguaa

SEQ ID NO: 115176 - RNA, 65 nt, Homo Sapiens
acugguaccugggggccugaauucuggcccccggcuccccacacagcugggacuggccuggaugg

SEQ ID NO: 115177 - RNA, 65 nt, Homo Sapiens
aggguuggggcagucccaugaccccaugucccagcuccccacacagcgcugggccagagaggcau

SEQ ID NO: 115178 - RNA, 65 nt, Homo Sapiens
agcugucccacagcggucgggccugggccguuaucuccccacaacccccagccaaucaggacuuu

SEQ ID NO: 115179 - RNA, 65 nt, Homo Sapiens
agcagcugcuucggauccacacuguaucugugucauccccacauggguccucauaaaggauuauu

SEQ ID NO: 115180 - RNA, 65 nt, Homo Sapiens
ggguuuggaccauuccccccacucccuacccuuaauccccacaugggaagaagcuaucaucacag

SEQ ID NO: 115181 - RNA, 65 nt, Homo Sapiens
uguacccucaacugccuccuuuuugcagagaacgauccccacaggaacuggucuaagaacacugu

SEQ ID NO: 115182 - RNA, 65 nt, Homo Sapiens
acccaagccuagcuggguggagccucaaugccaccuccccacaccgugggcacucaccucagcag

SEQ ID NO: 115183 - RNA, 65 nt, Homo Sapiens
uucucgacugcaguggggcgcuccgacgccgccccuccccacagcccauaagggcuggcggcuuc

SEQ ID NO: 115184 - RNA, 65 nt, Homo Sapiens
agccuguuuucauaauaaacuuaucuguccccauguccccacaccgccacccaaccuaaauguac

SEQ ID NO: 115185 - RNA, 65 nt, Homo Sapiens
acacuuaacaagcaguaaagccccaguucugagccuccccacauucuugcucucaguagcgucag

SEQ ID NO: 115186 - RNA, 65 nt, Homo Sapiens
uccaggaccucuaugacacucauaagcaauuuaccuccccacauuccagguccucuuacauuuga

SEQ ID NO: 115187 - RNA, 65 nt, Homo Sapiens
cagggcguggggagaccauuggacucuggauaggguccccacaucacaccccaaagagaagaagg

SEQ ID NO: 115188 - RNA, 63 nt, Homo Sapiens
uguagccugucaccuuucuuaacucaaaagcugucuccccacagugaagccagaagccaaaua

SEQ ID NO: 115189 - RNA, 65 nt, Homo Sapiens
ccuaagcugcucccagucucuuccagguucuacccuccccacagagcucccuauacuuuucuguc

SEQ ID NO: 115190 - RNA, 65 nt, Homo Sapiens
ucucggccgcggacccgggcccggcccgcuccagauccccacagcggucagggucuucuugcgac

SEQ ID NO: 115191 - RNA, 65 nt, Homo Sapiens
cuggcucuccacaccccuccccagggucaccgaaguccccacacgacacccuccuguguaccccc

SEQ ID NO: 115192 - RNA, 65 nt, Homo Sapiens
ccagcagggugucuucuagcccuuaggguccagucuccccacacccagccagauccggacccuuc

SEQ ID NO: 115193 - RNA, 65 nt, Homo Sapiens
uagccauugaauguaaaggggcauuuacagaugaauccccacacuauuuugugccauuucuggga

SEQ ID NO: 115194 - RNA, 65 nt, Homo Sapiens
aaagaaucauccugucccaugaaugcuaaacuuaguccccacaacaugcgugggggcacuacuaa

SEQ ID NO: 115195 - RNA, 65 nt, Homo Sapiens
cccuucuuccuguaucaagaaccaaaucgccgcuuuccccacaaguaacguggcucuugcccaau

SEQ ID NO: 115196 - RNA, 65 nt, Homo Sapiens
ugugaaugagagaacagucaggcagggagcccuucuccccacagagcuuucaggagcagacagug

SEQ ID NO: 115197 - RNA, 65 nt, Homo Sapiens
cuucugccccugcccuuccucacacugacacuuuguccccacaugggguggggagcagagugccc

SEQ ID NO: 115198 - RNA, 65 nt, Homo Sapiens
ucguguugcagauggcagccuuuucuccuucauuuuccccacauuuucucuggcccucuaccuug

SEQ ID NO: 115199 - RNA, 65 nt, Homo Sapiens
caaagaacugccccaucuccucccauggccuucccuccccacaguccucacagccucucccuuaa

SEQ ID NO: 115200 - RNA, 65 nt, Homo Sapiens
gcgcgcccccucugcaauguaugccccuugccccuuccccacacuaauaauuuauauauauaaau

SEQ ID NO: 115201 - RNA, 65 nt, Homo Sapiens
accaauguuccaaauccuuuagggagaugaggguauccccacagaaaaagaggaauaauagacca

SEQ ID NO: 115202 - RNA, 65 nt, Homo Sapiens
auuuaauugugauuuuaucaccuuucccauuucuuuccccacaagcuggcauuucaguaguugcu

SEQ ID NO: 115203 - RNA, 65 nt, Homo Sapiens
gcccccagcugccuccucacaucugcccuggggacuccccacacuccggggcagaucuuuccucu

SEQ ID NO: 115204 - RNA, 65 nt, Homo Sapiens
uugggucuaaucuuuccccuugacccagaacuuccuccccacaaaaaugccuuuaaaaaccuucc

SEQ ID NO: 115205 - RNA, 65 nt, Homo Sapiens
gugauucucuuuucuuaguggaguggaauguucuauccccacaagaaggauuauaucuuauagac

SEQ ID NO: 115206 - RNA, 65 nt, Homo Sapiens
acugcuuucuaauggggagggcugagggcucccuguccccacagcagguauguugggcucugccc

SEQ ID NO: 115207 - RNA, 65 nt, Homo Sapiens
cccuguuuucucuccuaacaugcugagauucugcauccccacagccuaaacugagccaguggcca

SEQ ID NO: 115208 - RNA, 65 nt, Homo Sapiens
gggccuccguccccagguccccaguggggcagcccuccccacagacgagccccccacauggugcc

SEQ ID NO: 115209 - RNA, 65 nt, Homo Sapiens
cauuaaauucuguaaaugaaauauggguuggacaguccccacacagguuauccuuacuugagucc

SEQ ID NO: 115210 - RNA, 54 nt, Homo Sapiens
uucucuacagacuccaaaaggcuguccccacagcuuuaugguuucggcgguuga

SEQ ID NO: 115211 - RNA, 65 nt, Homo Sapiens
gaaauacuguauugaauauucuucuucuucuagaauccccacaggucacuuccuucagcaucuca

SEQ ID NO: 115212 - RNA, 65 nt, Homo Sapiens
gacagucacuuccuucagcacauuuaggacuggguuccccacaguaggaaagcuaagucuugucu

SEQ ID NO: 115213 - RNA, 65 nt, Homo Sapiens
aggaggcaaaggguaccagcuauuuuccagauaucuccccacaaaacauguagaguuuguucagc

SEQ ID NO: 115214 - RNA, 65 nt, Homo Sapiens
cccuucuacucccuguuugcugaguccuuucccuguccccacaagguugcuguccucuuggcauc

SEQ ID NO: 115215 - RNA, 65 nt, Homo Sapiens
cuuccuuugcuucucuuuucacugguccccauucuuccccacagaacgcauccauccuugggucc

SEQ ID NO: 115216 - RNA, 65 nt, Homo Sapiens
ggggauuccuggucuguaacuguucucugaccuguuccccacacuuuaauauuugacauguuugg

SEQ ID NO: 115217 - RNA, 65 nt, Homo Sapiens
cauucccaacccaauacuggucuuucuuucucuuguccccacaccggaaaggaaugcugacuuuc

SEQ ID NO: 115218 - RNA, 65 nt, Homo Sapiens
cugggugauagggcggacuuaggcccccugccccuuccccacaaaagguggcugggaggguuucc

SEQ ID NO: 115219 - RNA, 65 nt, Homo Sapiens
cauucugggagcuggggaaccuccccguuguccuguccccacagcgccugugccagcucccuucc

SEQ ID NO: 115220 - RNA, 65 nt, Homo Sapiens
gcuggcuacacugcucaggcggagugaaccucugcuccccacacagaggaggcugcagaagcaau

SEQ ID NO: 115221 - RNA, 65 nt, Homo Sapiens
cgccccugugcucugcugucggcuggcagccucccuccccacaccccccucguccacccaccccu

SEQ ID NO: 115222 - RNA, 65 nt, Homo Sapiens
cugccccagccaacgagauugugcgcucguuccgguccccacagacaggcccuguccagccccca

SEQ ID NO: 115223 - RNA, 65 nt, Homo Sapiens
gugugucacaacaggcuaggagggcggcguguucauccccacacccacgccgugugucacgggcu

SEQ ID NO: 115224 - RNA, 65 nt, Homo Sapiens
acauaucaguauuuucuaucgaaaugucucaagauuccccacacuugccgcauagugcauaggcu

SEQ ID NO: 115225 - RNA, 65 nt, Homo Sapiens
cagaggcucgaggggcucagggccucaggcacccguccccacacgagggccccgugggugggccu

SEQ ID NO: 115226 - RNA, 65 nt, Homo Sapiens
gucccauccccacguccccucaucccgucaccucguccccacauccccuugccccgucaccucgu

SEQ ID NO: 115227 - RNA, 65 nt, Homo Sapiens
uccucauccccacguccucucguccccuugucccguccccacauacccucguccccaugucccca

SEQ ID NO: 115228 - RNA, 65 nt, Homo Sapiens
uagaaauuguaguucauaugagcagcauuuguuucuccccacaucgaagcagagcagaugauucg

SEQ ID NO: 115229 - RNA, 65 nt, Homo Sapiens
cgccuaugcacaaacguggaauacagacauaugcauccccacacaucccaaaagcacacaagcac

SEQ ID NO: 115230 - RNA, 65 nt, Homo Sapiens
gccuuaagguauauuauagacagggauguuguugauccccacacuuucauugaugaccauaucuc

SEQ ID NO: 115231 - RNA, 65 nt, Homo Sapiens
caaggcccagaccuggccucugccauccucccuguuccccacagguccuccaucaccccuggugg

SEQ ID NO: 115232 - RNA, 65 nt, Homo Sapiens
uggcaccacgacugagggcucccggcucggcuucuuccccacagcaggcugcucagagggggugc

SEQ ID NO: 115233 - RNA, 65 nt, Homo Sapiens
cugugcaauguuuuaaguucacaaguuccugcuccuccccacacugagcuccuuuguuccucccc

SEQ ID NO: 115234 - RNA, 65 nt, Homo Sapiens
aggcggagagagcuggggcuagaccggagggcuucuccccacagagaguuugaagguucucggaa

SEQ ID NO: 115235 - RNA, 65 nt, Homo Sapiens
cacacacauugauccuccucccugccuccucccaauccccacagacaccccacuuccagcagagu

SEQ ID NO: 115236 - RNA, 65 nt, Homo Sapiens
agucuacagguaaggaaaucguuuguuucucucuauccccacagaguuuggccucagaacuccau

SEQ ID NO: 115237 - RNA, 65 nt, Homo Sapiens
gcagaggaaacaggccagccagccuccuccacuccuccccacagcguguucuucaugagaguacu

SEQ ID NO: 115238 - RNA, 65 nt, Homo Sapiens
ccugcagccaccucccagcaccccgcccuccauccuccccacaucggcgagaugagcuggcgcag

SEQ ID NO: 115239 - RNA, 65 nt, Homo Sapiens
cccuacauuaacaagguuaacccuacccaucccauuccccacaggcacaucccauacccucuucu

SEQ ID NO: 115240 - RNA, 65 nt, Homo Sapiens
uugcuauguuaauauuugcuaaaacaauuguguccuccccacauuggaaguagggauauuuuuau

SEQ ID NO: 115241 - RNA, 65 nt, Homo Sapiens
aucucaccauauccaucuccagcuuucuaacauccuccccacaccgagaagugauaaacaccucc

SEQ ID NO: 115242 - RNA, 65 nt, Homo Sapiens
ucccuuuccacuugccagugaggguuuuucacuucuccccacaucuguucuggaaucuuaugccc

SEQ ID NO: 115243 - RNA, 65 nt, Homo Sapiens
cggaauugcuuucuucugagccucccuuccucuccuccccacaggcaccguguguccuccccucc

SEQ ID NO: 115244 - RNA, 65 nt, Homo Sapiens
uaccuuccgguggguugcugaacuaacuggugcauuccccacacuccaucagcccggacaguggg

SEQ ID NO: 115245 - RNA, 65 nt, Homo Sapiens
cagaggaggccacagacccccagcuaaccccucccuccccacagccccccacccugccuggugug

SEQ ID NO: 115246 - RNA, 65 nt, Homo Sapiens
ccugggccccucgugucucuucuugucuucugacguccccacagcagaggcuguucuggaaggcu

SEQ ID NO: 115247 - RNA, 65 nt, Homo Sapiens
auguggucuauacuauacugugguuuguuuuccuguccccacaucugagugaaggucuugcucuu

SEQ ID NO: 115248 - RNA, 65 nt, Homo Sapiens
aguucucggaaccuccucccuaauucucccuuccuuccccacaaggccuuugagguugugacugu

SEQ ID NO: 115249 - RNA, 65 nt, Homo Sapiens
cccccugccucuagcaccucuucugucccugucauuccccacacacguccuguucaccucgagag

SEQ ID NO: 115250 - RNA, 65 nt, Homo Sapiens
gcaaaggcaaaacaagcccugauaagcaaaagcaguccccacagccacagccuggcagcucugau

SEQ ID NO: 115251 - RNA, 65 nt, Homo Sapiens
accagaaucccugauguuaaugggcucugcccucauccccacagucuugggaucucagggcacaa

SEQ ID NO: 115252 - RNA, 65 nt, Homo Sapiens
agauuggaaguugaaauggcugagauuuggugaucuccccacagcuggcucugcaaguuaccucu

SEQ ID NO: 115253 - RNA, 65 nt, Homo Sapiens
cuucuauuucuuauggggccaucuuggccucaccauccccacacgugccgaugucagguucauug

SEQ ID NO: 115254 - RNA, 65 nt, Homo Sapiens
agacacucacuauuuucaugaacaguuacccucuguccccacaaccaaagacaacucauggccuc

SEQ ID NO: 115255 - RNA, 65 nt, Homo Sapiens
uacuccaaagaacagcuggagaacagggagggaccuccccacacccuugggcucccaggacaggu

SEQ ID NO: 115256 - RNA, 65 nt, Homo Sapiens
ucuaauugacuuccacaaaacuugucuccgauagcuccccacaucggugaaaagguacaauagug

SEQ ID NO: 115257 - RNA, 65 nt, Homo Sapiens
gacugugaauauugggauuucaauaucacaccccuuccccacaagcauaaaguggcagggagaua

SEQ ID NO: 115258 - RNA, 65 nt, Homo Sapiens
augcacucagccccacagaaccucagggaccacccuccccacagugaauggggcacuccaacacc

SEQ ID NO: 115259 - RNA, 65 nt, Homo Sapiens
aggaaaaaaaagcuggauuuacugcuccucuccccuccccacaaaggauuggaacuaucaugguc

SEQ ID NO: 115260 - RNA, 65 nt, Homo Sapiens
ccugggccucucucccgcccagcauccucccugaguccccacacagggccucacucugcacccca

SEQ ID NO: 115261 - RNA, 65 nt, Homo Sapiens
aucgugggcacgggcagggcucagccgcucccaccuccccacagaagcccaggaguguguggacg

SEQ ID NO: 115262 - RNA, 65 nt, Homo Sapiens
ccuguucucggcagcuucugucgcuggcccugggguccccacagcugcagcucuccugugagguu

SEQ ID NO: 115263 - RNA, 65 nt, Homo Sapiens
ucagcgcauggucgugcggcaugcccgccgccugcuccccacacggacuccaggcgguccccacc

SEQ ID NO: 115264 - RNA, 65 nt, Homo Sapiens
ucaccugcuguuuaauagacuuggggccaugugccuccccacacaugggcaaggacagguggaau

SEQ ID NO: 115265 - RNA, 65 nt, Homo Sapiens
ccugggugugcaccugcuccgggggguggaggugcuccccacaguccgggccaggacagccucag

SEQ ID NO: 115266 - RNA, 65 nt, Homo Sapiens
ggaaccugggggcaccucguucacccuguccccacuccccacaguuuuaggaucuaaaugauugc

SEQ ID NO: 115267 - RNA, 58 nt, Homo Sapiens
uggaggugaugcugaagugagcagccccuccccacaccaguugaacugcaggaagaga

SEQ ID NO: 115268 - RNA, 65 nt, Homo Sapiens
gcugaaaucagccauagcaguugacaaaacagcuauccccacaagugaugagauagucccuuuac

SEQ ID NO: 115269 - RNA, 65 nt, Homo Sapiens
uaaaggucucaucccacaaccccugacuuccucccuccccacaucaugaaggcagaggcaugcac

SEQ ID NO: 115270 - RNA, 65 nt, Homo Sapiens
uggcgacagcggggaaaugagggcugaaaauauccuccccacaagggcaauccccgggaccugcc

SEQ ID NO: 115271 - RNA, 65 nt, Homo Sapiens
cucagaagugcgccgccaugcugccuaggguacuguccccacaucugucccaacccagcuggagg

SEQ ID NO: 115272 - RNA, 65 nt, Homo Sapiens
aggccuccccgaggcagaaguugccugguccucuguccccacagugaccugacugggggugaggg

SEQ ID NO: 115273 - RNA, 65 nt, Homo Sapiens
cugccaacugagcccgcggcucccuccgacccugcuccccacagagccucaguaaacccauggaa

SEQ ID NO: 115274 - RNA, 65 nt, Homo Sapiens
acugcgcccggccauggaccuggcugucuuuaucauccccacaaacauuuugaaacuggaauauu

SEQ ID NO: 115275 - RNA, 65 nt, Homo Sapiens
ucggcacugcccccggccuuccaugagaagccgacuccccacaccgaguuuuaaagcaaagcccu

SEQ ID NO: 115276 - RNA, 65 nt, Homo Sapiens
cacgcccgagaaagccugggggacccagacaccuguccccacagucaaagccuggggacccagac

SEQ ID NO: 115277 - RNA, 65 nt, Homo Sapiens
ccccacagucaaagccuggggacccagacauccuguccccacagucagccuccugucccugcugg

SEQ ID NO: 115278 - RNA, 65 nt, Homo Sapiens
agagcccugggcuggaggcugagcugcaucccugcuccccacauggaggacccaacaggaggccg

SEQ ID NO: 115279 - RNA, 65 nt, Homo Sapiens
caacaaagaggggaugaaucacccuuggcccagccuccccacaaagccugacccugggcagguga

SEQ ID NO: 115280 - RNA, 65 nt, Homo Sapiens
uccugcuugccaguaaagccgcuaacauccacacuuccccacauugaccacaccccaaucucaga

SEQ ID NO: 115281 - RNA, 65 nt, Homo Sapiens
cccuaguggggaggggcagcuucuccagccccuccuccccacaaccugaguggucaggagccagu

SEQ ID NO: 115282 - RNA, 65 nt, Homo Sapiens
uccagcacagcugugcucuggagcuguccggguucuccccacacuuugcggcugcuggcaggacu

SEQ ID NO: 115283 - RNA, 65 nt, Homo Sapiens
agaagagaccagcgacucccucccaccuuccuucuuccccacaacgugcugguggacagugcccc

SEQ ID NO: 115284 - RNA, 65 nt, Homo Sapiens
gugcugaggcucccugcugccuucccauuuccuccuccccacaugaagcacucugaaaccaagac

SEQ ID NO: 115285 - RNA, 65 nt, Homo Sapiens
gauuuuuguaacuucucuuucauugguguucauuuuccccacaguaagccucagagcagccaagu

SEQ ID NO: 115286 - RNA, 65 nt, Homo Sapiens
agccauucuggacaccaggggaccuggacggaggguccccacagcccgugccccacgccgccugg

SEQ ID NO: 115287 - RNA, 65 nt, Homo Sapiens
uggucuugaagccucuggugcuguuucaaccuccauccccacaggaggguggaacucccauucuc

SEQ ID NO: 115288 - RNA, 65 nt, Homo Sapiens
uuagaggguaguauaaaugagcacagugcacauuguccccacacaccugaauuuucagucacugg

SEQ ID NO: 115289 - RNA, 65 nt, Homo Sapiens
cuagaucugccucuguuuugcuggucaaaaccucuuccccacaagccagauuguuucugaggaga

SEQ ID NO: 115290 - RNA, 65 nt, Homo Sapiens
gucucuaggucuguucuucuucccuagcauccuccuccccacaucuccuuucacccucuuggcuu

SEQ ID NO: 115291 - RNA, 65 nt, Homo Sapiens
ucuaugccuuggagcuccugacugcagggacucuguccccacacucaaaaagacucagcucacuc

SEQ ID NO: 115292 - RNA, 65 nt, Homo Sapiens
gagccucccucugacacagaggagguggcuccccuuccccacaccuuagaguggcugggagggua

SEQ ID NO: 115293 - RNA, 65 nt, Homo Sapiens
ccucccucuccauaucuccuuccccuacaccucccuccccacaccucccuacuccccugggcauc

SEQ ID NO: 115294 - RNA, 65 nt, Homo Sapiens
uuuauuuuugugucugugaaagugccaagaaccccuccccacauuuguagauccaugacccuuuu

SEQ ID NO: 115295 - RNA, 65 nt, Homo Sapiens
ucagcucagagagcaccaucccgggggucagggccuccccacaggagcccugcagugugguagcg

SEQ ID NO: 115296 - RNA, 65 nt, Homo Sapiens
cuccacuccggaucgaggccuguauagggcucguuuccccacacaugccuauuucugaagaggcu

SEQ ID NO: 115297 - RNA, 65 nt, Homo Sapiens
acuuuaacaccagguuuauggaaaaugucaggccuuccccacaacuccugucuaacugcugucgc

SEQ ID NO: 115298 - RNA, 65 nt, Homo Sapiens
ggccugcccucagccccacuccuguucugcaacuguccccacaggaaggggcucuguucccugua

SEQ ID NO: 115299 - RNA, 65 nt, Homo Sapiens
uaagggauaaaggccuuuuacagaagcuaaacccuuccccacaugugguagaaugugcucuucua

SEQ ID NO: 115300 - RNA, 65 nt, Homo Sapiens
aucucagggaccaugaugucucagucacuccacgcuccccacaggccaacccuggcacaggucau

SEQ ID NO: 115301 - RNA, 65 nt, Homo Sapiens
uccacggggcuccuuucccuccgaagggcugcucuuccccacaggcgcggggacagcagcccgac

SEQ ID NO: 115302 - RNA, 65 nt, Homo Sapiens
cacacacaugcaggcggcguggucucccugcucuguccccacacguuccucacauacaggcaaga

SEQ ID NO: 115303 - RNA, 65 nt, Homo Sapiens
uuugcaccccuuuccucccccuuccccuucaccgcuccccacagcaguacugaccucgucugucc

SEQ ID NO: 115304 - RNA, 65 nt, Homo Sapiens
caaagaucccagccuagggacaucuuugacucaguuccccacacccaaaauagcaccuuacaccc

SEQ ID NO: 115305 - RNA, 56 nt, Homo Sapiens
cucaccugcacccuaggaccccucucuccccacacccccgagagaagaagcaguga

SEQ ID NO: 115306 - RNA, 65 nt, Homo Sapiens
ucucucucgggcucacccugcuuucacaccugcuguccccacagacagccuggaaggaccagguu

SEQ ID NO: 115307 - RNA, 65 nt, Homo Sapiens
caagggagcucuuccuuccaaauugccccagguccuccccacaguagagaacacagaagaaaagc

SEQ ID NO: 115308 - RNA, 65 nt, Homo Sapiens
gccucugcuugggucuauguccuggcacaccccucuccccacagagcccacaccaccugcgcaug

SEQ ID NO: 115309 - RNA, 65 nt, Homo Sapiens
acagugcccuccagaagcaggcaaaccucacaggguccccacacaugccccuuugcccgccuccu

SEQ ID NO: 115310 - RNA, 65 nt, Homo Sapiens
cccagcugccuggcugggucuccccaucagccuccuccccacaucgaggacagcugccuguuucc

SEQ ID NO: 115311 - RNA, 65 nt, Homo Sapiens
acccacccagcugcugucaucuuccccucagccucuccccacaccggccccccugggggggcugc

SEQ ID NO: 115312 - RNA, 65 nt, Homo Sapiens
uccaggaacuccacucccaggaaaacacgccccccuccccacaccggcugagauuuuucuaaauu

SEQ ID NO: 115313 - RNA, 65 nt, Homo Sapiens
cuuccacacccugugcauagcugugcccugcacuguccccacagcggccacucuccccaccacgu

SEQ ID NO: 115314 - RNA, 65 nt, Homo Sapiens
gccaggcuggcaggggccagacaggucagcccugcuccccacagggauuucuccaauguguccug

SEQ ID NO: 115315 - RNA, 65 nt, Homo Sapiens
ggcagaagagggucuccaccccuggccgcaagaacuccccacagaacccaggauccugaaauucu

SEQ ID NO: 115316 - RNA, 65 nt, Homo Sapiens
cucugcugaugcacagagcuuccacccauaccuucuccccacagcagacuacugaccuucucacc

SEQ ID NO: 115317 - RNA, 65 nt, Homo Sapiens
ugggaugggggaggcagagacuaugaggugauccguccccacacagacccagccuucugggggug

SEQ ID NO: 115318 - RNA, 65 nt, Homo Sapiens
agccacauccucacaccugaacugucaugggucauuccccacaaggugggggucucuaaagagag

SEQ ID NO: 115319 - RNA, 65 nt, Homo Sapiens
ccguguucccagccgaaccacuggcuccugcuuuuuccccacagcugucccugagcccccuaguc

SEQ ID NO: 115320 - RNA, 65 nt, Homo Sapiens
ccugaauuccacuuccaggcccuucucagaccagcuccccacauucuuggcggcaaagcccagcc

SEQ ID NO: 115321 - RNA, 65 nt, Homo Sapiens
acuaccucaccccgacccccucauucacagugcccuccccacagcgcugagaagggacguuucca

SEQ ID NO: 115322 - RNA, 65 nt, Homo Sapiens
gcccuugaaaauccaauugguuucuguuauagcaguccccacaacaucaaagaaccaccacaagu

SEQ ID NO: 115323 - RNA, 65 nt, Homo Sapiens
gcauccuccucucaucugugcucuuuggggaaagauccccacagaccagucccauaaaccuggcc

SEQ ID NO: 115324 - RNA, 65 nt, Homo Sapiens
aagggaaggcagcuggcucuagggcuuggucccccuccccacagccggcaccucagugggugggc

SEQ ID NO: 115325 - RNA, 65 nt, Homo Sapiens
gaggaggccggggcucccaggaagcggacgcccgguccccacacagcgccgcggccgccccucca

SEQ ID NO: 115326 - RNA, 65 nt, Homo Sapiens
aggaggccggcuacugaggcucccagcacgcucucuccccacaucgucugcccaucuggguuuuu

SEQ ID NO: 115327 - RNA, 65 nt, Homo Sapiens
gagcagagagcacccuggugugggggcgaguggguuccccacaaccccgcuucugugugauucug

SEQ ID NO: 115328 - RNA, 65 nt, Homo Sapiens
cugccccucgagggggcccugccugccgcggggccuccccacaagccccucccaaagcgccggcc

SEQ ID NO: 115329 - RNA, 65 nt, Homo Sapiens
ccacccugcugugcuugggaacccccacuccccacuccccacaucccaacauccuggugucuguc

SEQ ID NO: 115330 - RNA, 65 nt, Homo Sapiens
gcaggggugacguauguagaaugcuuaggguguccuccccacagagcagauacuugaaccgacuc

SEQ ID NO: 115331 - RNA, 65 nt, Homo Sapiens
ucacucauucugaguuaggaaaagacacaagaccuuccccacauccugucugccuggguuaggga

SEQ ID NO: 115332 - RNA, 65 nt, Homo Sapiens
gagcagacuggggggcuguugccccucccuccaucuccccacacccaccccaccccacagcaggg

SEQ ID NO: 115333 - RNA, 65 nt, Homo Sapiens
ugcacggggauggggggacaacuccuacccuucuuuccccacaugccccacuaaaccaucugaca

SEQ ID NO: 115334 - RNA, 65 nt, Homo Sapiens
ccauggauaccucugugauucacgcugagcccaaguccccacacuggaaaacugggaaauggcca

SEQ ID NO: 115335 - RNA, 65 nt, Homo Sapiens
agucugggggaggguccccaccuuccuguaccuccuccccacagcuugcuuuuguuguaccgucu

SEQ ID NO: 115336 - RNA, 65 nt, Homo Sapiens
accagauucuuucccauucuguccaugaaucaucuuccccacacacaaucauucauaucuacuca

SEQ ID NO: 115337 - RNA, 65 nt, Homo Sapiens
guggagcugugguuugacagcgcuggcucugcuucuccccacacacuuacauggcaaagguaaaa

SEQ ID NO: 115338 - RNA, 65 nt, Homo Sapiens
ccuggagacccccagccaaacgggucagugucucauccccacauaacacaaaaagcagccugggg

SEQ ID NO: 115339 - RNA, 65 nt, Homo Sapiens
ggcucccgugcacuagcuuguuacagcugccucuguccccacaugugggggcaccuucuccagua

SEQ ID NO: 115340 - RNA, 65 nt, Homo Sapiens
gaacugcccagccugcuccuggcccccuggaagccuccccacagcugguaaucuggacuuaagga

SEQ ID NO: 115341 - RNA, 65 nt, Homo Sapiens
cccauggcugggaggggccucugaacggaacaguguccccacagagcgaauaaagccaaggcuuc

SEQ ID NO: 115342 - RNA, 65 nt, Homo Sapiens
ucccugagaaggugucaccuuaucuguccuccucuuccccacacacuggccucugggucccccuu

SEQ ID NO: 115343 - RNA, 65 nt, Homo Sapiens
cagccuccuccuggaccucuuggcccccagccccuuccccacacagccccagaagggucccagag

SEQ ID NO: 115344 - RNA, 65 nt, Homo Sapiens
aguuccagaaguucugaggcuggacaucggcccgcuccccacaaugaaauaaaguuauuuucuca

SEQ ID NO: 115345 - RNA, 65 nt, Homo Sapiens
gucccagccaggaucccccuggaagaaaaagggcguccccacacucuaggugauaggacuuacgc

SEQ ID NO: 115346 - RNA, 65 nt, Homo Sapiens
gcccaaaguugugcagagcgcuggggacuccagacuccccacagcagcagagacucgggacugag

SEQ ID NO: 115347 - RNA, 65 nt, Homo Sapiens
caccuggcaggugcacaccaugugcaugagucacuuccccacagugcucagagaagcaaaccucu

SEQ ID NO: 115348 - RNA, 65 nt, Homo Sapiens
cuucccagcacccuuaggaaaugcgcaccaagguuuccccacauccgcauccccugcuugccacu

SEQ ID NO: 115349 - RNA, 65 nt, Homo Sapiens
ucacagcaucuuccauccccacuccacucccugcauccccacacuggaaacuguucccuggaacc

SEQ ID NO: 115350 - RNA, 65 nt, Homo Sapiens
gaccuuugcugaauuaaagugaccccaccccagucuccccacacguccaaggggacuauuccccc

SEQ ID NO: 115351 - RNA, 65 nt, Homo Sapiens
gaggccuuggcaaauguuaacagaaaccccucccuuccccacaugagaaaaagagacaaauuacc

SEQ ID NO: 115352 - RNA, 65 nt, Homo Sapiens
ccccccccccaccgaggccucagagagggggcaccuccccacacacccuggggggggccaggcuc

SEQ ID NO: 115353 - RNA, 65 nt, Homo Sapiens
cccccagccccucagcccucuuuucccuuccucuuuccccacagcccuccugcccccucucccac

SEQ ID NO: 115354 - RNA, 65 nt, Homo Sapiens
ccagccaucgccgcccgcuccccgccgggagucuuuccccacaccgugacguucgugauguccug

SEQ ID NO: 115355 - RNA, 65 nt, Homo Sapiens
cggggcagaggcccuucucugacccaagcccugcauccccacauguuacgagcaagugccggcug

SEQ ID NO: 115356 - RNA, 65 nt, Homo Sapiens
cuuucucccugccaccacucagcacccgcucugauuccccacagcucuccuucaagacccaacug

SEQ ID NO: 115357 - RNA, 65 nt, Homo Sapiens
cuuccugggaaacagauacguggacccagacugaauccccacaccggugccagcuucgccaugcc

SEQ ID NO: 115358 - RNA, 65 nt, Homo Sapiens
uuguauaaaacuuuaauuuccuccucccuuuucccuccccacauucucucuugucucuucccugc

SEQ ID NO: 115359 - RNA, 65 nt, Homo Sapiens
gcgaggggaguuaccccuaacgcccguccuaagccuccccacaaguccccuucgaggauugcacc

SEQ ID NO: 115360 - RNA, 65 nt, Homo Sapiens
agccugccaaucgaagcccgcauugguuccauccauccccacaaccugccucuggcacccccuuu

SEQ ID NO: 115361 - RNA, 65 nt, Homo Sapiens
ccgccaucucucugccccgccccgccccuccggccuccccacaccccccuugcccucacuaccug

SEQ ID NO: 115362 - RNA, 57 nt, Homo Sapiens
gccuccauccuugggccugagagccccuccccacaacucaguguccuucaaauauac

SEQ ID NO: 115363 - RNA, 65 nt, Homo Sapiens
cagcagucagggacagacauacauuucucauaccuuccccacaucugagagaugacagggaaaac

SEQ ID NO: 115364 - RNA, 65 nt, Homo Sapiens
ucggaguuuacguguugcaccuuuucacagacgguuccccacagcauccucagacagcucuguga

SEQ ID NO: 115365 - RNA, 65 nt, Homo Sapiens
ccugaguccugggaucagacaccccuucacguguauccccacacaaaugcaagcucaccaagguc

SEQ ID NO: 115366 - RNA, 65 nt, Homo Sapiens
ucuggaaguguauugggcugaggugggauuuucccuccccacagugcacugagcaauggagggug

SEQ ID NO: 115367 - RNA, 65 nt, Homo Sapiens
cugcucuguuugggugggagaagauucucuggggguccccacauccucccaaggcuccccucaca

SEQ ID NO: 115368 - RNA, 65 nt, Homo Sapiens
cagcuccaaacgccuccucuagcuggcgagaaccuuccccacacuaagcucagccugagagaagg

SEQ ID NO: 115369 - RNA, 65 nt, Homo Sapiens
aggcuuagugcuuggcucagaggguggaugucccuuccccacaauucuggggucugugaugggga

SEQ ID NO: 115370 - RNA, 65 nt, Homo Sapiens
ugcacugugguuccaguguaaggaggcugcccacauccccacaugacacugucccugagugaucc

SEQ ID NO: 115371 - RNA, 65 nt, Homo Sapiens
aaccuggguucccuuuccuuauuuuccccccacucuccccacacuuuguggccucagaauugauc

SEQ ID NO: 115372 - RNA, 65 nt, Homo Sapiens
ccugccuuugguuccuggacgugcugcucuucagguccccacagcacagcagcacgggccccacu

SEQ ID NO: 115373 - RNA, 65 nt, Homo Sapiens
cugugggagugauuggccagucuguggacauaugauccccacaaauuuucguugcaugugauggu

SEQ ID NO: 115374 - RNA, 65 nt, Homo Sapiens
cuugcuccuccugggcaucuaacggcaagggccgguccccacacuguggguggacuuggaggagg

SEQ ID NO: 115375 - RNA, 65 nt, Homo Sapiens
gucagguagagcaccagcuuuguauaccaggcuuuuccccacauuuuuacucucuuuuucuagcc

SEQ ID NO: 115376 - RNA, 65 nt, Homo Sapiens
gaaacagacagaaaggguggaguaauuuguccaaguccccacagcuagaaagugccagagucgua

SEQ ID NO: 115377 - RNA, 65 nt, Homo Sapiens
gauguuucugcaucaugucuaccagggagcaggguuccccacaguuucagaggugguccaggacc

SEQ ID NO: 115378 - RNA, 65 nt, Homo Sapiens
ucacagaaauuugugaucugaaaacccggcucccuuccccacaaggcuccugggccuccgggaag

SEQ ID NO: 115379 - RNA, 65 nt, Homo Sapiens
auucuugguucuuugagcucguuucagaggcugaguccccacaucagcuuuaguucuuggacuuc

SEQ ID NO: 115380 - RNA, 65 nt, Homo Sapiens
aggaaagcacuucauuaugucuagaaaccuuaguguccccacauguugaaucugucacucuucca

SEQ ID NO: 115381 - RNA, 51 nt, Homo Sapiens
cugcuucuccccugggcugcguccccacagcggcugaacgacuacguguga

SEQ ID NO: 115382 - RNA, 65 nt, Homo Sapiens
ugacugggcuguggagguggcagaggagugccuuauccccacacuccauaucuuagcucagagca

SEQ ID NO: 115383 - RNA, 65 nt, Homo Sapiens
acccagcaggcgcuggugcugucagcugagggcucuccccacacccggaagcagguguguccaga

SEQ ID NO: 115384 - RNA, 65 nt, Homo Sapiens
cccugggcaggaccagaggcccacauggaugccacuccccacacagcccccaggccugcccagcc

SEQ ID NO: 115385 - RNA, 65 nt, Homo Sapiens
cagcccuuccuauuuccuuuccuauuuuuuuuuucuccccacacuuucuugggacucccaccuug

SEQ ID NO: 115386 - RNA, 65 nt, Homo Sapiens
cacauugaucuaucuaaaccugguggggagaauuauccccacauugucucauggaaagacucaac

SEQ ID NO: 115387 - RNA, 65 nt, Homo Sapiens
cucacggcugaguugcugcgccugcagacggaagcuccccacaggcagagcugcuuggaugugug

SEQ ID NO: 115388 - RNA, 65 nt, Homo Sapiens
aagcugcuccuggaugcccccucaacacgggccccuccccacagagggaccugugcuggccugug

SEQ ID NO: 115389 - RNA, 65 nt, Homo Sapiens
ccgcaggacugagccuggaguccauggcaauggucuccccacagacuuguugccuuugagccaga

SEQ ID NO: 115390 - RNA, 65 nt, Homo Sapiens
gguaagaguagcuggguuuuauuccccugacccuuuccccacauuaaauuguccugcagagguuc

SEQ ID NO: 115391 - RNA, 65 nt, Homo Sapiens
ugauacggcauccugcgagaccacacccauagcucuccccacagcuggcccccgaagaauggaac

SEQ ID NO: 115392 - RNA, 65 nt, Homo Sapiens
cuagaauucucccaacauuuaacauucuggaauccuccccacauucaauauucuaguacuuucug

SEQ ID NO: 115393 - RNA, 65 nt, Homo Sapiens
ccacucugauucaccucuucccugccaccccuuccuccccacacugaccuggguauccccugccu

SEQ ID NO: 115394 - RNA, 65 nt, Homo Sapiens
gcacacuggggccccggguugcucacccagucaccuccccacaucgcaccccacgcccuguucac

SEQ ID NO: 115395 - RNA, 65 nt, Homo Sapiens
cucauuccugcagaagguuucaguggccccugcuauccccacagcgugggugcuucuguugggcc

SEQ ID NO: 115396 - RNA, 65 nt, Homo Sapiens
guggaggaagggaccuguggccagcugcccuuucguccccacacuagcugaagguuggagaaaug

SEQ ID NO: 115397 - RNA, 65 nt, Homo Sapiens
ccagccucuagggaccccuccucccuuuuuccuuguccccacacuccuacaccuaacucaccuaa

SEQ ID NO: 115398 - RNA, 65 nt, Homo Sapiens
uauuggcuuguguacaucuauaugcuaaaaugacuuccccacauugacauuugugcgccaccuuu

SEQ ID NO: 115399 - RNA, 65 nt, Homo Sapiens
caaaaacagaaaacaaacaaacaaaaaacaaaaaauccccacaacuuugucaaauaauguacagg

SEQ ID NO: 115400 - RNA, 65 nt, Homo Sapiens
agagccguauguacucagccuuuccuauugggccuuccccacaauuagaauauuuugacuuagug

SEQ ID NO: 115401 - RNA, 65 nt, Homo Sapiens
ugacuacugagggcaguucucacuaccuuccucucuccccacaugguauucucuccauagaacag

SEQ ID NO: 115402 - RNA, 65 nt, Homo Sapiens
gcaccagagguaggagaccucugccuccacccaguuccccacaaaucaauacccuaccacagauc

SEQ ID NO: 115403 - RNA, 65 nt, Homo Sapiens
ugucugauguaugaguccucuuaaggaaauauuuuuccccacaauuguucagagaauuccucuca

SEQ ID NO: 115404 - RNA, 65 nt, Homo Sapiens
gccgcccgguaauuauuugcccgguaaccaccacuuccccacaccauucacgcuuaaacaaccaa

SEQ ID NO: 115405 - RNA, 64 nt, Homo Sapiens
ugcucccccuucauucugaugccucccuggggaacaaggauaaugacuuugcaucugcaccugg

SEQ ID NO: 115406 - RNA, 64 nt, Homo Sapiens
uuugcacgaacaugcaguuauugaagauuaggaucaaggauagacaagguauaguaguuaucuu

SEQ ID NO: 115407 - RNA, 64 nt, Homo Sapiens
gggcaugugguauacugaagcaauacccguuagacaaggauauuuuacuucuuccagacaccag

SEQ ID NO: 115408 - RNA, 64 nt, Homo Sapiens
cacugccaaguagaagugacucaaaacccucugacaaggauauucccuuggcuaugguccugcc

SEQ ID NO: 115409 - RNA, 64 nt, Homo Sapiens
cauccagcaguuccuuaaauaaggucaccaaggacaaggauaucaaauaacuacuguucaaucu

SEQ ID NO: 115410 - RNA, 64 nt, Homo Sapiens
ccaaauggugcuuaucuugauugaacauucagaacaaggauauuauuuucagugauuuugugag

SEQ ID NO: 115411 - RNA, 64 nt, Homo Sapiens
gccuaguaggcugaagcuucaggacucugcaggucaaggauaugugaugagcaccggccuaagu

SEQ ID NO: 115412 - RNA, 64 nt, Homo Sapiens
aaccaaaaggcuuucagaggugugaauggaucuccaaggauaaguguaacaguuggcaacaucc

SEQ ID NO: 115413 - RNA, 64 nt, Homo Sapiens
uucuuccucugacauggggaccacacuucaaggccaaggauaguguccucaugcuccucagugu

SEQ ID NO: 115414 - RNA, 64 nt, Homo Sapiens
cugacccauauaguuuacucgucuacuuuuuguucaaggauauguaaaugaauacuuuuacaaa

SEQ ID NO: 115415 - RNA, 64 nt, Homo Sapiens
agccuguuuuuucccuuuuuauucuacccccuaccaaggauaucauccuaaguguaaaucaguu

SEQ ID NO: 115416 - RNA, 64 nt, Homo Sapiens
uuuaguuugaguggaauuugcuuuuugaauguaucaaggauauauauuaaaauuuacaaaaugu

SEQ ID NO: 115417 - RNA, 64 nt, Homo Sapiens
cauugauucuuugcuucguauacuauaguugaaccaaggauaugauuucauguaguauggcuaa

SEQ ID NO: 115418 - RNA, 64 nt, Homo Sapiens
ugagcucugaguuucucaguaauuaauggaggcucaaggauagaagccauugcccuggagauga

SEQ ID NO: 115419 - RNA, 64 nt, Homo Sapiens
gaggaggagggaagaacaaaagccaaaaacuggacaaggauagauauuuucuccuuaaagcucc

SEQ ID NO: 115420 - RNA, 64 nt, Homo Sapiens
gcuggcugcuuccaggaggguaaaauuaaaaugccaaggauaaaauggaaguuuaaauuuucuc

SEQ ID NO: 115421 - RNA, 64 nt, Homo Sapiens
guauaauacgguauuauacccgcaugugcucuagcaaggauaccaaggcaagcauacauguagc

SEQ ID NO: 115422 - RNA, 64 nt, Homo Sapiens
aucaaaugagccaucagugaggcagcaguuacuucaaggauaugauauguuaaugaauccaaag

SEQ ID NO: 115423 - RNA, 64 nt, Homo Sapiens
gcuacaaguuagcucaagcaaugugacauuauuucaaggauaugugccagggaauucaggaacc

SEQ ID NO: 115424 - RNA, 64 nt, Homo Sapiens
aagagaaaaaauauguguauaucauggaaaaagacaaggauauuuuaauaaaacauuacuuauu

SEQ ID NO: 115425 - RNA, 64 nt, Homo Sapiens
gaagaaagaauaaauuucggcuguuuuaagccaccaaggauaauugguuacagcagcucuagga

SEQ ID NO: 115426 - RNA, 64 nt, Homo Sapiens
guucuucagugaaaagcaggagaagagcccacugcaaggauagcucauuaggcacaugaccgau

SEQ ID NO: 115427 - RNA, 64 nt, Homo Sapiens
uagauacaggcacugcucugaaaaccuggcuagccaaggauauucucagaauguuaucaccugu

SEQ ID NO: 115428 - RNA, 64 nt, Homo Sapiens
ccccagaauauuuccucuugacuucuuuuuguaacaaggauaauuuagggauuuauaaaguugu

SEQ ID NO: 115429 - RNA, 64 nt, Homo Sapiens
gcugagaaaauucuggaacuauggaucuugaccccaaggauauauuauuuuauuccaagaaaga

SEQ ID NO: 115430 - RNA, 64 nt, Homo Sapiens
aaugccaucaggaaauagcuaguggcuuugggggcaaggauagaagcagacugguggcaugccc

SEQ ID NO: 115431 - RNA, 64 nt, Homo Sapiens
uucuuauuuaaucuuuucuuagacauuuauaacucaaggauaccauuaaaagguauacuuuagu

SEQ ID NO: 115432 - RNA, 64 nt, Homo Sapiens
aucucaucuagaaaaugcaaguaacaaaauuauacaaggauagaauuuuuugauguuuauauua

SEQ ID NO: 115433 - RNA, 64 nt, Homo Sapiens
uuggaauaaagcacuauguugaaggaaguucauucaaggauaaguuuuuaaaugguugaaacuu

SEQ ID NO: 115434 - RNA, 64 nt, Homo Sapiens
aaugucuggauuggccuccaaaagagaguggcaccaaggauagcccuuuguggcuucgcugauu

SEQ ID NO: 115435 - RNA, 64 nt, Homo Sapiens
ugaaaucacuacuguguuuucuguuggucaugaucaaggauauuaacuugacuuugaaauauuc

SEQ ID NO: 115436 - RNA, 64 nt, Homo Sapiens
ggcaaaaucaauuuuguaauuucuguguuacacucaaggauaaaaggucuacagguuuacauuu

SEQ ID NO: 115437 - RNA, 64 nt, Homo Sapiens
guuaggauuaauuacuuaauaaaucaaaucagcccaaggauauaagucugucgggugggggcag

SEQ ID NO: 115438 - RNA, 64 nt, Homo Sapiens
gacaguuagaccccugggugggcccugccgugggcaaggauacccgguggcuucuggcaccugg

SEQ ID NO: 115439 - RNA, 64 nt, Homo Sapiens
ccuuuccaauagccccaugaaaagaagcaucacccaaggauauuguaaaaaggauguaacaagg

SEQ ID NO: 115440 - RNA, 64 nt, Homo Sapiens
cugaaguuauguaaaauaaaagcaucugauccuucaaggauaaaguugaggaucacaugguacg

SEQ ID NO: 115441 - RNA, 55 nt, Homo Sapiens
gaaauaagucaaaaaauuaauacaccaaggauaucggcaccauuacacaaaaugc

SEQ ID NO: 115442 - RNA, 64 nt, Homo Sapiens
gcggagacucuggccaagcuagugcuuggcuuuccaaggauacuagagcaaucuagaaucuuug

SEQ ID NO: 115443 - RNA, 64 nt, Homo Sapiens
gugaucaauuuuacccuguauuauuuuuugaaaacaaggauauuaaaacaagguauauacuuua

SEQ ID NO: 115444 - RNA, 64 nt, Homo Sapiens
uggagugaaaugcuggccaggcugaggucucauacaaggauauugguugcauggcccacuugga

SEQ ID NO: 115445 - RNA, 64 nt, Homo Sapiens
cauuuaucaaagaaguuaaaaaaggucuaaaucacaaggauagauaccuucuuuacaggagagg

SEQ ID NO: 115446 - RNA, 64 nt, Homo Sapiens
uuucacuuuuguuauauagguuuaauccccaagccaaggauaguacuuaguauuucacuacacu

SEQ ID NO: 115447 - RNA, 64 nt, Homo Sapiens
ucucccucuuucucucaagaauucaaaguaugagcaaggauaccaaaaaucacauccuacuaua

SEQ ID NO: 115448 - RNA, 64 nt, Homo Sapiens
agagaaguuuccagcaaaacccucaucagcauuacaaggauauuugaacuccaugcuugauggu

SEQ ID NO: 115449 - RNA, 64 nt, Homo Sapiens
uaagagacuugccccuuuugccuauucauuaacacaaggauacauccuagaggagagauuagua

SEQ ID NO: 115450 - RNA, 64 nt, Homo Sapiens
ucagucaugaaccuguuuucucuauaaucaaggacaaggauaauaugugugucauucaugaauc

SEQ ID NO: 115451 - RNA, 64 nt, Homo Sapiens
ggguuuuaucaaaacaaaauuuuacauuugaauacaaggauaauuggauuauauugcagcauau

SEQ ID NO: 115452 - RNA, 64 nt, Homo Sapiens
aaaaaauggaagauuaaaaaucaucacaucaguccaaggauauaccuggaucauauuccgggga

SEQ ID NO: 115453 - RNA, 64 nt, Homo Sapiens
uccauaucuugauggcuuuugggagcauuucacacaaggauauaaaaugcgguuuucuuaaaug

SEQ ID NO: 115454 - RNA, 64 nt, Homo Sapiens
ucaguuuguaucaguuaauaggauguucauauuccaaggauauuaguuguuuuuuuaaucaucc

SEQ ID NO: 115455 - RNA, 64 nt, Homo Sapiens
cacuggagccguaggaggcucuucaguugggccccaaggauaaggcuacugauuugauacuaaa

SEQ ID NO: 115456 - RNA, 64 nt, Homo Sapiens
gucgcauaaccacuucuucuauccccuguacuuucaaggauaauuuaggcuacaugagauuuug

SEQ ID NO: 115457 - RNA, 64 nt, Homo Sapiens
acguuaaaaaacaacaacagaucuagagauaccucaaggauaucauuuuugauuuuguguuaca

SEQ ID NO: 115458 - RNA, 64 nt, Homo Sapiens
ggaaccacaggacuauuuggaaauucuuaucauucaaggauauuuuucuuuuuucacacaguaa

SEQ ID NO: 115459 - RNA, 57 nt, Homo Sapiens
cacuaagaauguugcaguuaagaauuacaaggauaaauuaugacuggugacauuuaa

SEQ ID NO: 115460 - RNA, 64 nt, Homo Sapiens
cuuuggcaggggugugugugcaacuggcagaaaacaaggauauggagaucgcugauuggugaca

SEQ ID NO: 115461 - RNA, 64 nt, Homo Sapiens
cuuguauauuugaaaaauaauugucugccaauaccaaggauauuggcugaaggacaaauugaaa

SEQ ID NO: 115462 - RNA, 64 nt, Homo Sapiens
uaucugggacauuauuggcaggaugagauacagacaaggauagccugacaaugguaccuauuag

SEQ ID NO: 115463 - RNA, 64 nt, Homo Sapiens
agagcugggaaauucauguguuccugauaacaagcaaggauaucuggagagcacuagaaguggu

SEQ ID NO: 115464 - RNA, 64 nt, Homo Sapiens
cucacuuugcaugaggagcucagggcuggagccacaaggauaccaaggugaccgcagggggccc

SEQ ID NO: 115465 - RNA, 64 nt, Homo Sapiens
uuaaggcauuggcuuuuaaauuaauacauauauccaaggauauguuauagcugcaguguuugaa

SEQ ID NO: 115466 - RNA, 64 nt, Homo Sapiens
cacuucaaaacugguagaauauuuauucauaugacaaggauaccugaguaaaacuauccuuuuu

SEQ ID NO: 115467 - RNA, 64 nt, Homo Sapiens
cugcgugacagaaacaccagcauauuugcaacgccaaggauauuggucuuaagugcaagagcac

SEQ ID NO: 115468 - RNA, 64 nt, Homo Sapiens
gauagaaaaagugauuucuuucaaaucaugcugacaaggauacuuagguacucuugagagcaau

SEQ ID NO: 115469 - RNA, 64 nt, Homo Sapiens
gucccuuauuugaaggcaucuacuguauugucaucaaggauacuuggagaauugugaauguaug

SEQ ID NO: 115470 - RNA, 64 nt, Homo Sapiens
acagaccaacuaggcuacauacaccguugucauccaaggauaauacccuagauagugucacaug

SEQ ID NO: 115471 - RNA, 64 nt, Homo Sapiens
cugcagcuuuacugccuuccacuuugacacgcuucaaggauauacuccuuuuccuuaccauacc

SEQ ID NO: 115472 - RNA, 64 nt, Homo Sapiens
ugccccaacgaaugcugcugaauaaguaaaauuccaaggauauaaagacucccguuucucuuaa

SEQ ID NO: 115473 - RNA, 64 nt, Homo Sapiens
agugaacauuucuccuaagauuauaaaaauaagacaaggauaucugcugucaaugauuuuauuc

SEQ ID NO: 115474 - RNA, 64 nt, Homo Sapiens
aaaucuuuugguacuaccauuuggggaagccaagcaaggauaguaaauugaccagaacacaguu

SEQ ID NO: 115475 - RNA, 64 nt, Homo Sapiens
gaauaaaaccuugucuuccauuacaauuaacagucaaggauaaaacaagcacgcgcacaaucaa

SEQ ID NO: 115476 - RNA, 59 nt, Homo Sapiens
acuugcagaaagaaauauaaaugacauuucaaggauagaaguauaccugauuuuuuuuc

SEQ ID NO: 115477 - RNA, 64 nt, Homo Sapiens
aaauuugacauuauuucuuucuuucaacuacuaucaaggauaaucuuuuccauauuacugugaa

SEQ ID NO: 115478 - RNA, 64 nt, Homo Sapiens
uuucaugucccaccauuuucgagaaagcaguuuccaaggauauggagagaaagacgaagggaga

SEQ ID NO: 115479 - RNA, 64 nt, Homo Sapiens
guauuuuaaaaugggaguuguguaauguauuuuacaaggauaauauuuuaaaauacauuauccu

SEQ ID NO: 115480 - RNA, 64 nt, Homo Sapiens
ccacauuuggguuaacuccucagauuuggaguggcaaggauaaaagugagggcagaaguagcug

SEQ ID NO: 115481 - RNA, 64 nt, Homo Sapiens
aagucguccaguagaaaugcaucuaugaggucagcaaggauaugaugagauuuugcucacaguc

SEQ ID NO: 115482 - RNA, 64 nt, Homo Sapiens
ggaauaugauuuuccagagcacuuuucucugggacaaggauaaaaaaccuucuaccuccuaccu

SEQ ID NO: 115483 - RNA, 64 nt, Homo Sapiens
auacugcguuccuuauaggucuuacaugcauaugcaaggauauuuuaucuuauucauucauuuc

SEQ ID NO: 115484 - RNA, 64 nt, Homo Sapiens
cauucagaccuguugcuaacaaauuuauauuugccaaggauauuaggcaaaagaggcuacuuga

SEQ ID NO: 115485 - RNA, 64 nt, Homo Sapiens
uucgcaccaacucaaugaacaagcugaagaaauccaaggauacagucucagaggacaccauuag

SEQ ID NO: 115486 - RNA, 64 nt, Homo Sapiens
acugaacuguaaggguuagucuucaucuguaaaacaaggauaauauaacuucucuuuggcuuuu

SEQ ID NO: 115487 - RNA, 64 nt, Homo Sapiens
auuaaaacuagaaaugacuguccccacucuauaccaaggauauuaaaaguauuucucugucagu

SEQ ID NO: 115488 - RNA, 64 nt, Homo Sapiens
uauuuuauagaugggcaacuaauccaauacugcccaaggauaggaccucaaaaaaaaaaaaaag

SEQ ID NO: 115489 - RNA, 64 nt, Homo Sapiens
ugcacuuugcucaaaauuuuaaaaauaccaaucacaaggauaauagaguagccuaaaauuacua

SEQ ID NO: 115490 - RNA, 62 nt, Homo Sapiens
uuuuacaguacaaauggugaugaucaucaggucaaggauagucuggagcaauugagauguca

SEQ ID NO: 115491 - RNA, 64 nt, Homo Sapiens
auaugcaaauugcaagauuuaaaccauucugaugcaaggauaaaccuuuacuuugacuaccagc

SEQ ID NO: 115492 - RNA, 64 nt, Homo Sapiens
ugaagaaaaggaaauaaaaacuucucagcaacaucaaggauauauguugugcaaaguucaguuu

SEQ ID NO: 115493 - RNA, 64 nt, Homo Sapiens
uuuaaaugcuuucaaaucuguaguacggcuguugcaaggauauuaaaauagauaaaguauaaag

SEQ ID NO: 115494 - RNA, 64 nt, Homo Sapiens
ugaaacugggucucccugggccucucagcaucaucaaggauaaccauguucguggugcugaaug

SEQ ID NO: 115495 - RNA, 64 nt, Homo Sapiens
cuuuuaacuucuucccuucauucuugaauggcuccaaggauacccacacacacacacacacccc

SEQ ID NO: 115496 - RNA, 64 nt, Homo Sapiens
aucuuccuaaucuguuaauggucagugguguccccaaggauagugcuggcuuccauggaaaccc

SEQ ID NO: 115497 - RNA, 64 nt, Homo Sapiens
cuuuauucugcaagcaauacugauucagagcuuucaaggauaggaccacugagcucacugccca

SEQ ID NO: 115498 - RNA, 64 nt, Homo Sapiens
cuuuauucugcaagcaaucaugaugcagagcuuucaaggauaggaccacugagcucacugccca

SEQ ID NO: 115499 - RNA, 64 nt, Homo Sapiens
gagaaacuaugugacucauuuuaaaauaccugcacaaggauagagaacuguuuugaauaaggau

SEQ ID NO: 115500 - RNA, 64 nt, Homo Sapiens
ccaaagcccuuaagaccucaccagcgcucgugaccaaggauacacaggaacucugcuuccuggc

SEQ ID NO: 115501 - RNA, 64 nt, Homo Sapiens
aauaguucuggccagaaucaaagauucagcccuacaaggauauguuuuccugugaaauuaucua

SEQ ID NO: 115502 - RNA, 64 nt, Homo Sapiens
ccucuacuagguggcugugauuaaaugucccaagcaaggauagggaaggggaaugguugagccu

SEQ ID NO: 115503 - RNA, 64 nt, Homo Sapiens
aaaacugaagcuuuuuauuuaggcuuuuccaaaucaaggauaaauaucuuacgcacgauaucua

SEQ ID NO: 115504 - RNA, 64 nt, Homo Sapiens
cuaacagacggucacaaccagugccauggaaaaccaaggauauuagcaaaagcagaaguugcua

SEQ ID NO: 115505 - RNA, 64 nt, Homo Sapiens
ggggagcacacagggcccggcagcccccaggaaucaaggauagggcuaagguuuucaccuuaac

SEQ ID NO: 115506 - RNA, 64 nt, Homo Sapiens
aaaccaaacacugcauauucugagcaaacuaucgcaaggauagagaagcuggaaaccaucauuc

SEQ ID NO: 115507 - RNA, 64 nt, Homo Sapiens
gguuuuucucauguaucuuuuaaguauuaacuuacaaggauauaaaaugguuucugaaaauguu

SEQ ID NO: 115508 - RNA, 64 nt, Homo Sapiens
caugauucuuaaccaggcuaauccuucggagagacaaggauaugcccaagggccagcucaguuu

SEQ ID NO: 115509 - RNA, 64 nt, Homo Sapiens
ugcuggcccagggcccagagggacagaugccacacaaggauagaggugccccaggaccagcuca

SEQ ID NO: 115510 - RNA, 64 nt, Homo Sapiens
ggaaggguaugccuuuggguuguaaggccuaugccaaggauaaaccauggccuuuccucagugu

SEQ ID NO: 115511 - RNA, 64 nt, Homo Sapiens
caugauucagggaaugaagaaguccuauaaaaagcaaggauauggcuaaugguuguuuucugug

SEQ ID NO: 115512 - RNA, 64 nt, Homo Sapiens
ucuucugaagaucaaggcaaaacccagggacacccaaggauaugaccccucaauggacucucuc

SEQ ID NO: 115513 - RNA, 64 nt, Homo Sapiens
uauaagaccacugcuuaucuaagggaaaaagcugcaaggauauauaacaaaauauguauguccg

SEQ ID NO: 115514 - RNA, 64 nt, Homo Sapiens
uuucaaauguaugcuuaagcgauaagaaacagaccaaggauaacgauuagauguggaagggaag

SEQ ID NO: 115515 - RNA, 52 nt, Homo Sapiens
uauguaaauacggggcgggcuccaaggauaaguccugcaaaaacugaguuag

SEQ ID NO: 115516 - RNA, 64 nt, Homo Sapiens
aaaagagcuauuguaaauauauggaauuaguagacaaggauauuacccagaaaagacagaggug

SEQ ID NO: 115517 - RNA, 64 nt, Homo Sapiens
ugggauagauaacugagaggcucagaaucuuuaccaaggauauuuuuuaggauaagguagcugc

SEQ ID NO: 115518 - RNA, 64 nt, Homo Sapiens
uagucucuuguuuaaaaaaucuggagcgggaaugcaaggauacaaaacuuuagcaugcuuugag

SEQ ID NO: 115519 - RNA, 64 nt, Homo Sapiens
gguuucagucaucaacuacccaugaauuccugcccaaggauacuuaaucaggauuaaauuuucu

SEQ ID NO: 115520 - RNA, 64 nt, Homo Sapiens
guacuaguuguuaaaauggagcuuuuccuaaggccaaggauaauaacacauagaacugauggag

SEQ ID NO: 115521 - RNA, 64 nt, Homo Sapiens
agcugcagugguauuaauuucuuuugccauuagccaaggauagauuuuccagguacccuucucg

SEQ ID NO: 115522 - RNA, 64 nt, Homo Sapiens
aucauugccuuguguuacagcaauuccuuuuuagcaaggauaaagaaggcauuaaaaagaagug

SEQ ID NO: 115523 - RNA, 64 nt, Homo Sapiens
ugacucuccaauagguucuucucucuuggagagccaaggauaagcccgacauggugcuaguuuc

SEQ ID NO: 115524 - RNA, 64 nt, Homo Sapiens
aacguuuugauuuauaguaccaagugcuuaaacacaaggauaguguuagauuuucgagugacuu

SEQ ID NO: 115525 - RNA, 64 nt, Homo Sapiens
uuuucuuuucuuaguucauauuugcauuuucguucaaggauaugcuuagcaauaaaauguucuu

SEQ ID NO: 115526 - RNA, 64 nt, Homo Sapiens
cccagcaaauccuagaaguggagucuggauacuucaaggauagaaguguuggcacgcacagcca

SEQ ID NO: 115527 - RNA, 64 nt, Homo Sapiens
accuuucacgcaagugccaucuugccuucccgggcaaggauaggaagaguuggauuggacccua

SEQ ID NO: 115528 - RNA, 64 nt, Homo Sapiens
uuuguggucuucugugauuauuuaugcugccucccaaggauagaauugaaauaaaauguuuuca

SEQ ID NO: 115529 - RNA, 64 nt, Homo Sapiens
aagaaaauagaagguaaagagaaaaaaaagaaagcaaggauacuaaagaucgucugagaaaucu

SEQ ID NO: 115530 - RNA, 64 nt, Homo Sapiens
ucccuaaccucacucagucauuguucagaauccccaaggauauuuuaaguuucuaagggucuag

SEQ ID NO: 115531 - RNA, 64 nt, Homo Sapiens
uuuuacaagugguuuucuuauugaaguccguauacaaggauauaauuuuuuguaugaucaguuu

SEQ ID NO: 115532 - RNA, 64 nt, Homo Sapiens
ugcagagcccagagcccuucaucucucugagggucaaggauaccaggggucccaagucacagau

SEQ ID NO: 115533 - RNA, 64 nt, Homo Sapiens
gccuggccuguccucuaagucaaguuuaggaaaacaaggauaagauucugucauaggcauagag

SEQ ID NO: 115534 - RNA, 64 nt, Homo Sapiens
ugagaauguaaauaaaugugucuucuuuauggaccaaggauaugaaaucauuuuucuuuuguag

SEQ ID NO: 115535 - RNA, 64 nt, Homo Sapiens
cagaggaguuuaacgcgaucuucacauuuuacgacaaggauagaagcggcuacauugacgagca

SEQ ID NO: 115536 - RNA, 64 nt, Homo Sapiens
aaaaacuacauaaaaggccuaaaaguaagacccacaaggauauuccuuugcccuucuuguacuu

SEQ ID NO: 115537 - RNA, 64 nt, Homo Sapiens
uuuaucuuuucuuugaauaagaaaaaguaucuagcaaggauauuacuugugccuugaggcuagc

SEQ ID NO: 115538 - RNA, 64 nt, Homo Sapiens
uguccccuuguucucucugcucagaaccccacggcaaggauauagauuuggcccucauuuuccc

SEQ ID NO: 115539 - RNA, 64 nt, Homo Sapiens
aaauacuucacugccgggcaugucuaacacauuucaaggauagagggguuuccccucaggaauu

SEQ ID NO: 115540 - RNA, 64 nt, Homo Sapiens
gggagccggcggccucucgaacguggacaugccucaaggauacauuccaaccuccugcucuggg

SEQ ID NO: 115541 - RNA, 64 nt, Homo Sapiens
ggacacaccucugcuccaaagcuagcuagccagccaaggauaccgcauacuugugaacuaccuu

SEQ ID NO: 115542 - RNA, 64 nt, Homo Sapiens
ggaaaaaacccaaagaaccaaaaacaaaccaccccaaggauaauaauagcuacacugcuagcuu

SEQ ID NO: 115543 - RNA, 64 nt, Homo Sapiens
aacaggcacuguuagaugaaguaaaugauuucaacaaggauauuuguaucaggguucuacuuca

SEQ ID NO: 115544 - RNA, 64 nt, Homo Sapiens
cguugcugaacaagcgugugaaaucauuucagaucaaggauaagccaguguguacauauguuca

SEQ ID NO: 115545 - RNA, 64 nt, Homo Sapiens
uuauugggcauuugaugagguuuggcauggacuucaaggauaaaugaaugaaaacuuugcacca

SEQ ID NO: 115546 - RNA, 64 nt, Homo Sapiens
ucuuguguggucccagaaggagaagugaguuugccaaggauauggggcaggaggcucccucugc

SEQ ID NO: 115547 - RNA, 64 nt, Homo Sapiens
cguaugauguaugggguaucccucuauauagaaucaaggauaucuucagauugccauggggauu

SEQ ID NO: 115548 - RNA, 64 nt, Homo Sapiens
gauaaaaccuuuuuaauaagugaugcagagcagccaaggauauguugacccagaugucaaccag

SEQ ID NO: 115549 - RNA, 64 nt, Homo Sapiens
acagaagaagcuugugguauaucuauucuuaauucaaggauaaauaucaggggcauaaaaggcu

SEQ ID NO: 115550 - RNA, 64 nt, Homo Sapiens
cugucaacauuagaucaaugagacagaaaguuaacaaggauauccaggaauugaacacagcucu

SEQ ID NO: 115551 - RNA, 64 nt, Homo Sapiens
uugcaacagcuacagucuaaaauugcuucuuuaccaaggauauuuacagaaaagacucugacca

SEQ ID NO: 115552 - RNA, 64 nt, Homo Sapiens
uuuuuuguuauccuuugauuuuguuuaugaaaagcaaggauagcuuaauuuucaaaaacucaau

SEQ ID NO: 115553 - RNA, 64 nt, Homo Sapiens
uuuacuuauuugcuccuuguagagcugccuuuuccaaggauaccauaaacuccugagagcaggg

SEQ ID NO: 115554 - RNA, 64 nt, Homo Sapiens
uaaggcacuguggugguuaugacacgaaagcaagcaaggauauauugauccuggcauucuggaa

SEQ ID NO: 115555 - RNA, 64 nt, Homo Sapiens
ccagcauuugcgugaguaucgcuauggaggacuacaaggauaacgccccgaguuagaaaaagua

SEQ ID NO: 115556 - RNA, 64 nt, Homo Sapiens
auucaaaggagcucacauuuacagauccccccagcaaggauaaccagcccccaggccugggggc

SEQ ID NO: 115557 - RNA, 64 nt, Homo Sapiens
ccuuggccccgauuccggauccuugucgugcggucaaggauacaguucagguccgcccauuacu

SEQ ID NO: 115558 - RNA, 64 nt, Homo Sapiens
caaauuccccuaaagguucccagacugacaguuucaaggauaccucucagggguagugaagcug

SEQ ID NO: 115559 - RNA, 64 nt, Homo Sapiens
aaacggcagucauuuguucuccucggcucuguggcaaggauagcccuuuggagggggacucuug

SEQ ID NO: 115560 - RNA, 64 nt, Homo Sapiens
ucaccagccuguuguuuuaagagagaaaaaaaaucaaggauaucugauuggagcaaaccacuuc

SEQ ID NO: 115561 - RNA, 64 nt, Homo Sapiens
uauguaauaagaaacuuugcauuuugcuuuuuaacaaggauauuuuauauuguacaggaucaau

SEQ ID NO: 115562 - RNA, 64 nt, Homo Sapiens
ugcugaguuuugaugucaaaguguauauauagaccaaggauauguuguuuuaugaaacuuucac

SEQ ID NO: 115563 - RNA, 64 nt, Homo Sapiens
uuucuucgguaucuuuuaauuauaauucaaagaacaaggauagccauugcaaccucugugcuuu

SEQ ID NO: 115564 - RNA, 64 nt, Homo Sapiens
ggcuguuuucugucuuauuucucaguugagugagcaaggauacgaaaacaguguguuugaaaac

SEQ ID NO: 115565 - RNA, 64 nt, Homo Sapiens
agaaguuuuuuuuuauuuaaacucuauucaagugcaaggauaucugauuuuggaauucaggugc

SEQ ID NO: 115566 - RNA, 64 nt, Homo Sapiens
ggggcacggggccuccgagcuccagcuccguucccaaggauacucgugaagaccccaucugugu

SEQ ID NO: 115567 - RNA, 64 nt, Homo Sapiens
ucacucagcaaccaugcccuuagucugaagauaacaaggauacuuuaauauccagugccgguuc

SEQ ID NO: 115568 - RNA, 64 nt, Homo Sapiens
caaauuagaaaauccuauguccuaguuuccuuaccaaggauaauuaaauauaucacuaagagcu

SEQ ID NO: 115569 - RNA, 64 nt, Homo Sapiens
acaugguuagaaauuuaaagcaagaucauuuacccaaggauagguguuugguaauguugaagga

SEQ ID NO: 115570 - RNA, 64 nt, Homo Sapiens
ucauuggagcaaguguuggaucugaaguugaaaacaaggauauaauguaaaugucuguugaauu

SEQ ID NO: 115571 - RNA, 64 nt, Homo Sapiens
uguggagaaaaugaugagaagaacaaaaaagcugcaaggauaaaguuaacaggaauaaauauau

SEQ ID NO: 115572 - RNA, 64 nt, Homo Sapiens
aggaauauaaaaauucucaauugugcaaguacuucaaggauagccuuuuucuccuaggagcaac

SEQ ID NO: 115573 - RNA, 64 nt, Homo Sapiens
ugcauuuagccuggagccccgggaaaacauuaaucaaggauacugagggugauucccaguggug

SEQ ID NO: 115574 - RNA, 64 nt, Homo Sapiens
uuauagagcaguuggaggaaaagggggcuggagacaaggauaagcacagaaucuccugauagua

SEQ ID NO: 115575 - RNA, 64 nt, Homo Sapiens
gugaagaaauaggaaagaagaaguuaccauuaaccaaggauaugagagaacaaggaguuaaaag

SEQ ID NO: 115576 - RNA, 64 nt, Homo Sapiens
gcauuuuuuuuuucuuugaacuggaaaugauguaguucaggaaauccuuguguggcugaugugu

SEQ ID NO: 115577 - RNA, 64 nt, Homo Sapiens
gagggguauguuugucucccgugguggggauccaguucaggaggguccaguggccuuuggaaag

SEQ ID NO: 115578 - RNA, 64 nt, Homo Sapiens
uuuuguuuuguguuuuaaauguacugugacuuuaguucaggaaguguccaucccauucuauucu

SEQ ID NO: 115579 - RNA, 64 nt, Homo Sapiens
aaacacuaaaacgauuugagagugaacacagcuuguucaggaacgguuuaaguguucauguucu

SEQ ID NO: 115580 - RNA, 64 nt, Homo Sapiens
ccugcuuuugucaccuacuacugagcccaccacuguucaggaccaaggaaaaaacuccaauccc

SEQ ID NO: 115581 - RNA, 64 nt, Homo Sapiens
ucuaccccagcgagagcacacccucauccuccugguucaggaccgcgcccggccgaccugcuug

SEQ ID NO: 115582 - RNA, 64 nt, Homo Sapiens
cuuuuccuuuuguuuucauaauauaaugcaguuuguucaggaaaucagcacaaagccugauagu

SEQ ID NO: 115583 - RNA, 64 nt, Homo Sapiens
auauaauuaauuuaaauuuguuacagguuuucauguucaggauaaaccauacuuccaccuuggg

SEQ ID NO: 115584 - RNA, 64 nt, Homo Sapiens
gagaaaucagaaugaugcaaugugagaaacugauguucaggagacuucggauaauauagacagg

SEQ ID NO: 115585 - RNA, 64 nt, Homo Sapiens
uauaaaguuguuuuuuuaaaaauauguaaauaauguucaggaaaaacgcagggaacagagucuu

SEQ ID NO: 115586 - RNA, 64 nt, Homo Sapiens
guucucuugugcaacagcaaagggcuuccugagaguucaggaaauguccucgauaggccaugca

SEQ ID NO: 115587 - RNA, 64 nt, Homo Sapiens
ccuguucuucccagcauggcaagaccaccuucuaguucaggacuaaucgguacgccaugguuug

SEQ ID NO: 115588 - RNA, 64 nt, Homo Sapiens
cagugccccaccuuuuaucuuaguaggcucaaauguucaggaagcacagggauggaaaccucuu

SEQ ID NO: 115589 - RNA, 64 nt, Homo Sapiens
guugcuuucccaguagaagauguagcuaaaaaaaguucaggaucuggugacaaaugugcucccu

SEQ ID NO: 115590 - RNA, 64 nt, Homo Sapiens
uccccuguaggaggccagggaggggaacucagcaguucaggagccaccccaaaccauucuggga

SEQ ID NO: 115591 - RNA, 64 nt, Homo Sapiens
cacauugggaggccaaggcaggcacaucaccugaguucaggaguucaagaccagccuggccaac

SEQ ID NO: 115592 - RNA, 64 nt, Homo Sapiens
gcugccauauccugcuggcuccuugcuugauuucccucagcaaacccuugaacuugcuaggcca

SEQ ID NO: 115593 - RNA, 64 nt, Homo Sapiens
gaaggcaaguggugauggcgccacugcacuccuaccucagcaacagaguaagacucugucccaa

SEQ ID NO: 115594 - RNA, 64 nt, Homo Sapiens
gcugggagugguuagccggaauacuggggccugcccucagcaucccccauagcucccagcagcc

SEQ ID NO: 115595 - RNA, 64 nt, Homo Sapiens
cagccccagggugaucucaaaguaucuaauucacccucagcaugugggaagggacagguggggg

SEQ ID NO: 115596 - RNA, 64 nt, Homo Sapiens
auccgaaagaauuaagagaauaccuagaacauauccucagcaagaaacaaaaccaaacuggacu

SEQ ID NO: 115597 - RNA, 64 nt, Homo Sapiens
cccugcagcccuuuuggcuccccuuuucccugugccucagcacuccuuuccugguugcagauaa

SEQ ID NO: 115598 - RNA, 64 nt, Homo Sapiens
ccagccucaggaagaguagaaauuggguggugcuccucagcaggggaagguggauguuuaggcu

SEQ ID NO: 115599 - RNA, 64 nt, Homo Sapiens
ggacagguguagagauaaggacuggcaaccagagccucagcauccaaagauggacugaaguggg

SEQ ID NO: 115600 - RNA, 64 nt, Homo Sapiens
ucauaacucauuugcuuuguggcccagccuguggccucagcaucugccagaggccuggugcccu

SEQ ID NO: 115601 - RNA, 64 nt, Homo Sapiens
aggccuugccuuguguauguggaccugcaguuggccucagcagaggaagggggcaggccccuuu

SEQ ID NO: 115602 - RNA, 64 nt, Homo Sapiens
auaauccaugaauuuacugauuuaaaauuuaaaaccucagcaaauaaaauucugaaacagaggc

SEQ ID NO: 115603 - RNA, 64 nt, Homo Sapiens
uuugcucaacuacugauaaaugaauuauaaauggccucagcaguuauucuaaguuuucauucuu

SEQ ID NO: 115604 - RNA, 64 nt, Homo Sapiens
gccagagggguuggccaguuggagccugggucagccucagcagccuauccccauguccucuaug

SEQ ID NO: 115605 - RNA, 64 nt, Homo Sapiens
cggccagaccacaaggccagaagcaauaauggcaccucagcaguuccaguauggauagggguuc

SEQ ID NO: 115606 - RNA, 64 nt, Homo Sapiens
ucugagccaccgccugccaggugccacuccagaaccucagcagacauuugcuccuccuguuccu

SEQ ID NO: 115607 - RNA, 64 nt, Homo Sapiens
aagacccagugucauuugcugccgcuguguccugccucagcacacuguguguguguuucggaaa

SEQ ID NO: 115608 - RNA, 64 nt, Homo Sapiens
caccccgugacacguaguggcucuguuuucucuuccucagcaucuacgaacuucuccagcucug

SEQ ID NO: 115609 - RNA, 64 nt, Homo Sapiens
gacagcacagacccucuggccugccuccuguaggccucagcaggggaaguggaggugaaugucu

SEQ ID NO: 115610 - RNA, 64 nt, Homo Sapiens
gugggggucuuccuccuuacauuguguuuugugaccucagcagggggucauauguuuauuuuuc

SEQ ID NO: 115611 - RNA, 64 nt, Homo Sapiens
ccugaccuucgggugaccaguuuggugagcaaacccucagcagucucccucuaauguguggugc

SEQ ID NO: 115612 - RNA, 64 nt, Homo Sapiens
ccaagagcaaggaugaaaaauugaagucacagccccucagcaccaagcagaaggugaggacagg

SEQ ID NO: 115613 - RNA, 64 nt, Homo Sapiens
gugcccagagacaagugaaggugucugcccugggccucagcaaggauguguacaacagguagaa

SEQ ID NO: 115614 - RNA, 64 nt, Homo Sapiens
ucuuuucuggccaaaagcagaguuaaccccauguccucagcauuauagucuucucaaauuagaa

SEQ ID NO: 115615 - RNA, 64 nt, Homo Sapiens
cccuacagagcuguggaggaggcuuaugggucccccucagcaagcugcggagaacacccuuggu

SEQ ID NO: 115616 - RNA, 52 nt, Homo Sapiens
cgccuuaagcugauccugcgggccucagcagccggagcugaauacagccuga

SEQ ID NO: 115617 - RNA, 64 nt, Homo Sapiens
cugcccagcccuggcccaggcagcgcucgauggaccucagcaaggugccaagcccuggccccca

SEQ ID NO: 115618 - RNA, 64 nt, Homo Sapiens
ucuggcucugccucaggaggguguuccgugggacccucagcagcgaggggaccucuccacacag

SEQ ID NO: 115619 - RNA, 64 nt, Homo Sapiens
gugaagaaucaaagucagggcuucaaucacugcuccucagcaaucuguagacaaugagauuaag

SEQ ID NO: 115620 - RNA, 64 nt, Homo Sapiens
gcuuugugucuuucccaguuaaaccauggcuccuccucagcauggacacucacuggacaauauc

SEQ ID NO: 115621 - RNA, 64 nt, Homo Sapiens
ucucacaaaguguaccaugugugugugccuauuaccucagcauuuugguacuguccaugucugg

SEQ ID NO: 115622 - RNA, 64 nt, Homo Sapiens
cccgggacuauugccaagaaccaccaagugucagccucagcacuggcuuucugaguccuguugg

SEQ ID NO: 115623 - RNA, 64 nt, Homo Sapiens
ugccaaccuuaguguuucuccagccagacagaugccucagcaugaagggcuuggggacuugugg

SEQ ID NO: 115624 - RNA, 64 nt, Homo Sapiens
ccucugcaugcagcacagaagggugugaccaugcccucagcaccacucuuguccccacugaacg

SEQ ID NO: 115625 - RNA, 64 nt, Homo Sapiens
uuacuaaucucaguuuguucgcuuguccaauuagccucagcacaaggagacagcaugaacaccu

SEQ ID NO: 115626 - RNA, 64 nt, Homo Sapiens
ucuuuagagauuauccucucaacaaguggacucuccucagcaggaaagccuuucccuuaugauc

SEQ ID NO: 115627 - RNA, 64 nt, Homo Sapiens
gaagaacccuugugaaguaauggggacauugggaccucagcaauagguacugcccauugggaga

SEQ ID NO: 115628 - RNA, 64 nt, Homo Sapiens
agauuuaauggggccaagaggcccaggguccugcccucagcacugacugggugugccaaaauau

SEQ ID NO: 115629 - RNA, 64 nt, Homo Sapiens
ugucuacauucaguuguuuuguccuaagcaccugccucagcaauagcaauauaggccagacuug

SEQ ID NO: 115630 - RNA, 64 nt, Homo Sapiens
ccuccgcuacgcacagguagcuccucuccgugcuccucagcagugcgagugcacagacagcacc

SEQ ID NO: 115631 - RNA, 64 nt, Homo Sapiens
gagucugaguguucaaagccgcaggacccaggacccucagcaaucccguuugucaucugguuug

SEQ ID NO: 115632 - RNA, 64 nt, Homo Sapiens
agcucccucaagcuuaaugacucuguccaaagaaccucagcaucuguuuucccacuguuaagga

SEQ ID NO: 115633 - RNA, 64 nt, Homo Sapiens
gugucugggcugccccugccaaguucccccagucccucagcaccuggccccaggacugaggucc

SEQ ID NO: 115634 - RNA, 64 nt, Homo Sapiens
gagaaggaugccugggugccaggcaagacaagccccucagcaggagagaggcccagaggcucca

SEQ ID NO: 115635 - RNA, 64 nt, Homo Sapiens
accccucaacagagaugacuuugaugacucugccccucagcagggcuuacuaagcacuaccccu

SEQ ID NO: 115636 - RNA, 64 nt, Homo Sapiens
agggaugacacagcaaggaugacucagcacugccccucagcaaggaugacucagcacugccgcu

SEQ ID NO: 115637 - RNA, 64 nt, Homo Sapiens
aacagacaugacucagggauggcuuaguacugccccucagcagggaugacucagcaccgccucu

SEQ ID NO: 115638 - RNA, 64 nt, Homo Sapiens; identical to SEQ ID NO: 115636

SEQ ID NO: 115639 - RNA, 64 nt, Homo Sapiens
aggcaugacucugcagagaugacuuaguacugccccucagcagggaugacucaguacugccccu

SEQ ID NO: 115640 - RNA, 64 nt, Homo Sapiens
uacugccccucagcagggaugacucaguacugccccucagcagggaugacucagcacugccccu

SEQ ID NO: 115641 - RNA, 64 nt, Homo Sapiens
agugaugacacagcaaggaugacucagcacugccccucagcaaggaugacucagcacugccgcu

SEQ ID NO: 115642 - RNA, 64 nt, Homo Sapiens
aacagacaugacucagggauggcuuaguacugccccucagcagggaugacucagcaccgccccu

SEQ ID NO: 115643 - RNA, 64 nt, Homo Sapiens
aacagacaugacucagggauggcuuaguacugccccucagcagggaugacucagcagggaugac

SEQ ID NO: 115644 - RNA, 64 nt, Homo Sapiens
acagggaugacugcagggaugacucagcacugccccucagcagggaugacucagcacugccccu

SEQ ID NO: 115645 - RNA, 64 nt, Homo Sapiens
cacugccccucagcagggaugacucagcacugccccucagcagggaugacucagcagggaugac

SEQ ID NO: 115646 - RNA, 64 nt, Homo Sapiens
aggcaugacucugcagagaugacucagcacugccccucagcagggauggcucagcagggaugac

SEQ ID NO: 115647 - RNA, 64 nt, Homo Sapiens
agacaugacucagcagggaugacucagcaccgccccucagcaaggaugacucagcagggaugau

SEQ ID NO: 115648 - RNA, 64 nt, Homo Sapiens
uuuggauuuaaguuacuauccuggcuuugcccaaccucagcaaccuguaagacugauaaugaaa

SEQ ID NO: 115649 - RNA, 64 nt, Homo Sapiens
gcacgugacuguauuauacauggguagcuucugaccucagcauuaucuauauaguaccuuugcu

SEQ ID NO: 115650 - RNA, 64 nt, Homo Sapiens
ggcugccuugaaaucaagagacaauaacuuugaaccucagcaagaccuugaaccgccgguucau

SEQ ID NO: 115651 - RNA, 64 nt, Homo Sapiens
aaaaguguggcauagcuaccugcccauccccaacccucagcaaaguagaaucucuuuucuggua

SEQ ID NO: 115652 - RNA, 64 nt, Homo Sapiens
uugcuucacccgcugcagagcacacgcaacccagccucagcaucacagccgcagcucuguucag

SEQ ID NO: 115653 - RNA, 64 nt, Homo Sapiens
uccauuuucugagacccccagaaaggaaacugacccucagcagcugccugauuguuacgcgaau

SEQ ID NO: 115654 - RNA, 64 nt, Homo Sapiens
cccaccccacucaacccugaccggcccccaccacccucagcagccaaagugagagguggcuccc

SEQ ID NO: 115655 - RNA, 64 nt, Homo Sapiens
gauccccaaagugagaggugagucccccuucucaccucagcaauggguaucaccugguggccac

SEQ ID NO: 115656 - RNA, 64 nt, Homo Sapiens
auaggaggcaauaaucuuuuacacuguagucagaccucagcaaucccaccuccaucaaacgcag

SEQ ID NO: 115657 - RNA, 64 nt, Homo Sapiens
uccgacaccucccagcguggucccugacuaacagccucagcacaucuguuucagcaaaucucag

SEQ ID NO: 115658 - RNA, 64 nt, Homo Sapiens
augaggaccuccagggcauguugcucccuucuguccucagcaaggcucgguccuggacauucua

SEQ ID NO: 115659 - RNA, 64 nt, Homo Sapiens
ccucugcucagugccuguggggagcagccucuacccucagcauccuggccacaaguucuuccuu

SEQ ID NO: 115660 - RNA, 63 nt, Homo Sapiens
ugugaacauugcucuucauuuuggccuguacuucucccucagggacguagaacaauggaaugu

SEQ ID NO: 115661 - RNA, 63 nt, Homo Sapiens
aaacuuuuucuuuaaaauucaauuaagguacuucucccucagggacguagaacaauggaaugu

SEQ ID NO: 115662 - RNA, 63 nt, Homo Sapiens
augaagugccauuucuguuaagccucuuccucccucccucauggccuuguggcaugucugucu

SEQ ID NO: 115663 - RNA, 63 nt, Homo Sapiens
ccacccugcuuuuaaaaauuucuuuguaaaauucucccucaccaaaauuauuucaucuuguau

SEQ ID NO: 115664 - RNA, 63 nt, Homo Sapiens
ugagcagugaucacuuacuccuccgugaagcuucucccucagccaaaacucaagucccucuuc

SEQ ID NO: 115665 - RNA, 63 nt, Homo Sapiens
ccuccuuggccccucucccuguagaggucccaccucccucauugagggccuacggaugggucc

SEQ ID NO: 115666 - RNA, 63 nt, Homo Sapiens
ccagaucccguaggcagcccagcaccucaguggcucccucagaaguccccgaucgcugcugug

SEQ ID NO: 115667 - RNA, 63 nt, Homo Sapiens
aguuuggacaauuugaaauucacgguucccacccucccucaccgagauugcccuucccuaugc

SEQ ID NO: 115668 - RNA, 63 nt, Homo Sapiens
cccaauaggaggaucccaggcugcugucuuccccucccucaacuugcugcucccucaaccuuc

SEQ ID NO: 115669 - RNA, 63 nt, Homo Sapiens
cuuccugcugucuuccccucggccaaguugcugcucccucaacuaaaguuaaucucuuggucu

SEQ ID NO: 115670 - RNA, 63 nt, Homo Sapiens
ugguuucauuuaaugcuuuaucuggaaagccgucucccucagaagugggggaggugagacaga

SEQ ID NO: 115671 - RNA, 63 nt, Homo Sapiens
cucgucuguccugucaccugcccagcccauccccucccucauccucccgugacagccggcagg

SEQ ID NO: 115672 - RNA, 63 nt, Homo Sapiens
cucgcagccacucugugccccaaauucuucugccucccucaugaugguagcuaccucuuacuu

SEQ ID NO: 115673 - RNA, 63 nt, Homo Sapiens
ucuuuucccccuggcauggacuacucuuugugacucccucauauccucccuuucucagucuac

SEQ ID NO: 115674 - RNA, 63 nt, Homo Sapiens
uugcaaggccauaaguguuugccucacccugaacucccucaucccccgacuccucaccccuga

SEQ ID NO: 115675 - RNA, 63 nt, Homo Sapiens
ucaaaggguccucaaagcucuaugcaaguccuccucccucauccuuagcccccuguaugaccc

SEQ ID NO: 115676 - RNA, 63 nt, Homo Sapiens
caaguugugauaaauuugaucccaauagaauaccucccucauuuaagaaaaaucauaacucac

SEQ ID NO: 115677 - RNA, 63 nt, Homo Sapiens
uuuggaaauggagggaggaauuuucauugccuucucccucaugcaugaagauucgaacagcuu

SEQ ID NO: 115678 - RNA, 63 nt, Homo Sapiens
cccuuagccgucuuacucaacugccccuuuccucucccucagaauuuguguuugcugccucua

SEQ ID NO: 115679 - RNA, 63 nt, Homo Sapiens
ugucaaguggaauccuucccuuuccaacucuaccucccucacucagcuccuuuccccugauca

SEQ ID NO: 115680 - RNA, 63 nt, Homo Sapiens
ucagacugggaaucccugaagauggggccgugucucccucaaaguggggcucccucaggacag

SEQ ID NO: 115681 - RNA, 63 nt, Homo Sapiens
ugaagauggggccgugucucccucaaaguggggcucccucaggacagcguugugucuccccuc

SEQ ID NO: 115682 - RNA, 63 nt, Homo Sapiens
ucagacugcggcucccugaggacggggcugugucucccucagacuggggcucccugaagaaag

SEQ ID NO: 115683 - RNA, 63 nt, Homo Sapiens
ucagacuggggcucccugaagaaagggcugcuucucccucagacuggagcucccugaagaugg

SEQ ID NO: 115684 - RNA, 63 nt, Homo Sapiens
cccguguggcagagcuguggacuuucuucucggcucccucaacccuggcucaggcacagaagg

SEQ ID NO: 115685 - RNA, 63 nt, Homo Sapiens
ugccagcguugggugggacacccguggcggcugcucccucagaccucccuucuguggacugac

SEQ ID NO: 115686 - RNA, 63 nt, Homo Sapiens
guuuccaucucaggcauguaucccaccaagugccucccucacagccaugcccagaagccucac

SEQ ID NO: 115687 - RNA, 63 nt, Homo Sapiens
cuuggcuucuccagggcucuucccucaggcuuucucccucaguccuggggacuggggcgcucc

SEQ ID NO: 115688 - RNA, 63 nt, Homo Sapiens
cuuucucccucagucuuggcgacuggggcgcuccucccucagggcaccaggccggucccuggg

SEQ ID NO: 115689 - RNA, 63 nt, Homo Sapiens
caggacagccuguggccuuuccucagaggaacucucccucaccacugagccuuuuuggugcuc

SEQ ID NO: 115690 - RNA, 62 nt, Homo Sapiens
ggaacucucccucacccagggccuuuuuggugcucccucagaaugaagaaacagaagacuga

SEQ ID NO: 115691 - RNA, 63 nt, Homo Sapiens
cuggcacccacugcuacacucaccgcaguccagcucccucagugacucucuggccaccuccuc

SEQ ID NO: 115692 - RNA, 63 nt, Homo Sapiens
gucuggggcucuucugggagcugcccagcguaccucccucaccccagcccggagcccacagug

SEQ ID NO: 115693 - RNA, 63 nt, Homo Sapiens
cccagcgguccaaugccaccgucccagccccuccucccucagaccccagacccagagguccag

SEQ ID NO: 115694 - RNA, 63 nt, Homo Sapiens
cucagagguccaggcccccacccccaaccccuccucccucagacucagacccagggguccagg

SEQ ID NO: 115695 - RNA, 63 nt, Homo Sapiens
cccaggaguccagccccucccccccagccccuccucccucagaucagacccaggaguccagac

SEQ ID NO: 115696 - RNA, 63 nt, Homo Sapiens
cccaggaguccagaccccccaguccagccccuccucccucagaccuccucccucagacccagg

SEQ ID NO: 115697 - RNA, 63 nt, Homo Sapiens; identical to SEQ ID NO: 115695

SEQ ID NO: 115698 - RNA, 63 nt, Homo Sapiens
cccaggaguccagaccccccuccccagccccuccucccucagaccucaaaccaaggguacaga

SEQ ID NO: 115699 - RNA, 63 nt, Homo Sapiens
ccaaggguacagauccccagcccccagccccuccucccucaaacucaggcccaggaguccagg

SEQ ID NO: 115700 - RNA, 63 nt, Homo Sapiens
cccaggaguccaggcccccauucccagccccuccucccucaggaaggaauucaggaauaucug

SEQ ID NO: 115701 - RNA, 63 nt, Homo Sapiens
cccaggaguccaggccccagcccccagccccuccucccucagacucagacccgggaguccagg

SEQ ID NO: 115702 - RNA, 63 nt, Homo Sapiens
cccgggaguccaggcccccacccccagccccuccucccucagacucagacccaggaguccagg

SEQ ID NO: 115703 - RNA, 63 nt, Homo Sapiens
cccaggaguccaggcccccagccccagccccuccucccucagacucaggacccaggaguccag

SEQ ID NO: 115704 - RNA, 63 nt, Homo Sapiens
cccaggacuccaggcccccagccccaguaccuccucccucagacucagacccaggauucccgg

SEQ ID NO: 115705 - RNA, 63 nt, Homo Sapiens
cccaggauucccgggccccaccuccagcuccuccucccucagacucagauccaggagucuagu

SEQ ID NO: 115706 - RNA, 63 nt, Homo Sapiens
gcucuggcacaguguaaucccagaggugggauccucccucaugaucaacaccacuaggaaucc

SEQ ID NO: 115707 - RNA, 63 nt, Homo Sapiens
ucucugggaccuccuuagcccuguggccgucuccucccucagcccucucucugggcccagggg

SEQ ID NO: 115708 - RNA, 63 nt, Homo Sapiens
cugucccaagcccaccccuccucccaccaucaccucccucaccucgggacaguagcccuccac

SEQ ID NO: 115709 - RNA, 63 nt, Homo Sapiens
gaaaaacaggucucagcccaggguccucgcucacucccucacuccccacuuugaagccaucuc

SEQ ID NO: 115710 - RNA, 63 nt, Homo Sapiens
ugugucccgaguuccugaagcgcccacuccugccucccucauccuggggcucaagcgcugggc

SEQ ID NO: 115711 - RNA, 63 nt, Homo Sapiens
aggcugaauugaaaaagggcuccaggggcuagacucccucaggcaggugguggccagagaggc

SEQ ID NO: 115712 - RNA, 63 nt, Homo Sapiens
gccgcuaagacugcaagccuuacaccucaccaucucccucaugaguaagacugaaauaaaacu

SEQ ID NO: 115713 - RNA, 63 nt, Homo Sapiens
augaauagaaacuucuuauaagccuuuuuccuacucccucagauuauguaauuuauuuguaag

SEQ ID NO: 115714 - RNA, 64 nt, Homo Sapiens
ugccuucccaaacuccccauuuaaauuuugccuccucagagagauuccugccucagauuucagc

SEQ ID NO: 115715 - RNA, 64 nt, Homo Sapiens
uuugauagacucaaacagauaaaugagugaguaccucagagaaauucugauauacauugcuuga

SEQ ID NO: 115716 - RNA, 64 nt, Homo Sapiens
uggaaagcaggauuuaaccucuaguucucuuguucucagagaacagcagguugauaguagauua

SEQ ID NO: 115717 - RNA, 64 nt, Homo Sapiens
gguuuucuuagccccagcuuuaaaagcuagagaucucagagaaauagcuggcuuaacaaugaca

SEQ ID NO: 115718 - RNA, 64 nt, Homo Sapiens
acaaaugaguuacucucucgaaauuacagauugucucagagaaauaaggauaauaggacaagac

SEQ ID NO: 115719 - RNA, 64 nt, Homo Sapiens
agcaaccaacuggaguuaaugcuggcaaguaaggcucagagagaucuggaaugcgguaauaaga

SEQ ID NO: 115720 - RNA, 64 nt, Homo Sapiens
uuuucucccugagcuguaggguggaccuggaccccucagagaugcucgacugcaggguccuggg

SEQ ID NO: 115721 - RNA, 64 nt, Homo Sapiens
cuguugauuccacuucugucgaggagcuucggggcucagagaggugaugacgugcccaagguga

SEQ ID NO: 115722 - RNA, 64 nt, Homo Sapiens
gccaguccggucccagcuccacuuggucucaaagcucagagagacugggccuucugugcaggag

SEQ ID NO: 115723 - RNA, 64 nt, Homo Sapiens
ucaauucuuaaacacugugaagcaucugacucaucucagagauaaggagcuuggccccucugua

SEQ ID NO: 115724 - RNA, 64 nt, Homo Sapiens
agcuguuugcaauccaaaucauuaacagcagaaucucagagaaacaaaaauacuguaagucuca

SEQ ID NO: 115725 - RNA, 64 nt, Homo Sapiens
caaaaauacuguaagucucaauucccacucagcacucagagacauuuuucuucuuuuuuaaaau

SEQ ID NO: 115726 - RNA, 64 nt, Homo Sapiens
aggaccucauuguucuuagggaggcaaggugcugcucagagaggcccaucuguaggagauuagu

SEQ ID NO: 115727 - RNA, 64 nt, Homo Sapiens
gagggaaacaaaagccuguuaucaugaaagaaggcucagagaaaaccccauuuuucccagggua

SEQ ID NO: 115728 - RNA, 64 nt, Homo Sapiens
augaucaucuccaguuuauagaccagaaccagagcucagagaggcuagaugauugauuaccaag

SEQ ID NO: 115729 - RNA, 64 nt, Homo Sapiens
ucacagaagcacagcacccaugggaaggguccaucucagagaauuuacgagcagggaugaaggc

SEQ ID NO: 115730 - RNA, 64 nt, Homo Sapiens
ccugguuaaacaaaccagaaucccucuacauggacucagagaaaagagauugagauguaagucu

SEQ ID NO: 115731 - RNA, 64 nt, Homo Sapiens
cugugccucugucuccuuguugcccaacuacuaucucagagauauugugaggacaaauugagac

SEQ ID NO: 115732 - RNA, 64 nt, Homo Sapiens
agugggaucaacauuguggcgacacagaaacauccucagagauccucagccagcucuuuuaauu

SEQ ID NO: 115733 - RNA, 64 nt, Homo Sapiens
gagacaccuccuggaggcccuccauccugucucccucagagaagagcagcagggccccauggga

SEQ ID NO: 115734 - RNA, 64 nt, Homo Sapiens
gagcccccgcauaucagcaguucacccaguacuccucagagacugguuucccucuaaacccauc

SEQ ID NO: 115735 - RNA, 64 nt, Homo Sapiens
ugcgucccagccagccccgucgcucucguccauccucagagacaaagaagagggcagggaguuu

SEQ ID NO: 115736 - RNA, 64 nt, Homo Sapiens
aaagggaaaacccucaggccugaggugugugccacucagagacuucaccuaacuagagacaggc

SEQ ID NO: 115737 - RNA, 64 nt, Homo Sapiens
agugaauggucucucuuuggcuggaauuacaaaacucagagaaaugugucaucaggagaacauc

SEQ ID NO: 115738 - RNA, 64 nt, Homo Sapiens
acuccugaccuuucguaaugcuguucaccuucagcucagagagcauuuccuacaccgcagcugu

SEQ ID NO: 115739 - RNA, 64 nt, Homo Sapiens
uuacaaugugcuuuuuccgcgaacaggagcgauccucagagaguugcuucugcaacacaaaucg

SEQ ID NO: 115740 - RNA, 64 nt, Homo Sapiens
uaaaagcuuuuucacaguuuuaagaagacaaguggagggugaggauagugguggggggucuggc

SEQ ID NO: 115741 - RNA, 64 nt, Homo Sapiens
ccgagccuuuuuguugcuccgcucccaggagagugagggugacgcaauugauuaaaaccauuuu

SEQ ID NO: 115742 - RNA, 64 nt, Homo Sapiens
gccgcagcuuggcagccccuaaagcuuucugcaggagggugaaugucuaagaagucccauugcc

SEQ ID NO: 115743 - RNA, 64 nt, Homo Sapiens
aggaugugguccuaucagauggggugugggcuuggagggugaagagaacagugggacaugagca

SEQ ID NO: 115744 - RNA, 64 nt, Homo Sapiens
agccuucauaagaugaccuaucuagaaugaaaaggagggugauuuguaugcaacacagcaauaa

SEQ ID NO: 115745 - RNA, 64 nt, Homo Sapiens
gggaaccuccccugcugaggggaugggagaacuugagggugauccuuuaaaagaucuaacuaug

SEQ ID NO: 115746 - RNA, 64 nt, Homo Sapiens
cagguaucagagucacuccuugacaggccagggagagggugaaggaaguggaugaugugggagu

SEQ ID NO: 115747 - RNA, 64 nt, Homo Sapiens
cugccgaugccuuccugcccagcuugagugaaaggagggugagggugcagaacacgguguuuua

SEQ ID NO: 115748 - RNA, 64 nt, Homo Sapiens
guugcaugagucggaucccaguccauugucaguggagggugagggugaccccaucugcuauuuu

SEQ ID NO: 115749 - RNA, 64 nt, Homo Sapiens
ugagucggaucccaguccauugucaguggagggugagggugaccccaucugcuauuuuugugcu

SEQ ID NO: 115750 - RNA, 64 nt, Homo Sapiens
uggcugaggcaucgcucaaggcgauuguguggaugagggugagcuauuugaagcauguuuucua

SEQ ID NO: 115751 - RNA, 64 nt, Homo Sapiens
ggagggguauauggaaacacuccguuccuccucugagggugaguauuuaugcugguggcuucca

SEQ ID NO: 115752 - RNA, 64 nt, Homo Sapiens
cccaggccacacagacggacaugggcccacaugggagggugagcaggagcaaggcugugcuugc

SEQ ID NO: 115753 - RNA, 64 nt, Homo Sapiens
aggcagauugaagcucagcagggaagaggcuuuugagggugauccaggcgcuggagggauggcc

SEQ ID NO: 115754 - RNA, 64 nt, Homo Sapiens
gaauggcuggagucugcuguugucagaaggcagggagggugaugaaggacugacccacauggac

SEQ ID NO: 115755 - RNA, 64 nt, Homo Sapiens
ugaggaggagggacaaggaagaugacuaguuacggagggugaggguuguuuuuugccaaaaagc

SEQ ID NO: 115756 - RNA, 64 nt, Homo Sapiens
cacacuuuauccaacauacacuggagcuaguuuugagggugaaccauucucuagucugugaugu

SEQ ID NO: 115757 - RNA, 64 nt, Homo Sapiens
cccaaguggauggcucaggagucauggccguggugagggugaauguugggagcagugacagaga

SEQ ID NO: 115758 - RNA, 64 nt, Homo Sapiens
uuggaugcccugacccagcagggcgcuucguguggagggugaaccuaaccugguagagguagac

SEQ ID NO: 115759 - RNA, 64 nt, Homo Sapiens
cgcccaugucuggggccucccugcuggcacuacagagggugagcugggaggaaagacagccaug

SEQ ID NO: 115760 - RNA, 64 nt, Homo Sapiens
gcacgcuucucucguggucaugccaagaacacaggagggugagucuaacaagcacaccucaagc

SEQ ID NO: 115761 - RNA, 64 nt, Homo Sapiens
gugacaagggagugaccauccauccccuccacaggagggugaggaauugggacagguaauucca

SEQ ID NO: 115762 - RNA, 64 nt, Homo Sapiens
gagcacggggucacaccccuagcagaugcugugugagggugaugaucagccucccagaccugcc

SEQ ID NO: 115763 - RNA, 64 nt, Homo Sapiens
ugaaccagagcuggagugagcgaaugccuggucagagggugaccuguccacgacccaggcugga

SEQ ID NO: 115764 - RNA, 64 nt, Homo Sapiens
uauaagacauacauacuuuaagguuaugguaggagagggugagaggaaagcaugauuaguuugc

SEQ ID NO: 115765 - RNA, 64 nt, Homo Sapiens
gcagaaacucuuaagaaaucaguuguugucuauggagggugagacagcuuacauuuggauucag

SEQ ID NO: 115766 - RNA, 64 nt, Homo Sapiens
gggaacgcuugugauggugccacgcuuacucacugagggugaguuucaccccaugucccuucua

SEQ ID NO: 115767 - RNA, 64 nt, Homo Sapiens
acccugcccucugccacccaaggcacugaugcuagagggugauggggccagggcaggcaggagc

SEQ ID NO: 115768 - RNA, 64 nt, Homo Sapiens
cacugcacagaagacagcagcaacacaaauuugggagggugagaaucugcuuuugccuacguga

SEQ ID NO: 115769 - RNA, 64 nt, Homo Sapiens
gggcugagcaggaggggggcauacagagcucucugagggugauggcacacgcacgcacacacac

SEQ ID NO: 115770 - RNA, 64 nt, Homo Sapiens
guggccgcccaaggcccacgaugucaggggcggggagggugacagggaggagaggacaagggaa

SEQ ID NO: 115771 - RNA, 64 nt, Homo Sapiens
gcaaggggcgugggaguggcgugaaggggccaaggagggugaguaacuguucccaccugcugga

SEQ ID NO: 115772 - RNA, 64 nt, Homo Sapiens
uuuggcaguuacccaagagaggggcccauuguaugagggugaaguuaaggcccacuguuuuacu

SEQ ID NO: 115773 - RNA, 64 nt, Homo Sapiens
caggaggauggcucaagcccuccuagcacuuugggagggugagggcacaguucaugcccuguaa

SEQ ID NO: 115774 - RNA, 64 nt, Homo Sapiens
agguugucuuagcuuguacugcaccucaggaaaggagggugaccccuaucugugcauuuuaccg

SEQ ID NO: 115775 - RNA, 64 nt, Homo Sapiens
ugauuuucagcuaguccuuuguagagacauaaaggagggugauggugugugugccugugugugu

SEQ ID NO: 115776 - RNA, 64 nt, Homo Sapiens
gaagugggggguguuagguauuaagggguauagggagggugagguagcaucauuaagaucaguu

SEQ ID NO: 115777 - RNA, 64 nt, Homo Sapiens
acaaggguuguggggagggguugguucuuguuuugagggugagguaaucauuuucccccuuuua

SEQ ID NO: 115778 - RNA, 64 nt, Homo Sapiens
cuuaugauuacuuggguuaagucuuagccgaauccuuccauauuguuguuacacuuccauaguu

SEQ ID NO: 115779 - RNA, 64 nt, Homo Sapiens
ugucuuagccgaauccuuccaugugguuguuacacuuccauagucaaggguaaugaccaaauuu

SEQ ID NO: 115780 - RNA, 64 nt, Homo Sapiens
uagauuucagcuaugcagaaaaauuuagcuuaugcuuccauauuuuuaaauuuuguuuuuuaag

SEQ ID NO: 115781 - RNA, 64 nt, Homo Sapiens
ucuuguaagcucucuuccuaacagggcacauauucuuccauaauauaaacacuuuucugcccca

SEQ ID NO: 115782 - RNA, 64 nt, Homo Sapiens
guauaaagaacaagguaguuaucgggagcagugucuuccauaauugucacaauccuaacacauu

SEQ ID NO: 115783 - RNA, 64 nt, Homo Sapiens
uaugacaguuauacugucggaucggaagcagugccuuccauaauuuuuuuaauagaauauaauu

SEQ ID NO: 115784 - RNA, 64 nt, Homo Sapiens
uuucacauagcugucuagaguagcuuaccagaagcuuccauaguggugcagaggaaguggaagg

SEQ ID NO: 115785 - RNA, 64 nt, Homo Sapiens
uuuagacucaucuuacuguaccuguuccuuagaccuuccauaaugcuacugucucacugaaaca

SEQ ID NO: 115786 - RNA, 64 nt, Homo Sapiens
uuuaugguauuacacagggauaguugaggaagaucuuccauaauaaugucuaaauccuauacuc

SEQ ID NO: 115787 - RNA, 64 nt, Homo Sapiens
augaaauagauuauucaauauacagaaagauaugcuuccauaauuaauauauaucagugagucu

SEQ ID NO: 115788 - RNA, 64 nt, Homo Sapiens
uggaaucagugcaggcaaaauuuaggauuugccgcuuccauaaaucaaagcaugacuaauaggg

SEQ ID NO: 115789 - RNA, 64 nt, Homo Sapiens
uuuugugcacaccuauauuaccuuaagaaauuuccuuccauagacagcugccucaaagggaaau

SEQ ID NO: 115790 - RNA, 64 nt, Homo Sapiens
aagaaauggagaaaaaaauacuccuggcuucuggcuuccauaagcuuuucaaaacagggugcuc

SEQ ID NO: 115791 - RNA, 64 nt, Homo Sapiens
ggacgacaaaagaauuggaccaacagagaaaagacuuccauaaagcaauuacugaaaguggcug

SEQ ID NO: 115792 - RNA, 64 nt, Homo Sapiens
aaaucagacauggcaaaacaauaauggcuguuugcuuccauaaacaagugcaauuuuuuaaagu

SEQ ID NO: 115793 - RNA, 64 nt, Homo Sapiens
ugcuaaaaauaaagaugauagcauguucuucugucuuccauaguuauuacaacuaugagagccu

SEQ ID NO: 115794 - RNA, 64 nt, Homo Sapiens
uguuuuuccuagauaauucucuaaaaauaugauucuuccauauagaaugcuaagcuuauuuuua

SEQ ID NO: 115795 - RNA, 64 nt, Homo Sapiens
agauggggaaccugcuagugaacuaggagggagacuuccauagccucagacuuggauaggguag

SEQ ID NO: 115796 - RNA, 64 nt, Homo Sapiens
aguaacaacuccacagauuuagugaaaacaaguccuuccauaauagauauuucaaauuguuuuc

SEQ ID NO: 115797 - RNA, 64 nt, Homo Sapiens
aguuuuacuuuuuuuuuuuuccuuaaaugccaaucuuccauauucuguauaaauaguuuggucc

SEQ ID NO: 115798 - RNA, 61 nt, Homo Sapiens
uggagcuaagaguucagaggccaucaaggagagcagcaaguuuccauuuggcauuagccca

SEQ ID NO: 115799 - RNA, 61 nt, Homo Sapiens
ugucucacauggaaacagaaaacgcugggucagcagcaagcuguaguuuuuaaaaauguuu

SEQ ID NO: 115800 - RNA, 61 nt, Homo Sapiens
ugcuguucucaaccauucuuauuaauuugaaagcagcaauuucaauagauuuuuaggcuga

SEQ ID NO: 115801 - RNA, 61 nt, Homo Sapiens
uaaaaacguaugugaagccuccugaaaagugagcagcaacgucagaccaacaaaccuuccc

SEQ ID NO: 115802 - RNA, 61 nt, Homo Sapiens
gcuccguccugacugcccugugcccuggaaaagcagcaauagcauccgccccuuagagccc

SEQ ID NO: 115803 - RNA, 61 nt, Homo Sapiens
ggccuuguuagacagcacuugggccuuugccagcagcaagaggugaagcgaagccacucuu

SEQ ID NO: 115804 - RNA, 61 nt, Homo Sapiens
aaaaagaagaagaagaaaaaaaacaagaacaagcagcaacagcuguuuuguuggggcuaua

SEQ ID NO: 115805 - RNA, 61 nt, Homo Sapiens
uuucauggguaggaaagcuuguccugaccccagcagcaaagagguggcaggucgcuaauga

SEQ ID NO: 115806 - RNA, 61 nt, Homo Sapiens
aggacgucuguucuuuguggcugccacuaccagcagcaaccuucagacugaagcagcaauu

SEQ ID NO: 115807 - RNA, 61 nt, Homo Sapiens
cugccacuaccagcagcaaccuucagacugaagcagcaauuuacacccuggcaaggcuucu

SEQ ID NO: 115808 - RNA, 61 nt, Homo Sapiens
gcugccaugggauacagcaccugugggcaccagcagcaaggugaauccgcccagugauagc

SEQ ID NO: 115809 - RNA, 61 nt, Homo Sapiens
ggacaugaugaaaaauacgugagccugagaaagcagcaagacacaaaugaagaagaacaaa

SEQ ID NO: 115810 - RNA, 61 nt, Homo Sapiens
gcaguuguauuguguaacaaguacugcucccagcagcaauuagggagaaaacuagucuaaa

SEQ ID NO: 115811 - RNA, 61 nt, Homo Sapiens
gcuuguaggacuguucaccaagggggauaccagcagcaagagagugcacccguuuagcccu

SEQ ID NO: 115812 - RNA, 61 nt, Homo Sapiens
guggugagcaucauuauaccccccacagggcagcagcaaaugaaccaucuacgggcauaga

SEQ ID NO: 115813 - RNA, 61 nt, Homo Sapiens
aauaucucuuucuguguucaaagaagaaaauagcagcaagaaaaguugcuuuucaaagagg

SEQ ID NO: 115814 - RNA, 61 nt, Homo Sapiens
gaacuuuuugcuuucugccauuaaaaauuaaagcagcaaagcuaaauuuuuguaagaaaau

SEQ ID NO: 115815 - RNA, 61 nt, Homo Sapiens
ugggggucaggcuacagguggaagcuuuggaagcagcaaggaaggcccagcccugggcaag

SEQ ID NO: 115816 - RNA, 61 nt, Homo Sapiens
cacccuuucagaugugaccucuuuuggacuaagcagcaaucuguucucuugcucaaauaau

SEQ ID NO: 115817 - RNA, 61 nt, Homo Sapiens
caucuacucaacucugcuguugacaugcaaaagcagcaauagacaauaugcguguaaauga

SEQ ID NO: 115818 - RNA, 64 nt, Homo Sapiens
gaacggccaaauucccaugugagaggaagaugaccugauccaccuagccuuuucuucuggaucu

SEQ ID NO: 115819 - RNA, 64 nt, Homo Sapiens
uguuuuuuauauaaguuuuuucuauucaguuucacugauccaacuggcaguggguaaauauggc

SEQ ID NO: 115820 - RNA, 64 nt, Homo Sapiens
gcuauuaauugaaaacuucugaucgcaggauuuucugauccauaauuuuaugguaugagaaacu

SEQ ID NO: 115821 - RNA, 64 nt, Homo Sapiens
ugauaaaccagugaacuauguugcgcaguauauacugauccagaauggauucuagccuugcccg

SEQ ID NO: 115822 - RNA, 64 nt, Homo Sapiens
aggaucagucccuauuaugccauacucuuaugaccugauccaucccaggauguauggaauguuu

SEQ ID NO: 115823 - RNA, 53 nt, Homo Sapiens
augaaaauuuggaggaaaagguucugauccaggcuuuuggcauucucuuccag

SEQ ID NO: 115824 - RNA, 64 nt, Homo Sapiens
ugcccagaggcuccaucgucauguuaugcuccugcugauccagacuacgcuccagcugauccag

SEQ ID NO: 115825 - RNA, 64 nt, Homo Sapiens
uguuaugcuccugcugauccaugcuacgcuccagcugauccagaauacgcuccaacugauccag

SEQ ID NO: 115826 - RNA, 64 nt, Homo Sapiens; identical to SEQ ID NO: 60581

SEQ ID NO: 115827 - RNA, 64 nt, Homo Sapiens; identical to SEQ ID NO: 60582

SEQ ID NO: 115828 - RNA, 64 nt, Homo Sapiens
ugacagacggacagacagacaugcaaacaccagacugaagcacauguaauauagaccguguaug

SEQ ID NO: 115829 - RNA, 64 nt, Homo Sapiens
aguugggggguagaggcaggaaaugggaaccgagcugaagcagaggcugaguuagggggcuaga

SEQ ID NO: 115830 - RNA, 64 nt, Homo Sapiens
ucacacuacccuggucccugauugcaaggagcuucugaagcaagggugaauccuucccacacuc

SEQ ID NO: 115831 - RNA, 64 nt, Homo Sapiens
aggcuggagggcagggugagccuccacaugggugcugaagcaagaaaccgacagauguugagga

SEQ ID NO: 115832 - RNA, 64 nt, Homo Sapiens
cccaggcucaucaugggagccuggaagcugauaccugaagcacugaggacuucucgcccucugg

SEQ ID NO: 115833 - RNA, 64 nt, Homo Sapiens
gccaaacccucuuccuugucccacccagugggcccugaagcaggaucuuccuccccacaccuac

SEQ ID NO: 115834 - RNA, 64 nt, Homo Sapiens
cccauccggcgaaguucuuguuuuuuaaaaucugcugaagcagcgcaaaacuuaauaauaauuc

SEQ ID NO: 115835 - RNA, 64 nt, Homo Sapiens
cggccauguuggagagcaaaggguccucugggagcugaagcacagggagugcuuuguggcuuug

SEQ ID NO: 115836 - RNA, 64 nt, Homo Sapiens
aauucugccacuaccagcagggcuucucuucagacugaagcagcaucugaguacacccuggcaa

SEQ ID NO: 115837 - RNA, 64 nt, Homo Sapiens
guccaggagcagaguuagccuuggguaaucugaccugaagcauauuuccccuccccuccacuuc

SEQ ID NO: 115838 - RNA, 64 nt, Homo Sapiens
gaaggugggacgaaugacgaugcccauccacuaccugaagcacuaggacacucuugcagggcca

SEQ ID NO: 115839 - RNA, 64 nt, Homo Sapiens
gccagcugggcagccccuuaaagccaaaccccaccugaagcagaaccacuuuggccuccccugc

SEQ ID NO: 115840 - RNA, 64 nt, Homo Sapiens
ggacucuagaggcgaggccucccugaggaccgcgcugaagcaccccagggugccauccugcagg

SEQ ID NO: 115841 - RNA, 64 nt, Homo Sapiens
uggugugggcuggaacuggccuguugucuugacacugaagcagcacaaacaggacagagccagg

SEQ ID NO: 115842 - RNA, 64 nt, Homo Sapiens
ugaaaaugggaagcgaugacaagcacgugguacucugaagcacugcuucuagcucaauucccug

SEQ ID NO: 115843 - RNA, 64 nt, Homo Sapiens
ugguacucugaagcacuugaucuagcucaauucccugaagcacgagacagguugccaguaggcu

SEQ ID NO: 115844 - RNA, 64 nt, Homo Sapiens
uagggagggauuucacucuucuucccagguucuucugaagcacccacacaaaaugcacacucug

SEQ ID NO: 115845 - RNA, 64 nt, Homo Sapiens
uggcacgcaccuguaguccccgcuacgcagguggcugaagcagaagaaucacuugaaccugaga

SEQ ID NO: 115846 - RNA, 64 nt, Homo Sapiens
uacaguuuuuccagccauucuuuucuucccccuccugaagcaagcaaagagcguggaggcgugu

SEQ ID NO: 115847 - RNA, 64 nt, Homo Sapiens
ugauggcauguccaagugugcccagcagcggaugcugaagcaccagagcucaaggccuucaccu

SEQ ID NO: 115848 - RNA, 64 nt, Homo Sapiens
ggggggacugccugacucccagagggacuugaaacugaagcaagaagguugcauucuccaccaa

SEQ ID NO: 115849 - RNA, 64 nt, Homo Sapiens
aguugacggagcaaguuugaccuugguucuguugcugaagcaaauuuggaacuuuucugucuca

SEQ ID NO: 115850 - RNA, 64 nt, Homo Sapiens
uuucucauuuaaucugauguggcauuuucgucaucugaagcaugagugacaaguugggaaugau

SEQ ID NO: 115851 - RNA, 64 nt, Homo Sapiens
agcagacaagcacccauggaggcagguuucgggccugaagcagaucagagggcuuugcaaaaga

SEQ ID NO: 115852 - RNA, 64 nt, Homo Sapiens
auggauguauugauaaauagauagaaccagucaucugaagcaacuuaagaauuguagccuugac

SEQ ID NO: 115853 - RNA, 59 nt, Homo Sapiens
aaaagaaaggucuuuauagaccugcacagucacuagauuaauucauuaaaaugccccca

SEQ ID NO: 115854 - RNA, 59 nt, Homo Sapiens
acauuugcccugaauuugaacacucaacaucacuagauuuaaauauuuaguauauuuug

SEQ ID NO: 115855 - RNA, 59 nt, Homo Sapiens
gagcuacucaggagguugaggcaggggaaucacuagaacccaggaggcacuccagccug

SEQ ID NO: 115856 - RNA, 59 nt, Homo Sapiens
uuauuauauugacauuguuaugcaacauaucacuagaguguuuuuuaucuugcaaagcu

SEQ ID NO: 115857 - RNA, 64 nt, Homo Sapiens
uaaaguaugcuuuucuguuacauccaccuuugaggcuggucauaccuccaggaacaauacagag

SEQ ID NO: 115858 - RNA, 64 nt, Homo Sapiens
ugacccaggcugggggcagguguguuggagacaggcuggucaaagaggugacaaugauuaagag

SEQ ID NO: 115859 - RNA, 64 nt, Homo Sapiens
cucuagcccacaagccccucgcuaaauaaacgcugcuggucagcugugaugcacaccuacccuu

SEQ ID NO: 115860 - RNA, 64 nt, Homo Sapiens
gcaacaucuccacacagaaaaaaguccagccaaggcuggucaagcaggcuucugcaugccuggu

SEQ ID NO: 115861 - RNA, 64 nt, Homo Sapiens; identical to SEQ ID NO: 58780

SEQ ID NO: 115862 - RNA, 64 nt, Homo Sapiens; identical to SEQ ID NO: 58781

SEQ ID NO: 115863 - RNA, 64 nt, Homo Sapiens; identical to SEQ ID NO: 58782

SEQ ID NO: 115864 - RNA, 54 nt, Homo Sapiens; identical to SEQ ID NO: 58783

SEQ ID NO: 115865 - RNA, 64 nt, Homo Sapiens; identical to SEQ ID NO: 58784

SEQ ID NO: 115866 - RNA, 64 nt, Homo Sapiens; identical to SEQ ID NO: 58785

SEQ ID NO: 115867 - RNA, 64 nt, Homo Sapiens; identical to SEQ ID NO: 58786

SEQ ID NO: 115868 - RNA, 64 nt, Homo Sapiens; identical to SEQ ID NO: 58787

SEQ ID NO: 115869 - RNA, 64 nt, Homo Sapiens; identical to SEQ ID NO: 58788

SEQ ID NO: 115870 - RNA, 64 nt, Homo Sapiens; identical to SEQ ID NO: 58788

SEQ ID NO: 115871 - RNA, 64 nt, Homo Sapiens; identical to SEQ ID NO: 58790

SEQ ID NO: 115872 - RNA, 64 nt, Homo Sapiens; identical to SEQ ID NO: 58791

SEQ ID NO: 115873 - RNA, 64 nt, Homo Sapiens; identical to SEQ ID NO: 58792

SEQ ID NO: 115874 - RNA, 64 nt, Homo Sapiens; identical to SEQ ID NO: 58793

SEQ ID NO: 115875 - RNA, 64 nt, Homo Sapiens; identical to SEQ ID NO: 58794

SEQ ID NO: 115876 - RNA, 64 nt, Homo Sapiens; identical to SEQ ID NO: 58795

SEQ ID NO: 115877 - RNA, 64 nt, Homo Sapiens; identical to SEQ ID NO: 58796

SEQ ID NO: 115878 - RNA, 64 nt, Homo Sapiens
uuaagccucuaaaagaccucgggcaagucucacagaaacugagcugcagacggggaguagcuuu

SEQ ID NO: 115879 - RNA, 64 nt, Homo Sapiens
agaaacugagcugcagacggggaguagcuuuguggaaacugauuugauggacacugcaccagcu

SEQ ID NO: 115880 - RNA, 64 nt, Homo Sapiens
uggaaaggugguucauguucauucucaucagugugaaacugaggagucugcaauuuggaauaug

SEQ ID NO: 115881 - RNA, 64 nt, Homo Sapiens
uggccacuguggaaaucuugguuagggagucaaagaaacugagccuggggcaaacgaggcuucc

SEQ ID NO: 115882 - RNA, 64 nt, Homo Sapiens
ccaggagaagaagagggagaaauguacauacggggaaacugaagucauccagucuuacugucuc

SEQ ID NO: 115883 - RNA, 64 nt, Homo Sapiens
caggaacaggguucugcccugacccacagguggggaaacugaggcauacccagcccuauacgca

SEQ ID NO: 115884 - RNA, 64 nt, Homo Sapiens
gugcaaaugugugcucaagcuaauaaguuauugugaaacugaguuuccuuuaacuuacaaagcu

SEQ ID NO: 115885 - RNA, 64 nt, Homo Sapiens
aaaaaugggaaacagacuaaauggcuauucacaggaaacugauaagauauauguuauuuuuuua

SEQ ID NO: 115886 - RNA, 64 nt, Homo Sapiens
ucguuuucacaaaacuauuugaguagaauaaauggaaacugaauuccauuugugcccguuaaac

SEQ ID NO: 115887 - RNA, 64 nt, Homo Sapiens
uauuuaaagucagauuuauagacucgaggagacagaaacugaaucccacaccuggugcaauuag

SEQ ID NO: 115888 - RNA, 64 nt, Homo Sapiens
uauaacaccagagcuugcuggaaaaaugcuuucugaaacugagggguucaaaauucuguugaaa

SEQ ID NO: 115889 - RNA, 64 nt, Homo Sapiens
ugacaagagaauaauuuacaaugaaugggguugugaaacugauuuguuaagccuguaggacugg

SEQ ID NO: 115890 - RNA, 53 nt, Homo Sapiens
aaaagggaaagagaaagugagaagaaacugaagauggacucuauuaugugaag

SEQ ID NO: 115891 - RNA, 64 nt, Homo Sapiens
agauggacucuauuaugugaaguaguaauguucagaaacugauuauuuggaucagaaaccauug

SEQ ID NO: 115892 - RNA, 64 nt, Homo Sapiens
uauaaagguuacacauuuucaucauuuuguuauagaaacugauauaggaagaaaacaugacuuu

SEQ ID NO: 115893 - RNA, 64 nt, Homo Sapiens
ccauuauuucaaccgcuugcgcacccaugccauagaaacugagggagcucuaacagaccgauuu

SEQ ID NO: 115894 - RNA, 64 nt, Homo Sapiens
agcagaugaaugacuccaggaagaagguuaucaugaaacugaacucaccauuucuauuaauuuc

SEQ ID NO: 115895 - RNA, 64 nt, Homo Sapiens
ugaaaaaagggcaccuuugucacuugaaaggaaugaaacugaaugcaaaauaagcuaauuccau

SEQ ID NO: 115896 - RNA, 64 nt, Homo Sapiens
uggccuuaagggagcaaguuacuuuaugaaugaggaaacugaaagagcuuuaguuuguauuuuc

SEQ ID NO: 115897 - RNA, 64 nt, Homo Sapiens
ugagcccaguauccaaggaugacagguauccccugaaacugagcgcuuggaggaccgagccacu

SEQ ID NO: 115898 - RNA, 64 nt, Homo Sapiens
cuuaggaagagaaugaaacuauugcacagauggggaaacugaggcuauggaauccaaccucccc

SEQ ID NO: 115899 - RNA, 64 nt, Homo Sapiens
uucugaaaaucuccuuccagguuuuauaaaagaggaaacugaagcagcucuauauuuuaucccc

SEQ ID NO: 115900 - RNA, 64 nt, Homo Sapiens
uggcccucugugacucgacuguuggaaggggagagaaacugagauagagagguuggaaggggug

SEQ ID NO: 115901 - RNA, 64 nt, Homo Sapiens
guccugcccucuucucuggcgguuccaacugacagaaacugaggacuuaaaauggggaaacuga

SEQ ID NO: 115902 - RNA, 64 nt, Homo Sapiens
uuccaacugacagaaacugaucacuuaaaauggggaaacugaggagaucaacuagccaagucac

SEQ ID NO: 115903 - RNA, 64 nt, Homo Sapiens
agugaaguggcuugauugcuuuucaugauguaaagaaacugaacagguuaauaccaaguauuca

SEQ ID NO: 115904 - RNA, 64 nt, Homo Sapiens; identical to SEQ ID NO: 115903

SEQ ID NO: 115905 - RNA, 64 nt, Homo Sapiens
acuuuuagcuaacaauaagggcugugccccaauggaaacugaguucauuuucugagaaagguuu

SEQ ID NO: 115906 - RNA, 64 nt, Homo Sapiens
ccucuacagucaaggacuuuggcaugugguggcugaaacugagcuuuuuugugugggcuccagu

SEQ ID NO: 115907 - RNA, 64 nt, Homo Sapiens
ucauucauuagguaacaaggauuuagcauauuuugaaacugaagaacuacuggaaacugaaugc

SEQ ID NO: 115908 - RNA, 64 nt, Homo Sapiens
gcauuuagcauauuuugaaagcccagaacuacuggaaacugaauagucuuagcauacagugugu

SEQ ID NO: 115909 - RNA, 64 nt, Homo Sapiens
agagugucagggccgucuccauuuuaugguugaggaaacugaggucuagagaggucaagauuac

SEQ ID NO: 115910 - RNA, 64 nt, Homo Sapiens
agaaguagcaccauuauccccauuuaacagaagggaaacugaggcucggcaagcauaggcgagu

SEQ ID NO: 115911 - RNA, 63 nt, Homo Sapiens
gaccacccagcuuucucccagccacagccaagauucccaaagucaaggcccaaagauuuccaa

SEQ ID NO: 115912 - RNA, 63 nt, Homo Sapiens
auucccaaagucaaggcccaaagauuuccaagguucccaaagucaaggccaggccaaggccug

SEQ ID NO: 115913 - RNA, 63 nt, Homo Sapiens
cuaaaagugcuagagaauuuaacuaaaagcugguucccaaaugcauagcuggcauuuuaauuu

SEQ ID NO: 115914 - RNA, 63 nt, Homo Sapiens
guaaaucaucuaacuggauuuuuccauuggucauucccaaacacaccuaugguccuagaaucc

SEQ ID NO: 115915 - RNA, 63 nt, Homo Sapiens
gggaaguuguugacccaagaacauagguuauauuucccaaaucuuuaauuauugagugaaaga

SEQ ID NO: 115916 - RNA, 63 nt, Homo Sapiens
ccaucccaggaugugagugggucugaagauacauucccaaauaaacgaccuaggcuagaagau

SEQ ID NO: 115917 - RNA, 63 nt, Homo Sapiens
cugcaaaacaggcugauuucaauuaggcagcacuucccaaagugcacugaggaagguggcccc

SEQ ID NO: 115918 - RNA, 63 nt, Homo Sapiens
uccugaccucaggcgauccacccccaccucggcuucccaaagugcugagauuacaggugugag

SEQ ID NO: 115919 - RNA, 63 nt, Homo Sapiens
aauuauagguaccuguuuaggcgauaugcccaguucccaaaucgucaucugcuuuuucguucu

SEQ ID NO: 115920 - RNA, 63 nt, Homo Sapiens
uuguacaaucuguccuggaaauuuacaacgauuuucccaaauuaucaaccccaggaaguaauu

SEQ ID NO: 115921 - RNA, 63 nt, Homo Sapiens
uggcuggucgggaauaccugccuaagucagugguucccaaaucgauagaccuuaaauaagugu

SEQ ID NO: 115922 - RNA, 63 nt, Homo Sapiens
ucuuguaggccguuguuucagaucaaaugucauuucccaaauuuccaauugagaggaaaauga

SEQ ID NO: 115923 - RNA, 63 nt, Homo Sapiens
gaaagccauucugaaacccuagcaagucuugcuuucccaaacaauauacuguagccuuuuaac

SEQ ID NO: 115924 - RNA, 63 nt, Homo Sapiens
aagcccuuccuggcucccacggagugagcgguuuucccaaaacaucuccacugggggcuuacg

SEQ ID NO: 115925 - RNA, 63 nt, Homo Sapiens
uucuaaagaauuuaauucuaaaaguuauagacauucccaaagauauaccugcaagcaucacag

SEQ ID NO: 115926 - RNA, 63 nt, Homo Sapiens
gugaguuuuguaccuucuauuuuaaaagaggcuuucccaaacugugccauuuaucaauuuauu

SEQ ID NO: 115927 - RNA, 63 nt, Homo Sapiens
aaugauuugcacuuuuucacugcaugcuuacaauucccaaaggcaaaaucuguacugagguag

SEQ ID NO: 115928 - RNA, 63 nt, Homo Sapiens
aaccugcuugcuuccuaccacagauucuuuauuuucccaaacacuacaaaaaaacuuuuaaaa

SEQ ID NO: 115929 - RNA, 63 nt, Homo Sapiens
ggcuuuaggcggcagaugauauacauaucugacuucccaaaagcuccaggauuugugugcugu

SEQ ID NO: 115930 - RNA, 63 nt, Homo Sapiens
gggucagcucuuuuuaacuucuugcugcucuuuuucccaaaagguaaaaauauagauugaaaa

SEQ ID NO: 115931 - RNA, 63 nt, Homo Sapiens
uucuuuaugcauugucucaacacuuucccuuuuuucccaaaaugaguagagaauuaaagccac

SEQ ID NO: 115932 - RNA, 63 nt, Homo Sapiens
cauuuuuucuuuucaccacccuguugagcaauuuucccaaaaaaagggcagcaauuauuaaau

SEQ ID NO: 115933 - RNA, 63 nt, Homo Sapiens
uaaaaucuguuuuucucaucacaguaaucccauuucccaaaccugcauuuggauguguaaauu

SEQ ID NO: 115934 - RNA, 63 nt, Homo Sapiens
ccuuauguuuaaucagcgauuacccugagauacuucccaaagcucucugcaguuuuucccaag

SEQ ID NO: 115935 - RNA, 63 nt, Homo Sapiens
gaacauauuacuggggaaagcuaccaauuccuauucccaaaauauacacaaaucuuuacuucu

SEQ ID NO: 115936 - RNA, 63 nt, Homo Sapiens
auugcugaaaaaguagauuguaucuugggauaguucccaaaaggaugcacuuaugcaguaaau

SEQ ID NO: 115937 - RNA, 63 nt, Homo Sapiens
ucagugucuagggacuaguuuucucuuacauccuucccaaaaacccuaaaucugagucaguaa

SEQ ID NO: 115938 - RNA, 63 nt, Homo Sapiens
ucagugucuagggacugguuucucuaaaaauccuucccaaaaaccuaaaucugagucaguaau

SEQ ID NO: 115939 - RNA, 63 nt, Homo Sapiens
cauuuggauguacagaucgaacguagguguagauucccaaaugauauaacauuaaauaaugua

SEQ ID NO: 115940 - RNA, 63 nt, Homo Sapiens
cuagcucauuaaagaugaaauacauggcuaaucuucccaaaaaugcaguaggcauuacuacag

SEQ ID NO: 115941 - RNA, 63 nt, Homo Sapiens
gacgagccuugccugaccucuucggugcugaccuucccaaagugaugccuuacugguuuugua

SEQ ID NO: 115942 - RNA, 63 nt, Homo Sapiens
auguugaguuaccaauggaagccaaaaguucucuucccaaacugccaagaaugauacaggcca

SEQ ID NO: 115943 - RNA, 63 nt, Homo Sapiens
acaaagcaguuuuucccccuuuucagagacaacuucccaaagccugcguccucuguccccggg

SEQ ID NO: 115944 - RNA, 63 nt, Homo Sapiens
ugucuccccagaagacacaguccccuccacuccuucccaaaucuccacaccccccuuggggcc

SEQ ID NO: 115945 - RNA, 63 nt, Homo Sapiens
cagcaucuguccccagaaucaggcagaauccacuucccaaacagagccccacgcagguucacc

SEQ ID NO: 115946 - RNA, 63 nt, Homo Sapiens
uuuuuacuuggcauugguuuugaaaccagcuguuucccaaacucugcuucccaagggcaaccg

SEQ ID NO: 115947 - RNA, 63 nt, Homo Sapiens
cuaacugcagcucagcuuucacuauagcagugcuucccaaacggguucuagacuuggguguuu

SEQ ID NO: 115948 - RNA, 63 nt, Homo Sapiens
aggggggccugccaagggggggccuuguucuuguucccaaacucugacuuggaagaacucagc

SEQ ID NO: 115949 - RNA, 63 nt, Homo Sapiens
cuguuuaggcauuugugaaggauuccagagccuuucccaaagugagaccauuucugggguauu

SEQ ID NO: 115950 - RNA, 63 nt, Homo Sapiens
uuagcuuugugucaccuuugaaucugaggcaguuucccaaacaaaaaggcuggagccauuuuu

SEQ ID NO: 115951 - RNA, 63 nt, Homo Sapiens
uggagccauuuuucagaaguugcuuauacccuguucccaaacuaucagccuugauuaauuucu

SEQ ID NO: 115952 - RNA, 63 nt, Homo Sapiens
caguuauucauguuuucauuucuacaauuacaguucccaaaguguuuuuggaaaaacaaaauu

SEQ ID NO: 115953 - RNA, 63 nt, Homo Sapiens
cacaguuguucauguuauuuucuacaauuacaguucccaaagaguucuuggauaaagaaaauu

SEQ ID NO: 115954 - RNA, 63 nt, Homo Sapiens
gaggaccgacuuuauaacuuuuccaguguuugauucccaaauugggucugguuuuguuuugga

SEQ ID NO: 115955 - RNA, 63 nt, Homo Sapiens
gauugcuucagaugaaaacaaaucacacaccguuucccaaaccaacagucuucacauuucuau

SEQ ID NO: 115956 - RNA, 64 nt, Homo Sapiens; identical to SEQ ID NO: 110360

SEQ ID NO: 115957 - RNA, 64 nt, Homo Sapiens; identical to SEQ ID NO: 110361

SEQ ID NO: 115958 - RNA, 64 nt, Homo Sapiens; identical to SEQ ID NO: 110362

SEQ ID NO: 115959 - RNA, 64 nt, Homo Sapiens; identical to SEQ ID NO: 110363

SEQ ID NO: 115960 - RNA, 64 nt, Homo Sapiens; identical to SEQ ID NO: 110364

SEQ ID NO: 115961 - RNA, 64 nt, Homo Sapiens; identical to SEQ ID NO: 110365

SEQ ID NO: 115962 - RNA, 64 nt, Homo Sapiens; identical to SEQ ID NO: 110366

SEQ ID NO: 115963 - RNA, 64 nt, Homo Sapiens; identical to SEQ ID NO: 110367

SEQ ID NO: 115964 - RNA, 64 nt, Homo Sapiens; identical to SEQ ID NO: 110368

SEQ ID NO: 115965 - RNA, 64 nt, Homo Sapiens; identical to SEQ ID NO: 110369

SEQ ID NO: 115966 - RNA, 64 nt, Homo Sapiens; identical to SEQ ID NO: 110370

SEQ ID NO: 115967 - RNA, 64 nt, Homo Sapiens; identical to SEQ ID NO: 110371

SEQ ID NO: 115968 - RNA, 64 nt, Homo Sapiens; identical to SEQ ID NO: 110372

SEQ ID NO: 115969 - RNA, 64 nt, Homo Sapiens; identical to SEQ ID NO: 110373

SEQ ID NO: 115970 - RNA, 64 nt, Homo Sapiens; identical to SEQ ID NO: 110374

SEQ ID NO: 115971 - RNA, 64 nt, Homo Sapiens; identical to SEQ ID NO: 110375

SEQ ID NO: 115972 - RNA, 64 nt, Homo Sapiens; identical to SEQ ID NO: 110376

SEQ ID NO: 115973 - RNA, 64 nt, Homo Sapiens; identical to SEQ ID NO: 110377

SEQ ID NO: 115974 - RNA, 64 nt, Homo Sapiens; identical to SEQ ID NO: 110378

SEQ ID NO: 115975 - RNA, 64 nt, Homo Sapiens; identical to SEQ ID NO: 110379

SEQ ID NO: 115976 - RNA, 64 nt, Homo Sapiens; identical to SEQ ID NO: 110380

SEQ ID NO: 115977 - RNA, 64 nt, Homo Sapiens
aaacuccugaccucaggugauccgcccaccucagccucccaaagugcugggaugacagguguga

SEQ ID NO: 115978 - RNA, 64 nt, Homo Sapiens
cgccucucagguucaagugguucuccuuccucagccucccaaguagcugggauuacaggcaccu

SEQ ID NO: 115979 - RNA, 64 nt, Homo Sapiens
aguaugguaggggguuugaagaauccccuguccaccucccaaauccaggcccggcccccucugg

SEQ ID NO: 115980 - RNA, 64 nt, Homo Sapiens
ucaaucuccugaccucgugauccacccaccucgaccucccaaagugcugagauuacaggcguga

SEQ ID NO: 115981 - RNA, 64 nt, Homo Sapiens
aaacuccugaccucaagugaucugcccgccucggccucccaaagugcuggaaccacaggccuga

SEQ ID NO: 115982 - RNA, 64 nt, Homo Sapiens
aggaucucuuggccucaugaucagccugccucggccucccaaagugcugggauuacagguguga

SEQ ID NO: 115983 - RNA, 64 nt, Homo Sapiens
cgccuccuggguucaagcaguucucuugccucagccucccaaguagcugggaugacaggcgcac

SEQ ID NO: 115984 - RNA, 64 nt, Homo Sapiens
gaacuccugaccucaggugauccacccaccuuggccucccaaagugcugggauuacagguguga

SEQ ID NO: 115985 - RNA, 64 nt, Homo Sapiens
cucugccucccggguucaagccauucugccucagccucccaaguagcugggaguacaggcgucu

SEQ ID NO: 115986 - RNA, 64 nt, Homo Sapiens
ucgauauccugaucucgugauccgccugccucugccucccaaagugcugggauuacagguguga

SEQ ID NO: 115987 - RNA, 64 nt, Homo Sapiens
gaacuccuaaccucgggugauccacccaccuuggccucccaaaguguuaggauuacaggcauga

SEQ ID NO: 115988 - RNA, 64 nt, Homo Sapiens
uugaucucuugaccucgugauccguccaccucagccucccaaagugcugggauuacagguguga

SEQ ID NO: 115989 - RNA, 64 nt, Homo Sapiens
ggacuccugaccucaggucauccuccugccucggccucccaaagugcugagacuacagguguga

SEQ ID NO: 115990 - RNA, 64 nt, Homo Sapiens
agaagaucucugccuacaugaaguccagccgcuuccucccaaaaccucuguacacaaggguggc

SEQ ID NO: 115991 - RNA, 64 nt, Homo Sapiens
gccucagcuacccacuuuccuucaugaacaucccccucccaacacuacccuucccugcacuaaa

SEQ ID NO: 115992 - RNA, 64 nt, Homo Sapiens
aaacuccuggccucaggugauccucuugucucagccucccaaagugcugggauuacaggcauga

SEQ ID NO: 115993 - RNA, 64 nt, Homo Sapiens
ugccucuuggguucaagcgauucuccugccucagccucccaaguagcugggauuacaggcauac

SEQ ID NO: 115994 - RNA, 64 nt, Homo Sapiens
gaacuccugaccucaaguaaucugcccaccucggccucccaaagugcuaggauuacaggaguga

SEQ ID NO: 115995 - RNA, 64 nt, Homo Sapiens
ugcccuccagguucaagugauucuccucccucagccucccaaguagcugggauuacaggcaccc

SEQ ID NO: 115996 - RNA, 64 nt, Homo Sapiens
gaauuccagaccucaggugauccacccgccucggccucccaaagugcugggauuacaggugcga

SEQ ID NO: 115997 - RNA, 64 nt, Homo Sapiens
ugccuccugggcucaagcaauccucccacuucagccucccaaauagcuggggcuaccaugguau

SEQ ID NO: 115998 - RNA, 64 nt, Homo Sapiens
aaacuccuggccucaugugaucugcccaccucagccucccaaaguacagggauuagaguuguga

SEQ ID NO: 115999 - RNA, 64 nt, Homo Sapiens
ugcugggauuacaggcgugauccgcccgccucggccucccaaaggaacuccugaccucagguga

SEQ ID NO: 116000 - RNA, 64 nt, Homo Sapiens
agcugggauuacaggcacccuucuccugccucagccucccaagucaccucccggguucaaguga

SEQ ID NO: 116001 - RNA, 64 nt, Homo Sapiens
uacugggauuuaggcaugagucugccugcuucagccucccaaaggaacuacugagcucaagcaa

SEQ ID NO: 116002 - RNA, 64 nt, Homo Sapiens
uacacccucaaguagacccccugaucuucucccuccucccaaccaauacccaauagguuuuuuu

SEQ ID NO: 116003 - RNA, 64 nt, Homo Sapiens
ugcugggauuacuagacguauccacccacuuugaccucccaaagaaacuucugaccucagguga

SEQ ID NO: 116004 - RNA, 64 nt, Homo Sapiens
uguggggauuacaggugcgauccuccugccucagccucccaaaggaacuccuggccucaagugg

SEQ ID NO: 116005 - RNA, 64 nt, Homo Sapiens
ugcugggauuacaggugugauccacccgccucagccucccaaaggaacuccuaaccucaaguga

SEQ ID NO: 116006 - RNA, 64 nt, Homo Sapiens
uucugggauuacaggugugaucugcccaccucggccucccaaagucgaacuccugaccucguaa

SEQ ID NO: 116007 - RNA, 64 nt, Homo Sapiens
guuuccccuucacacuccugcguucacccacccuccucccaauuuccggccucugcucucccca

SEQ ID NO: 116008 - RNA, 64 nt, Homo Sapiens
ugcugggauuacaggcgugaucugccugccuuggccucccaaagucgaucucuugaccucguga

SEQ ID NO: 116009 - RNA, 64 nt, Homo Sapiens
uccauuucugucacccuuuuugcugugcugcuucccucccaaaccaucacuccccacuucuuuc

SEQ ID NO: 116010 - RNA, 64 nt, Homo Sapiens
ugcugggauuacaggcgugauccgccugccucugccucccaaagucgaucuccugaccucguga

SEQ ID NO: 116011 - RNA, 64 nt, Homo Sapiens
agcugggacuacaggcgccuuucuccugccucacccucccaagucgccucccagguugacacca

SEQ ID NO: 116012 - RNA, 64 nt, Homo Sapiens
gaacuccuggccucaagcaauccucucuccucagccucccaaagugcugggauuacaaguguga

SEQ ID NO: 116013 - RNA, 64 nt, Homo Sapiens
aaacuccuggguucaagcaauccucccaccucggccucccaaagugcugggauugcaggcauga

SEQ ID NO: 116014 - RNA, 64 nt, Homo Sapiens
gagguuguggaauuucuuucuucuccccuucuucccucccaaaagcuuagcuauguauaaagug

SEQ ID NO: 116015 - RNA, 64 nt, Homo Sapiens
aauuaugaucugacuggaaaacaauccuguauccccucccaaagaaucaugggcuuuuuuuuug

SEQ ID NO: 116016 - RNA, 64 nt, Homo Sapiens
aaacuccuaggcuuaagugauccucccgccuuagccucccaagugcuaggauuacaggcaucag

SEQ ID NO: 116017 - RNA, 64 nt, Homo Sapiens
ugccucccagcuucaagcgauucuccuguaucagccucccaaguagcugggauuauaggcaugu

SEQ ID NO: 116018 - RNA, 64 nt, Homo Sapiens
ugccucccggauucaagugauucuccugucucagccucccaaguagcugggauuacagugccug

SEQ ID NO: 116019 - RNA, 64 nt, Homo Sapiens
ucgaacuccugaccucaugagccgcccgccuuggccucccaaagugcugggacgugacaggagu

SEQ ID NO: 116020 - RNA, 64 nt, Homo Sapiens
ugcugggauuacaggcuugaucuacccaccuugaccucccaaaggaacucuugagcucaagcag

SEQ ID NO: 116021 - RNA, 64 nt, Homo Sapiens
agcugggacuauaggcaugcuccucccacuucaaccucccaaguugccuucugggcucaagcaa

SEQ ID NO: 116022 - RNA, 64 nt, Homo Sapiens
uggugagauuacaggcaugaucccccugccuuggccucccaaacaaacuccugggcucaaguga

SEQ ID NO: 116023 - RNA, 64 nt, Homo Sapiens
aacuggggccacaggugugcccccgcugccucagccucccaaauauggcucacugaagucuuga

SEQ ID NO: 116024 - RNA, 64 nt, Homo Sapiens
ugcugggauuacaggugugauccgcccgccucagccucccaaagaaacucuugacuucaaguga

SEQ ID NO: 116025 - RNA, 64 nt, Homo Sapiens
agcugggauuaaaggcacguuucuugugccucagccucccaagucaccuccuggguucaaguga

SEQ ID NO: 116026 - RNA, 64 nt, Homo Sapiens
agcugagauuacaggcgugaucugucugccucggccucccaaagaaacuccugacuucagguga

SEQ ID NO: 116027 - RNA, 64 nt, Homo Sapiens
agcugggacuaugggugcacuucuccuaccucagccucccaagucaccuccugaguucaagcca

SEQ ID NO: 116028 - RNA, 64 nt, Homo Sapiens
cucccccuggguugaagcaauucucaugccucagccucccaaguagccaggacuauaggcaccu

SEQ ID NO: 116029 - RNA, 64 nt, Homo Sapiens
ucgaucucuugaccuugggauccacccgccuuggccucccaaagugcugggauuacagguguga

SEQ ID NO: 116030 - RNA, 64 nt, Homo Sapiens
gaaacccuuggcucaagcaauuugccugccucagccucccaaagugcugggauuacaggcguga

SEQ ID NO: 116031 - RNA, 64 nt, Homo Sapiens
caccuccuggguucaugccauucuucugccucagccucccaaguagcugggacuacaggugccc

SEQ ID NO: 116032 - RNA, 64 nt, Homo Sapiens
ucgaucuccugaccuugugauccaccugucucggccucccaaagugcugggauuacaggccuca

SEQ ID NO: 116033 - RNA, 64 nt, Homo Sapiens
gaacuccugaccuccagugauccgccugccuugaccucccaaagugcugggauuacagacauga

SEQ ID NO: 116034 - RNA, 64 nt, Homo Sapiens
aacuccuggacuuaacgccauccaccugccacagccucccaaagugcuaggaauacaggagugc

SEQ ID NO: 116035 - RNA, 64 nt, Homo Sapiens
ccgccuccugggucaaaugauucuccugcuuuagccucccaaguagcugggacuacagguguac

SEQ ID NO: 116036 - RNA, 64 nt, Homo Sapiens
aaacuccugagcucaagugauccucccgucucagccucccaaagggcugagauuacagguguga

SEQ ID NO: 116037 - RNA, 64 nt, Homo Sapiens
aaccuccccggcucaagugauccuccugccucagccucccaaguagcugggacuacaggcguuc

SEQ ID NO: 116038 - RNA, 64 nt, Homo Sapiens
gaacuccuggacucaaaguauccucccgccucggccucccaaaguguugggauuauaggaguga

SEQ ID NO: 116039 - RNA, 64 nt, Homo Sapiens
cgaacuccuggccuaggugauccacccgccucgaccucccaaagugcugggauuacaggcauga

SEQ ID NO: 116040 - RNA, 64 nt, Homo Sapiens
gcuaccucuaccaugagcaauucuccugccucagccucccaaguagcuggaacuacaggcucau

SEQ ID NO: 116041 - RNA, 64 nt, Homo Sapiens
ucaaacuccugacuuugugauccacccgccucggccucccaaagugcugggauuacaggcauga

SEQ ID NO: 116042 - RNA, 64 nt, Homo Sapiens
ugcugggauuacaggugugauccacccgccucggccucccaaaaucgaucuccugacgucguga

SEQ ID NO: 116043 - RNA, 64 nt, Homo Sapiens
ugcugggauuacaggcgugauccacccaccucugccucccaaagaaacuccugggcucaagcaa

SEQ ID NO: 116044 - RNA, 64 nt, Homo Sapiens
ugcugggauuacagaugugauccuccugccucggccucccaaagaaccuccugggcucaagcaa

SEQ ID NO: 116045 - RNA, 64 nt, Homo Sapiens
agcugggaucacuggcacaauucucccaccucagccucccaaauugccuccugggcucaagcaa

SEQ ID NO: 116046 - RNA, 64 nt, Homo Sapiens
ggaagacagcucgagauccaaaaccauugucuuaccucccaacuccccucuccucccaaaccaa

SEQ ID NO: 116047 - RNA, 64 nt, Homo Sapiens
caaaaaccauugucuuaccuugccgccccccucuccucccaaacgacaaauaaucucuuggauc

SEQ ID NO: 116048 - RNA, 64 nt, Homo Sapiens
ugcugggauuacaggugugaauccucccaccuugccucccaaagucgaacucuggguucaagaa

SEQ ID NO: 116049 - RNA, 64 nt, Homo Sapiens
agcugggauuacaggcgugcuucuugugccuuagccucccaaguugccuucuggauucaaguga

SEQ ID NO: 116050 - RNA, 64 nt, Homo Sapiens
acccacuugauuauguauuugucaaaggcaucauccucccaacuagguuucauuucagggcaua

SEQ ID NO: 116051 - RNA, 64 nt, Homo Sapiens
ugcugggauugcaggcaugauccacccgccucagccucccaaaguugaucuccugaccucguga

SEQ ID NO: 116052 - RNA, 64 nt, Homo Sapiens
ugcugggauuacaggcaugauccaccugccucagccucccaaaggaacuccugaccucagguga

SEQ ID NO: 116053 - RNA, 64 nt, Homo Sapiens
agcugggacuacaggugcauuucuccugccucagccucccaaguugccucccgaguucaagcaa

SEQ ID NO: 116054 - RNA, 64 nt, Homo Sapiens
gaacuccugaccucaggugaucugcccaccuuggccucccaaagugcugggauuacaggcauga

SEQ ID NO: 116055 - RNA, 64 nt, Homo Sapiens
gaacuccugaccucaacugauccgcccaccuuggccucccaagugcugggauuacaggcgcgag

SEQ ID NO: 116056 - RNA, 64 nt, Homo Sapiens
caccuccuggguucaagcauuucuccugccucagccucccaaguagcugggauuacaggcagca

SEQ ID NO: 116057 - RNA, 64 nt, Homo Sapiens
aaacuccugaccucaagugauccgcccuccccagccucccaaagugcugggauuacagguguga

SEQ ID NO: 116058 - RNA, 64 nt, Homo Sapiens
gcaguggcgcaaucucgggucacugcaagcucugccucccaaguucaugccauucuccugccuc

SEQ ID NO: 116059 - RNA, 64 nt, Homo Sapiens
ugccucccaaguucaugccauucuccugccucagccucccaaguagcugggacuacaggcaccu

SEQ ID NO: 116060 - RNA, 64 nt, Homo Sapiens
gucuugaucugaccucgugauccgccgaccucggccucccaaagugcuggaauuacaggcguga

SEQ ID NO: 116061 - RNA, 64 nt, Homo Sapiens
cugccucccaguucaagcaauucuucugccucagccucccaaguagcugggauuacaggcaccc

SEQ ID NO: 116062 - RNA, 64 nt, Homo Sapiens
aaacuucugaccucaagugaucugcccaccuuggccucccaaagugcugggauuacagguguaa

SEQ ID NO: 116063 - RNA, 64 nt, Homo Sapiens
caccucccagguucaagcaauucuucugccucagccucccaaguagcugggauuacaggugccu

SEQ ID NO: 116064 - RNA, 64 nt, Homo Sapiens
aaacuccugaccucaagugauccaccugccucagccucccaaagugcugggauuauagucguga

SEQ ID NO: 116065 - RNA, 64 nt, Homo Sapiens
uugaucucuugaccucgugaucugccugccucggccucccaaagugcuggcauuacaggcauga

SEQ ID NO: 116066 - RNA, 64 nt, Homo Sapiens
caccucccggguucaagugauucucuggccucagccucccaaguagcugggacuacaggugugu

SEQ ID NO: 116067 - RNA, 64 nt, Homo Sapiens
aaacuccugaccuccagugaucugcccaccucggccucccaaagugcugggauuacagguguga

SEQ ID NO: 116068 - RNA, 64 nt, Homo Sapiens
ugcugggauuacaggugugaaccacccgucucggccucccaaagucaaucuccugaccuuguga

SEQ ID NO: 116069 - RNA, 64 nt, Homo Sapiens
agcugggacuacaggcacccuucuccuggcucagccucccaaguugcuucccagguucacgcca

SEQ ID NO: 116070 - RNA, 64 nt, Homo Sapiens
uacugggauuacaggcuugaucuucccacaccagccucccaaaaaaacccuugagcucaaguga

SEQ ID NO: 116071 - RNA, 64 nt, Homo Sapiens
agcuaggacuacagacauguuccucccaucucagccucccaagugaccuccuugacucaauuga

SEQ ID NO: 116072 - RNA, 64 nt, Homo Sapiens
ugcugggauuacaggcaugaucugccagccuccgccucccaacguuggccucgaacucagguga

SEQ ID NO: 116073 - RNA, 64 nt, Homo Sapiens
agcugggacuacaggcauguuucucaugccucagccucccaagcugcuuccuggguucaaacaa

SEQ ID NO: 116074 - RNA, 64 nt, Homo Sapiens
ucgaucuccugaccucaugauccacccgccucagccucccaaaguguugggauuacaggcguga

SEQ ID NO: 116075 - RNA, 64 nt, Homo Sapiens
ugccuccuggguucaagcgauucuccugccucugccucccaaguagcugggauuacaggcaccc

SEQ ID NO: 116076 - RNA, 64 nt, Homo Sapiens
caccuuccugguucaagggauucuccugccucagccucccaaguagcugggauuacaggcaugc

SEQ ID NO: 116077 - RNA, 64 nt, Homo Sapiens
gaacuucugaccucaggugaucugcccaccucggccucccaaagugcugggauuacaggcguga

SEQ ID NO: 116078 - RNA, 64 nt, Homo Sapiens
gaacuccugggcucaagugauccuccugccuuggccucccaaaaugcugggauuacaggcauga

SEQ ID NO: 116079 - RNA, 64 nt, Homo Sapiens
cgccucccggguucaagcaauucuccugccucagccucccaaguagcugggauuacaggugucu

SEQ ID NO: 116080 - RNA, 64 nt, Homo Sapiens
gaacuccugaccucaggugauccacccgccucagccucccaaagugcugggauuacaggcaaaa

SEQ ID NO: 116081 - RNA, 64 nt, Homo Sapiens
ucgaacuccugaccuugugaugcucccaccucggccucccaaagugcugggauuaaagcuguga

SEQ ID NO: 116082 - RNA, 64 nt, Homo Sapiens
ucgaucuccugaccucaugauccucccgccucagccucccaaaaugcugggauuacaggcguga

SEQ ID NO: 116083 - RNA, 64 nt, Homo Sapiens
ugccuccugggcucaacggauccuuccaccucagccucccaaguagcuuggacuauaggugcau

SEQ ID NO: 116084 - RNA, 64 nt, Homo Sapiens
gaacuccugggcucaagccauccucccuccucagccucccaaaauucugggauuacaggcauaa

SEQ ID NO: 116085 - RNA, 64 nt, Homo Sapiens
uuaaacucuugaccucauguuccacccgccacggccucccaaagugcugugauuaccgguguga

SEQ ID NO: 116086 - RNA, 64 nt, Homo Sapiens
uaacuucugagcucaagagaugcacuccccucagccucccaaagugcugggauuacaggcggcc

SEQ ID NO: 116087 - RNA, 64 nt, Homo Sapiens
aacugauguuuguuuuuuaaaggguaagaugcugccucccaaugggugaugccaucugacuggu

SEQ ID NO: 116088 - RNA, 64 nt, Homo Sapiens
caccucccagguucaagugauucuccugucucagccucccaaguagcugggacuacaggcauga

SEQ ID NO: 116089 - RNA, 64 nt, Homo Sapiens
aggaccugagccagaugcacaccaucucugauggccucccaaaccaaugugccuguuucucuuc

SEQ ID NO: 116090 - RNA, 64 nt, Homo Sapiens
ccacauccccugcuugagcccagcgcugcaugucccucccaagaaguccagaaugccugcaaau

SEQ ID NO: 116091 - RNA, 64 nt, Homo Sapiens
ugcugggauuacagggacgauccucucaucuuggccucccaaagggacuccugguuucaaguga

SEQ ID NO: 116092 - RNA, 64 nt, Homo Sapiens
ugcuaggauuacaggcgugaauccgccgccucggccucccaaaggucucgaacucgaccucgug

SEQ ID NO: 116093 - RNA, 64 nt, Homo Sapiens
ugcugggacuacaggcaugaucuuccuaucucagccucccaaaggaacuccuggucucgaguga

SEQ ID NO: 116094 - RNA, 64 nt, Homo Sapiens
aacuaagacuacaggcaugcuccugcugucucagccucccaagucaacuccugggcucaagcaa

SEQ ID NO: 116095 - RNA, 64 nt, Homo Sapiens
ugcuggauuacaggcgugagucuuccggccucagccucccaaaggaacuccugaccucaaguga

SEQ ID NO: 116096 - RNA, 64 nt, Homo Sapiens
agcugggauuacaccaccaugccucccaggucagccucccaagucuuggcucauugcaaccucu

SEQ ID NO: 116097 - RNA, 64 nt, Homo Sapiens
agcuggauuacaggcauacauucuccugccucagccucccaaguuaacucccagguucaagcua

SEQ ID NO: 116098 - RNA, 64 nt, Homo Sapiens
gcugucuccaguucuaguucguuaucgcugcuguccucccaacaucgcuacagggcaccuaucu

SEQ ID NO: 116099 - RNA, 64 nt, Homo Sapiens
uacugggauuacaggcaccuuucuccugccucagccucccaauucgccucccagguucaagcga

SEQ ID NO: 116100 - RNA, 64 nt, Homo Sapiens
ugcugggauuacaggcgugauucaccugccucggccucccaaaggaacuccugaccucaaguga

SEQ ID NO: 116101 - RNA, 64 nt, Homo Sapiens
agcugggauuacaggcaugugucuccugucucagccucccaaguuaccuccuggguucaagcaa

SEQ ID NO: 116102 - RNA, 64 nt, Homo Sapiens
uguucuguauuuagguaguuuguuugacccacauccucccaauuagcugaguggagcucagcug

SEQ ID NO: 116103 - RNA, 64 nt, Homo Sapiens
ugcugggauuacaggugugauccacccaccucagccucccaaagaacuuccugaccucagguua

SEQ ID NO: 116104 - RNA, 64 nt, Homo Sapiens
agcugggguuacaggcgcccuucucgugccucagccucccaagucaccuccuggguucaaguga

SEQ ID NO: 116105 - RNA, 64 nt, Homo Sapiens
ugcugggauuacaggcgugauccacccgccuuggccucccaaagucaaucuccugaccucguga

SEQ ID NO: 116106 - RNA, 64 nt, Homo Sapiens
ucacuccauucuccugccuccacugcaagcuccgccucccaaguacaguggcgcgaucucagcu

SEQ ID NO: 116107 - RNA, 64 nt, Homo Sapiens
ugcugagauuacaagugugauccacuugccucggccucccaaagaaacuccugaccucagguga

SEQ ID NO: 116108 - RNA, 64 nt, Homo Sapiens
agcuaggauuacaagugccuuucuucugccucagccucccaagucaccuccuggguucaagcga

SEQ ID NO: 116109 - RNA, 64 nt, Homo Sapiens
ugcugggaucacaggcgugauccacccaccccggccucccaaaagaacucccgaccucagguga

SEQ ID NO: 116110 - RNA, 64 nt, Homo Sapiens
gcucucccgggcuccagugauccucccgccucagccucccaaguagcugggauuauaggugugu

SEQ ID NO: 116111 - RNA, 64 nt, Homo Sapiens
aaacucccagccucaagcgaugcucccaccuccaccucccaaagugcugggauuacaggcguga

SEQ ID NO: 116112 - RNA, 64 nt, Homo Sapiens
caccucccagacucaagccauccucccaccucaaccucccaaguagcugggacuacaggcauau

SEQ ID NO: 116113 - RNA, 64 nt, Homo Sapiens
gaaauucugggcuaaagcaauccuaccaccuuggccucccaaagugcugagauuacaggcauga

SEQ ID NO: 116114 - RNA, 64 nt, Homo Sapiens
ugccucccagguucaagugauucuccugccucagccucccaaguagcugggauuacaggcgugc

SEQ ID NO: 116115 - RNA, 64 nt, Homo Sapiens
gaacucccgaccucaggugauccgccagccucagccucccaaagugcugggauuacaggcguga

SEQ ID NO: 116116 - RNA, 64 nt, Homo Sapiens
aaauuccugaccucaagugauccaccugccuuagccucccaaagugcugggauuacaggcauga

SEQ ID NO: 116117 - RNA, 64 nt, Homo Sapiens
ucgaucucuugaccuuguguuccacccgccuuggccucccaaagugcuggaauuacaggcauga

SEQ ID NO: 116118 - RNA, 64 nt, Homo Sapiens
ugacuccaggguucaggugauuauuuugccucagccucccaagcagcugggauuauagacaccc

SEQ ID NO: 116119 - RNA, 64 nt, Homo Sapiens
gaacuccugaccucaggugauccgcccgccucggccucccaaagugcugggauuacagacguga

SEQ ID NO: 116120 - RNA, 64 nt, Homo Sapiens
ugcuaggauuacaggcauaauccgccuaccucagccucccaaaggaacuccuggccucaagcga

SEQ ID NO: 116121 - RNA, 64 nt, Homo Sapiens
agcugagacuacaagcacccuucucuugcuucagccucccaagucuccuccuggauucaagcaa

SEQ ID NO: 116122 - RNA, 64 nt, Homo Sapiens
ugcugggauuacaggcuugauccacccgccucggccucccaaagucgaucuccugaccucguga

SEQ ID NO: 116123 - RNA, 64 nt, Homo Sapiens
gcuggcaggccacugugcaucugcacaugcguccccucccaagugcacaacuucaguaaaaaca

SEQ ID NO: 116124 - RNA, 64 nt, Homo Sapiens
gauaggaaacaccugaagcuccagggaacgauggccucccaauaauaaugaguggcagcuggcg

SEQ ID NO: 116125 - RNA, 64 nt, Homo Sapiens
uacuaggaguacaggcauaguccaccuuccucggccucccaaagaaacuccugaguucaagcaa

SEQ ID NO: 116126 - RNA, 64 nt, Homo Sapiens
agcugggaccacaagugugcuccuuccaccucagccucccaaguaacgucccccgcucaggugg

SEQ ID NO: 116127 - RNA, 64 nt, Homo Sapiens
accccaaacaaauggaagaguuauuuaaaacucaccucccaaucccguuagagagcugagaccc

SEQ ID NO: 116128 - RNA, 64 nt, Homo Sapiens
gggcuccucacuaucuagggucagcucugugccaccucccaagaccaccuggaaucccacaaca

SEQ ID NO: 116129 - RNA, 64 nt, Homo Sapiens
ugcugggauuacaggcgugaucugcccgccucggccucccaaagucgaucuccugaccuuguga

SEQ ID NO: 116130 - RNA, 64 nt, Homo Sapiens
uauugggauuacccgcgugauccgcccgccucggccucccaaagucgaucuccuaaccugguga

SEQ ID NO: 116131 - RNA, 64 nt, Homo Sapiens
agcucggacuacaggcguccuucuccugccucagccucccaagucgccucucggguucacgcca

SEQ ID NO: 116132 - RNA, 64 nt, Homo Sapiens
ugcugggauuacaggcgugaucugcccaccucagccucccaaaggaauuccugaccucagguga

SEQ ID NO: 116133 - RNA, 64 nt, Homo Sapiens
uggcaaaaauuagcuauacuggcagaauuccauuccucccaaggguaggauuaauucgaaaaua

SEQ ID NO: 116134 - RNA, 64 nt, Homo Sapiens
uuuuucuuauggcuguugaacuucguaucuugaaccucccaacauguuauacagaauugaaagc

SEQ ID NO: 116135 - RNA, 64 nt, Homo Sapiens
ugcugggauuacaggcgugaucagcccgccucggccucccaaaggaacuccugaccacagguaa

SEQ ID NO: 116136 - RNA, 64 nt, Homo Sapiens
ugcugggauuacaggcuugauccaccugccucagccucccaaaagucuugaacugaccucauga

SEQ ID NO: 116137 - RNA, 64 nt, Homo Sapiens
ugcugugauuacaggugugauccacccgccucgaccucccaaagucgaucucuugaccucauga

SEQ ID NO: 116138 - RNA, 64 nt, Homo Sapiens
ugcugugauuauaggccagacgaucucaagccacccucccaaaauugcccaggucucaaacucc

SEQ ID NO: 116139 - RNA, 64 nt, Homo Sapiens
agcuaggacuacaggcacauuccuuuugcuucagccucccaagcaaacuccugggcucaagaga

SEQ ID NO: 116140 - RNA, 64 nt, Homo Sapiens
ugcugggauuacaggcgugauccuucugccuuggccucccaaagaaacuccugaccucaggugg

SEQ ID NO: 116141 - RNA, 64 nt, Homo Sapiens
ugcugggauuacaggagugaucugcccgccucagccucccaaagucgaucuccugaccucguga

SEQ ID NO: 116142 - RNA, 64 nt, Homo Sapiens
uuuuuuuuuauuuugagcaauucuccugccucagccucccaaauagcugggauuacaggugcau

SEQ ID NO: 116143 - RNA, 64 nt, Homo Sapiens
aaacuccugaccucagaugauccgccugccuuggccucccaaagugcugggauuacaggugugg

SEQ ID NO: 116144 - RNA, 64 nt, Homo Sapiens
gaacuccugaccucaggugauacacccaucucggccucccaaagugcugggauuacaggcuuga

SEQ ID NO: 116145 - RNA, 64 nt, Homo Sapiens
uacaggcuggccucaagugauccucuuaccuuggccucccaaacaccgggauuauaggcgugag

SEQ ID NO: 116146 - RNA, 64 nt, Homo Sapiens
ugcugggauuacaggcgugaucuaccugccucggccucccaaaggaacucccgacgucagguga

SEQ ID NO: 116147 - RNA, 64 nt, Homo Sapiens
uucuaggauuacaggugugauccacccaccuuggccucccaaaguuggacuccugaccucguga

SEQ ID NO: 116148 - RNA, 64 nt, Homo Sapiens
ugcugggauuacaggcaugauccacccgccuuggccucccaaaguugaacuccugaccucguga

SEQ ID NO: 116149 - RNA, 64 nt, Homo Sapiens
aguugggauuacaggcaccuauucucugccucagccucccaagucugccucccggguucaagca

SEQ ID NO: 116150 - RNA, 64 nt, Homo Sapiens
cccuuauuuuuaaaauacuuaggucagaucuuggccucccaaacaaggaguccuucuacagaau

SEQ ID NO: 116151 - RNA, 64 nt, Homo Sapiens
ugcuaggauuacagguaugaucugcccgccuuggccucccaaagaaacuccugagcucaggcaa

SEQ ID NO: 116152 - RNA, 64 nt, Homo Sapiens
ugccucccaguuucaagugauucugcugucucagccucccaaguagcugggacuacaggcaugc

SEQ ID NO: 116153 - RNA, 64 nt, Homo Sapiens
uccaucucuugacauugugauccaccugccucggccucccaaagugcugggauuacaggcauga

SEQ ID NO: 116154 - RNA, 64 nt, Homo Sapiens
uuccugggcuccagggauccacagucccccuuggccucccaaaguguugggauuacaugcauga

SEQ ID NO: 116155 - RNA, 64 nt, Homo Sapiens
uugaacuccugagcucaugauccacccgccucagccucccaaagugcugggauuacaggccccu

SEQ ID NO: 116156 - RNA, 64 nt, Homo Sapiens
gcucacugccugggcucaagugaucuuacuccagccucccaagcagcugggacuacaccaccac

SEQ ID NO: 116157 - RNA, 64 nt, Homo Sapiens
auacuccucaguucacgcauuccucccaccuccaccucccaaacugcugggauuacagguguga

SEQ ID NO: 116158 - RNA, 64 nt, Homo Sapiens
guagaacaugagagacccccucccucaauuuccaccucccaagggaaguuuauguauuuuucua

SEQ ID NO: 116159 - RNA, 64 nt, Homo Sapiens
gaacuccugagcucaagggauccucccgccucagccucccaaagugcugguguuacaggcauaa

SEQ ID NO: 116160 - RNA, 64 nt, Homo Sapiens
ugcugggauuacaggugugauccacucaccucggccucccaaaggaacuccugaccucaaguga

SEQ ID NO: 116161 - RNA, 64 nt, Homo Sapiens
ugcugggauuacaggcaugaugugcccaacucggccucccaaaggaaccccuaggcucaaauga

SEQ ID NO: 116162 - RNA, 64 nt, Homo Sapiens
accugggacuacaggcacgcuccucacaccuuagccucccaaguccaggcucaggcucagguga

SEQ ID NO: 116163 - RNA, 64 nt, Homo Sapiens
uuugagucccuccaaagggcaagcucagccuucuccucccaagggggugggaggggcccacagg

SEQ ID NO: 116164 - RNA, 64 nt, Homo Sapiens
ugcugggaugacaggcaugauccaccggccucggccucccaaaggaacuccuggccucaaguga

SEQ ID NO: 116165 - RNA, 64 nt, Homo Sapiens
ugcugagauuacaggugugauccgcccgccucagccucccaaagaaacuccugaccucagguga

SEQ ID NO: 116166 - RNA, 64 nt, Homo Sapiens
agcugugauuacaggcgugcuucuccugccucagccucccaaaucaccuccuggguuccagcga

SEQ ID NO: 116167 - RNA, 64 nt, Homo Sapiens
cccagcacgcugucaucccccuuucuuguugaauccucccaacagaccaggcaccaccuggaca

SEQ ID NO: 116168 - RNA, 64 nt, Homo Sapiens
ccaacccccaccccguuucccaguauccuccagcccucccaaugucugaggucaggucugaggc

SEQ ID NO: 116169 - RNA, 64 nt, Homo Sapiens
caccucccagguucaagcaauucuccugccucagccucccaaguagcugggauuacaggcaccc

SEQ ID NO: 116170 - RNA, 64 nt, Homo Sapiens
gaacuucugaccucaggugauccaccugccucagccucccaaauugcugggauuacaggcguga

SEQ ID NO: 116171 - RNA, 64 nt, Homo Sapiens
caagcauuccccuuuaagagcuuccacugcacccccucccaagggacacagcgguaggaauggu

SEQ ID NO: 116172 - RNA, 64 nt, Homo Sapiens
gaacuccugaccucaggugauccaccugccuuggccucccaaagcacugggauuacaagcauga

SEQ ID NO: 116173 - RNA, 64 nt, Homo Sapiens
gaacuccugacuucaggugauccacccaucucagccucccaaagugcugggauuacaggcguga

SEQ ID NO: 116174 - RNA, 64 nt, Homo Sapiens
acaugucuucuuucagaaugggaauauaugugugccucccaacauuuacuguuaaaguguguua

SEQ ID NO: 116175 - RNA, 64 nt, Homo Sapiens
gaccuccuggguuccagugauucucaugccucauccucccaaguagcuggaacuacaggugugc

SEQ ID NO: 116176 - RNA, 64 nt, Homo Sapiens
uggucuucuggcuucuggauaucgcccaccuuggccucccaaagugcugggauuacagggauga

SEQ ID NO: 116177 - RNA, 64 nt, Homo Sapiens
ugcugggauuacaggcgugaucuacccgccucggccucccaaagucgaucuccugaccucauga

SEQ ID NO: 116178 - RNA, 64 nt, Homo Sapiens
ugcugggauuacaggcaugauccaccugccucagccucccaaagaaauuccuggccucagguga

SEQ ID NO: 116179 - RNA, 64 nt, Homo Sapiens
agcugggauuacuggcgcccuucuccugccucagccucccaagucaccucccagguucaagcga

SEQ ID NO: 116180 - RNA, 64 nt, Homo Sapiens
ugcuaggauuacuggcgugaucugcccaccucggccucccaaaggucucaaucugaccuuguga

SEQ ID NO: 116181 - RNA, 64 nt, Homo Sapiens
gugcugggauuauaggcguguccgcccgccuuggccucccaaaauugaucuccugaccucguga

SEQ ID NO: 116182 - RNA, 64 nt, Homo Sapiens
uguugcaauuacaggcaugauccuccugccuuggccucccaaaaaaacuccuggccucaagugg

SEQ ID NO: 116183 - RNA, 64 nt, Homo Sapiens
ugcugauaguacaggcaugauuuugaacuccuggccucccaaggugcuuuguugcucaggcugg

SEQ ID NO: 116184 - RNA, 64 nt, Homo Sapiens
cgccucccugguucaagugauucuccuaucucagccucccaaguagcugggacuauaggcacac

SEQ ID NO: 116185 - RNA, 64 nt, Homo Sapiens
aaacuccugaccucaggugauccaccugccucagccucccaaagugcugggauuacaggcguga

SEQ ID NO: 116186 - RNA, 64 nt, Homo Sapiens
ucaaacuucugaccucauaauccacccaccuuggccucccaaagugcuaggauuacaggcauga

SEQ ID NO: 116187 - RNA, 64 nt, Homo Sapiens
gguucaugagaggucugcucucaugaccuaaucaccucccaaaggccccaccucccaauaccau

SEQ ID NO: 116188 - RNA, 64 nt, Homo Sapiens
gcucucaugaccuaaucaccucccaaaggccccaccucccaauaccaucacauuagggguuagg

SEQ ID NO: 116189 - RNA, 64 nt, Homo Sapiens
ugcugggauuacaggcgugauccacccgccucggccucccaaaggaaccucugaccucagguga

SEQ ID NO: 116190 - RNA, 64 nt, Homo Sapiens
agcugggauuacaggugcccuucuccugccucagccucccaagucaccucucagauucaagcaa

SEQ ID NO: 116191 - RNA, 64 nt, Homo Sapiens
ugcugggauuacaggcgugauccguccgccuuggccucccaaagucaaacaccugaccuuguga

SEQ ID NO: 116192 - RNA, 64 nt, Homo Sapiens
agcugggauuacaggcgcagcaauucugacucagccucccaagucucugccucccaggaucaag

SEQ ID NO: 116193 - RNA, 64 nt, Homo Sapiens
ugcuggaauuacuggcgugauucgcccgccucggccucccaaagucgaucuccugaccucguga

SEQ ID NO: 116194 - RNA, 64 nt, Homo Sapiens
cauuaggauuauaggcgugaggcuuccaccucagccucccaaagacugcagccugaaacuccuu

SEQ ID NO: 116195 - RNA, 64 nt, Homo Sapiens
uacugggauuacaggccugaucuacccuccucggccucccaaagcaacuccagaucucagguga

SEQ ID NO: 116196 - RNA, 64 nt, Homo Sapiens
ucaagcgauucuccucucuccacugcaaccuccgccucccaagugcaguggcacgaucucggcu

SEQ ID NO: 116197 - RNA, 64 nt, Homo Sapiens
ugucuagaaaggccauuucgcuuagacaccucauccucccaagcauaugcuggaaguaauugug

SEQ ID NO: 116198 - RNA, 64 nt, Homo Sapiens
uguugggauuacaggcgugauccaccugccuaggccucccaaagucgaucuccugaccucguga

SEQ ID NO: 116199 - RNA, 64 nt, Homo Sapiens
uaccuccuggguucaagggauucuccugccucagccucccaaguagcugggauuacaggcgccu

SEQ ID NO: 116200 - RNA, 64 nt, Homo Sapiens
aaacuccugaccugaggcgaucugcccaccucggccucccaaagugcugggauuacaggcguga

SEQ ID NO: 116201 - RNA, 64 nt, Homo Sapiens
ugccucccggguucgcaccauucuccugccucagccucccaauuagcuuggccuacagucaucu

SEQ ID NO: 116202 - RNA, 64 nt, Homo Sapiens
ucgaucuccugaccucgugauccgcccaccucggccucccaaagugcugggauuacaggcauga

SEQ ID NO: 116203 - RNA, 64 nt, Homo Sapiens
ucaaacuccuaaccucgugauccgccugccucgaccucccaaagugcugggauuacaggcauga

SEQ ID NO: 116204 - RNA, 64 nt, Homo Sapiens
aaaauugggcagcuaaauuuuucaguuccaugugccucccaaauaaaaaacagaaaauaaguag

SEQ ID NO: 116205 - RNA, 64 nt, Homo Sapiens
ucgaucucuugaccucaugaucuacccgccuuggccucccaaagugcugagauuacaggcguga

SEQ ID NO: 116206 - RNA, 64 nt, Homo Sapiens
agacuccuggguucaagcaauccuccugccucagccucccaaguagcugagacuacaggcacga

SEQ ID NO: 116207 - RNA, 64 nt, Homo Sapiens
gaacucuuggccucaaguaauccuccugccucagccucccaaaguguugggauugcagauauga

SEQ ID NO: 116208 - RNA, 64 nt, Homo Sapiens
cucaaccuggguucaagugauccucucaccucagccucccaaguaguugugccuccuaggcaca

SEQ ID NO: 116209 - RNA, 64 nt, Homo Sapiens
gaacaccugggcucaacugauccgccugccucggccucccaaagugcugggauuacagguguga

SEQ ID NO: 116210 - RNA, 64 nt, Homo Sapiens
cgccucccggguucaagugauucuccugccucagccucccaaguaggugggauuacaggcgccc

SEQ ID NO: 116211 - RNA, 64 nt, Homo Sapiens
ucgaacuccugaccucgugauuggcccaccucagccucccaaagugcugguauuacagauguga

SEQ ID NO: 116212 - RNA, 64 nt, Homo Sapiens
ugcugggauuacaggcgugauccacccgccuccgccucccaaaggaacuccugaccgcaaguga

SEQ ID NO: 116213 - RNA, 64 nt, Homo Sapiens
agcugggaauacaggcacgcuuuuccugccucagccucccaagucaccuccuggguucaaguga

SEQ ID NO: 116214 - RNA, 64 nt, Homo Sapiens
gcugggauuacaggcgugagucugccugccucggccucccaagugaacuccugaccucaaguga

SEQ ID NO: 116215 - RNA, 64 nt, Homo Sapiens
agcugggauuacagucaggcuucuccugccucagccucccaagucgcccccuggguucaagcaa

SEQ ID NO: 116216 - RNA, 64 nt, Homo Sapiens
ugcugggauuacagaugugaucugcccgccuuggccucccaaaguaacuccugggcuuaaguga

SEQ ID NO: 116217 - RNA, 64 nt, Homo Sapiens
ugcugggauuacgggugugauccaccuuucucggccucccaaaguaacuccugaccucagguga

SEQ ID NO: 116218 - RNA, 64 nt, Homo Sapiens
agcugagauuacaggcgccuuucuccugccucagccucccaagucaccuccuggguuccagcag

SEQ ID NO: 116219 - RNA, 64 nt, Homo Sapiens
ugcuuggauuacagguguaauccgccugccucggccucccaaagcuugaucuccugacuuguga

SEQ ID NO: 116220 - RNA, 64 nt, Homo Sapiens
uggugggaucacaggcgugauccgccugccuuggccucccaaaggagcuccugaccucagguga

SEQ ID NO: 116221 - RNA, 64 nt, Homo Sapiens
ugcugggauuacaggugugauccgcccacauuggccucccaaaggaacuccugaccucagauga

SEQ ID NO: 116222 - RNA, 64 nt, Homo Sapiens
agcugggauuacaggugcgcuucuccugucucagccucccaaguugccuccuagauucaagcaa

SEQ ID NO: 116223 - RNA, 64 nt, Homo Sapiens
ugcugggauuauaggcgugaauccgcugucuuguccucccaaagcgaacuccugaccucaaaug

SEQ ID NO: 116224 - RNA, 64 nt, Homo Sapiens
agcugggauuacaggugcccuuuuccugccucagccucccaagucgccucccagauucaagcga

SEQ ID NO: 116225 - RNA, 64 nt, Homo Sapiens
aaacuccuggcuucaagagauccacccaccucagccucccaaagcgcuaggauuacaaguauga

SEQ ID NO: 116226 - RNA, 64 nt, Homo Sapiens
gcauguuaggagcgcuggaacguuuauucucuucccucccaauuauccacucuaauggagcaga

SEQ ID NO: 116227 - RNA, 64 nt, Homo Sapiens
gaacuucugaccucagaugaucugcccgccucagccucccaaagugcugggauuacaggcauga

SEQ ID NO: 116228 - RNA, 64 nt, Homo Sapiens
gaacucccgaccucagguaauccgcccgccucggccucccaaaaugcugggauuagagguguga

SEQ ID NO: 116229 - RNA, 64 nt, Homo Sapiens
cgccuccuggguucaagugauucuccugccacagccucccaaguagcugggauuacaggugccu

SEQ ID NO: 116230 - RNA, 64 nt, Homo Sapiens
gaacuccugaccucaguugauccgccugccucagccucccaaagugcugggcuuacaggccuga

SEQ ID NO: 116231 - RNA, 64 nt, Homo Sapiens
uuccuccaggguucaagugauucucccaccucagccucccaaguagcugggacuacgggcacau

SEQ ID NO: 116232 - RNA, 64 nt, Homo Sapiens
aaacuccugaccucaagcgauccacccaccuaggccucccaaagugcugggauuacaggcauga

SEQ ID NO: 116233 - RNA, 64 nt, Homo Sapiens
aaacucccgaccucaggugauccgcccgccugggccucccaaagugcugggauuacaggcguga

SEQ ID NO: 116234 - RNA, 64 nt, Homo Sapiens
agccuccuggauuuaagugauucuccugccucagccucccaaguagcugggauuacaggugugc

SEQ ID NO: 116235 - RNA, 64 nt, Homo Sapiens
ucgaacuccugaccucgugauccgccugccucagccucccaaagugcugggauuacagguguga

SEQ ID NO: 116236 - RNA, 64 nt, Homo Sapiens
ugccuccuggguucaagcaauucucccaccucagccucccaaguagcugggauuacagacgugu

SEQ ID NO: 116237 - RNA, 64 nt, Homo Sapiens
gaacuccugaccucaggugauccuccugccucggccucccaaagugcugggauuacaggcauga

SEQ ID NO: 116238 - RNA, 64 nt, Homo Sapiens
cgccuccuggguucaggcaauuuuccugccucagccucccaaguagcugggauuacaggcaccc

SEQ ID NO: 116239 - RNA, 64 nt, Homo Sapiens
gaacuccugaccucaggugauccuccugcauuggccucccaaagugcuggaauuccaggcauga

SEQ ID NO: 116240 - RNA, 64 nt, Homo Sapiens
aacuccuggggcucaagugauccuccugccuuggccucccaaaaugcuggauuacaggcaugug

SEQ ID NO: 116241 - RNA, 64 nt, Homo Sapiens
gauagcuucccacuggaaaguaaacaaaaccaucccucccaaccucaaagcuaggccacacucu

SEQ ID NO: 116242 - RNA, 64 nt, Homo Sapiens
ugccucccugguucaagugauucuccugccucauccucccaagaagcugagauuacagaugacc

SEQ ID NO: 116243 - RNA, 64 nt, Homo Sapiens
gaacuccugaccucaggugauccaccugccucagccucccaaagugcugagauuacaggcauga

SEQ ID NO: 116244 - RNA, 64 nt, Homo Sapiens
caccucgcagguucaagcaauccucccacuucagccucccaagcaccugggauuacaagcauga

SEQ ID NO: 116245 - RNA, 64 nt, Homo Sapiens
uccaucucuugaccucgugauccacccgccucagccucccaaagugcugggauuaacagguaug

SEQ ID NO: 116246 - RNA, 64 nt, Homo Sapiens
ugccucccagguucaagugcuucuccagccucagccucccaaguagcugagacuacaggcacac

SEQ ID NO: 116247 - RNA, 64 nt, Homo Sapiens
ugcugggauuacuggugugauccuccugccucagccucccaaaggaacuccugaacucaagcaa

SEQ ID NO: 116248 - RNA, 64 nt, Homo Sapiens
agcugggacuacaggcauguuccuuccacuucagccucccaaguaacuuccugggcucaaguga

SEQ ID NO: 116249 - RNA, 64 nt, Homo Sapiens
ugcugggauuauaggcauguuccacucgccucggccucccaaaggaacuccugaccucagguga

SEQ ID NO: 116250 - RNA, 64 nt, Homo Sapiens
agcugggauuacaggcguccuucuccugccucagccucccaaguugccuccuggguucaagcag

SEQ ID NO: 116251 - RNA, 64 nt, Homo Sapiens
ugcuaggauuacaagugugacccaccugccucggccucccaaaggaacuccugaccucaaauga

SEQ ID NO: 116252 - RNA, 64 nt, Homo Sapiens
agcugggauuacagaaagccuucuccugccucaaccucccaaguuaucgcccaggcucaaguga

SEQ ID NO: 116253 - RNA, 64 nt, Homo Sapiens
aaacucuugaccucaggugauccacccaccucagccucccaaagugcugggauuacaagcguga

SEQ ID NO: 116254 - RNA, 64 nt, Homo Sapiens
gaacuccuggccucaagugauucuccugccucagccucccaaagugcugggauuacagguguga

SEQ ID NO: 116255 - RNA, 64 nt, Homo Sapiens
cuccgccucccggguucacgccauucugcgucagccucccaaguagcugggacuacaggcaccu

SEQ ID NO: 116256 - RNA, 64 nt, Homo Sapiens
uugaucuccugaccgcauaauccacccaccucggccucccaaagugcugggauuacaggcguga

SEQ ID NO: 116257 - RNA, 64 nt, Homo Sapiens
caacucccagguucaagugagucucgugccucagccucccaaguagcugggauuacaggcaccc

SEQ ID NO: 116258 - RNA, 64 nt, Homo Sapiens
aaacuccugaccucaggugcuccaccugccuuggccucccaaagugcugggauuacaggcguga

SEQ ID NO: 116259 - RNA, 64 nt, Homo Sapiens
gaacuccuguccucagguaauccgcccaccucagccucccaaagugcugggauuacaggcguga

SEQ ID NO: 116260 - RNA, 64 nt, Homo Sapiens
gaccuccuggguucaagcgauucucccaccccagccucccaaguagcugggauuacaggugugu

SEQ ID NO: 116261 - RNA, 64 nt, Homo Sapiens
aaacuccugggcucaagcgauccuccuggcucagccucccaaagugcugggauuacaggcguga

SEQ ID NO: 116262 - RNA, 64 nt, Homo Sapiens
ugcagggauuacaggcaugaugcacccaccucagccucccaaagaaacuccugaccucagguga

SEQ ID NO: 116263 - RNA, 64 nt, Homo Sapiens
ugcugggauuacaggcaugauccacccgccucagccucccaaaggaacuccugaccucagguga

SEQ ID NO: 116264 - RNA, 64 nt, Homo Sapiens
ugcuggaauuacaggugugauccacccgccuuggccucccaaaggaaugccugaccucagguga

SEQ ID NO: 116265 - RNA, 64 nt, Homo Sapiens
agcugggauuacaggcacauuucuccugccucagccucccaaguugccuccuggguucaaucca

SEQ ID NO: 116266 - RNA, 64 nt, Homo Sapiens
ugcugggacuacaggugcauuccuccugccuuggccucccaaagaaacuccuagccuugauuga

SEQ ID NO: 116267 - RNA, 64 nt, Homo Sapiens
ugccucccagguucaagcaauucuccugccucagccucccaaguagcugggacuacaggcacac

SEQ ID NO: 116268 - RNA, 64 nt, Homo Sapiens
uccaucucuugaccuugugauccacccaccucagccucccaaagugcugggauuacaggcauga

SEQ ID NO: 116269 - RNA, 64 nt, Homo Sapiens
caacuccugaccuaaagugaucugcccgccuuggccucccaaagugcugggauuacagacauga

SEQ ID NO: 116270 - RNA, 64 nt, Homo Sapiens
ugcugggauuacaggugugaucugcccgccuuggccucccaaaggaacucuugaccucagguga

SEQ ID NO: 116271 - RNA, 64 nt, Homo Sapiens
ugcugggauuacaggugugauccgcccaccucggccucccaaaggaacuccugaccucagguga

SEQ ID NO: 116272 - RNA, 64 nt, Homo Sapiens
ugcugggauuacaggugugagccuccugccuuggccucccaaagaaaccccugggcucaagcaa

SEQ ID NO: 116273 - RNA, 64 nt, Homo Sapiens
agcugggaccacaggugggcuccuccugccucugccucccaagugaccucccaagcucaagcaa

SEQ ID NO: 116274 - RNA, 64 nt, Homo Sapiens
ucaagcaauccuccugccucucauguagccuggaccucccaagcugcaguggugugauuacagc

SEQ ID NO: 116275 - RNA, 64 nt, Homo Sapiens
ugcuaggauuacaggcgugauccaccugccucggccucccaaaggaacuccugaccucagguga

SEQ ID NO: 116276 - RNA, 64 nt, Homo Sapiens
ugcugggauuacacgcgugauccgcccaccuuggccucccaaaggaacuccugaccucagguga

SEQ ID NO: 116277 - RNA, 64 nt, Homo Sapiens
gaacuccuuggcucaagcaauccugcugccuuggccucccaaguauguaggacuacagguacuc

SEQ ID NO: 116278 - RNA, 64 nt, Homo Sapiens
aaacuccugggcugaaacaauccucccgccuuggccucccaaagugcugggauuauaggcacaa

SEQ ID NO: 116279 - RNA, 64 nt, Homo Sapiens
ugccucccguguucaagcaguucuccugccucagccucccaaauagcugggauuacaguugccu

SEQ ID NO: 116280 - RNA, 64 nt, Homo Sapiens
gaacuccugaccucaagugauccacccgccuuggccucccaaagugcugggauaauagguguca

SEQ ID NO: 116281 - RNA, 64 nt, Homo Sapiens
cgccuccugcguucaagugauuguccugucucagccucccaaguagcugggauuacaggcaccc

SEQ ID NO: 116282 - RNA, 64 nt, Homo Sapiens
gaacuccuaaccucaggugauccacccgccucggccucccaaagugcugggauuacaggcccgg

SEQ ID NO: 116283 - RNA, 64 nt, Homo Sapiens
caccuaccgaguucaagugauuuuccugccuuggccucccaaguagcugggauuacaggugugu

SEQ ID NO: 116284 - RNA, 64 nt, Homo Sapiens
aaacuccugaccucaagugaucugcccaccucagccucccaaagugcugagauuacaggcauga

SEQ ID NO: 116285 - RNA, 64 nt, Homo Sapiens
caacuccugaccucaagugauauguucaccucagccucccaaagugcugggauuacaggcauga

SEQ ID NO: 116286 - RNA, 64 nt, Homo Sapiens
cgccucccggguucaagcaauucuccugccucagccucccaaguagcugggauuacaggcgugu

SEQ ID NO: 116287 - RNA, 64 nt, Homo Sapiens
aaccucuuggguucaagugauucuugugccucagccucccaaguagcuggaauuacaggcacau

SEQ ID NO: 116288 - RNA, 64 nt, Homo Sapiens
gaacuccugaccucaggugauccacccaccuuggccucccaaagugcugagauuauaggcauga

SEQ ID NO: 116289 - RNA, 64 nt, Homo Sapiens
cgccucccggguucacgccauucuccugccucagccucccaaguagcugggacuacaggcaccc

SEQ ID NO: 116290 - RNA, 64 nt, Homo Sapiens
ucgaucuccugaccucgugauccgcccgccucagccucccaaagugcugggauuacaggcguga

SEQ ID NO: 116291 - RNA, 64 nt, Homo Sapiens
ugccucccggguucaugccauucuccugccucagccucccaaguagcugggacuacaggcgccu

SEQ ID NO: 116292 - RNA, 64 nt, Homo Sapiens
ucgaucuccugaccucgugauccacccgccucggccucccaaagugcugggauuacaggcguga

SEQ ID NO: 116293 - RNA, 64 nt, Homo Sapiens
ugcugggauuacaggcgugauccaccagccucagccucccaaaguugaucuccugaccuuguga

SEQ ID NO: 116294 - RNA, 64 nt, Homo Sapiens
agcugggauuacaggugugcuucuccugcuucagccucccaagucaccuccuggguucaaguga

SEQ ID NO: 116295 - RNA, 64 nt, Homo Sapiens
ugcuggaaucacaggggugauccuccauccucggccucccaaaggaacuccuggccuccaguga

SEQ ID NO: 116296 - RNA, 64 nt, Homo Sapiens
ugcugggauuacaggccugauucgcccgccgcguccucccaaagucgaucucuugaccucguga

SEQ ID NO: 116297 - RNA, 64 nt, Homo Sapiens
uugcugggauuacaggugugucugcccgccucggccucccaaaagaacucccgaccucagauga

SEQ ID NO: 116298 - RNA, 64 nt, Homo Sapiens
ugcugggauuacaggugugaucugcccgccuuggccucccaaaguccaucuccugaguuuguga

SEQ ID NO: 116299 - RNA, 64 nt, Homo Sapiens
ugcuaggauuccaggcgugacccgcccgccuuggccucccaaaguccugaccucaggugaucca

SEQ ID NO: 116300 - RNA, 64 nt, Homo Sapiens
ugcugggauuauaggcgugauccgcccuccucggccucccaaaguugaucuccugaccucguga

SEQ ID NO: 116301 - RNA, 64 nt, Homo Sapiens
ugcugggauuacaggcgugauccaccugccuuggccucccaaaggaacuccugaccucagguaa

SEQ ID NO: 116302 - RNA, 64 nt, Homo Sapiens
uguucguuuuacuuuuuuuuuccacccaccuuggccucccaaauaaacucuugaccucaaauga

SEQ ID NO: 116303 - RNA, 64 nt, Homo Sapiens
ugcugggauuacaggugugaucugccugccucggccucccaaagaaacuccugaccucagguga

SEQ ID NO: 116304 - RNA, 64 nt, Homo Sapiens
agcugggauuacaggcaugcuucuccugccgcagccucccaagacgccucccggauucaagcaa

SEQ ID NO: 116305 - RNA, 64 nt, Homo Sapiens
ugcuaggauuacaggcgugauccacccaucuccaccucccaaaggaacuccugggcucaaguga

SEQ ID NO: 116306 - RNA, 64 nt, Homo Sapiens
uguugggauuauaggcgugauccaccugccuuggccucccaaaggaacuccugaccucaaguga

SEQ ID NO: 116307 - RNA, 64 nt, Homo Sapiens
ugcuuggauuacaggcauaauccaccugccucagccucccaaagaaacuccugaccucauauga

SEQ ID NO: 116308 - RNA, 64 nt, Homo Sapiens
agcugggauuacaggcaccuuuauccugccucagccucccaaguugccuuccagguucaagcaa

SEQ ID NO: 116309 - RNA, 64 nt, Homo Sapiens
ugcugggauuacaggcaugauccacccaccucagccucccaaaggaaauccugaccucaaauga

SEQ ID NO: 116310 - RNA, 64 nt, Homo Sapiens
agcugggacuacaaggugccuucuccuaccucagccucccaaaucgcccccugggaucaagcga

SEQ ID NO: 116311 - RNA, 64 nt, Homo Sapiens
ugcugggauuacaggcaugaucccccugccucggccucccaaagucgauuuccugaccuuguga

SEQ ID NO: 116312 - RNA, 64 nt, Homo Sapiens
ugcugggauuacaggcaugauccacccgccucagccucccaaagaaacucccgaccucagguga

SEQ ID NO: 116313 - RNA, 64 nt, Homo Sapiens
ugcugggauuacagacgugaucugcccgccucugccucccaaagagacuccugggcucaagcaa

SEQ ID NO: 116314 - RNA, 64 nt, Homo Sapiens
agcugggacuacaauugugagccucccauuucagccucccaaguaaccugccagguugaaguga

SEQ ID NO: 116315 - RNA, 64 nt, Homo Sapiens
ugcugggauuacaggcaugauccacccaccuuggccucccaaaggaacgccugaccucagauga

SEQ ID NO: 116316 - RNA, 64 nt, Homo Sapiens
accugggacuacaggugugcuucucgugcuucagccucccaagucgccuccuggguucaaguga

SEQ ID NO: 116317 - RNA, 64 nt, Homo Sapiens
uguuaggauuaggggcaugauccgcccgccucagccucccaaagucgaacuccugaccucguga

SEQ ID NO: 116318 - RNA, 64 nt, Homo Sapiens
agccaggauuacaggcacgcuucuccugccucagccucccaaguugccucccagguucaagcaa

SEQ ID NO: 116319 - RNA, 64 nt, Homo Sapiens
ugcugggauuacagccaugauccagccguauuggccucccaagggaauuccagggcucaagcga

SEQ ID NO: 116320 - RNA, 64 nt, Homo Sapiens
cgggaaccucaagaucuccaaagcuacauaugccccucccaaacaguuacaaagauuuuuuaaa

SEQ ID NO: 116321 - RNA, 64 nt, Homo Sapiens
ugcugggauuacaggggugauccacccgccucagccucccaaagcaacuccugagcucaaguga

SEQ ID NO: 116322 - RNA, 64 nt, Homo Sapiens
uguugggauuacaggugugauccucccgccucagccucccaaaggaacucuugggcucaaguga

SEQ ID NO: 116323 - RNA, 64 nt, Homo Sapiens
agcugggagccugggcaugcuccuccugccucagccucccaagugaccucccaggcucaagcga

SEQ ID NO: 116324 - RNA, 64 nt, Homo Sapiens
cguugggauuauaggcgugauccuccugccucagccucccaaagaaacuccugggcucaaguga

SEQ ID NO: 116325 - RNA, 64 nt, Homo Sapiens
agcugggaugacagacuugcuccucccaccucagccucccaagcgacuucuuaggcucagguga

SEQ ID NO: 116326 - RNA, 64 nt, Homo Sapiens
caccuuccaggcuuaagcgauucucaugccucauccucccaaguaggugggauuacaggugccc

SEQ ID NO: 116327 - RNA, 64 nt, Homo Sapiens
gaacuccugacaucaggugauccaccugccucggccucccaaagugcugggauuacagguguga

SEQ ID NO: 116328 - RNA, 64 nt, Homo Sapiens
cgccucccggguucaagcgauucuccugccucagccucccaaguagcugggauuacaggcacgc

SEQ ID NO: 116329 - RNA, 64 nt, Homo Sapiens
aaacucccgaccucaaguagucugccugccucaaccucccaaagugcugggauuacaggcguga

SEQ ID NO: 116330 - RNA, 64 nt, Homo Sapiens
gggcauuacccaccauuguagucuaacacugcauccucccaacuaauccaucggacaagacccc

SEQ ID NO: 116331 - RNA, 64 nt, Homo Sapiens
auauaacccccuaaggaaucggaaauuguaucagccucccaagcuccagaaucccagaauucua

SEQ ID NO: 116332 - RNA, 64 nt, Homo Sapiens
uguugggauuacaggcgugauccacccgccuaggccucccaaaguugaacuccugaccucguga

SEQ ID NO: 116333 - RNA, 64 nt, Homo Sapiens
agcuggaauuacagggacccuucuccugucucagccucccaagucgccucugggguucaaguga

SEQ ID NO: 116334 - RNA, 64 nt, Homo Sapiens
ugcuaggauuacaggcaugauuugccugccugggccucccaaagucgaacuccugaccucguga

SEQ ID NO: 116335 - RNA, 64 nt, Homo Sapiens
ugcugggauuacaggugugaucugcccgccucggccucccaaaguugaucuccugagcucguga

SEQ ID NO: 116336 - RNA, 64 nt, Homo Sapiens
ggggcagccaauuccuaucauucagaucuuccuuccucccaaguacucaccaaccccuuccacu

SEQ ID NO: 116337 - RNA, 64 nt, Homo Sapiens
accucuccagauucaagugauccucccaucucagccucccaaguagcugggacuacaguugugc

SEQ ID NO: 116338 - RNA, 64 nt, Homo Sapiens
aaacuccugggcuccaacgaucugcccaccuuggccucccaaagugcugagauuacaggcguga

SEQ ID NO: 116339 - RNA, 64 nt, Homo Sapiens
cacuucuuggguucaagugauucuccugucucagccucccaaguagcugggauuacaggcauga

SEQ ID NO: 116340 - RNA, 64 nt, Homo Sapiens
gaacuccugaccucaggugauccacccgccuuggccucccaaagugcugggauuacaggcguga

SEQ ID NO: 116341 - RNA, 64 nt, Homo Sapiens
cgccuccuggguucaagugauucucccaccucagccucccaaguaggugggauuacagguacuc

SEQ ID NO: 116342 - RNA, 64 nt, Homo Sapiens
gaacuccugaccucagauggucugcccaccuccgccucccaaagugcugggauuacaggcguga

SEQ ID NO: 116343 - RNA, 64 nt, Homo Sapiens
ugcugggauuauaggcaugauccuccugcuuuggccucccaaaagaaauccugggcucaaguga

SEQ ID NO: 116344 - RNA, 64 nt, Homo Sapiens
agcugggacuacaggcacaguucucaugccucagccucccaaaugucuuccucucucgcccaag

SEQ ID NO: 116345 - RNA, 64 nt, Homo Sapiens
uguauguacuuccaguauccgcucaggccaaagaccucccaagcgaugggcuuggccaaaacag

SEQ ID NO: 116346 - RNA, 64 nt, Homo Sapiens
ugcugagauuacaggugugauccuccugucuuggccucccaaaggaacuccuagacucaaguga

SEQ ID NO: 116347 - RNA, 64 nt, Homo Sapiens
ugcugggauuacaggugugacccacccgccuuggccucccaaaguugaacuccugaccucguga

SEQ ID NO: 116348 - RNA, 64 nt, Homo Sapiens
cgccuccugaguucaagcgauucuccugccucagccucccaaguagcugggacugcaggcgcgc

SEQ ID NO: 116349 - RNA, 64 nt, Homo Sapiens
aacuccugacuucaggugauccacccgccuucagccucccaacgugcugggauuacagccguga

SEQ ID NO: 116350 - RNA, 64 nt, Homo Sapiens
ugccucccagguugaagcgauucuccugccucagccucccaaguagcugggauuacaggcaugc

SEQ ID NO: 116351 - RNA, 64 nt, Homo Sapiens
ucgaugaucugaccucgugaucugcccgccucggccucccaaagugcugggauuacaggccuga

SEQ ID NO: 116352 - RNA, 64 nt, Homo Sapiens
gaacuccuggacucaaucgauccucccaccucugccucccaaguaacugggacuauagcaugcc

SEQ ID NO: 116353 - RNA, 64 nt, Homo Sapiens
gaacuccuggacucaauugauccucccacuucugccucccaaguaacugggacuauagcaugcc

SEQ ID NO: 116354 - RNA, 64 nt, Homo Sapiens
ugccucccguguucaagcgauucuccugccuuggccucccaaguagcugggacuacaggcgccu

SEQ ID NO: 116355 - RNA, 64 nt, Homo Sapiens
ucgaucuccugaccucuugaucugcccaccuuggccucccaaagugcugggauuacaggcguga

SEQ ID NO: 116356 - RNA, 64 nt, Homo Sapiens
gaacucuugaccucaagugauccacucgcuucggccucccaaagugcugggauuauaggcguga

SEQ ID NO: 116357 - RNA, 64 nt, Homo Sapiens
ucgaacuccugaccucaugauccuccugccucggccucccaaagugcugggauuauaggcauga

SEQ ID NO: 116358 - RNA, 64 nt, Homo Sapiens
aaacuccugaccucaagagauccacucgccuugcccucccaaagugcugggauuacaggcuuga

SEQ ID NO: 116359 - RNA, 64 nt, Homo Sapiens
agucaaaacuauagccauauccaaaucuuuucccccucccaagaguucucagugucuacaugua

SEQ ID NO: 116360 - RNA, 64 nt, Homo Sapiens
ugcugggauuacaggugugauucuccugccucagccucccaaagugccuccugacuucaagcaa

SEQ ID NO: 116361 - RNA, 64 nt, Homo Sapiens
ugcuaggauuacaggcaugauccacccgccucagccucccaaagaaacuccugaccucaguuga

SEQ ID NO: 116362 - RNA, 64 nt, Homo Sapiens
uacugggauuacaggcgugaucugcccgccuuggccucccaaaguugaacuccugaccucguga

SEQ ID NO: 116363 - RNA, 64 nt, Homo Sapiens
agggcugcugguuuccgcagcaccaccggcaccgccucccaaacccccaugcccccucccugag

SEQ ID NO: 116364 - RNA, 64 nt, Homo Sapiens
cugugcguuccugagggccaacagccagcuccgcccucccaagggagggaaggcggagcugagg

SEQ ID NO: 116365 - RNA, 64 nt, Homo Sapiens
accucccggguuccagcaaauucuccugccucagccucccaaguagcugggauugcaggcgccc

SEQ ID NO: 116366 - RNA, 64 nt, Homo Sapiens
gaucuccugaccucaggugauccacccgccucggccucccaaagugcugggaugacaggcguga

SEQ ID NO: 116367 - RNA, 64 nt, Homo Sapiens
ugcugggauuacaggcuugauccaccugccucggccucccaaaggaacuccugaccucagguga

SEQ ID NO: 116368 - RNA, 64 nt, Homo Sapiens
agcugggauuacaggcaccuuucuccugccucagccucccaaguugccucccgggcucaagcga

SEQ ID NO: 116369 - RNA, 64 nt, Homo Sapiens
uaaguauuggaauuucacaaaagacauaggacuuaacuggaaaaugaaaaaaaaaagaaaaaga

SEQ ID NO: 116370 - RNA, 64 nt, Homo Sapiens
ccccagaaagugggaauuugauuuuauccuuccgaacuggaagaacauuuuuaugaagaauuuu

SEQ ID NO: 116371 - RNA, 64 nt, Homo Sapiens
aauacaaaggguauacucuguuggaugcaccagaaacuggaaacugggaccaguggcagagaug

SEQ ID NO: 116372 - RNA, 64 nt, Homo Sapiens
cccagaugcccaugagcaagagaguggacaaguaaacuggaauauucacauaauagaacauuau

SEQ ID NO: 116373 - RNA, 64 nt, Homo Sapiens
gagguucaacacuacguaccgcacuuuauaauuuaacuggaauugagaugaaggccagugacau

SEQ ID NO: 116374 - RNA, 64 nt, Homo Sapiens
caaaagccaggcucaacuuauagaauguuuuggaaacuggaaguaaugauacauuucacuucag

SEQ ID NO: 116375 - RNA, 64 nt, Homo Sapiens
gcugaugugagugugugugaugggaucuguaaggaacuggaacacacauguccuauccaaagga

SEQ ID NO: 116376 - RNA, 64 nt, Homo Sapiens
aggaccuggcuuggcuuuaaccguuuuucaagaaaacuggaaaucuggauuuucagcgaacaug

SEQ ID NO: 116377 - RNA, 64 nt, Homo Sapiens
aggagaguccuucucggcagagcucacugcaaacaacuggaauugagguugcacacugugauuu

SEQ ID NO: 116378 - RNA, 64 nt, Homo Sapiens
agaaaacagaggaguuuguagccagcagccuguaaacuggaaacacuggucucagccaaccucc

SEQ ID NO: 116379 - RNA, 64 nt, Homo Sapiens
uguaaaaugguauauucuuuaaaauaguguugauaacuggaauauuguauguaugcuuggagau

SEQ ID NO: 116380 - RNA, 64 nt, Homo Sapiens
aacuccguaaaaaagacagcuguauuuuccguccaacuggaauuguugaaucacacugcauagc

SEQ ID NO: 116381 - RNA, 64 nt, Homo Sapiens
uuucaguauaagcugaauaaauuuagagcuuucaaacuggaaaaaaaaaugaaacaaaacaaau

SEQ ID NO: 116382 - RNA, 64 nt, Homo Sapiens
agguggauacccgcuuccauggucuugcacuauaaacuggaauggauuucucaaugcgggacca

SEQ ID NO: 116383 - RNA, 64 nt, Homo Sapiens
aagcuaauuuuuuuuacaugucaauauuggcacaaacuggaaugaaagaauaguuugauucaga

SEQ ID NO: 116384 - RNA, 64 nt, Homo Sapiens
acuaaauauacaggguauguccuaacauggaguuaacuggaauagcaguacacuagcaaguauc

SEQ ID NO: 116385 - RNA, 64 nt, Homo Sapiens
acccuuuggcugugcugcgacuucuaguugugccaacuggaacccacccuccaauucacacugc

SEQ ID NO: 116386 - RNA, 64 nt, Homo Sapiens
auugaguuucuuuauuuuuaacgugaaauccauuaacuggaauaauugaaaguuaaacuauuua

SEQ ID NO: 116387 - RNA, 64 nt, Homo Sapiens
guccccuuccccaggggagcgccaugggaacgccaacuggaaagucugcuggacacccaagaaa

SEQ ID NO: 116388 - RNA, 64 nt, Homo Sapiens
ugguggaauguuuuggaauuaaaguuguacugugaacuggaagaucauaucaccuccaucccau

SEQ ID NO: 116389 - RNA, 64 nt, Homo Sapiens
cuccagggcgggaggcaagcccccuugccuuucaaacuggaaaccccagagaaaacggugcccc

SEQ ID NO: 116390 - RNA, 64 nt, Homo Sapiens
cgguugggggcugggagcccugggcguguaguguaacuggaaucuuuugccucucccagccacc

SEQ ID NO: 116391 - RNA, 64 nt, Homo Sapiens
uguauaacucuaaacgcccaugauaguagcuucaaacuggaaauagcgaaauaaaauaacucag

SEQ ID NO: 116392 - RNA, 64 nt, Homo Sapiens
uauacaaaaguaaauugggauacauaacaacuggaacuggaaauuugguaacuucacuagagca

SEQ ID NO: 116393 - RNA, 64 nt, Homo Sapiens
ggaaauuauacaaaaguaaaagagcauacauaacaacuggaacuagacuguugguaacuucacu

SEQ ID NO: 116394 - RNA, 64 nt, Homo Sapiens
uaguucuccuucaaguguugaaguucaacaccaaaacuggaacagguaguagguauuucgugag

SEQ ID NO: 116395 - RNA, 54 nt, Homo Sapiens
acauauuucacaacagggccauugaacuggaaucagcggaaucauacacucuga

SEQ ID NO: 116396 - RNA, 64 nt, Homo Sapiens
ucuaauuuuaggaggaccaaauucaguggauggcaacuggaacauugauuguaaggccagugaa

SEQ ID NO: 116397 - RNA, 64 nt, Homo Sapiens
aacauugauuguaaggccagugaaguuuucacccaacuggaauuugauggaaagaagguuugug

SEQ ID NO: 116398 - RNA, 64 nt, Homo Sapiens
guucuguagggauuuacuggacugcuuguugccaaacuggaaaucaaaugugaaugaucgacug

SEQ ID NO: 116399 - RNA, 64 nt, Homo Sapiens
cugccucuuggguucucaccucuuucucaauauuaacuggaaugcaagaggcaacuugucacuu

SEQ ID NO: 116400 - RNA, 64 nt, Homo Sapiens
uauuuauuuuuuaauaacccgcucugcuugccgaaacuggaaguagagucccgcagguacccca

SEQ ID NO: 116401 - RNA, 64 nt, Homo Sapiens
acagaaaacuagaauuucaucuacugcuucuaccaacuggaagcgccaaauucccuccucccuu

SEQ ID NO: 116402 - RNA, 64 nt, Homo Sapiens
gaacgcuugagaggcacuuuguaaagauuuguuaaacuggaaacguuuuacaugaucugauaca

SEQ ID NO: 116403 - RNA, 64 nt, Homo Sapiens
gaaugcuugagaggcacugaguaaagauuuguugaacuggaaauguuuuacaugauucuuaaac

SEQ ID NO: 116404 - RNA, 64 nt, Homo Sapiens
uaaaauuuauuauuuugaucuugaauuauuuauaaacuggaaagugguuugauuauugugaguc

SEQ ID NO: 116405 - RNA, 64 nt, Homo Sapiens
aaacaaacaaacaaacaacguaucuuacugacuaaacuggaauggaaaucuuauaauuaguguu

SEQ ID NO: 116406 - RNA, 64 nt, Homo Sapiens
ggccagccugaggacccccgccuaccaccucgagaacuggaagccaaccucuaaccuccugacc

SEQ ID NO: 116407 - RNA, 64 nt, Homo Sapiens
cuucaccagugcccaagucucuauggagaaugagaacuggaagccacugcuaccgucuacccag

SEQ ID NO: 116408 - RNA, 64 nt, Homo Sapiens
gaauaacuuuuucaagcaauggggcugcuuguagaacuggaagucagcuuuggcucgggagagu

SEQ ID NO: 116409 - RNA, 64 nt, Homo Sapiens
uuuguguuguaucuguaacauuugaauuccuucuaacuggaacagcuuggaccuuggcauuccg

SEQ ID NO: 116410 - RNA, 64 nt, Homo Sapiens
agcuguaccuggcacggcccauccuggacugagaaacuggaaccucagaggaacccgugccucu

SEQ ID NO: 116411 - RNA, 64 nt, Homo Sapiens
cugcugaauggaggagccgggggucccccaggccaacuggaaaaucucccaggcuaggccaauu

SEQ ID NO: 116412 - RNA, 64 nt, Homo Sapiens
auagcaguuauaacagaugugaaaauauacuugacucuaauaugauuauacaaaagagcaugga

SEQ ID NO: 116413 - RNA, 64 nt, Homo Sapiens
uuucaaagcuaaaauauauaauauacuaaaccaacucuaauauugcuucuuguguuuuacuguc

SEQ ID NO: 116414 - RNA, 64 nt, Homo Sapiens
auauggaauuccauauuaggauuuacucuguaaucucuaauaaaaaaauggaccuuaagaaacu

SEQ ID NO: 116415 - RNA, 64 nt, Homo Sapiens
aaauaagauauuugaacaaguguguaauuugugacucuaauauugggauuuaaauauaacaaaa

SEQ ID NO: 116416 - RNA, 64 nt, Homo Sapiens
gcuaguggagcaguugacauuaucguguuaaaagcucuaauaauaugguuuuuacauuuuucuc

SEQ ID NO: 116417 - RNA, 64 nt, Homo Sapiens
uuguggagggcagguuugagagugaaauaauaugcucuaauagaagaaggagauuaacauuaua

SEQ ID NO: 116418 - RNA, 64 nt, Homo Sapiens
aaccuuuuuugguggcuaauuaggguuuaaauacagaaacaagauuucaaauaaaacugucuuu

SEQ ID NO: 116419 - RNA, 64 nt, Homo Sapiens
guuacagaaguuucaagcuucacuuuugugcaguagaaacaaaaguaggcuacagucugugcca

SEQ ID NO: 116420 - RNA, 64 nt, Homo Sapiens
uugaccucaaggucuagaggucugcaguaagccaagaaacaaaggugggguggaugaggcaagg

SEQ ID NO: 116421 - RNA, 64 nt, Homo Sapiens
aaucgcugagcaaacccgcuuuuguuuccuucccagaaacaaugcaaaacaacagguggagaua

SEQ ID NO: 116422 - RNA, 64 nt, Homo Sapiens
uagcaacauugucauaugcaguuugccucaaaucagaaacaagaagacaucggaaucugagaug

SEQ ID NO: 116423 - RNA, 64 nt, Homo Sapiens
uggaucuaaagaaauuacccagugagcagugaggagaaacaaggagcuagaaaacauuggaaag

SEQ ID NO: 116424 - RNA, 64 nt, Homo Sapiens
uuuuauuaacuuuuuucaguuucuuuuuauucaaagaaacaaaauucaaucucugauaauauuu

SEQ ID NO: 116425 - RNA, 64 nt, Homo Sapiens
uaaucccuuuuagugggaaaggauauguucuaggagaaacaagcaauuuaccuucaccugggaa

SEQ ID NO: 116426 - RNA, 64 nt, Homo Sapiens
aaggauucaccaccuccaggaaaagugucuucucagaaacaaccagcugagaagguaauuaaag

SEQ ID NO: 116427 - RNA, 64 nt, Homo Sapiens
aaggagggaccaauaucugggacagugucuucucagaaacaaccagcugagaagguaauuaaag

SEQ ID NO: 116428 - RNA, 64 nt, Homo Sapiens
aagaagggacaacaaucugggacagugucuccucagaaacaaucggccuggaagguaguuacuc

SEQ ID NO: 116429 - RNA, 64 nt, Homo Sapiens
auggguggugggaaaucuggaacagugucuucucagaaacaaccagccucaaagguaauuaaac

SEQ ID NO: 116430 - RNA, 64 nt, Homo Sapiens
aaggauggacuacagugugggacagugucuucucagaaacaaccagccuugaagguaauuaaac

SEQ ID NO: 116431 - RNA, 64 nt, Homo Sapiens
aaggauggagaaaaaucugggacagugucuucucagaaacaaccagccuugaagguaauuaaac

SEQ ID NO: 116432 - RNA, 64 nt, Homo Sapiens
uugacauuuauuuuagaaaguccuauaauguggaagaaacaaacaguugcuaccaaagauucuu

SEQ ID NO: 116433 - RNA, 64 nt, Homo Sapiens
uacaaguugcuaguuuauaaugucuuacuaaugcagaaacaaggaaaaaagcaaaauuggccug

SEQ ID NO: 116434 - RNA, 64 nt, Homo Sapiens
auuguauucauuuaucuuagggggaacauuguaaagaaacaaaaagguccagaugaauguaugc

SEQ ID NO: 116435 - RNA, 64 nt, Homo Sapiens
aaacaaagcuuauguuagagaauaucuuacuguaagaaacaaggaaaauugcagaaacauuugc

SEQ ID NO: 116436 - RNA, 64 nt, Homo Sapiens
gaguucuugaagaagaaaccagaacaaauaaaauagaaacaauaaucagaguuuaauaauuaau

SEQ ID NO: 116437 - RNA, 64 nt, Homo Sapiens
ucugagaaguaggcuaagaggacugcuuccacuuagaaacaaacaugguagugcuuugguggag

SEQ ID NO: 116438 - RNA, 64 nt, Homo Sapiens
gcuggaauaucugcccaugcaaucuaggccuugaagaaacaaagcaggagagacuuguagguac

SEQ ID NO: 116439 - RNA, 64 nt, Homo Sapiens
uaaauuguuauaacuucauauccucugaauauuaagaaacaauuagaauuaaacuccuacugcu

SEQ ID NO: 116440 - RNA, 64 nt, Homo Sapiens
aacaccaaaaauugcgagccggaguguuugacgaagaaacaaaaguuuguauaccaugaugcau

SEQ ID NO: 116441 - RNA, 64 nt, Homo Sapiens
ugcucucuuuaaagcgaauucauacuaugacagcagaaacaaaacuucagauuucagaauuugu

SEQ ID NO: 116442 - RNA, 64 nt, Homo Sapiens
uaagacuugcaauuuuaucaaucuauuauuucuuagaaacaauuuacuagcuuagaauagaaag

SEQ ID NO: 116443 - RNA, 64 nt, Homo Sapiens
uauucgaaaagaggcuuuuaaaaugugcauguuuagaaacaaaauuucuucauggaaaucauau

SEQ ID NO: 116444 - RNA, 64 nt, Homo Sapiens
acaauugagauuugcccauagguuaaacaugguuagaaacaacugaaagcauaaaagaaaaauc

SEQ ID NO: 116445 - RNA, 64 nt, Homo Sapiens
uuaucuuuguucuccuaaugcucugaaaggauguagaaacaauauuuaaccaaagaacguaaua

SEQ ID NO: 116446 - RNA, 64 nt, Homo Sapiens
aaaguugagagacaguaacacaauuaaaugacuuagaaacaauguuugcuuuucacuggcauaa

SEQ ID NO: 116447 - RNA, 64 nt, Homo Sapiens
uacucugacauuaugggagcgaccagagcagcacagaaacaagcggaagauaguaucucagaau

SEQ ID NO: 116448 - RNA, 64 nt, Homo Sapiens
aggaccuauacaaucauaugagaaauuugaguaaagaaacaauaacugucacuccagagauuuu

SEQ ID NO: 116449 - RNA, 64 nt, Homo Sapiens
uagcuuuacauuugaaugccugacauuagcuguaagaaacaagauaagucucacauugcuaaca

SEQ ID NO: 116450 - RNA, 64 nt, Homo Sapiens
cccuaacuugugaaguugcuuucacaguagaacuagaaacaaaaaagcuaaagagugauuaucu

SEQ ID NO: 116451 - RNA, 64 nt, Homo Sapiens
guucacacccacucuaaaaccauguccucugaaaagaaacaaaaauacagugaucaucaaaugc

SEQ ID NO: 116452 - RNA, 64 nt, Homo Sapiens
aacugggaaauaugacuaaauuugacguaacuagagaaacaaggcuguauccacaugguacaag

SEQ ID NO: 116453 - RNA, 64 nt, Homo Sapiens
acauuuuaauuaaacaaucucuguaacagaaucaagaaacaaauacaaauuuuaauuaaacaau

SEQ ID NO: 116454 - RNA, 64 nt, Homo Sapiens
uuuaauuaaacaaucuguaaauauaacagaaucaagaaacaaauuucacaugguuucuccaugu

SEQ ID NO: 116455 - RNA, 64 nt, Homo Sapiens
acagaccacaugagacuaagauaagggaauccugagaaacaaucaacuguaaaaaucauggaaa

SEQ ID NO: 116456 - RNA, 64 nt, Homo Sapiens
ucuauaacaacaacuuuggaacaaaugguuaaaaagaaacaaaauuuacaaaaauauuuuucau

SEQ ID NO: 116457 - RNA, 64 nt, Homo Sapiens
uucucuaguacucauccaggguagaaaaauggauagaaacaaaaaucuugaaaguugaacucaa

SEQ ID NO: 116458 - RNA, 64 nt, Homo Sapiens
ucuaacccaacccuaucuugggagaagggaagaaagaaacaaugggaaggaagaaaggaaggag

SEQ ID NO: 116459 - RNA, 64 nt, Homo Sapiens
cagccuggguggacagagcaagacuccgucucaaagaaacaaacaaaaaauuaaaagggauaga

SEQ ID NO: 116460 - RNA, 64 nt, Homo Sapiens
cuuuuuccacauaguuaugguguuugaguuggaaagaaacaacuauagguagcuacacguacau

SEQ ID NO: 116461 - RNA, 64 nt, Homo Sapiens
acugccugcaaagaauuaacauccgucuagugggagaaacaaacacaccccacucacuaaguau

SEQ ID NO: 116462 - RNA, 64 nt, Homo Sapiens
ccagccugggaacaagagugaaacucucaaaagcagaaacaaaaacccaacauauaugggcugu

SEQ ID NO: 116463 - RNA, 64 nt, Homo Sapiens
acaucccggcccaaggcgcagugcugugcacggaagaaacaaaggagggcgcaggggcugccga

SEQ ID NO: 116464 - RNA, 64 nt, Homo Sapiens
agaaauaaaguuuuuauucucugcucacauucugagaaacaaaaugagaguucuucauuccuug

SEQ ID NO: 116465 - RNA, 64 nt, Homo Sapiens
uuuuggaugagcuuuuauaucuuucuuucugccaagaaacaaaguaagauguaagugaacaauu

SEQ ID NO: 116466 - RNA, 64 nt, Homo Sapiens
uuaaaaccuggauccacagaacaugguucaggacagaaacaagagaagugacuuccucaaaauc

SEQ ID NO: 116467 - RNA, 64 nt, Homo Sapiens
uccauuacucugauuuuugaaauaagugugugguagaaacaaacaugaacuguaguacauggac

SEQ ID NO: 116468 - RNA, 64 nt, Homo Sapiens
cugccauaauccuuuggaaauauacaugaagaauagaaacaagcaaaaagagugaaaaagagaa

SEQ ID NO: 116469 - RNA, 64 nt, Homo Sapiens
cugugagauguuauugcuuccauuuuauuagaagagaaacaaauuccaugcuuuauggaauuua

SEQ ID NO: 116470 - RNA, 64 nt, Homo Sapiens
cuuuuuguuuuaauaucuugcucucugacaggaaagaaacaauucacuuaccagccuccucacc

SEQ ID NO: 116471 - RNA, 64 nt, Homo Sapiens
gauucuuaaagauaagcuagguugugaaaauuucagaaacaauaguuggggauucaguauuuuu

SEQ ID NO: 116472 - RNA, 64 nt, Homo Sapiens
aggaacuucuuauaguugucaaaaaaaagaaaaaagaaacaaaaugccugcaaaaauaaaaggg

SEQ ID NO: 116473 - RNA, 64 nt, Homo Sapiens
auuucuacuuugaagucauagaaacaacucuuugagaaacaacagugcuuuaaaaaauaaauaa

SEQ ID NO: 116474 - RNA, 64 nt, Homo Sapiens
cuuugagaaacaacaauuucuuaaaaaauaaauaagaaacaacuauuccuauacgcagcgugcu

SEQ ID NO: 116475 - RNA, 64 nt, Homo Sapiens
cccagcuccuggccucacauggguggucacagggagaaacaaguacuguagcagaucuuugagu

SEQ ID NO: 116476 - RNA, 64 nt, Homo Sapiens
gagcaggaaggauaaaaaauaaagaaagacagagagaaacaaauuugcugggagagggaaagac

SEQ ID NO: 116477 - RNA, 64 nt, Homo Sapiens
uaaauuuuuuuauaggcccauaugcucuaucucaagaaacaagaugauuguaacauguccauga

SEQ ID NO: 116478 - RNA, 64 nt, Homo Sapiens
uacguuuucuuguccuuucaaaaguguucuugaaagaaacaaagcgaauaggcaguuagcacag

SEQ ID NO: 116479 - RNA, 64 nt, Homo Sapiens
uaagugggauuaugaugaguaacuggaggggcuuagaaacaaaaacuggaugaaagaguaugca

SEQ ID NO: 116480 - RNA, 64 nt, Homo Sapiens
uuaaucucuuauguauagggugauaaccuuccccagaaacaacagugauugcgauuguuuucua

SEQ ID NO: 116481 - RNA, 64 nt, Homo Sapiens
cauaaaaaccccaaaacuauauuaccaaaaaacaagaaacaaaaguacuaguacauaucuuuaa

SEQ ID NO: 116482 - RNA, 64 nt, Homo Sapiens
aauaguacauguauauguaucuaaaacuguucugagaaacaaugaaguuuaaagagcuaaagcu

SEQ ID NO: 116483 - RNA, 64 nt, Homo Sapiens
aauguaagauacuuuagaaagcauguaaaguacuagaaacaaugagguggcuucaauuagugcu

SEQ ID NO: 116484 - RNA, 64 nt, Homo Sapiens
cauucugagaccuaaauuuaaagggucaggcauuagaaacaaaaguguuucuucauaucuagga

SEQ ID NO: 116485 - RNA, 64 nt, Homo Sapiens
ggagaguuagguuauucaaaaaaccucucuuaguagaaacaaaguguuacuuguagccaaaaag

SEQ ID NO: 116486 - RNA, 64 nt, Homo Sapiens
cucaggguuuguugaauuaguuagccauagauggagaaacaaaguugguuagagugauauguau

SEQ ID NO: 116487 - RNA, 64 nt, Homo Sapiens
ucuccuccuuuaacuccuccuaccccccaagguaagaaacaaaaaacaaacaaacaaacaaaaa

SEQ ID NO: 116488 - RNA, 64 nt, Homo Sapiens
ccagcaccuaaaaagacucuuuucaaaaaaucacagaaacaaccuaggacaauuauuuguuaca

SEQ ID NO: 116489 - RNA, 64 nt, Homo Sapiens
auuguucgacuccaugauacuaaaacauaaugaaagaaacaaacuccaguauggagaagagaaa

SEQ ID NO: 116490 - RNA, 64 nt, Homo Sapiens
ugugggcaaaacuuuguuuuuguuuugcacaguaagaaacaauaggcaagcguuauguuuuugg

SEQ ID NO: 116491 - RNA, 64 nt, Homo Sapiens
uacugucuuaggaauuauuaggaguugauuccugagaaacaacacauuuuuccccaugaacggu

SEQ ID NO: 116492 - RNA, 64 nt, Homo Sapiens
uaugggagagacucagugagccagcaaaggccauagaaacaacaauuuauuaaauguauuuaug

SEQ ID NO: 116493 - RNA, 64 nt, Homo Sapiens
uggucuguaugguggaauuugucagcuggaacucagaaacaacaacuugaaaaaaaaauaauaa

SEQ ID NO: 116494 - RNA, 64 nt, Homo Sapiens
gauuggcucugagagaacuggcuaagauucaggaagaaacaaaaaauucagaauccuacaaggu

SEQ ID NO: 116495 - RNA, 64 nt, Homo Sapiens
ggcuguccaguuuauuaaaaaugccuugucgugcagaaacaaauccgauugcuccuguguaaag

SEQ ID NO: 116496 - RNA, 64 nt, Homo Sapiens
aguucaacuauuguuguacucacuauccucuuagagaaacaaucgucuuuaaauguuaaagaug

SEQ ID NO: 116497 - RNA, 64 nt, Homo Sapiens
uaugguugaguuuccauauaaguggaccagacacagaaacaaacagaaugagcuaguaagcgau

SEQ ID NO: 116498 - RNA, 64 nt, Homo Sapiens
uuuucaauuuuauuuuaguucuaaauuauguuucagaaacaaaagacaaugcuguacaguuuua

SEQ ID NO: 116499 - RNA, 64 nt, Homo Sapiens
uuucaguccugguuccucugauaagaucgacaaaagaaacaacaaaaugagaagaagagguucc

SEQ ID NO: 116500 - RNA, 64 nt, Homo Sapiens
gcccuccacccccgucucugcacugagauacauaagaaacaaggguaguuuacugucuguuuug

SEQ ID NO: 116501 - RNA, 64 nt, Homo Sapiens
acgcagacagucacaccacgacggggccacacagagaaacaaccggcuuaggggcuagcagccc

SEQ ID NO: 116502 - RNA, 64 nt, Homo Sapiens
ugaaaaaaaaagggggguggguggggcuggaagcagaaacaaaaggaaugcgggggagcaggca

SEQ ID NO: 116503 - RNA, 64 nt, Homo Sapiens
auaggggcagaucccuucauacucugauucagcgagaaacaaccguuuaaggagcaagacugag

SEQ ID NO: 116504 - RNA, 64 nt, Homo Sapiens
cuaugcugacaccucugcuucucuguagagucccagaaacaaaauguccuacccacccacccac

SEQ ID NO: 116505 - RNA, 64 nt, Homo Sapiens
aagccccacucagcucaguccuuguuuacagaagagaaacaaacaaaagggaaaaaacaauauc

SEQ ID NO: 116506 - RNA, 64 nt, Homo Sapiens
aaggcaggagaacagccacuacgccaggaaaagaagaaacaacaccauugggagaaaaacccag

SEQ ID NO: 116507 - RNA, 64 nt, Homo Sapiens
augcgcaucucuuucuuuguaaguaguagaauucagaaacaaaacagcguaauggagaaagggg

SEQ ID NO: 116508 - RNA, 64 nt, Homo Sapiens
caguuuugaccuaacauaccgaaacuaaagcaauagaaacaacaccacuaaugcaaacugggau

SEQ ID NO: 116509 - RNA, 64 nt, Homo Sapiens
ugaaauucacaaaguuaaacgugaugugcucaucagaaacaauuucuguguccuguuuuuauuc

SEQ ID NO: 116510 - RNA, 64 nt, Homo Sapiens
uuauucccuucaaugcaaaauacaugaugauuucagaaacaaagcauuugacuuucugucugug

SEQ ID NO: 116511 - RNA, 64 nt, Homo Sapiens
aguaugugggucagcuuaaaaauuuugauuguuaaugcccuauuuucuaauuuggcaccucuug

SEQ ID NO: 116512 - RNA, 64 nt, Homo Sapiens
uuaaauacuguuggcauuuuuaugguuccuuuaaaugcccuagcuauucccagagggguuuuuu

SEQ ID NO: 116513 - RNA, 64 nt, Homo Sapiens
gcaaugcuccauccccauuauauuacaaauaaagaugcccuaaaugaguguggaaauucuaaug

SEQ ID NO: 116514 - RNA, 64 nt, Homo Sapiens
cuuuuuuucauuuugauuuuugaaagugaagaugaugcccuaauuccugguaaggauuuggggc

SEQ ID NO: 116515 - RNA, 64 nt, Homo Sapiens
cccaguaggguuuucugaggcucgcuggugacucaugcccuaauugcaauccucugcuuuuauc

SEQ ID NO: 116516 - RNA, 64 nt, Homo Sapiens
agguuggacuuacauagaggaaagaaagcaagaaaugcccuauguacaugagguuuuaccuccu

SEQ ID NO: 116517 - RNA, 57 nt, Homo Sapiens
cagcacccucagggucuuaaggucuucaugcccuaucacaaauaccucuuuuaucug

SEQ ID NO: 116518 - RNA, 64 nt, Homo Sapiens
ggccucuccauauggcugguuggaauguaagcucaugcccuagaaugaguuuaauacugaaguc

SEQ ID NO: 116519 - RNA, 64 nt, Homo Sapiens
uggaaagaucuaagaucugauucuaucaucuaacaugcccuacuauccagcuugcaacuaaucc

SEQ ID NO: 116520 - RNA, 64 nt, Homo Sapiens
uuuuuuaacugacucuuaauuauacagacaguauaugcccuauuuacuaaaagacagguagcca

SEQ ID NO: 116521 - RNA, 64 nt, Homo Sapiens
gacaggaggaaagacccucuagacacuaaaccucaugcccuaagcuccaggcucugggccgugu

SEQ ID NO: 116522 - RNA, 64 nt, Homo Sapiens
ccacuuuaucuuuguucccaaggaaucuaaauagaugcccuagugccuagccagggcuuacucc

SEQ ID NO: 116523 - RNA, 64 nt, Homo Sapiens
gucuguaucacucugugucugcagaugcuagcacaugcccuaauguaaaguccccagagaaagc

SEQ ID NO: 116524 - RNA, 64 nt, Homo Sapiens
ugaaggaaaggggcauggggcuggagccaaagggaugcccuaucgggccauaaaccuauuuagu

SEQ ID NO: 116525 - RNA, 64 nt, Homo Sapiens
cugcaguguccuuggcaaauccccacuguacucaaugcccuacauucucuucuguggucucucc

SEQ ID NO: 116526 - RNA, 64 nt, Homo Sapiens
uuucuugcaguuuuuuuauggcauuuuuuuaaagaugcccuaaguguugaagaagaguuugcaa

SEQ ID NO: 116527 - RNA, 64 nt, Homo Sapiens
caagugugaagcuggacgugaugcaaaauaaccgaugcccuacaaaaagggcgcaucuuuaaga

SEQ ID NO: 116528 - RNA, 64 nt, Homo Sapiens
cuucccccuccccagccccaaacaugcccaucacaugcccuagaagguaagucccaugaaggca

SEQ ID NO: 116529 - RNA, 64 nt, Homo Sapiens
uaacagcagaguaacauaaacuugugaaaauguuaugcccuauggacuguagucccaaaaaagc

SEQ ID NO: 116530 - RNA, 64 nt, Homo Sapiens
uggauucuacuuauuuauaaagagacuuuuaucuaugcccuaucaguucuaucuguucuauuau

SEQ ID NO: 116531 - RNA, 64 nt, Homo Sapiens
cuguguucuagcuguccuggaucuccuccccuucaugcccuagcugcuggggucuggagugaac

SEQ ID NO: 116532 - RNA, 64 nt, Homo Sapiens
guaaguuguugguuuauacuuugcuuuuuaaaaaaugcccuauucaccucaacauuucaguguu

SEQ ID NO: 116533 - RNA, 64 nt, Homo Sapiens
gcaauuuugaugagaugucucuggggacacgaggaugcccuaaugaugcugacuugucaugguu

SEQ ID NO: 116534 - RNA, 64 nt, Homo Sapiens
aagaaucgaagacaucccuagugcauguacacgaaugcccuacgucauccuuccagcaccacug

SEQ ID NO: 116535 - RNA, 64 nt, Homo Sapiens
gcaauuggauuucagguucccuuuuugugccuucaugcccuacuucuuaaugccucucuaaagc

SEQ ID NO: 116536 - RNA, 64 nt, Homo Sapiens
augaaaaagcuucauucucuucagugucuucuagaugcccuacuuaaagagaacauuuucuuau

SEQ ID NO: 116537 - RNA, 64 nt, Homo Sapiens
cacccccacaggugaagguggugagcuggaccucaugcccuacagcuucagaccccccuggcca

SEQ ID NO: 116538 - RNA, 64 nt, Homo Sapiens
auccuaaagaacagaugaauuuuuuguuuuucugaugcccuacgucuuuuacucucucuauuuc

SEQ ID NO: 116539 - RNA, 64 nt, Homo Sapiens
gaggagaaggacaucacugugaacccccaagcgaaugcccuauuaauuccuuacaaugauggca

SEQ ID NO: 116540 - RNA, 64 nt, Homo Sapiens
agcaauccaccaguuuuucuaaguuauuuaaaagaugcccuagccagaguagagagcccccaca

SEQ ID NO: 116541 - RNA, 64 nt, Homo Sapiens
ugugaaacuccucagcagcuuaugaaauaugugcaugcccuagaguuguuguaaacuguaucag

SEQ ID NO: 116542 - RNA, 64 nt, Homo Sapiens
aguaucuaauuaaaaaccauuuuugcacauuaaaaugcccuagcgaaaagaacuauguuaauuu

SEQ ID NO: 116543 - RNA, 64 nt, Homo Sapiens
cugugaauuagucuggaaacccagugaaguuacaaugcccuaguaacgccucucaccagggcuu

SEQ ID NO: 116544 - RNA, 64 nt, Homo Sapiens
aggggacuguucucaccuuaacucagccagaaagaugcccuaguugugaucaaagguaacucga

SEQ ID NO: 116545 - RNA, 64 nt, Homo Sapiens
uggcagguguugggaccugcugcuccauggaugcaugcccuaagagugucacugagcuguguuu

SEQ ID NO: 116546 - RNA, 64 nt, Homo Sapiens
uuuaaauacguaauugucccuaugugaauuuuuuaugcccuaaguguuucucuuuuagugguau

SEQ ID NO: 116547 - RNA, 64 nt, Homo Sapiens
caugagaugccuuuucaucuuucggcccugaaagaugcccuaucaccccgaaucuuugcagccg

SEQ ID NO: 116548 - RNA, 64 nt, Homo Sapiens
uaucugcuaaagcaaaaaguuucaguuguauuggaugcccuaucuuaauuuguuaucagguugu

SEQ ID NO: 116549 - RNA, 64 nt, Homo Sapiens
uggugugaugcugcauuauauaaaauaagaguaaaugcccuacauucaaacauaucugaaugua

SEQ ID NO: 116550 - RNA, 64 nt, Homo Sapiens
aauauugacuuuauguagauauucuaaaucucauaugcccuacuugaaacuugccuguauuauu

SEQ ID NO: 116551 - RNA, 64 nt, Homo Sapiens
cugccugaaaccuguucuaccaauuauagaucaaaugcccuaaaauguagugacccgugaaaag

SEQ ID NO: 116552 - RNA, 64 nt, Homo Sapiens
guaacuuuuauuuuaauugacauucucuuauuaaaugcccuauccaucauuaaaagguuuauua

SEQ ID NO: 116553 - RNA, 64 nt, Homo Sapiens
cagugcuugucagcgcugggucuggggccucuguaugcccuaggccugugccaaaguggccaga

SEQ ID NO: 116554 - RNA, 64 nt, Homo Sapiens
ccuaaauaauaacaauagcacccauggcuacaugaugcccuauugcugcuacucuguagccacc

SEQ ID NO: 116555 - RNA, 64 nt, Homo Sapiens
cuuaucugggaaggcuggggccucucugcuccauaugcccuaaaugaugccuuccggcugaaac

SEQ ID NO: 116556 - RNA, 64 nt, Homo Sapiens
ggcacccaggccuuauaggaauucacccuggaccaugcccuaaaauaaccucaccccaaauaca

SEQ ID NO: 116557 - RNA, 64 nt, Homo Sapiens
auguuagaaauacaucuuuuauaaugggggaagaaugcccuauguuucaauucaaaacaaagac

SEQ ID NO: 116558 - RNA, 64 nt, Homo Sapiens
uggcugagcguuguuaucuuuuguuaucuuuuauaugcccuaggaaaguacaaccagaauugaa

SEQ ID NO: 116559 - RNA, 64 nt, Homo Sapiens
gcugaaggcuccugugccaugucuuagacauugcaugcccuaucaauuacuauaauccugagcc

SEQ ID NO: 116560 - RNA, 64 nt, Homo Sapiens
auuauuaccacccaagagaacaaacucuuaucaaaugcccuaaacuuuguucuuuuucugaagu

SEQ ID NO: 116561 - RNA, 64 nt, Homo Sapiens
gguggcccagcuggcuggaggcucaagaaaggagaugcccuaguaagcuuguccagcagaacca

SEQ ID NO: 116562 - RNA, 64 nt, Homo Sapiens
ggaagaguaaaaccagaaauaagucaagccuacaaugcccuagauuauuacucuaaucccaggu

SEQ ID NO: 116563 - RNA, 64 nt, Homo Sapiens
uccacauuuaauugcauuuugcucaaacuguagaaugcccuacauuccccccaccccaauuugc

SEQ ID NO: 116564 - RNA, 64 nt, Homo Sapiens
uuauagaacucauuuaagcuguuuuuauuuuaauaugcccuauaaacauuuuuauauuuuuuga

SEQ ID NO: 116565 - RNA, 64 nt, Homo Sapiens
uuccuauugauuucuguucuaaccccuguugaccaugcccuaauagaauacagguuuucaagca

SEQ ID NO: 116566 - RNA, 64 nt, Homo Sapiens
uaauauuugcaucaguauaauaaauuuuauuuuuaugcccuacuacauaaaauucuaucuuuga

SEQ ID NO: 116567 - RNA, 64 nt, Homo Sapiens
ccuuguuauuugggagacuuugcaguggugugagaugcccuacaggguagucuuccagaaguga

SEQ ID NO: 116568 - RNA, 64 nt, Homo Sapiens
uaaucauguaauuuaauucugcaaaaugugucagaugcccuaguuagaugauuuuugggaaagg

SEQ ID NO: 116569 - RNA, 64 nt, Homo Sapiens
ucucuuauuaaggagaaauaaaaaaaucaauuuaaugcccuaacuuacacacaugaauuucuua

SEQ ID NO: 116570 - RNA, 64 nt, Homo Sapiens
gagagggcagguggaacuggggcagaaucuagucaugcccuaaagcuaguccuguaaacaaugg

SEQ ID NO: 116571 - RNA, 64 nt, Homo Sapiens
agaaagagaugaaaucuugagagcagugggaaauaugcccuauugaauguuugcauuaaaagug

SEQ ID NO: 116572 - RNA, 64 nt, Homo Sapiens
gugaccaagcuguuucuccagcugccuugaggacaugcccuagggaacagugcucugaaucgua

SEQ ID NO: 116573 - RNA, 64 nt, Homo Sapiens
acacacaaugccuagcuggggggucggaaggcaaaugcccuagaugguggggucacgucuuucu

SEQ ID NO: 116574 - RNA, 64 nt, Homo Sapiens
ggcagugcucaggagcugcaugaggagaccuagcaugcccuauugacacagaaggcagacuggg

SEQ ID NO: 116575 - RNA, 53 nt, Homo Sapiens
cuaaucagucuguggucuaacaaaugcccuacucucuuaugcauuaguaucac

SEQ ID NO: 116576 - RNA, 64 nt, Homo Sapiens
gcgcugaagauccaugucuccucuaccaccaaggaugcccuagaugagcuaggaugcuuccagc

SEQ ID NO: 116577 - RNA, 64 nt, Homo Sapiens
gccccccaagugccugccccccccaagugccuucaugcccuaggauccccuguccccuccccaa

SEQ ID NO: 116578 - RNA, 53 nt, Homo Sapiens
acaacaaggcuuacuucuaguguaugcccuaugaccccccaucuuuccuccgc

SEQ ID NO: 116579 - RNA, 64 nt, Homo Sapiens
cucugcugcccucccauccucccuguauccauucaugcccuaucuuucauucuccacuccuaau

SEQ ID NO: 116580 - RNA, 64 nt, Homo Sapiens
gacagucaucugauaagaguaugacauggaugaaaugcccuacaggggccuuggacaucuuuaa

SEQ ID NO: 116581 - RNA, 64 nt, Homo Sapiens
uuugcauggacuauucuuuccagugcuguguaaaaugcccuaccgcaccuucucugcaugucug

SEQ ID NO: 116582 - RNA, 64 nt, Homo Sapiens
uugcagccuuuuugcuugauugcauguaauggaaaugcccuauauuuuccugcaaaauaaguac

SEQ ID NO: 116583 - RNA, 64 nt, Homo Sapiens
gggaucugcauuccccgcugcccaaucauuugcaaugcccuaauuagggcauccugccccucgc

SEQ ID NO: 116584 - RNA, 64 nt, Homo Sapiens
cagaccugacaggugagguccuccuccuuuuuccaugcccuaaaaagguuuggggcagaaagga

SEQ ID NO: 116585 - RNA, 64 nt, Homo Sapiens
accccugccuggauuucuucucauucaacagcugaugcccuauaaaaagcauaauguugaacau

SEQ ID NO: 116586 - RNA, 64 nt, Homo Sapiens
agaaggcccugcucucucccauccaagugaccagaugcccuacucagcuuccaucaccccuagc

SEQ ID NO: 116587 - RNA, 64 nt, Homo Sapiens
aggauuuccacguagacaccuaggaagagcccgcaugcccuagacucacuccagaggaaggauu

SEQ ID NO: 116588 - RNA, 64 nt, Homo Sapiens
gauacaacuaggaguaacaguuaccugguacuuaaugcccuaaaguaccacuuuccuuccacug

SEQ ID NO: 116589 - RNA, 64 nt, Homo Sapiens
ucuuauuuccucagggcucagagucacaucagaaaugcccuacacuccaugaaguuuucccacu

SEQ ID NO: 116590 - RNA, 64 nt, Homo Sapiens
cccaggucuagccgggcccagcccgccccgcaccaugcccuagcaccgccugcaaccucacugu

SEQ ID NO: 116591 - RNA, 64 nt, Homo Sapiens
uuuuuuuuuuaaagacaggguggcaugcgccaccaugcccuauucuccuggguagcuagcacca

SEQ ID NO: 116592 - RNA, 64 nt, Homo Sapiens
uuagaugguuuuugaagccugcuaaaacuagagaaugcccuaacaguguuccagguguaucuua

SEQ ID NO: 116593 - RNA, 64 nt, Homo Sapiens
gaggugccagcuauuucuguuaaaaacuugcuucaugcccuacauucacugugugauuuguuuu

SEQ ID NO: 116594 - RNA, 64 nt, Homo Sapiens
ggaacuccacucucccagccuacuucacaggccuaugcccuacgauacauaucugccccagugu

SEQ ID NO: 116595 - RNA, 64 nt, Homo Sapiens
ucagggcucugcauuccgugcucagcuucugcugaugcccuagcaccaugaccaauaucucuau

SEQ ID NO: 116596 - RNA, 64 nt, Homo Sapiens
gcuguaugccuagaaagugguugaaggauucuugaugcccuaaaaccaucuuguaagcuaaaug

SEQ ID NO: 116597 - RNA, 64 nt, Homo Sapiens
cuccacuaauuauacuuaaaccauaccuuugcacaugcccuacuugacauauuuauuccuaguu

SEQ ID NO: 116598 - RNA, 64 nt, Homo Sapiens
acagcuaugaagcagaauacuagauaucaccgcaaugcccuagauuuugguuauguuugguuag

SEQ ID NO: 116599 - RNA, 64 nt, Homo Sapiens
caaagggcauuccagcagcuaauuggguucauuuaugcccuauaaagggagaagugagagggac

SEQ ID NO: 116600 - RNA, 64 nt, Homo Sapiens
gccuaugugcgaagcaagaaaagguguccucagcaugcccuaugaaaauucaaagguggauuac

SEQ ID NO: 116601 - RNA, 64 nt, Homo Sapiens
uaauugaaguuaguguucucucccaagcagacgaaugcccuaauacaaggggucauccaucauu

SEQ ID NO: 116602 - RNA, 64 nt, Homo Sapiens
auaucaacgacugugcuuguccauuauuuuacacaugcccuagaagccaaaacugaaagccacu

SEQ ID NO: 116603 - RNA, 64 nt, Homo Sapiens
uuucacccagggcgacccuggguucuuuuggaaaaugcccuaagaaauguuugaaguaacgcug

SEQ ID NO: 116604 - RNA, 64 nt, Homo Sapiens
uguuugaucucuguuugucagaaugcaguaacuaaugcccuaaauaauguauauucuaaaaaga

SEQ ID NO: 116605 - RNA, 64 nt, Homo Sapiens
ccuccccccaugguguuuucauguuuuucccaguaugcccuaggagguggccgugccucuaagc

SEQ ID NO: 116606 - RNA, 64 nt, Homo Sapiens
acuuggccugagacugaccucucccuagguccaaaugcccuagucacauggcagacccacggcc

SEQ ID NO: 116607 - RNA, 64 nt, Homo Sapiens
gggccuccaucccuguauucuagcuuguuagcauaugcccuagaaauuuuuguuugauauaagu

SEQ ID NO: 116608 - RNA, 64 nt, Homo Sapiens
cuuaaaaaaaaaaaaaaaaguugcagauauauaaaugcccuaaagguaccagggguuuauuggg

SEQ ID NO: 116609 - RNA, 64 nt, Homo Sapiens
auccccuccucccccauacacaccuaggcuugaaaugcccuacaggcccagaacuuucucacau

SEQ ID NO: 116610 - RNA, 64 nt, Homo Sapiens
ccagcccgugagcugguccugcuuccucccuuccaugcccuaacuuuuaauaugcuuguucagc

SEQ ID NO: 116611 - RNA, 64 nt, Homo Sapiens
uuacaggagggcccggagaaacugagguauggccaugcccuagacccuccccaaggaugaccac

SEQ ID NO: 116612 - RNA, 64 nt, Homo Sapiens
uccuacugggcuuucccuaaugugguugggaguuaugcccuagacuaacuguauuguccuaguc

SEQ ID NO: 116613 - RNA, 64 nt, Homo Sapiens
auaccaauuucaauaacaaucgauuguucugcccaugcccuaccagaugagucaagggugaggc

SEQ ID NO: 116614 - RNA, 64 nt, Homo Sapiens
guuucucagagccugucacacuuucugcaaauacaugcccuaaaccagggucuggcugaaaagg

SEQ ID NO: 116615 - RNA, 64 nt, Homo Sapiens
uuugugccuuuuaauuaguuauguccauguaaacaugcccuauguaauguauauguuuguuaua

SEQ ID NO: 116616 - RNA, 64 nt, Homo Sapiens
aauauagauuuuaaucaccaagcaauucacaaaaaugcccuagaugaaaauauguauaaaaucu

SEQ ID NO: 116617 - RNA, 64 nt, Homo Sapiens
uaagcucucuucuucucgaaaaggugcuacugcaaugcccuacugagcaaccuuugagauuguc

SEQ ID NO: 116618 - RNA, 64 nt, Homo Sapiens
ggcaguuggcugggcucccaacugucuguccucaaugcccuaccccaacuccacuagugacccu

SEQ ID NO: 116619 - RNA, 64 nt, Homo Sapiens
auggaaaugguugacauuacacaugguauuugucaugcccuagcauggacugucucauacugcu

SEQ ID NO: 116620 - RNA, 64 nt, Homo Sapiens
cuggcuccuucagcagcuagagcucaguauacuaaugcccuaucuuaguagagauuucauagcu

SEQ ID NO: 116621 - RNA, 64 nt, Homo Sapiens
gccuccucuuuagcaggaauucacaacaguuuggaugcccuaaacuucuguagcucaggaacau

SEQ ID NO: 116622 - RNA, 64 nt, Homo Sapiens
gaggacugagugggucugagaucaggugaaagagaugcccuaaaaaaaauuuuugguagagaga

SEQ ID NO: 116623 - RNA, 64 nt, Homo Sapiens
ugccuguucuccagauggagacagggagcuggcaaugcccuacccccaccaguggcccccacuc

SEQ ID NO: 116624 - RNA, 64 nt, Homo Sapiens
cucugcugggcuguuuguaugagaacaagaguuaaugcccuaccaauauuguguuuacauugau

SEQ ID NO: 116625 - RNA, 64 nt, Homo Sapiens
cucucgcagcucuugaaagcuaccaccacaagggaugcccuacuucuuucuuuaaacauagagg

SEQ ID NO: 116626 - RNA, 64 nt, Homo Sapiens
aaccuggcuuuugaugcccggauugcaagaauaaaugcccuaaaggagagcacauaugcaaugc

SEQ ID NO: 116627 - RNA, 64 nt, Homo Sapiens
uucuguuuuaagccucagaaaaugaacuaagacaaugcccuagaugagcugccaaaaucugagc

SEQ ID NO: 116628 - RNA, 64 nt, Homo Sapiens
guuucauuuaguauuugguacaaucuaauaaauacuaauccaguccaauacuaauccaauccaa

SEQ ID NO: 116629 - RNA, 64 nt, Homo Sapiens
gguacaaucuaauaaauacuaauccaguccaauacuaauccaauccaauacuaauaauacuauu

SEQ ID NO: 116630 - RNA, 64 nt, Homo Sapiens
uuuucaagaauaaucacgcuuuccugaauccaaacuaauccaucaccggggugguuuaguggcu

SEQ ID NO: 116631 - RNA, 64 nt, Homo Sapiens
cacauggccccucccccugccaggagcuuuggaccuaauccaagcaucccuuugcccagaaaga

SEQ ID NO: 116632 - RNA, 64 nt, Homo Sapiens
acuaguaaaccaaauccaucugcacaucaaaaagcuaauccaacauuaucaagcaggcuuuagu

SEQ ID NO: 116633 - RNA, 64 nt, Homo Sapiens
gagaaaauguuuacaaacugcaucugacaaagaucuaauccagaaucuauaaagaacucaaaca

SEQ ID NO: 116634 - RNA, 62 nt, Homo Sapiens
uugauaaauuccacuggacuugagcuuggcagcugaacuauuggagggugggagagcccagc

SEQ ID NO: 116635 - RNA, 62 nt, Homo Sapiens
acucagacaguguacaaacuaagaaggccuaacugaacuaagccauauuuaucacccgugga

SEQ ID NO: 116636 - RNA, 62 nt, Homo Sapiens
ccugccacuguguaacauagcugagguaaaaacugaacuauguaaaugacucuacuaaaagu

SEQ ID NO: 116637 - RNA, 62 nt, Homo Sapiens
cuugcccugccaagcucccugcccuguugaugcugaacuacagccuugggacaggcaggcuu

SEQ ID NO: 116638 - RNA, 62 nt, Homo Sapiens
ucauucauucagcaaauaaucugaaauccagucugaacuaaggccugagcuguggauaccau

SEQ ID NO: 116639 - RNA, 62 nt, Homo Sapiens
uaagaauuuugcuuuagagaaugccacuuuggcugaacuacaaguguaggccaccauuauaa

SEQ ID NO: 116640 - RNA, 62 nt, Homo Sapiens
aucacugugcucccugggggacaucccacucucugaacuacaacuagaugauuacgaagauc

SEQ ID NO: 116641 - RNA, 62 nt, Homo Sapiens
aaccucuauucuaaacuaauuuugaacauuuucugaacuaaauagccaugacuguauuggac

SEQ ID NO: 116642 - RNA, 62 nt, Homo Sapiens
agacguguggaaaaagaaucauaaauaguuuacugaacuagcaaugaccagacaccuguuug

SEQ ID NO: 116643 - RNA, 62 nt, Homo Sapiens
uugagauuagacccaaacauauuucuguuccccugaacuaauauauacauaaauuuucagcu

SEQ ID NO: 116644 - RNA, 62 nt, Homo Sapiens
ugggagguggggagggguacccaccccauccccugaacuacuuuuauuuuuauucgcacauc

SEQ ID NO: 116645 - RNA, 62 nt, Homo Sapiens
gcaaaaggcagagaauuacaacucaauaauaacugaacuacacaaauuaaguagaaagugag

SEQ ID NO: 116646 - RNA, 62 nt, Homo Sapiens
uggaccugguuaaucauagauuaaagacucuucugaacuaguguuuuuugacaaucacuucc

SEQ ID NO: 116647 - RNA, 62 nt, Homo Sapiens
aaauagaaaauuuaaaugcuacuucaagaauucugaacuauuaucagaaagacacuaaucug

SEQ ID NO: 116648 - RNA, 62 nt, Homo Sapiens
augaggguauuuuugagugaauuuuaacugcucugaacuaaguauaagcucaugggccugca

SEQ ID NO: 116649 - RNA, 62 nt, Homo Sapiens
uacauaggucuuaccauugaccuaagaucaaucugaacuaucuuagcccagucagggagcuc

SEQ ID NO: 116650 - RNA, 62 nt, Homo Sapiens
cuuugccauaaugauagacucaauuuagcucucugaacuaguugguaauuuuuuuuuuuuaa

SEQ ID NO: 116651 - RNA, 62 nt, Homo Sapiens
gugucuugcggcagcugcagcaaguggaggggcugaacuacuggccagcucacuggaugaug

SEQ ID NO: 116652 - RNA, 62 nt, Homo Sapiens
ucuguagucaaaguauaccaaaaccaauuuaucugaacuaaauucuaaaguaugguuauaca

SEQ ID NO: 116653 - RNA, 62 nt, Homo Sapiens
cuacaacaggcagguacugcugccagggggcucugaacuagugccugcuacccaggacaccc

SEQ ID NO: 116654 - RNA, 62 nt, Homo Sapiens
gggggguggccacaggagauggggagaggagucugaacuaaaccccuggcuuuugugcacac

SEQ ID NO: 116655 - RNA, 62 nt, Homo Sapiens
gggccacauuucaccuccuuagucccccuggucugaacuaguugagagaguaguuuugaaca

SEQ ID NO: 116656 - RNA, 62 nt, Homo Sapiens
aacaaauccacagaauggguaaagaguagaaucugaacuauaucuugacaaauauuauucaa

SEQ ID NO: 116657 - RNA, 62 nt, Homo Sapiens
cgcgcugccccugcccugccucuguccuggcucugaacuaguagaugauggugccagagggc

SEQ ID NO: 116658 - RNA, 62 nt, Homo Sapiens
uaacuugagcauaagauaugagauacaugaaccugaacuauuaaaauaaaauauuauauuua

SEQ ID NO: 116659 - RNA, 62 nt, Homo Sapiens
ucuguggaaugcauugugaaguuuaagcuguacugaacuaaaugaagauuuauaccauugug

SEQ ID NO: 116660 - RNA, 62 nt, Homo Sapiens
ugcuggcaugucugggucguuggucucuaggccugaacuaggcagugacugcugcgcugugc

SEQ ID NO: 116661 - RNA, 62 nt, Homo Sapiens
caggcaggaaaaaagcccagguuguaugugcacugaacuaauacccagauccucugguccaa

SEQ ID NO: 116662 - RNA, 62 nt, Homo Sapiens
cacugaaaugguuaagaugguacauaacaauacugaacuauaguugugcaacaauaugaaua

SEQ ID NO: 116663 - RNA, 62 nt, Homo Sapiens
uaaccucugcaugugaaaacuuuuaacaguuacugaacuauguaaauaugugaauuuuuuua

SEQ ID NO: 116664 - RNA, 62 nt, Homo Sapiens
ugccugacuaagaugugaccagcucaggcagacugaacuaagcaccccucccauccugcgac

SEQ ID NO: 116665 - RNA, 62 nt, Homo Sapiens
aaagagaaaagaaaacucagaaagggaugaaucugaacuauaugauuacuuguagucagaau

SEQ ID NO: 116666 - RNA, 62 nt, Homo Sapiens
uuucucuggcacuccagucccaggccuugggccugaacuacuggaaaaggucuggcggcugg

SEQ ID NO: 116667 - RNA, 62 nt, Homo Sapiens
gguucccuggcaggggaagcugagagccauggcugaacuaucagggacaaaggcccaugucc

SEQ ID NO: 116668 - RNA, 62 nt, Homo Sapiens
gcagugcaaacccucuuccgcugagcagcugucugaacuauaggccccagugcugaagacca

SEQ ID NO: 116669 - RNA, 62 nt, Homo Sapiens
agagggaguauuguauugggaagaaaauguuacugaacuauugacugaaaguaaauuuagau

SEQ ID NO: 116670 - RNA, 62 nt, Homo Sapiens
auaccugucaccaugcagccgcugauaguucucugaacuaaaaggacuaauuguacuuugag

SEQ ID NO: 116671 - RNA, 62 nt, Homo Sapiens
auuagaagcaauuauaauuacaucugugauuucugaacuaauggugcuaauucagagaaaug

SEQ ID NO: 116672 - RNA, 62 nt, Homo Sapiens
cagaaagaacucaggacauauuaaaaaauaaacugaacuaaaacaacuuuugcccccugacu

SEQ ID NO: 116673 - RNA, 62 nt, Homo Sapiens
agcugaauuagucauguccauucagacauaaccugaacuacugaaaagaucaauuuccagaa

SEQ ID NO: 116674 - RNA, 62 nt, Homo Sapiens
cgguggcagugggugccuguagugugaugugucugaacuaauaaaguggcugaagaggcagg

SEQ ID NO: 116675 - RNA, 62 nt, Homo Sapiens
agcccauuuauacuguuccauuugcucaguaucugaacuauaguaaaaaguaguauugugua

SEQ ID NO: 116676 - RNA, 62 nt, Homo Sapiens
cgagcacuucucaccaaacugccagauguugucugaacuaaugggaaggacagacaucaagu

SEQ ID NO: 116677 - RNA, 62 nt, Homo Sapiens
augugcuagaggagggcacacagaacauaccacugaacuaguagggccuccacacugccugg

SEQ ID NO: 116678 - RNA, 62 nt, Homo Sapiens
uaacuuccuacguauccugcccuucagcaugccugaacuacauugccccuugcagugggacg

SEQ ID NO: 116679 - RNA, 62 nt, Homo Sapiens
uggaggucuagaugaggugccagauugaacugcugaacuaguaguccuguggcugaggggca

SEQ ID NO: 116680 - RNA, 62 nt, Homo Sapiens
aauuagacaucaguuagcaagauugaagcauccugaacuaugacucuaaucauuggccucau

SEQ ID NO: 116681 - RNA, 55 nt, Homo Sapiens
aaauuuaccauuuuguuuuugaugucugaacuauuaaaagucaagucuugucuaa

SEQ ID NO: 116682 - RNA, 62 nt, Homo Sapiens
ucugacaugaaaacuucucaccgccucagcagcugaacuaaaaaccugaauagccaugacaa

SEQ ID NO: 116683 - RNA, 62 nt, Homo Sapiens
cauugaugauuguuaaguuugcagacuuuggucugaacuagcugggaauauucagucaagga

SEQ ID NO: 116684 - RNA, 62 nt, Homo Sapiens
agauaauucauaagaauuugguaacuccaaaacugaacuauaauuguaugcaaucuuuaugu

SEQ ID NO: 116685 - RNA, 62 nt, Homo Sapiens
agcuuuugaaaacagacugagaagacaacaggcugaacuagaugcucuugaagaagaaaaac

SEQ ID NO: 116686 - RNA, 62 nt, Homo Sapiens
cccagaaucauguucaaaaauaauuguaaaaacugaacuauuuaugacaaagccucaauuac

SEQ ID NO: 116687 - RNA, 62 nt, Homo Sapiens
acacaggcuguagaaacaguucagugugucuccugaacuagcauucucaaguccuuuuacaa

SEQ ID NO: 116688 - RNA, 62 nt, Homo Sapiens
cucauaguuauuauccagaggacccaacugaacugaacuaauccuucuggcagauucaaauc

SEQ ID NO: 116689 - RNA, 62 nt, Homo Sapiens
cuucaucugaaugugcucugccgccuucuuaucugaacuagaugaauuggccauaauuauga

SEQ ID NO: 116690 - RNA, 62 nt, Homo Sapiens
cauuuuaguagggauucacugacuagauuuuacugaacuaugaaaauaaauacacauaauuu

SEQ ID NO: 116691 - RNA, 62 nt, Homo Sapiens
uaacuguaaaacauugaaugaaacuauuuuaccugaacuagauuuuaucugaaaguagguag

SEQ ID NO: 116692 - RNA, 62 nt, Homo Sapiens
ggagccccagauaaacaugauggggaaaagcacugaacuaagagucccaugguuucucuucu

SEQ ID NO: 116693 - RNA, 62 nt, Homo Sapiens
guagcuggucagggacuuuuuuuucuuuucuccugaacuacaugauucuaauuggaauguuc

SEQ ID NO: 116694 - RNA, 62 nt, Homo Sapiens
auuuuuauacuauauauugugucauugcuaaucugaacuauucauauucacaaaccaauacu

SEQ ID NO: 116695 - RNA, 62 nt, Homo Sapiens
acaugagccuuauagauuguaucuuuuuggugcugaacuauggguuaaacaguuuuguguag

SEQ ID NO: 116696 - RNA, 62 nt, Homo Sapiens
uuuauaacuucuugugagucccugggaucucucugaacuauuaggaagcuaagcagugggua

SEQ ID NO: 116697 - RNA, 62 nt, Homo Sapiens
uugugcuguguauaucacugccugcccccucccugaacuauuuuuaauuauuacaaguugcu

SEQ ID NO: 116698 - RNA, 62 nt, Homo Sapiens
uuguucuuauuuuuugccaccaaaucgauaaccugaacuaauuuuuguucauuuuuaauuug

SEQ ID NO: 116699 - RNA, 62 nt, Homo Sapiens
agaaccuggggguggauuugcacagcuuuucucugaacuaggucccuuccuucuuccacuuu

SEQ ID NO: 116700 - RNA, 62 nt, Homo Sapiens
aaaaacucuucuuuguaaucugcauucugaggcugaacuaauuuuauuuauuuauuuauuuu

SEQ ID NO: 116701 - RNA, 62 nt, Homo Sapiens
uuggggaaacaauuucuaggcgagacucucaucugaacuaacgcuacauuacaaacuuugga

SEQ ID NO: 116702 - RNA, 62 nt, Homo Sapiens
uaaugauugcuuuacuuuuacuuuucuuuuaucugaacuacuggguaacucagguaaagaug

SEQ ID NO: 116703 - RNA, 62 nt, Homo Sapiens
ccaauuguuauuaagccacuaaguacauugggcugaacuaaucuaucauguuauggaaugga

SEQ ID NO: 116704 - RNA, 62 nt, Homo Sapiens
uaccaucugauccccucagaccauccucagcccugaacuagcaaaguaacaucaacacuguc

SEQ ID NO: 116705 - RNA, 62 nt, Homo Sapiens
acaugucaauauucuuuuuuauaguuauucuucugaacuaaguaaaagcaaaucaacacuuu

SEQ ID NO: 116706 - RNA, 62 nt, Homo Sapiens
uccuuaguuuucagucuacuucacucuaaaagcugaacuacaaaaccuuuuuuaaaaaaggu

SEQ ID NO: 116707 - RNA, 62 nt, Homo Sapiens
uuuggugcuuaaaguugucaugaaaaauauugcugaacuacuccauuaugauaaauuaagca

SEQ ID NO: 116708 - RNA, 62 nt, Homo Sapiens
cuuguucagauuaagaguugccaaaauaccuucugaacuacacugcauuguugugccgagaa

SEQ ID NO: 116709 - RNA, 62 nt, Homo Sapiens
cauaagccuuuuauggcccucuugcagaucuucugaacuaugcacauuugugcuuuuuuugu

SEQ ID NO: 116710 - RNA, 62 nt, Homo Sapiens
aaaugucauguuaagcaauuucagaacauuaacugaacuauuuucaaagcagaaaaauugac

SEQ ID NO: 116711 - RNA, 62 nt, Homo Sapiens
aaguaaauauuuauuuaggaauacugugaacacugaacuaauuauuccugugucagucuaug

SEQ ID NO: 116712 - RNA, 62 nt, Homo Sapiens
uuugugccugaaaauaauagagcuugagcugucugaacuauuuuacauuuuauggugucuca

SEQ ID NO: 116713 - RNA, 62 nt, Homo Sapiens
guaagaaagggagaauauaguuuuagaggaagcugaacuaugacgaugcugggcgaagcggu

SEQ ID NO: 116714 - RNA, 62 nt, Homo Sapiens
uagagagacaggggaguugucaacuugggcuacugaacuacaugcauaaacuaaaaacuaac

SEQ ID NO: 116715 - RNA, 62 nt, Homo Sapiens
guuuugaauguuuaaagaaguuagcuggauuucugaacuauguauuuaaaacaaaguucaau

SEQ ID NO: 116716 - RNA, 62 nt, Homo Sapiens
ucagugucaacuauucagaaacuguaacacagcugaacuauucuuuucucuugugagggaag

SEQ ID NO: 116717 - RNA, 62 nt, Homo Sapiens
auauggagacauccucauuguuuauuacaucacugaacuaaauaaaaaucaguaaucaguac

SEQ ID NO: 116718 - RNA, 62 nt, Homo Sapiens
uugcucuuuuuuggcagggaaaaauccgacagcugaacuaggcauaaagagaguguuauaua

SEQ ID NO: 116719 - RNA, 62 nt, Homo Sapiens
gcuuggccuuggggagggcugcucuccucagucugaacuaagcacaagcgaggguagcagag

SEQ ID NO: 116720 - RNA, 60 nt, Homo Sapiens
ucagcuggcagcaguggugaaaagaaauuacugaacuauugucaaauggacuuccuguca

SEQ ID NO: 116721 - RNA, 62 nt, Homo Sapiens
gggccuauacuuuuauuuuucaacucuauuaacugaacuaugcuuggagagagcccugaauc

SEQ ID NO: 116722 - RNA, 62 nt, Homo Sapiens
auccacuguuagaauaccuaugguuagggcuucugaacuaaaauaauggaaaauuuuaacaa

SEQ ID NO: 116723 - RNA, 62 nt, Homo Sapiens
ggaauugagcuucccucccauuuuccuuguuccugaacuaauacuacuguaccuguuaugga

SEQ ID NO: 116724 - RNA, 62 nt, Homo Sapiens
uuguaucuuaaaauucauaccuugaauuuuaucugaacuaaaugucaaaagguuuauguaaa

SEQ ID NO: 116725 - RNA, 62 nt, Homo Sapiens
cauugagaaaucaaucaaaaacuggcauuauacugaacuauaccaaauuuuugccauuaaaa

SEQ ID NO: 116726 - RNA, 62 nt, Homo Sapiens
aaaguuuuacagaaaguagugaacugguaucacugaacuacugaauucaccaagauugggua

SEQ ID NO: 116727 - RNA, 62 nt, Homo Sapiens
acacaugaauaugugggcuaugacuuguguuccugaacuaugauuaccuagaaguuugucac

SEQ ID NO: 116728 - RNA, 62 nt, Homo Sapiens
ggcuaaugucaggagcugaucauuuguagauacugaacuaaggucauagaauucccaaauuu

SEQ ID NO: 116729 - RNA, 62 nt, Homo Sapiens
gagcaguggcagaaggugggccuucacccggccugaacuaagccguguucugccagcaccgc

SEQ ID NO: 116730 - RNA, 62 nt, Homo Sapiens
ccccugcucaacagagguuuaguuuacagucucugaacuaaaguaguaaccucccaaauugu

SEQ ID NO: 116731 - RNA, 62 nt, Homo Sapiens
caggacuacauaugacccagagagcaagguggcugaacuauagucuggaagcccucagguaa

SEQ ID NO: 116732 - RNA, 62 nt, Homo Sapiens
cucgacaauaaagauauuccgugucuuuaccccugaacuaagacacagggaguauuucagag

SEQ ID NO: 116733 - RNA, 62 nt, Homo Sapiens
ugacuguuguacuguagcucuuuagacaaccacugaacuagaagauguggacagcuugaugu

SEQ ID NO: 116734 - RNA, 62 nt, Homo Sapiens
agagcaguuacugucuguucucuuucccuccucugaacuauuucgcccccagccugagguga

SEQ ID NO: 116735 - RNA, 62 nt, Homo Sapiens; identical to SEQ ID NO: 116702

SEQ ID NO: 116736 - RNA, 62 nt, Homo Sapiens
auaggguuuuucuucagguguugcauuauuuucugaacuauacuagauuaaauuaaaauugg

SEQ ID NO: 116737 - RNA, 61 nt, Homo Sapiens
ggaagcuggaauucguaugacggagucuuaucugaacuacacuuacugaacagcuugaagg

SEQ ID NO: 116738 - RNA, 62 nt, Homo Sapiens
gauaugcauuugacuuguuaaacagccuauuccugaacuauaacaccugccaccacuauaaa

SEQ ID NO: 116739 - RNA, 62 nt, Homo Sapiens
gcacaauaucuucacacugugcuguauugcugcugaacuaaaugcacuuuuccccacauaug

SEQ ID NO: 116740 - RNA, 62 nt, Homo Sapiens
ccuuaucguucuauguaccagguauuuuauuacugaacuagcaacuagccuuuuccaccuuu

SEQ ID NO: 116741 - RNA, 62 nt, Homo Sapiens
guggugcauuuuuguaaguuauuuuuccuccacugaacuaggagcacuauguaggaaagacc

SEQ ID NO: 116742 - RNA, 62 nt, Homo Sapiens
aguccugggagagcugugguacuggugggaaccugaacuagguucaguccuguggucccugg

SEQ ID NO: 116743 - RNA, 62 nt, Homo Sapiens
cucugguaggauugcaggggaagcaaaagggacugaacuagcguaaauauguuuuaggaaga

SEQ ID NO: 116744 - RNA, 62 nt, Homo Sapiens
gucuauauuuaaaauuagaugguuguuguucccugaacuacuaauaauuuugugaauuuuuu

SEQ ID NO: 116745 - RNA, 62 nt, Homo Sapiens
ugaucucaguucucuuucaaucccguuagucucugaacuagggccauaaaugaccuaacguu

SEQ ID NO: 116746 - RNA, 62 nt, Homo Sapiens
cccuuguucuuggagggaccauuauuacaucucugaacuaccuuuguauccaacauguuuua

SEQ ID NO: 116747 - RNA, 62 nt, Homo Sapiens
ccccagccaaucaggacuuuccagacuuggcccugaacuacugacguuccuaccucuuauuu

SEQ ID NO: 116748 - RNA, 62 nt, Homo Sapiens
auuuugccuuagcuacugcaguggaaagagcacugaacuaggaguuggaagacaaggaugug

SEQ ID NO: 116749 - RNA, 62 nt, Homo Sapiens
cagggugucuggggcaggaggaggccaacucacugaacuagugcaggguauguggguggcac

SEQ ID NO: 116750 - RNA, 62 nt, Homo Sapiens
gcuaacagaucccccugaggcugccaacagaucugaacuaaugcucgcauuaguuucuguug

SEQ ID NO: 116751 - RNA, 61 nt, Homo Sapiens
aaaacaaaugugcuaugcucaaggguuggcuucugaacuacuguacacauuuuaauaaaau

SEQ ID NO: 116752 - RNA, 62 nt, Homo Sapiens
agccacaucuuguucaucacaauauggaggggcugaacuagucauuuagaauuagcagagcu

SEQ ID NO: 116753 - RNA, 62 nt, Homo Sapiens
gacaaauuggaccucaauguauuggacuaauucugaacuacauaguuggucuaagggucugu

SEQ ID NO: 116754 - RNA, 62 nt, Homo Sapiens
ugaaucuuaauauuucaaagccaggugaaaaucugaacuagauauucuuuguuggaauaugc

SEQ ID NO: 116755 - RNA, 62 nt, Homo Sapiens
uccuggcuguugugaaagaauuuuucuacauccugaacuauuuuuccuauuucuuuucaccu

SEQ ID NO: 116756 - RNA, 62 nt, Homo Sapiens
aaauuaaguuuuggguaaguguguuguuuaaucugaacuauaguaacuuaauacucuaaaca

SEQ ID NO: 116757 - RNA, 62 nt, Homo Sapiens
cagcagagcugagauuaauaucugggcuuuuccugaacuauucugguuauugagcccuuccu

SEQ ID NO: 116758 - RNA, 62 nt, Homo Sapiens
acauaacuaacuuucgaggcacuggaacauaccugaacuaagaauuaaaucuuuuacuuuau

SEQ ID NO: 116759 - RNA, 62 nt, Homo Sapiens
auguuaaugaagauggacaucacuauuuauuacugaacuauucuucggcuugugaggcuucc

SEQ ID NO: 116760 - RNA, 62 nt, Homo Sapiens
ucacagacaaggaaacuucuauaaacaggugccugaacuaguauaguuuuaucuggguacaa

SEQ ID NO: 116761 - RNA, 62 nt, Homo Sapiens
auaaauacaugcuuaauccuuguuuguuuuaacugaacuaaacguuucaaugaaacaaugua

SEQ ID NO: 116762 - RNA, 62 nt, Homo Sapiens
cuccccuaccuuagacugguagcuacccagaacugaacuagauuaaguaccugagcucucga

SEQ ID NO: 116763 - RNA, 60 nt, Homo Sapiens
caucacacacugagaaucucgauguaaacccugaacuaaacucuuguucaugcccaguaa

SEQ ID NO: 116764 - RNA, 62 nt, Homo Sapiens
acugauggguucccuaucaagguuaaaugacccugaacuaaacuaaccaucaacaauugcau

SEQ ID NO: 116765 - RNA, 62 nt, Homo Sapiens
acaguuaguauucuaaugaaaggaugaagagucugaacuagaagguagguuuaagccaucac

SEQ ID NO: 116766 - RNA, 62 nt, Homo Sapiens
ugcuuucucuucaagauaagugucucccugaucugaacuauuucuuuauuaaaaccucagca

SEQ ID NO: 116767 - RNA, 62 nt, Homo Sapiens
uggaaauuacugcuuucucuuaaugaggaacacugaacuaguuguguagguagauuccauau

SEQ ID NO: 116768 - RNA, 62 nt, Homo Sapiens
cguacugcauagcaucaagucaucugcuucuacugaacuauguauguauuuuaaagaaauuu

SEQ ID NO: 116769 - RNA, 62 nt, Homo Sapiens
aauuguuagcgggguuuugauauaauagaaaacugaacuagggaauuuaacuuuuugauuug

SEQ ID NO: 116770 - RNA, 62 nt, Homo Sapiens
ugguaauaaagugcuuauuucuuguucugaugcugaacuauuacccuuuuggaauuagaauu

SEQ ID NO: 116771 - RNA, 62 nt, Homo Sapiens
uaugggauuuguggacacagcuguuucuguuccugaacuagaagucuuccccagcucugacg

SEQ ID NO: 116772 - RNA, 62 nt, Homo Sapiens
guguuucuucauaucuaggagauuuggaaauucugaacuaaggucuuauaagaacaagaaau

SEQ ID NO: 116773 - RNA, 62 nt, Homo Sapiens
auuaaauaagugaauacaaaagauagcuucuucugaacuauuaauuacuucuuguacagcug

SEQ ID NO: 116774 - RNA, 62 nt, Homo Sapiens
caauggaaauaaugcugcauccuguucuccaucugaacuagauuuacagaucaauaaaagca

SEQ ID NO: 116775 - RNA, 62 nt, Homo Sapiens
guagggccucucuaagaauuuaaacugucuuccugaacuacugaacucagggaacaauacug

SEQ ID NO: 116776 - RNA, 62 nt, Homo Sapiens
augaugaacuauuuuauguaaaaugucauaaacugaacuaaaagcauuaauacuaguccaaa

SEQ ID NO: 116777 - RNA, 62 nt, Homo Sapiens
gcuaccaaauacauucccugauuaaacuuuaacugaacuaaguuacaaauugaggauuacca

SEQ ID NO: 116778 - RNA, 62 nt, Homo Sapiens
caauauauauguuuaacccagucacucaauuccugaacuaauugucugauaagcaucuuaaa

SEQ ID NO: 116779 - RNA, 62 nt, Homo Sapiens
cuggggacauccuggacuugagcacuuaguuucugaacuaguccuuuuuaaggggaggagag

SEQ ID NO: 116780 - RNA, 62 nt, Homo Sapiens
ugccuuuguuuugaaauuauaucaccuguguucugaacuaaaaugaugggaguucauuuugu

SEQ ID NO: 116781 - RNA, 62 nt, Homo Sapiens
auucuuucacaagguacaaaaucuugcauaagcugaacuaaaauaaaaaugaaaaggagaga

SEQ ID NO: 116782 - RNA, 62 nt, Homo Sapiens
auauacucuugggagagagcaugaaugguauucugaacuaucaccugauucaaggacuuugc

SEQ ID NO: 116783 - RNA, 62 nt, Homo Sapiens
auuuuucuuuaaaaagcaaacaugacuuggaacugaacuaacuugccucugccugguaccca

SEQ ID NO: 116784 - RNA, 62 nt, Homo Sapiens
cuaaucuggaauuuguuuuuauaaaugaaacgcugaacuauguuugccuugauaaagguaag

SEQ ID NO: 116785 - RNA, 62 nt, Homo Sapiens
acaacuguccaggcugagauaaaucccgggaccugaacuauuagcacgucacuagagacugg

SEQ ID NO: 116786 - RNA, 62 nt, Homo Sapiens
gcccacguggaggcccaccugccucugucucacugaacuagaagccgagccuagaaacuaac

SEQ ID NO: 116787 - RNA, 62 nt, Homo Sapiens
ugaacugugacugacagguaguuuuguuauaucugaacuaguccaauacuccaaguccuuga

SEQ ID NO: 116788 - RNA, 62 nt, Homo Sapiens
agggugggcaauucacagccuuucugaacugacugaacuagagcuugcagugaaguguucug

SEQ ID NO: 116789 - RNA, 62 nt, Homo Sapiens
cuucguaauucuaauguguacugcugguauagcugaacuacugaccuggaucuuaguccuag

SEQ ID NO: 116790 - RNA, 62 nt, Homo Sapiens
ucuuaguuucuguaaauucaugacuugucuuacugaacuacagccugguuuguagacuucca

SEQ ID NO: 116791 - RNA, 62 nt, Homo Sapiens
cucccucaggccgaaggaggagucagggagagcugaacuauuagagcugccugugccuuuug

SEQ ID NO: 116792 - RNA, 62 nt, Homo Sapiens
ccuaacauaaaacacagcaagaaucugguugucugaacuauuuuaaauuaaggagccagaug

SEQ ID NO: 116793 - RNA, 62 nt, Homo Sapiens
gauuguauuggugauuucuaaaacuguauuugcugaacuaagauguuuauaaacuauacaga

SEQ ID NO: 116794 - RNA, 62 nt, Homo Sapiens
cacauuucaacugcucaguaucaauuccucggcugaacuagcaauagaaugaaacacaaaau

SEQ ID NO: 116795 - RNA, 62 nt, Homo Sapiens
uuaaauaaaauauuggcaaaaaagaacuaggacugaacuauuuguuuuacgcuaaagaugga

SEQ ID NO: 116796 - RNA, 62 nt, Homo Sapiens
cauuaacagcccccgugggccuuucccauccucugaacuagguccuucgucucuccaacugc

SEQ ID NO: 116797 - RNA, 62 nt, Homo Sapiens
gaauaaaaaaaaaacaacgccaauugagauggcugaacuacuuuauauacaguuuuagggga

SEQ ID NO: 116798 - RNA, 62 nt, Homo Sapiens
cagauuggauuuccaaaccacagggucauggucugaacuacucuccugcaucccaugcuaag

SEQ ID NO: 116799 - RNA, 62 nt, Homo Sapiens
ucuucucucacgcucaagucaugaacacuguacugaacuacagagaagagaauaaaagugac

SEQ ID NO: 116800 - RNA, 62 nt, Homo Sapiens
gcccaauuugcuugcauuuuccaggggaaccacugaacuaaacagagggacugucaucuaaa

SEQ ID NO: 116801 - RNA, 62 nt, Homo Sapiens
aaaucuacccaaugagacuugauaccguuuuccugaacuaauguuaaccugauuucaauuuu

SEQ ID NO: 116802 - RNA, 62 nt, Homo Sapiens
uauuaaaaacaugaccacucgauaagaaaagccugaacuauuaugagcuggguacugacuga

SEQ ID NO: 116803 - RNA, 62 nt, Homo Sapiens
uuuuguguguauauauuuaacaugaagccuugcugaacuaagauuuuggaauugguguauau

SEQ ID NO: 116804 - RNA, 62 nt, Homo Sapiens
uagugcagcuuuucauuguguuaacuaacauucugaacuaguuuauucacaccagcaucauc

SEQ ID NO: 116805 - RNA, 62 nt, Homo Sapiens
gagaacugccagggaaucuuacuucgggaaugcugaacuaauucugccuccaaacaggggac

SEQ ID NO: 116806 - RNA, 62 nt, Homo Sapiens
ugauuaaacuagauagaccugguauacagucacugaacuaguagaugucaauaauuauuauu

SEQ ID NO: 116807 - RNA, 62 nt, Homo Sapiens
cuuugaagaaaccccuauaguuuuuaaaaggccugaacuauaguuuuggaauuugaagcuaa

SEQ ID NO: 116808 - RNA, 62 nt, Homo Sapiens
gagcaugauguuuaaucuaaucccuguguaugcugaacuacacagauuuauuuuuaugugga

SEQ ID NO: 116809 - RNA, 62 nt, Homo Sapiens
acuuccuagaggaagggacaucgaacuaagaccugaacuaugagaaauaggcaggaagaagu

SEQ ID NO: 116810 - RNA, 62 nt, Homo Sapiens
ccccucuacuuuaacuuuuacaaaaaaguaaccugaacuaaucugauguuaaccaauguauu

SEQ ID NO: 116811 - RNA, 62 nt, Homo Sapiens
aacuguaugugaaggggagccagggaacguuucugaacuaagcaaggacaaauucagagacc

SEQ ID NO: 116812 - RNA, 62 nt, Homo Sapiens
cagaccugagcuggcuuggacccauuugaggacugaacuaggcaggcaauggcuccagugcc

SEQ ID NO: 116813 - RNA, 62 nt, Homo Sapiens
cccggagcaccccacccccagaacaccucccucugaacuaauccgcuccacggagucuucca

SEQ ID NO: 116814 - RNA, 62 nt, Homo Sapiens
gaucuguggcuauuuugcaugugacuuucaaccugaacuaugucucaaaaaggcuacuguuu

SEQ ID NO: 116815 - RNA, 62 nt, Homo Sapiens
gguugcauucuccaccaagggaguuaaccuaccugaacuaaguagaaaugccagucuuccac

SEQ ID NO: 116816 - RNA, 62 nt, Homo Sapiens
aauagaacacuucuuggaggcuuucuucagaacugaacuagaaacaagguuuccaggcuccc

SEQ ID NO: 116817 - RNA, 62 nt, Homo Sapiens
uguaaguauuuacuuagagcuuuuucuuaaaucugaacuaacuugcuuuuagaagucuuuuu

SEQ ID NO: 116818 - RNA, 62 nt, Homo Sapiens
gaccagaggcugccagauguuggauguuguaucugaacuaagccucacaccuggcagcuuca

SEQ ID NO: 116819 - RNA, 62 nt, Homo Sapiens
agaggaaaaaaauggcaauuaaaaguuguuuucugaacuagaagaagaggccuauuaaaaaa

SEQ ID NO: 116820 - RNA, 62 nt, Homo Sapiens
cauuucucccuaauguucuuacccaaauguaccugaacuaaaaaauguuagauguuggugau

SEQ ID NO: 116821 - RNA, 62 nt, Homo Sapiens
aauugguuguuuaacacuucaugaggaaacuacugaacuagcuuugcuuaacauuagauguc

SEQ ID NO: 116822 - RNA, 62 nt, Homo Sapiens
gugcugcacucaaaugauggggcacagagauucugaacuaaauccuguuuaaaaaaccacau

SEQ ID NO: 116823 - RNA, 62 nt, Homo Sapiens
guuuggugucugaucuugagugcgacaccuagcugaacuaugacuuaauaaguauucccccc

SEQ ID NO: 116824 - RNA, 62 nt, Homo Sapiens
caaucagaucaacucugucugguaggcugggccugaacuagccaccaagcucuguccaauca

SEQ ID NO: 116825 - RNA, 62 nt, Homo Sapiens
cuuuauguacauaaucuugauggagcuauuagcugaacuauaaaauaugcucuugguaaaua

SEQ ID NO: 116826 - RNA, 62 nt, Homo Sapiens
aaacaucuaugccuuuucucagaaaugauuugcugaacuauguccauauuuuacagcuuaga

SEQ ID NO: 116827 - RNA, 62 nt, Homo Sapiens
gaguguuagaaaaaacuggaaacaucugauuucugaacuaucagggcaagcucauagcacau

SEQ ID NO: 116828 - RNA, 62 nt, Homo Sapiens
ugaaauuuuaaaugcacaguucuauuugcuaucugaacuaauucauuuauuaaguauauuug

SEQ ID NO: 116829 - RNA, 62 nt, Homo Sapiens
augguuuggccuggggaucuuagaugucugaccugaacuauuguagaacagcgcuggcuuuu

SEQ ID NO: 116830 - RNA, 62 nt, Homo Sapiens
uuuaagagacuuuguaaaaauguuuugccagccugaacuauauacgguucugugcaaagagg

SEQ ID NO: 116831 - RNA, 62 nt, Homo Sapiens
auauucuagaucuuguuuuagagcccaguauacugaacuagaucaaaaggaaaguugguuuu

SEQ ID NO: 116832 - RNA, 62 nt, Homo Sapiens
aggaagguuuagccuucuaaguccuugacuaacugaacuagaauguaacugaccuuaguaaa

SEQ ID NO: 116833 - RNA, 62 nt, Homo Sapiens
uaggguucuguggaaggagguauucugccagccugaacuauauuuaagaaacuuuguaaaaa

SEQ ID NO: 116834 - RNA, 64 nt, Homo Sapiens
cuccguggccaguugaagcgcuggauguuuccuagaacaagaaccaccaaagccuguucgcaca

SEQ ID NO: 116835 - RNA, 64 nt, Homo Sapiens
cccucccgucgagaagcugguagucagugagugagaacaagagaacaagaacacccugaacagu

SEQ ID NO: 116836 - RNA, 64 nt, Homo Sapiens
ucgagaagcugguagucagugagugagaacaagagaacaagaacacccugaacaguccugguug

SEQ ID NO: 116837 - RNA, 64 nt, Homo Sapiens
aguacuaucuuuguguugcacuuagagggugauggaacaagagaaauuuaguucaugcauuggu

SEQ ID NO: 116838 - RNA, 64 nt, Homo Sapiens
guggaaggcaguguuauuuaugagauguugagaggaacaagaagaugucaauaaauuugcuuuu

SEQ ID NO: 116839 - RNA, 64 nt, Homo Sapiens
uaauuauucacauaaauuuuguuuaauauugguugaacaagaaaucugacuuuaaaagauuauu

SEQ ID NO: 116840 - RNA, 64 nt, Homo Sapiens
gucauaacuuacagugaaaaagcccaauaauacagaacaagacaugaugggcaauacccuagca

SEQ ID NO: 116841 - RNA, 64 nt, Homo Sapiens
uuuucuaaaaagauaguggaacucugggaaugaggaacaagacuuccaugcugagcuugacaac

SEQ ID NO: 116842 - RNA, 64 nt, Homo Sapiens
uugcaugcucuugaggccauugaagacuaaaacugaacaagaugaaaggguaguuguuuuacaa

SEQ ID NO: 116843 - RNA, 64 nt, Homo Sapiens
cugucucaaaaaaaaaaaaaagccuggggugauagaacaagaccagaucacaccacugcacucc

SEQ ID NO: 116844 - RNA, 64 nt, Homo Sapiens
ugcuagcucuuaccaaaacaccagggucuaaagagaacaagaggcugauuuugguuuauucccu

SEQ ID NO: 116845 - RNA, 64 nt, Homo Sapiens
aaaacaauaacuguguguguuaaacgacacaagagaacaagaauuucuuuugugagagacacug

SEQ ID NO: 116846 - RNA, 64 nt, Homo Sapiens
cuuaaaaccgggcuuucacccaacguggucccuagaacaagaggucuuuucccacccugucacu

SEQ ID NO: 116847 - RNA, 64 nt, Homo Sapiens
aggcuggggaggguuuucccacaguguggagccugaacaagaagccugucuccaaagaucuccc

SEQ ID NO: 116848 - RNA, 64 nt, Homo Sapiens
agagguuguuggagcaagagugcugagauuguuggaacaagacgaacgaagagcaggaagaggu

SEQ ID NO: 116849 - RNA, 59 nt, Homo Sapiens
uuuauguaugaaaaacgauauguuacagagcuagaaaauauggauuaaaaauugcauug

SEQ ID NO: 116850 - RNA, 59 nt, Homo Sapiens
gguuuugcuuuguauuuuaugaggaugcugcuagaaaauugacuucuaguucuuuucua

SEQ ID NO: 116851 - RNA, 59 nt, Homo Sapiens
agggcugcuucugugaguucccagguugugcuagaaaguguaaauuauuuugcuuuuga

SEQ ID NO: 116852 - RNA, 59 nt, Homo Sapiens
ucucuaagauaagaggccagaguuguacugcuagaaacuaaaacaaaaaacaagaagca

SEQ ID NO: 116853 - RNA, 59 nt, Homo Sapiens
ggcacaucaucauaauccauuuucucuuugcuagaaaaucagcccauagagugcauucc

SEQ ID NO: 116854 - RNA, 59 nt, Homo Sapiens
gaaaaucauucugcuuuugaaucuuaaaagcuagaaaaaccauaauguaauauucuuuu

SEQ ID NO: 116855 - RNA, 59 nt, Homo Sapiens
agcaucucaugauggcccaaguucauagagcuagaaaguuuuuucuuacgugauuuuau

SEQ ID NO: 116856 - RNA, 59 nt, Homo Sapiens
agggccuagucagaagccucccaaacacugcuagaaaggcgucaaauuguuaucaggug

SEQ ID NO: 116857 - RNA, 64 nt, Homo Sapiens
acauucacuuucugccucugaggaaagauacagggaacaaaaaucaauuuguacagucuuaaua

SEQ ID NO: 116858 - RNA, 64 nt, Homo Sapiens
cauaccgcaaauaucugugggguccuguugaaaagaacaaaauaaaggagcccaaggggucauu

SEQ ID NO: 116859 - RNA, 64 nt, Homo Sapiens
uagcuuaauaggacaguaaaucuguguggggcuagaacaaaauuaagacauguuuggcaauauu

SEQ ID NO: 116860 - RNA, 64 nt, Homo Sapiens
aggugcuuuaccuugagccauuauuugugucagagaacaaaagaaacagaaucaauauauaaaa

SEQ ID NO: 116861 - RNA, 64 nt, Homo Sapiens
ucaaaaugaauagaaagaaaaaauguuuugaaaagaacaaaacaguaaugaauguaaugagaga

SEQ ID NO: 116862 - RNA, 64 nt, Homo Sapiens
uagcaugauguauuuaaagugcauuugaagaggagaacaaaauguucaaauuguuaaaacauug

SEQ ID NO: 116863 - RNA, 64 nt, Homo Sapiens
uuccaagcacuuuaggcagaggaccuguuuaagagaacaaaaugauaugaacaaaaauuacagg

SEQ ID NO: 116864 - RNA, 64 nt, Homo Sapiens
uacaggggaccuguuuaagagcaaaucaugauaugaacaaaaauugugaaagaaguuugcuaaa

SEQ ID NO: 116865 - RNA, 64 nt, Homo Sapiens
cccagcucugugccccaugcgccugacuucuuaagaacaaaaccuggaagggaauguaaaauuu

SEQ ID NO: 116866 - RNA, 64 nt, Homo Sapiens
caguucuuggcugccguccuguggcagcuuaauggaacaaaaauuacagacuuuggugaaccaa

SEQ ID NO: 116867 - RNA, 64 nt, Homo Sapiens
ugaacacucauuuuguuagcgagggugguaaagugaacaaaaaggggaaguaucaaacuacugc

SEQ ID NO: 116868 - RNA, 64 nt, Homo Sapiens
aaaaaaaaaacacuuaaacuuugugauacgaauagaacaaaaaaaaauauucacaacagggcag

SEQ ID NO: 116869 - RNA, 64 nt, Homo Sapiens
uucacaacagggcaguuguggaacuuuuucuguugaacaaaauaucuuuuugagcaaaaaaguc

SEQ ID NO: 116870 - RNA, 64 nt, Homo Sapiens
gucuauaugguacuugaucugaaacuuuauucuagaacaaaauaaaauauguuccuuuuucaaa

SEQ ID NO: 116871 - RNA, 64 nt, Homo Sapiens
guuuucugugauuaacaguggagcaaucuggaaggaacaaaaauauaauugucuacagaagcaa

SEQ ID NO: 116872 - RNA, 64 nt, Homo Sapiens
uuauuuggcucacaguucugcuggguaacgugaugaacaaaaaucuauaacagaauaccacaga

SEQ ID NO: 116873 - RNA, 64 nt, Homo Sapiens
uuuuuaucauuuaaaaaucuguuuauuaacaacugaacaaaacaauguuucuaaguugcacaca

SEQ ID NO: 116874 - RNA, 64 nt, Homo Sapiens
uuuaguaaagcuuuauaaauuagauguuucucuagaacaaaauauuuauuuucacauaagucaa

SEQ ID NO: 116875 - RNA, 64 nt, Homo Sapiens
acuaucucagaaauaccuuauggagcaaaacauagaacaaaauccucagugacaaucaucauau

SEQ ID NO: 116876 - RNA, 64 nt, Homo Sapiens
uacgcacauaccuucaugugagucuauuuccacugaacaaaaccagugccuuccucucucuacc

SEQ ID NO: 116877 - RNA, 64 nt, Homo Sapiens
uacacacauaccuucaugugagucuauuuccacugaacaaaaccacugccuuccucucucuacc

SEQ ID NO: 116878 - RNA, 64 nt, Homo Sapiens
uacacacguaccuucaugugcugaagaagucacugaacaaaaccuugcucagcuggcugagaca

SEQ ID NO: 116879 - RNA, 64 nt, Homo Sapiens
gacauaggccaugaaaaaaaugauccccaagugugaacaaaagaugcucuucuguggaccacug

SEQ ID NO: 116880 - RNA, 64 nt, Homo Sapiens
uuuaaggaaacaauauaaccacaaagcacaguuugaacaaaaucuccucuuuuagcugaugaac

SEQ ID NO: 116881 - RNA, 64 nt, Homo Sapiens
gagauaauuuagaaaacagguuuuuuucucucuugaacaaaacucaucaccuuuguuucaauau

SEQ ID NO: 116882 - RNA, 64 nt, Homo Sapiens
ucuggaauaagaaauuuguacuuguccagaccuggaacaaaauuaacaaugauaaauuucucag

SEQ ID NO: 116883 - RNA, 64 nt, Homo Sapiens
guguuuugaguuuagcugacuugguuugaaccgugaacaaaacuucuggaacgugaagagcugu

SEQ ID NO: 116884 - RNA, 64 nt, Homo Sapiens
gacgcagguuauuugggguggacgucagggaaaugaacaaaaggcaaggggacagacaagcugg

SEQ ID NO: 116885 - RNA, 64 nt, Homo Sapiens
agcaacuaaaugagaccuaaagguaaauacaagugaacaaaauaguuacucagacacuagggaa

SEQ ID NO: 116886 - RNA, 64 nt, Homo Sapiens
uauuaucaccaggauuuauacuuuuaaucaaguagaacaaaaacauuagcuugcuuaaggcaua

SEQ ID NO: 116887 - RNA, 64 nt, Homo Sapiens
cuagugauuaguaugccaacuuuuccaaggaagggaacaaaaguggauguaauccuuacauugc

SEQ ID NO: 116888 - RNA, 64 nt, Homo Sapiens
guuagaaaaacuuuaaaaaaacauacugauucuggaacaaaacagauuaaaaucgaacuuuauu

SEQ ID NO: 116889 - RNA, 64 nt, Homo Sapiens
auacuugacauccuuccacacccucccauauccagaacaaaaugcugugaaauaccucuacuuu

SEQ ID NO: 116890 - RNA, 64 nt, Homo Sapiens
caucaccuuuucugcuugcuguccucccagaaaugaacaaaaguauccugaggucacacaaucu

SEQ ID NO: 116891 - RNA, 64 nt, Homo Sapiens
aaccagcgauacguaaucaaacaaccuauguuuugaacaaaaacauguacuggcagauuaacau

SEQ ID NO: 116892 - RNA, 64 nt, Homo Sapiens
gacucuugugagaagacuaauuccacaagcuaaugaacaaaaggaaaacauacagacacucaaa

SEQ ID NO: 116893 - RNA, 64 nt, Homo Sapiens
aaaagccaccgcaauaauucugaaaagcaaaccagaacaaaacagaaucacauucguuucccag

SEQ ID NO: 116894 - RNA, 64 nt, Homo Sapiens
aaacaaaacaaacacaaacaggugcugauugaaagaacaaaacauguagaucauuuaugggauu

SEQ ID NO: 116895 - RNA, 64 nt, Homo Sapiens
auauugagauauauuacuguuugcauaucagguugaacaaaaugcuuggaacaaaauuaagcau

SEQ ID NO: 116896 - RNA, 64 nt, Homo Sapiens
uacuguuugcauaucagguugaacaaaaugcuuggaacaaaauuaagcauuauuucuagaccac

SEQ ID NO: 116897 - RNA, 64 nt, Homo Sapiens
aacuuuauguaauauagcuaacuccguauuuacagaacaaaaaaacacaguucccccuccugua

SEQ ID NO: 116898 - RNA, 64 nt, Homo Sapiens
agauuugauuauguauacaugacaccuaaagagggaacaaaaguuaguuuuauuuuuuuaauaa

SEQ ID NO: 116899 - RNA, 64 nt, Homo Sapiens
guauuaaauauuuuaaaaaugcucauucuuuguagaacaaaaauguuuguaauauuuaagaaau

SEQ ID NO: 116900 - RNA, 64 nt, Homo Sapiens
gcccugacuuuacagggggauccaugaucuccuagaacaaaaccgccuuugagaacugcuugac

SEQ ID NO: 116901 - RNA, 64 nt, Homo Sapiens
uuguucaucuugaagaauguauuaagugagacuugaacaaaauuuuuuuaauuuaaccuggcaa

SEQ ID NO: 116902 - RNA, 64 nt, Homo Sapiens
gucauaaagggcacuaaaagaaaaacucagguuagaacaaaaaucuuuccagcacauuuuuuuu

SEQ ID NO: 116903 - RNA, 64 nt, Homo Sapiens
gggaggagguguccacauuuucaaccuguaucaagaacaaaaauaauuaauuucagcuugauua

SEQ ID NO: 116904 - RNA, 64 nt, Homo Sapiens
cagaaaaggcauaccuaaggaagggugagcaacagaacaaaagguuuaucauggcauuucuuaa

SEQ ID NO: 116905 - RNA, 64 nt, Homo Sapiens
uaaagccagccaugcauugucaagcaauuccucugaacaaaaugccaaaagguaccccgauggc

SEQ ID NO: 116906 - RNA, 64 nt, Homo Sapiens
aauucugggaauccacagcucgacaaacuaacaggaacaaaauggcuuguuggcuccagucuuc

SEQ ID NO: 116907 - RNA, 64 nt, Homo Sapiens
aagacaagcuaaauguaguuauuuuauccuguuagaacaaaaauucuaauuaaaauaguuaacu

SEQ ID NO: 116908 - RNA, 64 nt, Homo Sapiens
uacuucauuuuuucccucuaauuauuuaagauuggaacaaaaguauaaauauuauuuauuugag

SEQ ID NO: 116909 - RNA, 64 nt, Homo Sapiens
uccuccaaaggaucacaacuccuugccggcaagggaacaaaacuggauagagaaugaguuugac

SEQ ID NO: 116910 - RNA, 64 nt, Homo Sapiens
uuuuaagaaguggcuauauagcucuggauaaaacgaacaaaagaauuagaauuccugcggggaa

SEQ ID NO: 116911 - RNA, 64 nt, Homo Sapiens
aaaggucuuuuuucacugcuaaaugcugauuugagaacaaaaggggcuaacaccugacuuuaga

SEQ ID NO: 116912 - RNA, 64 nt, Homo Sapiens
acccgaccuuuauugcugggggcaugucacaaaagaacaaaauauggcgagggaguggauauag

SEQ ID NO: 116913 - RNA, 64 nt, Homo Sapiens
ccuucauuguaaacuagcacgagcuuucagcuuugaacaaaaucaguggaaagaaaguuugaug

SEQ ID NO: 116914 - RNA, 64 nt, Homo Sapiens
aaugaagccuuuugauaugccaagccucaugaaagaacaaaagaauucaaaauuugaugugcua

SEQ ID NO: 116915 - RNA, 64 nt, Homo Sapiens
gcagccucuuaugcaccacaguuaaaucuagaacgaacaaaauuucagagcucaagacauggga

SEQ ID NO: 116916 - RNA, 64 nt, Homo Sapiens
aagacaugggacauuuaaauccucaaggaguuuggaacaaaauaaacagaucuaaaaauuuggu

SEQ ID NO: 116917 - RNA, 64 nt, Homo Sapiens; identical to SEQ ID NO: 44417

SEQ ID NO: 116918 - RNA, 64 nt, Homo Sapiens; identical to SEQ ID NO: 44418

SEQ ID NO: 116919 - RNA, 64 nt, Homo Sapiens; identical to SEQ ID NO: 44419

SEQ ID NO: 116920 - RNA, 64 nt, Homo Sapiens; identical to SEQ ID NO: 44420

SEQ ID NO: 116921 - RNA, 62 nt, Homo Sapiens; identical to SEQ ID NO: 44421

SEQ ID NO: 116922 - RNA, 64 nt, Homo Sapiens; identical to SEQ ID NO: 44422

SEQ ID NO: 116923 - RNA, 64 nt, Homo Sapiens; identical to SEQ ID NO: 44423

SEQ ID NO: 116924 - RNA, 64 nt, Homo Sapiens; identical to SEQ ID NO: 44424

SEQ ID NO: 116925 - RNA, 64 nt, Homo Sapiens
gaagagaguguuagaaaggguaggacugagaaacagccuauaaucuccaaagaaagaauaaguc

SEQ ID NO: 116926 - RNA, 64 nt, Homo Sapiens
agugcugggauuacaggugugagccaccgugcccagccuauacuucccuuuuugaauaccauuu

SEQ ID NO: 116927 - RNA, 64 nt, Homo Sapiens
gcucuagccccccagcuuucugguagcuucuuccagccuauacuggcaccaugugagcuggaag

SEQ ID NO: 116928 - RNA, 64 nt, Homo Sapiens
aauucuccucacuauaacugggugugguaguuuaagccuauaaucucagcccuuuuggaggcca

SEQ ID NO: 116929 - RNA, 64 nt, Homo Sapiens
aguugagcccuccuuugcauugacacugauaauuagccuauagggcucccuacccuuccauuaa

SEQ ID NO: 116930 - RNA, 64 nt, Homo Sapiens
agcuguguacagcgccaucugcguuccaccuccaagccuauaccucugugugucugucucucug

SEQ ID NO: 116931 - RNA, 64 nt, Homo Sapiens
uaaauuccaaaauauccaauguaacuuauugccuagccuauaaaauugaucuguguuaaucuga

SEQ ID NO: 116932 - RNA, 64 nt, Homo Sapiens
cccagggccuaacuuacacuaggaauuuuaaaacagccuauaugguacacauuagacucacccg

SEQ ID NO: 116933 - RNA, 64 nt, Homo Sapiens
aaaugcuggguugagccuuuugccuguuguacauagccuauacaaauucuugaauacaaaacuu

SEQ ID NO: 116934 - RNA, 63 nt, Homo Sapiens
agugugaagcuuuuaggaaagagccauugugcccagccuauauagugcugggauuacaggcau

SEQ ID NO: 116935 - RNA, 64 nt, Homo Sapiens
cgagugccugcuuaggugcuucauggagaaggaaagccuauaguagauguauagaguuggggaa

SEQ ID NO: 116936 - RNA, 64 nt, Homo Sapiens
guuuagaauauuuauuuguucccuuugucccuguagccuauacagacuggcccucuagcuucua

SEQ ID NO: 116937 - RNA, 64 nt, Homo Sapiens
gcagaauauugcaacuuuguguuguuuuaugaugagccuauaguugugauaccaauaaaacaug

SEQ ID NO: 116938 - RNA, 64 nt, Homo Sapiens
acuguugaugagcauuuuggauauucuaggagaaagccuauaauuucacauaguuucucuuuuu

SEQ ID NO: 116939 - RNA, 64 nt, Homo Sapiens
cagcgcgcacuguuaacugaacgucuuuuucuucagccuauacgcggauccuuguuuugagcuc

SEQ ID NO: 116940 - RNA, 64 nt, Homo Sapiens
aaaucucucccuucauuuacuuuuucuugcuauaagccuauauuuagguuucuuuucuauuuuu

SEQ ID NO: 116941 - RNA, 64 nt, Homo Sapiens
cccaagacuacaaaguuaccccuacccacaaugcagccuauacugauauuaauaguugagacca

SEQ ID NO: 116942 - RNA, 64 nt, Homo Sapiens
gaagaaaaagaucuagaaacucucaucauccugaagccuauaauagacucuuccacauguacaa

SEQ ID NO: 116943 - RNA, 64 nt, Homo Sapiens
guagauuccuuuccuucuuuuuuaagauuaucacagccuauauguacauggcuuacuuagagca

SEQ ID NO: 116944 - RNA, 64 nt, Homo Sapiens
uaggagucucuugaugagcagagccaccaggcccagccuauaucagugcugggauuacaggugu

SEQ ID NO: 116945 - RNA, 64 nt, Homo Sapiens
aaugaagcauuauuacauuuugugaaugguguucagccuauaagacgaagucucacaagaccua

SEQ ID NO: 116946 - RNA, 64 nt, Homo Sapiens
aaaaugugcccuuuuggccgggcaugguagcucaagccuauaaucccagcauguugagaggcug

SEQ ID NO: 116947 - RNA, 64 nt, Homo Sapiens
guggagacaguaaguuagaucccucccuuuggggagccuauauugcuggagucauacccagccu

SEQ ID NO: 116948 - RNA, 64 nt, Homo Sapiens
auccuauauagaaugcugcacuaauugacaacacagccuauaggccaaugcaugaguaaaaaaa

SEQ ID NO: 116949 - RNA, 64 nt, Homo Sapiens
auggacucagcacuuucuuuacuauuuguucaauagccuauauuucuagauauuaaauauuuuu

SEQ ID NO: 116950 - RNA, 64 nt, Homo Sapiens
aucacuguucuuuucuuucuuuuugugauugaaaagccuauacuacaauuugaaguaaauuuuu

SEQ ID NO: 116951 - RNA, 64 nt, Homo Sapiens
uuuucaagugucaggcaguguucugagaagcagcagccuauaacuguauguguguuccuugaag

SEQ ID NO: 116952 - RNA, 64 nt, Homo Sapiens
gaguugcagaagcuacugugcuuccucuuuggguagccuauaccuauacuuaucuccucauaau

SEQ ID NO: 116953 - RNA, 64 nt, Homo Sapiens
auguaugggagauguugguaugagaccuucguauagccuauaaagauaacgguuauuaauucuu

SEQ ID NO: 116954 - RNA, 64 nt, Homo Sapiens
uuuagccccaacucugugcuuuugagauguuguuagccuauaaccuaagaaaaauuguuucugc

SEQ ID NO: 116955 - RNA, 64 nt, Homo Sapiens
guuguuuuauccauuaucauagauuguguaugagagccuauauauacaaggugaaaauuaagaa

SEQ ID NO: 116956 - RNA, 64 nt, Homo Sapiens
gcccccuguuuuaugcccuucuaagauauuuuucagccuauaaauugguauucuguucugaagu

SEQ ID NO: 116957 - RNA, 64 nt, Homo Sapiens
uauuaaaauguuaacuuugcacaaauuguccccaagccuauaugaauucauguucaugccaaaa

SEQ ID NO: 116958 - RNA, 64 nt, Homo Sapiens
ugugaaaaaauucuaccuuagaaaucaaugcuacagccuauagcucuccauugauauaucugga

SEQ ID NO: 116959 - RNA, 64 nt, Homo Sapiens
uacagugaaaauguaagcugauaauucuguacauagccuauauuacguguagcuauaucuauau

SEQ ID NO: 116960 - RNA, 64 nt, Homo Sapiens
cggaugcauggaaggcgccucgccccucguggagagccuauaaaauagcucugggaauggaaug

SEQ ID NO: 116961 - RNA, 64 nt, Homo Sapiens
aaugcaucuuugacaguuaucuuauuuguaaggcagccuauaaaauaguucugaaguauuuuau

SEQ ID NO: 116962 - RNA, 64 nt, Homo Sapiens
cucaagaauuguuagcaaaugacagauuucuguaagccuauauauauagucaaaucgauuuagu

SEQ ID NO: 116963 - RNA, 64 nt, Homo Sapiens
cauuauuuuggcagaacuccuaagaauuuaugggagccuauauaaacauaucuugcuuuuaaaa

SEQ ID NO: 116964 - RNA, 64 nt, Homo Sapiens
uguguuucacauugcuaacugguauacaaaaauaagccuauaaagggcaaaaauuaccaauuau

SEQ ID NO: 116965 - RNA, 64 nt, Homo Sapiens
acuaguuaaaaauggaauuucucuuccuuuacuuagccuauaaauggagauucuaucuugguuu

SEQ ID NO: 116966 - RNA, 64 nt, Homo Sapiens
uuuagcugacaaagugcuuaauuuugaauugagaagccuauacaauucucaaaguucagcauuc

SEQ ID NO: 116967 - RNA, 64 nt, Homo Sapiens
ugucuuugcacgugagguggaucccuuuauuuugagccuauaugugcuugauaaauauuccugu

SEQ ID NO: 116968 - RNA, 64 nt, Homo Sapiens
ggcuugacuccaaucucagucccugcuguuccuuagccuauaguuuuuggugguugccagcaau

SEQ ID NO: 116969 - RNA, 64 nt, Homo Sapiens
uuuccauaugguauaccuugcuuccuuuguguucagccuauacucgagagccauucagaaaaga

SEQ ID NO: 116970 - RNA, 57 nt, Homo Sapiens
ccguaaccgugaaagagugacaaggacagccuauaggaaaaacaauaccacuuaaaa

SEQ ID NO: 116971 - RNA, 64 nt, Homo Sapiens
agugcugggauuacaggcgugcaccacugaguccagccuauauucuuguuuaucaguucaaaaa

SEQ ID NO: 116972 - RNA, 64 nt, Homo Sapiens
aggagggggugaaauaugaucuaacuuaugcaagagccuauaauuagucccagucucgacucua

SEQ ID NO: 116973 - RNA, 64 nt, Homo Sapiens
aacaaagaguucaagaaauaaguuuuuguuucacagccuauaaccagacacauacucauuuuuc

SEQ ID NO: 116974 - RNA, 64 nt, Homo Sapiens; identical to SEQ ID NO: 116971

SEQ ID NO: 116975 - RNA, 64 nt, Homo Sapiens
ccucuuuuauaaucuuccuuaaaagaaagaguguagccuauaaauacuaaauaugauaccuuuu

SEQ ID NO: 116976 - RNA, 64 nt, Homo Sapiens
auugugguacuuuuugauguaauuucugcaggacagccuauaaauauggagcacaagaaagaua

SEQ ID NO: 116977 - RNA, 64 nt, Homo Sapiens
agugcacauacgcaacugugaaauuugaaagaaaagccuauaaauuuucuuacagaaugacuga

SEQ ID NO: 116978 - RNA, 64 nt, Homo Sapiens
uguuucgauuuuugaucaauucuuuaauuuuggaagccuauaauacaguuuucuauucuuggag

SEQ ID NO: 116979 - RNA, 64 nt, Homo Sapiens
gggccugacacuucacagaguggggacccaccagagccuauagaaucaauuccuuggucucaca

SEQ ID NO: 116980 - RNA, 64 nt, Homo Sapiens
ugaugaacaccuggcucauccauagaguuuucacagccuauaucgcaaauuuucuaagccacgu

SEQ ID NO: 116981 - RNA, 64 nt, Homo Sapiens
ucccacuugcagucuuguagcuagaacuucucuaagccuauacguuucuguggaguaaauauug

SEQ ID NO: 116982 - RNA, 64 nt, Homo Sapiens
aaugcugggauuacaggcgugagccaccacgcccagccuauaccccauguauuuucauaaaggg

SEQ ID NO: 116983 - RNA, 64 nt, Homo Sapiens
cgaaaaggaggauggagccaggugccauggcuugagccuauaauccgaggcugaggugggagga

SEQ ID NO: 116984 - RNA, 64 nt, Homo Sapiens
uuuguucucucauguugaucuaaacaaucagcacagccuauaucaaaaaguaguauuuucuuau

SEQ ID NO: 116985 - RNA, 64 nt, Homo Sapiens
agaagucauuuuucuuucuucugacauuaacaugagccuauagaugaacaaacgugagaaucug

SEQ ID NO: 116986 - RNA, 64 nt, Homo Sapiens
aacagaguuauaauaaaacaguguuuuaaaaucuagccuauaaacaaaaacuaguuugaggcac

SEQ ID NO: 116987 - RNA, 64 nt, Homo Sapiens
cccagcacuucggaaggcggacgguggugacucaagccuauaauaaagcagauguaugcugggc

SEQ ID NO: 116988 - RNA, 64 nt, Homo Sapiens
gcccaaagaaggcaaaaagauaucaggcauaggcagccuauaggcuuuuaaacugucaggucau

SEQ ID NO: 116989 - RNA, 64 nt, Homo Sapiens
aaaaggaagguacacguuguuucaauguuuucccagccuauaaaagucaugagcuuuguuaauu

SEQ ID NO: 116990 - RNA, 64 nt, Homo Sapiens
aaauaaggcuccuucauguggcguauugggccauagccuauaauugguuagaaccuccuauuuu

SEQ ID NO: 116991 - RNA, 64 nt, Homo Sapiens
gcauuagcccaagagauuguggcuguuucuguauagccuauacuugaucugcacauuucaucgu

SEQ ID NO: 116992 - RNA, 64 nt, Homo Sapiens
ccuuacuuagcaugcacaaaggagagagggagagagccuauaccauauagcuugaaacauagag

SEQ ID NO: 116993 - RNA, 64 nt, Homo Sapiens
cagaacucagaaaaaauucagauaggcuugucagagccuauagcucaccugguaagaaaagaau

SEQ ID NO: 116994 - RNA, 64 nt, Homo Sapiens
auuuuguguaaauugaucuccuugagagccuaacagccuauaugaucaacucuuaagagcuaga

SEQ ID NO: 116995 - RNA, 64 nt, Homo Sapiens
ucauucuugcucugggaucugcacuuaacaugaaagccuauaggaguucaaaugcuugacguug

SEQ ID NO: 116996 - RNA, 64 nt, Homo Sapiens
cuuucaguucguuuguauucuaccuuuguaaaacagccuauagaugaugauguguuugggauac

SEQ ID NO: 116997 - RNA, 64 nt, Homo Sapiens
auggggugaaagagaggggaggcuugccuuugagagccuauauagccuuccugugagagaggau

SEQ ID NO: 116998 - RNA, 64 nt, Homo Sapiens
uucaucugugaaauggggauauuuauuuucccugagccuauaucggugacucuuggggauauuu

SEQ ID NO: 116999 - RNA, 64 nt, Homo Sapiens
ggaagacucagcaggaacaagguaggcuucaaagagccuauauuccucuuuuucccacaccgau

SEQ ID NO: 117000 - RNA, 64 nt, Homo Sapiens
ugccuggauccucugccacgcuguuuggcuccgaagccuauaugugucaacuauuucuuuaggc

SEQ ID NO: 117001 - RNA, 64 nt, Homo Sapiens
gaaaagaauggaggugagacgcauuuugaauuaaagccuauauuucccuucccucuccuugagu

SEQ ID NO: 117002 - RNA, 64 nt, Homo Sapiens
ugcauuuacugaauuguuaaauaacacagugaguagccuauaugcaaauuauuugagaaagacc

SEQ ID NO: 117003 - RNA, 64 nt, Homo Sapiens
guuugcuuugugaacaugugucaaaucuguucugagccuauaguaaugugaauaucauguuuuu

SEQ ID NO: 117004 - RNA, 64 nt, Homo Sapiens
guacaguauuaacgucaaccaucucuuuaaaguuagccuauaaauauuguuguauaauuuucuu

SEQ ID NO: 117005 - RNA, 64 nt, Homo Sapiens
cuuugauagaaaaaaauucaaagcugugccuuugagccuauacuauacuguguauguguggaaa

SEQ ID NO: 117006 - RNA, 64 nt, Homo Sapiens
auugguauuguuugacccuuuagaugguuuuugaagccuauacaaacuagagaaugcccuaacu

SEQ ID NO: 117007 - RNA, 64 nt, Homo Sapiens
ugagaggcuccagaaggauuucuagaucgcuucaagccuauacugauggccuuagcuuuguuca

SEQ ID NO: 117008 - RNA, 64 nt, Homo Sapiens
uuuuuggcguuugcauguacaacuuucuauuuuuagccuauauuuggaaagaaagcacuuaaca

SEQ ID NO: 117009 - RNA, 64 nt, Homo Sapiens
auauuucauauuucacauuuuauauguugcacauagccuauacaguaccuacauaguuuuuaaa

SEQ ID NO: 117010 - RNA, 64 nt, Homo Sapiens
aauuuuuuuuaauuggccaugucgccaaaaauacagccuauaguaaauguguuucuugcugcca

SEQ ID NO: 117011 - RNA, 64 nt, Homo Sapiens
aaaugaaaaauauauuggcacuuuuuuuuuucuaagccuauaugaucucagguauuucggaugu

SEQ ID NO: 117012 - RNA, 64 nt, Homo Sapiens
agugcucggauuacaggugugagccacugugccuagccuauaaugaucauuuuaauguuuccca

SEQ ID NO: 117013 - RNA, 64 nt, Homo Sapiens
aucaaagcacgauuuuagauaaccuaaacggcccagccuauacgaaguugauuauaucucgaug

SEQ ID NO: 117014 - RNA, 64 nt, Homo Sapiens
gacgaacugaucuguccuucacuuaccugcuuauagccuauacacuucaccaauagagugcacu

SEQ ID NO: 117015 - RNA, 64 nt, Homo Sapiens
ucgugucuuacuccaggugaagggggaaaaaaaaagccuauacuuuggcagguuaugaacuuug

SEQ ID NO: 117016 - RNA, 64 nt, Homo Sapiens
ggguauuauuuugaaaccagauuuuuaauuuaauagccuauauuuguagucuguuggauaggug

SEQ ID NO: 117017 - RNA, 64 nt, Homo Sapiens
uuucauagagcucaugagcaaugaaguauucuguagccuauauuuguaguucaauaaaagaaaa

SEQ ID NO: 117018 - RNA, 64 nt, Homo Sapiens
auggugucuuguaggaccaaacagcaaguagcuaagccuauagccaggaaaguucucuugugca

SEQ ID NO: 117019 - RNA, 64 nt, Homo Sapiens
uugccaucaguuacgcugaaccuggacaccgcugagccuauagggccagccuuccuuaaacuac

SEQ ID NO: 117020 - RNA, 64 nt, Homo Sapiens
ugcccaguacauguuuaaaagcucaggaaaugagagccuauaaguguagaggguuuagucccga

SEQ ID NO: 117021 - RNA, 64 nt, Homo Sapiens
aacacaaaauaucuauacuucaugcuccagcccaagccuauacccuguaauagcauacuauuau

SEQ ID NO: 117022 - RNA, 64 nt, Homo Sapiens
ugucagauaggucugacuaaccucuccgugcugcagccuauacuaaggugacccagggccacau

SEQ ID NO: 117023 - RNA, 64 nt, Homo Sapiens
ugaagagcauuuuugugaaguggguucugcaaggagccuauaaagccaagggugguguccauuu

SEQ ID NO: 117024 - RNA, 64 nt, Homo Sapiens
aauauaaacauauauacgugcugucucgcauaggagccuauauaucuugcuaagaggaaggaaa

SEQ ID NO: 117025 - RNA, 64 nt, Homo Sapiens
uccucuucuguaaaaugggucccuugaccuuuccagccuauauucugugugaccuugggcaagu

SEQ ID NO: 117026 - RNA, 64 nt, Homo Sapiens
gggaaacuguauccauaaugcugaccaaauaugcagccuauaacaccuuucaccacugugaaca

SEQ ID NO: 117027 - RNA, 64 nt, Homo Sapiens
ucuguauuucuaggcacaagguugguugcuaagaagccuauaagaggaauuucuuuuccuucau

SEQ ID NO: 117028 - RNA, 64 nt, Homo Sapiens
gaguucccucuucuaacccaguuaggaaaaccagagccuauaugugaaugcagucaugcaaacc

SEQ ID NO: 117029 - RNA, 64 nt, Homo Sapiens
guuuguuaauuuuucuaauuuuaccaaaguuugcagccuauaccucaauaaaacagggauauuu

SEQ ID NO: 117030 - RNA, 64 nt, Homo Sapiens
uuaauggguuuguaauauuuguaacgguuuuagcagccuauaacuuuucagcuggugcuuuuac

SEQ ID NO: 117031 - RNA, 64 nt, Homo Sapiens
uaguuguuacuuaccuaagaguuaccacuuccguagccuauaacaucaaaacguaguuuuugca

SEQ ID NO: 117032 - RNA, 64 nt, Homo Sapiens
cacuguggguguuauuuuuucaugucuggaccucagccuauauccugagacuaaguggaagugg

SEQ ID NO: 117033 - RNA, 64 nt, Homo Sapiens
gcaguggagcccugagcauuguaauaugcggcccagccuauaaacagccuccgugcuuagcaga

SEQ ID NO: 117034 - RNA, 64 nt, Homo Sapiens
ccauuuauauaccuacacgccaugcacacccacaagccuauacacccaagaaggacugucuaug

SEQ ID NO: 117035 - RNA, 64 nt, Homo Sapiens
ggugaaaaucacauagcugucuggugccagagccagccuauaguagaguccccugaccccaagc

SEQ ID NO: 117036 - RNA, 64 nt, Homo Sapiens
aggguccucuagcccacucccugccuacacacacagccuauaucaaacaugcacacgggcgagc

SEQ ID NO: 117037 - RNA, 64 nt, Homo Sapiens
uguguaguacagggaagucugacacagccucuccagccuauaaacagccggggggcuguggcac

SEQ ID NO: 117038 - RNA, 64 nt, Homo Sapiens
cccuucucgccgagccguggggcgcgggcggccgagccuauacauaguguacaggagacaucgc

SEQ ID NO: 117039 - RNA, 64 nt, Homo Sapiens
aaguggcuaaucuuaucccuucuccugaagaaaaagccuauaaaagaguugggugagguuaguc

SEQ ID NO: 117040 - RNA, 64 nt, Homo Sapiens
cucugcugcccaagaaaaugauccaacuagcccuagccuauaccaucaggcaccuuucccccuu

SEQ ID NO: 117041 - RNA, 64 nt, Homo Sapiens
uugccauuucccaguacuucccuuuacagucugcagccuauaaacaguggugucucaaagcaaa

SEQ ID NO: 117042 - RNA, 64 nt, Homo Sapiens
uucaaaaaugcuuaaccaucugaccauagugacuagccuauagugagucgaggaccaaacuuuu

SEQ ID NO: 117043 - RNA, 64 nt, Homo Sapiens
uuuuguuuaugcugcuccugauauaacacuuuccagccuauagcagaagcacauuuucagacug

SEQ ID NO: 117044 - RNA, 64 nt, Homo Sapiens
ccagaaauauuuuucaaaggacuaguaaucuaauagccuauaguuuauauuauuauuuuguauu

SEQ ID NO: 117045 - RNA, 64 nt, Homo Sapiens
gaggaagcccugguucuauuucaccuggcaggggagccuauaaggagagcgaugcccacuccua

SEQ ID NO: 117046 - RNA, 64 nt, Homo Sapiens
uugcugcauuccuaaacuguuuauuugcacuaugagccuauagacuaucaguucccuuugggcg

SEQ ID NO: 117047 - RNA, 64 nt, Homo Sapiens
uuuuauuuuucaauuuguuuuucauacuuuacagagccuauaauauugugcagugauguaaaug

SEQ ID NO: 117048 - RNA, 64 nt, Homo Sapiens
auaucaccauuggauguagaucuguuuagaaacuagccuauaaaucgcuuuguaaaaauuugca

SEQ ID NO: 117049 - RNA, 64 nt, Homo Sapiens
aucaaagcagaccaguggccuggaguauucccucagccuauagcgaaaucauuuccccauuggu

SEQ ID NO: 117050 - RNA, 59 nt, Homo Sapiens
acuguauaguaaaaguuggucuaauaguagaacuuuaaaauuuuuucuuauugugagga

SEQ ID NO: 117051 - RNA, 59 nt, Homo Sapiens
ugaauacauacaugcaugcugcuaaacuagaacuuuaauuuuuccccauaacuuuuaua

SEQ ID NO: 117052 - RNA, 59 nt, Homo Sapiens
gguuuuggggauuuucuuguuucacauuugaacuuuaugaguguuaaaacuuuucuguu

SEQ ID NO: 117053 - RNA, 59 nt, Homo Sapiens
gcacuccgacauuuucugagaacuucacggaacuuuauacugagcgagucacauuaagg

SEQ ID NO: 117054 - RNA, 59 nt, Homo Sapiens
gcuguacaauuugguuaugugacugcuuugaacuuuaaaaugcacguucccuagaugca

SEQ ID NO: 117055 - RNA, 59 nt, Homo Sapiens
cuuuuuugcucacagggacgcuggagggagaacuuuaagaggcgcucuuggcccugggc

SEQ ID NO: 117056 - RNA, 59 nt, Homo Sapiens
gaguugccuaccaggguuacuggagcccagaacuuuauaggcaugcacugaccucuucu

SEQ ID NO: 117057 - RNA, 59 nt, Homo Sapiens
ggaagaaccacuuuuaucuacagggaauggaacuuuaaugugcccucaucagcugaggg

SEQ ID NO: 117058 - RNA, 59 nt, Homo Sapiens
auaagagacuugaagcuggggcguggccagaacuuuauauuacaguugcgagccacugu

SEQ ID NO: 117059 - RNA, 59 nt, Homo Sapiens
guuuuuuuuuuuuuuuuuuugaugaaggggaacuuuauaaaaaucacauucaauuuuca

SEQ ID NO: 117060 - RNA, 59 nt, Homo Sapiens
aauccagaugcaaucauuggacagauguagaacuuuaaucauggaaagcccccauuugc

SEQ ID NO: 117061 - RNA, 59 nt, Homo Sapiens
agcgugacauuaugcauuacuuuagaagagaacuuuacguacuaaaggaagagugaguu

SEQ ID NO: 117062 - RNA, 59 nt, Homo Sapiens
uugauuauauuuggugaauucccaucugagaacuuuauuaugucauuuuuuuccaugac

SEQ ID NO: 117063 - RNA, 59 nt, Homo Sapiens
uguacaguaaaagucagaacucauuuaaagaacuuuaagggauccuuuagaaacauuuu

SEQ ID NO: 117064 - RNA, 59 nt, Homo Sapiens
uugcacuaccagucucccaaggguagcaagaacuuuaauuauuacaggggauaaauguu

SEQ ID NO: 117065 - RNA, 59 nt, Homo Sapiens
uugcccuuucaguuuuaucuccacucauagaacuuuaacaauuucaaaauaagcuuuuc

SEQ ID NO: 117066 - RNA, 59 nt, Homo Sapiens
gugaauagaugagacugacagaagguugugaacuuuauaacagguugacaccauucagu

SEQ ID NO: 117067 - RNA, 59 nt, Homo Sapiens
acaggacugaauguggaaaaccuagaaaagaacuuuauuuuaaacuuuaggaaauucau

SEQ ID NO: 117068 - RNA, 59 nt, Homo Sapiens
acuuggaauaauuuuauugcaaaaguguggaacuuuagaaaaaauugugcccaaaauau

SEQ ID NO: 117069 - RNA, 59 nt, Homo Sapiens
gugccuccauuuaucaagggguuuaaacugaacuuuaagcugaaauccuauauaaaaga

SEQ ID NO: 117070 - RNA, 64 nt, Homo Sapiens
gagagaagauuaucaaacaaaugaaacaaguaaaggaagaaagaagguaucuggaaagaaauag

SEQ ID NO: 117071 - RNA, 64 nt, Homo Sapiens
agcaaauuaaaacgauaucaugccuacaaugguuggaagaaaaaauacuuggaaacaaagaaag

SEQ ID NO: 117072 - RNA, 64 nt, Homo Sapiens
aguuucuuggccacugaauuagccaaaacacuuaggaagaaaucacuuaaauaccucuggcuua

SEQ ID NO: 117073 - RNA, 64 nt, Homo Sapiens
uguuggaauguaugcuaauugaacaugcaauuggggaagaaaaaauguagaaugauuuuugcua

SEQ ID NO: 117074 - RNA, 64 nt, Homo Sapiens
aggcaugcaccaaggaauuguuagagguugguggggaagaaaaugggccuugcucuuguggagc

SEQ ID NO: 117075 - RNA, 64 nt, Homo Sapiens
uuaggggcugcucugacgguggucaugcagacaaggaagaaaacaaauagccugcucaguagag

SEQ ID NO: 117076 - RNA, 64 nt, Homo Sapiens
uucuucccauccuguucagccugcuggugaccugggaagaaaccaugggagccaagcuugagga

SEQ ID NO: 117077 - RNA, 64 nt, Homo Sapiens
aaggggaagaagaucaaaacagaaaagaagaaggggaagaaaagaaggggaagaagaucaaaga

SEQ ID NO: 117078 - RNA, 64 nt, Homo Sapiens
aaggggaagaagaucaaagaaaagaaggggaaggggaagaaaaggaauuuauugcagaaauuga

SEQ ID NO: 117079 - RNA, 64 nt, Homo Sapiens
ggauggcaugaaagaaugacagauuguggcuggaggaagaaaaauguucccaaguggugaggug

SEQ ID NO: 117080 - RNA, 64 nt, Homo Sapiens
cagcuuguuuuuaaaacuuauguacaaacauacuggaagaaaacugauuggaggccauggccua

SEQ ID NO: 117081 - RNA, 64 nt, Homo Sapiens
auccugcuggggauuccauuugagaugcagugagggaagaaaggcugcuguguggagaagguuc

SEQ ID NO: 117082 - RNA, 64 nt, Homo Sapiens
acggcuuucauuaccaaauaauaagccuggggaaggaagaaaaagugggcgugggcuucuucac

SEQ ID NO: 117083 - RNA, 64 nt, Homo Sapiens
ugaaagcucuccuaauacuuacuuaaauagccauggaagaaaauuaugcuugucccuucugacu

SEQ ID NO: 117084 - RNA, 64 nt, Homo Sapiens
uuuuuguguguuuaaaaaaauugaagaaaauucaggaagaaacguguuaauaaacauuguacug

SEQ ID NO: 117085 - RNA, 64 nt, Homo Sapiens
gugguuuaauuggacuuaaacauacccgagacugggaagaaaaauuucacgcugcugauaaaga

SEQ ID NO: 117086 - RNA, 64 nt, Homo Sapiens
gagguuuacuuggacuuacacguacccgagacugggaagaaaaaauuaaugcugcugauaaaga

SEQ ID NO: 117087 - RNA, 64 nt, Homo Sapiens
uaaggugguauaccuuccaaauccugguucagauggaagaaauagcaggagagaggacccauua

SEQ ID NO: 117088 - RNA, 64 nt, Homo Sapiens
aggagagaggacccauuagcuggcagacccagggggaagaaaggagggcugugaggagauaccu

SEQ ID NO: 117089 - RNA, 64 nt, Homo Sapiens
cccauucucagugggcugcaguugcccaaccacaggaagaaagggaaggagguagagggaagaa

SEQ ID NO: 117090 - RNA, 64 nt, Homo Sapiens
gcccaaccacaggaagaaagggaaggagguagagggaagaaacagaagcaguguuccauuuucu

SEQ ID NO: 117091 - RNA, 64 nt, Homo Sapiens
ugugauguauguguccaguagggcuaaagccauaggaagaaaaaucuuuugguggggugggggu

SEQ ID NO: 117092 - RNA, 64 nt, Homo Sapiens
cuaaaucccuccuucacuuuuuacucauuucuagggaagaaauuagacuacaaauguuuagcug

SEQ ID NO: 117093 - RNA, 64 nt, Homo Sapiens
aaaacuguuucaucauuucucaggaggaagaaaaggaagaaagaugacaguugcccuuucaaag

SEQ ID NO: 117094 - RNA, 64 nt, Homo Sapiens
gaagaaagaaaaacuguuuccuuucaaagcaggaggaagaaaaguaucccucaugacaguugcc

SEQ ID NO: 117095 - RNA, 64 nt, Homo Sapiens
acuuccuuguuggcugauccauagagcauuacuuggaagaaaauuucacuauuugcauugaugu

SEQ ID NO: 117096 - RNA, 64 nt, Homo Sapiens
aaaacuaaguauuucuucauuguaccuuaguccaggaagaaauuaauggaauauggugugcuaa

SEQ ID NO: 117097 - RNA, 64 nt, Homo Sapiens
aaaucaacccauccauagaaccacuuaauuuagaggaagaaaaaacaaauauauuagucuaggg

SEQ ID NO: 117098 - RNA, 64 nt, Homo Sapiens
agaauaacugaacaaauauaugaaauggcaguaaggaagaaaacggaacucacugauggagaug

SEQ ID NO: 117099 - RNA, 64 nt, Homo Sapiens
agcugcccaagagaaaagaguguauguuuggaguggaagaaaaucgguuuugaaucucaugaac

SEQ ID NO: 117100 - RNA, 64 nt, Homo Sapiens
caagcuuagcuuccucaacuacuguuuuucagaaggaagaaagaaucaaauggaagaagaauca

SEQ ID NO: 117101 - RNA, 64 nt, Homo Sapiens
aacaaugucuaacccaacccgaaggagggagaagggaagaaagaaggaaagggaaggaagaaag

SEQ ID NO: 117102 - RNA, 64 nt, Homo Sapiens
aaggagggagaagggaagaagagaggaaagggaaggaagaaaggcaggaaagaagagagggaga

SEQ ID NO: 117103 - RNA, 64 nt, Homo Sapiens
cgcggaggaggcuggugacaggccaaaggccaguggaagaaacacccuuucaucucagagucca

SEQ ID NO: 117104 - RNA, 64 nt, Homo Sapiens
gauuucugcuuccuuuuauuuuuauaggaauagaggaagaaaugucagaugcgugcccagcucu

SEQ ID NO: 117105 - RNA, 64 nt, Homo Sapiens
cugagucuagguggagaaaacuaccguugagaagggaagaaaggguguugggaaaggauaagug

SEQ ID NO: 117106 - RNA, 64 nt, Homo Sapiens
caagaaagaggaagacaagucauuuggccacacuggaagaaagggagacaggaaacagggaguu

SEQ ID NO: 117107 - RNA, 64 nt, Homo Sapiens
uucuuaaauaacuccauucauacaaauugggaugggaagaaaauccuuuccucuugggaaagua

SEQ ID NO: 117108 - RNA, 64 nt, Homo Sapiens
uaagaccacaagucugcaggaaacucuggaaucaggaagaaaagcuauguucauacucuaaauc

SEQ ID NO: 117109 - RNA, 64 nt, Homo Sapiens
ucccuuuguuuacucagauuucucuuagccauaaggaagaaaaagaacucuugcaugaaaauag

SEQ ID NO: 117110 - RNA, 64 nt, Homo Sapiens
aaaaagaacucuugcaugaaaauagcaugaugcaggaagaaauugccaugcuaagaauagaacu

SEQ ID NO: 117111 - RNA, 64 nt, Homo Sapiens
gaagaauuagguuugaauugguugggugggaggaggaagaaaggucaucuugagaagcaggcgg

SEQ ID NO: 117112 - RNA, 64 nt, Homo Sapiens
gaagaauuagguuugaauugguugggugggaggaggaagaaaggugccacugagaagcaggcgg

SEQ ID NO: 117113 - RNA, 64 nt, Homo Sapiens
gaguuaggagaaagaagagcccuucugcuucugaggaagaaaagccaucauuuuaucgagagaa

SEQ ID NO: 117114 - RNA, 64 nt, Homo Sapiens
auuucaaaaauggcuaggaacuuggugaauaauuggaagaaagacuaauugucacaccuggaag

SEQ ID NO: 117115 - RNA, 64 nt, Homo Sapiens
ggacugaaaagaaauucuccauuaugaggaauugggaagaaaucugguauccaagcuuaaauuu

SEQ ID NO: 117116 - RNA, 64 nt, Homo Sapiens
auguuucaugaauccauuuggcacagagacacaaggaagaaaacacuaguaaccaucuuuccac

SEQ ID NO: 117117 - RNA, 64 nt, Homo Sapiens
aaucucuacuuuccuauacugccaaagaaugugaggaagaaaugggacucuuugguuauuuauu

SEQ ID NO: 117118 - RNA, 64 nt, Homo Sapiens
auaggcaagaaggacagcaguaaaugaagaccauggaagaaaagaaggaaugccaaagaucgag

SEQ ID NO: 117119 - RNA, 64 nt, Homo Sapiens
uugagagguuucuuaaucaagagccagguuaaguggaagaaacuuccaaagacccagagucuca

SEQ ID NO: 117120 - RNA, 64 nt, Homo Sapiens
gucuuacacggcuguaauuggggagagaugauuaggaagaaaauauuucauggugauggugcaa

SEQ ID NO: 117121 - RNA, 64 nt, Homo Sapiens
aaagcuguuuccuccuggugccaccucacccuuuggaagaaaggcaggaugugucacuaaugcu

SEQ ID NO: 117122 - RNA, 64 nt, Homo Sapiens
gaugcgguauuugcuuuugcgacucuaguucugcggaagaaaagguacgcagcugccgaacucu

SEQ ID NO: 117123 - RNA, 64 nt, Homo Sapiens
acucaguugauaaaccuuagcuuuuccaggaaagggaagaaaacagggcacuugcauccauugc

SEQ ID NO: 117124 - RNA, 64 nt, Homo Sapiens
cguggucaugaauagaaaaaguuauuaugggauuggaagaaacacuauacagucuauaaaaauu

SEQ ID NO: 117125 - RNA, 64 nt, Homo Sapiens
aggcagcauggagagaggccuuauaaaaauaaagggaagaaaggacauuuuagaaacggacagc

SEQ ID NO: 117126 - RNA, 64 nt, Homo Sapiens
uugguggcaguuguuuguuuuaaacugaccacuuggaagaaacaccuugguuaucugugguuuu

SEQ ID NO: 117127 - RNA, 64 nt, Homo Sapiens
cgaugaugauauucagacgaagcauugauguuauggaagaaagaaagaaacaaacaaaauauau

SEQ ID NO: 117128 - RNA, 64 nt, Homo Sapiens
aagaaguuuuuccuugauugugcuauguuucaguggaagaaauucuuugaaguagaugugagug

SEQ ID NO: 117129 - RNA, 64 nt, Homo Sapiens
agacaaaucaacuuugaagacacaaaaguuaauuggaagaaauaaaaacugugaacgaagaaua

SEQ ID NO: 117130 - RNA, 64 nt, Homo Sapiens
uuucacgcugcugauaaagacauaccugagaccaggaagaaaaagagguuuaauuggacuuaca

SEQ ID NO: 117131 - RNA, 64 nt, Homo Sapiens
auacaauugacauaggaauuacauuaaaauauuaggaagaaacaaggacaaauuuagaccuuga

SEQ ID NO: 117132 - RNA, 64 nt, Homo Sapiens
ccugccaucagaagggacagugucauuuacaaaaggaagaaauuguuuaucucaaguaauuugg

SEQ ID NO: 117133 - RNA, 64 nt, Homo Sapiens
ucagcaggaaguaaaaauucauugagaaauucguggaagaaaugcauaaguuuuuacugccagu

SEQ ID NO: 117134 - RNA, 64 nt, Homo Sapiens
caccuguuacccauuaggggugauaacauuaaugggaagaaaugauggcaacuuugaaugcuag

SEQ ID NO: 117135 - RNA, 64 nt, Homo Sapiens
ccaucucugggauuugaaauauccagacuuguagggaagaaaacaaugacuugacgaccuuaaa

SEQ ID NO: 117136 - RNA, 64 nt, Homo Sapiens
guucagaggaggcauaagcuauggagguuggaaaggaagaaagagaagagcugaaguaaaugua

SEQ ID NO: 117137 - RNA, 64 nt, Homo Sapiens
cccuguccuuccccaacuccccagcuccaagaguggaagaaauccccaagaucaucugggucuc

SEQ ID NO: 117138 - RNA, 64 nt, Homo Sapiens
gucugcucucuucucuccccucugucccucuucaggaagaaagagcucauucugucucacaagc

SEQ ID NO: 117139 - RNA, 64 nt, Homo Sapiens
ccccagcagugccugguucugagcaaacucccagggaagaaaacggcccugucuccauggccag

SEQ ID NO: 117140 - RNA, 64 nt, Homo Sapiens
uuccaagcaccggggcgaaaaaccacaaaggaaaggaagaaaauuuauauauauauaauauaaa

SEQ ID NO: 117141 - RNA, 64 nt, Homo Sapiens
ccucugcuuugucaugccauuaagcucacaauaaggaagaaauaacagauaaguccauuggugg

SEQ ID NO: 117142 - RNA, 64 nt, Homo Sapiens
gcugauagcucauauuauaaauuucuaaauccuaggaagaaacgcuuggagugcuucugaauau

SEQ ID NO: 117143 - RNA, 64 nt, Homo Sapiens
augcgcaaaggaaagcagucgaaaggagugagaaggaagaaacauaaauuuggaugucaacuga

SEQ ID NO: 117144 - RNA, 64 nt, Homo Sapiens
uauguaaaguuuaaucuauauagaagaggccuuuggaagaaaauaucaggucuuuacugaaugu

SEQ ID NO: 117145 - RNA, 64 nt, Homo Sapiens
uauuaaaaauugagucuuaaauuuaaaugggaagggaagaaaacaccaaauaagaaaaaaauuu

SEQ ID NO: 117146 - RNA, 64 nt, Homo Sapiens
caacgacgaagugcugagaagguuauggguaccaggaagaaacaaacagaagucuuaagauuag

SEQ ID NO: 117147 - RNA, 64 nt, Homo Sapiens
gcuuugggaauaguucauagggaagggacaacauggaagaaacagcgauuuaaauuguauugaa

SEQ ID NO: 117148 - RNA, 64 nt, Homo Sapiens
caguuccuaaaacuaaaacuccauucuagucuugggaagaaaaguuucuacucagaacugggga

SEQ ID NO: 117149 - RNA, 64 nt, Homo Sapiens
ucaaaaugguugacauaauuaaugagaagaauuuggaagaaauugguauuuuaauacugucugu

SEQ ID NO: 117150 - RNA, 64 nt, Homo Sapiens
ugacauagcaagacccugucuuaaaagaaaaaugggaagaaagacaagguaacaugaagaaaga

SEQ ID NO: 117151 - RNA, 64 nt, Homo Sapiens
ccccagguucucuuuucuuacagggugccaagaaggaagaaaaguaggugggaggacuaacuuc

SEQ ID NO: 117152 - RNA, 64 nt, Homo Sapiens
ggagcuaggcagaagccuuggcugccucugggaaggaagaaacaagcccccacccuccugccaa

SEQ ID NO: 117153 - RNA, 64 nt, Homo Sapiens
aauuccacaacugccuuuagcaaucagagcacugggaagaaauagagcuuuauucaaauuuuga

SEQ ID NO: 117154 - RNA, 64 nt, Homo Sapiens
aaaaaaauuaaaaggguagacuguaaaguuagggggaagaaagauuggucucgcugucgguuaa

SEQ ID NO: 117155 - RNA, 64 nt, Homo Sapiens
cuguauaugcaguauugagcacuguaggcaagagggaagaaagagaaggagccaucuccaucuu

SEQ ID NO: 117156 - RNA, 64 nt, Homo Sapiens
cacccacucuccucugccucaguaaguaucuggaggaagaaaacaggugaaagaagaaguaaaa

SEQ ID NO: 117157 - RNA, 64 nt, Homo Sapiens
cuguggaagggccaauggagaugcaagaauuucuggaagaaaggaggaagauguucaauagaac

SEQ ID NO: 117158 - RNA, 64 nt, Homo Sapiens
cuaauucagcauguguucauucccaagauggagaggaagaaacgaaaagcccuaugugaaaaga

SEQ ID NO: 117159 - RNA, 64 nt, Homo Sapiens
gugguggucccucuucccacgugcagcccuguugggaagaaaggaagaaaacaggucccuccag

SEQ ID NO: 117160 - RNA, 64 nt, Homo Sapiens
cccucuucccacgugcagcccuguugggaagaaaggaagaaaacaggucccuccaggggugcug

SEQ ID NO: 117161 - RNA, 64 nt, Homo Sapiens
ugccuuauugaaaaacuaaagcaaauucuuuauaggaagaaaauaugggaauuugauuacacau

SEQ ID NO: 117162 - RNA, 64 nt, Homo Sapiens
aacaggacuucuguuuacaauggaaaucugaaauggaagaaacaucuuuaaccuugugugucug

SEQ ID NO: 117163 - RNA, 64 nt, Homo Sapiens
ucacaccauaacuagguaacaguuugauaacuagggaagaaagcagaacaguuaagcagccgcc

SEQ ID NO: 117164 - RNA, 64 nt, Homo Sapiens
caaaaucuguagagcagggcaaguaacauggaagggaagaaaaggugaaaaauuagaaauguuc

SEQ ID NO: 117165 - RNA, 64 nt, Homo Sapiens
aggccccaccaagaggguggaucacaccucagugggaagaaaaauaaaauuuccuucagguuuu

SEQ ID NO: 117166 - RNA, 64 nt, Homo Sapiens
agcaugcuuugauaucugguucagacuaucaucaggaagaaaaaaaaaucccacaguaccugaa

SEQ ID NO: 117167 - RNA, 64 nt, Homo Sapiens
uugaaaucuucaauuugaucgaaacauggaucuuggaagaaauugaaauagcuuaagaagaagu

SEQ ID NO: 117168 - RNA, 64 nt, Homo Sapiens
gcuuaagaagaagugaaacacuuuaaacagcucaggaagaaauaguuuaaaucugagcaugcau

SEQ ID NO: 117169 - RNA, 64 nt, Homo Sapiens
aaucaagaagagcaaagcauagaggaacgggcuuggaagaaaauugguuucagaugaugaagaa

SEQ ID NO: 117170 - RNA, 64 nt, Homo Sapiens
caaggaaagaaugagucuaagaaugugaacaaaaggaagaaaauaaaguccaaaagucacuuuu

SEQ ID NO: 117171 - RNA, 64 nt, Homo Sapiens
gaacuugaugcucaguauuuacaagcauagaaauggaagaaaguaaguuaaccacagucgggaa

SEQ ID NO: 117172 - RNA, 64 nt, Homo Sapiens
caaaaaacaaaaaacuaaaguuuauuuagaaaaaggaagaaaaacuucuccaccaagcauuugg

SEQ ID NO: 117173 - RNA, 64 nt, Homo Sapiens
gcuucuggauguccagccagcaggcguggccgagggaagaaaaaaaggacuggaggccgccagg

SEQ ID NO: 117174 - RNA, 64 nt, Homo Sapiens
ccugugugcagggaaagagauuagaggccuuuagggaagaaaagggucccuaucuuccagcagg

SEQ ID NO: 117175 - RNA, 64 nt, Homo Sapiens
uguaggggagcaugguuuuuuucuguaacuguagggaagaaagcuuacgaggauuucuggaagc

SEQ ID NO: 117176 - RNA, 64 nt, Homo Sapiens
guuucucacugcuaacguugguguuucuggcgugggaagaaaugcacaggcgugcauggcaugc

SEQ ID NO: 117177 - RNA, 64 nt, Homo Sapiens
gcauuguaagaguucugucaugcagucugaaaagggaagaaacaggauggcuuucuguagccac

SEQ ID NO: 117178 - RNA, 64 nt, Homo Sapiens
caaaucauugaacugagggggaaaaauguaacuaggaagaaaaacccaauuuaagaaauuacau

SEQ ID NO: 117179 - RNA, 64 nt, Homo Sapiens
agucauuucugcugaaaaaacagaugauccugguggaagaaaagguugaaggcagcugcccucg

SEQ ID NO: 117180 - RNA, 64 nt, Homo Sapiens
agcaaguuguucaauuuuaauucagaaaaaucaaggaagaaaaaaaaaguuuccauggaagcug

SEQ ID NO: 117181 - RNA, 64 nt, Homo Sapiens
gguggccugggaguagauaugcugaaagcuguuuggaagaaacacuaaugggaaaguucauguu

SEQ ID NO: 117182 - RNA, 64 nt, Homo Sapiens
aucauggggaggucuaccuuuuuuauaguuuuggggaagaaaauaaaaaaucaucucacaugca

SEQ ID NO: 117183 - RNA, 64 nt, Homo Sapiens
ggaagauuggaaucugccugaggagcucacaucuggaagaaacacuucaagaauuucugaggac

SEQ ID NO: 117184 - RNA, 64 nt, Homo Sapiens
ugcuauuaaugggcuaauaauuauugguguuauuggaagaaaaaauaaauaaauaauuuaaauu

SEQ ID NO: 117185 - RNA, 64 nt, Homo Sapiens
caguaacauuauccuuagguaccuaaguaaaacaggaagaaaauguguccauaugucuuuaccu

SEQ ID NO: 117186 - RNA, 64 nt, Homo Sapiens
uuuuuuuuaacuuucuucuuccuguuaaaacauaggucacuaacugugauguuauuuguuuucu

SEQ ID NO: 117187 - RNA, 64 nt, Homo Sapiens
gagccaggccagugcuuccccagccccugggccuggucacuacacaguggaaaacagacaagcg

SEQ ID NO: 117188 - RNA, 64 nt, Homo Sapiens
gggcugucagggaucuuuucuauaccagaacugcggucacuauuuuguaauaaauguggcugga

SEQ ID NO: 117189 - RNA, 64 nt, Homo Sapiens
cgggugcagaaucacuuuacagacuaacauaacaggucacuacaaguaauagauacucagcacu

SEQ ID NO: 117190 - RNA, 64 nt, Homo Sapiens
accucuucccugagaagggcucccugccugucuuggucacuacccuacauagaaguuugcuuuu

SEQ ID NO: 117191 - RNA, 64 nt, Homo Sapiens
guauuuauucuuucucccaucuguuuaauaugugggucacuaggcuuguucucuugucuguggu

SEQ ID NO: 117192 - RNA, 64 nt, Homo Sapiens
gauugggacuuacccuuuaguuaccucuguguauggucacuagaaagugacaccuggggucagu

SEQ ID NO: 117193 - RNA, 64 nt, Homo Sapiens
accuuguguguaugugugugcagaagcacagaggggucacuagcgacacccuuguccccacaag

SEQ ID NO: 117194 - RNA, 64 nt, Homo Sapiens
uaaagcaaauaaacuuaaaaggauugacuuucccggucacuauaagaaaaaaaaucgacacugu

SEQ ID NO: 117195 - RNA, 64 nt, Homo Sapiens
gccaaauacugaaauggaagcccgucuuaccuggggucacuaacugguugguuaacugagcuaa

SEQ ID NO: 117196 - RNA, 64 nt, Homo Sapiens
acuccagccugggcucaauccuggaguucugucuggucacuaucagaaggaacacuuugaggga

SEQ ID NO: 117197 - RNA, 64 nt, Homo Sapiens
caacagucaguauuaucucuuaaauguauauguuggucacuaauugcacaaaaucuauaauuug

SEQ ID NO: 117198 - RNA, 64 nt, Homo Sapiens
aguugcagcgugaaaauaaauacuuuaacucaggggucacuacaggaagaccccguugagccgg

SEQ ID NO: 117199 - RNA, 64 nt, Homo Sapiens
ugggaaaauguaaacuuuaaacauaaugccacaaggucacuaauuucuagcagguaaaauuaua

SEQ ID NO: 117200 - RNA, 64 nt, Homo Sapiens
uaggcaucacauuuuuguguuaguuauuguuucuggucacuauagagagccgacuccacuuuca

SEQ ID NO: 117201 - RNA, 64 nt, Homo Sapiens
gcagagccuggggaagucaugggauuaacuugagggucacuauugagccuauuaauuaauuauu

SEQ ID NO: 117202 - RNA, 64 nt, Homo Sapiens
gcagcccagggcucacacugcgugggagggacugggucacuauugugguuuuuacuauaacuuu

SEQ ID NO: 117203 - RNA, 64 nt, Homo Sapiens
ccauucuccaaguggaauucccacuuagggcucuggucacuagauugcaaccuguguguuuguc

SEQ ID NO: 117204 - RNA, 64 nt, Homo Sapiens
uguagcucaguuucauuauugucauuguagaagcggucacuauuagcaggcauacuuuuccaca

SEQ ID NO: 117205 - RNA, 64 nt, Homo Sapiens
gcuggugaccuuauuuucuagauguuacaaaucaggucacuaugcaaacuagaauauccucagc

SEQ ID NO: 117206 - RNA, 64 nt, Homo Sapiens
gaauuuuuuguucccauggaagaaguaaagaagaggucacuagauguugcagugaaaaauagua

SEQ ID NO: 117207 - RNA, 64 nt, Homo Sapiens
uucuuuuuuugugacuagaaauucuuaagccgauggucacuauagcucauccuuaauguauggc

SEQ ID NO: 117208 - RNA, 64 nt, Homo Sapiens
uaguuggugcaguuaauauagaaaauauugaggaggucacuaauccuuucaaagucaaucuuug

SEQ ID NO: 117209 - RNA, 64 nt, Homo Sapiens
ccuaaauaaaccugaagcaguugauguccuuauaggucacuaccgucuaaccuuaaaaauugag

SEQ ID NO: 117210 - RNA, 64 nt, Homo Sapiens
uaucucaaaauauuucauacgaaucaugcauuugggucacuaauugaacaccuuucauauugga

SEQ ID NO: 117211 - RNA, 64 nt, Homo Sapiens
ccucuuacuuuauccuuuuuccuuaaguauugguggucacuacuauugaguuucuuccuuaaca

SEQ ID NO: 117212 - RNA, 64 nt, Homo Sapiens
cucccgagggaaguucaaaaggaccggcucauuuggucacuagucuauagaagaugacacagaa

SEQ ID NO: 117213 - RNA, 64 nt, Homo Sapiens
ugcuauuuuuucacuauaggaugacuauaauucuggucacuaaauauacacuuuagauagauga

SEQ ID NO: 117214 - RNA, 64 nt, Homo Sapiens
gacaauuauguuuuauagaccuacacuagugccaggucacuauuguaagauguuaaaaucucaa

SEQ ID NO: 117215 - RNA, 64 nt, Homo Sapiens
cauguguaucgaccaugugccauauaucaauuauggucacuagaaagucucuuuaugauacuuu

SEQ ID NO: 117216 - RNA, 64 nt, Homo Sapiens
aagaagaaaaggacuaacaacagcauguugauuuggucacuaaaugccaggaugguuagauaca

SEQ ID NO: 117217 - RNA, 64 nt, Homo Sapiens
acgucauuguguuuuuuguucauaauuauaucuaggucacuagaaacuuuacuucugaaaggaa

SEQ ID NO: 117218 - RNA, 64 nt, Homo Sapiens
ucuuacagaaguucugauauugaauuaaggaaugggucacuacuuaagacuuuaucauuucagc

SEQ ID NO: 117219 - RNA, 64 nt, Homo Sapiens
gggaggcauaaagacuaauuagcaaccauaauauggucacuacccuaauagacuaaaugaaauc

SEQ ID NO: 117220 - RNA, 64 nt, Homo Sapiens
cauaucuuucuugacuauacugauuucuuauuuuggucacuauuacuaaaucucuguuaauauu

SEQ ID NO: 117221 - RNA, 64 nt, Homo Sapiens
agcaugagaagcuggcugcuaagaugucacugggggucacuaaagcugaagccugaaggaaagc

SEQ ID NO: 117222 - RNA, 64 nt, Homo Sapiens
aaccuguauuguauuaaaauuagcaauauuuucuggucacuacuauagucauccuucaauucag

SEQ ID NO: 117223 - RNA, 64 nt, Homo Sapiens
ucauuggcguuuauaaagauuaguuugauaaacaggucacuaaaaaucaacccauccauagaaa

SEQ ID NO: 117224 - RNA, 64 nt, Homo Sapiens
gaaacguguagagcaagacucccuucaaauggacggucacuacacugagggaauauuucccuau

SEQ ID NO: 117225 - RNA, 64 nt, Homo Sapiens
uuuauaaugugcaucaacaugugaaagcaaucuaggucacuagcacagaggaaguugccaggaa

SEQ ID NO: 117226 - RNA, 64 nt, Homo Sapiens
cauuagaacucuucaaaaugggcucuucuaaugaggucacuacugaacaaaauuguucccucuu

SEQ ID NO: 117227 - RNA, 64 nt, Homo Sapiens
augugaguaaacacaccugcgcagcccuggcugaggucacuaggcuggccagaggcaggacagg

SEQ ID NO: 117228 - RNA, 64 nt, Homo Sapiens
acuuuggaucaaaauggugcaaccauaggauuuaggucacuagggaggauuuugaaaacuguau

SEQ ID NO: 117229 - RNA, 64 nt, Homo Sapiens
uuucaacuagcaucagguauuuggaaagccucauggucacuaauguuugcuaauuagaaauauc

SEQ ID NO: 117230 - RNA, 64 nt, Homo Sapiens
ucagaaacacgguccugauaguucuuugcaccgcggucacuauugggucucggcacucugcugu

SEQ ID NO: 117231 - RNA, 64 nt, Homo Sapiens
uuuugguugcaagcagcagacuggcucuuccaguggucacuacuccucuguccucucgcagggg

SEQ ID NO: 117232 - RNA, 64 nt, Homo Sapiens
agcacuuugggaggccaagguggggggaucacaaggucacuagauggcgagcauccuggccaac

SEQ ID NO: 117233 - RNA, 64 nt, Homo Sapiens
ugaucccucaggucugcugcauagcuuuugucacggucacuagcggcaagaguaaaacuguagc

SEQ ID NO: 117234 - RNA, 64 nt, Homo Sapiens
caaaggaggaaagaauggaugacacuuagggacaggucacuaagcagaauagguauuaguuggu

SEQ ID NO: 117235 - RNA, 64 nt, Homo Sapiens
augucacuaacaaguggcaaauggugaaaaaaguggucacuaugcuuuugucucucauaggcac

SEQ ID NO: 117236 - RNA, 64 nt, Homo Sapiens
aaaaaauuuaaaaaauuaaaaaauaaaaaaaagaggucacuaaaagaccaagaugggaaacgua

SEQ ID NO: 117237 - RNA, 64 nt, Homo Sapiens
gcauuuauaggaccuucuggugacagcuugagaaggucacuacuccaaauccuauuuaaagacc

SEQ ID NO: 117238 - RNA, 64 nt, Homo Sapiens
cccuuuuugagagaauuucuaaauugacuguaguggucacuaaaauucagcuaauuuguuuuua

SEQ ID NO: 117239 - RNA, 64 nt, Homo Sapiens
cucugccagcguggcagagccaucuacucagcaaggucacuaaguugcacccagccguuggcag

SEQ ID NO: 117240 - RNA, 64 nt, Homo Sapiens
aaguguuucauuaugaccagaucucugauuguauggucacuagguaugcaaucacgcauucaaa

SEQ ID NO: 117241 - RNA, 64 nt, Homo Sapiens
uuugauggacagggcugccuuuaaugagugugaaggucacuaagucacuuagacaucucaccgu

SEQ ID NO: 117242 - RNA, 64 nt, Homo Sapiens
gucucucugagccucaguuucgugacuuugaucaggucacuaguaguccccugcccacucccua

SEQ ID NO: 117243 - RNA, 64 nt, Homo Sapiens
ucaagcuugcucuuucucuuccuuugguuauuaaggucacuaaauaaaggaagugccuuggaaa

SEQ ID NO: 117244 - RNA, 64 nt, Homo Sapiens
aucaaaaguuacuggaacuggaaaagcacauuagggucacuauucaaaaaacagauaaucaggc

SEQ ID NO: 117245 - RNA, 64 nt, Homo Sapiens
uuagaagacgaccauucugaucugugugugaucuggucacuaugugacugccuuuacgguuucu

SEQ ID NO: 117246 - RNA, 64 nt, Homo Sapiens
caagacagcucacccgguccagaagcuccaugcuggucacuagggugcugugcucucuggcgcc

SEQ ID NO: 117247 - RNA, 64 nt, Homo Sapiens
ucugacugcauguuuacuuaaagcuucgguggaaggucacuauuagaucagaauagacuucaga

SEQ ID NO: 117248 - RNA, 64 nt, Homo Sapiens
cuuugucaucucuuucgcugccacuucuggcuguggucacuagcuuggccauagcaccucucuu

SEQ ID NO: 117249 - RNA, 64 nt, Homo Sapiens
augggucuggccugugagucuccccuugcagccuggucacuaggcaucacccccgcuuugguuc

SEQ ID NO: 117250 - RNA, 64 nt, Homo Sapiens
gacagccugacugugccaucagcuccguggcagcggucacuaaggaagaugcaggccgaucgcc

SEQ ID NO: 117251 - RNA, 64 nt, Homo Sapiens
gacccuucugggucagaggacaugugagacauagggucacuagagcaugugagaugagacuugg

SEQ ID NO: 117252 - RNA, 64 nt, Homo Sapiens
guauccugacaaguuccuaguauagugagggaauggucacuaaaaggugggucugggugagagu

SEQ ID NO: 117253 - RNA, 64 nt, Homo Sapiens
gccaagcuaauugacacccaguacacuuaagaguggucacuacaaauuaaaauaaaagguaacg

SEQ ID NO: 117254 - RNA, 64 nt, Homo Sapiens
guggucacuuucgcagggggugggaaugggguggggucacuaaggagagagggucaggagccag

SEQ ID NO: 117255 - RNA, 64 nt, Homo Sapiens
gcaaacagcugcagcucugugauuaaaauguuaaggucacuagaauaguguuaggaaaauguua

SEQ ID NO: 117256 - RNA, 64 nt, Homo Sapiens
aacugauuuucuaaaauuauucuccaggcaucugggucacuaaaagaaaaauccuggcagcuuu

SEQ ID NO: 117257 - RNA, 64 nt, Homo Sapiens
uaugaaagcaauugguuaggauacacuguacuggggucacuauuauuucugcugcaaaagacau

SEQ ID NO: 117258 - RNA, 64 nt, Homo Sapiens
gcauaguuucuuucucuuccuucauagaugacacggucacuagcucugccucagaaagcucugc

SEQ ID NO: 117259 - RNA, 64 nt, Homo Sapiens
cauuuuaugauuuuucugucauaugaaucaguacggucacuauaaauuacaccuuuaaagacug

SEQ ID NO: 117260 - RNA, 64 nt, Homo Sapiens
cuucaguuuguguuguguauauuuugauguauguggucacuaacaggucacuuuuauuuuuucu

SEQ ID NO: 117261 - RNA, 64 nt, Homo Sapiens
uagacguaaagccuucaguuuucaaaaucuuucuggucacuauaaagaucuuggaacagcaaau

SEQ ID NO: 117262 - RNA, 64 nt, Homo Sapiens
gucgcuuucuauuucucuuuuuauuccucuugcuggucacuacccauuaagaugaauguaauua

SEQ ID NO: 117263 - RNA, 64 nt, Homo Sapiens
ggggugaccuuguuccuugcauguccugccuuggggucacuaaauuucucuauaacugggauag

SEQ ID NO: 117264 - RNA, 64 nt, Homo Sapiens
gggagaaaauccaggucaugcaauuaacaucgugggucacuacauugcaaacuguccucuacau

SEQ ID NO: 117265 - RNA, 64 nt, Homo Sapiens
cgucuccaauaugacuauuaacccauggcucacaggucacuaagcaguguagcuuaggggagca

SEQ ID NO: 117266 - RNA, 64 nt, Homo Sapiens
gggagaaaugacauguuuucauugaaugaagaaaggucacuaaacauucuugguaaaccaggua

SEQ ID NO: 117267 - RNA, 64 nt, Homo Sapiens
gccugauugguccuccagguguggcccaggcaguggucacuacagguuguugagcugggaaacc

SEQ ID NO: 117268 - RNA, 64 nt, Homo Sapiens
ccgcaggucucaucccacacucuugagaagccuuggucacuacaguggucgcacauguuccucu

SEQ ID NO: 117269 - RNA, 64 nt, Homo Sapiens
caaaaggcaguuacauaucaauacagagacucaaggucacuagaaaugggccagcugggucaau

SEQ ID NO: 117270 - RNA, 64 nt, Homo Sapiens
ucacaaggcaaaguguuguauuuggcaaugggguggucacuacccucuaugcugucaucagacc

SEQ ID NO: 117271 - RNA, 64 nt, Homo Sapiens
uucugauccucauccuggguggagcgaugcugguggucacuagccacguugccaucagcuacca

SEQ ID NO: 117272 - RNA, 64 nt, Homo Sapiens
uucucuuaacacauaggaaaguuugugauacagcggucacuauugaucggugugaccugaaagg

SEQ ID NO: 117273 - RNA, 64 nt, Homo Sapiens
ucaacuuaaagugaauugucuuuguuauaaaugaggucacuauggacuuacccuaaagaucuuc

SEQ ID NO: 117274 - RNA, 64 nt, Homo Sapiens
aacaaauggaaauaacucccaggcaguaucagguggucacuacagagacuuccacaaaaacuuu

SEQ ID NO: 117275 - RNA, 64 nt, Homo Sapiens
uugucauuuaauuauauuucagguguccugaacaggucacuagacucuacauugggcagccuuu

SEQ ID NO: 117276 - RNA, 64 nt, Homo Sapiens
caacagauuugcagcucauuccuuacccugguuaggucacuacuuuugcagauuuugcuggcac

SEQ ID NO: 117277 - RNA, 64 nt, Homo Sapiens
agggcagcccagagguggcagcggcaggcaaucuggucacuaggucuuugugaugccaaaaaua

SEQ ID NO: 117278 - RNA, 64 nt, Homo Sapiens
acaaauguguauucgcccuccacaauuccagaauggucacuauggcaguaccugcgaguagaga

SEQ ID NO: 117279 - RNA, 64 nt, Homo Sapiens
caagccagaaacguaacugucacagccaagguagggucacuaacacucuucccaccucagugcc

SEQ ID NO: 117280 - RNA, 64 nt, Homo Sapiens
uuuuauguuuuccaaguuauaacuuggaguuaauggucacuagauuaucaguuaugagcagugu

SEQ ID NO: 117281 - RNA, 64 nt, Homo Sapiens
acacugaaauguuauacucaguguugauuucuucggucacuacacaacguaaaaucauuuguuu

SEQ ID NO: 117282 - RNA, 64 nt, Homo Sapiens
ucuuccucugcuaggugaauccggcccccgcugcggucacuauuccguucucacugcggcugca

SEQ ID NO: 117283 - RNA, 64 nt, Homo Sapiens
aauacagcuguugaagaauuuuucaugaaugugaggucacuaguaauuucaugccaaaaaugaa

SEQ ID NO: 117284 - RNA, 64 nt, Homo Sapiens
ucaucuguguuggauuucuucuggguugauagaaggucacuacuuggaggcugcuuauuccaga

SEQ ID NO: 117285 - RNA, 64 nt, Homo Sapiens
cacauuauaguaagaggggaucuuugcagcagaaggucacuacuuuugcaccaaacugucacca

SEQ ID NO: 117286 - RNA, 64 nt, Homo Sapiens
ggccuggugucuccccucccgacagggaauggucggucacuaugacccuccaugcugcgacaag

SEQ ID NO: 117287 - RNA, 64 nt, Homo Sapiens
aaguuugcuaccaagaugauugccuuauugaauaggucacuauuaaauuccuuuaaauguugau

SEQ ID NO: 117288 - RNA, 64 nt, Homo Sapiens
uuugaaguuccaguccucccccauugcuggccauggucacuaaauccuugcccuuugagagugu

SEQ ID NO: 117289 - RNA, 64 nt, Homo Sapiens
caacaagguuggcaccccaguagcugccagugcuggucacuaacccuagacuucccaacagccu

SEQ ID NO: 117290 - RNA, 64 nt, Homo Sapiens
uucuacugcucuucccccaccuagacuguggugaggucacuagaaacccagcugaggccugggc

SEQ ID NO: 117291 - RNA, 64 nt, Homo Sapiens
ucccagauaagaucacuccuucuggggacaagauggucacuaguagauccagguuuacuuucua

SEQ ID NO: 117292 - RNA, 64 nt, Homo Sapiens
cucaggauuggcgugugcuugaucuuuaaaauguggucacuaaagaacuuggcauuuuccugau

SEQ ID NO: 117293 - RNA, 64 nt, Homo Sapiens
cgaggucucuugaagacuugagaagcugucacaaggucacuacaagcccaaccugccccuucac

SEQ ID NO: 117294 - RNA, 64 nt, Homo Sapiens
caaaggacugaucacuguccuugccucuaggaggggucacuaagcccuuaccuagggcugggug

SEQ ID NO: 117295 - RNA, 64 nt, Homo Sapiens
ucuccuucauuacuuaaagauauucaugagggugggucacuacagauguuggggagcaagggcu

SEQ ID NO: 117296 - RNA, 64 nt, Homo Sapiens
auuuuuuaauuuuacaccugaaacaaagaaauguggucacuaaaaauaaaaguauauauguagg

SEQ ID NO: 117297 - RNA, 64 nt, Homo Sapiens
uggugaaaaaauaugguauuagugauaacaaaugggucacuaucaccauguuaugucgacuauu

SEQ ID NO: 117298 - RNA, 64 nt, Homo Sapiens
uuaagugacauaagccagaauggauggaacuagaggucacuauacaggggcaguuaaggaguca

SEQ ID NO: 117299 - RNA, 64 nt, Homo Sapiens
ucagccaguuaucaguagauacaauaucuuuaaaugaacacacgaguguaugucucacaauaua

SEQ ID NO: 117300 - RNA, 64 nt, Homo Sapiens
ugaaagauccauuuuaggucuuuuucaagaauagugaacacauuuuuuaacaaaauaaguugua

SEQ ID NO: 117301 - RNA, 64 nt, Homo Sapiens
cuugcucugucaccuaggcuagaguggaguggcaugaacacaacgcacugcagccucuaccucc

SEQ ID NO: 117302 - RNA, 64 nt, Homo Sapiens
uuauaaagagcaagcauagauggaaagugcauauugaacacaucugugcauuugagaaggcagg

SEQ ID NO: 117303 - RNA, 64 nt, Homo Sapiens
ugacucaggggaguacaaucuuuauucugaccaaugaacacagcauuggugucagaugcuggaa

SEQ ID NO: 117304 - RNA, 64 nt, Homo Sapiens
guacaauaguacaaaaaccaucaguaucuauauuugaacacacuuuaaaauuuugcagaggucu

SEQ ID NO: 117305 - RNA, 64 nt, Homo Sapiens
ccaguuuacaggaaagaugcuguguggagugugcugaacacacauagauucuaacauauugcca

SEQ ID NO: 117306 - RNA, 64 nt, Homo Sapiens
cacguuauaguccaugguccuagugcuuuaagaaugaacacaaucggcaccauuggucucuggg

SEQ ID NO: 117307 - RNA, 64 nt, Homo Sapiens
acagaacuauguuuugacuuaggauaauguggcuugaacacauucuucugagcaguuaaccucu

SEQ ID NO: 117308 - RNA, 64 nt, Homo Sapiens
ugguauauugcuuuaccaaagaaugauuaccaagugaacacacuuuauacauguguugcuuagu

SEQ ID NO: 117309 - RNA, 64 nt, Homo Sapiens
cugaagaaauccugggaauuaacaucugcacuccugaacacaccaguagaaaggucauccaaag

SEQ ID NO: 117310 - RNA, 64 nt, Homo Sapiens
gauuagguuaugguuuaaugguguggaagcauagugaacacacuaagugugagaagacuggcua

SEQ ID NO: 117311 - RNA, 64 nt, Homo Sapiens
uacuuuuguaaucagaaaauuaaauuuuuucuaaugaacacauauuacuuauucauucuguacu

SEQ ID NO: 117312 - RNA, 64 nt, Homo Sapiens
uauuuuaaggcaguuaaauuaaauuaaauagaggugaacacaauuuuguaauacgugugcauaa

SEQ ID NO: 117313 - RNA, 64 nt, Homo Sapiens
gaaguaaauucuaguuuguaguucucauuuguaaugaacacauuaacgacuagauuaaaauauu

SEQ ID NO: 117314 - RNA, 64 nt, Homo Sapiens
aacuuuucuaaauguagugccuuuaaaggaaaaaugaacacagggaagugacuuugcuacaaau

SEQ ID NO: 117315 - RNA, 64 nt, Homo Sapiens
uuucaagagcagacaucuuggagcaguacaaugaugaacacacguuauuuuucccaauugcccu

SEQ ID NO: 117316 - RNA, 64 nt, Homo Sapiens
gccuccucaucuucuuccugaucacaagacauccugaacacauugguggcuucaggccucggga

SEQ ID NO: 117317 - RNA, 64 nt, Homo Sapiens
uugucagugaugauguaaacgugaugagaauaggugaacacaccauggaauccaucaguguuac

SEQ ID NO: 117318 - RNA, 64 nt, Homo Sapiens
uuugcccaugacauugccuauaagcacaguuuuaugaacacaauuaaucuaucauaagcagacc

SEQ ID NO: 117319 - RNA, 64 nt, Homo Sapiens
gccagcccggggacuguccuggguggagggcaggugaacacaagcugcugccggggacuguccu

SEQ ID NO: 117320 - RNA, 64 nt, Homo Sapiens
cugcugccggggacuguccuggguggacggcaggugaacacaagcggcugccgcauguagccac

SEQ ID NO: 117321 - RNA, 64 nt, Homo Sapiens
gauggugaggcugcagugaggcaggagaaugguuugaacacaggcagcaacuuaggagccugag

SEQ ID NO: 117322 - RNA, 64 nt, Homo Sapiens
uucaggaugacagacugcaauaggcaaugucaagugaacacaaagguaagcugaaacuaauaau

SEQ ID NO: 117323 - RNA, 64 nt, Homo Sapiens
uaccaaaacugcauuuuggucuuguauaguguaaugaacacaaaggaaaacauggaaacuuaga

SEQ ID NO: 117324 - RNA, 64 nt, Homo Sapiens
ucuauauuuuaguauuuuuuguaguggagaugccugaacacaauagguuacugcugcgauugau

SEQ ID NO: 117325 - RNA, 64 nt, Homo Sapiens
acuccuucugcucaaggcugauguuuguaacuuaugaacacacgugaaguguugaguccaaaag

SEQ ID NO: 117326 - RNA, 64 nt, Homo Sapiens
cuuacuuuguugaaaaagaaaaagaaauuaaauuugaacacagugaaagcugcaaguaugccag

SEQ ID NO: 117327 - RNA, 64 nt, Homo Sapiens
uuauugaaacacucaaaaauaccacuucucaguaugaacacaauugcuaagagccuaauuuggu

SEQ ID NO: 117328 - RNA, 64 nt, Homo Sapiens
aacagucugagcagccaacccauuucaacaaaauugaacacaggacucuucugcucagcagcau

SEQ ID NO: 117329 - RNA, 64 nt, Homo Sapiens
cugauacacacguauucaaaguuuauggguacaacaaagacauaguacauguacauaauaugua

SEQ ID NO: 117330 - RNA, 64 nt, Homo Sapiens
agugugugaccuacaggcuuagaaaugguauagucaaagacauuuuauccacauuucuaauagu

SEQ ID NO: 117331 - RNA, 64 nt, Homo Sapiens
gagaaggaauuugaguuggaucaucuauugcuggcaaagacagaagccucacugcaagcacugc

SEQ ID NO: 117332 - RNA, 64 nt, Homo Sapiens
acaguagcauaggacccuacccucugggccaagucaaagacauucugacaucuuaguauuugca

SEQ ID NO: 117333 - RNA, 64 nt, Homo Sapiens
agagagcaagcacguucauaacaaaacagcaacacaaagacauguuaagcauguuuauuuauuu

SEQ ID NO: 117334 - RNA, 64 nt, Homo Sapiens
acuucgguaaaagaaaauagggaaaggccauaaacaaagacagacuuguaguuuauuuuguauu

SEQ ID NO: 117335 - RNA, 64 nt, Homo Sapiens
aaaaaauguuguauucugaagacccacaaaauaucaaagacauucuguaguuuauacaccgugu

SEQ ID NO: 117336 - RNA, 64 nt, Homo Sapiens
aucauacaauaaaauaaaagguaauucagggucccaaagacaaacuuacuaagaaaaaaucauu

SEQ ID NO: 117337 - RNA, 64 nt, Homo Sapiens
aucaucuauauauucauucauuugacaaagauaacaaagacagaaggguuuaagauggcaugga

SEQ ID NO: 117338 - RNA, 64 nt, Homo Sapiens
guuucaguuucugagagugguucucuuuuaagagcaaagacauuuugauuacaucugaagucuc

SEQ ID NO: 117339 - RNA, 64 nt, Homo Sapiens
aaaaaccucucaaacugagggggaaaauauuucucaaagacagcauuuagacauuagaaugucu

SEQ ID NO: 117340 - RNA, 64 nt, Homo Sapiens
agugaaaaaggaaggagugauguuaugaguucuacaaagacaauauuuaauuuccucuuaaaca

SEQ ID NO: 117341 - RNA, 64 nt, Homo Sapiens
ggaaauggcaaacaaaagacgcuguguuuugguucaaagacaagacgcuccaagcuuggaaaga

SEQ ID NO: 117342 - RNA, 64 nt, Homo Sapiens
agcugcagugaaaauuuuggugcaguucuuggcacaaagacaaaauucugaacuccccugugaa

SEQ ID NO: 117343 - RNA, 64 nt, Homo Sapiens
ggaagaaugggcugcagaaggagguuugucaacacaaagacacacacaaagacauggaagauua

SEQ ID NO: 117344 - RNA, 64 nt, Homo Sapiens
gaagauuagagguuugucaauagguuugucaacacaaagacaugaacaaaaagacauggaaggu

SEQ ID NO: 117345 - RNA, 64 nt, Homo Sapiens
gaagguuagagguuugucaagagguuugucaacacaaagacaugucagaugcaccacccaugga

SEQ ID NO: 117346 - RNA, 64 nt, Homo Sapiens
uuuuguuaauaagacaaagguaauauauuggauacaaagacacaaauguauuguguguucaauu

SEQ ID NO: 117347 - RNA, 64 nt, Homo Sapiens
auuuucaugaacaguuacccucuguccccacaaccaaagacaacucauggccuccuuuggcccu

SEQ ID NO: 117348 - RNA, 64 nt, Homo Sapiens
uuugaugacgauucuuaacagauuuguaugguuccaaagacacucucguuuuaagaaacuagca

SEQ ID NO: 117349 - RNA, 64 nt, Homo Sapiens
aaaccugaguaucaguacauggauuuaucccccgcaaagacaucagaauccugaugguaucaau

SEQ ID NO: 117350 - RNA, 64 nt, Homo Sapiens
uucuuuuuaaagcuguuuucaccacacaugaacccaaagacaugguuuacacccgggcagcagc

SEQ ID NO: 117351 - RNA, 64 nt, Homo Sapiens
ggcuggacccugcaugcaggcugccuguuucccccaaagacaauagcuccauccuccacuuauu

SEQ ID NO: 117352 - RNA, 64 nt, Homo Sapiens
cugcaugaaaaggguacagcaagucaacccaucccaaagacaaaccccuccuugagaagaccag

SEQ ID NO: 117353 - RNA, 64 nt, Homo Sapiens
uuggccacuuccccuccuugccaaagagcugaaucaaagacagccuuuccaaguccagguguuc

SEQ ID NO: 117354 - RNA, 64 nt, Homo Sapiens
caggaauaaagauguucuuugaaacccaugagaacaaagacacaacauaccagaaucucuggga

SEQ ID NO: 117355 - RNA, 64 nt, Homo Sapiens
aaucaauaaauguaauccagcauauaaacagaaccaaagacagaaaccacaugauuaucucaau

SEQ ID NO: 117356 - RNA, 64 nt, Homo Sapiens
aaaggacucauacuggagagacuacuacucagcucaaagacaugauguggaaaagcauuuagau

SEQ ID NO: 117357 - RNA, 64 nt, Homo Sapiens
aaaagacucauacuggagagaucacaacucugcucaaagacaugaugugggaaaguguucguau

SEQ ID NO: 117358 - RNA, 64 nt, Homo Sapiens
aaaggacucacacuagggagauuucauuggauuucaaagacaugaugugggaaagccuuuguuu

SEQ ID NO: 117359 - RNA, 64 nt, Homo Sapiens
ugauaaggcacacuagagauaucugggaagcuuccaaagacacaaugugggaaagcauuugauc

SEQ ID NO: 117360 - RNA, 64 nt, Homo Sapiens
uggcagugcagcauggagaucuuugggaaaccuucaaagacacaauguaggaaguccuucaauu

SEQ ID NO: 117361 - RNA, 64 nt, Homo Sapiens
aagaauuggcaaaacucuucagggauucugauuucaaagacauaccuaucauuaacauuagcuu

SEQ ID NO: 117362 - RNA, 64 nt, Homo Sapiens
guuguucauguuauuuaaagacaauuacaguucccaaagacacacuuggauaaagaaaauuucu

SEQ ID NO: 117363 - RNA, 64 nt, Homo Sapiens
ucaaauaacccaugugucccugguuggggcuggggagagugagaagcugagauacugggcacag

SEQ ID NO: 117364 - RNA, 64 nt, Homo Sapiens
uguggauguugcaccagaagagagugcaguguuggagagugacacugucggggcagcuggggcc

SEQ ID NO: 117365 - RNA, 64 nt, Homo Sapiens
aggcauuugucuuagagagagagagagcgcgggagagagugagagagagugagagcacaaagau

SEQ ID NO: 117366 - RNA, 64 nt, Homo Sapiens
cuuagagagagagagagcgcgggagagagugagagagagugagagcacaaagauaacgcaggag

SEQ ID NO: 117367 - RNA, 64 nt, Homo Sapiens
uguccagccugcaaagcuauguccagggcccgaggagagugaggcggggugacucauuucccuu

SEQ ID NO: 117368 - RNA, 64 nt, Homo Sapiens
acuccccucuucccauccuccaacugaaccagaagagagugaaggaaggcacacugucccacca

SEQ ID NO: 117369 - RNA, 64 nt, Homo Sapiens
gagagagagaaagagagagagugagagagagaaagagagugagaaguuuccagagagccagaga

SEQ ID NO: 117370 - RNA, 64 nt, Homo Sapiens
gagagaaagagagugagagauuuccagagagccagagagugagagguuggaagagaguaaccag

SEQ ID NO: 117371 - RNA, 64 nt, Homo Sapiens
cucuguauauaaauaugugacuuggguuaaauuugagagugauuccccaaauccuauugcuuau

SEQ ID NO: 117372 - RNA, 64 nt, Homo Sapiens
ucuagaaaaaagaaaaguguauauaucaguguuugagagugaccccuacacucaaacuauagug

SEQ ID NO: 117373 - RNA, 64 nt, Homo Sapiens
guacagugaugauguuaauggguacaaauuuuuucuucauuacuaaauacuggaaauugcacau

SEQ ID NO: 117374 - RNA, 64 nt, Homo Sapiens
auaaacaauauuuguaaaaaauugucuguaccagcuucauuaaagauauggguuuuaaauggac

SEQ ID NO: 117375 - RNA, 64 nt, Homo Sapiens
gagugauauugggaaagugagaucccccaagcagcuucauuacacucuccacaaucaaauggag

SEQ ID NO: 117376 - RNA, 64 nt, Homo Sapiens
acgguacacuauuguuuacuaugacaaagugauccuucauuauccugccuuugcauguaguaau

SEQ ID NO: 117377 - RNA, 64 nt, Homo Sapiens
acauuuaugugcuuaagauugucauuugcaaaugcuucauuauaagaauaaaaguaauugagca

SEQ ID NO: 117378 - RNA, 64 nt, Homo Sapiens
caaugugauuggccuuuuauaucaugcuuuugggcuucauuaguauuauaagaaaucuuaguua

SEQ ID NO: 117379 - RNA, 64 nt, Homo Sapiens
guuccaguaaucagaaaauccucaagaaaauugacuucauuauuuggaaggaaaauuaguauuu

SEQ ID NO: 117380 - RNA, 64 nt, Homo Sapiens
aaaacacaugcuuucuuaaaacagaagcucucuccuucauuaauuuaaauauuuuuaucggcuc

SEQ ID NO: 117381 - RNA, 64 nt, Homo Sapiens
ccucucucccauuucccgcuguggcugagccaaacuucauuacuuuccuuaggcccucugcccc

SEQ ID NO: 117382 - RNA, 64 nt, Homo Sapiens
uucuaaaccuuguuucuaacugucuaucaaauaucuucauuagacaucccacaguaauuuuaag

SEQ ID NO: 117383 - RNA, 64 nt, Homo Sapiens
agggauucaaaguauuuauauaaguucuaaaauccuucauuaugugaguaaaccucuauauuca

SEQ ID NO: 117384 - RNA, 64 nt, Homo Sapiens
aaacugguuaccaugccuuaaaccaaaauaauaccuucauuaucaucaacucacauauguucaa

SEQ ID NO: 117385 - RNA, 64 nt, Homo Sapiens
acuguguuaccuuuuaaaaucuauaguuauacaucuucauuaaucuucugaagcuagaaacaau

SEQ ID NO: 117386 - RNA, 64 nt, Homo Sapiens
guaaaucuaugagcaacuccaucguauucuaauucuucauuauagguuuccucauuuuacuaaa

SEQ ID NO: 117387 - RNA, 64 nt, Homo Sapiens
uuauuuuauuauuucuucuuguaucuucucuugccuucauuauuuuuuucacugccuucauuau

SEQ ID NO: 117388 - RNA, 64 nt, Homo Sapiens
uaucuucucuugccuucauuuuuuuuuucacugccuucauuauguuguuccuacauuuuguagg

SEQ ID NO: 117389 - RNA, 64 nt, Homo Sapiens
uucugcauuggaaaauauuucuuucaagguucaacuucauuaucuuggaaguuagggaguacug

SEQ ID NO: 117390 - RNA, 64 nt, Homo Sapiens
ucccucuucaagagucguuucacaugcacuuguacuucauuauucacacuuacuuugacaauuu

SEQ ID NO: 117391 - RNA, 64 nt, Homo Sapiens
gcagaaaugugccaccaugguuauucuauuuaaucuucauuauaucaguguuauccuggaacug

SEQ ID NO: 117392 - RNA, 64 nt, Homo Sapiens
aauagucaguauuuuaaaagugguugcuauuuuccuucauuauguuuauugugucuaaaagagu

SEQ ID NO: 117393 - RNA, 64 nt, Homo Sapiens
acaaacuuuacuugauaugacauguauagaaaaacuucauuagaucaguuguaccccaguguuc

SEQ ID NO: 117394 - RNA, 64 nt, Homo Sapiens
gugagaaaucugcagauagcgucaccugucugcccuucauuaaggccacaggucccugcccugu

SEQ ID NO: 117395 - RNA, 64 nt, Homo Sapiens
caguuuaagcuaugaacugugugucccaguaggaggucaagaaaaccuccacagccuucuggau

SEQ ID NO: 117396 - RNA, 64 nt, Homo Sapiens
agguagauuuccacaauaugcaaaguggugguggggucaagacagaugacaccagcacuuuaaa

SEQ ID NO: 117397 - RNA, 64 nt, Homo Sapiens
auaaaauuaauugaaggcagcaaaaggcacaguaggucaagaagcaggucucgaucccggacca

SEQ ID NO: 117398 - RNA, 64 nt, Homo Sapiens
cgaucccguucccguagucgcaaaucuuacagccggucaagaagcaggagcaggagccggagcc

SEQ ID NO: 117399 - RNA, 64 nt, Homo Sapiens; identical to SEQ ID NO: 112037

SEQ ID NO: 117400 - RNA, 64 nt, Homo Sapiens; identical to SEQ ID NO: 112038

SEQ ID NO: 117401 - RNA, 64 nt, Homo Sapiens; identical to SEQ ID NO: 112039

SEQ ID NO: 117402 - RNA, 64 nt, Homo Sapiens; identical to SEQ ID NO: 112040

SEQ ID NO: 117403 - RNA, 64 nt, Homo Sapiens; identical to SEQ ID NO: 112041

SEQ ID NO: 117404 - RNA, 64 nt, Homo Sapiens; identical to SEQ ID NO: 112042

SEQ ID NO: 117405 - RNA, 64 nt, Homo Sapiens; identical to SEQ ID NO: 112043

SEQ ID NO: 117406 - RNA, 64 nt, Homo Sapiens; identical to SEQ ID NO: 112044

SEQ ID NO: 117407 - RNA, 64 nt, Homo Sapiens; identical to SEQ ID NO: 112045

SEQ ID NO: 117408 - RNA, 64 nt, Homo Sapiens; identical to SEQ ID NO: 112046

SEQ ID NO: 117409 - RNA, 64 nt, Homo Sapiens; identical to SEQ ID NO: 112047

SEQ ID NO: 117410 - RNA, 64 nt, Homo Sapiens; identical to SEQ ID NO: 112048

SEQ ID NO: 117411 - RNA, 64 nt, Homo Sapiens; identical to SEQ ID NO: 112049

SEQ ID NO: 117412 - RNA, 64 nt, Homo Sapiens; identical to SEQ ID NO: 112050

SEQ ID NO: 117413 - RNA, 64 nt, Homo Sapiens; identical to SEQ ID NO: 112051

SEQ ID NO: 117414 - RNA, 64 nt, Homo Sapiens; identical to SEQ ID NO: 112052

SEQ ID NO: 117415 - RNA, 64 nt, Homo Sapiens; identical to SEQ ID NO: 112053

SEQ ID NO: 117416 - RNA, 64 nt, Homo Sapiens; identical to SEQ ID NO: 112054

SEQ ID NO: 117417 - RNA, 64 nt, Homo Sapiens; identical to SEQ ID NO: 112055

SEQ ID NO: 117418 - RNA, 64 nt, Homo Sapiens; identical to SEQ ID NO: 112056

SEQ ID NO: 117419 - RNA, 64 nt, Homo Sapiens; identical to SEQ ID NO: 112057

SEQ ID NO: 117420 - RNA, 64 nt, Homo Sapiens; identical to SEQ ID NO: 112058

SEQ ID NO: 117421 - RNA, 59 nt, Homo Sapiens; identical to SEQ ID NO: 112059

SEQ ID NO: 117422 - RNA, 64 nt, Homo Sapiens; identical to SEQ ID NO: 112060

SEQ ID NO: 117423 - RNA, 64 nt, Homo Sapiens; identical to SEQ ID NO: 112061

SEQ ID NO: 117424 - RNA, 64 nt, Homo Sapiens; identical to SEQ ID NO: 112062

SEQ ID NO: 117425 - RNA, 64 nt, Homo Sapiens; identical to SEQ ID NO: 112063

SEQ ID NO: 117426 - RNA, 64 nt, Homo Sapiens; identical to SEQ ID NO: 112064

SEQ ID NO: 117427 - RNA, 64 nt, Homo Sapiens; identical to SEQ ID NO: 112065

SEQ ID NO: 117428 - RNA, 54 nt, Homo Sapiens; identical to SEQ ID NO: 112066

SEQ ID NO: 117429 - RNA, 64 nt, Homo Sapiens; identical to SEQ ID NO: 112067

SEQ ID NO: 117430 - RNA, 64 nt, Homo Sapiens; identical to SEQ ID NO: 112068

SEQ ID NO: 117431 - RNA, 64 nt, Homo Sapiens; identical to SEQ ID NO: 112069

SEQ ID NO: 117432 - RNA, 64 nt, Homo Sapiens; identical to SEQ ID NO: 112070

SEQ ID NO: 117433 - RNA, 64 nt, Homo Sapiens; identical to SEQ ID NO: 112071

SEQ ID NO: 117434 - RNA, 64 nt, Homo Sapiens; identical to SEQ ID NO: 112072

SEQ ID NO: 117435 - RNA, 64 nt, Homo Sapiens; identical to SEQ ID NO: 112073

SEQ ID NO: 117436 - RNA, 64 nt, Homo Sapiens; identical to SEQ ID NO: 112074

SEQ ID NO: 117437 - RNA, 64 nt, Homo Sapiens; identical to SEQ ID NO: 112075

SEQ ID NO: 117438 - RNA, 64 nt, Homo Sapiens; identical to SEQ ID NO: 112076

SEQ ID NO: 117439 - RNA, 64 nt, Homo Sapiens; identical to SEQ ID NO: 112077

SEQ ID NO: 117440 - RNA, 64 nt, Homo Sapiens; identical to SEQ ID NO: 112078

SEQ ID NO: 117441 - RNA, 64 nt, Homo Sapiens; identical to SEQ ID NO: 112079

SEQ ID NO: 117442 - RNA, 64 nt, Homo Sapiens; identical to SEQ ID NO: 112080

SEQ ID NO: 117443 - RNA, 64 nt, Homo Sapiens; identical to SEQ ID NO: 112081

SEQ ID NO: 117444 - RNA, 64 nt, Homo Sapiens; identical to SEQ ID NO: 112082

SEQ ID NO: 117445 - RNA, 64 nt, Homo Sapiens; identical to SEQ ID NO: 112083

SEQ ID NO: 117446 - RNA, 64 nt, Homo Sapiens; identical to SEQ ID NO: 112084

SEQ ID NO: 117447 - RNA, 64 nt, Homo Sapiens; identical to SEQ ID NO: 112085

SEQ ID NO: 117448 - RNA, 64 nt, Homo Sapiens; identical to SEQ ID NO: 112086

SEQ ID NO: 117449 - RNA, 64 nt, Homo Sapiens; identical to SEQ ID NO: 112087

SEQ ID NO: 117450 - RNA, 64 nt, Homo Sapiens; identical to SEQ ID NO: 112088

SEQ ID NO: 117451 - RNA, 64 nt, Homo Sapiens; identical to SEQ ID NO: 112089

SEQ ID NO: 117452 - RNA, 64 nt, Homo Sapiens; identical to SEQ ID NO: 112090

SEQ ID NO: 117453 - RNA, 64 nt, Homo Sapiens; identical to SEQ ID NO: 112091

SEQ ID NO: 117454 - RNA, 64 nt, Homo Sapiens; identical to SEQ ID NO: 112092

SEQ ID NO: 117455 - RNA, 64 nt, Homo Sapiens; identical to SEQ ID NO: 112093

SEQ ID NO: 117456 - RNA, 64 nt, Homo Sapiens; identical to SEQ ID NO: 112094

SEQ ID NO: 117457 - RNA, 64 nt, Homo Sapiens; identical to SEQ ID NO: 112095

SEQ ID NO: 117458 - RNA, 64 nt, Homo Sapiens; identical to SEQ ID NO: 112096

SEQ ID NO: 117459 - RNA, 64 nt, Homo Sapiens; identical to SEQ ID NO: 112097

SEQ ID NO: 117460 - RNA, 64 nt, Homo Sapiens; identical to SEQ ID NO: 112098

SEQ ID NO: 117461 - RNA, 64 nt, Homo Sapiens; identical to SEQ ID NO: 112099

SEQ ID NO: 117462 - RNA, 64 nt, Homo Sapiens; identical to SEQ ID NO: 112100

SEQ ID NO: 117463 - RNA, 64 nt, Homo Sapiens; identical to SEQ ID NO: 112101

SEQ ID NO: 117464 - RNA, 64 nt, Homo Sapiens; identical to SEQ ID NO: 112102

SEQ ID NO: 117465 - RNA, 64 nt, Homo Sapiens; identical to SEQ ID NO: 112103

SEQ ID NO: 117466 - RNA, 64 nt, Homo Sapiens; identical to SEQ ID NO: 112104

SEQ ID NO: 117467 - RNA, 64 nt, Homo Sapiens; identical to SEQ ID NO: 112105

SEQ ID NO: 117468 - RNA, 64 nt, Homo Sapiens; identical to SEQ ID NO: 112106

SEQ ID NO: 117469 - RNA, 64 nt, Homo Sapiens; identical to SEQ ID NO: 112107

SEQ ID NO: 117470 - RNA, 64 nt, Homo Sapiens; identical to SEQ ID NO: 112108

SEQ ID NO: 117471 - RNA, 64 nt, Homo Sapiens; identical to SEQ ID NO: 112109

SEQ ID NO: 117472 - RNA, 64 nt, Homo Sapiens; identical to SEQ ID NO: 112110

SEQ ID NO: 117473 - RNA, 64 nt, Homo Sapiens; identical to SEQ ID NO: 112111

SEQ ID NO: 117474 - RNA, 64 nt, Homo Sapiens; identical to SEQ ID NO: 112112

SEQ ID NO: 117475 - RNA, 50 nt, Homo Sapiens; identical to SEQ ID NO: 112113

SEQ ID NO: 117476 - RNA, 64 nt, Homo Sapiens; identical to SEQ ID NO: 112114

SEQ ID NO: 117477 - RNA, 64 nt, Homo Sapiens; identical to SEQ ID NO: 112115

SEQ ID NO: 117478 - RNA, 64 nt, Homo Sapiens; identical to SEQ ID NO: 112116

SEQ ID NO: 117479 - RNA, 64 nt, Homo Sapiens; identical to SEQ ID NO: 112117

SEQ ID NO: 117480 - RNA, 64 nt, Homo Sapiens; identical to SEQ ID NO: 112118

SEQ ID NO: 117481 - RNA, 64 nt, Homo Sapiens; identical to SEQ ID NO: 112119

SEQ ID NO: 117482 - RNA, 64 nt, Homo Sapiens; identical to SEQ ID NO: 112120

SEQ ID NO: 117483 - RNA, 64 nt, Homo Sapiens; identical to SEQ ID NO: 112121

SEQ ID NO: 117484 - RNA, 64 nt, Homo Sapiens; identical to SEQ ID NO: 112122

SEQ ID NO: 117485 - RNA, 64 nt, Homo Sapiens; identical to SEQ ID NO: 112123

SEQ ID NO: 117486 - RNA, 64 nt, Homo Sapiens; identical to SEQ ID NO: 112124

SEQ ID NO: 117487 - RNA, 64 nt, Homo Sapiens; identical to SEQ ID NO: 112125

SEQ ID NO: 117488 - RNA, 64 nt, Homo Sapiens; identical to SEQ ID NO: 112126

SEQ ID NO: 117489 - RNA, 64 nt, Homo Sapiens; identical to SEQ ID NO: 112127

SEQ ID NO: 117490 - RNA, 64 nt, Homo Sapiens; identical to SEQ ID NO: 112128

SEQ ID NO: 117491 - RNA, 64 nt, Homo Sapiens; identical to SEQ ID NO: 112129

SEQ ID NO: 117492 - RNA, 64 nt, Homo Sapiens; identical to SEQ ID NO: 112130

SEQ ID NO: 117493 - RNA, 64 nt, Homo Sapiens; identical to SEQ ID NO: 112131

SEQ ID NO: 117494 - RNA, 64 nt, Homo Sapiens; identical to SEQ ID NO: 112132

SEQ ID NO: 117495 - RNA, 64 nt, Homo Sapiens; identical to SEQ ID NO: 112133

SEQ ID NO: 117496 - RNA, 64 nt, Homo Sapiens; identical to SEQ ID NO: 112134

SEQ ID NO: 117497 - RNA, 64 nt, Homo Sapiens; identical to SEQ ID NO: 112135

SEQ ID NO: 117498 - RNA, 64 nt, Homo Sapiens; identical to SEQ ID NO: 112136

SEQ ID NO: 117499 - RNA, 64 nt, Homo Sapiens; identical to SEQ ID NO: 112137

SEQ ID NO: 117500 - RNA, 64 nt, Homo Sapiens; identical to SEQ ID NO: 112138

SEQ ID NO: 117501 - RNA, 64 nt, Homo Sapiens; identical to SEQ ID NO: 112139

SEQ ID NO: 117502 - RNA, 64 nt, Homo Sapiens; identical to SEQ ID NO: 112140

SEQ ID NO: 117503 - RNA, 64 nt, Homo Sapiens
ucucccuccuuaaauaaagagagggguuaaacaugcccucuaaaaguaggugguuuugaagaga

SEQ ID NO: 117504 - RNA, 64 nt, Homo Sapiens
gcucagguagcacuuuauacucaggcagaucucagcccucuacugagucccuuagccaagcagu

SEQ ID NO: 117505 - RNA, 64 nt, Homo Sapiens
gccuuuggaagaggucuucggagaugccagaggagcccucuagggguccgaugccugggaggac

SEQ ID NO: 117506 - RNA, 64 nt, Homo Sapiens
guccaucugugaaaugaaaggaucagccuggacagcccucuaaacucccuuacagcucucagcc

SEQ ID NO: 117507 - RNA, 64 nt, Homo Sapiens
auggugaaaagcuccaucaaaaccaaugcaagacgcccucuaucaaaagcaacaggccauugug

SEQ ID NO: 117508 - RNA, 64 nt, Homo Sapiens
gccuucagccuuaauggaagaucuugaauacucugcccucuagagggcuuggaccagaucuaac

SEQ ID NO: 117509 - RNA, 64 nt, Homo Sapiens
ccacccacuucuaggccugccagucugacccagugcccucuagggggagagggaggcuuggaga

SEQ ID NO: 117510 - RNA, 64 nt, Homo Sapiens
auuuuuggcuccgagaagaguuuuggggcaugcagcccucuauccuggguccugugccuguccg

SEQ ID NO: 117511 - RNA, 64 nt, Homo Sapiens
gaacaacaaacugucaaaggggauagugcuucuugaccauuauagcauuuauuauacuuuaaug

SEQ ID NO: 117512 - RNA, 64 nt, Homo Sapiens
agcagaccuuauuucucccuucuccauagaccuugaccauuauagggagagcaacuucagggcu

SEQ ID NO: 117513 - RNA, 64 nt, Homo Sapiens
aaaauucugcuguguaauuccuaguuucuauaaugaccauuaaaagaaauaggugaagugcaag

SEQ ID NO: 117514 - RNA, 64 nt, Homo Sapiens
cuaauauaauacuuguucauucagaauaaauugagaccauuaauaacuucaaaguaagauuuug

SEQ ID NO: 117515 - RNA, 64 nt, Homo Sapiens
agagacccugguugguuuuuuuguggaauagcagcaaaucuacauggcagcaaaugccaacauu

SEQ ID NO: 117516 - RNA, 64 nt, Homo Sapiens
agaaauauauacauacagugcaguccacuacagccaaaucuaaaagucccacuugaaccauggc

SEQ ID NO: 117517 - RNA, 64 nt, Homo Sapiens
auaguguacuccaccuuuuacuuuuuuccugagacaaaucuacccuuauucuuucuuccucuuc

SEQ ID NO: 117518 - RNA, 64 nt, Homo Sapiens
uuuaaauagaugaaaauucuaaaugauuuucccucaaaucuaucuagauuauuuuaagaugaga

SEQ ID NO: 117519 - RNA, 64 nt, Homo Sapiens
uggguguaguuguauaugcaauuauauuccaaggcaaaucuaaauuaauauuuaaggccuugaa

SEQ ID NO: 117520 - RNA, 64 nt, Homo Sapiens
ugucuccuuuuuguuggauaaaaauaaguguuuucaaaucuauauuguuguuguugaagacagu

SEQ ID NO: 117521 - RNA, 64 nt, Homo Sapiens
uacaccucaaauucggagaaacaguuaauuugggcaaaucuacaguucuguuuuugcuacucua

SEQ ID NO: 117522 - RNA, 64 nt, Homo Sapiens
auuucuaauuguguugugaaaaugauaaaugcagcaaaucuagcuuucaguauuccuaauuuuu

SEQ ID NO: 117523 - RNA, 64 nt, Homo Sapiens
agugauugcaaacaggcuggauuuggacaaaaagcaaaucuagacaugcauguuucaggguuca

SEQ ID NO: 117524 - RNA, 64 nt, Homo Sapiens
ugaacuagaugguauuccuuauucacuuacauuacaaaucuaagaccaugugauaagcaugacu

SEQ ID NO: 117525 - RNA, 64 nt, Homo Sapiens
gcauagcauaaugagauaucuugggaaugggacccaaaucuaaacacaaaauucauuuauguuu

SEQ ID NO: 117526 - RNA, 64 nt, Homo Sapiens
uuggagcaguucagauuuucagauuagggaugcucaaaucuauauagauauaaaauuauccuca

SEQ ID NO: 117527 - RNA, 64 nt, Homo Sapiens
uuugcuuuucauguagaacucagcaguugacauccaaaucuagccagagcccuucacugccaug

SEQ ID NO: 117528 - RNA, 64 nt, Homo Sapiens
aaauccuuuuaaccauuuuaaccuagauguuuaacaaaucuaaucucuuauucuaauaaauaua

SEQ ID NO: 117529 - RNA, 64 nt, Homo Sapiens
ugaaaacaagucgauuuguaaaaaaaagaaucaccaaaucuauuggaauuuaaaccuguauuua

SEQ ID NO: 117530 - RNA, 64 nt, Homo Sapiens
guugucuuaaaauuguuaauauguugaauccacccaaaucuauuacugucaaugauuuuguauu

SEQ ID NO: 117531 - RNA, 64 nt, Homo Sapiens
cagauagucaucucaguccaaggaucccaaaacacaaaucuagaauugcaaagccagccuuuau

SEQ ID NO: 117532 - RNA, 64 nt, Homo Sapiens
guauuugugugugugugugugugugagcaccugacaaaucuaugaaaccgagugaaaggagaaa

SEQ ID NO: 117533 - RNA, 64 nt, Homo Sapiens
gacuuuugcuuccagcaaguauguuagacuagauauuauaaaacaacuagauccugaauaaaau

SEQ ID NO: 117534 - RNA, 64 nt, Homo Sapiens
aaacauuggaaaguuaagagaguucgagggaagaauuauaaagacuaggaguccuagaaagaga

SEQ ID NO: 117535 - RNA, 64 nt, Homo Sapiens
gaaccaucuuuguucaugaauaggaauauucaagauuauaaagguaucaggucuccuaaaauug

SEQ ID NO: 117536 - RNA, 64 nt, Homo Sapiens
uuuuuuacauauuaaauauguucuacuuaaauauauuauaaaaaauaaaggcaaaguggaauga

SEQ ID NO: 117537 - RNA, 64 nt, Homo Sapiens
ugacuuuauccuggcuauaaacagaaaauuauaaauuauaaauagauuuuuauuaaaaaccugg

SEQ ID NO: 117538 - RNA, 64 nt, Homo Sapiens
auaaauaugacuuuauccugaaccuggacagaaaauuauaaauucauuacugauuuuuauuaaa

SEQ ID NO: 117539 - RNA, 64 nt, Homo Sapiens
uaucuuuagccacagcaaacaagcuuguucauccauuauaaauaauaccucuugguaucuagaa

SEQ ID NO: 117540 - RNA, 64 nt, Homo Sapiens
cuuuauauuucugcuuuguaugcugcuguuuuaaauuauaaaacuucagcaaauuuuuugaaau

SEQ ID NO: 117541 - RNA, 64 nt, Homo Sapiens
cucuucuucuaacuuuuaguaagaggaaaaagggauuauaaaacccuucauaaaucaagaaggc

SEQ ID NO: 117542 - RNA, 64 nt, Homo Sapiens
acauugggcgguuuucuuaauuugaaguauaaaaauuauaaagaguaauuccaaagguauuaaa

SEQ ID NO: 117543 - RNA, 64 nt, Homo Sapiens
cauaugcucagcuauuuuaaagaggaaauuaaauauuauaaaagaaauaguaaagauaaguuau

SEQ ID NO: 117544 - RNA, 64 nt, Homo Sapiens
gaauguuaucaccuguuugucaaagcuuguuuaaauuauaaaacacuuuuaauuauauauauga

SEQ ID NO: 117545 - RNA, 64 nt, Homo Sapiens
aaugucuccguauuugaagaacugagcucuguacauuauaaauuugcuuaaagauuuugauuuu

SEQ ID NO: 117546 - RNA, 64 nt, Homo Sapiens
auuuuuaaaagucuugagcucuucuuaaauauacauuauaaagagcaagcauagauggaaagug

SEQ ID NO: 117547 - RNA, 64 nt, Homo Sapiens
aauaaguaaauguaucaaguuguuuauauaauaaauuauaaaacucuugaggcacuugguaugu

SEQ ID NO: 117548 - RNA, 64 nt, Homo Sapiens
aucuuuaauacaauauagaaauuguguaauaguuauuauaaauguuaauacacaacuuucaggu

SEQ ID NO: 117549 - RNA, 64 nt, Homo Sapiens
guuuugcuaaaauacacuuucaaaugcuaauuucauuauaaauuauguugacaugcuuaauuca

SEQ ID NO: 117550 - RNA, 64 nt, Homo Sapiens
uugcccuucauuacauguuuaaguuguuuuuuuuauuauaaaacacuucccguugaguaaugcc

SEQ ID NO: 117551 - RNA, 64 nt, Homo Sapiens
ccuugcuaauuuaguagugauuguuucaauguuuauuauaaaaguuacacuuugaaaggaaauc

SEQ ID NO: 117552 - RNA, 64 nt, Homo Sapiens
auauucagcccugaguggagggggugggggaugaauuauaaauuagguucuuguguauauuugg

SEQ ID NO: 117553 - RNA, 64 nt, Homo Sapiens
gauaauauauuauuuuuugcguauauauuuuaaaauuauaaauauuguuguuuuugagcuggcu

SEQ ID NO: 117554 - RNA, 64 nt, Homo Sapiens
gccucagcaguuuugcucaauuuucauucuuugaauuauaaaugauguaguaaacuauucuaag

SEQ ID NO: 117555 - RNA, 64 nt, Homo Sapiens
aggggauuauucuuuaguucguguuuuuucuuuuauuauaaacaaaccaucauuauauucuuuc

SEQ ID NO: 117556 - RNA, 64 nt, Homo Sapiens
gcacuggcuucuauauuuuauuucauauuuaugaauuauaaauaugaauuuaauuacuaaagaa

SEQ ID NO: 117557 - RNA, 64 nt, Homo Sapiens
uguacuguuuagaaauauacauauuuuauacaaaauuauaaagaaagcauagagagguaagcau

SEQ ID NO: 117558 - RNA, 64 nt, Homo Sapiens
aucuguuaucccaaucauuguugccucuccguuuauuauaaacuguaugcucacaacuuagugu

SEQ ID NO: 117559 - RNA, 64 nt, Homo Sapiens
auaagagcaugaaauuuuuaaaaauacacuugugauuauaaaauuaaucacaaauuucacuuau

SEQ ID NO: 117560 - RNA, 64 nt, Homo Sapiens
auuaaauucaauacauacugguuucagauaaaacauuauaaaaccaaauuacuugcaguucuga

SEQ ID NO: 117561 - RNA, 64 nt, Homo Sapiens
guauaugucuaugaagcuuccaucuaaugaaugaauuauaaaauggcugggaccuauccccuca

SEQ ID NO: 117562 - RNA, 64 nt, Homo Sapiens
cagagcuuuauuauccugacaggacauauaaaagauuauaaauauuaagcauaauagccacaau

SEQ ID NO: 117563 - RNA, 64 nt, Homo Sapiens
cagaacauacauguaccaguagagaaaaauauacauuauaaaaguuggauaugaaaaacagaag

SEQ ID NO: 117564 - RNA, 64 nt, Homo Sapiens
caccugucacuaccagaacccuugauucaacuugauuauaaauacuguauuucuucuugucacu

SEQ ID NO: 117565 - RNA, 64 nt, Homo Sapiens
auguuaauaccuauaaaauauugaacauuuccaaauuauaaacuuuuuuuuuguaaccaugaaa

SEQ ID NO: 117566 - RNA, 64 nt, Homo Sapiens
aaaaagcucucuugaaucuagguagcaugaacaaauuauaaaauuuguuuaaaaaagcaaacuu

SEQ ID NO: 117567 - RNA, 64 nt, Homo Sapiens
ucgcacaagugguuuauggaguguuuggauuguaauuauaaaugguucuuugauaugcaaauua

SEQ ID NO: 117568 - RNA, 64 nt, Homo Sapiens
uaugacauaagcaaucauuuuaugcuguuuaugaauuauaaauguguuuauagcucauuuguaa

SEQ ID NO: 117569 - RNA, 64 nt, Homo Sapiens
aaaacauuauauguauacaucaguauaguguuuuauuauaaagccaauuaucugauuaagcauu

SEQ ID NO: 117570 - RNA, 64 nt, Homo Sapiens
uacugacagaaguuauuuccaaguuuguguauauauuauaaaaauuacauauauaaaacuaagg

SEQ ID NO: 117571 - RNA, 64 nt, Homo Sapiens
uaauagcuacguuugggaaggaggaaacauuuaaauuauaaaggacugaauaaucuaaaaagca

SEQ ID NO: 117572 - RNA, 64 nt, Homo Sapiens
aucuuauuaccuauaacuauuaauuuuucauagaauuauaaaugucauuugacuaugucaaucu

SEQ ID NO: 117573 - RNA, 64 nt, Homo Sapiens
auaaaauuucuuagagaacaauuucagaggaaagauuauaaaauagauuccaugucuuucucau

SEQ ID NO: 117574 - RNA, 64 nt, Homo Sapiens
uaaaaauuuaucaacauuccgcagcaauauugauauuauaaagauguugcaccaggcugagaaa

SEQ ID NO: 117575 - RNA, 64 nt, Homo Sapiens
agggaaugaaugaaugaauagcuaugauauauuuauuauaaaauuauccucucauuuuuucacu

SEQ ID NO: 117576 - RNA, 64 nt, Homo Sapiens
uuucucaaaauaaaaaaacaguggagccauuuuuauuauaaaacggaaaaucauuauuuuaggu

SEQ ID NO: 117577 - RNA, 64 nt, Homo Sapiens
acucuguauuaguuuccuaguuuaauuuuuauuaauuauaaaaaaaaaucauuccaaauaagag

SEQ ID NO: 117578 - RNA, 64 nt, Homo Sapiens
ugaauuuugcagacuaaauugauaaguuacuucaauuauaaaauuucuuaauucuuacaauggu

SEQ ID NO: 117579 - RNA, 64 nt, Homo Sapiens
cucggguucaaagcuggauuuugaacugaagaagauuauaaaauuauuuauuguuauuauaaac

SEQ ID NO: 117580 - RNA, 64 nt, Homo Sapiens
ugaacugaagaagauuauaaaauuauuuauuguuauuauaaacaaaauuaacccuuugaauacu

SEQ ID NO: 117581 - RNA, 64 nt, Homo Sapiens
ucuauugacauccuuuuguuuucuaauuuuaaaaauuauaaagauguaaauggaauuauaaaua

SEQ ID NO: 117582 - RNA, 64 nt, Homo Sapiens
uucuaauuuuaaaaauuauaaagauguaaauggaauuauaaauacugugaccuaagaaaagacc

SEQ ID NO: 117583 - RNA, 64 nt, Homo Sapiens
cucaugaucagaaaauaguagaguugauuucaagauuauaaauaucaagaccacaaauaaucaa

SEQ ID NO: 117584 - RNA, 64 nt, Homo Sapiens
uugaugaaauucuuacaauugagguguuuauaaaauuauaaaauguacuucacaggaauauugu

SEQ ID NO: 117585 - RNA, 64 nt, Homo Sapiens
aauaaaauacuucuucugucguuuacaaaaugauauuauaaauaaaaaagugcacagugugauu

SEQ ID NO: 117586 - RNA, 64 nt, Homo Sapiens
aauguuuucguggcauguaaacuguauauuuaaaauuauaaauuucuuuuuauaacuauguuuu

SEQ ID NO: 117587 - RNA, 64 nt, Homo Sapiens
aauaauuauaucaucuauauuaguauuauaaaauauuauaaaguaaaauuaaugaauaccauau

SEQ ID NO: 117588 - RNA, 64 nt, Homo Sapiens
auuauaaaguaauaauuauaaauaccauauuaguauuauaaaauaacuuccaacaaaauuaaug

SEQ ID NO: 117589 - RNA, 64 nt, Homo Sapiens
uuguuggacuuggcauguuuccaugaacugcacuauuauaaacuauuaaaaugauagauugugg

SEQ ID NO: 117590 - RNA, 64 nt, Homo Sapiens
acgcucccccuaucccuaccccacaagccuuucgauuauaaaauacuaccaaucuuguuauaag

SEQ ID NO: 117591 - RNA, 64 nt, Homo Sapiens
aaaaauuagacacacuuuaaaccuucaaacagguauuauaaauaacaugugacuccuuaaugga

SEQ ID NO: 117592 - RNA, 64 nt, Homo Sapiens
uuugaagaauuacaaaucagaagaaaaagcaagcauuauaaacaaaacuaauaacuguuuuacu

SEQ ID NO: 117593 - RNA, 64 nt, Homo Sapiens
uaaagcaguaaucuuuaacuguagcauuccucuaauuauaaacagugaaaaaucaaaaucaguc

SEQ ID NO: 117594 - RNA, 64 nt, Homo Sapiens
ggccauggugaaaaauaguuuuugaaaacaucagauuauaaaaucaagauaguccggacgcggu

SEQ ID NO: 117595 - RNA, 64 nt, Homo Sapiens
gcacuuuaauuuggcaagccauuuuuccuguuuuauuauaaaucuauauuagauguuugaauau

SEQ ID NO: 117596 - RNA, 64 nt, Homo Sapiens
ugauuguaauaauucuuucccauaagucuguaguauuauaaaacauuccuagauauggaggaaa

SEQ ID NO: 117597 - RNA, 64 nt, Homo Sapiens
uggcuuuuaauggcuuaaacgaguuaucagacagauuauaaaaauuccuuuucuuaauugccca

SEQ ID NO: 117598 - RNA, 64 nt, Homo Sapiens
agucaccuaucaccuuuaaacgccuuuuuuuaaaauuauaaaauauuguaaagcagggucucaa

SEQ ID NO: 117599 - RNA, 64 nt, Homo Sapiens
uuuuauucauucaaauguauuuuuucuugugcauauuauaaaaauauauuuuaugagcucuuac

SEQ ID NO: 117600 - RNA, 64 nt, Homo Sapiens
ccaacauaugccgugaccuaaggagaaaucccaaauuauaaaagaauagggugggucaucaauu

SEQ ID NO: 117601 - RNA, 64 nt, Homo Sapiens
uagcaauucuugcucuaucaaguccaacaugcuuauuauaaacaucuaauaaaugaugaaauuc

SEQ ID NO: 117602 - RNA, 64 nt, Homo Sapiens
guacagcagaaaauauaccaugugucaaauuauaauuauaaaaguauuuuauuuuuuaguuauu

SEQ ID NO: 117603 - RNA, 64 nt, Homo Sapiens
uuuagcuuacuaaauauuugaauaguaucaacacauuauaaauaauguuaggaacaaaagacaa

SEQ ID NO: 117604 - RNA, 64 nt, Homo Sapiens
uuuacugaagggaacaucaaaauauuaaugguauauuauaaaauaaagacuuucuuaaaggaaa

SEQ ID NO: 117605 - RNA, 64 nt, Homo Sapiens
gacuguugucauucuggagguccuauuagagaauauuauaaaagggugaccuuguaggaaggau

SEQ ID NO: 117606 - RNA, 64 nt, Homo Sapiens
uagcaacucuggauauuuuuauaaaacuaguuacauuauaaacgguuucaaacauguuuaauuu

SEQ ID NO: 117607 - RNA, 64 nt, Homo Sapiens
aguaggaaaaaaagaaucugaaagauacaaagugauuauaaaagaauugacaggacaauaaaua

SEQ ID NO: 117608 - RNA, 64 nt, Homo Sapiens
aagaagguucacauaaauagcuucuggagugcaaauuauaaagacaucaacauuuuugaucaua

SEQ ID NO: 117609 - RNA, 64 nt, Homo Sapiens
caagaaaugauacauaaucauucucuuuaagacaauuauaaauuggauggagcuauuauucacu

SEQ ID NO: 117610 - RNA, 64 nt, Homo Sapiens
gcuauuauucacuacuucuuuucuuaguuugaaaauuauaaacaaauuuuaagcuuuauucaaa

SEQ ID NO: 117611 - RNA, 64 nt, Homo Sapiens
uagaaguguauuuucaguggcccuacugucuugcauuauaaaauacaugggcuccuauuuuuuc

SEQ ID NO: 117612 - RNA, 64 nt, Homo Sapiens
uuuuuguuuguaauuucaggauauauacuguaaaauuauaaauuauuuuuuuaaaaaaaauucu

SEQ ID NO: 117613 - RNA, 64 nt, Homo Sapiens
agauaaaugcuguggcuccuggaguaccaaagaaauuauaaacaaaccugugcucuaaacagug

SEQ ID NO: 117614 - RNA, 64 nt, Homo Sapiens
uugaauuucuacaaauggugugcuauagcaagcuauuauaaaacgugacuaauuuaucuauagc

SEQ ID NO: 117615 - RNA, 64 nt, Homo Sapiens
agagaacuguuuucucccugugugaauagauuuuauuauaaaucaaguaacuacaaauaagugu

SEQ ID NO: 117616 - RNA, 64 nt, Homo Sapiens
uaacuacaaauaaguguugucuugaauauuaucuauuauaaaagcuugaagcacuuuaauauaa

SEQ ID NO: 117617 - RNA, 64 nt, Homo Sapiens
ccuuaucuuuacccuuugggaacuaaauccauuuauuauaaaugggaugugaauauauguggaa

SEQ ID NO: 117618 - RNA, 64 nt, Homo Sapiens
caagugaggaauaaauagcagugacccaaacaggauuauaaaguuuccauagcaacuaaucaua

SEQ ID NO: 117619 - RNA, 64 nt, Homo Sapiens
gaucugauuacacuggacacagggucaauaacccauuauaaaauggugguucuaaaggacaccu

SEQ ID NO: 117620 - RNA, 64 nt, Homo Sapiens
auagcuuccugguucuguguuguaucaacauuucauuauaaauugcugcaguagcuuuuaagua

SEQ ID NO: 117621 - RNA, 64 nt, Homo Sapiens
caaaacagguucagauuucacaaccguacaucaaauuauaaaugauuacaucccuauuuauguu

SEQ ID NO: 117622 - RNA, 64 nt, Homo Sapiens
uaugaccuuuuuaaaucaacauuucuguggaauaauuauaaaaguuuugugauuuaauaauacu

SEQ ID NO: 117623 - RNA, 64 nt, Homo Sapiens
augguuuuguuuuuuuuuuuucagcccaucucuaauuauaaaacauuauuauuucagaacuagc

SEQ ID NO: 117624 - RNA, 64 nt, Homo Sapiens
gaugaaauuuuuuaaagauacaaccaugauaaccauuauaaaugaucuaugaucaaaaucuaaa

SEQ ID NO: 117625 - RNA, 64 nt, Homo Sapiens
uaaauuagacucuauuuugaauuaaaagaguuuuauuauaaaccguguguuuuugguuuuucua

SEQ ID NO: 117626 - RNA, 64 nt, Homo Sapiens
ccuguaucguggaccuuuugauaacauauagccuauuauaaaucguuccccugggauucugaau

SEQ ID NO: 117627 - RNA, 64 nt, Homo Sapiens
uuacaaaaacauaauucuggucauuauuaccucaauuauaaauauucauaguuuaagucuuuua

SEQ ID NO: 117628 - RNA, 64 nt, Homo Sapiens
aaggaguggauucuuaaauacacauucccgucacauuauaaauggucuuccacuaugucagagc

SEQ ID NO: 117629 - RNA, 64 nt, Homo Sapiens
ccacucuugagaaguaauuucuuuaucccauuuaauuauaaaaaugugauaacuacuuuuuaua

SEQ ID NO: 117630 - RNA, 64 nt, Homo Sapiens
augacuauuccuaaggccauuuaauaaaaucuuuauuauaaaccuuauuuauuuuaacacuuuu

SEQ ID NO: 117631 - RNA, 64 nt, Homo Sapiens
agcuagugaaagaccucagauuuuuuaauauaggauuauaaaucagacugcagacuauagauuu

SEQ ID NO: 117632 - RNA, 64 nt, Homo Sapiens
aaauuucauaguaauaguaacuuuauaaaauaauauuauaaaauacaggauuuaaaccuuucua

SEQ ID NO: 117633 - RNA, 64 nt, Homo Sapiens
uagucccagcuacuugggagguggaggugggaggauuauaaauagagacuuuccuuaagacuuu

SEQ ID NO: 117634 - RNA, 64 nt, Homo Sapiens
ugaagugucaaaaaaucucaauaauuucuugauaauuauaaaaauuuuaauaauuauaaaauua

SEQ ID NO: 117635 - RNA, 64 nt, Homo Sapiens
uaauaauuucuugauaauuagguagcuuuuaauaauuauaaaauaugcaaagccugaagacacu

SEQ ID NO: 117636 - RNA, 64 nt, Homo Sapiens
cuaaaauuaguaucaguauugcuauuuaagguaaauuauaaaaccuuuuaauacccauuuauug

SEQ ID NO: 117637 - RNA, 64 nt, Homo Sapiens
caauaauaauaugcaaacagaacuaugggaguguauuauaaaauuauaccuaaguguuuuuuua

SEQ ID NO: 117638 - RNA, 64 nt, Homo Sapiens
uuauuuuagcaaaucaguauauuuucuguauuuaauuauaaaaaauuaacuuaguuuuuaaaau

SEQ ID NO: 117639 - RNA, 64 nt, Homo Sapiens
uaucuacaaagaaaaauuaauuaggaauuacuuuauuauaaaaugcuccuagaagucuuaauug

SEQ ID NO: 117640 - RNA, 64 nt, Homo Sapiens
aaaaggauuauguauuuuuaauuucuuuuauugcauuauaaaaucuguguaugugauguuguua

SEQ ID NO: 117641 - RNA, 64 nt, Homo Sapiens
aaaagcaugugaaagugcacuuuguuguuuguuuauuauaaacaauugcaacaaaguuaggaag

SEQ ID NO: 117642 - RNA, 64 nt, Homo Sapiens
cguugccuccuugguuucagaagagaguaguuuuauuauaaauauuguauggacuuuguauauu

SEQ ID NO: 117643 - RNA, 64 nt, Homo Sapiens
agacauuuuauguauuauuucgauuuacuuccuaauuauaaaagcugcuuuuuugcagaacauu

SEQ ID NO: 117644 - RNA, 64 nt, Homo Sapiens
caauuugaguaaaauuuaaagggaagucauagggauuauaaauuucuuuuguuauguauaugua

SEQ ID NO: 117645 - RNA, 64 nt, Homo Sapiens
uauuuuuauuuuuuaguaauuauuugucuugcacauuauaaauaaacauuuuauguucaaucca

SEQ ID NO: 117646 - RNA, 64 nt, Homo Sapiens
ugaauuuggaaaaacauuuuuucaaaaacuacaaauuauaaaacaccaaaguguucauacuaaa

SEQ ID NO: 117647 - RNA, 64 nt, Homo Sapiens
uacuucuaugaaauaauaugcagucuauuuuuaaauuauaaauuaugugugaacuuagcuuuuc

SEQ ID NO: 117648 - RNA, 64 nt, Homo Sapiens
agaaauaccauauacauagauggaaaaacccaguauuauaaaaaccucaauucugaaaaucuau

SEQ ID NO: 117649 - RNA, 64 nt, Homo Sapiens
ucaacuaagaauuuucuaggaucuuucaaaaaugauuauaaaauucaugugaaauagaagugua

SEQ ID NO: 117650 - RNA, 64 nt, Homo Sapiens
acucagagaaacauuuauuucggcuugcugguuuauuauaaaagcaagguuuauuauaaaagau

SEQ ID NO: 117651 - RNA, 64 nt, Homo Sapiens
uucggcuugcugguuuauuauaaaagcaagguuuauuauaaaagauacuacaaaggauacagau

SEQ ID NO: 117652 - RNA, 64 nt, Homo Sapiens
auacagaaggagagauagauugaaaaugugucacauuauaaacaacuuucccuagucaaugcuc

SEQ ID NO: 117653 - RNA, 64 nt, Homo Sapiens
auacggaaggggagauagguaugugucacauuauauuauaaacacccuagucagugcucugaag

SEQ ID NO: 117654 - RNA, 64 nt, Homo Sapiens
cacgucuugucagauuucauaaauuauuuuuagaauuauaaauuuaugcuuucucucugcugug

SEQ ID NO: 117655 - RNA, 64 nt, Homo Sapiens
gauuucccaugccauaauuuagugugacuuuaauauuauaaaaugucacagcuuaaaaacauuc

SEQ ID NO: 117656 - RNA, 64 nt, Homo Sapiens
ugaugucuaaaaguuuccagugauuuauuaccacauuauaaacaucauguauaggcagucugca

SEQ ID NO: 117657 - RNA, 64 nt, Homo Sapiens
ugucaaauuuuuuuucuuagaaguagucuucauuauuauaaauuuguacaccaaaaggccaugg

SEQ ID NO: 117658 - RNA, 64 nt, Homo Sapiens
aggacugguuccuggacccauuccauuaaacuacauuauaaaccuuguugccuucacccuucag

SEQ ID NO: 117659 - RNA, 64 nt, Homo Sapiens
agauucucuacaguaagcauguguuacauuuguaauuauaaaaguaaguaaacuucauuuauga

SEQ ID NO: 117660 - RNA, 64 nt, Homo Sapiens
auaaacagauauauaaagauguacuuuaaaguuuauuauaaaauuggcuaaauaucuguugcau

SEQ ID NO: 117661 - RNA, 64 nt, Homo Sapiens
cauguguauauauaugcaaaugcaugucuauauaauuauaaaugguuugaaaugugcauagaua

SEQ ID NO: 117662 - RNA, 64 nt, Homo Sapiens
aauaaagggaagaaaggagguuuuagaaacggacagcuuauaaacaagugcaaaagaaaaaaca

SEQ ID NO: 117663 - RNA, 64 nt, Homo Sapiens
ugacacugcagcagaaaggccucuuguucaugucagcuuauaugcucccuuugugugcauacgc

SEQ ID NO: 117664 - RNA, 64 nt, Homo Sapiens
gugagaacacauuuagucaguuuauuuuuaugccagcuuauauuugugauaauagagaauuuua

SEQ ID NO: 117665 - RNA, 64 nt, Homo Sapiens
ucucaaaauucauauuguuaaauagcuaguugacagcuuauacuaauaucuauuccguauuaga

SEQ ID NO: 117666 - RNA, 64 nt, Homo Sapiens; identical to SEQ ID NO: 38403

SEQ ID NO: 117667 - RNA, 64 nt, Homo Sapiens; identical to SEQ ID NO: 38404

SEQ ID NO: 117668 - RNA, 64 nt, Homo Sapiens; identical to SEQ ID NO: 38405

SEQ ID NO: 117669 - RNA, 64 nt, Homo Sapiens; identical to SEQ ID NO: 38406

SEQ ID NO: 117670 - RNA, 64 nt, Homo Sapiens; identical to SEQ ID NO: 38407

SEQ ID NO: 117671 - RNA, 64 nt, Homo Sapiens; identical to SEQ ID NO: 38408

SEQ ID NO: 117672 - RNA, 64 nt, Homo Sapiens; identical to SEQ ID NO: 38409

SEQ ID NO: 117673 - RNA, 64 nt, Homo Sapiens; identical to SEQ ID NO: 38410

SEQ ID NO: 117674 - RNA, 64 nt, Homo Sapiens; identical to SEQ ID NO: 38411

SEQ ID NO: 117675 - RNA, 64 nt, Homo Sapiens; identical to SEQ ID NO: 38412

SEQ ID NO: 117676 - RNA, 64 nt, Homo Sapiens; identical to SEQ ID NO: 38413

SEQ ID NO: 117677 - RNA, 64 nt, Homo Sapiens; identical to SEQ ID NO: 38414

SEQ ID NO: 117678 - RNA, 64 nt, Homo Sapiens; identical to SEQ ID NO: 38415

SEQ ID NO: 117679 - RNA, 64 nt, Homo Sapiens; identical to SEQ ID NO: 38416

SEQ ID NO: 117680 - RNA, 64 nt, Homo Sapiens; identical to SEQ ID NO: 38417

SEQ ID NO: 117681 - RNA, 64 nt, Homo Sapiens; identical to SEQ ID NO: 38418

SEQ ID NO: 117682 - RNA, 64 nt, Homo Sapiens; identical to SEQ ID NO: 38419

SEQ ID NO: 117683 - RNA, 64 nt, Homo Sapiens; identical to SEQ ID NO: 38420

SEQ ID NO: 117684 - RNA, 64 nt, Homo Sapiens; identical to SEQ ID NO: 38421

SEQ ID NO: 117685 - RNA, 64 nt, Homo Sapiens; identical to SEQ ID NO: 38422

SEQ ID NO: 117686 - RNA, 64 nt, Homo Sapiens; identical to SEQ ID NO: 38423

SEQ ID NO: 117687 - RNA, 64 nt, Homo Sapiens; identical to SEQ ID NO: 38424

SEQ ID NO: 117688 - RNA, 64 nt, Homo Sapiens; identical to SEQ ID NO: 38425

SEQ ID NO: 117689 - RNA, 64 nt, Homo Sapiens; identical to SEQ ID NO: 38426

SEQ ID NO: 117690 - RNA, 64 nt, Homo Sapiens; identical to SEQ ID NO: 38427

SEQ ID NO: 117691 - RNA, 64 nt, Homo Sapiens; identical to SEQ ID NO: 38428

SEQ ID NO: 117692 - RNA, 64 nt, Homo Sapiens; identical to SEQ ID NO: 38429

SEQ ID NO: 117693 - RNA, 64 nt, Homo Sapiens; identical to SEQ ID NO: 38430

SEQ ID NO: 117694 - RNA, 64 nt, Homo Sapiens; identical to SEQ ID NO: 38431

SEQ ID NO: 117695 - RNA, 64 nt, Homo Sapiens; identical to SEQ ID NO: 38432

SEQ ID NO: 117696 - RNA, 64 nt, Homo Sapiens; identical to SEQ ID NO: 38433

SEQ ID NO: 117697 - RNA, 64 nt, Homo Sapiens; identical to SEQ ID NO: 38434

SEQ ID NO: 117698 - RNA, 64 nt, Homo Sapiens; identical to SEQ ID NO: 38435

SEQ ID NO: 117699 - RNA, 64 nt, Homo Sapiens; identical to SEQ ID NO: 38436

SEQ ID NO: 117700 - RNA, 64 nt, Homo Sapiens
uuaacaaugaagauuucauggacauccuacacuucaggauuacuugacuaucucaaacacauaa

SEQ ID NO: 117701 - RNA, 64 nt, Homo Sapiens
uaaccaguugaucucugugccaaauacauuauaucaggauuacacaaaaaguaucacaaaggau

SEQ ID NO: 117702 - RNA, 64 nt, Homo Sapiens
agauuccacugauugacauuugauaaauaaacaucaggauuauguuuauuguuuguuuucaguc

SEQ ID NO: 117703 - RNA, 64 nt, Homo Sapiens
cccaucuaaauuucuugaguuccugaauuuugaacaggauuaccuggagccuggagccacuuua

SEQ ID NO: 117704 - RNA, 64 nt, Homo Sapiens
cuaauaccaaagccaggcaaucauuuugugaggccaggauuacccagggauaacacuucccaaa

SEQ ID NO: 117705 - RNA, 64 nt, Homo Sapiens
aaggaaucaggauuuagccugaucuguacuguuucaggauuacaagaauggaaaaggagucuga

SEQ ID NO: 117706 - RNA, 64 nt, Homo Sapiens
auccagauuguuuuuaccacaugaugacgugacucaggauuaaauccugagcuacaguuucaaa

SEQ ID NO: 117707 - RNA, 64 nt, Homo Sapiens
caaugcuguuaaacaugguaagacugagguucugcaggauuaaagucagauuaaggguacagaa

SEQ ID NO: 117708 - RNA, 64 nt, Homo Sapiens
gaaagucaauaaaauagauaauuuaacaaaaguacaggauuagaacaugcuuauaccuauaaau

SEQ ID NO: 117709 - RNA, 64 nt, Homo Sapiens
augucaugaaggcuugaggucagccuacagauaacaggauuauuacaaggaugaauuuccacuu

SEQ ID NO: 117710 - RNA, 64 nt, Homo Sapiens
agggaagauacauacauauaugagguacaguuuuugaauguacugguaaugccuaauguggucu

SEQ ID NO: 117711 - RNA, 64 nt, Homo Sapiens
uaaaaacuuguauaguugucuagauuucugcaccugaauguauguuugaugcuuugauuugaaa

SEQ ID NO: 117712 - RNA, 64 nt, Homo Sapiens
aaaagggcuuauucuuccucgucuguugaaggccugaauguaacauguggguggaccccgucca

SEQ ID NO: 117713 - RNA, 64 nt, Homo Sapiens
uaaccugagcccucuccauuucccaugaaaagggugaauguauaccaccucaggccucacacuu

SEQ ID NO: 117714 - RNA, 64 nt, Homo Sapiens
cccuggcgacaguugagaccuccuggugugaagaugaauguaaaugaagaugaaugaauguaac

SEQ ID NO: 117715 - RNA, 64 nt, Homo Sapiens
uccuggugugaagaugaauggaugugaagaugaaugaauguaacccacggcagagagcagcgcc

SEQ ID NO: 117716 - RNA, 64 nt, Homo Sapiens
guuuaagauauguuuggugaccaaaacguaugugugaauguaguuauaaugcuuuugaaaaauu

SEQ ID NO: 117717 - RNA, 64 nt, Homo Sapiens
cagauuuagauucuuccuggggauuacacagcuaugaauguauuugcuucuaaaaccucccaaa

SEQ ID NO: 117718 - RNA, 64 nt, Homo Sapiens
uggaaaaccccuaaaaauccaugaccaggcucuaugaauguacagcucuaugaauguacaugga

SEQ ID NO: 117719 - RNA, 64 nt, Homo Sapiens
uggaaugaccaggcucuaugcugaccaggcucuaugaauguacagcaacaaggacuccucgcug

SEQ ID NO: 117720 - RNA, 64 nt, Homo Sapiens
uuacauagcacuugauacguguuaaaugaacauaugaauguaauuuauauauuccuagaauuua

SEQ ID NO: 117721 - RNA, 64 nt, Homo Sapiens
uagcagcucaauuuguacuacuucagccaaucugugaauguaaaaacuacacuguugccuugcu

SEQ ID NO: 117722 - RNA, 64 nt, Homo Sapiens
caggagaggaacugcauaacugaagaaguaucucugaauguaucagcgcaucaccugaaugucg

SEQ ID NO: 117723 - RNA, 64 nt, Homo Sapiens
guacacuuucaauccuccccccacgucccccgcaugaauguacugccaugcacccgcccagcca

SEQ ID NO: 117724 - RNA, 64 nt, Homo Sapiens
auuugauccucauuguguuccagguguccugauuugaauguacugauaucuuuguccauauacc

SEQ ID NO: 117725 - RNA, 64 nt, Homo Sapiens
aacuuacugugggcauuuacaugcgguuuggaaaugaauguagauugcugucuuuuuacacugu

SEQ ID NO: 117726 - RNA, 64 nt, Homo Sapiens
aaggaaucauuggugaacuuuccaagguuauuucugaauguaacaauuuccuuaaaaaugacuu

SEQ ID NO: 117727 - RNA, 64 nt, Homo Sapiens
agaauagauuaauaaauuggcuauguuguuccaaugaauguacagcacuuccauuaacuuuuga

SEQ ID NO: 117728 - RNA, 64 nt, Homo Sapiens
aagaugaauauauuccuuacuucaaccaagauuuugaauguaauaaacuuuauaaucgucauug

SEQ ID NO: 117729 - RNA, 64 nt, Homo Sapiens
uauuuucuaaacacuuuacucacacugcccacaaugaauguaacggcaaauaagaauguuugag

SEQ ID NO: 117730 - RNA, 64 nt, Homo Sapiens
guugaaaagucugguuuacuauagauacauguuuugaauguaaacuaucagaaauuguaagaga

SEQ ID NO: 117731 - RNA, 64 nt, Homo Sapiens
aucaguaguguuuacaagaucuaagaauacaguuugaauguauaccuaguaagugccacuucca

SEQ ID NO: 117732 - RNA, 64 nt, Homo Sapiens
aauacauuaaauuuuuaaaauauucuacuggaaaugaauguaauaugugauagugccgugaaug

SEQ ID NO: 117733 - RNA, 64 nt, Homo Sapiens
cuacuggaaaugaauguaauaugugauagugccgugaauguauuccaguucaaaagaauaguag

SEQ ID NO: 117734 - RNA, 64 nt, Homo Sapiens
gauuuagaaaauauauauaaaacaaguuaaaaacugaauguacucuucuguuugugaagaaaaa

SEQ ID NO: 117735 - RNA, 64 nt, Homo Sapiens
agaaguguacugaagggacuccacuuauaugaauugaauguaucaaaaacacacauucagccaa

SEQ ID NO: 117736 - RNA, 64 nt, Homo Sapiens
aacacuuaaaucuaacagaggauuuucagaguagugaauguaaggaaagcuuaauggaucucuc

SEQ ID NO: 117737 - RNA, 64 nt, Homo Sapiens
agcaucaaagaauucacacaggagagaaagcacaugaauguaaugaauguggaaaagcuuucag

SEQ ID NO: 117738 - RNA, 64 nt, Homo Sapiens
agcaucacaaaaugcauaggaaagagaaaucguaugaauguaaugaguaugagggcaguuucag

SEQ ID NO: 117739 - RNA, 64 nt, Homo Sapiens
ucaacaucagagcauucauaccaaagagaacucaugaauguaaugaagaugggaagauauuuau

SEQ ID NO: 117740 - RNA, 64 nt, Homo Sapiens
gcuuauauugacaacaaaucaucucgcuaaagagugaauguaggccaggcgcgguggcucaugc

SEQ ID NO: 117741 - RNA, 64 nt, Homo Sapiens
cgucucaaaaaaaaaaaaaaaaaaaaaaaaagagugaauguaauagucuugcagaaaaugaaug

SEQ ID NO: 117742 - RNA, 64 nt, Homo Sapiens
acaccuugacauuucuuuuuccugauuguuuauaugaauguagauuuacaauuucaaauguuac

SEQ ID NO: 117743 - RNA, 64 nt, Homo Sapiens
cgggaggacaagggcuuccacuuggagaaacauaugaauguauugcaagccauuuaauccgguu

SEQ ID NO: 117744 - RNA, 64 nt, Homo Sapiens
ggggggaucgaaaagaagguuaagucuccuuuacugaauguaaguuugggauacuaaaguaguu

SEQ ID NO: 117745 - RNA, 64 nt, Homo Sapiens
uugguugcugauguuuauaaauuggucuuaauguugaauguauuggaccuagcuguuguaaaga

SEQ ID NO: 117746 - RNA, 64 nt, Homo Sapiens
agcucugugaaucagaccagguuauuuugagucaugaauguacaucauuuggguuugagggugu

SEQ ID NO: 117747 - RNA, 64 nt, Homo Sapiens
cuuucaguacgagacaaagugaccugacccacacugaauguagucguucuggcuaacacuguug

SEQ ID NO: 117748 - RNA, 64 nt, Homo Sapiens
cagguaaauugucgggggagagaguuagcauguaugaauguaaggaugagggaagcgaagcaag

SEQ ID NO: 117749 - RNA, 64 nt, Homo Sapiens
aagugcccacauuugauggaggguggaaauaauuugaauguauuugauuuauaaguuuuuuuuu

SEQ ID NO: 117750 - RNA, 64 nt, Homo Sapiens
aaucuguugucauguuaguaaaugauuugaaaacugaauguaauacuugaguagauuuuuuuuu

SEQ ID NO: 117751 - RNA, 64 nt, Homo Sapiens
gacauagaguaaacaucuuaguaauauauuaaagugaauguaaauggugguuaaaauuacauua

SEQ ID NO: 117752 - RNA, 64 nt, Homo Sapiens
cuucuaaccccaguagaguagaacuaaauugcacugaauguauaguuaacucugucuugaauuc

SEQ ID NO: 117753 - RNA, 64 nt, Homo Sapiens
auaauuuuuugucauuugucuuuauguccagcuaugaauguagauuuugugucccgacagcccu

SEQ ID NO: 117754 - RNA, 64 nt, Homo Sapiens
aacaccagugaauuuacacugcaaagaaaaacuaugaauguauggaauuuuuuaaaaagaagua

SEQ ID NO: 117755 - RNA, 64 nt, Homo Sapiens
aauacucuuguaggagaaaaagcaacuguauaaaugaauguagagugacuuucugcaauauuuc

SEQ ID NO: 117756 - RNA, 64 nt, Homo Sapiens
cgacauuaugggcuuauuuauaaaauaaaaauucugaauguacaguuacucugguucuuuguuu

SEQ ID NO: 117757 - RNA, 64 nt, Homo Sapiens
ugcacugucacuuugcucugcacacuugagaggaugaauguaugagucaaugugcaguguagcc

SEQ ID NO: 117758 - RNA, 64 nt, Homo Sapiens
cauaaaggaauccaaagcuucuuuuaacaugucuugaauguacagguuuauuuugaugaaaguu

SEQ ID NO: 117759 - RNA, 64 nt, Homo Sapiens
auggucccauuucaauuuccuuaggagaaaaugcugaauguaagacagagcuauguaaagggac

SEQ ID NO: 117760 - RNA, 64 nt, Homo Sapiens
auaaguacccaugauuucuauaaugccuuccaucugaauguaaauuuuuuuaauacauauccaa

SEQ ID NO: 117761 - RNA, 64 nt, Homo Sapiens
guaaauaaguaacuuugacuguugcacgaaggcaugaauguauuuggcuacgcagggaugggca

SEQ ID NO: 117762 - RNA, 64 nt, Homo Sapiens
uuuuacugugaagcuaucugaccuauuaguauugugaauguagaauaauuuguuaacacuagaa

SEQ ID NO: 117763 - RNA, 64 nt, Homo Sapiens
cagggauaugcguauaguuuuguaguuuaaugauugaauguagaugccauuuuaccagcauuau

SEQ ID NO: 117764 - RNA, 64 nt, Homo Sapiens
cauuagggcuugcagacaaugucaccuaaauugcugaauguacucauuauaauaugauaucuga

SEQ ID NO: 117765 - RNA, 64 nt, Homo Sapiens
cuuugcaguaaguaucauguaaauaugcaaauguugaauguaauauagauuguguccucauuga

SEQ ID NO: 117766 - RNA, 64 nt, Homo Sapiens
uuaaccacaguguccuaaaccuauuuuuuucuagugaauguauuggaaaggaguuugaaugugu

SEQ ID NO: 117767 - RNA, 64 nt, Homo Sapiens
auguauguucaaguauucagucugugguacacauugaauguacuaugaaguagaggugacucuc

SEQ ID NO: 117768 - RNA, 64 nt, Homo Sapiens
cugcggcucagccuugcacacccacugccccgugugaauguagcuuccaccucauggauugcca

SEQ ID NO: 117769 - RNA, 64 nt, Homo Sapiens
acaucuacauuuuuuaaaacugaaucuuaaucgaugaauguaaacucgggggugcuggggccag

SEQ ID NO: 117770 - RNA, 64 nt, Homo Sapiens
uucugaauagaugaaagcauaaaaugugagaaacugaauguauuauucaggaagaauacugagu

SEQ ID NO: 117771 - RNA, 64 nt, Homo Sapiens
ggaagaauacugagugccuucauuuaacuaaaguugaauguaaaagucaauuugcacuucuuua

SEQ ID NO: 117772 - RNA, 64 nt, Homo Sapiens
agaucuuaacaauuccaauagaagagaagacauaugaauguaaggaaugugggaaaaucuuggc

SEQ ID NO: 117773 - RNA, 64 nt, Homo Sapiens
uucagcugugaucucacaagugugaaaaaucuuaugaauguaaaauguguggagauucuucuuu

SEQ ID NO: 117774 - RNA, 64 nt, Homo Sapiens
uucauaaaaggacacacacuggagagaaacccugugaauguaagaaauguagaaaagcauucca

SEQ ID NO: 117775 - RNA, 64 nt, Homo Sapiens
uacaugaaaggaugcacagaggagagaagcucugugaauguaagcauugugggaaagcauucau

SEQ ID NO: 117776 - RNA, 64 nt, Homo Sapiens
uacaugcaagaacacacaauggagagaaacccuaugaauguaaagaaugcagaaaagcauucag

SEQ ID NO: 117777 - RNA, 64 nt, Homo Sapiens
ugcauggaaggacucacacuggagaaaaacccuaugaauguaagcaguaugggaaagcguucag

SEQ ID NO: 117778 - RNA, 64 nt, Homo Sapiens
uucagaccugacaagauucuuugaauacagauaaugaauguaaacaauuaacuguuuauaauaa

SEQ ID NO: 117779 - RNA, 64 nt, Homo Sapiens
uuuaugaaaggacacacacuggagagaaacccuaugaauguaagaaauguggaaaagcguucca

SEQ ID NO: 117780 - RNA, 64 nt, Homo Sapiens
aauacaugcaaaacacacacuggagagaaaccuaugaauguaaggaaugcaaacaagcauucaa

SEQ ID NO: 117781 - RNA, 64 nt, Homo Sapiens
uacaugaaaggacucauacgagagagaauccguaugaauguaaggauugugggaaagcauucag

SEQ ID NO: 117782 - RNA, 64 nt, Homo Sapiens
uagacauguaaagacacaccagaaggaaacccuaugaauguaagcaauguggcaaaagcuuuca

SEQ ID NO: 117783 - RNA, 64 nt, Homo Sapiens
ugcauggaagcacucacacuuggcagaaacucuaugaauguaagcaguaugggaaagccuucag

SEQ ID NO: 117784 - RNA, 64 nt, Homo Sapiens
uucagaucggcuaggauucuuugaauacaaauaaugaauguaaacaauuaacuguuuauaauaa

SEQ ID NO: 117785 - RNA, 64 nt, Homo Sapiens
agcaaagccauucuuaagagucgugagguccuucugaauguaaaacuggagcccaggagaagcu

SEQ ID NO: 117786 - RNA, 64 nt, Homo Sapiens
auaauuaacuuaauuggagaugcauuaggucacuugaauguauaagcaagcaccuaugguaggc

SEQ ID NO: 117787 - RNA, 59 nt, Homo Sapiens; identical to SEQ ID NO: 58889

SEQ ID NO: 117788 - RNA, 64 nt, Homo Sapiens
uucaugugagaagucacacaggggagaaacccuaugaauguaauaaaugugggaaagccuuuuc

SEQ ID NO: 117789 - RNA, 64 nt, Homo Sapiens
uacauaugagaagucauacuggugagaaacccuuugaauguaaugaaugugggaaagcauucuc

SEQ ID NO: 117790 - RNA, 64 nt, Homo Sapiens
gaaucugggaauaccuuucuggagagaaacuguaugaauguagaaacacaucagaaaucucacu

SEQ ID NO: 117791 - RNA, 64 nt, Homo Sapiens
aauguggaagcaacuuuguaggggagaaacccuaugaauguaaaugaagacaugaaaacucacu

SEQ ID NO: 117792 - RNA, 64 nt, Homo Sapiens
gaauguggaaaacccuucagggagagaaacccuaugaauguaaauacaugaacgaauucauacu

SEQ ID NO: 117793 - RNA, 64 nt, Homo Sapiens
cagugugguaaagccuucagggagagaaaccuuaugaauguaaauacaugaaagaacccacacu

SEQ ID NO: 117794 - RNA, 64 nt, Homo Sapiens
aaaugugggaaaacauacaugcaaagaaacaguaugaauguaaagacaugaaaggaugcacacu

SEQ ID NO: 117795 - RNA, 64 nt, Homo Sapiens
cugugugggaaaacuuacuugcacagaaacacuaugaauguaaaaacaugagaggaaucacacu

SEQ ID NO: 117796 - RNA, 64 nt, Homo Sapiens
aaaugugggaaaguguucguggagaaaaacccuaugaauguaaacacaugaaagaacucacacu

SEQ ID NO: 117797 - RNA, 64 nt, Homo Sapiens
caauguggaaaaaccuacauguacagaaacgcuaugaauguaaacacaugaaaggaaucacacu

SEQ ID NO: 117798 - RNA, 64 nt, Homo Sapiens
cacauaguaaagccuuaauuggagauaaacccuaugaauguaaaagauagaaauaauucucauu

SEQ ID NO: 117799 - RNA, 64 nt, Homo Sapiens
aaauguagaaaagcauugagggagagaagucauaugaauguaaguacaugaaaggauucacucu

SEQ ID NO: 117800 - RNA, 64 nt, Homo Sapiens
ccauguggugaaggcuuaagagaaauaaacucuaugaauguaaaaaaaauaaaaaaaaagaaaa

SEQ ID NO: 117801 - RNA, 64 nt, Homo Sapiens
gaauguggaaaagcauugaggcaaagaagcuaugugaauguaaggacaugaaagaacucauacc

SEQ ID NO: 117802 - RNA, 64 nt, Homo Sapiens
gaaugcaggaaagcauucucggagagaagccguaugaauguaagaacaugaaaggauucacacu

SEQ ID NO: 117803 - RNA, 64 nt, Homo Sapiens
uaaugugggaaagcauuuggggagagaagccauaugaauguaaaaucaugagacaacucauaug

SEQ ID NO: 117804 - RNA, 64 nt, Homo Sapiens
caaugugggaaagcauuugagcagagaaaccccaugaauguaaggacgugaaaccacucacagu

SEQ ID NO: 117805 - RNA, 64 nt, Homo Sapiens
caguguucuaaagccuucccggggagaaacuguaugaauguaaggacaugaaagaacacguacu

SEQ ID NO: 117806 - RNA, 64 nt, Homo Sapiens
caguguucuaaagccuuucaggagagaaacuauaugaauguaagugcaugaaagaacucacucu

SEQ ID NO: 117807 - RNA, 64 nt, Homo Sapiens
aaguucuucagcacuugagcaauuuagauuguagugaauguaggacauaauuuauucuagguaa

SEQ ID NO: 117808 - RNA, 64 nt, Homo Sapiens
aaaaucuuuagccuuaucugagagaauaauguaaugaauguaggaucuucagcaaauuccuaug

SEQ ID NO: 117809 - RNA, 64 nt, Homo Sapiens
aaagcuuuuaucuauuacacucauguugacuuugugaauguagagaauagcauauagagaauaa

SEQ ID NO: 117810 - RNA, 64 nt, Homo Sapiens
gaaugugagaaggccucuucggugagaaacccuaugaauguaauaacaucaaagaauuccuacu

SEQ ID NO: 117811 - RNA, 64 nt, Homo Sapiens
gauuguaaaaaagcuuuucuggugacaaacccuaugaauguaaaaacaucagacaauucacacu

SEQ ID NO: 117812 - RNA, 64 nt, Homo Sapiens
gaauguguaaagaccuuuacagugugaaacccuaugaauguaagaacaucaaagaauucauacc

SEQ ID NO: 117813 - RNA, 64 nt, Homo Sapiens
gaaugugggaaugccuucauggggagaaacccuaugaauguaaugacaucagagaauucacagu

SEQ ID NO: 117814 - RNA, 64 nt, Homo Sapiens
ugagcccccuuuucuggacaccaacuguguccugugaauguaucgcuacugugagcuguucccg

SEQ ID NO: 117815 - RNA, 64 nt, Homo Sapiens
cagugucggggcugagccccuugagcugcuucagugaauguacagugcccggcacgagcugaac

SEQ ID NO: 117816 - RNA, 64 nt, Homo Sapiens
ccagagucguaauugaaaucuaggaagucucgcuugaauguaugcgauacauauuuucacuacg

SEQ ID NO: 117817 - RNA, 64 nt, Homo Sapiens
uuaaagguagaguuaacagaauauacugguggacugaauguagguugagagaggaagcgagaag

SEQ ID NO: 117818 - RNA, 64 nt, Homo Sapiens
cgcccccuccggggcugagccugggucugaagacugaauguaacaggggccgcuggcacuccug

SEQ ID NO: 117819 - RNA, 64 nt, Homo Sapiens
guguuguuuuuguaucaauauguuugugcagugaugaauguauuuauuucucagacuuggggcg

SEQ ID NO: 117820 - RNA, 64 nt, Homo Sapiens
auaccuaguuuacuugccaggagggaauguguggugaauguaaaucuaacaacuguggagauuu

SEQ ID NO: 117821 - RNA, 64 nt, Homo Sapiens
uauaacuauuuauuucuggaugggauguaaacucugaauguauuuuuugguguuccaaugaauc

SEQ ID NO: 117822 - RNA, 64 nt, Homo Sapiens
ugggaggggucgggggcacguuguucagacuaaaugaauguauccacagaaugagcuucgagcu

SEQ ID NO: 117823 - RNA, 64 nt, Homo Sapiens
gacccgugggcacuuuuccugcccccacccgcuuugaauguagaaucugccuuucuuuccccca

SEQ ID NO: 117824 - RNA, 64 nt, Homo Sapiens
cuauagcaguacaaugauuaguaauguaaaaauuaacacagaaauuaaccuaaggaaugaaggg

SEQ ID NO: 117825 - RNA, 64 nt, Homo Sapiens
uuuugaugaagacagaauuauuuuucucuguagaaacacagauaccacuuuaucagggaaguua

SEQ ID NO: 117826 - RNA, 64 nt, Homo Sapiens
uuucuuucuuaguccaguuguguugacacauaugaacacagacaaagugcuaugcggaggaaag

SEQ ID NO: 117827 - RNA, 64 nt, Homo Sapiens
cuugaaaggccaacagcaaguguuugugggacacaacacagauaauuuuuucuuaagucggcca

SEQ ID NO: 117828 - RNA, 64 nt, Homo Sapiens
uacuuuuguagaaguggaccaaguaacacucccaaacacagacagaacagagggacagaagaau

SEQ ID NO: 117829 - RNA, 64 nt, Homo Sapiens
gccugagauaagcaguacaagcaagaauuugggaaacacagaugcauugagccaaguuuguaua

SEQ ID NO: 117830 - RNA, 64 nt, Homo Sapiens
uggcucuggaaagcugaaagggcugcacuggaacaacacagaugagauauucuacacauuaauc

SEQ ID NO: 117831 - RNA, 64 nt, Homo Sapiens
cugagauggaaaacaagcccuuuauugaauuuucaacacagacucccugcuucucaucuccuua

SEQ ID NO: 117832 - RNA, 64 nt, Homo Sapiens
acuauccaugaagcagcgcugcaugucacuagguaacacagauccauccagaugguguuuacau

SEQ ID NO: 117833 - RNA, 64 nt, Homo Sapiens
caguggguuggaaguuuuguauauuuauuguauuaacacagagugucauaaaauaaaaugcugu

SEQ ID NO: 117834 - RNA, 64 nt, Homo Sapiens
aguaguuaaugaugauaacaauuuuaauugcaauaacacagacaauaagacauaaauaguuauc

SEQ ID NO: 117835 - RNA, 64 nt, Homo Sapiens
acaggggccuuacaaaguuugaaauagaaccacaaacacagaucaaaagccugcucaauuugga

SEQ ID NO: 117836 - RNA, 64 nt, Homo Sapiens
acugccugguuccugaugcaaacugcuuuguuguaacacagaguucaaacacugaucacaaaua

SEQ ID NO: 117837 - RNA, 64 nt, Homo Sapiens
guuagagaaaaagccuuuuucaacaauacaguacaacacagaauagaagcuaauuccuauugaa

SEQ ID NO: 117838 - RNA, 64 nt, Homo Sapiens
aagaaaggaaaacuacagaucaauauuuccauugaacacagaugcagaaauccucaaaauauua

SEQ ID NO: 117839 - RNA, 64 nt, Homo Sapiens
caaaauccaauauccauucauguuaaaaccucucaacacagaaggaauacaggagaacuuacuc

SEQ ID NO: 117840 - RNA, 64 nt, Homo Sapiens
aaacccuagugucaacucugaacagugaacggaaaacacagaguucaaaaugcagagaauggaa

SEQ ID NO: 117841 - RNA, 64 nt, Homo Sapiens
gaauacaggagaacuuacucugauaaaaccucucaacacagaagcaaaauccaauauccauuca

SEQ ID NO: 117842 - RNA, 64 nt, Homo Sapiens
cagaaauccuuaaaauguuacaauauuuccagugaacacagaugaagaaaggaaaacuacagau

SEQ ID NO: 117843 - RNA, 64 nt, Homo Sapiens
gcaaguucuauuuguucauugcuugccagagaugaacacagaauguucuguuucauuuuacaag

SEQ ID NO: 117844 - RNA, 64 nt, Homo Sapiens
aauuuuaguagaaucaggcacugcucgcagaaggaacacagauuguagagauuaacauaaauug

SEQ ID NO: 117845 - RNA, 64 nt, Homo Sapiens
aaaagcaauugccccagguccaucagagagagagaacacagaaggcaucuggcauccaaagcaa

SEQ ID NO: 117846 - RNA, 64 nt, Homo Sapiens
uagcuuucaggagccaaggcauuaggugaggucaaacacagagcggauugggaguaacagccuu

SEQ ID NO: 117847 - RNA, 64 nt, Homo Sapiens
gagguguccuccugaccaccaggcagucguuaaaaacacagagaucacugcaggcaggcaaucc

SEQ ID NO: 117848 - RNA, 64 nt, Homo Sapiens
caaauauugaagauuuuauauguugaucaucaauaacacagaauccaggaaccccguaccagcc

SEQ ID NO: 117849 - RNA, 64 nt, Homo Sapiens
ccacaguugaaggagggagagaacacgcugugaaaacacagaagcucccagagaagccuucuca

SEQ ID NO: 117850 - RNA, 64 nt, Homo Sapiens
uuuaucucuggaguagagcagacuauguugagcuaacacagaccugcugaaucagcuucuuucu

SEQ ID NO: 117851 - RNA, 64 nt, Homo Sapiens
cugcaauugugguauugcaguagagaaagaguuuaacacagagcuagccaagcagaaaggcugg

SEQ ID NO: 117852 - RNA, 64 nt, Homo Sapiens
cugccugagccuccuuauuuauucugccugguccaacacagauugucuggcugguccaacacag

SEQ ID NO: 117853 - RNA, 64 nt, Homo Sapiens
cugccugguccaacacagauagucuggcugguccaacacagauuuggccacugggcugggcugg

SEQ ID NO: 117854 - RNA, 64 nt, Homo Sapiens
acauuacaguguacacauuauacacugcaucuuuaacacagagucaccugugacaggcucuagg

SEQ ID NO: 117855 - RNA, 64 nt, Homo Sapiens
cuccuguuccagcuguaucagauacucguuccgcaacacagaaaugacucagaaucucagacaa

SEQ ID NO: 117856 - RNA, 64 nt, Homo Sapiens
aaggaacaagacugacugggcagggaauacuauacagccauaaaaaaaugugguacauacacac

SEQ ID NO: 117857 - RNA, 64 nt, Homo Sapiens
gaaaagauugaaaauggacgcugggauaacuggccagccauaugucucuauucaauaaaucgug

SEQ ID NO: 117858 - RNA, 64 nt, Homo Sapiens
cuccugucccagacaaggaagccccucuuuacaucagccauauuaggggaacgguugucagcuc

SEQ ID NO: 117859 - RNA, 64 nt, Homo Sapiens
gguugucagcuccccaaaugccuacuggauccuacagccauacaggaaaacagacggacacagc

SEQ ID NO: 117860 - RNA, 64 nt, Homo Sapiens
uccagauguucuucccuggguguugaugucaugacagccauacagugaguuuguucugaaacau

SEQ ID NO: 117861 - RNA, 64 nt, Homo Sapiens
gaccuuguucuuuacagacaucaugaucagccuccagccauacagaacaaaugagaaauuagaa

SEQ ID NO: 117862 - RNA, 64 nt, Homo Sapiens
uaucuuuccaguggcuaaaccacuuaaccucucuggguguuaccugcucauuuguuuaaaaaaa

SEQ ID NO: 117863 - RNA, 64 nt, Homo Sapiens
cuuagcaucucagcucuucugcaaggaagagcuuggguguuaggccucagaggcuguagggucc

SEQ ID NO: 117864 - RNA, 64 nt, Homo Sapiens
agcuuuguugacagaucagaaauaagauugacuuggguguuauauuucaucucucuccagacuc

SEQ ID NO: 117865 - RNA, 64 nt, Homo Sapiens
aauuuagaaaccacaggauaguguacccacagauggguguuaucaaggccagucaugaggaugg

SEQ ID NO: 117866 - RNA, 64 nt, Homo Sapiens
cugaggggggaagucacuuccaagcuccaguccuggguguuaccaggcugagaagcaggagauc

SEQ ID NO: 117867 - RNA, 64 nt, Homo Sapiens
uguggcaaugcagaagcugauagcauuaacagcaggguguuacagcauaauuguuaauucgcac

SEQ ID NO: 117868 - RNA, 64 nt, Homo Sapiens
ugccgcacauugucaaguuagaaauacuccagguggguguuagcacugugguggucucuggucc

SEQ ID NO: 117869 - RNA, 64 nt, Homo Sapiens
uuucuuagguacagcaauaguugauaggaugugaggguguuaccuuggggugaaguggagaagg

SEQ ID NO: 117870 - RNA, 64 nt, Homo Sapiens
aagugugcugcuuagaaugaucauccuaauugagggguguuaaagcugacaucaauucuaagac

SEQ ID NO: 117871 - RNA, 64 nt, Homo Sapiens
cuuuuuaccaaguacaaaaauaguugugaauuuaggguguuaaaaauguacuacuaaagagcac

SEQ ID NO: 117872 - RNA, 64 nt, Homo Sapiens
ccagcuauuuuccuuuuccuguacaauuugagccggguguuagguuauauauagauagaagacu

SEQ ID NO: 117873 - RNA, 64 nt, Homo Sapiens
uuguguucuuccuccuuagcuuggggguggggugggguguuacuuuuuucaguuaauaacauau

SEQ ID NO: 117874 - RNA, 64 nt, Homo Sapiens
auuuugcacaagaucuguuuacaaaagaaguccuggguguuaauuuauaauaaaaaucaucuau

SEQ ID NO: 117875 - RNA, 64 nt, Homo Sapiens
gugcaauagcaauuaaaauaauuuucaaaggaaaggguguuauacagggaagcacacccaaaga

SEQ ID NO: 117876 - RNA, 64 nt, Homo Sapiens
gaaucuuucuucccacuuccguuuuaauaaauggggguguuacuuucacuuuuaauuugcuggu

SEQ ID NO: 117877 - RNA, 64 nt, Homo Sapiens
gguagcauucuucuuuuggcaccaguagccgcugggguguuaaugauugagaagcacaacugaa

SEQ ID NO: 117878 - RNA, 64 nt, Homo Sapiens
caucaccuucuggaauaucacccuggaggaugaaggguguuacaugugucucuucaauaccuuu

SEQ ID NO: 117879 - RNA, 64 nt, Homo Sapiens
ccucaccaaaacuuggcaguggaaugucaugccaggguguuacuuugagggccaggaaagagaa

SEQ ID NO: 117880 - RNA, 64 nt, Homo Sapiens
uaagcuuugagucaaaagucauuuacauugccauggguguuaaaucauuuauuuuugauguaga

SEQ ID NO: 117881 - RNA, 64 nt, Homo Sapiens
cuuggagaagacacagccucuuggggacuauuaaggguguuagugauacuaagacuugaauuuu

SEQ ID NO: 117882 - RNA, 64 nt, Homo Sapiens
gggagcauaugagaggccauagugacagagaacaggguguuaugccagcacaagguaguaaucu

SEQ ID NO: 117883 - RNA, 64 nt, Homo Sapiens
uuugacagcugagagugggcagaguauuuuuauuggguguuaacaguguauuucuuugcuuugu

SEQ ID NO: 117884 - RNA, 64 nt, Homo Sapiens
ugaaauuuauacaccaauuguggcuaagcuuuauggguguuaaucuuucuucucugcugcccca

SEQ ID NO: 117885 - RNA, 64 nt, Homo Sapiens
gaguuauaagcucacuaggcagaauuucuuaaaaggguguuacugacaugucauucuguagacu

SEQ ID NO: 117886 - RNA, 64 nt, Homo Sapiens
cacacguacuuaaaugaaaggagauuccugguucggguguuacguaagugaaaaggucauagcu

SEQ ID NO: 117887 - RNA, 64 nt, Homo Sapiens
agggaagccccacauguccagcaccuugugccugggguguuaguggcaccgccuccccaccucc

SEQ ID NO: 117888 - RNA, 64 nt, Homo Sapiens
uauuuucaguugauuuuauuuuauauuccuaaugggguguuaaagccguuuuuuauuuuuuucu

SEQ ID NO: 117889 - RNA, 64 nt, Homo Sapiens
aaauaaguuacaauguuuuauucuuguaacugcuggguguuacaagugaguaggccugcuguau

SEQ ID NO: 117890 - RNA, 64 nt, Homo Sapiens
agaugcgaaguaaagaacguuugagguuuacaaaggguguuagccauggucucuucucugagga

SEQ ID NO: 117891 - RNA, 64 nt, Homo Sapiens
uguuuuauccaaauaguaaagagaugugaugguaggguguuaaguagauuaguugagaacacua

SEQ ID NO: 117892 - RNA, 64 nt, Homo Sapiens
gacuguuuaguagcagugauugucuuaauauuguggguguuaauuuuugauacuaagcauugaa

SEQ ID NO: 117893 - RNA, 64 nt, Homo Sapiens
cauguuaaaaaaggaacaguauucuuuauuuucuggguguuauauuuaaaaaagcaaguuugga

SEQ ID NO: 117894 - RNA, 64 nt, Homo Sapiens
guuccaguaaaauucuucugaccgaaaccaauguggguguuagaaaaauuaccauauagcuuaa

SEQ ID NO: 117895 - RNA, 64 nt, Homo Sapiens
gaagaggaugcuuugcugcugcugaaguguaccuggguguuagauuucagauccugggcugagc

SEQ ID NO: 117896 - RNA, 64 nt, Homo Sapiens
cuuaaggugccuuuuuaauucccuacaguuuuauggguguuaucagugcuggagaaucauguag

SEQ ID NO: 117897 - RNA, 64 nt, Homo Sapiens
gcucagaagaauuuaaguucuauucagccuuccuggguguuagaaccuagauucaaaauggcuu

SEQ ID NO: 117898 - RNA, 64 nt, Homo Sapiens
cuguuugugaucaguaaagcuaccacagauauaaggguguuaugcugaauccugagaagcuuuc

SEQ ID NO: 117899 - RNA, 64 nt, Homo Sapiens
uguuaugguucucuuuuauugaugggcaugcaguggguguuacuuggaaauggccaauuuuuau

SEQ ID NO: 117900 - RNA, 64 nt, Homo Sapiens
ucuauccugccauuuaaccccauacguguaaaauggguguuacacagcaucucugauguugcaa

SEQ ID NO: 117901 - RNA, 64 nt, Homo Sapiens
uucucaguguauuuuuguaaaaaauauauaaaggggguguuaaucgguguaaaucgcuguuugg

SEQ ID NO: 117902 - RNA, 64 nt, Homo Sapiens
cucuguugagaaauuuauuuaauguaaggaacuuggguguuaauaguugagagcuguuuaguaa

SEQ ID NO: 117903 - RNA, 64 nt, Homo Sapiens
ggaaguccaaccccagcauucagcacagugugguggguguuacggaaacauaaagaggaaauua

SEQ ID NO: 117904 - RNA, 64 nt, Homo Sapiens
ccucugucucuggcccuacccggguuccccagcaggguguuaagccugccucgggaguucugac

SEQ ID NO: 117905 - RNA, 64 nt, Homo Sapiens
uggggacucucuugaccucccuccagcccuuccuggguguuaacaggcccaggucaaggucuua

SEQ ID NO: 117906 - RNA, 64 nt, Homo Sapiens
uaccuccccugcacuggcaaaacacuaugcuuuuggguguuagacugaaauauuuuaagaguau

SEQ ID NO: 117907 - RNA, 64 nt, Homo Sapiens
aacccugucucuacuaaauauacaaaaauuaguuggguguuauggugcaugccuguaaucccag

SEQ ID NO: 117908 - RNA, 64 nt, Homo Sapiens
gcagugacuuuagaaacaaagaauuacuucuucaggguguuaaggaagguauaaccuucaugau

SEQ ID NO: 117909 - RNA, 64 nt, Homo Sapiens
agugcaccaggucacucugauuccuuucagauugggguguuagauaucuuauacugaaaaaaaa

SEQ ID NO: 117910 - RNA, 64 nt, Homo Sapiens
uuuuuuuauuuuuguuuuauuaauuuggggaaagggguguuagcauuagugccaugauaucuac

SEQ ID NO: 117911 - RNA, 64 nt, Homo Sapiens
auuuuaaagagaccccacagaagucuuuuaaccuggguguuagcuccagcaccacccuugcccc

SEQ ID NO: 117912 - RNA, 64 nt, Homo Sapiens
agagugaaucauccagacuccucauggauaggucggguguuaaaguuguuuugauuauguaccu

SEQ ID NO: 117913 - RNA, 64 nt, Homo Sapiens
gcgccaaguggagguuguaccuuucagcccuuugggguguuaaaagugucaagggcuggguuug

SEQ ID NO: 117914 - RNA, 64 nt, Homo Sapiens
ugaaaugaccauaaauauacaaauauaggacacuggguguuauccuuuuuuuaauuuuauucgg

SEQ ID NO: 117915 - RNA, 64 nt, Homo Sapiens
caguccuugggaaaugaguuuugauggugaauugggguguuaaggaagggaaagauugucauag

SEQ ID NO: 117916 - RNA, 64 nt, Homo Sapiens
gaauucggugacaugccuagcaguucaucaugguggguguuagaucaggguauggagcucacau

SEQ ID NO: 117917 - RNA, 64 nt, Homo Sapiens
ugaacuguuuucauuugcuuuuuauaauuugcauggguguuaggauuuuguauaugggaggaaa

SEQ ID NO: 117918 - RNA, 64 nt, Homo Sapiens
aacuggaauugaauuuguacaauuuugugaauuaggguguuaaaucagcgcauacauuggcaug

SEQ ID NO: 117919 - RNA, 64 nt, Homo Sapiens
gcccauuucuccagaacccauuugagggguggggggguguuaauuuaugcacuuauaagguguu

SEQ ID NO: 117920 - RNA, 64 nt, Homo Sapiens
ccccuucuuggacacugaaggaaaaggccaacuaggguguuagcccucugggcaccaaggaaac

SEQ ID NO: 117921 - RNA, 64 nt, Homo Sapiens
cuagaaugggcugugugauaacaucucaguugguggguguuaaguccaguuuuaguauuucacu

SEQ ID NO: 117922 - RNA, 64 nt, Homo Sapiens
guucuuucuccaaggaaauagggaaaccuaagauggguguuaugugagaguugaaacuggaacu

SEQ ID NO: 117923 - RNA, 64 nt, Homo Sapiens
aggcacuugucacuaugcuacugcugcucauccaggguguuacaagccucagcucagccucccc

SEQ ID NO: 117924 - RNA, 64 nt, Homo Sapiens
gcucaggagugggcagcaguuggggguaccccagggguguuaagcacccuuuagaacagggguc

SEQ ID NO: 117925 - RNA, 64 nt, Homo Sapiens
cucauuuuacagaggagggaggagcccacaagauggguguuauuuguguuauuuaaucccuuca

SEQ ID NO: 117926 - RNA, 64 nt, Homo Sapiens
aauucuuugaagaaauauaugaucucuacuuguuggguguuauguagcauuuauuaucacugug

SEQ ID NO: 117927 - RNA, 64 nt, Homo Sapiens
ggaugggcagggaaggaauccugguggaagucuuggguguuagugucagccaugggaaaugagc

SEQ ID NO: 117928 - RNA, 64 nt, Homo Sapiens
agugugagaucuuuggacacaugaaggagcgugaggguguuagccuguuccucucuuccuguug

SEQ ID NO: 117929 - RNA, 64 nt, Homo Sapiens
cuauuugauugcacuuaauuguuuuuaauaaaagggguguuacauuuuuuacauuuggauuuau

SEQ ID NO: 117930 - RNA, 64 nt, Homo Sapiens
acuuacacaguaccucguuuacacuguuuagguaggguguuaagugaaacuacagaucuuugga

SEQ ID NO: 117931 - RNA, 64 nt, Homo Sapiens
aagcagucccauuggugaggucauaauuccugagggguguuaagugaccauuuaaccucagaau

SEQ ID NO: 117932 - RNA, 64 nt, Homo Sapiens
uuaauauuucacgauacuaauuguggcauguuugggguguuauuacuuuauuugugaauaguga

SEQ ID NO: 117933 - RNA, 64 nt, Homo Sapiens
gcucaagggcuggcacuuuuuuaaauauaaaaauggguguuauuuuuauuuuuauuuguaaagu

SEQ ID NO: 117934 - RNA, 64 nt, Homo Sapiens
ugcuaugaaccuguugccccucagaguugguuuaggguguuagcagaaaccacgucuugaugcu

SEQ ID NO: 117935 - RNA, 64 nt, Homo Sapiens
agaauaaaagacagcuuuagcaacaguauuugaaggguguuagccacuugagaggcgauauugu

SEQ ID NO: 117936 - RNA, 64 nt, Homo Sapiens
guagccuuauucaccuuuuuugucuauggauuugggguguuacauaaauagguucagauuuuac

SEQ ID NO: 117937 - RNA, 64 nt, Homo Sapiens
auuuaugauuuauuugaagccacacuguuugcauggguguuacuugucuguaccucagagucug

SEQ ID NO: 117938 - RNA, 64 nt, Homo Sapiens
ggaggacguggacugggguaggaaaccacccugaggguguuaguaccuaguggugaaacggaug

SEQ ID NO: 117939 - RNA, 64 nt, Homo Sapiens
ccugguauuuggggggaugaccagcccaggcguuggguguuagucugcaugaguuugugagagg

SEQ ID NO: 117940 - RNA, 64 nt, Homo Sapiens
ggcucccuccgcagacugacuuuccucugugucuggguguuacagucugugcccacugcauccu

SEQ ID NO: 117941 - RNA, 64 nt, Homo Sapiens
ccaggcuccaaggacacccucccugcacaugauuggguguuaaugguggccuggguugugucuu

SEQ ID NO: 117942 - RNA, 64 nt, Homo Sapiens
uugcaguccugugugcuuccccuugcuggcuacuggguguuaguguauuccuggcccagagggc

SEQ ID NO: 117943 - RNA, 64 nt, Homo Sapiens
aaauacugcaguuacggagcgagacugcaaaaugggguguuaaaguuuaauugaaaaguauucu

SEQ ID NO: 117944 - RNA, 64 nt, Homo Sapiens
ugcuuuccuccauuuuugaguaagcuuuaaaaucggguguuaugaagacugacacaagagcaaa

SEQ ID NO: 117945 - RNA, 64 nt, Homo Sapiens
aaguuguauguggcaugaauauggucacgcaccuggguguuacaggguuuccccccuuuuauag

SEQ ID NO: 117946 - RNA, 64 nt, Homo Sapiens
cucauuuuuugauuuauuuuuauuuucucuuuguggguguuauauuugaucucuaaaucugaac

SEQ ID NO: 117947 - RNA, 64 nt, Homo Sapiens
aagucaauccaagagucugaugauuucuugaaaaggguguuagcuaaaggaucuuaggcaugac

SEQ ID NO: 117948 - RNA, 64 nt, Homo Sapiens
cauguacugaaaaugaacuuaugggaaagggccuggguguuaccuuguagcauaccuggauaua

SEQ ID NO: 117949 - RNA, 64 nt, Homo Sapiens
caugccugcuuuuuucacuuuuacacaagcugugggguguuacguaugcacuccccgcuugugu

SEQ ID NO: 117950 - RNA, 64 nt, Homo Sapiens
ccgcggcacaugcuucccaagguggucccacggaggguguuacugggcaccaguggacucgccc

SEQ ID NO: 117951 - RNA, 64 nt, Homo Sapiens
uccuugguugguguuuaaagccaacccaagaacaggguguuagguacuguuuuaagcaccuaga

SEQ ID NO: 117952 - RNA, 64 nt, Homo Sapiens
cuucagccucagugggguuccugauguuuaucuaggguguuacucaagcccaguuugagauuuu

SEQ ID NO: 117953 - RNA, 64 nt, Homo Sapiens
auguuuaucaugccuaagggacacugacucgcguggguguuaaaacaggagcuagcccaaucau

SEQ ID NO: 117954 - RNA, 64 nt, Homo Sapiens
ugcaggaacguggagacccuugcaguggugucguggguguuacgcgugcagcccaugcugaggc

SEQ ID NO: 117955 - RNA, 64 nt, Homo Sapiens
cgaggggagaguccucaucugcuggcauuuugugggguguuagugccaaacuugaauaggggcu

SEQ ID NO: 117956 - RNA, 64 nt, Homo Sapiens
aggcuguguaugaaaccaaugcccaggguuugaaggguguuagcauccauuucaggggagugug

SEQ ID NO: 117957 - RNA, 64 nt, Homo Sapiens
aggaacaagacagauccugacauagcuuuggccuggguguuaggucagaaggaguacuggugcg

SEQ ID NO: 117958 - RNA, 64 nt, Homo Sapiens
aacaaagggcaugugugagggaagcugcuuggguggguguuagggcuaugaaaucuuggauuug

SEQ ID NO: 117959 - RNA, 64 nt, Homo Sapiens
uugagaugguuaaaggugguguuugcaaguaauuggguguuagcaaacuguguuuuauaccagu

SEQ ID NO: 117960 - RNA, 64 nt, Homo Sapiens
uccgcucuauagggauagugugacacaguuuauuggguguuaagacagaaucagcugacauaau

SEQ ID NO: 117961 - RNA, 64 nt, Homo Sapiens
uauaaagacugaaggcaaaggucagauugcuuacggguguuauuuuuauaaguuguugaauucc

SEQ ID NO: 117962 - RNA, 64 nt, Homo Sapiens
accuagcugaauguuuuucuguguuuuuuucuauggguguuaucaaaagauaaacacaagauug

SEQ ID NO: 117963 - RNA, 64 nt, Homo Sapiens
uagagaucaaggaaggaagucuccgauguggagaggguguuauuaaugcccaaccuccagauac

SEQ ID NO: 117964 - RNA, 64 nt, Homo Sapiens
cuccuccaaguacccaggggcaucagagcugccuggguguuacauggcccagggaacccagguu

SEQ ID NO: 117965 - RNA, 64 nt, Homo Sapiens
gccugucggucagaacuugcuaguugcaggagacggguguuacacgcagucaucagaccucacc

SEQ ID NO: 117966 - RNA, 64 nt, Homo Sapiens
cagcuggauuccaucaggaaagcugcauugaucaggguguuaaccgcauaugaaacaacccaua

SEQ ID NO: 117967 - RNA, 64 nt, Homo Sapiens
uuugaggguaagaaguagauaaugaggccacuguggguguuauuuuuucaugucuggaccucag

SEQ ID NO: 117968 - RNA, 64 nt, Homo Sapiens
cacccucccgccugucggcccguagauuuaucaaggguguuaugggcccagcuuuggggggcca

SEQ ID NO: 117969 - RNA, 64 nt, Homo Sapiens
aaacaaagggcagagaguccuaaccaguuacagaggguguuagaagccauaucaaguuaaaggu

SEQ ID NO: 117970 - RNA, 64 nt, Homo Sapiens
agacucggcuugggcagcacuucggggggggaggggguguuaugggagggggacacauuggggc

SEQ ID NO: 117971 - RNA, 64 nt, Homo Sapiens
cacugucugcauauccauaagaauugagcgcuauggguguuaacgugcaugaggaucaguuugc

SEQ ID NO: 117972 - RNA, 64 nt, Homo Sapiens
uugcauuucaggggucaguauccuaugacaugauggguguuaccauccuaauuuuacaggcaag

SEQ ID NO: 117973 - RNA, 64 nt, Homo Sapiens
gugucaggugugggacuccuucugccccugcaguggguguuacgggcggugugcccuggcgagc

SEQ ID NO: 117974 - RNA, 64 nt, Homo Sapiens
ccucaucuuuuuagcaagguaaaaaaaccaaaauggguguuaucucugauaucuugaaaccagc

SEQ ID NO: 117975 - RNA, 64 nt, Homo Sapiens
guccaaaaguaaagaauaagaaaauaccaucugaggguguuacugaauauaaaacaaaccaaua

SEQ ID NO: 117976 - RNA, 64 nt, Homo Sapiens
accuggaaggauguugugcuucugaagccccacuggguguuacugcagcagggcguggcccagg

SEQ ID NO: 117977 - RNA, 64 nt, Homo Sapiens
aucuguacuccacauuccauuuuaauugauaugaggguguuaaaguaccuacuuaauggguuga

SEQ ID NO: 117978 - RNA, 64 nt, Homo Sapiens
agagggcagucacuguuccaaggagugaaggacuggguguuacuggagggaacacacuguauaa

SEQ ID NO: 117979 - RNA, 64 nt, Homo Sapiens
ucuuugauauguugaugaaauucuggaucaggagggguguuaaaacaucaaaaugauggcgacu

SEQ ID NO: 117980 - RNA, 64 nt, Homo Sapiens
uuacugauuauuuugaaaagacgguguuaugcuuggguguuagugaggcugauaugucauguca

SEQ ID NO: 117981 - RNA, 64 nt, Homo Sapiens
ugcucccaagccuaguuaucuccaguuguuuuaaggguguuaugaaaaauucuuaaaauauaua

SEQ ID NO: 117982 - RNA, 64 nt, Homo Sapiens
uaaggguuggggguagaggugugagggaagugggggguguuagguuuuaagggguauagggagg

SEQ ID NO: 117983 - RNA, 62 nt, Homo Sapiens
uugacucaaauggaaauuguuuucuaaauacagccuuuaaauauuucauaauucucaagauu

SEQ ID NO: 117984 - RNA, 62 nt, Homo Sapiens
aaauguaaauuuuuuaaaaacucugcaaaguagccuuuaaaauuaagcaucuuugaugaaua

SEQ ID NO: 117985 - RNA, 62 nt, Homo Sapiens
ucagggauagcaguaccauuuuacuuccgcaagccuuuaacugcaagaugaagcugcaaagg

SEQ ID NO: 117986 - RNA, 62 nt, Homo Sapiens
ccagugagaacucucaagaccucuucccccuugccuuuaaccuuuucugcagugaucuaaga

SEQ ID NO: 117987 - RNA, 62 nt, Homo Sapiens
uuaguucccugucucuugaaaaaugcccauuugccuuuaaaaaaaaaaguuacagaaauacu

SEQ ID NO: 117988 - RNA, 62 nt, Homo Sapiens
augaauguacugcauguuaccaucuuacuugagccuuuaauggacuuauuucuucaaauccu

SEQ ID NO: 117989 - RNA, 62 nt, Homo Sapiens
agagaaacuucacaugugaaccguguggcaaagccuuuaaaugguccucaacccuuaaugaa

SEQ ID NO: 117990 - RNA, 62 nt, Homo Sapiens
uaauuucuguugaaagacuucagaaaauauaggccuuuaaagugaagaagaguauucuuaag

SEQ ID NO: 117991 - RNA, 62 nt, Homo Sapiens
uuugcauuugauuucuaaacauuccuucauaugccuuuaaugaaagccagcaauuaucccau

SEQ ID NO: 117992 - RNA, 62 nt, Homo Sapiens
augagguuuuaugaauauucauguuuuugaaggccuuuaauuucugucugcauauuagcuuu

SEQ ID NO: 117993 - RNA, 62 nt, Homo Sapiens
agagaaacuacaaaugugaagaauguguuaaagccuuuaacaagucuucaacuuuuucugca

SEQ ID NO: 117994 - RNA, 62 nt, Homo Sapiens
aaaagccauacaaaugagaagaauguggcaaugccuuuaaucaguccucacaccuuucuaca

SEQ ID NO: 117995 - RNA, 62 nt, Homo Sapiens
agaaacccuacaaauguaaaaaacguggcaaugccuuuaacugguccucacaccuugcuaca

SEQ ID NO: 117996 - RNA, 62 nt, Homo Sapiens
aaaaauccuagaaaugugaaaaauaucacaaagccuuuaaaugguugucacacuugauugua

SEQ ID NO: 117997 - RNA, 62 nt, Homo Sapiens
auuuuugucaagagaucuuucagaaaauauaagccuuuaaagugaagaagaggagccaguug

SEQ ID NO: 117998 - RNA, 62 nt, Homo Sapiens
agaaagccuacaaaugugaagaauguggcaaagccuuuaaccaguuuucaacccuuauuaca

SEQ ID NO: 117999 - RNA, 62 nt, Homo Sapiens
agaaaccccacaaauguggagaaugcggaaaagccuuuaacugguccucaacucuuauuaca

SEQ ID NO: 118000 - RNA, 62 nt, Homo Sapiens
auacagugugaaaauuugcuaaagugauuuuugccuuuaaaggaggugauucagaaccuuuu

SEQ ID NO: 118001 - RNA, 62 nt, Homo Sapiens
uuaccucacugugggcuggagaagggaaaagugccuuuaaaaucagugaaugcagaacaaau

SEQ ID NO: 118002 - RNA, 62 nt, Homo Sapiens
acuuaacaagccuaaccuuguguaauaaaauugccuuuaaucauagaauaaguacaugcugc

SEQ ID NO: 118003 - RNA, 62 nt, Homo Sapiens
aaaaagccuccuuuaucugguuuugguauuuugccuuuaaauucaccuacaccagagagcca

SEQ ID NO: 118004 - RNA, 62 nt, Homo Sapiens
ucugaaauacuauaaaacacgcuuauuuuucagccuuuaaagaaaaauauugcuaaucuucu

SEQ ID NO: 118005 - RNA, 62 nt, Homo Sapiens
cacuagcaaagcaaauauuagaaauucugcaugccuuuaaaucuaauauagcuuguuuuguu

SEQ ID NO: 118006 - RNA, 62 nt, Homo Sapiens
aagcuuagaugagaaauuuuuuucauauacuggccuuuaaaucauuaauggacaauuggcua

SEQ ID NO: 118007 - RNA, 62 nt, Homo Sapiens
aaagaauguauuguaaauuggcauacaauacugccuuuaauagaaaaccuaaaugcuggggc

SEQ ID NO: 118008 - RNA, 62 nt, Homo Sapiens
aaaaaccccacaagugugaaaaacauggcaaagccuuuaagaagcccucaauucuuaacaga

SEQ ID NO: 118009 - RNA, 62 nt, Homo Sapiens
agaaauccuagaaaucugaagagugagauaaagccuuuaaaugguugucacacuucauugua

SEQ ID NO: 118010 - RNA, 62 nt, Homo Sapiens
ggcugucacacuugauuguagaaugugacaaagccuuuaaauagaaauccuagaaaugugaa

SEQ ID NO: 118011 - RNA, 62 nt, Homo Sapiens
aguccuuaaggcuuacuacagaauguggcaaagccuuuaaccggaauuccuauaauugugug

SEQ ID NO: 118012 - RNA, 62 nt, Homo Sapiens
ucaccuacaccagagagcuauuuugguauuuugccuuuaaauaaaaagccuccuccauaugg

SEQ ID NO: 118013 - RNA, 62 nt, Homo Sapiens
auagaauaaguacaugcugcuguaauaaaauugccuuuaaucacuuaacaagccuaaccuug

SEQ ID NO: 118014 - RNA, 64 nt, Homo Sapiens
aaaauguaauggcaaaaccaucaacagguuuuaaaccuggcauugcuguauaaagcugcagcuu

SEQ ID NO: 118015 - RNA, 64 nt, Homo Sapiens
accaucuaaaccuguaucaucucuuugaggcacuaccuggcagccugaagugaccacuuuucuu

SEQ ID NO: 118016 - RNA, 64 nt, Homo Sapiens
uaaacaucacccugcaaagcugugugccuacugaaccuggcaaagugaaggucgguggguuaac

SEQ ID NO: 118017 - RNA, 64 nt, Homo Sapiens
gcagaguacaagcccagcacgacguggcaaugagaccuggcagggggaaaggaggaacaauuag

SEQ ID NO: 118018 - RNA, 64 nt, Homo Sapiens
uuacuuaacuuacuguuuugacagaccuacucuuaccuggcaguguauuuuauaaagauuaaua

SEQ ID NO: 118019 - RNA, 64 nt, Homo Sapiens
gacuguagggagcugggucacgccguaggaggucaccuggcaguaggcugcucaggucuccaag

SEQ ID NO: 118020 - RNA, 64 nt, Homo Sapiens
agaaccuagaagggcuagaaccuggagggcuagaaccuggcagguuagaaccuagaagggcuag

SEQ ID NO: 118021 - RNA, 64 nt, Homo Sapiens
uagaacauggagagcuagaacccggcaggcuagaaccuggcaagcuagaaccuggagggaauga

SEQ ID NO: 118022 - RNA, 64 nt, Homo Sapiens
uuugaguauuuuuuuuuuuuuuacaggccacuacaccuggcacaagccucccaaagugcuggga

SEQ ID NO: 118023 - RNA, 64 nt, Homo Sapiens
uaccuauugacuguauccucaggacagacuuguaaccuggcaugcaucuaucacacaggcuuuc

SEQ ID NO: 118024 - RNA, 64 nt, Homo Sapiens
ccauacuagaauucacacugugggagugauucacaccuggcacaaagguuuguaacaaggcuuu

SEQ ID NO: 118025 - RNA, 64 nt, Homo Sapiens
acauauuagaauucaaacugugaauauaauucauaccuggcaaaaagguuuaugacaagauuuu

SEQ ID NO: 118026 - RNA, 64 nt, Homo Sapiens
gaaaacccuuuuugucaauaggcugauguaagaacaggcagaagucucccauuuuucugaaagu

SEQ ID NO: 118027 - RNA, 64 nt, Homo Sapiens
agucauaagccaggaaaugaggaacagccuuguccaggcagaacauugcuggagagcgaaagau

SEQ ID NO: 118028 - RNA, 64 nt, Homo Sapiens
accacacagagaaguggauggacacuucgccauccaggcagaacuaagccaggcauaaccacag

SEQ ID NO: 118029 - RNA, 64 nt, Homo Sapiens
agccaggcauaaccacagccaagcagauuaaccccaggcagaccgauaaaaagaccuccagaua

SEQ ID NO: 118030 - RNA, 64 nt, Homo Sapiens
gacagacuccuaaccaaccagauggacugccagacaggcagacaucagccacauggaauccuga

SEQ ID NO: 118031 - RNA, 64 nt, Homo Sapiens
ccagcccuccguggugcacaugcacccaccgagccaggcagaggauuccccacguguguucauc

SEQ ID NO: 118032 - RNA, 64 nt, Homo Sapiens
uuuuuuagaaaucaauacaucauauuucauuccccaggcagacagugaauaugaaauacaugug

SEQ ID NO: 118033 - RNA, 64 nt, Homo Sapiens
ggcacaggaggccacaguccuuccuggggcauuccaggcagagaaggagcagaggcucucccgg

SEQ ID NO: 118034 - RNA, 64 nt, Homo Sapiens
uaagauucucagaccaaauucuagaccaaagacacaggcagaccaaguccccaggccccgccug

SEQ ID NO: 118035 - RNA, 64 nt, Homo Sapiens
uuuuguggcuuuguucaaugcuuccacucuagggcaggcagagcagucuauacucucccaagcc

SEQ ID NO: 118036 - RNA, 64 nt, Homo Sapiens
cguuuguuaacaucaucaggaagaugggaaaggucaggcagaauuuuucugcccuacaaagggu

SEQ ID NO: 118037 - RNA, 64 nt, Homo Sapiens
ucccaccauugcaggcagcuacuucccaccauugcaggcagacugagcccucccuccagugguc

SEQ ID NO: 118038 - RNA, 64 nt, Homo Sapiens
cauggagaccagucccaguaccugaacgccuccgcaggcagauuuuaugacgaaauaagucacc

SEQ ID NO: 118039 - RNA, 64 nt, Homo Sapiens
gcaagcccuuguagcccucugagcccucauccugcaggcagagccccucagugcucugagaaac

SEQ ID NO: 118040 - RNA, 64 nt, Homo Sapiens
ccuccaugguggcaugggucagcagagcauggagcaggcagaggaagccuaucuguggggcugg

SEQ ID NO: 118041 - RNA, 64 nt, Homo Sapiens
cgguggccugugggugaggggaacggagcaggcucaggcagaauugaguacggugcgucugcuu

SEQ ID NO: 118042 - RNA, 64 nt, Homo Sapiens
ggaguucccgagaugcucggguuugagcagggagcaggcagagcugcagucagagacauuagaa

SEQ ID NO: 118043 - RNA, 64 nt, Homo Sapiens
ggcucaugccuauaagcacccugggaggccgaggcaggcagauuauuugagcucaggaguuuga

SEQ ID NO: 118044 - RNA, 64 nt, Homo Sapiens
acaguuuuauuacaauguaacaaaaguugaaaaucaggcagauguguauucaguauccaauuca

SEQ ID NO: 118045 - RNA, 64 nt, Homo Sapiens
ccucaugggggcuggggauccccaucagcacagccaggcagagaugauacccaccacacaccug

SEQ ID NO: 118046 - RNA, 64 nt, Homo Sapiens
caguagcuggugccaggacagagcucugggacagcaggcagaggccgagccugggccacagcuc

SEQ ID NO: 118047 - RNA, 64 nt, Homo Sapiens
aaguuaauauuuaauuaaauagcaguuuuugacccaggcagaauccuacauugcauaugggcau

SEQ ID NO: 118048 - RNA, 64 nt, Homo Sapiens
gagcugcagucccacgugggugucacccgccuggcaggcagaagcauccucucagcagucuucc

SEQ ID NO: 118049 - RNA, 64 nt, Homo Sapiens
guguuccugacagagggaagaaacugaauugugacaggcagaggaauucuauuaggaauggccc

SEQ ID NO: 118050 - RNA, 64 nt, Homo Sapiens
gaaccuugcaaacaccuuaaauguagcagaauaccaggcagacaggcacuuuugauaugagaca

SEQ ID NO: 118051 - RNA, 64 nt, Homo Sapiens
ccacuccucugauaacggccaaggccucuccuagcaggcagaagcuguuuuaaagagccauccc

SEQ ID NO: 118052 - RNA, 64 nt, Homo Sapiens
gauuuuuagaucaauuuuuaccacugagaaaagccaggcagaucagcuuuaccaugaaccugcu

SEQ ID NO: 118053 - RNA, 64 nt, Homo Sapiens
acaugcacacaugaagcuggaccgaugugaauggcaggcagauaacauuugcugagcaaggaga

SEQ ID NO: 118054 - RNA, 64 nt, Homo Sapiens
ggggcagugacuggaaaaggacagagcccagggccaggcagacugcucucauugccaauaugga

SEQ ID NO: 118055 - RNA, 64 nt, Homo Sapiens
ugcucucaggaccagagaagggaaaugacuucuccaggcagaggcagaucugagucuagaaccc

SEQ ID NO: 118056 - RNA, 64 nt, Homo Sapiens
aaagcaaaggagaguccugggagcccacaagauccaggcagaaggagauggguuuggggcuggc

SEQ ID NO: 118057 - RNA, 64 nt, Homo Sapiens
uaaacuagcuauccaaaccuuacuauuaaaagcgcaggcagauuuaauuugcuaaauagacuaa

SEQ ID NO: 118058 - RNA, 64 nt, Homo Sapiens
acaaaaccaacaauuuuauuugccucuacuacgucaggcagaauucuucaauuaaguugaacua

SEQ ID NO: 118059 - RNA, 64 nt, Homo Sapiens
cccagcccagcagcuucuguugucuaacguauggcaggcagacugggagcaggaaaacagaggg

SEQ ID NO: 118060 - RNA, 64 nt, Homo Sapiens
ucacuuugcuccucuugcccucugucuucugguccaggcagaucaggggcucuggggaaacugc

SEQ ID NO: 118061 - RNA, 64 nt, Homo Sapiens
ccgacgcagccugaaagagacccagacagagagacaggcagacacagccuaaaacagaccugga

SEQ ID NO: 118062 - RNA, 64 nt, Homo Sapiens
caggcagacacagccuaaaacagaccuggacagacaggcagacguagucugaaacagaccugaa

SEQ ID NO: 118063 - RNA, 64 nt, Homo Sapiens
aagccacccuguugugguaucugcuauggcugcacaggcagaaauagggacacaagugcagguu

SEQ ID NO: 118064 - RNA, 64 nt, Homo Sapiens
caggccuguaaucccagcauuuggaagaccaagacaggcagaucgcuucagcucaggaguucga

SEQ ID NO: 118065 - RNA, 64 nt, Homo Sapiens
aggcuggacucagcaggaacaccaaaucccggaccaggcagaaaccacccaagacugaggggcu

SEQ ID NO: 118066 - RNA, 64 nt, Homo Sapiens
agacuaacggcuaaagagacugaugcaucaacaccaggcagagaauaaagcagauuuuuuuguu

SEQ ID NO: 118067 - RNA, 63 nt, Homo Sapiens
aagcagaaagagcucauugaaucaugcauaccaugcagaaaguugagcuuuuagguuuugucc

SEQ ID NO: 118068 - RNA, 64 nt, Homo Sapiens
auauagugaggaguagcauaauauuuuuuaauaaugcagaaaacaucacugaaaugagagucac

SEQ ID NO: 118069 - RNA, 64 nt, Homo Sapiens
agcugucugcugaugaacggaaacccggucagcgugcagaaaccaucaugcggucagagugcag

SEQ ID NO: 118070 - RNA, 64 nt, Homo Sapiens
cggucagcgugcagaaaccaucaugcggucagagugcagaaaccuaacaguaggacacauccca

SEQ ID NO: 118071 - RNA, 64 nt, Homo Sapiens
uuggggaaaagggcccuuuccugaaaagugaguuugcagaaacccauugaggagacuccacaga

SEQ ID NO: 118072 - RNA, 64 nt, Homo Sapiens
cuucuguacucguugguaaaaccaguugauaaaaugcagaaaccagugggaccaguguugccac

SEQ ID NO: 118073 - RNA, 64 nt, Homo Sapiens
cuuugaaauagguucugccauccucuacgcucauugcagaaauaaaggcgggucccaaguucuc

SEQ ID NO: 118074 - RNA, 64 nt, Homo Sapiens
ugauugaaguaaggaguaaucacacuccuuggccugcagaaaugugaauccccaauuauugagg

SEQ ID NO: 118075 - RNA, 64 nt, Homo Sapiens
ccgcaaggcugugacagacucccagaggagauagugcagaaauuaccguccgaauaacagacag

SEQ ID NO: 118076 - RNA, 64 nt, Homo Sapiens
cuauaaacucuuugcuguuuuaugugcaaacuggugcagaaauucaguuuuguaaucacugacu

SEQ ID NO: 118077 - RNA, 64 nt, Homo Sapiens
aagaaaaacuaugguguaaucagaaagaaugauuugcagaaagaguuuggaaaaaacugcaaau

SEQ ID NO: 118078 - RNA, 64 nt, Homo Sapiens
uuuuuugucguguaagaaggaugcuggucagagcugcagaaaauaugaggcaauuaaaagucuu

SEQ ID NO: 118079 - RNA, 64 nt, Homo Sapiens
uuagaaauauauuggcagccaagacucugaacucugcagaaacauuuguuucacccagacuuca

SEQ ID NO: 118080 - RNA, 64 nt, Homo Sapiens
uauaaagaauuuggagauuguauagcauuuuuaaugcagaaaauaaauauuuguugacuaaaau

SEQ ID NO: 118081 - RNA, 64 nt, Homo Sapiens
auauagucuccucagauuuucucagaaaucuuaaugcagaaauugauagugccaaaaaaaaaau

SEQ ID NO: 118082 - RNA, 64 nt, Homo Sapiens
uauuacaaguugcuaguuuauaaugucuuacuaaugcagaaacaaggaaaaaagcaaaauuggc

SEQ ID NO: 118083 - RNA, 64 nt, Homo Sapiens
caauuuauaaaccuccccuucaaaacuaaggaguugcagaaaaaaauggauuucacagagccuu

SEQ ID NO: 118084 - RNA, 64 nt, Homo Sapiens
uuaaagaggaaauuaaucuuuauauauuauuucuugcagaaacauucauuauuuuauuaauauu

SEQ ID NO: 118085 - RNA, 64 nt, Homo Sapiens
gcauugaagaaaaaauguugagauaaaauugcugugcagaaaaaaguguuaaugaagccgaccu

SEQ ID NO: 118086 - RNA, 64 nt, Homo Sapiens
acguccuugauuaaaucaccccaauaugccccuuugcagaaaguauuggcuuuucccugaauuc

SEQ ID NO: 118087 - RNA, 64 nt, Homo Sapiens
augguaaaaaaaaucuugggauugagagucuucuugcagaaacuucucagccaaaguaaaaagg

SEQ ID NO: 118088 - RNA, 64 nt, Homo Sapiens
auuguuuaaauuugcuaguggauuuugucuaaugugcagaaauauauaugucuaaugugcagaa

SEQ ID NO: 118089 - RNA, 64 nt, Homo Sapiens
uuugucuaaugugcagaaauauauaugucuaaugugcagaaauauauauguguguaugugugua

SEQ ID NO: 118090 - RNA, 64 nt, Homo Sapiens
aauaucuguuucuugguggucuuuuauacuauauugcagaaaccaagacuggauugauugugga

SEQ ID NO: 118091 - RNA, 64 nt, Homo Sapiens
aacagaaucacucacacauacuuuuugccucuaaugcagaaaucuguucaaucggguuucuuuu

SEQ ID NO: 118092 - RNA, 64 nt, Homo Sapiens
gugcuauuauguaacuguggugauguucaacaguugcagaaauuucaauucuaauaaauaaugc

SEQ ID NO: 118093 - RNA, 64 nt, Homo Sapiens
uggucagaugaccaguguaguaccuucuuagcauugcagaaaggacugcuguuuggucaaagaa

SEQ ID NO: 118094 - RNA, 64 nt, Homo Sapiens
agaauuuuuauaccaucuacaucuauccuacuuaugcagaaaaauaggcaauaagaacuucauu

SEQ ID NO: 118095 - RNA, 64 nt, Homo Sapiens
cacugauucucuagaacacugggcaugaggauguugcagaaaucuagauggugggucccacaga

SEQ ID NO: 118096 - RNA, 64 nt, Homo Sapiens
ggaagagcuacccgugguugcucuacgauaagguugcagaaaugcauuggaggccuucaucccu

SEQ ID NO: 118097 - RNA, 64 nt, Homo Sapiens
cuaagucucaagggcuucagacuucaucucuagcugcagaaacagggccaaacuuacuaccuug

SEQ ID NO: 118098 - RNA, 64 nt, Homo Sapiens
uuugauuaaaucuuaauggggugaggguuuggggugcagaaaacucaucauagaggucuguuuu

SEQ ID NO: 118099 - RNA, 64 nt, Homo Sapiens
uccaaaagauugcuguagcuaggggaaaauuugcugcagaaaaugccuuuguagggacagcaaa

SEQ ID NO: 118100 - RNA, 64 nt, Homo Sapiens
gauuggaaacagcuaaauuagguauuuuauuagaugcagaaacaaaacugccaaaugcuuaccu

SEQ ID NO: 118101 - RNA, 64 nt, Homo Sapiens
uugcuuuuuuguaucacuuucauuuauuuuguacugcagaaaaauauuaagggaagcgcaaaca

SEQ ID NO: 118102 - RNA, 64 nt, Homo Sapiens
ugguguacauaaaacugucucauuauuauaaaguugcagaaauuuuuagguuguuucuaauuuu

SEQ ID NO: 118103 - RNA, 64 nt, Homo Sapiens
uauaaaaaagcaaaaaugaugaaaacuugaaaaaugcagaaaugaaaauaauauacucaucaua

SEQ ID NO: 118104 - RNA, 64 nt, Homo Sapiens
uucugguucccaaagucauugauauucagacaucugcagaaaugccuuuuagagauagguucuu

SEQ ID NO: 118105 - RNA, 64 nt, Homo Sapiens
uacugagcuguuguuacccuuuuuuccaugaaucugcagaaaauagggauaucuuuuuuauauu

SEQ ID NO: 118106 - RNA, 64 nt, Homo Sapiens
aggaucagggaaagauuuuacuucccccacccagugcagaaaucgcuuuugcuuuuguuuguuu

SEQ ID NO: 118107 - RNA, 64 nt, Homo Sapiens
agaacuuagccaaaccuaagccuuuacuugccuuugcagaaaacuacugaacacuuggaaguca

SEQ ID NO: 118108 - RNA, 64 nt, Homo Sapiens
agagaggcgggccccagacccaugugcugggaaaugcagaaaucacguugcuggugguuuuuca

SEQ ID NO: 118109 - RNA, 64 nt, Homo Sapiens
uucaguugcuuugcccaagauaggaguucucugaugcagaaauuauugggcucuuuuaggguaa

SEQ ID NO: 118110 - RNA, 64 nt, Homo Sapiens
aauggcuguccaguuuauuaaagaugccuugucgugcagaaacacucccgauugcuccugugua

SEQ ID NO: 118111 - RNA, 64 nt, Homo Sapiens
auguguaugaagcuuagauaugaagagaggggucugcagaaaggcucaccuuugggaguaauac

SEQ ID NO: 118112 - RNA, 64 nt, Homo Sapiens
gggguaagaaagggcacaugcauaugaaacaaucugcagaaaguggucacguggaggguacguu

SEQ ID NO: 118113 - RNA, 64 nt, Homo Sapiens
agcuggagcucauggguuuugcuguuggccacgcugcagaaaugugugacaguguacaguggca

SEQ ID NO: 118114 - RNA, 64 nt, Homo Sapiens
uuucuaaucucagaucggggucuucacaccaacaugcagaaaagauaaacacugucuucuuucg

SEQ ID NO: 118115 - RNA, 64 nt, Homo Sapiens
ggaaaucuuccaugcccugcaggcauucaauuccugcagaaaccgauguuauggaaggcgugcu

SEQ ID NO: 118116 - RNA, 64 nt, Homo Sapiens
gggaccuguuuuuuuucucauuugauuuugcuugugcagaaaauaguuuccagcacauggauug

SEQ ID NO: 118117 - RNA, 64 nt, Homo Sapiens
accaacuuccuuagauuuuuuuuuuuaagcuguuugcagaaaacugggugguagcgugucugaa

SEQ ID NO: 118118 - RNA, 64 nt, Homo Sapiens
ccagggcaggacaguuaucggauaaucugaggaaugcagaaaaagcaggaggacaauucccaca

SEQ ID NO: 118119 - RNA, 64 nt, Homo Sapiens
uccaucaggcuguuuccuaagacagaggaagcccugcagaaaguaugccagugcuccgagcuca

SEQ ID NO: 118120 - RNA, 64 nt, Homo Sapiens
cagaggacuagagccaaaaaagauuacauaaaagugcagaaagcucuuuccaagaugaacuuga

SEQ ID NO: 118121 - RNA, 64 nt, Homo Sapiens
cagaggacuagaggccaagaagauuacaucaaugugcagaaagcucuuaccaaaaugagugugc

SEQ ID NO: 118122 - RNA, 64 nt, Homo Sapiens
ggcuauguauugcacauuggcaagugcucuggggaugaggcauggguauaggaagggagaaagg

SEQ ID NO: 118123 - RNA, 64 nt, Homo Sapiens
ggaagagaacugggcugacuccaggaccuccaggaugaggcagaggcaugaugcuuccugcuca

SEQ ID NO: 118124 - RNA, 64 nt, Homo Sapiens
uccccugaaaaaguuaaugcuugaacuuuuuaagaugaggcaguaaauaauauuaaaguauuau

SEQ ID NO: 118125 - RNA, 64 nt, Homo Sapiens
uucaagauauuuguaaaagauuuauaauucuugaaugaggcaauuugcuucagaauuagauugc

SEQ ID NO: 118126 - RNA, 64 nt, Homo Sapiens
cuggaggcaggcccgggaaggcugcuguuuacucaucgggcagccacgugcucucuggaggaag

SEQ ID NO: 118127 - RNA, 64 nt, Homo Sapiens
ucccaguuccagcuuccuaaaauagacaguggguaucgggcagcagucacuggggcucaagggc

SEQ ID NO: 118128 - RNA, 64 nt, Homo Sapiens
aguuuucaguguguuggguguggggucuuuguggaucgggcaggaugcugcccaucgcuugcac

SEQ ID NO: 118129 - RNA, 64 nt, Homo Sapiens
aggauaacaucucucagugaagagccagaacucuaucgggcaccuggcugcugccucagcacag

SEQ ID NO: 118130 - RNA, 64 nt, Homo Sapiens
agcuuccauggucacugcuaagcaguagccagccaucgggcauuaauugauuuccuacuauauu

SEQ ID NO: 118131 - RNA, 64 nt, Homo Sapiens
caguggagccgcacacggccgcccccagcccaggaucgggcacuguuggguuuggggggacggu

SEQ ID NO: 118132 - RNA, 64 nt, Homo Sapiens
caaugagaacuuaucauguugguguguuagguaaaucgggcaaauaugauagugucuuacauug

SEQ ID NO: 118133 - RNA, 64 nt, Homo Sapiens
gaaacuugauauuguauuaaagaacuguaaggcaaucgggcaguauugccauaaauuguaguua

SEQ ID NO: 118134 - RNA, 64 nt, Homo Sapiens
guggcucccgccuguaauccauucacaggguaagaucgggcacaaaguugaggcagguugaagg

SEQ ID NO: 118135 - RNA, 64 nt, Homo Sapiens
acagucuggcccuccagacaagagcagcgcuggcaucgggcaggugauuccugacaccugcugc

SEQ ID NO: 118136 - RNA, 64 nt, Homo Sapiens
cuauauucauuaagguuuauuccauuuaguuaaaaucgggcacuaccauuaucuguuuaaagga

SEQ ID NO: 118137 - RNA, 64 nt, Homo Sapiens
gaaauuaguuucaaauuuaccucagcguuuguguaucgggcaaaaaucguuuugcccgauuccg

SEQ ID NO: 118138 - RNA, 64 nt, Homo Sapiens
uuucuaagugugauuuuccuugcauaaauaccucaucgggcagcaacuccagaaccacucuuuu

SEQ ID NO: 118139 - RNA, 64 nt, Homo Sapiens
cguuuucugcaaugguuuagugggguuuguuuucaucgggcauacuucuuggcuucucugguga

SEQ ID NO: 118140 - RNA, 64 nt, Homo Sapiens
acugacacugugucuugugaggaacaggaaggacaucgggcagggggcaccaggaacaccgucu

SEQ ID NO: 118141 - RNA, 64 nt, Homo Sapiens
gggacuucaccaggggguuuucuucccucaggcuaucgggcaggcacauauauccacucacaug

SEQ ID NO: 118142 - RNA, 64 nt, Homo Sapiens
ggggcuccggcccgggaccccuuccggcccaucuaucgggcaccagccgggccucgccgcgacc

SEQ ID NO: 118143 - RNA, 64 nt, Homo Sapiens
ggagaagugcauugaugugagaggagcagugccaaucgggcagaaguuugcaaauaggcagaau

SEQ ID NO: 118144 - RNA, 64 nt, Homo Sapiens
ggguuugggaugggugucuaaggcaggaguugacaucgggcaaccaaagaaaugaguuuugggg

SEQ ID NO: 118145 - RNA, 64 nt, Homo Sapiens
cccuugagugacagcccagggacuuaauguggccaucgggcaucaagcacaaggccaugcaggu

SEQ ID NO: 118146 - RNA, 64 nt, Homo Sapiens
ggggacgcagugccccagcugggaagagggcgggaucgggcacugguuccuccuuguccccgcu

SEQ ID NO: 118147 - RNA, 64 nt, Homo Sapiens
cuucccugugugccaacgccagucgaggcacgucaucgggcagcuccuucaguaaauguaacac

SEQ ID NO: 118148 - RNA, 64 nt, Homo Sapiens
gggagguggccaggccugccccuaaagcaggcugaucgggcaaugaagaggggccagaugacac

SEQ ID NO: 118149 - RNA, 64 nt, Homo Sapiens
gggaucuggggagggcuagcccaaaaccucccgcaucgggcaggcacccccugaaguacuuccu

SEQ ID NO: 118150 - RNA, 64 nt, Homo Sapiens
uugcugcugcugaauccuuucuggggacuuucucaucgggcagggagcagagggcuucucguuc

SEQ ID NO: 118151 - RNA, 64 nt, Homo Sapiens
guaucaagagcaugcaaaaccuccuuuggacgcgaucgggcacucugauggcaccaaaucuuga

SEQ ID NO: 118152 - RNA, 64 nt, Homo Sapiens
gccugcugccuccagacucugauccaggcugcuggagauccaauuuggugggaaguaagcugga

SEQ ID NO: 118153 - RNA, 64 nt, Homo Sapiens
cugcuggagauccaaugccuugggaaguaagcuggagauccagguccacuguaccaagacuugg

SEQ ID NO: 118154 - RNA, 64 nt, Homo Sapiens
uccucuccucugcaggacaugcugcccaugccaggagauccaacccaggggacuggcaacuaua

SEQ ID NO: 118155 - RNA, 64 nt, Homo Sapiens
gcuccacauuaaaccccagcccugucuggccagggagauccaugugcucaauguugcuggggga

SEQ ID NO: 118156 - RNA, 64 nt, Homo Sapiens
ugccugggcugcuccugucccacccacccucacugagauccauguaaggggcuccucuucccac

SEQ ID NO: 118157 - RNA, 64 nt, Homo Sapiens
gggggcccugaguggcaaguugcuuagcuaacaggagauccauaggcagccugcaggcuaggaa

SEQ ID NO: 118158 - RNA, 64 nt, Homo Sapiens
gcuguuucugguugggaagcguaaaagccagggagagauccagagaguuuucaaguuuuugcag

SEQ ID NO: 118159 - RNA, 64 nt, Homo Sapiens
aaaaacauucaaggguucugcccccagauuucgggagauccacguuccauguucugauugguuu

SEQ ID NO: 118160 - RNA, 64 nt, Homo Sapiens; identical to SEQ ID NO: 118126

SEQ ID NO: 118161 - RNA, 64 nt, Homo Sapiens; identical to SEQ ID NO: 118127

SEQ ID NO: 118162 - RNA, 64 nt, Homo Sapiens; identical to SEQ ID NO: 118128

SEQ ID NO: 118163 - RNA, 64 nt, Homo Sapiens; identical to SEQ ID NO: 118129

SEQ ID NO: 118164 - RNA, 64 nt, Homo Sapiens; identical to SEQ ID NO: 118130

SEQ ID NO: 118165 - RNA, 64 nt, Homo Sapiens; identical to SEQ ID NO: 118131

SEQ ID NO: 118166 - RNA, 64 nt, Homo Sapiens; identical to SEQ ID NO: 118132

SEQ ID NO: 118167 - RNA, 64 nt, Homo Sapiens; identical to SEQ ID NO: 118133

SEQ ID NO: 118168 - RNA, 64 nt, Homo Sapiens; identical to SEQ ID NO: 118134

SEQ ID NO: 118169 - RNA, 64 nt, Homo Sapiens; identical to SEQ ID NO: 118135

SEQ ID NO: 118170 - RNA, 64 nt, Homo Sapiens; identical to SEQ ID NO: 118136

SEQ ID NO: 118171 - RNA, 64 nt, Homo Sapiens; identical to SEQ ID NO: 118137

SEQ ID NO: 118172 - RNA, 64 nt, Homo Sapiens; identical to SEQ ID NO: 118138

SEQ ID NO: 118173 - RNA, 64 nt, Homo Sapiens; identical to SEQ ID NO: 118139

SEQ ID NO: 118174 - RNA, 64 nt, Homo Sapiens; identical to SEQ ID NO: 118140

SEQ ID NO: 118175 - RNA, 64 nt, Homo Sapiens; identical to SEQ ID NO: 118141

SEQ ID NO: 118176 - RNA, 64 nt, Homo Sapiens; identical to SEQ ID NO: 118142

SEQ ID NO: 118177 - RNA, 64 nt, Homo Sapiens; identical to SEQ ID NO: 118143

SEQ ID NO: 118178 - RNA, 64 nt, Homo Sapiens; identical to SEQ ID NO: 118144

SEQ ID NO: 118179 - RNA, 64 nt, Homo Sapiens; identical to SEQ ID NO: 118145

SEQ ID NO: 118180 - RNA, 64 nt, Homo Sapiens; identical to SEQ ID NO: 118146

SEQ ID NO: 118181 - RNA, 64 nt, Homo Sapiens; identical to SEQ ID NO: 118147

SEQ ID NO: 118182 - RNA, 64 nt, Homo Sapiens; identical to SEQ ID NO: 118148

SEQ ID NO: 118183 - RNA, 64 nt, Homo Sapiens; identical to SEQ ID NO: 118149

SEQ ID NO: 118184 - RNA, 64 nt, Homo Sapiens; identical to SEQ ID NO: 118150

SEQ ID NO: 118185 - RNA, 64 nt, Homo Sapiens; identical to SEQ ID NO: 118151

SEQ ID NO: 118186 - RNA, 64 nt, Homo Sapiens; identical to SEQ ID NO: 118152

SEQ ID NO: 118187 - RNA, 64 nt, Homo Sapiens; identical to SEQ ID NO: 118153

SEQ ID NO: 118188 - RNA, 64 nt, Homo Sapiens; identical to SEQ ID NO: 118154

SEQ ID NO: 118189 - RNA, 64 nt, Homo Sapiens; identical to SEQ ID NO: 118155

SEQ ID NO: 118190 - RNA, 64 nt, Homo Sapiens; identical to SEQ ID NO: 118156

SEQ ID NO: 118191 - RNA, 64 nt, Homo Sapiens; identical to SEQ ID NO: 118157

SEQ ID NO: 118192 - RNA, 64 nt, Homo Sapiens; identical to SEQ ID NO: 118158

SEQ ID NO: 118193 - RNA, 64 nt, Homo Sapiens; identical to SEQ ID NO: 118159

SEQ ID NO: 118194 - RNA, 64 nt, Homo Sapiens; identical to SEQ ID NO: 118126

SEQ ID NO: 118195 - RNA, 64 nt, Homo Sapiens; identical to SEQ ID NO: 118127

SEQ ID NO: 118196 - RNA, 64 nt, Homo Sapiens; identical to SEQ ID NO: 118128

SEQ ID NO: 118197 - RNA, 64 nt, Homo Sapiens; identical to SEQ ID NO: 118129

SEQ ID NO: 118198 - RNA, 64 nt, Homo Sapiens; identical to SEQ ID NO: 118130

SEQ ID NO: 118199 - RNA, 64 nt, Homo Sapiens; identical to SEQ ID NO: 118131

SEQ ID NO: 118200 - RNA, 64 nt, Homo Sapiens; identical to SEQ ID NO: 118132

SEQ ID NO: 118201 - RNA, 64 nt, Homo Sapiens; identical to SEQ ID NO: 118133

SEQ ID NO: 118202 - RNA, 64 nt, Homo Sapiens; identical to SEQ ID NO: 118134

SEQ ID NO: 118203 - RNA, 64 nt, Homo Sapiens; identical to SEQ ID NO: 118135

SEQ ID NO: 118204 - RNA, 64 nt, Homo Sapiens; identical to SEQ ID NO: 118136

SEQ ID NO: 118205 - RNA, 64 nt, Homo Sapiens; identical to SEQ ID NO: 118137

SEQ ID NO: 118206 - RNA, 64 nt, Homo Sapiens; identical to SEQ ID NO: 118138

SEQ ID NO: 118207 - RNA, 64 nt, Homo Sapiens; identical to SEQ ID NO: 118139

SEQ ID NO: 118208 - RNA, 64 nt, Homo Sapiens; identical to SEQ ID NO: 118140

SEQ ID NO: 118209 - RNA, 64 nt, Homo Sapiens; identical to SEQ ID NO: 118141

SEQ ID NO: 118210 - RNA, 64 nt, Homo Sapiens; identical to SEQ ID NO: 118142

SEQ ID NO: 118211 - RNA, 64 nt, Homo Sapiens; identical to SEQ ID NO: 118143

SEQ ID NO: 118212 - RNA, 64 nt, Homo Sapiens; identical to SEQ ID NO: 118144

SEQ ID NO: 118213 - RNA, 64 nt, Homo Sapiens; identical to SEQ ID NO: 118145

SEQ ID NO: 118214 - RNA, 64 nt, Homo Sapiens; identical to SEQ ID NO: 118146

SEQ ID NO: 118215 - RNA, 64 nt, Homo Sapiens; identical to SEQ ID NO: 118147

SEQ ID NO: 118216 - RNA, 64 nt, Homo Sapiens; identical to SEQ ID NO: 118148

SEQ ID NO: 118217 - RNA, 64 nt, Homo Sapiens; identical to SEQ ID NO: 118149

SEQ ID NO: 118218 - RNA, 64 nt, Homo Sapiens; identical to SEQ ID NO: 118150

SEQ ID NO: 118219 - RNA, 64 nt, Homo Sapiens; identical to SEQ ID NO: 118151

SEQ ID NO: 118220 - RNA, 64 nt, Homo Sapiens; identical to SEQ ID NO: 118152

SEQ ID NO: 118221 - RNA, 64 nt, Homo Sapiens; identical to SEQ ID NO: 118153

SEQ ID NO: 118222 - RNA, 64 nt, Homo Sapiens; identical to SEQ ID NO: 118154

SEQ ID NO: 118223 - RNA, 64 nt, Homo Sapiens; identical to SEQ ID NO: 118155

SEQ ID NO: 118224 - RNA, 64 nt, Homo Sapiens; identical to SEQ ID NO: 118156

SEQ ID NO: 118225 - RNA, 64 nt, Homo Sapiens; identical to SEQ ID NO: 118157

SEQ ID NO: 118226 - RNA, 64 nt, Homo Sapiens; identical to SEQ ID NO: 118158

SEQ ID NO: 118227 - RNA, 64 nt, Homo Sapiens; identical to SEQ ID NO: 118159

SEQ ID NO: 118228 - RNA, 64 nt, Homo Sapiens; identical to SEQ ID NO: 118126

SEQ ID NO: 118229 - RNA, 64 nt, Homo Sapiens; identical to SEQ ID NO: 118127

SEQ ID NO: 118230 - RNA, 64 nt, Homo Sapiens; identical to SEQ ID NO: 118128

SEQ ID NO: 118231 - RNA, 64 nt, Homo Sapiens; identical to SEQ ID NO: 118129

SEQ ID NO: 118232 - RNA, 64 nt, Homo Sapiens; identical to SEQ ID NO: 118130

SEQ ID NO: 118233 - RNA, 64 nt, Homo Sapiens; identical to SEQ ID NO: 118131

SEQ ID NO: 118234 - RNA, 64 nt, Homo Sapiens; identical to SEQ ID NO: 118132

SEQ ID NO: 118235 - RNA, 64 nt, Homo Sapiens; identical to SEQ ID NO: 118133

SEQ ID NO: 118236 - RNA, 64 nt, Homo Sapiens; identical to SEQ ID NO: 118134

SEQ ID NO: 118237 - RNA, 64 nt, Homo Sapiens; identical to SEQ ID NO: 118135

SEQ ID NO: 118238 - RNA, 64 nt, Homo Sapiens; identical to SEQ ID NO: 118136

SEQ ID NO: 118239 - RNA, 64 nt, Homo Sapiens; identical to SEQ ID NO: 118137

SEQ ID NO: 118240 - RNA, 64 nt, Homo Sapiens; identical to SEQ ID NO: 118138

SEQ ID NO: 118241 - RNA, 64 nt, Homo Sapiens; identical to SEQ ID NO: 118139

SEQ ID NO: 118242 - RNA, 64 nt, Homo Sapiens; identical to SEQ ID NO: 118140

SEQ ID NO: 118243 - RNA, 64 nt, Homo Sapiens; identical to SEQ ID NO: 118141

SEQ ID NO: 118244 - RNA, 64 nt, Homo Sapiens; identical to SEQ ID NO: 118142

SEQ ID NO: 118245 - RNA, 64 nt, Homo Sapiens; identical to SEQ ID NO: 118143

SEQ ID NO: 118246 - RNA, 64 nt, Homo Sapiens; identical to SEQ ID NO: 118144

SEQ ID NO: 118247 - RNA, 64 nt, Homo Sapiens; identical to SEQ ID NO: 118145

SEQ ID NO: 118248 - RNA, 64 nt, Homo Sapiens; identical to SEQ ID NO: 118146

SEQ ID NO: 118249 - RNA, 64 nt, Homo Sapiens; identical to SEQ ID NO: 118147

SEQ ID NO: 118250 - RNA, 64 nt, Homo Sapiens; identical to SEQ ID NO: 118148

SEQ ID NO: 118251 - RNA, 64 nt, Homo Sapiens; identical to SEQ ID NO: 118149

SEQ ID NO: 118252 - RNA, 64 nt, Homo Sapiens; identical to SEQ ID NO: 118150

SEQ ID NO: 118253 - RNA, 64 nt, Homo Sapiens; identical to SEQ ID NO: 118151

SEQ ID NO: 118254 - RNA, 64 nt, Homo Sapiens; identical to SEQ ID NO: 118152

SEQ ID NO: 118255 - RNA, 64 nt, Homo Sapiens; identical to SEQ ID NO: 118153

SEQ ID NO: 118256 - RNA, 64 nt, Homo Sapiens; identical to SEQ ID NO: 118154

SEQ ID NO: 118257 - RNA, 64 nt, Homo Sapiens; identical to SEQ ID NO: 118155

SEQ ID NO: 118258 - RNA, 64 nt, Homo Sapiens; identical to SEQ ID NO: 118156

SEQ ID NO: 118259 - RNA, 64 nt, Homo Sapiens; identical to SEQ ID NO: 118157

SEQ ID NO: 118260 - RNA, 64 nt, Homo Sapiens; identical to SEQ ID NO: 118158

SEQ ID NO: 118261 - RNA, 64 nt, Homo Sapiens; identical to SEQ ID NO: 118159

SEQ ID NO: 118262 - RNA, 64 nt, Homo Sapiens; identical to SEQ ID NO: 118126

SEQ ID NO: 118263 - RNA, 64 nt, Homo Sapiens; identical to SEQ ID NO: 118127

SEQ ID NO: 118264 - RNA, 64 nt, Homo Sapiens; identical to SEQ ID NO: 118128

SEQ ID NO: 118265 - RNA, 64 nt, Homo Sapiens; identical to SEQ ID NO: 118129

SEQ ID NO: 118266 - RNA, 64 nt, Homo Sapiens; identical to SEQ ID NO: 118130

SEQ ID NO: 118267 - RNA, 64 nt, Homo Sapiens; identical to SEQ ID NO: 118131

SEQ ID NO: 118268 - RNA, 64 nt, Homo Sapiens; identical to SEQ ID NO: 118132

SEQ ID NO: 118269 - RNA, 64 nt, Homo Sapiens; identical to SEQ ID NO: 118133

SEQ ID NO: 118270 - RNA, 64 nt, Homo Sapiens; identical to SEQ ID NO: 118134

SEQ ID NO: 118271 - RNA, 64 nt, Homo Sapiens; identical to SEQ ID NO: 118135

SEQ ID NO: 118272 - RNA, 64 nt, Homo Sapiens; identical to SEQ ID NO: 118136

SEQ ID NO: 118273 - RNA, 64 nt, Homo Sapiens; identical to SEQ ID NO: 118137

SEQ ID NO: 118274 - RNA, 64 nt, Homo Sapiens; identical to SEQ ID NO: 118138

SEQ ID NO: 118275 - RNA, 64 nt, Homo Sapiens; identical to SEQ ID NO: 118139

SEQ ID NO: 118276 - RNA, 64 nt, Homo Sapiens; identical to SEQ ID NO: 118140

SEQ ID NO: 118277 - RNA, 64 nt, Homo Sapiens; identical to SEQ ID NO: 118141

SEQ ID NO: 118278 - RNA, 64 nt, Homo Sapiens; identical to SEQ ID NO: 118142

SEQ ID NO: 118279 - RNA, 64 nt, Homo Sapiens; identical to SEQ ID NO: 118143

SEQ ID NO: 118280 - RNA, 64 nt, Homo Sapiens; identical to SEQ ID NO: 118144

SEQ ID NO: 118281 - RNA, 64 nt, Homo Sapiens; identical to SEQ ID NO: 118145

SEQ ID NO: 118282 - RNA, 64 nt, Homo Sapiens; identical to SEQ ID NO: 118146

SEQ ID NO: 118283 - RNA, 64 nt, Homo Sapiens; identical to SEQ ID NO: 118147

SEQ ID NO: 118284 - RNA, 64 nt, Homo Sapiens; identical to SEQ ID NO: 118148

SEQ ID NO: 118285 - RNA, 64 nt, Homo Sapiens; identical to SEQ ID NO: 118149

SEQ ID NO: 118286 - RNA, 64 nt, Homo Sapiens; identical to SEQ ID NO: 118150

SEQ ID NO: 118287 - RNA, 64 nt, Homo Sapiens; identical to SEQ ID NO: 118151

SEQ ID NO: 118288 - RNA, 64 nt, Homo Sapiens; identical to SEQ ID NO: 118152

SEQ ID NO: 118289 - RNA, 64 nt, Homo Sapiens; identical to SEQ ID NO: 118153

SEQ ID NO: 118290 - RNA, 64 nt, Homo Sapiens; identical to SEQ ID NO: 118154

SEQ ID NO: 118291 - RNA, 64 nt, Homo Sapiens; identical to SEQ ID NO: 118155

SEQ ID NO: 118292 - RNA, 64 nt, Homo Sapiens; identical to SEQ ID NO: 118156

SEQ ID NO: 118293 - RNA, 64 nt, Homo Sapiens; identical to SEQ ID NO: 118157

SEQ ID NO: 118294 - RNA, 64 nt, Homo Sapiens; identical to SEQ ID NO: 118158

SEQ ID NO: 118295 - RNA, 64 nt, Homo Sapiens; identical to SEQ ID NO: 118159

SEQ ID NO: 118296 - RNA, 64 nt, Homo Sapiens; identical to SEQ ID NO: 118126

SEQ ID NO: 118297 - RNA, 64 nt, Homo Sapiens; identical to SEQ ID NO: 118127

SEQ ID NO: 118298 - RNA, 64 nt, Homo Sapiens; identical to SEQ ID NO: 118128

SEQ ID NO: 118299 - RNA, 64 nt, Homo Sapiens; identical to SEQ ID NO: 118129

SEQ ID NO: 118300 - RNA, 64 nt, Homo Sapiens; identical to SEQ ID NO: 118130

SEQ ID NO: 118301 - RNA, 64 nt, Homo Sapiens; identical to SEQ ID NO: 118131

SEQ ID NO: 118302 - RNA, 64 nt, Homo Sapiens; identical to SEQ ID NO: 118132

SEQ ID NO: 118303 - RNA, 64 nt, Homo Sapiens; identical to SEQ ID NO: 118133

SEQ ID NO: 118304 - RNA, 64 nt, Homo Sapiens; identical to SEQ ID NO: 118134

SEQ ID NO: 118305 - RNA, 64 nt, Homo Sapiens; identical to SEQ ID NO: 118135

SEQ ID NO: 118306 - RNA, 64 nt, Homo Sapiens; identical to SEQ ID NO: 118136

SEQ ID NO: 118307 - RNA, 64 nt, Homo Sapiens; identical to SEQ ID NO: 118137

SEQ ID NO: 118308 - RNA, 64 nt, Homo Sapiens; identical to SEQ ID NO: 118138

SEQ ID NO: 118309 - RNA, 64 nt, Homo Sapiens; identical to SEQ ID NO: 118139

SEQ ID NO: 118310 - RNA, 64 nt, Homo Sapiens; identical to SEQ ID NO: 118140

SEQ ID NO: 118311 - RNA, 64 nt, Homo Sapiens; identical to SEQ ID NO: 118141

SEQ ID NO: 118312 - RNA, 64 nt, Homo Sapiens; identical to SEQ ID NO: 118142

SEQ ID NO: 118313 - RNA, 64 nt, Homo Sapiens; identical to SEQ ID NO: 118143

SEQ ID NO: 118314 - RNA, 64 nt, Homo Sapiens; identical to SEQ ID NO: 118144

SEQ ID NO: 118315 - RNA, 64 nt, Homo Sapiens; identical to SEQ ID NO: 118145

SEQ ID NO: 118316 - RNA, 64 nt, Homo Sapiens; identical to SEQ ID NO: 118146

SEQ ID NO: 118317 - RNA, 64 nt, Homo Sapiens; identical to SEQ ID NO: 118147

SEQ ID NO: 118318 - RNA, 64 nt, Homo Sapiens; identical to SEQ ID NO: 118148

SEQ ID NO: 118319 - RNA, 64 nt, Homo Sapiens; identical to SEQ ID NO: 118149

SEQ ID NO: 118320 - RNA, 64 nt, Homo Sapiens; identical to SEQ ID NO: 118150

SEQ ID NO: 118321 - RNA, 64 nt, Homo Sapiens; identical to SEQ ID NO: 118151

SEQ ID NO: 118322 - RNA, 64 nt, Homo Sapiens; identical to SEQ ID NO: 118152

SEQ ID NO: 118323 - RNA, 64 nt, Homo Sapiens; identical to SEQ ID NO: 118153

SEQ ID NO: 118324 - RNA, 64 nt, Homo Sapiens; identical to SEQ ID NO: 118154

SEQ ID NO: 118325 - RNA, 64 nt, Homo Sapiens; identical to SEQ ID NO: 118155

SEQ ID NO: 118326 - RNA, 64 nt, Homo Sapiens; identical to SEQ ID NO: 118156

SEQ ID NO: 118327 - RNA, 64 nt, Homo Sapiens; identical to SEQ ID NO: 118157

SEQ ID NO: 118328 - RNA, 64 nt, Homo Sapiens; identical to SEQ ID NO: 118158

SEQ ID NO: 118329 - RNA, 64 nt, Homo Sapiens; identical to SEQ ID NO: 118159

SEQ ID NO: 118330 - RNA, 64 nt, Homo Sapiens; identical to SEQ ID NO: 118126

SEQ ID NO: 118331 - RNA, 64 nt, Homo Sapiens; identical to SEQ ID NO: 118127

SEQ ID NO: 118332 - RNA, 64 nt, Homo Sapiens; identical to SEQ ID NO: 118128

SEQ ID NO: 118333 - RNA, 64 nt, Homo Sapiens; identical to SEQ ID NO: 118129

SEQ ID NO: 118334 - RNA, 64 nt, Homo Sapiens; identical to SEQ ID NO: 118130

SEQ ID NO: 118335 - RNA, 64 nt, Homo Sapiens; identical to SEQ ID NO: 118131

SEQ ID NO: 118336 - RNA, 64 nt, Homo Sapiens; identical to SEQ ID NO: 118132

SEQ ID NO: 118337 - RNA, 64 nt, Homo Sapiens; identical to SEQ ID NO: 118133

SEQ ID NO: 118338 - RNA, 64 nt, Homo Sapiens; identical to SEQ ID NO: 118134

SEQ ID NO: 118339 - RNA, 64 nt, Homo Sapiens; identical to SEQ ID NO: 118135

SEQ ID NO: 118340 - RNA, 64 nt, Homo Sapiens; identical to SEQ ID NO: 118136

SEQ ID NO: 118341 - RNA, 64 nt, Homo Sapiens; identical to SEQ ID NO: 118137

SEQ ID NO: 118342 - RNA, 64 nt, Homo Sapiens; identical to SEQ ID NO: 118138

SEQ ID NO: 118343 - RNA, 64 nt, Homo Sapiens; identical to SEQ ID NO: 118139

SEQ ID NO: 118344 - RNA, 64 nt, Homo Sapiens; identical to SEQ ID NO: 118140

SEQ ID NO: 118345 - RNA, 64 nt, Homo Sapiens; identical to SEQ ID NO: 118141

SEQ ID NO: 118346 - RNA, 64 nt, Homo Sapiens; identical to SEQ ID NO: 118142

SEQ ID NO: 118347 - RNA, 64 nt, Homo Sapiens; identical to SEQ ID NO: 118143

SEQ ID NO: 118348 - RNA, 64 nt, Homo Sapiens; identical to SEQ ID NO: 118144

SEQ ID NO: 118349 - RNA, 64 nt, Homo Sapiens; identical to SEQ ID NO: 118145

SEQ ID NO: 118350 - RNA, 64 nt, Homo Sapiens; identical to SEQ ID NO: 118146

SEQ ID NO: 118351 - RNA, 64 nt, Homo Sapiens; identical to SEQ ID NO: 118147

SEQ ID NO: 118352 - RNA, 64 nt, Homo Sapiens; identical to SEQ ID NO: 118148

SEQ ID NO: 118353 - RNA, 64 nt, Homo Sapiens; identical to SEQ ID NO: 118149

SEQ ID NO: 118354 - RNA, 64 nt, Homo Sapiens; identical to SEQ ID NO: 118150

SEQ ID NO: 118355 - RNA, 64 nt, Homo Sapiens; identical to SEQ ID NO: 118151

SEQ ID NO: 118356 - RNA, 64 nt, Homo Sapiens; identical to SEQ ID NO: 118152

SEQ ID NO: 118357 - RNA, 64 nt, Homo Sapiens; identical to SEQ ID NO: 118153

SEQ ID NO: 118358 - RNA, 64 nt, Homo Sapiens; identical to SEQ ID NO: 118154

SEQ ID NO: 118359 - RNA, 64 nt, Homo Sapiens; identical to SEQ ID NO: 118155

SEQ ID NO: 118360 - RNA, 64 nt, Homo Sapiens; identical to SEQ ID NO: 118156

SEQ ID NO: 118361 - RNA, 64 nt, Homo Sapiens; identical to SEQ ID NO: 118157

SEQ ID NO: 118362 - RNA, 64 nt, Homo Sapiens; identical to SEQ ID NO: 118158

SEQ ID NO: 118363 - RNA, 64 nt, Homo Sapiens; identical to SEQ ID NO: 118159

SEQ ID NO: 118364 - RNA, 64 nt, Homo Sapiens; identical to SEQ ID NO: 118126

SEQ ID NO: 118365 - RNA, 64 nt, Homo Sapiens; identical to SEQ ID NO: 118127

SEQ ID NO: 118366 - RNA, 64 nt, Homo Sapiens; identical to SEQ ID NO: 118128

SEQ ID NO: 118367 - RNA, 64 nt, Homo Sapiens; identical to SEQ ID NO: 118129

SEQ ID NO: 118368 - RNA, 64 nt, Homo Sapiens; identical to SEQ ID NO: 118130

SEQ ID NO: 118369 - RNA, 64 nt, Homo Sapiens; identical to SEQ ID NO: 118131

SEQ ID NO: 118370 - RNA, 64 nt, Homo Sapiens; identical to SEQ ID NO: 118132

SEQ ID NO: 118371 - RNA, 64 nt, Homo Sapiens; identical to SEQ ID NO: 118133

SEQ ID NO: 118372 - RNA, 64 nt, Homo Sapiens; identical to SEQ ID NO: 118134

SEQ ID NO: 118373 - RNA, 64 nt, Homo Sapiens; identical to SEQ ID NO: 118135

SEQ ID NO: 118374 - RNA, 64 nt, Homo Sapiens; identical to SEQ ID NO: 118136

SEQ ID NO: 118375 - RNA, 64 nt, Homo Sapiens; identical to SEQ ID NO: 118137

SEQ ID NO: 118376 - RNA, 64 nt, Homo Sapiens; identical to SEQ ID NO: 118138

SEQ ID NO: 118377 - RNA, 64 nt, Homo Sapiens; identical to SEQ ID NO: 118139

SEQ ID NO: 118378 - RNA, 64 nt, Homo Sapiens; identical to SEQ ID NO: 118140

SEQ ID NO: 118379 - RNA, 64 nt, Homo Sapiens; identical to SEQ ID NO: 118141

SEQ ID NO: 118380 - RNA, 64 nt, Homo Sapiens; identical to SEQ ID NO: 118142

SEQ ID NO: 118381 - RNA, 64 nt, Homo Sapiens; identical to SEQ ID NO: 118143

SEQ ID NO: 118382 - RNA, 64 nt, Homo Sapiens; identical to SEQ ID NO: 118144

SEQ ID NO: 118383 - RNA, 64 nt, Homo Sapiens; identical to SEQ ID NO: 118145

SEQ ID NO: 118384 - RNA, 64 nt, Homo Sapiens; identical to SEQ ID NO: 118146

SEQ ID NO: 118385 - RNA, 64 nt, Homo Sapiens; identical to SEQ ID NO: 118147

SEQ ID NO: 118386 - RNA, 64 nt, Homo Sapiens; identical to SEQ ID NO: 118148

SEQ ID NO: 118387 - RNA, 64 nt, Homo Sapiens; identical to SEQ ID NO: 118149

SEQ ID NO: 118388 - RNA, 64 nt, Homo Sapiens; identical to SEQ ID NO: 118150

SEQ ID NO: 118389 - RNA, 64 nt, Homo Sapiens; identical to SEQ ID NO: 118151

SEQ ID NO: 118390 - RNA, 64 nt, Homo Sapiens; identical to SEQ ID NO: 118152

SEQ ID NO: 118391 - RNA, 64 nt, Homo Sapiens; identical to SEQ ID NO: 118153

SEQ ID NO: 118392 - RNA, 64 nt, Homo Sapiens; identical to SEQ ID NO: 118154

SEQ ID NO: 118393 - RNA, 64 nt, Homo Sapiens; identical to SEQ ID NO: 118155

SEQ ID NO: 118394 - RNA, 64 nt, Homo Sapiens; identical to SEQ ID NO: 118156

SEQ ID NO: 118395 - RNA, 64 nt, Homo Sapiens; identical to SEQ ID NO: 118157

SEQ ID NO: 118396 - RNA, 64 nt, Homo Sapiens; identical to SEQ ID NO: 118158

SEQ ID NO: 118397 - RNA, 64 nt, Homo Sapiens; identical to SEQ ID NO: 118159

SEQ ID NO: 118398 - RNA, 64 nt, Homo Sapiens; identical to SEQ ID NO: 118126

SEQ ID NO: 118399 - RNA, 64 nt, Homo Sapiens; identical to SEQ ID NO: 118127

SEQ ID NO: 118400 - RNA, 64 nt, Homo Sapiens; identical to SEQ ID NO: 118128

SEQ ID NO: 118401 - RNA, 64 nt, Homo Sapiens; identical to SEQ ID NO: 118129

SEQ ID NO: 118402 - RNA, 64 nt, Homo Sapiens; identical to SEQ ID NO: 118130

SEQ ID NO: 118403 - RNA, 64 nt, Homo Sapiens; identical to SEQ ID NO: 118131

SEQ ID NO: 118404 - RNA, 64 nt, Homo Sapiens; identical to SEQ ID NO: 118132

SEQ ID NO: 118405 - RNA, 64 nt, Homo Sapiens; identical to SEQ ID NO: 118133

SEQ ID NO: 118406 - RNA, 64 nt, Homo Sapiens; identical to SEQ ID NO: 118134

SEQ ID NO: 118407 - RNA, 64 nt, Homo Sapiens; identical to SEQ ID NO: 118135

SEQ ID NO: 118408 - RNA, 64 nt, Homo Sapiens; identical to SEQ ID NO: 118136

SEQ ID NO: 118409 - RNA, 64 nt, Homo Sapiens; identical to SEQ ID NO: 118137

SEQ ID NO: 118410 - RNA, 64 nt, Homo Sapiens; identical to SEQ ID NO: 118138

SEQ ID NO: 118411 - RNA, 64 nt, Homo Sapiens; identical to SEQ ID NO: 118139

SEQ ID NO: 118412 - RNA, 64 nt, Homo Sapiens; identical to SEQ ID NO: 118140

SEQ ID NO: 118413 - RNA, 64 nt, Homo Sapiens; identical to SEQ ID NO: 118141

SEQ ID NO: 118414 - RNA, 64 nt, Homo Sapiens; identical to SEQ ID NO: 118142

SEQ ID NO: 118415 - RNA, 64 nt, Homo Sapiens; identical to SEQ ID NO: 118143

SEQ ID NO: 118416 - RNA, 64 nt, Homo Sapiens; identical to SEQ ID NO: 118144

SEQ ID NO: 118417 - RNA, 64 nt, Homo Sapiens; identical to SEQ ID NO: 118145

SEQ ID NO: 118418 - RNA, 64 nt, Homo Sapiens; identical to SEQ ID NO: 118146

SEQ ID NO: 118419 - RNA, 64 nt, Homo Sapiens; identical to SEQ ID NO: 118147

SEQ ID NO: 118420 - RNA, 64 nt, Homo Sapiens; identical to SEQ ID NO: 118148

SEQ ID NO: 118421 - RNA, 64 nt, Homo Sapiens; identical to SEQ ID NO: 118149

SEQ ID NO: 118422 - RNA, 64 nt, Homo Sapiens; identical to SEQ ID NO: 118150

SEQ ID NO: 118423 - RNA, 64 nt, Homo Sapiens; identical to SEQ ID NO: 118151

SEQ ID NO: 118424 - RNA, 64 nt, Homo Sapiens; identical to SEQ ID NO: 118152

SEQ ID NO: 118425 - RNA, 64 nt, Homo Sapiens; identical to SEQ ID NO: 118153

SEQ ID NO: 118426 - RNA, 64 nt, Homo Sapiens; identical to SEQ ID NO: 118154

SEQ ID NO: 118427 - RNA, 64 nt, Homo Sapiens; identical to SEQ ID NO: 118155

SEQ ID NO: 118428 - RNA, 64 nt, Homo Sapiens; identical to SEQ ID NO: 118156

SEQ ID NO: 118429 - RNA, 64 nt, Homo Sapiens; identical to SEQ ID NO: 118157

SEQ ID NO: 118430 - RNA, 64 nt, Homo Sapiens; identical to SEQ ID NO: 118158

SEQ ID NO: 118431 - RNA, 64 nt, Homo Sapiens; identical to SEQ ID NO: 118159

SEQ ID NO: 118432 - RNA, 64 nt, Homo Sapiens; identical to SEQ ID NO: 118126

SEQ ID NO: 118433 - RNA, 64 nt, Homo Sapiens; identical to SEQ ID NO: 118127

SEQ ID NO: 118434 - RNA, 64 nt, Homo Sapiens; identical to SEQ ID NO: 118128

SEQ ID NO: 118435 - RNA, 64 nt, Homo Sapiens; identical to SEQ ID NO: 118129

SEQ ID NO: 118436 - RNA, 64 nt, Homo Sapiens; identical to SEQ ID NO: 118130

SEQ ID NO: 118437 - RNA, 64 nt, Homo Sapiens; identical to SEQ ID NO: 118131

SEQ ID NO: 118438 - RNA, 64 nt, Homo Sapiens; identical to SEQ ID NO: 118132

SEQ ID NO: 118439 - RNA, 64 nt, Homo Sapiens; identical to SEQ ID NO: 118133

SEQ ID NO: 118440 - RNA, 64 nt, Homo Sapiens; identical to SEQ ID NO: 118134

SEQ ID NO: 118441 - RNA, 64 nt, Homo Sapiens; identical to SEQ ID NO: 118135

SEQ ID NO: 118442 - RNA, 64 nt, Homo Sapiens; identical to SEQ ID NO: 118136

SEQ ID NO: 118443 - RNA, 64 nt, Homo Sapiens; identical to SEQ ID NO: 118137

SEQ ID NO: 118444 - RNA, 64 nt, Homo Sapiens; identical to SEQ ID NO: 118138

SEQ ID NO: 118445 - RNA, 64 nt, Homo Sapiens; identical to SEQ ID NO: 118139

SEQ ID NO: 118446 - RNA, 64 nt, Homo Sapiens; identical to SEQ ID NO: 118140

SEQ ID NO: 118447 - RNA, 64 nt, Homo Sapiens; identical to SEQ ID NO: 118141

SEQ ID NO: 118448 - RNA, 64 nt, Homo Sapiens; identical to SEQ ID NO: 118142

SEQ ID NO: 118449 - RNA, 64 nt, Homo Sapiens; identical to SEQ ID NO: 118143

SEQ ID NO: 118450 - RNA, 64 nt, Homo Sapiens; identical to SEQ ID NO: 118144

SEQ ID NO: 118451 - RNA, 64 nt, Homo Sapiens; identical to SEQ ID NO: 118145

SEQ ID NO: 118452 - RNA, 64 nt, Homo Sapiens; identical to SEQ ID NO: 118146

SEQ ID NO: 118453 - RNA, 64 nt, Homo Sapiens; identical to SEQ ID NO: 118147

SEQ ID NO: 118454 - RNA, 64 nt, Homo Sapiens; identical to SEQ ID NO: 118148

SEQ ID NO: 118455 - RNA, 64 nt, Homo Sapiens; identical to SEQ ID NO: 118149

SEQ ID NO: 118456 - RNA, 64 nt, Homo Sapiens; identical to SEQ ID NO: 118150

SEQ ID NO: 118457 - RNA, 64 nt, Homo Sapiens; identical to SEQ ID NO: 118151

SEQ ID NO: 118458 - RNA, 64 nt, Homo Sapiens; identical to SEQ ID NO: 118152

SEQ ID NO: 118459 - RNA, 64 nt, Homo Sapiens; identical to SEQ ID NO: 118153

SEQ ID NO: 118460 - RNA, 64 nt, Homo Sapiens; identical to SEQ ID NO: 118154

SEQ ID NO: 118461 - RNA, 64 nt, Homo Sapiens; identical to SEQ ID NO: 118155

SEQ ID NO: 118462 - RNA, 64 nt, Homo Sapiens; identical to SEQ ID NO: 118156

SEQ ID NO: 118463 - RNA, 64 nt, Homo Sapiens; identical to SEQ ID NO: 118157

SEQ ID NO: 118464 - RNA, 64 nt, Homo Sapiens; identical to SEQ ID NO: 118158

SEQ ID NO: 118465 - RNA, 64 nt, Homo Sapiens; identical to SEQ ID NO: 118159

SEQ ID NO: 118466 - RNA, 64 nt, Homo Sapiens; identical to SEQ ID NO: 118126

SEQ ID NO: 118467 - RNA, 64 nt, Homo Sapiens; identical to SEQ ID NO: 118127

SEQ ID NO: 118468 - RNA, 64 nt, Homo Sapiens; identical to SEQ ID NO: 118128

SEQ ID NO: 118469 - RNA, 64 nt, Homo Sapiens; identical to SEQ ID NO: 118129

SEQ ID NO: 118470 - RNA, 64 nt, Homo Sapiens; identical to SEQ ID NO: 118130

SEQ ID NO: 118471 - RNA, 64 nt, Homo Sapiens; identical to SEQ ID NO: 118131

SEQ ID NO: 118472 - RNA, 64 nt, Homo Sapiens; identical to SEQ ID NO: 118132

SEQ ID NO: 118473 - RNA, 64 nt, Homo Sapiens; identical to SEQ ID NO: 118133

SEQ ID NO: 118474 - RNA, 64 nt, Homo Sapiens; identical to SEQ ID NO: 118134

SEQ ID NO: 118475 - RNA, 64 nt, Homo Sapiens; identical to SEQ ID NO: 118135

SEQ ID NO: 118476 - RNA, 64 nt, Homo Sapiens; identical to SEQ ID NO: 118136

SEQ ID NO: 118477 - RNA, 64 nt, Homo Sapiens; identical to SEQ ID NO: 118137

SEQ ID NO: 118478 - RNA, 64 nt, Homo Sapiens; identical to SEQ ID NO: 118138

SEQ ID NO: 118479 - RNA, 64 nt, Homo Sapiens; identical to SEQ ID NO: 118139

SEQ ID NO: 118480 - RNA, 64 nt, Homo Sapiens; identical to SEQ ID NO: 118140

SEQ ID NO: 118481 - RNA, 64 nt, Homo Sapiens; identical to SEQ ID NO: 118141

SEQ ID NO: 118482 - RNA, 64 nt, Homo Sapiens; identical to SEQ ID NO: 118142

SEQ ID NO: 118483 - RNA, 64 nt, Homo Sapiens; identical to SEQ ID NO: 118143

SEQ ID NO: 118484 - RNA, 64 nt, Homo Sapiens; identical to SEQ ID NO: 118144

SEQ ID NO: 118485 - RNA, 64 nt, Homo Sapiens; identical to SEQ ID NO: 118145

SEQ ID NO: 118486 - RNA, 64 nt, Homo Sapiens; identical to SEQ ID NO: 118146

SEQ ID NO: 118487 - RNA, 64 nt, Homo Sapiens; identical to SEQ ID NO: 118147

SEQ ID NO: 118488 - RNA, 64 nt, Homo Sapiens; identical to SEQ ID NO: 118148

SEQ ID NO: 118489 - RNA, 64 nt, Homo Sapiens; identical to SEQ ID NO: 118149

SEQ ID NO: 118490 - RNA, 64 nt, Homo Sapiens; identical to SEQ ID NO: 118150

SEQ ID NO: 118491 - RNA, 64 nt, Homo Sapiens; identical to SEQ ID NO: 118151

SEQ ID NO: 118492 - RNA, 64 nt, Homo Sapiens; identical to SEQ ID NO: 118152

SEQ ID NO: 118493 - RNA, 64 nt, Homo Sapiens; identical to SEQ ID NO: 118153

SEQ ID NO: 118494 - RNA, 64 nt, Homo Sapiens; identical to SEQ ID NO: 118154

SEQ ID NO: 118495 - RNA, 64 nt, Homo Sapiens; identical to SEQ ID NO: 118155

SEQ ID NO: 118496 - RNA, 64 nt, Homo Sapiens; identical to SEQ ID NO: 118156

SEQ ID NO: 118497 - RNA, 64 nt, Homo Sapiens; identical to SEQ ID NO: 118157

SEQ ID NO: 118498 - RNA, 64 nt, Homo Sapiens; identical to SEQ ID NO: 118158

SEQ ID NO: 118499 - RNA, 64 nt, Homo Sapiens; identical to SEQ ID NO: 118159

SEQ ID NO: 118500 - RNA, 64 nt, Homo Sapiens; identical to SEQ ID NO: 118126

SEQ ID NO: 118501 - RNA, 64 nt, Homo Sapiens; identical to SEQ ID NO: 118127

SEQ ID NO: 118502 - RNA, 64 nt, Homo Sapiens; identical to SEQ ID NO: 118128

SEQ ID NO: 118503 - RNA, 64 nt, Homo Sapiens; identical to SEQ ID NO: 118129

SEQ ID NO: 118504 - RNA, 64 nt, Homo Sapiens; identical to SEQ ID NO: 118130

SEQ ID NO: 118505 - RNA, 64 nt, Homo Sapiens; identical to SEQ ID NO: 118131

SEQ ID NO: 118506 - RNA, 64 nt, Homo Sapiens; identical to SEQ ID NO: 118132

SEQ ID NO: 118507 - RNA, 64 nt, Homo Sapiens; identical to SEQ ID NO: 118133

SEQ ID NO: 118508 - RNA, 64 nt, Homo Sapiens; identical to SEQ ID NO: 118134

SEQ ID NO: 118509 - RNA, 64 nt, Homo Sapiens; identical to SEQ ID NO: 118135

SEQ ID NO: 118510 - RNA, 64 nt, Homo Sapiens; identical to SEQ ID NO: 118136

SEQ ID NO: 118511 - RNA, 64 nt, Homo Sapiens; identical to SEQ ID NO: 118137

SEQ ID NO: 118512 - RNA, 64 nt, Homo Sapiens; identical to SEQ ID NO: 118138

SEQ ID NO: 118513 - RNA, 64 nt, Homo Sapiens; identical to SEQ ID NO: 118139

SEQ ID NO: 118514 - RNA, 64 nt, Homo Sapiens; identical to SEQ ID NO: 118140

SEQ ID NO: 118515 - RNA, 64 nt, Homo Sapiens; identical to SEQ ID NO: 118141

SEQ ID NO: 118516 - RNA, 64 nt, Homo Sapiens; identical to SEQ ID NO: 118142

SEQ ID NO: 118517 - RNA, 64 nt, Homo Sapiens; identical to SEQ ID NO: 118143

SEQ ID NO: 118518 - RNA, 64 nt, Homo Sapiens; identical to SEQ ID NO: 118144

SEQ ID NO: 118519 - RNA, 64 nt, Homo Sapiens; identical to SEQ ID NO: 118145

SEQ ID NO: 118520 - RNA, 64 nt, Homo Sapiens; identical to SEQ ID NO: 118146

SEQ ID NO: 118521 - RNA, 64 nt, Homo Sapiens; identical to SEQ ID NO: 118147

SEQ ID NO: 118522 - RNA, 64 nt, Homo Sapiens; identical to SEQ ID NO: 118148

SEQ ID NO: 118523 - RNA, 64 nt, Homo Sapiens; identical to SEQ ID NO: 118149

SEQ ID NO: 118524 - RNA, 64 nt, Homo Sapiens; identical to SEQ ID NO: 118150

SEQ ID NO: 118525 - RNA, 64 nt, Homo Sapiens; identical to SEQ ID NO: 118151

SEQ ID NO: 118526 - RNA, 64 nt, Homo Sapiens; identical to SEQ ID NO: 118152

SEQ ID NO: 118527 - RNA, 64 nt, Homo Sapiens; identical to SEQ ID NO: 118153

SEQ ID NO: 118528 - RNA, 64 nt, Homo Sapiens; identical to SEQ ID NO: 118154

SEQ ID NO: 118529 - RNA, 64 nt, Homo Sapiens; identical to SEQ ID NO: 118155

SEQ ID NO: 118530 - RNA, 64 nt, Homo Sapiens; identical to SEQ ID NO: 118156

SEQ ID NO: 118531 - RNA, 64 nt, Homo Sapiens; identical to SEQ ID NO: 118157

SEQ ID NO: 118532 - RNA, 64 nt, Homo Sapiens; identical to SEQ ID NO: 118158

SEQ ID NO: 118533 - RNA, 64 nt, Homo Sapiens; identical to SEQ ID NO: 118159

SEQ ID NO: 118534 - RNA, 64 nt, Homo Sapiens; identical to SEQ ID NO: 118126

SEQ ID NO: 118535 - RNA, 64 nt, Homo Sapiens; identical to SEQ ID NO: 118127

SEQ ID NO: 118536 - RNA, 64 nt, Homo Sapiens; identical to SEQ ID NO: 118128

SEQ ID NO: 118537 - RNA, 64 nt, Homo Sapiens; identical to SEQ ID NO: 118129

SEQ ID NO: 118538 - RNA, 64 nt, Homo Sapiens; identical to SEQ ID NO: 118130

SEQ ID NO: 118539 - RNA, 64 nt, Homo Sapiens; identical to SEQ ID NO: 118131

SEQ ID NO: 118540 - RNA, 64 nt, Homo Sapiens; identical to SEQ ID NO: 118132

SEQ ID NO: 118541 - RNA, 64 nt, Homo Sapiens; identical to SEQ ID NO: 118133

SEQ ID NO: 118542 - RNA, 64 nt, Homo Sapiens; identical to SEQ ID NO: 118134

SEQ ID NO: 118543 - RNA, 64 nt, Homo Sapiens; identical to SEQ ID NO: 118135

SEQ ID NO: 118544 - RNA, 64 nt, Homo Sapiens; identical to SEQ ID NO: 118136

SEQ ID NO: 118545 - RNA, 64 nt, Homo Sapiens; identical to SEQ ID NO: 118137

SEQ ID NO: 118546 - RNA, 64 nt, Homo Sapiens; identical to SEQ ID NO: 118138

SEQ ID NO: 118547 - RNA, 64 nt, Homo Sapiens; identical to SEQ ID NO: 118139

SEQ ID NO: 118548 - RNA, 64 nt, Homo Sapiens; identical to SEQ ID NO: 118140

SEQ ID NO: 118549 - RNA, 64 nt, Homo Sapiens; identical to SEQ ID NO: 118141

SEQ ID NO: 118550 - RNA, 64 nt, Homo Sapiens; identical to SEQ ID NO: 118142

SEQ ID NO: 118551 - RNA, 64 nt, Homo Sapiens; identical to SEQ ID NO: 118143

SEQ ID NO: 118552 - RNA, 64 nt, Homo Sapiens; identical to SEQ ID NO: 118144

SEQ ID NO: 118553 - RNA, 64 nt, Homo Sapiens; identical to SEQ ID NO: 118145

SEQ ID NO: 118554 - RNA, 64 nt, Homo Sapiens; identical to SEQ ID NO: 118146

SEQ ID NO: 118555 - RNA, 64 nt, Homo Sapiens; identical to SEQ ID NO: 118147

SEQ ID NO: 118556 - RNA, 64 nt, Homo Sapiens; identical to SEQ ID NO: 118148

SEQ ID NO: 118557 - RNA, 64 nt, Homo Sapiens; identical to SEQ ID NO: 118149

SEQ ID NO: 118558 - RNA, 64 nt, Homo Sapiens; identical to SEQ ID NO: 118150

SEQ ID NO: 118559 - RNA, 64 nt, Homo Sapiens; identical to SEQ ID NO: 118151

SEQ ID NO: 118560 - RNA, 64 nt, Homo Sapiens; identical to SEQ ID NO: 118152

SEQ ID NO: 118561 - RNA, 64 nt, Homo Sapiens; identical to SEQ ID NO: 118153

SEQ ID NO: 118562 - RNA, 64 nt, Homo Sapiens; identical to SEQ ID NO: 118154

SEQ ID NO: 118563 - RNA, 64 nt, Homo Sapiens; identical to SEQ ID NO: 118155

SEQ ID NO: 118564 - RNA, 64 nt, Homo Sapiens; identical to SEQ ID NO: 118156

SEQ ID NO: 118565 - RNA, 64 nt, Homo Sapiens; identical to SEQ ID NO: 118157

SEQ ID NO: 118566 - RNA, 64 nt, Homo Sapiens; identical to SEQ ID NO: 118158

SEQ ID NO: 118567 - RNA, 64 nt, Homo Sapiens; identical to SEQ ID NO: 118159

SEQ ID NO: 118568 - RNA, 64 nt, Homo Sapiens; identical to SEQ ID NO: 118126

SEQ ID NO: 118569 - RNA, 64 nt, Homo Sapiens; identical to SEQ ID NO: 118127

SEQ ID NO: 118570 - RNA, 64 nt, Homo Sapiens; identical to SEQ ID NO: 118128

SEQ ID NO: 118571 - RNA, 64 nt, Homo Sapiens; identical to SEQ ID NO: 118129

SEQ ID NO: 118572 - RNA, 64 nt, Homo Sapiens; identical to SEQ ID NO: 118130

SEQ ID NO: 118573 - RNA, 64 nt, Homo Sapiens; identical to SEQ ID NO: 118131

SEQ ID NO: 118574 - RNA, 64 nt, Homo Sapiens; identical to SEQ ID NO: 118132

SEQ ID NO: 118575 - RNA, 64 nt, Homo Sapiens; identical to SEQ ID NO: 118133

SEQ ID NO: 118576 - RNA, 64 nt, Homo Sapiens; identical to SEQ ID NO: 118134

SEQ ID NO: 118577 - RNA, 64 nt, Homo Sapiens; identical to SEQ ID NO: 118135

SEQ ID NO: 118578 - RNA, 64 nt, Homo Sapiens; identical to SEQ ID NO: 118136

SEQ ID NO: 118579 - RNA, 64 nt, Homo Sapiens; identical to SEQ ID NO: 118137

SEQ ID NO: 118580 - RNA, 64 nt, Homo Sapiens; identical to SEQ ID NO: 118138

SEQ ID NO: 118581 - RNA, 64 nt, Homo Sapiens; identical to SEQ ID NO: 118139

SEQ ID NO: 118582 - RNA, 64 nt, Homo Sapiens; identical to SEQ ID NO: 118140

SEQ ID NO: 118583 - RNA, 64 nt, Homo Sapiens; identical to SEQ ID NO: 118141

SEQ ID NO: 118584 - RNA, 64 nt, Homo Sapiens; identical to SEQ ID NO: 118142

SEQ ID NO: 118585 - RNA, 64 nt, Homo Sapiens; identical to SEQ ID NO: 118143

SEQ ID NO: 118586 - RNA, 64 nt, Homo Sapiens; identical to SEQ ID NO: 118144

SEQ ID NO: 118587 - RNA, 64 nt, Homo Sapiens; identical to SEQ ID NO: 118145

SEQ ID NO: 118588 - RNA, 64 nt, Homo Sapiens; identical to SEQ ID NO: 118146

SEQ ID NO: 118589 - RNA, 64 nt, Homo Sapiens; identical to SEQ ID NO: 118147

SEQ ID NO: 118590 - RNA, 64 nt, Homo Sapiens; identical to SEQ ID NO: 118148

SEQ ID NO: 118591 - RNA, 64 nt, Homo Sapiens; identical to SEQ ID NO: 118149

SEQ ID NO: 118592 - RNA, 64 nt, Homo Sapiens; identical to SEQ ID NO: 118150

SEQ ID NO: 118593 - RNA, 64 nt, Homo Sapiens; identical to SEQ ID NO: 118151

SEQ ID NO: 118594 - RNA, 64 nt, Homo Sapiens; identical to SEQ ID NO: 118152

SEQ ID NO: 118595 - RNA, 64 nt, Homo Sapiens; identical to SEQ ID NO: 118153

SEQ ID NO: 118596 - RNA, 64 nt, Homo Sapiens; identical to SEQ ID NO: 118154

SEQ ID NO: 118597 - RNA, 64 nt, Homo Sapiens; identical to SEQ ID NO: 118155

SEQ ID NO: 118598 - RNA, 64 nt, Homo Sapiens; identical to SEQ ID NO: 118156

SEQ ID NO: 118599 - RNA, 64 nt, Homo Sapiens; identical to SEQ ID NO: 118157

SEQ ID NO: 118600 - RNA, 64 nt, Homo Sapiens; identical to SEQ ID NO: 118158

SEQ ID NO: 118601 - RNA, 64 nt, Homo Sapiens; identical to SEQ ID NO: 118159

SEQ ID NO: 118602 - RNA, 64 nt, Homo Sapiens; identical to SEQ ID NO: 118126

SEQ ID NO: 118603 - RNA, 64 nt, Homo Sapiens; identical to SEQ ID NO: 118127

SEQ ID NO: 118604 - RNA, 64 nt, Homo Sapiens; identical to SEQ ID NO: 118128

SEQ ID NO: 118605 - RNA, 64 nt, Homo Sapiens; identical to SEQ ID NO: 118129

SEQ ID NO: 118606 - RNA, 64 nt, Homo Sapiens; identical to SEQ ID NO: 118130

SEQ ID NO: 118607 - RNA, 64 nt, Homo Sapiens; identical to SEQ ID NO: 118131

SEQ ID NO: 118608 - RNA, 64 nt, Homo Sapiens; identical to SEQ ID NO: 118132

SEQ ID NO: 118609 - RNA, 64 nt, Homo Sapiens; identical to SEQ ID NO: 118133

SEQ ID NO: 118610 - RNA, 64 nt, Homo Sapiens; identical to SEQ ID NO: 118134

SEQ ID NO: 118611 - RNA, 64 nt, Homo Sapiens; identical to SEQ ID NO: 118135

SEQ ID NO: 118612 - RNA, 64 nt, Homo Sapiens; identical to SEQ ID NO: 118136

SEQ ID NO: 118613 - RNA, 64 nt, Homo Sapiens; identical to SEQ ID NO: 118137

SEQ ID NO: 118614 - RNA, 64 nt, Homo Sapiens; identical to SEQ ID NO: 118138

SEQ ID NO: 118615 - RNA, 64 nt, Homo Sapiens; identical to SEQ ID NO: 118139

SEQ ID NO: 118616 - RNA, 64 nt, Homo Sapiens; identical to SEQ ID NO: 118140

SEQ ID NO: 118617 - RNA, 64 nt, Homo Sapiens; identical to SEQ ID NO: 118141

SEQ ID NO: 118618 - RNA, 64 nt, Homo Sapiens; identical to SEQ ID NO: 118142

SEQ ID NO: 118619 - RNA, 64 nt, Homo Sapiens; identical to SEQ ID NO: 118143

SEQ ID NO: 118620 - RNA, 64 nt, Homo Sapiens; identical to SEQ ID NO: 118144

SEQ ID NO: 118621 - RNA, 64 nt, Homo Sapiens; identical to SEQ ID NO: 118145

SEQ ID NO: 118622 - RNA, 64 nt, Homo Sapiens; identical to SEQ ID NO: 118146

SEQ ID NO: 118623 - RNA, 64 nt, Homo Sapiens; identical to SEQ ID NO: 118147

SEQ ID NO: 118624 - RNA, 64 nt, Homo Sapiens; identical to SEQ ID NO: 118148

SEQ ID NO: 118625 - RNA, 64 nt, Homo Sapiens; identical to SEQ ID NO: 118149

SEQ ID NO: 118626 - RNA, 64 nt, Homo Sapiens; identical to SEQ ID NO: 118150

SEQ ID NO: 118627 - RNA, 64 nt, Homo Sapiens; identical to SEQ ID NO: 118151

SEQ ID NO: 118628 - RNA, 64 nt, Homo Sapiens; identical to SEQ ID NO: 118152

SEQ ID NO: 118629 - RNA, 64 nt, Homo Sapiens; identical to SEQ ID NO: 118153

SEQ ID NO: 118630 - RNA, 64 nt, Homo Sapiens; identical to SEQ ID NO: 118154

SEQ ID NO: 118631 - RNA, 64 nt, Homo Sapiens; identical to SEQ ID NO: 118155

SEQ ID NO: 118632 - RNA, 64 nt, Homo Sapiens; identical to SEQ ID NO: 118156

SEQ ID NO: 118633 - RNA, 64 nt, Homo Sapiens; identical to SEQ ID NO: 118157

SEQ ID NO: 118634 - RNA, 64 nt, Homo Sapiens; identical to SEQ ID NO: 118158

SEQ ID NO: 118635 - RNA, 64 nt, Homo Sapiens; identical to SEQ ID NO: 118159

SEQ ID NO: 118636 - RNA, 64 nt, Homo Sapiens
ccccguggcuuccugucugcuggccucuccugcuacuuaucacuucaccacgaacucucugccu

SEQ ID NO: 118637 - RNA, 64 nt, Homo Sapiens
gaaacaggugguaaaguaguuuggccuguucacaacuuaucaggaccaauaucuaguguggacu

SEQ ID NO: 118638 - RNA, 64 nt, Homo Sapiens
gaucagcccuauaugaaacauaaguuguguuauaacuuaucagccguauauggaacauaaauag

SEQ ID NO: 118639 - RNA, 64 nt, Homo Sapiens
ugaaaaauagaaguauaauuugaaaaaacauuucacuuaucagagauuuuuauauuuauacaaa

SEQ ID NO: 118640 - RNA, 64 nt, Homo Sapiens
ccauuucccccugcucccccacagccgguucugcacuuaucaccgagucgccccuggaagcaga

SEQ ID NO: 118641 - RNA, 64 nt, Homo Sapiens
uugaaaaacuuuucagcaguuucuuauaagcauaacuuaucauauggcccagccauuucacuac

SEQ ID NO: 118642 - RNA, 64 nt, Homo Sapiens
ugaucaauuugaagucccuguuugggaaugaggcacuuaucagcaugaagaauuuuuucucauu

SEQ ID NO: 118643 - RNA, 64 nt, Homo Sapiens
gcuauuuucuuaugaaaacggccuuuguguauacacuuaucaaaguuuguguguauauauauau

SEQ ID NO: 118644 - RNA, 64 nt, Homo Sapiens
acugccuauaguaaccaaaaaagcuucucucucaacuuaucagaaauuuuagcucuugcuucuc

SEQ ID NO: 118645 - RNA, 64 nt, Homo Sapiens
accaucaaguccuuuuucuugcgguagugucuuuacuuaucaaacugaaagcaaagaugcagca

SEQ ID NO: 118646 - RNA, 64 nt, Homo Sapiens
augcauuccuauugcccauguuuuccaguccuucacuuaucaauguaaaggaccagguuuuuug

SEQ ID NO: 118647 - RNA, 64 nt, Homo Sapiens
aguuaaugcagaguuaaugaacagucuaauauugacuuaucagaauaagcuaacucuaaauuua

SEQ ID NO: 118648 - RNA, 64 nt, Homo Sapiens
ugguguuagguggccuuaaguucucaguaaugacacuuaucaaauaggaacuuaguguuacuca

SEQ ID NO: 118649 - RNA, 64 nt, Homo Sapiens
auugugaguauuuauuagauucguaggucauauuacuuaucaacugagccaaaugucugugugc

SEQ ID NO: 118650 - RNA, 64 nt, Homo Sapiens
gaagcacucacaggcaccacacacguaucauguaacuuaucagugggguggguuacuguugaag

SEQ ID NO: 118651 - RNA, 64 nt, Homo Sapiens
uauuguuuuaauggaaagcaaaaaacccccccaaacuuaucagaauccucguucuuuuucagac

SEQ ID NO: 118652 - RNA, 64 nt, Homo Sapiens
uucugugaaaucaaauccaguuuuaagaggagccacuuaucaaagagauuuuaacaguaguaag

SEQ ID NO: 118653 - RNA, 64 nt, Homo Sapiens
uaccucugcacuuugucaaugcuucucuuguggcacuuaucacacuguauuuuacuuguuuaca

SEQ ID NO: 118654 - RNA, 64 nt, Homo Sapiens
aauggaagaugcuuuggaugggaggaacuuucugacuuaucagcccccaacaaaagaagcuaca

SEQ ID NO: 118655 - RNA, 64 nt, Homo Sapiens
ugaaaggauauuuauauagcagagguuuaauaagacuuaucagaaaccuccucccccaaacacu

SEQ ID NO: 118656 - RNA, 64 nt, Homo Sapiens
cacauuguuuuaaaaagaaauuaaucaugaaauuacuuaucaucuuuauuuaaaagauucauuu

SEQ ID NO: 118657 - RNA, 64 nt, Homo Sapiens
ccuaacuauugcaacuugacgggugauguuucuuacuuaucaucucauacagcuagcauuagau

SEQ ID NO: 118658 - RNA, 64 nt, Homo Sapiens
ggggauacguucuaagaaauauuagucacguaucacuuaucaauaauguauaaauuucacguaa

SEQ ID NO: 118659 - RNA, 64 nt, Homo Sapiens
cguguuauauuccauacuuacuugcuccacucgcacuuaucaaaaggagaggaagauuugucua

SEQ ID NO: 118660 - RNA, 64 nt, Homo Sapiens
uggcuuuuagcuuuuauguuaugugugaagacauacuuaucaguagaguccauucaccugagaa

SEQ ID NO: 118661 - RNA, 64 nt, Homo Sapiens
ucuaccugggugugcccacgaagacaaccaucacacuuaucaauggcacgcuccugccuaccca

SEQ ID NO: 118662 - RNA, 64 nt, Homo Sapiens
acaaaagcaggaacaagacucagagcaagaagucacuuaucaccaaggggauggcccaggccau

SEQ ID NO: 118663 - RNA, 64 nt, Homo Sapiens
cacagaagaaaggaguuaggaaaaguacugauugacuuaucaaaagaagaucugauuaagggcu

SEQ ID NO: 118664 - RNA, 64 nt, Homo Sapiens
uaauuacugugguaauuaaauguguucaguauguacuuaucaguacauuuagucugcaauguuu

SEQ ID NO: 118665 - RNA, 64 nt, Homo Sapiens
aagucuguuacaguugcuagagguuuucauuaaaacuuaucagaugagaggcuuuuuuaggaua

SEQ ID NO: 118666 - RNA, 64 nt, Homo Sapiens
uccagccuucacuccagcugguuaaaaauguugcacuuaucagcaacccuaccacuuucaucug

SEQ ID NO: 118667 - RNA, 64 nt, Homo Sapiens
cugaugucucagugaaucagucuguuuauuaagcacuuaucagggcuuccacacacuuauuuau

SEQ ID NO: 118668 - RNA, 64 nt, Homo Sapiens
uacuuuucuggguaugugcugauuaaggggguggacuuaucaacacuauaauuguucccuauga

SEQ ID NO: 118669 - RNA, 64 nt, Homo Sapiens
aauggucaagcugagauuuucaugucgauuagguacuuaucaaguuaaggcagaaaaaaaguua

SEQ ID NO: 118670 - RNA, 64 nt, Homo Sapiens
augugaacuguuuuccucaucgccaaaauaaaucacuuaucaaaucauuaaaaaauaagccugc

SEQ ID NO: 118671 - RNA, 64 nt, Homo Sapiens
uugcauuguaauuacuuccuaccuauauuauuaaacuuaucacaccuccucuguaugcugucac

SEQ ID NO: 118672 - RNA, 64 nt, Homo Sapiens
aggaaaaauagaaaggaaaaagcuacuguaagaaacuuaucauaaugcuauuuguuguuguaua

SEQ ID NO: 118673 - RNA, 64 nt, Homo Sapiens
uucuugaugcuuccaaaugauuaauucaccacauacuuaucaauaaaacauuauaaaaguaauu

SEQ ID NO: 118674 - RNA, 64 nt, Homo Sapiens
cuuccaaccuaucuguucugucucccaauguaccacuuaucaacuaaucccucuccucucugau

SEQ ID NO: 118675 - RNA, 64 nt, Homo Sapiens
ccaagaguucuagauguuugauuuucuaauuaauacuuaucagaucuacaaaaaucauuauuau

SEQ ID NO: 118676 - RNA, 64 nt, Homo Sapiens
agacagcacuacagauaucaugguuucuuuucuuacuuaucaaaguugacaugaguggaauacu

SEQ ID NO: 118677 - RNA, 64 nt, Homo Sapiens
gcucuauauugaaugaaagcgggucucuugauagacuuaucauauacaaguacguaaggauuca

SEQ ID NO: 118678 - RNA, 64 nt, Homo Sapiens
ugauggacacuuagguuaaucauuuucuuuauccacuuaucaguuccaugguacauauauacca

SEQ ID NO: 118679 - RNA, 64 nt, Homo Sapiens
auguucaauuugauacaguaaaucauauuaucauacuuaucauagaauauaaacauagagcuag

SEQ ID NO: 118680 - RNA, 64 nt, Homo Sapiens
cauaguguaucguggcaugaugggcuucugugagacuuaucacaagaaaagcuucugauggaca

SEQ ID NO: 118681 - RNA, 64 nt, Homo Sapiens
ggucccauaggagcagccuuagcauccccugugaacuuaucaaaaaugcaaauucucaggcccc

SEQ ID NO: 118682 - RNA, 64 nt, Homo Sapiens
ucaaaucguuuauuucacacgcuguucuaauggcacuuaucauuagaaucuuaccuugugcagu

SEQ ID NO: 118683 - RNA, 64 nt, Homo Sapiens
agggaaacaaaauauuuauuuguuuuggaaucccacuuaucaaaucauucaaaacuuucagcug

SEQ ID NO: 118684 - RNA, 64 nt, Homo Sapiens
gcuaacaacucaaucucauuaaguuggaaaaaaaacuuaucaaagagacauuuacaugguuugg

SEQ ID NO: 118685 - RNA, 64 nt, Homo Sapiens
uauacauuauagauaauucuaagacagcacacaaacuuaucaauaaagccaucuccuugugggc

SEQ ID NO: 118686 - RNA, 64 nt, Homo Sapiens
cagcucuuacacagugauagguuuguuccaugggacuuaucauaggccuggugauucuugaaag

SEQ ID NO: 118687 - RNA, 64 nt, Homo Sapiens
gugaaaauacuucaaguaucgauguuacagacauacuuaucaccuuuucccccugaaccauuug

SEQ ID NO: 118688 - RNA, 64 nt, Homo Sapiens
ccaguaugcaucuuuaagauaguuacaucuucaaacuuaucauuuuuugaaaagaauuguugau

SEQ ID NO: 118689 - RNA, 64 nt, Homo Sapiens
ucuaacaguuuauuguauaaacgcacaacuuuacacuuaucauucaaguucaggagccgcagag

SEQ ID NO: 118690 - RNA, 64 nt, Homo Sapiens
ccaugugccuauacacccagauuccauaccaaagacuuaucacacuuugaaaggauagagcuuc

SEQ ID NO: 118691 - RNA, 64 nt, Homo Sapiens
agacucacuuuucuuucuuuaaauuuuuccauaaacuuaucagaaaaccuugaugaaaaacaca

SEQ ID NO: 118692 - RNA, 64 nt, Homo Sapiens
uggagaccuaauguaauaauaguaacaggaaaccacuuaucacauagucacaauuuuuuucagc

SEQ ID NO: 118693 - RNA, 64 nt, Homo Sapiens
ccuacuuaagagugcugugugaacauuuugcaaaacuuaucacgcaagacacugaggagauacu

SEQ ID NO: 118694 - RNA, 64 nt, Homo Sapiens
uuccucuagguguuuccacucugccgacuugcugacuuaucaacgucccagcuugucagcucug

SEQ ID NO: 118695 - RNA, 64 nt, Homo Sapiens
ugcuaguuagaaauucuuaucaauuuggcaagcuacuuaucaaccagacugaccacaagaacug

SEQ ID NO: 118696 - RNA, 64 nt, Homo Sapiens
aaacuuccugaaauucuuguaauuuuuuucccauacuuaucagaaguguguuuaccaacuuauu

SEQ ID NO: 118697 - RNA, 64 nt, Homo Sapiens
cuucuagagguaacuuggauagccuaggcaggcaacuuaucauguggugaaggccgccucaggg

SEQ ID NO: 118698 - RNA, 64 nt, Homo Sapiens
gaaaagggggagaaauauagccccuagccuaauaacuuaucauuuguaaaaugacuuauaaaaa

SEQ ID NO: 118699 - RNA, 64 nt, Homo Sapiens
ugcucauugcuuucuaagaucuauuuccccaaagacuuaucagauauuagauuuuccuccuuuc

SEQ ID NO: 118700 - RNA, 64 nt, Homo Sapiens
uugcuaauguuuccauaguuuugucaccaugaucacuuaucagucaugcucaaugaaaagguga

SEQ ID NO: 118701 - RNA, 64 nt, Homo Sapiens
gacaaacuuucugaacaccaccaccaccaauaauacuuaucagcaucauaaaguaucucuuaaa

SEQ ID NO: 118702 - RNA, 64 nt, Homo Sapiens
uuuuuccuauuuuucuucuuuuugcuuuuuuugcacuuaucagaaauauuugaugugugcauug

SEQ ID NO: 118703 - RNA, 64 nt, Homo Sapiens
ccccaacaaauaauuugccaaguguccaaugagaacuuaucauguugguguguuagguaaaucg

SEQ ID NO: 118704 - RNA, 64 nt, Homo Sapiens
caaaacgugcaauucaggagcccagcagugacacacuuaucacgccuaggcuccaguuugcaaa

SEQ ID NO: 118705 - RNA, 64 nt, Homo Sapiens
ugcacguggccgacaugcugguuaaggugaacgcacuuaucaaggaucgggaagguuaugcucc

SEQ ID NO: 118706 - RNA, 64 nt, Homo Sapiens
uuguaucuguuuaugccucuuucugcuaagaaagacuuaucaucguuucuucacuugcagcguu

SEQ ID NO: 118707 - RNA, 64 nt, Homo Sapiens
guauaccacuggaguuuucugcacaaaaauaaaaacuuaucacuuagaucagcugaaacucuaa

SEQ ID NO: 118708 - RNA, 64 nt, Homo Sapiens
cucuuuguuguuuagucugucauugaaucaaucuacuuaucaucuugggucuuugaguauugua

SEQ ID NO: 118709 - RNA, 64 nt, Homo Sapiens
gcugccugauuuguugggaccuucugagccuucuacuuaucauguaaauguauuggcacagugc

SEQ ID NO: 118710 - RNA, 63 nt, Homo Sapiens
auuucaugaaaaugacauuaaaugcaauaauuuuacuuaucauaaacauuuuguacaucauua

SEQ ID NO: 118711 - RNA, 64 nt, Homo Sapiens
agggcaauucuauccguugaucuuaguggugaaaacuuaucagauguagacuuccuagaugauu

SEQ ID NO: 118712 - RNA, 64 nt, Homo Sapiens
aaggcaggaaaguagguaugucauuucaugccuuacuuaucaaauacagcucaaaacuuuuguu

SEQ ID NO: 118713 - RNA, 64 nt, Homo Sapiens
aucuuccucaagcacuugcucaggcuaaagugacacuuaucagagggacuuggacuggaggaua

SEQ ID NO: 118714 - RNA, 64 nt, Homo Sapiens
uauggucaaccugguuucaucaccuagcugcaucacuuaucagccuuggaccccauguguccau

SEQ ID NO: 118715 - RNA, 64 nt, Homo Sapiens
uuuuuauauauuuuuaaauugccuacaauuguggacuuaucauaaucaccaauauaaauuuauu

SEQ ID NO: 118716 - RNA, 64 nt, Homo Sapiens
ccucucacuacuuuccuggcaucuaaugcaacaaacuuaucacacacacacacacacacacaca

SEQ ID NO: 118717 - RNA, 54 nt, Homo Sapiens
cccgaucuccuccugccugaggccacuuaucagggccuggagcccugauggaag

SEQ ID NO: 118718 - RNA, 64 nt, Homo Sapiens
gccauguaaaaauuaauuccguauugaaauaguaacuuaucaauguaucaauuaccaccugguu

SEQ ID NO: 118719 - RNA, 55 nt, Homo Sapiens
guuguucggucagcccuucccauguacuuaucaaucaacaacagcagacuucuag

SEQ ID NO: 118720 - RNA, 64 nt, Homo Sapiens
uauauacauauuauguaugguuguaaauucauacacuuaucacaugaauguguuacuguauaca

SEQ ID NO: 118721 - RNA, 64 nt, Homo Sapiens
gccucugaaaaaucuagacuagaacccuguagugacuuaucauguggcccuauuacuccugcuu

SEQ ID NO: 118722 - RNA, 64 nt, Homo Sapiens
uaucuguguuuguguuggcaugcaagauuuagguacuuaucaaagauaauggggaauuaaggca

SEQ ID NO: 118723 - RNA, 64 nt, Homo Sapiens
cccuugguccuacucuaggaagugugauugucacacuuaucauguuguccagagguccagucug

SEQ ID NO: 118724 - RNA, 64 nt, Homo Sapiens
cauuaucuuugucuguucacuuucuaucuuauauacuuaucagggccauacugguaagcuugcg

SEQ ID NO: 118725 - RNA, 64 nt, Homo Sapiens
cauaaguugcaaauauuacuauguaacuuuucugacuuaucauuccuuuaaaauuuaacauucc

SEQ ID NO: 118726 - RNA, 64 nt, Homo Sapiens
gauaauugcaguuucacaagauacucacuucagcacuuaucagaugcaauugcauauuauguuu

SEQ ID NO: 118727 - RNA, 64 nt, Homo Sapiens
auacuauuguagaaaguguaucuauugucccuucacuuaucagcgaaaguuuaguggcagcacu

SEQ ID NO: 118728 - RNA, 64 nt, Homo Sapiens
gaaagguuucugucuuaaaaaaaaaaauccuuguacuuaucaauuuugccccuuaggcagucag

SEQ ID NO: 118729 - RNA, 64 nt, Homo Sapiens
ugugccauagcaccuggucuaaaggagagggcucacuuaucacuccuccccugcccucagaagg

SEQ ID NO: 118730 - RNA, 64 nt, Homo Sapiens
ccagcuauguuggacuaggguuguauuuuaaauaacuuaucauucugucuuucuggauggggac

SEQ ID NO: 118731 - RNA, 64 nt, Homo Sapiens
acacguaucccccaaaugcuacuguguauuuuguacuuaucacuauuuggguggcucuuauuaa

SEQ ID NO: 118732 - RNA, 64 nt, Homo Sapiens
cuucauccuauaucagcacagcugccauacuucgacuuaucaggauucuggcugguggccugcg

SEQ ID NO: 118733 - RNA, 64 nt, Homo Sapiens
uuucaagaaugacugcaguggguuuuggaaacagacuuaucauuauugauuugagguuucccag

SEQ ID NO: 118734 - RNA, 64 nt, Homo Sapiens
ccugcucacacacccuugucacaccccccacucuacuuaucaucggaggagaccaggccucuac

SEQ ID NO: 118735 - RNA, 64 nt, Homo Sapiens
gaacaaauauguaucauuauuuauuuuugauuucacuuaucauauuucuauaaccaaauugauc

SEQ ID NO: 118736 - RNA, 64 nt, Homo Sapiens
uuuuauuaaacacagggaaagacucagcugcuauacuuaucacauuuggaugauuuuuuaagca

SEQ ID NO: 118737 - RNA, 64 nt, Homo Sapiens
accaauaaacauuuauacuagauuuuuuauuuccacuuaucauuaaugauuuaauguuggauuu

SEQ ID NO: 118738 - RNA, 64 nt, Homo Sapiens
ccaccaggaagcacagguccaaggcuggucccacacuuaucagcagcaacaacugucaguucau

SEQ ID NO: 118739 - RNA, 64 nt, Homo Sapiens
uuuacugugucucauguuuuuauaaugaggugguacuuaucauuacuauuugcuugugaaaagg

SEQ ID NO: 118740 - RNA, 64 nt, Homo Sapiens
acguauuuauugccaaacuaaaaaagcuuauuuaacuuaucaaaugucacugcacaucaauaua

SEQ ID NO: 118741 - RNA, 64 nt, Homo Sapiens
aaaaaaacuccugugucggucagaacaacuugcuacuuaucauuuuuguauaaaaaggaaauua

SEQ ID NO: 118742 - RNA, 64 nt, Homo Sapiens
aauuaccacauuugccuucccuucaucagcuaacacuuaucacuuauacuaccaauaacuuguu

SEQ ID NO: 118743 - RNA, 64 nt, Homo Sapiens
cuuaaacuacaguaaagaaauaauagcaaagcccacuuaucauauuacugguuuuuccaauaag

SEQ ID NO: 118744 - RNA, 64 nt, Homo Sapiens
uagcacaaaggacgugccauuugagauaaagcacacuuaucacaggacccgugggguugcuuca

SEQ ID NO: 118745 - RNA, 64 nt, Homo Sapiens
guaugcuuugguuuagugcaaugugugguagauuacuuaucagaaaacauauaugucaucucua

SEQ ID NO: 118746 - RNA, 64 nt, Homo Sapiens
uccugagagguggugggcaggagggaggagugagacuuaucagaugggacgcuugccccaagac

SEQ ID NO: 118747 - RNA, 64 nt, Homo Sapiens
gcccuagaaagugcuaggagcccuacaaaugaagacuuaucaggguucuaaggacuagaggucu

SEQ ID NO: 118748 - RNA, 64 nt, Homo Sapiens
ggccccggcugggugagcugagauggaguccucgacuuaucaccacaccacugccccaaggacc

SEQ ID NO: 118749 - RNA, 64 nt, Homo Sapiens
aagccacccccaaaugcccaagaaaaaaagaaagacuuaucaacauuuguuccaugagcagaaa

SEQ ID NO: 118750 - RNA, 64 nt, Homo Sapiens
ggaccacuuuaguuuaaucaaggguguguauguaacuuaucacuuggcugggauuauucaaagu

SEQ ID NO: 118751 - RNA, 64 nt, Homo Sapiens
aacaguagggcacagucauucugugaauccuuuuacuuaucaaaauuugguagcuauucuaagg

SEQ ID NO: 118752 - RNA, 64 nt, Homo Sapiens
aagaaggaaaaaaaaagacuucuguucaaaguuaacuuaucagcuacauccucuguaacguggu

SEQ ID NO: 118753 - RNA, 64 nt, Homo Sapiens
cauuccagaaccucucuuuucuaagaugcacaacacuuaucaaagauauguuuaguuuagacuu

SEQ ID NO: 118754 - RNA, 64 nt, Homo Sapiens
uacuuagagucgggaugcacaacuucaaccaccgacuuaucaaugcagccgccuguguauugca

SEQ ID NO: 118755 - RNA, 64 nt, Homo Sapiens
gaccuuuuucuauguguagucugacuguauaaacacuuaucacuuuuucacacaucagaaaaaa

SEQ ID NO: 118756 - RNA, 64 nt, Homo Sapiens
ucacccucacacuggaggaggaugucugcucuggacuuaucaccccaggagaacugaacccgga

SEQ ID NO: 118757 - RNA, 64 nt, Homo Sapiens
acaguuguggaaaaguguucuagcaacagcauauacuuaucaucauugccuuuccacuacucua

SEQ ID NO: 118758 - RNA, 64 nt, Homo Sapiens
acaggugugguguaauuuauaaaauuagaaagcaacuuaucagcuacuuaagagaaauggcaag

SEQ ID NO: 118759 - RNA, 64 nt, Homo Sapiens
gugcugucccuuguauuuacuuuaagcacugaucacuuaucauucauucgguaugguuuucccu

SEQ ID NO: 118760 - RNA, 64 nt, Homo Sapiens
gagcccaccuggcuuugaaucugggcccuacuuaacuuaucagcuaugugguuuugggcauaag

SEQ ID NO: 118761 - RNA, 64 nt, Homo Sapiens
auucuuaugucacuuuagaagugaaagaguucagacuuaucaccaauaauauggcauuuaagag

SEQ ID NO: 118762 - RNA, 64 nt, Homo Sapiens
cacaacagguaauagcaauacaaugaguggcuuuacuuaucaauguguuuggaauuggguuuuu

SEQ ID NO: 118763 - RNA, 64 nt, Homo Sapiens
uuuagauacucaucaggaccucacaggagcugagacuuaucagccagaauguguucuucggaca

SEQ ID NO: 118764 - RNA, 64 nt, Homo Sapiens
uacuuaguaucauggggguucccuguuuccugguacuuaucaaaaaaguuagaacuauuacaac

SEQ ID NO: 118765 - RNA, 64 nt, Homo Sapiens
acuagggagaccauuaacuaguuuaucauuaaccacuuaucaguguauugauguuaaagcauuu

SEQ ID NO: 118766 - RNA, 64 nt, Homo Sapiens
gguaccuaugaaccuagaacuugaagugacuccuacuuaucacguaaauuuuuaugucugauau

SEQ ID NO: 118767 - RNA, 64 nt, Homo Sapiens
acccuccucuuuucugccuggcccccuacaccauacuuaucaccaggagaucuggggaggcccu

SEQ ID NO: 118768 - RNA, 64 nt, Homo Sapiens
agcaggcccuuucugacaugcuuuagcagagauaacuuaucagggcuaguuuaaacaaaugugu

SEQ ID NO: 118769 - RNA, 64 nt, Homo Sapiens
auauaaaaagaagagguugaaagauuauuaaauaacuuaucaggcaucucaaugguuacuaucu

SEQ ID NO: 118770 - RNA, 64 nt, Homo Sapiens
agcugauggauucaucugcuuuggcugaaauuaaacuuaucauuagucuagcuagcauuucagc

SEQ ID NO: 118771 - RNA, 64 nt, Homo Sapiens
acuaauauuuuuagaucuuuuuacuucaccucauacuuaucaccaauguauaucuccauuuauu

SEQ ID NO: 118772 - RNA, 64 nt, Homo Sapiens
aaaggcuuaggcauguucaaacgccugcaaaacuacuuaucacucagcuuuaguuuuucuaauc

SEQ ID NO: 118773 - RNA, 64 nt, Homo Sapiens; identical to SEQ ID NO: 118769

SEQ ID NO: 118774 - RNA, 64 nt, Homo Sapiens; identical to SEQ ID NO: 100180

SEQ ID NO: 118775 - RNA, 64 nt, Homo Sapiens; identical to SEQ ID NO: 100181

SEQ ID NO: 118776 - RNA, 64 nt, Homo Sapiens; identical to SEQ ID NO: 100182

SEQ ID NO: 118777 - RNA, 64 nt, Homo Sapiens; identical to SEQ ID NO: 100183

SEQ ID NO: 118778 - RNA, 64 nt, Homo Sapiens; identical to SEQ ID NO: 100184

SEQ ID NO: 118779 - RNA, 64 nt, Homo Sapiens; identical to SEQ ID NO: 100185

SEQ ID NO: 118780 - RNA, 64 nt, Homo Sapiens; identical to SEQ ID NO: 100186

SEQ ID NO: 118781 - RNA, 64 nt, Homo Sapiens; identical to SEQ ID NO: 100187

SEQ ID NO: 118782 - RNA, 64 nt, Homo Sapiens; identical to SEQ ID NO: 100188

SEQ ID NO: 118783 - RNA, 64 nt, Homo Sapiens; identical to SEQ ID NO: 100189

SEQ ID NO: 118784 - RNA, 64 nt, Homo Sapiens; identical to SEQ ID NO: 100190

SEQ ID NO: 118785 - RNA, 64 nt, Homo Sapiens; identical to SEQ ID NO: 100191

SEQ ID NO: 118786 - RNA, 64 nt, Homo Sapiens
uccuucccagaagucucccgagagacauauuuguguggccuagaaguccucuguggucuccccu

SEQ ID NO: 118787 - RNA, 64 nt, Homo Sapiens
accuuauugugagguuccauccagccaaguuuauguggccuauugucucaggacucucaucacu

SEQ ID NO: 118788 - RNA, 64 nt, Homo Sapiens
cggauauggggagccacugaguuugcaguccagcguggccuacaccuaauuucaugacccagug

SEQ ID NO: 118789 - RNA, 64 nt, Homo Sapiens
aaccuaauuucaugacccagacacaaggcugguuguggccuacauuucuguuuucuguuucaua

SEQ ID NO: 118790 - RNA, 64 nt, Homo Sapiens
cuaaggugcaggugagagggaccugcgggacccuguggccuaccuaucuaccaguaugagccau

SEQ ID NO: 118791 - RNA, 53 nt, Homo Sapiens
auugcuuacauccacccugugugguggccuagcagggaacgucucagguguag

SEQ ID NO: 118792 - RNA, 64 nt, Homo Sapiens
uguuuuuuuuuauucaacuuucaauauaaccuuuuauucauagauucuaccaacuaugguugcc

SEQ ID NO: 118793 - RNA, 64 nt, Homo Sapiens
gcuaugucacuauuuuuguacccaauucauaguuuauucauaauucuagugcauuuccaugguc

SEQ ID NO: 118794 - RNA, 64 nt, Homo Sapiens
auuuauuaaaucagaauguuguaugcaaaauauauauucauaccaaaauuuucuuuauuguaaa

SEQ ID NO: 118795 - RNA, 64 nt, Homo Sapiens
gcguuuuuuguaauuuaugauucuagaacaaaauuauucauagucauaugaguugaugugauac

SEQ ID NO: 118796 - RNA, 64 nt, Homo Sapiens
aacgagaagaauucagaaaaauuuauaaagcacauauucauaaugaguaaccgacaauauauuu

SEQ ID NO: 118797 - RNA, 64 nt, Homo Sapiens
aaaaaucaaguagcugauguggaagccaaacacauauucauaaaccagcaagcaacuucccugg

SEQ ID NO: 118798 - RNA, 64 nt, Homo Sapiens
auauaaaagaaauauaucugccuuacuagaaauauauucauaaucugaagacuaguuauauauu

SEQ ID NO: 118799 - RNA, 64 nt, Homo Sapiens
accagaaaaugaguuugucuuucauccagaaguguauucauauuuuagacugaaaaacuguugg

SEQ ID NO: 118800 - RNA, 64 nt, Homo Sapiens
aaaucaugguaccuguuuuaaaaugagaaguuauuauucauacuguguugcucauuugacaaaa

SEQ ID NO: 118801 - RNA, 64 nt, Homo Sapiens
augaugucuuccucucucucaaaauaaacuaaccuauucauauugcugugaaugcuuuaucuug

SEQ ID NO: 118802 - RNA, 64 nt, Homo Sapiens
acaguuagaucaccaugcuguguuaguuaugccuuauucauaucaauucuggucucggugcaaa

SEQ ID NO: 118803 - RNA, 64 nt, Homo Sapiens
acacucaaaacugugaaaauugguacugugcaucuauucauaaagaacaauuguaaaccugaca

SEQ ID NO: 118804 - RNA, 64 nt, Homo Sapiens
ccuaaucucauuauaucuuagucugaauaccccauauucauacuuucucaucugaauggaauaa

SEQ ID NO: 118805 - RNA, 64 nt, Homo Sapiens
guuauuuaagugucauugauauccuuucuuuuuauauucauaauucaauagcagucaacauuuu

SEQ ID NO: 118806 - RNA, 64 nt, Homo Sapiens
uauugggauuggauggccucauuaagcagcuugguauucauaaacagagucuaccuugaaacca

SEQ ID NO: 118807 - RNA, 64 nt, Homo Sapiens
ugcauucuuuuggcaguucugaagaacaacgguuuauucauacucaucuaaagcagcaggucua

SEQ ID NO: 118808 - RNA, 64 nt, Homo Sapiens
cacuuuccacauagaaaauacuaaauugguucuguauucauaaauaauuugcaucucauuuugc

SEQ ID NO: 118809 - RNA, 64 nt, Homo Sapiens
uuauccuucagagcaaugacugaaaaaaaauuucuauucauagcagggauuuuuuuuuuuuuaa

SEQ ID NO: 118810 - RNA, 64 nt, Homo Sapiens
cccuucuaaaguguacaauucaguggugugaguauauucauaagauuuauacuuggugucuauu

SEQ ID NO: 118811 - RNA, 64 nt, Homo Sapiens
ugugaguauauucauaagauuuauacuuggugucuauucauaagacuuauauccagcauauuca

SEQ ID NO: 118812 - RNA, 64 nt, Homo Sapiens
acuuggugucuauucauaagacuuauauccagcauauucauaacuagagccauaucacagaugc

SEQ ID NO: 118813 - RNA, 64 nt, Homo Sapiens
ccugugucacuucugacaugagccuguaaacauauauucauauauguaccugcacauguaccca

SEQ ID NO: 118814 - RNA, 64 nt, Homo Sapiens
aggucuuauuccuuuaguauggacuuaaaguacuuauucauauaccuuguaacuaaaaauuaga

SEQ ID NO: 118815 - RNA, 64 nt, Homo Sapiens
uuauguguaccuuggagucauccucuuggucuuguauucauauugugggacagugggaauagca

SEQ ID NO: 118816 - RNA, 64 nt, Homo Sapiens
uauauugugcuuuaauuuuuuaaaaaguauucuuuauucauauguauagaaugcuuaaaauagc

SEQ ID NO: 118817 - RNA, 64 nt, Homo Sapiens; identical to SEQ ID NO: 97557

SEQ ID NO: 118818 - RNA, 64 nt, Homo Sapiens; identical to SEQ ID NO: 97558

SEQ ID NO: 118819 - RNA, 64 nt, Homo Sapiens; identical to SEQ ID NO: 97559

SEQ ID NO: 118820 - RNA, 64 nt, Homo Sapiens; identical to SEQ ID NO: 97560

SEQ ID NO: 118821 - RNA, 64 nt, Homo Sapiens; identical to SEQ ID NO: 97561

SEQ ID NO: 118822 - RNA, 64 nt, Homo Sapiens; identical to SEQ ID NO: 97562

SEQ ID NO: 118823 - RNA, 64 nt, Homo Sapiens; identical to SEQ ID NO: 97563

SEQ ID NO: 118824 - RNA, 64 nt, Homo Sapiens; identical to SEQ ID NO: 97564

SEQ ID NO: 118825 - RNA, 64 nt, Homo Sapiens; identical to SEQ ID NO: 97565

SEQ ID NO: 118826 - RNA, 64 nt, Homo Sapiens; identical to SEQ ID NO: 97566

SEQ ID NO: 118827 - RNA, 62 nt, Homo Sapiens; identical to SEQ ID NO: 97567

SEQ ID NO: 118828 - RNA, 64 nt, Homo Sapiens; identical to SEQ ID NO: 97568

SEQ ID NO: 118829 - RNA, 64 nt, Homo Sapiens; identical to SEQ ID NO: 97569

SEQ ID NO: 118830 - RNA, 64 nt, Homo Sapiens; identical to SEQ ID NO: 97570

SEQ ID NO: 118831 - RNA, 64 nt, Homo Sapiens; identical to SEQ ID NO: 97571

SEQ ID NO: 118832 - RNA, 64 nt, Homo Sapiens; identical to SEQ ID NO: 97572

SEQ ID NO: 118833 - RNA, 64 nt, Homo Sapiens; identical to SEQ ID NO: 104428

SEQ ID NO: 118834 - RNA, 64 nt, Homo Sapiens; identical to SEQ ID NO: 104429

SEQ ID NO: 118835 - RNA, 64 nt, Homo Sapiens; identical to SEQ ID NO: 104430

SEQ ID NO: 118836 - RNA, 64 nt, Homo Sapiens; identical to SEQ ID NO: 104431

SEQ ID NO: 118837 - RNA, 64 nt, Homo Sapiens; identical to SEQ ID NO: 104432

SEQ ID NO: 118838 - RNA, 64 nt, Homo Sapiens; identical to SEQ ID NO: 104433

SEQ ID NO: 118839 - RNA, 64 nt, Homo Sapiens; identical to SEQ ID NO: 104434

SEQ ID NO: 118840 - RNA, 64 nt, Homo Sapiens; identical to SEQ ID NO: 104435

SEQ ID NO: 118841 - RNA, 64 nt, Homo Sapiens; identical to SEQ ID NO: 104436

SEQ ID NO: 118842 - RNA, 64 nt, Homo Sapiens; identical to SEQ ID NO: 104437

SEQ ID NO: 118843 - RNA, 64 nt, Homo Sapiens; identical to SEQ ID NO: 104438

SEQ ID NO: 118844 - RNA, 64 nt, Homo Sapiens; identical to SEQ ID NO: 104439

SEQ ID NO: 118845 - RNA, 64 nt, Homo Sapiens; identical to SEQ ID NO: 104440

SEQ ID NO: 118846 - RNA, 64 nt, Homo Sapiens; identical to SEQ ID NO: 104441

SEQ ID NO: 118847 - RNA, 64 nt, Homo Sapiens; identical to SEQ ID NO: 104442

SEQ ID NO: 118848 - RNA, 64 nt, Homo Sapiens; identical to SEQ ID NO: 104443

SEQ ID NO: 118849 - RNA, 64 nt, Homo Sapiens; identical to SEQ ID NO: 104444

SEQ ID NO: 118850 - RNA, 64 nt, Homo Sapiens; identical to SEQ ID NO: 104445

SEQ ID NO: 118851 - RNA, 64 nt, Homo Sapiens; identical to SEQ ID NO: 104446

SEQ ID NO: 118852 - RNA, 64 nt, Homo Sapiens; identical to SEQ ID NO: 104447

SEQ ID NO: 118853 - RNA, 64 nt, Homo Sapiens; identical to SEQ ID NO: 104448

SEQ ID NO: 118854 - RNA, 64 nt, Homo Sapiens; identical to SEQ ID NO: 104449

SEQ ID NO: 118855 - RNA, 64 nt, Homo Sapiens; identical to SEQ ID NO: 104450

SEQ ID NO: 118856 - RNA, 64 nt, Homo Sapiens; identical to SEQ ID NO: 104451

SEQ ID NO: 118857 - RNA, 64 nt, Homo Sapiens
gaauuggagggcauauguuacugucauucaggacaacauggaugcagccauaaaaacugaauuc

SEQ ID NO: 118858 - RNA, 64 nt, Homo Sapiens
uucuucaaaaauuacaaauagccauguggagaacaacauggacuugggaauguaaacuagagca

SEQ ID NO: 118859 - RNA, 64 nt, Homo Sapiens
ucguaugacccuggccucucgugaagagcagcacaacauggaaagagccaaaaugucacaguuc

SEQ ID NO: 118860 - RNA, 64 nt, Homo Sapiens
aaaugcuuuuauuagccaauaggaauuuuaaaauaacauggaacuuacacaaaaggcuuuucau

SEQ ID NO: 118861 - RNA, 64 nt, Homo Sapiens
cuugugugaccauuagcauucuuuuuuucuguguaacauggaaacccuucaccagaaugucaau

SEQ ID NO: 118862 - RNA, 64 nt, Homo Sapiens
cucaugagucauccuccagguccuacuugucuuuaacauggacauuguucuuggcucuggccuu

SEQ ID NO: 118863 - RNA, 64 nt, Homo Sapiens
uuccuaccuaguaacuugagacuuuaaaagaagaaacauggagaagaugugggagcgaauuuau

SEQ ID NO: 118864 - RNA, 64 nt, Homo Sapiens
ucauauagagguuaauuuaaucaaaaugagcuaaaacauggaacaaucacugaauaauuuaaaa

SEQ ID NO: 118865 - RNA, 64 nt, Homo Sapiens; identical to SEQ ID NO: 100778

SEQ ID NO: 118866 - RNA, 64 nt, Homo Sapiens; identical to SEQ ID NO: 100779

SEQ ID NO: 118867 - RNA, 64 nt, Homo Sapiens; identical to SEQ ID NO: 100780

SEQ ID NO: 118868 - RNA, 64 nt, Homo Sapiens; identical to SEQ ID NO: 100781

SEQ ID NO: 118869 - RNA, 64 nt, Homo Sapiens; identical to SEQ ID NO: 100782

SEQ ID NO: 118870 - RNA, 64 nt, Homo Sapiens; identical to SEQ ID NO: 100783

SEQ ID NO: 118871 - RNA, 64 nt, Homo Sapiens; identical to SEQ ID NO: 100784

SEQ ID NO: 118872 - RNA, 64 nt, Homo Sapiens; identical to SEQ ID NO: 100785

SEQ ID NO: 118873 - RNA, 64 nt, Homo Sapiens; identical to SEQ ID NO: 100786

SEQ ID NO: 118874 - RNA, 64 nt, Homo Sapiens; identical to SEQ ID NO: 100787

SEQ ID NO: 118875 - RNA, 64 nt, Homo Sapiens; identical to SEQ ID NO: 100788

SEQ ID NO: 118876 - RNA, 64 nt, Homo Sapiens; identical to SEQ ID NO: 100789

SEQ ID NO: 118877 - RNA, 64 nt, Homo Sapiens; identical to SEQ ID NO: 100790

SEQ ID NO: 118878 - RNA, 64 nt, Homo Sapiens
ggcuggguucauuuguguaaccgugggacggugcccaagccagagaccaugcucaucugcuggu

SEQ ID NO: 118879 - RNA, 64 nt, Homo Sapiens
ggaaccuguguccgguauucucagagaugcaccaccaagccaaggaggugggccagucugugga

SEQ ID NO: 118880 - RNA, 64 nt, Homo Sapiens
ggcacccgucggcaacccugugcaguccaggucaccaagccagcuugaaauuucauccagaguc

SEQ ID NO: 118881 - RNA, 64 nt, Homo Sapiens
ucucuuaacucuguaaugcaacuuuggaaucaccccaagccaauuuugaaacuucuuagcuguc

SEQ ID NO: 118882 - RNA, 64 nt, Homo Sapiens
gagacccugagacagugugaggggguggggacugccaagccacccuaagaccuugggaggaaaa

SEQ ID NO: 118883 - RNA, 64 nt, Homo Sapiens
gcagcauuggaaggcuggggccgggcaggccaggccaagccaagcagggggccacagggugggc

SEQ ID NO: 118884 - RNA, 64 nt, Homo Sapiens
uuuuuaguauguggcguaucaugcaagugcuaugccaagccaugucuaaauggcuuuaauuaua

SEQ ID NO: 118885 - RNA, 64 nt, Homo Sapiens
uuccuagaggguaaauaugacuccuuucucuaucccaagccaaccaagagcacauucuuaaagg

SEQ ID NO: 118886 - RNA, 64 nt, Homo Sapiens
cuuggcagggugaggggccaucugaaaggccaagccaagccauggagacccgggagggccuucc

SEQ ID NO: 118887 - RNA, 64 nt, Homo Sapiens
ccaugcuuggcagggugaggcuuccucugaaaggccaagccaagacucagagacccgggagggc

SEQ ID NO: 118888 - RNA, 64 nt, Homo Sapiens
guuauugacucaauaagugcuugcacuauggcuuccaagccaauaaauaaaccaaaccagccac

SEQ ID NO: 118889 - RNA, 64 nt, Homo Sapiens
ccacccgacagguucuucugcagggacuuaacagccaagccacagaaagugaucucaagagguc

SEQ ID NO: 118890 - RNA, 64 nt, Homo Sapiens
cagcccuucucccuguacccucucucucugcaucccaagccaucgcaggaucccaggggaaggg

SEQ ID NO: 118891 - RNA, 56 nt, Homo Sapiens
aaggcuacacuggugugucuggagcuccaagccaaccuguucccgccguccucuga

SEQ ID NO: 118892 - RNA, 63 nt, Homo Sapiens
guuccauuuaacauuccaacacauuaguaugaaauuuacuacacaaagaaaugccaauaugug

SEQ ID NO: 118893 - RNA, 63 nt, Homo Sapiens
acucaggauuauaaggcuggacagcaacaaauaauuuacuaucauaaaauauuggcaaacaau

SEQ ID NO: 118894 - RNA, 63 nt, Homo Sapiens
augagaacaguaugggggaauaucgugagacuuauuuacuaccacccuuuuaaaaccaucaga

SEQ ID NO: 118895 - RNA, 63 nt, Homo Sapiens
uucuaaaguuuauugauacuaagggacaggugaauuuacuacucaauugcauacccauauuuu

SEQ ID NO: 118896 - RNA, 63 nt, Homo Sapiens
gcuuuguaacaauugcauaccauuuuauaaaccauuuacuaugaguaacauaaaauaaaagua

SEQ ID NO: 118897 - RNA, 63 nt, Homo Sapiens
augauuaagacuuacauuuuacuucccacauauauuuacuaaguauaucuauuaaaaauuuca

SEQ ID NO: 118898 - RNA, 63 nt, Homo Sapiens
cagaugaauucagugugagguugcuaucauaauauuuacuaugaaugaauaucugcaugggau

SEQ ID NO: 118899 - RNA, 63 nt, Homo Sapiens
auuuuuaaaauucagaauguaaaaauuggguaaauuuacuacugaggggagugcacuuauuua

SEQ ID NO: 118900 - RNA, 63 nt, Homo Sapiens
uuuuugauguuuauauauaaacucuauauccuaauuuacuaauacucaucagaugucagccuu

SEQ ID NO: 118901 - RNA, 63 nt, Homo Sapiens
auuguuguaaaaugaggaauaagguaaugccucauuuacuagugauacuaaugacuacaaaaa

SEQ ID NO: 118902 - RNA, 63 nt, Homo Sapiens
uguauuuccuuguguguaaauuuccaugugaugauuuacuaguugcuagcaaggcugagcacu

SEQ ID NO: 118903 - RNA, 55 nt, Homo Sapiens
ggcgcaugagaccauauuaaauucuauuuacuauuuguugaauuuauuuuuccgu

SEQ ID NO: 118904 - RNA, 63 nt, Homo Sapiens
cuauucguggugggggugggggggaacccuaugauuuacuaugcagaugaagaggguaggaac

SEQ ID NO: 118905 - RNA, 63 nt, Homo Sapiens
cguguuuccagcaguuggcaguugugcaaauguauuuacuaugccuggagggcacuguguuug

SEQ ID NO: 118906 - RNA, 63 nt, Homo Sapiens
cuauaugugaauaucccugucccuacacagggaauuuacuaccucuaucucacuggcugcauu

SEQ ID NO: 118907 - RNA, 64 nt, Homo Sapiens
agccugggugacagagcgagacucuggcucauaaaauaauaauaauaauaaauaaauaaaaaau

SEQ ID NO: 118908 - RNA, 64 nt, Homo Sapiens
cugggugacagagcgagacucuggcucauaaaauaauaauaauaauaaauaaauaaaaaauaaa

SEQ ID NO: 118909 - RNA, 64 nt, Homo Sapiens
ggugacagagcgagacucuggcucauaaaauaauaauaauaauaaauaaauaaaaaauaaaugu

SEQ ID NO: 118910 - RNA, 64 nt, Homo Sapiens
gacagagcgagacucuggcucauaaaauaauaauaauaauaaauaaauaaaaaauaaauguuuu

SEQ ID NO: 118911 - RNA, 64 nt, Homo Sapiens
uaccugcaaaaaauauuuuguauauauccaauuuaauaauaaaugcacucauguuaggaagguc

SEQ ID NO: 118912 - RNA, 64 nt, Homo Sapiens
auguuaggaaggucaaaaaaaaggaaaaaagaaaaauaauaaaaaauaauaaaaauccuuagga

SEQ ID NO: 118913 - RNA, 64 nt, Homo Sapiens
ggucaaaaaaaaggaaaaaagaaaaauaauaaaaaauaauaaaaauccuuaggauaacuugagg

SEQ ID NO: 118914 - RNA, 64 nt, Homo Sapiens
cuagaaauaacaugauuuagucauaauugugaaaaauaauaauaauuuuucuuggauuuauguu

SEQ ID NO: 118915 - RNA, 64 nt, Homo Sapiens
gaaauaacaugauuuagucauaauugugaaaaauaauaauaauuuuucuuggauuuauguucug

SEQ ID NO: 118916 - RNA, 64 nt, Homo Sapiens
gugauuuugugagaucagcugaaccacuuaugauaauaauaauaaaaaagacugcuuugcccuc

SEQ ID NO: 118917 - RNA, 64 nt, Homo Sapiens
auuuugugagaucagcugaaccacuuaugauaauaauaauaaaaaagacugcuuugcccucacg

SEQ ID NO: 118918 - RNA, 64 nt, Homo Sapiens
uugaucauccagagaacauugacagacaauuaugaauaauaaagauguuaacaauccaucugua

SEQ ID NO: 118919 - RNA, 64 nt, Homo Sapiens
cucuaaaauacauaaguaaauuuaaaaaaaaaagaauaauaauuugaacagugaauguugaugu

SEQ ID NO: 118920 - RNA, 64 nt, Homo Sapiens
ccugggugacagagcaagacuccaucucaaaaaaaauaauaauaauaaauaaauaaaaaauccc

SEQ ID NO: 118921 - RNA, 64 nt, Homo Sapiens
gggugacagagcaagacuccaucucaaaaaaaauaauaauaauaaauaaauaaaaaaucccaau

SEQ ID NO: 118922 - RNA, 64 nt, Homo Sapiens
ugacagagcaagacuccaucucaaaaaaaauaauaauaauaaauaaauaaaaaaucccaauuac

SEQ ID NO: 118923 - RNA, 64 nt, Homo Sapiens
guaaacuauuauuuuugguuccugguauagaauaaauaauaaauguaaaggguuugggacagca

SEQ ID NO: 118924 - RNA, 64 nt, Homo Sapiens
aaucccauccauauauccaaaguaaacuuuaaguaauaauaaaguagccuguaauuaugagaac

SEQ ID NO: 118925 - RNA, 64 nt, Homo Sapiens
uggacaguuuacaaucguugccaucaaaaauaauaauaauaaacagagcccacauugucuguag

SEQ ID NO: 118926 - RNA, 64 nt, Homo Sapiens
aacuggacaguuuacaaucguagccaucaaaaauaauaauaauagugagagcccacauugucug

SEQ ID NO: 118927 - RNA, 64 nt, Homo Sapiens
auaaacuggacaguuuacaacuguagccaucaaaaauaauaauaggugugagagcccacauugu

SEQ ID NO: 118928 - RNA, 64 nt, Homo Sapiens
guaggcucagcucuuucccaguuuugauaguaauaauaauaaauuucaugaaaaguauguuguu

SEQ ID NO: 118929 - RNA, 64 nt, Homo Sapiens
aauguaggcucagcucuuucguuguuuugauaguaauaauaauauucuucaugaaaaguauguu

SEQ ID NO: 118930 - RNA, 64 nt, Homo Sapiens
accuauauaguauguucucuauucauaaagcaauaauaauaaaagauucaaagugguaacccaa

SEQ ID NO: 118931 - RNA, 64 nt, Homo Sapiens
aaaaccuauauaguauguuccaaauucauaaagcaauaauaauagaugauucaaagugguaacc

SEQ ID NO: 118932 - RNA, 64 nt, Homo Sapiens
gucuuucugaugaggcugccuauuaaacuuagagaauaauaauacuuccuaaacugaucacaac

SEQ ID NO: 118933 - RNA, 64 nt, Homo Sapiens
gaacuacagcaaaaggcagaagaaagugagacucaauaauaacuacuugcuguucaaauuaagu

SEQ ID NO: 118934 - RNA, 64 nt, Homo Sapiens
ugaaaaaaacuuuagaguucacuagggaucaugaaauaauaaacuuuugggguaucaguguuug

SEQ ID NO: 118935 - RNA, 64 nt, Homo Sapiens
gugugugccugcaguccuagucauccuuacaaaaaauaauaaugcugggaaacauagcaagauc

SEQ ID NO: 118936 - RNA, 64 nt, Homo Sapiens
ccagaggaaaugcauacaggauuuucuuaauuugaauaauaaaauuaccaaaaaauuuuuaagu

SEQ ID NO: 118937 - RNA, 64 nt, Homo Sapiens
acgauaauacuucuuuuccauaguucucagcaauaauaauaaugaaaaccaaaugauaucuaag

SEQ ID NO: 118938 - RNA, 64 nt, Homo Sapiens
augacgauaauacuucuuuuaaguaguucucagcaauaauaauaaacaaaaccaaaugauaucu

SEQ ID NO: 118939 - RNA, 64 nt, Homo Sapiens
uccguccuaaugcuuuaaauuuuaggguucuuuuaauaauaaugugauuuuugaagguauuuac

SEQ ID NO: 118940 - RNA, 64 nt, Homo Sapiens
ccaaucugaguuuagccucaaaguagcucauauaaauaauaaaaaaaacugaggcaguuaacca

SEQ ID NO: 118941 - RNA, 64 nt, Homo Sapiens
cagauaauugguuuuugccuauuuguaggacugaaauaauaauccuaauguaagauuagcuauu

SEQ ID NO: 118942 - RNA, 64 nt, Homo Sapiens
ccaugucuauagcuguagauaaaauaauaauaauaauaauaaaauugcauuauagccaguagua

SEQ ID NO: 118943 - RNA, 64 nt, Homo Sapiens
aaaccaugucuauagcuguaguaaaaauaauaauaauaauaauagaguugcauuauagccagua

SEQ ID NO: 118944 - RNA, 64 nt, Homo Sapiens
auaaaaccaugucuauagcuguaguaaaaauaauaauaauaauacaggaguugcauuauagcca

SEQ ID NO: 118945 - RNA, 64 nt, Homo Sapiens
auaauaaaaccaugucuauaccaguaguaaaaauaauaauaauaauccaggaguugcauuauag

SEQ ID NO: 118946 - RNA, 64 nt, Homo Sapiens
auaauaauaaaaccaugucuuagccaguaguaaaaauaauaauaauaauccaggaguugcauua

SEQ ID NO: 118947 - RNA, 64 nt, Homo Sapiens
aagagauugaaacuccaaacauaagguucuuccuaauaauaauuuauucuauuccuuaccagua

SEQ ID NO: 118948 - RNA, 64 nt, Homo Sapiens
uucuggucuucuuuaccaauauaaucauaauguaaauaauaauuuguauauuguguugcagaug

SEQ ID NO: 118949 - RNA, 64 nt, Homo Sapiens
augucucuuccaaucaugacuuuggaacucccugaauaauaaaaaugagaguugagauaaauag

SEQ ID NO: 118950 - RNA, 64 nt, Homo Sapiens
aagaaucuaaaugucgucuuugacucaaguaccaaauaauaauaaugcuauacuuaaauuacuu

SEQ ID NO: 118951 - RNA, 64 nt, Homo Sapiens
aaucuaaaugucgucuuugacucaaguaccaaauaauaauaaugcuauacuuaaauuacuugug

SEQ ID NO: 118952 - RNA, 64 nt, Homo Sapiens
uuuucucugucuuccaugucuugagaucucagagaauaauaauaaaaauguuacuuuauacgua

SEQ ID NO: 118953 - RNA, 64 nt, Homo Sapiens
ucucugucuuccaugucuugagaucucagagaauaauaauaaaaauguuacuuuauacguauau

SEQ ID NO: 118954 - RNA, 64 nt, Homo Sapiens
uccccagggccucugcucuccugggagacaaagcaauaauaaaaggaaguguuuguaaucccag

SEQ ID NO: 118955 - RNA, 64 nt, Homo Sapiens
ucaaaaauaaacaaauaaauuuuaaaaauaaauaaauaauaaaaggaaguguuagacaauguaa

SEQ ID NO: 118956 - RNA, 64 nt, Homo Sapiens
acugcagcgccgauuugaggguggagauauagauaauaauaauauuaauaauaauaauggccac

SEQ ID NO: 118957 - RNA, 64 nt, Homo Sapiens
auuugaggguggagauauagauaauaauaauauuaauaauaauaauggccacauggaucgaaca

SEQ ID NO: 118958 - RNA, 64 nt, Homo Sapiens
ugaggguggagauauagauaauaauaauauuaauaauaauaauggccacauggaucgaacacuc

SEQ ID NO: 118959 - RNA, 64 nt, Homo Sapiens
auuucauuauguuggccaacagaacuugauuguaaauaauaauaaagaaaucuguuauauacuu

SEQ ID NO: 118960 - RNA, 64 nt, Homo Sapiens
ucauuauguuggccaacagaacuugauuguaaauaauaauaaagaaaucuguuauauacuuuuc

SEQ ID NO: 118961 - RNA, 64 nt, Homo Sapiens
auugaagaaaaaaauaacuuugaaaaaauacgaaaauaauaaacagauuuuauguaguauuaag

SEQ ID NO: 118962 - RNA, 64 nt, Homo Sapiens
ccgauuuucauauaaauguacaauacaacugugaaauaauaagguaauaaaauaauuuuuaugg

SEQ ID NO: 118963 - RNA, 64 nt, Homo Sapiens
uccuaaauuuuuuauauuuauaaauuuguuuaauaauaauaauauauuucucuugauucuuggu

SEQ ID NO: 118964 - RNA, 64 nt, Homo Sapiens
auauccuaaauuuuuuauaugguuaaauuuguuuaauaauaauaaaguauuucucuugauucuu

SEQ ID NO: 118965 - RNA, 64 nt, Homo Sapiens
uuuaaaaaacauuuaaaaaaucuguuauuuacaaaauaauaauuuacuuuuuggaaacaaaucu

SEQ ID NO: 118966 - RNA, 64 nt, Homo Sapiens
agcauauaauugucuacagaucacuguuauguugaauaauaauucaguauugucacuuuugcuc

SEQ ID NO: 118967 - RNA, 64 nt, Homo Sapiens
uaaacaugcuguuaccagaguguucuuuugcaauaauaauaaauucacuaaucaugagaaaaac

SEQ ID NO: 118968 - RNA, 64 nt, Homo Sapiens
aauuaaacaugcuguuaccaaacuguucuuuugcaauaauaauaauuucacuaaucaugagaaa

SEQ ID NO: 118969 - RNA, 64 nt, Homo Sapiens
auaguaacaauggcuaaugaggauaauuauaauuaauaauaauccaugcucagauauguaucua

SEQ ID NO: 118970 - RNA, 64 nt, Homo Sapiens
ugaaucauguaauauuuaaguuguaaaaaaaaauaauaauaauuuccuuuacagguuuauuucu

SEQ ID NO: 118971 - RNA, 64 nt, Homo Sapiens
auuugaaucauguaauauuuucuuuguaaaaaaaaauaauaauaugauccuuuacagguuuauu

SEQ ID NO: 118972 - RNA, 64 nt, Homo Sapiens
uuccuuaaacauccaauaauuuaaaaugauuuucaauaauaauaaucaaaugaaaaagcuucau

SEQ ID NO: 118973 - RNA, 64 nt, Homo Sapiens
cuuaaacauccaauaauuuaaaaugauuuucaauaauaauaaucaaaugaaaaagcuucauucu

SEQ ID NO: 118974 - RNA, 64 nt, Homo Sapiens
aaaagaaagggucuuuucagaaacugaaguaggaaauaauaacagacaaggucaaaaaauagau

SEQ ID NO: 118975 - RNA, 64 nt, Homo Sapiens
auuuucauaaucacugcagccuuggacuuguaauaauaauaagucacuuccucaggugcagacc

SEQ ID NO: 118976 - RNA, 64 nt, Homo Sapiens
aguauuuucauaaucacugcacccuuggacuuguaauaauaauaggacacuuccucaggugcag

SEQ ID NO: 118977 - RNA, 64 nt, Homo Sapiens
ccugcuguguaagcugacagaaaaaaauaauaauaauaauaaggcuuggacuugucagcaaaaa

SEQ ID NO: 118978 - RNA, 64 nt, Homo Sapiens
aggccugcuguguaagcugaaaaaaaaaaauaauaauaauaauacaucuuggacuugucagcaa

SEQ ID NO: 118979 - RNA, 64 nt, Homo Sapiens
auaaggccugcuguguaagccaaaaaaaaaaaauaauaauaauaugccaucuuggacuugucag

SEQ ID NO: 118980 - RNA, 64 nt, Homo Sapiens
auaauaaggccugcuguguacagcaaaaaaaaaaaauaauaauagacugccaucuuggacuugu

SEQ ID NO: 118981 - RNA, 64 nt, Homo Sapiens
uauauagagggagcuguauuguguagcuguccaaaauaauaacaauguauauucuuccuugauu

SEQ ID NO: 118982 - RNA, 64 nt, Homo Sapiens
uaaguacaggcaggaauuuguucugggucaauggaauaauaaauagcugagaggugucugccac

SEQ ID NO: 118983 - RNA, 64 nt, Homo Sapiens
uaucaauuacacauuuuuguuaauauguaggaccaauaauaaaugucuacagcaugccaguaaa

SEQ ID NO: 118984 - RNA, 64 nt, Homo Sapiens
cacaguaaacauucuauuuccuacacagaguaauaauaauaaaacaugauagauaaauauguau

SEQ ID NO: 118985 - RNA, 64 nt, Homo Sapiens
aaacacaguaaacauucuauuaucuacacagaguaauaauaauaugacaugauagauaaauaug

SEQ ID NO: 118986 - RNA, 64 nt, Homo Sapiens
uaaaaauaaaaauaaaaaagaaaauaauaauaauaauaauaaagcagagugagacuccaucuca

SEQ ID NO: 118987 - RNA, 64 nt, Homo Sapiens
aaguaaaaauaaaaauaaaaucaaaaauaauaauaauaauaauaugacagagugagacuccauc

SEQ ID NO: 118988 - RNA, 64 nt, Homo Sapiens
auaaaguaaaaauaaaaauaaucucaaaaauaauaauaauaauagggugacagagugagacucc

SEQ ID NO: 118989 - RNA, 64 nt, Homo Sapiens
auaauaaaguaaaaauaaaauccaucucaaaaauaauaauaauaccugggugacagagugagac

SEQ ID NO: 118990 - RNA, 64 nt, Homo Sapiens
auaauaauaaaguaaaaauagacuccaucucaaaaauaauaauacagccugggugacagaguga

SEQ ID NO: 118991 - RNA, 64 nt, Homo Sapiens
uuuugcuaucuuuuuuaguguuaaagagauaaagaauaauaauuaaccaaccuuguuuaauaga

SEQ ID NO: 118992 - RNA, 64 nt, Homo Sapiens
uaucggcagaugaugcuuuggaagaugcagaagcaauaauaaaguacuugacuaccuacuggug

SEQ ID NO: 118993 - RNA, 64 nt, Homo Sapiens
ugcacuuuugaauguccaaaauuuauauuuuagaaauaauaaaaagaaagauacuuacauguuc

SEQ ID NO: 118994 - RNA, 64 nt, Homo Sapiens
guugcauuucaguaaaagcagaauaaccuuucaaaauaauaacaggcugggugcaauggcucac

SEQ ID NO: 118995 - RNA, 64 nt, Homo Sapiens
cuggccugggcaacagagcaagacccugucucaaaauaauaauaauauauaauuuuacaccaaa

SEQ ID NO: 118996 - RNA, 64 nt, Homo Sapiens
gccugggcaacagagcaagacccugucucaaaauaauaauaauauauaauuuuacaccaaaagu

SEQ ID NO: 118997 - RNA, 64 nt, Homo Sapiens
acaacguguuucugaaaaacagauuuucauaaguaauaauaaaaauaauaauaaaaaaguuuug

SEQ ID NO: 118998 - RNA, 64 nt, Homo Sapiens
uucugaaaaacagauuuucauaaguaauaauaaaaauaauaauaaaaaaguuuugguaugguaa

SEQ ID NO: 118999 - RNA, 64 nt, Homo Sapiens
ugaaaaacagauuuucauaaguaauaauaaaaauaauaauaaaaaaguuuugguaugguaagcc

SEQ ID NO: 119000 - RNA, 64 nt, Homo Sapiens
uaccccccaauuguuuuucaauccccuuuucucaaauaauaaauuaguuaaaucaguuucugag

SEQ ID NO: 119001 - RNA, 64 nt, Homo Sapiens
gugaugaaauugagacuuuuugugguuuucucucaauaauaagugaaccaauuucaaaugugau

SEQ ID NO: 119002 - RNA, 64 nt, Homo Sapiens
agacuauuaagagcaauaaauucuguuguagaauaauaauaaaacuuucugaauuuugaguauc

SEQ ID NO: 119003 - RNA, 64 nt, Homo Sapiens
aaaagacuauuaagagcaauaucuucuguuguagaauaauaauauuucuuucugaauuuugagu

SEQ ID NO: 119004 - RNA, 64 nt, Homo Sapiens
ccaguggaaauuuucuaccuuaugagaugaugaaaauaauaaagauagccuauuuauuauaaau

SEQ ID NO: 119005 - RNA, 64 nt, Homo Sapiens
aauaauuuuggcugagaaugucugguuaucuaugaauaauaaugugauuaggggcacccaaagu

SEQ ID NO: 119006 - RNA, 64 nt, Homo Sapiens
uguuguuugcuuuccuuaacauaauaauaauaauaauaauaauauaauaauaauaauaauaaua

SEQ ID NO: 119007 - RNA, 64 nt, Homo Sapiens
auauguuguuugcuuuccuuauaauaauaauaauaauaauaauaugauaauaauaauaauaaua

SEQ ID NO: 119008 - RNA, 64 nt, Homo Sapiens
auaauauguuguuugcuuucauaauaauaauaauaauaauaauaugaugauaauaauaauaaua

SEQ ID NO: 119009 - RNA, 64 nt, Homo Sapiens
auaauaauauguuguuugcuauaauaauaauaauaauaauaauauaaugaugauaauaauaaua

SEQ ID NO: 119010 - RNA, 64 nt, Homo Sapiens
auaauaauaauauguuguuuauaauaauaauaauaauaauaauauaauaaugaugauaauaaua

SEQ ID NO: 119011 - RNA, 64 nt, Homo Sapiens
auaauaauaauaauauguugauaauaauaauaauaauaauaauaugauaauaaugaugauaaua

SEQ ID NO: 119012 - RNA, 64 nt, Homo Sapiens
auaauaauaauaauaauaugauaauaauaauaauaauaauaauacaaugauaauaaugaugaua

SEQ ID NO: 119013 - RNA, 64 nt, Homo Sapiens
auaauaauaauaauaauaauauaauaauaauaauaauaauaauaacacaaugauaauaaugaug

SEQ ID NO: 119014 - RNA, 64 nt, Homo Sapiens
auaauaauaauaauaauaauaugauaauaauaauaauaauaauaugcacacaaugauaauaaug

SEQ ID NO: 119015 - RNA, 64 nt, Homo Sapiens
auaauaauaauaauaauaauaugaugauaauaauaauaauaauaauuugcacacaaugauaaua

SEQ ID NO: 119016 - RNA, 64 nt, Homo Sapiens
auaauaauaauaauaauaauauaaugaugauaauaauaauaauauucauuugcacacaaugaua

SEQ ID NO: 119017 - RNA, 64 nt, Homo Sapiens
auaauaauaauaauaauaauauaauaaugaugauaauaauaauauauuucauuugcacacaaug

SEQ ID NO: 119018 - RNA, 64 nt, Homo Sapiens
uggugccucaguuuccccaccuuuaaaaaaaaauaauaauaauccugucuaacuguagacaaau

SEQ ID NO: 119019 - RNA, 64 nt, Homo Sapiens
aucuggugccucaguuucccaaucuuuaaaaaaaaauaauaauaucccugucuaacuguagaca

SEQ ID NO: 119020 - RNA, 64 nt, Homo Sapiens
gacaugccaccgaaguacaacugagagacaguaaaauaauaacuaaccaacagugaauguggag

SEQ ID NO: 119021 - RNA, 64 nt, Homo Sapiens
augaaaagagaagguacccuuaugauaggagaauaauaauaaagaauauaaauaauaauuaagc

SEQ ID NO: 119022 - RNA, 64 nt, Homo Sapiens
aagaugaaaagagaagguacagcuaugauaggagaauaauaauauuuaauauaaauaauaauua

SEQ ID NO: 119023 - RNA, 64 nt, Homo Sapiens
aagcuaugauaggagaauaagaaaguuuaauauaaauaauaauuaagguaguaauuuaaacagg

SEQ ID NO: 119024 - RNA, 64 nt, Homo Sapiens
cucuucuguuuucaacaucuaggagugaguauauaauaauaagggaaucauuggaucuuuaaau

SEQ ID NO: 119025 - RNA, 64 nt, Homo Sapiens
cucuuccaaagccuuaauaaaaauuauuauguaaaauaauaagauuccauaaaaguaguuggga

SEQ ID NO: 119026 - RNA, 64 nt, Homo Sapiens
aguguuuaugaauagaaucacuauguuaaauaauaauaauaacuguuauauauaugaauauucc

SEQ ID NO: 119027 - RNA, 64 nt, Homo Sapiens
acuaguguuuaugaauagaaucccuauguuaaauaauaauaauaccuguuauauauaugaauau

SEQ ID NO: 119028 - RNA, 64 nt, Homo Sapiens
auaacuaguguuuaugaauauauucccuauguuaaauaauaauaguaccuguuauauauaugaa

SEQ ID NO: 119029 - RNA, 64 nt, Homo Sapiens
aaaaaagcccuuuaaacuuuuuuuggaccuaaauaauaauaaaaugugauuuuuaaaaacuuuu

SEQ ID NO: 119030 - RNA, 64 nt, Homo Sapiens
aaaaaaaaagcccuuuaaacuuuuuuuggaccuaaauaauaauauguugugauuuuuaaaaacu

SEQ ID NO: 119031 - RNA, 64 nt, Homo Sapiens
acauauuuuucuucagauuauuuuuauugugaauaauaauaagggcuugcagaauaaagccaac

SEQ ID NO: 119032 - RNA, 64 nt, Homo Sapiens
aggacauauuuuucuucagaaacuuuuuauugugaauaauaauacaggcuugcagaauaaagcc

SEQ ID NO: 119033 - RNA, 64 nt, Homo Sapiens
aguggaauauaaggaaagcagaaaauacaacuuaaauaauaaacuaaauucuauaggaacauau

SEQ ID NO: 119034 - RNA, 64 nt, Homo Sapiens
uuuaauauugagaaagaaacuguuguaaaaaaauaauaauaaugauguuuguccugaacacuuu

SEQ ID NO: 119035 - RNA, 64 nt, Homo Sapiens
auguuuaauauugagaaagauuuuguuguaaaaaaauaauaauagugauguuuguccugaacac

SEQ ID NO: 119036 - RNA, 64 nt, Homo Sapiens
acacuuuugguuaagucuguuuuaugacuucauuaauaauaaauucccuggccuuucauauuuu

SEQ ID NO: 119037 - RNA, 64 nt, Homo Sapiens
cuguuauauaaaugguuaaaagagguuuuucuuaaauaauaaagaucauguaaaaguaacaaau

SEQ ID NO: 119038 - RNA, 64 nt, Homo Sapiens
aaaaaaaaaagaaugcucauuguaaaaauaaaaaaauaauaauaagcaaggaguaaaaugugaa

SEQ ID NO: 119039 - RNA, 64 nt, Homo Sapiens
aaaaaaagaaugcucauuguaaaaauaaaaaaauaauaauaagcaaggaguaaaaugugaagug

SEQ ID NO: 119040 - RNA, 64 nt, Homo Sapiens
auaaugggccuuguaagucuuuucaccauucaugaauaauaauaaauauguacugcuggcaugu

SEQ ID NO: 119041 - RNA, 64 nt, Homo Sapiens
augggccuuguaagucuuuucaccauucaugaauaauaauaaauauguacugcuggcauguaau

SEQ ID NO: 119042 - RNA, 64 nt, Homo Sapiens
aaauaauccaagacuucucacuggggaauaagggaauaauaaauaggguacaaacuccuaauag

SEQ ID NO: 119043 - RNA, 64 nt, Homo Sapiens
aaaaaggaauuuuaaauuuaacucuucacauggaaauaauaaagcucuuuauaugagcuguccc

SEQ ID NO: 119044 - RNA, 64 nt, Homo Sapiens
uaucuuuaaaaagcuuuucaugauguuaaagcauaauaauaacaugugccaagaauaaaugaaa

SEQ ID NO: 119045 - RNA, 64 nt, Homo Sapiens
ugcuaaaaggccuuuuagaaaguuuggugcuguuaauaauaauuacuauuuaguaaaaaguuuu

SEQ ID NO: 119046 - RNA, 64 nt, Homo Sapiens
cuuguuucuuuccucccuguuaaagaggaaaaauaauaauaacugaaaagucaaggacuaauuu

SEQ ID NO: 119047 - RNA, 64 nt, Homo Sapiens
acucuuguuucuuuccucccuuuuaaagaggaaaaauaauaauauuugaaaagucaaggacuaa

SEQ ID NO: 119048 - RNA, 64 nt, Homo Sapiens
caacuuguuuccuuuuggccguguuuuaaaaaauaauaauaaaaaauuaaaccggaugcuaacg

SEQ ID NO: 119049 - RNA, 64 nt, Homo Sapiens
aaacaacuuguuuccuuuugacgguguuuuaaaaaauaauaauaaauaauuaaaccggaugcua

SEQ ID NO: 119050 - RNA, 64 nt, Homo Sapiens
aaauaaauaaaaauccaaacauaauaauaauaauaauaauaaauaaacauccuuuagaugcaaa

SEQ ID NO: 119051 - RNA, 64 nt, Homo Sapiens
aauaaauaaauaaaaauccaaaaauaauaauaauaauaauaauaccaaaacauccuuuagaugc

SEQ ID NO: 119052 - RNA, 64 nt, Homo Sapiens
auaaauaaauaaauaaaaauugcaaaauaauaauaauaauaauaccuccaaaacauccuuuaga

SEQ ID NO: 119053 - RNA, 64 nt, Homo Sapiens
auaauaaauaaauaaauaaaagaugcaaaauaauaauaauaauagcuccuccaaaacauccuuu

SEQ ID NO: 119054 - RNA, 64 nt, Homo Sapiens
auaauaauaaauaaauaaauuuuagaugcaaaauaauaauaauaugugcuccuccaaaacaucc

SEQ ID NO: 119055 - RNA, 64 nt, Homo Sapiens
auaauaauaauaaauaaauauccuuuagaugcaaaauaauaauacucugugcuccuccaaaaca

SEQ ID NO: 119056 - RNA, 64 nt, Homo Sapiens
aagugcugcuuacaucacugaacaacaacaaaaaaauaauaauggaguagcuguugcccuucuc

SEQ ID NO: 119057 - RNA, 64 nt, Homo Sapiens
uuuguuuacuuuucagguuuguacuacaagguuuaauaauaaaaacaaaguuuuuuggacauuu

SEQ ID NO: 119058 - RNA, 64 nt, Homo Sapiens
uucauaauuucacccugugacuauccugaaaagaaauaauaaucauuuuaugauugaugggcca

SEQ ID NO: 119059 - RNA, 64 nt, Homo Sapiens
agcaguuaacuuuacucuugguucugagucuccaaauaauaauagccgacguuuauugagcacu

SEQ ID NO: 119060 - RNA, 64 nt, Homo Sapiens
ugagccccugucaagugccagucaugauaguaguaauaauaauaauaaacaucuauuggaccag

SEQ ID NO: 119061 - RNA, 64 nt, Homo Sapiens
gccccugucaagugccagucaugauaguaguaauaauaauaauaaacaucuauuggaccaggcu

SEQ ID NO: 119062 - RNA, 64 nt, Homo Sapiens
ccugucaagugccagucaugauaguaguaauaauaauaauaaacaucuauuggaccaggcucug

SEQ ID NO: 119063 - RNA, 64 nt, Homo Sapiens
ccuccacauagauguuuuuauauuacaugaauuuaauaauaaacuaaacuuuuuuuugucuccc

SEQ ID NO: 119064 - RNA, 64 nt, Homo Sapiens
acacauauaauauauaugcuaaaguauaaagaguaauaauaaugacaauaaacaaaccccugug

SEQ ID NO: 119065 - RNA, 64 nt, Homo Sapiens
aaugccaacaaaauugguuguaaucaaauuuuaaaauaauaauaauuuggcccccccuuuuaaa

SEQ ID NO: 119066 - RNA, 64 nt, Homo Sapiens
gccaacaaaauugguuguaaucaaauuuuaaaauaauaauaauuuggcccccccuuuuaaaaua

SEQ ID NO: 119067 - RNA, 64 nt, Homo Sapiens
ucuauccuggguaacagcgagacucugucuuaaaaauaauaacaauaauaauaauaauaaagac

SEQ ID NO: 119068 - RNA, 64 nt, Homo Sapiens
gguaacagcgagacucugucuuaaaaauaauaacaauaauaauaauaauaaagacuuacuuaac

SEQ ID NO: 119069 - RNA, 64 nt, Homo Sapiens
aacagcgagacucugucuuaaaaauaauaacaauaauaauaauaauaaagacuuacuuaaccaa

SEQ ID NO: 119070 - RNA, 64 nt, Homo Sapiens
agcgagacucugucuuaaaaauaauaacaauaauaauaauaauaaagacuuacuuaaccaauau

SEQ ID NO: 119071 - RNA, 64 nt, Homo Sapiens
gagacucugucuuaaaaauaauaacaauaauaauaauaauaaagacuuacuuaaccaauauuau

SEQ ID NO: 119072 - RNA, 64 nt, Homo Sapiens
gccaaagacugcuugcuaguaggaaaaaauuucaaauaauaaccaaagcugaaaaauggucugu

SEQ ID NO: 119073 - RNA, 64 nt, Homo Sapiens
aaaugagagugugagagaaaguaccuucuauuuuaauaauaauauuauuauaaaaauaauaaau

SEQ ID NO: 119074 - RNA, 64 nt, Homo Sapiens
guaccuucuauuuuaauaauaauauuauuauaaaaauaauaaaucuuuuuaacuuuuauauuuu

SEQ ID NO: 119075 - RNA, 64 nt, Homo Sapiens
gaaaugcugcccuagaaguacaauaggaaggcuaaauaauaauaaccuguuuucugguuguugu

SEQ ID NO: 119076 - RNA, 64 nt, Homo Sapiens
augcugcccuagaaguacaauaggaaggcuaaauaauaauaaccuguuuucugguuguuguugg

SEQ ID NO: 119077 - RNA, 64 nt, Homo Sapiens
aauaugcagauuucuaauuggcauucauaaggugaauaauaauaagugcccaaugaaaaaaucu

SEQ ID NO: 119078 - RNA, 64 nt, Homo Sapiens
augcagauuucuaauuggcauucauaaggugaauaauaauaagugcccaaugaaaaaaucuauu

SEQ ID NO: 119079 - RNA, 64 nt, Homo Sapiens
auauuuuuguauagaagaguaaggcauauuauaaaauaauaaugcaucuugugggcauuauaca

SEQ ID NO: 119080 - RNA, 64 nt, Homo Sapiens
uuaccaacugcugagauuuuaauucuuuuuaaagaauaauaauggacuggaccuuaguacugua

SEQ ID NO: 119081 - RNA, 64 nt, Homo Sapiens
uauaauaaucaagaaauuaggucaaguggggaauaauaauaaugaaucaaguuucuaagaaggu

SEQ ID NO: 119082 - RNA, 64 nt, Homo Sapiens
auguauaauaaucaagaaauggugucaaguggggaauaauaauaaacaaucaaguuucuaagaa

SEQ ID NO: 119083 - RNA, 64 nt, Homo Sapiens
ggauuauggauaacaagagaauauacccaugugaaauaauaauuauauacuaagaauaaauaaa

SEQ ID NO: 119084 - RNA, 64 nt, Homo Sapiens
uuccaccuuuuccugcuguagaaucauuugcucaaauaauaacaauguuaguauucaucucuuu

SEQ ID NO: 119085 - RNA, 64 nt, Homo Sapiens
uuuuucagaaagaauugaguuuuauuuccuuaauaauaauaaacuuccuaugauccuuccacac

SEQ ID NO: 119086 - RNA, 64 nt, Homo Sapiens
aacuuuuucagaaagaauugcacuuuauuuccuuaauaauaauauauuuccuaugauccuucca

SEQ ID NO: 119087 - RNA, 64 nt, Homo Sapiens
agcugcaauuuaaggcagcaauccaagagacuugaauaauaauaauucaacaacagcuuuauuu

SEQ ID NO: 119088 - RNA, 64 nt, Homo Sapiens
ugcaauuuaaggcagcaauccaagagacuugaauaauaauaauucaacaacagcuuuauuuuua

SEQ ID NO: 119089 - RNA, 64 nt, Homo Sapiens
uuaauagccuugaaagcuuugauaaguuuucaguaauaauaaccuauuuaaucagaugaugaug

SEQ ID NO: 119090 - RNA, 64 nt, Homo Sapiens
gccuaggccucuauuuccuugucuccaaaaugagaauaauaaaauuuaggucaggauuacuaua

SEQ ID NO: 119091 - RNA, 64 nt, Homo Sapiens
guggaguauaaaggcuacacccuuauuguaaaaaaauaauaauaauaaaaugaaagaaacaauc

SEQ ID NO: 119092 - RNA, 64 nt, Homo Sapiens
gaguauaaaggcuacacccuuauuguaaaaaaauaauaauaauaaaaugaaagaaacaaucacc

SEQ ID NO: 119093 - RNA, 64 nt, Homo Sapiens
uauaaaggcuacacccuuauuguaaaaaaauaauaauaauaaaaugaaagaaacaaucaccacc

SEQ ID NO: 119094 - RNA, 64 nt, Homo Sapiens
agguuaggaaacagguuaaaacucagagaacuccaauaauaaugguuuaaaaacaucaggggcu

SEQ ID NO: 119095 - RNA, 64 nt, Homo Sapiens
aaaaaaaaguguguaaauauauuuaguugaaucaaauaauaaagaugaaucauuaugaauucac

SEQ ID NO: 119096 - RNA, 64 nt, Homo Sapiens
aaaaaagaaaaucauucuguuauuggcagggaauaauaauaaaaauguguuagauggaaaaugc

SEQ ID NO: 119097 - RNA, 64 nt, Homo Sapiens
aaaaaaaaagaaaaucauucugcuauuggcagggaauaauaauauaaauguguuagauggaaaa

SEQ ID NO: 119098 - RNA, 64 nt, Homo Sapiens
aaaaauaaauaaaaaggagacuaaaaacaaaaauaauaauaaagucuguuuuuagcuagaaacu

SEQ ID NO: 119099 - RNA, 64 nt, Homo Sapiens
aagaaaaauaaauaaaaaggacucuaaaaacaaaaauaauaauaagcucuguuuuuagcuagaa

SEQ ID NO: 119100 - RNA, 64 nt, Homo Sapiens
aaaaacucugaagaaacuugguuauuaaaauaauaauaauaauugaaguucugggauucagguu

SEQ ID NO: 119101 - RNA, 64 nt, Homo Sapiens
auuaaaaacucugaagaaacguuguuauuaaaauaauaauaauacuggaaguucugggauucag

SEQ ID NO: 119102 - RNA, 64 nt, Homo Sapiens
auaauuaaaaacucugaagacagguuguuauuaaaauaauaauauaucuggaaguucugggauu

SEQ ID NO: 119103 - RNA, 64 nt, Homo Sapiens
caucuacaaauuuauaaacacucaugcugacugaaauaauaagaccacaaauauaaauacagua

SEQ ID NO: 119104 - RNA, 64 nt, Homo Sapiens
aaaggacuuugguuuaaaguaaugucagcuuuacaauaauaaaaaggugcuuaaaucagaguaa

SEQ ID NO: 119105 - RNA, 64 nt, Homo Sapiens
aggaccacuugaaaagugaugcuaaacagccaguaauaauaauuuaaauauaauuuauuauuuc

SEQ ID NO: 119106 - RNA, 64 nt, Homo Sapiens
cuuauaucaauuuaaaauuugcuagugguuugaaaauaauaauguacugacuacauguaugcug

SEQ ID NO: 119107 - RNA, 64 nt, Homo Sapiens
gcuuuuuaaagaaacauaaccacaaaccuuuucaaauaauaauaauaauaauaauaaaaaaugu

SEQ ID NO: 119108 - RNA, 64 nt, Homo Sapiens
uuuuaaagaaacauaaccacaaaccuuuucaaauaauaauaauaauaauaauaaaaaauguauu

SEQ ID NO: 119109 - RNA, 64 nt, Homo Sapiens
uaaagaaacauaaccacaaaccuuuucaaauaauaauaauaauaauaauaaaaaauguauuuua

SEQ ID NO: 119110 - RNA, 64 nt, Homo Sapiens
agaaacauaaccacaaaccuuuucaaauaauaauaauaauaauaauaaaaaauguauuuuaaag

SEQ ID NO: 119111 - RNA, 64 nt, Homo Sapiens
aacauaaccacaaaccuuuucaaauaauaauaauaauaauaauaaaaaauguauuuuaaagaug

SEQ ID NO: 119112 - RNA, 64 nt, Homo Sapiens
auaaccacaaaccuuuucaaauaauaauaauaauaauaauaaaaaauguauuuuaaagauggcc

SEQ ID NO: 119113 - RNA, 64 nt, Homo Sapiens
uuuuuuaaacaaguuuuuuguagaucccuuguaaaauaauaauaauaauguugugaaucuccau

SEQ ID NO: 119114 - RNA, 64 nt, Homo Sapiens
uuuaaacaaguuuuuuguagaucccuuguaaaauaauaauaauaauguugugaaucuccaugcc

SEQ ID NO: 119115 - RNA, 64 nt, Homo Sapiens
aaacaaguuuuuuguagaucccuuguaaaauaauaauaauaauguugugaaucuccaugccaag

SEQ ID NO: 119116 - RNA, 64 nt, Homo Sapiens
uguuacguuuuauugguuucucuaagauaaaaauaauaauaaaggaagccuuuggugaauuccu

SEQ ID NO: 119117 - RNA, 64 nt, Homo Sapiens
aaguguuacguuuuauugguccuucuaagauaaaaauaauaauauaugaagccuuuggugaauu

SEQ ID NO: 119118 - RNA, 64 nt, Homo Sapiens
uaauucuuuuucagaaaauauguugcuagagaacaauaauaaaagaugagaauuguuugagguu

SEQ ID NO: 119119 - RNA, 64 nt, Homo Sapiens
ucaucagaauccuuggcugaggcuucauuuuaggaauaauaaauacaucguuuacuuuuuaacu

SEQ ID NO: 119120 - RNA, 64 nt, Homo Sapiens
uauuuaaucuuauuaaguguuuuuuuaaaaaaauaauaauaaaaccuuacgcugggaaagcugg

SEQ ID NO: 119121 - RNA, 64 nt, Homo Sapiens
aaauauuuaaucuuauuaagugguuuuuuaaaaaaauaauaauagcuccuuacgcugggaaagc

SEQ ID NO: 119122 - RNA, 64 nt, Homo Sapiens
cuuuuuuaaaaucugcugaaggagagcaaaacuuaauaauaauucugaagcacacggccauguu

SEQ ID NO: 119123 - RNA, 64 nt, Homo Sapiens
aguaagcuagcaaauaguaauacugcuuaauucaaauaauaauugaaacuuaaauuuuaguucu

SEQ ID NO: 119124 - RNA, 64 nt, Homo Sapiens
uuuaagaaauaaauuuauuuacauaauccaguaaaauaauaauuagaacacagcccugcuucug

SEQ ID NO: 119125 - RNA, 64 nt, Homo Sapiens
gcaaacuuaacaccccacugcacauaguaauaauaauaauaaugucaaaagagacuuagacucc

SEQ ID NO: 119126 - RNA, 64 nt, Homo Sapiens
auggcaaacuuaacaccccaucccacauaguaauaauaauaauaugaucaaaagagacuuagac

SEQ ID NO: 119127 - RNA, 64 nt, Homo Sapiens
auaauggcaaacuuaacaccgacucccacauaguaauaauaauagugugaucaaaagagacuua

SEQ ID NO: 119128 - RNA, 64 nt, Homo Sapiens
agccugggugacagagcgacccucugucucaaaaaauaauaauaauaauaaauaaaacaacaac

SEQ ID NO: 119129 - RNA, 64 nt, Homo Sapiens
cugggugacagagcgacccucugucucaaaaaauaauaauaauaauaaauaaaacaacaacaaa

SEQ ID NO: 119130 - RNA, 64 nt, Homo Sapiens
ggugacagagcgacccucugucucaaaaaauaauaauaauaauaaauaaaacaacaacaaaaug

SEQ ID NO: 119131 - RNA, 64 nt, Homo Sapiens
gacagagcgacccucugucucaaaaaauaauaauaauaauaaauaaaacaacaacaaaaugcau

SEQ ID NO: 119132 - RNA, 64 nt, Homo Sapiens
aaaccuuuacuauuuccaauguauguuuguuaaaaauaauaauaauaaaaccaaaagccuuugu

SEQ ID NO: 119133 - RNA, 64 nt, Homo Sapiens
ccuuuacuauuuccaauguauguuuguuaaaaauaauaauaauaaaaccaaaagccuuugugga

SEQ ID NO: 119134 - RNA, 64 nt, Homo Sapiens
uuacuauuuccaauguauguuuguuaaaaauaauaauaauaaaaccaaaagccuuuguggaaac

SEQ ID NO: 119135 - RNA, 64 nt, Homo Sapiens
ccaucacccaccaucaccgcugcugcaaagaggcaauaauaaaggaacugaagacagcuguauu

SEQ ID NO: 119136 - RNA, 64 nt, Homo Sapiens
cuaugaauuguuaauuaaggugccaaaaaaaauuaauaauaaagcuugguuuuuugaaaaaccc

SEQ ID NO: 119137 - RNA, 64 nt, Homo Sapiens
ugaaacaaucugauuggggcacaguguugauaauaauaauaaaauuacaggugccaaaaagggg

SEQ ID NO: 119138 - RNA, 64 nt, Homo Sapiens
aaaugaaacaaucugauugggggacaguguugauaauaauaauaauuuuacaggugccaaaaag

SEQ ID NO: 119139 - RNA, 64 nt, Homo Sapiens
agacaaagcacauguuuguuuaggaccaauaaagaauaauaaaauggguaaagagucacauugg

SEQ ID NO: 119140 - RNA, 64 nt, Homo Sapiens
aaaugccuucaauuucugaggacccaaacaaaaaaauaauaaucugccaaggaaccuuuacaca

SEQ ID NO: 119141 - RNA, 64 nt, Homo Sapiens
cugagaggccucaggaaagucauuccuuuuuaaaaauaauaauaaauguaaggggguacagugc

SEQ ID NO: 119142 - RNA, 64 nt, Homo Sapiens
agaggccucaggaaagucauuccuuuuuaaaaauaauaauaaauguaaggggguacagugcagu

SEQ ID NO: 119143 - RNA, 64 nt, Homo Sapiens
aagauagguuaaaguauuugacaaaagugaauacaauaauaacacuugugucaaaaugauauag

SEQ ID NO: 119144 - RNA, 64 nt, Homo Sapiens
gcuuuccuucagaaaacucugaaguuauauuugcaauaauaaugaaaccagcauuuaguaccag

SEQ ID NO: 119145 - RNA, 64 nt, Homo Sapiens
uuugauucuuuuucuuuugugcacauaagaaauaaauaauaauaauaaauaaagaauaaaauuu

SEQ ID NO: 119146 - RNA, 64 nt, Homo Sapiens
gauucuuuuucuuuugugcacauaagaaauaaauaauaauaauaaauaaagaauaaaauuuugu

SEQ ID NO: 119147 - RNA, 64 nt, Homo Sapiens
ucuuuuucuuuugugcacauaagaaauaaauaauaauaauaaauaaagaauaaaauuuuguaug

SEQ ID NO: 119148 - RNA, 64 nt, Homo Sapiens
aacuuugccaaugauagugaccacagcaaaagcaaauaauaauaauauuaauaauaauaaagag

SEQ ID NO: 119149 - RNA, 64 nt, Homo Sapiens
uuugccaaugauagugaccacagcaaaagcaaauaauaauaauauuaauaauaauaaagagaaa

SEQ ID NO: 119150 - RNA, 64 nt, Homo Sapiens
agugaccacagcaaaagcaaauaauaauaauauuaauaauaauaaagagaaauaaaauaauaaa

SEQ ID NO: 119151 - RNA, 64 nt, Homo Sapiens
gaccacagcaaaagcaaauaauaauaauauuaauaauaauaaagagaaauaaaauaauaaaaua

SEQ ID NO: 119152 - RNA, 64 nt, Homo Sapiens
uaauaauaauauuaauaauaauaaagagaaauaaaauaauaaaauaaaaaacaauagcacagcc

SEQ ID NO: 119153 - RNA, 64 nt, Homo Sapiens
ccuuccaaaaaaagugccggucaauaaaauuaauaauaauaaaaugacagagugagacuccauc

SEQ ID NO: 119154 - RNA, 64 nt, Homo Sapiens
aaaccuuccaaaaaaagugcaucucaauaaaauuaauaauaauagggugacagagugagacucc

SEQ ID NO: 119155 - RNA, 64 nt, Homo Sapiens
aaaggaaagcaacgaaugcaaacaauuuaaaaauaauaauaacacaaacacaugaacuuguuac

SEQ ID NO: 119156 - RNA, 64 nt, Homo Sapiens
acaaaaggaaagcaacgaauuacaacaauuuaaaaauaauaauaggccaaacacaugaacuugu

SEQ ID NO: 119157 - RNA, 64 nt, Homo Sapiens
uggaaguuuuaguuuacaaacauaaaaaaagaauaauaauaacuuugcaugauggcuaagcuaa

SEQ ID NO: 119158 - RNA, 64 nt, Homo Sapiens
acuuggaaguuuuaguuuacuaacauaaaaaaagaauaauaauaauuuugcaugauggcuaagc

SEQ ID NO: 119159 - RNA, 64 nt, Homo Sapiens
aaaauaacuuuguuaguguuuauuccagcaucagaauaauaagcuuaugaauauuugaccaaau

SEQ ID NO: 119160 - RNA, 64 nt, Homo Sapiens
agcaucuaagugguuggguuuggugaaagaaaauaauaauaauguugaauagaguauacuggau

SEQ ID NO: 119161 - RNA, 64 nt, Homo Sapiens
augagcaucuaagugguugggauuggugaaagaaaauaauaauaauguugaauagaguauacug

SEQ ID NO: 119162 - RNA, 64 nt, Homo Sapiens
ccuuggugaugcauuacaacuuguuuucuuauguaauaauaaugaugaugaugaugauaauaau

SEQ ID NO: 119163 - RNA, 64 nt, Homo Sapiens
uuucuuauguaauaauaaugaugaugaugaugauaauaauaaauauuuuugagugcuuacuaug

SEQ ID NO: 119164 - RNA, 64 nt, Homo Sapiens
augguuuucuaaacuccaaaauggucaucuuaucaauaauaauaauauugaccauuuccuaucu

SEQ ID NO: 119165 - RNA, 64 nt, Homo Sapiens
guuuucuaaacuccaaaauggucaucuuaucaauaauaauaauauugaccauuuccuaucugcc

SEQ ID NO: 119166 - RNA, 64 nt, Homo Sapiens
ggaaagagugaugaauuauauuauauuauauaaaaauaauaauaaaaauauaaagaaagcuacc

SEQ ID NO: 119167 - RNA, 64 nt, Homo Sapiens
aagagugaugaauuauauuauauuauauaaaaauaauaauaaaaauauaaagaaagcuaccuuu

SEQ ID NO: 119168 - RNA, 64 nt, Homo Sapiens
uaauuaaaaauuuauuuaucuguuuauuuaaaauaauaauaaaaaauaacagucugaacuuauu

SEQ ID NO: 119169 - RNA, 64 nt, Homo Sapiens
aaauaauuaaaaauuuauuuauuuguuuauuuaaaauaauaauaauaaauaacagucugaacuu

SEQ ID NO: 119170 - RNA, 64 nt, Homo Sapiens
uguaaucagcaguaaaggaggguggaugaaaagaaauaauaaauguauaauuugaggaguggau

SEQ ID NO: 119171 - RNA, 64 nt, Homo Sapiens
uaaauauauguauuagaugagguaccaaaguaauaauaauaauauccuucagaugaagaaauuu

SEQ ID NO: 119172 - RNA, 64 nt, Homo Sapiens
auauaaauauauguauuagauuugguaccaaaguaauaauaauacauuccuucagaugaagaaa

SEQ ID NO: 119173 - RNA, 64 nt, Homo Sapiens
cugguagaaaaaugaaaacuauaaacuuuuuugaaauaauaaauggaauuaugucugcugaaua

SEQ ID NO: 119174 - RNA, 64 nt, Homo Sapiens
uuuuuugaaauaauaaaucuaauuaugucugcugaauaauaaacccuucuguaaagguuuuugg

SEQ ID NO: 119175 - RNA, 64 nt, Homo Sapiens
cuuuaaagcauguugucaacguuuucuuaaacugaauaauaaucacucaucuucugucaaagau

SEQ ID NO: 119176 - RNA, 64 nt, Homo Sapiens
aaucauaucaagucaauuaguuugguuucacacuaauaauaaugacaaaaagcacaugcagagu

SEQ ID NO: 119177 - RNA, 64 nt, Homo Sapiens
aguguuagugcucagaaaucaccauaaucacgaaaauaauaauaauaaaucuuuaacauacuac

SEQ ID NO: 119178 - RNA, 64 nt, Homo Sapiens
guuagugcucagaaaucaccauaaucacgaaaauaauaauaauaaaucuuuaacauacuaccua

SEQ ID NO: 119179 - RNA, 64 nt, Homo Sapiens
agugcucagaaaucaccauaaucacgaaaauaauaauaauaaaucuuuaacauacuaccuaaag

SEQ ID NO: 119180 - RNA, 64 nt, Homo Sapiens
gcucgaaagaaaaaaauguuaaaaauauaucuauaauaauaauuuuuugucauuugucuuuaug

SEQ ID NO: 119181 - RNA, 64 nt, Homo Sapiens
gguccaaguacuuuguauuguauacgugagucauaauaauaaaaagaagaagaaaaauaauaga

SEQ ID NO: 119182 - RNA, 64 nt, Homo Sapiens
agccuacaugacaaugugacacuccaucucaaaaaauaauaauaauaacaauauaagaacuagc

SEQ ID NO: 119183 - RNA, 64 nt, Homo Sapiens
cuacaugacaaugugacacuccaucucaaaaaauaauaauaauaacaauauaagaacuagcugg

SEQ ID NO: 119184 - RNA, 64 nt, Homo Sapiens
caugacaaugugacacuccaucucaaaaaauaauaauaauaacaauauaagaacuagcugggca

SEQ ID NO: 119185 - RNA, 64 nt, Homo Sapiens
aguacaaugagccuuacuguauuuaguguggcagaauaauaacaucaguggcaggccacugauu

SEQ ID NO: 119186 - RNA, 64 nt, Homo Sapiens
cugagaguuugguaaaagaauauuuucuucucugaauaauaauuauuuucacagugaaaauuuc

SEQ ID NO: 119187 - RNA, 64 nt, Homo Sapiens
agugaggccaagaaaguuuccgguuaaguucuuuaauaauaauccuacaguuuaucuuaagaaa

SEQ ID NO: 119188 - RNA, 64 nt, Homo Sapiens
augacugcuaucauaggcauccauauuuaauauuaauaauaauaauuaauaauaauaauaaacc

SEQ ID NO: 119189 - RNA, 64 nt, Homo Sapiens
acugcuaucauaggcauccauauuuaauauuaauaauaauaauuaauaauaauaauaaacccaa

SEQ ID NO: 119190 - RNA, 64 nt, Homo Sapiens
uaggcauccauauuuaauauuaauaauaauaauuaauaauaauaauaaacccaacacccauccc

SEQ ID NO: 119191 - RNA, 64 nt, Homo Sapiens
gcauccauauuuaauauuaauaauaauaauuaauaauaauaauaaacccaacacccauccccca

SEQ ID NO: 119192 - RNA, 64 nt, Homo Sapiens
uccauauuuaauauuaauaauaauaauuaauaauaauaauaaacccaacacccaucccccagaa

SEQ ID NO: 119193 - RNA, 64 nt, Homo Sapiens
gcuguuguuuagggguaaauaacaguaaauaauuaauaauaauaauaauaauaauaaaggagcu

SEQ ID NO: 119194 - RNA, 64 nt, Homo Sapiens
guuguuuagggguaaauaacaguaaauaauuaauaauaauaauaauaauaauaaaggagcugac

SEQ ID NO: 119195 - RNA, 64 nt, Homo Sapiens
guuuagggguaaauaacaguaaauaauuaauaauaauaauaauaauaauaaaggagcugacguu

SEQ ID NO: 119196 - RNA, 64 nt, Homo Sapiens
uagggguaaauaacaguaaauaauuaauaauaauaauaauaauaauaaaggagcugacguucuu

SEQ ID NO: 119197 - RNA, 64 nt, Homo Sapiens
ggguaaauaacaguaaauaauuaauaauaauaauaauaauaauaaaggagcugacguucuuagc

SEQ ID NO: 119198 - RNA, 64 nt, Homo Sapiens
uaaauaacaguaaauaauuaauaauaauaauaauaauaauaaaggagcugacguucuuagccuu

SEQ ID NO: 119199 - RNA, 64 nt, Homo Sapiens
uuauagaaaugugaacacugaauuuauuuuaaaaaauaauaauaaaaauuuaaaaaaauuaaaa

SEQ ID NO: 119200 - RNA, 64 nt, Homo Sapiens
uagaaaugugaacacugaauuuauuuuaaaaaauaauaauaaaaauuuaaaaaaauuaaaaaua

SEQ ID NO: 119201 - RNA, 64 nt, Homo Sapiens
guaaauacugugaaguguguacugaagauuuaauaauaauaaaucauauuuauaccuuucaggu

SEQ ID NO: 119202 - RNA, 64 nt, Homo Sapiens
aauguaaauacugugaaguggguacugaagauuuaauaauaauaacccauauuuauaccuuuca

SEQ ID NO: 119203 - RNA, 64 nt, Homo Sapiens
aaauuaauucuaaaggcccacuucaaugcuuaauaauaauaaacuauaaauauuaauaauacaa

SEQ ID NO: 119204 - RNA, 64 nt, Homo Sapiens
aacaaauuaauucuaaaggccaacuucaaugcuuaauaauaauauacuauaaauauuaauaaua

SEQ ID NO: 119205 - RNA, 64 nt, Homo Sapiens
gaugauaaagauguuucugagucauaauaacaauaauaauaaaucagcagcaauaguagaagua

SEQ ID NO: 119206 - RNA, 64 nt, Homo Sapiens
aaugaugauaaagauguuucguagucauaauaacaauaauaauauagcagcagcaauaguagaa

SEQ ID NO: 119207 - RNA, 64 nt, Homo Sapiens
ccaacaaggaauucagaguaaucauuaaguaguuaauaauaauuuguuucuuaaagcucugaac

SEQ ID NO: 119208 - RNA, 64 nt, Homo Sapiens
cucugaauuuuucgaaagggauuuaagaaggauuaauaauaaugcaugcuuggcccugcauuua

SEQ ID NO: 119209 - RNA, 64 nt, Homo Sapiens
uaagugagcugaacucaccucaaaaaaaaaaaauaauaauaaaagacagagcaagacucugucu

SEQ ID NO: 119210 - RNA, 64 nt, Homo Sapiens
aaauaagugagcugaacucaucucaaaaaaaaaaaauaauaauaggcgacagagcaagacucug

SEQ ID NO: 119211 - RNA, 64 nt, Homo Sapiens
caaaaaugccccucccccaucucuauuuuaaaauaauaauaacauggacagaacaaggcccugu

SEQ ID NO: 119212 - RNA, 64 nt, Homo Sapiens
acacaaaaaugccccuccccugucucuauuuuaaaauaauaauaggguggacagaacaaggccc

SEQ ID NO: 119213 - RNA, 64 nt, Homo Sapiens
gccaagggggagagagacacaagcaaaaaauaauaauaauaaauaccaccaaucugugaaagua

SEQ ID NO: 119214 - RNA, 64 nt, Homo Sapiens
aaugccaagggggagagagaguaaagcaaaaaauaauaauaauaauuaccaccaaucugugaaa

SEQ ID NO: 119215 - RNA, 64 nt, Homo Sapiens
auaaaugccaagggggagagaaaguaaagcaaaaaauaauaauacucauuaccaccaaucugug

SEQ ID NO: 119216 - RNA, 64 nt, Homo Sapiens
auagggacgcauaugcuuuuuaaagcaaucuaaaaauaauaauaaguauagcgacuauauaccu

SEQ ID NO: 119217 - RNA, 64 nt, Homo Sapiens
gggacgcauaugcuuuuuaaagcaaucuaaaaauaauaauaaguauagcgacuauauaccuacu

SEQ ID NO: 119218 - RNA, 64 nt, Homo Sapiens
cuccagucugggcaacagagugagacccugucucaauaauaauaauaauaauaaugaugauacu

SEQ ID NO: 119219 - RNA, 64 nt, Homo Sapiens
cagucugggcaacagagugagacccugucucaauaauaauaauaauaauaaugaugauacucua

SEQ ID NO: 119220 - RNA, 64 nt, Homo Sapiens
ucugggcaacagagugagacccugucucaauaauaauaauaauaauaaugaugauacucuaaga

SEQ ID NO: 119221 - RNA, 64 nt, Homo Sapiens
gggcaacagagugagacccugucucaauaauaauaauaauaauaaugaugauacucuaagaaaa

SEQ ID NO: 119222 - RNA, 64 nt, Homo Sapiens
caacagagugagacccugucucaauaauaauaauaauaauaaugaugauacucuaagaaaaaaa

SEQ ID NO: 119223 - RNA, 64 nt, Homo Sapiens
gggaguccuuggaccacaucauaauaauaagugaaauaauaaguuacauuagaauuuauuauua

SEQ ID NO: 119224 - RNA, 64 nt, Homo Sapiens
gaaauaauaagugggaguccaauuuauuauuaauaauaauaaguuugugcggacgauacauuag

SEQ ID NO: 119225 - RNA, 61 nt, Homo Sapiens
agugaaauaauaagugggagaauuuauuauuaauaauaauauugugcggacgauacauuag

SEQ ID NO: 119226 - RNA, 64 nt, Homo Sapiens
uauccccauaugucuguguuuguuugagauuuuuaauaauaaauaauaaauuuuugaagaaugg

SEQ ID NO: 119227 - RNA, 64 nt, Homo Sapiens
auaugucuguguuuguuugagauuuuuaauaauaaauaauaaauuuuugaagaauggaagugga

SEQ ID NO: 119228 - RNA, 64 nt, Homo Sapiens
aucuguuuuuucauuugauccuaucgacaaucauaauaauaauaaauuauauauauaacccaua

SEQ ID NO: 119229 - RNA, 64 nt, Homo Sapiens
uguuuuuucauuugauccuaucgacaaucauaauaauaauaaauuauauauauaacccauauaa

SEQ ID NO: 119230 - RNA, 64 nt, Homo Sapiens
cgugccaagcaauaagauuuauguauauuuguuuaauaauaaccuauuucaagucugaguuuug

SEQ ID NO: 119231 - RNA, 64 nt, Homo Sapiens
uugauuuuacagucuguaaugcuugauguuuuaaaauaauaacauuuuuauauuuuuuaaaaga

SEQ ID NO: 119232 - RNA, 64 nt, Homo Sapiens
uuugaaaaaauuacccucuagcucuaacacugaaaauaauaauaaauuguagaucucugcaacu

SEQ ID NO: 119233 - RNA, 64 nt, Homo Sapiens
gaaaaaauuacccucuagcucuaacacugaaaauaauaauaaauuguagaucucugcaacuaag

SEQ ID NO: 119234 - RNA, 64 nt, Homo Sapiens
cgauuaaugguuugcugcuugacuagccuagggaaauaauaauaaagguaaaguaaacuuuuuu

SEQ ID NO: 119235 - RNA, 64 nt, Homo Sapiens
uuaaugguuugcugcuugacuagccuagggaaauaauaauaaagguaaaguaaacuuuuuuaau

SEQ ID NO: 119236 - RNA, 64 nt, Homo Sapiens
caauccucuuucucucucuuaaugcaugauacagaauaauaauaagaauuucaucuuuaaauga

SEQ ID NO: 119237 - RNA, 64 nt, Homo Sapiens
uccucuuucucucucuuaaugcaugauacagaauaauaauaagaauuucaucuuuaaaugagua

SEQ ID NO: 119238 - RNA, 64 nt, Homo Sapiens
aggccaaaaauaaaauuguuuaaaaugcuagaauaauaauaaaaaaauaaaagaguggaagccc

SEQ ID NO: 119239 - RNA, 64 nt, Homo Sapiens
aaaaggccaaaaauaaaauucccuaaaaugcuagaauaauaauauaaaaauaaaagaguggaag

SEQ ID NO: 119240 - RNA, 64 nt, Homo Sapiens
uugacuucuuuuccuugaauggaaaacacuuugaaauaauaauaaacauuguuauaaacuaaua

SEQ ID NO: 119241 - RNA, 64 nt, Homo Sapiens
acuucuuuuccuugaauggaaaacacuuugaaauaauaauaaacauuguuauaaacuaauauau

SEQ ID NO: 119242 - RNA, 64 nt, Homo Sapiens
aaauauuccuaucugcuuauaaaauggcugcuauaauaauaauaauacagauguuguuauauaa

SEQ ID NO: 119243 - RNA, 64 nt, Homo Sapiens
uauuccuaucugcuuauaaaauggcugcuauaauaauaauaauacagauguuguuauauaaggu

SEQ ID NO: 119244 - RNA, 64 nt, Homo Sapiens
ccagccugggcaacaagagcaaaacucagucucaaauaauaauaauaacaacaacuuaaugugc

SEQ ID NO: 119245 - RNA, 64 nt, Homo Sapiens
gccugggcaacaagagcaaaacucagucucaaauaauaauaauaacaacaacuuaaugugcugc

SEQ ID NO: 119246 - RNA, 64 nt, Homo Sapiens
ugggcaacaagagcaaaacucagucucaaauaauaauaauaacaacaacuuaaugugcugcugc

SEQ ID NO: 119247 - RNA, 64 nt, Homo Sapiens
auuguuauaaacuaauauauaaacacuuugaaauaauaauaaacacuucuuuuccuugaaugga

SEQ ID NO: 119248 - RNA, 64 nt, Homo Sapiens
aacauuguuauaaacuaauaggaaaacacuuugaaauaauaauauugacuucuuuuccuugaau

SEQ ID NO: 119249 - RNA, 64 nt, Homo Sapiens
caugcuugauuuaggagagaauaaagggcuauauaauaauaaauccagauuuccggauaagaau

SEQ ID NO: 119250 - RNA, 64 nt, Homo Sapiens
uuaaauuuaacuuugacauccagcuauagacagaaauaauaagccacccuggguguaaacuuga

SEQ ID NO: 119251 - RNA, 64 nt, Homo Sapiens
uagucaaguaauggcuuuugaaaaaguaaaguucaauaauaacuaaggcugugauuuuuuucaa

SEQ ID NO: 119252 - RNA, 64 nt, Homo Sapiens
acaagggcugugcuaugcuaccauauucuuguucaauaauaauagguuuguuguuuuuuuuaca

SEQ ID NO: 119253 - RNA, 64 nt, Homo Sapiens
auaguauauguucccauuuaugugaaaugugcagaauaauaauaaaaauguauagaauagcaaa

SEQ ID NO: 119254 - RNA, 64 nt, Homo Sapiens
guauauguucccauuuaugugaaaugugcagaauaauaauaaaaauguauagaauagcaaaucu

SEQ ID NO: 119255 - RNA, 64 nt, Homo Sapiens
agcaaacucuauugguguguuguaaaacaauaauaauaauaaaagcauagcuauuuguuuuuau

SEQ ID NO: 119256 - RNA, 64 nt, Homo Sapiens
aaaagcaaacucuauugguguauuguaaaacaauaauaauaauaagagcauagcuauuuguuuu

SEQ ID NO: 119257 - RNA, 64 nt, Homo Sapiens
auaaaaagcaaacucuauuguuuuauuguaaaacaauaauaauacugagagcauagcuauuugu

SEQ ID NO: 119258 - RNA, 64 nt, Homo Sapiens
caggacuaacuguguuuggguuggguguaguauaaauaauaauaauggcuaauauuuccugagc

SEQ ID NO: 119259 - RNA, 64 nt, Homo Sapiens
gacuaacuguguuuggguuggguguaguauaaauaauaauaauggcuaauauuuccugagcauc

SEQ ID NO: 119260 - RNA, 64 nt, Homo Sapiens
aaagccagacaacuucuguuucuucucuuggugaaauaauaaaaugcaaaugaaucauuguuaa

SEQ ID NO: 119261 - RNA, 64 nt, Homo Sapiens
gaacuuugacuguugcugguaaauuagaagcuacaauaauaauuaagggcagaaauuauacuua

SEQ ID NO: 119262 - RNA, 64 nt, Homo Sapiens
auaaaugaucuuggacaagauaagagagaaaaauaauaauaacaccagaaacgcugaauccaau

SEQ ID NO: 119263 - RNA, 64 nt, Homo Sapiens
acaauaaaugaucuuggacaaauuaagagagaaaaauaauaauagagccagaaacgcugaaucc

SEQ ID NO: 119264 - RNA, 64 nt, Homo Sapiens
cuuauaaaauuggguucauacaaaugggaguaauaauaauaaucgccucaguuuucucaucugc

SEQ ID NO: 119265 - RNA, 64 nt, Homo Sapiens
auccuuauaaaauuggguucugccaaaugggaguaauaauaauaugagccucaguuuucucauc

SEQ ID NO: 119266 - RNA, 64 nt, Homo Sapiens
auauaauacugaaaaggauuaauaauaacauaauaauaauaaaaugauggcaaaaagacagugu

SEQ ID NO: 119267 - RNA, 64 nt, Homo Sapiens
aaaauauaauacugaaaagguguaauaauaacauaauaauaauauuuugauggcaaaaagacag

SEQ ID NO: 119268 - RNA, 64 nt, Homo Sapiens
uaauaauaauaaaaauauaacaaaaagacaguguaauaauaacacacaggccucauuuugaugg

SEQ ID NO: 119269 - RNA, 64 nt, Homo Sapiens
augugaaaacucgacgcucgacaacaacaacaacaauaauaaagugauaauaauaauaauaaua

SEQ ID NO: 119270 - RNA, 64 nt, Homo Sapiens
acaacaacaacaauaauaaaaugauaauaauaauaauaauaacaugaugaugaugaugaugaug

SEQ ID NO: 119271 - RNA, 64 nt, Homo Sapiens
acaacaacaacaacaauaauaugaugauaauaauaauaauaauacgaugaugaugaugaugaug

SEQ ID NO: 119272 - RNA, 64 nt, Homo Sapiens
auaacaacaacaacaacaauaugaugaugauaauaauaauaauacuucgaugaugaugaugaug

SEQ ID NO: 119273 - RNA, 64 nt, Homo Sapiens
auaauaacaacaacaacaacaugaugaugaugauaauaauaauaauacuucgaugaugaugaug

SEQ ID NO: 119274 - RNA, 64 nt, Homo Sapiens
caugcaucauuuuucauuuguugguuaaaaaaauaauaauaaaauaguaaggauacauucaagc

SEQ ID NO: 119275 - RNA, 64 nt, Homo Sapiens
aaacaugcaucauuuuucauagcuugguuaaaaaaauaauaauauuauaguaaggauacauuca

SEQ ID NO: 119276 - RNA, 64 nt, Homo Sapiens
acacaaugaauucuucacuuagugauuaacugugaauaauaaaugcggauagcauuugguaggu

SEQ ID NO: 119277 - RNA, 64 nt, Homo Sapiens
aacaagaaaccaagugggcuuccuagcugacgccaauaauaaaaacguuuaaggccacguauag

SEQ ID NO: 119278 - RNA, 64 nt, Homo Sapiens
ucugguugcuuauuuuuagaaaaugaggacauuuaauaauaauaaaaaaaaagggauuaauagc

SEQ ID NO: 119279 - RNA, 64 nt, Homo Sapiens
gguugcuuauuuuuagaaaaugaggacauuuaauaauaauaaaaaaaaagggauuaauagcuuu

SEQ ID NO: 119280 - RNA, 64 nt, Homo Sapiens
cagccugggcaacagagugaaacucugucucaaaaauaauaauaauaaaaaaaagcuuccaucu

SEQ ID NO: 119281 - RNA, 64 nt, Homo Sapiens
ccugggcaacagagugaaacucugucucaaaaauaauaauaauaaaaaaaagcuuccaucuccc

SEQ ID NO: 119282 - RNA, 64 nt, Homo Sapiens
gggcaacagagugaaacucugucucaaaaauaauaauaauaaaaaaaagcuuccaucucccagc

SEQ ID NO: 119283 - RNA, 64 nt, Homo Sapiens
ugucuucuuacuuugauaacucuucuuaguuuaaaauaauaauaauaacacaucuuuggucauc

SEQ ID NO: 119284 - RNA, 64 nt, Homo Sapiens
cuucuuacuuugauaacucuucuuaguuuaaaauaauaauaauaacacaucuuuggucaucuau

SEQ ID NO: 119285 - RNA, 64 nt, Homo Sapiens
cuuacuuugauaacucuucuuaguuuaaaauaauaauaauaacacaucuuuggucaucuauguc

SEQ ID NO: 119286 - RNA, 64 nt, Homo Sapiens
gauccagaagaauugaauggugcuuaaauugagaaauaauaauaaauauaucuauauagaauag

SEQ ID NO: 119287 - RNA, 64 nt, Homo Sapiens
ccagaagaauugaauggugcuuaaauugagaaauaauaauaaauauaucuauauagaauagaca

SEQ ID NO: 119288 - RNA, 64 nt, Homo Sapiens
ugcucagauuucuuuguuucaauaaauaaaaaauaauaauaaauugacagugagacucugucuc

SEQ ID NO: 119289 - RNA, 64 nt, Homo Sapiens
aauugcucagauuucuuugucucaauaaauaaaaaauaauaauagggugacagugagacucugu

SEQ ID NO: 119290 - RNA, 64 nt, Homo Sapiens
cuggagacuuggccacaccucaaauaauaauaauaauaauaaagaagagagcaagacucugucu

SEQ ID NO: 119291 - RNA, 64 nt, Homo Sapiens
aagcuggagacuuggccacaucucaaauaauaauaauaauaauaggcaagagagcaagacucug

SEQ ID NO: 119292 - RNA, 64 nt, Homo Sapiens
auaaagcuggagacuuggcccugucucaaauaauaauaauaauacugggcaagagagcaagacu

SEQ ID NO: 119293 - RNA, 64 nt, Homo Sapiens
auaauaaagcuggagacuugacucugucucaaauaauaauaauaagccugggcaagagagcaag

SEQ ID NO: 119294 - RNA, 64 nt, Homo Sapiens
auaauaauaaagcuggagacaagacucugucucaaauaauaauauccagccugggcaagagagc

SEQ ID NO: 119295 - RNA, 64 nt, Homo Sapiens
uaugaagcucuguuuuuuaaaaauaaaauaaaauaauaauaauguuugcauuaauuugguuaaa

SEQ ID NO: 119296 - RNA, 64 nt, Homo Sapiens
auguaugaagcucuguuuuuaaaaaauaaaauaaaauaauaauaacuuuugcauuaauuugguu

SEQ ID NO: 119297 - RNA, 64 nt, Homo Sapiens
gcaucuuguaaauuuucucuuuuuucuaaaaauaaauaauaauaaaauccuaaaucucaacaaa

SEQ ID NO: 119298 - RNA, 64 nt, Homo Sapiens
ucuuguaaauuuucucuuuuuucuaaaaauaaauaauaauaaaauccuaaaucucaacaaacca

SEQ ID NO: 119299 - RNA, 64 nt, Homo Sapiens
acauggugaauuaucucuacuaaaaauacaaaaaaauaauaauaauagccaggcgugguggcac

SEQ ID NO: 119300 - RNA, 64 nt, Homo Sapiens
uggugaauuaucucuacuaaaaauacaaaaaaauaauaauaauagccaggcgugguggcacaug

SEQ ID NO: 119301 - RNA, 64 nt, Homo Sapiens
uuauggaaauggaaauaaucuuuccuaaacuaccaauaauaacuuuaaauuuuugaucaaccau

SEQ ID NO: 119302 - RNA, 64 nt, Homo Sapiens
uaaaauauuaaaaagguauuauaaagguauuuaaaauaauaauaauaaaguguuauuuuccugg

SEQ ID NO: 119303 - RNA, 64 nt, Homo Sapiens
aauauuaaaaagguauuauaaagguauuuaaaauaauaauaauaaaguguuauuuuccugggau

SEQ ID NO: 119304 - RNA, 64 nt, Homo Sapiens
auuaaaaagguauuauaaagguauuuaaaauaauaauaauaaaguguuauuuuccugggauuca

SEQ ID NO: 119305 - RNA, 64 nt, Homo Sapiens
ugucuuccauuguuaaaugaugauuaaaaauaauaauaauaaagagaguugaaauguugagaga

SEQ ID NO: 119306 - RNA, 64 nt, Homo Sapiens
aagugucuuccauuguuaaaagaugauuaaaaauaauaauaauaccaagaguugaaauguugag

SEQ ID NO: 119307 - RNA, 64 nt, Homo Sapiens
auaaagugucuuccauuguugagagaugauuaaaaauaauaauacuaccaagaguugaaauguu

SEQ ID NO: 119308 - RNA, 64 nt, Homo Sapiens
guuuuaagaauaucugaguaaaauaacaauaugaaauaauaaacagaagcucuaacgucaggua

SEQ ID NO: 119309 - RNA, 64 nt, Homo Sapiens
uagagaguugacaaguugcuuguaguuuuaaaaaaauaauaaaguauacccuucugguauauca

SEQ ID NO: 119310 - RNA, 64 nt, Homo Sapiens
caacaggguuuuuuuccagaugugcuuucuaaauaauaauaaaauuccccaauaaauuguugug

SEQ ID NO: 119311 - RNA, 64 nt, Homo Sapiens
aaacaacaggguuuuuuuccgugugugcuuucuaaauaauaauauuuuuccccaauaaauuguu

SEQ ID NO: 119312 - RNA, 64 nt, Homo Sapiens
aucaggaguuuccuccauaaacuauuauuuucagaauaauaauaaaacaagaauuaugacuagc

SEQ ID NO: 119313 - RNA, 64 nt, Homo Sapiens
aggaguuuccuccauaaacuauuauuuucagaauaauaauaaaacaagaauuaugacuagcauc

SEQ ID NO: 119314 - RNA, 64 nt, Homo Sapiens
uuaaagaugagaaaagccaccaucucaaaaaaauaauaauaaucugggcaacagagcaagacuc

SEQ ID NO: 119315 - RNA, 64 nt, Homo Sapiens
aucuuaaagaugagaaaagccuccaucucaaaaaaauaauaauagccugggcaacagagcaaga

SEQ ID NO: 119316 - RNA, 64 nt, Homo Sapiens
uagcucugaagggcagaggguugaccaaaaaaauaauaauaaguaaggaucugcaguuuuguuu

SEQ ID NO: 119317 - RNA, 64 nt, Homo Sapiens
aguuagcucugaagggcagauuuuugaccaaaaaaauaauaauauggaaggaucugcaguuuug

SEQ ID NO: 119318 - RNA, 64 nt, Homo Sapiens
cauuuuacuuuuaauuauguaaauuugguuagaaaauaauaauaaaugguuagugcuauugugu

SEQ ID NO: 119319 - RNA, 64 nt, Homo Sapiens
uuuacuuuuaauuauguaaauuugguuagaaaauaauaauaaaugguuagugcuauuguguaau

SEQ ID NO: 119320 - RNA, 64 nt, Homo Sapiens
cccugcuugcuccuguguaacagcucagaugaugaauaauaauaaaacuguacuuuuuuggaug

SEQ ID NO: 119321 - RNA, 64 nt, Homo Sapiens
ugcuugcuccuguguaacagcucagaugaugaauaauaauaaaacuguacuuuuuuggauggug

SEQ ID NO: 119322 - RNA, 64 nt, Homo Sapiens
gacauugacccagacauauuguacucuuucuaaaaauaauaauaauaaugcuaacagaaagaag

SEQ ID NO: 119323 - RNA, 64 nt, Homo Sapiens
auugacccagacauauuguacucuuucuaaaaauaauaauaauaaugcuaacagaaagaagaga

SEQ ID NO: 119324 - RNA, 64 nt, Homo Sapiens
gacccagacauauuguacucuuucuaaaaauaauaauaauaaugcuaacagaaagaagagaacc

SEQ ID NO: 119325 - RNA, 64 nt, Homo Sapiens
gugucauuguuuuuugaucaaaauaaaaaaaaauaauaauaaauugucaacaaacugggaaaua

SEQ ID NO: 119326 - RNA, 64 nt, Homo Sapiens
aaugugucauuguuuuuugaauaaaauaaaaaaaaauaauaauaaggugucaacaaacugggaa

SEQ ID NO: 119327 - RNA, 64 nt, Homo Sapiens
aaaauaugauaaagugaaagacaguaauaauaauaauaauaacaggaaagauaaugaugguaac

SEQ ID NO: 119328 - RNA, 64 nt, Homo Sapiens
acaaaaauaugauaaagugaaacacaguaauaauaauaauaauaagaggaaagauaaugauggu

SEQ ID NO: 119329 - RNA, 64 nt, Homo Sapiens
auaacaaaaauaugauaaaggguaacacaguaauaauaauaauaucuagaggaaagauaaugau

SEQ ID NO: 119330 - RNA, 64 nt, Homo Sapiens
auaauaacaaaaauaugauagaugguaacacaguaauaauaauaugcucuagaggaaagauaau

SEQ ID NO: 119331 - RNA, 64 nt, Homo Sapiens
aaaauuaccgagaaccccauuaauaauaaacauaaauaauaaacgaauaauuaaugauaaaaca

SEQ ID NO: 119332 - RNA, 64 nt, Homo Sapiens
auaaauaauaaacaaaauuauaaugauaaaacauaauaauaaacauaaaaauuuauugaauaau

SEQ ID NO: 119333 - RNA, 64 nt, Homo Sapiens; identical to SEQ ID NO: 119318

SEQ ID NO: 119334 - RNA, 64 nt, Homo Sapiens; identical to SEQ ID NO: 119319

SEQ ID NO: 119335 - RNA, 64 nt, Homo Sapiens
accugauauuuggcugggcgaaacaauaauaauaaauaauaaaagcaagauugcaucucaaaac

SEQ ID NO: 119336 - RNA, 64 nt, Homo Sapiens
aauaaaaaccugauauuuggucaaaacaaacaauaauaauaaauugacagagcaagauugcauc

SEQ ID NO: 119337 - RNA, 64 nt, Homo Sapiens
aauaauaaaaaccugauauuaucucaaaacaaacaauaauaauagcgugacagagcaagauugc

SEQ ID NO: 119338 - RNA, 64 nt, Homo Sapiens
cuuuggaacucccugaauaauaaaaaugagaguugagauaaauaggggaaaaaaaauuuuuuuc

SEQ ID NO: 119339 - RNA, 64 nt, Homo Sapiens
gacuuuuagauaacaaagauuucaaauguuaaaagagauaaaagucagguuaauacuaucuuaa

SEQ ID NO: 119340 - RNA, 64 nt, Homo Sapiens
aauauuugcaagcaacuuuuguacaguauuuaucgagauaaacauggcaaucaaaauguccauu

SEQ ID NO: 119341 - RNA, 64 nt, Homo Sapiens
ucaacuuaaguuuuuacuccauuaugcacaguuugagauaaauaaauuuuugaaauauggacac

SEQ ID NO: 119342 - RNA, 64 nt, Homo Sapiens
uagccccuuuccuugcagguuuuuuagauauacagagauaaaaacaguuuggguacugugcuga

SEQ ID NO: 119343 - RNA, 64 nt, Homo Sapiens
gaaaugauuuuuuuucuuacuuacagaguguaaagagauaaaaaaaaguguucuucuacaaauc

SEQ ID NO: 119344 - RNA, 64 nt, Homo Sapiens
cugauuaguuuuaaccagugccucaaaaggaagugagauaaaucgaguuugguuauccauuuau

SEQ ID NO: 119345 - RNA, 64 nt, Homo Sapiens
uccauguauaaaauagauagcugagucagccagagagauaaauauauaauguuuucaacuguau

SEQ ID NO: 119346 - RNA, 64 nt, Homo Sapiens
gaguacccaaaugcuaccacuggagaaggaaugagagauaaagaaagagacaggugacaucuaa

SEQ ID NO: 119347 - RNA, 64 nt, Homo Sapiens
uuguuucauuguucugucaauaauuguuaccaaagagauaaaaauaaaagcagaauguauauca

SEQ ID NO: 119348 - RNA, 64 nt, Homo Sapiens
aggaauauuuugucaaacagggaggggaaaagaagagauaaacauuuuuccuuuuuuuuuaagu

SEQ ID NO: 119349 - RNA, 64 nt, Homo Sapiens
agauaaacacuaggugcuuuacacguauuuccuugagauaaacacucuguggcuacauauacac

SEQ ID NO: 119350 - RNA, 64 nt, Homo Sapiens
gcaaauugcuuuuuuaaaagugaauacaucgagagagauaaaugaaaaguaugaauggucaaaa

SEQ ID NO: 119351 - RNA, 64 nt, Homo Sapiens
uagagguauugacuuuucguacaaaaaaaccuaggagauaaaugaaaaucacaauauuccgaaa

SEQ ID NO: 119352 - RNA, 64 nt, Homo Sapiens
cuacagaaggaaagagaucuucuagauaaaaaaagagauaaagaaaggaaaaggagagagcuag

SEQ ID NO: 119353 - RNA, 64 nt, Homo Sapiens
aaauacgagugauagaaguauucaagaaguucuggagauaaaaagaaaaugaugaaaagaguag

SEQ ID NO: 119354 - RNA, 64 nt, Homo Sapiens
uauacuggugagaaauccuagaaaucugaagagugagauaaagccuuuaaaugguugucacacu

SEQ ID NO: 119355 - RNA, 64 nt, Homo Sapiens
cucacacuuuauugcuaggaaagcauuuauacuugagauaaauuauacaaauauaaagacugug

SEQ ID NO: 119356 - RNA, 64 nt, Homo Sapiens
cuuugaguguaaaaaaugugaaguacucacacuggagauaaaccuuagguuuucaagcacauga

SEQ ID NO: 119357 - RNA, 64 nt, Homo Sapiens
cuuuaaguguaaagaaugugaaggacucacacuggagauaaacccguucuuuccaaauacaugg

SEQ ID NO: 119358 - RNA, 64 nt, Homo Sapiens
gaauaaggcaauaaauguugauucaaaaaggaaugagauaaaaaaaaucuuaggagauaaacac

SEQ ID NO: 119359 - RNA, 64 nt, Homo Sapiens
cauucaaaaaggaaugagauagauaaaaucuuaggagauaaacaaggcaucccaucuccaucac

SEQ ID NO: 119360 - RNA, 64 nt, Homo Sapiens
ucuucuaagaccuuuuuuggauagucaaauauaagagauaaauaguuuaauuuuuucagaccuu

SEQ ID NO: 119361 - RNA, 64 nt, Homo Sapiens
uuuuuucagaccuuuuuuggauaguccaauauuagagauaaauaguuuaauuuuuucagauaua

SEQ ID NO: 119362 - RNA, 64 nt, Homo Sapiens
guuuuuuaaagcaacuguaccuucuucccauuauuuagagcacacucaaguuaguucugucacg

SEQ ID NO: 119363 - RNA, 64 nt, Homo Sapiens
gaagaagcggcaccugccauagcucacaucuguuuuagagcauacaguuauauaaauagcaugc

SEQ ID NO: 119364 - RNA, 64 nt, Homo Sapiens
cccagcauuugggccaacuuagcagaggcacaaguuagagcaggggaaggaauccccuucuuag

SEQ ID NO: 119365 - RNA, 64 nt, Homo Sapiens
ggcacaaguuagagcaggccaaggaauccccuucuuagagcagauucuaggcaaggaacuaagg

SEQ ID NO: 119366 - RNA, 64 nt, Homo Sapiens
auaauccuugccuauguacuuaaaaaaaaaaaacuuagagcacauauuugacaacucuaaaaaa

SEQ ID NO: 119367 - RNA, 64 nt, Homo Sapiens
guguuugaaauuauguccaugcugguagaagcaguuagagcaauugaaggaaagaaagaggaag

SEQ ID NO: 119368 - RNA, 64 nt, Homo Sapiens
auuuaauaauaugagugaggauuugcuuucuccauuagagcauuaagcuaaaacuaucaacauu

SEQ ID NO: 119369 - RNA, 64 nt, Homo Sapiens
acuugcacuuuaauuuuccuccaacugucuaaaauuagagcaaauacauuggcaauacagcugc

SEQ ID NO: 119370 - RNA, 64 nt, Homo Sapiens
uauuaauccaagacuggaauuguacuucagacauuuagagcagaauuccaagaacucaaaagug

SEQ ID NO: 119371 - RNA, 64 nt, Homo Sapiens
uacacuugcuuuggucaccagaggaggacagagcuuagagcagcuguggagaaucugaagcauu

SEQ ID NO: 119372 - RNA, 64 nt, Homo Sapiens
ccuaaccuuccuguaaaccccuuuaguggcuucauuagagcaggcguucagcucacuguucuau

SEQ ID NO: 119373 - RNA, 64 nt, Homo Sapiens
cucacuguucuauucaucucaaggaauaaugggcuuagagcaguuucuguccugcugguuaacu

SEQ ID NO: 119374 - RNA, 64 nt, Homo Sapiens
gaguaaauauaagaccucuuguagcuacaauguuuuagagcauguuucaucuucauuuuuaaua

SEQ ID NO: 119375 - RNA, 64 nt, Homo Sapiens
agcauggcugaaguauuaaaauguuuaauauuuuuuagagcaaaauuguuggaaagcauuuggc

SEQ ID NO: 119376 - RNA, 64 nt, Homo Sapiens
accacacugucucccuggaguccaccucacguuuuuagagcagauguuuugacauauuucaguu

SEQ ID NO: 119377 - RNA, 64 nt, Homo Sapiens
caucuaaccucauucaggaacugccacagggauuuuagagcagacgugcaugggacuaguucau

SEQ ID NO: 119378 - RNA, 64 nt, Homo Sapiens; identical to SEQ ID NO: 76570

SEQ ID NO: 119379 - RNA, 64 nt, Homo Sapiens; identical to SEQ ID NO: 76571

SEQ ID NO: 119380 - RNA, 64 nt, Homo Sapiens; identical to SEQ ID NO: 76572

SEQ ID NO: 119381 - RNA, 64 nt, Homo Sapiens; identical to SEQ ID NO: 76573

SEQ ID NO: 119382 - RNA, 64 nt, Homo Sapiens; identical to SEQ ID NO: 76574

SEQ ID NO: 119383 - RNA, 64 nt, Homo Sapiens; identical to SEQ ID NO: 76575

SEQ ID NO: 119384 - RNA, 64 nt, Homo Sapiens; identical to SEQ ID NO: 76576

SEQ ID NO: 119385 - RNA, 64 nt, Homo Sapiens; identical to SEQ ID NO: 76577

SEQ ID NO: 119386 - RNA, 64 nt, Homo Sapiens; identical to SEQ ID NO: 76578

SEQ ID NO: 119387 - RNA, 64 nt, Homo Sapiens; identical to SEQ ID NO: 76579

SEQ ID NO: 119388 - RNA, 64 nt, Homo Sapiens
uaguaaauuugaaugaacuaaagauauaucucuaccuucucauuugaauaucuuuaguucauuc

SEQ ID NO: 119389 - RNA, 64 nt, Homo Sapiens
ugguaaaucugaaugaacuaaagauguaucuguaccuucucauuugauguauuaaucauaaaau

SEQ ID NO: 119390 - RNA, 64 nt, Homo Sapiens
gccucagagaugccuggauguggccccucccccuccuucucacccuuaaggacucccaaaccca

SEQ ID NO: 119391 - RNA, 64 nt, Homo Sapiens
gcugaggggccuggaccagcuguccuuuacaccaccuucucaacacugcugaaaagaacccaag

SEQ ID NO: 119392 - RNA, 64 nt, Homo Sapiens
ucggcucccguuuguuguaggcccuucccaggugccuucucagcucccucaucuguaaaccgag

SEQ ID NO: 119393 - RNA, 64 nt, Homo Sapiens
ccuuucccccuaacuuccuccaagggaugcugccccuucucagcccccugcguguguauauugg

SEQ ID NO: 119394 - RNA, 64 nt, Homo Sapiens
ugggucccuaacuucaagaaauucccauuaugcuccuucucaccuuucuuuuuugcuaauuaug

SEQ ID NO: 119395 - RNA, 64 nt, Homo Sapiens
uauuuccuauuaagcccacugauuucuucacaauccuucucaaauuacaauuccaaagagccgc

SEQ ID NO: 119396 - RNA, 64 nt, Homo Sapiens
uucucccacagcugccuacaacagagucucccagccuucucagagagcuaaaaccagaaauuuc

SEQ ID NO: 119397 - RNA, 64 nt, Homo Sapiens
acagaggacacaaauacguuguuccagagcucagccuucucacucuaaaagaaagauauuuuuc

SEQ ID NO: 119398 - RNA, 64 nt, Homo Sapiens
aauguaaaauucgucaucaaccuaacaaacacaaccuucucagcagcauuucuccccugugaug

SEQ ID NO: 119399 - RNA, 64 nt, Homo Sapiens
uuggguuuucucuucuccugagcccagaacuuuuccuucucauucaaccagguuccgacagucc

SEQ ID NO: 119400 - RNA, 64 nt, Homo Sapiens
cauggcccacccaggccuggggcuuagcaccugcccuucucacccagcggggggacuuccaucg

SEQ ID NO: 119401 - RNA, 64 nt, Homo Sapiens
cucugaggauccaggcucagaggaugcagcugccccuucucagcuggagcgggcguugugguca

SEQ ID NO: 119402 - RNA, 64 nt, Homo Sapiens
uggcuacgucugcauucaagguuccugcccugcaccuucucagagccgaccugcggcccccgug

SEQ ID NO: 119403 - RNA, 64 nt, Homo Sapiens
gaggggagcacugagcuaacagucucuuaggcuuccuucucauuuccacuacucacucuagcuu

SEQ ID NO: 119404 - RNA, 64 nt, Homo Sapiens
cugauccccugacucuccagcuuccaggaagguuccuucucagagccaaauacucuuugugcaa

SEQ ID NO: 119405 - RNA, 64 nt, Homo Sapiens
cuagcaggagaugaugaauucucguggcucucggccuucucagagaaauaaaugcuuuguguaa

SEQ ID NO: 119406 - RNA, 64 nt, Homo Sapiens
gauuguauuuuuuacaguuuuuuggguuuggcuuccuucucacauuucuuuagcuuugaauuuu

SEQ ID NO: 119407 - RNA, 64 nt, Homo Sapiens
ucuucuacuguaaaauucauacaaacuuuuauauccuucucaugauuuugaaagaauacagaaa

SEQ ID NO: 119408 - RNA, 64 nt, Homo Sapiens
acuaaaagcagaaaagcuaacguuugaaguaucaccuucucauaaauaauuccuauggacacuc

SEQ ID NO: 119409 - RNA, 64 nt, Homo Sapiens
agagcagagcaccuaagccuuuccaaugaaaaacagaacacaaagccucccugcagggccccug

SEQ ID NO: 119410 - RNA, 64 nt, Homo Sapiens
uuuagagucucucuuccuccaaacacacuuaaaaagaacacacauugcagaaaaacaggauuag

SEQ ID NO: 119411 - RNA, 64 nt, Homo Sapiens
agcccaggaaaaagagaagcagggccaaauggaaagaacacauaauaaacaagaaaaaaacaga

SEQ ID NO: 119412 - RNA, 64 nt, Homo Sapiens
agcacaaacaugggucaaaggaaaaucuuaaaagagaacacaccaaaaaagugaaagagaaauu

SEQ ID NO: 119413 - RNA, 64 nt, Homo Sapiens
cuggcauuccagagggucaagaagugacuuguucagaacacauuguuuuuaacagaaaaaaaau

SEQ ID NO: 119414 - RNA, 64 nt, Homo Sapiens
gucccuuucaggggcuagacacaggcuucucguaagaacacagccuuagaggcaccugagcaac

SEQ ID NO: 119415 - RNA, 64 nt, Homo Sapiens
cuaacaagggucuguggcagcuguuaaugaauuaagaacacauuaccuugugcucuacuccuuc

SEQ ID NO: 119416 - RNA, 64 nt, Homo Sapiens; identical to SEQ ID NO: 119415

SEQ ID NO: 119417 - RNA, 64 nt, Homo Sapiens
agaacuaaacaaucccagccccacccagcaacacagaacacaggaguuugcuuuuggcuucuca

SEQ ID NO: 119418 - RNA, 64 nt, Homo Sapiens
uuuauuuuuguuucauugguuguuucacagaauuagaacacacacgacuuuuuauuccuccauu

SEQ ID NO: 119419 - RNA, 64 nt, Homo Sapiens
gagggacaaacacagccaugcuagucagugacagagaacacagaaugcaugccagugcugguua

SEQ ID NO: 119420 - RNA, 64 nt, Homo Sapiens
uccaaucuguuaccagcaagaaucugaguaagcuagaacacacauuuacagaaauuuuaguuac

SEQ ID NO: 119421 - RNA, 64 nt, Homo Sapiens
acaauuucuggcuuggggaggagucccucuagguagaacacagcuucagaaacuagcuuuaaga

SEQ ID NO: 119422 - RNA, 64 nt, Homo Sapiens
gaggauuuuuccagauaaauuuguacucaaggaaagaacacaagaaguaaguacaaaaguuucu

SEQ ID NO: 119423 - RNA, 64 nt, Homo Sapiens
auucauaucugccaagauccuuugaauacaugcaagaacacacaauggagagaaacccuaugaa

SEQ ID NO: 119424 - RNA, 64 nt, Homo Sapiens
uuucacuucuuccaguucuuuucaauaucaugaaagaacacacuagggagaaacccuaucaaug

SEQ ID NO: 119425 - RNA, 64 nt, Homo Sapiens
aagguccaguucuucccccucaguaccaaauuucagaacacaagagauagcacauacccccacc

SEQ ID NO: 119426 - RNA, 64 nt, Homo Sapiens
caaaguaaacuguguaggggagaugcuguguaacagaacacagcaggucaucugauaauuucac

SEQ ID NO: 119427 - RNA, 51 nt, Homo Sapiens
aagccaagguagguguuugauagaacacauuuaaacaucaguauuaugaaa

SEQ ID NO: 119428 - RNA, 64 nt, Homo Sapiens
cuuuuuuuuucagccauaccucuuaacaccucauagaacacacuuugggaaacaguggggguag

SEQ ID NO: 119429 - RNA, 64 nt, Homo Sapiens
auagaacaacaaacugucaaaugggauagugcuucuugaccauuucagcauuuauuauacuuua

SEQ ID NO: 119430 - RNA, 64 nt, Homo Sapiens
auaagcagaccuuauuucucgcuucuccauagaccuugaccauuuuggggagagcaacuucagg

SEQ ID NO: 119431 - RNA, 64 nt, Homo Sapiens
uaaguuuccugagggcuggauuaaucaaauuugucuugaccaaacuguuuguaaagcuugucuc

SEQ ID NO: 119432 - RNA, 64 nt, Homo Sapiens
uacuuuguauaacacauucuucauuuuccacacacuugaccauccaaugcauggccauauuuau

SEQ ID NO: 119433 - RNA, 64 nt, Homo Sapiens
aaaagucauugcuguucuugcugugaauaaguaucuugaccauaaaaauauccaacucuggauu

SEQ ID NO: 119434 - RNA, 64 nt, Homo Sapiens
auaggguguauaaaucguguaguccgccuuuucccuugaccacuggacauuggcauccugggaa

SEQ ID NO: 119435 - RNA, 64 nt, Homo Sapiens
guguuaugggauaaggggagugucaggcucuccucuugaccacucuccuccaauuccagccacu

SEQ ID NO: 119436 - RNA, 64 nt, Homo Sapiens
gugggaacugcaccaggguaugcagcaggauuaacuugaccaugcccgcccuggcauggcaacc

SEQ ID NO: 119437 - RNA, 64 nt, Homo Sapiens
caccuagcugugcaagaccuaguauauuuaaacucaagacaauguugccugccuggugugccuc

SEQ ID NO: 119438 - RNA, 64 nt, Homo Sapiens
caacagaagcauuuguauuuuguaucugaguugccaagacaaauuaaacuguuagcacuguuga

SEQ ID NO: 119439 - RNA, 64 nt, Homo Sapiens
cacacccaccggccuugaauuucucugguggucucaagacaagaacaagagcugacucuagaau

SEQ ID NO: 119440 - RNA, 64 nt, Homo Sapiens
cgcacaugccccagggguuuucaccaaggauuuucaagacaaacuggaguaagaauuaaagccc

SEQ ID NO: 119441 - RNA, 64 nt, Homo Sapiens
gaggucuggcuugagaacgauuuuuuccccaagacaagacaauccaucucccccaccuccccac

SEQ ID NO: 119442 - RNA, 64 nt, Homo Sapiens
caaucgaggucuggcuugagcccacuuuuuuccccaagacaagauaggacaucucccccaccuc

SEQ ID NO: 119443 - RNA, 64 nt, Homo Sapiens
aggcugagcgcaggaggacaggcaccaccggaugccacaccaggcaggaggagguguggacagu

SEQ ID NO: 119444 - RNA, 64 nt, Homo Sapiens
gaugucucgcuccaccugggucugggaccuggcuccacaccaguuaccugggaccaguaggugc

SEQ ID NO: 119445 - RNA, 64 nt, Homo Sapiens
ugauaaaaugcagaaacccuugggaccaguguugccacaccagugagccuggacugacacccag

SEQ ID NO: 119446 - RNA, 64 nt, Homo Sapiens
acacugaaccacaggacagacaccuguccuugggccacaccaucgaacccugucugccccuucc

SEQ ID NO: 119447 - RNA, 64 nt, Homo Sapiens
cccaguuccucaccagcuacucuggccauauaucccacaccagaaggaacaaguguggcugugu

SEQ ID NO: 119448 - RNA, 64 nt, Homo Sapiens
ggugcccgagugaucugaggauuuauaauccaagccacaccacccugguuguucucugggcuug

SEQ ID NO: 119449 - RNA, 64 nt, Homo Sapiens
auugggcccuggacguugagcccagauguuggagccacaccagccuggauuucaaucccagaau

SEQ ID NO: 119450 - RNA, 64 nt, Homo Sapiens
gaagacucaagugcaccugaucccugcgcaacagccacaccaggagaacaggcuguccuuggcg

SEQ ID NO: 119451 - RNA, 64 nt, Homo Sapiens
gagaccugcggaaagcccccucccugagucgucgccacaccaggcgacaggcaccacccccucu

SEQ ID NO: 119452 - RNA, 64 nt, Homo Sapiens
ucugugggagcccgggugccaggcccucccaacaccacaccacccuccaggccccccugcccuc

SEQ ID NO: 119453 - RNA, 64 nt, Homo Sapiens
ggaugaucugcucagagcucuuccaugccauucuccacaccaagaagcuuuaucaguuuuccuc

SEQ ID NO: 119454 - RNA, 64 nt, Homo Sapiens
cauuccaggacauucauuugcauaaggagucaaaccacaccagucuuggauuggcugugagcca

SEQ ID NO: 119455 - RNA, 64 nt, Homo Sapiens
guccggauggaagucugcauccucgguacugaagccacaccagugugacuggcagcuuuagcag

SEQ ID NO: 119456 - RNA, 64 nt, Homo Sapiens
cagagcaugaggaaccaguugcacaugugaauuuccacaccaaaauugcuuccucagugucagg

SEQ ID NO: 119457 - RNA, 64 nt, Homo Sapiens
ugaccacggcagggcccgugucaagcagauccugccacaccagacguagcccucccugcaggca

SEQ ID NO: 119458 - RNA, 64 nt, Homo Sapiens
ccacccgagcgcagugccaccugcuggcccagggccacaccaaguagagaccaagguggccgag

SEQ ID NO: 119459 - RNA, 64 nt, Homo Sapiens
cccucccuccucgucugccaagccucgccuccuaccacaccacaccaggccaccccagcugcaa

SEQ ID NO: 119460 - RNA, 64 nt, Homo Sapiens
ccuccucgucugccaagccucgccuccuaccacaccacaccaggccaccccagcugcaagugcc

SEQ ID NO: 119461 - RNA, 51 nt, Homo Sapiens
agaccuugcuucaagaauaaaccacaccagugaacaagaaggaaaggccuu

SEQ ID NO: 119462 - RNA, 64 nt, Homo Sapiens
ugucuuucuguguguuuaaaaacagugggaaaauccacaccacacucuaaguggacagcucaga

SEQ ID NO: 119463 - RNA, 64 nt, Homo Sapiens
ggagugacgaccaccgccccaccaccuccugggaccacaccacuaccgcccccaaccacagcag

SEQ ID NO: 119464 - RNA, 64 nt, Homo Sapiens
cgugggcuucugggcaggcucacgcagacgccggccacaccauccaccuggccgccuccaugga

SEQ ID NO: 119465 - RNA, 64 nt, Homo Sapiens
ugauucucccucuggguaaccagucccaggugaaccacaccauccugcaguacuaucgcugcau

SEQ ID NO: 119466 - RNA, 64 nt, Homo Sapiens
uguaacacacuaacaaaagcaugaaaaauaggaaccacaccaaugcaacauuugugcagaaauu

SEQ ID NO: 119467 - RNA, 64 nt, Homo Sapiens
caacacaccucaccucacaccacagcacaccucaccacaccacaccgcacugcaccauaccuca

SEQ ID NO: 119468 - RNA, 64 nt, Homo Sapiens
cacaccgcacugcaccauaccucaccacaucucaccacaccacagcacaccucaccacacaaca

SEQ ID NO: 119469 - RNA, 64 nt, Homo Sapiens
cgcaccgcaccgcaccguaccucgccacaucucaccacaccacaccacaccacaccucacugcc

SEQ ID NO: 119470 - RNA, 64 nt, Homo Sapiens
cgcaccgcaccguaccucgccacaucucaccacaccacaccacaccacaccucacugcccacac

SEQ ID NO: 119471 - RNA, 64 nt, Homo Sapiens
cgcaccguaccucgccacaucucaccacaccacaccacaccacaccucacugcccacacacggc

SEQ ID NO: 119472 - RNA, 64 nt, Homo Sapiens
cuggcagcacuucccccagggacuuggacccuuuccacaccagaggggugaggcaaaggccucu

SEQ ID NO: 119473 - RNA, 64 nt, Homo Sapiens
cuugcuuucaagcaaaaugcauucccugaagaagccacaccaacccagauuucagcuuugaguu

SEQ ID NO: 119474 - RNA, 64 nt, Homo Sapiens
cugacuuuggcagugccacauuugaccaugagcaccacaccaccauuguggccacccgucacua

SEQ ID NO: 119475 - RNA, 64 nt, Homo Sapiens
ucuuugcuggccugaccccugaggagcgguccuuccacaccagccgcaacccaagcagaugaca

SEQ ID NO: 119476 - RNA, 64 nt, Homo Sapiens
acagguaggggugcagggcuaaagggcuggaguaccacaccaacguagugccagcacaguccua

SEQ ID NO: 119477 - RNA, 64 nt, Homo Sapiens
ggaaaccagaugugagcugcaucuacuuuacaccccacaccaaaagcugagagcaggaagagcg

SEQ ID NO: 119478 - RNA, 64 nt, Homo Sapiens
gugagcuccagcugcugcgcacggcggccuaccuccacaccacaaccaccuucaccuggaugug

SEQ ID NO: 119479 - RNA, 64 nt, Homo Sapiens
aacaagauacgcucgccacaguccuucuuugacaccacaccaucaggccgcauccugaacugcu

SEQ ID NO: 119480 - RNA, 64 nt, Homo Sapiens
cacugcgccagugacacauacucagggggcguggccacaccacaccuaaaucccaggccccuuu

SEQ ID NO: 119481 - RNA, 64 nt, Homo Sapiens
uuuacgaucuaagcuuuuaacacccucaaaugcaccacaccaguguugaucuguuuucagugca

SEQ ID NO: 119482 - RNA, 64 nt, Homo Sapiens
accagacuuuuucuucuaaaaucuggaugucauugacgauaauguuuauggagauaaggucuaa

SEQ ID NO: 119483 - RNA, 64 nt, Homo Sapiens
cuucuuuuccacaucucauugcaauaauaauaaugacgauaauaugauaucuaaguaguucuca

SEQ ID NO: 119484 - RNA, 64 nt, Homo Sapiens
acccaacagaucuuuccagagguccaugguggaagacgauaacccugugaaauacuuuauaaaa

SEQ ID NO: 119485 - RNA, 64 nt, Homo Sapiens
uuugguaauugaauucugaagaauuuaucugcaugacgauaacuaggcauucuauccauuugua

SEQ ID NO: 119486 - RNA, 64 nt, Homo Sapiens
ccauuuaggauguguauuuaaugcauuuaguaaugacgauaaaguguuuuuaguaugcuuuuag

SEQ ID NO: 119487 - RNA, 64 nt, Homo Sapiens
auugaaugagggugagggcaaggaauugaaaagagacgauaaacguguggggcugagguucuaa

SEQ ID NO: 119488 - RNA, 64 nt, Homo Sapiens
aaaaaaaugcugaaaauacacauucuccugggaagacgauaaacagcuagcuaagaagccgagg

SEQ ID NO: 119489 - RNA, 64 nt, Homo Sapiens
uggcaguggaaggaaagaagggggggcuucccgggacgauaaccgaggaggaaagcgagggggu

SEQ ID NO: 119490 - RNA, 64 nt, Homo Sapiens
acgaauuacguaaauuauacuuucauacaaaggagacgauaaggcaguaaacauggagacacgg

SEQ ID NO: 119491 - RNA, 64 nt, Homo Sapiens
ucccuguauauuauguucauuugugcauuaaucugacgauaauuuuaaaaauuucuuguauuuc

SEQ ID NO: 119492 - RNA, 64 nt, Homo Sapiens
uaaauaauggagcaugcagugagcacaucuagcugacgauaaucacaccuuuucccccgucuuu

SEQ ID NO: 119493 - RNA, 64 nt, Homo Sapiens
agucgaaacucgugacuucgggaaaccgcuggcagacgauaacccuagcucaaaggagagucaa

SEQ ID NO: 119494 - RNA, 64 nt, Homo Sapiens
ggcugcaaaauucauuuuauaauggcuauuuugugacgauaagauguaguucauguuuuucugu

SEQ ID NO: 119495 - RNA, 64 nt, Homo Sapiens
uagaaauuaccuuuauauucaaaguuuaguaugugacgauaaacgagaaaccagcugguuuaga

SEQ ID NO: 119496 - RNA, 64 nt, Homo Sapiens
cuuaagugugaauuuuuaaaaaguaaagugugaugacgauaacacguauuuggaguuuauuuag

SEQ ID NO: 119497 - RNA, 64 nt, Homo Sapiens
ugccuucucugagacucaguccucuauaaacuuggacgauaaugcucaguucugucacuucuua

SEQ ID NO: 119498 - RNA, 64 nt, Homo Sapiens
ugucauuccauuauauauccacaccaacaugggugacgauaauucaaagucauauuuugccucu

SEQ ID NO: 119499 - RNA, 64 nt, Homo Sapiens
guuuugugaaagcuucugauuaauuuauuauauugacgauaaaacucaaaccuacccagccuuc

SEQ ID NO: 119500 - RNA, 64 nt, Homo Sapiens
aaguuauuuuggguuaagucauaucaaaaguggagacgauaauacccauuuggagaaugcuuuu

SEQ ID NO: 119501 - RNA, 64 nt, Homo Sapiens
uauucaggaaguuaaaauguaauuacacuauaaugacgauaaugcacauugggauuggaauauu

SEQ ID NO: 119502 - RNA, 64 nt, Homo Sapiens
uuucgacacaucaguaccacuaauggaugauggagacgauaacacucuuuaccaucggguacgu

SEQ ID NO: 119503 - RNA, 64 nt, Homo Sapiens
gccccgaucuuucacacacuggugacccugagagaggagggaggagggaaccuggcgggggugu

SEQ ID NO: 119504 - RNA, 64 nt, Homo Sapiens
ucuuucacacacuggugacccugagagaggagggaggagggaaccuggcgggggugucugaggc

SEQ ID NO: 119505 - RNA, 64 nt, Homo Sapiens
accggggacagacccaggggcgggcagagagggaaggagggaggaggcaucuucccugaagccc

SEQ ID NO: 119506 - RNA, 64 nt, Homo Sapiens
aggugucauugugcccgaugucuggcuccccugcaggagggaggcuccaggguaagacagggcu

SEQ ID NO: 119507 - RNA, 64 nt, Homo Sapiens
ccuggugccaucuggccuggcuggagccaggaacaggagggacacuuccccagaauccgcaugu

SEQ ID NO: 119508 - RNA, 64 nt, Homo Sapiens
ggagcugugccacccaaauccagaggaagcaaggaggagggaggugggguagggaggaguguag

SEQ ID NO: 119509 - RNA, 64 nt, Homo Sapiens
augggaaagugaggggcuugagaaagugggugggaggagggaaggauuuuuuaggagccuuaau

SEQ ID NO: 119510 - RNA, 64 nt, Homo Sapiens
auggauggacggauggggugggggaaggaaggaaaggagggagaaaggagggaauacuggcucc

SEQ ID NO: 119511 - RNA, 64 nt, Homo Sapiens
gauggggugggggaaggaaggaaaggagggagaaaggagggaauacuggcuccaucuuugagag

SEQ ID NO: 119512 - RNA, 64 nt, Homo Sapiens
acccucucacuuuccugccuguuccccacuccacaggagggagcugacguuggcuugaaaggag

SEQ ID NO: 119513 - RNA, 64 nt, Homo Sapiens
cauagagccggauggggagagucaacaggaaaaaaggagggaggaggaaaagccacaagagaca

SEQ ID NO: 119514 - RNA, 64 nt, Homo Sapiens
cagagcacuggcucuccagccccaggaggagaacaggagggaggaggagaugaaagaggaggga

SEQ ID NO: 119515 - RNA, 64 nt, Homo Sapiens
caggaggagaacaggagggaggaggagaugaaagaggagggacagguucuuggugcuguaccuu

SEQ ID NO: 119516 - RNA, 64 nt, Homo Sapiens
cagacugaggaagcugugacgaauucuacagagaaggagggaaugugaaccaaacuaguucuca

SEQ ID NO: 119517 - RNA, 64 nt, Homo Sapiens
gguauguuugucucccagucuggggauccaguucaggagggaggaguggccuuuggaaaggugg

SEQ ID NO: 119518 - RNA, 64 nt, Homo Sapiens
cugcccugcuuuggucccagcacuggguuucaggaggagggagaaauacuccucccacacuaga

SEQ ID NO: 119519 - RNA, 64 nt, Homo Sapiens
guggggguccagggcugguguccaugaaggacugaggagggagacagcugccaugauaaguccu

SEQ ID NO: 119520 - RNA, 64 nt, Homo Sapiens
guggaccagaaugaaaacugucaguauaaggauaaggagggaagugaaaaguagagaaauggau

SEQ ID NO: 119521 - RNA, 64 nt, Homo Sapiens
gauugguagcaaaggaugggauagccugaauuugaggagggaauuuuuguuugacuccuuacca

SEQ ID NO: 119522 - RNA, 64 nt, Homo Sapiens
gccugacugaaacaggugaggcccccuccccaggaggagggaugagcaucuuucuagccaauga

SEQ ID NO: 119523 - RNA, 64 nt, Homo Sapiens
cugaagacaccguggccccugccagagaggaggaaggagggaaacccaccuggagacgaaugua

SEQ ID NO: 119524 - RNA, 64 nt, Homo Sapiens
uggaaaggggauaucagauucaagucaagcaggaaggagggagagaagcagcaggacacauugg

SEQ ID NO: 119525 - RNA, 64 nt, Homo Sapiens
ucuuucccaggccgcaccauaagagaaaauguaaaggagggagagaauaaggaggaggagggag

SEQ ID NO: 119526 - RNA, 64 nt, Homo Sapiens
agagaaaauguaaaggaggguuagaauaaggaggaggagggagaccucuguuggaggcacaguu

SEQ ID NO: 119527 - RNA, 64 nt, Homo Sapiens
auuccaaaguuuugaagucaucuuagcuuuccacaggagggagagaacuuaaaaaagcaacagu

SEQ ID NO: 119528 - RNA, 64 nt, Homo Sapiens
caagaauuacaaguagaauggcagcuggaauuuaaggagggacaagaaucaauggauaagcgug

SEQ ID NO: 119529 - RNA, 64 nt, Homo Sapiens
cagaauuucuaauggaaguuuguugugaauguaaaggagggagcauucuuugcuuuuuaauaua

SEQ ID NO: 119530 - RNA, 64 nt, Homo Sapiens
caagaaagagucagguuagggagcagugaaagugaggagggaagacaauucugugaacucugua

SEQ ID NO: 119531 - RNA, 64 nt, Homo Sapiens
caggcuucgcuucaaggcggcgagcccgggguggaggagggagccugagccugcauggugccgc

SEQ ID NO: 119532 - RNA, 64 nt, Homo Sapiens
gagaagcaagggggcugcugcacccaggacucugaggagggacacugguggguugcaggaacag

SEQ ID NO: 119533 - RNA, 64 nt, Homo Sapiens
agggacagggguuucaccagguuuugcaaaguggaggagggacguccaagagaaaggaggcucc

SEQ ID NO: 119534 - RNA, 64 nt, Homo Sapiens
cugaaguaagagauggcagacaugcuggcagagcaggagggagauggaagccucccucacucuc

SEQ ID NO: 119535 - RNA, 64 nt, Homo Sapiens
cagagccgaguuucggaguugacacaccgugcucaggagggaccgacuugggggcagaaguuca

SEQ ID NO: 119536 - RNA, 64 nt, Homo Sapiens
guaggucuuuucggagugacuuucagaaagugagaggagggaccuuguugcugucagauucuau

SEQ ID NO: 119537 - RNA, 64 nt, Homo Sapiens
ccaucugagaaguggcccaugugcuucaaggcccaggagggagaucugucagcucauucuugcc

SEQ ID NO: 119538 - RNA, 64 nt, Homo Sapiens
caccggaguucaacgucccagcagucuugguaaaaggagggagccugcugagccaggagggaga

SEQ ID NO: 119539 - RNA, 64 nt, Homo Sapiens
gcagucuugguaaaaggagggagccugcugagccaggagggagaaaagaagauugaccagcuug

SEQ ID NO: 119540 - RNA, 64 nt, Homo Sapiens
uggccucugcuaagcucaaggcgugaggaugggaaggagggagguauucguaaggaugggaagg

SEQ ID NO: 119541 - RNA, 64 nt, Homo Sapiens
gaugggaaggagggagguauucguaaggaugggaaggagggagguauucgugcagcauaugagg

SEQ ID NO: 119542 - RNA, 64 nt, Homo Sapiens
gcauuucucuggcugguuccccacuuccccaggaaggagggacacuuggcgccucuguuugcca

SEQ ID NO: 119543 - RNA, 64 nt, Homo Sapiens
gaaguuaugaauugaauuggguugucaaagucaaaggagggaaucugccccaccugccaucuug

SEQ ID NO: 119544 - RNA, 64 nt, Homo Sapiens
agaggccagcccggggcuggggaggcgcaaggagaggagggauccaguggggccgugggcuggg

SEQ ID NO: 119545 - RNA, 64 nt, Homo Sapiens
cauacaggcccacaccugagcuccugucugccugaggagggaaagggggaguggccaggucagg

SEQ ID NO: 119546 - RNA, 64 nt, Homo Sapiens
gcuggagggaggcugggcggguacagcgcggaggaggagggaggccaggcgggcauggcgugga

SEQ ID NO: 119547 - RNA, 64 nt, Homo Sapiens
ggaggagggaggccaggcgggcauggcguggaggaggagggaggccgggcggucacagcaugga

SEQ ID NO: 119548 - RNA, 64 nt, Homo Sapiens
ggaggagggaggccgggcggucacagcauggaggaggagggaggcgcugcugguguucuuauuc

SEQ ID NO: 119549 - RNA, 64 nt, Homo Sapiens
gaggagguucccuugcugggaaggaagcacguggaggagggacgguugagcucucagccuuagg

SEQ ID NO: 119550 - RNA, 64 nt, Homo Sapiens
gaaaaggaagaacucuugacgaaucucucagccaaggagggaaaaguuccacccacagaguagu

SEQ ID NO: 119551 - RNA, 64 nt, Homo Sapiens
cgcuccugggaccgugggcgggaggagggagagaaggagggagggagggagagaauggcccgag

SEQ ID NO: 119552 - RNA, 64 nt, Homo Sapiens
gaaggagggaggcgcuccuggaauggcccgagggaggagggagagagggagggagggagggaga

SEQ ID NO: 119553 - RNA, 64 nt, Homo Sapiens
auggugggccucagggaggagaaggagucccaucaggagggaagggaaaaggaaccaagaagua

SEQ ID NO: 119554 - RNA, 64 nt, Homo Sapiens
aggaaccaagaaguagaaggcguaagagcuacaaaggagggaaaguggggaacaaaacaauuaa

SEQ ID NO: 119555 - RNA, 64 nt, Homo Sapiens
uguaauuggggagagggagugugccccucggggcaggagggaagggcaucuggggaagggcagg

SEQ ID NO: 119556 - RNA, 64 nt, Homo Sapiens
ucggggcaggagggaagggcaucuggggaagggcaggagggaagagcuguccaugcagccacgc

SEQ ID NO: 119557 - RNA, 64 nt, Homo Sapiens
uuuuauuuauucccacaguuuugccgccagugggaggagggagggauuuugcuuaaaacagcac

SEQ ID NO: 119558 - RNA, 64 nt, Homo Sapiens
gggagaaagggaggaagccucuggucaugagcagaggagggaggaacuccuggcagcuuuggcc

SEQ ID NO: 119559 - RNA, 64 nt, Homo Sapiens
gggccuagggcucugacccaccggcagcaggcagaggagggaggugugaugcugaaggauacug

SEQ ID NO: 119560 - RNA, 64 nt, Homo Sapiens
gcagagcaugucugccaagcgcgccagccaggccaggagggagugagccaguucagucacuagu

SEQ ID NO: 119561 - RNA, 64 nt, Homo Sapiens
uacugaacccagagucaggagaggguaacagaagaggagggaccuggugaacagagagaaccag

SEQ ID NO: 119562 - RNA, 64 nt, Homo Sapiens
gagcuguuggggcaggggugacacagaagucccuaggagggaagagacccaaaguggggggugg

SEQ ID NO: 119563 - RNA, 64 nt, Homo Sapiens
ccugagcacacugcuuuggacugggacacugagcaggagggagggaaagagggggcaggggcug

SEQ ID NO: 119564 - RNA, 64 nt, Homo Sapiens
cuggaguagcagaggggcugccccuggucugaggaggagggacucauucccuaacucccuccug

SEQ ID NO: 119565 - RNA, 64 nt, Homo Sapiens
ccaaggccauucccuaacucugcagccuggaaagaggagggagggugggcaaggugggaccucc

SEQ ID NO: 119566 - RNA, 64 nt, Homo Sapiens
auuaagggcccugggggagaauaaagcucagagcaggagggaguaaggaaacauuuccuuuuug

SEQ ID NO: 119567 - RNA, 64 nt, Homo Sapiens
gccugcaucuuuggcucugcugugaucugauuggaggagggacaguuucugguacccauccucu

SEQ ID NO: 119568 - RNA, 64 nt, Homo Sapiens
agagcuaggagcaaagccuguucauggcagauguaggagggacugucgcugcuucgugggauac

SEQ ID NO: 119569 - RNA, 64 nt, Homo Sapiens
ccacccugaggagucugagguccugagcacugccaggagggacaaaggagccugugaacccagg

SEQ ID NO: 119570 - RNA, 64 nt, Homo Sapiens
ggaguccuuuuugugccaaaggugugguagcaaaaggagggagaguugcacaggagugggaugg

SEQ ID NO: 119571 - RNA, 64 nt, Homo Sapiens
agcucuggggagccagcuuuuaugcacagagcagaggagggagaccccagccaggugucccucc

SEQ ID NO: 119572 - RNA, 64 nt, Homo Sapiens
gggccccacaggcuccccaggacgagagccucacaggagggaggucagaaaugcagacacccca

SEQ ID NO: 119573 - RNA, 64 nt, Homo Sapiens
gggagcaggauguggcccugagcucagacgucacaggagggagcaaagaaaaccauuuucaggg

SEQ ID NO: 119574 - RNA, 64 nt, Homo Sapiens
uuagcuuaugcuucuuuagauggaauaaugggaaaggagggaaaugggaaauggauggaaaugg

SEQ ID NO: 119575 - RNA, 64 nt, Homo Sapiens
aaggagggaaaugggaaauggauggaaaugggaaaggagggaaaauaauagcccagugagagcu

SEQ ID NO: 119576 - RNA, 64 nt, Homo Sapiens
gcacccacgggugugcuggauacuggaguuugagaggagggaggugcuggggccaaaggagaca

SEQ ID NO: 119577 - RNA, 64 nt, Homo Sapiens
acucagguucgcccucugggccagguccuucacgaggagggagcuacccuucgccagaaguuug

SEQ ID NO: 119578 - RNA, 64 nt, Homo Sapiens
aucaacugcuauccuuccccucaccccucagcccaggagggaaagggcauuuucuuuuucaucu

SEQ ID NO: 119579 - RNA, 64 nt, Homo Sapiens
gcacuggagggcgcaucaaagaagaguccuacccaggagggagagcgcagcugcugcaggauuc

SEQ ID NO: 119580 - RNA, 64 nt, Homo Sapiens
ccgaggcugcugagacccuuagaucuuugggccuaggagggagucagagagggggaugucugaa

SEQ ID NO: 119581 - RNA, 64 nt, Homo Sapiens
agccuggaaaagauggggaaccugcuagugaacuaggagggagacuuccauagccucagacuug

SEQ ID NO: 119582 - RNA, 64 nt, Homo Sapiens
caggcccugcucagaggucagagggucugggcagaggagggaccacauuccccugccuugcccc

SEQ ID NO: 119583 - RNA, 64 nt, Homo Sapiens
cuuugcagccuggccagcagcucagagugcaccgaggagggaaggauggcuaagcugggaccgg

SEQ ID NO: 119584 - RNA, 64 nt, Homo Sapiens
uggggagagggaugcuauuuauucaguuuggggcaggagggagaggagggaaaguauuucugac

SEQ ID NO: 119585 - RNA, 64 nt, Homo Sapiens
ggaugcuauuuauucaguuuggggcaggagggagaggagggaaaguauuucugacccugaugcc

SEQ ID NO: 119586 - RNA, 64 nt, Homo Sapiens
aacagccuguguuuuuuauguuugaggggguaggaggagggagauuuaacugcugugaacucac

SEQ ID NO: 119587 - RNA, 64 nt, Homo Sapiens
ggagaagcccagcagaagcugggggagagaggaaaggagggagguuugauucugaucauggggu

SEQ ID NO: 119588 - RNA, 64 nt, Homo Sapiens
cuggagggggcgcuggaggaaggccuaggagacuaggagggaauagagucuagacagacggcac

SEQ ID NO: 119589 - RNA, 64 nt, Homo Sapiens
aggaauaaggggaaggaagaggggugguagucagaggagggaggcaagaugaggcaccaggaaa

SEQ ID NO: 119590 - RNA, 64 nt, Homo Sapiens
gccaaagauggagaagagugccagggaccccucaaggagggagacgcuccauaucccagggcau

SEQ ID NO: 119591 - RNA, 64 nt, Homo Sapiens
gcccagguaagaccucucugaagagcugucaugaaggagggagggagcacauuccuggcagaga

SEQ ID NO: 119592 - RNA, 64 nt, Homo Sapiens
gaggggcagaguggagugucacccugagcaaggaaggagggaggauggccugcuguucacaugg

SEQ ID NO: 119593 - RNA, 64 nt, Homo Sapiens
cuucagccugucuggcugcuuacucugugauggcaggagggaacaccucuuuguagugcuuggc

SEQ ID NO: 119594 - RNA, 64 nt, Homo Sapiens
ugcccuucccccacccccacggcucuccugguugaggagggaggggccuggcugaccccuccag

SEQ ID NO: 119595 - RNA, 64 nt, Homo Sapiens
aggaagagagagugggaggcagagugugauggggaggagggacaggaagacccuuuuaaugaug

SEQ ID NO: 119596 - RNA, 64 nt, Homo Sapiens
aagagaagacaagagccugaugagcaggguucccaggagggagagggcuuucuccccuuuugcu

SEQ ID NO: 119597 - RNA, 64 nt, Homo Sapiens
aaaagaaagcaaaggaacaggaagggcagaaggaaggagggaagagaggggagaagaaggaagg

SEQ ID NO: 119598 - RNA, 59 nt, Homo Sapiens
cccaagccuuuggugagaagccaauucccacuugacagaaggcguccauccauucaucu

SEQ ID NO: 119599 - RNA, 59 nt, Homo Sapiens
acaaguguucagagaggucccccucugccacuugacagggaccuucaaaccucgacagu

SEQ ID NO: 119600 - RNA, 59 nt, Homo Sapiens
uccuuagaaaaaagaggcuauuuguauguacuugacaauauauaauaaaguuuuaaaaa

SEQ ID NO: 119601 - RNA, 59 nt, Homo Sapiens
aaaacccauucuuucaguuacucaaacuuacuugacaacgagcaaaguauuaaaaauuu

SEQ ID NO: 119602 - RNA, 59 nt, Homo Sapiens
guaacauuaguaaacugucugaggacaugacuugacauacccuuacuggaugacucuca

SEQ ID NO: 119603 - RNA, 59 nt, Homo Sapiens
uuuuaagggcauguuauuugaaguaaaucacuugacaaccaagaaauuauauuuauaug

SEQ ID NO: 119604 - RNA, 59 nt, Homo Sapiens
gcaaguagagaagacacacucugaaacaaacuugacaaaaaguaaagaaacacaaauag

SEQ ID NO: 119605 - RNA, 59 nt, Homo Sapiens
guaaaaauauaauuucucucucugaaaagacuugacauuaccugaaaaaugauauuuug

SEQ ID NO: 119606 - RNA, 64 nt, Homo Sapiens
ccagcuguucuccagggcuuggggaaacagaaaccacucacauagggauuccuggauggcuuca

SEQ ID NO: 119607 - RNA, 64 nt, Homo Sapiens
gcuauuuguucuuuggaaugacugcuccacuccacacucacaccucuauucacagaccagcauc

SEQ ID NO: 119608 - RNA, 64 nt, Homo Sapiens
uaaagagaaagaauacuugacagcucuaugcccacacucacauuacagcugaugugaaagagau

SEQ ID NO: 119609 - RNA, 64 nt, Homo Sapiens
ugugugcccucagccagagauuuaucaaccugcucacucacaaauuauuggcuaguuagcuuuc

SEQ ID NO: 119610 - RNA, 64 nt, Homo Sapiens
augucauuugaaccucacaauuucagagcaccuucacucacauauucuguggaacuuggcaaau

SEQ ID NO: 119611 - RNA, 64 nt, Homo Sapiens
ugcacacacacacacacauaacaauuuaugugcacacucacacaacuauaaugcacacucacac

SEQ ID NO: 119612 - RNA, 64 nt, Homo Sapiens
caauuuaugugcacacucacgaaacuauaaugcacacucacacauaaaccaagagagaaagcaa

SEQ ID NO: 119613 - RNA, 64 nt, Homo Sapiens
uugcagaagcugauggggcaaacucaagcuucuucacucacagcacccuauauacacuuggagu

SEQ ID NO: 119614 - RNA, 64 nt, Homo Sapiens
auccuuucacacauuugccuugacaaacuucuuucacucacaucuuuuucacugacuuuuuuug

SEQ ID NO: 119615 - RNA, 64 nt, Homo Sapiens
cauaaacuaauuauuucucucacacauacaaguacacucacauacagaaaucaacagaaucacu

SEQ ID NO: 119616 - RNA, 64 nt, Homo Sapiens
uacaaguacacucacauacagaaaucaacagaaucacucacacauucuuuuugccucuaaugca

SEQ ID NO: 119617 - RNA, 64 nt, Homo Sapiens
cacaggcauacucacacacaaaaauauacacacacacucacacacacaaaacuucaaaugcuac

SEQ ID NO: 119618 - RNA, 64 nt, Homo Sapiens
agcacaggaugcuggaaaacuaguggggaauccgcacucacaaaagaagacaaauggcgcccac

SEQ ID NO: 119619 - RNA, 64 nt, Homo Sapiens
cccuugucugaugccccaaacacacacacacucacacucacacucuucugauacacagccacug

SEQ ID NO: 119620 - RNA, 64 nt, Homo Sapiens
cacacucccuugucugaugcccacugcacacacacacucacacuugguugcuucugauacacag

SEQ ID NO: 119621 - RNA, 64 nt, Homo Sapiens
caugcauacacuuagguuuccucaugcacacacacacucacacacguacaugcacaaauacaca

SEQ ID NO: 119622 - RNA, 64 nt, Homo Sapiens
cacacacacacacacacucucacacacacacucacacucacauacccuaacuuuuaauguacau

SEQ ID NO: 119623 - RNA, 64 nt, Homo Sapiens
cacauacacacacacacacaguacaucacacacacacucacacugcccagcccuaacuuuuaau

SEQ ID NO: 119624 - RNA, 64 nt, Homo Sapiens
auccuaugagcccacgcccgcccacuccuggccccacucacaccacucccaccauccugugagc

SEQ ID NO: 119625 - RNA, 64 nt, Homo Sapiens
aucuuguaagacugugcccgcccacucccggccccacucacaacacucacaccaaccugugagc

SEQ ID NO: 119626 - RNA, 64 nt, Homo Sapiens
aaccugugagccccacuccccccacucccagccccacucacaccacucacuccauccugugagc

SEQ ID NO: 119627 - RNA, 64 nt, Homo Sapiens
aaccugugagccccacuccccccaugcccggccccacucacacccacucccaccauccugugag

SEQ ID NO: 119628 - RNA, 64 nt, Homo Sapiens
gcugggcccagaggcacagccggggccugccuagcacucacaugcuggacaggucugggagagg

SEQ ID NO: 119629 - RNA, 64 nt, Homo Sapiens
ucggucuucggcauugguucccuuugcuccaccccacucacagagacacagggcauccaacuga

SEQ ID NO: 119630 - RNA, 64 nt, Homo Sapiens
uuccuucauggccuguuuuggggcuugccagagacacucacaguaacagagccugcgggaaacg

SEQ ID NO: 119631 - RNA, 64 nt, Homo Sapiens
ccccaaggcccacggcucaaucccuggcccaccccacucacacucuccucccuguucccguucc

SEQ ID NO: 119632 - RNA, 64 nt, Homo Sapiens
gacaucuuggaacucaaucuucuguuggaucacgggaaaucaagacacccaggaggaauugaaa

SEQ ID NO: 119633 - RNA, 64 nt, Homo Sapiens
aguagaaaaaugucacguuuccauaucuccugcuggaaaucagaaaauauaauaaaauugcaca

SEQ ID NO: 119634 - RNA, 64 nt, Homo Sapiens
aauaguacaaguuauuaucaaggauguuuuacagggaaaucaaaagaauauuaucauacuuuau

SEQ ID NO: 119635 - RNA, 64 nt, Homo Sapiens
aauuaggcuuuauuaucuuccuaaaucaaggaaaggaaaucauccccagaccauuuaugcugag

SEQ ID NO: 119636 - RNA, 64 nt, Homo Sapiens
uacacacacacacacacacaaggcucuggaaguuggaaaucacauggaauaauaccuaacaggc

SEQ ID NO: 119637 - RNA, 64 nt, Homo Sapiens
aacuguuucaagaaccuguauuauaauuuaaaguggaaaucagauaucugguuuaauguuguau

SEQ ID NO: 119638 - RNA, 64 nt, Homo Sapiens
agaaugccaaaccacauuuuuaucacacuucuuuggaaaucaaugccuuugcauagaaaaucaa

SEQ ID NO: 119639 - RNA, 64 nt, Homo Sapiens
agguaugggugaaauuggaaauuacuaaucuauuggaaaucaguuccugacauaguaaaguuug

SEQ ID NO: 119640 - RNA, 64 nt, Homo Sapiens
acauuuauuuucaaagcgaggaacuaaauaucaaggaaaucaagcaaaguguagacaucuguag

SEQ ID NO: 119641 - RNA, 64 nt, Homo Sapiens
gaaaaagaggccuuguuuaugguuuaaacaagauggaaaucaauugaagauugaaauauccaaa

SEQ ID NO: 119642 - RNA, 64 nt, Homo Sapiens
aauugccuaauugcugcaaaguauaacccagauaggaaaucauauguuuuuuuccaagagucau

SEQ ID NO: 119643 - RNA, 64 nt, Homo Sapiens
gagcucucucagugugaacaugccuucugugggcggaaaucaggaagccaccagcuguuaaugg

SEQ ID NO: 119644 - RNA, 64 nt, Homo Sapiens
gugcuuaauuuacucuguuguaaagggauaaaguggaaaucauuuuuuuccguggaguggugau

SEQ ID NO: 119645 - RNA, 64 nt, Homo Sapiens
auaaaugugaaccuaagaaaacuccaccucugaaggaaaucauuugaauuuuguuuuuguacgu

SEQ ID NO: 119646 - RNA, 64 nt, Homo Sapiens
cgugugaucggaacucaggucccaagauacagaaggaaaucaugccaacauuaauacucaggac

SEQ ID NO: 119647 - RNA, 64 nt, Homo Sapiens
aaacagauggacaaguuggauuuggcucauauuuggaaaucaaggagacccaccugcauguugu

SEQ ID NO: 119648 - RNA, 64 nt, Homo Sapiens
ucugguugguaggugucuacauaauagaauuaggggaaaucaaauuuuugguuuucugauggaa

SEQ ID NO: 119649 - RNA, 64 nt, Homo Sapiens
ccaaguguagcugagcaauuuauaugauacuugaggaaaucaggauauugggugaugucaaagg

SEQ ID NO: 119650 - RNA, 64 nt, Homo Sapiens
uuuucuuuaaauccaaagauuaucuucagguuggggaaaucaaucuugugaaaauuuauccauu

SEQ ID NO: 119651 - RNA, 64 nt, Homo Sapiens
cuaccuuuuuguuguuguugggauugcaagcuugggaaaucaagauuuucuuucuuucuauauu

SEQ ID NO: 119652 - RNA, 64 nt, Homo Sapiens
agcugcuuagcuggugcuggccugaggcagggcaggaaaucagaauagcauuugcuucucuggg

SEQ ID NO: 119653 - RNA, 64 nt, Homo Sapiens
uagcuuguggaguuuaugggccaccaggguuuggggaaaucaccaucccgcggaugcugugacc

SEQ ID NO: 119654 - RNA, 64 nt, Homo Sapiens
uagcaguuaccccauggcaucuuccuugcaaaugggaaaucacagcagaaacugaauuaauaug

SEQ ID NO: 119655 - RNA, 64 nt, Homo Sapiens
uuuacggaauguggugcugaaauaccguuacuugggaaaucaucacucuggagcaacuuaguca

SEQ ID NO: 119656 - RNA, 64 nt, Homo Sapiens
ugaaagugacaaauuuuaaauuuucucuaauaguccucaucauaaacuuuuuaaaggaaaauaa

SEQ ID NO: 119657 - RNA, 64 nt, Homo Sapiens
ggggcacugcugcaacuucugcuuucaucccaugccucaucaaugaggaaagggaacaaagugu

SEQ ID NO: 119658 - RNA, 64 nt, Homo Sapiens
ccgacaaccagaggcugaaagaugaaaauggugcccucaucagagucaucagcaaacuguccaa

SEQ ID NO: 119659 - RNA, 64 nt, Homo Sapiens
cccuugguucacuugagugugcaagucauuaaauccucaucauuuuaggguugccagugauauu

SEQ ID NO: 119660 - RNA, 64 nt, Homo Sapiens
cacuccccgcauggggaggccgccaccaccaacaccucaucauccuucucaucgcuaacaccac

SEQ ID NO: 119661 - RNA, 64 nt, Homo Sapiens
uguuggaggcugggaaccccgcagcgcgaggcugccucaucaacggcaagaggaaaggaggggu

SEQ ID NO: 119662 - RNA, 64 nt, Homo Sapiens
uagaaccuuuccagguucucuuagagccauaugcccucaucaucccaggggagaacuacauugg

SEQ ID NO: 119663 - RNA, 64 nt, Homo Sapiens
uguuacacauugaggcugucuuuaaggggccugcccucaucaucaacgucucagcccuucaguu

SEQ ID NO: 119664 - RNA, 64 nt, Homo Sapiens
caggaucaacugugggcaaagugccugccucugaccucaucaugguucuaguucucauacagaa

SEQ ID NO: 119665 - RNA, 64 nt, Homo Sapiens
gcugggcagugcguuuagucuguggccuagaagaccucaucagcccccgagaggaggccuugca

SEQ ID NO: 119666 - RNA, 64 nt, Homo Sapiens
ccuugccacuggagcucucuuaauaccgucaaacccucaucaucuguggguugcuuuuuuuuuu

SEQ ID NO: 119667 - RNA, 64 nt, Homo Sapiens
gaucuuugggcccuuguauccauuauccuuaugaccucaucacccucagacuuuaagacaagaa

SEQ ID NO: 119668 - RNA, 64 nt, Homo Sapiens
aauauaaccaauucuaaauuuguuuuagcucuaaccucaucaaaccaaaggcacagauuugugu

SEQ ID NO: 119669 - RNA, 64 nt, Homo Sapiens
acagcucucagccuaagagcgcagcacugaacagccucaucauuccacuuuucaugggaaauau

SEQ ID NO: 119670 - RNA, 64 nt, Homo Sapiens
ugggcucccugaucuuggacaagcagcaugaggcccucaucagacugcuuuccaccaugaguug

SEQ ID NO: 119671 - RNA, 64 nt, Homo Sapiens
gaauggagaaucucauuaaaacccagaggagaagccucaucauuggaauguccaggucaucuuc

SEQ ID NO: 119672 - RNA, 64 nt, Homo Sapiens
uggauaccaccaucuaagcuccuguaucagcaguccucaucaucacucaucugccaagcuccuc

SEQ ID NO: 119673 - RNA, 64 nt, Homo Sapiens
caucccuccauguacucuggguaucagcaacuguccucaucagucuccauaccccuucagcuuu

SEQ ID NO: 119674 - RNA, 64 nt, Homo Sapiens
uggauagaaucaucuaagcuccuguaucagcacuccucaucaucacucaucugccaagcuccuc

SEQ ID NO: 119675 - RNA, 64 nt, Homo Sapiens
caucucuccauauacuuuggguaucagcaucuguccucaucagucuccauaccccuucagcuuu

SEQ ID NO: 119676 - RNA, 64 nt, Homo Sapiens
cgucucaacugauuuacucacuuagcuucccuucccucaucagcauaguauaauagaauguaug

SEQ ID NO: 119677 - RNA, 64 nt, Homo Sapiens
aaggucagugaagucuaucaaucauucuccccuuccucaucagcaaugguagauagaaaugucc

SEQ ID NO: 119678 - RNA, 64 nt, Homo Sapiens
ccaugcugccuuucccucauuuuguuuuuuuccgccucaucacaaauccuuaacuucuccccau

SEQ ID NO: 119679 - RNA, 64 nt, Homo Sapiens
aaugugccccuacaggccggagugauuuaacuuaccucaucaagagacauaugagcaagaaaaa

SEQ ID NO: 119680 - RNA, 64 nt, Homo Sapiens
ucaucuugccacccacccccuaccauugagccaccaugcccagccccaaagccucuuaauugcu

SEQ ID NO: 119681 - RNA, 64 nt, Homo Sapiens
uccccagagugcugggauuacacacgugagucaccaugcccagccccaaagccauuucuugaag

SEQ ID NO: 119682 - RNA, 64 nt, Homo Sapiens
cucccauauagcugggauuauaggugccugccaccaugcccagcuaauuuuuguguuuuuagua

SEQ ID NO: 119683 - RNA, 64 nt, Homo Sapiens
cucccaaguagcugggauuauaggcaugugccaccaugcccagcaaauuuuguauuuuuuuuug

SEQ ID NO: 119684 - RNA, 64 nt, Homo Sapiens
gcucaugcucccugccgagaacagcuuccuagcucaugcccauaugucuggguucucccugcag

SEQ ID NO: 119685 - RNA, 64 nt, Homo Sapiens
uaauuuuuuuuaauuuuuagcaggugagccccagcaugcccagccucccgaguagcugggacua

SEQ ID NO: 119686 - RNA, 64 nt, Homo Sapiens
cagugagugccuuaaaguuggagaaguaacugcccaugcccagaaauaaggaugccagugccca

SEQ ID NO: 119687 - RNA, 64 nt, Homo Sapiens
aacacagccuguguggaaggcagaacaaagaaugcaugcccagucagaaaucuguucuauucug

SEQ ID NO: 119688 - RNA, 64 nt, Homo Sapiens
ccuagucccaucugggccccccaccugccugccacaugcccacgcgugcugcuccuggacuggc

SEQ ID NO: 119689 - RNA, 64 nt, Homo Sapiens
uuuagcccugaagcagggcucagggcggggauagcaugcccaauuuguuucccucauggccgac

SEQ ID NO: 119690 - RNA, 64 nt, Homo Sapiens
cugcugaguaguugggauuacaggcgcccaccaccaugcccagcuaauuuuuguguuuuuauug

SEQ ID NO: 119691 - RNA, 64 nt, Homo Sapiens
cuccugaguagcugggacuacaggugugcaccaacaugcccagcuaauuuuuuauauuuuuagu

SEQ ID NO: 119692 - RNA, 64 nt, Homo Sapiens
uuauuuuguguuuuuaguagcaagcaugcgccaccaugcccagccucucaaguagcugggauua

SEQ ID NO: 119693 - RNA, 64 nt, Homo Sapiens
uaauuuuuuuguagagauggcagguguucgccaccaugcccagcuucccaaguagcugggacua

SEQ ID NO: 119694 - RNA, 64 nt, Homo Sapiens
cuccagagacagcuguguggagcaaaucagaguucaugcccaaguccccagguuggaauggcug

SEQ ID NO: 119695 - RNA, 64 nt, Homo Sapiens
uuucuggcagcaaucccugccuucuuuuugggcccaugcccagacuucugguuuaaggaauggu

SEQ ID NO: 119696 - RNA, 64 nt, Homo Sapiens
uccgugcuauuaaucacuuguuagagcaacaugacaugcccagcaucccacuucccgaaaaugu

SEQ ID NO: 119697 - RNA, 64 nt, Homo Sapiens
uguugaucuaaggggccgcgaauuucgcacaaugcaugcccaccuggggcuggggcagaugccu

SEQ ID NO: 119698 - RNA, 64 nt, Homo Sapiens
uucaggucacuucggacaccgguguuuucugaggcaugcccaggacucccucagccccuggaac

SEQ ID NO: 119699 - RNA, 64 nt, Homo Sapiens
cucccaaagugcuaggauuacaggcgugagccaccaugcccagccuacucuaaauuauugauaa

SEQ ID NO: 119700 - RNA, 64 nt, Homo Sapiens
ugaccucaccaguugagacaccuaguguauggcucaugcccagccuuccaccugggauucucca

SEQ ID NO: 119701 - RNA, 64 nt, Homo Sapiens
cagagaggaucuugcucauucauggccauauccacaugcccauggccacucaguagauuguuga

SEQ ID NO: 119702 - RNA, 64 nt, Homo Sapiens
acacaggcuucuuccuagagccagcccuauauaacaugcccacaagggcaacaguuaucacagu

SEQ ID NO: 119703 - RNA, 64 nt, Homo Sapiens
acauuucugcuaauagggagucauaaaccuggcucaugcccaacugugcaggacacaauccaaa

SEQ ID NO: 119704 - RNA, 64 nt, Homo Sapiens
uaauuguuguauguuuaguacaggcacccaccaccaugcccagccuccccaguagcugggauua

SEQ ID NO: 119705 - RNA, 64 nt, Homo Sapiens
ucauuugcaccuuuaccucucaguagggagucaacaugcccaaggugaggggcccugccuuccu

SEQ ID NO: 119706 - RNA, 64 nt, Homo Sapiens
gcacaggauagaugugcuauaaugucuccuuacccaugcccacgagaugcuugucugaugccug

SEQ ID NO: 119707 - RNA, 64 nt, Homo Sapiens
ugagcccugacagcaccaaggacucaaggacucccaugcccaccgugucacagugccaucucca

SEQ ID NO: 119708 - RNA, 64 nt, Homo Sapiens
ugucagcucaaaggaucucuggguaaggggaugacaugcccaggagggcugaguacaguccugg

SEQ ID NO: 119709 - RNA, 64 nt, Homo Sapiens
uccgucaccuccccauccccgaagaaaugaaaggcaugcccacguucucuugaacuggagaggg

SEQ ID NO: 119710 - RNA, 64 nt, Homo Sapiens
ugacccucaguuccucaaacacagacccagggugcaugcccaucuccagcccagggcagcuccc

SEQ ID NO: 119711 - RNA, 64 nt, Homo Sapiens
aucugggggagcugcugauggaguccucgcugcucaugcccacagcccucccagagugcuaugc

SEQ ID NO: 119712 - RNA, 64 nt, Homo Sapiens
aggacucuagccucugaccuagccuccugagcuccaugcccaucacguugcugagcaacucgcc

SEQ ID NO: 119713 - RNA, 64 nt, Homo Sapiens
gcaaguggggagguucucugccauggagccuuggcaugcccaggguggcaccacugagccuaga

SEQ ID NO: 119714 - RNA, 64 nt, Homo Sapiens
uuggagugccacguggccgcgucccgggcacugucaugcccagcgccacauggccgcugcccac

SEQ ID NO: 119715 - RNA, 64 nt, Homo Sapiens
uuggagugccacauggccgcgucccgggcacugucaugcccagcgccacguggccgcugcccac

SEQ ID NO: 119716 - RNA, 64 nt, Homo Sapiens
uuggagugccacguggccgcguccugggugcugucaugcccagccgccacacuggccggcccac

SEQ ID NO: 119717 - RNA, 52 nt, Homo Sapiens
cccugggcacaccuugcugaggccccaguagggguggggagggagggagagg

SEQ ID NO: 119718 - RNA, 64 nt, Homo Sapiens
ugcugggauuacaggugugagcugccacgcccagccccaguacacucuucucuggaccagaucu

SEQ ID NO: 119719 - RNA, 64 nt, Homo Sapiens
cuauugagguccuaugucucugauuuuuuuuuuuccccaguauugcccuggagcugucucugga

SEQ ID NO: 119720 - RNA, 64 nt, Homo Sapiens
cuguaaaaugagaauucugcccccucaccucuuaccccaguacuauucuccagagguaaucuau

SEQ ID NO: 119721 - RNA, 64 nt, Homo Sapiens
cauccuggggaguuuaagguccccagggaaccacccccaguaacaauuuccaccccaguccccu

SEQ ID NO: 119722 - RNA, 64 nt, Homo Sapiens
ucagccuucccucuuccucugcccuguucuguguccccaguagcccccuccccuggcuuugauu

SEQ ID NO: 119723 - RNA, 64 nt, Homo Sapiens
aacggaucaaagcucccacgccaguccacuagggccccaguaguugacagccuugcuccucucc

SEQ ID NO: 119724 - RNA, 64 nt, Homo Sapiens
ucccaguuacaucaaacagugacuuccaguuauuccccaguaagucugagugguuccuucaagc

SEQ ID NO: 119725 - RNA, 64 nt, Homo Sapiens
gaacauucucaauuaagugauaaguccaaaugaugaaggaaauguuuuaauucacaaauggaga

SEQ ID NO: 119726 - RNA, 64 nt, Homo Sapiens
uuuaccuuuuggacaguaauuucuaucacaguuagaaggaaaugauagucaaauacacguuuag

SEQ ID NO: 119727 - RNA, 64 nt, Homo Sapiens
ccguugcaaaaggguauuuuuagugggggaucaagaaggaaacuggcucuguccuccucgaccc

SEQ ID NO: 119728 - RNA, 64 nt, Homo Sapiens
aacggaguuagcucccaggcguggguaagggcaggaaggaaauggccugcccacaggacaagaa

SEQ ID NO: 119729 - RNA, 64 nt, Homo Sapiens
gcuggagucagcacuguccacagcagcaucccaagaaggaaagagcagagguaagaggaagagg

SEQ ID NO: 119730 - RNA, 64 nt, Homo Sapiens
ucucagaugaaagagaggguaaaggcgacaucaagaaggaaaggcagaaaaagcaagaagaaga

SEQ ID NO: 119731 - RNA, 64 nt, Homo Sapiens
ccuuuuugucaauaacucuguguaagaacaggcagaaggaaaacauuuuucugaaaguggcuga

SEQ ID NO: 119732 - RNA, 64 nt, Homo Sapiens
ccuauuuugggguaucagugaucuucagaggaaggaaggaaaaucucuuggauuuuuugaaaua

SEQ ID NO: 119733 - RNA, 64 nt, Homo Sapiens
uacgugauuguaauggaggcgaaaagcugugaaggaaggaaauucaguggcagaacaugcagca

SEQ ID NO: 119734 - RNA, 64 nt, Homo Sapiens
gcuggaaaaccaccaccgccgguggaucaggcccgaaggaaaaucugugcccccuaaaccaggc

SEQ ID NO: 119735 - RNA, 64 nt, Homo Sapiens
gcugaaaucaagcacauauuuugaaauggacugugaaggaaaaggggacaggaacaaaggacca

SEQ ID NO: 119736 - RNA, 64 nt, Homo Sapiens
aaauaaauuaggcccaauccaagaaauugagugagaaggaaacacuuguuuuauucacagaggu

SEQ ID NO: 119737 - RNA, 64 nt, Homo Sapiens
aaggggaagacacccuaguuugcuggccuuuuuggaaggaaagggacuuuggcuugcuugaggc

SEQ ID NO: 119738 - RNA, 64 nt, Homo Sapiens
cacccagaaugcuucugcaauuauuguuggccaugaaggaaaaugcaacaugggagagaaguuc

SEQ ID NO: 119739 - RNA, 64 nt, Homo Sapiens
agggaaggugauugcugcuaccaacuuuugguaggaaggaaaaccuuuacauuauuugcugaua

SEQ ID NO: 119740 - RNA, 64 nt, Homo Sapiens
uguugcauaucaauuguagguugugucaaucuuggaaggaaagcuuuauagaguauaugguaua

SEQ ID NO: 119741 - RNA, 62 nt, Homo Sapiens
augcuguggaugaacgaugaaugucaaugucagaaggaaaagagaauuuuggccaucaaaau

SEQ ID NO: 119742 - RNA, 64 nt, Homo Sapiens
auguuguguucauuuguugagccauaucucagaagaaggaaagggagcuacagaaaggagguuu

SEQ ID NO: 119743 - RNA, 64 nt, Homo Sapiens
accaaaacaugggaugaagcuaaaucaaugcuuagaaggaaauuuauagcuucaaauacuuaua

SEQ ID NO: 119744 - RNA, 64 nt, Homo Sapiens
auaauugauaauaacaguccaaagaaagcagaaagaaggaaagccuagaacagaaauaaaugaa

SEQ ID NO: 119745 - RNA, 64 nt, Homo Sapiens
acauuuucuugaaaggggaagggcugggucacaggaaggaaacacugcacagauucccaggcca

SEQ ID NO: 119746 - RNA, 64 nt, Homo Sapiens
ggauuaggcaaaaauaauuuggcaaccauuuuuagaaggaaaaagaggggacgggacagacgaa

SEQ ID NO: 119747 - RNA, 64 nt, Homo Sapiens
uagaaaaugcguagauacaaaaucuaugauuauugaaggaaauuuguuucuuuauuaccaaugu

SEQ ID NO: 119748 - RNA, 64 nt, Homo Sapiens
cagagcuuauuuuucaccuaagcaugaggcaagggaaggaaaagcacauggggacaggggaugg

SEQ ID NO: 119749 - RNA, 64 nt, Homo Sapiens
uucaaugugacugaaacaaaauguuuuuugauaggaaggaaacuggaauucuuuguacuaauac

SEQ ID NO: 119750 - RNA, 64 nt, Homo Sapiens
uccauuuuaggugauaaaauuuuuuaaaaguuuugaaggaaaccucuggauaaauggacaaggc

SEQ ID NO: 119751 - RNA, 64 nt, Homo Sapiens
cugauuugcuuucuguuuccagaauauagcuccugaaggaaacaucuuaccucaauugaguaac

SEQ ID NO: 119752 - RNA, 64 nt, Homo Sapiens
cuacucauaucuucauugucauguuuaaaaauuggaaggaaauauuugaucucagcuucugaaa

SEQ ID NO: 119753 - RNA, 64 nt, Homo Sapiens
guucauguucauauguacuuacucuguauaaguugaaggaaaauccaugugguucacguacaaa

SEQ ID NO: 119754 - RNA, 64 nt, Homo Sapiens
ggcgagggaggggggugggacucuaacuggacaugaaggaaaggucugcugcaccuuguaaaug

SEQ ID NO: 119755 - RNA, 64 nt, Homo Sapiens
uccaacugaccuagugaagguucagaugcaaauggaaggaaaaaggaaacuggaaggaaaacca

SEQ ID NO: 119756 - RNA, 64 nt, Homo Sapiens
gguucagaugcaaauggaaggaaaaaggaaacuggaaggaaaaccauugcgguaaguucuccaa

SEQ ID NO: 119757 - RNA, 64 nt, Homo Sapiens
auaugucugccaaguuguuagaaucuuugaaucagaaggaaaaaaagcagcgcugguugacaaa

SEQ ID NO: 119758 - RNA, 64 nt, Homo Sapiens
ccaaccugagauuuguaguccaggauuacaaccagaaggaaaguaugacagauuucuacuuaac

SEQ ID NO: 119759 - RNA, 64 nt, Homo Sapiens
cgugauuuggugaaggccacaggaaguagagauagaaggaaauauucucaucuuuaagguaagg

SEQ ID NO: 119760 - RNA, 64 nt, Homo Sapiens
ugcugugguugcugcugcuugaggcagccauuuggaaggaaaacugugaccaaauagucuacag

SEQ ID NO: 119761 - RNA, 64 nt, Homo Sapiens
cuuaccaaaaauauauuuuguuaaagcaugcuuagaaggaaaagcacuuacuauuuucagcuuu

SEQ ID NO: 119762 - RNA, 64 nt, Homo Sapiens
ggaaucaauauacucuuuguaugaagaggaguaggaaggaaaaugccuauauaugauuauuuga

SEQ ID NO: 119763 - RNA, 64 nt, Homo Sapiens
ugauccuccugagacuaacuauaagaaaugaauggaaggaaauaucaaguggauaacaauauuu

SEQ ID NO: 119764 - RNA, 64 nt, Homo Sapiens
agggagggaaacagggagaaaggaaggaagaaaggaaggaaagaucagugaauucuaagaagga

SEQ ID NO: 119765 - RNA, 64 nt, Homo Sapiens
ugagggccaugaaagccacagaggaugggcugaggaaggaaagaaaugggguuacugcucccag

SEQ ID NO: 119766 - RNA, 64 nt, Homo Sapiens
uugcauuaagcuuuuucaauaaaggaaaauuacggaaggaaaauaggcaacaccagcaaauuau

SEQ ID NO: 119767 - RNA, 64 nt, Homo Sapiens
aaggauauaggaagagagggaugaaagaaggcaggaaggaaagaagagaagaagaaauggaaaa

SEQ ID NO: 119768 - RNA, 64 nt, Homo Sapiens
cuggugacuaaaauaagguuauuuaugugcuauggaaggaaaugucaauguacauuuugaacau

SEQ ID NO: 119769 - RNA, 64 nt, Homo Sapiens
gggaauuuaguuacagugcuuggaaugagaaggggaaggaaagaauuaacaaaugccaagauuu

SEQ ID NO: 119770 - RNA, 64 nt, Homo Sapiens
augcacaagcuaaacauaauuugaaugggucuaugaaggaaaaauaaugcuuagacuuuggugu

SEQ ID NO: 119771 - RNA, 64 nt, Homo Sapiens
gcuucaggaggaggcugugaucuucuggagccuggaaggaaagggggguguguuugucuccugc

SEQ ID NO: 119772 - RNA, 64 nt, Homo Sapiens
ggacaaaaccuuaagcuguugguugggggacucugaaggaaacguuuugcgcaaacuccuucag

SEQ ID NO: 119773 - RNA, 64 nt, Homo Sapiens
accgaagagcaaacaaaagugcauaccacuugaagaaggaaagaaauuucuaccaaauaguaga

SEQ ID NO: 119774 - RNA, 64 nt, Homo Sapiens
ccaucagugaauccugaaaccaaacuuagaaagggaaggaaaucuuagaaaaggaaaacgugaa

SEQ ID NO: 119775 - RNA, 64 nt, Homo Sapiens
uagcuuuuaucaauuuuuuucuuuaagaaauggagaaggaaaaauuuuucauaaaaauuaaaug

SEQ ID NO: 119776 - RNA, 64 nt, Homo Sapiens
cuuguuacugaaagagacuaaagaaagaaggaaggaaggaaaaauaauuggacaaagagagaga

SEQ ID NO: 119777 - RNA, 64 nt, Homo Sapiens
cauuuaauaguuauaacgucguuacuuguacuaugaaggaaaauacucagugucagcuugagcc

SEQ ID NO: 119778 - RNA, 64 nt, Homo Sapiens
gguggcggucacucccucugccacuauccccagggaaggaaaggcuccgccauuugggaaagug

SEQ ID NO: 119779 - RNA, 64 nt, Homo Sapiens
uggucccaaaguacggcagcugcaaaaaguaguggaaggaaauugucuacgugucuuggaaaaa

SEQ ID NO: 119780 - RNA, 64 nt, Homo Sapiens
cuccagaauuccacuucuaguuauuuauucaagagaaggaaaaacaaugaucacagcaauacuu

SEQ ID NO: 119781 - RNA, 64 nt, Homo Sapiens
uucaauaaaugcaauauuauuggcagacauuguugaaggaaaaaagccagacaaacaacuacau

SEQ ID NO: 119782 - RNA, 64 nt, Homo Sapiens
aguaucaaaggcagaaaggaggaugaaagacaaagaaggaaaagaucugugaggugauaggcaa

SEQ ID NO: 119783 - RNA, 64 nt, Homo Sapiens
gcuggcaagguggguuccagucugccuugauggagaaggaaaagcuccccacccaccaaaugcc

SEQ ID NO: 119784 - RNA, 64 nt, Homo Sapiens
aauuuugauguaacaauuuuaaggacacagauuugaaggaaaaaaagaaacuguuguuugguua

SEQ ID NO: 119785 - RNA, 64 nt, Homo Sapiens
agaauaaagaagagaaacguaagaaaaaagaaaagaaggaaagauuuuugaaagagcaagagga

SEQ ID NO: 119786 - RNA, 64 nt, Homo Sapiens
ucaucuuugcauagcccauggucagagccaaugagaaggaaaccaaucggaagugcaggagcug

SEQ ID NO: 119787 - RNA, 64 nt, Homo Sapiens
ugugggggacggggggcaugcccccgcuccagaggaaggaaagcgggcgacuaccccagugccc

SEQ ID NO: 119788 - RNA, 64 nt, Homo Sapiens
uuuaaucucugcaguuuauuaagaugauacacucgaaggaaacugaaacuuuguacuuuuuaau

SEQ ID NO: 119789 - RNA, 64 nt, Homo Sapiens
aaugugacagaauguuccauuagggaaaucuccugaaggaaaaaauuuugcaaacagcucuucu

SEQ ID NO: 119790 - RNA, 64 nt, Homo Sapiens
cagauuaucuaaagccaucugaacauugguuugugaaggaaaaauaucauggcaugacuuaagg

SEQ ID NO: 119791 - RNA, 64 nt, Homo Sapiens
agaaauuguugcuauugucauucuuuugcugagugaaggaaagguauuuugugauuuaugugau

SEQ ID NO: 119792 - RNA, 64 nt, Homo Sapiens
cgcauacaggcucuagucaagaaugaauuagagugaaggaaagcugugugacaccuggcauucc

SEQ ID NO: 119793 - RNA, 64 nt, Homo Sapiens
aaaauaugaauacuguaaaggaaauaaauggugggaaggaaaaguagagaaagaaaugccaauu

SEQ ID NO: 119794 - RNA, 64 nt, Homo Sapiens
uagagaaagaaaugccaauugaaauaaacggugggaaggaaaagaaaauaugaauacuguaaag

SEQ ID NO: 119795 - RNA, 64 nt, Homo Sapiens
ugugugacaccuggcauuccgaaugaauuagagugaaggaaagcggcauacaggcucuagucaa

SEQ ID NO: 119796 - RNA, 64 nt, Homo Sapiens
uagagaaagaaaugccaauuggaagaaauggugggaaggaaaagauaaauccuguaguuuaaaa

SEQ ID NO: 119797 - RNA, 64 nt, Homo Sapiens; identical to SEQ ID NO: 119795

SEQ ID NO: 119798 - RNA, 64 nt, Homo Sapiens
aacuaggucugacucuggggauuuuuuuccagccgaaggaaaaucacuuccguuaugucccccu

SEQ ID NO: 119799 - RNA, 64 nt, Homo Sapiens
cgaucauccuuaagcaacugaaguuaaaauuguugaaggaaaaggcacuuaaauugguuacuuu

SEQ ID NO: 119800 - RNA, 64 nt, Homo Sapiens
gcucaguaugcuagcaacaugagaagucuaucaagaaggaaauggccgcauuccccccaaugug

SEQ ID NO: 119801 - RNA, 64 nt, Homo Sapiens
gacccaucggugaugcgcucaccuguguguuugagaaggaaaaugcaucacaauuggcaauaaa

SEQ ID NO: 119802 - RNA, 64 nt, Homo Sapiens
aauguguauaaacugcugucuaugccugcacugggaaggaaacaacugcccuucucacgggcuc

SEQ ID NO: 119803 - RNA, 64 nt, Homo Sapiens
aagguaaaaucacuucagaugauuggcuuaaagugaaggaaauaaaaucacugugaaauuucau

SEQ ID NO: 119804 - RNA, 64 nt, Homo Sapiens
ggaugaggacaacugugaacagauugacauuauugaaggaaagguuuuuuuuuuuuaaaggcaa

SEQ ID NO: 119805 - RNA, 64 nt, Homo Sapiens
ggcuagucuggcuuuuuuuugacacagaaaaagggaaggaaauugagauacuacaugggagggg

SEQ ID NO: 119806 - RNA, 64 nt, Homo Sapiens
uuuuuuaacuguuaaaccaaaggaaagcacaaaugaaggaaauccuguguaaagcauugagaag

SEQ ID NO: 119807 - RNA, 64 nt, Homo Sapiens
gcacaaaugaaggaaauccuguguaaagcauugagaaggaaagaagccuggagcagccucuccu

SEQ ID NO: 119808 - RNA, 64 nt, Homo Sapiens
ggaucuagggcccugggaggagguugagccuggggaaggaaaaagcaggaaacugaaggaagca

SEQ ID NO: 119809 - RNA, 64 nt, Homo Sapiens
cuggauuggauucgguaaaaagaggggguugcuagaaggaaaaacaggugugaccugauccugc

SEQ ID NO: 119810 - RNA, 64 nt, Homo Sapiens
ucugggcuuccuucaucucaauucugacaguguggaaggaaaucuguagguacccagguccuca

SEQ ID NO: 119811 - RNA, 64 nt, Homo Sapiens
aggaguuaaggacuuccuagagaagguagucccugaaggaaaaguaggaaucuggcagugaaag

SEQ ID NO: 119812 - RNA, 64 nt, Homo Sapiens
accagaagugauuuggaagaaaugaaagaagcaagaaggaaagcagaacuacaacaccgaagga

SEQ ID NO: 119813 - RNA, 64 nt, Homo Sapiens
aaagaagcaagaaggaaagcagaacuacaacaccgaaggaaaugugacggaauaaaaacauaau

SEQ ID NO: 119814 - RNA, 64 nt, Homo Sapiens
cuaaacuccccuuauggucuagauaauuaacaaugaaggaaacuuuuagcccuuacucaaaauc

SEQ ID NO: 119815 - RNA, 64 nt, Homo Sapiens
aauagggaaaagcuuucagcagaagaaaccccaugaaggaaaaguuacuagaaaauaucaucuu

SEQ ID NO: 119816 - RNA, 64 nt, Homo Sapiens
ccugagccuaucuggcugggcaaggugaucaagugaaggaaaaacccgggaggggcuuauguua

SEQ ID NO: 119817 - RNA, 64 nt, Homo Sapiens
ucucaagaaacaaagaucuccgcuuccuugaguggaaggaaaugcugacagccugucucuaugg

SEQ ID NO: 119818 - RNA, 64 nt, Homo Sapiens
uuucuccucucaagugccaggugguauuuagguugaaggaaagacagaggagccacugaucuga

SEQ ID NO: 119819 - RNA, 64 nt, Homo Sapiens
aaacaucacauuuuggugucgcaaguagaggaaagaaggaaauacacauguuagauaaauuuuu

SEQ ID NO: 119820 - RNA, 64 nt, Homo Sapiens
ucuguuuuccaugguuuugaucaacagugcaugugaaggaaaguaaagggacaggcaguagugu

SEQ ID NO: 119821 - RNA, 64 nt, Homo Sapiens
uauuguaauuuauuuauaguacuuuuuuuuccuugaaggaaaauacugacuuuaagauguauuu

SEQ ID NO: 119822 - RNA, 64 nt, Homo Sapiens
uggcggaggaacuccugccacgccacugugucaugaaggaaagugaaagggaacgaggaaguag

SEQ ID NO: 119823 - RNA, 64 nt, Homo Sapiens
uccucaaaaucaguuuuuauauuccccaaaagaagaaggaaaccaaggaguagcuauauauuuc

SEQ ID NO: 119824 - RNA, 64 nt, Homo Sapiens
uuugugucauuuuugccaucauuauuaucauacugaaggaaauuuuccagaucauuaggacaua

SEQ ID NO: 119825 - RNA, 64 nt, Homo Sapiens
cucaaaggguacuuccacugauggaaacaaaguggaaggaaagaugcucagguacagagaagga

SEQ ID NO: 119826 - RNA, 64 nt, Homo Sapiens
ugacaacccugugguuuccaaggagcugagaauagaaggaaacuagcuuacaugagaacagacu

SEQ ID NO: 119827 - RNA, 64 nt, Homo Sapiens
guuaaaaaaaaaaaaagucugauugguuuuaauugaaggaaagauuuguacuacaguucuuuug

SEQ ID NO: 119828 - RNA, 64 nt, Homo Sapiens
aagucacaaccaaauaguauauugauaaagccaggaaggaaauaaccggccugcuuucauaggc

SEQ ID NO: 119829 - RNA, 64 nt, Homo Sapiens
cuuuuaagucucauguuugcgacauguggagcuagaaggaaaagaaaagguuacacugugcacc

SEQ ID NO: 119830 - RNA, 64 nt, Homo Sapiens
uaguagcaauggauacuuuuaguguuauaagguggaaggaaacacauuuuucaggaaaguuuug

SEQ ID NO: 119831 - RNA, 64 nt, Homo Sapiens
uagaaauuuauuauuaaaagcuguaauccagagagaaggaaacgauuuugcccagcacauggag

SEQ ID NO: 119832 - RNA, 64 nt, Homo Sapiens
gagagagaaagaaagucuccgggaaggaaagagagaaggaaagaccgcucagcaacauagaaga

SEQ ID NO: 119833 - RNA, 64 nt, Homo Sapiens
gagaaggaaagagagagagacaacauagaagagggaaggaaagaccucugcccuacccgcucag

SEQ ID NO: 119834 - RNA, 64 nt, Homo Sapiens
aaaaaaaaagaauguacucaagacucugucucaagaaggaaaaaccagccugggugacagagug

SEQ ID NO: 119835 - RNA, 64 nt, Homo Sapiens
uuagcaacagguaauugaagguaaggagaugggugaaggaaaauaaagcccuuuaagagucaug

SEQ ID NO: 119836 - RNA, 64 nt, Homo Sapiens
aaguuugguuuuauaaaauuguuccuucaaaguugaaggaaaaaauuuucaacuuuuuaguuuu

SEQ ID NO: 119837 - RNA, 64 nt, Homo Sapiens
aaaagcccaaacuuaaccucaaauugaauuaaaagaaggaaaaauuuuuuuuguauaaaaauuu

SEQ ID NO: 119838 - RNA, 64 nt, Homo Sapiens
cuuuuacacagcacaugaagcaguaauccagaaagaaggaaaugcagaauuuuauuaucaaagu

SEQ ID NO: 119839 - RNA, 64 nt, Homo Sapiens
ucauuuucaggaaaguuuguaguauuacaaggcagaaggaaacacaguagcaaugguugcucua

SEQ ID NO: 119840 - RNA, 64 nt, Homo Sapiens
aaauacauuuacaucacagcguggugguaugacagcauaccauuacugugaucugaaaaugugu

SEQ ID NO: 119841 - RNA, 64 nt, Homo Sapiens
agaauaauuuuauuucauuuuauuuuuauuuccugcauaccauuuuaugcaaaugacuuuauuu

SEQ ID NO: 119842 - RNA, 64 nt, Homo Sapiens
aguauuugguucuaaaaaauguuagccuuccucguaaaaguagcacaagcccacuuaugaauca

SEQ ID NO: 119843 - RNA, 64 nt, Homo Sapiens
cuuaccuucuaugugauggaaagacuagagcuuauaaaaguacuuccauuuuuuuauucuccug

SEQ ID NO: 119844 - RNA, 64 nt, Homo Sapiens
ccauaccguugacgcgcuguagucaacuugacuguaaaaguaccagauggugggcggacaccga

SEQ ID NO: 119845 - RNA, 64 nt, Homo Sapiens
ucuggacuuaagaguuuaaaacaaaugugccauguaaaaguaagaaaauguuuauagccaaaua

SEQ ID NO: 119846 - RNA, 64 nt, Homo Sapiens
caguccuaugguaaugacuuaggaggaaugcagauaaaaguaccuuguaagauaaauauaaauu

SEQ ID NO: 119847 - RNA, 64 nt, Homo Sapiens
agcacucugacauguacauuuaaagugacaguuuuaaaaguaaaaugguguuaaaucucugaaa

SEQ ID NO: 119848 - RNA, 64 nt, Homo Sapiens
guauaucuguaaucaguuguuaagugaauggcacuaaaaguaucgagaacagcuuucuuuccca

SEQ ID NO: 119849 - RNA, 64 nt, Homo Sapiens
uauaaaauugaauucuacucauuagaguacuuuuuaaaaguacagcagaaagaaaagaagugga

SEQ ID NO: 119850 - RNA, 64 nt, Homo Sapiens
caaaauucccuucccaaaacuaucuuggauuuucuaaaaguaggacagugguuuuggggguuau

SEQ ID NO: 119851 - RNA, 64 nt, Homo Sapiens
gaaacauaagauaaguaccucucaaugaaaaauguaaaaguaccuagaaauucacaaaaaaauu

SEQ ID NO: 119852 - RNA, 64 nt, Homo Sapiens
auuuauagcuucaaauacuuauauacauauuuuuuaaaaguagcuuuacauaggaaggaagugg

SEQ ID NO: 119853 - RNA, 64 nt, Homo Sapiens
aaaaauauugggcucuaauucuagucauauacaauaaaaguaucuggaauaguuuucuagaaaa

SEQ ID NO: 119854 - RNA, 64 nt, Homo Sapiens
ugggcuaagguuauuauugcugcacuuuagauguuaaaaguauuuuccuaaggaagucaauuaa

SEQ ID NO: 119855 - RNA, 64 nt, Homo Sapiens
uuuaauucaccacauacuuaaaagcaaaacauuauaaaaguaauugcaauaacaaacauuaaug

SEQ ID NO: 119856 - RNA, 64 nt, Homo Sapiens
ugagcagucauuugcaaauguguuagagcuagaauaaaaguaauguuaauaaaaugcaauuuca

SEQ ID NO: 119857 - RNA, 64 nt, Homo Sapiens
uuuuaaagguuacuugaaugauguaucgauggaauaaaaguaugauuccccaaaaccuugacag

SEQ ID NO: 119858 - RNA, 64 nt, Homo Sapiens
uaucuauauuuuuauuauucaugaauuaaauuacuaaaaguauguuuauacugugaauuaauau

SEQ ID NO: 119859 - RNA, 64 nt, Homo Sapiens
auuccucgguguauuaaucuaagguuucaaaguauaaaaguauaugggguaggccgggugcagu

SEQ ID NO: 119860 - RNA, 64 nt, Homo Sapiens
uuuguuaacuuuuguuuuuuuuuguuuguuuucuuaaaaguaccucugcauugagcauauuuuc

SEQ ID NO: 119861 - RNA, 64 nt, Homo Sapiens
uuaaaugugggagguaaggaaaaggauuuagagguaaaaguacacuaaguuugcaacauuuauu

SEQ ID NO: 119862 - RNA, 64 nt, Homo Sapiens
uuguuuuuuaucuuuaacuccauagcaauuuacauaaaaguauaauuacuguaaacuacauugc

SEQ ID NO: 119863 - RNA, 64 nt, Homo Sapiens
guuuacauccuuuuggaaaggagaugacagugccuaaaaguacaauugguaaaggaaauuugaa

SEQ ID NO: 119864 - RNA, 64 nt, Homo Sapiens
uuauugcuauuuaauaaaaaauuuuauugaguuauaaaaguaucuccgaauguaucauugaaua

SEQ ID NO: 119865 - RNA, 64 nt, Homo Sapiens
gaaaaaugcuuuuuaguacuggauuaaucuuaccuaaaaguacuacauaugcuaguguuuaguu

SEQ ID NO: 119866 - RNA, 64 nt, Homo Sapiens
auuguuucagagucacaguuucuauucucaaaguuaaaaguaaaucuucuguguuuauggccaa

SEQ ID NO: 119867 - RNA, 64 nt, Homo Sapiens
aaauuuugugaugaauaaaacuggucucuaaguguaaaaguagugguaaugguacauacguuca

SEQ ID NO: 119868 - RNA, 64 nt, Homo Sapiens
uauaaaacaauuguuuacguguacuuuuaacuuuuaaaaguacuuaauuaacauauguuguuug

SEQ ID NO: 119869 - RNA, 64 nt, Homo Sapiens
uuaaaugugaaauugaucugcaucagcuuauuuauaaaaguaauguuauuuccaagaaaauguu

SEQ ID NO: 119870 - RNA, 64 nt, Homo Sapiens
cuuaacucuucaagcaagauaaauucauacuuuauaaaaguaucaaugcuguagauggauggaa

SEQ ID NO: 119871 - RNA, 64 nt, Homo Sapiens
auuguuacaacuaacacaaauuccuauuaaauauuaaaaguaguucugguuuauuaaucaacgg

SEQ ID NO: 119872 - RNA, 64 nt, Homo Sapiens
aguagacguauauuguccguuaaauauuuacuuauaaaaguacaaaauugaccuccgguauaua

SEQ ID NO: 119873 - RNA, 64 nt, Homo Sapiens
gauccauuauccuuugaagaaaucacaaauuggcuaaaaguacucuccaucaggcaaaauuuaa

SEQ ID NO: 119874 - RNA, 64 nt, Homo Sapiens
aacauuauuuccaccauaaaccggacuguguaaguaaaaguacaaguguuuuagaaacaugagu

SEQ ID NO: 119875 - RNA, 64 nt, Homo Sapiens
agacuacacauuacauugaacacuuguaccccacuaaaaguauuuucuaaaauaacauuccucu

SEQ ID NO: 119876 - RNA, 64 nt, Homo Sapiens
agaauaaacacaacaauuaaauaggacucccaaauaaaaguaucuacacaugucauuuugugau

SEQ ID NO: 119877 - RNA, 64 nt, Homo Sapiens
uguuaugugcacuuaagccgguuaucagaauuaauaaaaguaucuucuuuccaccauucaggag

SEQ ID NO: 119878 - RNA, 64 nt, Homo Sapiens
auuuggguuucacuccauaugucauaaagggcacuaaaaguaacacucagguuagaacaaaaau

SEQ ID NO: 119879 - RNA, 64 nt, Homo Sapiens
auaguaacguauuguccuucaaaaguuauuacacuaaaaguauuaauuuuuucauaauucaaac

SEQ ID NO: 119880 - RNA, 64 nt, Homo Sapiens
uguuuuaccuuuggugugcauuauaaaugugcaauaaaaguauuuugauacaacuaugcagauu

SEQ ID NO: 119881 - RNA, 64 nt, Homo Sapiens
ggauguggguuuguacaaaauucuuuuuugcccuuaaaaguaagacaagucaucguacccggcc

SEQ ID NO: 119882 - RNA, 64 nt, Homo Sapiens
uuaugacuugacauuuccuugaucuguuggaggcuaaaaguagguauaaaugauauugaauguu

SEQ ID NO: 119883 - RNA, 64 nt, Homo Sapiens
auuuaggcuggcaauauauauauuaaccauauuuuaaaaguaccaauuuuguuuuuacagaaaa

SEQ ID NO: 119884 - RNA, 64 nt, Homo Sapiens
uuucuugaaauaaucuaaaguugauaugauuuuguaaaaguauuaaaaaggaaaaauguaauaa

SEQ ID NO: 119885 - RNA, 64 nt, Homo Sapiens
auauucaaaaccacccagcaggggagaucaugccuaaaaguaauaaaaggaguaaaaacacauu

SEQ ID NO: 119886 - RNA, 64 nt, Homo Sapiens
gaggaaaucugacagggaaauuaucuguaugaacuaaaaguaagggaaccccggggaaugggag

SEQ ID NO: 119887 - RNA, 64 nt, Homo Sapiens
uuuguagagcugaguguuaauacgggccgagaaauaaaaguaucuucugcuccggcuguuucac

SEQ ID NO: 119888 - RNA, 64 nt, Homo Sapiens
cacauuugaauauuguguauuucauacuauucuuuaaaaguaaucuuauguccuuuccuacaug

SEQ ID NO: 119889 - RNA, 64 nt, Homo Sapiens
guuauugacuuuuguaacuuacuaauagggauguuaaaaguaacaaaaccaagucaaacuuggu

SEQ ID NO: 119890 - RNA, 64 nt, Homo Sapiens
agcauggauugccaauuccacccugcuuagauuuuaaaaguauacuuuuuagucuggauuucug

SEQ ID NO: 119891 - RNA, 64 nt, Homo Sapiens
cuggauccccugggguauuuuuguagucuucugauaaaaguagacagggcauuuauauaaagag

SEQ ID NO: 119892 - RNA, 64 nt, Homo Sapiens
uauuuuaaauuguuuucagcaguguuaaaugugauaaaaguacaguuccauuuucucucuugua

SEQ ID NO: 119893 - RNA, 64 nt, Homo Sapiens
uugcugucaaagaaacaccuuauuuucacggaauuaaaaguagcuaagugguguaguauuaaaa

SEQ ID NO: 119894 - RNA, 64 nt, Homo Sapiens
cuacuuuugacaacgccucaaacuuuucuaaccauaaaaguaauuauacuggugagaaauccua

SEQ ID NO: 119895 - RNA, 64 nt, Homo Sapiens
caguuauacuagaauauauuuuuuccagaugcaguaaaaguaaaauauuuaauccauaauuaag

SEQ ID NO: 119896 - RNA, 64 nt, Homo Sapiens
aauuuggggaacuaauaaauggcauaagaaauuauaaaaguauuuagagauugcaguaaagaca

SEQ ID NO: 119897 - RNA, 64 nt, Homo Sapiens
aauaccagcauacuugucuuugcacaacaccaacuaaaaguagucuggacugauuuuaacccgc

SEQ ID NO: 119898 - RNA, 64 nt, Homo Sapiens
acauaauuuuuuuuuuucucauauacuuauauaauaaaaguauauaacauacuuuuauuaaaau

SEQ ID NO: 119899 - RNA, 64 nt, Homo Sapiens
aauuuuuugcaguuauugcauuuguauauaacuuuaaaaguagaaaacuaaaauugguaaaaua

SEQ ID NO: 119900 - RNA, 64 nt, Homo Sapiens
uaaagguaaaagguuugaaauuuugcuaaauaacuaaaaguaugcaauguaggugcucaguacu

SEQ ID NO: 119901 - RNA, 64 nt, Homo Sapiens
gugaugagcaugccuaaaucggucaggaauuuaauaaaaguacaggcuuauaaaauaugaguau

SEQ ID NO: 119902 - RNA, 64 nt, Homo Sapiens
gaaaauuuaaguaaagucuuuuaaaugaaaccuguaaaaguauugacucuucuaccaaguuggu

SEQ ID NO: 119903 - RNA, 64 nt, Homo Sapiens
gcaacucauguuauggguuaaaugaauauuuuuguaaaaguaaaagcaacaaauuuauaaauug

SEQ ID NO: 119904 - RNA, 64 nt, Homo Sapiens
agccauuuguuguaaaugccaugagaaucaguuauaaaaguauuugauguaauguuuauaagcu

SEQ ID NO: 119905 - RNA, 64 nt, Homo Sapiens
ucucuuagcaguuuuuguuuuuaacauuuuaauuuaaaaguauucauaauucucagguguacug

SEQ ID NO: 119906 - RNA, 64 nt, Homo Sapiens
auauacuucaugcuguuuauaauuucaucugucuuaaaaguaaaugccuaaagcugugccuaga

SEQ ID NO: 119907 - RNA, 64 nt, Homo Sapiens
uauauguuacuguauugcaauagaaaaauuacuuuaaaaguagcccucuugcagaaagaagcau

SEQ ID NO: 119908 - RNA, 64 nt, Homo Sapiens
auuuuuccaauagauuucauccuauaaagauuuguaaaaguaaaguacaaacauugaacaauua

SEQ ID NO: 119909 - RNA, 64 nt, Homo Sapiens
uuaagugaucauggaucauuaccaaacacucauuuaaaaguaggacuuuaauaccaaacuuaaa

SEQ ID NO: 119910 - RNA, 64 nt, Homo Sapiens
agggcccaggaucaagucacucaucucagaauguccccaccaauccccgccacagcaggcgccu

SEQ ID NO: 119911 - RNA, 64 nt, Homo Sapiens
aggucugcccugcuugcaaauccacuagcaccgaccccaccaccugguuccggcucugcacgcu

SEQ ID NO: 119912 - RNA, 64 nt, Homo Sapiens
agucgccccuggaagcagauucccauugaguuuuccccaccaaggggaccaugcacaugguaga

SEQ ID NO: 119913 - RNA, 64 nt, Homo Sapiens
cgggccuguggugggaagacgggcaacaaguauaccccaccagggccugagugacuagaggaag

SEQ ID NO: 119914 - RNA, 64 nt, Homo Sapiens
uccuugcuaaucugagcuacuuagaguguggucuccccaccaacuccaguuuugugcccuaagc

SEQ ID NO: 119915 - RNA, 64 nt, Homo Sapiens
agagggugaaaaagagaaaugugagcauccgcucccccaccaccccgcccagccccuagcccca

SEQ ID NO: 119916 - RNA, 64 nt, Homo Sapiens
ucaguggaacacaccauucuaagaggacacccccccccaccaccagcuuucagggacagugggc

SEQ ID NO: 119917 - RNA, 64 nt, Homo Sapiens
uucacuggcuggggggcucuccucuuucuguaccccccaccauuagagggggaugcucucaucc

SEQ ID NO: 119918 - RNA, 64 nt, Homo Sapiens
aggguaggagagagccuggaucucuggccccaacccccaccagaccucaugcccuggacacugc

SEQ ID NO: 119919 - RNA, 64 nt, Homo Sapiens
cagagaugggagguggugaggcguccucaccuccccccaccacagcuguggcugguaaggcaac

SEQ ID NO: 119920 - RNA, 64 nt, Homo Sapiens
gccacacucagugccauggggaagcgggcgucucccccaccagccccaccaggcgguguagggg

SEQ ID NO: 119921 - RNA, 64 nt, Homo Sapiens
agugccauggggaagcgggcgucucccccaccagccccaccaggcgguguaggggcagcaggcu

SEQ ID NO: 119922 - RNA, 64 nt, Homo Sapiens
accucuguggccuccauggucucccaccccaucuccccaccaccuuucugaucaugccccuucu

SEQ ID NO: 119923 - RNA, 64 nt, Homo Sapiens
uguauuuucuaggauuugagaauuuccuuagcuuccccaccauaaagggggaaaagccaauaga

SEQ ID NO: 119924 - RNA, 64 nt, Homo Sapiens
cagcaaugaggccugaccuuuuuugcuauaaccgccccaccacuccccugcccuugccaacauc

SEQ ID NO: 119925 - RNA, 64 nt, Homo Sapiens
gugugcaagcacacaucacuuuagaggggcugcgccccaccagauaggaaggggaggauuuucu

SEQ ID NO: 119926 - RNA, 64 nt, Homo Sapiens
guuuguggucuaaggaugucuugagcccugugugccccaccauucaugaccucuguauucucua

SEQ ID NO: 119927 - RNA, 64 nt, Homo Sapiens
gcaagggggcagaucccagagccccucucaccccccccaccacaggccugcuccuuccuuagcc

SEQ ID NO: 119928 - RNA, 64 nt, Homo Sapiens
ugcagauuucuugcugcuucggccaggcuucucuccccaccaccagggcccguuggguagcugg

SEQ ID NO: 119929 - RNA, 64 nt, Homo Sapiens
gcgggugucacucacgcacuagacucccuagugcccccaccaugggauacagggagcagccagg

SEQ ID NO: 119930 - RNA, 64 nt, Homo Sapiens
gacccagcggcuucuucacucauguuuguagcucccccaccaaaauacagcagccaacaacacc

SEQ ID NO: 119931 - RNA, 64 nt, Homo Sapiens
uuccgccaggugugccuggccuggggggccuccaccccaccauccagcaugcagccacuucacc

SEQ ID NO: 119932 - RNA, 64 nt, Homo Sapiens
ccccccaaccaccagcagcagcagggcccuccucccccaccagcucuccccacagggccccuca

SEQ ID NO: 119933 - RNA, 64 nt, Homo Sapiens
agcuccccuuccuugcccgccucuccccccgccgccccaccaguuaaacggaugaccaaagacc

SEQ ID NO: 119934 - RNA, 64 nt, Homo Sapiens
aggggcuggggagcucagcuuggucucagagucuccccaccagauacuguuuaaaaaaguagca

SEQ ID NO: 119935 - RNA, 64 nt, Homo Sapiens
ugccaggcccggccacugagagcagcugcugcugccccaccacccccuuccuggaucuggagag

SEQ ID NO: 119936 - RNA, 64 nt, Homo Sapiens
uccuggaagaggagggggccagucacugugccagccccaccacaacccggccccuucccccagg

SEQ ID NO: 119937 - RNA, 64 nt, Homo Sapiens
ucccccucccauagggcugccagucccuguggucccccaccagccuggccugccuuucuuuggu

SEQ ID NO: 119938 - RNA, 64 nt, Homo Sapiens
gugucacaugggcugccaggaggggcucccauccccccaccauugcuggcaguguuggccacgu

SEQ ID NO: 119939 - RNA, 64 nt, Homo Sapiens
uggccucuuagacuagucauaguggauuuguuuuccccaccaaggggauuaagaccagaauauc

SEQ ID NO: 119940 - RNA, 64 nt, Homo Sapiens
cacccccacacacgucaucuccuucucucucuccccccaccacccccucucucucucugucucu

SEQ ID NO: 119941 - RNA, 64 nt, Homo Sapiens
ccuacacaucuugccagccccccuggcuaugcacccccaccauuccccuggccucgggagcggc

SEQ ID NO: 119942 - RNA, 64 nt, Homo Sapiens
uuugugaguauuucagaggggccuuccaguauggccccaccaugacuacacaggcaugcccagu

SEQ ID NO: 119943 - RNA, 64 nt, Homo Sapiens
cccuaugaccccccaucuuuccuccgccccugacccccaccacccugcugcucggacuaugcuc

SEQ ID NO: 119944 - RNA, 64 nt, Homo Sapiens
uagaagagcaucagggcugcucucugaggagcugccccaccagccauccuugaagagacaauuc

SEQ ID NO: 119945 - RNA, 64 nt, Homo Sapiens
ugcacugccccccacauucuccuuuccugcccuuccccaccaccacagugcucccgagagccug

SEQ ID NO: 119946 - RNA, 64 nt, Homo Sapiens
ccccaucccagaggccuugcccaccccuacccuaccccaccacaagugccuucaaaacccaccc

SEQ ID NO: 119947 - RNA, 64 nt, Homo Sapiens
agcguuucuaggacagaggggccucccagucuccccccaccacccgugcacgacuuccucacca

SEQ ID NO: 119948 - RNA, 64 nt, Homo Sapiens
gcucugccuggacuuggagagaugggaggcagacccccaccaccauacaugcugucuguggccc

SEQ ID NO: 119949 - RNA, 64 nt, Homo Sapiens
accacgugcagguggagcucgggcuuccccagcgccccaccaccgcacauuagcgaccaggcuu

SEQ ID NO: 119950 - RNA, 64 nt, Homo Sapiens
cgccugccccgcggaagaccucgguuuccuguccccccaccaccacuccucucuuggauccgcc

SEQ ID NO: 119951 - RNA, 64 nt, Homo Sapiens
uccucucccugggaucuggaauuaaaucgcacacccccaccauuccauaccgaaauuuucugaa

SEQ ID NO: 119952 - RNA, 64 nt, Homo Sapiens
ugagccauugcagggggcagggaaguucacccccccccaccacccccccgcccccccgaagcca

SEQ ID NO: 119953 - RNA, 64 nt, Homo Sapiens
gaaaaggccugggggggaugguauauggcccuuuccccaccaggcgcuaaggggaacacccccu

SEQ ID NO: 119954 - RNA, 64 nt, Homo Sapiens
cccuuggaauuuucuggcacuuccucucuauugcccccaccaccaccacccccaucacugcuuu

SEQ ID NO: 119955 - RNA, 64 nt, Homo Sapiens
gguaggaaugggccggcgauugggaccagcugggccccaccacggccacgccaggcaaagcgcc

SEQ ID NO: 119956 - RNA, 64 nt, Homo Sapiens
cugccccccacccacccugcaccccucgcccuccccccaccacagaaucuaagaccuuucagcu

SEQ ID NO: 119957 - RNA, 64 nt, Homo Sapiens
uaggccacuccuccaaaggauacucagcccugggccccaccaccgaacuccuggaaauaucagu

SEQ ID NO: 119958 - RNA, 64 nt, Homo Sapiens
auguggcccuggccugcuggugaaucagacccuaccccaccacggacucaccucugccucaaug

SEQ ID NO: 119959 - RNA, 64 nt, Homo Sapiens
cuucugaucuuagggguuggccugccuuccagugccccaccaccaggcaugggccaaucccauu

SEQ ID NO: 119960 - RNA, 64 nt, Homo Sapiens
uucagaucuguuccucuggauucaacugauccuuccccaccaucacucuuaucagcuuagagug

SEQ ID NO: 119961 - RNA, 64 nt, Homo Sapiens
ccucuuugcauugcccauuuaugcccauucccgcccccaccaugcuagguuugugcuucuagcc

SEQ ID NO: 119962 - RNA, 58 nt, Homo Sapiens
accgacucucccaacccagaagaugagcccccaccaccugaccuucucuuuuagauaa

SEQ ID NO: 119963 - RNA, 64 nt, Homo Sapiens
ccugugacacuggcguucuccucuccccuccuucccccaccacaggucucuccugcauaggcag

SEQ ID NO: 119964 - RNA, 64 nt, Homo Sapiens
uucccuguugcaugagccugcgacaggaccucacccccaccaccaggcuucuauuugggauuca

SEQ ID NO: 119965 - RNA, 64 nt, Homo Sapiens
cuuguaaugaucaugucagccuucagaagagaauccccaccaacuucugugccuccucagaugg

SEQ ID NO: 119966 - RNA, 64 nt, Homo Sapiens
gauccccugccaucuugccuuaggaacagccuucccccaccagcagccauggcuggcuggggcu

SEQ ID NO: 119967 - RNA, 64 nt, Homo Sapiens
gaguuggcccugagcucuauccaccaagccagcaccccaccaucccuuugcaggggagucaaag

SEQ ID NO: 119968 - RNA, 64 nt, Homo Sapiens
aucucuucuccuuccccuuucugagaaacgucauccccaccaguuaacguuuccuguacacccu

SEQ ID NO: 119969 - RNA, 64 nt, Homo Sapiens
agguugucuucacugggagcguggggcccccaggccccaccagcaccguccuccccuaaugagg

SEQ ID NO: 119970 - RNA, 64 nt, Homo Sapiens
gaaaaggaaagcacaggcuaagcaguugaagguuccccaccauucagugagagcagaaccccca

SEQ ID NO: 119971 - RNA, 55 nt, Homo Sapiens
uugguucagcacuguccugacugcuccccaccagcacgcugaccugugaacccca

SEQ ID NO: 119972 - RNA, 64 nt, Homo Sapiens
ugucggggguguggggcugcccuggggcccgugcccccaccaggccagccccugcuggguucag

SEQ ID NO: 119973 - RNA, 64 nt, Homo Sapiens
cucccuaccuccuuaacuuuguccgcccccuccuccccaccauccucccgcguccugcagggua

SEQ ID NO: 119974 - RNA, 64 nt, Homo Sapiens
cagagccuuccgaagccaacaugguacauuccggccccaccacuccaaccccauugcuaacaac

SEQ ID NO: 119975 - RNA, 64 nt, Homo Sapiens
ccuuucacuccauccccugcaucgggagcaauacccccaccaccccagacccuucccccaccac

SEQ ID NO: 119976 - RNA, 64 nt, Homo Sapiens
ucgggagcaauacccccacccucccagacccuucccccaccacaggccccccccacccuucucu

SEQ ID NO: 119977 - RNA, 64 nt, Homo Sapiens
ggcccccgucagggagaggucaccagcugcugugccccaccacgucuggcucccugccccuuaa

SEQ ID NO: 119978 - RNA, 64 nt, Homo Sapiens
uggagggaaggauaaagccacuucuggcuucagcccccaccaggggaaggaaggagggcacauu

SEQ ID NO: 119979 - RNA, 64 nt, Homo Sapiens
gcuucucaacaaccauguuacuccacuuccccacccccaccaggccucccuccuccccuccuac

SEQ ID NO: 119980 - RNA, 64 nt, Homo Sapiens
cuccuccccuccuacucccuuuucucacucucauccccaccacagaucccuggauugcugggaa

SEQ ID NO: 119981 - RNA, 64 nt, Homo Sapiens
uuuaaacguggauuguuuaaagaagcucuccaggccccaccaagaggguggaucacaccucagu

SEQ ID NO: 119982 - RNA, 64 nt, Homo Sapiens
gcacaacugaaauuuccccacucuguuggggcuuccccaccacauucaugucccucucccgugu

SEQ ID NO: 119983 - RNA, 64 nt, Homo Sapiens
uuucccuucaaaauagcaccgggcuuugggguauccccaccaacaaccauucuacucuucuggu

SEQ ID NO: 119984 - RNA, 64 nt, Homo Sapiens
ucugaaugucuaaccugcucucucuacucacagcccccaccagcagcaauauacuuaaccugaa

SEQ ID NO: 119985 - RNA, 64 nt, Homo Sapiens
accagcucccuggccucccuacccucccugaaccccccaccacuucccccuuucaccagaugcc

SEQ ID NO: 119986 - RNA, 64 nt, Homo Sapiens
uggagaauuacaaggguuuuaaccuauuuaaaaaccccaccauuaaaacagggaguugaagucc

SEQ ID NO: 119987 - RNA, 64 nt, Homo Sapiens
ucugugcccugcacugucccaugcaggccacucuccccaccacgcuaguaaaggaacuaugcaa

SEQ ID NO: 119988 - RNA, 55 nt, Homo Sapiens
ucugcucgagagguccguggggcacccccaccaccaggggaaguugaaacccuag

SEQ ID NO: 119989 - RNA, 64 nt, Homo Sapiens
ccauaggucgccccagggccucugcccacccgagccccaccacucucagaacccccgcccagcg

SEQ ID NO: 119990 - RNA, 64 nt, Homo Sapiens
gguuggguggauggagcucagaaggaaaccccagccccaccacggaugacaccaucccucccgu

SEQ ID NO: 119991 - RNA, 64 nt, Homo Sapiens
ggccugagaccccgguugcccauucauggcugcaccccaccaugucaaacccaagaccagcccc

SEQ ID NO: 119992 - RNA, 64 nt, Homo Sapiens
aguggggccugagcugagcacugcccccucacccccccaccaccccuucccauuucaucggugg

SEQ ID NO: 119993 - RNA, 64 nt, Homo Sapiens
gagggcaccccauccucagugcccaaugcuguggccccaccaggcccagagccugguuggccau

SEQ ID NO: 119994 - RNA, 64 nt, Homo Sapiens
ccacacugaccacccucaacccauugcgcccaguccccaccacagugaccacacccucacuggc

SEQ ID NO: 119995 - RNA, 64 nt, Homo Sapiens
gggcuagcuaaaggguggggagagggaagaugggccccaccacgcucucaagagaacgcaccug

SEQ ID NO: 119996 - RNA, 64 nt, Homo Sapiens
uuuuuccccuuuucuguucauuucaucuggcuccccccaccaccuccccaccccaccccccacc

SEQ ID NO: 119997 - RNA, 64 nt, Homo Sapiens
ucccggaccccagggaggugcugagcuguccagaccccaccaucuccacagggccuuggguucc

SEQ ID NO: 119998 - RNA, 64 nt, Homo Sapiens
cauagcaggaauggcaggaauggggugugggcguccccaccacgggcugggagccggcaggguu

SEQ ID NO: 119999 - RNA, 62 nt, Homo Sapiens
gcauggcgcccugucucuguguggauccugcauuccccaccaagucuuccugcaauaaaaaa

SEQ ID NO: 120000 - RNA, 64 nt, Homo Sapiens
ugugccccagagagcagggccccacccacuuccuccccaccacccgccccggacagaggucugc

SEQ ID NO: 120001 - RNA, 64 nt, Homo Sapiens
acagccccagaaggagcagcccccaucucccucuccccaccaaggggucagcagggacccacug

SEQ ID NO: 120002 - RNA, 64 nt, Homo Sapiens
gcuuugcagauguccuugaauggcccaggccccuccccaccaggcaagaguuccaaagagccuc

SEQ ID NO: 120003 - RNA, 64 nt, Homo Sapiens
ccauacagcguguguguggacuggagaaggguguccccaccagcccugaggucuggagaaaccc

SEQ ID NO: 120004 - RNA, 64 nt, Homo Sapiens
gcugcaccccgcagcagcaugguggugagggucuccccaccaguuggcaggccccugugugugg

SEQ ID NO: 120005 - RNA, 64 nt, Homo Sapiens
guugcagcuaggucggggccccaguuaagcugugccccaccacccuaggcaaugaggggcagga

SEQ ID NO: 120006 - RNA, 64 nt, Homo Sapiens
cuccaccucaaagucauuugacugcccccauccaccccaccacccuaaucuuccaccaccucuc

SEQ ID NO: 120007 - RNA, 64 nt, Homo Sapiens
uguucuccucgagggcuccagcauccucugcuucccccaccacguucccaucacccaccucauu

SEQ ID NO: 120008 - RNA, 64 nt, Homo Sapiens
acuguaguggccuuuggagaugcccccaccucccccccaccaacucucgcguguuggagagaag

SEQ ID NO: 120009 - RNA, 64 nt, Homo Sapiens; identical to SEQ ID NO: 76855

SEQ ID NO: 120010 - RNA, 64 nt, Homo Sapiens; identical to SEQ ID NO: 76856

SEQ ID NO: 120011 - RNA, 64 nt, Homo Sapiens; identical to SEQ ID NO: 76857

SEQ ID NO: 120012 - RNA, 64 nt, Homo Sapiens; identical to SEQ ID NO: 76858

SEQ ID NO: 120013 - RNA, 64 nt, Homo Sapiens; identical to SEQ ID NO: 76859

SEQ ID NO: 120014 - RNA, 64 nt, Homo Sapiens; identical to SEQ ID NO: 76860

SEQ ID NO: 120015 - RNA, 64 nt, Homo Sapiens; identical to SEQ ID NO: 76861

SEQ ID NO: 120016 - RNA, 64 nt, Homo Sapiens; identical to SEQ ID NO: 76862

SEQ ID NO: 120017 - RNA, 64 nt, Homo Sapiens; identical to SEQ ID NO: 76863

SEQ ID NO: 120018 - RNA, 64 nt, Homo Sapiens; identical to SEQ ID NO: 76864

SEQ ID NO: 120019 - RNA, 64 nt, Homo Sapiens; identical to SEQ ID NO: 76865

SEQ ID NO: 120020 - RNA, 64 nt, Homo Sapiens; identical to SEQ ID NO: 76866

SEQ ID NO: 120021 - RNA, 64 nt, Homo Sapiens; identical to SEQ ID NO: 76867

SEQ ID NO: 120022 - RNA, 64 nt, Homo Sapiens; identical to SEQ ID NO: 76868

SEQ ID NO: 120023 - RNA, 64 nt, Homo Sapiens; identical to SEQ ID NO: 76869

SEQ ID NO: 120024 - RNA, 64 nt, Homo Sapiens; identical to SEQ ID NO: 76870

SEQ ID NO: 120025 - RNA, 64 nt, Homo Sapiens; identical to SEQ ID NO: 101929

SEQ ID NO: 120026 - RNA, 64 nt, Homo Sapiens; identical to SEQ ID NO: 101930

SEQ ID NO: 120027 - RNA, 64 nt, Homo Sapiens; identical to SEQ ID NO: 101931

SEQ ID NO: 120028 - RNA, 64 nt, Homo Sapiens; identical to SEQ ID NO: 101932

SEQ ID NO: 120029 - RNA, 64 nt, Homo Sapiens; identical to SEQ ID NO: 101933

SEQ ID NO: 120030 - RNA, 64 nt, Homo Sapiens; identical to SEQ ID NO: 101934

SEQ ID NO: 120031 - RNA, 64 nt, Homo Sapiens; identical to SEQ ID NO: 101935

SEQ ID NO: 120032 - RNA, 64 nt, Homo Sapiens; identical to SEQ ID NO: 101936

SEQ ID NO: 120033 - RNA, 64 nt, Homo Sapiens; identical to SEQ ID NO: 101937

SEQ ID NO: 120034 - RNA, 64 nt, Homo Sapiens; identical to SEQ ID NO: 101938

SEQ ID NO: 120035 - RNA, 64 nt, Homo Sapiens; identical to SEQ ID NO: 101939

SEQ ID NO: 120036 - RNA, 64 nt, Homo Sapiens; identical to SEQ ID NO: 101940

SEQ ID NO: 120037 - RNA, 64 nt, Homo Sapiens; identical to SEQ ID NO: 101941

SEQ ID NO: 120038 - RNA, 64 nt, Homo Sapiens; identical to SEQ ID NO: 101942

SEQ ID NO: 120039 - RNA, 64 nt, Homo Sapiens; identical to SEQ ID NO: 101943

SEQ ID NO: 120040 - RNA, 64 nt, Homo Sapiens; identical to SEQ ID NO: 101944

SEQ ID NO: 120041 - RNA, 64 nt, Homo Sapiens; identical to SEQ ID NO: 101945

SEQ ID NO: 120042 - RNA, 64 nt, Homo Sapiens; identical to SEQ ID NO: 101946

SEQ ID NO: 120043 - RNA, 64 nt, Homo Sapiens; identical to SEQ ID NO: 101947

SEQ ID NO: 120044 - RNA, 64 nt, Homo Sapiens
gccugacacugcgcucuagccccgcgcgccguggcaccccaacaccggcagggaaccuacccuc

SEQ ID NO: 120045 - RNA, 64 nt, Homo Sapiens
ccuacccucggcucccgggucuccccucccucgccaccccaaccagcggcuucugcgccgcccu

SEQ ID NO: 120046 - RNA, 64 nt, Homo Sapiens
aaccccaagagacuucacacaacacuuauguaugcaccccaaagacuaauggggagagggaggg

SEQ ID NO: 120047 - RNA, 64 nt, Homo Sapiens
ggaagccaggaaagcuugguguuuucucuggguacaccccaagcagcgucuccuuuuggauaca

SEQ ID NO: 120048 - RNA, 64 nt, Homo Sapiens
aaccuaugucacugacucagaugcagggucugcucaccccaacacaugccuucccuccccagcc

SEQ ID NO: 120049 - RNA, 64 nt, Homo Sapiens
gcauggccucugcccauccugcaccuguccaccccaccccaacacccuggaagccacugucaau

SEQ ID NO: 120050 - RNA, 64 nt, Homo Sapiens
uucaucugugaccuccaggcgcuggagcaucggccaccccaagacuuuuuugcaccccaaguug

SEQ ID NO: 120051 - RNA, 64 nt, Homo Sapiens
uggcuggagcaucggccaccucaugucuuuuuugcaccccaagugcucccgagaagaggagcgc

SEQ ID NO: 120052 - RNA, 64 nt, Homo Sapiens
cgagagaaggaacagcuguggaacaggcuuuuuacaccccaagugcaugggguugcucgcccac

SEQ ID NO: 120053 - RNA, 64 nt, Homo Sapiens
auaugcugaauuuuuuuaagcaaauggaucauggcaccccaaaaugaaaguuauagaaagcugu

SEQ ID NO: 120054 - RNA, 64 nt, Homo Sapiens
ccagacuucacacaguauucgugacaccaagacccaccccaauccuucaccggcacccucaccu

SEQ ID NO: 120055 - RNA, 64 nt, Homo Sapiens
gcuauuacagagacuggaguggaggcuggaaaagcaccccaagauuuguugccauuuugguuug

SEQ ID NO: 120056 - RNA, 64 nt, Homo Sapiens
auaguguguguguuuuguauacacuguaugaccccaccccaaaucuuuguauuguccacauucu

SEQ ID NO: 120057 - RNA, 64 nt, Homo Sapiens
aaguuucaugaaucuguaacuagaauuuaauuuucaccccaauaauguucuauauagccuuugc

SEQ ID NO: 120058 - RNA, 64 nt, Homo Sapiens
uccucaaaucaaaagccuucuggacacucacuuccaccccaaacuucacauccagaaauucugu

SEQ ID NO: 120059 - RNA, 64 nt, Homo Sapiens
acuccaggcuccccuaaagaucacagcccaggcucaccccaagacuuucuuguuaugccuucca

SEQ ID NO: 120060 - RNA, 64 nt, Homo Sapiens
agggcaagagcuguggaaaauaaccccaccuccccaccccaaaauaaucauucacauguaaaaa

SEQ ID NO: 120061 - RNA, 64 nt, Homo Sapiens
ccaccuucacccucuuccuuuacccaacuacccccaccccaaucugacuaaggacugagccccc

SEQ ID NO: 120062 - RNA, 64 nt, Homo Sapiens
gcacccucuccagaugcagcuccagaugagaguacaccccaacauacaccccaacagcacccuc

SEQ ID NO: 120063 - RNA, 64 nt, Homo Sapiens
gcacccucuccagaugagaguccagaugagaguacaccccaacauacaccccaacagcacccuc

SEQ ID NO: 120064 - RNA, 64 nt, Homo Sapiens
gcacccucuccagaugagaguccagaugagaguacaccccaacagugcccccaacagcacccuc

SEQ ID NO: 120065 - RNA, 64 nt, Homo Sapiens
gcacccucuccagaugggagccuucccaggaguacaccccaacaccgcuccucuauggccccug

SEQ ID NO: 120066 - RNA, 64 nt, Homo Sapiens
aucugaaccauuccugucuucuccccccaccuuccaccccaaccagcuuccucugacgguuacc

SEQ ID NO: 120067 - RNA, 54 nt, Homo Sapiens
ccccggccaagccuggacuccucccaccccaagcggcugcugccugcgcccuga

SEQ ID NO: 120068 - RNA, 64 nt, Homo Sapiens
gaggccagggaggggaacucagcaguucaggagccaccccaaaccauucugggacagggacacc

SEQ ID NO: 120069 - RNA, 64 nt, Homo Sapiens
acccucucggccaucccacgagggucgccaugaucaccccaacucuagaggccgcagcagagcu

SEQ ID NO: 120070 - RNA, 64 nt, Homo Sapiens
ccucugcaaccacgaaucgacccaacccaucggccaccccaagcgcacccaucagccaacacuc

SEQ ID NO: 120071 - RNA, 64 nt, Homo Sapiens
agaaauccugcacccaucaguuuagaaaguuuaucaccccaaagaccauuaucacuagaucaau

SEQ ID NO: 120072 - RNA, 64 nt, Homo Sapiens
ugggccucucuuuucucagggacuuuguauuuuccacuucuaacgaggugaaucuucuuugaca

SEQ ID NO: 120073 - RNA, 64 nt, Homo Sapiens
agggccaaaaagagaaaagauguggaagcuaaaacacuucuacuuauuugcccauuucuaucac

SEQ ID NO: 120074 - RNA, 64 nt, Homo Sapiens
ugguuuuuugaucaguguagagacuuuuaaaaagcacuucuacuuccugaagccuucguuuuca

SEQ ID NO: 120075 - RNA, 64 nt, Homo Sapiens
uuacaggugagggaaccaagugacuggcucuuaucacuucuaguuaucgguucauuuaaccugg

SEQ ID NO: 120076 - RNA, 64 nt, Homo Sapiens
aauaguaugauaaaugcacaauauuuaaauauugcacuucuauauacuguguuuuauuuugaaa

SEQ ID NO: 120077 - RNA, 64 nt, Homo Sapiens
aucaugcacugaauucaaaaagauuugacucaagcacuucuagagcauaaauggugacucuagu

SEQ ID NO: 120078 - RNA, 64 nt, Homo Sapiens
aaagucuuuucucaucaguagaaucuauuuuggucacuucuagucaaugaaaaauguaaacuuu

SEQ ID NO: 120079 - RNA, 64 nt, Homo Sapiens
uguuugaaugaaaaaugcuuauguauugacagaacacuucuagaaugauacccaaacuccugga

SEQ ID NO: 120080 - RNA, 63 nt, Homo Sapiens
ucuacaucacuggcugcucuuucacacuuugcccuaugacauuaguuuauuacauuuagcuug

SEQ ID NO: 120081 - RNA, 63 nt, Homo Sapiens
aacaaugugugggauaauguuuuaaguucaugucuaugacauggcagcaggaacuuuaaauuu

SEQ ID NO: 120082 - RNA, 63 nt, Homo Sapiens
uaaugaaccagcuacguauauagcccuaaauugcuaugacaacgcuaugcauagcuugggcaa

SEQ ID NO: 120083 - RNA, 63 nt, Homo Sapiens
uuacuucaaacuguguacugugguuggucauuucuaugacaauaauuguuuaucaucuugaca

SEQ ID NO: 120084 - RNA, 63 nt, Homo Sapiens
uggcacugcaggugagaaccccgcccauccgugcuaugacauggaggcacugaagcccgagga

SEQ ID NO: 120085 - RNA, 63 nt, Homo Sapiens
auuuaauccaaacagggguucuuagucucagcacuaugacauuuugggcugacuacuuauuug

SEQ ID NO: 120086 - RNA, 63 nt, Homo Sapiens
ucaaauuuucuauugccagaaaauuuucaaacacuaugacacagaccaguccggcaccaucaa

SEQ ID NO: 120087 - RNA, 63 nt, Homo Sapiens
ccccuccacaggauuccaccucaacaaccagcucuaugacaucauuaccaugcgguacgcaga

SEQ ID NO: 120088 - RNA, 63 nt, Homo Sapiens
ccgggacuuuuuuucuuuuuucuuuuuuuuuugcuaugacagaguaaugcuaacguaaggaca

SEQ ID NO: 120089 - RNA, 63 nt, Homo Sapiens
guucuggucuccaaguaucguuaagcacaggugcuaugacagaaaaaguucugggguggaagu

SEQ ID NO: 120090 - RNA, 64 nt, Homo Sapiens
ucucccuacccauuuggcucuggaagcugcuuggcccccccagaucagggccugggugaacucc

SEQ ID NO: 120091 - RNA, 64 nt, Homo Sapiens
ggagggagggcgucugaugcucucucucugccuccccccccauccugucaggcacaggugacgg

SEQ ID NO: 120092 - RNA, 64 nt, Homo Sapiens
ugucaacacugcauugucuuuugagcucuuuuuucccccccaacaaaguuuuuuuguuuuuugu

SEQ ID NO: 120093 - RNA, 64 nt, Homo Sapiens
uccccuuccuccuuacccucccucccuuacucuccccccccaccaccacccuccacccccaacu

SEQ ID NO: 120094 - RNA, 64 nt, Homo Sapiens
ccuguaagcagaagcagcauccaagugccccuggcccccccauguguugauucaacccgguucc

SEQ ID NO: 120095 - RNA, 64 nt, Homo Sapiens
agucuccccagcucccugaugaugcucacccccgcccccccaccucaggugcugcuggugugag

SEQ ID NO: 120096 - RNA, 64 nt, Homo Sapiens
cugcacaaagacacauacauucaccgcccccccgcccccccaacgcgcacacacacguccucuc

SEQ ID NO: 120097 - RNA, 64 nt, Homo Sapiens
aaccucauucaaauauuuacccgggacacacacccccccccacacacacacacagacacacuca

SEQ ID NO: 120098 - RNA, 64 nt, Homo Sapiens
guccuggcuaccagcucucaccuacacccacgcacccccccacacacuaugcucucucaagaau

SEQ ID NO: 120099 - RNA, 64 nt, Homo Sapiens
cacuaugcucucucaagaauguaauuuauuggggcccccccagcugcuuuccucaccugccccu

SEQ ID NO: 120100 - RNA, 64 nt, Homo Sapiens
ccuuguccuacguccaaggucggcccagaugugucccccccagguccauggcccugucccaggc

SEQ ID NO: 120101 - RNA, 64 nt, Homo Sapiens
uccaggaaagagcagucagaccaggcuggagacccccccccaacaaagggcuggcucccccucc

SEQ ID NO: 120102 - RNA, 64 nt, Homo Sapiens
ccuccucugccaggguuucugccgagggccugagcccccccaucuccuggugccccagacgggg

SEQ ID NO: 120103 - RNA, 64 nt, Homo Sapiens
cacccaggauguccuggcuccacuggagggcaagcccccccaccuaaccagugccuuuccuccc

SEQ ID NO: 120104 - RNA, 64 nt, Homo Sapiens
acauuugucucaccccugauauugguuccugaugcccccccaacaaaaauaaauaaauaaauua

SEQ ID NO: 120105 - RNA, 64 nt, Homo Sapiens
ugcuauacaaacauuuugcuaagucugcccaaagcccccccaaugcauuccuucaacaaaauac

SEQ ID NO: 120106 - RNA, 64 nt, Homo Sapiens
ccugccccuuggaagaguugacccgcccccccaccccccccaccgguggcaccucuccaccugu

SEQ ID NO: 120107 - RNA, 64 nt, Homo Sapiens
ccccccaccccugccccuuguccaccuguacccgcccccccaccccucuucccgguggcaccuc

SEQ ID NO: 120108 - RNA, 64 nt, Homo Sapiens
cccacuucaccccuccccaguccuuucuagccugcccccccaccacaccccgaggagggagggc

SEQ ID NO: 120109 - RNA, 64 nt, Homo Sapiens
ccgggcagggcccagugggaugucuucccacugucccccccauccuuccccgccacacccgcuc

SEQ ID NO: 120110 - RNA, 64 nt, Homo Sapiens
gguucugagcccuggcugcuuguccuccucgcaacccccccaggccggagcuuccuuccuuagc

SEQ ID NO: 120111 - RNA, 64 nt, Homo Sapiens
guggcacgccugccccaggaugcccccuuucccucccccccaugcccagagccccgccugccuc

SEQ ID NO: 120112 - RNA, 64 nt, Homo Sapiens
agcccucgauggacagccucgcccagagcccacgcccccccaaguuucugucucagcgggcagu

SEQ ID NO: 120113 - RNA, 64 nt, Homo Sapiens
cccuccccuccccauaccaaacaggcggaugugucccccccagcgacugacggacggacgacgg

SEQ ID NO: 120114 - RNA, 64 nt, Homo Sapiens
caaacaaaaaauacaauaaauauuugaacccccucccccccagcacaacccccccaaaacaacc

SEQ ID NO: 120115 - RNA, 64 nt, Homo Sapiens
aauaaauauuugaacccccucccccccagcacaacccccccaaaacaacccaacccacgaggac

SEQ ID NO: 120116 - RNA, 64 nt, Homo Sapiens
aacaauuugguaacacaccacaggaaguagcucucccccccagcccccuccucccucaagggag

SEQ ID NO: 120117 - RNA, 64 nt, Homo Sapiens
ccaccacucccccacccugaccgugcugaacagacccccccacacgagagaaaauaaaggagca

SEQ ID NO: 120118 - RNA, 64 nt, Homo Sapiens
agagcccgaggggcaccccagccccgccucugcucccccccaccccacccacccucggggcgcc

SEQ ID NO: 120119 - RNA, 64 nt, Homo Sapiens
cccccuucucugugacacaccucccugcccccgacccccccauacccaaccggcgggggggugu

SEQ ID NO: 120120 - RNA, 64 nt, Homo Sapiens
cccgcccgguccaccuagaccaccccucagggcgcccccccaccccggcgggacccccagggac

SEQ ID NO: 120121 - RNA, 64 nt, Homo Sapiens
aacacaaaaaaagaaaaucuaaaaucacccaccacccccccaaaagagacagagagagagaaaa

SEQ ID NO: 120122 - RNA, 64 nt, Homo Sapiens
gaggccuaggccccugccaccuccccacacaccccccccccaccaggcuccagagagggggcac

SEQ ID NO: 120123 - RNA, 64 nt, Homo Sapiens
acacuugaggccaaaggacacuggaggcagcccccccccccacacaccuuggcgucacgguggg

SEQ ID NO: 120124 - RNA, 64 nt, Homo Sapiens
gcuccuggaguucucaucggccuccccccccacccccccccacugaaucuucuggaggagccuc

SEQ ID NO: 120125 - RNA, 64 nt, Homo Sapiens
cccccccacugcuccuggaggaggagccucccuccccccccacccccguccuuagaaucuucug

SEQ ID NO: 120126 - RNA, 64 nt, Homo Sapiens
cucuagccugagcagugcaggggucugucuugggcccccccagauugggagacaaagggguaga

SEQ ID NO: 120127 - RNA, 64 nt, Homo Sapiens
guguggccccaccuguucuuccugcucuuuccuccccccccaagcccccaccaguauggcccca

SEQ ID NO: 120128 - RNA, 64 nt, Homo Sapiens
ccauuuguggaaaguggagaagguucuucccaagcuggcagaggucucaggacacaggucaugg

SEQ ID NO: 120129 - RNA, 64 nt, Homo Sapiens
gcaggcgaagggcaggaggacacagaggucucuccuggcagaaaguaccucauagccagcucua

SEQ ID NO: 120130 - RNA, 64 nt, Homo Sapiens
caaauaaacccagugucagggacuccccgucuuccuggcagacaguccauuuacgauucucacu

SEQ ID NO: 120131 - RNA, 64 nt, Homo Sapiens
cuuugagaauggggagaaacuuucuauaguucuccuggcagagccagagaccugggacucugua

SEQ ID NO: 120132 - RNA, 64 nt, Homo Sapiens
ggcagggagaauggggagagggaccuccuugugucuggcagagaccuguggaccuggccucccc

SEQ ID NO: 120133 - RNA, 64 nt, Homo Sapiens
ccccgccccugggguuggcagccucaguuggccccuggcagaggaacaaggacacagacauucc

SEQ ID NO: 120134 - RNA, 64 nt, Homo Sapiens
gguuuucuuucuccaugccagaguucaguuccuucuggcagagagaccuuccuuaggacuucca

SEQ ID NO: 120135 - RNA, 64 nt, Homo Sapiens
uagggggcugcuuugggcuuguggcgggucugggcuggcagaggacacccuccucuagaauuua

SEQ ID NO: 120136 - RNA, 64 nt, Homo Sapiens
ucauuuucaaaagcaauucuucggugcuguguagcuggcagaaaguucuguccaguaaacgcag

SEQ ID NO: 120137 - RNA, 64 nt, Homo Sapiens
gauggaagaaauagcaggagagaggacccauuagcuggcagacccagggggaagaaaggagggc

SEQ ID NO: 120138 - RNA, 64 nt, Homo Sapiens
agcaggauccucuuggccuuagacuagacgugaccuggcagauuaauucagucccucuccccaa

SEQ ID NO: 120139 - RNA, 64 nt, Homo Sapiens
aagaggccaucagaaggacgugugcccucagggacuggcagagcacaggcaaccuuguguucuc

SEQ ID NO: 120140 - RNA, 64 nt, Homo Sapiens
cggagcaugcccgagagccuggacagcccaaccucuggcagaccagggguuaccagccucacag

SEQ ID NO: 120141 - RNA, 64 nt, Homo Sapiens
cauauuuaauucaccagcaguaauccuuuaauaacuggcagagcacuuuauucuucuggugagc

SEQ ID NO: 120142 - RNA, 64 nt, Homo Sapiens
gaugccccauggugggcaggcagaugaugaaguacuggcagauuugcaggcugggaaggcuaga

SEQ ID NO: 120143 - RNA, 64 nt, Homo Sapiens
ccccacccuucucuccuuuccucauccuaagugccuggcagaugaaggaguuuucaggagcuuu

SEQ ID NO: 120144 - RNA, 64 nt, Homo Sapiens
gcccggccccuggggggaggaggcugcggccgggcuggcagaggccaguuggcgagggacacga

SEQ ID NO: 120145 - RNA, 64 nt, Homo Sapiens
guccuggugccccagacggggagggcccugggcucuggcagaugagguuccacaagugccucug

SEQ ID NO: 120146 - RNA, 64 nt, Homo Sapiens
gcuucagagcgagcacgacagggcucagaugcugcuggcagaguugucucgggagcggggugag

SEQ ID NO: 120147 - RNA, 64 nt, Homo Sapiens
ugugccccugccccggaccaagaagggcagcuggcuggcagacaaggugaagaggcugaugcgg

SEQ ID NO: 120148 - RNA, 64 nt, Homo Sapiens
uggcccugugugggaccacacugucaucucgcugcuggcagaaaagccugaucccaggaggccc

SEQ ID NO: 120149 - RNA, 64 nt, Homo Sapiens
gcggcacagccuggcagggaccucguccccaagccuggcagaaugagagggguugaggucccga

SEQ ID NO: 120150 - RNA, 64 nt, Homo Sapiens
cauagaccauggccuguuagcuugguccuuggggcuggcagaccuccuauagcugcugcuuuuu

SEQ ID NO: 120151 - RNA, 64 nt, Homo Sapiens
aaaaguggucccgcuaccauauagauccuuacagcuggcagaguugucccaccagcuguuucag

SEQ ID NO: 120152 - RNA, 64 nt, Homo Sapiens
ggaugaggagacagaauagagugauaggaagcgucuggcagauacuccuuuugccacugcugug

SEQ ID NO: 120153 - RNA, 64 nt, Homo Sapiens
aucugcccagacagccgcagugaggaugagcguccuggcagagacgcaguugucucugggcgcu

SEQ ID NO: 120154 - RNA, 64 nt, Homo Sapiens
uugugcccccuggagcaguggaggcgcacuguuccuggcagauagcgccccagcauuguguugu

SEQ ID NO: 120155 - RNA, 64 nt, Homo Sapiens
uuuccagaaggaggucacuuggcauaggaacaaucuggcagaaggaggaugaucagagaacuug

SEQ ID NO: 120156 - RNA, 64 nt, Homo Sapiens
ccgagggugccuggccagucccaaaugggggcugcuggcagaccggcccagggcaucgcuaaac

SEQ ID NO: 120157 - RNA, 64 nt, Homo Sapiens
ugggagcuccugucgaccgauggcagagagagcgcuggcagaucgggacgcuggcuggcucgac

SEQ ID NO: 120158 - RNA, 64 nt, Homo Sapiens
gagcgcuggcagaucugggagcuggcuggcucgacuggcagagaacaguccgcgccugggggac

SEQ ID NO: 120159 - RNA, 64 nt, Homo Sapiens; identical to SEQ ID NO: 83374

SEQ ID NO: 120160 - RNA, 64 nt, Homo Sapiens; identical to SEQ ID NO: 83375

SEQ ID NO: 120161 - RNA, 64 nt, Homo Sapiens; identical to SEQ ID NO: 83376

SEQ ID NO: 120162 - RNA, 64 nt, Homo Sapiens; identical to SEQ ID NO: 83377

SEQ ID NO: 120163 - RNA, 64 nt, Homo Sapiens; identical to SEQ ID NO: 83378

SEQ ID NO: 120164 - RNA, 64 nt, Homo Sapiens; identical to SEQ ID NO: 83379

SEQ ID NO: 120165 - RNA, 64 nt, Homo Sapiens; identical to SEQ ID NO: 83380

SEQ ID NO: 120166 - RNA, 64 nt, Homo Sapiens; identical to SEQ ID NO: 83381

SEQ ID NO: 120167 - RNA, 64 nt, Homo Sapiens; identical to SEQ ID NO: 83382

SEQ ID NO: 120168 - RNA, 64 nt, Homo Sapiens; identical to SEQ ID NO: 83383

SEQ ID NO: 120169 - RNA, 64 nt, Homo Sapiens; identical to SEQ ID NO: 83384

SEQ ID NO: 120170 - RNA, 64 nt, Homo Sapiens; identical to SEQ ID NO: 83385

SEQ ID NO: 120171 - RNA, 64 nt, Homo Sapiens; identical to SEQ ID NO: 83386

SEQ ID NO: 120172 - RNA, 64 nt, Homo Sapiens; identical to SEQ ID NO: 83387

SEQ ID NO: 120173 - RNA, 64 nt, Homo Sapiens; identical to SEQ ID NO: 83388

SEQ ID NO: 120174 - RNA, 64 nt, Homo Sapiens; identical to SEQ ID NO: 83389

SEQ ID NO: 120175 - RNA, 64 nt, Homo Sapiens; identical to SEQ ID NO: 83374

SEQ ID NO: 120176 - RNA, 64 nt, Homo Sapiens; identical to SEQ ID NO: 83375

SEQ ID NO: 120177 - RNA, 64 nt, Homo Sapiens; identical to SEQ ID NO: 83376

SEQ ID NO: 120178 - RNA, 64 nt, Homo Sapiens; identical to SEQ ID NO: 83377

SEQ ID NO: 120179 - RNA, 64 nt, Homo Sapiens; identical to SEQ ID NO: 83378

SEQ ID NO: 120180 - RNA, 64 nt, Homo Sapiens; identical to SEQ ID NO: 83379

SEQ ID NO: 120181 - RNA, 64 nt, Homo Sapiens; identical to SEQ ID NO: 83380

SEQ ID NO: 120182 - RNA, 64 nt, Homo Sapiens; identical to SEQ ID NO: 83381

SEQ ID NO: 120183 - RNA, 64 nt, Homo Sapiens; identical to SEQ ID NO: 83382

SEQ ID NO: 120184 - RNA, 64 nt, Homo Sapiens; identical to SEQ ID NO: 83383

SEQ ID NO: 120185 - RNA, 64 nt, Homo Sapiens; identical to SEQ ID NO: 83384

SEQ ID NO: 120186 - RNA, 64 nt, Homo Sapiens; identical to SEQ ID NO: 83385

SEQ ID NO: 120187 - RNA, 64 nt, Homo Sapiens; identical to SEQ ID NO: 83386

SEQ ID NO: 120188 - RNA, 64 nt, Homo Sapiens; identical to SEQ ID NO: 83387

SEQ ID NO: 120189 - RNA, 64 nt, Homo Sapiens; identical to SEQ ID NO: 83388

SEQ ID NO: 120190 - RNA, 64 nt, Homo Sapiens; identical to SEQ ID NO: 83389

SEQ ID NO: 120191 - RNA, 64 nt, Homo Sapiens; identical to SEQ ID NO: 83374

SEQ ID NO: 120192 - RNA, 64 nt, Homo Sapiens; identical to SEQ ID NO: 83375

SEQ ID NO: 120193 - RNA, 64 nt, Homo Sapiens; identical to SEQ ID NO: 83376

SEQ ID NO: 120194 - RNA, 64 nt, Homo Sapiens; identical to SEQ ID NO: 83377

SEQ ID NO: 120195 - RNA, 64 nt, Homo Sapiens; identical to SEQ ID NO: 83378

SEQ ID NO: 120196 - RNA, 64 nt, Homo Sapiens; identical to SEQ ID NO: 83379

SEQ ID NO: 120197 - RNA, 64 nt, Homo Sapiens; identical to SEQ ID NO: 83380

SEQ ID NO: 120198 - RNA, 64 nt, Homo Sapiens; identical to SEQ ID NO: 83381

SEQ ID NO: 120199 - RNA, 64 nt, Homo Sapiens; identical to SEQ ID NO: 83382

SEQ ID NO: 120200 - RNA, 64 nt, Homo Sapiens; identical to SEQ ID NO: 83383

SEQ ID NO: 120201 - RNA, 64 nt, Homo Sapiens; identical to SEQ ID NO: 83384

SEQ ID NO: 120202 - RNA, 64 nt, Homo Sapiens; identical to SEQ ID NO: 83385

SEQ ID NO: 120203 - RNA, 64 nt, Homo Sapiens; identical to SEQ ID NO: 83386

SEQ ID NO: 120204 - RNA, 64 nt, Homo Sapiens; identical to SEQ ID NO: 83387

SEQ ID NO: 120205 - RNA, 64 nt, Homo Sapiens; identical to SEQ ID NO: 83388

SEQ ID NO: 120206 - RNA, 64 nt, Homo Sapiens; identical to SEQ ID NO: 83389

SEQ ID NO: 120207 - RNA, 64 nt, Homo Sapiens; identical to SEQ ID NO: 83374

SEQ ID NO: 120208 - RNA, 64 nt, Homo Sapiens; identical to SEQ ID NO: 83375

SEQ ID NO: 120209 - RNA, 64 nt, Homo Sapiens; identical to SEQ ID NO: 83376

SEQ ID NO: 120210 - RNA, 64 nt, Homo Sapiens; identical to SEQ ID NO: 83377

SEQ ID NO: 120211 - RNA, 64 nt, Homo Sapiens; identical to SEQ ID NO: 83378

SEQ ID NO: 120212 - RNA, 64 nt, Homo Sapiens; identical to SEQ ID NO: 83379

SEQ ID NO: 120213 - RNA, 64 nt, Homo Sapiens; identical to SEQ ID NO: 83380

SEQ ID NO: 120214 - RNA, 64 nt, Homo Sapiens; identical to SEQ ID NO: 83381

SEQ ID NO: 120215 - RNA, 64 nt, Homo Sapiens; identical to SEQ ID NO: 83382

SEQ ID NO: 120216 - RNA, 64 nt, Homo Sapiens; identical to SEQ ID NO: 83383

SEQ ID NO: 120217 - RNA, 64 nt, Homo Sapiens; identical to SEQ ID NO: 83384

SEQ ID NO: 120218 - RNA, 64 nt, Homo Sapiens; identical to SEQ ID NO: 83385

SEQ ID NO: 120219 - RNA, 64 nt, Homo Sapiens; identical to SEQ ID NO: 83386

SEQ ID NO: 120220 - RNA, 64 nt, Homo Sapiens; identical to SEQ ID NO: 83387

SEQ ID NO: 120221 - RNA, 64 nt, Homo Sapiens; identical to SEQ ID NO: 83388

SEQ ID NO: 120222 - RNA, 64 nt, Homo Sapiens; identical to SEQ ID NO: 83389

SEQ ID NO: 120223 - RNA, 64 nt, Homo Sapiens; identical to SEQ ID NO: 83374

SEQ ID NO: 120224 - RNA, 64 nt, Homo Sapiens; identical to SEQ ID NO: 83375

SEQ ID NO: 120225 - RNA, 64 nt, Homo Sapiens; identical to SEQ ID NO: 83376

SEQ ID NO: 120226 - RNA, 64 nt, Homo Sapiens; identical to SEQ ID NO: 83377

SEQ ID NO: 120227 - RNA, 64 nt, Homo Sapiens; identical to SEQ ID NO: 83378

SEQ ID NO: 120228 - RNA, 64 nt, Homo Sapiens; identical to SEQ ID NO: 83379

SEQ ID NO: 120229 - RNA, 64 nt, Homo Sapiens; identical to SEQ ID NO: 83380

SEQ ID NO: 120230 - RNA, 64 nt, Homo Sapiens; identical to SEQ ID NO: 83381

SEQ ID NO: 120231 - RNA, 64 nt, Homo Sapiens; identical to SEQ ID NO: 83382

SEQ ID NO: 120232 - RNA, 64 nt, Homo Sapiens; identical to SEQ ID NO: 83383

SEQ ID NO: 120233 - RNA, 64 nt, Homo Sapiens; identical to SEQ ID NO: 83384

SEQ ID NO: 120234 - RNA, 64 nt, Homo Sapiens; identical to SEQ ID NO: 83385

SEQ ID NO: 120235 - RNA, 64 nt, Homo Sapiens; identical to SEQ ID NO: 83386

SEQ ID NO: 120236 - RNA, 64 nt, Homo Sapiens; identical to SEQ ID NO: 83387

SEQ ID NO: 120237 - RNA, 64 nt, Homo Sapiens; identical to SEQ ID NO: 83388

SEQ ID NO: 120238 - RNA, 64 nt, Homo Sapiens; identical to SEQ ID NO: 83389

SEQ ID NO: 120239 - RNA, 62 nt, Homo Sapiens
uuuuuaccaauuccaauuucaaaaugucucaauggugcuauaauaaauaaacuucaacacuc

SEQ ID NO: 120240 - RNA, 62 nt, Homo Sapiens
aauauuugggaaggcuuuaaagacgcauguuauggugcuaauguacuuucacuuuuaaacuc

SEQ ID NO: 120241 - RNA, 62 nt, Homo Sapiens
uacuaaagauuuuggcagaaagccugacuacuuggugcuaaccugaaaggaaaaaaaguaga

SEQ ID NO: 120242 - RNA, 62 nt, Homo Sapiens
aaucagauucaacccgaaggauguaugagaucuggugcuagcagcuucacauaccccucucc

SEQ ID NO: 120243 - RNA, 62 nt, Homo Sapiens
cuacccccgcugcccccuccacaguuccugaauggugcuaaggaucugcagcaguuggcaac

SEQ ID NO: 120244 - RNA, 62 nt, Homo Sapiens
cuugugcagcggaccacuugcccaguuugcuguggugcuagccuuccccaucauccaccggg

SEQ ID NO: 120245 - RNA, 62 nt, Homo Sapiens
acugaauaaggugcuucugcuucuucuagagauggugcuaaagaaaggacuagcauaugaga

SEQ ID NO: 120246 - RNA, 62 nt, Homo Sapiens
caauggggcuggugggcaugcuguccacuguguggugcuaggacugccaaugccaggcccaa

SEQ ID NO: 120247 - RNA, 62 nt, Homo Sapiens
agguaauaauaggcuugaaaauugauauccuguggugcuaaaguacaguagaaagagaggag

SEQ ID NO: 120248 - RNA, 62 nt, Homo Sapiens
uaguuaauagcauugggauauagucacuguaauggugcuauuaacaaacagucaacaccauu

SEQ ID NO: 120249 - RNA, 62 nt, Homo Sapiens
guuucuuuaagaaaguacuugcuaugccaauguggugcuauuucccauuuauuguuuggcca

SEQ ID NO: 120250 - RNA, 62 nt, Homo Sapiens
uuguaguuuguuauaugaaauuuuuaguauaauggugcuauuaacaguauguaaaacucugu

SEQ ID NO: 120251 - RNA, 62 nt, Homo Sapiens
cagggaggccgggugugaccucaucuuucucauggugcuauccuggugcuauuggggugggg

SEQ ID NO: 120252 - RNA, 62 nt, Homo Sapiens
ggugugaccucaucuuucucauggugcuauccuggugcuauugggguggggagcucccuccc

SEQ ID NO: 120253 - RNA, 64 nt, Homo Sapiens
uauuauuuuaguuagccuacuuggcauuuacuacaucggucacuucuccaggcugcccuaaauu

SEQ ID NO: 120254 - RNA, 64 nt, Homo Sapiens
ggaaccgaugguggguggggcugcagagugccccaucggucaccuuguuucucaacuaccucgc

SEQ ID NO: 120255 - RNA, 64 nt, Homo Sapiens
uuugggaaucuguagcugugcuuugagaauugccaucggucauguguugcaccguucucuguau

SEQ ID NO: 120256 - RNA, 64 nt, Homo Sapiens
gguccggggcaccuucacgguuuucugugccaccaucggucacccauugaucggcccacucuga

SEQ ID NO: 120257 - RNA, 64 nt, Homo Sapiens
augucucuggaauugaggugguagugaacagcagaucggucagcaccagaagucaacugaguua

SEQ ID NO: 120258 - RNA, 64 nt, Homo Sapiens
cgacuucgguucacuucacggauguucaguggauaucggucacaugccagguccccagcuacgc

SEQ ID NO: 120259 - RNA, 64 nt, Homo Sapiens
auugucgaggccaggguucgggaaguacacugccaucggucaggggacagcugccucccaccuu

SEQ ID NO: 120260 - RNA, 64 nt, Homo Sapiens
agaaacaauugguuaaugggcuugcaaauuaauaaucggucauuugaguuagaggaagaauucu

SEQ ID NO: 120261 - RNA, 64 nt, Homo Sapiens
ucuauuuccuuuuuugagaaacuuuuauauacguaucggucauuuuuauuuuauuucuagugaa

SEQ ID NO: 120262 - RNA, 64 nt, Homo Sapiens
uuuuuaauauguugacuuuauuucugagcaaagcaucggucauguguguauuuuuucauagucc

SEQ ID NO: 120263 - RNA, 64 nt, Homo Sapiens
aacgagcacgauguggaaaaugcuacaaaaagacaucggucaguagaauacgguuuuggugucc

SEQ ID NO: 120264 - RNA, 64 nt, Homo Sapiens
cguaagucucccuucaccuguuacagaguuucagaucggucacugauaguauguauuucuuuag

SEQ ID NO: 120265 - RNA, 64 nt, Homo Sapiens
guagacaaucauuuguuguuacccaugcagacagaucggucacuugguccggaaaggagugcug

SEQ ID NO: 120266 - RNA, 64 nt, Homo Sapiens
cgcacugcccuugggacuucucuuccauggccaaaucggucauccucugugccaugaagauaag

SEQ ID NO: 120267 - RNA, 64 nt, Homo Sapiens
cuuugcccuaagcugccaagugcuccccaaggagaucggucaccaggagagcagccacaaaggu

SEQ ID NO: 120268 - RNA, 64 nt, Homo Sapiens
agguaacagaggacaguagucuguaaacauauaaaucggucauaacuaucguggucuuuauuuc

SEQ ID NO: 120269 - RNA, 64 nt, Homo Sapiens
auuggucuuguuugauaauggaaagaucccagggaucggucauauuuauaaugauuuuaauaga

SEQ ID NO: 120270 - RNA, 64 nt, Homo Sapiens
ggggcagcggggcuggccauggcuggcagagggcaucggucagccacucuggggacccgcuggg

SEQ ID NO: 120271 - RNA, 64 nt, Homo Sapiens
aaaucagcuuggauuggugcuuaugauaaaagucaucggucagaggggugguagaagcugcugu

SEQ ID NO: 120272 - RNA, 64 nt, Homo Sapiens
augggcugauagauauccuuggcacauccguaccaucggucagcagggccacugaguagucauu

SEQ ID NO: 120273 - RNA, 64 nt, Homo Sapiens
gcuccuccuccauuuuacccccuacccauccuugaucggucaugccuagccugacccuuuagua

SEQ ID NO: 120274 - RNA, 64 nt, Homo Sapiens
agggccacugaguagucauuggcacauccguaccaucggucagcaugggcugauagauauccuu

SEQ ID NO: 120275 - RNA, 64 nt, Homo Sapiens
cccacugacuggacuucagagucuggaggguuccaucggucaggggaauggcggccacgugacc

SEQ ID NO: 120276 - RNA, 64 nt, Homo Sapiens
aauccagacggaguucugcccaggggugcugcauaucggucaccaggcacccagggccaugcca

SEQ ID NO: 120277 - RNA, 63 nt, Homo Sapiens
ccgguuuauaaaacaacagaacagccaggaaaauggugcuaggagagacaguggagaggccag

SEQ ID NO: 120278 - RNA, 63 nt, Homo Sapiens
gccuggaugccgaggaagcugcuggaugcuuaauggugcuagaggcucaaguguguuugaaac

SEQ ID NO: 120279 - RNA, 63 nt, Homo Sapiens
ugaagaccuguuauguagaggaaauacgagggguggugcuagaagacagacaucuguggaaug

SEQ ID NO: 120280 - RNA, 63 nt, Homo Sapiens
ucacuuagaaagaugggguuccuguagauuuuuuggugcuaagggauacuuugucauuaugau

SEQ ID NO: 120281 - RNA, 63 nt, Homo Sapiens
uguuuauuaaaaaaauggaacuguacacuuguuuggugcuaauuaauacaucaaaauauacug

SEQ ID NO: 120282 - RNA, 63 nt, Homo Sapiens
agugaugagcugagucagggauagggaguccccuggugcuaaccgugaacguagagacuuguu

SEQ ID NO: 120283 - RNA, 63 nt, Homo Sapiens
gaucaaguguggcuguaggccuuuguuuuccaauggugcuauauucuguuuucaaacacuuca

SEQ ID NO: 120284 - RNA, 63 nt, Homo Sapiens
uggggguucuggaccagaugaucccuuccaauguggugcuagcaggcaggaucccuucuccac

SEQ ID NO: 120285 - RNA, 63 nt, Homo Sapiens
gagucucaaucuguuacccaggcuggagugcaguggugcuaucuuggcucacugcaaacccgc

SEQ ID NO: 120286 - RNA, 63 nt, Homo Sapiens
ucagcuauucuuacugacauaccagucuuuagcuggugcuauggucuguucuuuaguucuagu

SEQ ID NO: 120287 - RNA, 63 nt, Homo Sapiens
ggguggggggaaagaaacuauuaucugacacacuggugcuauuaauuauuucaaauuuauauu

SEQ ID NO: 120288 - RNA, 63 nt, Homo Sapiens
ucuugaacaguugcaaucuuggcagcuugaaaauggugcuacacucuguuuugugugccuucc

SEQ ID NO: 120289 - RNA, 63 nt, Homo Sapiens
agggagucagaauauauuuguaaguuaaaucauuggugcuaauaauaaauguggauuuuguau

SEQ ID NO: 120290 - RNA, 63 nt, Homo Sapiens
uauauggcaacugcagaaggcugagccuccucauggugcuauaaccccuugggacacucaucc

SEQ ID NO: 120291 - RNA, 63 nt, Homo Sapiens
aggagguggccuuuguccccuggagcagccaguuggugcuacugcuguggccagcuggggggc

SEQ ID NO: 120292 - RNA, 63 nt, Homo Sapiens
cccugggacuggaagucgcccaggcaggcuuuuuggugcuaggggcacagggccacuguccuc

SEQ ID NO: 120293 - RNA, 63 nt, Homo Sapiens
augacauaugacaauaagcccagguuuguuuuuuggugcuaauaauuauaaucaaaaucaaug

SEQ ID NO: 120294 - RNA, 63 nt, Homo Sapiens
gcuccuggugccaaagucuggagcccuggauucuggugcuauaauucuugucuuugaguguug

SEQ ID NO: 120295 - RNA, 63 nt, Homo Sapiens
ggagccggaugaggacaggggaccgggaccacguggugcuaugccccaggaggccggggcuac

SEQ ID NO: 120296 - RNA, 63 nt, Homo Sapiens
uauuuuuuaaaugguuauguauaggaagcacgcuggugcuaaguuugaugauuuguuuggcau

SEQ ID NO: 120297 - RNA, 63 nt, Homo Sapiens
gauauggucauuuacaagaccugagcaccuguuuggugcuaagcuuucuucagcuaaugauua

SEQ ID NO: 120298 - RNA, 63 nt, Homo Sapiens
gcucuuggaguggacaugacacagccuucuacauggugcuacucagccgaggggacccugcuc

SEQ ID NO: 120299 - RNA, 63 nt, Homo Sapiens
gucuaauauaauuuuauauugcauguucugcacuggugcuaauuuuggaucuuaugaugcuga

SEQ ID NO: 120300 - RNA, 63 nt, Homo Sapiens
agcugcuucagauauaaaauccugccaacguguuggugcuauagaccccaccccucugcuggu

SEQ ID NO: 120301 - RNA, 63 nt, Homo Sapiens
gacuagggguccuuugugaauguccugggcuuauggugcuaugccucuccaugcugcaaucac

SEQ ID NO: 120302 - RNA, 63 nt, Homo Sapiens
auuaggcuugcuuguuacacgcuagucuaaccauggugcuauuaugauggcuuggaaaagcag

SEQ ID NO: 120303 - RNA, 63 nt, Homo Sapiens
agggacagccacaggccucuuggcgccaccugcuggugcuaaucgcuucggagcgguccucag

SEQ ID NO: 120304 - RNA, 63 nt, Homo Sapiens
ucugauguucuuuccaugaaugaacaaauuuucuggugcuaaggaaguguuacuaucuugauu

SEQ ID NO: 120305 - RNA, 63 nt, Homo Sapiens
uacacaagcuuaguguacgaguccacaggcggguggugcuacaggagggcccuucagagcaga

SEQ ID NO: 120306 - RNA, 63 nt, Homo Sapiens
cagagcugaggucauuguaugccucccugaaaguggugcuagaagggcccagugaggacaucc

SEQ ID NO: 120307 - RNA, 63 nt, Homo Sapiens
augaaaaccucugcacuuuaucaucacaauucauggugcuaaaauagugagagaaaugggauu

SEQ ID NO: 120308 - RNA, 63 nt, Homo Sapiens
uggucaacccugccugcauaacccucaccuaccuggugcuaguggaggagcacauuuuucuug

SEQ ID NO: 120309 - RNA, 63 nt, Homo Sapiens
agcugacaauuuccaaagcaagauuaaacccuuuggugcuaggcuucauuaaugaugaucuuc

SEQ ID NO: 120310 - RNA, 63 nt, Homo Sapiens
aauaccuaggaaauauuuuuccagucuacaauuuggugcuauugugcaguaacuaauaguacu

SEQ ID NO: 120311 - RNA, 63 nt, Homo Sapiens
ucacucacuauugcaaggacagcaucaaagagauggugcuaaaccauucaugaugaacucacc

SEQ ID NO: 120312 - RNA, 63 nt, Homo Sapiens
uuggagcucaguccacgguccucccccacuggauggugcuacugcuguggaaucuuguaaaaa

SEQ ID NO: 120313 - RNA, 63 nt, Homo Sapiens
gugugaauaaagguaauuuuauugaaucuucauuggugcuaaugauggacaguuaaaaagaua

SEQ ID NO: 120314 - RNA, 63 nt, Homo Sapiens
gacauuuacugaguuuuugcuucauguuagauauggugcuaaguuuuaaucauucaaggaaaa

SEQ ID NO: 120315 - RNA, 63 nt, Homo Sapiens
uuuuuuaccaauuccaauuucaaaaugucucaauggugcuauaauaaauaaacuucaacacuc

SEQ ID NO: 120316 - RNA, 63 nt, Homo Sapiens
uaauauuugggaaggcuuuaaagacgcauguuauggugcuaauguacuuucacuuuuaaacuc

SEQ ID NO: 120317 - RNA, 63 nt, Homo Sapiens
cuaagaaaaaaacuugucuucccuucugauugauggugcuauuuuguuuguuuuguuuuguuu

SEQ ID NO: 120318 - RNA, 63 nt, Homo Sapiens
uuauccuauuuucuaccauuaucuauguuuucauggugcuauuaauuacaaguuuaguucuuu

SEQ ID NO: 120319 - RNA, 63 nt, Homo Sapiens
aucuacuuuuacucauaaguaaaagcccuagacuggugcuaaugucaaaccacuggccuccac

SEQ ID NO: 120320 - RNA, 63 nt, Homo Sapiens
cagcuacaacaacagcugagaucacuuaauaaauggugcuaaacuagcuugucucaugcucuu

SEQ ID NO: 120321 - RNA, 63 nt, Homo Sapiens
ccugggcagaugcugcagcccgcccccuucucauggugcuacuuccucugucagcuacagaaa

SEQ ID NO: 120322 - RNA, 63 nt, Homo Sapiens
cauggccggcugcagaggacgcagcagagcgcauggugcuagccugggccucacggugcuccg

SEQ ID NO: 120323 - RNA, 63 nt, Homo Sapiens
ccuucaccccugagcacgcuaaagcaaaaaaauuggugcuaaauuaauuucuaaagauuaaaa

SEQ ID NO: 120324 - RNA, 63 nt, Homo Sapiens
aagaguaggaauucucucuaaauaagcuuugaauggugcuaauuuuguagacaaacaacugau

SEQ ID NO: 120325 - RNA, 63 nt, Homo Sapiens
auucuuccuauaaaauuccuuuuccuuuaaugauggugcuaaagcuaaaaagguauuauuauu

SEQ ID NO: 120326 - RNA, 63 nt, Homo Sapiens
uaugguaagggaaagggaccuggucuugggguauggugcuagcuucccuggcuuauuucaucc

SEQ ID NO: 120327 - RNA, 63 nt, Homo Sapiens
aacuggcccccagcccagccuuggcucagaguguggugcuagagccucauccccaggaccccc

SEQ ID NO: 120328 - RNA, 63 nt, Homo Sapiens
gccaauguauuugaaugcuuuaaauauuuuaaauggugcuauaaaacuaacaagaggcagugu

SEQ ID NO: 120329 - RNA, 63 nt, Homo Sapiens
gugucuguggacccucgcucugaccuaucaguauggugcuaauggagggaacauccugcugca

SEQ ID NO: 120330 - RNA, 63 nt, Homo Sapiens
uugcaaucugguugugauuuauauuuuaaagcuuggugcuaaaccacaauauguauagcauau

SEQ ID NO: 120331 - RNA, 63 nt, Homo Sapiens
ugcagcugagggauuuucacagugugcuccagauggugcuagaggaagucccagagccuguaa

SEQ ID NO: 120332 - RNA, 63 nt, Homo Sapiens
cccugccccacuggggauaggagccugugucccuggugcuaagcacucucuucacuugggcca

SEQ ID NO: 120333 - RNA, 63 nt, Homo Sapiens
gagucucacucuguugcucuggcuggagugcaguggugcuaucucagcucacugcaagcucca

SEQ ID NO: 120334 - RNA, 63 nt, Homo Sapiens
ucucuugauuugaccucagugcuuugaauucacuggugcuacaauauguaacugugguuaauu

SEQ ID NO: 120335 - RNA, 63 nt, Homo Sapiens
aaaucuggaaaagugcucauauucacagguggcuggugcuagucuaacuuaauucauguguau

SEQ ID NO: 120336 - RNA, 63 nt, Homo Sapiens
cuaagaaguguguucaugcaacagccauagagauggugcuauugaaaggcaaucugcccaucc

SEQ ID NO: 120337 - RNA, 63 nt, Homo Sapiens
aggugauccucccaccucagcuuccagauuagcuggugcuauaggcaugcaccaccacgucca

SEQ ID NO: 120338 - RNA, 63 nt, Homo Sapiens
gcuuucucccugucuggauucaguggcucacguuggugcuacacagcuagaauagauauauuu

SEQ ID NO: 120339 - RNA, 63 nt, Homo Sapiens
caauuauaauuacaucugugauuucugaacuaauggugcuaauucagagaaauggaaagugaa

SEQ ID NO: 120340 - RNA, 63 nt, Homo Sapiens
caggaccccuuuugucucugggaccagacuuguuggugcuaccccuuacuccccucugcaacc

SEQ ID NO: 120341 - RNA, 63 nt, Homo Sapiens
acccagcgcugcccgugccccuagcaggagcccuggugcuacccccugugaagagccaagcag

SEQ ID NO: 120342 - RNA, 63 nt, Homo Sapiens
cauacuagguucagucugaaagaaaucuccuaauggugcuauagagagggagguaacagaaag

SEQ ID NO: 120343 - RNA, 63 nt, Homo Sapiens
auccuccugaccucaaagugcagaugggaaggguggugcuaagaagcagugggguugggaccu

SEQ ID NO: 120344 - RNA, 63 nt, Homo Sapiens
ugcuuacuucgggauagcagcauuacuucaacauggugcuaagccaugaagaauguguagaug

SEQ ID NO: 120345 - RNA, 63 nt, Homo Sapiens
acauucugacacauaucauuucuguaguuuuuuuggugcuauaauuuguccauuuaaaaauga

SEQ ID NO: 120346 - RNA, 63 nt, Homo Sapiens
uacuaaagauuuuggcagaaaagccugacuacuuggugcuaacgcugaaaggaaaaaaaguag

SEQ ID NO: 120347 - RNA, 63 nt, Homo Sapiens
aaucagauucaacccgaaggcauguaugagaucuggugcuagccagcuucacauaccccucuc

SEQ ID NO: 120348 - RNA, 63 nt, Homo Sapiens
ggcuugugugcacgugagcgcugucccuccccuuggugcuagaggggucucagcagaacccca

SEQ ID NO: 120349 - RNA, 63 nt, Homo Sapiens
auuguauguauuuaaaugauaaauaugcugccuuggugcuaauucaugugaucucugggaaaa

SEQ ID NO: 120350 - RNA, 63 nt, Homo Sapiens
ugaagaaaaaaauguacauuuugauuuuauaauuggugcuauuuugucauuuuaugaauauca

SEQ ID NO: 120351 - RNA, 63 nt, Homo Sapiens
cagaaaagaaauuuggaccuguguggaugaucuuggugcuaagguaacuucagguuggauccu

SEQ ID NO: 120352 - RNA, 63 nt, Homo Sapiens
cucugcaacacgacacccaggugacaucaggaauggugcuagcaggaccacgucucacccagg

SEQ ID NO: 120353 - RNA, 63 nt, Homo Sapiens
uguggucuucuugacacauuaaaguuccuuuccuggugcuaacaaguaaucagaagcuaaagu

SEQ ID NO: 120354 - RNA, 63 nt, Homo Sapiens
aaucaccgucuguguuugaguggauuugagucuuggugcuaucggcauuggugucuggagacc

SEQ ID NO: 120355 - RNA, 63 nt, Homo Sapiens
uguagcuaucuuugaaaucacuugacuuugcaauggugcuaagcugauagauuuaaauacaca

SEQ ID NO: 120356 - RNA, 63 nt, Homo Sapiens
aaaaagagugaaaauauuuuaauuagcaguagauggugcuacuggcuuucauuugcugacuug

SEQ ID NO: 120357 - RNA, 63 nt, Homo Sapiens
uaauuuuuuaaucuuaguuuaauggucucucccuggugcuaacugcugacaguggccaccucu

SEQ ID NO: 120358 - RNA, 63 nt, Homo Sapiens
gaaaaaaaagauuuguuucugaaagacuucuuauggugcuauuccauaaacuuuuuuucaaac

SEQ ID NO: 120359 - RNA, 63 nt, Homo Sapiens
ccugacaaauaagagaucauaaugagaaugucauggugcuaaaaaugaguguuuuuuuaaggg

SEQ ID NO: 120360 - RNA, 63 nt, Homo Sapiens
ugaagacucugcuaauauagguucucacuuaacuggugcuaugauuauuacuguguucgcaca

SEQ ID NO: 120361 - RNA, 63 nt, Homo Sapiens
uaaaaaauuguaaagacuggcauuuuauuaugauggugcuagggagagcacuuugaaagauaa

SEQ ID NO: 120362 - RNA, 63 nt, Homo Sapiens
aguaggucuucaaauauggguaauucuugaugcuggugcuagaugugaguccugagauggauu

SEQ ID NO: 120363 - RNA, 63 nt, Homo Sapiens
guuagauuaaucugcauuuuuuucauucucguauggugcuagacucugacaaaaauacaugua

SEQ ID NO: 120364 - RNA, 63 nt, Homo Sapiens
aaauucuauuuauuaaugaaagugucacccuuuuggugcuaagcaggagaauucacaauuaaa

SEQ ID NO: 120365 - RNA, 63 nt, Homo Sapiens
ggauaaaacacgucauguggauucauuuugaauuggugcuauugguauuuccucuguuauugc

SEQ ID NO: 120366 - RNA, 63 nt, Homo Sapiens
ggucaaaagcugccccacccacucucccucacauggugcuaggcugggagcugcccugagagc

SEQ ID NO: 120367 - RNA, 63 nt, Homo Sapiens
ugucaacccuccugcccuuuguggucuuagguauggugcuauagguugcaugcgucuuuaucu

SEQ ID NO: 120368 - RNA, 63 nt, Homo Sapiens
ggcuucuuguccuucucuuugacuucuguggcauggugcuagugcauguacccugugguauug

SEQ ID NO: 120369 - RNA, 63 nt, Homo Sapiens
gguauuuuaggccaagugugcacccacauccaauggugcuacaagugacugaaauaauauuug

SEQ ID NO: 120370 - RNA, 63 nt, Homo Sapiens
gcuacccccgcugcccccuccacaguuccugaauggugcuaaggaucugcagcaguuggcaac

SEQ ID NO: 120371 - RNA, 63 nt, Homo Sapiens
ccuugugcagcggaccacuugcccaguuugcuguggugcuagccuuccccaucauccaccggg

SEQ ID NO: 120372 - RNA, 63 nt, Homo Sapiens
gugcccuggugaaauaaauaagaacaguuaacuuggugcuaauauucccuugcgccuuuucaa

SEQ ID NO: 120373 - RNA, 63 nt, Homo Sapiens
aaaugaaaauauuagaaaguuguuuucuccuuuuggugcuaaauaaccagccuuguaacaaua

SEQ ID NO: 120374 - RNA, 63 nt, Homo Sapiens
acuaauaacaucucuuaccauauuggaaggaaauggugcuaaaguauuguauuaaaaugagac

SEQ ID NO: 120375 - RNA, 63 nt, Homo Sapiens
uuggacuuucaacaugcuccagacacugaugaauggugcuauuagaugcugccacaggaccug

SEQ ID NO: 120376 - RNA, 63 nt, Homo Sapiens
uuaaaacuaaaaaaaacuuuccccuuccucaaguggugcuauugacuuugaacuuaaauauau

SEQ ID NO: 120377 - RNA, 63 nt, Homo Sapiens
ccaugcaggggucagugcagccugccauucuucuggugcuacugucaagacauuucucuaacu

SEQ ID NO: 120378 - RNA, 63 nt, Homo Sapiens
caucccgcggagcuucugcugggcuccggcgacuggugcuacgagcggcgaacgccaggcucu

SEQ ID NO: 120379 - RNA, 63 nt, Homo Sapiens
uucuauuuauuuucuacaucuggccaguggcucuggugcuagaugccacuguagccagaucuc

SEQ ID NO: 120380 - RNA, 63 nt, Homo Sapiens
uacugaauaaggugcuucugcuucuucuagagauggugcuaaagaaaggacuagcauaugaga

SEQ ID NO: 120381 - RNA, 63 nt, Homo Sapiens
ccaauggggcuggugggcaugcuguccacuguguggugcuaggacugccaaugccaggcccaa

SEQ ID NO: 120382 - RNA, 63 nt, Homo Sapiens
agaaauuaauuugcaguguuuggauuguauauauggugcuaaaaauaaauuaauuuacuuuau

SEQ ID NO: 120383 - RNA, 63 nt, Homo Sapiens
uuaucccgaaaaaguguacauagaucuaaaauuuggugcuauguguauaucuugagcuuuuaa

SEQ ID NO: 120384 - RNA, 63 nt, Homo Sapiens
gugcauguacauagaauucuuucuguauucagauggugcuaauucagacuccagacugaauuu

SEQ ID NO: 120385 - RNA, 63 nt, Homo Sapiens
uguauuuucauugaaguaggagagauuaucagauggugcuaaagaaagugugaagaucuuaug

SEQ ID NO: 120386 - RNA, 63 nt, Homo Sapiens
gcaagaaguggggccucgagcugucagucaucauggugcuauccucugaaccccucagcugcc

SEQ ID NO: 120387 - RNA, 63 nt, Homo Sapiens
caguuauaccuaacauauuaugcaauuuucucuuggugcuaccugauggaauuccugcacuua

SEQ ID NO: 120388 - RNA, 63 nt, Homo Sapiens
uauugcuacuauuuuauagacagugguaauaaauggugcuagacauuccuuaacccgcugccu

SEQ ID NO: 120389 - RNA, 63 nt, Homo Sapiens
acccccauuaccugagggaauuaauauucacuuuggugcuacuaguagaggccuuucugacuc

SEQ ID NO: 120390 - RNA, 63 nt, Homo Sapiens
uccccucucuccuccucaacggaaaggaaccaauggugcuauuuucuccccgcacauacucac

SEQ ID NO: 120391 - RNA, 63 nt, Homo Sapiens
cggacuucggagcauagaguacacggggagcgguggugcuacaaagcuaagccagcucagaga

SEQ ID NO: 120392 - RNA, 63 nt, Homo Sapiens
agcucuccaccagguggugugcaccccccacuuuggugcuaaucucggcucucccacaggugg

SEQ ID NO: 120393 - RNA, 63 nt, Homo Sapiens
uauguauuaaguuggguccucccagcucugucauggugcuaucacagucaugucuuaauggau

SEQ ID NO: 120394 - RNA, 63 nt, Homo Sapiens
aaagaguauuaauuacuuugauuagauuaaugguggugcuaagaauucauuucaaacucuaaa

SEQ ID NO: 120395 - RNA, 63 nt, Homo Sapiens
gauuguuaaauucaaugcuuauucuugacuccuuggugcuaaauaaacccauuuuggugcaau

SEQ ID NO: 120396 - RNA, 63 nt, Homo Sapiens
ccuugcccaggcaaggaaagguuaccuucacaauggugcuacccuucucgagcaggagugaua

SEQ ID NO: 120397 - RNA, 63 nt, Homo Sapiens
ucugaaacgagcguuagagucuuccuuccaacguggugcuaucaugagguuuucauuuuuauu

SEQ ID NO: 120398 - RNA, 63 nt, Homo Sapiens
uuaauaguauuucagauacuugaagaauguugauggugcuagaagaauuugagaagaaauacu

SEQ ID NO: 120399 - RNA, 63 nt, Homo Sapiens
agagagcauagcugcuuccaucucuuacccaaguggugcuaaacaauuuuucuuccaauguuu

SEQ ID NO: 120400 - RNA, 63 nt, Homo Sapiens
cagguaauaauaggcuugaaaauugauauccuguggugcuaaaguacaguagaaagagaggag

SEQ ID NO: 120401 - RNA, 63 nt, Homo Sapiens
uuaguuaauagcauugggauauagucacuguaauggugcuauuaacaaacagucaacaccauu

SEQ ID NO: 120402 - RNA, 63 nt, Homo Sapiens
cuauuaaugucucacuuuacuuucaaguaauauuggugcuauuuaacauuuuacaguaaaugu

SEQ ID NO: 120403 - RNA, 63 nt, Homo Sapiens
ccagguugggagggggaaggugagggcuucggguggugcuauaauguggcacuggaucuugag

SEQ ID NO: 120404 - RNA, 63 nt, Homo Sapiens
agacugagcaccugcuucaugcucagcccugacuggugcuauaggcuggagaagcucacccaa

SEQ ID NO: 120405 - RNA, 63 nt, Homo Sapiens
agccucaggcucuccugcccugggccucccaauuggugcuaucuguuacugcccgugcucacg

SEQ ID NO: 120406 - RNA, 63 nt, Homo Sapiens
ucccuggcugccugugaauggcccacauuugaguggugcuaacuugaugugaguaggcauuaa

SEQ ID NO: 120407 - RNA, 63 nt, Homo Sapiens
uuguuuacuugguuuucuaguguuaaccagucauggugcuagaccuaaaugucagugcagcag

SEQ ID NO: 120408 - RNA, 63 nt, Homo Sapiens
caauuaugcucuguguuucaagcaauucuaugcuggugcuaugacccaauucaucaacuggaa

SEQ ID NO: 120409 - RNA, 63 nt, Homo Sapiens
auuuuauuugaaaaaaguuaauuuuaucugguauggugcuaauaaggccaauaguuuuagauu

SEQ ID NO: 120410 - RNA, 63 nt, Homo Sapiens
acagugugagacucagguugacuguuuucuucuuggugcuaugcuauaagaaaagugaaagua

SEQ ID NO: 120411 - RNA, 63 nt, Homo Sapiens
gucugcuuuagcacgcacgcuccgaaugacuccuggugcuaggccaugcuggcugcugucacu

SEQ ID NO: 120412 - RNA, 63 nt, Homo Sapiens
aggucauuguggcuaucugcauuuauaaauguguggugcuaacuguaugugucuuuaucagug

SEQ ID NO: 120413 - RNA, 63 nt, Homo Sapiens
cauagugcugugucauccugguccauguaggacuggugcuaaccaccugccaucaugaggaug

SEQ ID NO: 120414 - RNA, 63 nt, Homo Sapiens
ggugugcuuucuugagcccucauaaggaaguacuggugcuagguuuugcaagauuuuguauac

SEQ ID NO: 120415 - RNA, 63 nt, Homo Sapiens
acagccugccauauuuuucacagcaugcaacaauggugcuaggauagcuauuucuuacuguaa

SEQ ID NO: 120416 - RNA, 63 nt, Homo Sapiens
cgagggccgaaacuccugucugcuaucgagcccuggugcuauguggccccggagccacagcac

SEQ ID NO: 120417 - RNA, 63 nt, Homo Sapiens
ucagcucaccacaaccucugggcuggagugcgguggugcuauuaguuuugcucucauugccca

SEQ ID NO: 120418 - RNA, 63 nt, Homo Sapiens
gaggccagggugcaggguucuucuucacaguguuggugcuaaucacuuucucugccacagcug

SEQ ID NO: 120419 - RNA, 63 nt, Homo Sapiens
gagcguuuucuuuugguaaaaguauuaccauuauggugcuacuuaucuuauguauuucuuuua

SEQ ID NO: 120420 - RNA, 63 nt, Homo Sapiens
aaacccugaccagacacuuguuaaggaaacucuuggugcuacacugacgcguaacugcccauu

SEQ ID NO: 120421 - RNA, 63 nt, Homo Sapiens
acucagaucaaagacaaaaucugauccauauauuggugcuagauucugcaggaaaccccagca

SEQ ID NO: 120422 - RNA, 63 nt, Homo Sapiens
gacgcaugcaagacucagacccggggaaugguguggugcuaaucucaacaccugacauucaca

SEQ ID NO: 120423 - RNA, 63 nt, Homo Sapiens
gucuugugcuggucuguuaaauccugcccuccuuggugcuagauccaguugugccucagggca

SEQ ID NO: 120424 - RNA, 63 nt, Homo Sapiens
gccagggccaucuggacuauggggcuuaugaguuggugcuagaaaggagaugggccuggggug

SEQ ID NO: 120425 - RNA, 63 nt, Homo Sapiens
cugguuacaacuugagauuugcauccaugucaguggugcuauguaucaaggaguucuaucaag

SEQ ID NO: 120426 - RNA, 63 nt, Homo Sapiens
gauaaauauuacauuuacccugaccaugggauguggugcuaaugccguuuauucagguggggc

SEQ ID NO: 120427 - RNA, 63 nt, Homo Sapiens
ggccaagggucauuuuauacucugggccuggguuggugcuauagguucaaaacuggcuuuucc

SEQ ID NO: 120428 - RNA, 63 nt, Homo Sapiens
auaaaauccaauauuguaauauaaaggacaggcuggugcuaacccagguaaaugguaugauca

SEQ ID NO: 120429 - RNA, 63 nt, Homo Sapiens
gagaagguccuccuuccucugaggggcguggcguggugcuacuaccuuuucagaaucauggca

SEQ ID NO: 120430 - RNA, 63 nt, Homo Sapiens
cacucgguugucuuuacuuuuaaaaguaauacuuggugcuaagaauuucaggauuauuguauu

SEQ ID NO: 120431 - RNA, 63 nt, Homo Sapiens
acuccccagcguggccucacugucuucuggucuuggugcuacugaaauugucacccagaauuu

SEQ ID NO: 120432 - RNA, 63 nt, Homo Sapiens
cuuguuguuugcgcauuuuuuuuuaaagcauauuggugcuagaaaaggcagcuaaaggaagug

SEQ ID NO: 120433 - RNA, 63 nt, Homo Sapiens
cuguguuacgacauuaauugcaaauagcaaguauggugcuaaagucuacaccaauggaauuag

SEQ ID NO: 120434 - RNA, 63 nt, Homo Sapiens
auuuaaucugugaggaacuaaaugacaggagauuggugcuaauacgggggaccaagcuuuguc

SEQ ID NO: 120435 - RNA, 63 nt, Homo Sapiens
acuugccuaguuguacccaccccuccaggucccuggugcuagagcuucugagaagggccuuuc

SEQ ID NO: 120436 - RNA, 63 nt, Homo Sapiens
aucuaagucuuccaaugccugcaucaaacuuucuggugcuaggaaaggaaaaaaauaauaauu

SEQ ID NO: 120437 - RNA, 63 nt, Homo Sapiens
gugaguucguucugacucuuagagucuaggaaauggugcuauucggaaaggaaucuaauucca

SEQ ID NO: 120438 - RNA, 63 nt, Homo Sapiens
uuccauugugacuuuggaauaauuuucuguguguggugcuaauaugaaaugcucuuuacauuc

SEQ ID NO: 120439 - RNA, 63 nt, Homo Sapiens
ugaccugggguccagcgagggaaacacaggcccuggugcuaucaggcaggaccuucggccuaa

SEQ ID NO: 120440 - RNA, 63 nt, Homo Sapiens
gucuguuaaacagggcuggccuucaucccgaaguggugcuaugccuuuauuuguuuagacgug

SEQ ID NO: 120441 - RNA, 63 nt, Homo Sapiens
auugcugugcaaagaaauucggagcuuaguaaguggugcuacauuuucuuauuuucuggugga

SEQ ID NO: 120442 - RNA, 63 nt, Homo Sapiens
agagggccugugcuccacacggacuugggucuuuggugcuaggggguggggguugggugggag

SEQ ID NO: 120443 - RNA, 63 nt, Homo Sapiens
caagaagcugagcuggcagagagcuccaccauuuggugcuaaaaaaaaaaacguccugagguu

SEQ ID NO: 120444 - RNA, 63 nt, Homo Sapiens
cuggggcuguauuuaucucugaggcaugguguguggugcuacagggaauuuguacguuuauac

SEQ ID NO: 120445 - RNA, 63 nt, Homo Sapiens
ccacccucccacacagccggccacagggagaacuggugcuaaccagggugcuugcuuugguca

SEQ ID NO: 120446 - RNA, 63 nt, Homo Sapiens
ccaguuacuaacuacggaaauagcauccucugcuggugcuaagugugauuaggaagaagccug

SEQ ID NO: 120447 - RNA, 63 nt, Homo Sapiens
gagucucacuuugucacccaugcuggaguauaguggugcuaucucggcucacugcaaccauug

SEQ ID NO: 120448 - RNA, 63 nt, Homo Sapiens
acaauuucugguguucaacccugugcuugcugguggugcuaacggcggaagagucagaggacc

SEQ ID NO: 120449 - RNA, 63 nt, Homo Sapiens
ucauuccugcuguaagagaacgcacaccucucuuggugcuauuauugucuauguaacauguag

SEQ ID NO: 120450 - RNA, 63 nt, Homo Sapiens
gauuccgcuauuucacagacccauaacuccuuuuggugcuaauuuuaauaauauauacaagcu

SEQ ID NO: 120451 - RNA, 63 nt, Homo Sapiens
aaguaaaagaugaaauguucuuaucaagucuguuggugcuaaagucagaucagcaucaggcug

SEQ ID NO: 120452 - RNA, 63 nt, Homo Sapiens
uacuuggcagccaagaauuuggagguuuuaaaauggugcuaauucuguccucugaggucuucc

SEQ ID NO: 120453 - RNA, 63 nt, Homo Sapiens
gagacagggaagagaagugcaagaauugguugcuggugcuacauggcggcagcuuugacauuu

SEQ ID NO: 120454 - RNA, 63 nt, Homo Sapiens
aucaaaaucauaguaaaauauuaccuguuuucauggugcuaauauuaccuguucucccacugc

SEQ ID NO: 120455 - RNA, 63 nt, Homo Sapiens
agaaaaaggggcaguuuucuuugcccaagcauuuggugcuaguuagaggcuguucacucucuc

SEQ ID NO: 120456 - RNA, 63 nt, Homo Sapiens
uaaucaggccccuguuaugcuuagggggagcccuggugcuacuugcuugaaguuuucagugua

SEQ ID NO: 120457 - RNA, 63 nt, Homo Sapiens
caugauuuuuuuugaguagggagcauuaguaccuggugcuagagaauagaacccucaaauaau

SEQ ID NO: 120458 - RNA, 63 nt, Homo Sapiens
guauaccuuugugauuuucuaaugaguuuuccauggugcuacaaauaauccagacuaccaggu

SEQ ID NO: 120459 - RNA, 63 nt, Homo Sapiens
cccucgauguacauagcuuugcagccgccuacuuggugcuaacgcaggggcaagcaggagcua

SEQ ID NO: 120460 - RNA, 63 nt, Homo Sapiens
uggcccaggcacuggaguggcugucuuccacacuggugcuaacuguuguccggagccagcuca

SEQ ID NO: 120461 - RNA, 63 nt, Homo Sapiens
aagccauuucucuugauuuuaacauugcaguaauggugcuacgauaacaacguauguaauugu

SEQ ID NO: 120462 - RNA, 63 nt, Homo Sapiens
uuuauuuccaauggauauuucauacuuucccacuggugcuauucugauuugucuuauuuuuuu

SEQ ID NO: 120463 - RNA, 63 nt, Homo Sapiens
uaaacaauuuuuuucuaacgauaacugaauuuauggugcuauuuuacuugaggugugccuugu

SEQ ID NO: 120464 - RNA, 63 nt, Homo Sapiens
ccuccaagugucaugauuuaucauuuuggaugcuggugcuaaagcuuuuuuuuccguuuuugu

SEQ ID NO: 120465 - RNA, 63 nt, Homo Sapiens
caggaagaagccaguaaacauuggggggaagaguggugcuagcuagcuuaaaaauguuggggg

SEQ ID NO: 120466 - RNA, 63 nt, Homo Sapiens
cugugucaaacaccucuguaguguccuacacaauggugcuauugccgggcgcaggaacugugu

SEQ ID NO: 120467 - RNA, 63 nt, Homo Sapiens
ugaguuggacagaauucuaguccaucucacuucuggugcuaccaggccuucucuacaaccuag

SEQ ID NO: 120468 - RNA, 63 nt, Homo Sapiens
aauugaacuggaacacagcacuagggucacagauggugcuauuguacuggacgugcucagggu

SEQ ID NO: 120469 - RNA, 63 nt, Homo Sapiens
auauaaguuuggaaguuugcauuuuccaugccuuggugcuagcauuuggguauuauugaaaau

SEQ ID NO: 120470 - RNA, 63 nt, Homo Sapiens
guuucuuuaagaaaguacuuagcuaugccaauguggugcuauuuucccauuuauuguuuggcc

SEQ ID NO: 120471 - RNA, 63 nt, Homo Sapiens
uuguaguuuguuauaugaaauuuuuuaguauaauggugcuauuaaacaguauguaaaacucug

SEQ ID NO: 120472 - RNA, 63 nt, Homo Sapiens
ccaggguggccagccccgcccgcggggucuccauggugcuaggguagggcaccgugagugcag

SEQ ID NO: 120473 - RNA, 63 nt, Homo Sapiens
uaacacuccuaagaaauguugauggcuauuuuguggugcuaacauguaguuggggcaccuaua

SEQ ID NO: 120474 - RNA, 63 nt, Homo Sapiens
aggagcacuccacagucggagguguaaucauauuggugcuauuucuuggaagagaaguuauug

SEQ ID NO: 120475 - RNA, 63 nt, Homo Sapiens
uaugaauaacccacagauguacugaauuacuuuuggugcuaucuuguacucuucaaucuguaa

SEQ ID NO: 120476 - RNA, 63 nt, Homo Sapiens
uuccucucuuggagagccaaagaaagcccgacauggugcuaguggaaagagaaugcuucccau

SEQ ID NO: 120477 - RNA, 63 nt, Homo Sapiens
gagaaggcaaccuucacuggccaugagggguaguggugcuaggaagucuccugauucggacaa

SEQ ID NO: 120478 - RNA, 63 nt, Homo Sapiens
ucuucuucuuuuuguuaacauaaugucacaacauggugcuacuauaaugaagccugacucagc

SEQ ID NO: 120479 - RNA, 63 nt, Homo Sapiens
auauaugcuuaggaggacagugcaaauaaaagguggugcuauggaaauuuacauaucaaguac

SEQ ID NO: 120480 - RNA, 63 nt, Homo Sapiens
cagaaaauuccuagcucacauuacaaucuguauuggugcuaguuguucuagucuguugcgcug

SEQ ID NO: 120481 - RNA, 63 nt, Homo Sapiens
guuccccaguucauaugugaagagacuugauuuuggugcuaaagggaagcuagauggacuagg

SEQ ID NO: 120482 - RNA, 63 nt, Homo Sapiens
ccaagacuguaacagggagacugcauggucaaguggugcuaacagaaaaaccaaaacccaacc

SEQ ID NO: 120483 - RNA, 63 nt, Homo Sapiens
uuuauguauuaugcuugaaauuuuuccccuguuuggugcuaugcuucuuuucuuuugcaugca

SEQ ID NO: 120484 - RNA, 63 nt, Homo Sapiens
ccugcauguaaacacgccugcaguggucucacauggugcuacgggaccucugaaacccuggac

SEQ ID NO: 120485 - RNA, 63 nt, Homo Sapiens
uuccucuguucaaagcugccugucccuaccccauggugcuaggaagaggaguggggugguguc

SEQ ID NO: 120486 - RNA, 63 nt, Homo Sapiens
auuaagugacuggauauguaaagucguuuaauguggugcuaaaaaguaaaggacuuuuaauca

SEQ ID NO: 120487 - RNA, 63 nt, Homo Sapiens
ccucgugaaauagugugcaguggaggucucuuguggugcuagauguguguuuagagcuaaacc

SEQ ID NO: 120488 - RNA, 63 nt, Homo Sapiens
augaaaucuucuugauuuuaaauaauauacgaauggugcuauuaauauugcuaaaaucaacgu

SEQ ID NO: 120489 - RNA, 63 nt, Homo Sapiens
cagccugggugcacaguagcugcaacuccccauuggugcuaccuggcucuccugucucugcag

SEQ ID NO: 120490 - RNA, 63 nt, Homo Sapiens
aguugcaggaggagagguggauggcaaugugauuggugcuauaacucaggcagccugggaguc

SEQ ID NO: 120491 - RNA, 63 nt, Homo Sapiens
agugaaguaaggcccaaagggaaaagacaacauuggugcuaacuauaacuuuugcauauguga

SEQ ID NO: 120492 - RNA, 63 nt, Homo Sapiens
aaauuuucaaacuagauuuauaugguaccuauuuggugcuagucaaguacuagguuguccauu

SEQ ID NO: 120493 - RNA, 63 nt, Homo Sapiens
ccccucucacuacccagcagcccugcgcccuaauggugcuaacgcuguggcggagcucccgcc

SEQ ID NO: 120494 - RNA, 63 nt, Homo Sapiens
caagagauaugaggaugggagauuuuguggacuuggugcuaguugaagcucauuucucccaga

SEQ ID NO: 120495 - RNA, 63 nt, Homo Sapiens
ucauuuuuuaaguauuucuaaaaacuuaaguaauggugcuacuaaguucuacauaauaaaggu

SEQ ID NO: 120496 - RNA, 63 nt, Homo Sapiens
acugccuuccgccauccccauuuggacaauaaauggugcuauggggcccucagguguguguac

SEQ ID NO: 120497 - RNA, 63 nt, Homo Sapiens
agcuuugcucugagugccuacaaagcuaaugcuuggugcuagaaacaucaucauuauuaaacu

SEQ ID NO: 120498 - RNA, 63 nt, Homo Sapiens
agaugcucacugagcugcugcuuuuaugugugcuggugcuauguguguucauguccgcggcag

SEQ ID NO: 120499 - RNA, 63 nt, Homo Sapiens
ucgauccugaagaucgugugaaggaagcguucuuggugcuacacacagucuggaaaagcagcc

SEQ ID NO: 120500 - RNA, 63 nt, Homo Sapiens
cuuggggagaccaaaagucggacaggaaacaucuggugcuauuaucugggacuuggccugacc

SEQ ID NO: 120501 - RNA, 63 nt, Homo Sapiens
ggcagccccagcccagcccgccgggagcaaggauggugcuaggucauucauggcuggccuccc

SEQ ID NO: 120502 - RNA, 63 nt, Homo Sapiens
gggacugcugugcagacccaagcaaucccaaccuggugcuaggucauuucacuuuucugaaaa

SEQ ID NO: 120503 - RNA, 63 nt, Homo Sapiens
gaaaguuugccaggaggaacaaagagauugugguggugcuaaaggaggccauaagcuacacag

SEQ ID NO: 120504 - RNA, 63 nt, Homo Sapiens
acaagagcucucugccuccggucacucuugcuguggugcuacguggaagugaauggagacuga

SEQ ID NO: 120505 - RNA, 63 nt, Homo Sapiens
uuuauacagugaagcaacagacacugcauuugcuggugcuauucacuaucuuaauuuugcgau

SEQ ID NO: 120506 - RNA, 63 nt, Homo Sapiens
agacccuugggagguggcccuaucccuaggcaguggugcuaggaggacagaaggcuauauggg

SEQ ID NO: 120507 - RNA, 63 nt, Homo Sapiens
auguugugugugcuggggagggguccuucuguuuggugcuacccuugucuacucugccccugg

SEQ ID NO: 120508 - RNA, 63 nt, Homo Sapiens
gauuuaccauuccuuauuaucaagucuuugaaauggugcuaugaaaugagaaaucagugacaa

SEQ ID NO: 120509 - RNA, 63 nt, Homo Sapiens
agcuucagcggaacaggguguugaguggcagcguggugcuagcccaccgagagccaggcagcu

SEQ ID NO: 120510 - RNA, 63 nt, Homo Sapiens
gaaauugagaugcccccccagggagggaaucacuggugcuauaucuaugugauggguggggug

SEQ ID NO: 120511 - RNA, 63 nt, Homo Sapiens
acaggagcuacaccuugaucuuccuaguuguccuggugcuaaccuacucuuugcaccugacuu

SEQ ID NO: 120512 - RNA, 63 nt, Homo Sapiens
ggagggaacagaaguuaggaggcaacuuugggauggugcuagagcauggaaagcacagagaau

SEQ ID NO: 120513 - RNA, 63 nt, Homo Sapiens
guuacacaauauggaggcaaauuguguuuuccauggugcuacaguuacuacaauaauacaugu

SEQ ID NO: 120514 - RNA, 63 nt, Homo Sapiens
uggcaauagauaacucagcgugauuuggagaauuggugcuaguuguguuuuccucacacacuu

SEQ ID NO: 120515 - RNA, 63 nt, Homo Sapiens
gagcucccgcccccacugggcccuccuuccuccuggugcuaauuuggggaccccaggggccgc

SEQ ID NO: 120516 - RNA, 63 nt, Homo Sapiens
ggccgucuuggugucucguggcacgcgucacaguggugcuagucuguuuuuaacaaaagagga

SEQ ID NO: 120517 - RNA, 63 nt, Homo Sapiens
cugcagacagggucggagguguuagcgagccuuuggugcuagaagccugcggggucaugugcu

SEQ ID NO: 120518 - RNA, 63 nt, Homo Sapiens
accccaugaucaagaauccugcuccacuaagaauggugcuaaaguaaaacuaguuuaauaagc

SEQ ID NO: 120519 - RNA, 63 nt, Homo Sapiens
cacacucucaccuaggugagcgcauugagccaguggugcuaaaugcuacauacuccaacugaa

SEQ ID NO: 120520 - RNA, 63 nt, Homo Sapiens
ccugaagcgcucucgagcuguucuguaaauaccuggugcuaacaucccaugccgcucccuccu

SEQ ID NO: 120521 - RNA, 63 nt, Homo Sapiens
uucagggaugucgugggcgggggaggggguucuuggugcuacagcccucuccccaccccuaaa

SEQ ID NO: 120522 - RNA, 63 nt, Homo Sapiens
ucagggaggccgggugugaccucaucuuucucauggugcuauccuggugcuauuggggugggg

SEQ ID NO: 120523 - RNA, 63 nt, Homo Sapiens
gggugugaccucaucuuucucauggugcuauccuggugcuauugggguggggagcucccuccc

SEQ ID NO: 120524 - RNA, 63 nt, Homo Sapiens
uccucccaccucagcaccugcucuggugccugguggugcuagccacaaacccuucacagacug

SEQ ID NO: 120525 - RNA, 63 nt, Homo Sapiens
gacccugcccuggggcccacggccacccccucauggugcuacacaggggcaccccgacaucca

SEQ ID NO: 120526 - RNA, 63 nt, Homo Sapiens
ccuccccagaguuaagcacuccuucacaccuuuuggugcuaccccucacuccuccgucgcugc

SEQ ID NO: 120527 - RNA, 63 nt, Homo Sapiens
cccgggcgagguggcgcccggagugacgaugauuggugcuaagcugcacgaacccuacagcga

SEQ ID NO: 120528 - RNA, 63 nt, Homo Sapiens
gccccuuggggaaauggggcuagaaagcugcacuggugcuaaucugguggcauuguuuacagc

SEQ ID NO: 120529 - RNA, 63 nt, Homo Sapiens
ggcccuuuccccaggaauccccauggagccugguggugcuaacgccuggccucugucuguuug

SEQ ID NO: 120530 - RNA, 63 nt, Homo Sapiens
auucuauucugcaaauacacuucaacuaauuuuuggugcuauuuuaauguuaauguauggaaa

SEQ ID NO: 120531 - RNA, 63 nt, Homo Sapiens
cugcaguauacagcgggaaaaacugaggcacuuuggugcuagggguuugggacugaggcgugg

SEQ ID NO: 120532 - RNA, 63 nt, Homo Sapiens
aaacgcccuccgcucccucugcucccaacccuguggugcuaggaccacuccccgccuucccua

SEQ ID NO: 120533 - RNA, 63 nt, Homo Sapiens
auaaugguuuuuaacaccuuuuacucuucuuacuggugcuauuuuguagaauaaggaacaacg

SEQ ID NO: 120534 - RNA, 63 nt, Homo Sapiens
aaugcaaguaacuagccauuguucaaaugacaguggugcuauuucucuuuuguggccuuuuag

SEQ ID NO: 120535 - RNA, 63 nt, Homo Sapiens
gcccuguugccgagcccagcugugggcggcuccuggugcuaacaacaaaguuccacuuccagg

SEQ ID NO: 120536 - RNA, 63 nt, Homo Sapiens
uuuuuugaaccccauucuuuccuucucugaaaguggugcuauaaguuuuagaaucuuuuaaau

SEQ ID NO: 120537 - RNA, 63 nt, Homo Sapiens
gacuaguuucuuugcuuuuugugauuauuuugauggugcuaguauuucuauuuuuguuauccu

SEQ ID NO: 120538 - RNA, 63 nt, Homo Sapiens
gggcccucucucugggcccaccucaacauuccauggugcuaguccagucaggcugcagaggca

SEQ ID NO: 120539 - RNA, 63 nt, Homo Sapiens
uggaaaagacacagaagccaaccugagaaccccuggugcuauuuuaaaggagacauauugcug

SEQ ID NO: 120540 - RNA, 63 nt, Homo Sapiens
ccuaagguuaacuuugaauaguuuuuuugguuauggugcuauuggagaaaauaauuuuuaugg

SEQ ID NO: 120541 - RNA, 63 nt, Homo Sapiens
gagaguagcugcugugaaacuauguagucccauuggugcuaauugagugaccguuugaaucca

SEQ ID NO: 120542 - RNA, 63 nt, Homo Sapiens
aagaauuugccugggcaguauuguggugacaguuggugcuaauuaugucagaaaaggaugagu

SEQ ID NO: 120543 - RNA, 63 nt, Homo Sapiens
ggugaccaucugguacauugggccaucuggagcuggugcuauagaguccagcugcagccacgu

SEQ ID NO: 120544 - RNA, 63 nt, Homo Sapiens
aagcgugauguucgccauacggcguggacucccuggugcuagaugcuguccauccuuuuucag

SEQ ID NO: 120545 - RNA, 63 nt, Homo Sapiens
guaucuaguuguauuauucauagaaaaucaaucuggugcuaaugguuggcccugguguuguug

SEQ ID NO: 120546 - RNA, 63 nt, Homo Sapiens
guaacaaauauaagguuuacgagcuaugagaauuggugcuaucaccauuagcuauuugcugua

SEQ ID NO: 120547 - RNA, 63 nt, Homo Sapiens
aggugcacuugacaguauugaggucauuuguuauggugcuauuucaauuagucuagguuuagg

SEQ ID NO: 120548 - RNA, 63 nt, Homo Sapiens
cauuguccccaacuuuacuacugcugccgucaauggugcuacuauauaugaucaagauaacau

SEQ ID NO: 120549 - RNA, 63 nt, Homo Sapiens
acaguauguuacaugcauucuaccacuacauuuuggugcuauuuaaggugugcaauuuucuau

SEQ ID NO: 120550 - RNA, 63 nt, Homo Sapiens
uguuuauuguuauuacuuuguuugaagaggaaauggugcuauauuuauuuuauaaguuagaac

SEQ ID NO: 120551 - RNA, 63 nt, Homo Sapiens
agaguauaugcuaucuaggcuccccuuccaaucuggugcuaguaucaccguguggcaaaacau

SEQ ID NO: 120552 - RNA, 63 nt, Homo Sapiens
caguguugauuuuugugaugaagcauguuaguuuggugcuacaaagcuguugucaauuaucua

SEQ ID NO: 120553 - RNA, 63 nt, Homo Sapiens
guuugauuuggaugauugugguuucugucaagcuggugcuacucugcugagaucugcuguccu

SEQ ID NO: 120554 - RNA, 63 nt, Homo Sapiens
gugcuuuuuugaaguuuauuguuuuuacguuguuggugcuaaauugugaucuuaguguauaua

SEQ ID NO: 120555 - RNA, 63 nt, Homo Sapiens
gaaaguacccuagacuuagauuggggaaagcuguggugcuacacucuauccagcuaaauaggc

SEQ ID NO: 120556 - RNA, 63 nt, Homo Sapiens
cauguccaggaguggccguugcuacaagucaccuggugcuacgaccagggugagaauaaagac

SEQ ID NO: 120557 - RNA, 64 nt, Homo Sapiens
accgguuuauaaaacaacagaacagccaggaaaauggugcuaggagagacaguggagaggccag

SEQ ID NO: 120558 - RNA, 64 nt, Homo Sapiens
agccuggaugccgaggaagcugcuggaugcuuaauggugcuagaggcucaaguguguuugaaac

SEQ ID NO: 120559 - RNA, 64 nt, Homo Sapiens
cugaagaccuguuauguagaggaaauacgagggguggugcuagaagacagacaucuguggaaug

SEQ ID NO: 120560 - RNA, 64 nt, Homo Sapiens
gucacuuagaaagaugggguuccuguagauuuuuuggugcuaagggauacuuugucauuaugau

SEQ ID NO: 120561 - RNA, 64 nt, Homo Sapiens
uuguuuauuaaaaaaauggaacuguacacuuguuuggugcuaauuaauacaucaaaauauacug

SEQ ID NO: 120562 - RNA, 64 nt, Homo Sapiens
gagugaugagcugagucagggauagggaguccccuggugcuaaccgugaacguagagacuuguu

SEQ ID NO: 120563 - RNA, 64 nt, Homo Sapiens
ugaucaaguguggcuguaggccuuuguuuuccaauggugcuauauucuguuuucaaacacuuca

SEQ ID NO: 120564 - RNA, 64 nt, Homo Sapiens
auggggguucuggaccagaugaucccuuccaauguggugcuagcaggcaggaucccuucuccac

SEQ ID NO: 120565 - RNA, 64 nt, Homo Sapiens
agagucucaaucuguuacccaggcuggagugcaguggugcuaucuuggcucacugcaaacccgc

SEQ ID NO: 120566 - RNA, 64 nt, Homo Sapiens
uucagcuauucuuacugacauaccagucuuuagcuggugcuauggucuguucuuuaguucuagu

SEQ ID NO: 120567 - RNA, 64 nt, Homo Sapiens
gggguggggggaaagaaacuauuaucugacacacuggugcuauuaauuauuucaaauuuauauu

SEQ ID NO: 120568 - RNA, 64 nt, Homo Sapiens
cucuugaacaguugcaaucuuggcagcuugaaaauggugcuacacucuguuuugugugccuucc

SEQ ID NO: 120569 - RNA, 64 nt, Homo Sapiens
cagggagucagaauauauuuguaaguuaaaucauuggugcuaauaauaaauguggauuuuguau

SEQ ID NO: 120570 - RNA, 64 nt, Homo Sapiens
uuauauggcaacugcagaaggcugagccuccucauggugcuauaaccccuugggacacucaucc

SEQ ID NO: 120571 - RNA, 64 nt, Homo Sapiens
gaggagguggccuuuguccccuggagcagccaguuggugcuacugcuguggccagcuggggggc

SEQ ID NO: 120572 - RNA, 64 nt, Homo Sapiens
cccugggacuggaagucgccccaggcaggcuuuuuggugcuaggaggcacagggccacuguccu

SEQ ID NO: 120573 - RNA, 64 nt, Homo Sapiens
augacauaugacaauaagccgcagguuuguuuuuuggugcuaauuaauuauaaucaaaaucaau

SEQ ID NO: 120574 - RNA, 64 nt, Homo Sapiens
gcuccuggugccaaagucugggagcccuggauucuggugcuauaaauucuugucuuugaguguu

SEQ ID NO: 120575 - RNA, 64 nt, Homo Sapiens
ggagccggaugaggacagggcgaccgggaccacguggugcuaugcccccaggaggccggggcua

SEQ ID NO: 120576 - RNA, 64 nt, Homo Sapiens
uauuuuuuaaaugguuauguuauaggaagcacgcuggugcuaagguuugaugauuuguuuggca

SEQ ID NO: 120577 - RNA, 64 nt, Homo Sapiens
gauauggucauuuacaagacacugagcaccuguuuggugcuaagccuuucuucagcuaaugauu

SEQ ID NO: 120578 - RNA, 64 nt, Homo Sapiens
gcucuuggaguggacaugaccacagccuucuacauggugcuacuucagccgaggggacccugcu

SEQ ID NO: 120579 - RNA, 64 nt, Homo Sapiens
gucuaauauaauuuuauauuagcauguucugcacuggugcuaauuuuuggaucuuaugaugcug

SEQ ID NO: 120580 - RNA, 64 nt, Homo Sapiens
agcugcuucagauauaaaauuccugccaacguguuggugcuauaagaccccaccccucugcugg

SEQ ID NO: 120581 - RNA, 64 nt, Homo Sapiens
gacuagggguccuuugugaacuguccugggcuuauggugcuauguccucuccaugcugcaauca

SEQ ID NO: 120582 - RNA, 64 nt, Homo Sapiens
auuaggcuugcuuguuacacggcuagucuaaccauggugcuauuaaugauggcuuggaaaagca

SEQ ID NO: 120583 - RNA, 64 nt, Homo Sapiens
agggacagccacaggccucuguggcgccaccugcuggugcuaaugcgcuucggagcgguccuca

SEQ ID NO: 120584 - RNA, 64 nt, Homo Sapiens
ucugauguucuuuccaugaauugaacaaauuuucuggugcuaagggaaguguuacuaucuugau

SEQ ID NO: 120585 - RNA, 64 nt, Homo Sapiens
uacacaagcuuaguguacgaaguccacaggcggguggugcuacagggagggcccuucagagcag

SEQ ID NO: 120586 - RNA, 64 nt, Homo Sapiens
cagagcugaggucauuguaucgccucccugaaaguggugcuagagagggcccagugaggacauc

SEQ ID NO: 120587 - RNA, 64 nt, Homo Sapiens
augaaaaccucugcacuuuauucaucacaauucauggugcuaaacauagugagagaaaugggau

SEQ ID NO: 120588 - RNA, 64 nt, Homo Sapiens
uggucaacccugccugcauagacccucaccuaccuggugcuagugggaggagcacauuuuucuu

SEQ ID NO: 120589 - RNA, 64 nt, Homo Sapiens
agcugacaauuuccaaagcacagauuaaacccuuuggugcuaggccuucauuaaugaugaucuu

SEQ ID NO: 120590 - RNA, 64 nt, Homo Sapiens
aaauaccuaggaaauauuuuuccagucuacaauuuggugcuauugugcaguaacuaauaguacu

SEQ ID NO: 120591 - RNA, 64 nt, Homo Sapiens
gucacucacuauugcaaggacagcaucaaagagauggugcuaaaccauucaugaugaacucacc

SEQ ID NO: 120592 - RNA, 64 nt, Homo Sapiens
uuuggagcucaguccacgguccucccccacuggauggugcuacugcuguggaaucuuguaaaaa

SEQ ID NO: 120593 - RNA, 64 nt, Homo Sapiens
ugugugaauaaagguaauuuuauugaaucuucauuggugcuaaugauggacaguuaaaaagaua

SEQ ID NO: 120594 - RNA, 64 nt, Homo Sapiens
ugacauuuacugaguuuuugcuucauguuagauauggugcuaaguuuuaaucauucaaggaaaa

SEQ ID NO: 120595 - RNA, 64 nt, Homo Sapiens
uuuuuuuaccaauuccaauuucaaaaugucucaauggugcuauaauaaauaaacuucaacacuc

SEQ ID NO: 120596 - RNA, 64 nt, Homo Sapiens
cuaauauuugggaaggcuuuaaagacgcauguuauggugcuaauguacuuucacuuuuaaacuc

SEQ ID NO: 120597 - RNA, 64 nt, Homo Sapiens
acuaagaaaaaaacuugucuucccuucugauugauggugcuauuuuguuuguuuuguuuuguuu

SEQ ID NO: 120598 - RNA, 64 nt, Homo Sapiens
auuauccuauuuucuaccauuaucuauguuuucauggugcuauuaauuacaaguuuaguucuuu

SEQ ID NO: 120599 - RNA, 64 nt, Homo Sapiens
uaucuacuuuuacucauaaguaaaagcccuagacuggugcuaaugucaaaccacuggccuccac

SEQ ID NO: 120600 - RNA, 64 nt, Homo Sapiens
gcagcuacaacaacagcugagaucacuuaauaaauggugcuaaacuagcuugucucaugcucuu

SEQ ID NO: 120601 - RNA, 64 nt, Homo Sapiens
cccugggcagaugcugcagcccgcccccuucucauggugcuacuuccucugucagcuacagaaa

SEQ ID NO: 120602 - RNA, 64 nt, Homo Sapiens
cauggccggcugcagaggacggcagcagagcgcauggugcuagcucugggccucacggugcucc

SEQ ID NO: 120603 - RNA, 64 nt, Homo Sapiens
ccuucaccccugagcacgcuaaaagcaaaaaaauuggugcuaaauuuaauuucuaaagauuaaa

SEQ ID NO: 120604 - RNA, 64 nt, Homo Sapiens
aagaguaggaauucucucuauaauaagcuuugaauggugcuaauguuuguagacaaacaacuga

SEQ ID NO: 120605 - RNA, 64 nt, Homo Sapiens
auucuuccuauaaaauuccuuuuuccuuuaaugauggugcuaaaggcuaaaaagguauuauuau

SEQ ID NO: 120606 - RNA, 64 nt, Homo Sapiens
uaugguaagggaaagggacccuggucuugggguauggugcuagcuuucccuggcuuauuucauc

SEQ ID NO: 120607 - RNA, 64 nt, Homo Sapiens
aacuggcccccagcccagcccuuggcucagaguguggugcuagaagccucauccccaggacccc

SEQ ID NO: 120608 - RNA, 64 nt, Homo Sapiens
gccaauguauuugaaugcuuuuaaauauuuuaaauggugcuauacaaacuaacaagaggcagug

SEQ ID NO: 120609 - RNA, 64 nt, Homo Sapiens
gugucuguggacccucgcucaugaccuaucaguauggugcuaaugggagggaacauccugcugc

SEQ ID NO: 120610 - RNA, 64 nt, Homo Sapiens
guugcaaucugguugugauuuauauuuuaaagcuuggugcuaaaccacaauauguauagcauau

SEQ ID NO: 120611 - RNA, 64 nt, Homo Sapiens
uugcagcugagggauuuucacagugugcuccagauggugcuagaggaagucccagagccuguaa

SEQ ID NO: 120612 - RNA, 64 nt, Homo Sapiens
ccccugccccacuggggauaggagccugugucccuggugcuaagcacucucuucacuugggcca

SEQ ID NO: 120613 - RNA, 64 nt, Homo Sapiens
agagucucacucuguugcucuggcuggagugcaguggugcuaucucagcucacugcaagcucca

SEQ ID NO: 120614 - RNA, 64 nt, Homo Sapiens
uucucuugauuugaccucagugcuuugaauucacuggugcuacaauauguaacugugguuaauu

SEQ ID NO: 120615 - RNA, 64 nt, Homo Sapiens
aaaaucuggaaaagugcucauauucacagguggcuggugcuagucuaacuuaauucauguguau

SEQ ID NO: 120616 - RNA, 64 nt, Homo Sapiens
ucuaagaaguguguucaugcaacagccauagagauggugcuauugaaaggcaaucugcccaucc

SEQ ID NO: 120617 - RNA, 64 nt, Homo Sapiens
caggugauccucccaccucagcuuccagauuagcuggugcuauaggcaugcaccaccacgucca

SEQ ID NO: 120618 - RNA, 64 nt, Homo Sapiens
ggcuuucucccugucuggauucaguggcucacguuggugcuacacagcuagaauagauauauuu

SEQ ID NO: 120619 - RNA, 64 nt, Homo Sapiens
gcaauuauaauuacaucugugauuucugaacuaauggugcuaauucagagaaauggaaagugaa

SEQ ID NO: 120620 - RNA, 64 nt, Homo Sapiens
ccaggaccccuuuugucucugggaccagacuuguuggugcuaccccuuacuccccucugcaacc

SEQ ID NO: 120621 - RNA, 64 nt, Homo Sapiens
gacccagcgcugcccgugccccuagcaggagcccuggugcuacccccugugaagagccaagcag

SEQ ID NO: 120622 - RNA, 64 nt, Homo Sapiens
ccauacuagguucagucugaaagaaaucuccuaauggugcuauagagagggagguaacagaaag

SEQ ID NO: 120623 - RNA, 64 nt, Homo Sapiens
auccuccugaccucaaagugucagaugggaaggguggugcuaaguaagcagugggguugggacc

SEQ ID NO: 120624 - RNA, 64 nt, Homo Sapiens
ugcuuacuucgggauagcaggcauuacuucaacauggugcuaaggccaugaagaauguguagau

SEQ ID NO: 120625 - RNA, 64 nt, Homo Sapiens
acauucugacacauaucauuaucuguaguuuuuuuggugcuauaaauuuguccauuuaaaaaug

SEQ ID NO: 120626 - RNA, 64 nt, Homo Sapiens
uacuaaagauuuuggcagaagaagccugacuacuuggugcuaacagcugaaaggaaaaaaagua

SEQ ID NO: 120627 - RNA, 64 nt, Homo Sapiens
aaucagauucaacccgaaggccauguaugagaucuggugcuagcucagcuucacauaccccucu

SEQ ID NO: 120628 - RNA, 64 nt, Homo Sapiens
ggcuugugugcacgugagcgacugucccuccccuuggugcuagacggggucucagcagaacccc

SEQ ID NO: 120629 - RNA, 64 nt, Homo Sapiens
auuguauguauuuaaaugauaaaauaugcugccuuggugcuaauuucaugugaucucugggaaa

SEQ ID NO: 120630 - RNA, 64 nt, Homo Sapiens
ugaagaaaaaaauguacauuauugauuuuauaauuggugcuauuuuugucauuuuaugaauauc

SEQ ID NO: 120631 - RNA, 64 nt, Homo Sapiens
cagaaaagaaauuuggaccuuguguggaugaucuuggugcuaagaguaacuucagguuggaucc

SEQ ID NO: 120632 - RNA, 64 nt, Homo Sapiens
cucugcaacacgacacccagggugacaucaggaauggugcuagcgaggaccacgucucacccag

SEQ ID NO: 120633 - RNA, 64 nt, Homo Sapiens
uguggucuucuugacacauuuaaaguuccuuuccuggugcuaacaaaguaaucagaagcuaaag

SEQ ID NO: 120634 - RNA, 64 nt, Homo Sapiens
aaucaccgucuguguuugagcuggauuugagucuuggugcuaucuggcauuggugucuggagac

SEQ ID NO: 120635 - RNA, 64 nt, Homo Sapiens
uuguagcuaucuuugaaaucacuugacuuugcaauggugcuaagcugauagauuuaaauacaca

SEQ ID NO: 120636 - RNA, 64 nt, Homo Sapiens
caaaaagagugaaaauauuuuaauuagcaguagauggugcuacuggcuuucauuugcugacuug

SEQ ID NO: 120637 - RNA, 64 nt, Homo Sapiens
uuaauuuuuuaaucuuaguuuaauggucucucccuggugcuaacugcugacaguggccaccucu

SEQ ID NO: 120638 - RNA, 64 nt, Homo Sapiens
ggaaaaaaaagauuuguuucugaaagacuucuuauggugcuauuccauaaacuuuuuuucaaac

SEQ ID NO: 120639 - RNA, 64 nt, Homo Sapiens
ccugacaaauaagagaucaugaaugagaaugucauggugcuaaagaaugaguguuuuuuuaagg

SEQ ID NO: 120640 - RNA, 64 nt, Homo Sapiens
ugaagacucugcuaauauagaguucucacuuaacuggugcuaugaauuauuacuguguucgcac

SEQ ID NO: 120641 - RNA, 64 nt, Homo Sapiens
uaaaaaauuguaaagacuggacauuuuauuaugauggugcuaggagagagcacuuugaaagaua

SEQ ID NO: 120642 - RNA, 64 nt, Homo Sapiens
aguaggucuucaaauauggguuaauucuugaugcuggugcuagacugugaguccugagauggau

SEQ ID NO: 120643 - RNA, 64 nt, Homo Sapiens
guuagauuaaucugcauuuuauuucauucucguauggugcuagagcucugacaaaaauacaugu

SEQ ID NO: 120644 - RNA, 64 nt, Homo Sapiens
gaaauucuauuuauuaaugaaagugucacccuuuuggugcuaagcaggagaauucacaauuaaa

SEQ ID NO: 120645 - RNA, 64 nt, Homo Sapiens
aggauaaaacacgucauguggauucauuuugaauuggugcuauugguauuuccucuguuauugc

SEQ ID NO: 120646 - RNA, 64 nt, Homo Sapiens
gggucaaaagcugccccacccacucucccucacauggugcuaggcugggagcugcccugagagc

SEQ ID NO: 120647 - RNA, 64 nt, Homo Sapiens
cugucaacccuccugcccuuuguggucuuagguauggugcuauagguugcaugcgucuuuaucu

SEQ ID NO: 120648 - RNA, 64 nt, Homo Sapiens
uggcuucuuguccuucucuuugacuucuguggcauggugcuagugcauguacccugugguauug

SEQ ID NO: 120649 - RNA, 64 nt, Homo Sapiens
ugguauuuuaggccaagugugcacccacauccaauggugcuacaagugacugaaauaauauuug

SEQ ID NO: 120650 - RNA, 64 nt, Homo Sapiens
ugcuacccccgcugcccccuccacaguuccugaauggugcuaaggaucugcagcaguuggcaac

SEQ ID NO: 120651 - RNA, 64 nt, Homo Sapiens
cccuugugcagcggaccacuugcccaguuugcuguggugcuagccuuccccaucauccaccggg

SEQ ID NO: 120652 - RNA, 64 nt, Homo Sapiens
gugcccuggugaaauaaauaaagaacaguuaacuuggugcuaauaauucccuugcgccuuuuca

SEQ ID NO: 120653 - RNA, 64 nt, Homo Sapiens
aaaugaaaauauuagaaaguauguuuucuccuuuuggugcuaaaauaaccagccuuguaacaau

SEQ ID NO: 120654 - RNA, 64 nt, Homo Sapiens
acuaauaacaucucuuaccacuauuggaaggaaauggugcuaaauguauuguauuaaaaugaga

SEQ ID NO: 120655 - RNA, 64 nt, Homo Sapiens
uuggacuuucaacaugcuccgagacacugaugaauggugcuauugagaugcugccacaggaccu

SEQ ID NO: 120656 - RNA, 64 nt, Homo Sapiens
uuaaaacuaaaaaaaacuuuuccccuuccucaaguggugcuauuggacuuugaacuuaaauaua

SEQ ID NO: 120657 - RNA, 64 nt, Homo Sapiens
ccaugcaggggucagugcaguccugccauucuucuggugcuacuugucaagacauuucucuaac

SEQ ID NO: 120658 - RNA, 64 nt, Homo Sapiens
caucccgcggagcuucugcuugggcuccggcgacuggugcuacgcagcggcgaacgccaggcuc

SEQ ID NO: 120659 - RNA, 64 nt, Homo Sapiens
uuucuauuuauuuucuacaucuggccaguggcucuggugcuagaugccacuguagccagaucuc

SEQ ID NO: 120660 - RNA, 64 nt, Homo Sapiens
uuacugaauaaggugcuucugcuucuucuagagauggugcuaaagaaaggacuagcauaugaga

SEQ ID NO: 120661 - RNA, 64 nt, Homo Sapiens
accaauggggcuggugggcaugcuguccacuguguggugcuaggacugccaaugccaggcccaa

SEQ ID NO: 120662 - RNA, 64 nt, Homo Sapiens
aagaaauuaauuugcaguguuuggauuguauauauggugcuaaaaauaaauuaauuuacuuuau

SEQ ID NO: 120663 - RNA, 64 nt, Homo Sapiens
uuuaucccgaaaaaguguacauagaucuaaaauuuggugcuauguguauaucuugagcuuuuaa

SEQ ID NO: 120664 - RNA, 64 nt, Homo Sapiens
ugugcauguacauagaauucuuucuguauucagauggugcuaauucagacuccagacugaauuu

SEQ ID NO: 120665 - RNA, 64 nt, Homo Sapiens
uuguauuuucauugaaguaggagagauuaucagauggugcuaaagaaagugugaagaucuuaug

SEQ ID NO: 120666 - RNA, 64 nt, Homo Sapiens
ugcaagaaguggggccucgagcugucagucaucauggugcuauccucugaaccccucagcugcc

SEQ ID NO: 120667 - RNA, 64 nt, Homo Sapiens
gcaguuauaccuaacauauuaugcaauuuucucuuggugcuaccugauggaauuccugcacuua

SEQ ID NO: 120668 - RNA, 64 nt, Homo Sapiens
uauugcuacuauuuuauagaucagugguaauaaauggugcuagaacauuccuuaacccgcugcc

SEQ ID NO: 120669 - RNA, 64 nt, Homo Sapiens
acccccauuaccugagggaacuuaauauucacuuuggugcuacuaaguagaggccuuucugacu

SEQ ID NO: 120670 - RNA, 64 nt, Homo Sapiens
uccccucucuccuccucaaccggaaaggaaccaauggugcuauucuucuccccgcacauacuca

SEQ ID NO: 120671 - RNA, 64 nt, Homo Sapiens
cggacuucggagcauagaguaacacggggagcgguggugcuacacaagcuaagccagcucagag

SEQ ID NO: 120672 - RNA, 64 nt, Homo Sapiens
agcucuccaccaggugguguggcaccccccacuuuggugcuaauccucggcucucccacaggug

SEQ ID NO: 120673 - RNA, 64 nt, Homo Sapiens
uauguauuaaguuggguccuucccagcucugucauggugcuaucuacagucaugucuuaaugga

SEQ ID NO: 120674 - RNA, 64 nt, Homo Sapiens
aaagaguauuaauuacuuugaauuagauuaaugguggugcuaaguaauucauuucaaacucuaa

SEQ ID NO: 120675 - RNA, 64 nt, Homo Sapiens
gauuguuaaauucaaugcuuuauucuugacuccuuggugcuaaaauaaacccauuuuggugcaa

SEQ ID NO: 120676 - RNA, 64 nt, Homo Sapiens
ccuugcccaggcaaggaaagaguuaccuucacaauggugcuaccucuucucgagcaggagugau

SEQ ID NO: 120677 - RNA, 64 nt, Homo Sapiens
ucugaaacgagcguuagaguucuuccuuccaacguggugcuauccaugagguuuucauuuuuau

SEQ ID NO: 120678 - RNA, 64 nt, Homo Sapiens
auuaauaguauuucagauacuugaagaauguugauggugcuagaagaauuugagaagaaauacu

SEQ ID NO: 120679 - RNA, 64 nt, Homo Sapiens
cagagagcauagcugcuuccaucucuuacccaaguggugcuaaacaauuuuucuuccaauguuu

SEQ ID NO: 120680 - RNA, 64 nt, Homo Sapiens
ucagguaauaauaggcuugaaaauugauauccuguggugcuaaaguacaguagaaagagaggag

SEQ ID NO: 120681 - RNA, 64 nt, Homo Sapiens
guuaguuaauagcauugggauauagucacuguaauggugcuauuaacaaacagucaacaccauu

SEQ ID NO: 120682 - RNA, 64 nt, Homo Sapiens
ccuauuaaugucucacuuuacuuucaaguaauauuggugcuauuuaacauuuuacaguaaaugu

SEQ ID NO: 120683 - RNA, 64 nt, Homo Sapiens
gccagguugggagggggaaggugagggcuucggguggugcuauaauguggcacuggaucuugag

SEQ ID NO: 120684 - RNA, 64 nt, Homo Sapiens
aagacugagcaccugcuucaugcucagcccugacuggugcuauaggcuggagaagcucacccaa

SEQ ID NO: 120685 - RNA, 64 nt, Homo Sapiens
gagccucaggcucuccugcccugggccucccaauuggugcuaucuguuacugcccgugcucacg

SEQ ID NO: 120686 - RNA, 64 nt, Homo Sapiens
aucccuggcugccugugaauggcccacauuugaguggugcuaacuugaugugaguaggcauuaa

SEQ ID NO: 120687 - RNA, 64 nt, Homo Sapiens
uuguuuacuugguuuucuagguguuaaccagucauggugcuagacccuaaaugucagugcagca

SEQ ID NO: 120688 - RNA, 64 nt, Homo Sapiens
caauuaugcucuguguuucaaagcaauucuaugcuggugcuauggacccaauucaucaacugga

SEQ ID NO: 120689 - RNA, 64 nt, Homo Sapiens
auuuuauuugaaaaaaguuauauuuuaucugguauggugcuaaugaaggccaauaguuuuagau

SEQ ID NO: 120690 - RNA, 64 nt, Homo Sapiens
acagugugagacucagguugaacuguuuucuucuuggugcuauggcuauaagaaaagugaaagu

SEQ ID NO: 120691 - RNA, 64 nt, Homo Sapiens
ugucugcuuuagcacgcacgcuccgaaugacuccuggugcuaggccaugcuggcugcugucacu

SEQ ID NO: 120692 - RNA, 64 nt, Homo Sapiens
aaggucauuguggcuaucugcauuuauaaauguguggugcuaacuguaugugucuuuaucagug

SEQ ID NO: 120693 - RNA, 64 nt, Homo Sapiens
gcauagugcugugucauccugguccauguaggacuggugcuaaccaccugccaucaugaggaug

SEQ ID NO: 120694 - RNA, 64 nt, Homo Sapiens
aggugugcuuucuugagcccucauaaggaaguacuggugcuagguuuugcaagauuuuguauac

SEQ ID NO: 120695 - RNA, 64 nt, Homo Sapiens
cacagccugccauauuuuucacagcaugcaacaauggugcuaggauagcuauuucuuacuguaa

SEQ ID NO: 120696 - RNA, 64 nt, Homo Sapiens
acgagggccgaaacuccugucugcuaucgagcccuggugcuauguggccccggagccacagcac

SEQ ID NO: 120697 - RNA, 64 nt, Homo Sapiens
ucagcucaccacaaccucugaggcuggagugcgguggugcuauugaguuuugcucucauugccc

SEQ ID NO: 120698 - RNA, 64 nt, Homo Sapiens
gaggccagggugcaggguucguucuucacaguguuggugcuaaugcacuuucucugccacagcu

SEQ ID NO: 120699 - RNA, 64 nt, Homo Sapiens
gagcguuuucuuuugguaaaaaguauuaccauuauggugcuacucuaucuuauguauuucuuuu

SEQ ID NO: 120700 - RNA, 64 nt, Homo Sapiens
aaacccugaccagacacuuguuuaaggaaacucuuggugcuacaucugacgcguaacugcccau

SEQ ID NO: 120701 - RNA, 64 nt, Homo Sapiens
gacucagaucaaagacaaaaucugauccauauauuggugcuagauucugcaggaaaccccagca

SEQ ID NO: 120702 - RNA, 64 nt, Homo Sapiens
agacgcaugcaagacucagacccggggaaugguguggugcuaaucucaacaccugacauucaca

SEQ ID NO: 120703 - RNA, 64 nt, Homo Sapiens
ugucuugugcuggucuguuaaauccugcccuccuuggugcuagauccaguugugccucagggca

SEQ ID NO: 120704 - RNA, 64 nt, Homo Sapiens
gccagggccaucuggacuaugggggcuuaugaguuggugcuagauaaggagaugggccuggggu

SEQ ID NO: 120705 - RNA, 64 nt, Homo Sapiens
cugguuacaacuugagauuuggcauccaugucaguggugcuaugcuaucaaggaguucuaucaa

SEQ ID NO: 120706 - RNA, 64 nt, Homo Sapiens
gauaaauauuacauuuaccccugaccaugggauguggugcuaauugccguuuauucaggugggg

SEQ ID NO: 120707 - RNA, 64 nt, Homo Sapiens
ggccaagggucauuuuauaccucugggccuggguuggugcuauaagguucaaaacuggcuuuuc

SEQ ID NO: 120708 - RNA, 64 nt, Homo Sapiens
auaaaauccaauauuguaauaauaaaggacaggcuggugcuaacuccagguaaaugguaugauc

SEQ ID NO: 120709 - RNA, 64 nt, Homo Sapiens
gagaagguccuccuuccucuagaggggcguggcguggugcuacuaaccuuuucagaaucauggc

SEQ ID NO: 120710 - RNA, 64 nt, Homo Sapiens
gcacucgguugucuuuacuuuuaaaaguaauacuuggugcuaagaauuucaggauuauuguauu

SEQ ID NO: 120711 - RNA, 64 nt, Homo Sapiens
cacuccccagcguggccucacugucuucuggucuuggugcuacugaaauugucacccagaauuu

SEQ ID NO: 120712 - RNA, 64 nt, Homo Sapiens
gcuuguuguuugcgcauuuuuuuuuaaagcauauuggugcuagaaaaggcagcuaaaggaagug

SEQ ID NO: 120713 - RNA, 64 nt, Homo Sapiens
ucuguguuacgacauuaauugcaaauagcaaguauggugcuaaagucuacaccaauggaauuag

SEQ ID NO: 120714 - RNA, 64 nt, Homo Sapiens
aauuuaaucugugaggaacuaaaugacaggagauuggugcuaauacgggggaccaagcuuuguc

SEQ ID NO: 120715 - RNA, 64 nt, Homo Sapiens
gacuugccuaguuguacccaccccuccaggucccuggugcuagagcuucugagaagggccuuuc

SEQ ID NO: 120716 - RNA, 64 nt, Homo Sapiens
aaucuaagucuuccaaugccugcaucaaacuuucuggugcuaggaaaggaaaaaaauaauaauu

SEQ ID NO: 120717 - RNA, 64 nt, Homo Sapiens
gugaguucguucugacucuuaagagucuaggaaauggugcuauuacggaaaggaaucuaauucc

SEQ ID NO: 120718 - RNA, 64 nt, Homo Sapiens
uuccauugugacuuuggaaucaauuuucuguguguggugcuaaugaugaaaugcucuuuacauu

SEQ ID NO: 120719 - RNA, 64 nt, Homo Sapiens
ugaccugggguccagcgaggagaaacacaggcccuggugcuaucgaggcaggaccuucggccua

SEQ ID NO: 120720 - RNA, 64 nt, Homo Sapiens
gucuguuaaacagggcuggcgcuucaucccgaaguggugcuauguccuuuauuuguuuagacgu

SEQ ID NO: 120721 - RNA, 64 nt, Homo Sapiens
auugcugugcaaagaaauucaggagcuuaguaaguggugcuacaauuuucuuauuuucuggugg

SEQ ID NO: 120722 - RNA, 64 nt, Homo Sapiens
agagggccugugcuccacacgggacuugggucuuuggugcuagguggguggggguuggguggga

SEQ ID NO: 120723 - RNA, 64 nt, Homo Sapiens
ccaagaagcugagcuggcagagagcuccaccauuuggugcuaaaaaaaaaaacguccugagguu

SEQ ID NO: 120724 - RNA, 64 nt, Homo Sapiens
ccuggggcuguauuuaucucugaggcaugguguguggugcuacagggaauuuguacguuuauac

SEQ ID NO: 120725 - RNA, 64 nt, Homo Sapiens
cccacccucccacacagccggccacagggagaacuggugcuaaccagggugcuugcuuugguca

SEQ ID NO: 120726 - RNA, 64 nt, Homo Sapiens
cccaguuacuaacuacggaaauagcauccucugcuggugcuaagugugauuaggaagaagccug

SEQ ID NO: 120727 - RNA, 64 nt, Homo Sapiens
agagucucacuuugucacccaugcuggaguauaguggugcuaucucggcucacugcaaccauug

SEQ ID NO: 120728 - RNA, 64 nt, Homo Sapiens
acaauuucugguguucaaccccugugcuugcugguggugcuaacgggcggaagagucagaggac

SEQ ID NO: 120729 - RNA, 64 nt, Homo Sapiens
ucauuccugcuguaagagaagcgcacaccucucuuggugcuauugauugucuauguaacaugua

SEQ ID NO: 120730 - RNA, 64 nt, Homo Sapiens
gauuccgcuauuucacagacuccauaacuccuuuuggugcuaauuuuuaauaauauauacaagc

SEQ ID NO: 120731 - RNA, 64 nt, Homo Sapiens
aaguaaaagaugaaauguucguuaucaagucuguuggugcuaaaugucagaucagcaucaggcu

SEQ ID NO: 120732 - RNA, 64 nt, Homo Sapiens
uuacuuggcagccaagaauuuggagguuuuaaaauggugcuaauucuguccucugaggucuucc

SEQ ID NO: 120733 - RNA, 64 nt, Homo Sapiens
ugagacagggaagagaagugcaagaauugguugcuggugcuacauggcggcagcuuugacauuu

SEQ ID NO: 120734 - RNA, 64 nt, Homo Sapiens
aaucaaaaucauaguaaaauauuaccuguuuucauggugcuaauauuaccuguucucccacugc

SEQ ID NO: 120735 - RNA, 64 nt, Homo Sapiens
aagaaaaaggggcaguuuucuuugcccaagcauuuggugcuaguuagaggcuguucacucucuc

SEQ ID NO: 120736 - RNA, 64 nt, Homo Sapiens
cuaaucaggccccuguuaugcuuagggggagcccuggugcuacuugcuugaaguuuucagugua

SEQ ID NO: 120737 - RNA, 64 nt, Homo Sapiens
acaugauuuuuuuugaguagggagcauuaguaccuggugcuagagaauagaacccucaaauaau

SEQ ID NO: 120738 - RNA, 64 nt, Homo Sapiens
uguauaccuuugugauuuucuaaugaguuuuccauggugcuacaaauaauccagacuaccaggu

SEQ ID NO: 120739 - RNA, 64 nt, Homo Sapiens
cccucgauguacauagcuuuagcagccgccuacuuggugcuaacugcaggggcaagcaggagcu

SEQ ID NO: 120740 - RNA, 64 nt, Homo Sapiens
uggcccaggcacuggaguggacugucuuccacacuggugcuaaccuguuguccggagccagcuc

SEQ ID NO: 120741 - RNA, 64 nt, Homo Sapiens
aagccauuucucuugauuuuuaacauugcaguaauggugcuacgaauaacaacguauguaauug

SEQ ID NO: 120742 - RNA, 64 nt, Homo Sapiens
uuuauuuccaauggauauuuucauacuuucccacuggugcuauugcugauuugucuuauuuuuu

SEQ ID NO: 120743 - RNA, 64 nt, Homo Sapiens
uaaacaauuuuuuucuaacguauaacugaauuuauggugcuauuauuacuugaggugugccuug

SEQ ID NO: 120744 - RNA, 64 nt, Homo Sapiens
ccuccaagugucaugauuuauucauuuuggaugcuggugcuaaaugcuuuuuuuuccguuuuug

SEQ ID NO: 120745 - RNA, 64 nt, Homo Sapiens
caggaagaagccaguaaacaguuggggggaagaguggugcuagcguagcuuaaaaauguugggg

SEQ ID NO: 120746 - RNA, 64 nt, Homo Sapiens
cugugucaaacaccucuguauguguccuacacaauggugcuauuugccgggcgcaggaacugug

SEQ ID NO: 120747 - RNA, 64 nt, Homo Sapiens
ugaguuggacagaauucuagguccaucucacuucuggugcuaccaaggccuucucuacaaccua

SEQ ID NO: 120748 - RNA, 64 nt, Homo Sapiens
aauugaacuggaacacagcaucuagggucacagauggugcuauuaguacuggacgugcucaggg

SEQ ID NO: 120749 - RNA, 64 nt, Homo Sapiens
auauaaguuuggaaguuugcuauuuuccaugccuuggugcuagcaauuuggguauuauugaaaa

SEQ ID NO: 120750 - RNA, 64 nt, Homo Sapiens
guuucuuuaagaaaguacuucagcuaugccaauguggugcuauuuuucccauuuauuguuuggc

SEQ ID NO: 120751 - RNA, 64 nt, Homo Sapiens
uuguaguuuguuauaugaaaguuuuuuaguauaauggugcuauucaaacaguauguaaaacucu

SEQ ID NO: 120752 - RNA, 64 nt, Homo Sapiens
ccaggguggccagccccgccgcgcggggucuccauggugcuaggaguagggcaccgugagugca

SEQ ID NO: 120753 - RNA, 64 nt, Homo Sapiens
auaacacuccuaagaaauguugauggcuauuuuguggugcuaacauguaguuggggcaccuaua

SEQ ID NO: 120754 - RNA, 64 nt, Homo Sapiens
aaggagcacuccacagucggagguguaaucauauuggugcuauuucuuggaagagaaguuauug

SEQ ID NO: 120755 - RNA, 64 nt, Homo Sapiens
auaugaauaacccacagauguacugaauuacuuuuggugcuaucuuguacucuucaaucuguaa

SEQ ID NO: 120756 - RNA, 64 nt, Homo Sapiens
uuccucucuuggagagccaauagaaagcccgacauggugcuaguuggaaagagaaugcuuccca

SEQ ID NO: 120757 - RNA, 64 nt, Homo Sapiens
gagaaggcaaccuucacuggaccaugagggguaguggugcuagggaagucuccugauucggaca

SEQ ID NO: 120758 - RNA, 64 nt, Homo Sapiens
ucuucuucuuuuuguuaacacuaaugucacaacauggugcuacucauaaugaagccugacucag

SEQ ID NO: 120759 - RNA, 64 nt, Homo Sapiens
auauaugcuuaggaggacagcugcaaauaaaagguggugcuaugugaaauuuacauaucaagua

SEQ ID NO: 120760 - RNA, 64 nt, Homo Sapiens
cagaaaauuccuagcucacaguuacaaucuguauuggugcuaguauguucuagucuguugcgcu

SEQ ID NO: 120761 - RNA, 64 nt, Homo Sapiens
guuccccaguucauaugugagagagacuugauuuuggugcuaaaggggaagcuagauggacuag

SEQ ID NO: 120762 - RNA, 64 nt, Homo Sapiens
ccaagacuguaacagggagaccugcauggucaaguggugcuaacaagaaaaaccaaaacccaac

SEQ ID NO: 120763 - RNA, 64 nt, Homo Sapiens
uuuauguauuaugcuugaaaauuuuuccccuguuuggugcuaugucuucuuuucuuuugcaugc

SEQ ID NO: 120764 - RNA, 64 nt, Homo Sapiens
ccugcauguaaacacgccugccaguggucucacauggugcuacgaggaccucugaaacccugga

SEQ ID NO: 120765 - RNA, 64 nt, Homo Sapiens
uuuccucuguucaaagcugccugucccuaccccauggugcuaggaagaggaguggggugguguc

SEQ ID NO: 120766 - RNA, 64 nt, Homo Sapiens
cauuaagugacuggauauguaaagucguuuaauguggugcuaaaaaguaaaggacuuuuaauca

SEQ ID NO: 120767 - RNA, 64 nt, Homo Sapiens
cccucgugaaauagugugcaguggaggucucuuguggugcuagauguguguuuagagcuaaacc

SEQ ID NO: 120768 - RNA, 64 nt, Homo Sapiens
aaugaaaucuucuugauuuuaaauaauauacgaauggugcuauuaauauugcuaaaaucaacgu

SEQ ID NO: 120769 - RNA, 64 nt, Homo Sapiens
ccagccugggugcacaguagcugcaacuccccauuggugcuaccuggcucuccugucucugcag

SEQ ID NO: 120770 - RNA, 64 nt, Homo Sapiens
aaguugcaggaggagagguggauggcaaugugauuggugcuauaacucaggcagccugggaguc

SEQ ID NO: 120771 - RNA, 64 nt, Homo Sapiens
agugaaguaaggcccaaaggagaaaagacaacauuggugcuaacuuauaacuuuugcauaugug

SEQ ID NO: 120772 - RNA, 64 nt, Homo Sapiens
aaauuuucaaacuagauuuauuaugguaccuauuuggugcuaguacaaguacuagguuguccau

SEQ ID NO: 120773 - RNA, 64 nt, Homo Sapiens
ccccucucacuacccagcagccccugcgcccuaauggugcuaacggcuguggcggagcucccgc

SEQ ID NO: 120774 - RNA, 64 nt, Homo Sapiens
caagagauaugaggaugggaagauuuuguggacuuggugcuaguaugaagcucauuucucccag

SEQ ID NO: 120775 - RNA, 64 nt, Homo Sapiens
ucauuuuuuaaguauuucuauaaaacuuaaguaauggugcuacuaaaguucuacauaauaaagg

SEQ ID NO: 120776 - RNA, 64 nt, Homo Sapiens
acugccuuccgccauccccacuuuggacaauaaauggugcuaugggggcccucaggugugugua

SEQ ID NO: 120777 - RNA, 64 nt, Homo Sapiens
cagcuuugcucugagugccuacaaagcuaaugcuuggugcuagaaacaucaucauuauuaaacu

SEQ ID NO: 120778 - RNA, 64 nt, Homo Sapiens
gagaugcucacugagcugcugcuuuuaugugugcuggugcuauguguguucauguccgcggcag

SEQ ID NO: 120779 - RNA, 64 nt, Homo Sapiens
cucgauccugaagaucgugugaaggaagcguucuuggugcuacacacagucuggaaaagcagcc

SEQ ID NO: 120780 - RNA, 64 nt, Homo Sapiens
ccuuggggagaccaaaagucggacaggaaacaucuggugcuauuaucugggacuuggccugacc

SEQ ID NO: 120781 - RNA, 64 nt, Homo Sapiens
gggcagccccagcccagcccgccgggagcaaggauggugcuaggucauucauggcuggccuccc

SEQ ID NO: 120782 - RNA, 64 nt, Homo Sapiens
agggacugcugugcagacccaagcaaucccaaccuggugcuaggucauuucacuuuucugaaaa

SEQ ID NO: 120783 - RNA, 64 nt, Homo Sapiens
ggaaaguuugccaggaggaacaaagagauugugguggugcuaaaggaggccauaagcuacacag

SEQ ID NO: 120784 - RNA, 64 nt, Homo Sapiens
aacaagagcucucugccuccggucacucuugcuguggugcuacguggaagugaauggagacuga

SEQ ID NO: 120785 - RNA, 64 nt, Homo Sapiens
uuuauacagugaagcaacaguacacugcauuugcuggugcuauuccacuaucuuaauuuugcga

SEQ ID NO: 120786 - RNA, 64 nt, Homo Sapiens
cagacccuugggagguggcccuaucccuaggcaguggugcuaggaggacagaaggcuauauggg

SEQ ID NO: 120787 - RNA, 64 nt, Homo Sapiens
gauguugugugugcuggggagggguccuucuguuuggugcuacccuugucuacucugccccugg

SEQ ID NO: 120788 - RNA, 64 nt, Homo Sapiens
gauuuaccauuccuuauuauacaagucuuugaaauggugcuauguaaaugagaaaucagugaca

SEQ ID NO: 120789 - RNA, 64 nt, Homo Sapiens
agcuucagcggaacaggguguuugaguggcagcguggugcuagccccaccgagagccaggcagc

SEQ ID NO: 120790 - RNA, 64 nt, Homo Sapiens
gaaauugagaugcccccccaggggagggaaucacuggugcuauaaucuaugugauggguggggu

SEQ ID NO: 120791 - RNA, 64 nt, Homo Sapiens
acaggagcuacaccuugaucuuuccuaguuguccuggugcuaacccuacucuuugcaccugacu

SEQ ID NO: 120792 - RNA, 64 nt, Homo Sapiens
gggagggaacagaaguuaggaggcaacuuugggauggugcuagagcauggaaagcacagagaau

SEQ ID NO: 120793 - RNA, 64 nt, Homo Sapiens
guuacacaauauggaggcaauauuguguuuuccauggugcuacauguuacuacaauaauacaug

SEQ ID NO: 120794 - RNA, 64 nt, Homo Sapiens
uggcaauagauaacucagcguugauuuggagaauuggugcuaguguguguuuuccucacacacu

SEQ ID NO: 120795 - RNA, 64 nt, Homo Sapiens
cgagcucccgcccccacugggcccuccuuccuccuggugcuaauuuggggaccccaggggccgc

SEQ ID NO: 120796 - RNA, 64 nt, Homo Sapiens
gggccgucuuggugucucguggcacgcgucacaguggugcuagucuguuuuuaacaaaagagga

SEQ ID NO: 120797 - RNA, 64 nt, Homo Sapiens
ccugcagacagggucggagguguuagcgagccuuuggugcuagaagccugcggggucaugugcu

SEQ ID NO: 120798 - RNA, 64 nt, Homo Sapiens
caccccaugaucaagaauccugcuccacuaagaauggugcuaaaguaaaacuaguuuaauaagc

SEQ ID NO: 120799 - RNA, 64 nt, Homo Sapiens
ucacacucucaccuaggugagcgcauugagccaguggugcuaaaugcuacauacuccaacugaa

SEQ ID NO: 120800 - RNA, 64 nt, Homo Sapiens
uccugaagcgcucucgagcuguucuguaaauaccuggugcuaacaucccaugccgcucccuccu

SEQ ID NO: 120801 - RNA, 64 nt, Homo Sapiens
uuucagggaugucgugggcgggggaggggguucuuggugcuacagcccucuccccaccccuaaa

SEQ ID NO: 120802 - RNA, 64 nt, Homo Sapiens
cucagggaggccgggugugaccucaucuuucucauggugcuauccuggugcuauuggggugggg

SEQ ID NO: 120803 - RNA, 64 nt, Homo Sapiens
cgggugugaccucaucuuucucauggugcuauccuggugcuauugggguggggagcucccuccc

SEQ ID NO: 120804 - RNA, 64 nt, Homo Sapiens
uccucccaccucagcaccuggcucuggugccugguggugcuagcacacaaacccuucacagacu

SEQ ID NO: 120805 - RNA, 64 nt, Homo Sapiens
gacccugcccuggggcccacaggccacccccucauggugcuacaccaggggcaccccgacaucc

SEQ ID NO: 120806 - RNA, 64 nt, Homo Sapiens
ccuccccagaguuaagcacucccuucacaccuuuuggugcuaccuccucacuccuccgucgcug

SEQ ID NO: 120807 - RNA, 64 nt, Homo Sapiens
cccgggcgagguggcgcccgagagugacgaugauuggugcuaagccugcacgaacccuacagcg

SEQ ID NO: 120808 - RNA, 64 nt, Homo Sapiens
gccccuuggggaaauggggccuagaaagcugcacuggugcuaaugcugguggcauuguuuacag

SEQ ID NO: 120809 - RNA, 64 nt, Homo Sapiens
ggcccuuuccccaggaauccgccauggagccugguggugcuaacggccuggccucugucuguuu

SEQ ID NO: 120810 - RNA, 64 nt, Homo Sapiens
auucuauucugcaaauacacauucaacuaauuuuuggugcuauuuuuaauguuaauguauggaa

SEQ ID NO: 120811 - RNA, 64 nt, Homo Sapiens
gcugcaguauacagcgggaaaaacugaggcacuuuggugcuagggguuugggacugaggcgugg

SEQ ID NO: 120812 - RNA, 64 nt, Homo Sapiens
caaacgcccuccgcucccucugcucccaacccuguggugcuaggaccacuccccgccuucccua

SEQ ID NO: 120813 - RNA, 64 nt, Homo Sapiens
cauaaugguuuuuaacaccuuuuacucuucuuacuggugcuauuuuguagaauaaggaacaacg

SEQ ID NO: 120814 - RNA, 64 nt, Homo Sapiens
aaaugcaaguaacuagccauuguucaaaugacaguggugcuauuucucuuuuguggccuuuuag

SEQ ID NO: 120815 - RNA, 64 nt, Homo Sapiens
ugcccuguugccgagcccagcugugggcggcuccuggugcuaacaacaaaguuccacuuccagg

SEQ ID NO: 120816 - RNA, 64 nt, Homo Sapiens
uuuuuuugaaccccauucuuuccuucucugaaaguggugcuauaaguuuuagaaucuuuuaaau

SEQ ID NO: 120817 - RNA, 64 nt, Homo Sapiens
gacuaguuucuuugcuuuuuugugauuauuuugauggugcuagucauuucuauuuuuguuaucc

SEQ ID NO: 120818 - RNA, 64 nt, Homo Sapiens
gggcccucucucugggcccaaccucaacauuccauggugcuagugccagucaggcugcagaggc

SEQ ID NO: 120819 - RNA, 64 nt, Homo Sapiens
cuggaaaagacacagaagccaaccugagaaccccuggugcuauuuuaaaggagacauauugcug

SEQ ID NO: 120820 - RNA, 64 nt, Homo Sapiens
ccuaagguuaacuuugaauagguuuuuuugguuauggugcuauuuggagaaaauaauuuuuaug

SEQ ID NO: 120821 - RNA, 64 nt, Homo Sapiens
gagaguagcugcugugaaacauauguagucccauuggugcuaauaugagugaccguuugaaucc

SEQ ID NO: 120822 - RNA, 64 nt, Homo Sapiens
aagaauuugccugggcaguauuuguggugacaguuggugcuaauguaugucagaaaaggaugag

SEQ ID NO: 120823 - RNA, 64 nt, Homo Sapiens
ggugaccaucugguacauuguggccaucuggagcuggugcuauaugaguccagcugcagccacg

SEQ ID NO: 120824 - RNA, 64 nt, Homo Sapiens
aagcgugauguucgccauacgggcguggacucccuggugcuagauugcuguccauccuuuuuca

SEQ ID NO: 120825 - RNA, 64 nt, Homo Sapiens
uguaucuaguuguauuauucauagaaaaucaaucuggugcuaaugguuggcccugguguuguug

SEQ ID NO: 120826 - RNA, 64 nt, Homo Sapiens
uguaacaaauauaagguuuacgagcuaugagaauuggugcuaucaccauuagcuauuugcugua

SEQ ID NO: 120827 - RNA, 64 nt, Homo Sapiens
uaggugcacuugacaguauugaggucauuuguuauggugcuauuucaauuagucuagguuuagg

SEQ ID NO: 120828 - RNA, 64 nt, Homo Sapiens
ucauuguccccaacuuuacuacugcugccgucaauggugcuacuauauaugaucaagauaacau

SEQ ID NO: 120829 - RNA, 64 nt, Homo Sapiens
cacaguauguuacaugcauucuaccacuacauuuuggugcuauuuaaggugugcaauuuucuau

SEQ ID NO: 120830 - RNA, 64 nt, Homo Sapiens
uguuuauuguuauuacuuugcuuugaagaggaaauggugcuauacuuuauuuuauaaguuagaa

SEQ ID NO: 120831 - RNA, 64 nt, Homo Sapiens
agaguauaugcuaucuaggcuuccccuuccaaucuggugcuaguaaucaccguguggcaaaaca

SEQ ID NO: 120832 - RNA, 64 nt, Homo Sapiens
caguguugauuuuugugaugaaagcauguuaguuuggugcuacauaagcuguugucaauuaucu

SEQ ID NO: 120833 - RNA, 64 nt, Homo Sapiens
guuugauuuggaugauuguguguuucugucaagcuggugcuacuccugcugagaucugcugucc

SEQ ID NO: 120834 - RNA, 64 nt, Homo Sapiens
gugcuuuuuugaaguuuauuaguuuuuacguuguuggugcuaaaauugugaucuuaguguauau

SEQ ID NO: 120835 - RNA, 64 nt, Homo Sapiens
gaaaguacccuagacuuagacuuggggaaagcuguggugcuacaucucuauccagcuaaauagg

SEQ ID NO: 120836 - RNA, 64 nt, Homo Sapiens
acauguccaggaguggccguugcuacaagucaccuggugcuacgaccagggugagaauaaagac

SEQ ID NO: 120837 - RNA, 64 nt, Homo Sapiens; identical to SEQ ID NO: 78230

SEQ ID NO: 120838 - RNA, 64 nt, Homo Sapiens; identical to SEQ ID NO: 78231

SEQ ID NO: 120839 - RNA, 64 nt, Homo Sapiens; identical to SEQ ID NO: 78232

SEQ ID NO: 120840 - RNA, 64 nt, Homo Sapiens; identical to SEQ ID NO: 78233

SEQ ID NO: 120841 - RNA, 64 nt, Homo Sapiens; identical to SEQ ID NO: 78234

SEQ ID NO: 120842 - RNA, 64 nt, Homo Sapiens; identical to SEQ ID NO: 78235

SEQ ID NO: 120843 - RNA, 64 nt, Homo Sapiens; identical to SEQ ID NO: 78236

SEQ ID NO: 120844 - RNA, 64 nt, Homo Sapiens; identical to SEQ ID NO: 78237

SEQ ID NO: 120845 - RNA, 64 nt, Homo Sapiens; identical to SEQ ID NO: 78238

SEQ ID NO: 120846 - RNA, 64 nt, Homo Sapiens; identical to SEQ ID NO: 78239

SEQ ID NO: 120847 - RNA, 64 nt, Homo Sapiens; identical to SEQ ID NO: 78240

SEQ ID NO: 120848 - RNA, 64 nt, Homo Sapiens; identical to SEQ ID NO: 78241

SEQ ID NO: 120849 - RNA, 64 nt, Homo Sapiens
gaagccaccaucgguuccagcgucucccagacuucucguacaguuaauuugugucaucccauca

SEQ ID NO: 120850 - RNA, 64 nt, Homo Sapiens
cuuuugugaagauuucaagggauguacauacuuucucguacacauuuaaacuuucugaagugcu

SEQ ID NO: 120851 - RNA, 64 nt, Homo Sapiens
ccuucuuccacagugggaaggaugagcccacucacucguacaugaucucacacagaggucaacc

SEQ ID NO: 120852 - RNA, 64 nt, Homo Sapiens
auuuuuuuguacugcuggucguauuauccagguacucguacacuugcacuauugcaaaacgggu

SEQ ID NO: 120853 - RNA, 64 nt, Homo Sapiens
uugaaacucaucuugguaaauaaauugcaaauuacucguacaguuuuacaaggaucucauggca

SEQ ID NO: 120854 - RNA, 64 nt, Homo Sapiens
uuugccaauaccaaguuucaacccuagcucuuuucucguacaauuguguaaguuuuaguugccu

SEQ ID NO: 120855 - RNA, 64 nt, Homo Sapiens
uuccuucuguuaaucuuuuguauucacuuaugcucucguacauugaguacuuuuauuccaaaac

SEQ ID NO: 120856 - RNA, 64 nt, Homo Sapiens
aaaucuuacuguaccgccuguuguaucugggagccucguacagaggcucgcacagcagugauca

SEQ ID NO: 120857 - RNA, 64 nt, Homo Sapiens
gacauccucucucuacccauacuccauauggcuucucguacacuccugcuccuggccacccaaa

SEQ ID NO: 120858 - RNA, 64 nt, Homo Sapiens
uggguucuuauccugauccuugcagcucuguuagcucguacauguuaacuuaguaaauuugaag

SEQ ID NO: 120859 - RNA, 64 nt, Homo Sapiens
uauuugcaguguauuugcuucucaugaacuauuucucguacaaaucauuaaauaguucauugga

SEQ ID NO: 120860 - RNA, 64 nt, Homo Sapiens
gagcagugaucuccaaggccagcugcagggccugcucguacacuugcucaaccuggaccagccc

SEQ ID NO: 120861 - RNA, 64 nt, Homo Sapiens
guggcuccuuugaaguggaguccugccagcccuucucguacagggcaccccucuuccccagcug

SEQ ID NO: 120862 - RNA, 64 nt, Homo Sapiens
acaggaaccugacacauaguugggaaccuucucccucguacagcugaauacaucauccgcagcc

SEQ ID NO: 120863 - RNA, 64 nt, Homo Sapiens
aggcauuuuguuauucuguuaaaaaccacacacacucguacaugcagacaccuccaaugagaua

SEQ ID NO: 120864 - RNA, 64 nt, Homo Sapiens
uaauagugauauuuuggacauuauaggacuuugccucguacaauccauuauuacaguaauuuua

SEQ ID NO: 120865 - RNA, 64 nt, Homo Sapiens
auauuacugugaccacaaggacugaucaugugcacucguacagucagggcacagucccuaaauu

SEQ ID NO: 120866 - RNA, 59 nt, Homo Sapiens
cacaaauacacacucaugcaucuuacucccucguacaugaccccuucaccuuugaguga

SEQ ID NO: 120867 - RNA, 64 nt, Homo Sapiens
cauuuuuuucuugaauuuuauauccguuuguucacucguacaugccuagccuacagaaggggau

SEQ ID NO: 120868 - RNA, 64 nt, Homo Sapiens
auaaaaggucucagccuguaguaaaggauccuuucucguacagaagaaucuagugcgugggaca

SEQ ID NO: 120869 - RNA, 64 nt, Homo Sapiens
ucaccuguggaugucuauaauuauuuaaaauauacucguacauuuuccaaucacaaggaaagau

SEQ ID NO: 120870 - RNA, 64 nt, Homo Sapiens
auuauuaagacacagcugagucuuguuuuggcaucucguacaacggagcacuguuacaaauccu

SEQ ID NO: 120871 - RNA, 64 nt, Homo Sapiens
ugggauaggaggccauucauggcaugguguuugucucguacagucaucaacagugagcaaaucu

SEQ ID NO: 120872 - RNA, 64 nt, Homo Sapiens
agaucuccuucccguggaaugaaauccgaaacaucucguacagugacaaggagguaggacaugu

SEQ ID NO: 120873 - RNA, 64 nt, Homo Sapiens
ugaaauuuuuuagcaguacuuuagcuugaaaguacucguacaaauacuguuagauuuaguugca

SEQ ID NO: 120874 - RNA, 64 nt, Homo Sapiens; identical to SEQ ID NO: 71901

SEQ ID NO: 120875 - RNA, 64 nt, Homo Sapiens; identical to SEQ ID NO: 71902

SEQ ID NO: 120876 - RNA, 64 nt, Homo Sapiens; identical to SEQ ID NO: 71903

SEQ ID NO: 120877 - RNA, 64 nt, Homo Sapiens; identical to SEQ ID NO: 71904

SEQ ID NO: 120878 - RNA, 64 nt, Homo Sapiens; identical to SEQ ID NO: 71905

SEQ ID NO: 120879 - RNA, 64 nt, Homo Sapiens; identical to SEQ ID NO: 71906

SEQ ID NO: 120880 - RNA, 64 nt, Homo Sapiens; identical to SEQ ID NO: 71907

SEQ ID NO: 120881 - RNA, 64 nt, Homo Sapiens; identical to SEQ ID NO: 71908

SEQ ID NO: 120882 - RNA, 64 nt, Homo Sapiens; identical to SEQ ID NO: 71909

SEQ ID NO: 120883 - RNA, 64 nt, Homo Sapiens; identical to SEQ ID NO: 71910

SEQ ID NO: 120884 - RNA, 64 nt, Homo Sapiens; identical to SEQ ID NO: 71911

SEQ ID NO: 120885 - RNA, 64 nt, Homo Sapiens; identical to SEQ ID NO: 71912

SEQ ID NO: 120886 - RNA, 64 nt, Homo Sapiens; identical to SEQ ID NO: 71913

SEQ ID NO: 120887 - RNA, 64 nt, Homo Sapiens; identical to SEQ ID NO: 71914

SEQ ID NO: 120888 - RNA, 64 nt, Homo Sapiens; identical to SEQ ID NO: 71915

SEQ ID NO: 120889 - RNA, 64 nt, Homo Sapiens; identical to SEQ ID NO: 71916

SEQ ID NO: 120890 - RNA, 64 nt, Homo Sapiens; identical to SEQ ID NO: 71917

SEQ ID NO: 120891 - RNA, 64 nt, Homo Sapiens; identical to SEQ ID NO: 71918

SEQ ID NO: 120892 - RNA, 64 nt, Homo Sapiens; identical to SEQ ID NO: 71919

SEQ ID NO: 120893 - RNA, 64 nt, Homo Sapiens; identical to SEQ ID NO: 71920

SEQ ID NO: 120894 - RNA, 64 nt, Homo Sapiens; identical to SEQ ID NO: 71921

SEQ ID NO: 120895 - RNA, 64 nt, Homo Sapiens; identical to SEQ ID NO: 71922

SEQ ID NO: 120896 - RNA, 64 nt, Homo Sapiens; identical to SEQ ID NO: 71923

SEQ ID NO: 120897 - RNA, 64 nt, Homo Sapiens; identical to SEQ ID NO: 71924

SEQ ID NO: 120898 - RNA, 64 nt, Homo Sapiens; identical to SEQ ID NO: 71925

SEQ ID NO: 120899 - RNA, 64 nt, Homo Sapiens; identical to SEQ ID NO: 71926

SEQ ID NO: 120900 - RNA, 64 nt, Homo Sapiens; identical to SEQ ID NO: 71927

SEQ ID NO: 120901 - RNA, 64 nt, Homo Sapiens; identical to SEQ ID NO: 71928

SEQ ID NO: 120902 - RNA, 64 nt, Homo Sapiens; identical to SEQ ID NO: 71929

SEQ ID NO: 120903 - RNA, 64 nt, Homo Sapiens; identical to SEQ ID NO: 71930

SEQ ID NO: 120904 - RNA, 64 nt, Homo Sapiens; identical to SEQ ID NO: 71931

SEQ ID NO: 120905 - RNA, 64 nt, Homo Sapiens; identical to SEQ ID NO: 71932

SEQ ID NO: 120906 - RNA, 64 nt, Homo Sapiens; identical to SEQ ID NO: 71933

SEQ ID NO: 120907 - RNA, 64 nt, Homo Sapiens; identical to SEQ ID NO: 71934

SEQ ID NO: 120908 - RNA, 64 nt, Homo Sapiens; identical to SEQ ID NO: 71935

SEQ ID NO: 120909 - RNA, 64 nt, Homo Sapiens; identical to SEQ ID NO: 71936

SEQ ID NO: 120910 - RNA, 64 nt, Homo Sapiens; identical to SEQ ID NO: 71937

SEQ ID NO: 120911 - RNA, 64 nt, Homo Sapiens; identical to SEQ ID NO: 71938

SEQ ID NO: 120912 - RNA, 64 nt, Homo Sapiens; identical to SEQ ID NO: 71939

SEQ ID NO: 120913 - RNA, 64 nt, Homo Sapiens; identical to SEQ ID NO: 71940

SEQ ID NO: 120914 - RNA, 64 nt, Homo Sapiens
cuuuccaaaaccgcaaggguagacugguuuauccacccacaacaucuacgaaucguacuucuuu

SEQ ID NO: 120915 - RNA, 64 nt, Homo Sapiens
ccagaugaguuuaucaugucagugaaaaauaauuacccacaaaugccaccagaacuuacgauuc

SEQ ID NO: 120916 - RNA, 64 nt, Homo Sapiens
uauggguuaaaucucgguagugguagguucugcugggcagaacauugagcccuagggcaguucu

SEQ ID NO: 120917 - RNA, 64 nt, Homo Sapiens
aaaaucgaaccaaccuuuuaugggagggugaagggggcagaauggcagccuucuguacaacaga

SEQ ID NO: 120918 - RNA, 64 nt, Homo Sapiens
uaggaagugcccuggagggggccagcaggucacggggcagaaucucucagguugcugugggauc

SEQ ID NO: 120919 - RNA, 64 nt, Homo Sapiens
auuuugccaaauguaucuuuucugcuuuugaauugggcagaagauuuuagcaacuauauucuac

SEQ ID NO: 120920 - RNA, 64 nt, Homo Sapiens
ucuuagcagaugggaggaacugcugagagaagaugggcagaaagcuggagccccuggaguuggc

SEQ ID NO: 120921 - RNA, 64 nt, Homo Sapiens
guguuugugacugauuacuggcugugucuugggugggcagaaacucgaacuugcuauguaauuu

SEQ ID NO: 120922 - RNA, 64 nt, Homo Sapiens
uuggcuauuugaguaaccuaggauuagugagaaggggcagaaggagauacaacuccacugcaag

SEQ ID NO: 120923 - RNA, 64 nt, Homo Sapiens
ccuugacaauguagcaauaaauagaugcugccaagggcagaaaauggggagguuagcucagagc

SEQ ID NO: 120924 - RNA, 64 nt, Homo Sapiens
caaaccuaguuaaauaggugucacccaaugccaagggcagaaaguaaccuauaugugauggaga

SEQ ID NO: 120925 - RNA, 64 nt, Homo Sapiens
ugcucucugugaccaaaagaaggaguccaauuaugggcagaaucgcuucagugacauugucaac

SEQ ID NO: 120926 - RNA, 64 nt, Homo Sapiens
uuuuaccacaauaaaugcaauuaaaagguuuuauguuauguauaaaauguuuaaaaauaaaugg

SEQ ID NO: 120927 - RNA, 64 nt, Homo Sapiens
uuuuaucauaauuuaaaaaaaaaugguaaauuuuguuauguauauguacccauaaaaaugguua

SEQ ID NO: 120928 - RNA, 64 nt, Homo Sapiens
guauguaauacugauaaugaguacagcacauucaguuauguacaacacugccaguuguauaaaa

SEQ ID NO: 120929 - RNA, 64 nt, Homo Sapiens
gcauaaugacauauacaauaugcagaagauuacaguuauguacuugguuagauuugacugguuu

SEQ ID NO: 120930 - RNA, 64 nt, Homo Sapiens
agaccugaagaauuacuaucucuguuucuuggugguuauguaaacuauauugcagaaaccaaua

SEQ ID NO: 120931 - RNA, 64 nt, Homo Sapiens
uauauauauauauauaauauuuuuuuaaauguguguuauguacaaaaaggcuugguggugggau

SEQ ID NO: 120932 - RNA, 64 nt, Homo Sapiens
auagaauuguguaaacuagaacaggguaaacaguguuauguagacuuuaacuauauacuaugua

SEQ ID NO: 120933 - RNA, 64 nt, Homo Sapiens
auaucaaagagaaacauguuagugugaaaauauuguuauguaucuauuugagugauugcuggga

SEQ ID NO: 120934 - RNA, 64 nt, Homo Sapiens
uaaaaacaacacagaaaucuccugcucugauauaguuauguaacugaucucuuaaucuguagca

SEQ ID NO: 120935 - RNA, 64 nt, Homo Sapiens
guaaauguacaguuuucuuuuuuuuuuuuuuuugguuauguauacaaaaguuuuaacuacuuuu

SEQ ID NO: 120936 - RNA, 64 nt, Homo Sapiens
gggugagacacaacagucugaaucucacuuggauguuauguaaggccaagguagcacugugaga

SEQ ID NO: 120937 - RNA, 64 nt, Homo Sapiens
gcuaguucucaaagcugcccaacagcagguaguuguuauguagacgucuuuggaguugacaugg

SEQ ID NO: 120938 - RNA, 64 nt, Homo Sapiens
uguuccuuuaauguuguaauaaguuaaacaaaagguuauguaacucagaaacagaaccagagag

SEQ ID NO: 120939 - RNA, 64 nt, Homo Sapiens
uuaguccucugcuguuuacuuguugagagagaugguuauguaagaaaaagaaaaauaauugaaa

SEQ ID NO: 120940 - RNA, 64 nt, Homo Sapiens
aguucaaauacuauagcugucaguugaugaauuuguuauguaguaaaauguaugacuuuguaug

SEQ ID NO: 120941 - RNA, 64 nt, Homo Sapiens
gcauuaugggucaaaaaucaaacauuccucucauguuauguauauuuuguuccuguuauauugg

SEQ ID NO: 120942 - RNA, 64 nt, Homo Sapiens
uccucuaaaguaacuccuuaaguuaguucuucuucacccucacuucuguuccucucuuucacua

SEQ ID NO: 120943 - RNA, 64 nt, Homo Sapiens
cuggcgcugcugagccucaacucgacauccugcacacccucagcggugucgcgccgccuccacg

SEQ ID NO: 120944 - RNA, 64 nt, Homo Sapiens
uagagguaggauaucccugacucucacuccccuccacccucagcagggguuucuuggaagcugg

SEQ ID NO: 120945 - RNA, 64 nt, Homo Sapiens
ccagccucuuccccacauuaacacacucccagcucacccucaccgagagccgcaggggccugcc

SEQ ID NO: 120946 - RNA, 64 nt, Homo Sapiens
acugggaaggaagccugugaauggcccuccuccccacccucauggaccccuaguuccacugcac

SEQ ID NO: 120947 - RNA, 64 nt, Homo Sapiens
cauuccucaggaagcgucucccugccgcaggccccacccucaaggaggccagaaaguuguuagg

SEQ ID NO: 120948 - RNA, 64 nt, Homo Sapiens
cugugugacucaaaccaaauuucccuaucuuugccacccucauggagucaaaaaaucucaauuc

SEQ ID NO: 120949 - RNA, 64 nt, Homo Sapiens
cugggacuugcaaaaaggguggaaccaucagaaacacccucacacauggaaauucccuucaucu

SEQ ID NO: 120950 - RNA, 64 nt, Homo Sapiens
cuggagggcgucccagccuacaacauuccagccccacccucaggggggacccucaucccaggaa

SEQ ID NO: 120951 - RNA, 64 nt, Homo Sapiens
ucccuccuuuuccugcuggcgucucccuccugugcacccucagggccugagugucccugaucgg

SEQ ID NO: 120952 - RNA, 64 nt, Homo Sapiens
uuugcuguccagcugccugucguuuggcccagaccacccucagaaaaaaaccagcugccucucc

SEQ ID NO: 120953 - RNA, 64 nt, Homo Sapiens
ggccuuauuugacauuuucacugauaacugaucgcacccucauguugcaguguucguccccuau

SEQ ID NO: 120954 - RNA, 64 nt, Homo Sapiens
ugugacaccaagacccacccccugucuucaccggcacccucaccuggugcaaagcuggggccag

SEQ ID NO: 120955 - RNA, 64 nt, Homo Sapiens
cccacccccagggugcccugggcugggcuggccccacccucaccccuugcugcugaccauccua

SEQ ID NO: 120956 - RNA, 64 nt, Homo Sapiens
aggacucgucucuccauuccgggugacaccaugucacccucacccuuauccggccuggccugga

SEQ ID NO: 120957 - RNA, 64 nt, Homo Sapiens
guuggccgcuccuuauccgggccacucugcgccccacccucacuaaaguaguggcuauuuuugu

SEQ ID NO: 120958 - RNA, 64 nt, Homo Sapiens
auugagcugacugagggaagaugcaccuugaucucacccucacuccaaggcacauagcaggauc

SEQ ID NO: 120959 - RNA, 64 nt, Homo Sapiens
cccauucccaguaucgcuguuccuacgcccauuucacccucauuaccuucugcuuccaaggaau

SEQ ID NO: 120960 - RNA, 64 nt, Homo Sapiens
gcagggucacaggcaucccgggagaaugggccuccacccucagccagcccucacugcugacagg

SEQ ID NO: 120961 - RNA, 64 nt, Homo Sapiens
gaaacgucauccccaccaguuaacguuuccuguacacccucacccucucucguccaucucuguu

SEQ ID NO: 120962 - RNA, 64 nt, Homo Sapiens
ugcuuggccucaaugcaggcauguggguggggggcacccucacggugcacacacacagacccac

SEQ ID NO: 120963 - RNA, 64 nt, Homo Sapiens
ugcuuuuccagcccacaaaggccucagcccagcccacccucacccacagauaguggcggcaaug

SEQ ID NO: 120964 - RNA, 64 nt, Homo Sapiens
aaaggggcagguggggacaccucgccuucuagggcacccucagccaaggcaucacucccagccc

SEQ ID NO: 120965 - RNA, 62 nt, Homo Sapiens
ugcacccuaggaccucacugccucucuccccacacccucacccccgagagaagaagcaguga

SEQ ID NO: 120966 - RNA, 64 nt, Homo Sapiens
ccucgccgcucgaccccgcccucaccacacugaccacccucaacccauugcgcccaguccccac

SEQ ID NO: 120967 - RNA, 64 nt, Homo Sapiens
aacccauugcgcccaguccccaccacagugaccacacccucacuggcucggcccugcccccagu

SEQ ID NO: 120968 - RNA, 64 nt, Homo Sapiens
gugugagguugggugauagccguuccuuccccgacacccucaauuuccccaucucugauccucu

SEQ ID NO: 120969 - RNA, 64 nt, Homo Sapiens
auccucuaaucugccucugaacccauucacccuucacccucacuccugguccccauacccagca

SEQ ID NO: 120970 - RNA, 64 nt, Homo Sapiens
uccuccucgcaguagcccugucaggugcccacaucacccucauuccugagccauuucugcuguu

SEQ ID NO: 120971 - RNA, 64 nt, Homo Sapiens
uucaaggcccuuccugucuuacaccccaucauuucacccucacaugggaguaaggcccccaggg

SEQ ID NO: 120972 - RNA, 64 nt, Homo Sapiens
acuagaucuagaaucagagcuggauucaauuccuguccuucacauuuacuagcugugcaaccuu

SEQ ID NO: 120973 - RNA, 64 nt, Homo Sapiens
cucuccucuucuagcauuucuuccaauuauuacaguccuucaagauuccauuucuuaacagucu

SEQ ID NO: 120974 - RNA, 64 nt, Homo Sapiens
aagagucuugcagggggacccacagauaugccauguccuucacacgugcuugggcuccuuaacc

SEQ ID NO: 120975 - RNA, 64 nt, Homo Sapiens
cuagaagcaccauguuuuuucuaugaccuuuucaguccuucaggucauuuuaagguccacugca

SEQ ID NO: 120976 - RNA, 64 nt, Homo Sapiens
agcaguuaucaauuguuaguagccaucuuugugaguccuucaaggacaagcuuacaucuuccuc

SEQ ID NO: 120977 - RNA, 64 nt, Homo Sapiens
gggagaauuaacccuucgauucccuguaagucauguccuucacaaauaugugugugugucucag

SEQ ID NO: 120978 - RNA, 64 nt, Homo Sapiens
gccuuuguuggccugaugugcugcugugaugcugguccuucaucuuagguguucaugcaguucu

SEQ ID NO: 120979 - RNA, 64 nt, Homo Sapiens
uuucacaagcucuugccucacaaccccugcagaaguccuucaacaaaacuaauaauagacuagu

SEQ ID NO: 120980 - RNA, 64 nt, Homo Sapiens
uaauucauguggagauuuuuaagugguuucaauuguccuucagaaacguuacuuguauauuggu

SEQ ID NO: 120981 - RNA, 64 nt, Homo Sapiens
gcaguccaguugggauuauuucuagagcauuguuguccuucacuacucugggguuauuucucug

SEQ ID NO: 120982 - RNA, 64 nt, Homo Sapiens
aaccucucucaguaacugguaggcaugucacuguguccuucaguauacuuauggcagauaagua

SEQ ID NO: 120983 - RNA, 64 nt, Homo Sapiens
uaucugaucaaugaagaccuuuauguccuucuguguccuucaugcuagaaagggauuuggcauu

SEQ ID NO: 120984 - RNA, 64 nt, Homo Sapiens
ugaugggcaccugugggaaaggaacuuccauccaguccuucacauaccacgacauccaacagcu

SEQ ID NO: 120985 - RNA, 64 nt, Homo Sapiens
cucccuaccacgacauccaagaaacacguuaaauguccuucagcguucuagguaaugaguacau

SEQ ID NO: 120986 - RNA, 64 nt, Homo Sapiens
auuauaaaagcacuaacucugacaauauggcaauguccuucaaacagaaguacauauugaagag

SEQ ID NO: 120987 - RNA, 64 nt, Homo Sapiens
aucuguggagcaagaaaggaucugcccuagggagguccuucagacaacugggacagaggcuaca

SEQ ID NO: 120988 - RNA, 64 nt, Homo Sapiens
uacccucugggaaagcccuugugucccucccagaguccuucagguaggcccucgcagaugcugc

SEQ ID NO: 120989 - RNA, 64 nt, Homo Sapiens
aggccggaaugcucauggccccuguggucugcuuguccuucagcccaugcccagcagauaccuc

SEQ ID NO: 120990 - RNA, 64 nt, Homo Sapiens
uauuccuuuagauuggaggacauccauuagcugcguccuucagcauguauuuugcugguaagcu

SEQ ID NO: 120991 - RNA, 64 nt, Homo Sapiens
guaggugagcaccagucuccgacuaacugugcauguccuucaugucacauggugguuaaguagu

SEQ ID NO: 120992 - RNA, 64 nt, Homo Sapiens
aagguaccaggacucaggcuucucauccccuccucccgcaaagcgguuuucugacccucagggc

SEQ ID NO: 120993 - RNA, 64 nt, Homo Sapiens
aacacuuucugcacuuaucucuccuugggcucuucccgcaaaucauugcuucccugcuauuucc

SEQ ID NO: 120994 - RNA, 64 nt, Homo Sapiens
aauucuguggcagggcaaggcccccccccccccccccgcaaaauauucaaaaaguacaucuucc

SEQ ID NO: 120995 - RNA, 64 nt, Homo Sapiens
ccuggccccugcaggagucaacaggcauggaguccccgcaaaaacugcacucggucgggccucc

SEQ ID NO: 120996 - RNA, 64 nt, Homo Sapiens
auuaagauagguucuuucuguauaugaaacgcuccccgcaaauucacuggcagcucagaauuau

SEQ ID NO: 120997 - RNA, 64 nt, Homo Sapiens
auaaagagcaauguuuucaggggcauuaaaaauucccgcaaacugcuguuggaguuucuguuua

SEQ ID NO: 120998 - RNA, 64 nt, Homo Sapiens
cccuuugugcuguggggcugugguuugguguguucccgcaaaccucagguugcugguugcugug

SEQ ID NO: 120999 - RNA, 64 nt, Homo Sapiens
gggacauaguaugugacaauuguucagguuaguacccgcaaaacauacaugcaaagcaauaucu

SEQ ID NO: 121000 - RNA, 64 nt, Homo Sapiens
aacauguuuagcaaaaaccaauucaguuccauuccccgcaaaaaaccccuaacuuuacucugaa

SEQ ID NO: 121001 - RNA, 64 nt, Homo Sapiens
acauagcagacccccgccauauaccaggauaacccccgcaaaccuauuggaaggcagcucccgc

SEQ ID NO: 121002 - RNA, 64 nt, Homo Sapiens
gugcaguccuugcucauauuuccuucaucuuaaccccgcaaacaagaauuaagaugaucccaau

SEQ ID NO: 121003 - RNA, 64 nt, Homo Sapiens
caaguagcuaggacuacaggcguucaccacugcgcccgcaaaguuuuuuuguuguuuuuuuuuu

SEQ ID NO: 121004 - RNA, 64 nt, Homo Sapiens
acauguguacauucuucaccuccuggugcccuaucccgcaaaaugggcuuccugccugguuuuu

SEQ ID NO: 121005 - RNA, 64 nt, Homo Sapiens
agaguggggaaggugagugggaguguggacaaaccccgcaaaucgccagaguagggguuggggg

SEQ ID NO: 121006 - RNA, 64 nt, Homo Sapiens
ucuggagucccugggacacauguaagaaccugcccccgcaaaacucucagcugugguacugccc

SEQ ID NO: 121007 - RNA, 64 nt, Homo Sapiens
ccauuaggugauacauagauaagggcuuuuucuccccgcaaacaccccuaagaaugguucugug

SEQ ID NO: 121008 - RNA, 64 nt, Homo Sapiens
uagaaaccagguuauuucucccugcuuauggcuccccgcaaagggacuugcagcguguccugca

SEQ ID NO: 121009 - RNA, 64 nt, Homo Sapiens
aauguauuggugauuuggagauuugaccucaucucccgcaaauaguuuuaaaguucaugguaag

SEQ ID NO: 121010 - RNA, 64 nt, Homo Sapiens
uucucuuuuugccaaaauuaacuguuuggugaagcccgcaaaaccuccucgcuuugcaugcaug

SEQ ID NO: 121011 - RNA, 64 nt, Homo Sapiens
ggggacggaaggacauuugaaccugagaacaagucccgcaaaccgcugggcggcugggaauucc

SEQ ID NO: 121012 - RNA, 64 nt, Homo Sapiens
agaaacucacugugauuccacuuuagagcaacuucccgcaaaucggcaaaguccucagccagug

SEQ ID NO: 121013 - RNA, 64 nt, Homo Sapiens
gccucugggggaccccccagccuggucccaguuucccgcaaagucaagccccccagccucccac

SEQ ID NO: 121014 - RNA, 64 nt, Homo Sapiens
aguaaaagucaaaccaaacuaccaccccccgccccccgcaaaaaguucuagucaauucugaacc

SEQ ID NO: 121015 - RNA, 64 nt, Homo Sapiens
ugaaucucgagcuaccuauuaagucaaagucacucccgcaaaccacaaaggcuggccugugugu

SEQ ID NO: 121016 - RNA, 64 nt, Homo Sapiens
ucauccuaggcaacagagcgagacucugucuccccccgcaaaaaaaaaaaagaaagaaagaaag

SEQ ID NO: 121017 - RNA, 64 nt, Homo Sapiens
cugccacugucagggaccagccggccaacgcccacccgcaaaggugucuaaaaacuucagcuuu

SEQ ID NO: 121018 - RNA, 64 nt, Homo Sapiens
gaccaggaagcugccaucagggaucuuccccugccccgcaaagcuaggcuccagcugcaggcgg

SEQ ID NO: 121019 - RNA, 64 nt, Homo Sapiens
accuuccauucccaccacacagacucugggccuccccgcaaaauggcuccagaauuagaguaau

SEQ ID NO: 121020 - RNA, 64 nt, Homo Sapiens
gccgcccuggcuuggcagcccugcccacgcugcccccgcaaacaauggugugugcguuuuuaca

SEQ ID NO: 121021 - RNA, 64 nt, Homo Sapiens
ucuuguuuguuacaaccuuugugagucagccaugcccgcaaagcgugcuguguuuuaguccugg

SEQ ID NO: 121022 - RNA, 64 nt, Homo Sapiens
uucuauagggaacugccuagcaggacuauuaacccccgcaaaguauuguaacuaaaaucuuccu

SEQ ID NO: 121023 - RNA, 64 nt, Homo Sapiens
uuagaccagagcuguugauccugacccuuccccccccgcaaaugggggagaaaaacucucaucc

SEQ ID NO: 121024 - RNA, 64 nt, Homo Sapiens
cugccccucaaguucaaccccgggaccgcccagccccgcaaagcaaagacccugacuucuccug

SEQ ID NO: 121025 - RNA, 64 nt, Homo Sapiens
gcagguaaggugaaccagcugcacggaccagguucccgcaaaacauugccagcuagugaggcau

SEQ ID NO: 121026 - RNA, 64 nt, Homo Sapiens
cccuugagaauguacuuugugagauccaccccugcccgcaaaacauugcuccaaacuccaccac

SEQ ID NO: 121027 - RNA, 64 nt, Homo Sapiens
guuuucccggggacucuauaggcagcugcuccugcccgcaaagcaagagcaucauuccuauucu

SEQ ID NO: 121028 - RNA, 64 nt, Homo Sapiens
gaggaucuuuaggccugaguugugaagcgcaacccccgcaaaacgcauuugccaucacaguugg

SEQ ID NO: 121029 - RNA, 64 nt, Homo Sapiens
gccuuccucugcucugggaccagugguuuauuuucccgcaaacgcugagugacucggggccgga

SEQ ID NO: 121030 - RNA, 64 nt, Homo Sapiens
gacaagguuccucccucuccagagaccagcgacucccgcaaagguccuucuuccccacaacaga

SEQ ID NO: 121031 - RNA, 64 nt, Homo Sapiens
aaagcaaagcuaauugcaaagaccaaccucaauccccgcaaacucacacagacacguaauacca

SEQ ID NO: 121032 - RNA, 64 nt, Homo Sapiens
caucaaaccugaguaucagucaauggauuuaucccccgcaaagacuccagaauccugaugguau

SEQ ID NO: 121033 - RNA, 64 nt, Homo Sapiens
ccagagcugggugaguggggagacaccucagagccccgcaaaacccacugaccggaggcaaaag

SEQ ID NO: 121034 - RNA, 64 nt, Homo Sapiens
gacucggagccgagggccucagacugguccagagcccgcaaaugacaugggaugggggaggcag

SEQ ID NO: 121035 - RNA, 51 nt, Homo Sapiens
uguaccuggugagcugcugaacccgcaaaugcugcugccccagcucuacac

SEQ ID NO: 121036 - RNA, 64 nt, Homo Sapiens
agaagccgccagggcaggggcacggagggcccuucccgcaaagcacagggacacagccagagcc

SEQ ID NO: 121037 - RNA, 64 nt, Homo Sapiens
uuguggcuucaaacacgaaacauaacaaaugauccccgcaaauuauauaaguuauuuguugcag

SEQ ID NO: 121038 - RNA, 64 nt, Homo Sapiens
gugagcagagaccccgugcagugcauucagacaccccgcaaagcaggacucuguggaaauugac

SEQ ID NO: 121039 - RNA, 64 nt, Homo Sapiens; identical to SEQ ID NO: 119503

SEQ ID NO: 121040 - RNA, 64 nt, Homo Sapiens; identical to SEQ ID NO: 119504

SEQ ID NO: 121041 - RNA, 64 nt, Homo Sapiens; identical to SEQ ID NO: 119505

SEQ ID NO: 121042 - RNA, 64 nt, Homo Sapiens; identical to SEQ ID NO: 119506

SEQ ID NO: 121043 - RNA, 64 nt, Homo Sapiens; identical to SEQ ID NO: 119507

SEQ ID NO: 121044 - RNA, 64 nt, Homo Sapiens; identical to SEQ ID NO: 119508

SEQ ID NO: 121045 - RNA, 64 nt, Homo Sapiens; identical to SEQ ID NO: 119509

SEQ ID NO: 121046 - RNA, 64 nt, Homo Sapiens; identical to SEQ ID NO: 119510

SEQ ID NO: 121047 - RNA, 64 nt, Homo Sapiens; identical to SEQ ID NO: 119511

SEQ ID NO: 121048 - RNA, 64 nt, Homo Sapiens; identical to SEQ ID NO: 119512

SEQ ID NO: 121049 - RNA, 64 nt, Homo Sapiens; identical to SEQ ID NO: 119513

SEQ ID NO: 121050 - RNA, 64 nt, Homo Sapiens; identical to SEQ ID NO: 119514

SEQ ID NO: 121051 - RNA, 64 nt, Homo Sapiens; identical to SEQ ID NO: 119515

SEQ ID NO: 121052 - RNA, 64 nt, Homo Sapiens; identical to SEQ ID NO: 119516

SEQ ID NO: 121053 - RNA, 64 nt, Homo Sapiens; identical to SEQ ID NO: 119517

SEQ ID NO: 121054 - RNA, 64 nt, Homo Sapiens; identical to SEQ ID NO: 119518

SEQ ID NO: 121055 - RNA, 64 nt, Homo Sapiens; identical to SEQ ID NO: 119519

SEQ ID NO: 121056 - RNA, 64 nt, Homo Sapiens; identical to SEQ ID NO: 119520

SEQ ID NO: 121057 - RNA, 64 nt, Homo Sapiens; identical to SEQ ID NO: 119521

SEQ ID NO: 121058 - RNA, 64 nt, Homo Sapiens; identical to SEQ ID NO: 119522

SEQ ID NO: 121059 - RNA, 64 nt, Homo Sapiens; identical to SEQ ID NO: 119523

SEQ ID NO: 121060 - RNA, 64 nt, Homo Sapiens; identical to SEQ ID NO: 119524

SEQ ID NO: 121061 - RNA, 64 nt, Homo Sapiens; identical to SEQ ID NO: 119525

SEQ ID NO: 121062 - RNA, 64 nt, Homo Sapiens; identical to SEQ ID NO: 119526

SEQ ID NO: 121063 - RNA, 64 nt, Homo Sapiens; identical to SEQ ID NO: 119527

SEQ ID NO: 121064 - RNA, 64 nt, Homo Sapiens; identical to SEQ ID NO: 119528

SEQ ID NO: 121065 - RNA, 64 nt, Homo Sapiens; identical to SEQ ID NO: 119529

SEQ ID NO: 121066 - RNA, 64 nt, Homo Sapiens; identical to SEQ ID NO: 119530

SEQ ID NO: 121067 - RNA, 64 nt, Homo Sapiens; identical to SEQ ID NO: 119531

SEQ ID NO: 121068 - RNA, 64 nt, Homo Sapiens; identical to SEQ ID NO: 119532

SEQ ID NO: 121069 - RNA, 64 nt, Homo Sapiens; identical to SEQ ID NO: 119533

SEQ ID NO: 121070 - RNA, 64 nt, Homo Sapiens; identical to SEQ ID NO: 119534

SEQ ID NO: 121071 - RNA, 64 nt, Homo Sapiens; identical to SEQ ID NO: 119535

SEQ ID NO: 121072 - RNA, 64 nt, Homo Sapiens; identical to SEQ ID NO: 119536

SEQ ID NO: 121073 - RNA, 64 nt, Homo Sapiens; identical to SEQ ID NO: 119537

SEQ ID NO: 121074 - RNA, 64 nt, Homo Sapiens; identical to SEQ ID NO: 119538

SEQ ID NO: 121075 - RNA, 64 nt, Homo Sapiens; identical to SEQ ID NO: 119539

SEQ ID NO: 121076 - RNA, 64 nt, Homo Sapiens; identical to SEQ ID NO: 119540

SEQ ID NO: 121077 - RNA, 64 nt, Homo Sapiens; identical to SEQ ID NO: 119541

SEQ ID NO: 121078 - RNA, 64 nt, Homo Sapiens; identical to SEQ ID NO: 119542

SEQ ID NO: 121079 - RNA, 64 nt, Homo Sapiens; identical to SEQ ID NO: 119543

SEQ ID NO: 121080 - RNA, 64 nt, Homo Sapiens; identical to SEQ ID NO: 119544

SEQ ID NO: 121081 - RNA, 64 nt, Homo Sapiens; identical to SEQ ID NO: 119545

SEQ ID NO: 121082 - RNA, 64 nt, Homo Sapiens; identical to SEQ ID NO: 119546

SEQ ID NO: 121083 - RNA, 64 nt, Homo Sapiens; identical to SEQ ID NO: 119547

SEQ ID NO: 121084 - RNA, 64 nt, Homo Sapiens; identical to SEQ ID NO: 119548

SEQ ID NO: 121085 - RNA, 64 nt, Homo Sapiens; identical to SEQ ID NO: 119549

SEQ ID NO: 121086 - RNA, 64 nt, Homo Sapiens; identical to SEQ ID NO: 119550

SEQ ID NO: 121087 - RNA, 64 nt, Homo Sapiens; identical to SEQ ID NO: 119551

SEQ ID NO: 121088 - RNA, 64 nt, Homo Sapiens; identical to SEQ ID NO: 119552

SEQ ID NO: 121089 - RNA, 64 nt, Homo Sapiens; identical to SEQ ID NO: 119553

SEQ ID NO: 121090 - RNA, 64 nt, Homo Sapiens; identical to SEQ ID NO: 119554

SEQ ID NO: 121091 - RNA, 64 nt, Homo Sapiens; identical to SEQ ID NO: 119555

SEQ ID NO: 121092 - RNA, 64 nt, Homo Sapiens; identical to SEQ ID NO: 119556

SEQ ID NO: 121093 - RNA, 64 nt, Homo Sapiens; identical to SEQ ID NO: 119557

SEQ ID NO: 121094 - RNA, 64 nt, Homo Sapiens; identical to SEQ ID NO: 119558

SEQ ID NO: 121095 - RNA, 64 nt, Homo Sapiens; identical to SEQ ID NO: 119559

SEQ ID NO: 121096 - RNA, 64 nt, Homo Sapiens; identical to SEQ ID NO: 119560

SEQ ID NO: 121097 - RNA, 64 nt, Homo Sapiens; identical to SEQ ID NO: 119561

SEQ ID NO: 121098 - RNA, 64 nt, Homo Sapiens; identical to SEQ ID NO: 119562

SEQ ID NO: 121099 - RNA, 64 nt, Homo Sapiens; identical to SEQ ID NO: 119563

SEQ ID NO: 121100 - RNA, 64 nt, Homo Sapiens; identical to SEQ ID NO: 119564

SEQ ID NO: 121101 - RNA, 64 nt, Homo Sapiens; identical to SEQ ID NO: 119565

SEQ ID NO: 121102 - RNA, 64 nt, Homo Sapiens; identical to SEQ ID NO: 119566

SEQ ID NO: 121103 - RNA, 64 nt, Homo Sapiens; identical to SEQ ID NO: 119567

SEQ ID NO: 121104 - RNA, 64 nt, Homo Sapiens; identical to SEQ ID NO: 119568

SEQ ID NO: 121105 - RNA, 64 nt, Homo Sapiens; identical to SEQ ID NO: 119569

SEQ ID NO: 121106 - RNA, 64 nt, Homo Sapiens; identical to SEQ ID NO: 119570

SEQ ID NO: 121107 - RNA, 64 nt, Homo Sapiens; identical to SEQ ID NO: 119571

SEQ ID NO: 121108 - RNA, 64 nt, Homo Sapiens; identical to SEQ ID NO: 119572

SEQ ID NO: 121109 - RNA, 64 nt, Homo Sapiens; identical to SEQ ID NO: 119573

SEQ ID NO: 121110 - RNA, 64 nt, Homo Sapiens; identical to SEQ ID NO: 119574

SEQ ID NO: 121111 - RNA, 64 nt, Homo Sapiens; identical to SEQ ID NO: 119575

SEQ ID NO: 121112 - RNA, 64 nt, Homo Sapiens; identical to SEQ ID NO: 119576

SEQ ID NO: 121113 - RNA, 64 nt, Homo Sapiens; identical to SEQ ID NO: 119577

SEQ ID NO: 121114 - RNA, 64 nt, Homo Sapiens; identical to SEQ ID NO: 119578

SEQ ID NO: 121115 - RNA, 64 nt, Homo Sapiens; identical to SEQ ID NO: 119579

SEQ ID NO: 121116 - RNA, 64 nt, Homo Sapiens; identical to SEQ ID NO: 119580

SEQ ID NO: 121117 - RNA, 64 nt, Homo Sapiens; identical to SEQ ID NO: 119581

SEQ ID NO: 121118 - RNA, 64 nt, Homo Sapiens; identical to SEQ ID NO: 119582

SEQ ID NO: 121119 - RNA, 64 nt, Homo Sapiens; identical to SEQ ID NO: 119583

SEQ ID NO: 121120 - RNA, 64 nt, Homo Sapiens; identical to SEQ ID NO: 119584

SEQ ID NO: 121121 - RNA, 64 nt, Homo Sapiens; identical to SEQ ID NO: 119585

SEQ ID NO: 121122 - RNA, 64 nt, Homo Sapiens; identical to SEQ ID NO: 119586

SEQ ID NO: 121123 - RNA, 64 nt, Homo Sapiens; identical to SEQ ID NO: 119587

SEQ ID NO: 121124 - RNA, 64 nt, Homo Sapiens; identical to SEQ ID NO: 119588

SEQ ID NO: 121125 - RNA, 64 nt, Homo Sapiens; identical to SEQ ID NO: 119589

SEQ ID NO: 121126 - RNA, 64 nt, Homo Sapiens; identical to SEQ ID NO: 119590

SEQ ID NO: 121127 - RNA, 64 nt, Homo Sapiens; identical to SEQ ID NO: 119591

SEQ ID NO: 121128 - RNA, 64 nt, Homo Sapiens; identical to SEQ ID NO: 119592

SEQ ID NO: 121129 - RNA, 64 nt, Homo Sapiens; identical to SEQ ID NO: 119593

SEQ ID NO: 121130 - RNA, 64 nt, Homo Sapiens; identical to SEQ ID NO: 119594

SEQ ID NO: 121131 - RNA, 64 nt, Homo Sapiens; identical to SEQ ID NO: 119595

SEQ ID NO: 121132 - RNA, 64 nt, Homo Sapiens; identical to SEQ ID NO: 119596

SEQ ID NO: 121133 - RNA, 64 nt, Homo Sapiens; identical to SEQ ID NO: 119597

SEQ ID NO: 121134 - RNA, 64 nt, Homo Sapiens
cuuggggauuaucugucauuagaggaaaaaugauccaguggacaccucauuuguguggaaaguc

SEQ ID NO: 121135 - RNA, 64 nt, Homo Sapiens
ggaaagaaugugggauuugguuccagggggcagcccaguggaauaacaccaccuuccuccuggc

SEQ ID NO: 121136 - RNA, 64 nt, Homo Sapiens
acaugcagccucaguggagaccuaggaggacccaccaguggagcucugcuccucccaccucauc

SEQ ID NO: 121137 - RNA, 64 nt, Homo Sapiens
auucccugaugggggacaugggguuguggugacuccaguggaacccucagccuugcccuggcug

SEQ ID NO: 121138 - RNA, 64 nt, Homo Sapiens
ugauggggaagaugaauauuacaaaucucugucaccaguggacuguaucccugaggagaacaac

SEQ ID NO: 121139 - RNA, 64 nt, Homo Sapiens
aucaaguuacuuuucaauccauucagaaucugccccaguggagacccaggaguuccuuuccugc

SEQ ID NO: 121140 - RNA, 64 nt, Homo Sapiens
cauccauucuuuggaacaaacuaccccacauuggccaguggacuauguggucuucucuaccccu

SEQ ID NO: 121141 - RNA, 64 nt, Homo Sapiens
cucuuccuauguggucuucuggaacauuccauccccaguggagucucagccuacacaagggagg

SEQ ID NO: 121142 - RNA, 64 nt, Homo Sapiens
cuuacggaaaacacagagaaguaacuauucuaauccaguggaauaaccuucuaccuuguaauau

SEQ ID NO: 121143 - RNA, 64 nt, Homo Sapiens
gauguuguuuuuaauggauauaaaaagcacugucccaguggauucucaacugccaguaauuuuu

SEQ ID NO: 121144 - RNA, 64 nt, Homo Sapiens
agggugucaggaaggcaggggugccgggucccacccaguggaguaacaaacuguggguggcguu

SEQ ID NO: 121145 - RNA, 64 nt, Homo Sapiens
auaccucucagccuccagcguugcaagugcaaggccaguggaguuaaucugcaacgugcacgag

SEQ ID NO: 121146 - RNA, 64 nt, Homo Sapiens
cuucagguguaguaguucuguguugacccuuuguccaguggaauuggugauucugaauuguccu

SEQ ID NO: 121147 - RNA, 64 nt, Homo Sapiens
auuguugauuucaguaagcuguguggugaggcuaccaguggaagagacaucccuugacuuuugu

SEQ ID NO: 121148 - RNA, 64 nt, Homo Sapiens
aaugugacauugcuuuucagacuguuuucauuucuguuuuuagcagagacaugcaacaacaaca

SEQ ID NO: 121149 - RNA, 64 nt, Homo Sapiens
uauuuccacauaaugaggagccaaagaaaucugauguuuuuaacaauuaaacugcuaauguuaa

SEQ ID NO: 121150 - RNA, 64 nt, Homo Sapiens
accuguacauuuguaaacugaccugacuccauuuuguuuuuaaauguguggguuauguugcagc

SEQ ID NO: 121151 - RNA, 64 nt, Homo Sapiens
ucuuacccagugcuguugcccuuuugaguauuuuuguuuuuaaaauaaugauuguaaaauguuu

SEQ ID NO: 121152 - RNA, 64 nt, Homo Sapiens
uuguuucaacugaauuuguaauuaacucugaauuuguuuuuaaucauuaguaauauuucaguug

SEQ ID NO: 121153 - RNA, 64 nt, Homo Sapiens
uggaacuuuauugcauucuuuauuuuaaaaagcuuguuuuuacguaaucauagagcuugcuauu

SEQ ID NO: 121154 - RNA, 64 nt, Homo Sapiens
ugaaacucaaauauuuucauuuuggauauucuccuguuuuuauuaaaccagugauuacaccugg

SEQ ID NO: 121155 - RNA, 64 nt, Homo Sapiens
guccuugcaucaacgggaugccacauuucauaacuguuuuuaaugguaaaaaaaaaaaaaaaaa

SEQ ID NO: 121156 - RNA, 64 nt, Homo Sapiens
cgcugggucagcagcaagcuguaguuuuuaaaaauguuuuuaguuaaacguugaggagaaaaaa

SEQ ID NO: 121157 - RNA, 64 nt, Homo Sapiens
uauuucuguccuggcagcauguuccagcucuugauguuuuuaaacuuuuuuuuagaagaaaaau

SEQ ID NO: 121158 - RNA, 64 nt, Homo Sapiens
uuucuuaaaacacugaaugaauuuugaagcuuaauguuuuuaaaggcauaguuuuaucuuugac

SEQ ID NO: 121159 - RNA, 64 nt, Homo Sapiens
ccaaugccuuuuuaaaauaaagcuucuguggucuuguuuuuaauggcucaacugucugauguaa

SEQ ID NO: 121160 - RNA, 64 nt, Homo Sapiens
auccuagcucuuugucaaagauggucuguagaaauguuuuuaaagauuagggaugcuguacuuu

SEQ ID NO: 121161 - RNA, 64 nt, Homo Sapiens
cauuuuacucucaaaggucuccuuaaauugggcuuguuuuuacuuguccuauuuaauuccccac

SEQ ID NO: 121162 - RNA, 64 nt, Homo Sapiens
gcaaaagaaccaagacagaauguauaugaagaauuguuuuuaauuuuguaaauuaaaaaaaaau

SEQ ID NO: 121163 - RNA, 64 nt, Homo Sapiens
aauguaccaucaagagucauguauguuuuauuuuuguuuuuauuuuuuauuuuuugagauggag

SEQ ID NO: 121164 - RNA, 64 nt, Homo Sapiens
acaggugcacgccaccacgcccggcuaauuuuuguguuuuuagcagagacaggguuucaccacg

SEQ ID NO: 121165 - RNA, 64 nt, Homo Sapiens
ugaacucaaaauguauuugaucacaguucuauaauguuuuuaccuaccuauuauggaauaauca

SEQ ID NO: 121166 - RNA, 64 nt, Homo Sapiens
auaaucuucagugagaucuuuuuauaaaacuucuuguuuuuaggauucccuuugcuucuuccuu

SEQ ID NO: 121167 - RNA, 64 nt, Homo Sapiens
gcucuaucaugucuagcauaauuuaaaaaaucaguguuuuuaggauuugggaaaauaaacugua

SEQ ID NO: 121168 - RNA, 64 nt, Homo Sapiens
auacacaauaaacacuaauccuccaaacuuucacuguuuuuauuaguaugaauauaaaauuuga

SEQ ID NO: 121169 - RNA, 64 nt, Homo Sapiens
uuauaacuuauugagcacuuuuaguagugauaacuguuuuuaaacuugccuaauaccuuucuug

SEQ ID NO: 121170 - RNA, 64 nt, Homo Sapiens
uuuuuauugucuacaaaccauuaaauguaaauauuguuuuuagagucagucauuggcuuuguca

SEQ ID NO: 121171 - RNA, 64 nt, Homo Sapiens
uauuuuauacauacguauuauauagagaaacaaauguuuuuauuaaauguuucauugacccaag

SEQ ID NO: 121172 - RNA, 64 nt, Homo Sapiens
auuuuuuaccauuuuauggaaaauauuuaaaaucuguuuuuacaggguuuuuuuuuuuuuuuuu

SEQ ID NO: 121173 - RNA, 64 nt, Homo Sapiens
ugugacuauaagcuuugugcuuagagaauguauguguuuuuaucugucaguaugggaggauaua

SEQ ID NO: 121174 - RNA, 64 nt, Homo Sapiens
uuucaagugaaucuaaaagcuuuugcuuuuccuuuguuuuuaugaagaaaaaauacauuuuaua

SEQ ID NO: 121175 - RNA, 64 nt, Homo Sapiens
uuauauuagaaguguuaacuuagcuugaaggaucuguuuuuaaaaaucauaaacugugugcaga

SEQ ID NO: 121176 - RNA, 64 nt, Homo Sapiens
auauguuaugagaaguugcugauuaaaucagugcuguuuuuacaccacuucuggccaacucaga

SEQ ID NO: 121177 - RNA, 64 nt, Homo Sapiens
auuuuuuuauuauggugcagcuuuuuuuuaauuauguuuuuaaaauuauacaguugaaaaauau

SEQ ID NO: 121178 - RNA, 64 nt, Homo Sapiens
agagcugaguaaaaugaaggaaaagcauguuauguguuuuuaaggaaaaugugcacacauauac

SEQ ID NO: 121179 - RNA, 64 nt, Homo Sapiens
ugcuauaccaugcgucugucguugugcuuuuuucuguuuuuagaccaauuuuuuacaguucuuu

SEQ ID NO: 121180 - RNA, 64 nt, Homo Sapiens
gguaacgagggcaacagggagcaccugucuggauuguuuuuaaaccuccauacucaagcugucu

SEQ ID NO: 121181 - RNA, 64 nt, Homo Sapiens
uugaaccaacaucuuuuuuauuauauucagaguauguuuuuaaguguaucuuaauauauacauu

SEQ ID NO: 121182 - RNA, 64 nt, Homo Sapiens
auuucuucgugaacauagaguuuggggccgaaaauguuuuuaaaguauguguuugaguuaaaua

SEQ ID NO: 121183 - RNA, 64 nt, Homo Sapiens
guuugauuucaaagcaagucaaccugcuuuuuucuguuuuuacaguggaaucuaggaggccacu

SEQ ID NO: 121184 - RNA, 64 nt, Homo Sapiens
caggugcccgccaccacacccggcuaauuuuuuguguuuuuacaaaauacaaaaaaguagagac

SEQ ID NO: 121185 - RNA, 64 nt, Homo Sapiens
aacaaggaaacugagguccauuagaaaucauuucuguuuuuacauuuuacaauucugagugauc

SEQ ID NO: 121186 - RNA, 64 nt, Homo Sapiens
uguugauagugaacgaaaaguuauuaaggcuguuuguuuuuaagaaacaaaguggacuugauuu

SEQ ID NO: 121187 - RNA, 64 nt, Homo Sapiens
uaacuguacuuguacucacucgccuggccuaaaauguuuuuaaaauuacaggcaugaaccacca

SEQ ID NO: 121188 - RNA, 64 nt, Homo Sapiens
auagacacgguuucaccaugcuaauuuuuuuguguguuuuuagugcguccgccaccaugccugg

SEQ ID NO: 121189 - RNA, 64 nt, Homo Sapiens
auauguguauauuuuaucaguauauauauguauguguuuuuaaauuuuccacuuuugaucuauu

SEQ ID NO: 121190 - RNA, 64 nt, Homo Sapiens
acagcuauccaguaaggcuauaccaaauacuuuuuguuuuuaacgagcacauaacaauagauga

SEQ ID NO: 121191 - RNA, 64 nt, Homo Sapiens
ucuuaaguuucuuugcugcgagugagcuuucccauguuuuuauguauuuugauaauauuuuuac

SEQ ID NO: 121192 - RNA, 64 nt, Homo Sapiens
uuaaagugaauguuuuucuccaaacaaaaauauauguuuuuacuaagauauuucauagacaaac

SEQ ID NO: 121193 - RNA, 64 nt, Homo Sapiens
uaaauuacaauuuuaucuguaugcucucacuguuuguuuuuauuuuuacauguuuauaaaucuu

SEQ ID NO: 121194 - RNA, 64 nt, Homo Sapiens
gcuauuugaacaagugggccgugugugacaauucuguuuuuaauuggaacaaauuauuuuuggu

SEQ ID NO: 121195 - RNA, 64 nt, Homo Sapiens
ccucauuguacaaaauauaauuuuucugaaggcuuguuuuuaguggagcaauaaccagcccuuu

SEQ ID NO: 121196 - RNA, 64 nt, Homo Sapiens
ugugaauuauauuucuacuaaaaaauaaguagacuguuuuuaugaauaggauauaaaagggaca

SEQ ID NO: 121197 - RNA, 64 nt, Homo Sapiens
uuucuguccagaagagcuuuuuuggguuauuucuuguuuuuauuuuaaucacaaaguguguggg

SEQ ID NO: 121198 - RNA, 64 nt, Homo Sapiens
ucuuggguauaaauucuagggauuauugcagggguguuuuuaaaaaugguaugaaagguaaugu

SEQ ID NO: 121199 - RNA, 64 nt, Homo Sapiens
gauaaauaagauuuaugguucuugccauauuugcuguuuuuaugaauuuuaucuugccuugucu

SEQ ID NO: 121200 - RNA, 64 nt, Homo Sapiens
agagacaggguuucaccaugcuggcuaauuuuuguguuuuuaguacgggugcgugccaccaugc

SEQ ID NO: 121201 - RNA, 64 nt, Homo Sapiens
aaugucagcuaugugccccauacuucuucggauguguuuuuaaucuacaccccacagggccccc

SEQ ID NO: 121202 - RNA, 64 nt, Homo Sapiens
auggaucuguauguguucuaccuaauaugaugacuguuuuuaauacauugacagauugaauuug

SEQ ID NO: 121203 - RNA, 64 nt, Homo Sapiens
auuaacaaaacaguccuaaauucuauauaauuccuguuuuuauuguaaaaaaugguguuuuauc

SEQ ID NO: 121204 - RNA, 64 nt, Homo Sapiens
aaaaggaagcuuacaugccuacauugacuauuuuuguuuuuauugauacuuauuuaaauagaug

SEQ ID NO: 121205 - RNA, 64 nt, Homo Sapiens
cacucuaagaaauguguuuagguaagaguacaguuguuuuuauaauucuuaauaucaacuguuu

SEQ ID NO: 121206 - RNA, 64 nt, Homo Sapiens
ucauauauuuuauaguuuugucuacuugaaccaauguuuuuauuaguguuucacuaggaacacc

SEQ ID NO: 121207 - RNA, 64 nt, Homo Sapiens
cuugccucacugugugugugaaugcuuuuuaauguguuuuuaccgucagugagaaaaauuuauc

SEQ ID NO: 121208 - RNA, 64 nt, Homo Sapiens
cuauuauccuuuauuuccaguuuagaauugguuuuguuuuuauuguaaugaaaauucuauuuuu

SEQ ID NO: 121209 - RNA, 64 nt, Homo Sapiens
uuuuuuuuuuuuuuuuuuuuuuugaguuguuguuuguuuuuagauccacaguacaugagaaucc

SEQ ID NO: 121210 - RNA, 64 nt, Homo Sapiens
ccauggcaaccauaacuuuugaaccaaaaaaaauuguuuuuacaucuuuaugcugaaaaugugu

SEQ ID NO: 121211 - RNA, 64 nt, Homo Sapiens
uuguuuuguuacucauagaacugguguuguuugcuguuuuuauuucucuaauuguugcagaguu

SEQ ID NO: 121212 - RNA, 64 nt, Homo Sapiens
gaguucugccuguuacaaagcuacagaacuguauuguuuuuauuuuccuucuugagcacauguu

SEQ ID NO: 121213 - RNA, 64 nt, Homo Sapiens
auuuuaaaauuuaugaaaucuauauuccagguauuguuuuuagucugaaaaacaaacuccccca

SEQ ID NO: 121214 - RNA, 64 nt, Homo Sapiens
uaggugaugguugguugaaaggaauuguuauugcuguuuuuauuuuuuacuuuuuuugagacag

SEQ ID NO: 121215 - RNA, 64 nt, Homo Sapiens
caggcaugagccaccgcgcccggccccaaucaucuguuuuuaaacaaucguuuuugagcagaua

SEQ ID NO: 121216 - RNA, 64 nt, Homo Sapiens
uucaccccucucugguacuuguggcuugcuaguauguuuuuaugauaaucucgggcauuguuug

SEQ ID NO: 121217 - RNA, 64 nt, Homo Sapiens
ggcauuguuugcauuguguuuauuaauaggguuuuguuuuuauuguuuccuuuuuuacaguaaa

SEQ ID NO: 121218 - RNA, 64 nt, Homo Sapiens
aguuaauaaaaaacagaguauuuuauguaauuucuguuuuuaaaaagacauuauuaaauggguc

SEQ ID NO: 121219 - RNA, 64 nt, Homo Sapiens
gcuuuccuauaaauguuuggguuguguuugguauuguuuuuagugguuaauaguuuuccaguug

SEQ ID NO: 121220 - RNA, 64 nt, Homo Sapiens
uuaauguauuuucauacuacauacugaauuuguauguuuuuaaaauuguuacaucuagacaacu

SEQ ID NO: 121221 - RNA, 64 nt, Homo Sapiens
auauauuguuacuuuaacagaacuugcauuauuuuguuuuuaauaaauauaaacaugaaauuuu

SEQ ID NO: 121222 - RNA, 64 nt, Homo Sapiens
uguuuccuaaaugaaacauuuguacaacauuugauguuuuuacuuaugaaauauucuccucccc

SEQ ID NO: 121223 - RNA, 64 nt, Homo Sapiens
caugcuuaauugugaucacuuucuugcacugugauguuuuuacgugaauauguugaaguagaag

SEQ ID NO: 121224 - RNA, 64 nt, Homo Sapiens
cauuuaaugaagccuauuuuucuguuccagcaacuguuuuuaugaaagaaaaacuugaaaugcu

SEQ ID NO: 121225 - RNA, 64 nt, Homo Sapiens
auaggugccugccaccaugcccagcuaauuuuuguguuuuuaguagagauggagucucaccaca

SEQ ID NO: 121226 - RNA, 64 nt, Homo Sapiens
gacuuuucuauuucaaguaaagcuuugaguuacuuguuuuuauacauauucaucauguacccuu

SEQ ID NO: 121227 - RNA, 64 nt, Homo Sapiens
guuuuuucuuaaaauuuauuuuaacuugacaguauguuuuuaguucccccaauuuaauuaaugg

SEQ ID NO: 121228 - RNA, 64 nt, Homo Sapiens
auugacucugaguguaagagaguauguguuuuuuuguuuuuaguucugcucuagaucauaauug

SEQ ID NO: 121229 - RNA, 64 nt, Homo Sapiens
ucuuuccagcuugccuguuuuugaguauguuugauguuuuuaaaauuuugucuucucuguggaa

SEQ ID NO: 121230 - RNA, 64 nt, Homo Sapiens
gugucucccccuaggugcaauuagguuguuucuuuguuuuuaguuucaauucuaugugcauagc

SEQ ID NO: 121231 - RNA, 64 nt, Homo Sapiens
agugaugcaauuuauugauuagugaguaagauacuguuuuuauugagagauuugauuuuuauaa

SEQ ID NO: 121232 - RNA, 64 nt, Homo Sapiens
uuccugcauuacaagguaaaaauuuguuaauguuuguuuuuauucagcuugggaaagcuuugug

SEQ ID NO: 121233 - RNA, 64 nt, Homo Sapiens
ccugguaaagacauuugugaggcuacccuagauguguuuuuauuuuauuugcuuuaaauuugcu

SEQ ID NO: 121234 - RNA, 64 nt, Homo Sapiens
guauuauugguuauagaaacuuuugauuaacaaauguuuuuaaaguuauaucaaugucagccua

SEQ ID NO: 121235 - RNA, 64 nt, Homo Sapiens
gaugagacuauucucugcuuuccacaggacuuucuguuuuuagguccuguugaacuugcaucuu

SEQ ID NO: 121236 - RNA, 64 nt, Homo Sapiens
uccugacucacauucugucaccuggguuuuguaauguuuuuaugaaagaccgcaacaccugaau

SEQ ID NO: 121237 - RNA, 64 nt, Homo Sapiens
ugugacacaacugugugauuuauguuaauuuguguguuuuuagccaaauaguugcauagcagua

SEQ ID NO: 121238 - RNA, 64 nt, Homo Sapiens
uauguaggcccagucgucaugaugugcuauaaucuguuuuuacgcauuaugucaaccaggucca

SEQ ID NO: 121239 - RNA, 64 nt, Homo Sapiens
uucaagcaaaaucuuacuguaaucucauguaguuuguuuuuaauaaauaugauuuuaaugcuuu

SEQ ID NO: 121240 - RNA, 64 nt, Homo Sapiens
acuagcauugaaugcaguccuucugaaaagcugguguuuuuacaaauuuuguacagauaccaac

SEQ ID NO: 121241 - RNA, 64 nt, Homo Sapiens
uuuuuuuuuauuuagaugaccuuuuauuuuucuuuguuuuuauuacagaggcacuuaauuugau

SEQ ID NO: 121242 - RNA, 64 nt, Homo Sapiens
uuuauuuuuuuaauuuuuucggaagaggauucauuguuuuuauuugugcuauuuguguuaacau

SEQ ID NO: 121243 - RNA, 64 nt, Homo Sapiens
aucagcagcauuuggcaagucaugauaacuaaucuguuuuuaguuagauuaucuauuuuucucc

SEQ ID NO: 121244 - RNA, 64 nt, Homo Sapiens
aacauugaagauaaucaggagcgugaaagguguuuguuuuuaaccaaauucauacuaauuaccc

SEQ ID NO: 121245 - RNA, 64 nt, Homo Sapiens
gucucuugagccuuaguuaaaaaaauuacuucuauguuuuuauuuauuuuauuuccuuuuauua

SEQ ID NO: 121246 - RNA, 64 nt, Homo Sapiens
gauaagauacgucuauuuuuaguuuguaugguaguguuuuuauacagauaacauuuuaguuuca

SEQ ID NO: 121247 - RNA, 64 nt, Homo Sapiens
aauuccuuggaggcuggaagcaaacauaauugcauguuuuuaaaaguacaguagccaaggaaua

SEQ ID NO: 121248 - RNA, 64 nt, Homo Sapiens
auauuucgucugaauaaguaaaaccaagaaaacuuguuuuuagaggcaaaaugugaguaaauug

SEQ ID NO: 121249 - RNA, 64 nt, Homo Sapiens
ccagugugacuuuaucuucugggugguuugauaguguuuuuaaaaguaauauauaauguggggu

SEQ ID NO: 121250 - RNA, 64 nt, Homo Sapiens
ugugaauaggcuggcugugccuguagagcucuuguguuuuuagugaugacaugaaauacaaaga

SEQ ID NO: 121251 - RNA, 64 nt, Homo Sapiens
ucugugcaccuuauuugaccacacuccaaaauucuguuuuuauuuuaacccuugaaucugcuuu

SEQ ID NO: 121252 - RNA, 64 nt, Homo Sapiens
ugggguuuauguuuuuuaagguaaauacggguauuguuuuuaauuauuaccauguauuaaauug

SEQ ID NO: 121253 - RNA, 64 nt, Homo Sapiens
guaaagauaacaggaaaauaaguuuugauugcauuguuuuuaaaauaagcuaguuuucugaggu

SEQ ID NO: 121254 - RNA, 64 nt, Homo Sapiens
gugaagaguaauuugguacaaugaaggcaguguuuguuuuuaaguuaaaggaaaugggcuaaac

SEQ ID NO: 121255 - RNA, 64 nt, Homo Sapiens
ggcuguagugauuccuggggccagaguggcauuauguuuuuacaaaauaaugacauaugucaca

SEQ ID NO: 121256 - RNA, 64 nt, Homo Sapiens
caggauaguuuuguuuaaauucuugcagauuacauguuuuuacaguggccugcuauugaggaaa

SEQ ID NO: 121257 - RNA, 64 nt, Homo Sapiens
augaaugggacccggauuugggggguuguuuguuuguuuuuagaacauagaguggcauggccgu

SEQ ID NO: 121258 - RNA, 64 nt, Homo Sapiens
uuuauuucaguuaacaagauacuuugacuugaaguguuuuuaguguaucccuaugaaaaucauu

SEQ ID NO: 121259 - RNA, 64 nt, Homo Sapiens
gaaauuaggaacacugcuauuuuuuucuuaaaaauguuuuuaagaauauguucguuucuuugac

SEQ ID NO: 121260 - RNA, 64 nt, Homo Sapiens
ggagcaaaagcugacuuuuaaacuugaccccugcuguuuuuaaacagcuuuuccuuuuggucuc

SEQ ID NO: 121261 - RNA, 64 nt, Homo Sapiens
aaagcaccugaugcugcaucacaacugcaauguuuguuuuuauuuuuggcuuuaugucuauacu

SEQ ID NO: 121262 - RNA, 64 nt, Homo Sapiens
guauuuucaaaaugaauuuuaaguagauauuugguguuuuuaucuugucaaagacaguuucaaa

SEQ ID NO: 121263 - RNA, 64 nt, Homo Sapiens
gaugagguuuuaaccauuauucaggguggucuuuuguuuuuaaaucuuuuuuuaacuaauaaga

SEQ ID NO: 121264 - RNA, 64 nt, Homo Sapiens
acgguguguauuuuauacagaaaugcauuauaaauguuuuuaauuguguucuguuuuuugcagu

SEQ ID NO: 121265 - RNA, 64 nt, Homo Sapiens
augcuuguucagugccgguacauuuacuuaaaucuguuuuuauuuuugucauguagaauacuac

SEQ ID NO: 121266 - RNA, 64 nt, Homo Sapiens
uuuauuaucugcaagguuuuuuuguguguguuuuuguuuuuauuuucaauaugcaaguuaggcu

SEQ ID NO: 121267 - RNA, 64 nt, Homo Sapiens
agcaauuucauucaaaaugccaacuggagaagucuguuuuuaaauacauuuuguuguuauuuuu

SEQ ID NO: 121268 - RNA, 64 nt, Homo Sapiens
caauccuauaaggcacagggaacaagcauucuccuguuuuuacagauuguauccugaggcugag

SEQ ID NO: 121269 - RNA, 64 nt, Homo Sapiens
cacauauaaagcuuugucuuuuuguuguuguuguuguuuuuaagauggaguuucccucuguugc

SEQ ID NO: 121270 - RNA, 64 nt, Homo Sapiens
caaugcgaauuuccccuucuacauugucuaucccuguuuuuauaugucuccauucuuuuuaaaa

SEQ ID NO: 121271 - RNA, 64 nt, Homo Sapiens
aaaguuguuuuguuuguuuucaguaauauuuugcuguuuuuaagacuuggaaaacuaagugcag

SEQ ID NO: 121272 - RNA, 64 nt, Homo Sapiens
aaaccacuggaacucuuguccaguuuuuaaauuauguuuuuacuggaauguuuuugugucagug

SEQ ID NO: 121273 - RNA, 64 nt, Homo Sapiens
aaaacauugaaauauuaguuuaucugaagggaauuguuuuuauacucuuagagguuaaucagag

SEQ ID NO: 121274 - RNA, 64 nt, Homo Sapiens
aaccuauuuugaaaggucaggauuuucaaaaaaauguuuuuaaaaguguuuaaaagcaaauacu

SEQ ID NO: 121275 - RNA, 64 nt, Homo Sapiens
aguguaucacaauuuucuuuuuguuacagcuggcuguuuuuauauggcuaugaaaacagcuauu

SEQ ID NO: 121276 - RNA, 64 nt, Homo Sapiens
uuggaaauaaaaguucacugccguaauucaaauuuguuuuuauuccuuguauuauauggcacug

SEQ ID NO: 121277 - RNA, 64 nt, Homo Sapiens
gggcaugucaucuaagagagccaaucauggaugcuguuuuuauuuuaauugggagauaaugaaa

SEQ ID NO: 121278 - RNA, 64 nt, Homo Sapiens
ucacacagcucaacgguugagaggagaaaacaauuguuuuuaaaaauggagauuuuggugggag

SEQ ID NO: 121279 - RNA, 64 nt, Homo Sapiens
auuucauucguauaccuaaguuguuuuuaaauaauguuuuuauaaauguugaagauguagaacu

SEQ ID NO: 121280 - RNA, 64 nt, Homo Sapiens
uaauguuuuuauaauuucauaagauguagaacuuuguuuuuaaaccuuuuuuggcccaauguug

SEQ ID NO: 121281 - RNA, 64 nt, Homo Sapiens
auaaaaaucaauagggaugacauuuguaagauucuguuuuuagcauuuggauauauagcuauca

SEQ ID NO: 121282 - RNA, 64 nt, Homo Sapiens
gggcuucaauacccagguggagguaaguagaaaguguuuuuauaagcaacgccagacuauauua

SEQ ID NO: 121283 - RNA, 64 nt, Homo Sapiens
aaaaugcauuuuuuauucuucuucaguauagauuuguuuuuauuccucucacaaaggaaaauga

SEQ ID NO: 121284 - RNA, 64 nt, Homo Sapiens
uaugaauguauuucauucaugcaguaaaauacucuguuuuuaaguugagauauuuaaaguuuug

SEQ ID NO: 121285 - RNA, 64 nt, Homo Sapiens
uuuaauuuuuccuuuuuuucuauauccuucaguuuguuuuuauuaauuuugguuuaucuuggca

SEQ ID NO: 121286 - RNA, 64 nt, Homo Sapiens
auacaaagcugaaugucauuugaauguuaauagguguuuuuauuaaguuuucuguaccuuguga

SEQ ID NO: 121287 - RNA, 64 nt, Homo Sapiens
cucucucucuuuuuuuuuuuuuuuuguaaugcacuguuuuuaauuuaaggaaguuugauuuuug

SEQ ID NO: 121288 - RNA, 64 nt, Homo Sapiens
gaccaauugaguaagaacauuacaaacaaguggauguuuuuaauaaguaauuauaaauacguau

SEQ ID NO: 121289 - RNA, 64 nt, Homo Sapiens
uauucauucauggcaauuuaugacuuauuuuacuuguuuuuaauaugccaccuaugagugccag

SEQ ID NO: 121290 - RNA, 64 nt, Homo Sapiens
uugaaucucaguaaagauuuaaccaaugcaguauuguuuuuacaaaguagcuauaccguaguca

SEQ ID NO: 121291 - RNA, 64 nt, Homo Sapiens
guauauaugucuugcucagauuaauguguucauuuguuuuuaaugauuguaaaauagugaaauu

SEQ ID NO: 121292 - RNA, 64 nt, Homo Sapiens
gcagccauauccacuuauccagugauauaagcauuguuuuuauucuggauuuuuuuuaauaauu

SEQ ID NO: 121293 - RNA, 64 nt, Homo Sapiens
ugugaaacguugagaacaauaaucgcugcaguuuuguuuuuauggagaugugcgugcaaagaau

SEQ ID NO: 121294 - RNA, 64 nt, Homo Sapiens
uuaugcagagaugugcgugcgaaauccucagaaauguuuuuauagacauguuaauucaauucua

SEQ ID NO: 121295 - RNA, 64 nt, Homo Sapiens
uagucaaacuucaagaaacauuccuuuacaccuauguuuuuaagguggaccagucugaaugucu

SEQ ID NO: 121296 - RNA, 64 nt, Homo Sapiens
uauucugagaaguugaggcauccaaacauuaauuuguuuuuauuuucauaaaaaacuuucaaga

SEQ ID NO: 121297 - RNA, 64 nt, Homo Sapiens
ccaaauucauguuuuaaggcugggcacuuuuauuuguuuuuaucacauauggcuucuuaaaacu

SEQ ID NO: 121298 - RNA, 64 nt, Homo Sapiens
aaacaugcugugugccacaguuuuaauagcaauguguuuuuauuuucuguuuacauauacuuuu

SEQ ID NO: 121299 - RNA, 64 nt, Homo Sapiens
guagaagacaauuaauuuauuugcuuccaaauuuuguuuuuacucuguauuucuugguaucaug

SEQ ID NO: 121300 - RNA, 64 nt, Homo Sapiens
ggaaacaucuauuaugguaaauaaacucucucuuuguuuuuaaaauguguauaauuauugccuc

SEQ ID NO: 121301 - RNA, 64 nt, Homo Sapiens
cuugauguuuuccaacuuucuuuuccuacagcacuguuuuuaauauuuguuuacuguugugaau

SEQ ID NO: 121302 - RNA, 64 nt, Homo Sapiens
gucuagagccuuuaaaaaacugggagacacaagauguuuuuauaaaguagcaggguggucaggg

SEQ ID NO: 121303 - RNA, 64 nt, Homo Sapiens
agucacuuaauuugucucauaauacaguuccuaguguuuuuagaguauugucuuguuuuuaaaa

SEQ ID NO: 121304 - RNA, 64 nt, Homo Sapiens
aaauacaguuccuaguguuucugaaguauugucuuguuuuuaaaaagaauuaaagcaagaaaau

SEQ ID NO: 121305 - RNA, 64 nt, Homo Sapiens
uguuuugacgauuucaauacuuacuucaacuuuguguuuuuaaaacaguuauuauuauuuaaaa

SEQ ID NO: 121306 - RNA, 64 nt, Homo Sapiens
aucacaaucauuuuauggaagaugugugauaaucuguuuuuacugguauuaauaaacacauaca

SEQ ID NO: 121307 - RNA, 64 nt, Homo Sapiens
uauaccuguaucucccaacuagaaacagcuccaguguuuuuaagagaauguuucuuaaaaccaa

SEQ ID NO: 121308 - RNA, 64 nt, Homo Sapiens
caguguggaguguauuggggauuuuguuauauuuuguuuuuaucuggauuguuuuuguccuagg

SEQ ID NO: 121309 - RNA, 64 nt, Homo Sapiens
cucuauacacuugauaaggguaaauuuaucuuaguguuuuuaaacuugguuuugguuacuugag

SEQ ID NO: 121310 - RNA, 64 nt, Homo Sapiens
uuguggcccauuuaugaaguccccaaaagaguuauguuuuuaagugccuuggcaggcucacuuc

SEQ ID NO: 121311 - RNA, 64 nt, Homo Sapiens
cccuuucaagccuuauacaguaguacacuguacuuguuuuuaguaguaagaccuacuuucccac

SEQ ID NO: 121312 - RNA, 64 nt, Homo Sapiens
gucaauaacacuguauuuuaauguacuugaaaaauguuuuuauuuuuguuuuauuuuugacaga

SEQ ID NO: 121313 - RNA, 64 nt, Homo Sapiens
cuuguacaaacaguauuucugguguauauuuuaauguuuuuaaaaagaguaauuucauuuaaau

SEQ ID NO: 121314 - RNA, 64 nt, Homo Sapiens
uuucuuuaaauuucugccugucagucuauauugcuguuuuuauuauacaucaguuucuuuguau

SEQ ID NO: 121315 - RNA, 64 nt, Homo Sapiens
guuucuuuguauaacuugugaguuccauguguuuuguuuuuauuauguaaauaucauuauaaau

SEQ ID NO: 121316 - RNA, 64 nt, Homo Sapiens
gacccuuauacuucaagagaacacacucagugcuuguuuuuauuuucuugacacauuuauuaac

SEQ ID NO: 121317 - RNA, 64 nt, Homo Sapiens
aaaagaauugaugcuagagguaaaaaaaaauacuuguuuuuaaaaaauccuuuacgucuugugu

SEQ ID NO: 121318 - RNA, 64 nt, Homo Sapiens
uucagcaucacugugucuguauuucaaguacaaauguuuuuaaaaaggauucuuuauacauaug

SEQ ID NO: 121319 - RNA, 64 nt, Homo Sapiens
uuuaaaaaguccacaagaaugaucaaguaagauuuguuuuuauucuuacagacaucacccgugu

SEQ ID NO: 121320 - RNA, 64 nt, Homo Sapiens
auauucucacuugaaugaagauuguuuuuuucuuuguuuuuacugguaguguucugauuuguga

SEQ ID NO: 121321 - RNA, 64 nt, Homo Sapiens
caaagucuugaguucuguauauggccugguuucuuguuuuuauuaauagaugguuuauuuacua

SEQ ID NO: 121322 - RNA, 64 nt, Homo Sapiens
gcuaacauagaccccaaaaucuggaugcuuucaauguuuuuaauuuuauuggaacuugauuuuc

SEQ ID NO: 121323 - RNA, 64 nt, Homo Sapiens
cuaguaauaugcagaaaacaugugcuauuagcauuguuuuuagaugaggacaaaaucuuaaaua

SEQ ID NO: 121324 - RNA, 64 nt, Homo Sapiens
gaaaagaagugauaguaguuucucucucucuuuuuguuuuuauaaccaccuugcagacaaaauc

SEQ ID NO: 121325 - RNA, 64 nt, Homo Sapiens
uauaaacaaauauucuuuacaaugucuuuuuaaauguuuuuaaaaaaagaugaugaaaaugcag

SEQ ID NO: 121326 - RNA, 64 nt, Homo Sapiens
caacugaagguuaacagccaagaggcuauuuugauguuuuuauacaugaaguucuuuugagagg

SEQ ID NO: 121327 - RNA, 64 nt, Homo Sapiens
ugaaaagaaugagauuuauacuaacacugagcgcuguuuuuaaaaaauuggauugacuuacuac

SEQ ID NO: 121328 - RNA, 64 nt, Homo Sapiens
auuccacuaucccuuuucuacauguuuaaagacguguuuuuaaaaagcaaauaaaaucaaaagu

SEQ ID NO: 121329 - RNA, 64 nt, Homo Sapiens
gaguuugugauaacucauaaugcaugcaaaucauuguuuuuacaaucuugacuugacuuuuuua

SEQ ID NO: 121330 - RNA, 64 nt, Homo Sapiens
caguuaaaauacuucuagaaucaugaagagauaauguuuuuaggucuuagaacuuaggugguag

SEQ ID NO: 121331 - RNA, 64 nt, Homo Sapiens
ucagcccuauuuguauuauuauauuuccauguaauguuuuuauuugcagucuaugcacaacacu

SEQ ID NO: 121332 - RNA, 64 nt, Homo Sapiens
gauuaaaguaagauuaaaauauuuaaguuauuuuuguuuuuauaugagccuuguaaugauguau

SEQ ID NO: 121333 - RNA, 64 nt, Homo Sapiens
uccguguuucuuugaauuuaaaaagaguauacuguguuuuuaaaccauuugaauuaauaacaug

SEQ ID NO: 121334 - RNA, 64 nt, Homo Sapiens
uauugauggggacuuuuccauuuucucacugaguuguuuuuauggauuaaccaggaaagaaagc

SEQ ID NO: 121335 - RNA, 64 nt, Homo Sapiens
caucuuuuguaacuaugacauuuuaaacuguuucuguuuuuauuauacugaaacccaauggugu

SEQ ID NO: 121336 - RNA, 64 nt, Homo Sapiens
cuguuucuguuuuuauucaucugaaacccaaugguguuuuuaaaaaagagguaucaaguaaaua

SEQ ID NO: 121337 - RNA, 64 nt, Homo Sapiens
guugcaaaaaaauguuaaugcuuguacuuauuuuuguuuuuauugcuuacauguuuugaaaauc

SEQ ID NO: 121338 - RNA, 64 nt, Homo Sapiens
gcaaguuugucugggaugucacuagagugcauuauguuuuuaauuacucauuuugcuuucaauc

SEQ ID NO: 121339 - RNA, 64 nt, Homo Sapiens
aaagaauggggauggggagagcuacgugguaguauguuuuuauuaggagaauaaugcaauaaaa

SEQ ID NO: 121340 - RNA, 64 nt, Homo Sapiens
aagacaagucucgguguucccuuuauucuuaguuuguuuuuaaauauuaauuuuggcauucuaa

SEQ ID NO: 121341 - RNA, 64 nt, Homo Sapiens
gaagugagaaguucauauuucuuuggcuuuuuuguguuuuuaaaaguuacuccuuuuagggagc

SEQ ID NO: 121342 - RNA, 64 nt, Homo Sapiens
accuguguauuuuuuaaagcuacaaucuguucaauguuuuuaaaaaucuguuuauaugacauug

SEQ ID NO: 121343 - RNA, 64 nt, Homo Sapiens
uaauuuuggaaacagaaggagaagcacugccauuuguuuuuauuucaacaauuggaaaaauuac

SEQ ID NO: 121344 - RNA, 64 nt, Homo Sapiens
auuauuggaauucagacacuguucuuaccguguuuguuuuuaaucaaauauuaccuaaaaaugu

SEQ ID NO: 121345 - RNA, 64 nt, Homo Sapiens
auaaacuuauagaaugucaaacuuugccuucaacuguuuuuauuucuagucucuuccacuuuaa

SEQ ID NO: 121346 - RNA, 64 nt, Homo Sapiens
aaugguuaaauggaccacugguuucuuagagaaauguuuuuaggcuuaauucauucaauuguca

SEQ ID NO: 121347 - RNA, 64 nt, Homo Sapiens
agauuuaaugauuucaaagaaaauaaugguucuuuguuuuuaauguuaaccuuuuuuaaauaca

SEQ ID NO: 121348 - RNA, 64 nt, Homo Sapiens
uuuuauuccauucaauaaagaacaaaaccaauaguguuuuuauuacuuucaucugaaacauucc

SEQ ID NO: 121349 - RNA, 64 nt, Homo Sapiens
gcagaaagacuuuuguuuuacugaagacaaaagauguuuuuauuuuagacccagaagagaggag

SEQ ID NO: 121350 - RNA, 64 nt, Homo Sapiens
agcugguauuuaagaugcuuguaaauacuauuuauguuuuuaauuuuguaaaauaaagauuucu

SEQ ID NO: 121351 - RNA, 64 nt, Homo Sapiens
auuucuauugggaagaggcuaaauuuuaucuuacuguuuuuauaccccuuguuagauuuuuuuu

SEQ ID NO: 121352 - RNA, 64 nt, Homo Sapiens
aaaaguuuuacugccauauuggccuuccucuuucuguuuuuaaaaggauucugcugguacgaga

SEQ ID NO: 121353 - RNA, 64 nt, Homo Sapiens
ugaugauggucauugaaacuuacaaacuuauucauguuuuuaggcauuccucugguccuaaaua

SEQ ID NO: 121354 - RNA, 64 nt, Homo Sapiens
auagguaauuauauugaaugaaggcugagaagguuguuuuuauauuauaauuaucucauuuguu

SEQ ID NO: 121355 - RNA, 64 nt, Homo Sapiens
uuuauguauacuagccuggcuuuaccauguaauuuguuuuuaaaccuaugaauuuaaaaccagg

SEQ ID NO: 121356 - RNA, 64 nt, Homo Sapiens
aucaaauguauuuuuuuacuauuuacaaaauugauguuuuuauauauccaauauggacaaucau

SEQ ID NO: 121357 - RNA, 64 nt, Homo Sapiens
agcguagaguaggaagucucaucuauuuuuuauuuguuuuuauuuaaauguuaguuuugacuuc

SEQ ID NO: 121358 - RNA, 64 nt, Homo Sapiens
uauuuuuugccacuggugaucuguuuuuugcuuuuguuuuuauugacaaaguggaacaguggag

SEQ ID NO: 121359 - RNA, 64 nt, Homo Sapiens
uuuuuuuuuuuuggcuuuuguaggugguuguuguuguuuuuacuguuuugcuguuguuuaggag

SEQ ID NO: 121360 - RNA, 64 nt, Homo Sapiens
ggaugggaggugguguguguuauuuuguuaauuauguuuuuaggggauuuuuuauuuuauuuuu

SEQ ID NO: 121361 - RNA, 64 nt, Homo Sapiens
gagaaucuuguuuuaaaauggugugguuuguguguguuuuuaauuuguuguugucauugcgugu

SEQ ID NO: 121362 - RNA, 64 nt, Homo Sapiens
uuguuguugucauugcgugucaguauucauacaguguuuuuauuauuaccuagaacccuuccug

SEQ ID NO: 121363 - RNA, 64 nt, Homo Sapiens
gauauauuaauuggaauuccuuugcauaggagaauguuuuuaugaucuguuuagugcuuauuau

SEQ ID NO: 121364 - RNA, 64 nt, Homo Sapiens
gcaacuauaggugugugccacuacaccuggcuaauguuuuuaguuuuuuagagauggagucuug

SEQ ID NO: 121365 - RNA, 64 nt, Homo Sapiens
cagagggucaagaagugacuuguucagaacacauuguuuuuaacagaaaaaaaaucuuuuuaua

SEQ ID NO: 121366 - RNA, 64 nt, Homo Sapiens
gccucugcuucuuaagcuuuccugcugcucgcuuuguuuuuaaaaguaacuuggguugcauucu

SEQ ID NO: 121367 - RNA, 64 nt, Homo Sapiens
aagggacugcagaggcgggcaagcccucucuauguguuuuuauccccaccuuccccggaaucug

SEQ ID NO: 121368 - RNA, 64 nt, Homo Sapiens
auccccaccuuccccggaaucuggggagggcuuuuguuuuuacguuuucaaguucagcauugua

SEQ ID NO: 121369 - RNA, 64 nt, Homo Sapiens
auaccccaagguaauaggaaaaguuugaguuaaguguuuuuaauucagucagugaauucagaau

SEQ ID NO: 121370 - RNA, 64 nt, Homo Sapiens
auagauaaauucuuguaacauuaaaggauuaaaauguuuuuacauuguuuuugggugucuccuu

SEQ ID NO: 121371 - RNA, 64 nt, Homo Sapiens
aguauuugugcagaaaaacaaguccuaaaguauuuguuuuuauuuguaccauccacuugugccu

SEQ ID NO: 121372 - RNA, 64 nt, Homo Sapiens
guugcauuuuaaucaguaaucuaccugguggauuuguuuuuaaccaaaaagaugaauuaucaau

SEQ ID NO: 121373 - RNA, 64 nt, Homo Sapiens
aguugggguuuauuguacaguuuaaaauguuagauguuuuuaauuuuuuaaauaaauggaauac

SEQ ID NO: 121374 - RNA, 64 nt, Homo Sapiens
ucucuucaaugacauagaaaguucauggaacucauguuuuuaaagggcuauguaaauauaugaa

SEQ ID NO: 121375 - RNA, 64 nt, Homo Sapiens
ugcaauauaugccugacugaccuacuuggaaacauguuuuuauuauuuagcauuuuuauuccag

SEQ ID NO: 121376 - RNA, 64 nt, Homo Sapiens
guuguaaaaaccauauuugcgguuuuccaaaagauguuuuuagaugugagugguucagucauga

SEQ ID NO: 121377 - RNA, 64 nt, Homo Sapiens
aaaguauguguguguaucagauaagaccauuugcuguuuuuauucacugcuaaaaguaggugau

SEQ ID NO: 121378 - RNA, 64 nt, Homo Sapiens
gcaauuauuguaguaauuuccauuuuccuaaauauguuuuuaaaaagcucaucuagggucaccu

SEQ ID NO: 121379 - RNA, 64 nt, Homo Sapiens
ucgacaaugaagaugaucauccauaacuuucauuuguuuuuauauucauuuuaucaaaaauuac

SEQ ID NO: 121380 - RNA, 64 nt, Homo Sapiens
cuaaggaauaauuaucuuccccaucagucuucaguguuuuuaaugcaauuugaaucuuaacuuu

SEQ ID NO: 121381 - RNA, 64 nt, Homo Sapiens
ugugcucaggcaugauuacauugcacagugacuuuguuuuuaucagagguuggcuguuuauggu

SEQ ID NO: 121382 - RNA, 64 nt, Homo Sapiens
ugagagagaaaaauuaaagcaugugcaauugauauguuuuuagaguuauuaagucaaaggaaca

SEQ ID NO: 121383 - RNA, 64 nt, Homo Sapiens
uuuagacuucuuauuuccacuuuuuaaaauucauuguuuuuaaacuuuuguuuuauaguuaugc

SEQ ID NO: 121384 - RNA, 64 nt, Homo Sapiens
ucacauacuuacaacucaacauaauccacaaagauguuuuuaucugcaguuuaucguuuuaaaa

SEQ ID NO: 121385 - RNA, 64 nt, Homo Sapiens
uggaaagaugucaacuauaggaugcugugcaguuuguuuuuauagaugucuguacucuauaugu

SEQ ID NO: 121386 - RNA, 64 nt, Homo Sapiens
ugggccagaagauucugcaauuuacagcuucuuuuguuuuuaaucaucuauuaaguucuggaua

SEQ ID NO: 121387 - RNA, 64 nt, Homo Sapiens
ggggauggguagagugggaauuuuuuccuaaucauguuuuuaacauuuuaaaauaaaauuuaau

SEQ ID NO: 121388 - RNA, 64 nt, Homo Sapiens
uugaaauauuuccuagagaauaguaaccagguuuuguuuuuaacuuuaaaaccuaauuacuuuu

SEQ ID NO: 121389 - RNA, 64 nt, Homo Sapiens
uuucucuacacauuuuuuuucuuugaauuaaauuuguuuuuaauaaauguuaauagaccauauu

SEQ ID NO: 121390 - RNA, 64 nt, Homo Sapiens
ucuagaagaucuucuaagcauuuaugccauuuucuguuuuuaaaguguggcuaugagaauauga

SEQ ID NO: 121391 - RNA, 64 nt, Homo Sapiens
aggaaaaacugcuggugauacuuuuuuuaaguuuuguuuuuaucuugccuguuggcuucaauac

SEQ ID NO: 121392 - RNA, 64 nt, Homo Sapiens
ggaaucuaacuuuuuauauugucauuauuauuguuguuuuuaaacgguucuuugucuuuucugu

SEQ ID NO: 121393 - RNA, 64 nt, Homo Sapiens
guaguuuuauuuccacuaagugaaaaaagaacuguguuuuuaaacuguaggagaauuuaauaaa

SEQ ID NO: 121394 - RNA, 64 nt, Homo Sapiens
aaagagaugggcauuguuuccccuauaauugugcuguuuuuauaacuuuuguaaauauuacuuu

SEQ ID NO: 121395 - RNA, 64 nt, Homo Sapiens
uuauaacuuuuguaaauauuacuuuuucuggcuguguuuuuauaacuuauccauaugcaugaug

SEQ ID NO: 121396 - RNA, 64 nt, Homo Sapiens
uugcucuuuuguguuguacugaacacaauauuuguguuuuuauuauuuaugccacgucaguggg

SEQ ID NO: 121397 - RNA, 64 nt, Homo Sapiens
gagugagugaagaaagcuaaguugugaacaagaguguuuuuauagcauauguguugaaguaaca

SEQ ID NO: 121398 - RNA, 64 nt, Homo Sapiens
agugauaaaaggacucuauucacuaaguagccuguguuuuuaaauccagggcugcaggcagcaa

SEQ ID NO: 121399 - RNA, 64 nt, Homo Sapiens
uuugcauaggacaacuaaccugucuguguaacuuuguuuuuauuuuaacucuuacuagaaaauc

SEQ ID NO: 121400 - RNA, 64 nt, Homo Sapiens
auuaaacuuugcagaagugauucauauucaguacuguuuuuaaucacuuuuuaaaauauaagga

SEQ ID NO: 121401 - RNA, 64 nt, Homo Sapiens
guagaauaugcaucaauuucuugaaggagauucauguuuuuauaagaauuuucauguaauuauu

SEQ ID NO: 121402 - RNA, 64 nt, Homo Sapiens
aaaaaaagccaugauuuauucgaugugauuggcuuguuuuuauguggcgccaagaacgaaccug

SEQ ID NO: 121403 - RNA, 64 nt, Homo Sapiens
uuuuuuuuucuuuaacagauuuguauuuaagaauuguuuuuaaaaaauuuuaagauuuacacaa

SEQ ID NO: 121404 - RNA, 64 nt, Homo Sapiens
uacauuuugcuuuuuaaaguugauuuuuuucuauuguuuuuagaaaaaauaaaauaacuggcaa

SEQ ID NO: 121405 - RNA, 64 nt, Homo Sapiens
uguguucuuuugcgucugaugucucacuuuggcauguuuuuagacucauccaagcuguuuugug

SEQ ID NO: 121406 - RNA, 64 nt, Homo Sapiens
ugagcauuuguguaaaaguauguauuugcacauguguuuuuauuucucuuggguaaguaccuag

SEQ ID NO: 121407 - RNA, 64 nt, Homo Sapiens
gucuuuugugaugugucuguucgugccuuuugccuguuuuuaaguugggaugcuuauuguugac

SEQ ID NO: 121408 - RNA, 64 nt, Homo Sapiens
gcauaaagcuuuaguuuggccuuauuuuauuucuuguuuuuauaucagccggccuauaaaucuc

SEQ ID NO: 121409 - RNA, 64 nt, Homo Sapiens
ucuuggauuuauaguaccuuauauauuuuguggauguuuuuauuaaaaagacaaaccagaugua

SEQ ID NO: 121410 - RNA, 64 nt, Homo Sapiens
gucacuuuaugcguuuuccaguuuacagaaugucuguuuuuaaaagaaggaacaaaggucugga

SEQ ID NO: 121411 - RNA, 64 nt, Homo Sapiens
ccaaguugagugaauugguaacaaucagguauuauguuuuuaaaauaaaagccaaauuaauccu

SEQ ID NO: 121412 - RNA, 64 nt, Homo Sapiens
ucaucucauuugaucucaaauucaguuugccaaguguuuuuacaaccauuaauuuuugcauugc

SEQ ID NO: 121413 - RNA, 64 nt, Homo Sapiens
ucuuuuagaaaaggccaauaauauuuuaacuuuuuguuuuuauuaagaaguauuuaaacuuuca

SEQ ID NO: 121414 - RNA, 64 nt, Homo Sapiens
uuuuguaugccaaucuuaaaauauaauuguacuguguuuuuaaaguuggcugugcuguauuuug

SEQ ID NO: 121415 - RNA, 64 nt, Homo Sapiens
gcauauauaaguugucaaggaaacaaagcccaaauguuuuuaaaacaaguauacaguuuuuguc

SEQ ID NO: 121416 - RNA, 64 nt, Homo Sapiens
uuaauucaucuguuuuaaccauuaaaaccuguuuuguuuuuagcuuuguguaagaguuguuacu

SEQ ID NO: 121417 - RNA, 64 nt, Homo Sapiens
uaaauuuaccaccagauacaguaacuugugauuauguuuuuaacaauuuguaauuacaguuuuu

SEQ ID NO: 121418 - RNA, 64 nt, Homo Sapiens
gauuuugauacauuuuaauguuuuucuaauugacuguuuuuaaucauuauuuuugguguauugc

SEQ ID NO: 121419 - RNA, 64 nt, Homo Sapiens
gguggauuuuguuuaaaaaaaaugucuguaaauauguuuuuaaaguauagccuauggcagaaaa

SEQ ID NO: 121420 - RNA, 64 nt, Homo Sapiens
caaaauaagaacgaggauuucuuuuuaaaacacauguuuuuauaccagggccgaccagaggagc

SEQ ID NO: 121421 - RNA, 64 nt, Homo Sapiens
agguauccagcccugauauuuuguguaaauaaaauguuuuuaaaaccuguuaguuaaaacacuu

SEQ ID NO: 121422 - RNA, 64 nt, Homo Sapiens
aauuagaauuagucauuauucuugaugaagagucuguuuuuaaucauaaaaaucaugacaguua

SEQ ID NO: 121423 - RNA, 64 nt, Homo Sapiens
ccuuaacuuacuguugcuuacaccccugaaagucuguuuuuaagcaaauggguaauaguagaaa

SEQ ID NO: 121424 - RNA, 64 nt, Homo Sapiens
ugagagaaucaaaugaguuuacuuuuguuccuguuguuuuuaacuagcuuuaaguuuaaagaug

SEQ ID NO: 121425 - RNA, 64 nt, Homo Sapiens
aaaagcaaccaaauuauuuuuugcugaaacuagauguuuuuacaugagaaauacuguauguguu

SEQ ID NO: 121426 - RNA, 64 nt, Homo Sapiens
guuacaaaggaaguucuaaaauuaugccucccucuguuuuuauaaguugccaucgaaaagugau

SEQ ID NO: 121427 - RNA, 64 nt, Homo Sapiens
uaaagcacaaaauaaccuauuguuagaaaauauguguuuuuauaaaugaauguaaaauaauuaa

SEQ ID NO: 121428 - RNA, 64 nt, Homo Sapiens
aacauuuucaugaccugguuauagccuuugcugguguuuuuaaaauaccuggacucaaugacaa

SEQ ID NO: 121429 - RNA, 64 nt, Homo Sapiens
caacagaugcauucauuucucuuggaauguguauuguuuuuauuuugcgaaacaaaacaaaaca

SEQ ID NO: 121430 - RNA, 64 nt, Homo Sapiens
uacucugacccugaguggaaagggguuuuuguucuguuuuuauuuuaccuacauguacuauuua

SEQ ID NO: 121431 - RNA, 64 nt, Homo Sapiens
uuaauuuuuaaaaaucuuuuguuuuacuuaauucuguuuuuauuauuauuauuauuuuguuuga

SEQ ID NO: 121432 - RNA, 64 nt, Homo Sapiens
ucauagaaaagauuauuugcuucaucaguuaacuuguuuuuauaaaucagggcuguguucauac

SEQ ID NO: 121433 - RNA, 64 nt, Homo Sapiens
cagugaauaaaccaaggugaggccuugagcucuuuguuuuuauauuaaugaggagaaaaguaug

SEQ ID NO: 121434 - RNA, 64 nt, Homo Sapiens
uuggcuuaaguuuauuauagaaaaucaacacuaauguuuuuagauuuuaauuguccuauugaug

SEQ ID NO: 121435 - RNA, 64 nt, Homo Sapiens
cuugcuaacuuugcuguaauuuuuuuaaacgucuuguuuuuaauauagcaaacuaucucaauac

SEQ ID NO: 121436 - RNA, 64 nt, Homo Sapiens
gaaaauuguugcgauuuauuuuuucaagagaucauguuuuuaaagugucuuuugcagaguuuua

SEQ ID NO: 121437 - RNA, 64 nt, Homo Sapiens
uguacugugugccgagaaggcauuucuagacccguguuuuuaaaggagggaacuuuggggauug

SEQ ID NO: 121438 - RNA, 64 nt, Homo Sapiens
aagaaggcagucaguggaucuuaaaaugacaaucuguuuuuaaauuggauucuaugaaaaugca

SEQ ID NO: 121439 - RNA, 64 nt, Homo Sapiens
ucaauagggucacguuaagccaugcuguaagcauuguuuuuauuuucaggcuuagccugagcac

SEQ ID NO: 121440 - RNA, 64 nt, Homo Sapiens
uugggaaauaagcaccuguauuuuuuuccaaaacuguuuuuaaagcuguauacgcauacauaua

SEQ ID NO: 121441 - RNA, 64 nt, Homo Sapiens
acaggugugcaccaccaugccugguucauuuuuguguuuuuaguagagaugggguuuuaccaua

SEQ ID NO: 121442 - RNA, 64 nt, Homo Sapiens
uugacugcuuuauguugaaugccucagcagaaucuguuuuuauguaacugcuauuuauaaaaau

SEQ ID NO: 121443 - RNA, 64 nt, Homo Sapiens
cagagucaugcauauuuucuuuauagacaaauuguguuuuuauagaaacauuuuauacaaacuu

SEQ ID NO: 121444 - RNA, 64 nt, Homo Sapiens
ccucagagaacucugcauuugcagugcauuuguguguuuuuaacagauaaucacuucaccaacu

SEQ ID NO: 121445 - RNA, 64 nt, Homo Sapiens
ugcaguggcugccuucuauuagugccagcuguaauguuuuuaaacaaaucggggcucuuguauc

SEQ ID NO: 121446 - RNA, 64 nt, Homo Sapiens
guuucuuuuguagaccgaacuuggcuuuagcagauguuuuuaaaauuugugaacaaauguuccc

SEQ ID NO: 121447 - RNA, 64 nt, Homo Sapiens
aacaauagcaccuugaaaauuuuuuguuuuguuuuguuuuuaacaagacagaaacugagaauuu

SEQ ID NO: 121448 - RNA, 64 nt, Homo Sapiens
aguuaagauggaagacuuccuucuugacaaauuguguuuuuagugaauuucuuaaaccguuuua

SEQ ID NO: 121449 - RNA, 64 nt, Homo Sapiens
ccccacaaauguuaguuguguguguguguguguguguuuuuaaucacuguaaccggaugcauuu

SEQ ID NO: 121450 - RNA, 64 nt, Homo Sapiens
augguucugagaaagaagcuguacguuuucuuuauguuuuuaugaccaaagcaguuucuuguca

SEQ ID NO: 121451 - RNA, 64 nt, Homo Sapiens
ucuuuuuucaaucuguacauuugggcugucuguauguuuuuauagcugguuuuuaaaaagcaua

SEQ ID NO: 121452 - RNA, 64 nt, Homo Sapiens
aaauaucauuguccuccucccccagccucaaauauguuuuuaaauacuggcgugagccaccaug

SEQ ID NO: 121453 - RNA, 64 nt, Homo Sapiens
ggccuuuuucaaaugcagaucaauucuguccuacuguuuuuacaaaaguaaaaggugaugaggg

SEQ ID NO: 121454 - RNA, 64 nt, Homo Sapiens
ugccggcugaggauucugucauaucauguaaguuuguuuuuauuaagguggucucaguauugca

SEQ ID NO: 121455 - RNA, 64 nt, Homo Sapiens
ucugggagggcaaaaaagagaauuaauuugcuucuguuuuuaggucaugaaacugauguaaggc

SEQ ID NO: 121456 - RNA, 64 nt, Homo Sapiens
uccuucauccugguccuggcuuuauggaacaccauguuuuuagcauguuuuuaaauaaaaacgg

SEQ ID NO: 121457 - RNA, 64 nt, Homo Sapiens
gguccuggcuuuauggaacaccauguuuuuagcauguuuuuaaauaaaaacggauaaaguguca

SEQ ID NO: 121458 - RNA, 64 nt, Homo Sapiens
gauauaaccuuuaaaaauuuucucauuaagacaauguuuuuaauuuaauuugccucauuacauc

SEQ ID NO: 121459 - RNA, 64 nt, Homo Sapiens
auauauauuaaccauauuuuaaaaguaccaauuuuguuuuuacagaaaagauaaaacucaaaag

SEQ ID NO: 121460 - RNA, 64 nt, Homo Sapiens
agccuuacuggguugaaaaggaguagcucagaccuguuuuuauuugcucaauaacucuacucau

SEQ ID NO: 121461 - RNA, 64 nt, Homo Sapiens
gcacuuaauuuuaauguaagaaaguuguucauuuuguuuuuauaaaauacaugaggacaaugcu

SEQ ID NO: 121462 - RNA, 64 nt, Homo Sapiens
cgcauuuacagauuggugucaaagacauucacuauguuuuuaugguucauguuauauccucccc

SEQ ID NO: 121463 - RNA, 64 nt, Homo Sapiens
gauauuuaauauuucuauauucugcuuuucuagcuguuuuuaccuaguuagcuugugacuuugc

SEQ ID NO: 121464 - RNA, 64 nt, Homo Sapiens
uugacaauuccgauuugaugcugcaauuacuugcuguuuuuauugaucuuaugguuuauuucuu

SEQ ID NO: 121465 - RNA, 64 nt, Homo Sapiens
aaauuggcagaggcagggugucaacuugauuagguguuuuuaugggaauguaauuugaaaucac

SEQ ID NO: 121466 - RNA, 64 nt, Homo Sapiens
gaaauuugacuuaaaauucuugagcacguuaauauguuuuuaagaucugauuaucuuugagaga

SEQ ID NO: 121467 - RNA, 64 nt, Homo Sapiens
uuaucaaauaguuuucucuuugugucuguguuaguguuuuuaaagcugcucauuucauuuuguc

SEQ ID NO: 121468 - RNA, 64 nt, Homo Sapiens
gcguaaaacagcaucauuguacuuaagcuauggauguuuuuauuuuauauuuucuuuauuuaua

SEQ ID NO: 121469 - RNA, 64 nt, Homo Sapiens
aaucuguuuggcauuaagugaauuuuaauguuuuuguuuuuauauccuuuuagcucuuaagugu

SEQ ID NO: 121470 - RNA, 64 nt, Homo Sapiens
cuuuugaacugaaauucaguaaauguccaaguaauguuuuuauaauaaacuaagccauauuuag

SEQ ID NO: 121471 - RNA, 64 nt, Homo Sapiens
aucaaaugauuacuaguguuaauaguagauaacuuguuuuuauuguuggugcauauuaguauaa

SEQ ID NO: 121472 - RNA, 64 nt, Homo Sapiens
gaauacaauccuuugcauuguuaaggagguuuuuuguuuuuaaauggugggucaaggagcuagu

SEQ ID NO: 121473 - RNA, 64 nt, Homo Sapiens
cgguaggccugagccucaacucuucagaaaauaguguuuuuaauauuccucuucagaaaauagu

SEQ ID NO: 121474 - RNA, 64 nt, Homo Sapiens
aauaguguuuuuaauauuccucuucagaaaauaguguuuuuaauauuccgagcuagagcucuuc

SEQ ID NO: 121475 - RNA, 64 nt, Homo Sapiens
acuaaaaaucaguuauggcacaauaaagauuuucuguuuuuaaauuguauuucaucugcuuccu

SEQ ID NO: 121476 - RNA, 64 nt, Homo Sapiens
cguuuauucugaugauaaaaacaguuagccagacuguuuuuaaagcaccuggcgggaagcagaa

SEQ ID NO: 121477 - RNA, 64 nt, Homo Sapiens
uuuguacaaaagaagauuguaaucagcagaagcauguuuuuaugaaucaugcgcuguauguuuu

SEQ ID NO: 121478 - RNA, 64 nt, Homo Sapiens
ucaacauccuuuauuauuuggugagaggaucaaauguuuuuauagguagauccuaaaaagcaug

SEQ ID NO: 121479 - RNA, 64 nt, Homo Sapiens
cuucaacucucacuuucuuacuucaagucuucucuguuuuuauuacaguggauaaaaaacaguc

SEQ ID NO: 121480 - RNA, 64 nt, Homo Sapiens
auuaaacugcaguguuuccuacugcugcauuuuuuguuuuuaaauucuccucacgaauuguuuu

SEQ ID NO: 121481 - RNA, 64 nt, Homo Sapiens
uuuguugucacagugugacaucagaccuacagauuguuuuuauacacaguggagucuuuuuauu

SEQ ID NO: 121482 - RNA, 64 nt, Homo Sapiens
aaaaguuucaagggagaagguuaaagcagaagucuguuuuuagguacauuuuccgaaacuacag

SEQ ID NO: 121483 - RNA, 64 nt, Homo Sapiens
auacagagacaagcacgucaaggugaagagagcguguuuuuaaaugagcagcuuucagcacugg

SEQ ID NO: 121484 - RNA, 64 nt, Homo Sapiens
uuuuaaaaauuucuaguagauuuuuggccuuuccuguuuuuaaaaaucaguuucauuuucauau

SEQ ID NO: 121485 - RNA, 64 nt, Homo Sapiens
cuguuaaaguuuugauguacaucgagcugaauucuguuuuuaccaguuucaaaaccuucaagug

SEQ ID NO: 121486 - RNA, 64 nt, Homo Sapiens
ccuucuuuuguagcauauaggugauguuugcucuuguuuuuauuaauuuauauguauauuuuuu

SEQ ID NO: 121487 - RNA, 64 nt, Homo Sapiens
aagaacuuacugauuauuuucuucauccaacuuauguuuuuaaaugaggauuauugauaguacu

SEQ ID NO: 121488 - RNA, 64 nt, Homo Sapiens
cagucuugaaauuuugccaccacagaaagaaagauguuuuuaaaagcuuggcccaaagaauagg

SEQ ID NO: 121489 - RNA, 64 nt, Homo Sapiens
caaucaguguuagacaacagugaggcauaucauguguuuuuauuaaaaaugauaaagauguguu

SEQ ID NO: 121490 - RNA, 64 nt, Homo Sapiens
uaucauucuuuaaaguuuacaaaaaaaaaccuuauguuuuuauguaaucagucauuacacuagg

SEQ ID NO: 121491 - RNA, 64 nt, Homo Sapiens
uucugucaguacagcguauauggaaaauucaaguuguuuuuaacauauucaaguauguucagua

SEQ ID NO: 121492 - RNA, 64 nt, Homo Sapiens
guuaauguagcauauauaaaacuucccuuugcaauguuuuuauuaugauauucucuugaguauu

SEQ ID NO: 121493 - RNA, 64 nt, Homo Sapiens
uuuuguugguagaaacaguauaucaguugacauuuguuuuuaguaauuuaaguguucauuuucc

SEQ ID NO: 121494 - RNA, 64 nt, Homo Sapiens
uuugugucuauuggggugggacuauuuuuagcaauguuuuuaaaggugaagacaugcuacaacu

SEQ ID NO: 121495 - RNA, 64 nt, Homo Sapiens
caucuuagguauaacagcacuuuugguuuuccucuguuuuuaaagaaacuuuaucaucuuucac

SEQ ID NO: 121496 - RNA, 64 nt, Homo Sapiens
guuaaauguggguaaccugugccugucauuuguuuguuuuuagggcuuguuauuucacugaagu

SEQ ID NO: 121497 - RNA, 64 nt, Homo Sapiens
auuaaacaaauaugaaauuauauuuuaaauauauuguuuuuaacaugaaauuaaugaaagagua

SEQ ID NO: 121498 - RNA, 64 nt, Homo Sapiens
uaaauuuauauugaguuuaauuagguauagcaauuguuuuuaggcuuaguacccagaacuccuu

SEQ ID NO: 121499 - RNA, 64 nt, Homo Sapiens
gccagguaauaagugugaucuggaaagaugguuguguuuuuauuguaggauauuuugaccugac

SEQ ID NO: 121500 - RNA, 64 nt, Homo Sapiens
augccauuugacauuucaaaauucuugagaaauuuguuuuuauuccaaugcucccaagcugaau

SEQ ID NO: 121501 - RNA, 64 nt, Homo Sapiens
guuuuugaaugaaggaaaugaagugaguggagaguguuuuuaauuaggaaugcacauguaaucc

SEQ ID NO: 121502 - RNA, 64 nt, Homo Sapiens
uuugcacugcucuuuccuggcuaagcuauguguauguuuuuaauggauccaucugagaugcaug

SEQ ID NO: 121503 - RNA, 64 nt, Homo Sapiens
uuaugguuacauaugaugauagauuuuaacuuauuguuuuuauuuauacuuauuucuugagaga

SEQ ID NO: 121504 - RNA, 64 nt, Homo Sapiens
uucgugugcaugaguguggaugggugccuguggguguuuuuagacaccagagaaaacacagucu

SEQ ID NO: 121505 - RNA, 64 nt, Homo Sapiens
cuggcauucagagaacccuugcaacucgagaagcuguuuuuauuucguuuuuguuuugauccag

SEQ ID NO: 121506 - RNA, 64 nt, Homo Sapiens
uuguaguuugaaaguuguacaugauaagacauuuuguuuuuacuguauguuuuuacugaaugau

SEQ ID NO: 121507 - RNA, 64 nt, Homo Sapiens
guuguacaugauaagacauuuuguuuuuacuguauguuuuuacugaaugaucuauuccccaucc

SEQ ID NO: 121508 - RNA, 64 nt, Homo Sapiens
cuacaggucuuagaacuccaagauguuccauaaguguuuuuacuugugaggaaugagaagccau

SEQ ID NO: 121509 - RNA, 64 nt, Homo Sapiens
uauuaguccaaaggaaaacaacagcaacaaaaucuguuuuuaaaaugucuuauaugaacauaua

SEQ ID NO: 121510 - RNA, 64 nt, Homo Sapiens
uucaaaggaagcauuucuagaaaaaaggagauaauguuuuuaaauuucauuaucaaacuugggc

SEQ ID NO: 121511 - RNA, 64 nt, Homo Sapiens
agaggaauggguuagcccuaauguagaaugucauuguuuuuaaaacuguuuuauaucuuaagag

SEQ ID NO: 121512 - RNA, 64 nt, Homo Sapiens
auccaguaccucugcuuuucuuuugcugugcucuuguuuuuaacuuauuuuuuuuuuaacaacu

SEQ ID NO: 121513 - RNA, 64 nt, Homo Sapiens
ggaaagaaaauaacuuugugaagccaguguauucuguuuuuaaaacugugccugcagugcaaua

SEQ ID NO: 121514 - RNA, 64 nt, Homo Sapiens
auucucaucucaacauuguggaauuuuccaugaauguuuuuaauacuaugcaaaacaucaaagu

SEQ ID NO: 121515 - RNA, 64 nt, Homo Sapiens
uuucuuuccaaaaggcagcuuaaccaucuaccucuguuuuuaauguaacuuggccacuaauaau

SEQ ID NO: 121516 - RNA, 64 nt, Homo Sapiens
guaaaaguaucuuuuucagcauuuuuuuagaauguguuuuuauuaauguaauuagacaaaaauc

SEQ ID NO: 121517 - RNA, 64 nt, Homo Sapiens
guuauucuaaauuauaguaguuuuaaaauguaucuguuuuuaaguauuuuucuuuuggaacacu

SEQ ID NO: 121518 - RNA, 64 nt, Homo Sapiens
uacaaauccagaauucuguauacuaugaagacaauguuuuuaauaugccuuuuaaaauacuguu

SEQ ID NO: 121519 - RNA, 64 nt, Homo Sapiens
gccauaguuuuauaaccaaaauaacaaucuguaguguuuuuacuuggaguugauuagauuacaa

SEQ ID NO: 121520 - RNA, 64 nt, Homo Sapiens
guuagcuaauugcugugacugcaggaagugggaguguuuuuauuaaagucuuucagcugugacu

SEQ ID NO: 121521 - RNA, 64 nt, Homo Sapiens
ugccugaaauauauuuuuuugcuaaucuggaauuuguuuuuauuuaaaugaaacgcugaacuau

SEQ ID NO: 121522 - RNA, 64 nt, Homo Sapiens
guacagcaucuguacuuugugugauauauuucuauguuuuuaauuaggaguugaugugguguga

SEQ ID NO: 121523 - RNA, 64 nt, Homo Sapiens
uguauauauauuaaaaaaaaaacaaaguuuuguauguuuuuauuacuuuaacuauuguuauaaa

SEQ ID NO: 121524 - RNA, 64 nt, Homo Sapiens
uacugcugcuggucaggacauuaaaauauugaaguguuuuuaaaaauuaaagaagaagaaaagu

SEQ ID NO: 121525 - RNA, 64 nt, Homo Sapiens
gcaagacguaaagaauuuucaucccguaucacaguguuuuuauugcucgcccagacaccaugug

SEQ ID NO: 121526 - RNA, 64 nt, Homo Sapiens
agaagaaaacaguacagaaggcaaaguuuacagauguuuuuaauucuaguauuuuaucuggaac

SEQ ID NO: 121527 - RNA, 64 nt, Homo Sapiens
ucuuccuccccucaguggcaguuuggucuucaccuguuuuuaagcuaccuuaaacgcacuuuuc

SEQ ID NO: 121528 - RNA, 64 nt, Homo Sapiens
gaaagaaaaauaauauuugauuuugaaucuuaaauguuuuuaaaaauuagacuugaaugggcac

SEQ ID NO: 121529 - RNA, 64 nt, Homo Sapiens
uuuuagggaauucauccucuaagaauuauguuuuuguuuuuaaucauauguuccaaacaggcac

SEQ ID NO: 121530 - RNA, 64 nt, Homo Sapiens
uagauguaaaaaaaauucaguuuaaaagaacauuuguuuuuacauuaaauguuuauuugaaauc

SEQ ID NO: 121531 - RNA, 64 nt, Homo Sapiens
gggaaacuggcuggaaauaguaaucacaccucucuguuuuuaguuagagucuaaugaaacucuc

SEQ ID NO: 121532 - RNA, 64 nt, Homo Sapiens
uuaggccuucagucaauuccgaagcuccuucaguuguuuuuauaaugggcguuuucacaugcac

SEQ ID NO: 121533 - RNA, 64 nt, Homo Sapiens
gguugucugaacuauuuuaaauuaaggagccagauguuuuuagucaggcuauccugacaagacu

SEQ ID NO: 121534 - RNA, 64 nt, Homo Sapiens
aagaacuuuccuaccuguaggcaauagauugcuauguuuuuaacaaauuguggcaaauucuaaa

SEQ ID NO: 121535 - RNA, 64 nt, Homo Sapiens
cauuguugcugcacuggcaauaaguauguggcacuguuuuuauuuguuuauguuauuuaaauac

SEQ ID NO: 121536 - RNA, 64 nt, Homo Sapiens
uucugaagcuuaauauuagagacccaaguaagauuguuuuuagucuugcuugaggaaugcacac

SEQ ID NO: 121537 - RNA, 64 nt, Homo Sapiens
uuuauccagaaugcuucucuuuagggaacaaggauguuuuuaauggcauaacaaaggcaagacu

SEQ ID NO: 121538 - RNA, 64 nt, Homo Sapiens
gguuuguuuuuucaagaaaauuuugcagaagcuauguuuuuaaaguguacauuuuauaaaguuu

SEQ ID NO: 121539 - RNA, 64 nt, Homo Sapiens
cauuuccaaauuccuagaaaaguuuguuuuacuuuguuuuuauucuguuaaugcauucuuucuu

SEQ ID NO: 121540 - RNA, 64 nt, Homo Sapiens
uguuuguguauugaaaacucaauauguaaucuuguguuuuuauauguauacuuguauauuccua

SEQ ID NO: 121541 - RNA, 64 nt, Homo Sapiens
agcaaaauuacaccuuuaugagaaaccauaaaauuguuuuuauuuuucaggccagacauagcuu

SEQ ID NO: 121542 - RNA, 64 nt, Homo Sapiens
aacacuuuuauagaguuaguaaguuacucgguacuguuuuuaagaguguggcccgaagcuuaaa

SEQ ID NO: 121543 - RNA, 64 nt, Homo Sapiens
cuggggguucggggagaggcuugucuuuuacuuuuguuuuuaacgaauucugauuccuuuuuug

SEQ ID NO: 121544 - RNA, 64 nt, Homo Sapiens
uuaauuuuuuccuugcaauguacuuucuuuucuguguuuuuaaguucaucaauuuuuuguuuuu

SEQ ID NO: 121545 - RNA, 64 nt, Homo Sapiens
auuuuuaugauuuuauuuuuuaguauccuaaauguguuuuuaagcuuaaucccuagguuauacg

SEQ ID NO: 121546 - RNA, 64 nt, Homo Sapiens
cagugagaagauaauaaaccacuaaaacuuuucauguuuuuagcgaagaaaaaaguccaugaaa

SEQ ID NO: 121547 - RNA, 64 nt, Homo Sapiens
ugugaaugcaagugauuaaucuucuguuaguuuuuguuuuuaagguacugaauagguuuuuuuu

SEQ ID NO: 121548 - RNA, 64 nt, Homo Sapiens
aaaagcguccagaaaggagaaaggaaaguucugcuguuuuuagcguuuugcugaaaaugacauu

SEQ ID NO: 121549 - RNA, 64 nt, Homo Sapiens
gaagccagcucaagcaauauaacauuagagaaaauguuuuuaaaugagcacaauuagccguaau

SEQ ID NO: 121550 - RNA, 64 nt, Homo Sapiens
auguagagcauuauguguggguacaaaaaugguuuguuuuuaauuacaacuguucuuauccaca

SEQ ID NO: 121551 - RNA, 64 nt, Homo Sapiens
gcauugcguuaaaaaaaaaaaucaugccacgcauuguuuuuaaaaaacagauacucuuuacacc

SEQ ID NO: 121552 - RNA, 64 nt, Homo Sapiens
aguaaauacaugcauugucauugucuguguuuauuguuuuuauggauugagagcuaguguagaa

SEQ ID NO: 121553 - RNA, 64 nt, Homo Sapiens
uugagucaauaugauuagguaaaaaaaaaccuaauguuuuuaucuuuaagagacucuuuuaaaa

SEQ ID NO: 121554 - RNA, 64 nt, Homo Sapiens
agacucuuuuaaaaaaaaaaguucaggggcucccuguuuuuaaguauuugugacaauaagaugu

SEQ ID NO: 121555 - RNA, 64 nt, Homo Sapiens
aagcagaugggaacugaauuguguuuucagguuuuguuuuuaguaggugauauucauucguauc

SEQ ID NO: 121556 - RNA, 64 nt, Homo Sapiens
uuggggaauuuuuuuuuaaggggaucuaaaaaaauguuuuuagaacauguaaaauguuuaaugg

SEQ ID NO: 121557 - RNA, 64 nt, Homo Sapiens
cuuucuuaucacuuauaguuuuuaaggcaguggcuguuuuuagauaauuaauuccaacuguacu

SEQ ID NO: 121558 - RNA, 64 nt, Homo Sapiens
uguauuuaguuauggccuauucucagcguuuuuuuguuuuuaaugcuuuaaaaaaauacaugca

SEQ ID NO: 121559 - RNA, 64 nt, Homo Sapiens
uaaguuggcccaugcaacauaauagucaaauucauguuuuuaagcuuuaaaauuacuuuuuuaa

SEQ ID NO: 121560 - RNA, 64 nt, Homo Sapiens
gugaagcuuuaaaauuacuuuuuuacaaauacuuuguuuuuaaaaaaaaaaugcuuuuuaaaau

SEQ ID NO: 121561 - RNA, 64 nt, Homo Sapiens
cacuuuuucugaaugaucuuguuuuugguguagauguuuuuauuguguggguuaguuuaaugaa

SEQ ID NO: 121562 - RNA, 64 nt, Homo Sapiens
auauuguguaauuuuaauaaauaauaacuauuguuguuuuuaugaucauuacuaccauuugugu

SEQ ID NO: 121563 - RNA, 64 nt, Homo Sapiens
ucugacuuuuuuaaaauuccuugggaugucugguuguuuuuauucagguucuaugccaucugca

SEQ ID NO: 121564 - RNA, 64 nt, Homo Sapiens
uagagguaaaauugagauggggaaugcuuuguguuguuuuuaagaaagacuucauagggucacu

SEQ ID NO: 121565 - RNA, 64 nt, Homo Sapiens
uggagaguuugguuaucaauaugcacugaauaauuguuuuuaaccugaaaguugguauuuuuua

SEQ ID NO: 121566 - RNA, 64 nt, Homo Sapiens
uuuaaauguagcaaacauacauaagucgugaggauguuuuuauaguaaguacuagggaagcuuu

SEQ ID NO: 121567 - RNA, 64 nt, Homo Sapiens
uggagaacucuauagcccuuagaacacuucauuuuguuuuuaguaaguuacauuuuauuuaguu

SEQ ID NO: 121568 - RNA, 64 nt, Homo Sapiens
uuauuuuauuuuugagagguguagguuaaauuuuuguuuuuauuaguuaaagaauauuauuucu

SEQ ID NO: 121569 - RNA, 64 nt, Homo Sapiens
auuuuuuuuuuuuuuuuuuuaauaaugaggauaauguuuuuaagugaauuucauugaacuaaau

SEQ ID NO: 121570 - RNA, 64 nt, Homo Sapiens
cuuccucaaagcauuugcaagacuggcagacaguuguuuuuauuuaguuucugcauuucaagaa

SEQ ID NO: 121571 - RNA, 64 nt, Homo Sapiens
cauuuugaucaauguuuauauaucuauuuauacauguuuuuaauuccaaucaguaugggauuua

SEQ ID NO: 121572 - RNA, 64 nt, Homo Sapiens
agagacuggguuucaccguguggguaauuuuuuguguuuuuagucaguugugugccaccacacc

SEQ ID NO: 121573 - RNA, 64 nt, Homo Sapiens
auuucacaugaaaagaaucauaagaauuaauuuuuguuuuuaauacugggaccaguuccggggu

SEQ ID NO: 121574 - RNA, 64 nt, Homo Sapiens
uccuuuuuguuggacuugaguuaauguugccacguguuuuuauggguauuuguggagccuaugu

SEQ ID NO: 121575 - RNA, 64 nt, Homo Sapiens
ugauagacaugucucaauuauauauguguguguauguuuuuaaagcuaaaaacauuacuuuuag

SEQ ID NO: 121576 - RNA, 64 nt, Homo Sapiens
ugaaagaaaauaaaauuuaugcuauucuuugcuuuguuuuuauaaaugaauuuuucauagaauu

SEQ ID NO: 121577 - RNA, 64 nt, Homo Sapiens
gugcugagauugccaaucacgguuaaacacaaaguguuuuuauagaaugaagaaacagucuuua

SEQ ID NO: 121578 - RNA, 64 nt, Homo Sapiens
auaguaauucuggaaagagcaaauaaaugaagauuguuuuuauuugccugauaaaguaauugaa

SEQ ID NO: 121579 - RNA, 64 nt, Homo Sapiens
gugacuacauugaaacuugaguuuguuucuuguguguuuuuauagaagugguguuuuuuuucca

SEQ ID NO: 121580 - RNA, 64 nt, Homo Sapiens
uauuuucuuuuuugauaauuuauuguaccaaagcuguuuuuauagcacauagaugucuguaacc

SEQ ID NO: 121581 - RNA, 64 nt, Homo Sapiens
ugcaccaaaaaucaaggacaaaaauaaguguguuuguuuuuacaggugugaaagucacagcuug

SEQ ID NO: 121582 - RNA, 64 nt, Homo Sapiens
aguccuaaaagaguaacuguaauuggauguuuauuguuuuuaucuaaaguaagguguauguguu

SEQ ID NO: 121583 - RNA, 64 nt, Homo Sapiens
uucaguuuguacaauccacauugcgaaacaggucuguuuuuauggaagccacaugggguuucag

SEQ ID NO: 121584 - RNA, 64 nt, Homo Sapiens
agaagcaaaauggcuuuucuaauauuuaagaaauuguuuuuaacggugguuuccugaaaaguug

SEQ ID NO: 121585 - RNA, 64 nt, Homo Sapiens
aaugaagaaaagggaagacauagucauuguucuguguuuuuauuuaagaacaugcuuggacacu

SEQ ID NO: 121586 - RNA, 64 nt, Homo Sapiens
uuuguuuuguugucguuuucucuguguuucuguuuguuuuuagguguuaagucuuuguucuuuu

SEQ ID NO: 121587 - RNA, 64 nt, Homo Sapiens
aauuccuuuuagagacagucguuacaaugucagguguuuuuaaauucuggaggagaaaaaauga

SEQ ID NO: 121588 - RNA, 64 nt, Homo Sapiens
acucaaaguaagcaauggagaguaacauaaaacauguuuuuaucuuuaugugggagaaggaagg

SEQ ID NO: 121589 - RNA, 64 nt, Homo Sapiens
ccugaugggccaggaagggcguggacauggaggcuguuuuuacaguuuuuuuuuuguuguuguu

SEQ ID NO: 121590 - RNA, 64 nt, Homo Sapiens
ggcuguuuuuacaguuuuuuuuuuguuguuguuuuguuuuuaaagaauacagaaggagccaagc

SEQ ID NO: 121591 - RNA, 64 nt, Homo Sapiens
auaaucucgggcauuguuugguggcuugcuaguauguuuuuauguucaccccucucugguacuu

SEQ ID NO: 121592 - RNA, 64 nt, Homo Sapiens
caaucguuuuugagcagauacggccccaaucaucuguuuuuaaacaggcaugagccaccgcgcc

SEQ ID NO: 121593 - RNA, 64 nt, Homo Sapiens
cuaacaaaauguuuccccuuguacaauuaugcuguguuuuuaaaaaacauugaccuguguguuu

SEQ ID NO: 121594 - RNA, 64 nt, Homo Sapiens
auuaugcuguguuuuuaaaaaacauugaccuguguguuuuuauaaaagaaaaaguauguugugc

SEQ ID NO: 121595 - RNA, 64 nt, Homo Sapiens
gugaaaacauaagccauggugaacugauaauuuuuguuuuuaaauuauuuauauuacugaauug

SEQ ID NO: 121596 - RNA, 64 nt, Homo Sapiens
aaauuaaauaauagaugugaaaaugcuuugaaaauguuuuuaagugcuaugcauauuuauagag

SEQ ID NO: 121597 - RNA, 64 nt, Homo Sapiens
auaaauuguuccaugcugguggaaagauagagauuguuuuuagagguugguuguuguguuuuag

SEQ ID NO: 121598 - RNA, 64 nt, Homo Sapiens
acuauguauagucugagccagaucaaaguauguauguuuuuaauaugcauagaacaaaagauuu

SEQ ID NO: 121599 - RNA, 64 nt, Homo Sapiens
ucuuacagugguaaucacauucuuuuuauccuucuguuuuuaguuuauccuuccuuuaacuuaa

SEQ ID NO: 121600 - RNA, 57 nt, Homo Sapiens
ccaggaaggcugacagaugaacacuauuguuuuuaaaccccuggugggcguccauag

SEQ ID NO: 121601 - RNA, 64 nt, Homo Sapiens
uuugcacucaaaucuuaagagcuuuguuuguucuuguuuuuaagguguuuauucuugaugaaaa

SEQ ID NO: 121602 - RNA, 64 nt, Homo Sapiens
aauuagccuaagauauacuuuagagcagaaauucuguuuuuaaaucccuuuagcuguguuauua

SEQ ID NO: 121603 - RNA, 64 nt, Homo Sapiens
guuaacuagugucaucuauuuagagaaacauuuuuguuuuuaauugcucaaagcugucgccgcu

SEQ ID NO: 121604 - RNA, 64 nt, Homo Sapiens
gaaaaacauuuggcauuccugaauaauuuccaaauguuuuuaauccaaagaaaaagguuuaaag

SEQ ID NO: 121605 - RNA, 64 nt, Homo Sapiens
gccaggugcucagugacuggccaucacauuaaugaaugacgagauuggaguacacugucaccaa

SEQ ID NO: 121606 - RNA, 64 nt, Homo Sapiens
acucucuccaaaaacaaaccagaaacagaaaagaaaugacgacccaagaccccccuacaagcau

SEQ ID NO: 121607 - RNA, 64 nt, Homo Sapiens
auacuucuuuuccacaucucucagcaauaauaauaaugacgauaaaaugauaucuaaguaguuc

SEQ ID NO: 121608 - RNA, 64 nt, Homo Sapiens
guauugcuuuuauaaauguacaaauaguuacugaaaugacgagacccuuguuugcacagcauua

SEQ ID NO: 121609 - RNA, 64 nt, Homo Sapiens
aguccaauguaucucauuauuucuaaaucuuguuaaugacgaagaagagaaauuucccagccua

SEQ ID NO: 121610 - RNA, 64 nt, Homo Sapiens
ucacuauacuuagugaauauagcucccuggguggaaugacgacuaacaguuuaguuucaaaccu

SEQ ID NO: 121611 - RNA, 64 nt, Homo Sapiens
ucacugugucccccaggcuggagugcaguggcacaaugacgacucacugcagccucaaccuccu

SEQ ID NO: 121612 - RNA, 64 nt, Homo Sapiens
uaaugggugcagccaaccaaaaauaccuaauguaaaugacgagugagagggauaguguuaggag

SEQ ID NO: 121613 - RNA, 64 nt, Homo Sapiens
auuccauuuaggauguguauuuaaugcauuuaguaaugacgauaaaguguuuuuaguaugcuuu

SEQ ID NO: 121614 - RNA, 64 nt, Homo Sapiens
gcaguuuuauuuuuggagauaggcuucacauugcaaugacgauuccuccucaggcuuaaaucuc

SEQ ID NO: 121615 - RNA, 64 nt, Homo Sapiens
auuuuucuacucaaugugaaguuguuuguauucaaaugacgauuaagacgugucgcacuuuuca

SEQ ID NO: 121616 - RNA, 64 nt, Homo Sapiens
gcaauauuaagaagacauuguuuccucagucuucaaugacgagauuauaaagucacuuuuuauu

SEQ ID NO: 121617 - RNA, 64 nt, Homo Sapiens
uacuggaugcagcacgccaauauaccuaauguuaaaugacgaguggaaggauagcauuuggaga

SEQ ID NO: 121618 - RNA, 64 nt, Homo Sapiens
cuacacaguacuggagaacuuucacuggaucagcaaugacgagccaagcuggaggacguagaau

SEQ ID NO: 121619 - RNA, 64 nt, Homo Sapiens
ccuagcucuaagagcaauucagcaacaacaugcuaaugacgacaauguucuuguuuguaucauu

SEQ ID NO: 121620 - RNA, 64 nt, Homo Sapiens
cccuucccauuaaagagagucuauugcuguaagaaaugacgaucacccguauuuauguuuuuac

SEQ ID NO: 121621 - RNA, 64 nt, Homo Sapiens
guauagcuuuuaaguuauuugacaagauauuuauaaugacgacucacuagaguuaguuuuaaaa

SEQ ID NO: 121622 - RNA, 64 nt, Homo Sapiens
caugaguguuagcuuuuuggaaggaaaaccuuauaaugacgauuaaagacuuuuuuuuuaagga

SEQ ID NO: 121623 - RNA, 64 nt, Homo Sapiens
caaaugccaaugaccagauguuuugucuuuacagaaugacgauaagcuucuuauauagguacuc

SEQ ID NO: 121624 - RNA, 64 nt, Homo Sapiens
cuguguaagauuuuuguaaguauauuuguauuuaaaugacgaccgaucacgcguuuuucuuuuu

SEQ ID NO: 121625 - RNA, 64 nt, Homo Sapiens
ucucuuuucagauccgaauucagaggccucagguaaugacgacaucauuuuaaggcauggagcu

SEQ ID NO: 121626 - RNA, 51 nt, Homo Sapiens
agggcucaguggaggucugagaaugacgauacccgugacucagcccuggac

SEQ ID NO: 121627 - RNA, 64 nt, Homo Sapiens
ccuucaaaaugcugcuuccauuagcuggucuaagaaugacgaugauagagaaugcccucagcuc

SEQ ID NO: 121628 - RNA, 64 nt, Homo Sapiens
aaucuauaggaaagcucaagucugcuuagcagaaaaugacgauuugcgcauaauaaugacauaa

SEQ ID NO: 121629 - RNA, 64 nt, Homo Sapiens
gugcuucaguuuguuuagcauuaccuuuuaauguaaugacgaguugucucucagaauuguuuuc

SEQ ID NO: 121630 - RNA, 64 nt, Homo Sapiens
ccugccuuggugcugcuuccgccugcauaugcagaaugacgauggagcucugcugccagucaag

SEQ ID NO: 121631 - RNA, 64 nt, Homo Sapiens
aacuuuaauguuuuaaaccucuuuuauaaaauucaaugacgacuacuagaauucuuuucaaaag

SEQ ID NO: 121632 - RNA, 64 nt, Homo Sapiens
gaacucuggcuuuuggaagcgagaguaaaaagcuaaugacgaggaaccgaaaaaucgcgagugu

SEQ ID NO: 121633 - RNA, 64 nt, Homo Sapiens
aaaaaauuacgaaagaaaagaaaucucuaugcaaaaugacgaacaugguccuguggacuccucu

SEQ ID NO: 121634 - RNA, 64 nt, Homo Sapiens
ccgugugucucgucuccugaaagucuacuucacuaaugacgauguuuuaucuguagcagaaacc

SEQ ID NO: 121635 - RNA, 64 nt, Homo Sapiens
cuccuggggcuuuagggggcaggaaggugggacgaaugacgaugcccauccacuaccugaagca

SEQ ID NO: 121636 - RNA, 64 nt, Homo Sapiens
ggaugaacugcacauuguugaagcagaggccaugaaugacgaaggcaguccaauuaaaguaaca

SEQ ID NO: 121637 - RNA, 64 nt, Homo Sapiens
cauauuguauuagcuucccagggcuuccauaacaaaugacgacaaacuugggugcuuacaacaa

SEQ ID NO: 121638 - RNA, 64 nt, Homo Sapiens
uaaugggugcagcacaccaagauauacuaacguaaaugacgaguggggagggauagcauuagga

SEQ ID NO: 121639 - RNA, 64 nt, Homo Sapiens
ugcagagaacucagcaccaaguggaauccuuucaaaugacgagcugcaguuuguuugaaguuaa

SEQ ID NO: 121640 - RNA, 64 nt, Homo Sapiens
cugaacugaacugagugugucagaagugcugguuaaugacgagaagagauugccugaaaaacaa

SEQ ID NO: 121641 - RNA, 64 nt, Homo Sapiens
cugcucagcaacuccaccugggcaucucucuccuaaugacgaaguucugauuuuuaagguagug

SEQ ID NO: 121642 - RNA, 64 nt, Homo Sapiens
ugauugggaguagagucucaugucuuuaugugggaaugacgacucuguguuaugugugaacagu

SEQ ID NO: 121643 - RNA, 64 nt, Homo Sapiens
ccucauggaguuccggcgggacgcauccauguuaaaugacgagcugucccacaucaacgcgcgg

SEQ ID NO: 121644 - RNA, 64 nt, Homo Sapiens
aaacugagagggaaggugucguuuuuacacugcuaaugacgagaguggcucuuuuuagcuaggc

SEQ ID NO: 121645 - RNA, 64 nt, Homo Sapiens
gcuuuaaaauauguauucaaauguuauuaaccacaaugacgaccugcuuugauuuaaccaagaa

SEQ ID NO: 121646 - RNA, 64 nt, Homo Sapiens
aggguauauauauuuucuuaacgcugacauacagaaugacgaaagcacgaugauaccagagucc

SEQ ID NO: 121647 - RNA, 64 nt, Homo Sapiens; identical to SEQ ID NO: 121646

SEQ ID NO: 121648 - RNA, 64 nt, Homo Sapiens
gcucuugagccaaacacuguguuucguuuggcucaaugacgaauguugaagaugcuuuuauguu

SEQ ID NO: 121649 - RNA, 64 nt, Homo Sapiens
ugaaguagugcaaacauagcgucacccaggcuggaaugacgaagaugggacagggucucacucu

SEQ ID NO: 121650 - RNA, 64 nt, Homo Sapiens
ugaggcagggaauagaccuccagauguggugaacaaugacgaauucagccaaguggcgguagca

SEQ ID NO: 121651 - RNA, 64 nt, Homo Sapiens
cgcugcacccugcugucccucuccaggccuuggcaaugacgaucccccaaagagcccgucugca

SEQ ID NO: 121652 - RNA, 64 nt, Homo Sapiens
ccuaaugcuaucccuccccccucccccuaauguaaaugacgaguuaauggugcagcacaccaac

SEQ ID NO: 121653 - RNA, 64 nt, Homo Sapiens
aaaaaggccacguaugugccuugaauguagccaaaaugacgaacaacacccagaaaucugugau

SEQ ID NO: 121654 - RNA, 64 nt, Homo Sapiens
auguauucaggaaguuaaaaauuaauuacacuauaaugacgauacuacacauugggauuggaau

SEQ ID NO: 121655 - RNA, 64 nt, Homo Sapiens
ucuccaaggcaagcccagcuggugugacuuagacaaugacgaggcuucaacucacugucuuuuu

SEQ ID NO: 121656 - RNA, 64 nt, Homo Sapiens
ggggccaguagacccccggagaagcaguaccgacaaugacgaagauaccagaucccuucccaac

SEQ ID NO: 121657 - RNA, 64 nt, Homo Sapiens
aaguaaggaucugcaaaucuugaaucguccucaaaaugacgaagcuugaauuguccucaagaug

SEQ ID NO: 121658 - RNA, 64 nt, Homo Sapiens
uucacccaggaggucacagaaugacagcaagggaaaugacgaccaagagaagaagcuuaaaguc

SEQ ID NO: 121659 - RNA, 64 nt, Homo Sapiens
cugucucuuuggaugaugccucuacaucagccugaaugacgaggucuccgggagucccucagcu

SEQ ID NO: 121660 - RNA, 64 nt, Homo Sapiens
acuuaauggguguacuuuuuugggcuugccagguaaugacgaaacuucuaaaaauuauacccca

SEQ ID NO: 121661 - RNA, 64 nt, Homo Sapiens; identical to SEQ ID NO: 88782

SEQ ID NO: 121662 - RNA, 64 nt, Homo Sapiens; identical to SEQ ID NO: 88783

SEQ ID NO: 121663 - RNA, 64 nt, Homo Sapiens; identical to SEQ ID NO: 88784

SEQ ID NO: 121664 - RNA, 64 nt, Homo Sapiens; identical to SEQ ID NO: 88785

SEQ ID NO: 121665 - RNA, 64 nt, Homo Sapiens; identical to SEQ ID NO: 88786

SEQ ID NO: 121666 - RNA, 64 nt, Homo Sapiens; identical to SEQ ID NO: 88787

SEQ ID NO: 121667 - RNA, 64 nt, Homo Sapiens; identical to SEQ ID NO: 88788

SEQ ID NO: 121668 - RNA, 64 nt, Homo Sapiens; identical to SEQ ID NO: 88789

SEQ ID NO: 121669 - RNA, 64 nt, Homo Sapiens; identical to SEQ ID NO: 88790

SEQ ID NO: 121670 - RNA, 64 nt, Homo Sapiens; identical to SEQ ID NO: 88791

SEQ ID NO: 121671 - RNA, 62 nt, Homo Sapiens
caccagacuuuuucuucuaaaaucuggaugucauugacgauaauguuuauggagauaagguc

SEQ ID NO: 121672 - RNA, 64 nt, Homo Sapiens
agugcugaacaguggaggaauuagcagcuuccagauugacgacaugccagugacagacaggcuc

SEQ ID NO: 121673 - RNA, 64 nt, Homo Sapiens
ggugucuugggcagagcugggcuuccuccuggaaauugacgagguggcgccgucuccaggggcu

SEQ ID NO: 121674 - RNA, 64 nt, Homo Sapiens
gcuuguguuguuuagcaucuaaagguauuuaagaauugacgagacucuuuacuguaaugacuca

SEQ ID NO: 121675 - RNA, 64 nt, Homo Sapiens
gcuuuuagagacugcuccuaaaacacaucacuagauugacgaggagucccccaauuccagagag

SEQ ID NO: 121676 - RNA, 64 nt, Homo Sapiens
uacugaauucugacaaaauaaaaaaagauaccuuauugacgaaauauuuaggauaaacaaaauu

SEQ ID NO: 121677 - RNA, 64 nt, Homo Sapiens
uauguauuauaauuuuuuagcgcuaucacaaaacauugacgaugaauuaaaucuucuggagggu

SEQ ID NO: 121678 - RNA, 64 nt, Homo Sapiens
ggguugaguggaguuaugugucgcuuuuauucggauugacgaaaaucaaccauaauuuucaagg

SEQ ID NO: 121679 - RNA, 64 nt, Homo Sapiens
auguguagcgcaugauuguuguuuggugaugguuauugacgacaacggaguucagugccugggu

SEQ ID NO: 121680 - RNA, 64 nt, Homo Sapiens
uggcuacaguaccaugccucaagaaaaaugcauuauugacgaacccaacuagacauucuacaga

SEQ ID NO: 121681 - RNA, 64 nt, Homo Sapiens
cacuuacugguuuaauuugccuuuccaaagcuacauugacgagauuucacuaucccuucugcag

SEQ ID NO: 121682 - RNA, 64 nt, Homo Sapiens
gcuugcuuagcaucagcucuuggcaugagggggaauugacgaguugaugcucaugucuguguca

SEQ ID NO: 121683 - RNA, 64 nt, Homo Sapiens
ccaaagauagcagaagaguagauaagugcucaguauugacgaccuacaucugaaaucuacaaca

SEQ ID NO: 121684 - RNA, 64 nt, Homo Sapiens
ggcauugacaugugcugcuaguuuauaaacuggcauugacgaaaaucauuugaaucucuucugg

SEQ ID NO: 121685 - RNA, 64 nt, Homo Sapiens
cuacuacaaugcccuccauucuucagggcugagaauugacgagaagccagcucacccaucccag

SEQ ID NO: 121686 - RNA, 64 nt, Homo Sapiens
auaggucuauagcauacuaauauccaccugauuuauugacgaaguagacauuaggcaaagccaa

SEQ ID NO: 121687 - RNA, 64 nt, Homo Sapiens
uguucaacuccaccagaaauuaccucgagucagcauugacgauauuggaggagcugccgugcug

SEQ ID NO: 121688 - RNA, 64 nt, Homo Sapiens
ccauggagauuuugaaaaguucucuguggugcguauugacgaccacugggaaggccaaguacag

SEQ ID NO: 121689 - RNA, 64 nt, Homo Sapiens
acucagguggaggcuugagaccagggagacuggcauugacgagaugauaauguccccaaucaua

SEQ ID NO: 121690 - RNA, 64 nt, Homo Sapiens
uccuccccucacaaaacuguaauuuuucuucuuuauugacgaauucuuuaauuuggaauucagu

SEQ ID NO: 121691 - RNA, 64 nt, Homo Sapiens
uguuuguuccagugauacugaacgauuguuagaaauugacgaugcucagcuuaccuuuuugaga

SEQ ID NO: 121692 - RNA, 64 nt, Homo Sapiens
acauccuuugcagggcagccccacaacuuuaaacauugacgauuccuucucugaacacaggcag

SEQ ID NO: 121693 - RNA, 64 nt, Homo Sapiens
ugcaugacuuccgccgagggugcuggacgggaagauugacgaccguugaagagcuuccuggagg

SEQ ID NO: 121694 - RNA, 64 nt, Homo Sapiens
acucugcucccauccccaggauagaagcggcuacauugacgagcaugagcuggaugcccuuuug

SEQ ID NO: 121695 - RNA, 64 nt, Homo Sapiens
ucuacauuucagugcuuuuuaaugccugaggcugauugacgacaguggauggcacaggaucaau

SEQ ID NO: 121696 - RNA, 64 nt, Homo Sapiens
uuuguuuugugaaagcuucugauuaauuuauuauauugacgauaaaacucaaaccuacccagcc

SEQ ID NO: 121697 - RNA, 64 nt, Homo Sapiens
agggaaggucuuuuauuggauuuuggagauggaaauugacgaggauaaguuaccaaaguugcca

SEQ ID NO: 121698 - RNA, 64 nt, Homo Sapiens
cuagagacaggcaaacugcaaaccauggugagaaauugacgacuucacacuauggacagcuuuu

SEQ ID NO: 121699 - RNA, 64 nt, Homo Sapiens
gcauugagcguagcuagcuuuguauccacucaccauugacgaugcaggagccacauggauugau

SEQ ID NO: 121700 - RNA, 64 nt, Homo Sapiens
gucauucagccuguguaaccauguggaaauaaaaauugacgaccaauguauuauauggacaacu

SEQ ID NO: 121701 - RNA, 64 nt, Homo Sapiens
uaggguuucuaaaauaagguuuuuuauuguaaaaauugacgauugcccugcauuucuaccaagu

SEQ ID NO: 121702 - RNA, 64 nt, Homo Sapiens
ucugaucaaugacuacacccacaacaucccgcucauugacgacacggacguggacgagaacgag

SEQ ID NO: 121703 - RNA, 64 nt, Homo Sapiens
cugaaaacuguugcuuuuucuuuuucccucccccauugacgacauagcggcccccgcguccggg

SEQ ID NO: 121704 - RNA, 64 nt, Homo Sapiens; identical to SEQ ID NO: 88782

SEQ ID NO: 121705 - RNA, 64 nt, Homo Sapiens; identical to SEQ ID NO: 88783

SEQ ID NO: 121706 - RNA, 64 nt, Homo Sapiens; identical to SEQ ID NO: 88784

SEQ ID NO: 121707 - RNA, 64 nt, Homo Sapiens; identical to SEQ ID NO: 88785

SEQ ID NO: 121708 - RNA, 64 nt, Homo Sapiens; identical to SEQ ID NO: 88786

SEQ ID NO: 121709 - RNA, 64 nt, Homo Sapiens; identical to SEQ ID NO: 88787

SEQ ID NO: 121710 - RNA, 64 nt, Homo Sapiens; identical to SEQ ID NO: 88788

SEQ ID NO: 121711 - RNA, 64 nt, Homo Sapiens; identical to SEQ ID NO: 88789

SEQ ID NO: 121712 - RNA, 64 nt, Homo Sapiens; identical to SEQ ID NO: 88790

SEQ ID NO: 121713 - RNA, 64 nt, Homo Sapiens; identical to SEQ ID NO: 88791

SEQ ID NO: 121714 - RNA, 64 nt, Homo Sapiens; identical to SEQ ID NO: 83612

SEQ ID NO: 121715 - RNA, 64 nt, Homo Sapiens; identical to SEQ ID NO: 83613

SEQ ID NO: 121716 - RNA, 64 nt, Homo Sapiens; identical to SEQ ID NO: 83614

SEQ ID NO: 121717 - RNA, 64 nt, Homo Sapiens; identical to SEQ ID NO: 83615

SEQ ID NO: 121718 - RNA, 64 nt, Homo Sapiens; identical to SEQ ID NO: 83616

SEQ ID NO: 121719 - RNA, 64 nt, Homo Sapiens; identical to SEQ ID NO: 83617

SEQ ID NO: 121720 - RNA, 64 nt, Homo Sapiens; identical to SEQ ID NO: 83618

SEQ ID NO: 121721 - RNA, 64 nt, Homo Sapiens; identical to SEQ ID NO: 83619

SEQ ID NO: 121722 - RNA, 64 nt, Homo Sapiens; identical to SEQ ID NO: 83620

SEQ ID NO: 121723 - RNA, 64 nt, Homo Sapiens; identical to SEQ ID NO: 83621

SEQ ID NO: 121724 - RNA, 64 nt, Homo Sapiens; identical to SEQ ID NO: 83622

SEQ ID NO: 121725 - RNA, 64 nt, Homo Sapiens; identical to SEQ ID NO: 83623

SEQ ID NO: 121726 - RNA, 64 nt, Homo Sapiens; identical to SEQ ID NO: 83624

SEQ ID NO: 121727 - RNA, 64 nt, Homo Sapiens; identical to SEQ ID NO: 83625

SEQ ID NO: 121728 - RNA, 64 nt, Homo Sapiens; identical to SEQ ID NO: 83626

SEQ ID NO: 121729 - RNA, 64 nt, Homo Sapiens; identical to SEQ ID NO: 83627

SEQ ID NO: 121730 - RNA, 64 nt, Homo Sapiens; identical to SEQ ID NO: 83628

SEQ ID NO: 121731 - RNA, 64 nt, Homo Sapiens; identical to SEQ ID NO: 83629

SEQ ID NO: 121732 - RNA, 64 nt, Homo Sapiens; identical to SEQ ID NO: 83630

SEQ ID NO: 121733 - RNA, 64 nt, Homo Sapiens; identical to SEQ ID NO: 83631

SEQ ID NO: 121734 - RNA, 64 nt, Homo Sapiens; identical to SEQ ID NO: 83632

SEQ ID NO: 121735 - RNA, 60 nt, Homo Sapiens; identical to SEQ ID NO: 83633

SEQ ID NO: 121736 - RNA, 64 nt, Homo Sapiens; identical to SEQ ID NO: 83634

SEQ ID NO: 121737 - RNA, 64 nt, Homo Sapiens; identical to SEQ ID NO: 83635

SEQ ID NO: 121738 - RNA, 64 nt, Homo Sapiens; identical to SEQ ID NO: 83636

SEQ ID NO: 121739 - RNA, 64 nt, Homo Sapiens; identical to SEQ ID NO: 83637

SEQ ID NO: 121740 - RNA, 64 nt, Homo Sapiens; identical to SEQ ID NO: 83638

SEQ ID NO: 121741 - RNA, 64 nt, Homo Sapiens; identical to SEQ ID NO: 83639

SEQ ID NO: 121742 - RNA, 64 nt, Homo Sapiens; identical to SEQ ID NO: 83640

SEQ ID NO: 121743 - RNA, 64 nt, Homo Sapiens; identical to SEQ ID NO: 83641

SEQ ID NO: 121744 - RNA, 64 nt, Homo Sapiens; identical to SEQ ID NO: 83642

SEQ ID NO: 121745 - RNA, 64 nt, Homo Sapiens; identical to SEQ ID NO: 83643

SEQ ID NO: 121746 - RNA, 64 nt, Homo Sapiens; identical to SEQ ID NO: 83644

SEQ ID NO: 121747 - RNA, 64 nt, Homo Sapiens; identical to SEQ ID NO: 83645

SEQ ID NO: 121748 - RNA, 64 nt, Homo Sapiens; identical to SEQ ID NO: 83646

SEQ ID NO: 121749 - RNA, 64 nt, Homo Sapiens; identical to SEQ ID NO: 83647

SEQ ID NO: 121750 - RNA, 64 nt, Homo Sapiens; identical to SEQ ID NO: 83648

SEQ ID NO: 121751 - RNA, 64 nt, Homo Sapiens; identical to SEQ ID NO: 83649

SEQ ID NO: 121752 - RNA, 64 nt, Homo Sapiens; identical to SEQ ID NO: 83650

SEQ ID NO: 121753 - RNA, 54 nt, Homo Sapiens; identical to SEQ ID NO: 83651

SEQ ID NO: 121754 - RNA, 64 nt, Homo Sapiens; identical to SEQ ID NO: 83652

SEQ ID NO: 121755 - RNA, 64 nt, Homo Sapiens; identical to SEQ ID NO: 83653

SEQ ID NO: 121756 - RNA, 64 nt, Homo Sapiens; identical to SEQ ID NO: 83654

SEQ ID NO: 121757 - RNA, 64 nt, Homo Sapiens; identical to SEQ ID NO: 83655

SEQ ID NO: 121758 - RNA, 64 nt, Homo Sapiens; identical to SEQ ID NO: 83656

SEQ ID NO: 121759 - RNA, 64 nt, Homo Sapiens; identical to SEQ ID NO: 83657

SEQ ID NO: 121760 - RNA, 59 nt, Homo Sapiens; identical to SEQ ID NO: 83658

SEQ ID NO: 121761 - RNA, 64 nt, Homo Sapiens; identical to SEQ ID NO: 83659

SEQ ID NO: 121762 - RNA, 64 nt, Homo Sapiens; identical to SEQ ID NO: 83660

SEQ ID NO: 121763 - RNA, 64 nt, Homo Sapiens; identical to SEQ ID NO: 83661

SEQ ID NO: 121764 - RNA, 64 nt, Homo Sapiens; identical to SEQ ID NO: 83662

SEQ ID NO: 121765 - RNA, 64 nt, Homo Sapiens; identical to SEQ ID NO: 83663

SEQ ID NO: 121766 - RNA, 64 nt, Homo Sapiens; identical to SEQ ID NO: 83664

SEQ ID NO: 121767 - RNA, 64 nt, Homo Sapiens; identical to SEQ ID NO: 83665

SEQ ID NO: 121768 - RNA, 64 nt, Homo Sapiens; identical to SEQ ID NO: 83666

SEQ ID NO: 121769 - RNA, 64 nt, Homo Sapiens; identical to SEQ ID NO: 83667

SEQ ID NO: 121770 - RNA, 64 nt, Homo Sapiens; identical to SEQ ID NO: 83668

SEQ ID NO: 121771 - RNA, 64 nt, Homo Sapiens
gcuacuguucuuuauugugaaguuuauuucuacugugcuuuauuuuucuuuugagaguaccccc

SEQ ID NO: 121772 - RNA, 64 nt, Homo Sapiens
gugcacucuccuguaaggucuaauuuaaacacuagugcuuuaguccuuuuuucauuauggaaaa

SEQ ID NO: 121773 - RNA, 64 nt, Homo Sapiens
uuuuaacauuaagugccuuuggggugacucuacugugcuuuaucgaacacauaggaaugucugu

SEQ ID NO: 121774 - RNA, 64 nt, Homo Sapiens
guguggugcaucuuuggagacugggucagugcaugugcuuuaugugugagaccaaauugcugac

SEQ ID NO: 121775 - RNA, 64 nt, Homo Sapiens
auauuuggcuucaaaggaguaccuuuacuuacaugugcuuuaugguaaguacauugaauuuuac

SEQ ID NO: 121776 - RNA, 64 nt, Homo Sapiens
uuguaaugcauauccaucuuggauucaauccaaggugcuuuagcuaucaguaguaccaaaggau

SEQ ID NO: 121777 - RNA, 64 nt, Homo Sapiens
caccuauucaauaacugaaaaagacauuaccauagugcuuuacauuuuuaaaguaauguuacaa

SEQ ID NO: 121778 - RNA, 64 nt, Homo Sapiens
uuuaggugaucaggaugccguugguggcauuuacgugcuuuauaugauuuuuaccucuguaaca

SEQ ID NO: 121779 - RNA, 64 nt, Homo Sapiens
caaauagcaauacuuauagaauggauuuaugugagugcuuuaaaauguuuccuuuuugggugaa

SEQ ID NO: 121780 - RNA, 64 nt, Homo Sapiens
ucauguccuugaauauaguucugguuuucaagcagugcuuuauccaccuaacuguucagucauu

SEQ ID NO: 121781 - RNA, 64 nt, Homo Sapiens
ugagaugacuaaauuaugccagauaaagugaaaagugcuuuaggcuguaacccuugguugccag

SEQ ID NO: 121782 - RNA, 64 nt, Homo Sapiens
gggcuuugguuuucuuuuugcuuuuuuuccccaugugcuuuaguggaggaagauguuuuguaau

SEQ ID NO: 121783 - RNA, 64 nt, Homo Sapiens
uuauaccuauagcuuuggucuuacaaaagacaaugugcuuuaugauucagguggauaaauaguc

SEQ ID NO: 121784 - RNA, 64 nt, Homo Sapiens
uuauagguagugguuauuagaccggaacaauugugugcuuuauuaaaaaaagauuuguaaaauc

SEQ ID NO: 121785 - RNA, 64 nt, Homo Sapiens
caugcacaggaagauauugguggccggugguuuugugcuuuaaaaaugcaauaucugaccaaga

SEQ ID NO: 121786 - RNA, 64 nt, Homo Sapiens
uuaaaagggaaguuauuuauauuuuguguauaaugugcuuuauuugcaaaucacccacuccuuu

SEQ ID NO: 121787 - RNA, 64 nt, Homo Sapiens
gauaguuguuaaaguuacaauaacuuuaacuuuugugcuuuaggucugauggcaguuccucaaa

SEQ ID NO: 121788 - RNA, 64 nt, Homo Sapiens
uaguacaugugacucaccagaacucucagaucuugugcuuuaguuccccaacaugguuaauucc

SEQ ID NO: 121789 - RNA, 64 nt, Homo Sapiens
cuuucugauauggcaguuacacuuuuucacuuaagugcuuuaguuuagacuaacuuuacaacuu

SEQ ID NO: 121790 - RNA, 64 nt, Homo Sapiens
gaggacagguuucuguuaagaucaccaaguagcugugcuuuaauuagagccagacaagcuuuca

SEQ ID NO: 121791 - RNA, 63 nt, Homo Sapiens
aaucacccucgcuccgucaggcgggacucgugucccagagaggaaggggcugcugaggucuga

SEQ ID NO: 121792 - RNA, 63 nt, Homo Sapiens
cucccaguuuugcucugcccagcaguguuggugcccagagaugacaagggccagggagccugg

SEQ ID NO: 121793 - RNA, 63 nt, Homo Sapiens
uccagacacuucacggaaggaagaucacauguccccagagaggcacccccaggcaagcucgag

SEQ ID NO: 121794 - RNA, 63 nt, Homo Sapiens
gagggccucgccuggcugcagccugcgccaccgcccagagacccaagcugccuccccucuccu

SEQ ID NO: 121795 - RNA, 63 nt, Homo Sapiens
ggcucuccagaaccuucuaucccacagucaggccccagagagggcaggacaagccuugucccg

SEQ ID NO: 121796 - RNA, 63 nt, Homo Sapiens
aagucaccagauauuuuguucccaucaguuuagcccagagauagacaguagaaugcaaauacc

SEQ ID NO: 121797 - RNA, 63 nt, Homo Sapiens
accugcagguguaagggacgauuggaguuucuucccagagagucugucccagaaggacugugg

SEQ ID NO: 121798 - RNA, 63 nt, Homo Sapiens
agcccucagcagcugcagaccgccccucaccaacccagagaaccugcuuuacuuugcccaggg

SEQ ID NO: 121799 - RNA, 63 nt, Homo Sapiens
aggggucagaggcccaggcccugacuucggcuucccagagaucucuccgccuuaguuaagagc

SEQ ID NO: 121800 - RNA, 63 nt, Homo Sapiens
uccugucuguauuugaugcaggauuaaacacuucccagagaggauucuagucugguaaauaac

SEQ ID NO: 121801 - RNA, 63 nt, Homo Sapiens
gccaguggauccccugcggucaggcugggcagccccagagagaggauguggaaagcacuuuuu

SEQ ID NO: 121802 - RNA, 63 nt, Homo Sapiens
gcgugucgguguauauaggaaccauguacagagcccagagaagcccccuacauccccccggga

SEQ ID NO: 121803 - RNA, 63 nt, Homo Sapiens
ugacugcagaagaccaagaaccuguuccccaagcccagagauguccaccugggcuggacugcc

SEQ ID NO: 121804 - RNA, 63 nt, Homo Sapiens
guguucucaggaagacugccuccaccaccgcuacccagagaaccucugcaucuggcauuucug

SEQ ID NO: 121805 - RNA, 63 nt, Homo Sapiens
gcagccagcaccaccuacacaggagucuucagacccagagaaggacggugccaagggccccag

SEQ ID NO: 121806 - RNA, 63 nt, Homo Sapiens
uugguuugacacccagccucuucccuggcccuccccagagaacuuuggguaccuggugggucu

SEQ ID NO: 121807 - RNA, 63 nt, Homo Sapiens
aaccugcacacuugacaaguggagaaacagaagcccagagagagcacuggguuuguucaggac

SEQ ID NO: 121808 - RNA, 63 nt, Homo Sapiens
uauucggauauucuguuuacacacccaugucaucccagagaggugaucacagggcagggacac

SEQ ID NO: 121809 - RNA, 63 nt, Homo Sapiens
ucccugacuccuggugcccucucccuuuguccccccagagagacauaugcccccagagagagc

SEQ ID NO: 121810 - RNA, 63 nt, Homo Sapiens
cucucccuuuguccccccagagagacauaugcccccagagagagcaaaucgaagcgugggagg

SEQ ID NO: 121811 - RNA, 63 nt, Homo Sapiens
augauuaggauuagugcccuuauuuaaaaaggccccagagagcuaacucacccuuccaccaua

SEQ ID NO: 121812 - RNA, 63 nt, Homo Sapiens
ccccaccucucacuuugcugugagcccgggaaccccagagaccacuccuguggagagcugagg

SEQ ID NO: 121813 - RNA, 63 nt, Homo Sapiens
gugagggccaggcccuucccggcugcgaggacgcccagagaccgcgggcgcugagcgcguugg

SEQ ID NO: 121814 - RNA, 63 nt, Homo Sapiens
cccaauuccaucaccacugccaacaacuccucccccagagaucuggcuggagcccagaaaaag

SEQ ID NO: 121815 - RNA, 63 nt, Homo Sapiens
uaagacuauguugguacuuggacuuguucgugccccagagaugggcaaagcugugcacuugca

SEQ ID NO: 121816 - RNA, 63 nt, Homo Sapiens
gccaaaacugauuagcuaguggacagagauaugcccagagaugcauauguguauauuuuuaug

SEQ ID NO: 121817 - RNA, 63 nt, Homo Sapiens
cucuuaucuaugaagacaucuucccagaguguccccagagacaugcaagucaugggucacacc

SEQ ID NO: 121818 - RNA, 55 nt, Homo Sapiens
uuccuuucaaaccucccaguuuuuucccagagaaucuauuaucauggaaaacuaa

SEQ ID NO: 121819 - RNA, 63 nt, Homo Sapiens
ccaccuccgcccugggcaggcccuucccuguuccccagagagccagcccugggaagacacauu

SEQ ID NO: 121820 - RNA, 63 nt, Homo Sapiens
gucccagggagccauccuaguggucgccucugucccagagaugagcugccggucuuggcuucc

SEQ ID NO: 121821 - RNA, 63 nt, Homo Sapiens
gcuuuuccaacacauuuuaacuucucuucuccacccagagaugccaucacuauaaucaacgaa

SEQ ID NO: 121822 - RNA, 63 nt, Homo Sapiens
augagucuauggcaucagguacgggucccaggccccagagaagguuggcuuucccccagccgc

SEQ ID NO: 121823 - RNA, 63 nt, Homo Sapiens
uuugcccacacacacuccuuagaauccugggcccccagagacccuggggcugguggauugggc

SEQ ID NO: 121824 - RNA, 63 nt, Homo Sapiens
aggcagcuuggucuaguggaggcuucucuugagcccagagacaugaccuucagcuccuaugca

SEQ ID NO: 121825 - RNA, 63 nt, Homo Sapiens
ccauuugccucucaacacuccaggacaggaucccccagagaccucugaaagucaggccugcug

SEQ ID NO: 121826 - RNA, 63 nt, Homo Sapiens
cccucugcagauaggcgugggcccugcuuuggucccagagaggguuucaggaggagggagacu

SEQ ID NO: 121827 - RNA, 63 nt, Homo Sapiens
guggguggagcugccugcugcagccuggggcugcccagagacugaaucagaguggggagggga

SEQ ID NO: 121828 - RNA, 63 nt, Homo Sapiens
auauacauucuuuaucuugauugaucccuguuacccagagaauccucuugcucaaaaaucugu

SEQ ID NO: 121829 - RNA, 63 nt, Homo Sapiens
ggaacggcuugcucuucuuuagcccaugaacuucccagagaguuaccuuaaacucccacugca

SEQ ID NO: 121830 - RNA, 63 nt, Homo Sapiens
cccaugagcugacauuuuacucugauucucuuacccagagauggacccacugcagacacaggc

SEQ ID NO: 121831 - RNA, 63 nt, Homo Sapiens
ccuuuaguguaaguagcuggcuagaugaugccccccagagaugcaucagguuaaagacuucau

SEQ ID NO: 121832 - RNA, 63 nt, Homo Sapiens
aauuuaguccauaugaacuacacauacgugcuacccagagauuaauauaauuuuauauuuaca

SEQ ID NO: 121833 - RNA, 63 nt, Homo Sapiens
uaaauuccagaaggagggcaugacaggguuugccccagagaucaacuacacagaggcacaucc

SEQ ID NO: 121834 - RNA, 63 nt, Homo Sapiens
uuuaucuucuuccuuggcauuguuguggucagccccagagaauuugucuuuauccacccccac

SEQ ID NO: 121835 - RNA, 63 nt, Homo Sapiens
aggagcauccuuaccuccaaugcucuccuggcacccagagaaauaagacugucauguaagagg

SEQ ID NO: 121836 - RNA, 63 nt, Homo Sapiens
gugccccgggcgggccgcgccccucggggcucccccagagacugccaagcugccuuaacucgc

SEQ ID NO: 121837 - RNA, 63 nt, Homo Sapiens
ugagggcuccuuccucaggauuuaccuaggaggcccagagaugucugcgaucaguuaacccau

SEQ ID NO: 121838 - RNA, 63 nt, Homo Sapiens
uuaaacagaaacaguagcugcuccaagagcuaccccagagaccccccaucuauucucuguugg

SEQ ID NO: 121839 - RNA, 63 nt, Homo Sapiens
cccagagcucucaagcuccuuagcagugacauucccagagagcauauauguagauauauauuu

SEQ ID NO: 121840 - RNA, 63 nt, Homo Sapiens
ccuuccucagcucucuucuuuuucuucccagcacccagagaauaaccccaguccugagcuugg

SEQ ID NO: 121841 - RNA, 63 nt, Homo Sapiens
aucuguuucccuguguccugaucuuccaggcagcccagagaaguuaucuaaaccuuuaaaccu

SEQ ID NO: 121842 - RNA, 63 nt, Homo Sapiens
gugucuauauccuccuucuaaccauauguuccccccagagaauuuugugugcaugggucaguc

SEQ ID NO: 121843 - RNA, 63 nt, Homo Sapiens
agggugucuuccuagaacauguucccaucugagcccagagauacaggauagucuaagggaggu

SEQ ID NO: 121844 - RNA, 63 nt, Homo Sapiens
gcgcagaugcuagcacaugcguuuuguaaaguccccagagaaaacagcugaguuguugagucu

SEQ ID NO: 121845 - RNA, 63 nt, Homo Sapiens
cucauuuaguuagaaaauaauauucauaugcuucccagagaaguuagaaguacguuuuugcau

SEQ ID NO: 121846 - RNA, 63 nt, Homo Sapiens
agagccucagcaagagaguuguucucacacuggcccagagaaaucacagccugacauggccag

SEQ ID NO: 121847 - RNA, 63 nt, Homo Sapiens
uuuaccuuucccaagcaucucacagggaaccugcccagagagcacuguccaagcucucagccc

SEQ ID NO: 121848 - RNA, 63 nt, Homo Sapiens
ucugcuccuuccugcucacaggccuauguccugcccagagaccagugcacaucagcacuaugg

SEQ ID NO: 121849 - RNA, 63 nt, Homo Sapiens
uuaacuaauauauccaugauagauagaauuuggcccagagaggauaccaauauucuauuuugc

SEQ ID NO: 121850 - RNA, 63 nt, Homo Sapiens
caaugggguccuucuguagguaucagccuguggcccagagacacaaucauguuaacucuuccu

SEQ ID NO: 121851 - RNA, 63 nt, Homo Sapiens
cagaggggaagagggugcuaauuccucuuugcacccagagacuucugcacaaaacuuuuggga

SEQ ID NO: 121852 - RNA, 63 nt, Homo Sapiens
uuccaacucaguaggaccccgucucaugaugcccccagagaacgcaguaauugcauuuuaucu

SEQ ID NO: 121853 - RNA, 63 nt, Homo Sapiens
agcuguguccauggugugucaugaaggauguaccccagagaguaacaugagccacugggcaga

SEQ ID NO: 121854 - RNA, 63 nt, Homo Sapiens
cccacauuccaaaagggggccugggaugcuagccccagagaugccagcccuucaggaagcagg

SEQ ID NO: 121855 - RNA, 63 nt, Homo Sapiens
gcugcacugcagcaaaaacaaaaccaccaccaccccagagaaaaccauguacuaauuggagug

SEQ ID NO: 121856 - RNA, 63 nt, Homo Sapiens
gcuuaagggucccaggaguacugcagggacagccccagagaggcccaacucuggccccuuucu

SEQ ID NO: 121857 - RNA, 63 nt, Homo Sapiens
gcccuagacccugccagaaaagggggcucuucccccagagaaguggcuuggagggaacuuccc

SEQ ID NO: 121858 - RNA, 63 nt, Homo Sapiens
ggaggagccugcugcauucuccugcugagggaucccagagagggcaggugcccaccccacagg

SEQ ID NO: 121859 - RNA, 63 nt, Homo Sapiens
ggcagagccccaggcguccccagcuguucaccucccagagaguccccagagccccaaagggcu

SEQ ID NO: 121860 - RNA, 63 nt, Homo Sapiens
uuccaugaggcaggcugaaccugcagauaugcgcccagagauauggaucgcccaagaguugcg

SEQ ID NO: 121861 - RNA, 63 nt, Homo Sapiens
auggaaggaagagaguagggccagugaaggcugcccagagagaaugucacagaugaggcugcc

SEQ ID NO: 121862 - RNA, 63 nt, Homo Sapiens
aaaguuccugcuuuaguguuuuguucccucugccccagagagcuccccuuagugaucucaguu

SEQ ID NO: 121863 - RNA, 63 nt, Homo Sapiens
gagcccagcccugggcuggggggcuccucaggacccagagaugugccuggaaccacuccugau

SEQ ID NO: 121864 - RNA, 63 nt, Homo Sapiens
cccucagguuguucucugauucuuccucccaaccccagagacugcagauuugugccaugcggc

SEQ ID NO: 121865 - RNA, 63 nt, Homo Sapiens
ccucuauccuaaggaagaccaagcaggccuggacccagagacgucccccaucgugggacacga

SEQ ID NO: 121866 - RNA, 63 nt, Homo Sapiens
uggcaggugaugugcuggguauagcauggaccucccagagaagcucaagcuauguggcacugu

SEQ ID NO: 121867 - RNA, 63 nt, Homo Sapiens
gauugugcuucucaacuccaccccauaauuucucccagagaccaucuaucaccuuuuccccaa

SEQ ID NO: 121868 - RNA, 63 nt, Homo Sapiens
acucuaucacagugcacauaggauguuccagcucccagagaaggcuccagcagaaaccagauu

SEQ ID NO: 121869 - RNA, 63 nt, Homo Sapiens
ggcuggggcagcgccaaggcuuccucuauaacccccagagacaacuggcacacgccccacgcc

SEQ ID NO: 121870 - RNA, 59 nt, Homo Sapiens
gaaaaaaaggagacagacaacaacauccucccagagaagcacgaccuggccuggauuga

SEQ ID NO: 121871 - RNA, 63 nt, Homo Sapiens
acugcuguuuucauuuuaaucacaaccgcuguccccagagauaaaaagcaguuagcauuucca

SEQ ID NO: 121872 - RNA, 63 nt, Homo Sapiens
ugacauuuuagcuuuauuguuaaggggaucucucccagagacuaugcuccuugacugaaacuu

SEQ ID NO: 121873 - RNA, 63 nt, Homo Sapiens
gcuugaucaaaggcacacagggggaggcuaaagcccagagacauccccgcccguuuuacaaag

SEQ ID NO: 121874 - RNA, 63 nt, Homo Sapiens
aaauuuggcuuuuuuuuucuggcuuggauauugcccagagaagagcuuucuucuuacaccuug

SEQ ID NO: 121875 - RNA, 61 nt, Homo Sapiens
ccugugcugaauguggacucagagagcuguacccagagaguugcaauuugugucuuccuaa

SEQ ID NO: 121876 - RNA, 63 nt, Homo Sapiens
cacacaaaggaaucuuuauugccugggacaggccccagagagucugagcaacaggaggacuca

SEQ ID NO: 121877 - RNA, 63 nt, Homo Sapiens
agaggcucugaaagaaaggacccauaaacauagcccagagaaguucugacaaaaaguccagaa

SEQ ID NO: 121878 - RNA, 63 nt, Homo Sapiens
uuggacuccggacuauccaugacugucugcucacccagagacccuccaggcuggccuuuggcc

SEQ ID NO: 121879 - RNA, 63 nt, Homo Sapiens
cugggccuucauggacacaucagcuggucacuccccagagaagaugcaggaguuucuccuggg

SEQ ID NO: 121880 - RNA, 63 nt, Homo Sapiens
uucagcauccuguaucuacacuuggaaagacaacccagagaugguggaccuggagaccauccc

SEQ ID NO: 121881 - RNA, 63 nt, Homo Sapiens
cuagaaaacuguucuuugcugugcccuguguaucccagagaugcuauguuucuauaagauaug

SEQ ID NO: 121882 - RNA, 63 nt, Homo Sapiens
acccauacagacaguggccugggaacuggagcacccagagaaacucagcuuugggaugugggu

SEQ ID NO: 121883 - RNA, 63 nt, Homo Sapiens
ucaaggaagcuuuucauucuuagagcgaaagggcccagagauaaauagcugugauggaaggac

SEQ ID NO: 121884 - RNA, 63 nt, Homo Sapiens
acaaucaacuaguauuuguugagcuccuauuugcccagagauggucauauuuaaacagaagua

SEQ ID NO: 121885 - RNA, 63 nt, Homo Sapiens
ggggauuguagcagacgucugggcuuuuccccacccagagaauagcccccuucgauacacauc

SEQ ID NO: 121886 - RNA, 63 nt, Homo Sapiens
ucauagagucaacuguuucaucaucauagugagcccagagagccacugcccagcagcaugcuc

SEQ ID NO: 121887 - RNA, 63 nt, Homo Sapiens
acuguaaaaacagcuguagguauaauguauauucccagagaauuguauuuaacuaauuaaugu

SEQ ID NO: 121888 - RNA, 63 nt, Homo Sapiens
accaccggcacuuacaaaaugugcggacugaaucccagagaacacuggcagauguauacagua

SEQ ID NO: 121889 - RNA, 63 nt, Homo Sapiens
accacugaaguagaauugauuguucagcuggagcccagagaauuuaauuuaauguuuuuucuu

SEQ ID NO: 121890 - RNA, 63 nt, Homo Sapiens
ucaacugauuaaagcagugaccagcaggaacugcccagagaacuggcuggccuuguuuccuga

SEQ ID NO: 121891 - RNA, 63 nt, Homo Sapiens
gcucaugccuccaagucagaguuucccuggugccccagagacaggagcacaagugggaucuga

SEQ ID NO: 121892 - RNA, 63 nt, Homo Sapiens
aguguuuuacacaaaugcauaucuugaacgucacccagagacuguaauuuguguaguuuuucu

SEQ ID NO: 121893 - RNA, 63 nt, Homo Sapiens
ggacugguuuuccaguacaucuuuaaacaaggccccagagacucuaugucugcccguccauca

SEQ ID NO: 121894 - RNA, 63 nt, Homo Sapiens
gcggccgaggccggagcaccacauccaccucgccccagagaggcucugcucccuccuauggag

SEQ ID NO: 121895 - RNA, 63 nt, Homo Sapiens
gccccggggcugccguuuugcugggcagugguucccagagagucagagcuggcaccccucagu

SEQ ID NO: 121896 - RNA, 63 nt, Homo Sapiens
cuguucccgcugcacggcccaccggcggccagccccagagaccagaacugauccagagcugga

SEQ ID NO: 121897 - RNA, 63 nt, Homo Sapiens
ggcaggggcaggcugaggaguugcccuuugccccccagagacugacucucagagccagagaug

SEQ ID NO: 121898 - RNA, 63 nt, Homo Sapiens
cucuuaaugcuguguuugagcuuucaugaguuucccagagagacauagcuggaaaauuccuau

SEQ ID NO: 121899 - RNA, 63 nt, Homo Sapiens
cugcccuuccacccggaggccacccccguccaccccagagaccaacccuucauaggaaauccc

SEQ ID NO: 121900 - RNA, 63 nt, Homo Sapiens
ucuuccacaaacaagaugagucccuucuccaggcccagagaacgcugugucagcccagccccu

SEQ ID NO: 121901 - RNA, 63 nt, Homo Sapiens
gcaaagggccuaccucggggaggaaacaggaagcccagagagggggauguaggagggggaagg

SEQ ID NO: 121902 - RNA, 63 nt, Homo Sapiens
cucucccuccuccucuuucaauucaccccaucucccagagacaucucugcucagaacacuacc

SEQ ID NO: 121903 - RNA, 63 nt, Homo Sapiens
agcugggccucuugcauucguucaaagagguugcccagagaaagggaacagggaauagaaccu

SEQ ID NO: 121904 - RNA, 63 nt, Homo Sapiens
augugggcagugggcagagagcacccgcagagucccagagaugcaguagccuuggggcagagg

SEQ ID NO: 121905 - RNA, 63 nt, Homo Sapiens
cagccugggcagucuguuuagaguucuuuuggucccagagaggccagugucugucaugccccu

SEQ ID NO: 121906 - RNA, 63 nt, Homo Sapiens
gcucuuccugcccucacccuggugaguguggcacccagagacuagggcagacaaacaggugag

SEQ ID NO: 121907 - RNA, 63 nt, Homo Sapiens
agcgaaguagcuugcucccucugggggaaugagcccagagaacugcauggaggcccuccugug

SEQ ID NO: 121908 - RNA, 63 nt, Homo Sapiens
aaguuuuggacuuaacaacaggaagauagguagcccagagaagcugagcaccugcuucaugaa

SEQ ID NO: 121909 - RNA, 63 nt, Homo Sapiens
aaugaaaaggcacaugcuuugcuguuguaacaucccagagaaguaauuguuuuagagcguguu

SEQ ID NO: 121910 - RNA, 63 nt, Homo Sapiens
auccaggcacugaacugcucauaagucuagaugcccagagagcgcccggaggggucuggaggc

SEQ ID NO: 121911 - RNA, 63 nt, Homo Sapiens
guagaaagaguccaguguaaaccucgaagagcucccagagauuacagaggacaggugacaacc

SEQ ID NO: 121912 - RNA, 63 nt, Homo Sapiens
ucuaugaaaaccaguggcuugcccuggugauuacccagagauaggugauaacuacuuagcacu

SEQ ID NO: 121913 - RNA, 63 nt, Homo Sapiens
ugcagcucucuguccacaaccagcccccugaggcccagagacaccacagccucauuuuacaga

SEQ ID NO: 121914 - RNA, 63 nt, Homo Sapiens
ccuggcacacaaggcccaaggccagggaggggacccagagaggaaggugagaggaaggcaaag

SEQ ID NO: 121915 - RNA, 63 nt, Homo Sapiens
cccugggcucagaucuguaacccuuuccaaaagcccagagauggaacucaggaaaagcaggaa

SEQ ID NO: 121916 - RNA, 63 nt, Homo Sapiens
cugaaugacaugcucacaguucugaaacugagacccagagagguuuugugccaaacccauagg

SEQ ID NO: 121917 - RNA, 63 nt, Homo Sapiens
caucucuuccauuuuugauuaaggcugcuugcccccagagagcgguucagguggggucuccag

SEQ ID NO: 121918 - RNA, 63 nt, Homo Sapiens
uguuccguacccacugcugaccccagggcagagcccagagaagcucccauuugcucucaguga

SEQ ID NO: 121919 - RNA, 63 nt, Homo Sapiens
agaacuaacccacacaggaugaggaaacagcaacccagagaggcaaaucuuuauuuugcagau

SEQ ID NO: 121920 - RNA, 63 nt, Homo Sapiens
guuuuggagccaggcauugacuuuggcauggaccccagagauaggauacaucugaaagcauuc

SEQ ID NO: 121921 - RNA, 63 nt, Homo Sapiens
aagaacccucggacucaggcagcugagaauaaacccagagacacaucagcagggggaaagcca

SEQ ID NO: 121922 - RNA, 63 nt, Homo Sapiens
gggcagaaggggcggcccggacgggggagcuuucccagagacccggggauggauuggccucca

SEQ ID NO: 121923 - RNA, 63 nt, Homo Sapiens
auaauggccagagauauccacagcuuggaggagcccagagaccguuugcuuuauacccacaca

SEQ ID NO: 121924 - RNA, 63 nt, Homo Sapiens
ugguuaugcagaagcagagaugaggaggcuggccccagagaugaucuugcccuuccuaacuaa

SEQ ID NO: 121925 - RNA, 63 nt, Homo Sapiens
caccucagcaaaugcugcaaaauccuguuuucccccagagagcuggagguuaaauacuaccag

SEQ ID NO: 121926 - RNA, 63 nt, Homo Sapiens
guaaauaaugugggaaaauaguauuguuuagcucccagagaaacauuuguuccacaguuaaca

SEQ ID NO: 121927 - RNA, 63 nt, Homo Sapiens
gggcucagccauucggcuuggggcaccaggcuccccagagacaaugcucaguauucauucaua

SEQ ID NO: 121928 - RNA, 63 nt, Homo Sapiens
uuuagacaauuuuaggcucaauauauccuuggucccagagaugucuuuguaauuuaugcuuuc

SEQ ID NO: 121929 - RNA, 63 nt, Homo Sapiens
uggaggagcuaaaaaagcaaacaaauauaaaaucccagagaggcaucccuacucaucagaaag

SEQ ID NO: 121930 - RNA, 63 nt, Homo Sapiens
gaaugcgcuuuggauuguuuauuauauuccauucccagagagacaauagcaacagaaauauaa

SEQ ID NO: 121931 - RNA, 63 nt, Homo Sapiens
agccuucagucccuaucagcgccuccuuuacuucccagagaacuucacagagacucuguccuu

SEQ ID NO: 121932 - RNA, 63 nt, Homo Sapiens
gagcugugucccuuuacuaugcaagcacaugaccccagagacagcugguucacuggcagaucc

SEQ ID NO: 121933 - RNA, 63 nt, Homo Sapiens
ugugugcaaggcaauaguuagccuugauuuuagcccagagacagauggcagagcuaucucucu

SEQ ID NO: 121934 - RNA, 63 nt, Homo Sapiens
ggagauguaaugacagagaguucuggugagauacccagagagaaaaagagagagcaggguggg

SEQ ID NO: 121935 - RNA, 63 nt, Homo Sapiens
cugcuccccacaccuagccuuuguucuggaaaccccagagagggcugggcuugacucaucuca

SEQ ID NO: 121936 - RNA, 63 nt, Homo Sapiens
accaggcaagagucuugcuuauugggcugcauccccagagaggauaugaauuauuuuuugaaa

SEQ ID NO: 121937 - RNA, 63 nt, Homo Sapiens
ggggacccaaagggucuggccucuuugggcagccccagagaugaggggucagcagaggagagc

SEQ ID NO: 121938 - RNA, 63 nt, Homo Sapiens
cacuccccuugccccacacccuuuacuccccagcccagagagacgcugcuuuuaccaggaaag

SEQ ID NO: 121939 - RNA, 63 nt, Homo Sapiens
ggcagcaccauuugacagguuaggaugcuggggcccagagagguuaagugucuugcccgaggu

SEQ ID NO: 121940 - RNA, 63 nt, Homo Sapiens
cagaccuggcuguggagagcagcuaauguguggcccagagagccugucuguguggagcacgua

SEQ ID NO: 121941 - RNA, 63 nt, Homo Sapiens
ugugcuuauuucugccauugucccucucacguucccagagaggucauucuuuuugguccaacu

SEQ ID NO: 121942 - RNA, 63 nt, Homo Sapiens
cccagcgucuugacgggagcauuggccccugagcccagagaagcuggaagccugccgaaaaca

SEQ ID NO: 121943 - RNA, 63 nt, Homo Sapiens
agggcccagcccugcuuccuggaguggauguggcccagagaaggaggcugggggaucaccagc

SEQ ID NO: 121944 - RNA, 63 nt, Homo Sapiens
agaagcgcuuucuaagaaugggucaaauccaaacccagagaaccagcucuuucugcaugugcu

SEQ ID NO: 121945 - RNA, 63 nt, Homo Sapiens
ugugugcaaaaaugauacucagagagugucaaacccagagaaagaacaguccauauuagcucc

SEQ ID NO: 121946 - RNA, 63 nt, Homo Sapiens
uuugagggaugaacggguagugcuucccucgaacccagagauucuugccccuuauuucuuccc

SEQ ID NO: 121947 - RNA, 63 nt, Homo Sapiens
agauugggcacaacuaaggcguagcaaagcccucccagagaaacccugggaacugggucuugg

SEQ ID NO: 121948 - RNA, 63 nt, Homo Sapiens
guuaaucauggauguuagagcagaguuacccaacccagagacuugccucuguauuuaagccaa

SEQ ID NO: 121949 - RNA, 63 nt, Homo Sapiens
ccaaagacagcuacaggaagcagguuugagauucccagagagguccccucucccacugaguca

SEQ ID NO: 121950 - RNA, 63 nt, Homo Sapiens
gacaagauaggacauggccuguuuccauuaucacccagagagggacugcuacuuccugucucu

SEQ ID NO: 121951 - RNA, 63 nt, Homo Sapiens
ccugguccgucuugggucuggggaugucgccuccccagagaugcucugggcugccggugggag

SEQ ID NO: 121952 - RNA, 63 nt, Homo Sapiens
ccaauaugugccacgugccuguggcugcagacucccagagaaccagcacuggguuuacagaau

SEQ ID NO: 121953 - RNA, 63 nt, Homo Sapiens
cuucaggcaccuaggggagagcgugccugacaacccagagagauucgacagucagccuugugu

SEQ ID NO: 121954 - RNA, 63 nt, Homo Sapiens
ugccaagccuguggaucaggaauaucaacagcccccagagaguggugcuggcugagggucuga

SEQ ID NO: 121955 - RNA, 63 nt, Homo Sapiens
gcaccucccuucccucccugaggcaggugagaacccagagagaggggccugcaggugagcagg

SEQ ID NO: 121956 - RNA, 63 nt, Homo Sapiens
acaccucagggcgggugagguuccgacacugaucccagagaugccguggauacgccagggucc

SEQ ID NO: 121957 - RNA, 63 nt, Homo Sapiens
auuugaguuguuuuggugccugccucugccaugcccagagaaucagggcaggcuugccaccgg

SEQ ID NO: 121958 - RNA, 63 nt, Homo Sapiens
aggacuuggcugcgcguaacugccuggucagugcccagagacaagugaaggugucugcccugg

SEQ ID NO: 121959 - RNA, 63 nt, Homo Sapiens
cuuuacgaguguuuuuuauuugggacccucgagcccagagauauuaauggauaucuguauuca

SEQ ID NO: 121960 - RNA, 63 nt, Homo Sapiens
cagaggaagcagcccucccucgauggccucuagcccagagaagcccgcgcaucuuggacccac

SEQ ID NO: 121961 - RNA, 63 nt, Homo Sapiens
agaaaaaaaaaaaaggaggggaaaugcauuuuccccagagauaaaggcugccauuuugggggu

SEQ ID NO: 121962 - RNA, 63 nt, Homo Sapiens
agaguguaugauucuggaacagggugaaacucucccagagacgaagaaagaguccugggauuu

SEQ ID NO: 121963 - RNA, 63 nt, Homo Sapiens
augacaugacaucacucccaauucucuccaaaccccagagaaauacugacgaaguuuucugau

SEQ ID NO: 121964 - RNA, 63 nt, Homo Sapiens
uguuuugaguuuugcccuggggcuugaaugagucccagagagucguucggauggugggaggcu

SEQ ID NO: 121965 - RNA, 63 nt, Homo Sapiens
gagcacugcagaucagcaacguguagguacacacccagagaugguacaacaaaggugacgggu

SEQ ID NO: 121966 - RNA, 63 nt, Homo Sapiens
aagccagaaaaccaagguaauuuaauuagaaagcccagagaaaagaaauaaacauuuagagga

SEQ ID NO: 121967 - RNA, 63 nt, Homo Sapiens
cgaaauaucauuuguggguuuaaaccuuucauucccagagaucaaaggguauuucauaguuuu

SEQ ID NO: 121968 - RNA, 63 nt, Homo Sapiens
uuaagugacuuccucgaggugagaaaacugagacccagagagcauuaaucucauuguacaagu

SEQ ID NO: 121969 - RNA, 63 nt, Homo Sapiens
ugucuugucagccucucuagcuacgguacucuccccagagauacccuuuaacacuggugaaag

SEQ ID NO: 121970 - RNA, 63 nt, Homo Sapiens
ugcccuaacagaacacuucagagaaauucuuugcccagagagcgagccugcaauuggaaauau

SEQ ID NO: 121971 - RNA, 63 nt, Homo Sapiens
uucugaucuccaaaaagaggguucuucucuuuucccagagaccaguuauuuucugaaaaauug

SEQ ID NO: 121972 - RNA, 63 nt, Homo Sapiens
gauuuccuucucuuagaagugggaauacggggucccagagaaaaaaggguucuuggaggccag

SEQ ID NO: 121973 - RNA, 63 nt, Homo Sapiens
aggagaaaucuguagugagcuugaccauuuuuucccagagaagauuaaaaggaagcagaagca

SEQ ID NO: 121974 - RNA, 63 nt, Homo Sapiens
ucagccaccgagucuccugggcuggcuggaguccccagagauagggaccagaugcuucccugu

SEQ ID NO: 121975 - RNA, 63 nt, Homo Sapiens
ugcuucauuuucuuuuuauauugguauagcaaccccagagaagacuacaaugggcugaaacag

SEQ ID NO: 121976 - RNA, 63 nt, Homo Sapiens
accaugacuugaggcacaaaucuugucuggugacccagagaucaagaaagaauugcaguaaag

SEQ ID NO: 121977 - RNA, 63 nt, Homo Sapiens
gcagcuucccuuggcucugggguuggcuugcaacccagagagaucucuucuugcugcaaaacu

SEQ ID NO: 121978 - RNA, 63 nt, Homo Sapiens
uucugugaaaacauuuugcuuaagaauaugcaacccagagaauuccacaguaguucaggcaau

SEQ ID NO: 121979 - RNA, 63 nt, Homo Sapiens
gucgcuacuaaaagaaugaaaugagcauucuagcccagagacugccaaagccgaaaauaguau

SEQ ID NO: 121980 - RNA, 63 nt, Homo Sapiens
gaaugugaagacacgcgcuauuugucuugcuuccccagagauaagggaaauggguagagccug

SEQ ID NO: 121981 - RNA, 63 nt, Homo Sapiens
cucugccuggaggcgggccugguucgucuaggucccagagacccuuggugccccgacccccag

SEQ ID NO: 121982 - RNA, 63 nt, Homo Sapiens
gccgccuucuuggugccaaacccccuucccccacccagagacugggcagcugugucugguucg

SEQ ID NO: 121983 - RNA, 63 nt, Homo Sapiens
gaggcaagcccccuugccuuucaaacuggaaaccccagagaaaacggugcccccaccugucgc

SEQ ID NO: 121984 - RNA, 63 nt, Homo Sapiens
uacacuuuacagguaccuguuaucccuacgcuucccagagagaacaaugcugugagagaguuu

SEQ ID NO: 121985 - RNA, 63 nt, Homo Sapiens
gaaggagccaggacacagcucagcuugcucacgcccagagagagaaaaaguuaagcugcugac

SEQ ID NO: 121986 - RNA, 63 nt, Homo Sapiens
cucuugucccugggaggccucugcuugucacuucccagagauugcagagguguguccugccua

SEQ ID NO: 121987 - RNA, 63 nt, Homo Sapiens
gcccagagcacuguuggaagucugguuagaguccccagagaguuacucuaaguuaaaaugagc

SEQ ID NO: 121988 - RNA, 61 nt, Homo Sapiens
gucugaaguggacugugugagccugggcauucccagagaggaagggccgcugugcacugcc

SEQ ID NO: 121989 - RNA, 63 nt, Homo Sapiens
cuuuuaauccaaagaacauguauaguuuuuguacccagagacuaugauuuauauugauugcac

SEQ ID NO: 121990 - RNA, 63 nt, Homo Sapiens
uccucugccgggaggguguuuucaacuccaaaccccagagagggguuguagauuggguccagc

SEQ ID NO: 121991 - RNA, 63 nt, Homo Sapiens
uuuaugaugacugcuuaacuccccacugccugucccagagaggcuuuccaauguagcucagua

SEQ ID NO: 121992 - RNA, 63 nt, Homo Sapiens
ucagauggaacgaaaggcgaugugcaaggccaucccagagagacggaagcaggugcgauacua

SEQ ID NO: 121993 - RNA, 63 nt, Homo Sapiens
cuaugucuggucaccagcucccuccugcuggcacccagagacccggacccgcagggccugccu

SEQ ID NO: 121994 - RNA, 63 nt, Homo Sapiens
ggugucacguuggggaacaaguguccuucagaacccagagaaggccgccguucuguaaauagc

SEQ ID NO: 121995 - RNA, 63 nt, Homo Sapiens
aaaacgggccgguauuuacacacgcgcaaaacacccagagacggcacaaggagguugaacuca

SEQ ID NO: 121996 - RNA, 63 nt, Homo Sapiens
aggucagacaacaggcaaccggccgugccagugcccagagagccuucagaccagccagcaagg

SEQ ID NO: 121997 - RNA, 63 nt, Homo Sapiens
aucaguaugugcuuaccuguuacauuuugucaucccagagacaccaguuucuugucuuuuuua

SEQ ID NO: 121998 - RNA, 63 nt, Homo Sapiens
caguaggaaauuucuccuuaaucacaauagcaucccagagagaagaauuccaauuaauuaaau

SEQ ID NO: 121999 - RNA, 63 nt, Homo Sapiens
uuuucucucccauaccaucaagcuuugaauacccccagagaccuccauggaggagguguccca

SEQ ID NO: 122000 - RNA, 63 nt, Homo Sapiens
gggcugcucucccggaggccaaaggagcucacgcccagagacuaacuguggccaugacugagg

SEQ ID NO: 122001 - RNA, 63 nt, Homo Sapiens
gagugugggagugauucccaccgucucccuuggcccagagacgaauggucucugucaagcggg

SEQ ID NO: 122002 - RNA, 63 nt, Homo Sapiens
auuaauuauauuucuacagacauauuuagcgcacccagagaaaaaauugauuuguuaugguua

SEQ ID NO: 122003 - RNA, 63 nt, Homo Sapiens
ccuuguaaguguccccucugucuuugucuugcucccagagacacucuaaccaaucaaauaguu

SEQ ID NO: 122004 - RNA, 63 nt, Homo Sapiens
aaaccuuggggccccagaugcugggcuuggauucccagagaggaacagggaagagacauaccc

SEQ ID NO: 122005 - RNA, 63 nt, Homo Sapiens
gguauuguggcugugccagggugacauaugcuucccagagacuaugggacccacguggaguag

SEQ ID NO: 122006 - RNA, 63 nt, Homo Sapiens
ggacauuucccuccugggagggaccuguggggccccagagaggggcuccuccaggcacguccc

SEQ ID NO: 122007 - RNA, 63 nt, Homo Sapiens
uacuaaaauacugauuaucuuaaucacauuuuccccagagauaaacauugagagaacgaaagc

SEQ ID NO: 122008 - RNA, 63 nt, Homo Sapiens
cgagagcugucggaaccagaugcaacccggcagcccagagaacucuccugggaggcugugggu

SEQ ID NO: 122009 - RNA, 63 nt, Homo Sapiens
auaaagugaaucaaauuugacauuauuuuagaucccagagaaaucaggugugauuaguucucc

SEQ ID NO: 122010 - RNA, 63 nt, Homo Sapiens
uagggcauagaguugucuccuucccaacacggacccagagagcagcccuucccugcucaaagc

SEQ ID NO: 122011 - RNA, 63 nt, Homo Sapiens
uacagagcagugugggcagccccaagugugguccccagagagcguuuggcuuuccugucuguc

SEQ ID NO: 122012 - RNA, 63 nt, Homo Sapiens
aguguuccucgacauguuucuccagugacaccucccagagaaguuguaaguauaaaaugaaaa

SEQ ID NO: 122013 - RNA, 63 nt, Homo Sapiens
ugaaauguugacuuaagugagggggaaauaaaacccagagagagagagagagcgagagagaga

SEQ ID NO: 122014 - RNA, 63 nt, Homo Sapiens
agauccucaucugagagugcuuaaaaugggauccccagagaccauuaaccaauacuggaacug

SEQ ID NO: 122015 - RNA, 63 nt, Homo Sapiens
cccagccugaggcuccagcugaugcccucagcucccagagagggggugccccaucuagcuggg

SEQ ID NO: 122016 - RNA, 63 nt, Homo Sapiens
ccacaccacgugcccucuuggcccagccuuccucccagagaggcggccugacuuaccuggaug

SEQ ID NO: 122017 - RNA, 63 nt, Homo Sapiens
gcuuaccccucucuaggguuuccaugacuauugcccagagaaguuccuuccccucuguaaaug

SEQ ID NO: 122018 - RNA, 53 nt, Homo Sapiens
gauugugggagacacuuuuuacucccagagaagcaaguagcaaaaaaacauga

SEQ ID NO: 122019 - RNA, 63 nt, Homo Sapiens
cacucagugagccuccugugggggcaucucuuccccagagaggucacaugggacugggauaug

SEQ ID NO: 122020 - RNA, 63 nt, Homo Sapiens
aggaacaaaggucuggaguuggucaguaaguugcccagagagaguuagcguuacuucuccugu

SEQ ID NO: 122021 - RNA, 63 nt, Homo Sapiens
gucaggccgaaccccauuucgcucaucagcccccccagagaggugacacguggacaaaugcgg

SEQ ID NO: 122022 - RNA, 63 nt, Homo Sapiens
gcucugcacgucaccaaguaugagcugcagccccccagagagagaguccagcuccccccaaga

SEQ ID NO: 122023 - RNA, 63 nt, Homo Sapiens
gagguuuuuuaaaagacugucuucuucuuaaagcccagagaaaccccaacaaauauuaaaugg

SEQ ID NO: 122024 - RNA, 63 nt, Homo Sapiens
ucacacuggccaggaaugcuggaugcugaaucucccagagagcccagacuuuaggagugugag

SEQ ID NO: 122025 - RNA, 63 nt, Homo Sapiens
uccauaauuuaaaauaaaaugcuauuuuuuuuccccagagacuacaucuauugucauuccauu

SEQ ID NO: 122026 - RNA, 63 nt, Homo Sapiens
gauaaguaaauauuuaagaaguaaacugcauagcccagagaaauaauuuuuuaaaaauggaag

SEQ ID NO: 122027 - RNA, 63 nt, Homo Sapiens
accagucacaucaaucaggguguacugcacaaccccagagaauacguacaguuguauggauug

SEQ ID NO: 122028 - RNA, 63 nt, Homo Sapiens
gacucuuuuuguaagauuuucugugcaccuuaccccagagacacuuaaaugucgguccaggcc

SEQ ID NO: 122029 - RNA, 63 nt, Homo Sapiens
ccccuuccccaugggaagaccucucccagucuacccagagaagcggggggccccagucagccu

SEQ ID NO: 122030 - RNA, 63 nt, Homo Sapiens
cacgagaagugaccuucagggucaucaggcugucccagagagguccgcguucuccccaccccg

SEQ ID NO: 122031 - RNA, 63 nt, Homo Sapiens
uguacauacauuguauaggccaucuguaaauaucccagagaacaaucacuauucuuaagcacu

SEQ ID NO: 122032 - RNA, 63 nt, Homo Sapiens
cuugcuguuuaaaaguaaugcaauaugugaacgcccagagaacaagcacuguggaacugcuau

SEQ ID NO: 122033 - RNA, 63 nt, Homo Sapiens
ggacacuuggcuuuggggggaaggaaacugaggcccagagaggggcaaccacuggccaagggu

SEQ ID NO: 122034 - RNA, 63 nt, Homo Sapiens
auaacaugguacaugcuucaggacuacauaugacccagagagcaagguggcugaacuauaguc

SEQ ID NO: 122035 - RNA, 63 nt, Homo Sapiens
aaaacccaagaguuuguacagacauccugucuucccagagaagguggacacucuugggcucau

SEQ ID NO: 122036 - RNA, 63 nt, Homo Sapiens
gguagggagaggacaaggggucaccgagcccuucccagagagcagggagcuuauaaauggaac

SEQ ID NO: 122037 - RNA, 63 nt, Homo Sapiens
ugcaaagcaguguccaggagcaggccacuacugcccagagagcagaggaggagguuguuggca

SEQ ID NO: 122038 - RNA, 63 nt, Homo Sapiens
cugcucgggaaggccugagggaagcccacccgccccagagacugcccacccugggccucccgu

SEQ ID NO: 122039 - RNA, 63 nt, Homo Sapiens
uuuuaagguaucugccuauaugauuuguuugcccccagagaauccuguacaucuaauauauac

SEQ ID NO: 122040 - RNA, 63 nt, Homo Sapiens
uguugugcuguguauuuugaacggcuuucaugucccagagaccggcucugcauagccaggaug

SEQ ID NO: 122041 - RNA, 63 nt, Homo Sapiens
ggggaaggcagccuguccaugcuauugggggagcccagagacaaccagucggaagggauucug

SEQ ID NO: 122042 - RNA, 63 nt, Homo Sapiens
caacuauguuauccauccugaagucuggugguccccagagaaagggacacaagucacuucaag

SEQ ID NO: 122043 - RNA, 63 nt, Homo Sapiens
gugcgugccacuaccaaagcaaugcagacccggcccagagacuuaaagaagccucuucuauuu

SEQ ID NO: 122044 - RNA, 63 nt, Homo Sapiens
guuugauccaacccucuuaugagaugcuaaggccccagagaucuaggaggauccacaggauuu

SEQ ID NO: 122045 - RNA, 63 nt, Homo Sapiens
agcagcccugagccccuguauuucuuccccaagcccagagaaguucaggaaagaagugcagaa

SEQ ID NO: 122046 - RNA, 63 nt, Homo Sapiens
ggucucgacccacucaaggagcagagaccugugcccagagaagagggucagaacuggacagcu

SEQ ID NO: 122047 - RNA, 63 nt, Homo Sapiens; identical to SEQ ID NO: 121970

SEQ ID NO: 122048 - RNA, 63 nt, Homo Sapiens
cuuccagcacagcccucuacgccggggguguggcccagagaaggaccuucagcccucccuaca

SEQ ID NO: 122049 - RNA, 63 nt, Homo Sapiens
aaacaaugggaacaauuucagcccauguccaagcccagagagauaacuggacauuaguguaca

SEQ ID NO: 122050 - RNA, 63 nt, Homo Sapiens
aauuacucauuaaccagcauucugaaccauaaacccagagaagccugaggucuccuauucuac

SEQ ID NO: 122051 - RNA, 63 nt, Homo Sapiens
cugccuucccuacacuagaacauugcaggagcucccagagagaaaccugggcuaagaguuugg

SEQ ID NO: 122052 - RNA, 63 nt, Homo Sapiens
acugaggcuacggggaacuugagcagccucaagcccagagaaguacuuuaaaugccugccaag

SEQ ID NO: 122053 - RNA, 63 nt, Homo Sapiens
ccaccucucccccaagggcccguuucccuggugcccagagaaccccaaugccaacccccaccc

SEQ ID NO: 122054 - RNA, 63 nt, Homo Sapiens
gaaaucucuuuguggcuuucaugggcagggaaucccagagauagcaaaugccaccugaccaga

SEQ ID NO: 122055 - RNA, 63 nt, Homo Sapiens
uuaucuuccuuuugugguuuuuaauuugaagaccccagagaauuccauuacauaaugauuuug

SEQ ID NO: 122056 - RNA, 63 nt, Homo Sapiens
cuaauacuuucucccuaauggaagcccugaucccccagagagcuacaggucugcucccgacgg

SEQ ID NO: 122057 - RNA, 63 nt, Homo Sapiens
cccaaacuugugacugcaucccucuggagucuacccagagacagagaaugugucuuuaugugg

SEQ ID NO: 122058 - RNA, 63 nt, Homo Sapiens
aggaaacagacagcggacugaggaagcgauggccccagagaaagggccccuguagccuggcuc

SEQ ID NO: 122059 - RNA, 63 nt, Homo Sapiens
ccaauaagaauccucuauuaugcccaccccagccccagagaaaacaaaugaagagaaaagcca

SEQ ID NO: 122060 - RNA, 63 nt, Homo Sapiens
ccccccagacacugcagggcucaggaucugccccccagagaccuaaaggcuccuggccucuca

SEQ ID NO: 122061 - RNA, 63 nt, Homo Sapiens
uucauuuaguugauauaaucauaguuuuuuguccccagagacauugaucaccaugaaagaaga

SEQ ID NO: 122062 - RNA, 63 nt, Homo Sapiens
uguaucagcaggaagccauuggacagugaaacacccagagacuuggugugggccagaaacaag

SEQ ID NO: 122063 - RNA, 63 nt, Homo Sapiens
gcuguccgccagugcaucauaacaucacuggggcccagagagaacagagcacagcucaugggc

SEQ ID NO: 122064 - RNA, 63 nt, Homo Sapiens
agcagagucaguuacaccuggcgggagagguggcccagagaacucuagcaucacuccugagcu

SEQ ID NO: 122065 - RNA, 63 nt, Homo Sapiens
ccaaaagauuggauacgcauucuuccaacguggcccagagaagauguggcccaacacaauucu

SEQ ID NO: 122066 - RNA, 63 nt, Homo Sapiens
uuauaagaacugauguggccgcagccacuucagcccagagagaagguccaacccugcaaugaa

SEQ ID NO: 122067 - RNA, 63 nt, Homo Sapiens
ugugggcagaagcagugaagcacuucagccaagcccagagaagcagcguuugccagagguggc

SEQ ID NO: 122068 - RNA, 63 nt, Homo Sapiens
uuuaccguaugaagccuggaaguuccuuuccuucccagagaguauuuucugcaugggacucug

SEQ ID NO: 122069 - RNA, 63 nt, Homo Sapiens
uaagaagaaaaccucuaaauuuaagacuuacaccccagagauugucuuuuuugcccagaucuu

SEQ ID NO: 122070 - RNA, 63 nt, Homo Sapiens
agcauguagcaggggggaaugaacuggugucugcccagagagcgcauggcuuugaccuaguau

SEQ ID NO: 122071 - RNA, 63 nt, Homo Sapiens
aagccgcuggcuguaugaaaaaaaugugacucucccagagaaguugugucugaaaccgguuuu

SEQ ID NO: 122072 - RNA, 63 nt, Homo Sapiens
uggauucccuuggcggccguccccuggcccuggcccagagauucuagggcugggguucucaag

SEQ ID NO: 122073 - RNA, 63 nt, Homo Sapiens
cuuaaauccaaguuguuucuccuucccaccuggcccagagaugauccuuggucaucauugucu

SEQ ID NO: 122074 - RNA, 63 nt, Homo Sapiens
ccccuuccccaucagaagacugaggggagagcccccagagagcccucccaguuggccagaauc

SEQ ID NO: 122075 - RNA, 63 nt, Homo Sapiens
ccccuuagcacaccuagagguugacucaaucuacccagagaugucccuagggucucuucuugc

SEQ ID NO: 122076 - RNA, 63 nt, Homo Sapiens
aaagugcauuacuuaaagauagaauggaaaaaacccagagagcuaaugcacuuuaaauaaggu

SEQ ID NO: 122077 - RNA, 63 nt, Homo Sapiens
gagcccaccugcugccugggaguggugucgggucccagagaggggccugaugaaagcuuccug

SEQ ID NO: 122078 - RNA, 63 nt, Homo Sapiens
cugcucagccaggccucuccugggagccacucgcccagagacucagcuuggccaacuuggggg

SEQ ID NO: 122079 - RNA, 63 nt, Homo Sapiens
ggcccucucugaaggaggccaccuccuaaaaggcccagagagaagagccccacucucagaggc

SEQ ID NO: 122080 - RNA, 63 nt, Homo Sapiens
cagacuugggugcuuagcuucagauacucuaugcccagagauagugcacuuggcagcugucag

SEQ ID NO: 122081 - RNA, 63 nt, Homo Sapiens
guaaagcuaggcagaugagcccagaagaauggucccagagaaagcagacuggcuccaauagau

SEQ ID NO: 122082 - RNA, 63 nt, Homo Sapiens
gugccuacuguuccccaccucagaagcuuccugcccagagagccagcagccuugggauacuaa

SEQ ID NO: 122083 - RNA, 63 nt, Homo Sapiens
uugcacugugcucucccacaaguccagcugcaacccagagauaguggaaacugaaauuaggaa

SEQ ID NO: 122084 - RNA, 63 nt, Homo Sapiens
cucugaaaccaaacagcauccugccaugagcuucccagagacagaagagacuggagcaaaguc

SEQ ID NO: 122085 - RNA, 63 nt, Homo Sapiens
uacugccacuaguguucaagugccucuuguuuucccagagauuuccugggucugccagaggcc

SEQ ID NO: 122086 - RNA, 63 nt, Homo Sapiens
uuccccaucuguuggaccaaauaaucucaaaggcccagagaggacagugaccauccacagaca

SEQ ID NO: 122087 - RNA, 63 nt, Homo Sapiens
auuccuuccaggagcaguaggugggagguuugacccagagaagccaauccuugcauuccagga

SEQ ID NO: 122088 - RNA, 63 nt, Homo Sapiens
aaccaaggagcuggggcccaaggccaguccugccccagagacacuccaaguccgccaggggca

SEQ ID NO: 122089 - RNA, 63 nt, Homo Sapiens
caaagagggccccagcccagccccaccacagaucccagagauaggggcccagucuccaugggg

SEQ ID NO: 122090 - RNA, 63 nt, Homo Sapiens
ugcacccggggcugcaaacgucuccgugcagcccccagagagaggcccaugggcucagaccag

SEQ ID NO: 122091 - RNA, 63 nt, Homo Sapiens
uuuccuaccaccuuuguggccgaccccaagcaccccagagauaugaggcacccuuugcuccac

SEQ ID NO: 122092 - RNA, 63 nt, Homo Sapiens
agauuguucuccagcaccccacauucaccccugcccagagauucccccuucuccucuccccua

SEQ ID NO: 122093 - RNA, 63 nt, Homo Sapiens
gucagucccucuaucccuucuccuguccaggggcccagagagaaacacaccuaccccuggccu

SEQ ID NO: 122094 - RNA, 63 nt, Homo Sapiens
cgaggccgcgugcgugagaaccgcgccgguguccccagagaccaggcugugucccucuucucu

SEQ ID NO: 122095 - RNA, 63 nt, Homo Sapiens
guccagccuaaucaagucaaauggagaaacaggcccagagaggaagguggcuuaccaagauca

SEQ ID NO: 122096 - RNA, 63 nt, Homo Sapiens
uuaucccagucguacucuuccagguuuggaagacccagagaggccaagaucccauccuuagcc

SEQ ID NO: 122097 - RNA, 63 nt, Homo Sapiens
gaccucacucuaacucaaaguaauguccagguucccagagaauaucugcugguauuuuucugu

SEQ ID NO: 122098 - RNA, 63 nt, Homo Sapiens
guguuuucaucucuuggucauaauuccgagauccccagagaccacuguuucuggaguaucugu

SEQ ID NO: 122099 - RNA, 63 nt, Homo Sapiens
gggacugcagagaggcuacuggaagguuaaggacccagagagaaaucgagaggugcccuacag

SEQ ID NO: 122100 - RNA, 63 nt, Homo Sapiens
gagacuuucagcccuaaaucuagacucaagguucccagagaugacaaauggagaagaaaggcc

SEQ ID NO: 122101 - RNA, 63 nt, Homo Sapiens
uauggauuaucuuuauaucacugucuuucuaagcccagagaugucauaagugacaagaaaagu

SEQ ID NO: 122102 - RNA, 63 nt, Homo Sapiens
guccuauacucacaucagacaugugaucauagucccagagacagaguugaggucucgaagaaa

SEQ ID NO: 122103 - RNA, 63 nt, Homo Sapiens
aggagggagccgggagccuggugggaagccuuccccagagagauggcuuuaggggcuuuauuu

SEQ ID NO: 122104 - RNA, 63 nt, Homo Sapiens
ccauauccuuucuugaacgcacauucagcuuaccccagagagcaagugaggcaaucuggcaaa

SEQ ID NO: 122105 - RNA, 63 nt, Homo Sapiens
cagcaaccugccagcuacaggagcccccugcgucccagagacucccucacccaggcaggcucc

SEQ ID NO: 122106 - RNA, 63 nt, Homo Sapiens
auucuacccaaaugucaggaccaggauuuucuacccagagaccaagguguucuucccaaagac

SEQ ID NO: 122107 - RNA, 63 nt, Homo Sapiens
auucuacccauaugucaggaccaggauuuucuacccagagaccaagguuaucuuccuaaagac

SEQ ID NO: 122108 - RNA, 63 nt, Homo Sapiens
auucuacccauaugucaggaccgggauuuucuacccagagaccugcauguucucuccaacgac

SEQ ID NO: 122109 - RNA, 63 nt, Homo Sapiens
ucuucccaucaauauccuaaaugugggggagggcccagagaauggcacccaagagccugcggg

SEQ ID NO: 122110 - RNA, 63 nt, Homo Sapiens
aguccuucacacucacacuacucuguuccucuucccagagacaucgauucacuucaaagagcu

SEQ ID NO: 122111 - RNA, 63 nt, Homo Sapiens
guaucguggcaccguggcgcccgccccgcuucccccagagacucuguggcugcggccgggagc

SEQ ID NO: 122112 - RNA, 63 nt, Homo Sapiens
cuaaccaccaugccuacuugaagcucaagagaucccagagauuacaccaaugcugcuauccgc

SEQ ID NO: 122113 - RNA, 63 nt, Homo Sapiens
ucaucagagcuccucuguccccgcuuugagucccccagagaugaaaauaccagaaaaugaggg

SEQ ID NO: 122114 - RNA, 63 nt, Homo Sapiens
gaauagugcuguuuccuauuggcuggggcagcucccagagaauuagacuguggcccagaauag

SEQ ID NO: 122115 - RNA, 63 nt, Homo Sapiens
ccucagucccucccuccuggccauacccccugccccagagaagccugcuauccagccgcaaau

SEQ ID NO: 122116 - RNA, 63 nt, Homo Sapiens
cccugccaacuuuccagacuccuuccugggcagcccagagagacuucccaggacccuggguca

SEQ ID NO: 122117 - RNA, 63 nt, Homo Sapiens
auucgugggcugagggcaauuucuguaaauagucccagagagauccguggguuuccccuuuga

SEQ ID NO: 122118 - RNA, 63 nt, Homo Sapiens
gucuggccuugcccaaggcccuccuuucugcuucccagagaggccaggaggcaggggaaaaau

SEQ ID NO: 122119 - RNA, 63 nt, Homo Sapiens
uggacuuggcuggcuugcagcuccaggccccggcccagagauugagguaacgaggagggcgga

SEQ ID NO: 122120 - RNA, 63 nt, Homo Sapiens
uuguagauccuuagagguccggaauccuggcagcccagagacuuauuucccauuugugccaga

SEQ ID NO: 122121 - RNA, 63 nt, Homo Sapiens
ucccugccccuccaggaccucuccgagccugcccccagagacguagcugccggccucuggagg

SEQ ID NO: 122122 - RNA, 63 nt, Homo Sapiens
uauugcauugagcagugggguuaccugacggaccccagagaccaugagauuuacuaaguugac

SEQ ID NO: 122123 - RNA, 63 nt, Homo Sapiens
acccuuuuacucuggggagaaguacugccaagucccagagaaaauuguuaguccgggaccuuc

SEQ ID NO: 122124 - RNA, 63 nt, Homo Sapiens
agcuucagugacaaacauaucucugacguugaucccagagagcaucuuuuccagaguaugcaa

SEQ ID NO: 122125 - RNA, 63 nt, Homo Sapiens
cccaagccaaaaaccuuagccugcagguuggaccccagagauuagacccauguaaauaccaga

SEQ ID NO: 122126 - RNA, 63 nt, Homo Sapiens
agggagugggugggcaggggacaugugaggguccccagagagaccuggggggaggcaggaggc

SEQ ID NO: 122127 - RNA, 63 nt, Homo Sapiens
uaaguaauuuauauaagaaaugaaggcugucugcccagagaaagugcuauuagugcaauaagg

SEQ ID NO: 122128 - RNA, 63 nt, Homo Sapiens
ccuuaaccuuuguugguuuuaaacccuuauuuucccagagaugaaaucuggucuagcugggug

SEQ ID NO: 122129 - RNA, 63 nt, Homo Sapiens
cccugcugacugcgccugucuucucccucugaccccagagaaaggggcuguggucagcuggga

SEQ ID NO: 122130 - RNA, 63 nt, Homo Sapiens
gcccgggacccccgucuccaggggugccccagacccagagauuagccucccacuucggcgcag

SEQ ID NO: 122131 - RNA, 63 nt, Homo Sapiens
aucuccacccaucucuacaucugggcacagcaacccagagauggccaaaagcauucaagccug

SEQ ID NO: 122132 - RNA, 63 nt, Homo Sapiens
agauggccuucuuugucaucuucacucuccacccccagagaggagucagagccauaacucaau

SEQ ID NO: 122133 - RNA, 63 nt, Homo Sapiens
gguuugacuuauucuucguaucauuagaagaaccccagagauagcauuccucuauuuuauuuu

SEQ ID NO: 122134 - RNA, 63 nt, Homo Sapiens
aggaggaggagggagaaauggccaccacaucaccccagagaaauuucuggaaucugauugagu

SEQ ID NO: 122135 - RNA, 63 nt, Homo Sapiens
gccacggugggagcugcgccuuggagcaacagucccagagaggccuacucacauuuccuuggg

SEQ ID NO: 122136 - RNA, 63 nt, Homo Sapiens
acacgaugcguauuuuaguucuuugguauacgacccagagauacuguaauaucuuacuaaggc

SEQ ID NO: 122137 - RNA, 63 nt, Homo Sapiens
cuaaaagccacuggcagcacguaaaacaacugacccagagaagguaggaaggggaguaauaau

SEQ ID NO: 122138 - RNA, 63 nt, Homo Sapiens
auacgaccuguguaaggucagggacaaaugaggcccagagagacagcuccuucucuuuucuca

SEQ ID NO: 122139 - RNA, 63 nt, Homo Sapiens
ggaaaauccucuggcuggcuuuuccacaagauucccagagacaggugccccaaaaugcaagau

SEQ ID NO: 122140 - RNA, 63 nt, Homo Sapiens
aaucagacuucacacugcaaaguucccugaaaacccagagaggguccuugcaccugcauccgu

SEQ ID NO: 122141 - RNA, 63 nt, Homo Sapiens
ccuccaccgcugccuaagugaggcagggccuugcccagagauggggcagagggcagaggcugg

SEQ ID NO: 122142 - RNA, 63 nt, Homo Sapiens
gcccccacaagcuccucagggacccagaucauccccagagagaaguuguggcucuuugucuag

SEQ ID NO: 122143 - RNA, 63 nt, Homo Sapiens
agcccgaacacccgcaucccccuaagccuaggccccagagaucggggcccuggcuauuuggga

SEQ ID NO: 122144 - RNA, 63 nt, Homo Sapiens
ugacaguauuagggagugaagcucuuugggcuccccagagaccgacccucuuggcuuucccgu

SEQ ID NO: 122145 - RNA, 63 nt, Homo Sapiens
aaccagcuccacggcuccugcagacagcugcugcccagagaagaaguacugagagcccagccc

SEQ ID NO: 122146 - RNA, 63 nt, Homo Sapiens
ggggagcccacuguccuggggcccucccuguuccccagagaaacucagccuggccagacacag

SEQ ID NO: 122147 - RNA, 63 nt, Homo Sapiens
uacuugaagggccagagccacuccucuccccagcccagagacaugcugacggccagggagaag

SEQ ID NO: 122148 - RNA, 63 nt, Homo Sapiens
gcuccuugggaugaagagggccuccaucccuuccccagagaugccagccuggccuguggcugc

SEQ ID NO: 122149 - RNA, 63 nt, Homo Sapiens
cuacucggccaaaccuagcccauucccacuugccccagagaagcaacucccccccaacaaugc

SEQ ID NO: 122150 - RNA, 63 nt, Homo Sapiens
cucaaagcagccuuuuguccccugaagagcucacccagagagggcccuucugggguccugguu

SEQ ID NO: 122151 - RNA, 63 nt, Homo Sapiens
ugccuaguccugugugccuuugguuuggaggcucccagagacgcuuggaccucuuugauucug

SEQ ID NO: 122152 - RNA, 63 nt, Homo Sapiens
aggccaggaaggcccgagauugacccuuaucuucccagagacccucuccacccagcccgcucc

SEQ ID NO: 122153 - RNA, 63 nt, Homo Sapiens
auucucaucagcacuuuuguaagccaaguaaagcccagagaaggugccagaauuaagugaguc

SEQ ID NO: 122154 - RNA, 63 nt, Homo Sapiens
auuuggcaguacaaaugagucugaguguaauagcccagagauuuauauauaguugaaugucua

SEQ ID NO: 122155 - RNA, 63 nt, Homo Sapiens
ggaaacagacuuaucauuauugauuugagguuucccagagauauaguucacaguuaauuguug

SEQ ID NO: 122156 - RNA, 63 nt, Homo Sapiens
ugcuuguccagauuucacauuggcuuuguaucgcccagagagggauaggcacacgaggaugag

SEQ ID NO: 122157 - RNA, 63 nt, Homo Sapiens
auaucaauucauauuguaguuguuagcauucuacccagagauaaguaaaggagaaaauaaaau

SEQ ID NO: 122158 - RNA, 63 nt, Homo Sapiens
aauguuuguuuauaucacuguuaauuuucuacccccagagauauuuucauucuuguauuauaa

SEQ ID NO: 122159 - RNA, 63 nt, Homo Sapiens
accuguccugcccuucuuagcuugaagggaaaccccagagacucuucugucagggaaaacuag

SEQ ID NO: 122160 - RNA, 63 nt, Homo Sapiens
aucucagcucuccuaaucccaucacuuccccagcccagagaagacauuccaacccugucugau

SEQ ID NO: 122161 - RNA, 63 nt, Homo Sapiens
ugguaagaagccaaauauuuaagcucacuucuucccagagagaggaagcucugcucaggccuc

SEQ ID NO: 122162 - RNA, 63 nt, Homo Sapiens
uaucucuaaggccaauaaggauaacauuaucuacccagagaguuuagaagaaaaguaggaguc

SEQ ID NO: 122163 - RNA, 63 nt, Homo Sapiens
ucuucaccucccugcaaaccuaccagugaggcucccagagacgcagcugucucagugccaggg

SEQ ID NO: 122164 - RNA, 63 nt, Homo Sapiens
ugauggcuuugucccaucauagggggguguccccccagagacaaagcugcagagcacauucca

SEQ ID NO: 122165 - RNA, 63 nt, Homo Sapiens
cuuuuaaggacgcuuaugaucacauugcgccuacccagagaacccaggucgucuuucuauuuu

SEQ ID NO: 122166 - RNA, 63 nt, Homo Sapiens
gccuggaaauuauaaaucucugggcauuccuuccccagagagguugccuucccuuuugcccuu

SEQ ID NO: 122167 - RNA, 63 nt, Homo Sapiens
cuacccagugaaacucccaccugaaggcuccuacccagagauuuaaauaucaguucuguuuau

SEQ ID NO: 122168 - RNA, 63 nt, Homo Sapiens
uuggaguguaggauucccuccucaagggugggccccagagaguucuccagcccugcaugccgu

SEQ ID NO: 122169 - RNA, 63 nt, Homo Sapiens
uggcagauugugacaaucucugguucugugauucccagagagcgccauccuaaggggacauga

SEQ ID NO: 122170 - RNA, 63 nt, Homo Sapiens
cccgaguucccccagcccuuggggugacuucaucccagagagauggggaccggccaggaagga

SEQ ID NO: 122171 - RNA, 63 nt, Homo Sapiens
auguggcaggcaguggggccaggcuuccgggagcccagagagcaggggaggagcgacaccucc

SEQ ID NO: 122172 - RNA, 63 nt, Homo Sapiens
uguggcccacuugugggagucuccuguccaccucccagagacggccacccagcgggucuggcu

SEQ ID NO: 122173 - RNA, 63 nt, Homo Sapiens
accgccaccugccggccucgagaggggccgaugcccagagacacagcccccacggacaaaacc

SEQ ID NO: 122174 - RNA, 63 nt, Homo Sapiens
ugugagucuucucgaaggaggguugacucagaacccagagacaauacaaaaccccucacuucc

SEQ ID NO: 122175 - RNA, 63 nt, Homo Sapiens
uacucaucccuuaacuucucccuuaccagugaccccagagacagagccaggacaggagugggg

SEQ ID NO: 122176 - RNA, 63 nt, Homo Sapiens
aauacugccuuuggaauaugacagaaucaauagcccagagagcuuagucaaagacgauaucac

SEQ ID NO: 122177 - RNA, 63 nt, Homo Sapiens
caucagcaagagagagcagcuggaacagcaggucccagagaacuacuucuaugugccagaccu

SEQ ID NO: 122178 - RNA, 63 nt, Homo Sapiens
ugaaggagcaccuggccuuaacagcuuggcucucccagagaggccuggggauccagcggaugg

SEQ ID NO: 122179 - RNA, 63 nt, Homo Sapiens
gacuggagagugaggaggagcaguagcuacaggcccagagaugggagcgccuggaagcagaac

SEQ ID NO: 122180 - RNA, 63 nt, Homo Sapiens
gggagugguggcucacgccuucaagagaacccacccagagacucuaacaggaagguguccagu

SEQ ID NO: 122181 - RNA, 63 nt, Homo Sapiens
gagaugcuuaacaaaaaaaaggaaacagcucaucccagagaaggccgagccagacugugacca

SEQ ID NO: 122182 - RNA, 63 nt, Homo Sapiens
uggggucagccuuaaguagggccacugugacaacccagagaccuguggccguagagggaaaca

SEQ ID NO: 122183 - RNA, 63 nt, Homo Sapiens
cggagcccugcuugcuguauagccuucuggccacccagagagcgggcuuuaauguguaggaaa

SEQ ID NO: 122184 - RNA, 63 nt, Homo Sapiens
uugaccaaguuacauauucuauuugccuuucuccccagagagcuauggggagguuugaugagc

SEQ ID NO: 122185 - RNA, 63 nt, Homo Sapiens
uuguggacuuggugcuagucgaagcucauuucucccagagauuuccacucccuccgcugccau

SEQ ID NO: 122186 - RNA, 63 nt, Homo Sapiens
cagccacaagcuugcccgcccuggcucccucugcccagagacuauggaguaaggcauucagga

SEQ ID NO: 122187 - RNA, 63 nt, Homo Sapiens
cugcacagucggugccugggaggcacguagaggcccagagagucccuggggguucugcucuga

SEQ ID NO: 122188 - RNA, 63 nt, Homo Sapiens
cccugcagagccaauggugcacauugguuuaagcccagagauccugcuugagcccuggacuca

SEQ ID NO: 122189 - RNA, 63 nt, Homo Sapiens
gucccacucaguccauagcagagaaugaaagggcccagagaggguggugaccucugccugaag

SEQ ID NO: 122190 - RNA, 63 nt, Homo Sapiens
gccacuucccucccagugccagucuccauccaccccagagaggaacaggcgggugggccaugu

SEQ ID NO: 122191 - RNA, 63 nt, Homo Sapiens
gaccccagccuggggaacacgcugcccgcacugcccagagagcagugcaaacaccacaacacg

SEQ ID NO: 122192 - RNA, 63 nt, Homo Sapiens
gcgagaagccaaggccagguucuggguguagggcccagagaagcagaacagcccagagcccca

SEQ ID NO: 122193 - RNA, 63 nt, Homo Sapiens
ugcacugugaccucuggcuuccccagcagcuuucccagagaggcagaggggccuuccacagcc

SEQ ID NO: 122194 - RNA, 63 nt, Homo Sapiens
gacuccccagcccagcaccccuuccucgugggucccagagaccucaucagccuugggauagca

SEQ ID NO: 122195 - RNA, 63 nt, Homo Sapiens
ucaggacccaguccaggccuucuacgggcuaggcccagagacuuggguugcuggucccccuuc

SEQ ID NO: 122196 - RNA, 62 nt, Homo Sapiens
cagcccgcuuuggucugugagcugaggcuguccccagagaggauggcagcagguauuggguc

SEQ ID NO: 122197 - RNA, 63 nt, Homo Sapiens
ucacaguucacauucagcucagcagagcaagaccccagagaugcuuagagacaggacaccugg

SEQ ID NO: 122198 - RNA, 63 nt, Homo Sapiens
ccccgacguagcugccccccuggggggccacagcccagagaaccagccuaggaacacucggga

SEQ ID NO: 122199 - RNA, 63 nt, Homo Sapiens
ggcuccaguguggggugaggcagugagguuaggcccagagagcuggaguuggcucagaugaaa

SEQ ID NO: 122200 - RNA, 63 nt, Homo Sapiens
aggcaggggcaucugucuguugcacguagguuccccagagagccgagggccaggcagaauggc

SEQ ID NO: 122201 - RNA, 63 nt, Homo Sapiens
caaaaagguauaacuuuaacugaggcggauuuccccagagaaauuaauuuauugggaaugagc

SEQ ID NO: 122202 - RNA, 63 nt, Homo Sapiens
aagggucaaccuggaggcagggaaaccccaagacccagagaggcagaucucaugugcuacgaa

SEQ ID NO: 122203 - RNA, 63 nt, Homo Sapiens
uacagauugcccuccccggcaucacuacuccuccccagagacaacaccgcaucaguccccauc

SEQ ID NO: 122204 - RNA, 63 nt, Homo Sapiens
cuccaugaacugugcucccacacccaggcccaccccagagaccgggcagagggacaggucaga

SEQ ID NO: 122205 - RNA, 62 nt, Homo Sapiens
aaaaaaaaaaaaaaaaaaaaccuagcgugacuacccagagaccugccuccuccccugccagc

SEQ ID NO: 122206 - RNA, 63 nt, Homo Sapiens
ugggcugggcccuaugggauccaauaauaaagccccagagaacccaaaugucaggguguuugc

SEQ ID NO: 122207 - RNA, 63 nt, Homo Sapiens
augcauuuagauuuauauuucuugagcugugugcccagagaucaggucaucucaaggcugaua

SEQ ID NO: 122208 - RNA, 63 nt, Homo Sapiens
agccugagcaccguguuacccaaggccagagggcccagagagagagcccacuguaucugggcc

SEQ ID NO: 122209 - RNA, 63 nt, Homo Sapiens
cccucauccuuccucugggagcugcccucaagccccagagagccuucugaggacacaaggugg

SEQ ID NO: 122210 - RNA, 63 nt, Homo Sapiens
ccauagucgucaaagcuuuguaaggguccaagucccagagaauacucgcaacaacuuaauuuc

SEQ ID NO: 122211 - RNA, 63 nt, Homo Sapiens
gcauaauuccgaaacaaaaccuaaaguuuucuucccagagagaccacuuguggaaaaaaagug

SEQ ID NO: 122212 - RNA, 63 nt, Homo Sapiens
cucugagcuggugggcaggauggcuggguggcccccagagaagcacagaccugagaugggguc

SEQ ID NO: 122213 - RNA, 63 nt, Homo Sapiens
gagccaagggcacuuugcugccaccgcugcauucccagagaucaagcagcccggugccguggc

SEQ ID NO: 122214 - RNA, 63 nt, Homo Sapiens
acaggaaacagcaaacaguggggugaucugcagcccagagaccuucaaaugcgaacacuauaa

SEQ ID NO: 122215 - RNA, 63 nt, Homo Sapiens
uaguuggauugguacauucacugcugccagguacccagagaugucaucucucuccagguagag

SEQ ID NO: 122216 - RNA, 63 nt, Homo Sapiens
gcaggggugggagagccagcucucucuacccggcccagagaccccuuccuuuccucugcagca

SEQ ID NO: 122217 - RNA, 63 nt, Homo Sapiens
agucucagaugaccacggguuuaaccuucuuaucccagagacacccaauucuagagcuuuaug

SEQ ID NO: 122218 - RNA, 63 nt, Homo Sapiens
cccuuugaccacaucgcucuaggauaacuggcacccagagaaaaggacuccucagaaaaaaca

SEQ ID NO: 122219 - RNA, 63 nt, Homo Sapiens
ggcccgaugacuuaaagggaaaaauaauucauucccagagaugagucagaacagucuccucaa

SEQ ID NO: 122220 - RNA, 63 nt, Homo Sapiens
ugugcuugggcuaugguggccauaaacccugagcccagagagcuugggucacugucaccugag

SEQ ID NO: 122221 - RNA, 63 nt, Homo Sapiens
acuaagguggcuuucccacuccuggcccacagccccagagagccugucugugcauccugaacc

SEQ ID NO: 122222 - RNA, 63 nt, Homo Sapiens
cggcuuccagggagaccuccccgcccagcagcccccagagacacaacaaccuaccuuccagcc

SEQ ID NO: 122223 - RNA, 63 nt, Homo Sapiens
agguccauccccagcaaauguuuuggagguccccccagagagcagagugggccauggcagaag

SEQ ID NO: 122224 - RNA, 63 nt, Homo Sapiens
guccuaaaaauaggggccguuuucuuacacacccccagagagaggagggacugucacacuggu

SEQ ID NO: 122225 - RNA, 50 nt, Homo Sapiens
ggagaggaguuccuuacuaacccagagacuucaguguccugaaagauucc

SEQ ID NO: 122226 - RNA, 63 nt, Homo Sapiens
uguguuugcuuguuugcccaccuuuggcugauacccagagaaccugggcacuugcugccugau

SEQ ID NO: 122227 - RNA, 63 nt, Homo Sapiens
uuggucuggggcauuuuccucuccuuaucuugccccagagacaauucaagauuucuauauggg

SEQ ID NO: 122228 - RNA, 63 nt, Homo Sapiens
cuuucuucuguccucagcuugagaucuucuuagcccagagagcaguggaguugagugaggagg

SEQ ID NO: 122229 - RNA, 63 nt, Homo Sapiens
ccucacuauuggcagaaaagaccccauuuaaaacccagagaacacuggagggggaugcucuag

SEQ ID NO: 122230 - RNA, 63 nt, Homo Sapiens
accagggaugguacuagggggaagugacaaggccccagagacucagagggaggaaucgaggaa

SEQ ID NO: 122231 - RNA, 63 nt, Homo Sapiens
cucacucaccacuaccagccagccucagaaggccccagagagacccugcaagaccacggaggg

SEQ ID NO: 122232 - RNA, 63 nt, Homo Sapiens
aggguuagggaugucuccacccugauggggugucccagagacauuuucccauggcaguccucc

SEQ ID NO: 122233 - RNA, 63 nt, Homo Sapiens
ggucggggcaucuggccuggccagugcccugaucccagagagcccgaggaggugucucaggcu

SEQ ID NO: 122234 - RNA, 63 nt, Homo Sapiens
ggagcagcagcaggacagacccccacgaggccccccagagaggaggaagaucccacggaggaa

SEQ ID NO: 122235 - RNA, 63 nt, Homo Sapiens
cugccugagggacaacagacaucagaacaaacccccagagagaaacagucaaaaucagggccc

SEQ ID NO: 122236 - RNA, 63 nt, Homo Sapiens
caagaaaaugcuucacucaacaguccucaugugcccagagauguuuauagaacuguuugaauu

SEQ ID NO: 122237 - RNA, 63 nt, Homo Sapiens
cccguggccccugugccuguucggugggggugucccagagaagccuggcaccaguacccccgu

SEQ ID NO: 122238 - RNA, 63 nt, Homo Sapiens
cggggcccccccacccccaaagcuggcagcauacccagagaucgggggcagccaagaagccgg

SEQ ID NO: 122239 - RNA, 63 nt, Homo Sapiens
gccccaccuucuucaucccucugccugcaccaccccagagaagaaccuaccuugcuuugggag

SEQ ID NO: 122240 - RNA, 63 nt, Homo Sapiens
uccuugaggagaacaagugcacggccgcacccucccagagaacgcaucgagcuagcucccugc

SEQ ID NO: 122241 - RNA, 63 nt, Homo Sapiens
auuggcuuaugccagauaccgggguaccuagaacccagagaacugggggugggggaggggaga

SEQ ID NO: 122242 - RNA, 63 nt, Homo Sapiens
gcuguccucucauugggugacaggacuauugagcccagagagacggggaugcuugccccucuc

SEQ ID NO: 122243 - RNA, 63 nt, Homo Sapiens
cuguccuuccccucauccacaugaccugcagggcccagagacacccucuaggucugggcagcc

SEQ ID NO: 122244 - RNA, 63 nt, Homo Sapiens
uagggcuggagggacagggaugcugacaggagacccagagagcguugguuuaggcauccugug

SEQ ID NO: 122245 - RNA, 63 nt, Homo Sapiens
ucucugaugugccagugggccuuccuaugcucacccagagaacuccuuccugggggucuguuc

SEQ ID NO: 122246 - RNA, 63 nt, Homo Sapiens
cuucaccagcaccugccucuucccugcccgucucccagagaugauccaggcucguagagucac

SEQ ID NO: 122247 - RNA, 63 nt, Homo Sapiens
ggcguccuggugaggacaagccucuucucugggcccagagagacccagccccuaccuugagac

SEQ ID NO: 122248 - RNA, 63 nt, Homo Sapiens
agcucaugugucuaaagugaaaaagcuguauggcccagagaggaagaagauccuaucaugaau

SEQ ID NO: 122249 - RNA, 63 nt, Homo Sapiens
ggacugggagggcccacuucggugggaucugugcccagagaugagcagacuggugagcagacu

SEQ ID NO: 122250 - RNA, 63 nt, Homo Sapiens
gcaggcagccacgcccugcaagauaggcaggaccccagagaggacugaccccugccagggcac

SEQ ID NO: 122251 - RNA, 63 nt, Homo Sapiens
gcccaggaaguccccgugguagagcaccggccucccagagaaagaagacccucagauguggcc

SEQ ID NO: 122252 - RNA, 63 nt, Homo Sapiens
cagaggaaauaaaguuuaauucccugcugacugcccagagacuuacugccacuucgccuuaca

SEQ ID NO: 122253 - RNA, 63 nt, Homo Sapiens
agcaugucuuccuuuaccucaaggccgagccagcccagagaggaagauagcaagcuaccuucc

SEQ ID NO: 122254 - RNA, 63 nt, Homo Sapiens
acccaguucuagguacugucgggaugcccuugccccagagagaagucuaggagggggauaaau

SEQ ID NO: 122255 - RNA, 63 nt, Homo Sapiens
uggcagggcucagagaagcaaacuccccuacagcccagagaugggucagagguggggacagag

SEQ ID NO: 122256 - RNA, 63 nt, Homo Sapiens
ggcccagagguuuacaaguuggcucuccuagugcccagagacacgaaggggacggccggcggg

SEQ ID NO: 122257 - RNA, 63 nt, Homo Sapiens
ucucccuacuuuuucucacuggccucguuuugacccagagaaagccuauggaaguuaugcagu

SEQ ID NO: 122258 - RNA, 63 nt, Homo Sapiens
ggggccgcuccaggccccacagagcaggagacccccagagaaagccggggcuggcaggaggcg

SEQ ID NO: 122259 - RNA, 63 nt, Homo Sapiens
gccucaacugacagcugaggaaaggcaauuaggcccagagaggcagagacacucgcuuaagau

SEQ ID NO: 122260 - RNA, 63 nt, Homo Sapiens
ggccacgcccagcuuccuccccccgacuccccccccagagacacggucccaccauguuaccca

SEQ ID NO: 122261 - RNA, 63 nt, Homo Sapiens
ggaccacaugagccuucuccgaaggcucauguucccagagaaguucucaguggcaaaaccuag

SEQ ID NO: 122262 - RNA, 63 nt, Homo Sapiens
ugcauugcuuucuccugguuaagggaugagauucccagagaccgcagagcauuuuccuuaugg

SEQ ID NO: 122263 - RNA, 63 nt, Homo Sapiens
cgucacaccaguguuaugccgaugugugagauucccagagagucuucggugcuaggaaagagu

SEQ ID NO: 122264 - RNA, 63 nt, Homo Sapiens
ccucagaucaguauugugcaacagaagacuggccccagagagacaaaaggagaaagauaaaau

SEQ ID NO: 122265 - RNA, 63 nt, Homo Sapiens
uaguuuauauaagaauugcuacuauccuguagacccagagacaguuugguuugaauuauuagu

SEQ ID NO: 122266 - RNA, 63 nt, Homo Sapiens
gaacggcaaucuuuccacacggcugagacacagcccagagacuugugcaaagcaguauguaca

SEQ ID NO: 122267 - RNA, 63 nt, Homo Sapiens
gugugugacgaggcccccgauguucuugauuuucccagagaagcaaauaaacagcgugaacag

SEQ ID NO: 122268 - RNA, 63 nt, Homo Sapiens
accucucccccaaggccacugcgcucuugggaccccagagaaaacccggagcaagcaggagug

SEQ ID NO: 122269 - RNA, 63 nt, Homo Sapiens
cuggcccauguggagcuggcaugggggacacagcccagagacagagaagcuuaugaggaagug

SEQ ID NO: 122270 - RNA, 63 nt, Homo Sapiens
acacaaagcucuucaggcagcugauagauuucccccagagagcuauucaaggacuuccuaagg

SEQ ID NO: 122271 - RNA, 63 nt, Homo Sapiens
aacauggaagaugaaaggggaggggaugucaggcccagagaagcaaguggcuuucaacacaca

SEQ ID NO: 122272 - RNA, 63 nt, Homo Sapiens
caccccauucccgcagugggagcaaacugcaugcccagagacccagcggacacacgcgguuug

SEQ ID NO: 122273 - RNA, 63 nt, Homo Sapiens
cccccucccaaacugugacugguauuuauuggacccagagaaccgggccgggcacagcguggc

SEQ ID NO: 122274 - RNA, 63 nt, Homo Sapiens
cuguauggacccuuccugccauuuguauuuugucccagagagaaaggcucuuuggggggcccc

SEQ ID NO: 122275 - RNA, 63 nt, Homo Sapiens
ccuccucuggagccuucgccuggggagacagaacccagagagaaacaagagaguccagaaguc

SEQ ID NO: 122276 - RNA, 63 nt, Homo Sapiens
ccuugaaggagccccccacauccuccccuacaucccagagaugccaccacuugugucuccaca

SEQ ID NO: 122277 - RNA, 53 nt, Homo Sapiens
auggcgagagcgaccugugaggccccagagaccugacccaacacccccgacgg

SEQ ID NO: 122278 - RNA, 63 nt, Homo Sapiens
agggaacagcaugcccccuccggggucaugccacccagagacugucgcugucuauggccccaa

SEQ ID NO: 122279 - RNA, 63 nt, Homo Sapiens
cgucugggguccaucucccuccugagcuagaaacccagagauggaggcugucuugcuauggca

SEQ ID NO: 122280 - RNA, 63 nt, Homo Sapiens
cugaguaguggggauccagagaggacccccgcccccagagacuugguuuuggcuccagccuuc

SEQ ID NO: 122281 - RNA, 63 nt, Homo Sapiens
ggccaccagaaggugacacccccagaaucccuccccagagacugcaccagcgcagccagcagg

SEQ ID NO: 122282 - RNA, 63 nt, Homo Sapiens
acucaagcaauagggccccgccauaggaagacccccagagagagggucagcaggggggccccg

SEQ ID NO: 122283 - RNA, 63 nt, Homo Sapiens
aucagaacaacggaggauagcuuugugccuggacccagagagugugggacuccccgcuucauc

SEQ ID NO: 122284 - RNA, 63 nt, Homo Sapiens
ccuuggccccaagugaacucaagauuuggcagccccagagaugccaacugcagcaugcccacc

SEQ ID NO: 122285 - RNA, 63 nt, Homo Sapiens
cgguuuaaccagggcucuguaagaccacucccacccagagacuuguguggccugguguggccu

SEQ ID NO: 122286 - RNA, 63 nt, Homo Sapiens
ucaucaaaccagguguccuuggcauuguguccacccagagagcucacuguuuucuuuucuuuu

SEQ ID NO: 122287 - RNA, 63 nt, Homo Sapiens
uuuucccauucagcugugagugcccaacccuaucccagagaccuugaugcuuggccucccaau

SEQ ID NO: 122288 - RNA, 63 nt, Homo Sapiens
uuuuccuguaaguaauuaagaagacuaaguagccccagagauaagaccuccucggaucauugu

SEQ ID NO: 122289 - RNA, 63 nt, Homo Sapiens
gcccaagcaguccucacuuugcuuaacaguggccccagagagcaggaguagugaugcugguga

SEQ ID NO: 122290 - RNA, 63 nt, Homo Sapiens
gggaugggaagaggcucuuugcaaacgaggguccccagagaagacuggcggggaccugauggg

SEQ ID NO: 122291 - RNA, 63 nt, Homo Sapiens
gaggagguggaacugauguaggggguggcacuccccagagacugcccucacgaggggacuggg

SEQ ID NO: 122292 - RNA, 63 nt, Homo Sapiens
cacugcuacccucuauuucccacucagggcugucccagagagaaggcagccgaacugaggauu

SEQ ID NO: 122293 - RNA, 63 nt, Homo Sapiens
ggugagagggaugcaggcauggguuggggguggcccagagaaacuuaugacagcuguacacaa

SEQ ID NO: 122294 - RNA, 63 nt, Homo Sapiens
agggccugcccgggaaggugccaccaccugugccccagagagccugccccacccacuuccucc

SEQ ID NO: 122295 - RNA, 63 nt, Homo Sapiens
aauccagccccgaaugucagaggacggccccgucccagagaacagcagcacccugcagugccc

SEQ ID NO: 122296 - RNA, 63 nt, Homo Sapiens
cccccugaggggugagcccuccccuccccagcucccagagagggaacacccaggccagggaca

SEQ ID NO: 122297 - RNA, 63 nt, Homo Sapiens
cacugugugcccccuggagcccaggacuuuguccccagagacccucuccccuuggugccuaac

SEQ ID NO: 122298 - RNA, 63 nt, Homo Sapiens
uuccacacugaaucucaccugcugggaccugcucccagagaccggcuguuggggacuuuaccu

SEQ ID NO: 122299 - RNA, 63 nt, Homo Sapiens
uugccacacugaaucucaccgcugggaccugcucccagagaccggcggucggggacuuuaccu

SEQ ID NO: 122300 - RNA, 63 nt, Homo Sapiens
uugccacacugaaugucaccgcugggaccugcucccagagaccggcuguuggggacuuuaccu

SEQ ID NO: 122301 - RNA, 63 nt, Homo Sapiens
gcauggaggcuccacgcaacucaaccaauggcacccagagaggcagggaauuaauucccccag

SEQ ID NO: 122302 - RNA, 63 nt, Homo Sapiens
cuacuagacugggucagcaaaguacccagugagcccagagaucugggacuuccugcucaucau

SEQ ID NO: 122303 - RNA, 63 nt, Homo Sapiens
cugggucuagaaagcggcucugggaugaggcuucccagagacccuggacagcaggagagggug

SEQ ID NO: 122304 - RNA, 63 nt, Homo Sapiens
uccaccucaacuucuggcugcauuggcccccaccccagagaccauaccacacauuucucaucu

SEQ ID NO: 122305 - RNA, 63 nt, Homo Sapiens
cacgcccgacgcagacccggccucuggaggguccccagagaccaggccaucagcccaccucca

SEQ ID NO: 122306 - RNA, 63 nt, Homo Sapiens
aaacuccccaaggugccugacugacaugaagcucccagagauaagucugugaaaugaaagucc

SEQ ID NO: 122307 - RNA, 63 nt, Homo Sapiens
aaacucccuaaaaugccugaagcucccgaaagucccagagaugugugcaccucccggaagugc

SEQ ID NO: 122308 - RNA, 63 nt, Homo Sapiens
aagcucccugagaugaaacuagcuuccaaaagucccagagaugugugcaccucccagaagugc

SEQ ID NO: 122309 - RNA, 63 nt, Homo Sapiens
cagagacccaaagggagagagaagagguggaaacccagagagaagaaagagacccagaaaaag

SEQ ID NO: 122310 - RNA, 63 nt, Homo Sapiens
uugagaauguucaucucuccacccucauuccuucccagagaugagcccugacacuccuuucag

SEQ ID NO: 122311 - RNA, 56 nt, Homo Sapiens
gcaauaaaacugacucucaagccccucccagagaugaggagauugggcggauuuga

SEQ ID NO: 122312 - RNA, 63 nt, Homo Sapiens
ucauuuagggcugaaacacuccagccauuauaucccagagagcaaaucuuuaguaggaauccu

SEQ ID NO: 122313 - RNA, 63 nt, Homo Sapiens
uugcuguaauuaucugcccuaaccuccagugaccccagagacuuguccuaggugucugcugug

SEQ ID NO: 122314 - RNA, 63 nt, Homo Sapiens
aaaccuuuagaacaucucugcuuuggagaaagacccagagaucaggcagaggugcagauucaa

SEQ ID NO: 122315 - RNA, 63 nt, Homo Sapiens
guucuggggccaaggccuacccaggggccucugcccagagaacucacaacccccucucugacc

SEQ ID NO: 122316 - RNA, 63 nt, Homo Sapiens
uuggcuuguaaaccuucgucucccucucuuuuacccagagacagcacauacgugugcacacgc

SEQ ID NO: 122317 - RNA, 63 nt, Homo Sapiens
ucugucacuugcucuuucacucucucucucauucccagagagccacgggggagggaucacccu

SEQ ID NO: 122318 - RNA, 63 nt, Homo Sapiens
agauaaggucaugggagaguggguggggacacacccagagacuggcuuugggauugggcacug

SEQ ID NO: 122319 - RNA, 63 nt, Homo Sapiens
uguauucccguuuuacagauaaggaaacugaggcccagagagcugaaguacugcacccagcau

SEQ ID NO: 122320 - RNA, 63 nt, Homo Sapiens
ccauucccaacuagacauuaccaaagugaccuacccagagauugcuucucauccccaguccca

SEQ ID NO: 122321 - RNA, 63 nt, Homo Sapiens
caugaaugggauuagugcccuuauauaaagagacccagagagcuccaucaccccuucugccau

SEQ ID NO: 122322 - RNA, 63 nt, Homo Sapiens
uucacaccuguaugauagucauggaaacugaagcccagagagguuaagaaauuugcuaggauc

SEQ ID NO: 122323 - RNA, 63 nt, Homo Sapiens
gggcccugcccaacuucaggcagaacagggaggcccagagauuacagauccccuccuguaagu

SEQ ID NO: 122324 - RNA, 63 nt, Homo Sapiens
uacaguuugacacugaucugguccaugaggcugcccagagaaagcacugcuucuguaugucuc

SEQ ID NO: 122325 - RNA, 63 nt, Homo Sapiens
augcugcugcaacuggaagaagcuggaaccagucccagagaggcucggccuggaaacaguccc

SEQ ID NO: 122326 - RNA, 63 nt, Homo Sapiens
gccugggagucgggcggccccggucaggcccugcccagagagcuccugguuccugaacugagc

SEQ ID NO: 122327 - RNA, 63 nt, Homo Sapiens
uagcccccuacuguggcccccauagccccauaacccagagagggagcuggacuucagggagcc

SEQ ID NO: 122328 - RNA, 63 nt, Homo Sapiens
ugcugccagcucucaacauagcaggccauaggacccagagaagaaucccagcguugcucaaag

SEQ ID NO: 122329 - RNA, 63 nt, Homo Sapiens
uagaauucuuuggcgggaaggguaugauggguucccagagacaagaagcccaaccuucuggcc

SEQ ID NO: 122330 - RNA, 62 nt, Homo Sapiens
augagcagguccaacucugauuauucucgaugcccagagaugcucaugcaccugugcacacu

SEQ ID NO: 122331 - RNA, 63 nt, Homo Sapiens
gucuguaccucaggggaugccccgcuguggucacccagagaaucacccuuccuggucuacaga

SEQ ID NO: 122332 - RNA, 63 nt, Homo Sapiens
cacauggggaguagacccugagccucauguuaccccagagagaaagaccugagugaccaguca

SEQ ID NO: 122333 - RNA, 63 nt, Homo Sapiens
ugcaaucuucuagcucuccaaacugcuaaacaucccagagauucugcucugaaaaauggggaa

SEQ ID NO: 122334 - RNA, 63 nt, Homo Sapiens
uugcugcugcggcccugucccaguaaggcacuacccagagagccagggcucagguggguggag

SEQ ID NO: 122335 - RNA, 63 nt, Homo Sapiens
gggcaagggcuuugggcaagagugcuagaagaccccagagagaccugggcugggcagagugac

SEQ ID NO: 122336 - RNA, 63 nt, Homo Sapiens
cuugacaccggucucugcugggccuaugcaguucccagagacuuugaaaaugcauguuccuca

SEQ ID NO: 122337 - RNA, 63 nt, Homo Sapiens
agcgcccuggucucuugagcggggcaaggagagcccagagagacuucaggagcucucuaccca

SEQ ID NO: 122338 - RNA, 63 nt, Homo Sapiens
aaggggcagcuuugcaaggacagcuacuccugccccagagaugccugcggcaccggguucagg

SEQ ID NO: 122339 - RNA, 63 nt, Homo Sapiens
ccaugggccaccugcucugucugccugaccuuacccagagaagcaacagggcaacuggaaccc

SEQ ID NO: 122340 - RNA, 63 nt, Homo Sapiens
uggcugugacccguccaaggaaggggaaaggaccccagagaagugguguccugcacggaauag

SEQ ID NO: 122341 - RNA, 63 nt, Homo Sapiens
cgcugugauuggcaggaggccacccccaggauucccagagagaccugggccucagccuccagg

SEQ ID NO: 122342 - RNA, 63 nt, Homo Sapiens
gcaggugugugggacagacuggggccaccaaaacccagagaugcuuuuccacagccacucacu

SEQ ID NO: 122343 - RNA, 63 nt, Homo Sapiens
gggucugcuggagucuccacgcaggccccccaacccagagacucuccagcacagcagagacca

SEQ ID NO: 122344 - RNA, 63 nt, Homo Sapiens
aaagccugcacaacccaaccucgcuuagggacccccagagaugcuggaaucgcuaggaggguu

SEQ ID NO: 122345 - RNA, 63 nt, Homo Sapiens
gugggcagggcaugcgcuccccuggcugagcaccccagagauucuccugcaccuuccucaugc

SEQ ID NO: 122346 - RNA, 63 nt, Homo Sapiens
agggagagaacacgcugugaaaacacagaagcucccagagaagccuucucagcuuuuaucucu

SEQ ID NO: 122347 - RNA, 63 nt, Homo Sapiens
cagaaaggcuggaguuauuauucaacucaaucucccagagaacucagaggcuacaguuucuac

SEQ ID NO: 122348 - RNA, 63 nt, Homo Sapiens
gagcugcucugccuuccagccaccucucacccacccagagaugacuauagugagcccaugcag

SEQ ID NO: 122349 - RNA, 63 nt, Homo Sapiens
acaaaaaagcccaacuugccccaggaggcuucucccagagaggaacaaaaucugagucuccag

SEQ ID NO: 122350 - RNA, 63 nt, Homo Sapiens
ggcuccacccacuagaugccaguggcacccccucccagagaugacaaacgaaaaugucucuag

SEQ ID NO: 122351 - RNA, 63 nt, Homo Sapiens
cagaagaggcucccaggcccaagcucugugugacccagagaaauaaagaugccucaguguggc

SEQ ID NO: 122352 - RNA, 63 nt, Homo Sapiens
ggccagcccccaaugguccccuuacggacaggucccagagauggacagaggcacccagggccc

SEQ ID NO: 122353 - RNA, 63 nt, Homo Sapiens
gacccguguccucagagcaccacacacugagcacccagagacagcgggccuggcagcgggccg

SEQ ID NO: 122354 - RNA, 63 nt, Homo Sapiens
cccaggucugcugcccaggaacccuccagaccucccagagagugaauaaagugugacuugcaa

SEQ ID NO: 122355 - RNA, 63 nt, Homo Sapiens
ucaccauggucuaaucccaagagggacucgucacccagagaccucaaaaggccccaggccuac

SEQ ID NO: 122356 - RNA, 63 nt, Homo Sapiens
cugaggagcaggugucccugagaacccaaacuucccagagaguaugugagaaccaaccaauga

SEQ ID NO: 122357 - RNA, 54 nt, Homo Sapiens
ucagccggaagagaaaaugaagaccccagagacauuuauuggggaguaggaugu

SEQ ID NO: 122358 - RNA, 63 nt, Homo Sapiens
cucuauauaaguaggggcagcuuagcccugaggcccagagaccugcuguccuuuuucuccuug

SEQ ID NO: 122359 - RNA, 63 nt, Homo Sapiens
cagaugcuaagcgcuucagagaggaggugucugcccagagauguggagcagaagcugggcccu

SEQ ID NO: 122360 - RNA, 63 nt, Homo Sapiens
uaaagaugccucaguguggcaagcucugugugacccagagaaacagaagaggcucccaggccc

SEQ ID NO: 122361 - RNA, 63 nt, Homo Sapiens
gcggcugagaaugagaacgccucuuucccuguucccagagaaucugaagauucagacaggaac

SEQ ID NO: 122362 - RNA, 63 nt, Homo Sapiens
aaaaagugacuugcccaagguuggacacaggaccccagagagggaaagggcucauuaagccuu

SEQ ID NO: 122363 - RNA, 63 nt, Homo Sapiens
aucugagaaccaaccaaugaagaacccaaacuucccagagagucugaggagcaggugucccug

SEQ ID NO: 122364 - RNA, 63 nt, Homo Sapiens
gacagcugcucaggcccuaaacucccugggcuucccagagagugccccugcucagucagcccc

SEQ ID NO: 122365 - RNA, 63 nt, Homo Sapiens
gugcccggagcuggccguguaagggcuaggccacccagagacuccaccuaugccacagugccu

SEQ ID NO: 122366 - RNA, 63 nt, Homo Sapiens
ggacuacucucuucaccccuaaaggggcucccucccagagaagcuuggccugaguaaacuugg

SEQ ID NO: 122367 - RNA, 63 nt, Homo Sapiens
agaggaggcuguugguaggaaagggacaagauucccagagagggugcuaaggggauggggaag

SEQ ID NO: 122368 - RNA, 63 nt, Homo Sapiens
ggguccuugggccuggcuucuaugucuugggaucccagagauucacccaccuaaagacaugua

SEQ ID NO: 122369 - RNA, 63 nt, Homo Sapiens
aaagugaugaggagacugaggacacaccuguaucccagagagccugggaaaaugaacguccag

SEQ ID NO: 122370 - RNA, 63 nt, Homo Sapiens
aaggccaggggucuuggugccacccgugacccacccagagagccaccuccugcggcagaacag

SEQ ID NO: 122371 - RNA, 63 nt, Homo Sapiens
uagguacaaugucuaucaggaaagcaaagcuuccccagagacgcucagcuuguauccauugac

SEQ ID NO: 122372 - RNA, 63 nt, Homo Sapiens
uguuaucuuaugcuugagguaggcacugguuugcccagagaauuuuuauuuuucccagaccac

SEQ ID NO: 122373 - RNA, 63 nt, Homo Sapiens
gaguggucgugagcuggucuuggggcacaauuacccagagauauauuuauuaacagccaaccu

SEQ ID NO: 122374 - RNA, 63 nt, Homo Sapiens
ggaacugaaauccuugagaguuccggggagaaacccagagaugccugauuucauuccucgaug

SEQ ID NO: 122375 - RNA, 63 nt, Homo Sapiens
cauuccacccuguuacuuauguagaaacugaggcccagagagggaagaugaccugccccaagu

SEQ ID NO: 122376 - RNA, 63 nt, Homo Sapiens
cucacuugcuucuuauccuuacacucccccagccccagagaaacugccacauacaccacaaaa

SEQ ID NO: 122377 - RNA, 63 nt, Homo Sapiens
uauaacccagacuaagguugaacaaccugcaugcccagagaaaacuauggcgacaaaggggaa

SEQ ID NO: 122378 - RNA, 63 nt, Homo Sapiens
agaaacuuauuauuggcuucuguuucauauggacccagagagccccaccaaaccuacgucaag

SEQ ID NO: 122379 - RNA, 63 nt, Homo Sapiens
cagaaacuagacauuagaauguugaggcaguuucccagagaaacaagcauauugccucaugga

SEQ ID NO: 122380 - RNA, 63 nt, Homo Sapiens
accugccuccccuccauagucuuguuggagaagcccagagagaaugggacuccaacuaaggga

SEQ ID NO: 122381 - RNA, 63 nt, Homo Sapiens
uguaauuugccugagaucaagaguaaauggaggcccagagaaagauauccucuucuuaaaaau

SEQ ID NO: 122382 - RNA, 63 nt, Homo Sapiens
ggggaauuguuccuguaaauuuuucuaaagagucccagagaauccccaaaauggaccuuuuuu

SEQ ID NO: 122383 - RNA, 63 nt, Homo Sapiens
cucccauccacccuucuccauucaaauugugaacccagagacaccagagcauccauggccaau

SEQ ID NO: 122384 - RNA, 63 nt, Homo Sapiens
gcuaugcugcuuuuccaauucaaugauucuugucccagagaggagguauaccuacagcagcua

SEQ ID NO: 122385 - RNA, 56 nt, Homo Sapiens
uauagacacuggaguacuggaaaggucccagagauaucagcuuucugaugaguuaa

SEQ ID NO: 122386 - RNA, 63 nt, Homo Sapiens
cagagguggguaggagguuaucccucgggcaggcccagagagcgaccgugaacaccugcuucc

SEQ ID NO: 122387 - RNA, 59 nt, Homo Sapiens
ccugacaaagcgugccacccaucugcaaucccagagaauaugaucucacugagcucuaa

SEQ ID NO: 122388 - RNA, 63 nt, Homo Sapiens
caucauguucucuuuuuguucauaggaaagauacccagagaccaaauaucugccaucaucugc

SEQ ID NO: 122389 - RNA, 63 nt, Homo Sapiens
ggaagggacuugaccgagguggggaaaugaaggcccagagaagauaaccuacuuacuccguaa

SEQ ID NO: 122390 - RNA, 63 nt, Homo Sapiens
uaugcugccacuucacauccaggcuuacaucuucccagagaaccugccaccugcccugcugcc

SEQ ID NO: 122391 - RNA, 63 nt, Homo Sapiens
ggguguccuggcccuuaguguggccaagcgugacccagagaugugaagccaaaaaugaagccg

SEQ ID NO: 122392 - RNA, 63 nt, Homo Sapiens
uacaagaugugggaaucagcuuacagaaaugaucccagagaccaaccaagggccuaauguuug

SEQ ID NO: 122393 - RNA, 63 nt, Homo Sapiens
aucugcaugauuggcauuaguuaccacagccugcccagagagaaacuaucuucucccaacauu

SEQ ID NO: 122394 - RNA, 64 nt, Homo Sapiens
gaaucacccucgcuccgucaggcgggacucgugucccagagaggaaggggcugcugaggucuga

SEQ ID NO: 122395 - RNA, 64 nt, Homo Sapiens
ccucccaguuuugcucugcccagcaguguuggugcccagagaugacaagggccagggagccugg

SEQ ID NO: 122396 - RNA, 64 nt, Homo Sapiens
cuccagacacuucacggaaggaagaucacauguccccagagaggcacccccaggcaagcucgag

SEQ ID NO: 122397 - RNA, 64 nt, Homo Sapiens
ugagggccucgccuggcugcagccugcgccaccgcccagagacccaagcugccuccccucuccu

SEQ ID NO: 122398 - RNA, 64 nt, Homo Sapiens
uggcucuccagaaccuucuaucccacagucaggccccagagagggcaggacaagccuugucccg

SEQ ID NO: 122399 - RNA, 64 nt, Homo Sapiens
uaagucaccagauauuuuguucccaucaguuuagcccagagauagacaguagaaugcaaauacc

SEQ ID NO: 122400 - RNA, 64 nt, Homo Sapiens
caccugcagguguaagggacgauuggaguuucuucccagagagucugucccagaaggacugugg

SEQ ID NO: 122401 - RNA, 64 nt, Homo Sapiens
cagcccucagcagcugcagaccgccccucaccaacccagagaaccugcuuuacuuugcccaggg

SEQ ID NO: 122402 - RNA, 64 nt, Homo Sapiens
caggggucagaggcccaggcccugacuucggcuucccagagaucucuccgccuuaguuaagagc

SEQ ID NO: 122403 - RNA, 64 nt, Homo Sapiens
uuccugucuguauuugaugcaggauuaaacacuucccagagaggauucuagucugguaaauaac

SEQ ID NO: 122404 - RNA, 64 nt, Homo Sapiens
ugccaguggauccccugcggucaggcugggcagccccagagagaggauguggaaagcacuuuuu

SEQ ID NO: 122405 - RNA, 64 nt, Homo Sapiens
ugcgugucgguguauauaggaaccauguacagagcccagagaagcccccuacauccccccggga

SEQ ID NO: 122406 - RNA, 64 nt, Homo Sapiens
uugacugcagaagaccaagaaccuguuccccaagcccagagauguccaccugggcuggacugcc

SEQ ID NO: 122407 - RNA, 64 nt, Homo Sapiens
uguguucucaggaagacugccuccaccaccgcuacccagagaaccucugcaucuggcauuucug

SEQ ID NO: 122408 - RNA, 64 nt, Homo Sapiens
agcagccagcaccaccuacacaggagucuucagacccagagaaggacggugccaagggccccag

SEQ ID NO: 122409 - RNA, 64 nt, Homo Sapiens
uuugguuugacacccagccucuucccuggcccuccccagagaacuuuggguaccuggugggucu

SEQ ID NO: 122410 - RNA, 64 nt, Homo Sapiens
caaccugcacacuugacaaguggagaaacagaagcccagagagagcacuggguuuguucaggac

SEQ ID NO: 122411 - RNA, 64 nt, Homo Sapiens
cuauucggauauucuguuuacacacccaugucaucccagagaggugaucacagggcagggacac

SEQ ID NO: 122412 - RNA, 64 nt, Homo Sapiens
uucccugacuccuggugcccucucccuuuguccccccagagagacauaugcccccagagagagc

SEQ ID NO: 122413 - RNA, 64 nt, Homo Sapiens
ccucucccuuuguccccccagagagacauaugcccccagagagagcaaaucgaagcgugggagg

SEQ ID NO: 122414 - RNA, 64 nt, Homo Sapiens
caugauuaggauuagugcccuuauuuaaaaaggccccagagagcuaacucacccuuccaccaua

SEQ ID NO: 122415 - RNA, 64 nt, Homo Sapiens
cccccaccucucacuuugcugugagcccgggaaccccagagaccacuccuguggagagcugagg

SEQ ID NO: 122416 - RNA, 64 nt, Homo Sapiens
agugagggccaggcccuucccggcugcgaggacgcccagagaccgcgggcgcugagcgcguugg

SEQ ID NO: 122417 - RNA, 64 nt, Homo Sapiens
ucccaauuccaucaccacugccaacaacuccucccccagagaucuggcuggagcccagaaaaag

SEQ ID NO: 122418 - RNA, 64 nt, Homo Sapiens
cuaagacuauguugguacuuggacuuguucgugccccagagaugggcaaagcugugcacuugca

SEQ ID NO: 122419 - RNA, 64 nt, Homo Sapiens
ugccaaaacugauuagcuaguggacagagauaugcccagagaugcauauguguauauuuuuaug

SEQ ID NO: 122420 - RNA, 64 nt, Homo Sapiens
gcucuuaucuaugaagacaucuucccagaguguccccagagacaugcaagucaugggucacacc

SEQ ID NO: 122421 - RNA, 55 nt, Homo Sapiens; identical to SEQ ID NO: 121818

SEQ ID NO: 122422 - RNA, 64 nt, Homo Sapiens
ccaccuccgcccugggcaggucccuucccuguuccccagagagcucagcccugggaagacacau

SEQ ID NO: 122423 - RNA, 64 nt, Homo Sapiens
gucccagggagccauccuagcuggucgccucugucccagagauggagcugccggucuuggcuuc

SEQ ID NO: 122424 - RNA, 64 nt, Homo Sapiens
gcuuuuccaacacauuuuaaacuucucuucuccacccagagaugaccaucacuauaaucaacga

SEQ ID NO: 122425 - RNA, 64 nt, Homo Sapiens
augagucuauggcaucaggucacgggucccaggccccagagaaguguuggcuuucccccagccg

SEQ ID NO: 122426 - RNA, 64 nt, Homo Sapiens
uuugcccacacacacuccuucagaauccugggcccccagagaccccuggggcugguggauuggg

SEQ ID NO: 122427 - RNA, 64 nt, Homo Sapiens
aggcagcuuggucuaguggaaggcuucucuugagcccagagacauugaccuucagcuccuaugc

SEQ ID NO: 122428 - RNA, 64 nt, Homo Sapiens
ccauuugccucucaacacucgcaggacaggaucccccagagaccaucugaaagucaggccugcu

SEQ ID NO: 122429 - RNA, 64 nt, Homo Sapiens
cccucugcagauaggcguggugcccugcuuuggucccagagagggguuucaggaggagggagac

SEQ ID NO: 122430 - RNA, 64 nt, Homo Sapiens
guggguggagcugccugcugacagccuggggcugcccagagacuagaaucagaguggggagggg

SEQ ID NO: 122431 - RNA, 64 nt, Homo Sapiens
auauacauucuuuaucuugauuugaucccuguuacccagagaauuccucuugcucaaaaaucug

SEQ ID NO: 122432 - RNA, 64 nt, Homo Sapiens
ggaacggcuugcucuucuuuaagcccaugaacuucccagagaguauaccuuaaacucccacugc

SEQ ID NO: 122433 - RNA, 64 nt, Homo Sapiens
cccaugagcugacauuuuaccucugauucucuuacccagagaugcgacccacugcagacacagg

SEQ ID NO: 122434 - RNA, 64 nt, Homo Sapiens
ccuuuaguguaaguagcuggucuagaugaugccccccagagaugccaucagguuaaagacuuca

SEQ ID NO: 122435 - RNA, 64 nt, Homo Sapiens
aauuuaguccauaugaacuaacacauacgugcuacccagagauuuaauauaauuuuauauuuac

SEQ ID NO: 122436 - RNA, 64 nt, Homo Sapiens
uaaauuccagaaggagggcacugacaggguuugccccagagaucuaacuacacagaggcacauc

SEQ ID NO: 122437 - RNA, 64 nt, Homo Sapiens
uuuaucuucuuccuuggcaucuguuguggucagccccagagaauuuugucuuuauccaccccca

SEQ ID NO: 122438 - RNA, 64 nt, Homo Sapiens
aggagcauccuuaccuccaagugcucuccuggcacccagagaaaauaagacugucauguaagag

SEQ ID NO: 122439 - RNA, 64 nt, Homo Sapiens
gugccccgggcgggccgcgcccccucggggcucccccagagacuagccaagcugccuuaacucg

SEQ ID NO: 122440 - RNA, 64 nt, Homo Sapiens
ugagggcuccuuccucaggauuuuaccuaggaggcccagagauguucugcgaucaguuaaccca

SEQ ID NO: 122441 - RNA, 64 nt, Homo Sapiens
uuaaacagaaacaguagcuggcuccaagagcuaccccagagaccaccccaucuauucucuguug

SEQ ID NO: 122442 - RNA, 64 nt, Homo Sapiens
cccagagcucucaagcuccuuuagcagugacauucccagagagcuauauauguagauauauauu

SEQ ID NO: 122443 - RNA, 64 nt, Homo Sapiens
ccuuccucagcucucuucuuguuucuucccagcacccagagaaugaaccccaguccugagcuug

SEQ ID NO: 122444 - RNA, 64 nt, Homo Sapiens
aucuguuucccuguguccuguaucuuccaggcagcccagagaagguuaucuaaaccuuuaaacc

SEQ ID NO: 122445 - RNA, 64 nt, Homo Sapiens
gugucuauauccuccuucuacaccauauguuccccccagagaaucuuugugugcaugggucagu

SEQ ID NO: 122446 - RNA, 64 nt, Homo Sapiens
agggugucuuccuagaacauuguucccaucugagcccagagauaccaggauagucuaagggagg

SEQ ID NO: 122447 - RNA, 64 nt, Homo Sapiens
gcgcagaugcuagcacaugcuguuuuguaaaguccccagagaaacacagcugaguuguugaguc

SEQ ID NO: 122448 - RNA, 64 nt, Homo Sapiens
cucauuuaguuagaaaauaauuauucauaugcuucccagagaaguuuagaaguacguuuuugca

SEQ ID NO: 122449 - RNA, 64 nt, Homo Sapiens
agagccucagcaagagaguugguucucacacuggcccagagaaagucacagccugacauggcca

SEQ ID NO: 122450 - RNA, 64 nt, Homo Sapiens
uuuaccuuucccaagcaucuccacagggaaccugcccagagagcaacuguccaagcucucagcc

SEQ ID NO: 122451 - RNA, 64 nt, Homo Sapiens
ucugcuccuuccugcucacagggccuauguccugcccagagaccaagugcacaucagcacuaug

SEQ ID NO: 122452 - RNA, 64 nt, Homo Sapiens
uuaacuaauauauccaugaucagauagaauuuggcccagagagggauaccaauauucuauuuug

SEQ ID NO: 122453 - RNA, 64 nt, Homo Sapiens
caaugggguccuucuguagguuaucagccuguggcccagagacaccaaucauguuaacucuucc

SEQ ID NO: 122454 - RNA, 64 nt, Homo Sapiens
cagaggggaagagggugcuaaauuccucuuugcacccagagacuuucugcacaaaacuuuuggg

SEQ ID NO: 122455 - RNA, 64 nt, Homo Sapiens
uuccaacucaguaggaccccugucucaugaugcccccagagaacggcaguaauugcauuuuauc

SEQ ID NO: 122456 - RNA, 64 nt, Homo Sapiens
gagcuguguccauggugugucaugaaggauguaccccagagaguaacaugagccacugggcaga

SEQ ID NO: 122457 - RNA, 64 nt, Homo Sapiens
ucccacauuccaaaagggggccugggaugcuagccccagagaugccagcccuucaggaagcagg

SEQ ID NO: 122458 - RNA, 64 nt, Homo Sapiens
ugcugcacugcagcaaaaacaaaaccaccaccaccccagagaaaaccauguacuaauuggagug

SEQ ID NO: 122459 - RNA, 64 nt, Homo Sapiens
ggcuuaagggucccaggaguacugcagggacagccccagagaggcccaacucuggccccuuucu

SEQ ID NO: 122460 - RNA, 64 nt, Homo Sapiens
ugcccuagacccugccagaaaagggggcucuucccccagagaaguggcuuggagggaacuuccc

SEQ ID NO: 122461 - RNA, 64 nt, Homo Sapiens
uggaggagccugcugcauucuccugcugagggaucccagagagggcaggugcccaccccacagg

SEQ ID NO: 122462 - RNA, 64 nt, Homo Sapiens
gggcagagccccaggcguccccagcuguucaccucccagagaguccccagagccccaaagggcu

SEQ ID NO: 122463 - RNA, 64 nt, Homo Sapiens
cuuccaugaggcaggcugaaccugcagauaugcgcccagagauauggaucgcccaagaguugcg

SEQ ID NO: 122464 - RNA, 64 nt, Homo Sapiens
gauggaaggaagagaguagggccagugaaggcugcccagagagaaugucacagaugaggcugcc

SEQ ID NO: 122465 - RNA, 64 nt, Homo Sapiens
gaaaguuccugcuuuaguguuuuguucccucugccccagagagcuccccuuagugaucucaguu

SEQ ID NO: 122466 - RNA, 64 nt, Homo Sapiens
agagcccagcccugggcuggggggcuccucaggacccagagaugugccuggaaccacuccugau

SEQ ID NO: 122467 - RNA, 64 nt, Homo Sapiens
ccccucagguuguucucugauucuuccucccaaccccagagacugcagauuugugccaugcggc

SEQ ID NO: 122468 - RNA, 64 nt, Homo Sapiens
gccucuauccuaaggaagaccaagcaggccuggacccagagacgucccccaucgugggacacga

SEQ ID NO: 122469 - RNA, 64 nt, Homo Sapiens
cuggcaggugaugugcuggguauagcauggaccucccagagaagcucaagcuauguggcacugu

SEQ ID NO: 122470 - RNA, 64 nt, Homo Sapiens
cgauugugcuucucaacuccaccccauaauuucucccagagaccaucuaucaccuuuuccccaa

SEQ ID NO: 122471 - RNA, 64 nt, Homo Sapiens
acucuaucacagugcacauauggauguuccagcucccagagaagagcuccagcagaaaccagau

SEQ ID NO: 122472 - RNA, 64 nt, Homo Sapiens
ggcuggggcagcgccaaggccuuccucuauaacccccagagacaaacuggcacacgccccacgc

SEQ ID NO: 122473 - RNA, 59 nt, Homo Sapiens; identical to SEQ ID NO: 121870

SEQ ID NO: 122474 - RNA, 64 nt, Homo Sapiens
acugcuguuuucauuuuaauacacaaccgcuguccccagagauagaaaagcaguuagcauuucc

SEQ ID NO: 122475 - RNA, 64 nt, Homo Sapiens
ugacauuuuagcuuuauuguuuaaggggaucucucccagagacuuaugcuccuugacugaaacu

SEQ ID NO: 122476 - RNA, 64 nt, Homo Sapiens
gcuugaucaaaggcacacaggggggaggcuaaagcccagagacauuccccgcccguuuuacaaa

SEQ ID NO: 122477 - RNA, 64 nt, Homo Sapiens
aaauuuggcuuuuuuuuucugggcuuggauauugcccagagaagaagcuuucuucuuacaccuu

SEQ ID NO: 122478 - RNA, 61 nt, Homo Sapiens; identical to SEQ ID NO: 121875

SEQ ID NO: 122479 - RNA, 64 nt, Homo Sapiens
cacacaaaggaaucuuuauuagccugggacaggccccagagaguacugagcaacaggaggacuc

SEQ ID NO: 122480 - RNA, 64 nt, Homo Sapiens
agaggcucugaaagaaaggaacccauaaacauagcccagagaagauucugacaaaaaguccaga

SEQ ID NO: 122481 - RNA, 64 nt, Homo Sapiens
uuggacuccggacuauccaucgacugucugcucacccagagaccacuccaggcuggccuuuggc

SEQ ID NO: 122482 - RNA, 64 nt, Homo Sapiens
cugggccuucauggacacaugcagcuggucacuccccagagaagcaugcaggaguuucuccugg

SEQ ID NO: 122483 - RNA, 64 nt, Homo Sapiens
uucagcauccuguaucuacaccuuggaaagacaacccagagaugaguggaccuggagaccaucc

SEQ ID NO: 122484 - RNA, 64 nt, Homo Sapiens
cuagaaaacuguucuuugcuggugcccuguguaucccagagauggcuauguuucuauaagauau

SEQ ID NO: 122485 - RNA, 64 nt, Homo Sapiens
acccauacagacaguggccuugggaacuggagcacccagagaaagcucagcuuugggauguggg

SEQ ID NO: 122486 - RNA, 64 nt, Homo Sapiens
ucaaggaagcuuuucauucucuagagcgaaagggcccagagauagaauagcugugauggaagga

SEQ ID NO: 122487 - RNA, 64 nt, Homo Sapiens
aacaaucaacuaguauuuguugagcuccuauuugcccagagauggucauauuuaaacagaagua

SEQ ID NO: 122488 - RNA, 64 nt, Homo Sapiens
gggggauuguagcagacgucugggcuuuuccccacccagagaauagcccccuucgauacacauc

SEQ ID NO: 122489 - RNA, 64 nt, Homo Sapiens
uucauagagucaacuguuucaucaucauagugagcccagagagccacugcccagcagcaugcuc

SEQ ID NO: 122490 - RNA, 64 nt, Homo Sapiens
cacuguaaaaacagcuguagguauaauguauauucccagagaauuguauuuaacuaauuaaugu

SEQ ID NO: 122491 - RNA, 64 nt, Homo Sapiens
uaccaccggcacuuacaaaaugugcggacugaaucccagagaacacuggcagauguauacagua

SEQ ID NO: 122492 - RNA, 64 nt, Homo Sapiens
uaccacugaaguagaauugauuguucagcuggagcccagagaauuuaauuuaauguuuuuucuu

SEQ ID NO: 122493 - RNA, 64 nt, Homo Sapiens
aucaacugauuaaagcagugaccagcaggaacugcccagagaacuggcuggccuuguuuccuga

SEQ ID NO: 122494 - RNA, 64 nt, Homo Sapiens
ggcucaugccuccaagucagaguuucccuggugccccagagacaggagcacaagugggaucuga

SEQ ID NO: 122495 - RNA, 64 nt, Homo Sapiens
aaguguuuuacacaaaugcauaucuugaacgucacccagagacuguaauuuguguaguuuuucu

SEQ ID NO: 122496 - RNA, 64 nt, Homo Sapiens
aggacugguuuuccaguacaucuuuaaacaaggccccagagacucuaugucugcccguccauca

SEQ ID NO: 122497 - RNA, 64 nt, Homo Sapiens
cgcggccgaggccggagcaccacauccaccucgccccagagaggcucugcucccuccuauggag

SEQ ID NO: 122498 - RNA, 64 nt, Homo Sapiens
ggccccggggcugccguuuugcugggcagugguucccagagagucagagcuggcaccccucagu

SEQ ID NO: 122499 - RNA, 64 nt, Homo Sapiens
gcuguucccgcugcacggcccaccggcggccagccccagagaccagaacugauccagagcugga

SEQ ID NO: 122500 - RNA, 64 nt, Homo Sapiens
aggcaggggcaggcugaggaguugcccuuugccccccagagacugacucucagagccagagaug

SEQ ID NO: 122501 - RNA, 64 nt, Homo Sapiens
acucuuaaugcuguguuugagcuuucaugaguuucccagagagacauagcuggaaaauuccuau

SEQ ID NO: 122502 - RNA, 64 nt, Homo Sapiens
cugcccuuccacccggaggcccacccccguccaccccagagaccgaacccuucauaggaaaucc

SEQ ID NO: 122503 - RNA, 64 nt, Homo Sapiens
ucuuccacaaacaagaugaguucccuucuccaggcccagagaacggcugugucagcccagcccc

SEQ ID NO: 122504 - RNA, 64 nt, Homo Sapiens
gcaaagggccuaccucgggggaggaaacaggaagcccagagaggagggauguaggagggggaag

SEQ ID NO: 122505 - RNA, 64 nt, Homo Sapiens
cucucccuccuccucuuucacauucaccccaucucccagagacacucucugcucagaacacuac

SEQ ID NO: 122506 - RNA, 64 nt, Homo Sapiens
agcugggccucuugcauucguuucaaagagguugcccagagaaaggggaacagggaauagaacc

SEQ ID NO: 122507 - RNA, 64 nt, Homo Sapiens
augugggcagugggcagagaggcacccgcagagucccagagauggcaguagccuuggggcagag

SEQ ID NO: 122508 - RNA, 64 nt, Homo Sapiens
cagccugggcagucuguuuaugaguucuuuuggucccagagagguccagugucugucaugcccc

SEQ ID NO: 122509 - RNA, 64 nt, Homo Sapiens
gcucuuccugcccucacccugggugaguguggcacccagagacuaagggcagacaaacagguga

SEQ ID NO: 122510 - RNA, 64 nt, Homo Sapiens
agcgaaguagcuugcucccugcugggggaaugagcccagagaacgugcauggaggcccuccugu

SEQ ID NO: 122511 - RNA, 64 nt, Homo Sapiens
aaguuuuggacuuaacaacaaggaagauagguagcccagagaagccugagcaccugcuucauga

SEQ ID NO: 122512 - RNA, 64 nt, Homo Sapiens
aaugaaaaggcacaugcuuuugcuguuguaacaucccagagaaguuaauuguuuuagagcgugu

SEQ ID NO: 122513 - RNA, 64 nt, Homo Sapiens
auccaggcacugaacugcuccauaagucuagaugcccagagagcugcccggaggggucuggagg

SEQ ID NO: 122514 - RNA, 64 nt, Homo Sapiens
guagaaagaguccaguguaacaccucgaagagcucccagagauuaacagaggacaggugacaac

SEQ ID NO: 122515 - RNA, 64 nt, Homo Sapiens
ucuaugaaaaccaguggcuuugcccuggugauuacccagagauagggugauaacuacuuagcac

SEQ ID NO: 122516 - RNA, 64 nt, Homo Sapiens
ugcagcucucuguccacaacacagcccccugaggcccagagacaaccacagccucauuuuacag

SEQ ID NO: 122517 - RNA, 64 nt, Homo Sapiens
ccuggcacacaaggcccaagggccagggaggggacccagagagggaaggugagaggaaggcaaa

SEQ ID NO: 122518 - RNA, 64 nt, Homo Sapiens
cccugggcucagaucuguaaacccuuuccaaaagcccagagaugggaacucaggaaaagcagga

SEQ ID NO: 122519 - RNA, 64 nt, Homo Sapiens
cugaaugacaugcucacagugucugaaacugagacccagagaggcuuuugugccaaacccauag

SEQ ID NO: 122520 - RNA, 64 nt, Homo Sapiens
caucucuuccauuuuugauugaaggcugcuugcccccagagagcugguucagguggggucucca

SEQ ID NO: 122521 - RNA, 64 nt, Homo Sapiens
uguuccguacccacugcugaaccccagggcagagcccagagaagacucccauuugcucucagug

SEQ ID NO: 122522 - RNA, 64 nt, Homo Sapiens
agaacuaacccacacaggauugaggaaacagcaacccagagaggucaaaucuuuauuuugcaga

SEQ ID NO: 122523 - RNA, 64 nt, Homo Sapiens
guuuuggagccaggcauugaccuuuggcauggaccccagagauaaggauacaucugaaagcauu

SEQ ID NO: 122524 - RNA, 64 nt, Homo Sapiens
aagaacccucggacucaggcaagcugagaauaaacccagagacaccaucagcagggggaaagcc

SEQ ID NO: 122525 - RNA, 64 nt, Homo Sapiens
ugggcagaaggggcggcccggacgggggagcuuucccagagacccggggauggauuggccucca

SEQ ID NO: 122526 - RNA, 64 nt, Homo Sapiens
gauaauggccagagauauccacagcuuggaggagcccagagaccguuugcuuuauacccacaca

SEQ ID NO: 122527 - RNA, 64 nt, Homo Sapiens
gugguuaugcagaagcagagaugaggaggcuggccccagagaugaucuugcccuuccuaacuaa

SEQ ID NO: 122528 - RNA, 64 nt, Homo Sapiens
acaccucagcaaaugcugcaaaauccuguuuucccccagagagcuggagguuaaauacuaccag

SEQ ID NO: 122529 - RNA, 64 nt, Homo Sapiens
uguaaauaaugugggaaaauaguauuguuuagcucccagagaaacauuuguuccacaguuaaca

SEQ ID NO: 122530 - RNA, 64 nt, Homo Sapiens
cgggcucagccauucggcuuggggcaccaggcuccccagagacaaugcucaguauucauucaua

SEQ ID NO: 122531 - RNA, 64 nt, Homo Sapiens
uuuagacaauuuuaggcucacauauauccuuggucccagagauguucuuuguaauuuaugcuuu

SEQ ID NO: 122532 - RNA, 64 nt, Homo Sapiens
uggaggagcuaaaaaagcaagacaaauauaaaaucccagagaggucaucccuacucaucagaaa

SEQ ID NO: 122533 - RNA, 64 nt, Homo Sapiens
gaaugcgcuuuggauuguuuaauuauauuccauucccagagagaucaauagcaacagaaauaua

SEQ ID NO: 122534 - RNA, 64 nt, Homo Sapiens
cagccuucagucccuaucagcgccuccuuuacuucccagagaacuucacagagacucuguccuu

SEQ ID NO: 122535 - RNA, 64 nt, Homo Sapiens
ugagcugugucccuuuacuaugcaagcacaugaccccagagacagcugguucacuggcagaucc

SEQ ID NO: 122536 - RNA, 64 nt, Homo Sapiens
cugugugcaaggcaauaguuagccuugauuuuagcccagagacagauggcagagcuaucucucu

SEQ ID NO: 122537 - RNA, 64 nt, Homo Sapiens
aggagauguaaugacagagaguucuggugagauacccagagagaaaaagagagagcaggguggg

SEQ ID NO: 122538 - RNA, 64 nt, Homo Sapiens
gcugcuccccacaccuagccuuuguucuggaaaccccagagagggcugggcuugacucaucuca

SEQ ID NO: 122539 - RNA, 64 nt, Homo Sapiens
caccaggcaagagucuugcuuauugggcugcauccccagagaggauaugaauuauuuuuugaaa

SEQ ID NO: 122540 - RNA, 64 nt, Homo Sapiens
gggggacccaaagggucuggccucuuugggcagccccagagaugaggggucagcagaggagagc

SEQ ID NO: 122541 - RNA, 64 nt, Homo Sapiens
ccacuccccuugccccacacccuuuacuccccagcccagagagacgcugcuuuuaccaggaaag

SEQ ID NO: 122542 - RNA, 64 nt, Homo Sapiens
aggcagcaccauuugacagguuaggaugcuggggcccagagagguuaagugucuugcccgaggu

SEQ ID NO: 122543 - RNA, 64 nt, Homo Sapiens
gcagaccuggcuguggagagcagcuaauguguggcccagagagccugucuguguggagcacgua

SEQ ID NO: 122544 - RNA, 64 nt, Homo Sapiens
uugugcuuauuucugccauugucccucucacguucccagagaggucauucuuuuugguccaacu

SEQ ID NO: 122545 - RNA, 64 nt, Homo Sapiens
ccccagcgucuugacgggagcauuggccccugagcccagagaagcuggaagccugccgaaaaca

SEQ ID NO: 122546 - RNA, 64 nt, Homo Sapiens
cagggcccagcccugcuuccuggaguggauguggcccagagaaggaggcugggggaucaccagc

SEQ ID NO: 122547 - RNA, 64 nt, Homo Sapiens
agaagcgcuuucuaagaauguggucaaauccaaacccagagaacucagcucuuucugcaugugc

SEQ ID NO: 122548 - RNA, 64 nt, Homo Sapiens
ugugugcaaaaaugauacuccagagagugucaaacccagagaaaggaacaguccauauuagcuc

SEQ ID NO: 122549 - RNA, 64 nt, Homo Sapiens
uuugagggaugaacggguagcugcuucccucgaacccagagauuccuugccccuuauuucuucc

SEQ ID NO: 122550 - RNA, 64 nt, Homo Sapiens
agauugggcacaacuaaggcgguagcaaagcccucccagagaaaacccugggaacugggucuug

SEQ ID NO: 122551 - RNA, 64 nt, Homo Sapiens
guuaaucauggauguuagagacagaguuacccaacccagagacuuugccucuguauuuaagcca

SEQ ID NO: 122552 - RNA, 64 nt, Homo Sapiens
ccaaagacagcuacaggaagacagguuugagauucccagagaggauccccucucccacugaguc

SEQ ID NO: 122553 - RNA, 64 nt, Homo Sapiens
gacaagauaggacauggccuuguuuccauuaucacccagagaggugacugcuacuuccugucuc

SEQ ID NO: 122554 - RNA, 64 nt, Homo Sapiens
ccugguccgucuugggucugggggaugucgccuccccagagaugucucugggcugccgguggga

SEQ ID NO: 122555 - RNA, 64 nt, Homo Sapiens
accaauaugugccacgugccuguggcugcagacucccagagaaccagcacuggguuuacagaau

SEQ ID NO: 122556 - RNA, 64 nt, Homo Sapiens
ccuucaggcaccuaggggagagcgugccugacaacccagagagauucgacagucagccuugugu

SEQ ID NO: 122557 - RNA, 64 nt, Homo Sapiens
gugccaagccuguggaucaggaauaucaacagcccccagagaguggugcuggcugagggucuga

SEQ ID NO: 122558 - RNA, 64 nt, Homo Sapiens
ugcaccucccuucccucccugaggcaggugagaacccagagagaggggccugcaggugagcagg

SEQ ID NO: 122559 - RNA, 64 nt, Homo Sapiens
uacaccucagggcgggugagguuccgacacugaucccagagaugccguggauacgccagggucc

SEQ ID NO: 122560 - RNA, 64 nt, Homo Sapiens
uauuugaguuguuuuggugccugccucugccaugcccagagaaucagggcaggcuugccaccgg

SEQ ID NO: 122561 - RNA, 64 nt, Homo Sapiens
aaggacuuggcugcgcguaacugccuggucagugcccagagacaagugaaggugucugcccugg

SEQ ID NO: 122562 - RNA, 64 nt, Homo Sapiens
ucuuuacgaguguuuuuuauuugggacccucgagcccagagauauuaauggauaucuguauuca

SEQ ID NO: 122563 - RNA, 64 nt, Homo Sapiens
ucagaggaagcagcccucccucgauggccucuagcccagagaagcccgcgcaucuuggacccac

SEQ ID NO: 122564 - RNA, 64 nt, Homo Sapiens
aagaaaaaaaaaaaaggaggggaaaugcauuuuccccagagauaaaggcugccauuuugggggu

SEQ ID NO: 122565 - RNA, 64 nt, Homo Sapiens
aagaguguaugauucuggaacagggugaaacucucccagagacgaagaaagaguccugggauuu

SEQ ID NO: 122566 - RNA, 64 nt, Homo Sapiens
gaugacaugacaucacucccaauucucuccaaaccccagagaaauacugacgaaguuuucugau

SEQ ID NO: 122567 - RNA, 64 nt, Homo Sapiens
cuguuuugaguuuugcccuggggcuugaaugagucccagagagucguucggauggugggaggcu

SEQ ID NO: 122568 - RNA, 64 nt, Homo Sapiens
gagcacugcagaucagcaacuguguagguacacacccagagaugaguacaacaaaggugacggg

SEQ ID NO: 122569 - RNA, 64 nt, Homo Sapiens
aagccagaaaaccaagguaaauuuaauuagaaagcccagagaaagagaaauaaacauuuagagg

SEQ ID NO: 122570 - RNA, 64 nt, Homo Sapiens
cgaaauaucauuuguggguuuuaaaccuuucauucccagagaucgaaaggguauuucauaguuu

SEQ ID NO: 122571 - RNA, 64 nt, Homo Sapiens
uuaagugacuuccucgagguugagaaaacugagacccagagagcuauuaaucucauuguacaag

SEQ ID NO: 122572 - RNA, 64 nt, Homo Sapiens
ugucuugucagccucucuaggcuacgguacucuccccagagauaccccuuuaacacuggugaaa

SEQ ID NO: 122573 - RNA, 64 nt, Homo Sapiens
ugcccuaacagaacacuucaugagaaauucuuugcccagagagcagagccugcaauuggaaaua

SEQ ID NO: 122574 - RNA, 64 nt, Homo Sapiens
uucugaucuccaaaaagagggguucuucucuuuucccagagaccuaguuauuuucugaaaaauu

SEQ ID NO: 122575 - RNA, 64 nt, Homo Sapiens
gauuuccuucucuuagaaguggggaauacggggucccagagaaaaaaaggguucuuggaggcca

SEQ ID NO: 122576 - RNA, 64 nt, Homo Sapiens
aggagaaaucuguagugagcauugaccauuuuuucccagagaaguauuaaaaggaagcagaagc

SEQ ID NO: 122577 - RNA, 64 nt, Homo Sapiens
ucagccaccgagucuccuggugcuggcuggaguccccagagauaugggaccagaugcuucccug

SEQ ID NO: 122578 - RNA, 64 nt, Homo Sapiens
ugcuucauuuucuuuuuauaguugguauagcaaccccagagaaggacuacaaugggcugaaaca

SEQ ID NO: 122579 - RNA, 64 nt, Homo Sapiens
accaugacuugaggcacaaagucuugucuggugacccagagaucuaagaaagaauugcaguaaa

SEQ ID NO: 122580 - RNA, 64 nt, Homo Sapiens
gcagcuucccuuggcucuggugguuggcuugcaacccagagagauucucuucuugcugcaaaac

SEQ ID NO: 122581 - RNA, 64 nt, Homo Sapiens
uucugugaaaacauuuugcuuuaagaauaugcaacccagagaauguccacaguaguucaggcaa

SEQ ID NO: 122582 - RNA, 64 nt, Homo Sapiens
gucgcuacuaaaagaaugaauaugagcauucuagcccagagacuagccaaagccgaaaauagua

SEQ ID NO: 122583 - RNA, 64 nt, Homo Sapiens
gaaugugaagacacgcgcuaguuugucuugcuuccccagagauagagggaaauggguagagccu

SEQ ID NO: 122584 - RNA, 64 nt, Homo Sapiens
cucugccuggaggcgggccuggguucgucuaggucccagagaccucuuggugccccgaccccca

SEQ ID NO: 122585 - RNA, 64 nt, Homo Sapiens
ggccgccuucuuggugccaaacccccuucccccacccagagacugggcagcugugucugguucg

SEQ ID NO: 122586 - RNA, 64 nt, Homo Sapiens
ggaggcaagcccccuugccuuucaaacuggaaaccccagagaaaacggugcccccaccugucgc

SEQ ID NO: 122587 - RNA, 64 nt, Homo Sapiens
uuacacuuuacagguaccuguuaucccuacgcuucccagagagaacaaugcugugagagaguuu

SEQ ID NO: 122588 - RNA, 64 nt, Homo Sapiens
ggaaggagccaggacacagcucagcuugcucacgcccagagagagaaaaaguuaagcugcugac

SEQ ID NO: 122589 - RNA, 64 nt, Homo Sapiens
gcucuugucccugggaggccucugcuugucacuucccagagauugcagagguguguccugccua

SEQ ID NO: 122590 - RNA, 64 nt, Homo Sapiens
ggcccagagcacuguuggaagucugguuagaguccccagagaguuacucuaaguuaaaaugagc

SEQ ID NO: 122591 - RNA, 61 nt, Homo Sapiens; identical to SEQ ID NO: 121988

SEQ ID NO: 122592 - RNA, 64 nt, Homo Sapiens
gcuuuuaauccaaagaacauguauaguuuuuguacccagagacuaugauuuauauugauugcac

SEQ ID NO: 122593 - RNA, 64 nt, Homo Sapiens
uuccucugccgggaggguguuuucaacuccaaaccccagagagggguuguagauuggguccagc

SEQ ID NO: 122594 - RNA, 64 nt, Homo Sapiens
cuuuaugaugacugcuuaacuccccacugccugucccagagaggcuuuccaauguagcucagua

SEQ ID NO: 122595 - RNA, 64 nt, Homo Sapiens
cucagauggaacgaaaggcgaugugcaaggccaucccagagagacggaagcaggugcgauacua

SEQ ID NO: 122596 - RNA, 64 nt, Homo Sapiens
acuaugucuggucaccagcucccuccugcuggcacccagagacccggacccgcagggccugccu

SEQ ID NO: 122597 - RNA, 64 nt, Homo Sapiens
uggugucacguuggggaacaaguguccuucagaacccagagaaggccgccguucuguaaauagc

SEQ ID NO: 122598 - RNA, 64 nt, Homo Sapiens
gaaaacgggccgguauuuacacacgcgcaaaacacccagagacggcacaaggagguugaacuca

SEQ ID NO: 122599 - RNA, 64 nt, Homo Sapiens
aggucagacaacaggcaaccgggccgugccagugcccagagagcucuucagaccagccagcaag

SEQ ID NO: 122600 - RNA, 64 nt, Homo Sapiens
aucaguaugugcuuaccuguauacauuuugucaucccagagacagccaguuucuugucuuuuuu

SEQ ID NO: 122601 - RNA, 64 nt, Homo Sapiens
caguaggaaauuucuccuuauaucacaauagcaucccagagagaaagaauuccaauuaauuaaa

SEQ ID NO: 122602 - RNA, 64 nt, Homo Sapiens
uuuucucucccauaccaucaaagcuuugaauacccccagagacccuccauggaggagguguccc

SEQ ID NO: 122603 - RNA, 64 nt, Homo Sapiens
gggcugcucucccggaggccgaaaggagcucacgcccagagacucaacuguggccaugacugag

SEQ ID NO: 122604 - RNA, 64 nt, Homo Sapiens
gagugugggagugauucccagccgucucccuuggcccagagacggaauggucucugucaagcgg

SEQ ID NO: 122605 - RNA, 64 nt, Homo Sapiens
auuaauuauauuucuacagaacauauuuagcgcacccagagaaauaaauugauuuguuaugguu

SEQ ID NO: 122606 - RNA, 64 nt, Homo Sapiens
ccuuguaaguguccccucuguucuuugucuugcucccagagacaacucuaaccaaucaaauagu

SEQ ID NO: 122607 - RNA, 64 nt, Homo Sapiens
aaaccuuggggccccagaugccugggcuuggauucccagagaggaaacagggaagagacauacc

SEQ ID NO: 122608 - RNA, 64 nt, Homo Sapiens
gguauuguggcugugccaggggugacauaugcuucccagagacuaaugggacccacguggagua

SEQ ID NO: 122609 - RNA, 64 nt, Homo Sapiens
ggacauuucccuccugggagcggaccuguggggccccagagagguggcuccuccaggcacgucc

SEQ ID NO: 122610 - RNA, 64 nt, Homo Sapiens
auacuaaaauacugauuaucuuaaucacauuuuccccagagauaaacauugagagaacgaaagc

SEQ ID NO: 122611 - RNA, 64 nt, Homo Sapiens
ccgagagcugucggaaccagaugcaacccggcagcccagagaacucuccugggaggcugugggu

SEQ ID NO: 122612 - RNA, 64 nt, Homo Sapiens
cauaaagugaaucaaauuugacauuauuuuagaucccagagaaaucaggugugauuaguucucc

SEQ ID NO: 122613 - RNA, 64 nt, Homo Sapiens
uuagggcauagaguugucuccuucccaacacggacccagagagcagcccuucccugcucaaagc

SEQ ID NO: 122614 - RNA, 64 nt, Homo Sapiens
cuacagagcagugugggcagccccaagugugguccccagagagcguuuggcuuuccugucuguc

SEQ ID NO: 122615 - RNA, 64 nt, Homo Sapiens
gaguguuccucgacauguuucuccagugacaccucccagagaaguuguaaguauaaaaugaaaa

SEQ ID NO: 122616 - RNA, 64 nt, Homo Sapiens
uugaaauguugacuuaagugagggggaaauaaaacccagagagagagagagagcgagagagaga

SEQ ID NO: 122617 - RNA, 64 nt, Homo Sapiens
aagauccucaucugagagugcuuaaaaugggauccccagagaccauuaaccaauacuggaacug

SEQ ID NO: 122618 - RNA, 64 nt, Homo Sapiens
ucccagccugaggcuccagcugaugcccucagcucccagagagggggugccccaucuagcuggg

SEQ ID NO: 122619 - RNA, 64 nt, Homo Sapiens
gccacaccacgugcccucuuggcccagccuuccucccagagaggcggccugacuuaccuggaug

SEQ ID NO: 122620 - RNA, 64 nt, Homo Sapiens
gcuuaccccucucuaggguuguccaugacuauugcccagagaagcuuccuuccccucuguaaau

SEQ ID NO: 122621 - RNA, 53 nt, Homo Sapiens; identical to SEQ ID NO: 122018

SEQ ID NO: 122622 - RNA, 64 nt, Homo Sapiens
cacucagugagccuccuguggggggcaucucuuccccagagaggcucacaugggacugggauau

SEQ ID NO: 122623 - RNA, 64 nt, Homo Sapiens
aggaacaaaggucuggaguuuggucaguaaguugcccagagagauguuagcguuacuucuccug

SEQ ID NO: 122624 - RNA, 64 nt, Homo Sapiens
gucaggccgaaccccauuucggcucaucagcccccccagagagggugacacguggacaaaugcg

SEQ ID NO: 122625 - RNA, 64 nt, Homo Sapiens
gcucugcacgucaccaaguaaugagcugcagccccccagagagaugaguccagcuccccccaag

SEQ ID NO: 122626 - RNA, 64 nt, Homo Sapiens
gagguuuuuuaaaagacugugcuucuucuuaaagcccagagaaaaccccaacaaauauuaaaug

SEQ ID NO: 122627 - RNA, 64 nt, Homo Sapiens
ucacacuggccaggaaugcugggaugcugaaucucccagagagcgccagacuuuaggaguguga

SEQ ID NO: 122628 - RNA, 64 nt, Homo Sapiens
uccauaauuuaaaauaaaauugcuauuuuuuuuccccagagacugacaucuauugucauuccau

SEQ ID NO: 122629 - RNA, 64 nt, Homo Sapiens
gauaaguaaauauuuaagaagguaaacugcauagcccagagaaacuaauuuuuuaaaaauggaa

SEQ ID NO: 122630 - RNA, 64 nt, Homo Sapiens
accagucacaucaaucagggguguacugcacaaccccagagaaucacguacaguuguauggauu

SEQ ID NO: 122631 - RNA, 64 nt, Homo Sapiens
gacucuuuuuguaagauuuuccugugcaccuuaccccagagacaccuuaaaugucgguccaggc

SEQ ID NO: 122632 - RNA, 64 nt, Homo Sapiens
ccccuuccccaugggaagacucucucccagucuacccagagaagacggggggccccagucagcc

SEQ ID NO: 122633 - RNA, 64 nt, Homo Sapiens
ccacgagaagugaccuucagggucaucaggcugucccagagagguccgcguucuccccaccccg

SEQ ID NO: 122634 - RNA, 64 nt, Homo Sapiens
cuguacauacauuguauaggccaucuguaaauaucccagagaacaaucacuauucuuaagcacu

SEQ ID NO: 122635 - RNA, 64 nt, Homo Sapiens
ccuugcuguuuaaaaguaaugcaauaugugaacgcccagagaacaagcacuguggaacugcuau

SEQ ID NO: 122636 - RNA, 64 nt, Homo Sapiens
aggacacuuggcuuuggggggaaggaaacugaggcccagagaggggcaaccacuggccaagggu

SEQ ID NO: 122637 - RNA, 64 nt, Homo Sapiens
cauaacaugguacaugcuucaggacuacauaugacccagagagcaagguggcugaacuauaguc

SEQ ID NO: 122638 - RNA, 64 nt, Homo Sapiens
aaaaacccaagaguuuguacagacauccugucuucccagagaagguggacacucuugggcucau

SEQ ID NO: 122639 - RNA, 64 nt, Homo Sapiens
ggguagggagaggacaaggggucaccgagcccuucccagagagcagggagcuuauaaauggaac

SEQ ID NO: 122640 - RNA, 64 nt, Homo Sapiens
cugcaaagcaguguccaggagcaggccacuacugcccagagagcagaggaggagguuguuggca

SEQ ID NO: 122641 - RNA, 64 nt, Homo Sapiens
gcugcucgggaaggccugagggaagcccacccgccccagagacugcccacccugggccucccgu

SEQ ID NO: 122642 - RNA, 64 nt, Homo Sapiens
uuuuaagguaucugccuauacugauuuguuugcccccagagaaucccuguacaucuaauauaua

SEQ ID NO: 122643 - RNA, 64 nt, Homo Sapiens
uguugugcuguguauuuugagacggcuuucaugucccagagaccgggcucugcauagccaggau

SEQ ID NO: 122644 - RNA, 64 nt, Homo Sapiens
ggggaaggcagccuguccauggcuauugggggagcccagagacagaccagucggaagggauucu

SEQ ID NO: 122645 - RNA, 64 nt, Homo Sapiens
caacuauguuauccauccuggaagucuggugguccccagagaaaugggacacaagucacuucaa

SEQ ID NO: 122646 - RNA, 64 nt, Homo Sapiens
gugcgugccacuaccaaagcuaaugcagacccggcccagagacucuaaagaagccucuucuauu

SEQ ID NO: 122647 - RNA, 64 nt, Homo Sapiens
guuugauccaacccucuuauugagaugcuaaggccccagagaucguaggaggauccacaggauu

SEQ ID NO: 122648 - RNA, 64 nt, Homo Sapiens
agcagcccugagccccuguaauuucuuccccaagcccagagaagauucaggaaagaagugcaga

SEQ ID NO: 122649 - RNA, 64 nt, Homo Sapiens
ggucucgacccacucaaggaugcagagaccugugcccagagaaggagggucagaacuggacagc

SEQ ID NO: 122650 - RNA, 64 nt, Homo Sapiens; identical to SEQ ID NO: 122573

SEQ ID NO: 122651 - RNA, 64 nt, Homo Sapiens
cuuccagcacagcccucuacagccggggguguggcccagagaagugaccuucagcccucccuac

SEQ ID NO: 122652 - RNA, 64 nt, Homo Sapiens
aaacaaugggaacaauuucaagcccauguccaagcccagagagauuaacuggacauuaguguac

SEQ ID NO: 122653 - RNA, 64 nt, Homo Sapiens
aauuacucauuaaccagcaucucugaaccauaaacccagagaaggccugaggucuccuauucua

SEQ ID NO: 122654 - RNA, 64 nt, Homo Sapiens
cugccuucccuacacuagaagcauugcaggagcucccagagagagaaccugggcuaagaguuug

SEQ ID NO: 122655 - RNA, 64 nt, Homo Sapiens
acugaggcuacggggaacuuggagcagccucaagcccagagaaguuacuuuaaaugccugccaa

SEQ ID NO: 122656 - RNA, 64 nt, Homo Sapiens
ccaccucucccccaagggccccguuucccuggugcccagagaacucccaaugccaacccccacc

SEQ ID NO: 122657 - RNA, 64 nt, Homo Sapiens
agaaaucucuuuguggcuuucaugggcagggaaucccagagauagcaaaugccaccugaccaga

SEQ ID NO: 122658 - RNA, 64 nt, Homo Sapiens
cuuaucuuccuuuugugguuuuuaauuugaagaccccagagaauuccauuacauaaugauuuug

SEQ ID NO: 122659 - RNA, 64 nt, Homo Sapiens
gcuaauacuuucucccuaauggaagcccugaucccccagagagcuacaggucugcucccgacgg

SEQ ID NO: 122660 - RNA, 64 nt, Homo Sapiens
gcccaaacuugugacugcaucccucuggagucuacccagagacagagaaugugucuuuaugugg

SEQ ID NO: 122661 - RNA, 64 nt, Homo Sapiens
gaggaaacagacagcggacugaggaagcgauggccccagagaaagggccccuguagccuggcuc

SEQ ID NO: 122662 - RNA, 64 nt, Homo Sapiens
ccaauaagaauccucuauuaaugcccaccccagccccagagaaacacaaaugaagagaaaagcc

SEQ ID NO: 122663 - RNA, 64 nt, Homo Sapiens
ccccccagacacugcagggcaucaggaucugccccccagagaccguaaaggcuccuggccucuc

SEQ ID NO: 122664 - RNA, 64 nt, Homo Sapiens
uucauuuaguugauauaaucaauaguuuuuuguccccagagacaauugaucaccaugaaagaag

SEQ ID NO: 122665 - RNA, 64 nt, Homo Sapiens
uguaucagcaggaagccauugggacagugaaacacccagagacuguggugugggccagaaacaa

SEQ ID NO: 122666 - RNA, 64 nt, Homo Sapiens
gcuguccgccagugcaucaucaacaucacuggggcccagagagacacagagcacagcucauggg

SEQ ID NO: 122667 - RNA, 64 nt, Homo Sapiens
agcagagucaguuacaccugugcgggagagguggcccagagaaccucuagcaucacuccugagc

SEQ ID NO: 122668 - RNA, 64 nt, Homo Sapiens
ccaaaagauuggauacgcauuucuuccaacguggcccagagaagcauguggcccaacacaauuc

SEQ ID NO: 122669 - RNA, 64 nt, Homo Sapiens
uuauaagaacugauguggccagcagccacuucagcccagagagaaagguccaacccugcaauga

SEQ ID NO: 122670 - RNA, 64 nt, Homo Sapiens
ugugggcagaagcagugaagccacuucagccaagcccagagaagccagcguuugccagaggugg

SEQ ID NO: 122671 - RNA, 64 nt, Homo Sapiens
uuuaccguaugaagccuggagaguuccuuuccuucccagagaguaauuuucugcaugggacucu

SEQ ID NO: 122672 - RNA, 64 nt, Homo Sapiens
uaagaagaaaaccucuaaauuuuaagacuuacaccccagagauuagucuuuuuugcccagaucu

SEQ ID NO: 122673 - RNA, 64 nt, Homo Sapiens
agcauguagcaggggggaauugaacuggugucugcccagagagcggcauggcuuugaccuagua

SEQ ID NO: 122674 - RNA, 64 nt, Homo Sapiens
aagccgcuggcuguaugaaauaaaaugugacucucccagagaaguuugugucugaaaccgguuu

SEQ ID NO: 122675 - RNA, 64 nt, Homo Sapiens
uggauucccuuggcggccgugccccuggcccuggcccagagauuccuagggcugggguucucaa

SEQ ID NO: 122676 - RNA, 64 nt, Homo Sapiens
cuuaaauccaaguuguuucuuccuucccaccuggcccagagaugcauccuuggucaucauuguc

SEQ ID NO: 122677 - RNA, 64 nt, Homo Sapiens
ccccuuccccaucagaagaccugaggggagagcccccagagagccccucccaguuggccagaau

SEQ ID NO: 122678 - RNA, 64 nt, Homo Sapiens
ccccuuagcacaccuagaggcuugacucaaucuacccagagauguucccuagggucucuucuug

SEQ ID NO: 122679 - RNA, 64 nt, Homo Sapiens
aaagugcauuacuuaaagauuagaauggaaaaaacccagagagcuuaaugcacuuuaaauaagg

SEQ ID NO: 122680 - RNA, 64 nt, Homo Sapiens
gagcccaccugcugccuggggaguggugucgggucccagagagggggccugaugaaagcuuccu

SEQ ID NO: 122681 - RNA, 64 nt, Homo Sapiens
ccugcucagccaggccucuccugggagccacucgcccagagacucagcuuggccaacuuggggg

SEQ ID NO: 122682 - RNA, 64 nt, Homo Sapiens
uggcccucucugaaggaggccaccuccuaaaaggcccagagagaagagccccacucucagaggc

SEQ ID NO: 122683 - RNA, 64 nt, Homo Sapiens
ccagacuugggugcuuagcuucagauacucuaugcccagagauagugcacuuggcagcugucag

SEQ ID NO: 122684 - RNA, 64 nt, Homo Sapiens
uguaaagcuaggcagaugagcccagaagaauggucccagagaaagcagacuggcuccaauagau

SEQ ID NO: 122685 - RNA, 64 nt, Homo Sapiens
ugugccuacuguuccccaccucagaagcuuccugcccagagagccagcagccuugggauacuaa

SEQ ID NO: 122686 - RNA, 64 nt, Homo Sapiens
cuugcacugugcucucccacaaguccagcugcaacccagagauaguggaaacugaaauuaggaa

SEQ ID NO: 122687 - RNA, 64 nt, Homo Sapiens
gcucugaaaccaaacagcauccugccaugagcuucccagagacagaagagacuggagcaaaguc

SEQ ID NO: 122688 - RNA, 64 nt, Homo Sapiens
uuacugccacuaguguucaagugccucuuguuuucccagagauuuccugggucugccagaggcc

SEQ ID NO: 122689 - RNA, 64 nt, Homo Sapiens
uuuccccaucuguuggaccaaauaaucucaaaggcccagagaggacagugaccauccacagaca

SEQ ID NO: 122690 - RNA, 64 nt, Homo Sapiens
cauuccuuccaggagcaguaggugggagguuugacccagagaagccaauccuugcauuccagga

SEQ ID NO: 122691 - RNA, 64 nt, Homo Sapiens
caaccaaggagcuggggcccaaggccaguccugccccagagacacuccaaguccgccaggggca

SEQ ID NO: 122692 - RNA, 64 nt, Homo Sapiens
acaaagagggccccagcccagccccaccacagaucccagagauaggggcccagucuccaugggg

SEQ ID NO: 122693 - RNA, 64 nt, Homo Sapiens
uugcacccggggcugcaaacgucuccgugcagcccccagagagaggcccaugggcucagaccag

SEQ ID NO: 122694 - RNA, 64 nt, Homo Sapiens
auuuccuaccaccuuuguggccgaccccaagcaccccagagauaugaggcacccuuugcuccac

SEQ ID NO: 122695 - RNA, 64 nt, Homo Sapiens
gagauuguucuccagcaccccacauucaccccugcccagagauucccccuucuccucuccccua

SEQ ID NO: 122696 - RNA, 64 nt, Homo Sapiens
ugucagucccucuaucccuucuccuguccaggggcccagagagaaacacaccuaccccuggccu

SEQ ID NO: 122697 - RNA, 64 nt, Homo Sapiens
ccgaggccgcgugcgugagaaccgcgccgguguccccagagaccaggcugugucccucuucucu

SEQ ID NO: 122698 - RNA, 64 nt, Homo Sapiens
aguccagccuaaucaagucaaauggagaaacaggcccagagaggaagguggcuuaccaagauca

SEQ ID NO: 122699 - RNA, 64 nt, Homo Sapiens
uuuaucccagucguacucuuccagguuuggaagacccagagaggccaagaucccauccuuagcc

SEQ ID NO: 122700 - RNA, 64 nt, Homo Sapiens
ugaccucacucuaacucaaaguaauguccagguucccagagaauaucugcugguauuuuucugu

SEQ ID NO: 122701 - RNA, 64 nt, Homo Sapiens
aguguuuucaucucuuggucauaauuccgagauccccagagaccacuguuucuggaguaucugu

SEQ ID NO: 122702 - RNA, 64 nt, Homo Sapiens
agggacugcagagaggcuacuggaagguuaaggacccagagagaaaucgagaggugcccuacag

SEQ ID NO: 122703 - RNA, 64 nt, Homo Sapiens
agagacuuucagcccuaaaucuagacucaagguucccagagaugacaaauggagaagaaaggcc

SEQ ID NO: 122704 - RNA, 64 nt, Homo Sapiens
cuauggauuaucuuuauaucacugucuuucuaagcccagagaugucauaagugacaagaaaagu

SEQ ID NO: 122705 - RNA, 64 nt, Homo Sapiens
uguccuauacucacaucagacaugugaucauagucccagagacagaguugaggucucgaagaaa

SEQ ID NO: 122706 - RNA, 64 nt, Homo Sapiens
aaggagggagccgggagccuggugggaagccuuccccagagagauggcuuuaggggcuuuauuu

SEQ ID NO: 122707 - RNA, 64 nt, Homo Sapiens
uccauauccuuucuugaacgcacauucagcuuaccccagagagcaagugaggcaaucuggcaaa

SEQ ID NO: 122708 - RNA, 64 nt, Homo Sapiens
ccagcaaccugccagcuacaggagcccccugcgucccagagacucccucacccaggcaggcucc

SEQ ID NO: 122709 - RNA, 64 nt, Homo Sapiens
uauucuacccaaaugucaggaccaggauuuucuacccagagaccaagguguucuucccaaagac

SEQ ID NO: 122710 - RNA, 64 nt, Homo Sapiens
uauucuacccauaugucaggaccaggauuuucuacccagagaccaagguuaucuuccuaaagac

SEQ ID NO: 122711 - RNA, 64 nt, Homo Sapiens
uauucuacccauaugucaggaccgggauuuucuacccagagaccugcauguucucuccaacgac

SEQ ID NO: 122712 - RNA, 64 nt, Homo Sapiens
cucuucccaucaauauccuaaaugugggggagggcccagagaauggcacccaagagccugcggg

SEQ ID NO: 122713 - RNA, 64 nt, Homo Sapiens
caguccuucacacucacacuacucuguuccucuucccagagacaucgauucacuucaaagagcu

SEQ ID NO: 122714 - RNA, 64 nt, Homo Sapiens
guaucguggcaccguggcgccccgccccgcuucccccagagacugcuguggcugcggccgggag

SEQ ID NO: 122715 - RNA, 64 nt, Homo Sapiens
cuaaccaccaugccuacuugcaagcucaagagaucccagagauugacaccaaugcugcuauccg

SEQ ID NO: 122716 - RNA, 64 nt, Homo Sapiens
ucaucagagcuccucuguccgccgcuuugagucccccagagauggaaaauaccagaaaaugagg

SEQ ID NO: 122717 - RNA, 64 nt, Homo Sapiens
gaauagugcuguuuccuauugggcuggggcagcucccagagaaucuagacuguggcccagaaua

SEQ ID NO: 122718 - RNA, 64 nt, Homo Sapiens
ccucagucccucccuccugguccauacccccugccccagagaaggccugcuauccagccgcaaa

SEQ ID NO: 122719 - RNA, 64 nt, Homo Sapiens
cccugccaacuuuccagacuaccuuccugggcagcccagagagagcuucccaggacccuggguc

SEQ ID NO: 122720 - RNA, 64 nt, Homo Sapiens
auucgugggcugagggcaauauucuguaaauagucccagagagauuccguggguuuccccuuug

SEQ ID NO: 122721 - RNA, 64 nt, Homo Sapiens
gucuggccuugcccaaggccucuccuuucugcuucccagagaggcccaggaggcaggggaaaaa

SEQ ID NO: 122722 - RNA, 64 nt, Homo Sapiens
uggacuuggcuggcuugcagacuccaggccccggcccagagauuggagguaacgaggagggcgg

SEQ ID NO: 122723 - RNA, 64 nt, Homo Sapiens
uuguagauccuuagagguccaggaauccuggcagcccagagacuauauuucccauuugugccag

SEQ ID NO: 122724 - RNA, 64 nt, Homo Sapiens
ucccugccccuccaggaccugcuccgagccugcccccagagacgcuagcugccggccucuggag

SEQ ID NO: 122725 - RNA, 64 nt, Homo Sapiens
uauugcauugagcaguggggcuuaccugacggaccccagagaccaaugagauuuacuaaguuga

SEQ ID NO: 122726 - RNA, 64 nt, Homo Sapiens
acccuuuuacucuggggagacaguacugccaagucccagagaaacauuguuaguccgggaccuu

SEQ ID NO: 122727 - RNA, 64 nt, Homo Sapiens
agcuucagugacaaacauauacucugacguugaucccagagagcgaucuuuuccagaguaugca

SEQ ID NO: 122728 - RNA, 64 nt, Homo Sapiens
cccaagccaaaaaccuuagcacugcagguuggaccccagagauugagacccauguaaauaccag

SEQ ID NO: 122729 - RNA, 64 nt, Homo Sapiens
agggagugggugggcaggggcacaugugaggguccccagagagacccuggggggaggcaggagg

SEQ ID NO: 122730 - RNA, 64 nt, Homo Sapiens
uaaguaauuuauauaagaaagugaaggcugucugcccagagaaaugugcuauuagugcaauaag

SEQ ID NO: 122731 - RNA, 64 nt, Homo Sapiens
ccuuaaccuuuguugguuuugaaacccuuauuuucccagagaugcaaaucuggucuagcugggu

SEQ ID NO: 122732 - RNA, 64 nt, Homo Sapiens
ccccugcugacugcgccugucuucucccucugaccccagagaaaggggcuguggucagcuggga

SEQ ID NO: 122733 - RNA, 64 nt, Homo Sapiens
ugcccgggacccccgucuccaggggugccccagacccagagauuagccucccacuucggcgcag

SEQ ID NO: 122734 - RNA, 64 nt, Homo Sapiens
caucuccacccaucucuacaucugggcacagcaacccagagauggccaaaagcauucaagccug

SEQ ID NO: 122735 - RNA, 64 nt, Homo Sapiens
cagauggccuucuuugucaucuucacucuccacccccagagaggagucagagccauaacucaau

SEQ ID NO: 122736 - RNA, 64 nt, Homo Sapiens
ugguuugacuuauucuucguaucauuagaagaaccccagagauagcauuccucuauuuuauuuu

SEQ ID NO: 122737 - RNA, 64 nt, Homo Sapiens
gaggaggaggagggagaaauggccaccacaucaccccagagaaauuucuggaaucugauugagu

SEQ ID NO: 122738 - RNA, 64 nt, Homo Sapiens
gccacggugggagcugcgccguuggagcaacagucccagagaggcccuacucacauuuccuugg

SEQ ID NO: 122739 - RNA, 64 nt, Homo Sapiens
acacgaugcguauuuuaguuccuuugguauacgacccagagauaucuguaauaucuuacuaagg

SEQ ID NO: 122740 - RNA, 64 nt, Homo Sapiens
cuaaaagccacuggcagcacuguaaaacaacugacccagagaaguguaggaaggggaguaauaa

SEQ ID NO: 122741 - RNA, 64 nt, Homo Sapiens
auacgaccuguguaaggucaagggacaaaugaggcccagagagaccagcuccuucucuuuucuc

SEQ ID NO: 122742 - RNA, 64 nt, Homo Sapiens
ggaaaauccucuggcuggcuuuuuccacaagauucccagagacaaggugccccaaaaugcaaga

SEQ ID NO: 122743 - RNA, 64 nt, Homo Sapiens
aaucagacuucacacugcaauaguucccugaaaacccagagagguguccuugcaccugcauccg

SEQ ID NO: 122744 - RNA, 64 nt, Homo Sapiens
ccuccaccgcugccuaaguggaggcagggccuugcccagagaugggggcagagggcagaggcug

SEQ ID NO: 122745 - RNA, 63 nt, Homo Sapiens; identical to SEQ ID NO: 122142

SEQ ID NO: 122746 - RNA, 64 nt, Homo Sapiens
agcccgaacacccgcaucccaccuaagccuaggccccagagaucaggggcccuggcuauuuggg

SEQ ID NO: 122747 - RNA, 64 nt, Homo Sapiens
ugacaguauuagggagugaaugcucuuugggcuccccagagaccagacccucuuggcuuucccg

SEQ ID NO: 122748 - RNA, 64 nt, Homo Sapiens
aaccagcuccacggcuccugccagacagcugcugcccagagaagcaaguacugagagcccagcc

SEQ ID NO: 122749 - RNA, 64 nt, Homo Sapiens
ggggagcccacuguccugggggcccucccuguuccccagagaaaccucagccuggccagacaca

SEQ ID NO: 122750 - RNA, 64 nt, Homo Sapiens
uacuugaagggccagagccagcuccucuccccagcccagagacagugcugacggccagggagaa

SEQ ID NO: 122751 - RNA, 64 nt, Homo Sapiens
gcuccuugggaugaagagggcccuccaucccuuccccagagaugcccagccuggccuguggcug

SEQ ID NO: 122752 - RNA, 64 nt, Homo Sapiens
cuacucggccaaaccuagccccauucccacuugccccagagaaggcaacucccccccaacaaug

SEQ ID NO: 122753 - RNA, 64 nt, Homo Sapiens
cucaaagcagccuuuuguccuccugaagagcucacccagagaggugcccuucugggguccuggu

SEQ ID NO: 122754 - RNA, 64 nt, Homo Sapiens
ugccuaguccugugugccuugugguuuggaggcucccagagacgccuuggaccucuuugauucu

SEQ ID NO: 122755 - RNA, 64 nt, Homo Sapiens
aggccaggaaggcccgagaucugacccuuaucuucccagagaccgcucuccacccagcccgcuc

SEQ ID NO: 122756 - RNA, 64 nt, Homo Sapiens
auucucaucagcacuuuugucaagccaaguaaagcccagagaagagugccagaauuaagugagu

SEQ ID NO: 122757 - RNA, 64 nt, Homo Sapiens
cauuuggcaguacaaaugagucugaguguaauagcccagagauuuauauauaguugaaugucua

SEQ ID NO: 122758 - RNA, 64 nt, Homo Sapiens
uggaaacagacuuaucauuauugauuugagguuucccagagauauaguucacaguuaauuguug

SEQ ID NO: 122759 - RNA, 64 nt, Homo Sapiens
ugcuuguccagauuucacauguggcuuuguaucgcccagagaggugauaggcacacgaggauga

SEQ ID NO: 122760 - RNA, 64 nt, Homo Sapiens
auaucaauucauauuguaguuuguuagcauucuacccagagauacaguaaaggagaaaauaaaa

SEQ ID NO: 122761 - RNA, 64 nt, Homo Sapiens
aauguuuguuuauaucacugauuaauuuucuacccccagagauaauuuucauucuuguauuaua

SEQ ID NO: 122762 - RNA, 64 nt, Homo Sapiens
gaccuguccugcccuucuuagcuugaagggaaaccccagagacucuucugucagggaaaacuag

SEQ ID NO: 122763 - RNA, 64 nt, Homo Sapiens
aaucucagcucuccuaaucccaucacuuccccagcccagagaagacauuccaacccugucugau

SEQ ID NO: 122764 - RNA, 64 nt, Homo Sapiens
cugguaagaagccaaauauuuaagcucacuucuucccagagagaggaagcucugcucaggccuc

SEQ ID NO: 122765 - RNA, 64 nt, Homo Sapiens
guaucucuaaggccaauaaggauaacauuaucuacccagagaguuuagaagaaaaguaggaguc

SEQ ID NO: 122766 - RNA, 64 nt, Homo Sapiens
cucuucaccucccugcaaaccuaccagugaggcucccagagacgcagcugucucagugccaggg

SEQ ID NO: 122767 - RNA, 64 nt, Homo Sapiens
gugauggcuuugucccaucauagggggguguccccccagagacaaagcugcagagcacauucca

SEQ ID NO: 122768 - RNA, 64 nt, Homo Sapiens
gcuuuuaaggacgcuuaugaucacauugcgccuacccagagaacccaggucgucuuucuauuuu

SEQ ID NO: 122769 - RNA, 64 nt, Homo Sapiens
gccuggaaauuauaaaucucuugggcauuccuuccccagagaggguugccuucccuuuugcccu

SEQ ID NO: 122770 - RNA, 64 nt, Homo Sapiens
cuacccagugaaacucccacucugaaggcuccuacccagagauuuuaaauaucaguucuguuua

SEQ ID NO: 122771 - RNA, 64 nt, Homo Sapiens
uuggaguguaggauucccucucucaagggugggccccagagaguaucuccagcccugcaugccg

SEQ ID NO: 122772 - RNA, 64 nt, Homo Sapiens
uggcagauugugacaaucucaugguucugugauucccagagagcugccauccuaaggggacaug

SEQ ID NO: 122773 - RNA, 64 nt, Homo Sapiens
cccgaguucccccagcccuuaggggugacuucaucccagagagacuggggaccggccaggaagg

SEQ ID NO: 122774 - RNA, 64 nt, Homo Sapiens
auguggcaggcaguggggcccaggcuuccgggagcccagagagcaaggggaggagcgacaccuc

SEQ ID NO: 122775 - RNA, 64 nt, Homo Sapiens
guguggcccacuugugggagucuccuguccaccucccagagacggccacccagcgggucuggcu

SEQ ID NO: 122776 - RNA, 64 nt, Homo Sapiens
caccgccaccugccggccucgagaggggccgaugcccagagacacagcccccacggacaaaacc

SEQ ID NO: 122777 - RNA, 64 nt, Homo Sapiens
gugugagucuucucgaaggaggguugacucagaacccagagacaauacaaaaccccucacuucc

SEQ ID NO: 122778 - RNA, 64 nt, Homo Sapiens
cuacucaucccuuaacuucucccuuaccagugaccccagagacagagccaggacaggagugggg

SEQ ID NO: 122779 - RNA, 64 nt, Homo Sapiens
caauacugccuuuggaauaugacagaaucaauagcccagagagcuuagucaaagacgauaucac

SEQ ID NO: 122780 - RNA, 64 nt, Homo Sapiens
ccaucagcaagagagagcagcuggaacagcaggucccagagaacuacuucuaugugccagaccu

SEQ ID NO: 122781 - RNA, 64 nt, Homo Sapiens
ugaaggagcaccuggccuuagacagcuuggcucucccagagagguccuggggauccagcggaug

SEQ ID NO: 122782 - RNA, 64 nt, Homo Sapiens
gacuggagagugaggaggagccaguagcuacaggcccagagaugaggagcgccuggaagcagaa

SEQ ID NO: 122783 - RNA, 64 nt, Homo Sapiens
gggagugguggcucacgccuuucaagagaacccacccagagacuccuaacaggaagguguccag

SEQ ID NO: 122784 - RNA, 64 nt, Homo Sapiens
gagaugcuuaacaaaaaaaaaggaaacagcucaucccagagaagagccgagccagacugugacc

SEQ ID NO: 122785 - RNA, 64 nt, Homo Sapiens
uggggucagccuuaaguaggagccacugugacaacccagagacccuguggccguagagggaaac

SEQ ID NO: 122786 - RNA, 64 nt, Homo Sapiens
cggagcccugcuugcuguauaagccuucuggccacccagagagcugggcuuuaauguguaggaa

SEQ ID NO: 122787 - RNA, 64 nt, Homo Sapiens
uugaccaaguuacauauucucauuugccuuucuccccagagagcuuauggggagguuugaugag

SEQ ID NO: 122788 - RNA, 64 nt, Homo Sapiens
uuguggacuuggugcuagucugaagcucauuucucccagagauucuccacucccuccgcugcca

SEQ ID NO: 122789 - RNA, 64 nt, Homo Sapiens
gcagccacaagcuugcccgcccuggcucccucugcccagagacuauggaguaaggcauucagga

SEQ ID NO: 122790 - RNA, 64 nt, Homo Sapiens
gcugcacagucggugccugggaggcacguagaggcccagagagucccuggggguucugcucuga

SEQ ID NO: 122791 - RNA, 64 nt, Homo Sapiens
ucccugcagagccaauggugcacauugguuuaagcccagagauccugcuugagcccuggacuca

SEQ ID NO: 122792 - RNA, 64 nt, Homo Sapiens
ggucccacucaguccauagcagagaaugaaagggcccagagaggguggugaccucugccugaag

SEQ ID NO: 122793 - RNA, 64 nt, Homo Sapiens
ggccacuucccucccagugccagucuccauccaccccagagaggaacaggcgggugggccaugu

SEQ ID NO: 122794 - RNA, 64 nt, Homo Sapiens
agaccccagccuggggaacacgcugcccgcacugcccagagagcagugcaaacaccacaacacg

SEQ ID NO: 122795 - RNA, 64 nt, Homo Sapiens
agcgagaagccaaggccagguucuggguguagggcccagagaagcagaacagcccagagcccca

SEQ ID NO: 122796 - RNA, 64 nt, Homo Sapiens
augcacugugaccucuggcuuccccagcagcuuucccagagaggcagaggggccuuccacagcc

SEQ ID NO: 122797 - RNA, 64 nt, Homo Sapiens
ugacuccccagcccagcaccccuuccucgugggucccagagaccucaucagccuugggauagca

SEQ ID NO: 122798 - RNA, 64 nt, Homo Sapiens
cucaggacccaguccaggccuucuacgggcuaggcccagagacuuggguugcuggucccccuuc

SEQ ID NO: 122799 - RNA, 62 nt, Homo Sapiens; identical to SEQ ID NO: 122196

SEQ ID NO: 122800 - RNA, 64 nt, Homo Sapiens
cucacaguucacauucagcucagcagagcaagaccccagagaugcuuagagacaggacaccugg

SEQ ID NO: 122801 - RNA, 64 nt, Homo Sapiens
accccgacguagcugccccccuggggggccacagcccagagaaccagccuaggaacacucggga

SEQ ID NO: 122802 - RNA, 64 nt, Homo Sapiens
cggcuccaguguggggugaggcagugagguuaggcccagagagcuggaguuggcucagaugaaa

SEQ ID NO: 122803 - RNA, 64 nt, Homo Sapiens
aggcaggggcaucugucugucugcacguagguuccccagagagcccgagggccaggcagaaugg

SEQ ID NO: 122804 - RNA, 64 nt, Homo Sapiens
caaaaagguauaacuuuaaccugaggcggauuuccccagagaaaauuaauuuauugggaaugag

SEQ ID NO: 122805 - RNA, 64 nt, Homo Sapiens
aagggucaaccuggaggcagaggaaaccccaagacccagagaggccagaucucaugugcuacga

SEQ ID NO: 122806 - RNA, 64 nt, Homo Sapiens
uacagauugcccuccccggccaucacuacuccuccccagagacacacaccgcaucaguccccau

SEQ ID NO: 122807 - RNA, 64 nt, Homo Sapiens
cuccaugaacugugcucccaacacccaggcccaccccagagaccugggcagagggacaggucag

SEQ ID NO: 122808 - RNA, 63 nt, Homo Sapiens
aaaaaaaaaaaaaaaaaaaacccuagcgugacuacccagagacucugccuccuccccugccag

SEQ ID NO: 122809 - RNA, 64 nt, Homo Sapiens
ugggcugggcccuaugggaucccaauaauaaagccccagagaacuccaaaugucaggguguuug

SEQ ID NO: 122810 - RNA, 64 nt, Homo Sapiens
augcauuuagauuuauauuuacuugagcugugugcccagagaucuaggucaucucaaggcugau

SEQ ID NO: 122811 - RNA, 64 nt, Homo Sapiens
agccugagcaccguguuaccccaaggccagagggcccagagagacgagcccacuguaucugggc

SEQ ID NO: 122812 - RNA, 64 nt, Homo Sapiens
cccucauccuuccucugggaggcugcccucaagccccagagagcgcuucugaggacacaaggug

SEQ ID NO: 122813 - RNA, 64 nt, Homo Sapiens
ccauagucgucaaagcuuugcuaaggguccaagucccagagaauuacucgcaacaacuuaauuu

SEQ ID NO: 122814 - RNA, 64 nt, Homo Sapiens
gcauaauuccgaaacaaaacgcuaaaguuuucuucccagagagauccacuuguggaaaaaaagu

SEQ ID NO: 122815 - RNA, 64 nt, Homo Sapiens
ccucugagcuggugggcaggauggcuggguggcccccagagaagcacagaccugagaugggguc

SEQ ID NO: 122816 - RNA, 64 nt, Homo Sapiens
ugagccaagggcacuuugcugccaccgcugcauucccagagaucaagcagcccggugccguggc

SEQ ID NO: 122817 - RNA, 64 nt, Homo Sapiens
cacaggaaacagcaaacaguggggugaucugcagcccagagaccuucaaaugcgaacacuauaa

SEQ ID NO: 122818 - RNA, 64 nt, Homo Sapiens
guaguuggauugguacauucacugcugccagguacccagagaugucaucucucuccagguagag

SEQ ID NO: 122819 - RNA, 64 nt, Homo Sapiens
ggcaggggugggagagccagcucucucuacccggcccagagaccccuuccuuuccucugcagca

SEQ ID NO: 122820 - RNA, 64 nt, Homo Sapiens
cagucucagaugaccacggguuuaaccuucuuaucccagagacacccaauucuagagcuuuaug

SEQ ID NO: 122821 - RNA, 64 nt, Homo Sapiens
ucccuuugaccacaucgcucuaggauaacuggcacccagagaaaaggacuccucagaaaaaaca

SEQ ID NO: 122822 - RNA, 64 nt, Homo Sapiens
uggcccgaugacuuaaagggaaaaauaauucauucccagagaugagucagaacagucuccucaa

SEQ ID NO: 122823 - RNA, 64 nt, Homo Sapiens
augugcuugggcuaugguggccauaaacccugagcccagagagcuugggucacugucaccugag

SEQ ID NO: 122824 - RNA, 64 nt, Homo Sapiens
gacuaagguggcuuucccacuccuggcccacagccccagagagccugucugugcauccugaacc

SEQ ID NO: 122825 - RNA, 64 nt, Homo Sapiens
ccggcuuccagggagaccuccccgcccagcagcccccagagacacaacaaccuaccuuccagcc

SEQ ID NO: 122826 - RNA, 64 nt, Homo Sapiens
gagguccauccccagcaaauguuuuggagguccccccagagagcagagugggccauggcagaag

SEQ ID NO: 122827 - RNA, 64 nt, Homo Sapiens
uguccuaaaaauaggggccguuuucuuacacacccccagagagaggagggacugucacacuggu

SEQ ID NO: 122828 - RNA, 50 nt, Homo Sapiens; identical to SEQ ID NO: 122225

SEQ ID NO: 122829 - RNA, 64 nt, Homo Sapiens
cuguguuugcuuguuugcccaccuuuggcugauacccagagaaccugggcacuugcugccugau

SEQ ID NO: 122830 - RNA, 64 nt, Homo Sapiens
cuuggucuggggcauuuuccucuccuuaucuugccccagagacaauucaagauuucuauauggg

SEQ ID NO: 122831 - RNA, 64 nt, Homo Sapiens
ucuuucuucuguccucagcuugagaucuucuuagcccagagagcaguggaguugagugaggagg

SEQ ID NO: 122832 - RNA, 64 nt, Homo Sapiens
gccucacuauuggcagaaaagaccccauuuaaaacccagagaacacuggagggggaugcucuag

SEQ ID NO: 122833 - RNA, 64 nt, Homo Sapiens
caccagggaugguacuagggggaagugacaaggccccagagacucagagggaggaaucgaggaa

SEQ ID NO: 122834 - RNA, 64 nt, Homo Sapiens
ucucacucaccacuaccagccagccucagaaggccccagagagacccugcaagaccacggaggg

SEQ ID NO: 122835 - RNA, 64 nt, Homo Sapiens
gaggguuagggaugucuccacccugauggggugucccagagacauuuucccauggcaguccucc

SEQ ID NO: 122836 - RNA, 64 nt, Homo Sapiens
cggucggggcaucuggccuggccagugcccugaucccagagagcccgaggaggugucucaggcu

SEQ ID NO: 122837 - RNA, 64 nt, Homo Sapiens
uggagcagcagcaggacagacccccacgaggccccccagagaggaggaagaucccacggaggaa

SEQ ID NO: 122838 - RNA, 64 nt, Homo Sapiens
acugccugagggacaacagacaucagaacaaacccccagagagaaacagucaaaaucagggccc

SEQ ID NO: 122839 - RNA, 64 nt, Homo Sapiens
ccaagaaaaugcuucacucaacaguccucaugugcccagagauguuuauagaacuguuugaauu

SEQ ID NO: 122840 - RNA, 64 nt, Homo Sapiens
ccccguggccccugugccuguucggugggggugucccagagaagccuggcaccaguacccccgu

SEQ ID NO: 122841 - RNA, 64 nt, Homo Sapiens
cggggcccccccacccccaagagcuggcagcauacccagagaucagggggcagccaagaagccg

SEQ ID NO: 122842 - RNA, 64 nt, Homo Sapiens
gccccaccuucuucaucccugcugccugcaccaccccagagaagaaaccuaccuugcuuuggga

SEQ ID NO: 122843 - RNA, 64 nt, Homo Sapiens
uccuugaggagaacaagugccacggccgcacccucccagagaacggcaucgagcuagcucccug

SEQ ID NO: 122844 - RNA, 64 nt, Homo Sapiens
auuggcuuaugccagauaccagggguaccuagaacccagagaacgugggggugggggaggggag

SEQ ID NO: 122845 - RNA, 64 nt, Homo Sapiens
gcuguccucucauugggugaccaggacuauugagcccagagagaacggggaugcuugccccucu

SEQ ID NO: 122846 - RNA, 64 nt, Homo Sapiens
cuguccuuccccucauccaccaugaccugcagggcccagagacaccccucuaggucugggcagc

SEQ ID NO: 122847 - RNA, 64 nt, Homo Sapiens
uagggcuggagggacagggagugcugacaggagacccagagagccguugguuuaggcauccugu

SEQ ID NO: 122848 - RNA, 64 nt, Homo Sapiens
ucucugaugugccagugggcccuuccuaugcucacccagagaacuuccuuccugggggucuguu

SEQ ID NO: 122849 - RNA, 64 nt, Homo Sapiens
cuucaccagcaccugccucucucccugcccgucucccagagauggauccaggcucguagaguca

SEQ ID NO: 122850 - RNA, 64 nt, Homo Sapiens
ggcguccuggugaggacaagcccucuucucugggcccagagagaucccagccccuaccuugaga

SEQ ID NO: 122851 - RNA, 64 nt, Homo Sapiens
agcucaugugucuaaagugauaaaagcuguauggcccagagaggaaagaagauccuaucaugaa

SEQ ID NO: 122852 - RNA, 64 nt, Homo Sapiens
ggacugggagggcccacuucuggugggaucugugcccagagauggagcagacuggugagcagac

SEQ ID NO: 122853 - RNA, 64 nt, Homo Sapiens
gcaggcagccacgcccugcacagauaggcaggaccccagagagggacugaccccugccagggca

SEQ ID NO: 122854 - RNA, 64 nt, Homo Sapiens
gcccaggaaguccccguggucagagcaccggccucccagagaaaggaagacccucagauguggc

SEQ ID NO: 122855 - RNA, 64 nt, Homo Sapiens
cagaggaaauaaaguuuaauaucccugcugacugcccagagacucuacugccacuucgccuuac

SEQ ID NO: 122856 - RNA, 64 nt, Homo Sapiens
agcaugucuuccuuuaccuccaaggccgagccagcccagagaggaaagauagcaagcuaccuuc

SEQ ID NO: 122857 - RNA, 64 nt, Homo Sapiens
acccaguucuagguacugucugggaugcccuugccccagagagacagucuaggagggggauaaa

SEQ ID NO: 122858 - RNA, 64 nt, Homo Sapiens
uggcagggcucagagaagcagaacuccccuacagcccagagaugaggucagagguggggacaga

SEQ ID NO: 122859 - RNA, 64 nt, Homo Sapiens
ggcccagagguuuacaaguugggcucuccuagugcccagagacaccgaaggggacggccggcgg

SEQ ID NO: 122860 - RNA, 64 nt, Homo Sapiens
gucucccuacuuuuucucacuggccucguuuugacccagagaaagccuauggaaguuaugcagu

SEQ ID NO: 122861 - RNA, 64 nt, Homo Sapiens
aggggccgcuccaggccccacagagcaggagacccccagagaaagccggggcuggcaggaggcg

SEQ ID NO: 122862 - RNA, 64 nt, Homo Sapiens
agccucaacugacagcugaggaaaggcaauuaggcccagagaggcagagacacucgcuuaagau

SEQ ID NO: 122863 - RNA, 64 nt, Homo Sapiens
aggccacgcccagcuuccuccccccgacuccccccccagagacacggucccaccauguuaccca

SEQ ID NO: 122864 - RNA, 64 nt, Homo Sapiens
ggaccacaugagccuucuccggaaggcucauguucccagagaagguucucaguggcaaaaccua

SEQ ID NO: 122865 - RNA, 64 nt, Homo Sapiens
ugcauugcuuucuccugguugaagggaugagauucccagagaccggcagagcauuuuccuuaug

SEQ ID NO: 122866 - RNA, 64 nt, Homo Sapiens
cgucacaccaguguuaugccugaugugugagauucccagagaguucuucggugcuaggaaagag

SEQ ID NO: 122867 - RNA, 64 nt, Homo Sapiens
ccucagaucaguauugugcauacagaagacuggccccagagagagcaaaaggagaaagauaaaa

SEQ ID NO: 122868 - RNA, 64 nt, Homo Sapiens
uaguuuauauaagaauugcuuacuauccuguagacccagagacaaguuugguuugaauuauuag

SEQ ID NO: 122869 - RNA, 64 nt, Homo Sapiens
gaacggcaaucuuuccacacaggcugagacacagcccagagacuaugugcaaagcaguauguac

SEQ ID NO: 122870 - RNA, 64 nt, Homo Sapiens
ggugugugacgaggcccccgauguucuugauuuucccagagaagcaaauaaacagcgugaacag

SEQ ID NO: 122871 - RNA, 64 nt, Homo Sapiens
caccucucccccaaggccacugcgcucuugggaccccagagaaaacccggagcaagcaggagug

SEQ ID NO: 122872 - RNA, 64 nt, Homo Sapiens
ccuggcccauguggagcuggcaugggggacacagcccagagacagagaagcuuaugaggaagug

SEQ ID NO: 122873 - RNA, 64 nt, Homo Sapiens
cacacaaagcucuucaggcagcugauagauuucccccagagagcuauucaaggacuuccuaagg

SEQ ID NO: 122874 - RNA, 64 nt, Homo Sapiens
aaacauggaagaugaaaggggaggggaugucaggcccagagaagcaaguggcuuucaacacaca

SEQ ID NO: 122875 - RNA, 64 nt, Homo Sapiens
ccaccccauucccgcagugggagcaaacugcaugcccagagacccagcggacacacgcgguuug

SEQ ID NO: 122876 - RNA, 64 nt, Homo Sapiens
gcccccucccaaacugugacugguauuuauuggacccagagaaccgggccgggcacagcguggc

SEQ ID NO: 122877 - RNA, 64 nt, Homo Sapiens
ucuguauggacccuuccugccauuuguauuuugucccagagagaaaggcucuuuggggggcccc

SEQ ID NO: 122878 - RNA, 64 nt, Homo Sapiens
gccuccucuggagccuucgccuggggagacagaacccagagagaaacaagagaguccagaaguc

SEQ ID NO: 122879 - RNA, 64 nt, Homo Sapiens
accuugaaggagccccccacauccuccccuacaucccagagaugccaccacuugugucuccaca

SEQ ID NO: 122880 - RNA, 53 nt, Homo Sapiens; identical to SEQ ID NO: 122277

SEQ ID NO: 122881 - RNA, 64 nt, Homo Sapiens
cagggaacagcaugcccccuccggggucaugccacccagagacugucgcugucuauggccccaa

SEQ ID NO: 122882 - RNA, 64 nt, Homo Sapiens
ccgucugggguccaucucccuccugagcuagaaacccagagauggaggcugucuugcuauggca

SEQ ID NO: 122883 - RNA, 64 nt, Homo Sapiens
gcugaguaguggggauccagagaggacccccgcccccagagacuugguuuuggcuccagccuuc

SEQ ID NO: 122884 - RNA, 64 nt, Homo Sapiens
gggccaccagaaggugacacccccagaaucccuccccagagacugcaccagcgcagccagcagg

SEQ ID NO: 122885 - RNA, 64 nt, Homo Sapiens
cacucaagcaauagggccccgccauaggaagacccccagagagagggucagcaggggggccccg

SEQ ID NO: 122886 - RNA, 64 nt, Homo Sapiens
gaucagaacaacggaggauagcuuugugccuggacccagagagugugggacuccccgcuucauc

SEQ ID NO: 122887 - RNA, 64 nt, Homo Sapiens
gccuuggccccaagugaacucaagauuuggcagccccagagaugccaacugcagcaugcccacc

SEQ ID NO: 122888 - RNA, 64 nt, Homo Sapiens
ucgguuuaaccagggcucuguaagaccacucccacccagagacuuguguggccugguguggccu

SEQ ID NO: 122889 - RNA, 64 nt, Homo Sapiens
cucaucaaaccagguguccuuggcauuguguccacccagagagcucacuguuuucuuuucuuuu

SEQ ID NO: 122890 - RNA, 64 nt, Homo Sapiens
cuuuucccauucagcugugagugcccaacccuaucccagagaccuugaugcuuggccucccaau

SEQ ID NO: 122891 - RNA, 64 nt, Homo Sapiens
guuuuccuguaaguaauuaagaagacuaaguagccccagagauaagaccuccucggaucauugu

SEQ ID NO: 122892 - RNA, 64 nt, Homo Sapiens
ugcccaagcaguccucacuuugcuuaacaguggccccagagagcaggaguagugaugcugguga

SEQ ID NO: 122893 - RNA, 64 nt, Homo Sapiens
ugggaugggaagaggcucuuugcaaacgaggguccccagagaagacuggcggggaccugauggg

SEQ ID NO: 122894 - RNA, 64 nt, Homo Sapiens
ggaggagguggaacugauguaggggguggcacuccccagagacugcccucacgaggggacuggg

SEQ ID NO: 122895 - RNA, 64 nt, Homo Sapiens
gcacugcuacccucuauuucccacucagggcugucccagagagaaggcagccgaacugaggauu

SEQ ID NO: 122896 - RNA, 64 nt, Homo Sapiens
aggugagagggaugcaggcauggguuggggguggcccagagaaacuuaugacagcuguacacaa

SEQ ID NO: 122897 - RNA, 64 nt, Homo Sapiens
agggccugcccgggaaggugcccaccaccugugccccagagagcucugccccacccacuuccuc

SEQ ID NO: 122898 - RNA, 64 nt, Homo Sapiens
aauccagccccgaaugucagcaggacggccccgucccagagaaccagcagcacccugcagugcc

SEQ ID NO: 122899 - RNA, 64 nt, Homo Sapiens
cccccugaggggugagcccuaccccuccccagcucccagagaggugaacacccaggccagggac

SEQ ID NO: 122900 - RNA, 64 nt, Homo Sapiens
cacugugugcccccuggagccccaggacuuuguccccagagaccccucuccccuuggugccuaa

SEQ ID NO: 122901 - RNA, 64 nt, Homo Sapiens
uuccacacugaaucucaccuugcugggaccugcucccagagacccggcuguuggggacuuuacc

SEQ ID NO: 122902 - RNA, 64 nt, Homo Sapiens
uugccacacugaaucucaccugcugggaccugcucccagagacccggcggucggggacuuuacc

SEQ ID NO: 122903 - RNA, 64 nt, Homo Sapiens
uugccacacugaaugucaccugcugggaccugcucccagagacccggcuguuggggacuuuacc

SEQ ID NO: 122904 - RNA, 64 nt, Homo Sapiens
gcauggaggcuccacgcaacgucaaccaauggcacccagagaggccagggaauuaauuccccca

SEQ ID NO: 122905 - RNA, 64 nt, Homo Sapiens
cuacuagacugggucagcaauaguacccagugagcccagagauccugggacuuccugcucauca

SEQ ID NO: 122906 - RNA, 64 nt, Homo Sapiens
cugggucuagaaagcggcucgugggaugaggcuucccagagaccccuggacagcaggagagggu

SEQ ID NO: 122907 - RNA, 64 nt, Homo Sapiens
uccaccucaacuucuggcugucauuggcccccaccccagagaccgauaccacacauuucucauc

SEQ ID NO: 122908 - RNA, 64 nt, Homo Sapiens
cacgcccgacgcagacccggaccucuggaggguccccagagacccaggccaucagcccaccucc

SEQ ID NO: 122909 - RNA, 64 nt, Homo Sapiens
aaacuccccaaggugccugaccugacaugaagcucccagagauaaagucugugaaaugaaaguc

SEQ ID NO: 122910 - RNA, 64 nt, Homo Sapiens
aaacucccuaaaaugccugacagcucccgaaagucccagagaugaugugcaccucccggaagug

SEQ ID NO: 122911 - RNA, 64 nt, Homo Sapiens
aagcucccugagaugaaacucagcuuccaaaagucccagagaugaugugcaccucccagaagug

SEQ ID NO: 122912 - RNA, 64 nt, Homo Sapiens
cagagacccaaagggagagaggaagagguggaaacccagagagagagaaagagacccagaaaaa

SEQ ID NO: 122913 - RNA, 64 nt, Homo Sapiens
uugagaauguucaucucuccgacccucauuccuucccagagaugcagcccugacacuccuuuca

SEQ ID NO: 122914 - RNA, 56 nt, Homo Sapiens; identical to SEQ ID NO: 122311

SEQ ID NO: 122915 - RNA, 64 nt, Homo Sapiens
ucauuuagggcugaaacacuuccagccauuauaucccagagagcaaaaucuuuaguaggaaucc

SEQ ID NO: 122916 - RNA, 64 nt, Homo Sapiens
uugcuguaauuaucugcccugaaccuccagugaccccagagacuuuguccuaggugucugcugu

SEQ ID NO: 122917 - RNA, 64 nt, Homo Sapiens
gaaaccuuuagaacaucucugcuuuggagaaagacccagagaucaggcagaggugcagauucaa

SEQ ID NO: 122918 - RNA, 64 nt, Homo Sapiens
gguucuggggccaaggccuacccaggggccucugcccagagaacucacaacccccucucugacc

SEQ ID NO: 122919 - RNA, 64 nt, Homo Sapiens
auuggcuuguaaaccuucgucucccucucuuuuacccagagacagcacauacgugugcacacgc

SEQ ID NO: 122920 - RNA, 64 nt, Homo Sapiens
cucugucacuugcucuuucacucucucucucauucccagagagccacgggggagggaucacccu

SEQ ID NO: 122921 - RNA, 64 nt, Homo Sapiens
gagauaaggucaugggagaguggguggggacacacccagagacuggcuuugggauugggcacug

SEQ ID NO: 122922 - RNA, 64 nt, Homo Sapiens
guguauucccguuuuacagauaaggaaacugaggcccagagagcugaaguacugcacccagcau

SEQ ID NO: 122923 - RNA, 64 nt, Homo Sapiens
uccauucccaacuagacauuaccaaagugaccuacccagagauugcuucucauccccaguccca

SEQ ID NO: 122924 - RNA, 64 nt, Homo Sapiens
ucaugaaugggauuagugcccuuauauaaagagacccagagagcuccaucaccccuucugccau

SEQ ID NO: 122925 - RNA, 64 nt, Homo Sapiens
uuucacaccuguaugauagucauggaaacugaagcccagagagguuaagaaauuugcuaggauc

SEQ ID NO: 122926 - RNA, 64 nt, Homo Sapiens
ugggcccugcccaacuucaggcagaacagggaggcccagagauuacagauccccuccuguaagu

SEQ ID NO: 122927 - RNA, 64 nt, Homo Sapiens
guacaguuugacacugaucugguccaugaggcugcccagagaaagcacugcuucuguaugucuc

SEQ ID NO: 122928 - RNA, 64 nt, Homo Sapiens
gaugcugcugcaacuggaagaagcuggaaccagucccagagaggcucggccuggaaacaguccc

SEQ ID NO: 122929 - RNA, 64 nt, Homo Sapiens
ggccugggagucgggcggccccggucaggcccugcccagagagcuccugguuccugaacugagc

SEQ ID NO: 122930 - RNA, 64 nt, Homo Sapiens
uuagcccccuacuguggcccccauagccccauaacccagagagggagcuggacuucagggagcc

SEQ ID NO: 122931 - RNA, 64 nt, Homo Sapiens
cugcugccagcucucaacauagcaggccauaggacccagagaagaaucccagcguugcucaaag

SEQ ID NO: 122932 - RNA, 64 nt, Homo Sapiens
uuagaauucuuuggcgggaaggguaugauggguucccagagacaagaagcccaaccuucuggcc

SEQ ID NO: 122933 - RNA, 62 nt, Homo Sapiens; identical to SEQ ID NO: 122330

SEQ ID NO: 122934 - RNA, 64 nt, Homo Sapiens
cgucuguaccucaggggaugccccgcuguggucacccagagaaucacccuuccuggucuacaga

SEQ ID NO: 122935 - RNA, 64 nt, Homo Sapiens
cacauggggaguagacccugaagccucauguuaccccagagagacaagaccugagugaccaguc

SEQ ID NO: 122936 - RNA, 64 nt, Homo Sapiens
ugcaaucuucuagcucuccaaaacugcuaaacaucccagagauuucugcucugaaaaaugggga

SEQ ID NO: 122937 - RNA, 64 nt, Homo Sapiens
uugcugcugcggcccuguccgcaguaaggcacuacccagagagcacagggcucaggugggugga

SEQ ID NO: 122938 - RNA, 64 nt, Homo Sapiens
gggcaagggcuuugggcaagcagugcuagaagaccccagagagauccugggcugggcagaguga

SEQ ID NO: 122939 - RNA, 64 nt, Homo Sapiens
cuugacaccggucucugcugaggccuaugcaguucccagagacucuugaaaaugcauguuccuc

SEQ ID NO: 122940 - RNA, 64 nt, Homo Sapiens
agcgcccuggucucuugagcaggggcaaggagagcccagagagaccuucaggagcucucuaccc

SEQ ID NO: 122941 - RNA, 64 nt, Homo Sapiens
aaggggcagcuuugcaaggagcagcuacuccugccccagagauguccugcggcaccggguucag

SEQ ID NO: 122942 - RNA, 64 nt, Homo Sapiens
ccaugggccaccugcucuguccugccugaccuuacccagagaagccaacagggcaacuggaacc

SEQ ID NO: 122943 - RNA, 64 nt, Homo Sapiens
uggcugugacccguccaagggaaggggaaaggaccccagagaaggugguguccugcacggaaua

SEQ ID NO: 122944 - RNA, 64 nt, Homo Sapiens
cgcugugauuggcaggaggcgcacccccaggauucccagagagacccugggccucagccuccag

SEQ ID NO: 122945 - RNA, 64 nt, Homo Sapiens
gcaggugugugggacagacuuggggccaccaaaacccagagaugccuuuuccacagccacucac

SEQ ID NO: 122946 - RNA, 64 nt, Homo Sapiens
gggucugcuggagucuccacagcaggccccccaacccagagacugcuccagcacagcagagacc

SEQ ID NO: 122947 - RNA, 64 nt, Homo Sapiens
caaagccugcacaacccaaccucgcuuagggacccccagagaugcuggaaucgcuaggaggguu

SEQ ID NO: 122948 - RNA, 64 nt, Homo Sapiens
cgugggcagggcaugcgcuccccuggcugagcaccccagagauucuccugcaccuuccucaugc

SEQ ID NO: 122949 - RNA, 64 nt, Homo Sapiens
gagggagagaacacgcugugaaaacacagaagcucccagagaagccuucucagcuuuuaucucu

SEQ ID NO: 122950 - RNA, 64 nt, Homo Sapiens
gcagaaaggcuggaguuauuauucaacucaaucucccagagaacucagaggcuacaguuucuac

SEQ ID NO: 122951 - RNA, 64 nt, Homo Sapiens
gagcugcucugccuuccagcgcaccucucacccacccagagauguacuauagugagcccaugca

SEQ ID NO: 122952 - RNA, 64 nt, Homo Sapiens
acaaaaaagcccaacuugccgccaggaggcuucucccagagaggaaacaaaaucugagucucca

SEQ ID NO: 122953 - RNA, 64 nt, Homo Sapiens
gggcuccacccacuagaugccaguggcacccccucccagagaugacaaacgaaaaugucucuag

SEQ ID NO: 122954 - RNA, 64 nt, Homo Sapiens
gcagaagaggcucccaggcccaagcucugugugacccagagaaauaaagaugccucaguguggc

SEQ ID NO: 122955 - RNA, 64 nt, Homo Sapiens
aggccagcccccaaugguccccuuacggacaggucccagagauggacagaggcacccagggccc

SEQ ID NO: 122956 - RNA, 64 nt, Homo Sapiens
ggacccguguccucagagcaccacacacugagcacccagagacagcgggccuggcagcgggccg

SEQ ID NO: 122957 - RNA, 64 nt, Homo Sapiens
acccaggucugcugcccaggaacccuccagaccucccagagagugaauaaagugugacuugcaa

SEQ ID NO: 122958 - RNA, 64 nt, Homo Sapiens
gucaccauggucuaaucccaagagggacucgucacccagagaccucaaaaggccccaggccuac

SEQ ID NO: 122959 - RNA, 64 nt, Homo Sapiens
gcugaggagcaggugucccugagaacccaaacuucccagagaguaugugagaaccaaccaauga

SEQ ID NO: 122960 - RNA, 54 nt, Homo Sapiens; identical to SEQ ID NO: 122357

SEQ ID NO: 122961 - RNA, 64 nt, Homo Sapiens
gcucuauauaaguaggggcagcuuagcccugaggcccagagaccugcuguccuuuuucuccuug

SEQ ID NO: 122962 - RNA, 64 nt, Homo Sapiens
ccagaugcuaagcgcuucagagaggaggugucugcccagagauguggagcagaagcugggcccu

SEQ ID NO: 122963 - RNA, 64 nt, Homo Sapiens
uaaagaugccucaguguggccaagcucugugugacccagagaaagcagaagaggcucccaggcc

SEQ ID NO: 122964 - RNA, 64 nt, Homo Sapiens
gcggcugagaaugagaacgcccucuuucccuguucccagagaaugcugaagauucagacaggaa

SEQ ID NO: 122965 - RNA, 64 nt, Homo Sapiens
aaaaagugacuugcccaagguuuggacacaggaccccagagaggagaaagggcucauuaagccu

SEQ ID NO: 122966 - RNA, 64 nt, Homo Sapiens
aucugagaaccaaccaaugagagaacccaaacuucccagagagugcugaggagcaggugucccu

SEQ ID NO: 122967 - RNA, 64 nt, Homo Sapiens
gacagcugcucaggcccuaacacucccugggcuucccagagaguggccccugcucagucagccc

SEQ ID NO: 122968 - RNA, 64 nt, Homo Sapiens
gugcccggagcuggccguguuaagggcuaggccacccagagacugccaccuaugccacagugcc

SEQ ID NO: 122969 - RNA, 64 nt, Homo Sapiens
ggacuacucucuucaccccugaaaggggcucccucccagagaagccuuggccugaguaaacuug

SEQ ID NO: 122970 - RNA, 64 nt, Homo Sapiens
agaggaggcuguugguaggagaagggacaagauucccagagaggggugcuaaggggauggggaa

SEQ ID NO: 122971 - RNA, 64 nt, Homo Sapiens
ggguccuugggccuggcuucauaugucuugggaucccagagauugcacccaccuaaagacaugu

SEQ ID NO: 122972 - RNA, 64 nt, Homo Sapiens
aaagugaugaggagacugagggacacaccuguaucccagagagcucugggaaaaugaacgucca

SEQ ID NO: 122973 - RNA, 64 nt, Homo Sapiens
aaggccaggggucuuggugcgcacccgugacccacccagagagcucaccuccugcggcagaaca

SEQ ID NO: 122974 - RNA, 64 nt, Homo Sapiens
cuagguacaaugucuaucaggaaagcaaagcuuccccagagacgcucagcuuguauccauugac

SEQ ID NO: 122975 - RNA, 64 nt, Homo Sapiens
uuguuaucuuaugcuugagguaggcacugguuugcccagagaauuuuuauuuuucccagaccac

SEQ ID NO: 122976 - RNA, 64 nt, Homo Sapiens
agaguggucgugagcuggucuuggggcacaauuacccagagauauauuuauuaacagccaaccu

SEQ ID NO: 122977 - RNA, 64 nt, Homo Sapiens
gggaacugaaauccuugagaguuccggggagaaacccagagaugccugauuucauuccucgaug

SEQ ID NO: 122978 - RNA, 64 nt, Homo Sapiens
acauuccacccuguuacuuauguagaaacugaggcccagagagggaagaugaccugccccaagu

SEQ ID NO: 122979 - RNA, 64 nt, Homo Sapiens
ccucacuugcuucuuauccuuacacucccccagccccagagaaacugccacauacaccacaaaa

SEQ ID NO: 122980 - RNA, 64 nt, Homo Sapiens
uuauaacccagacuaagguugaacaaccugcaugcccagagaaaacuauggcgacaaaggggaa

SEQ ID NO: 122981 - RNA, 64 nt, Homo Sapiens
aagaaacuuauuauuggcuucuguuucauauggacccagagagccccaccaaaccuacgucaag

SEQ ID NO: 122982 - RNA, 64 nt, Homo Sapiens
ccagaaacuagacauuagaauguugaggcaguuucccagagaaacaagcauauugccucaugga

SEQ ID NO: 122983 - RNA, 64 nt, Homo Sapiens
aaccugccuccccuccauagucuuguuggagaagcccagagagaaugggacuccaacuaaggga

SEQ ID NO: 122984 - RNA, 64 nt, Homo Sapiens
uguaauuugccugagaucaaugaguaaauggaggcccagagaaaugauauccucuucuuaaaaa

SEQ ID NO: 122985 - RNA, 64 nt, Homo Sapiens
ggggaauuguuccuguaaauuuuuucuaaagagucccagagaauuccccaaaauggaccuuuuu

SEQ ID NO: 122986 - RNA, 64 nt, Homo Sapiens
cucccauccacccuucuccauuucaaauugugaacccagagacagccagagcauccauggccaa

SEQ ID NO: 122987 - RNA, 64 nt, Homo Sapiens
gcuaugcugcuuuuccaauuacaaugauucuugucccagagagguagguauaccuacagcagcu

SEQ ID NO: 122988 - RNA, 56 nt, Homo Sapiens; identical to SEQ ID NO: 122385

SEQ ID NO: 122989 - RNA, 64 nt, Homo Sapiens
cagagguggguaggagguuacucccucgggcaggcccagagagcagaccgugaacaccugcuuc

SEQ ID NO: 122990 - RNA, 59 nt, Homo Sapiens; identical to SEQ ID NO: 122387

SEQ ID NO: 122991 - RNA, 64 nt, Homo Sapiens
caucauguucucuuuuuguuccauaggaaagauacccagagaccaaaauaucugccaucaucug

SEQ ID NO: 122992 - RNA, 64 nt, Homo Sapiens
ggaagggacuugaccgagguaggggaaaugaaggcccagagaaguauaaccuacuuacuccgua

SEQ ID NO: 122993 - RNA, 64 nt, Homo Sapiens
uaugcugccacuucacaucccaggcuuacaucuucccagagaacgcugccaccugcccugcugc

SEQ ID NO: 122994 - RNA, 64 nt, Homo Sapiens
ggguguccuggcccuuagugguggccaagcgugacccagagaugcugaagccaaaaaugaagcc

SEQ ID NO: 122995 - RNA, 64 nt, Homo Sapiens
uacaagaugugggaaucagcguuacagaaaugaucccagagaccuaaccaagggccuaauguuu

SEQ ID NO: 122996 - RNA, 64 nt, Homo Sapiens
caucugcaugauuggcauuaguuaccacagccugcccagagagaaacuaucuucucccaacauu

SEQ ID NO: 122997 - RNA, 64 nt, Homo Sapiens
ggacgaagcgaggagaguucggguuagggauuccccgggagagagcgacagguaacgcagugcg

SEQ ID NO: 122998 - RNA, 64 nt, Homo Sapiens
ggagcgaagauccggaacucgcgucgcccgagccccgggagagacgaagacagcccgguaggcu

SEQ ID NO: 122999 - RNA, 64 nt, Homo Sapiens
augcaggggauagcagugaggucagaagucuuucccgggagagagauggccuggguuaucauug

SEQ ID NO: 123000 - RNA, 64 nt, Homo Sapiens
gacagccggggcugggugcugcaggggcuucagcccgggagagggggugggcguguucuuugug

SEQ ID NO: 123001 - RNA, 64 nt, Homo Sapiens
ccccucacaccaccgccaggagaggccuuucccaccgggagagaaacuuccagaccagccccuc

SEQ ID NO: 123002 - RNA, 64 nt, Homo Sapiens
ccccucacaccacagccaggagaggccuuucccaccgggagagaaacuuccagaccagcccucu

SEQ ID NO: 123003 - RNA, 64 nt, Homo Sapiens
gcccucucacuacagccagaagaggccuuucccaccgggagaggaacuuccagaccagccccuc

SEQ ID NO: 123004 - RNA, 64 nt, Homo Sapiens
cuuuccccaauccccagguccagccccaccuuccccgggagaagacagggggccucucugccuc

SEQ ID NO: 123005 - RNA, 64 nt, Homo Sapiens
cccccuccucuccccagacccacaccuguguccuccgggagaggagaggcugcagaggcgggga

SEQ ID NO: 123006 - RNA, 64 nt, Homo Sapiens
ggccaggagcccuggcccgcaagagggacagagcccgggagagacucgcucacucccauguugg

SEQ ID NO: 123007 - RNA, 64 nt, Homo Sapiens
ccgcgcuuuccccuccucccugggauggacgcugccgggagacugccaguggagacggaaucug

SEQ ID NO: 123008 - RNA, 64 nt, Homo Sapiens
cccagaggcucccggagacuaaccugcuguuggcccgggagagcucggggagcccuacccgcca

SEQ ID NO: 123009 - RNA, 64 nt, Homo Sapiens
ccuuagacgcaggaugggccacggcugucugaggccgggagaugccacccccgugcaacccagg

SEQ ID NO: 123010 - RNA, 64 nt, Homo Sapiens
uggccauugguaaaaagacucgguggcaauaguuccgggagaaugaaagggaggugacuucgcc

SEQ ID NO: 123011 - RNA, 64 nt, Homo Sapiens
gaugaauauauauauauauauauauauacacacacacacagaaaauuuuauaugugugugugga

SEQ ID NO: 123012 - RNA, 64 nt, Homo Sapiens
aucaugugcccuauaaaagucuggaaagagaagucacacagacaaaaaauaaaaaagucuuccu

SEQ ID NO: 123013 - RNA, 64 nt, Homo Sapiens
uaaauauagaaaaaugaaacgauaucauuaggaucacacagaguaaaauaauuuugugagccca

SEQ ID NO: 123014 - RNA, 64 nt, Homo Sapiens
cacacacacacacacgggauuguguguauacacacacacagacauguaaauauauaucugugua

SEQ ID NO: 123015 - RNA, 64 nt, Homo Sapiens
agucugugugugaggcauagccccuggacacacacacacagacacacacacugccuggaugcau

SEQ ID NO: 123016 - RNA, 64 nt, Homo Sapiens
gcacacacgcacaugcacagauaugccgccugggcacacagauaagcugcccaaaugcacgcac

SEQ ID NO: 123017 - RNA, 64 nt, Homo Sapiens
ccggacacacacgugcacagauaugcugccuggacacacagauaaugcugccuugacacacaca

SEQ ID NO: 123018 - RNA, 64 nt, Homo Sapiens
acacacacgcacgcagauaugcugccuggacacacacacagauaaugcugccucaacacucaca

SEQ ID NO: 123019 - RNA, 64 nt, Homo Sapiens
ugggguacacugaacuucaacauacacacacagacacacagaugauuacacgcacauagccacg

SEQ ID NO: 123020 - RNA, 64 nt, Homo Sapiens
cacagaugugggguacacuguagccacgcauacacacacagacacugcauagauuacacgcaca

SEQ ID NO: 123021 - RNA, 64 nt, Homo Sapiens
gcacauuucacacacauauaacacauuacacacacacacagaauacaccuguaugugcacauac

SEQ ID NO: 123022 - RNA, 64 nt, Homo Sapiens
uggacacaguacaauucuucaacauacagaaacacacacagauaugugauagcauacaaauuca

SEQ ID NO: 123023 - RNA, 64 nt, Homo Sapiens
cccaaaccacuaaaaacuaccacaggcaugcacacacacagaacaaugcaacagaagacaaaag

SEQ ID NO: 123024 - RNA, 64 nt, Homo Sapiens
gaggcuggaggagccacuggcauaucucuaacaccacacagaaagcagccuaggaaaccuuaac

SEQ ID NO: 123025 - RNA, 64 nt, Homo Sapiens
aaagucuuuccaaacuguuuaacaaaacgaaauacacacagaaacaugcccacacagacaaaaa

SEQ ID NO: 123026 - RNA, 64 nt, Homo Sapiens
aaaaaacaaaacgaaauacaccuaugcucaugcccacacagacauccuuuucaguauaaccucc

SEQ ID NO: 123027 - RNA, 64 nt, Homo Sapiens
uggccacccucccaccacagacaggccugggugccacacagagggcagacccuucugccccaug

SEQ ID NO: 123028 - RNA, 64 nt, Homo Sapiens
uauauuaaagcacaaguuuccacucaugcucacacacacagagauccacuugcacacacgcaca

SEQ ID NO: 123029 - RNA, 64 nt, Homo Sapiens
aaguggguccuuauguacacaccacguucacacacacacagagggaccacgugugcacgcauga

SEQ ID NO: 123030 - RNA, 64 nt, Homo Sapiens
ggguggcggcguuugcugugaaccacgcucaggccacacagagacacauacuugguuucuggga

SEQ ID NO: 123031 - RNA, 64 nt, Homo Sapiens
cauccacacuucaaauugagcacacacacacacacacacagacuggcauacucacacacagaca

SEQ ID NO: 123032 - RNA, 64 nt, Homo Sapiens
cacacacacacacacacacacacaggcauacucacacacagacauauacacacacacucacaca

SEQ ID NO: 123033 - RNA, 64 nt, Homo Sapiens
gacacacacagacacaaaauuacauacacagacacacacagaaaccgccacagagacacaccau

SEQ ID NO: 123034 - RNA, 64 nt, Homo Sapiens
cacaaucacacgcagccccuuacacagaaagacacacacagacaaacacaccauuacacacaca

SEQ ID NO: 123035 - RNA, 64 nt, Homo Sapiens
gacacagacacaaaaucacauacauacacagacacacacagaaaccccgccacagagacaccau

SEQ ID NO: 123036 - RNA, 64 nt, Homo Sapiens
caaaaucacacacacacccucacacagaaagacacacacagacacaccauuacauacacagaca

SEQ ID NO: 123037 - RNA, 64 nt, Homo Sapiens
gacacacacagacacaaaauuacauacacagacacacacagaaaccccaccacagagacaccau

SEQ ID NO: 123038 - RNA, 64 nt, Homo Sapiens
cacauacacccaugaugugacaccccugaacacacacacagacaacacaacacacacacauaca

SEQ ID NO: 123039 - RNA, 64 nt, Homo Sapiens
cacaacacacacacauacacacacccugaaaacacacacagacaaucuggcccucuccacaugc

SEQ ID NO: 123040 - RNA, 64 nt, Homo Sapiens
cacauggaugcacacacacacacgccaaugcacacacacagagauaugcacacacacggaugca

SEQ ID NO: 123041 - RNA, 64 nt, Homo Sapiens
cacacacacagagauaugcacacacacggaugcacacacagauggucacacagagauacgcaaa

SEQ ID NO: 123042 - RNA, 64 nt, Homo Sapiens
gauaugcacacacacggaugcacacacagauggucacacagagauacgcaaacacaccgaugca

SEQ ID NO: 123043 - RNA, 64 nt, Homo Sapiens
aacacaccgaugcacacgcacauagagauaugcacacacagaugcacacacagauauacacaug

SEQ ID NO: 123044 - RNA, 64 nt, Homo Sapiens
cacacgcacauagagauaugcacacacagaugcacacacagauauacacauggaugcacgcaca

SEQ ID NO: 123045 - RNA, 64 nt, Homo Sapiens
gaugcacagagauaugcacacaccgaugugcgcacacacagauaugcacacacauggaugagca

SEQ ID NO: 123046 - RNA, 64 nt, Homo Sapiens
cacacacaccaaugcgcacacacaccgauguacacacacagaugcacacacagaugcacacaca

SEQ ID NO: 123047 - RNA, 64 nt, Homo Sapiens
ugcgcacacacaccgauguacacacacagaugcacacacagaugcacacacaccgaugcugacu

SEQ ID NO: 123048 - RNA, 64 nt, Homo Sapiens
auacacacucgcaacaugucuacacacguccacacacacagacacacagauaccccaaauccuc

SEQ ID NO: 123049 - RNA, 64 nt, Homo Sapiens
ucgcaacaugucuacacacguccacacacacagacacacagauaccccaaauccucucagaacu

SEQ ID NO: 123050 - RNA, 64 nt, Homo Sapiens
cagggcgugucugagagacuuacauaaucagugccacacagaggagcaggucgggagaguagag

SEQ ID NO: 123051 - RNA, 64 nt, Homo Sapiens
uggguaagaugaaaaacuguagacuucuguaaagcacacagaugguuucuuuucuguggggccc

SEQ ID NO: 123052 - RNA, 64 nt, Homo Sapiens
gcagggaggggacuggggaagugcgcacacagcccacacagacaacacgcacccacacagacac

SEQ ID NO: 123053 - RNA, 64 nt, Homo Sapiens
agugcgcacacagcccacacagacaacacgcacccacacagacacagagggaagggguugggau

SEQ ID NO: 123054 - RNA, 64 nt, Homo Sapiens
ucuggucaccucugggcgccgcacugucccagaccacacagaagguccuuccugccugagcccu

SEQ ID NO: 123055 - RNA, 64 nt, Homo Sapiens
cacaaccuggacccaggcagcgcuggugucucuucacacagaggccgcacuccccacuggcagc

SEQ ID NO: 123056 - RNA, 64 nt, Homo Sapiens
agauuuaaaaaaaaaaaaggacaaaaaaagaaaacacacagaagcagaagaggaaaaaaaagca

SEQ ID NO: 123057 - RNA, 64 nt, Homo Sapiens
aacaaccacgcagacagucagcagcccacggggccacacagagaggagcagggcuuaggggcua

SEQ ID NO: 123058 - RNA, 64 nt, Homo Sapiens
cagugacaacacacaccaugcggugaugaugucacacacagacacggcgauggcaucacacaga

SEQ ID NO: 123059 - RNA, 64 nt, Homo Sapiens
gugaugaugucacacacagacgcggcgauggcaucacacagacgacauauuaaugucacacaga

SEQ ID NO: 123060 - RNA, 64 nt, Homo Sapiens
cggcgauggcaucacacagaacacauauuaaugucacacagacgucacgggccaugucgacguc

SEQ ID NO: 123061 - RNA, 64 nt, Homo Sapiens
uggggaacuuggcaugacgugaugcagcacgucgcacacagacauauagcgauggcgucgugca

SEQ ID NO: 123062 - RNA, 64 nt, Homo Sapiens
gacaggaguauuuuuuuuuuuuuacagcuuuacacacacagaugugggcuuugauuuccaagua

SEQ ID NO: 123063 - RNA, 64 nt, Homo Sapiens
caaaggacauuaugugugcauguguguauaagugcacacagaaauauauauacauauguagacu

SEQ ID NO: 123064 - RNA, 64 nt, Homo Sapiens
uauuguguacaccaugcccauguauauacaaguacacacagauguacacacagauguacacaug

SEQ ID NO: 123065 - RNA, 64 nt, Homo Sapiens
caugcccauguauauacaaguacacacagauguacacacagauguacacaugcuccagccccag

SEQ ID NO: 123066 - RNA, 64 nt, Homo Sapiens
acccaccacacacacacacacacacacacacacacacacagacacacagacacauacgcacaca

SEQ ID NO: 123067 - RNA, 64 nt, Homo Sapiens
cacacacacacacacacacacacacacacacagacacacagacacauacgcacacacgugcaca

SEQ ID NO: 123068 - RNA, 64 nt, Homo Sapiens
cacaaaaugucacaauccugagggcuggaaaagucacacagacacugcucgcacagauuacuuc

SEQ ID NO: 123069 - RNA, 64 nt, Homo Sapiens
cugccucagcugcucgcacaccuucacaaccagccacacagagcagcccugcagccaaacagag

SEQ ID NO: 123070 - RNA, 64 nt, Homo Sapiens
caccaaguaccaguauaagccacagacacacacacacacagacacagacacacaaacacacaca

SEQ ID NO: 123071 - RNA, 64 nt, Homo Sapiens
cacacacacacagacacacccacacaaacacacacacacagacacucugcauuuacacaccaga

SEQ ID NO: 123072 - RNA, 64 nt, Homo Sapiens
gauaaggaacaaaaguguuucacacacacacacacacacagagacacagacacacacacacaca

SEQ ID NO: 123073 - RNA, 64 nt, Homo Sapiens
cacacacacacacacacacacauacacacacacacacacagacacacagagacccuugaguaca

SEQ ID NO: 123074 - RNA, 64 nt, Homo Sapiens
cccuugaguacacauacacauauacacacacacacacacagagaggagaagcacuguugaaauu

SEQ ID NO: 123075 - RNA, 64 nt, Homo Sapiens
gcggucacgcccucagccccuccgggcacacgugccgccugaccgggcgacccuuuucaguucg

SEQ ID NO: 123076 - RNA, 64 nt, Homo Sapiens
gcuggucucgaacuccugaccucaggugauccacccgccugagccucccaaagugcugggauua

SEQ ID NO: 123077 - RNA, 64 nt, Homo Sapiens
cggaguucuuuaucuucagugagaaugugccugcccgccugagagccagcuuccgcguuggagg

SEQ ID NO: 123078 - RNA, 64 nt, Homo Sapiens
auaacugaaaauaggcauauagauauauuccaagccgccugacgaucuaauuguaaaaaguaaa

SEQ ID NO: 123079 - RNA, 64 nt, Homo Sapiens
ccagccugcgggaagcugaccucugacccagacuccgccugaggcacccugcugcugcuccucc

SEQ ID NO: 123080 - RNA, 64 nt, Homo Sapiens
gguccuacacauuccagacauuuuccuuuuugagccgccugaaaguacagcuggagcccuuccc

SEQ ID NO: 123081 - RNA, 64 nt, Homo Sapiens
agcagaaacccccaggaggagagagaugcugcucccgccugauuggggccucacccagaaggaa

SEQ ID NO: 123082 - RNA, 64 nt, Homo Sapiens
ccgagagccuggcaggugaaacucugcaggccuuccgccugauuauuauuuauucacuccuuuc

SEQ ID NO: 123083 - RNA, 64 nt, Homo Sapiens
gacccagacccacuuccuccagagaggccucucuccgccugagcuauuucccuugcuagugugc

SEQ ID NO: 123084 - RNA, 64 nt, Homo Sapiens
uccagaaccucagccccgauuccagcacccaccaccgccugacccuguguaaccugcugucccg

SEQ ID NO: 123085 - RNA, 64 nt, Homo Sapiens
gaaaccacggccacauuugguacucacuuaaagcccgccugacacaggccucucucaccucucc

SEQ ID NO: 123086 - RNA, 64 nt, Homo Sapiens
gggucggauggccccaguggcgcccauccccuugccgccugacuggccaucugugcuccaugcc

SEQ ID NO: 123087 - RNA, 64 nt, Homo Sapiens
uuuucucauugccauuaguagggagucacacaagccgccugacuuuuuauggugcuguuaacau

SEQ ID NO: 123088 - RNA, 64 nt, Homo Sapiens
aagcccucaggggaaggaacagauucaccauugcccgccugaagaccccaacucgccaaagaaa

SEQ ID NO: 123089 - RNA, 64 nt, Homo Sapiens
caggacaccuggcuucuugaauggugagaggaggccgccugagugacccagaaacucagaguug

SEQ ID NO: 123090 - RNA, 64 nt, Homo Sapiens
accucucccuuuggggauuuaaugucuggugcugccgccugaguuucaagaauuaaagcugcaa

SEQ ID NO: 123091 - RNA, 64 nt, Homo Sapiens
gccccaggagacaucggcuagcaucugguccuugccgccugagaugggauuggacaguaguggu

SEQ ID NO: 123092 - RNA, 64 nt, Homo Sapiens
uguaaucuggucugagcugggccugugggaggggccgccugaggccugugcgcuguuguccucg

SEQ ID NO: 123093 - RNA, 64 nt, Homo Sapiens
augacuuagaugggcagaaucaacaaagaugaaaccgccugaggacacauuuaacaaguaacau

SEQ ID NO: 123094 - RNA, 64 nt, Homo Sapiens
uauuuuaccaguuuccagaauuuccaguacaggaccgccugaagagagagccauuguucaauuc

SEQ ID NO: 123095 - RNA, 64 nt, Homo Sapiens
cugaagugcauccaaaggugcucagagagccggcccgccugaaucauucucgauuuaacucgag

SEQ ID NO: 123096 - RNA, 64 nt, Homo Sapiens
ccuacugacaaguaaauuuauacaggacugaaaaccgccugaaaccugcugcaacuauuguuau

SEQ ID NO: 123097 - RNA, 64 nt, Homo Sapiens
gggccccagcuggcccguucuacucaccuaagugccgccugacccuuguacacuaggagcuggc

SEQ ID NO: 123098 - RNA, 64 nt, Homo Sapiens
ucgaucgcccgcggucccccgcgaggccuccccuccgccugauucucaccccaagccccagccc

SEQ ID NO: 123099 - RNA, 64 nt, Homo Sapiens
ugucuugggcuguaggcuaggccucagcugcuguccgccugaucgcacuggcccccucucccca

SEQ ID NO: 123100 - RNA, 64 nt, Homo Sapiens
cugugccgcugagccgcgcuguccaggugugcggccgccugagcccgagccaggagcacuagag

SEQ ID NO: 123101 - RNA, 64 nt, Homo Sapiens
ggcuggggccugggucagagcggugcugcccgugccgccugaagagcugcagccagaacaggug

SEQ ID NO: 123102 - RNA, 64 nt, Homo Sapiens
ggcacaaggccuggcuggcugcgagcucaggaggccgccugaggacugcacaccgggcccacac

SEQ ID NO: 123103 - RNA, 64 nt, Homo Sapiens
acugcacacccugcccgcugcuuaccccuccugcccgccugagacagcucuggcugguucugcc

SEQ ID NO: 123104 - RNA, 64 nt, Homo Sapiens
ugccuucauguggacccuuauugcccggggagucccgccugacccuuuccgcguacagaagugc

SEQ ID NO: 123105 - RNA, 64 nt, Homo Sapiens
uuauuugacucuguggcucuaagacugccuugaaccgccugaggccuaugcaucugaacaagug

SEQ ID NO: 123106 - RNA, 64 nt, Homo Sapiens
ccagcgugacggagcccacacugccaccuuguggccgccugagacccucgcgccccccgcgccc

SEQ ID NO: 123107 - RNA, 64 nt, Homo Sapiens
ugauaucgucacuguuuagggcuucugcugggucccgccugaggggggcaccggggacucgcgg

SEQ ID NO: 123108 - RNA, 64 nt, Homo Sapiens
ggacaggcccagcgcggccagcgucccaggguacccgccugagcuccugcugcggaggagcugc

SEQ ID NO: 123109 - RNA, 64 nt, Homo Sapiens
aaauggaaacacacacagacgcagacaagaacagccgccugacgagaauauuuuugaaagcuac

SEQ ID NO: 123110 - RNA, 64 nt, Homo Sapiens
guguuuugcccuauauaccuuccuuacugugcauccgccugaaauucuuuguuuaugcacuuuu

SEQ ID NO: 123111 - RNA, 64 nt, Homo Sapiens
ccggcucuccucuccccuguccugcacccaucccccgccugaagccaccggcuccaauugccag

SEQ ID NO: 123112 - RNA, 64 nt, Homo Sapiens
cuccugaguaucugggacuacucaggugauccucccgccugagcugcauccuugaaauccuggg

SEQ ID NO: 123113 - RNA, 64 nt, Homo Sapiens
gcagcagcagucucugucauagggccucccuugcccgccugagacccgcgguacuggcgccauc

SEQ ID NO: 123114 - RNA, 64 nt, Homo Sapiens
gcuggccccggccggucacauugacugauggccaccgccugacgaaucgagugccugugugucu

SEQ ID NO: 123115 - RNA, 64 nt, Homo Sapiens
gcugaaugcccccugcuuacuuggugagggugccccgccugagucagugcucucagcuggcagu

SEQ ID NO: 123116 - RNA, 64 nt, Homo Sapiens
gccgagcuaacuguugccacuagaggagccggugccgccugaaugcuacuuguguggcauaagc

SEQ ID NO: 123117 - RNA, 64 nt, Homo Sapiens
ccaaggagggucuuugguaccuuucugccuacauccgccugagaucuccacugcaacagucugu

SEQ ID NO: 123118 - RNA, 64 nt, Homo Sapiens
ggacaccagacucagcucuuaugacugcagcuggccgccugaggaggagaaugcugugcugugg

SEQ ID NO: 123119 - RNA, 64 nt, Homo Sapiens
uucccacacauguggaagccacguugccucucgaccgccugaggcccuuaaguacaucgcuuuc

SEQ ID NO: 123120 - RNA, 64 nt, Homo Sapiens
gggaugacuucagcuagaguagugaagaguccacccgccugagucaucugucucugcaaugcaa

SEQ ID NO: 123121 - RNA, 64 nt, Homo Sapiens
caugcacacugcaaauaucaaauuuccuuuaacaccgccugaaaucaugccccuaagaaaagug

SEQ ID NO: 123122 - RNA, 64 nt, Homo Sapiens
gcgacggggcuuccgggaagagggguaggaaggcccgccugagcaacgggacugcugggagagg

SEQ ID NO: 123123 - RNA, 64 nt, Homo Sapiens
ucggacaccaccauggucagggggaccucaucucccgccugaccucuuugaugagaaccgcaca

SEQ ID NO: 123124 - RNA, 64 nt, Homo Sapiens
gcagcccuggcccccaucagcccugcuagacgcaccgccugaaggcacagcuaaccacuucgca

SEQ ID NO: 123125 - RNA, 54 nt, Homo Sapiens
gggccgaggccgaggccugagcggccgccugaccgucgaccuuggggcucucca

SEQ ID NO: 123126 - RNA, 64 nt, Homo Sapiens
ccacaccaccauuguggccacccgucacuaucgcccgccugaggugauccuuggugagugacug

SEQ ID NO: 123127 - RNA, 64 nt, Homo Sapiens
ugucccuguggccccauccaaccacuguacacacccgccugacaccgugggucauuacaaaaaa

SEQ ID NO: 123128 - RNA, 64 nt, Homo Sapiens
aaaccagcucugucccugugcaggcuccaggcucccgccugacaaacaggcagggagccacagu

SEQ ID NO: 123129 - RNA, 64 nt, Homo Sapiens
acuccagccccuugguccuguggauggcuggaucccgccugaaacggaccugcagagcagcagc

SEQ ID NO: 123130 - RNA, 64 nt, Homo Sapiens
guuagaaauguacauucucaggcuccacagcaggccgccugaaucaaauccugggaggugggga

SEQ ID NO: 123131 - RNA, 64 nt, Homo Sapiens
uaccccgaaaccggccccgacgccccgcagaggcccgccugaagccagcccggcgcccuagcag

SEQ ID NO: 123132 - RNA, 64 nt, Homo Sapiens
cuccaccgccucucugcucugacccuucucaggcccgccugaugugcuggaccaucccccugcu

SEQ ID NO: 123133 - RNA, 64 nt, Homo Sapiens
caucgguaaauaaaaguuuuugauccuguugaacccgccugagacggugcugugcaggggaaag

SEQ ID NO: 123134 - RNA, 64 nt, Homo Sapiens
acggagauugucuuucugccggaaagcaagcucaccgccugaacaccccagggucaagggugaa

SEQ ID NO: 123135 - RNA, 64 nt, Homo Sapiens
ugggggucagcucuuuauauauuauacaccucagccgccugagaccaucuuauuucuuuugggg

SEQ ID NO: 123136 - RNA, 54 nt, Homo Sapiens
cuuccuggagccaggaccugggagccgccugagcaagucccggacgaugaauga

SEQ ID NO: 123137 - RNA, 64 nt, Homo Sapiens
ugggggagccgaccaauuagccagacacugcgccccgccugaccggccuccgaugccuggccug

SEQ ID NO: 123138 - RNA, 64 nt, Homo Sapiens
ucgagcuucaggacagagcagccaaugaaaacggccgccugaacccacagcaauaagaaugaau

SEQ ID NO: 123139 - RNA, 64 nt, Homo Sapiens
gaagguucuugucacugugauuggaugcuggaugccgccugauagacaugcuggccuggcugag

SEQ ID NO: 123140 - RNA, 64 nt, Homo Sapiens
gcccggcuaaaaagcgcggccugcgccgccgccgccgccugauuucgcucgggcuucgggugac

SEQ ID NO: 123141 - RNA, 64 nt, Homo Sapiens
ccagcccaaggccuuuuauuccagcacuuucuuuccgccugagugcuuuguucuuucauuuccu

SEQ ID NO: 123142 - RNA, 64 nt, Homo Sapiens
gacccgacuggaauccacucugcccccgccuccuccgccugaauagccccccuugccugcccgc

SEQ ID NO: 123143 - RNA, 64 nt, Homo Sapiens
cgccuccuggguucaagugauucucauggcucagccgccugaguagcugggauuacagguguga

SEQ ID NO: 123144 - RNA, 64 nt, Homo Sapiens
auacuuucucauuuuacagaggaagacuuagaagccgccugaucaauuaccuuccuuuuuggcu

SEQ ID NO: 123145 - RNA, 64 nt, Homo Sapiens
ucgcuguuucggggacucggggcggccaguaccaccgccugaggcggggcucagcagcguugca

SEQ ID NO: 123146 - RNA, 64 nt, Homo Sapiens
ucuaugaggacauggguggugggcaaagugacagccgccugagccccucugccugguccccuuu

SEQ ID NO: 123147 - RNA, 53 nt, Homo Sapiens
ggugagacggccgagggacacuaccgccugacaccuaccggcuggugcaguag

SEQ ID NO: 123148 - RNA, 64 nt, Homo Sapiens
gccagccccccaccccgccuccccugccuaguccccgccugagucaggccugggggcagcccuu

SEQ ID NO: 123149 - RNA, 64 nt, Homo Sapiens
gcaaagcuuucugggaguugcuacggacaggagcccgccugagcccuugaaaugucacgggcuu

SEQ ID NO: 123150 - RNA, 64 nt, Homo Sapiens
ccucgcgagacuuucgguccccgggcucuugucaccgccugagaaguggacgaacccccucccc

SEQ ID NO: 123151 - RNA, 64 nt, Homo Sapiens
uggaacagaacggagccaucgcuggccagcagccccgccugacaacugagcagaagcccccaca

SEQ ID NO: 123152 - RNA, 64 nt, Homo Sapiens
uccccgguuugcagaauggaugcccuccgccgcuccgccugagcccuccugaccuucgccgccc

SEQ ID NO: 123153 - RNA, 64 nt, Homo Sapiens
uuagaaauaccaugcacuuggggguaccaauuaaccgccugaaaauuagcauauugauaguucu

SEQ ID NO: 123154 - RNA, 64 nt, Homo Sapiens
gcuggcuacuauccaugcacgacccuucuugugaccgccugacucugaauagcucuucauagcu

SEQ ID NO: 123155 - RNA, 64 nt, Homo Sapiens
agguguggugccgucccgcccagugugcguccggccgccugagcccucucgccagccacuccug

SEQ ID NO: 123156 - RNA, 64 nt, Homo Sapiens
gcacccagcgcuguggcuguaacugcacacgaagccgccugacguucucaguuugugaaacgcu

SEQ ID NO: 123157 - RNA, 64 nt, Homo Sapiens
caggcaaggggauggagagggcuugccuucccucccgccugaccuuccucagucauuucugcaa

SEQ ID NO: 123158 - RNA, 64 nt, Homo Sapiens
cugcccuccccuguggaaaggucuauaugacgggccgccugaggccccagaacucgucugugaa

SEQ ID NO: 123159 - RNA, 64 nt, Homo Sapiens
cagcuccggcagccacagaaggcugcagcccagcccgccugagacacgacgccugccccagggg

SEQ ID NO: 123160 - RNA, 64 nt, Homo Sapiens
gccacaaugagaaugaugcaccugucuuccacagccgccugaaacccgaagccaccauccccac

SEQ ID NO: 123161 - RNA, 64 nt, Homo Sapiens
uauuggaucauaggagagcacggacucagcacucccgccugaugugcgaggagugguguccuga

SEQ ID NO: 123162 - RNA, 62 nt, Homo Sapiens
gucucacauuuuuacuugguguaauuaauaaacgaagauaaaucauaguguauguguauuau

SEQ ID NO: 123163 - RNA, 62 nt, Homo Sapiens
ccagcucacaaaugaaaacguaaaaauaauuccgaagauacaauuuugcaugguuuuaaaau

SEQ ID NO: 123164 - RNA, 62 nt, Homo Sapiens
gucuuuaggauaaggcagaguuacaaaaugggcgaagauauuuauauuuugaauuauuuauu

SEQ ID NO: 123165 - RNA, 62 nt, Homo Sapiens
acacacuuuaaaccaauuaaagguucauagaccgaagauacuuaugacuaaauagucugugc

SEQ ID NO: 123166 - RNA, 62 nt, Homo Sapiens
aacaucuauugcuuuuucccccccucgcuaaacgaagauauugaggagucaaugucauucua

SEQ ID NO: 123167 - RNA, 62 nt, Homo Sapiens
gggacucuguguauuauucagguuuauuggcacgaagauacuuguuuuaaguuccuugagaa

SEQ ID NO: 123168 - RNA, 62 nt, Homo Sapiens
auacuguuauucauuuauccgguagaaagguacgaagauacaccagaguuguucucguccaa

SEQ ID NO: 123169 - RNA, 62 nt, Homo Sapiens
agacgaaggcagucgagguguggaggugaucacgaagauacauguguuugacuguuuaauuu

SEQ ID NO: 123170 - RNA, 62 nt, Homo Sapiens
uauguggcaucacgguggaagacaaccuagaacgaagauagcucaauacaauuuacugacau

SEQ ID NO: 123171 - RNA, 62 nt, Homo Sapiens
caaaaacauacuucaaaaauaaaugcccauuucgaagauauagcuuuggcccaaugccuaua

SEQ ID NO: 123172 - RNA, 62 nt, Homo Sapiens
ugcaccuccuucgcugucaagugggucccccacgaagauacugcacggagagcagugccaag

SEQ ID NO: 123173 - RNA, 62 nt, Homo Sapiens
uacauguuugggauuuuuauuuuuuacguguccgaagauaagcuccaggucuuaucguaucc

SEQ ID NO: 123174 - RNA, 62 nt, Homo Sapiens
agugagcggcugccuccgggugggagggacuucgaagauaaggggcuggccacggccaggug

SEQ ID NO: 123175 - RNA, 62 nt, Homo Sapiens
ccaugagccauuucacagaaaaaccaucccaccgaagauauugucuaucaccccaggggcca

SEQ ID NO: 123176 - RNA, 62 nt, Homo Sapiens
auaaaauuauggauccagauuguucugagagacgaagauacuugcugcugauagaggugaaa

SEQ ID NO: 123177 - RNA, 62 nt, Homo Sapiens
ucucugucagagaagccacugcaagaugcugccgaagauaacccucucuuuccugccucauu

SEQ ID NO: 123178 - RNA, 62 nt, Homo Sapiens
agaguaaugagagacauuuuagagaauucagccgaagauaugaacuuucuguccacuauagg

SEQ ID NO: 123179 - RNA, 62 nt, Homo Sapiens
gcuuuauucuuuaguguuaaauaagauaaauacgaagauaaacauugauaagaguccuauaa

SEQ ID NO: 123180 - RNA, 62 nt, Homo Sapiens
uuggcuaaucaguauacaagaugauacuguaacgaagauaaaaguaguaucaaaugaaagug

SEQ ID NO: 123181 - RNA, 62 nt, Homo Sapiens
gcugcugugccugauguccggacagcccugcucgaagauauagaaagagugaccugcacaaa

SEQ ID NO: 123182 - RNA, 62 nt, Homo Sapiens
uuuugguuguaggcggcuuccaacccagaaggcgaagauagcccacacuuggcuugagcacu

SEQ ID NO: 123183 - RNA, 62 nt, Homo Sapiens
aaggggccccccugggauggggagaagggcuucgaagauaaacugagcuccauuccccuggc

SEQ ID NO: 123184 - RNA, 62 nt, Homo Sapiens
aaucuguugcugacuagcauuagacuguuacacgaagauaaacugaauaagcauuuagcuuu

SEQ ID NO: 123185 - RNA, 62 nt, Homo Sapiens
guagacccccggagaagcaguaccgacaaugacgaagauaccagaucccuucccaaccccuu

SEQ ID NO: 123186 - RNA, 62 nt, Homo Sapiens
gcuuugcgaaugggaucagguaagucaagucacgaagauagaugggaccuuugggaagugau

SEQ ID NO: 123187 - RNA, 62 nt, Homo Sapiens
caagagcucccaagauuugcaaaggcacaugccgaagauacuaaucaguagcaagugcugga

SEQ ID NO: 123188 - RNA, 62 nt, Homo Sapiens
aaacucuagucccuuuaaacugaguggucuuucgaagauaaauauacaugugccuuaccagg

SEQ ID NO: 123189 - RNA, 62 nt, Homo Sapiens
ugccuucuuugccuagccaauuuuauuucuuucgaagauaauuacugguaugugaugccaac

SEQ ID NO: 123190 - RNA, 62 nt, Homo Sapiens
ggauggggaugggggcugacgguaaggucacucgaagauaagccaccaaagccagguuuccu

SEQ ID NO: 123191 - RNA, 64 nt, Homo Sapiens
agucuggcuaucugagauacagcugugagagccggauccggaguuaccugagggaggugagccu

SEQ ID NO: 123192 - RNA, 64 nt, Homo Sapiens
augugaaacagucauccuucugcauaaauugaaggauccggauuccuuaaugauggacugaaug

SEQ ID NO: 123193 - RNA, 64 nt, Homo Sapiens
ucgccaacucaccccgggcagagagaggagcgaagauccggaaccugcgucgcccgagccccgg

SEQ ID NO: 123194 - RNA, 64 nt, Homo Sapiens
ggcgccgucgcucggguggccgcgaaacgcuacggauccggacggggccgccugucccggcguc

SEQ ID NO: 123195 - RNA, 64 nt, Homo Sapiens
gcagggguguucccucugcuaggggcuggaggaagauccggagggaguguggcugcaagagaaa

SEQ ID NO: 123196 - RNA, 64 nt, Homo Sapiens
uuuaugagaaggauuagaaaagcccucaauuugugauccggaaucgguguaagaucuucucauc

SEQ ID NO: 123197 - RNA, 64 nt, Homo Sapiens
cuucggaaauccugcaaauagaaagauaauucuagauccggaauaccuguaucugguggaaacc

SEQ ID NO: 123198 - RNA, 64 nt, Homo Sapiens
acgaugacaguguuccccgauaccaugcuguaaggauccggaaagaagagcgagagaucaaaga

SEQ ID NO: 123199 - RNA, 64 nt, Homo Sapiens
gguggggugggugggugcuggcgguggggaccaagauccggaaagaugaauaaagacaaacaug

SEQ ID NO: 123200 - RNA, 64 nt, Homo Sapiens
uccgccuggggcagaaagccacaaacuccauccagauccggaacgucagccagcucccagccac

SEQ ID NO: 123201 - RNA, 64 nt, Homo Sapiens
gaguggccgggccugcggacuccccgccgcgcuggauccggacuggacgaccucguaucccgcg

SEQ ID NO: 123202 - RNA, 64 nt, Homo Sapiens
uguuuuuuaagauugagaauacauaccugacaacgauccggaaacugcuccucaccacucccgu

SEQ ID NO: 123203 - RNA, 64 nt, Homo Sapiens
uuccccccaucccucugagggccggcggaugcuggauccggagccccagguuccgccccagagc

SEQ ID NO: 123204 - RNA, 64 nt, Homo Sapiens
caggacccagaagcaccuccacaugcgggggaaggauccggaacagaagucuguccgucuauga

SEQ ID NO: 123205 - RNA, 64 nt, Homo Sapiens
agagggagccaggcagcuguguacagugagaagggauccggaugggggagcucuguacagaggg

SEQ ID NO: 123206 - RNA, 64 nt, Homo Sapiens
cuucccuuaggguccagucucggagggccagccagauccggaccggguggaagcagcggugccg

SEQ ID NO: 123207 - RNA, 64 nt, Homo Sapiens
aacuaaauagcauguauugugucuuuugcaugaugauccggauuuaauuugauaucacagucua

SEQ ID NO: 123208 - RNA, 64 nt, Homo Sapiens
acuuugccaaccugcccagcugcugccgcuggaggauccggaaagaguuuccgaagagugaagg

SEQ ID NO: 123209 - RNA, 64 nt, Homo Sapiens
gaaauguguuagagggucugucaggcucucacaggauccggagggaaucucgucauaagugauc

SEQ ID NO: 123210 - RNA, 64 nt, Homo Sapiens
ucaguccccuccccaaccucagugacugacagaggauccggaucucagagccugagaccagguu

SEQ ID NO: 123211 - RNA, 64 nt, Homo Sapiens
gccgaaggccgcgugcuuccgcacauuugcacacgauccggagacacccgcgggggcucccccu

SEQ ID NO: 123212 - RNA, 64 nt, Homo Sapiens
uuuagcggccugccaccacagcacgcggccuccugauccggaagcacgcagcauguucccugcu

SEQ ID NO: 123213 - RNA, 64 nt, Homo Sapiens
auuacuuucuuuucuggagugccaugcuggcgaggauccggaugcggcagcacccucuuucggg

SEQ ID NO: 123214 - RNA, 64 nt, Homo Sapiens
auauauauacuguucauguaacauagcacaacaugauccggauagaagaauuguaaagaccugu

SEQ ID NO: 123215 - RNA, 64 nt, Homo Sapiens
uguucaacucuuaugcuacauuaaaaccacacuggauccggauacguaugguggcucacgccug

SEQ ID NO: 123216 - RNA, 64 nt, Homo Sapiens
ggacccugguggggguggcuccuucucacugcuggauccggacuuuuuaaauaaaaacaaguaa

SEQ ID NO: 123217 - RNA, 64 nt, Homo Sapiens
cagccugaaacagacccagacacagccugaaacagauccggacagacagacagaaacagccuga

SEQ ID NO: 123218 - RNA, 64 nt, Homo Sapiens
gggagggacgggagcugguugggguggcuuagcagauccggacagggcccucugucccuguguc

SEQ ID NO: 123219 - RNA, 64 nt, Homo Sapiens
aucaugaggaacaacugaccaaguauguggacuggauccggauggagucuacaccuauauuugc

SEQ ID NO: 123220 - RNA, 64 nt, Homo Sapiens
cagcucccaggggcccagagggcagcuuugcaaggauccggagcuccugccccagagaugaagg

SEQ ID NO: 123221 - RNA, 63 nt, Homo Sapiens
gccagaaguccagcugcugacagcccuggaugugauccggagucccuucccaccaggggcuga

SEQ ID NO: 123222 - RNA, 63 nt, Homo Sapiens
cccuucccaccaggggcugacagcccuggaugugauccggagugccagaaguccagcugcuga

SEQ ID NO: 123223 - RNA, 64 nt, Homo Sapiens
agcauagccauacaccucagccugugaaaugaacgauccggacccucaccaacuuuccccaccu

SEQ ID NO: 123224 - RNA, 64 nt, Homo Sapiens
ccaagcccacggcucccucgcgccccgcggccgcgauccggaccgaaaugacaccgcacgccag

SEQ ID NO: 123225 - RNA, 64 nt, Homo Sapiens
aagcgggcgagggcagcgccgguaccugggcugggauccggagcccgacccgcgggcgaggccg

SEQ ID NO: 123226 - RNA, 64 nt, Homo Sapiens
aacuuugcucggacacacugucugucagugagcagauccggaagucgacagggacaucuuaggc

SEQ ID NO: 123227 - RNA, 64 nt, Homo Sapiens
cggaaggagggagcucugaugagcacgguuugucacacgauaaagggauuuuuuuuuucagggc

SEQ ID NO: 123228 - RNA, 64 nt, Homo Sapiens
uuuacuccuccaucucaguauaacaaagcucaaaacacgauaagcaccaaauuguuauuugcac

SEQ ID NO: 123229 - RNA, 64 nt, Homo Sapiens
ccaguauggugagugccaagacagagagcuaugaacacgauaucuaucugggaacacugagaag

SEQ ID NO: 123230 - RNA, 64 nt, Homo Sapiens
ccauggccaauucaguuucauuuauccccucagaacacgauaaaagguccguuuccuuacacau

SEQ ID NO: 123231 - RNA, 64 nt, Homo Sapiens
guacuaacaucuuaauuuugcgcccggcggcgaaacacgauauuauuacaggcgugagccaccg

SEQ ID NO: 123232 - RNA, 64 nt, Homo Sapiens
ugcauucauacaaagugagaguaggaagacucaaacacgauauuacccaaguuccugagacuag

SEQ ID NO: 123233 - RNA, 64 nt, Homo Sapiens
acuuacucuuaaaucaagcagauauaaaaacugaacacgauaacuuguuuuuuguuuaagucga

SEQ ID NO: 123234 - RNA, 64 nt, Homo Sapiens
ucuuauuccauacuucuuuauuuggauagcguugacacgauagacuacuuuuuaguaaaauauu

SEQ ID NO: 123235 - RNA, 64 nt, Homo Sapiens
gaaagauugugcacuuuaacucuguucccagcaaacacgauaaacccgagcuaaucauggaaug

SEQ ID NO: 123236 - RNA, 64 nt, Homo Sapiens
ugcaugagaagaucuguuauuucuauauuuauaaacacgauaaaagcccuguaagccagcuuuc

SEQ ID NO: 123237 - RNA, 64 nt, Homo Sapiens
ugggaggacgcagcccacugcccagaaacaagaaacacgauaccauucuggccuuccccacccc

SEQ ID NO: 123238 - RNA, 64 nt, Homo Sapiens
gcaaagacgauggauugacaguagcacacuuugcacacgauaaaugcaggaagcucagggggca

SEQ ID NO: 123239 - RNA, 64 nt, Homo Sapiens
aaauaauuuuuacuuauauuuuucagaggauuugacacgauaagccucaucugauggaagagag

SEQ ID NO: 123240 - RNA, 64 nt, Homo Sapiens
gcauuuuauuaaaagaauaauuauaauuaaaaaaacacgauacagaucagugcauauaguauau

SEQ ID NO: 123241 - RNA, 64 nt, Homo Sapiens
uggaaaauuuauaagaaaguaauccaaauaagaaacacgauaguugaaaauaauuuuuauagua

SEQ ID NO: 123242 - RNA, 64 nt, Homo Sapiens
ccuuuccagaaguuccugggauaaauacauauacacacgauacuugauaauaugaucguauucu

SEQ ID NO: 123243 - RNA, 64 nt, Homo Sapiens
cgucaaaguugugcccaacacuguggaucagcaaacacgauagaggagaccagucaguacuucu

SEQ ID NO: 123244 - RNA, 64 nt, Homo Sapiens
ccuuucaaaagacuuucuaagcaaaaaaacccaaacacgauaaagauccuuuauuggugguaga

SEQ ID NO: 123245 - RNA, 64 nt, Homo Sapiens
aaagagagagagagagaauuccgaauuggggaacacacgauaccuguuuuucuuuuccguugcu

SEQ ID NO: 123246 - RNA, 64 nt, Homo Sapiens
acuugggcuauuauucaaggaccauugcuauagaacacgauaggauuuacacaagaaguaacuc

SEQ ID NO: 123247 - RNA, 64 nt, Homo Sapiens
ucguuccaccuuggcgucacacaugcauugagacacacgauacccaggcgugcacacgcagcgc

SEQ ID NO: 123248 - RNA, 64 nt, Homo Sapiens
ucuuuuuccuuccccuggacuguccucugacccuuuggcucauccuagauugcaguguguccug

SEQ ID NO: 123249 - RNA, 64 nt, Homo Sapiens
caugcagauggagaagugguguuggcagcaagcuuuggcucauguggauuugguuuaaguggug

SEQ ID NO: 123250 - RNA, 64 nt, Homo Sapiens
ucugucacccaggcuagagugcgguggugugaucuuggcucacugcaaccucccccuccugggu

SEQ ID NO: 123251 - RNA, 64 nt, Homo Sapiens
ucuguugcucaggcuggagugcaguggugcaaucuuggcucacugcaaccuacaccucccgggu

SEQ ID NO: 123252 - RNA, 64 nt, Homo Sapiens
ucugucacccaggcuggaaugcaguggugugaucuuggcucacugcaaccuccacuucccgggu

SEQ ID NO: 123253 - RNA, 64 nt, Homo Sapiens
ugagacuggguaauugauaaagaaaaagguuuguuuggcucacaauuuugcuggcuagaagguu

SEQ ID NO: 123254 - RNA, 64 nt, Homo Sapiens
gccaucguccaggcuggagugcgcuggcuugaucuuggcucacugcagccucaauguccccagg

SEQ ID NO: 123255 - RNA, 64 nt, Homo Sapiens
cuuguugccagggcuggagugcaauggcgugaucuuggcucacugcaaccuccgccucccgggu

SEQ ID NO: 123256 - RNA, 64 nt, Homo Sapiens
gugguggaggcaaagggcagaauuucugaccccuuuggcucagcugcccuuccccacaaauaaa

SEQ ID NO: 123257 - RNA, 64 nt, Homo Sapiens
ucugccacccaggcuggaguacaguggcaugaucuuggcucacugcaacgucugccuccugggu

SEQ ID NO: 123258 - RNA, 64 nt, Homo Sapiens
ucuguugcccaggcuggagugcaguggugccaucuuggcucacuccaagcucccccucccgugu

SEQ ID NO: 123259 - RNA, 64 nt, Homo Sapiens
aaaaaaaucuuuuuauaaaaugaacuuuuaacacuuggcucaaaccucuaggucauacugccaa

SEQ ID NO: 123260 - RNA, 64 nt, Homo Sapiens
gcaggggaaacugcuguggauuugagaggcaaaguuggcucagcugugugcccaguuccuccug

SEQ ID NO: 123261 - RNA, 64 nt, Homo Sapiens
uuuguguuuuuauuggagguggggugucacuauguuggcucagcugauuucaaauuccugaccu

SEQ ID NO: 123262 - RNA, 64 nt, Homo Sapiens
cucugucaccaggcuggagugcaguggugcgaucuuggcucauggcaaccucugccucccaggu

SEQ ID NO: 123263 - RNA, 64 nt, Homo Sapiens
uguuacuuuccuaaggaguccuagcauccuuagauuggcucaacuccacugaccuacugaauau

SEQ ID NO: 123264 - RNA, 64 nt, Homo Sapiens
cagaaaucuggaagucaucuucaccaucuacccauuggcucaagcuguauguaagugaaaagca

SEQ ID NO: 123265 - RNA, 64 nt, Homo Sapiens
gcaaccuccgccuccugggugcaacgguacgaucuuggcucaguucucucgcccaggcuggagu

SEQ ID NO: 123266 - RNA, 64 nt, Homo Sapiens
auagccuugaccucucaggcgcaauggugcaaucuuggcucacuucugucucccaggcuggagu

SEQ ID NO: 123267 - RNA, 64 nt, Homo Sapiens
gcaaccuccgccucuugggugcaguggugugaucuuggcucacuucugucgcccaggcuggagu

SEQ ID NO: 123268 - RNA, 64 nt, Homo Sapiens
ggguuucuagggcugugacgcgccucguuucugguuggcucagcgaagagguacaggcgguguc

SEQ ID NO: 123269 - RNA, 64 nt, Homo Sapiens
caggagagagggaaggcugccaugagucuugcuuuuggcucauauuuccugcagggaggggugc

SEQ ID NO: 123270 - RNA, 64 nt, Homo Sapiens
uaauuuuuuuuuuuuuuuuuaaacauuguccugguuggcucauuccuuuuuggcucuggcuuuu

SEQ ID NO: 123271 - RNA, 64 nt, Homo Sapiens
guaaccuccaccucccaggcuggcucacuugaucuuggcucacuggagugcaguggugugaucu

SEQ ID NO: 123272 - RNA, 64 nt, Homo Sapiens
ugaucuuggcucacuguaacgcaguggugugaucuuggcucacuucugucacccaggcuggagu

SEQ ID NO: 123273 - RNA, 64 nt, Homo Sapiens
uggaacagggcuggggcugggaggcugucaguccuuggcucaccgcccucccagguaccuagca

SEQ ID NO: 123274 - RNA, 64 nt, Homo Sapiens
cuguguugaaacccagaaccuguucaccuggucuuuggcucacuucagcuggguguacugagcc

SEQ ID NO: 123275 - RNA, 64 nt, Homo Sapiens
uguguucaucaaauacuccugagacucugggcucuuggcucagaaaacugcauggccuuggaga

SEQ ID NO: 123276 - RNA, 64 nt, Homo Sapiens
agccagcauuggugaauauuaauguauuuuucaguuggcucaucgcucagcaaguggagguuuc

SEQ ID NO: 123277 - RNA, 64 nt, Homo Sapiens
gcaaccuccgccucccgggugcaauggcaccgucuuggcucacuuuguugcccaggcugggagg

SEQ ID NO: 123278 - RNA, 64 nt, Homo Sapiens
auugcuuuguaguaaccccuugcuugguuaaaaauuggcucacuuaccaucaaaucucugucuc

SEQ ID NO: 123279 - RNA, 64 nt, Homo Sapiens
ccuguaaucccagcacuuugcucagcuggguguuuuggcucagguaaucagcuauaugaagaau

SEQ ID NO: 123280 - RNA, 64 nt, Homo Sapiens
gcaacuugggccucccaggugcaguggugcaaucuuggcucacuucugucacccaggcuggagu

SEQ ID NO: 123281 - RNA, 64 nt, Homo Sapiens
uugaaaaauccguauccucugcuucuggugaacauuggcucagggguuagcaucuuagcaguau

SEQ ID NO: 123282 - RNA, 64 nt, Homo Sapiens
gccagagcgacuuugaucaccaucaccaacaacauuggcucaauagcaagaaugugugcccuua

SEQ ID NO: 123283 - RNA, 64 nt, Homo Sapiens
cuuguugcccaggcuggagugcaacggcaugauuuuggcucacugcagccucugccucccaggc

SEQ ID NO: 123284 - RNA, 64 nt, Homo Sapiens
ucuguugcccaggcuggagugcaguggcgugaucuuggcucacuacaaccuccaccuuccaggc

SEQ ID NO: 123285 - RNA, 64 nt, Homo Sapiens
auuaaucuuagucugaaaucaaaauauagauuaauuggcucagcuuuaauaccuuucuaggagg

SEQ ID NO: 123286 - RNA, 64 nt, Homo Sapiens
ucagucacuggaugcacaaaaucacuguguaacauuggcucacuuggugagcauaggguugacu

SEQ ID NO: 123287 - RNA, 64 nt, Homo Sapiens
cuugccugcuggugacaagcagagcgccugugauuuggcucaagacuccuauaugaugcaggug

SEQ ID NO: 123288 - RNA, 64 nt, Homo Sapiens
acuuaagccugauuuuccugaugcuuauuguaacuuggcucauugccugcagguaaagaauaac

SEQ ID NO: 123289 - RNA, 64 nt, Homo Sapiens
gcaaccuccaccuccugggugcaguggcacagucuuggcucacuccuguugugcaggcuggagu

SEQ ID NO: 123290 - RNA, 64 nt, Homo Sapiens
gcaaccuccaccucccgggugcaguggcacgaucuuggcucacuccuguugugcaggcuguagu

SEQ ID NO: 123291 - RNA, 64 nt, Homo Sapiens
gcaaccuccgccucccaggugcaguggcgcaaucuuggcucacucucuguugccaggcuggagu

SEQ ID NO: 123292 - RNA, 64 nt, Homo Sapiens
acccuacccuggcagggaccucagcuguggggaacacagcuacauagcccugguuagcugacag

SEQ ID NO: 123293 - RNA, 64 nt, Homo Sapiens
caguggggcuggcaucaagggccccaccccaccucacagcuacuccccuacccaacccugcccu

SEQ ID NO: 123294 - RNA, 64 nt, Homo Sapiens
auucccaguaaagauaccaucagcuaauaaguggcacagcuaauaaguaauuugccuaagguca

SEQ ID NO: 123295 - RNA, 64 nt, Homo Sapiens
aaguggcacagcuaauauucaauuugccuaaggucacagcuaauacaggccagauaagugaagu

SEQ ID NO: 123296 - RNA, 64 nt, Homo Sapiens
uggggacugucugcuggcucguggggucacggcccacagcuagggggucacggcccacagcuag

SEQ ID NO: 123297 - RNA, 64 nt, Homo Sapiens
uggggucacggcccacagcuauggggucacggcccacagcuaggcucauuuucaucagcacagc

SEQ ID NO: 123298 - RNA, 64 nt, Homo Sapiens
ugugucagggccauucaaauuguugguguugcaucacagcuaccuuaacuguuuuuaacaugga

SEQ ID NO: 123299 - RNA, 64 nt, Homo Sapiens
cccccuucaccccccccacccccgccuugccacacacagcuaauauucuaaugguaaauuucuc

SEQ ID NO: 123300 - RNA, 64 nt, Homo Sapiens
ggcccagagagguuaagugucuugcccgaggucacacagcuaucugcaugucccacaacucccc

SEQ ID NO: 123301 - RNA, 64 nt, Homo Sapiens
aaauacaaaaguuaaccaagccuaugcuuguagucacagcuacucgggaggccgaggugggagg

SEQ ID NO: 123302 - RNA, 64 nt, Homo Sapiens
acaaaaccgaaaaagcaaaauuagggucugacuucacagcuaugugcaacgggguggcauucac

SEQ ID NO: 123303 - RNA, 64 nt, Homo Sapiens
cugcaaagggcaaauuauaaggaccaaauaacuucacagcuacucucaguuccacagaauguca

SEQ ID NO: 123304 - RNA, 64 nt, Homo Sapiens
uauguugagggaacucugccaccugcgugcaacccacagcuaaaguaaauucaaugacacuacu

SEQ ID NO: 123305 - RNA, 64 nt, Homo Sapiens
guuucccuacaagagggaaagaaggcaaaaacggcacagcuaucuccaaacacaucugaguuca

SEQ ID NO: 123306 - RNA, 64 nt, Homo Sapiens
uaggcaggacaugcugaagccaaagccaauaacacacagcuaacacacagcucccauaaccgcu

SEQ ID NO: 123307 - RNA, 64 nt, Homo Sapiens
ugaaggcaaugccauccucaaacacugcaggcaucacagcuaacaauugugaagucgucuuaac

SEQ ID NO: 123308 - RNA, 64 nt, Homo Sapiens
cucaucuuagugccugagaguauuuaggcagauugaaaaggacaccuuuuaacucaccucucaa

SEQ ID NO: 123309 - RNA, 64 nt, Homo Sapiens
gauacaugguugugaccugaggauuuaagggauggaaaaggaagacuagaggcuugcauaauaa

SEQ ID NO: 123310 - RNA, 64 nt, Homo Sapiens
aguuuuauugcuuauagaaagaaggaugggaagagaaaaggagcagcagagagaacccagguua

SEQ ID NO: 123311 - RNA, 64 nt, Homo Sapiens
guugcacaaggguugugaauggucugacuugagagaaaaggaauugcacugaaacauguggucu

SEQ ID NO: 123312 - RNA, 64 nt, Homo Sapiens
ggaaauagauguguguuuaauggaauugaagucugaaaaggaaguaguuauuuuagcagaaaau

SEQ ID NO: 123313 - RNA, 64 nt, Homo Sapiens
aauugaauuauuuuucuccaaauugagacucucagaaaaggaagauugaauuagcguguuuuuu

SEQ ID NO: 123314 - RNA, 64 nt, Homo Sapiens
ugagaacucuuguuucuuggggaaggagaggagggaaaaggaccagggucaagggggaccagag

SEQ ID NO: 123315 - RNA, 64 nt, Homo Sapiens
acugacugauuaauuauuccugauaacaucucaagaaaaggagaaggaaaguguuucuggagaa

SEQ ID NO: 123316 - RNA, 64 nt, Homo Sapiens
acauaagaaacuccauuuugacugugucuguguagaaaaggaagaaaagaaagaucagauuguu

SEQ ID NO: 123317 - RNA, 64 nt, Homo Sapiens
caggagccacugugaggugagucuuggugcauuggaaaaggagugacaucccuccguggugugu

SEQ ID NO: 123318 - RNA, 64 nt, Homo Sapiens
uaauacaauuccagaaagugauuuuuacucucuggaaaaggagaaaacaauggugauuuuauuu

SEQ ID NO: 123319 - RNA, 64 nt, Homo Sapiens
ucugcuuucguguuuuuggguuauuuuuuucagugaaaaggaaugcccuugcauggaaaacugu

SEQ ID NO: 123320 - RNA, 64 nt, Homo Sapiens
aucuuaucacacugauguguucaacuguuuaugggaaaaggaaacuaggaugguuuuauuugug

SEQ ID NO: 123321 - RNA, 64 nt, Homo Sapiens
uucuacaacgcuagaacuguugaacuucuugggagaaaaggagaaucuuuguuuuguugugcug

SEQ ID NO: 123322 - RNA, 64 nt, Homo Sapiens
ccagcgcagagcagagugcugaguaaagaugucagaaaaggaaagcaauggucugguacaaguc

SEQ ID NO: 123323 - RNA, 64 nt, Homo Sapiens
aaagaaagguuuuuugguuuuggacccaagagaagaaaaggaagggcuauuacauaagaaacaa

SEQ ID NO: 123324 - RNA, 64 nt, Homo Sapiens
uguacuggcuauuacauaaguaaagcuaacacaggaaaaggaacacaauuuuaggcucaaaaau

SEQ ID NO: 123325 - RNA, 64 nt, Homo Sapiens
uuuaggaggagaauuugugaaggagcguuccuaggaaaaggaauaauuccauuacuccauuuac

SEQ ID NO: 123326 - RNA, 64 nt, Homo Sapiens
aaguccugcagaaucaauccaugcaccaagcguggaaaaggagaaggcuuaaucuucagcuucu

SEQ ID NO: 123327 - RNA, 64 nt, Homo Sapiens
gccagagaaaaaucacagcuuccuugucggaggggaaaaggacaggugaucuggggaaaacgca

SEQ ID NO: 123328 - RNA, 64 nt, Homo Sapiens
uuauuuucuucagccugugcaaaacaaagcaauggaaaaggaaacuaaaaaauauacauacuag

SEQ ID NO: 123329 - RNA, 64 nt, Homo Sapiens
caggaaaacuacagguguugcucuccuguuuacugaaaaggaguguuuccugcugacuacaacc

SEQ ID NO: 123330 - RNA, 64 nt, Homo Sapiens
guagcucaacuugugauaaaucaacucuauaaaggaaaaggaaucaaucaccccugccuuuugu

SEQ ID NO: 123331 - RNA, 64 nt, Homo Sapiens
uaggagaaagaagagcagcucugcuucugaggaagaaaaggagucauuuuaucgagagaaccuu

SEQ ID NO: 123332 - RNA, 64 nt, Homo Sapiens
acagguuugaggggcuggggagugggaggggggagaaaaggaauguauuuaaacaauuuccgau

SEQ ID NO: 123333 - RNA, 64 nt, Homo Sapiens
ugacaagaaauuuaaagaaucaaaacgaugguuugaaaaggaaaccuaugauacaugcaggaga

SEQ ID NO: 123334 - RNA, 64 nt, Homo Sapiens
caauccugcugcuggguauauacccgaaagaaaggaaaaggaagccaguauauugaagagguau

SEQ ID NO: 123335 - RNA, 64 nt, Homo Sapiens
aaaugagauucugucauuugcaauaauauagauggaaaaggaggcccuuaugugaagugaaaua

SEQ ID NO: 123336 - RNA, 64 nt, Homo Sapiens
gagaggcugagaucauucagaaggaguguguucagaaaaggagauuuagucuccuuuuucaaca

SEQ ID NO: 123337 - RNA, 64 nt, Homo Sapiens
cuggugcuuccccuguuugcccucuggcugcauagaaaaggauugggagccuguccguucagag

SEQ ID NO: 123338 - RNA, 64 nt, Homo Sapiens
gaagugugacggagcaggcgggcugaggagaguggaaaaggaagcgacccagaaauggcaggga

SEQ ID NO: 123339 - RNA, 64 nt, Homo Sapiens
ugaaaaaaaaaaaugcuuuuaaaaaagauaaaaugaaaaggagagcucucuuuuucucucucuu

SEQ ID NO: 123340 - RNA, 64 nt, Homo Sapiens
aauaucuuuuuuggaacuaaauucugggaggcaagaaaaggacagaugaggggacauuuucugg

SEQ ID NO: 123341 - RNA, 64 nt, Homo Sapiens
aaaagcaaaaagcaagggagagacaugugaggaggaaaaggaaaggaguccucuagcaggccua

SEQ ID NO: 123342 - RNA, 61 nt, Homo Sapiens
gagaacagguccugaugugaacaaccuaugggaaaaggaaaggucgagagaaucuugucca

SEQ ID NO: 123343 - RNA, 64 nt, Homo Sapiens
cucuaagucaagugcaaggacuuaacuugcguuugaaaaggaauuagagggucagaaacaccca

SEQ ID NO: 123344 - RNA, 64 nt, Homo Sapiens
uguaagagguggccuucauguuaccaaggggcaggaaaaggauaccugaggaaucaaggggcca

SEQ ID NO: 123345 - RNA, 64 nt, Homo Sapiens
gcacaggaugcccuccaaggauacucaggaaugggaaaaggacaaucuccaguauuuccuuugg

SEQ ID NO: 123346 - RNA, 64 nt, Homo Sapiens
uauuuuggcuuacucuuuggaugagaccagacaagaaaaggauuaaacggguggcuccuuuaau

SEQ ID NO: 123347 - RNA, 64 nt, Homo Sapiens
accuuagacaaaaaaagcagaacccacuggaguagaaaaggaagcauguagcauauacucagua

SEQ ID NO: 123348 - RNA, 64 nt, Homo Sapiens
ucauuucuucuucucacgucugugacaaaugguugaaaaggagucaacauggccccaacuauag

SEQ ID NO: 123349 - RNA, 64 nt, Homo Sapiens
uagggaacuccagacugacacagcaguuguuuuugaaaaggaaauaaacuuugaugaauuagau

SEQ ID NO: 123350 - RNA, 64 nt, Homo Sapiens
aaaacucuggagugagaggaugccagaggaucaagaaaaggaucacaguuucuugaagaagcuu

SEQ ID NO: 123351 - RNA, 64 nt, Homo Sapiens
ugugagagaaaaaccaaucaauguuuacaaaauggaaaaggacacagcauguccuuugaacucc

SEQ ID NO: 123352 - RNA, 64 nt, Homo Sapiens
caacgacagccccaaucuucccgucuuuaugagagaaaaggaaaaaggaaucaaagguggaaga

SEQ ID NO: 123353 - RNA, 64 nt, Homo Sapiens
gaguguggaagggggucuaggagagggagagcuggaaaaggagcugauggggucuuauccuggc

SEQ ID NO: 123354 - RNA, 64 nt, Homo Sapiens
caaggcggcagagcugugcgcccacccagcuauugaaaaggacuuucugugggcacacacucug

SEQ ID NO: 123355 - RNA, 64 nt, Homo Sapiens
uuuuucccauaagacaaugacauacgcuuuuaaugaaaaggaaucacguuagaggaaaaauauu

SEQ ID NO: 123356 - RNA, 64 nt, Homo Sapiens
aaggaacuugucucuucaucuaauaugauagcgggaaaaggagaggaaacuacugccuuuagaa

SEQ ID NO: 123357 - RNA, 64 nt, Homo Sapiens
cuucugugcguugggucaguuucuguuacguaacgaaaaggauaaacaucucccacgggagagg

SEQ ID NO: 123358 - RNA, 64 nt, Homo Sapiens
uuuuuaagugcuguauuaauaauacuuucugaaagaaaaggacacuuaccccaaaacuucaauc

SEQ ID NO: 123359 - RNA, 64 nt, Homo Sapiens
cuuccacugaaacauuuggaccagcucauguuuggaaaaggaauauaauuaaaaacccaaagaa

SEQ ID NO: 123360 - RNA, 64 nt, Homo Sapiens
gcuccaucaaagaggacccccggcaagacuuggagaaaaggaaaaugcuuuuccucaggaaauu

SEQ ID NO: 123361 - RNA, 64 nt, Homo Sapiens
gauuauuaugagugggggacuggugacuuuauaugaaaaggaaggaagagugaccuaagcuagc

SEQ ID NO: 123362 - RNA, 64 nt, Homo Sapiens
cauaacugugcuugucucagucaaacuuaauugggaaaaggaggaguaagagcaggcccuuucu

SEQ ID NO: 123363 - RNA, 64 nt, Homo Sapiens
cccuuagaaugggaaagaaaaaaaaaguaagaaagaaaaggacuacuccaucucaaaaaaaaaa

SEQ ID NO: 123364 - RNA, 64 nt, Homo Sapiens
cccuggccaggcgcagugacaauaggcucaguuagaaaaggacuccauuuguaccuaagagaaa

SEQ ID NO: 123365 - RNA, 64 nt, Homo Sapiens
gguagauacagucagugucagaggaucagaugaagaaaaggagauggacuuuagacaaaagcaa

SEQ ID NO: 123366 - RNA, 64 nt, Homo Sapiens
ccuguuacagaaaagacaagaggagaacauaagagaaaaggaaagaaaagaacauaagaacuca

SEQ ID NO: 123367 - RNA, 64 nt, Homo Sapiens
gguagauacagucagugucagaacaccugaugaagaaaaggagacaauauggauuuagaaaaag

SEQ ID NO: 123368 - RNA, 64 nt, Homo Sapiens
auaaaaacuguggcugaccauuauucauagaaaugaaaaggaaaaacaaagucaacugaaucuu

SEQ ID NO: 123369 - RNA, 64 nt, Homo Sapiens
ucuguauuuucuauuagccauccaacucucuuaugaaaaggaacgaaaaauacuguuucuucua

SEQ ID NO: 123370 - RNA, 61 nt, Homo Sapiens
cugaagacuuauggcagugaacacaucugauuucccacagcacaacagcccugcauggguu

SEQ ID NO: 123371 - RNA, 61 nt, Homo Sapiens
accuuguaaaacugcugggagaaaagcaugauucccacaaggacuaaguaucagugauuug

SEQ ID NO: 123372 - RNA, 61 nt, Homo Sapiens
ccagucuggauccaggucugcucuuggcgcauucccacacugcgggaccuacaaguccuuc

SEQ ID NO: 123373 - RNA, 61 nt, Homo Sapiens
uggguuguuggaaucccaccccaaaaccaucuucccacauggccaggagcgcccugacauc

SEQ ID NO: 123374 - RNA, 61 nt, Homo Sapiens
caugacuaguauuucuaauuagccuaauaaauucccacacuuucugaagugaacacuaaug

SEQ ID NO: 123375 - RNA, 61 nt, Homo Sapiens
agauuaaaguaggcuggguuucauuuccaucuucccacacaucucauugaauuugaugguu

SEQ ID NO: 123376 - RNA, 61 nt, Homo Sapiens
ggagucacacuaauacuaucaacuaucagucuucccacagcuucaaucacugucauuauuc

SEQ ID NO: 123377 - RNA, 61 nt, Homo Sapiens
ucaaaauaaauuaucacuucgaaaacuugcuuucccacacuaagguaaguucagacuagau

SEQ ID NO: 123378 - RNA, 61 nt, Homo Sapiens
gguaucaaugcuguagauggauggaagaggcuucccacaggaaggugccaccagucaguug

SEQ ID NO: 123379 - RNA, 61 nt, Homo Sapiens
uuuacucuucuagaguacuguuaaugccccuuucccacagucuuuuauauaauuaaauaua

SEQ ID NO: 123380 - RNA, 61 nt, Homo Sapiens
uuagccuugcacuccagggcccuaccugcauuucccacaugacuuucuggaagccucccaa

SEQ ID NO: 123381 - RNA, 61 nt, Homo Sapiens
gguaggcuucaaagagccuauauuccucuuuuucccacaccgaucaagucaacucaguacu

SEQ ID NO: 123382 - RNA, 61 nt, Homo Sapiens
gccuauugauacuuggggagucccccagcacuucccacaguuuucucugcauuuaaaaaaa

SEQ ID NO: 123383 - RNA, 61 nt, Homo Sapiens
acaaaugggacacauggucuguugaugauacuucccacaccguugcuguacaaaagcaaug

SEQ ID NO: 123384 - RNA, 61 nt, Homo Sapiens
ccguucuucgguuugccaugugaagcugagcuucccacaucccugggacuuugcagucaaa

SEQ ID NO: 123385 - RNA, 61 nt, Homo Sapiens
cccuucguccugcccaaggguucgcccuuguuucccacauuaaaaccauccuuccuuuccu

SEQ ID NO: 123386 - RNA, 61 nt, Homo Sapiens
ucucaaccccagcagucuggcuuguuucucauucccacaauuuccuggguuccaccaagca

SEQ ID NO: 123387 - RNA, 61 nt, Homo Sapiens
agguaccaggauggcaggacccgcacgccucuucccacaccugucagcuucggaagcaucu

SEQ ID NO: 123388 - RNA, 61 nt, Homo Sapiens
cuguaugggagaaaaagaguaagaggaaauauucccacagccaugaagggugaaagggcac

SEQ ID NO: 123389 - RNA, 61 nt, Homo Sapiens
cugcucugggugguaagggaagcccucccgguucccacaggcuaugaugcugcauggcaga

SEQ ID NO: 123390 - RNA, 61 nt, Homo Sapiens
uuuguuccucaauagcuggguguucugcccuuucccacaccgccccuggcuuccucuucca

SEQ ID NO: 123391 - RNA, 61 nt, Homo Sapiens
uuggaggcuuuuccaacgucuguucugcccuuucccacauggccccuggcuuccucuucca

SEQ ID NO: 123392 - RNA, 61 nt, Homo Sapiens
uaaucugaggaaugcagaaacaggaggacaauucccacagauugucauuugagaaaggaug

SEQ ID NO: 123393 - RNA, 61 nt, Homo Sapiens
cccaacgcagucuguguaugcuguccuuggcuucccacagcuuggggugaaggagacauuu

SEQ ID NO: 123394 - RNA, 64 nt, Homo Sapiens; identical to SEQ ID NO: 86383

SEQ ID NO: 123395 - RNA, 64 nt, Homo Sapiens; identical to SEQ ID NO: 86384

SEQ ID NO: 123396 - RNA, 64 nt, Homo Sapiens; identical to SEQ ID NO: 86385

SEQ ID NO: 123397 - RNA, 64 nt, Homo Sapiens; identical to SEQ ID NO: 86386

SEQ ID NO: 123398 - RNA, 64 nt, Homo Sapiens; identical to SEQ ID NO: 86387

SEQ ID NO: 123399 - RNA, 64 nt, Homo Sapiens; identical to SEQ ID NO: 86388

SEQ ID NO: 123400 - RNA, 64 nt, Homo Sapiens; identical to SEQ ID NO: 86389

SEQ ID NO: 123401 - RNA, 64 nt, Homo Sapiens; identical to SEQ ID NO: 86390

SEQ ID NO: 123402 - RNA, 64 nt, Homo Sapiens; identical to SEQ ID NO: 86391

SEQ ID NO: 123403 - RNA, 64 nt, Homo Sapiens; identical to SEQ ID NO: 86392

SEQ ID NO: 123404 - RNA, 64 nt, Homo Sapiens; identical to SEQ ID NO: 86393

SEQ ID NO: 123405 - RNA, 64 nt, Homo Sapiens; identical to SEQ ID NO: 86394

SEQ ID NO: 123406 - RNA, 61 nt, Homo Sapiens; identical to SEQ ID NO: 86395

SEQ ID NO: 123407 - RNA, 64 nt, Homo Sapiens; identical to SEQ ID NO: 86396

SEQ ID NO: 123408 - RNA, 64 nt, Homo Sapiens; identical to SEQ ID NO: 86397

SEQ ID NO: 123409 - RNA, 64 nt, Homo Sapiens; identical to SEQ ID NO: 86398

SEQ ID NO: 123410 - RNA, 64 nt, Homo Sapiens; identical to SEQ ID NO: 86399

SEQ ID NO: 123411 - RNA, 64 nt, Homo Sapiens; identical to SEQ ID NO: 86400

SEQ ID NO: 123412 - RNA, 64 nt, Homo Sapiens; identical to SEQ ID NO: 86401

SEQ ID NO: 123413 - RNA, 64 nt, Homo Sapiens; identical to SEQ ID NO: 86402

SEQ ID NO: 123414 - RNA, 64 nt, Homo Sapiens; identical to SEQ ID NO: 86403

SEQ ID NO: 123415 - RNA, 64 nt, Homo Sapiens; identical to SEQ ID NO: 86404

SEQ ID NO: 123416 - RNA, 64 nt, Homo Sapiens; identical to SEQ ID NO: 86405

SEQ ID NO: 123417 - RNA, 64 nt, Homo Sapiens; identical to SEQ ID NO: 86406

SEQ ID NO: 123418 - RNA, 64 nt, Homo Sapiens; identical to SEQ ID NO: 86407

SEQ ID NO: 123419 - RNA, 64 nt, Homo Sapiens; identical to SEQ ID NO: 86408

SEQ ID NO: 123420 - RNA, 64 nt, Homo Sapiens; identical to SEQ ID NO: 86409

SEQ ID NO: 123421 - RNA, 64 nt, Homo Sapiens; identical to SEQ ID NO: 86410

SEQ ID NO: 123422 - RNA, 64 nt, Homo Sapiens; identical to SEQ ID NO: 86411

SEQ ID NO: 123423 - RNA, 64 nt, Homo Sapiens; identical to SEQ ID NO: 86412

SEQ ID NO: 123424 - RNA, 64 nt, Homo Sapiens; identical to SEQ ID NO: 86413

SEQ ID NO: 123425 - RNA, 64 nt, Homo Sapiens; identical to SEQ ID NO: 86414

SEQ ID NO: 123426 - RNA, 64 nt, Homo Sapiens; identical to SEQ ID NO: 86415

SEQ ID NO: 123427 - RNA, 64 nt, Homo Sapiens; identical to SEQ ID NO: 86416

SEQ ID NO: 123428 - RNA, 64 nt, Homo Sapiens; identical to SEQ ID NO: 86417

SEQ ID NO: 123429 - RNA, 64 nt, Homo Sapiens; identical to SEQ ID NO: 86418

SEQ ID NO: 123430 - RNA, 64 nt, Homo Sapiens; identical to SEQ ID NO: 86419

SEQ ID NO: 123431 - RNA, 64 nt, Homo Sapiens; identical to SEQ ID NO: 86420

SEQ ID NO: 123432 - RNA, 64 nt, Homo Sapiens; identical to SEQ ID NO: 86421

SEQ ID NO: 123433 - RNA, 64 nt, Homo Sapiens; identical to SEQ ID NO: 86422

SEQ ID NO: 123434 - RNA, 64 nt, Homo Sapiens; identical to SEQ ID NO: 86423

SEQ ID NO: 123435 - RNA, 64 nt, Homo Sapiens; identical to SEQ ID NO: 86424

SEQ ID NO: 123436 - RNA, 64 nt, Homo Sapiens; identical to SEQ ID NO: 86425

SEQ ID NO: 123437 - RNA, 64 nt, Homo Sapiens; identical to SEQ ID NO: 86426

SEQ ID NO: 123438 - RNA, 64 nt, Homo Sapiens; identical to SEQ ID NO: 86427

SEQ ID NO: 123439 - RNA, 64 nt, Homo Sapiens; identical to SEQ ID NO: 86428

SEQ ID NO: 123440 - RNA, 64 nt, Homo Sapiens; identical to SEQ ID NO: 86429

SEQ ID NO: 123441 - RNA, 64 nt, Homo Sapiens; identical to SEQ ID NO: 86430

SEQ ID NO: 123442 - RNA, 64 nt, Homo Sapiens; identical to SEQ ID NO: 86431

SEQ ID NO: 123443 - RNA, 64 nt, Homo Sapiens; identical to SEQ ID NO: 86432

SEQ ID NO: 123444 - RNA, 64 nt, Homo Sapiens; identical to SEQ ID NO: 86433

SEQ ID NO: 123445 - RNA, 64 nt, Homo Sapiens; identical to SEQ ID NO: 86434

SEQ ID NO: 123446 - RNA, 64 nt, Homo Sapiens; identical to SEQ ID NO: 86435

SEQ ID NO: 123447 - RNA, 64 nt, Homo Sapiens; identical to SEQ ID NO: 86436

SEQ ID NO: 123448 - RNA, 64 nt, Homo Sapiens; identical to SEQ ID NO: 86437

SEQ ID NO: 123449 - RNA, 64 nt, Homo Sapiens; identical to SEQ ID NO: 86438

SEQ ID NO: 123450 - RNA, 64 nt, Homo Sapiens; identical to SEQ ID NO: 86439

SEQ ID NO: 123451 - RNA, 64 nt, Homo Sapiens; identical to SEQ ID NO: 86440

SEQ ID NO: 123452 - RNA, 64 nt, Homo Sapiens; identical to SEQ ID NO: 86441

SEQ ID NO: 123453 - RNA, 64 nt, Homo Sapiens; identical to SEQ ID NO: 86442

SEQ ID NO: 123454 - RNA, 64 nt, Homo Sapiens; identical to SEQ ID NO: 86443

SEQ ID NO: 123455 - RNA, 64 nt, Homo Sapiens; identical to SEQ ID NO: 86444

SEQ ID NO: 123456 - RNA, 64 nt, Homo Sapiens; identical to SEQ ID NO: 86445

SEQ ID NO: 123457 - RNA, 60 nt, Homo Sapiens; identical to SEQ ID NO: 86446

SEQ ID NO: 123458 - RNA, 64 nt, Homo Sapiens; identical to SEQ ID NO: 86447

SEQ ID NO: 123459 - RNA, 64 nt, Homo Sapiens; identical to SEQ ID NO: 86448

SEQ ID NO: 123460 - RNA, 64 nt, Homo Sapiens; identical to SEQ ID NO: 86449

SEQ ID NO: 123461 - RNA, 64 nt, Homo Sapiens; identical to SEQ ID NO: 86450

SEQ ID NO: 123462 - RNA, 64 nt, Homo Sapiens; identical to SEQ ID NO: 86451

SEQ ID NO: 123463 - RNA, 64 nt, Homo Sapiens; identical to SEQ ID NO: 86452

SEQ ID NO: 123464 - RNA, 64 nt, Homo Sapiens; identical to SEQ ID NO: 86453

SEQ ID NO: 123465 - RNA, 64 nt, Homo Sapiens; identical to SEQ ID NO: 86454

SEQ ID NO: 123466 - RNA, 64 nt, Homo Sapiens; identical to SEQ ID NO: 86455

SEQ ID NO: 123467 - RNA, 64 nt, Homo Sapiens; identical to SEQ ID NO: 86456

SEQ ID NO: 123468 - RNA, 64 nt, Homo Sapiens; identical to SEQ ID NO: 86457

SEQ ID NO: 123469 - RNA, 64 nt, Homo Sapiens; identical to SEQ ID NO: 86458

SEQ ID NO: 123470 - RNA, 64 nt, Homo Sapiens; identical to SEQ ID NO: 86459

SEQ ID NO: 123471 - RNA, 64 nt, Homo Sapiens; identical to SEQ ID NO: 86460

SEQ ID NO: 123472 - RNA, 64 nt, Homo Sapiens; identical to SEQ ID NO: 86461

SEQ ID NO: 123473 - RNA, 55 nt, Homo Sapiens; identical to SEQ ID NO: 86462

SEQ ID NO: 123474 - RNA, 64 nt, Homo Sapiens; identical to SEQ ID NO: 86463

SEQ ID NO: 123475 - RNA, 64 nt, Homo Sapiens; identical to SEQ ID NO: 86464

SEQ ID NO: 123476 - RNA, 64 nt, Homo Sapiens; identical to SEQ ID NO: 86465

SEQ ID NO: 123477 - RNA, 64 nt, Homo Sapiens; identical to SEQ ID NO: 86466

SEQ ID NO: 123478 - RNA, 64 nt, Homo Sapiens; identical to SEQ ID NO: 86467

SEQ ID NO: 123479 - RNA, 64 nt, Homo Sapiens; identical to SEQ ID NO: 86468

SEQ ID NO: 123480 - RNA, 64 nt, Homo Sapiens; identical to SEQ ID NO: 86469

SEQ ID NO: 123481 - RNA, 64 nt, Homo Sapiens; identical to SEQ ID NO: 86470

SEQ ID NO: 123482 - RNA, 64 nt, Homo Sapiens; identical to SEQ ID NO: 86471

SEQ ID NO: 123483 - RNA, 64 nt, Homo Sapiens; identical to SEQ ID NO: 86472

SEQ ID NO: 123484 - RNA, 64 nt, Homo Sapiens; identical to SEQ ID NO: 86473

SEQ ID NO: 123485 - RNA, 64 nt, Homo Sapiens; identical to SEQ ID NO: 86474

SEQ ID NO: 123486 - RNA, 64 nt, Homo Sapiens; identical to SEQ ID NO: 86475

SEQ ID NO: 123487 - RNA, 64 nt, Homo Sapiens; identical to SEQ ID NO: 86476

SEQ ID NO: 123488 - RNA, 64 nt, Homo Sapiens; identical to SEQ ID NO: 86477

SEQ ID NO: 123489 - RNA, 64 nt, Homo Sapiens; identical to SEQ ID NO: 86478

SEQ ID NO: 123490 - RNA, 64 nt, Homo Sapiens; identical to SEQ ID NO: 86479

SEQ ID NO: 123491 - RNA, 64 nt, Homo Sapiens; identical to SEQ ID NO: 86480

SEQ ID NO: 123492 - RNA, 64 nt, Homo Sapiens; identical to SEQ ID NO: 86481

SEQ ID NO: 123493 - RNA, 64 nt, Homo Sapiens; identical to SEQ ID NO: 86482

SEQ ID NO: 123494 - RNA, 64 nt, Homo Sapiens; identical to SEQ ID NO: 86483

SEQ ID NO: 123495 - RNA, 64 nt, Homo Sapiens; identical to SEQ ID NO: 86484

SEQ ID NO: 123496 - RNA, 64 nt, Homo Sapiens; identical to SEQ ID NO: 86485

SEQ ID NO: 123497 - RNA, 64 nt, Homo Sapiens; identical to SEQ ID NO: 86486

SEQ ID NO: 123498 - RNA, 64 nt, Homo Sapiens; identical to SEQ ID NO: 86487

SEQ ID NO: 123499 - RNA, 64 nt, Homo Sapiens; identical to SEQ ID NO: 86488

SEQ ID NO: 123500 - RNA, 64 nt, Homo Sapiens; identical to SEQ ID NO: 86489

SEQ ID NO: 123501 - RNA, 64 nt, Homo Sapiens; identical to SEQ ID NO: 86490

SEQ ID NO: 123502 - RNA, 64 nt, Homo Sapiens; identical to SEQ ID NO: 86491

SEQ ID NO: 123503 - RNA, 64 nt, Homo Sapiens; identical to SEQ ID NO: 86492

SEQ ID NO: 123504 - RNA, 64 nt, Homo Sapiens; identical to SEQ ID NO: 86493

SEQ ID NO: 123505 - RNA, 51 nt, Homo Sapiens; identical to SEQ ID NO: 86494

SEQ ID NO: 123506 - RNA, 64 nt, Homo Sapiens; identical to SEQ ID NO: 86495

SEQ ID NO: 123507 - RNA, 64 nt, Homo Sapiens; identical to SEQ ID NO: 86496

SEQ ID NO: 123508 - RNA, 64 nt, Homo Sapiens; identical to SEQ ID NO: 86497

SEQ ID NO: 123509 - RNA, 64 nt, Homo Sapiens; identical to SEQ ID NO: 86498

SEQ ID NO: 123510 - RNA, 64 nt, Homo Sapiens; identical to SEQ ID NO: 86499

SEQ ID NO: 123511 - RNA, 64 nt, Homo Sapiens; identical to SEQ ID NO: 86500

SEQ ID NO: 123512 - RNA, 64 nt, Homo Sapiens; identical to SEQ ID NO: 86501

SEQ ID NO: 123513 - RNA, 64 nt, Homo Sapiens; identical to SEQ ID NO: 86502

SEQ ID NO: 123514 - RNA, 64 nt, Homo Sapiens; identical to SEQ ID NO: 86503

SEQ ID NO: 123515 - RNA, 64 nt, Homo Sapiens; identical to SEQ ID NO: 86504

SEQ ID NO: 123516 - RNA, 64 nt, Homo Sapiens; identical to SEQ ID NO: 86505

SEQ ID NO: 123517 - RNA, 64 nt, Homo Sapiens; identical to SEQ ID NO: 86506

SEQ ID NO: 123518 - RNA, 64 nt, Homo Sapiens; identical to SEQ ID NO: 86507

SEQ ID NO: 123519 - RNA, 64 nt, Homo Sapiens; identical to SEQ ID NO: 86508

SEQ ID NO: 123520 - RNA, 64 nt, Homo Sapiens; identical to SEQ ID NO: 86509

SEQ ID NO: 123521 - RNA, 64 nt, Homo Sapiens; identical to SEQ ID NO: 86510

SEQ ID NO: 123522 - RNA, 64 nt, Homo Sapiens; identical to SEQ ID NO: 86511

SEQ ID NO: 123523 - RNA, 64 nt, Homo Sapiens; identical to SEQ ID NO: 86512

SEQ ID NO: 123524 - RNA, 64 nt, Homo Sapiens; identical to SEQ ID NO: 86513

SEQ ID NO: 123525 - RNA, 64 nt, Homo Sapiens; identical to SEQ ID NO: 86514

SEQ ID NO: 123526 - RNA, 64 nt, Homo Sapiens; identical to SEQ ID NO: 86515

SEQ ID NO: 123527 - RNA, 64 nt, Homo Sapiens; identical to SEQ ID NO: 86516

SEQ ID NO: 123528 - RNA, 64 nt, Homo Sapiens; identical to SEQ ID NO: 86517

SEQ ID NO: 123529 - RNA, 64 nt, Homo Sapiens; identical to SEQ ID NO: 86518

SEQ ID NO: 123530 - RNA, 64 nt, Homo Sapiens; identical to SEQ ID NO: 86519

SEQ ID NO: 123531 - RNA, 64 nt, Homo Sapiens; identical to SEQ ID NO: 86520

SEQ ID NO: 123532 - RNA, 64 nt, Homo Sapiens; identical to SEQ ID NO: 86521

SEQ ID NO: 123533 - RNA, 64 nt, Homo Sapiens; identical to SEQ ID NO: 86522

SEQ ID NO: 123534 - RNA, 64 nt, Homo Sapiens; identical to SEQ ID NO: 86523

SEQ ID NO: 123535 - RNA, 64 nt, Homo Sapiens; identical to SEQ ID NO: 86524

SEQ ID NO: 123536 - RNA, 64 nt, Homo Sapiens; identical to SEQ ID NO: 86525

SEQ ID NO: 123537 - RNA, 64 nt, Homo Sapiens
uugcccaauuaauacuagggugcaguguauccuggagagguagggugugugggggaggaauccc

SEQ ID NO: 123538 - RNA, 64 nt, Homo Sapiens
uccggucccaaggacaaggcucuuccagugcuaggagagguaugagcagccucucaccugugag

SEQ ID NO: 123539 - RNA, 64 nt, Homo Sapiens
gaagucugcacauaacuaauucuaggccuggugugagagguaggcagccuuccuaguugguuuu

SEQ ID NO: 123540 - RNA, 64 nt, Homo Sapiens
gugagcagagcagcugaaauugugccaguugcuggagagguagugaugugccaggugccugcgu

SEQ ID NO: 123541 - RNA, 64 nt, Homo Sapiens
gguagccacgagcugauaaucaagagguagaggggagagguagaggggagagguagagaugaga

SEQ ID NO: 123542 - RNA, 64 nt, Homo Sapiens
gaugagacaagagguagagggcaggggucagggggagagguagaugcugcaaaaugacccagag

SEQ ID NO: 123543 - RNA, 64 nt, Homo Sapiens
gguggagauacccuuuuugaaagguggccuuggugagagguauggagccaagucuucuagguug

SEQ ID NO: 123544 - RNA, 64 nt, Homo Sapiens
guaaaagggaagaaugucugauacugaucuauuagagagguacuuuagaggcuucuugauuggc

SEQ ID NO: 123545 - RNA, 64 nt, Homo Sapiens
aguacuucaaauucaacaggguuuaauuagaagugagagguagagccagucuguuuucuuccau

SEQ ID NO: 123546 - RNA, 64 nt, Homo Sapiens
cuuuuguuguguguuuuauauuguggaggguggagagagguagacagauguucacuuuugcaau

SEQ ID NO: 123547 - RNA, 64 nt, Homo Sapiens
uacagucagugucacuucagcagaugaagaaaaggagagguagauuagacaaaagcaagaggau

SEQ ID NO: 123548 - RNA, 64 nt, Homo Sapiens
uacagucagugucacuucagcugaugaagaaaaggagagguagaggauuuagaaaaaggaacac

SEQ ID NO: 123549 - RNA, 64 nt, Homo Sapiens
ucgguucacacggaucgugcggcucuggcugcccagggcccaaccccauggagagggaaugugu

SEQ ID NO: 123550 - RNA, 64 nt, Homo Sapiens
acaucuccuggauuccuuagggugcucccacuccagggcccagcguuuuuuaauccaguggcaa

SEQ ID NO: 123551 - RNA, 64 nt, Homo Sapiens
cuggcugcagucucuguggcgugcagggcaggccagggcccaugguuccaucuccgagaguggu

SEQ ID NO: 123552 - RNA, 64 nt, Homo Sapiens
acuuucaucagauccugccuggugcuccagaccuagggcccagcggagcaguuacaucgggucu

SEQ ID NO: 123553 - RNA, 64 nt, Homo Sapiens
ccccugccucuuccucccacuuccagccucuccaagggcccacccucccaggugccaggugguc

SEQ ID NO: 123554 - RNA, 64 nt, Homo Sapiens
gauaucaaggaagcuuuucaaggacuagagcgaaagggcccagaggaggaauagcugugaugga

SEQ ID NO: 123555 - RNA, 64 nt, Homo Sapiens
agcaagggcauugccuccucucucugcucacuucagggcccagugcacucacuucacagugaca

SEQ ID NO: 123556 - RNA, 64 nt, Homo Sapiens
uccccuacaauccuugggcagagcauguggucugagggcccacagugaaagaacagcaguggug

SEQ ID NO: 123557 - RNA, 64 nt, Homo Sapiens
ggagagggggugaugaccccuccccaagccccucagggcccagaccuuccugcucuccagcagg

SEQ ID NO: 123558 - RNA, 64 nt, Homo Sapiens
ggcagggucaggcugggguaagccgggguuccacagggcccagcccuggcaggggucuggcccc

SEQ ID NO: 123559 - RNA, 64 nt, Homo Sapiens
cccucuuggccgcuaaggcuccaguggaccacagagggcccaaucacuaaagguauuaauaagu

SEQ ID NO: 123560 - RNA, 64 nt, Homo Sapiens
gaggcugcuaaccagcaggauauuccuucccucuagggcccaaacacacaaagccuuaugagag

SEQ ID NO: 123561 - RNA, 64 nt, Homo Sapiens
ucaaaaacccugggguccugggccagagacaggcagggcccaguccaggggccccaggccuccc

SEQ ID NO: 123562 - RNA, 64 nt, Homo Sapiens
caccaggugaggugagcgugugugcucucagggaagggcccaggaucccaugccugggaggagc

SEQ ID NO: 123563 - RNA, 64 nt, Homo Sapiens
acuuugcacuucggcuggcuagagauagcuuucaagggcccaacggaggcggcgguggcacuga

SEQ ID NO: 123564 - RNA, 64 nt, Homo Sapiens
ccacagccacaggugcgaucucauaagcacugacagggcccagcagaaaaccagccacuucuuu

SEQ ID NO: 123565 - RNA, 64 nt, Homo Sapiens
gagugaaaggaccuuugggggugggugggagcaaagggcccaccugcugguuggugaaagcagu

SEQ ID NO: 123566 - RNA, 64 nt, Homo Sapiens
gagggucuccuaccuggaagucccccugagcuccagggcccagcccuaccugccagugcuggug

SEQ ID NO: 123567 - RNA, 64 nt, Homo Sapiens
uaacagugauagaaguuagauaauagaaaaccucagggcccaagaaauauuucauguccuauuu

SEQ ID NO: 123568 - RNA, 64 nt, Homo Sapiens
ccaggagaucgcuugguuuuuuuuuaaggaagaaagggcccaagagaaaacagucuuccauaga

SEQ ID NO: 123569 - RNA, 64 nt, Homo Sapiens
accuuucugcuaggauuggcuucccgcagagggcagggcccauccuaagcagcuuccaaguccc

SEQ ID NO: 123570 - RNA, 64 nt, Homo Sapiens
ggcgggcuggcuugacucaggcccugugagauagagggcccagcccagccccacccacagaucc

SEQ ID NO: 123571 - RNA, 64 nt, Homo Sapiens
gaugggcuugagggggcucagagcauaaggcuucagggcccaaguugggagaagugaccaaagu

SEQ ID NO: 123572 - RNA, 64 nt, Homo Sapiens
aagcugcccuuuggguaggugcugggcuccugggagggcccagaugauggggugaggcaugucu

SEQ ID NO: 123573 - RNA, 64 nt, Homo Sapiens
ggaaucuuaccaaugccaaccaggcuuugacaaaagggcccacagaauaaacuguuuucuccac

SEQ ID NO: 123574 - RNA, 64 nt, Homo Sapiens
ggcuggcugggauuuuuuuuuaaccucucucaucagggcccaaguaaagaaagauugugcacuu

SEQ ID NO: 123575 - RNA, 64 nt, Homo Sapiens
ugcugcaacuaaaugugaaacuuggcccacuuccagggcccaggggcuccucccuuggcuuucc

SEQ ID NO: 123576 - RNA, 64 nt, Homo Sapiens
uauuaaggcugagagugaagaaggcaccagcaccagggcccaggaagggcugggucugccucag

SEQ ID NO: 123577 - RNA, 64 nt, Homo Sapiens
ccggcgcuuugauugccugaguuucugacacuucagggcccagagguccugcgaggggcagaac

SEQ ID NO: 123578 - RNA, 64 nt, Homo Sapiens
cagaacuggacccccaugccagugcugcugcaggagggcccauauacuagggucugcugagcug

SEQ ID NO: 123579 - RNA, 64 nt, Homo Sapiens
gacuauuugcugugggcucuccuccagccugcccagggcccacccagaugccucugggguuacc

SEQ ID NO: 123580 - RNA, 64 nt, Homo Sapiens
gacugugcacauuucacuaggguccaaauacagaagggcccagggcccaggggcuugcagcuuc

SEQ ID NO: 123581 - RNA, 64 nt, Homo Sapiens
cacauuucacuaggguccaaauacagaagggcccagggcccaggggcuugcagcuucgugaggg

SEQ ID NO: 123582 - RNA, 64 nt, Homo Sapiens
agccugugcuguacaccccgccagcuucucccugagggcccacccugugcugcauacccaccgc

SEQ ID NO: 123583 - RNA, 64 nt, Homo Sapiens
agccugugcugcauacccacccagcuucucccugagggcccacccugugcugcauacccaccgc

SEQ ID NO: 123584 - RNA, 64 nt, Homo Sapiens
agccugugcugcauacccaccugcccugccucugagggcccaccgucuuggggccgaacagccc

SEQ ID NO: 123585 - RNA, 64 nt, Homo Sapiens
agggucuauggggagaggaaagcccucaucuugaagggcccaggccacaugcucugagaagagg

SEQ ID NO: 123586 - RNA, 64 nt, Homo Sapiens
ggcugaguuuucucuuugugcuggagccugagucagggcccagaccucuggggcucuaggguug

SEQ ID NO: 123587 - RNA, 64 nt, Homo Sapiens
aggcacggagggaaggucagaggagaaggcaggcagggcccagugagaggggagcaugccuucc

SEQ ID NO: 123588 - RNA, 64 nt, Homo Sapiens
cuuggucacagggcgguucugggcacuugaacucagggcccaagcagaagcacaggcccagucc

SEQ ID NO: 123589 - RNA, 64 nt, Homo Sapiens
uuguaggaaggucuggccuggggucgggugaaggagggcccaggucaguucuggggucccagug

SEQ ID NO: 123590 - RNA, 64 nt, Homo Sapiens
ggcacgggggcaugggcagagagggccacggggcagggcccacugagggaacaucaguggcccu

SEQ ID NO: 123591 - RNA, 64 nt, Homo Sapiens
ugagauccauccacgauccagcuccgguggagaaagggcccaugucaagccuuguucugcaccc

SEQ ID NO: 123592 - RNA, 64 nt, Homo Sapiens
guguaucccaccccugcccgagagcugacuguggagggcccacaugccuccugacagcuuccaa

SEQ ID NO: 123593 - RNA, 64 nt, Homo Sapiens
gaucacaugggggucacugcggcggcugugacucagggcccaggaaagguggugggggguggau

SEQ ID NO: 123594 - RNA, 64 nt, Homo Sapiens
gcggcuuucugggucucagcccucucugcgguugagggcccagaggacagagagauggacaugc

SEQ ID NO: 123595 - RNA, 64 nt, Homo Sapiens
gucuccaccccccuccccccgccccgcacuccuaagggcccaucugcccagccucugaguuuuc

SEQ ID NO: 123596 - RNA, 64 nt, Homo Sapiens
ugcugagaagccaccgggaaagcagccagcacaaagggcccaggaagccagcccccgagagcug

SEQ ID NO: 123597 - RNA, 64 nt, Homo Sapiens
ggaccggugcuggggccucuccuugcugugugugagggcccagguggaaggcgcggaccugaca

SEQ ID NO: 123598 - RNA, 64 nt, Homo Sapiens
cuuagcagugcucccugcccguggcuccgcgcccagggcccaggagaaccccagcccuguccag

SEQ ID NO: 123599 - RNA, 64 nt, Homo Sapiens
aggccaacccaucaucuagacccaugcaccugccagggcccagcucggcucccuguggcuugug

SEQ ID NO: 123600 - RNA, 64 nt, Homo Sapiens
cuucccggcaccucccagccggcggucaggagugagggcccagcgcuuugcggcggugugagcu

SEQ ID NO: 123601 - RNA, 64 nt, Homo Sapiens
ugaauaaacagaaugagcuggcugggcccaugcaagggcccaccagaaaaaacccauccuaaag

SEQ ID NO: 123602 - RNA, 64 nt, Homo Sapiens; identical to SEQ ID NO: 74086

SEQ ID NO: 123603 - RNA, 64 nt, Homo Sapiens; identical to SEQ ID NO: 74087

SEQ ID NO: 123604 - RNA, 64 nt, Homo Sapiens; identical to SEQ ID NO: 74088

SEQ ID NO: 123605 - RNA, 64 nt, Homo Sapiens; identical to SEQ ID NO: 74089

SEQ ID NO: 123606 - RNA, 64 nt, Homo Sapiens; identical to SEQ ID NO: 74090

SEQ ID NO: 123607 - RNA, 64 nt, Homo Sapiens; identical to SEQ ID NO: 74091

SEQ ID NO: 123608 - RNA, 64 nt, Homo Sapiens; identical to SEQ ID NO: 74092

SEQ ID NO: 123609 - RNA, 64 nt, Homo Sapiens; identical to SEQ ID NO: 74093

SEQ ID NO: 123610 - RNA, 64 nt, Homo Sapiens; identical to SEQ ID NO: 74094

SEQ ID NO: 123611 - RNA, 64 nt, Homo Sapiens; identical to SEQ ID NO: 74095

SEQ ID NO: 123612 - RNA, 64 nt, Homo Sapiens; identical to SEQ ID NO: 74096

SEQ ID NO: 123613 - RNA, 64 nt, Homo Sapiens; identical to SEQ ID NO: 74097

SEQ ID NO: 123614 - RNA, 64 nt, Homo Sapiens; identical to SEQ ID NO: 74098

SEQ ID NO: 123615 - RNA, 64 nt, Homo Sapiens; identical to SEQ ID NO: 74099

SEQ ID NO: 123616 - RNA, 64 nt, Homo Sapiens; identical to SEQ ID NO: 74100

SEQ ID NO: 123617 - RNA, 64 nt, Homo Sapiens; identical to SEQ ID NO: 74101

SEQ ID NO: 123618 - RNA, 64 nt, Homo Sapiens; identical to SEQ ID NO: 74102

SEQ ID NO: 123619 - RNA, 64 nt, Homo Sapiens; identical to SEQ ID NO: 74103

SEQ ID NO: 123620 - RNA, 64 nt, Homo Sapiens; identical to SEQ ID NO: 123549

SEQ ID NO: 123621 - RNA, 64 nt, Homo Sapiens; identical to SEQ ID NO: 123550

SEQ ID NO: 123622 - RNA, 64 nt, Homo Sapiens; identical to SEQ ID NO: 123551

SEQ ID NO: 123623 - RNA, 64 nt, Homo Sapiens; identical to SEQ ID NO: 123552

SEQ ID NO: 123624 - RNA, 64 nt, Homo Sapiens; identical to SEQ ID NO: 123553

SEQ ID NO: 123625 - RNA, 64 nt, Homo Sapiens; identical to SEQ ID NO: 123554

SEQ ID NO: 123626 - RNA, 64 nt, Homo Sapiens; identical to SEQ ID NO: 123555

SEQ ID NO: 123627 - RNA, 64 nt, Homo Sapiens; identical to SEQ ID NO: 123556

SEQ ID NO: 123628 - RNA, 64 nt, Homo Sapiens; identical to SEQ ID NO: 123557

SEQ ID NO: 123629 - RNA, 64 nt, Homo Sapiens; identical to SEQ ID NO: 123558

SEQ ID NO: 123630 - RNA, 64 nt, Homo Sapiens; identical to SEQ ID NO: 123559

SEQ ID NO: 123631 - RNA, 64 nt, Homo Sapiens; identical to SEQ ID NO: 123560

SEQ ID NO: 123632 - RNA, 64 nt, Homo Sapiens; identical to SEQ ID NO: 123561

SEQ ID NO: 123633 - RNA, 64 nt, Homo Sapiens; identical to SEQ ID NO: 123562

SEQ ID NO: 123634 - RNA, 64 nt, Homo Sapiens; identical to SEQ ID NO: 123563

SEQ ID NO: 123635 - RNA, 64 nt, Homo Sapiens; identical to SEQ ID NO: 123564

SEQ ID NO: 123636 - RNA, 64 nt, Homo Sapiens; identical to SEQ ID NO: 123565

SEQ ID NO: 123637 - RNA, 64 nt, Homo Sapiens; identical to SEQ ID NO: 123566

SEQ ID NO: 123638 - RNA, 64 nt, Homo Sapiens; identical to SEQ ID NO: 123567

SEQ ID NO: 123639 - RNA, 64 nt, Homo Sapiens; identical to SEQ ID NO: 123568

SEQ ID NO: 123640 - RNA, 64 nt, Homo Sapiens; identical to SEQ ID NO: 123569

SEQ ID NO: 123641 - RNA, 64 nt, Homo Sapiens; identical to SEQ ID NO: 123570

SEQ ID NO: 123642 - RNA, 64 nt, Homo Sapiens; identical to SEQ ID NO: 123571

SEQ ID NO: 123643 - RNA, 64 nt, Homo Sapiens; identical to SEQ ID NO: 123572

SEQ ID NO: 123644 - RNA, 64 nt, Homo Sapiens; identical to SEQ ID NO: 123573

SEQ ID NO: 123645 - RNA, 64 nt, Homo Sapiens; identical to SEQ ID NO: 123574

SEQ ID NO: 123646 - RNA, 64 nt, Homo Sapiens; identical to SEQ ID NO: 123575

SEQ ID NO: 123647 - RNA, 64 nt, Homo Sapiens; identical to SEQ ID NO: 123576

SEQ ID NO: 123648 - RNA, 64 nt, Homo Sapiens; identical to SEQ ID NO: 123577

SEQ ID NO: 123649 - RNA, 64 nt, Homo Sapiens; identical to SEQ ID NO: 123578

SEQ ID NO: 123650 - RNA, 64 nt, Homo Sapiens; identical to SEQ ID NO: 123579

SEQ ID NO: 123651 - RNA, 64 nt, Homo Sapiens; identical to SEQ ID NO: 123580

SEQ ID NO: 123652 - RNA, 64 nt, Homo Sapiens; identical to SEQ ID NO: 123581

SEQ ID NO: 123653 - RNA, 64 nt, Homo Sapiens; identical to SEQ ID NO: 123582

SEQ ID NO: 123654 - RNA, 64 nt, Homo Sapiens; identical to SEQ ID NO: 123583

SEQ ID NO: 123655 - RNA, 64 nt, Homo Sapiens; identical to SEQ ID NO: 123584

SEQ ID NO: 123656 - RNA, 64 nt, Homo Sapiens; identical to SEQ ID NO: 123585

SEQ ID NO: 123657 - RNA, 64 nt, Homo Sapiens; identical to SEQ ID NO: 123586

SEQ ID NO: 123658 - RNA, 64 nt, Homo Sapiens; identical to SEQ ID NO: 123587

SEQ ID NO: 123659 - RNA, 64 nt, Homo Sapiens; identical to SEQ ID NO: 123588

SEQ ID NO: 123660 - RNA, 64 nt, Homo Sapiens; identical to SEQ ID NO: 123589

SEQ ID NO: 123661 - RNA, 64 nt, Homo Sapiens; identical to SEQ ID NO: 123590

SEQ ID NO: 123662 - RNA, 64 nt, Homo Sapiens; identical to SEQ ID NO: 123591

SEQ ID NO: 123663 - RNA, 64 nt, Homo Sapiens; identical to SEQ ID NO: 123592

SEQ ID NO: 123664 - RNA, 64 nt, Homo Sapiens; identical to SEQ ID NO: 123593

SEQ ID NO: 123665 - RNA, 64 nt, Homo Sapiens; identical to SEQ ID NO: 123594

SEQ ID NO: 123666 - RNA, 64 nt, Homo Sapiens; identical to SEQ ID NO: 123595

SEQ ID NO: 123667 - RNA, 64 nt, Homo Sapiens; identical to SEQ ID NO: 123596

SEQ ID NO: 123668 - RNA, 64 nt, Homo Sapiens; identical to SEQ ID NO: 123597

SEQ ID NO: 123669 - RNA, 64 nt, Homo Sapiens; identical to SEQ ID NO: 123598

SEQ ID NO: 123670 - RNA, 64 nt, Homo Sapiens; identical to SEQ ID NO: 123599

SEQ ID NO: 123671 - RNA, 64 nt, Homo Sapiens; identical to SEQ ID NO: 123600

SEQ ID NO: 123672 - RNA, 64 nt, Homo Sapiens; identical to SEQ ID NO: 123601

SEQ ID NO: 123673 - RNA, 64 nt, Homo Sapiens; identical to SEQ ID NO: 74086

SEQ ID NO: 123674 - RNA, 64 nt, Homo Sapiens; identical to SEQ ID NO: 74087

SEQ ID NO: 123675 - RNA, 64 nt, Homo Sapiens; identical to SEQ ID NO: 74088

SEQ ID NO: 123676 - RNA, 64 nt, Homo Sapiens; identical to SEQ ID NO: 74089

SEQ ID NO: 123677 - RNA, 64 nt, Homo Sapiens; identical to SEQ ID NO: 74090

SEQ ID NO: 123678 - RNA, 64 nt, Homo Sapiens; identical to SEQ ID NO: 74091

SEQ ID NO: 123679 - RNA, 64 nt, Homo Sapiens; identical to SEQ ID NO: 74092

SEQ ID NO: 123680 - RNA, 64 nt, Homo Sapiens; identical to SEQ ID NO: 74093

SEQ ID NO: 123681 - RNA, 64 nt, Homo Sapiens; identical to SEQ ID NO: 74094

SEQ ID NO: 123682 - RNA, 64 nt, Homo Sapiens; identical to SEQ ID NO: 74095

SEQ ID NO: 123683 - RNA, 64 nt, Homo Sapiens; identical to SEQ ID NO: 74096

SEQ ID NO: 123684 - RNA, 64 nt, Homo Sapiens; identical to SEQ ID NO: 74097

SEQ ID NO: 123685 - RNA, 64 nt, Homo Sapiens; identical to SEQ ID NO: 74098

SEQ ID NO: 123686 - RNA, 64 nt, Homo Sapiens; identical to SEQ ID NO: 74099

SEQ ID NO: 123687 - RNA, 64 nt, Homo Sapiens; identical to SEQ ID NO: 74100

SEQ ID NO: 123688 - RNA, 64 nt, Homo Sapiens; identical to SEQ ID NO: 74101

SEQ ID NO: 123689 - RNA, 64 nt, Homo Sapiens; identical to SEQ ID NO: 74102

SEQ ID NO: 123690 - RNA, 64 nt, Homo Sapiens; identical to SEQ ID NO: 74103

SEQ ID NO: 123691 - RNA, 64 nt, Homo Sapiens; identical to SEQ ID NO: 96836

SEQ ID NO: 123692 - RNA, 64 nt, Homo Sapiens; identical to SEQ ID NO: 96837

SEQ ID NO: 123693 - RNA, 64 nt, Homo Sapiens; identical to SEQ ID NO: 96838

SEQ ID NO: 123694 - RNA, 64 nt, Homo Sapiens; identical to SEQ ID NO: 96839

SEQ ID NO: 123695 - RNA, 64 nt, Homo Sapiens; identical to SEQ ID NO: 96840

SEQ ID NO: 123696 - RNA, 64 nt, Homo Sapiens; identical to SEQ ID NO: 96841

SEQ ID NO: 123697 - RNA, 64 nt, Homo Sapiens; identical to SEQ ID NO: 96842

SEQ ID NO: 123698 - RNA, 64 nt, Homo Sapiens; identical to SEQ ID NO: 96843

SEQ ID NO: 123699 - RNA, 64 nt, Homo Sapiens; identical to SEQ ID NO: 96844

SEQ ID NO: 123700 - RNA, 64 nt, Homo Sapiens; identical to SEQ ID NO: 96845

SEQ ID NO: 123701 - RNA, 64 nt, Homo Sapiens; identical to SEQ ID NO: 96846

SEQ ID NO: 123702 - RNA, 64 nt, Homo Sapiens; identical to SEQ ID NO: 96847

SEQ ID NO: 123703 - RNA, 64 nt, Homo Sapiens; identical to SEQ ID NO: 96848

SEQ ID NO: 123704 - RNA, 64 nt, Homo Sapiens; identical to SEQ ID NO: 96849

SEQ ID NO: 123705 - RNA, 64 nt, Homo Sapiens; identical to SEQ ID NO: 96850

SEQ ID NO: 123706 - RNA, 64 nt, Homo Sapiens; identical to SEQ ID NO: 96851

SEQ ID NO: 123707 - RNA, 64 nt, Homo Sapiens; identical to SEQ ID NO: 96852

SEQ ID NO: 123708 - RNA, 64 nt, Homo Sapiens; identical to SEQ ID NO: 96853

SEQ ID NO: 123709 - RNA, 64 nt, Homo Sapiens; identical to SEQ ID NO: 96854

SEQ ID NO: 123710 - RNA, 64 nt, Homo Sapiens; identical to SEQ ID NO: 96855

SEQ ID NO: 123711 - RNA, 64 nt, Homo Sapiens; identical to SEQ ID NO: 96856

SEQ ID NO: 123712 - RNA, 64 nt, Homo Sapiens; identical to SEQ ID NO: 96857

SEQ ID NO: 123713 - RNA, 64 nt, Homo Sapiens; identical to SEQ ID NO: 96858

SEQ ID NO: 123714 - RNA, 64 nt, Homo Sapiens; identical to SEQ ID NO: 96859

SEQ ID NO: 123715 - RNA, 64 nt, Homo Sapiens; identical to SEQ ID NO: 96860

SEQ ID NO: 123716 - RNA, 64 nt, Homo Sapiens; identical to SEQ ID NO: 96861

SEQ ID NO: 123717 - RNA, 64 nt, Homo Sapiens; identical to SEQ ID NO: 96862

SEQ ID NO: 123718 - RNA, 64 nt, Homo Sapiens; identical to SEQ ID NO: 96863

SEQ ID NO: 123719 - RNA, 64 nt, Homo Sapiens; identical to SEQ ID NO: 96864

SEQ ID NO: 123720 - RNA, 64 nt, Homo Sapiens; identical to SEQ ID NO: 96865

SEQ ID NO: 123721 - RNA, 64 nt, Homo Sapiens; identical to SEQ ID NO: 96866

SEQ ID NO: 123722 - RNA, 64 nt, Homo Sapiens; identical to SEQ ID NO: 96867

SEQ ID NO: 123723 - RNA, 64 nt, Homo Sapiens; identical to SEQ ID NO: 96868

SEQ ID NO: 123724 - RNA, 64 nt, Homo Sapiens; identical to SEQ ID NO: 96869

SEQ ID NO: 123725 - RNA, 64 nt, Homo Sapiens; identical to SEQ ID NO: 96870

SEQ ID NO: 123726 - RNA, 64 nt, Homo Sapiens; identical to SEQ ID NO: 96871

SEQ ID NO: 123727 - RNA, 64 nt, Homo Sapiens; identical to SEQ ID NO: 96872

SEQ ID NO: 123728 - RNA, 64 nt, Homo Sapiens; identical to SEQ ID NO: 96873

SEQ ID NO: 123729 - RNA, 64 nt, Homo Sapiens; identical to SEQ ID NO: 96874

SEQ ID NO: 123730 - RNA, 64 nt, Homo Sapiens; identical to SEQ ID NO: 96875

SEQ ID NO: 123731 - RNA, 64 nt, Homo Sapiens
ugaccgaaacuugauauuuuuuucuuucaugaguguccggcaucugcuggucuucauugugaaa

SEQ ID NO: 123732 - RNA, 64 nt, Homo Sapiens
gcuuuuguggaaauugucagccucuacgggcagaguccggcauccccuccccagacugccugcu

SEQ ID NO: 123733 - RNA, 64 nt, Homo Sapiens
agucacaggcccaggaaggcggcucagggccagguccucacagccaugacucugccuaaccaug

SEQ ID NO: 123734 - RNA, 64 nt, Homo Sapiens
caccugcugcuguaugaauacaaagcagacauuuuccucacaccuggacuugaagguuugaugc

SEQ ID NO: 123735 - RNA, 64 nt, Homo Sapiens
gcgcguggggccacugccguggcggcggcugcccuccucacacucggcuccgcgccgccuccgg

SEQ ID NO: 123736 - RNA, 64 nt, Homo Sapiens
ggauugcugaggaaugcagggacgccuguuucuguccucacaccacagaaagaaaccugaggga

SEQ ID NO: 123737 - RNA, 64 nt, Homo Sapiens
guucaucauaacccaaccccuaacuggcucuccuuccucacacaacauagaccuccccaaaagu

SEQ ID NO: 123738 - RNA, 64 nt, Homo Sapiens
uucuccauagaagaugcuuuugcccacaggguauuccucacauucugaauaccuguuuccauag

SEQ ID NO: 123739 - RNA, 64 nt, Homo Sapiens
caaaugagaagaauguggcaaugccuuuaaucaguccucacaccuuucuacacauaagauaauu

SEQ ID NO: 123740 - RNA, 64 nt, Homo Sapiens
caaauguaaaaaacguggcaaugccuuuaacugguccucacaccuugcuacauauaagacaguu

SEQ ID NO: 123741 - RNA, 64 nt, Homo Sapiens
acuguggcugcaggugggacuuuguuguuuggauuccucacagccuuggcuccugagaaaggug

SEQ ID NO: 123742 - RNA, 64 nt, Homo Sapiens
guuccccucacagucaaugcagugguauagcauauccucacauuucuagugcccuugagacugu

SEQ ID NO: 123743 - RNA, 64 nt, Homo Sapiens
uagggaugcucaaaucuauauagauauaaaauuauccucacaguaacauagaaucucuuggugc

SEQ ID NO: 123744 - RNA, 64 nt, Homo Sapiens
uucagcccccugcagcuaagaauuguauugacuguccucacagcggcuuuucauagcuuucagc

SEQ ID NO: 123745 - RNA, 64 nt, Homo Sapiens
gaggagggaaggauggcuaagcugggaccggcaguccucacagggugccugugagaaaggacau

SEQ ID NO: 123746 - RNA, 64 nt, Homo Sapiens
uucucuugaguacccuuggcuuccagccaugcuguccucacauacgguaaagccaaagagcugu

SEQ ID NO: 123747 - RNA, 64 nt, Homo Sapiens
ugcugucuugacaucucuugccuuguccuccgguauguucuaaagcugugucugagaucuggau

SEQ ID NO: 123748 - RNA, 64 nt, Homo Sapiens
acugguguuaaauguugucuacagugcaaaauccauguucuaacauauguaauaauugccagga

SEQ ID NO: 123749 - RNA, 64 nt, Homo Sapiens
gcccagcuaguaaucccuuuuagugggaaaggauauguucuaggagaaacaagcaauuuaccuu

SEQ ID NO: 123750 - RNA, 64 nt, Homo Sapiens
cuggucuccccugcuguuaguaacagucaccaaaauguucuaagcaacuacuuuccuagaguau

SEQ ID NO: 123751 - RNA, 64 nt, Homo Sapiens
ugcauuuaauucugaaaucaaguuacuugaaaaaauguucuauaugcuagugauuucauuacca

SEQ ID NO: 123752 - RNA, 64 nt, Homo Sapiens
agcaucugccucuauucaauugauggauggaaauauguucuaacccacaaaauguugcaaguca

SEQ ID NO: 123753 - RNA, 64 nt, Homo Sapiens
auaagaccuguucucucuagauguauauuuuuaaauguucuaacauugcagaaguaagacaaac

SEQ ID NO: 123754 - RNA, 64 nt, Homo Sapiens
uccuagguccagcaagucacuuuagugucugugaauguucuaguuucccugcgaagacuugaga

SEQ ID NO: 123755 - RNA, 64 nt, Homo Sapiens
uuggucuuuuuuauuuuagguuguuuuauguugaauguucuauaucuuauuaguuaauuuguau

SEQ ID NO: 123756 - RNA, 64 nt, Homo Sapiens
uucucagcuauucugagcuuauuuauuuauuuguauguucuaauggcuaaacauuuacauuaaa

SEQ ID NO: 123757 - RNA, 64 nt, Homo Sapiens
gauauauguauaugcuaaaauauaacuugcaaagauguucuaaauacacaugcuauaaguucgc

SEQ ID NO: 123758 - RNA, 64 nt, Homo Sapiens
aguagcaauacugcaccuggugaucacaaagauaauguucuacuucugauagaaauaauuucuc

SEQ ID NO: 123759 - RNA, 64 nt, Homo Sapiens
guacauauacuuagaacauuuaaacauuuaaacaauguucuaaggaaaugcuucagggauucca

SEQ ID NO: 123760 - RNA, 64 nt, Homo Sapiens
cccuuugucagauugcaguuugaggauugcauacauguucuaaaacagagaggaggaaaaaaga

SEQ ID NO: 123761 - RNA, 64 nt, Homo Sapiens
acaagagucauuuuuagaggauuuuaacagguucauguucuaugauguaaaaucaagacacaca

SEQ ID NO: 123762 - RNA, 64 nt, Homo Sapiens
gaaaaugauaacucaucuuuucugauaauugccuauguucuagguaacaggaaaacaggcauua

SEQ ID NO: 123763 - RNA, 64 nt, Homo Sapiens
cacuauggacagauguaaaaaagcaugcuuagcaauguucuaauuuauuugaauugagcaccuc

SEQ ID NO: 123764 - RNA, 64 nt, Homo Sapiens
gaaaagaaaaaaaaaauauaaucuuuuaucaauaauguucuauagaguugguagauugcuguug

SEQ ID NO: 123765 - RNA, 64 nt, Homo Sapiens
auggagguucuaaggccuaggauucuaaaaugugauguucuaaggcucugagagucuagauucu

SEQ ID NO: 123766 - RNA, 64 nt, Homo Sapiens
uuauaguucuaggcacuguaguucuaagacucaaauguucuaaguuucuaagauucuaaagguc

SEQ ID NO: 123767 - RNA, 64 nt, Homo Sapiens
uaaacuuauggccauacaugaggucaucaguauuauguucuaaauugauucaaccuuaaaaaua

SEQ ID NO: 123768 - RNA, 64 nt, Homo Sapiens
aagaagugucuggguuguuugaagcauggaacauauguucuaguggcuaccagaagccgagaua

SEQ ID NO: 123769 - RNA, 64 nt, Homo Sapiens
guacuuuaguaguuugaaguauguguauuguaaaauguucuaccauguuuucuuucguaauuuu

SEQ ID NO: 123770 - RNA, 64 nt, Homo Sapiens
augugcacaagcggguuucuugagauucuauagaauguucuagacaaugagauauacuaaacaa

SEQ ID NO: 123771 - RNA, 64 nt, Homo Sapiens
acaguagugauuaauagugucaugguagcuaaaggagaaaaaggggguuucguuuacacgcugu

SEQ ID NO: 123772 - RNA, 64 nt, Homo Sapiens
ggggguuuuguuuacaaacuucuuuuuguauugagagaaaaauagccaaagcaucuuugacaga

SEQ ID NO: 123773 - RNA, 64 nt, Homo Sapiens
auucccuuuuaacuuaaaaaaauuguaaaugugggagaaaaaacccugcaggauggaaacaauu

SEQ ID NO: 123774 - RNA, 64 nt, Homo Sapiens
aguauaccuaugugugcagcaguaaaaaauuagugagaaaaagcaacuuuuugucacucuuagg

SEQ ID NO: 123775 - RNA, 64 nt, Homo Sapiens
auaccaaauacaagauuuuaaaagcaaccauggggagaaaaagaucagugaaagcaagacaguc

SEQ ID NO: 123776 - RNA, 64 nt, Homo Sapiens
cagcaacaauguacccaaaagaggguagaauucugagaaaaacuauuagcuuagaauuugcaac

SEQ ID NO: 123777 - RNA, 64 nt, Homo Sapiens
caaaccaugccuuuuuuuuaaggagcaaaaaucugagaaaaaaagugagagaccucugccuaca

SEQ ID NO: 123778 - RNA, 64 nt, Homo Sapiens
uucaagguggcagcuguuagggcugaaucuucuggagaaaaaggugccaucucaggagaauagc

SEQ ID NO: 123779 - RNA, 64 nt, Homo Sapiens
gcuggggccccuauaacaaaagacagauugacaagagaaaaacaaacauaaauuuauuagcggg

SEQ ID NO: 123780 - RNA, 64 nt, Homo Sapiens
uacgcgacaguuauuuuuacaguaagguauuuucgagaaaaaugcauuacguguuuuggaaaau

SEQ ID NO: 123781 - RNA, 64 nt, Homo Sapiens
cagaagcugcaaaagggaucuucgaaacugggcagagaaaaaauaaaguggaauauuaaguaaa

SEQ ID NO: 123782 - RNA, 64 nt, Homo Sapiens
aaaauagaagacauauaaaucacccccaaaaaaagagaaaaagauaugaauuugucacauguau

SEQ ID NO: 123783 - RNA, 64 nt, Homo Sapiens
ucuauagggcaaaucaccuggcaaaacauaaacugagaaaaaguacauuaugggauugcaacca

SEQ ID NO: 123784 - RNA, 64 nt, Homo Sapiens
caugugaugaagacaaauauguauaccuggcauagagaaaaauauauaccugguacauuggaga

SEQ ID NO: 123785 - RNA, 64 nt, Homo Sapiens
cuggcauagagaaaaauauauaccugguacauuggagaaaaauaauuacacuuucaaagagaau

SEQ ID NO: 123786 - RNA, 64 nt, Homo Sapiens
ggcaguguaacaaccuauagugccauugauccaugagaaaaagauuuucugguacuacuccaaa

SEQ ID NO: 123787 - RNA, 64 nt, Homo Sapiens
acuuuuaauuuuuauuuuggcaaaacugucaaaugagaaaaaugauuuuaaaaacuuuuuuuuc

SEQ ID NO: 123788 - RNA, 64 nt, Homo Sapiens
ucuguuucgaauauagccacagaaauaaaggauggagaaaaaucugggacagguaauuuugcaa

SEQ ID NO: 123789 - RNA, 64 nt, Homo Sapiens
ucuguuucgaacauagccacagaaauaaaggauggagaaaaaucugggacagguaauuuugcaa

SEQ ID NO: 123790 - RNA, 64 nt, Homo Sapiens
ucuguuuugaguauagccagagaaaacaaggauggagaaaaaucuaggacagguaauuuugaaa

SEQ ID NO: 123791 - RNA, 64 nt, Homo Sapiens
agugaugagaaggauucuuuuucgaauauaaccagagaaaaaaaggauggagaaauaucuagga

SEQ ID NO: 123792 - RNA, 64 nt, Homo Sapiens
ucuguuuuggguauagccagagaaaacaaggauggagaaaaaucuaggacagguaauuuugaaa

SEQ ID NO: 123793 - RNA, 64 nt, Homo Sapiens
ccaugcugcauacauucuguaaaagagagagagagagaaaaagauccaguuccguucugagaga

SEQ ID NO: 123794 - RNA, 64 nt, Homo Sapiens
gagagagagagaaaaagacccaguuccguucugagagaaaaagaagcaaacauguugcuguuuc

SEQ ID NO: 123795 - RNA, 64 nt, Homo Sapiens
aaggcaaagcuuuuguggagucaggggggagacugagaaaaaaugaauuaacccuguguuguca

SEQ ID NO: 123796 - RNA, 64 nt, Homo Sapiens
cuaggcacuuuuguccagagccugcugucccauggagaaaaaguuuuaagcacugaaaaaauuu

SEQ ID NO: 123797 - RNA, 64 nt, Homo Sapiens
aguacuugccacaaaaucaauaaaagauguuuuugagaaaaaaaggaagaaaccaacucauuca

SEQ ID NO: 123798 - RNA, 64 nt, Homo Sapiens
augcagagauuaagagcauauagaccaccuaguggagaaaaauggaguaaaggagauaaguaag

SEQ ID NO: 123799 - RNA, 64 nt, Homo Sapiens
aaagagacugguagcucaucauccuaccauaaaagagaaaaaaauucggaaagugaucagagca

SEQ ID NO: 123800 - RNA, 64 nt, Homo Sapiens
gauugaugacaagcaaguuacucaggaaucaaaagagaaaaaaguuucugaaaacaaugaaacc

SEQ ID NO: 123801 - RNA, 64 nt, Homo Sapiens
guuacuuuguuauucagcuugccugaaauaauuugagaaaaaagaaguuccguuauauacugug

SEQ ID NO: 123802 - RNA, 64 nt, Homo Sapiens
cagaguuuuagaaaugagauuaaguuuuagaaaugagaaaaauaggucaguuugauuggauacu

SEQ ID NO: 123803 - RNA, 64 nt, Homo Sapiens
auauuaacacaaaaaaaugcuuaaaacgaggagagagaaaaauagagcaagaaaagagaaaaua

SEQ ID NO: 123804 - RNA, 64 nt, Homo Sapiens
ggaagggaacuuauuucuuaaaagacaaacgggagagaaaaagaaugagcaaacaaaaaaaucg

SEQ ID NO: 123805 - RNA, 64 nt, Homo Sapiens
uguuauguuuuuggcaugaacaaaagaaacaagagagaaaaaaaucaaaauaauuaaaauaaau

SEQ ID NO: 123806 - RNA, 64 nt, Homo Sapiens
gcucuuugaauguaugucaaacucaguuacuccagagaaaaaacugccuuucccuucaaagugc

SEQ ID NO: 123807 - RNA, 64 nt, Homo Sapiens
agaagcacuccucgguacucccauaauccucucggagaaaaaaaucacaaggcaacugugaguc

SEQ ID NO: 123808 - RNA, 64 nt, Homo Sapiens
gugcacuguauauagaagucuaaaacacaccuaagagaaaaagaucgaauuuuucagaugauuc

SEQ ID NO: 123809 - RNA, 51 nt, Homo Sapiens
auaacauccauaguguuuagagagaaaaaaauaaaccaauaaccuaccuac

SEQ ID NO: 123810 - RNA, 64 nt, Homo Sapiens
cuacuucuaggauugcaaaggagucuuccaacuagagaaaaauuguccacugacauuugggauu

SEQ ID NO: 123811 - RNA, 64 nt, Homo Sapiens
gucaucauuguagaaaagcaagaaaaugcagauagagaaaaagaagaaaauaaaacuggaguau

SEQ ID NO: 123812 - RNA, 64 nt, Homo Sapiens
agaaaaaguuuucuaaccccugcucuagguuacggagaaaaaaaaaauggaauaauguucucug

SEQ ID NO: 123813 - RNA, 64 nt, Homo Sapiens
agcacuagagagggagggggaagagcagaaguuagagaaaaaaagccaccggaggaaaggaaaa

SEQ ID NO: 123814 - RNA, 64 nt, Homo Sapiens
uuccuuccuccaaagaauuaauaggcaacagugggagaaaaaaaaggcauaauggcaaauccuu

SEQ ID NO: 123815 - RNA, 64 nt, Homo Sapiens
ucaauccuaacuagaaauacuaaaaauggcuuuugagaaaaauacuuccucugcuuguauuuug

SEQ ID NO: 123816 - RNA, 64 nt, Homo Sapiens
ucacuguuaaagccauugacuccuuuaguacacugagaaaaaucuuauaguaaaacuagccuuu

SEQ ID NO: 123817 - RNA, 64 nt, Homo Sapiens
uguggguacuugcuaauaaauuguguguuuguaagagaaaaaugcaacaugacaagcugugagu

SEQ ID NO: 123818 - RNA, 64 nt, Homo Sapiens
aauaaugugauggcaaucuuaacaaaacaaaaaggagaaaaaguucaguuaagaaaucuacuuu

SEQ ID NO: 123819 - RNA, 64 nt, Homo Sapiens
uuuuucucucacuauaguauaagaaucuauuuuggagaaaaaaagaaaauaugagggucucgaa

SEQ ID NO: 123820 - RNA, 64 nt, Homo Sapiens
aacaaaagcaaaaaaaaaaagcaaaaaaagaaaagagaaaaaaagaaaaaaugcaaauggaaua

SEQ ID NO: 123821 - RNA, 64 nt, Homo Sapiens
gcaaagcucacugaacauaaguuaauucauacuggagaaaaacccuacaaauguaaagaaugug

SEQ ID NO: 123822 - RNA, 64 nt, Homo Sapiens
ucaacucuuauuacacauaagauaauucacaguggagaaaaacccuacaaaugugaagaaugug

SEQ ID NO: 123823 - RNA, 64 nt, Homo Sapiens
guuuuccuuauugcacaggaaagcauuuauacuugagaaaaauuguauaaagaauggaaaaguc

SEQ ID NO: 123824 - RNA, 64 nt, Homo Sapiens
guaucauagaucuuauuguacacauuuuguaccagagaaaaacccugaagcaguuguucaaacu

SEQ ID NO: 123825 - RNA, 64 nt, Homo Sapiens
ucaaacuuuguucaauaccaggaaauuuauauuggagaaaaacccuaugaguguaaugaauuug

SEQ ID NO: 123826 - RNA, 64 nt, Homo Sapiens
ucacgcuugauuguagguaagauaauuuauauuggagaaaaauccuccaaguaugaagaaugug

SEQ ID NO: 123827 - RNA, 64 nt, Homo Sapiens
ucacaccuuauugcacaggaaagcauuuauacuugagaaaaauuguauaaagaauauggaaaag

SEQ ID NO: 123828 - RNA, 64 nt, Homo Sapiens
ucaaacuuuguucgacaucagggaauuuguauuggagaaaaacccugcaaauguaauaaauaug

SEQ ID NO: 123829 - RNA, 64 nt, Homo Sapiens
acauguucagacuaacauucuuuugcaguauagugagaaaaaaacauuuuaaaauuaauuauca

SEQ ID NO: 123830 - RNA, 64 nt, Homo Sapiens
aagaacuguccgucccccuuaaggguaagcuagagagaaaaagaauuugggcuuauuuagaaaa

SEQ ID NO: 123831 - RNA, 52 nt, Homo Sapiens
acccagcgaaggcgccuucuuagagaaaaacaugugguucuccuccaguuga

SEQ ID NO: 123832 - RNA, 64 nt, Homo Sapiens
gaagcauaaucgugggcauccugugcugccauuagagaaaaaaacuuucucccagcuuugccgc

SEQ ID NO: 123833 - RNA, 64 nt, Homo Sapiens
ucaucuucaucucggaauuccagucauaacucuagagaaaaacucaaauuauugcuucaaccau

SEQ ID NO: 123834 - RNA, 64 nt, Homo Sapiens
uaggagauguuucuccugaaacuaucuugaacaagagaaaaaacgcagcuuaaugugauauaug

SEQ ID NO: 123835 - RNA, 64 nt, Homo Sapiens
ucuaguauauuuuaagagaucacacagcaaaaaggagaaaaaauguaaaagaugaaguuuuaua

SEQ ID NO: 123836 - RNA, 64 nt, Homo Sapiens
uuuuggcuuuagauuuaaaguaauuuuuuuaaaggagaaaaauuguucauaaggaggugagaag

SEQ ID NO: 123837 - RNA, 64 nt, Homo Sapiens
aaucaaagggcagucucaauugccuuuuuaaggagagaaaaaaacuguugaauguuucuaaaaa

SEQ ID NO: 123838 - RNA, 64 nt, Homo Sapiens
ucuugccuuauccaggaauaauugccccuuugcagagaaaaaaaaaaacuuaaaaaaagcacau

SEQ ID NO: 123839 - RNA, 64 nt, Homo Sapiens
ugcuagcuaggcaguaauaaacucuguuacagaagagaaaaagggccgggcacaguggcuuauu

SEQ ID NO: 123840 - RNA, 64 nt, Homo Sapiens
uuccagaaguuaaucauuugaauucugaacacuggagaaaaaccgaaaaauggacggggcauga

SEQ ID NO: 123841 - RNA, 64 nt, Homo Sapiens
aagauugcuauauuuuggguuauuuucuugacaggagaaaaagaucuaaagaucuuuuauuuuc

SEQ ID NO: 123842 - RNA, 64 nt, Homo Sapiens
aaauuugguaaguuguguguaaaaagaagagcaagagaaaaagcaaauugaaaucagaagaaca

SEQ ID NO: 123843 - RNA, 64 nt, Homo Sapiens
uuauuuacagcucuuaaugcccaaaagguccuucgagaaaaaauuucacuugaugaaaacuccu

SEQ ID NO: 123844 - RNA, 64 nt, Homo Sapiens
ucagguuuuaaacaggaaaacuuaugugaacugagagaaaaaaacaaaagaaaaugcacucuaa

SEQ ID NO: 123845 - RNA, 64 nt, Homo Sapiens
acuuuguugccaaaagguuguuaagcuaaacuaagagaaaaauaaauaaaacuguucucagaca

SEQ ID NO: 123846 - RNA, 64 nt, Homo Sapiens
uaaaauaaauucccaauuccauaacaagauaauugagaaaaaaaaaaauaauugagaaaaauaa

SEQ ID NO: 123847 - RNA, 64 nt, Homo Sapiens
aauaacaagauaauugagaaagagcaaaauaauugagaaaaauagccaaacuugagccaaucug

SEQ ID NO: 123848 - RNA, 64 nt, Homo Sapiens
aagcaaaucagaaaacccaccccauuucuggggggagaaaaaaauuuuccuucugaagucugag

SEQ ID NO: 123849 - RNA, 64 nt, Homo Sapiens
agaaaagauucuucuuaaaauaacuaaagaagaggagaaaaagagcccaguaaaauuucaggau

SEQ ID NO: 123850 - RNA, 64 nt, Homo Sapiens
aucuauucuacaugaggaggcugagaaaggggaagagaaaaacaaaccaaauggaugauguuag

SEQ ID NO: 123851 - RNA, 64 nt, Homo Sapiens
aggaaacacgaaagaaaagucaggaagguagagagagaaaaagggagggaaggagaaagaaugg

SEQ ID NO: 123852 - RNA, 64 nt, Homo Sapiens
auuuucucucauguuaguacauucacucuauguagagaaaaaauaaacaaguccccaagaaaaa

SEQ ID NO: 123853 - RNA, 64 nt, Homo Sapiens
aguccccaagaaaaaauucauuuagccuucccuggagaaaaacauggucagucacaaauucuuu

SEQ ID NO: 123854 - RNA, 64 nt, Homo Sapiens
agauuacccaaaaacugucuuuaaaagagagagagagaaaaaaaaaauaguauuugcauaaccc

SEQ ID NO: 123855 - RNA, 64 nt, Homo Sapiens
caguuuauuuuuaaagauagauccuuuuauaggugagaaaaaaacaaucuggaagaaaaaaacc

SEQ ID NO: 123856 - RNA, 64 nt, Homo Sapiens
ugagaggaagacuauaaaaacgcauacacugagagagaaaaaaguugaaaagauuaggaaucua

SEQ ID NO: 123857 - RNA, 64 nt, Homo Sapiens
ugauauuuagaaaguuaauuagaggauuuuuuuggagaaaaaaacauauccagguuagcuggua

SEQ ID NO: 123858 - RNA, 64 nt, Homo Sapiens
ucaaggaauaaagauuguuuaaaauaagacuucugagaaaaaguaggaagaaaauguagauuag

SEQ ID NO: 123859 - RNA, 64 nt, Homo Sapiens
aucccuuuuacggauucaguaagguuuaggaggugagaaaaagugugaucacuaaaaugaggcc

SEQ ID NO: 123860 - RNA, 64 nt, Homo Sapiens
aaugcuguguuuaaucuucuaaaagagagagagagagaaaaagauuaucucaaaaaaaaaaaaa

SEQ ID NO: 123861 - RNA, 64 nt, Homo Sapiens
aaagggaaccugcaauaaucuugaaaaagaaaaagagaaaaauuuuaaaauccugcuauaggag

SEQ ID NO: 123862 - RNA, 64 nt, Homo Sapiens
agaaaaagagaaaaauuuuaaaauccugcuauaggagaaaaaaagagaaaaaaauaaaaaucaa

SEQ ID NO: 123863 - RNA, 64 nt, Homo Sapiens
aaaaauuuuaaaauccugcuauaggagaaaaaaagagaaaaaaauaaaaaucaaaaaaaaaaaa

SEQ ID NO: 123864 - RNA, 64 nt, Homo Sapiens
ucugcacucugcugcuuugaaaucugguugaaaugagaaaaagcauuuucuguuuucccaccag

SEQ ID NO: 123865 - RNA, 64 nt, Homo Sapiens
aaguguggucuuuuucuuuccuccuaauguugaagagaaaaaaaaaaaaaaaaguuugcccaga

SEQ ID NO: 123866 - RNA, 64 nt, Homo Sapiens
ccauguuuagggaugugccucaguugggagcaaggagaaaaaugggaagaaccaguuuuaucca

SEQ ID NO: 123867 - RNA, 64 nt, Homo Sapiens
aaauaaaauccauucucacggcaggcaaaucagugagaaaaauguaaagaucuggaggauuuac

SEQ ID NO: 123868 - RNA, 64 nt, Homo Sapiens
gagccgacggaggaggaggagccuuccaaacagagagaaaaaaaugaggccgaaaauuuagagg

SEQ ID NO: 123869 - RNA, 64 nt, Homo Sapiens
acgcuacacuguccuggcagaaaacaaaagugacgagaaaaaaaguaggucccacugcgucugu

SEQ ID NO: 123870 - RNA, 64 nt, Homo Sapiens
aaguaauauggcccacacuuuauucaccacccuggagaaaaaaaaacccaggaauauguggaaa

SEQ ID NO: 123871 - RNA, 64 nt, Homo Sapiens
acaaugcaauacuuacauuuuaauacucuuguaggagaaaaagcaacuguauaaaugaauguag

SEQ ID NO: 123872 - RNA, 64 nt, Homo Sapiens
ugacaggagaugggauuuuaaaugagcugcaagagagaaaaaucaacuuucaggauguauuuua

SEQ ID NO: 123873 - RNA, 64 nt, Homo Sapiens
auaaaguagaaaaagaaaaacacagucaaagaaagagaaaaaagucagcaguuugugccuccua

SEQ ID NO: 123874 - RNA, 64 nt, Homo Sapiens
cauucagaaaucauggauuuaaguuauaaauaaagagaaaaacuuuccuacucuaauucaacua

SEQ ID NO: 123875 - RNA, 64 nt, Homo Sapiens
aauuuuucuucaauacaauaauuuuaaugagucagagaaaaauuugugcuuaccacacugccac

SEQ ID NO: 123876 - RNA, 64 nt, Homo Sapiens
uauuuauuaccguucccuucaccagaggugggaggagaaaaaguagguuugaacagugggagau

SEQ ID NO: 123877 - RNA, 64 nt, Homo Sapiens
gauaauacauacacaugaacuuuuaaaacaccuugagaaaaaaaagcacugauaaacagaauac

SEQ ID NO: 123878 - RNA, 64 nt, Homo Sapiens
gacuuagagaagaggaagagaagugauauacagagagaaaaaaaaguaagaauaaaaacuacca

SEQ ID NO: 123879 - RNA, 64 nt, Homo Sapiens
aguagaaacccagaaaagacugacuuauaaccaggagaaaaaucugcaaagaagcaauaaaaua

SEQ ID NO: 123880 - RNA, 64 nt, Homo Sapiens
ccaaaauagcugcccuuaaagaguuguuagcagagagaaaaauaacagugaaugugcuccuggu

SEQ ID NO: 123881 - RNA, 64 nt, Homo Sapiens
caaaccaaagaaacaaugaucuacucaaacauuggagaaaaaaacugccagaggaggaguugcc

SEQ ID NO: 123882 - RNA, 64 nt, Homo Sapiens
uaugagaauaucaguugguauaaagagagagaaagagaaaaacauuucagcccuuagaugaggu

SEQ ID NO: 123883 - RNA, 64 nt, Homo Sapiens
uuacuuucaaugugaggaaugaaugauaaauuaagagaaaaaaauaucaggaaggucaauauau

SEQ ID NO: 123884 - RNA, 64 nt, Homo Sapiens
gaugcaucaagcuuguuuguaaagggaaaaaaaggagaaaaaacgcaucuuuuuaaaacaagga

SEQ ID NO: 123885 - RNA, 64 nt, Homo Sapiens
gaaaagcaaaugaguguuuuagcaacugguguuggagaaaaaaaaauagagauugauaagauuu

SEQ ID NO: 123886 - RNA, 64 nt, Homo Sapiens
caaagccacuaguauuagaaaggggaagcggauggagaaaaacccccacaaggggagaaaaagu

SEQ ID NO: 123887 - RNA, 64 nt, Homo Sapiens
aggggaagcggauggagaaacacccccacaaggggagaaaaaguuauuuaaacaucaucucacc

SEQ ID NO: 123888 - RNA, 64 nt, Homo Sapiens
ucuguaguuuagaguguaagaaguaauggguacagagaaaaaaaauuuaagaccaauauuuuaa

SEQ ID NO: 123889 - RNA, 64 nt, Homo Sapiens
gaguuaauugcaaugugauaguggguagaaaggagagaaaaacccacugaaggguucaaauaca

SEQ ID NO: 123890 - RNA, 64 nt, Homo Sapiens
guagauuuuaauuugacucauucacuuuuuguuggagaaaaauacaacagcaaacuucagccgu

SEQ ID NO: 123891 - RNA, 64 nt, Homo Sapiens
ccucaauauauuuguaaccuaugauucccagugggagaaaaaugaucagauuguuuucacaguu

SEQ ID NO: 123892 - RNA, 64 nt, Homo Sapiens
aacaaaaggaaguaguuaaaguuugacaaccuuugagaaaaagauguacaggagaaaaaggguu

SEQ ID NO: 123893 - RNA, 64 nt, Homo Sapiens
guuguuugacaaccuuugagguccuauuguacaggagaaaaaggaaaacacauuuguauguuaa

SEQ ID NO: 123894 - RNA, 64 nt, Homo Sapiens
uuugauucaggauggcugggacuaaggccuaguugagaaaaacccgugagccagucauccauac

SEQ ID NO: 123895 - RNA, 64 nt, Homo Sapiens
aaauuuuaaaaacuuuaaaauuuucucagguuaagagaaaaacgggggcaaggcagaggacagg

SEQ ID NO: 123896 - RNA, 64 nt, Homo Sapiens
cguagaaaaccauaacaucggccaucuuggaaaagagaaaaacaauggaguuacuuauuuaaaa

SEQ ID NO: 123897 - RNA, 64 nt, Homo Sapiens
uucaacugugaauguagaagugggggggaggggggagaaaaagaaaacucuggcguuagaggau

SEQ ID NO: 123898 - RNA, 64 nt, Homo Sapiens
gucugccccagaaacucucacacuuccagacccugagaaaaaagccacccugaauuuacccggc

SEQ ID NO: 123899 - RNA, 64 nt, Homo Sapiens
guuguuguuguuuuuuuuuaagaaucuucugauagagaaaaagacugcuuugucacucaaacau

SEQ ID NO: 123900 - RNA, 64 nt, Homo Sapiens
gcagucuaauaaaauccuagaauacagguauauugagaaaaaaaccuuuuugucucaaucuucc

SEQ ID NO: 123901 - RNA, 64 nt, Homo Sapiens
ucaguguuuuccuauaagcuaggcauuccuacuggagaaaaauggacuuggaaaguuggagaag

SEQ ID NO: 123902 - RNA, 64 nt, Homo Sapiens
ucgcaccuucaaaugcauggaaggacucacacuggagaaaaacccuaugaauguaagcaguaug

SEQ ID NO: 123903 - RNA, 64 nt, Homo Sapiens
gauguaugagaauuacaagucacauuaguaagaagagaaaaauuuuggucauguuuaugauuug

SEQ ID NO: 123904 - RNA, 64 nt, Homo Sapiens
ugagggcaacaggagauguggggacguguuaggagagaaaaaaaaaaaaacaaaaauauauaug

SEQ ID NO: 123905 - RNA, 64 nt, Homo Sapiens
ucaaccaacacaagaucaaaaaggaaaaggacgagagaaaaauuauuuuuaagauaauuaaaca

SEQ ID NO: 123906 - RNA, 64 nt, Homo Sapiens
ucaaaccuuacuaaacauaagauaacucauacuggagaaaaaucuuacaaaugugaagaaugug

SEQ ID NO: 123907 - RNA, 64 nt, Homo Sapiens
auacaccuuauugcacagaaaaucauuuauauuugagaaaaauuguagaaauauagacugugaa

SEQ ID NO: 123908 - RNA, 64 nt, Homo Sapiens
aaugggagcuucuaaugaggacaaacaaaaaauagagaaaaauuaauaaagucaaaauguuuau

SEQ ID NO: 123909 - RNA, 64 nt, Homo Sapiens
aaaacauuaaugauacaugaaucuuggccacaaugagaaaaauaaaaaugaaaaaagagcaggc

SEQ ID NO: 123910 - RNA, 64 nt, Homo Sapiens
cugcaaauguaauaaauuuggggaauucagauuggagaaaaaccuuaaacuuuguucaacauca

SEQ ID NO: 123911 - RNA, 64 nt, Homo Sapiens
guaccaauauaaagacugugaagcauuuauacuugagaaaaauucucacaccuuauugccagga

SEQ ID NO: 123912 - RNA, 64 nt, Homo Sapiens
uaaaaugcacaaaggaacacauauauaauauugagagaaaaaauaguuauauggauagauuaca

SEQ ID NO: 123913 - RNA, 64 nt, Homo Sapiens
uuagcuuucuacuuuauaucuggaagguucauaggagaaaaauuugaauggcuuauuuaauaaa

SEQ ID NO: 123914 - RNA, 64 nt, Homo Sapiens
gaugugggagaggacauauauguuuagagcaacagagaaaaaaaaguauguuuuucugugugua

SEQ ID NO: 123915 - RNA, 64 nt, Homo Sapiens
auaggaaagugacauguagggagagccaacacaggagaaaaaccucagagcuuucuauccaucu

SEQ ID NO: 123916 - RNA, 64 nt, Homo Sapiens
acagcagcaagacacgcacagucaaccauuuuccgagaaaaaaagaaaauuccccacuuggaaa

SEQ ID NO: 123917 - RNA, 64 nt, Homo Sapiens
cugagggccacugcagaugacucuccuuugaaaugagaaaaagaaaagaaagcaagaacagaaa

SEQ ID NO: 123918 - RNA, 64 nt, Homo Sapiens
cugucacaaacuuaagaggaaauaaggaaaaggagagaaaaaagaaauugguuaugaauaaaag

SEQ ID NO: 123919 - RNA, 64 nt, Homo Sapiens
auguuucccuguauuugauaaaacacauaauuuugagaaaaauaaaguuuuaaauguaucuaug

SEQ ID NO: 123920 - RNA, 64 nt, Homo Sapiens
agcggauaguguuuauggagaauggguuccuguggagaaaaauggugaagaaaacaaagaugau

SEQ ID NO: 123921 - RNA, 64 nt, Homo Sapiens
ccccgguaacuggaggaaugggagccguuuugaugagaaaaaugggcuggagagaaggagaagg

SEQ ID NO: 123922 - RNA, 64 nt, Homo Sapiens
augucugaagauguuaagauccccugauuacuuugagaaaaacaacuaaaacaagaaccguguu

SEQ ID NO: 123923 - RNA, 64 nt, Homo Sapiens
cuuuuugcuucucuuuuagaaauacuuguggggagagaaaaaaggaugguuugggcauauuggu

SEQ ID NO: 123924 - RNA, 64 nt, Homo Sapiens
aauuaugcuagagcaauuagacacccauggcgaggagaaaaaagaaccucuacuuaaaccucac

SEQ ID NO: 123925 - RNA, 64 nt, Homo Sapiens
acauaaaacuagauaacuuugaaaaaagccacaggagaaaaaucuucaggaucuugggcuaggu

SEQ ID NO: 123926 - RNA, 64 nt, Homo Sapiens
uaagaaaaaaaaaaauccugaaaagaaaaaaaaugagaaaaaaggcuaucuauaaaaaagagaa

SEQ ID NO: 123927 - RNA, 64 nt, Homo Sapiens
aaaaaaaaugagaaaaaagucuaucuauaaaaaagagaaaaaaguaugagaaaaaauauacuug

SEQ ID NO: 123928 - RNA, 64 nt, Homo Sapiens
auacuugcuaucuauaaaaaucauagaguucuaugagaaaaaauggaaagaaguuauagaaucu

SEQ ID NO: 123929 - RNA, 64 nt, Homo Sapiens
guaaguacauaauugugaauuuguauauaaaaaggagaaaaauguugaggacagugacugccau

SEQ ID NO: 123930 - RNA, 64 nt, Homo Sapiens
agaaguguaaucucuguauccccaaaagcuacgggagaaaaagcucuuuucaucucagucauaa

SEQ ID NO: 123931 - RNA, 64 nt, Homo Sapiens
aaccuacucaagaaaagacaacacaagaacuuaagagaaaaagaugaacaacacuaacaugaga

SEQ ID NO: 123932 - RNA, 64 nt, Homo Sapiens
aaucuguugaagaaaggacaguaagcacaggaaagagaaaaagaacccuccgagaaagaagaac

SEQ ID NO: 123933 - RNA, 64 nt, Homo Sapiens
uauauauaaaaaauaaaaagcuauuucuaguuuauuucacuauaaaguuuugcuuuauuaaaaa

SEQ ID NO: 123934 - RNA, 64 nt, Homo Sapiens
aucacaguguauuaguauuuguuacauuuuuguauuucacuaucuuuauacuauauaauauggu

SEQ ID NO: 123935 - RNA, 64 nt, Homo Sapiens
uuagagcaacauugucuuauuaaagcauaguuuauuucacuagaaaaaauuuaauaucaaggac

SEQ ID NO: 123936 - RNA, 64 nt, Homo Sapiens
agaggccauauauauugccuccuuauccuugagauuucacuaccuuuauguuaaaaguugugua

SEQ ID NO: 123937 - RNA, 64 nt, Homo Sapiens
gugggggacaaaaugaacacggucaggcucuuaauuucacuauggaccaguaggaaccaggcug

SEQ ID NO: 123938 - RNA, 57 nt, Homo Sapiens
gacagccacuuuuuacucucaaccauuuuucacuagcgaaaaaguucgaagaaauga

SEQ ID NO: 123939 - RNA, 64 nt, Homo Sapiens
gggguaugcaguuuacccaaguccaaauaaagcauuucacuagguuacacguuauguauaugug

SEQ ID NO: 123940 - RNA, 64 nt, Homo Sapiens
guuaaggucugagugcaugugugcauuaaaaacauuucacuaccuauucucucauggacuucuc

SEQ ID NO: 123941 - RNA, 64 nt, Homo Sapiens
cauuaguuaagacugugcuauugugguuguauuauuucacuaauucucaagcuccuauuacuau

SEQ ID NO: 123942 - RNA, 64 nt, Homo Sapiens
uuugcuaaacuuuguaaugcgaacuugcuucccuuuucacuaauaaaaaguguaacacuaaggu

SEQ ID NO: 123943 - RNA, 64 nt, Homo Sapiens
aggaacagcuaaggaauaauaauauuuguagguguuucacuauacuuuugauauuauacugaug

SEQ ID NO: 123944 - RNA, 64 nt, Homo Sapiens
guauaaguagcugccaauuuuguaauggagcucuuuucacuaggcacaaauaaagugagaguaa

SEQ ID NO: 123945 - RNA, 64 nt, Homo Sapiens
ugaugccaaaauauuuugcuaccacaucgucuguuuucacuagguaugagauggcugaaaaaau

SEQ ID NO: 123946 - RNA, 64 nt, Homo Sapiens
uuggcuaggcuggucuugaaaguagagacggggguuucacuaugggcuaauuuuuuguauuuuu

SEQ ID NO: 123947 - RNA, 64 nt, Homo Sapiens
uaacacugggccuuacugcaaacuaaaaucaaaguuucacuacaacaaauacacacccccacaa

SEQ ID NO: 123948 - RNA, 64 nt, Homo Sapiens
ggccaugugguucccugcagagcucggcauuugguuucacuaagggaagaaaugcuagccugga

SEQ ID NO: 123949 - RNA, 64 nt, Homo Sapiens
uaaaacucucaguuucuugguaaguaguggaagguuucacuaagacaugauauuugacuuuuca

SEQ ID NO: 123950 - RNA, 64 nt, Homo Sapiens
uaaagaucugaguuucuugguaaguaguggaagguuucacuaagaaaugguauuugacuuuuca

SEQ ID NO: 123951 - RNA, 64 nt, Homo Sapiens
uuaguauuaggucgguacuaagaaauaagcauguuuucacuaauuuaaguacuugagacucuug

SEQ ID NO: 123952 - RNA, 64 nt, Homo Sapiens
ucucauuauugagauucauccauauuguugaauguuucacuaguuaauguuuauuguucaauau

SEQ ID NO: 123953 - RNA, 64 nt, Homo Sapiens
guagcuuaaacucuguuugguuaaaaucuucuucuuucacuauccuacaauuuuuucaggauua

SEQ ID NO: 123954 - RNA, 64 nt, Homo Sapiens
agcccaaaccucagcauucugaaaaucauuacacuuucacuagagaaagagcaaggcuguuuuu

SEQ ID NO: 123955 - RNA, 64 nt, Homo Sapiens
uuaugacauuagcuuuaaagguguaaaaaagauguuucacuaauguaacggugaaagagaaucc

SEQ ID NO: 123956 - RNA, 64 nt, Homo Sapiens
cgugauauagugagaaagauucuaccaaccacuguuucacuacuuuuuaguuaaaauuggguau

SEQ ID NO: 123957 - RNA, 64 nt, Homo Sapiens
cucuccuccccgcugccccuaacugcagcucagcuuucacuauagcagugcuucccaaacgggu

SEQ ID NO: 123958 - RNA, 64 nt, Homo Sapiens
acuuggguguuugauuugaagaguuacgcauuuauuucacuauuuauugggaaaaaaaugcauu

SEQ ID NO: 123959 - RNA, 64 nt, Homo Sapiens; identical to SEQ ID NO: 85524

SEQ ID NO: 123960 - RNA, 64 nt, Homo Sapiens; identical to SEQ ID NO: 85525

SEQ ID NO: 123961 - RNA, 64 nt, Homo Sapiens; identical to SEQ ID NO: 85526

SEQ ID NO: 123962 - RNA, 64 nt, Homo Sapiens; identical to SEQ ID NO: 85527

SEQ ID NO: 123963 - RNA, 64 nt, Homo Sapiens; identical to SEQ ID NO: 85528

SEQ ID NO: 123964 - RNA, 64 nt, Homo Sapiens; identical to SEQ ID NO: 85529

SEQ ID NO: 123965 - RNA, 64 nt, Homo Sapiens; identical to SEQ ID NO: 85530

SEQ ID NO: 123966 - RNA, 64 nt, Homo Sapiens; identical to SEQ ID NO: 85531

SEQ ID NO: 123967 - RNA, 64 nt, Homo Sapiens; identical to SEQ ID NO: 85532

SEQ ID NO: 123968 - RNA, 64 nt, Homo Sapiens; identical to SEQ ID NO: 85533

SEQ ID NO: 123969 - RNA, 64 nt, Homo Sapiens; identical to SEQ ID NO: 85534

SEQ ID NO: 123970 - RNA, 64 nt, Homo Sapiens; identical to SEQ ID NO: 85535

SEQ ID NO: 123971 - RNA, 55 nt, Homo Sapiens; identical to SEQ ID NO: 85536

SEQ ID NO: 123972 - RNA, 64 nt, Homo Sapiens; identical to SEQ ID NO: 85537

SEQ ID NO: 123973 - RNA, 64 nt, Homo Sapiens; identical to SEQ ID NO: 85538

SEQ ID NO: 123974 - RNA, 64 nt, Homo Sapiens; identical to SEQ ID NO: 85539

SEQ ID NO: 123975 - RNA, 64 nt, Homo Sapiens; identical to SEQ ID NO: 85540

SEQ ID NO: 123976 - RNA, 64 nt, Homo Sapiens; identical to SEQ ID NO: 85541

SEQ ID NO: 123977 - RNA, 64 nt, Homo Sapiens; identical to SEQ ID NO: 85542

SEQ ID NO: 123978 - RNA, 64 nt, Homo Sapiens; identical to SEQ ID NO: 85543

SEQ ID NO: 123979 - RNA, 64 nt, Homo Sapiens; identical to SEQ ID NO: 85544

SEQ ID NO: 123980 - RNA, 64 nt, Homo Sapiens; identical to SEQ ID NO: 85545

SEQ ID NO: 123981 - RNA, 64 nt, Homo Sapiens; identical to SEQ ID NO: 85546

SEQ ID NO: 123982 - RNA, 64 nt, Homo Sapiens; identical to SEQ ID NO: 85547

SEQ ID NO: 123983 - RNA, 64 nt, Homo Sapiens; identical to SEQ ID NO: 85548

SEQ ID NO: 123984 - RNA, 64 nt, Homo Sapiens; identical to SEQ ID NO: 85549

SEQ ID NO: 123985 - RNA, 64 nt, Homo Sapiens; identical to SEQ ID NO: 85550

SEQ ID NO: 123986 - RNA, 64 nt, Homo Sapiens; identical to SEQ ID NO: 85551

SEQ ID NO: 123987 - RNA, 64 nt, Homo Sapiens; identical to SEQ ID NO: 85552

SEQ ID NO: 123988 - RNA, 64 nt, Homo Sapiens; identical to SEQ ID NO: 85553

SEQ ID NO: 123989 - RNA, 64 nt, Homo Sapiens; identical to SEQ ID NO: 85554

SEQ ID NO: 123990 - RNA, 64 nt, Homo Sapiens; identical to SEQ ID NO: 85555

SEQ ID NO: 123991 - RNA, 64 nt, Homo Sapiens; identical to SEQ ID NO: 85556

SEQ ID NO: 123992 - RNA, 64 nt, Homo Sapiens; identical to SEQ ID NO: 85557

SEQ ID NO: 123993 - RNA, 64 nt, Homo Sapiens; identical to SEQ ID NO: 85558

SEQ ID NO: 123994 - RNA, 64 nt, Homo Sapiens; identical to SEQ ID NO: 85559

SEQ ID NO: 123995 - RNA, 64 nt, Homo Sapiens; identical to SEQ ID NO: 85560

SEQ ID NO: 123996 - RNA, 64 nt, Homo Sapiens; identical to SEQ ID NO: 85561

SEQ ID NO: 123997 - RNA, 64 nt, Homo Sapiens; identical to SEQ ID NO: 85562

SEQ ID NO: 123998 - RNA, 64 nt, Homo Sapiens; identical to SEQ ID NO: 85563

SEQ ID NO: 123999 - RNA, 62 nt, Homo Sapiens; identical to SEQ ID NO: 85564

SEQ ID NO: 124000 - RNA, 57 nt, Homo Sapiens; identical to SEQ ID NO: 85565

SEQ ID NO: 124001 - RNA, 64 nt, Homo Sapiens; identical to SEQ ID NO: 85566

SEQ ID NO: 124002 - RNA, 64 nt, Homo Sapiens; identical to SEQ ID NO: 85567

SEQ ID NO: 124003 - RNA, 64 nt, Homo Sapiens; identical to SEQ ID NO: 85568

SEQ ID NO: 124004 - RNA, 64 nt, Homo Sapiens; identical to SEQ ID NO: 85569

SEQ ID NO: 124005 - RNA, 64 nt, Homo Sapiens; identical to SEQ ID NO: 85570

SEQ ID NO: 124006 - RNA, 64 nt, Homo Sapiens; identical to SEQ ID NO: 85571

SEQ ID NO: 124007 - RNA, 64 nt, Homo Sapiens
ccuggggcacccuggcuggcuggagacccugagagacccugagaacaggagauuuuauuauauc

SEQ ID NO: 124008 - RNA, 64 nt, Homo Sapiens
gacccugagaccuggggcacuuauuauaucuggagacccugagauguggccugaacaggagauu

SEQ ID NO: 124009 - RNA, 64 nt, Homo Sapiens
ccccuggauuuugcauucacggggcucccaacaugacccugaguccugacucucggggggagaa

SEQ ID NO: 124010 - RNA, 64 nt, Homo Sapiens
gaucccaccucaacagcuccgacccgcguggcgcgacccugaccuccgagccugguagggaagg

SEQ ID NO: 124011 - RNA, 64 nt, Homo Sapiens
ccucuguguugguccugcgcuguccuuccagcaugacccugagaaggaucuccagaaagccgcc

SEQ ID NO: 124012 - RNA, 64 nt, Homo Sapiens
gacacuuugagacaccaaucucuccagcucagcagacccugaagauucucuggcaacacccuug

SEQ ID NO: 124013 - RNA, 64 nt, Homo Sapiens
gggacugcugguuucucgcagccauugccugccugacccugaaccagcaccuucuuuuccgagu

SEQ ID NO: 124014 - RNA, 64 nt, Homo Sapiens
ucaguaccgucugaagcuccuggaggaggacgaugacccugaugacucggaggugauuugcagc

SEQ ID NO: 124015 - RNA, 64 nt, Homo Sapiens
cuuaauaaacgcagcgacguuccugcccagcucugacccugaugagaccuugccuccccuccuc

SEQ ID NO: 124016 - RNA, 64 nt, Homo Sapiens
ugugacaucuaccucccgaccauucaggccaagugacccugacaacgaacuggauccaaaaaac

SEQ ID NO: 124017 - RNA, 64 nt, Homo Sapiens
cuuccuccuaaacugucagccccuuucaggcuuucuucccuauccacccucagcuuuaugggau

SEQ ID NO: 124018 - RNA, 64 nt, Homo Sapiens
agagcauccugaucaauugcaaguacuuccacuucuucccuaaaugcgcuuuguguguuuucca

SEQ ID NO: 124019 - RNA, 64 nt, Homo Sapiens
aaagccaguagcacauacgcagggcauugcagggcuucccuauugaugguucaagugcuuuucu

SEQ ID NO: 124020 - RNA, 64 nt, Homo Sapiens
agauaagcuucauguacauuugucaccucucuuucuucccuauccugcccugcugucccaaucc

SEQ ID NO: 124021 - RNA, 64 nt, Homo Sapiens
aagaucuuuaaaguuauuuucuuaagaguuucugcuucccuacaauccugagaaaacaucugga

SEQ ID NO: 124022 - RNA, 64 nt, Homo Sapiens
auaugcccuuuauuaugcuauaggugggcauuuucuucccuagauaacugguaaauuucuacuu

SEQ ID NO: 124023 - RNA, 64 nt, Homo Sapiens
cacccaaucauucuaaagcacuccucugagaggccuucccuaacauucuuugcuccaaugucac

SEQ ID NO: 124024 - RNA, 64 nt, Homo Sapiens
uucuaccugaaccuucuuccccacuaugccuggccuucccuaucgcuaggauuacaagugugag

SEQ ID NO: 124025 - RNA, 64 nt, Homo Sapiens
gcuaguauccuaaagcugcaaaaaggaaaaaauccuucccuagaacagagugauacgcuguuua

SEQ ID NO: 124026 - RNA, 64 nt, Homo Sapiens
agcaugguggcacgugccuguucuucucaagcuccuucccuaggccugguucacuccuggcagu

SEQ ID NO: 124027 - RNA, 64 nt, Homo Sapiens
uuauacuuuucucaguucuacuuaugacaccucacuucccuagagaaggccugccuccccauag

SEQ ID NO: 124028 - RNA, 64 nt, Homo Sapiens
cucccaacccuguggugcuaggaccacuccccgccuucccuacggccuccucgcccugcacauu

SEQ ID NO: 124029 - RNA, 64 nt, Homo Sapiens
uuuauaaugaaagaaaaaggcauuggagacugaaggcagaaaugguugugacagugcuguuugg

SEQ ID NO: 124030 - RNA, 64 nt, Homo Sapiens
agaauguagaucaauaaguacuuuuuagugauguggcagaaaucccuguugauucuaaguuuua

SEQ ID NO: 124031 - RNA, 64 nt, Homo Sapiens
gcuauuacugaauuauagaaacugguuuauuucuggcagaaagcugcagugccaccugaguucc

SEQ ID NO: 124032 - RNA, 64 nt, Homo Sapiens
cccauucacuucucuagaaagcugccaagacagaggcagaaagaaauggaugauaguucuguca

SEQ ID NO: 124033 - RNA, 64 nt, Homo Sapiens
aaauccucgguaacauugaugugaguuauaaugaggcagaaacauacugacaaaauacauggaa

SEQ ID NO: 124034 - RNA, 64 nt, Homo Sapiens
uguagugauaaccucucuccauuguaacaguaaaggcagaaagcauaccaucuggcggcugcac

SEQ ID NO: 124035 - RNA, 64 nt, Homo Sapiens
cuuagcagaugggaggaacugcugagagaagaugggcagaaagcuggagccccuggaguuggcu

SEQ ID NO: 124036 - RNA, 64 nt, Homo Sapiens
uguuugugacugauuacuggcugugucuugggugggcagaaacucgaacuugcuauguaauuug

SEQ ID NO: 124037 - RNA, 64 nt, Homo Sapiens
agaucauuuaguugggucugaaaagaguaucaaaggcagaaaggaggaugaaagacaaagaagg

SEQ ID NO: 124038 - RNA, 64 nt, Homo Sapiens
caaccacucaccaguccuagucaaagcuaggaaaggcagaaacaaaagacagggaauaguggga

SEQ ID NO: 124039 - RNA, 64 nt, Homo Sapiens
gaauguuugagguccagccuugguguagagaagcggcagaaacagaaaucccaaaaggugucau

SEQ ID NO: 124040 - RNA, 64 nt, Homo Sapiens
aucauacucuugugagguuggauuuaaccacagaggcagaaaguuggucuacuuugcucguucc

SEQ ID NO: 124041 - RNA, 64 nt, Homo Sapiens
ggagaagcaggcaccuuuuuacuuacacaaucauggcagaaaaaugcuggugaggccucaggac

SEQ ID NO: 124042 - RNA, 64 nt, Homo Sapiens
ugugucaguuggaggaaaauccuccauacacugaggcagaaacuuuuccuauuacugaggaaaa

SEQ ID NO: 124043 - RNA, 64 nt, Homo Sapiens
ugcuccaagaaccaacacuagacaaagcccgggaggcagaaagacagccccgaggcugagacca

SEQ ID NO: 124044 - RNA, 64 nt, Homo Sapiens
aaaugacuguagaacuuauuaucuggaggaaauaggcagaaacaaugacccaaucugccuuuga

SEQ ID NO: 124045 - RNA, 64 nt, Homo Sapiens
cccucccugucccuucgaguccaggacaacaacgggcagaaaucgagagugugcucuccccggc

SEQ ID NO: 124046 - RNA, 64 nt, Homo Sapiens
aguugggagcuauccuuguuuaugccucacuauuggcagaaaagaccccauuuaaaacccagag

SEQ ID NO: 124047 - RNA, 64 nt, Homo Sapiens
gccgggcgcgguggcucaugccacaauagaaaaaggcagaaaagagagucucagggaaagagaa

SEQ ID NO: 124048 - RNA, 64 nt, Homo Sapiens
ucccuugacccugagagguaacucaggaagcugaggcagaaagaacaugccugugaucccagcu

SEQ ID NO: 124049 - RNA, 64 nt, Homo Sapiens
aguuugggguucugggucgguuccagcggcuuuaggcagaaagugcucgcucucacccagcaca

SEQ ID NO: 124050 - RNA, 64 nt, Homo Sapiens
agguccuaucaaaggaggcugccggaacucaagaggcagaaaaagaccaguuaggcggugcaga

SEQ ID NO: 124051 - RNA, 64 nt, Homo Sapiens
gcuggacucagcaggaacaccaaaucccggaccaggcagaaaccacccaagacugaggggcucg

SEQ ID NO: 124052 - RNA, 64 nt, Homo Sapiens
agauuguuugaaaaaaaaaaaaggggagcagggaggcagaaaguccuggaaaaguaaauuguuu

SEQ ID NO: 124053 - RNA, 64 nt, Homo Sapiens
cauuucacuaagcuccuccuuuacuuucucucuccucuuugaugucaaacgccuugaaaacaag

SEQ ID NO: 124054 - RNA, 64 nt, Homo Sapiens
uucuccuuuaaauucuuuccuaccuugguccugccucuuugaguauauuaguagguuuuuuuua

SEQ ID NO: 124055 - RNA, 64 nt, Homo Sapiens
acugggccuggaagaccaucccagccucugaguucucuuugaguaugagugauuacuuggauuu

SEQ ID NO: 124056 - RNA, 64 nt, Homo Sapiens
gcugggucuggaagacuguuguggccucucaguucucuuugagucugacugacuguggccaguc

SEQ ID NO: 124057 - RNA, 64 nt, Homo Sapiens
uuuuuuuguuauuauuuucuuagccagaacaucucucuuugaacucacacugauacacaccugc

SEQ ID NO: 124058 - RNA, 64 nt, Homo Sapiens
ccuuucugcuuucuggagggcaccaggggccuuucucuuugauaaauuuuuuuugucuguugac

SEQ ID NO: 124059 - RNA, 64 nt, Homo Sapiens
uuggguucuccccagccccugcacacaacauccucucuuugaguaguccugccuuuccuagcau

SEQ ID NO: 124060 - RNA, 64 nt, Homo Sapiens
cauucaucaccucugccuucuccuccuuccuguucucuuugaacgagaaccuuuuccacacacc

SEQ ID NO: 124061 - RNA, 64 nt, Homo Sapiens
aggcacuauuccuggugcaguauuucagggauuucucuuugagggguucuuuucugguagcuca

SEQ ID NO: 124062 - RNA, 64 nt, Homo Sapiens
acauuguguaauauuuguaugagaaugacucaagcucuuugagaacauuccaaacuaguaacau

SEQ ID NO: 124063 - RNA, 64 nt, Homo Sapiens
gaucugaacacaguuuagugcuuuacaugcugugcucuuugaagagauuucaacaagaauauug

SEQ ID NO: 124064 - RNA, 64 nt, Homo Sapiens
ccaggagguuggugacugaaacauucacacagggcucuuugauggacccacgaacgcucuuagc

SEQ ID NO: 124065 - RNA, 64 nt, Homo Sapiens
cagcccaaaaccagucauguucuuccaaaagcuucucuuugauagaauuuugaggccaugccac

SEQ ID NO: 124066 - RNA, 64 nt, Homo Sapiens
cugauuuuauccuggagaauacagugcaauauuucucuuugauuauuuauuccucuugauugug

SEQ ID NO: 124067 - RNA, 64 nt, Homo Sapiens
ggcucccaauagggagggggcugcccucuacagucucuuugacuguaagacagggcucuguauc

SEQ ID NO: 124068 - RNA, 64 nt, Homo Sapiens
agggaagaauguuagguucaugguaacuaguaugcucuuugagauuuuuacaguguugaaacuu

SEQ ID NO: 124069 - RNA, 64 nt, Homo Sapiens
uguguaagcuuucuccaugucagaagcaagccugcucuuugauaaaucugucuuccugaaaauc

SEQ ID NO: 124070 - RNA, 64 nt, Homo Sapiens
agucucgacuuuuccuuuuuugaguccuguguggcucuuugaaucagcgugaaacugaggcucc

SEQ ID NO: 124071 - RNA, 64 nt, Homo Sapiens
ggaacgcauccggcuccaagcacacugugcccugcucuuugagguuggagauuuacaguaugcc

SEQ ID NO: 124072 - RNA, 64 nt, Homo Sapiens
uuuuuuauagguggagcaauacaauuugaauagucucuuugagaaguaugugcccuaucucaug

SEQ ID NO: 124073 - RNA, 64 nt, Homo Sapiens
auuucuuuuuacacguguaauuucugugaaauugcucuuugaaauaagaaaaaaacuggcuuca

SEQ ID NO: 124074 - RNA, 64 nt, Homo Sapiens
cacuguaauuucuaccagaauaguguguauuucucucuuugagaaaguaguagcaagacaugcu

SEQ ID NO: 124075 - RNA, 64 nt, Homo Sapiens
acaauuggaauacauuucaaugcaucagucuguucucuuugaccacucaguucugcauauacag

SEQ ID NO: 124076 - RNA, 64 nt, Homo Sapiens
cggcggagacgauggucagcguuccuacaaaacccucuuugauggauauuugguuggaaacucc

SEQ ID NO: 124077 - RNA, 64 nt, Homo Sapiens
acaccuggcuggacgcccugaaauucuccgcuaucucuuugacacugaucgccaaagcacguca

SEQ ID NO: 124078 - RNA, 64 nt, Homo Sapiens
gaacaguuucaguauugagauggcucaggagaggcucuuugauuuuuaaaguuuuggggugggg

SEQ ID NO: 124079 - RNA, 64 nt, Homo Sapiens
cucugucucgcuugcucgcucucgcuguuucucucucuuugaggcauuuguuuggaaaaaaucg

SEQ ID NO: 124080 - RNA, 64 nt, Homo Sapiens
uaccacacucaugggucacuggggcugcgcagggcucuuugagguggguggcuucuuuuggaaa

SEQ ID NO: 124081 - RNA, 64 nt, Homo Sapiens
uguguccgucaucccagcccccgguuggagccugcucuuugaacuccgcugccuuccuuagcag

SEQ ID NO: 124082 - RNA, 64 nt, Homo Sapiens
cagauaauuuuuaaguuuccuagugauucucaaucucuuugaauuuuacuuacauuuacacaca

SEQ ID NO: 124083 - RNA, 64 nt, Homo Sapiens
cagauaauguauaaguuucccagugauucucaaccucuuugaauuuuacuuauaauuacauaca

SEQ ID NO: 124084 - RNA, 64 nt, Homo Sapiens
cucuguagccaggcuggagugcaguggcauaaucucagcucacugcaaccucugcuucccgggu

SEQ ID NO: 124085 - RNA, 64 nt, Homo Sapiens
cuugucgcccaggcuggaguguaguggcgcagucucagcucacugcaaccuccaccucccgggu

SEQ ID NO: 124086 - RNA, 64 nt, Homo Sapiens
gauuugccuuuuguuguuuucucucuuuggugauucagcucagcucaugggccucaucccuucu

SEQ ID NO: 124087 - RNA, 64 nt, Homo Sapiens
gccuuuuguuguuuucucucuuuggugauucagcucagcucaugggccucaucccuucucuccc

SEQ ID NO: 124088 - RNA, 64 nt, Homo Sapiens
auucuuacuaugguuagaaagugaauuagaaauuucagcucaguuucuauuuuacuauucaagu

SEQ ID NO: 124089 - RNA, 64 nt, Homo Sapiens
uaguaugaaagcuggaacauggccuuguucaaccucagcucagaauauguguacagcaaguuuu

SEQ ID NO: 124090 - RNA, 64 nt, Homo Sapiens
ucuguugcccgggcuggaguacaauggcaugaucucagcucacugcaaccuccaccuccugggu

SEQ ID NO: 124091 - RNA, 64 nt, Homo Sapiens
caccacagccagccaguaugaccuaucuuaaucaucagcucaacuguaauuuaaauuuggcugu

SEQ ID NO: 124092 - RNA, 64 nt, Homo Sapiens
ccucaggugcaguggcccuaugaccgaugagaccucagcucagccgucagggcccagggugcug

SEQ ID NO: 124093 - RNA, 64 nt, Homo Sapiens
agggaugggccugaccugaccaaugcaccgucccucagcucaggccacagugcuggcugggccc

SEQ ID NO: 124094 - RNA, 64 nt, Homo Sapiens
ucugucgcccuggcuggagugcaauggugugaucucagcucacugcacccuccgccucucgggu

SEQ ID NO: 124095 - RNA, 64 nt, Homo Sapiens
uuagucacccagacuagaggucaguggcaggaucucagcucacugcaaccucugccuccugggc

SEQ ID NO: 124096 - RNA, 64 nt, Homo Sapiens
gagcuccugccgcagggggcccugcacacugaugucagcucaccagucucuucccugacagggc

SEQ ID NO: 124097 - RNA, 64 nt, Homo Sapiens
ccugagccuggggcgucucggagcuggauccccgucagcucauccaggcuggacaaaccaguuc

SEQ ID NO: 124098 - RNA, 64 nt, Homo Sapiens
gcaaccuccaccuccugggugcagugaugccaucucagcucacuucugucacacaggcuggaau

SEQ ID NO: 124099 - RNA, 64 nt, Homo Sapiens
gcaagcuccgccucccaaguacaguggcgcgaucucagcucacuucuguugcccaggcuggagu

SEQ ID NO: 124100 - RNA, 64 nt, Homo Sapiens
ggucuuccccgccaugauucuuaguuaucagaaaucagcucaguaaauuauguucagugauaac

SEQ ID NO: 124101 - RNA, 64 nt, Homo Sapiens
ucaagauuucauaaucauuuuaagagggcaucaaucagcucaacucauggauuauuaauggauu

SEQ ID NO: 124102 - RNA, 64 nt, Homo Sapiens
cucccucuggccccuucuccacuggagcaugggcucagcucaucagcacaaccauucugaaguu

SEQ ID NO: 124103 - RNA, 64 nt, Homo Sapiens
cgcccucuguugcucccuagggcccaguguuuccucagcucaucaacgagucuggccuggugcc

SEQ ID NO: 124104 - RNA, 64 nt, Homo Sapiens
uucugacgugucccagccugcagcucacccucacucagcucacuaguguccgccgccgccucuc

SEQ ID NO: 124105 - RNA, 64 nt, Homo Sapiens
gcuaggaaaaaccauuuccaagggucaccaagggucagcucaggucuuugacuucauuuccuga

SEQ ID NO: 124106 - RNA, 64 nt, Homo Sapiens
ucugucacccagguuggagugcaguggcgugaucucagcucacugcaaccuccaccucgcaggu

SEQ ID NO: 124107 - RNA, 64 nt, Homo Sapiens
cucuguugccaggcuggagugcaguggcgcgaucucagcucacuacaaccuccgccucccaugu

SEQ ID NO: 124108 - RNA, 64 nt, Homo Sapiens
ucugucuccuaagcuggagugcaguggcaucaucucagcucacugcaaccucugccucccaggu

SEQ ID NO: 124109 - RNA, 64 nt, Homo Sapiens
acuccaggcgguccccacccacagaagcagaccuucagcucaggccccggcauugccaucagca

SEQ ID NO: 124110 - RNA, 64 nt, Homo Sapiens
gaccccaccccacccacagagcacgagggccccgucagcucagucugugucagccccgauggcc

SEQ ID NO: 124111 - RNA, 64 nt, Homo Sapiens
agagcucgugggauuccugcugcuccagguguccucagcucaccugucccagacugaggacagg

SEQ ID NO: 124112 - RNA, 64 nt, Homo Sapiens
uccccgaguuggacaaggaggcuguuucugcacaucagcucauuucccgcaccccauuucuugc

SEQ ID NO: 124113 - RNA, 64 nt, Homo Sapiens
gcaagcuccgccuccucccggcaguggugcgaucucagcucacuucugucgcccaggcuggagu

SEQ ID NO: 124114 - RNA, 64 nt, Homo Sapiens
gcaaccucugccuccugggugcaauggcacaaucucagcucacacuuguuguccagucuggagu

SEQ ID NO: 124115 - RNA, 64 nt, Homo Sapiens
uuaaaagucuuugcaguggucugaggucuuaauaucagcucauuuuuauuuggcuuucugugaa

SEQ ID NO: 124116 - RNA, 64 nt, Homo Sapiens
gcagccucugucucccgggcgcaguggugugaucucagcucacuucugucaucuaggcuggagu

SEQ ID NO: 124117 - RNA, 64 nt, Homo Sapiens
gcaaccucugccuccugguugcaguggugcgaucucagcucacuucuguuacccaggcuggagu

SEQ ID NO: 124118 - RNA, 64 nt, Homo Sapiens
ggaucucugcaucaucuugagacaugcccaggugucagcucaaaaguccuggggguaaggggau

SEQ ID NO: 124119 - RNA, 64 nt, Homo Sapiens
uuuuggcucuguuauggagcccccacagaggcccucagcucaguccaucaagcauuccaguagc

SEQ ID NO: 124120 - RNA, 64 nt, Homo Sapiens
gaagucgcccgggcugcaguucaguggugcaaucucagcucacugcaagcucugccucccaggu

SEQ ID NO: 124121 - RNA, 64 nt, Homo Sapiens
ccagcauuuggaagaccaagacaggcagaucgcuucagcucaggaguucgagaucauucuggcc

SEQ ID NO: 124122 - RNA, 64 nt, Homo Sapiens
ugcucucccuuguggacccugguaaagaaaagccucagcucauagugaacacagcagaccuaga

SEQ ID NO: 124123 - RNA, 64 nt, Homo Sapiens
uucacacuaaacauaugaaugcagcacugcugccucagcucagcuucgugccuggguuccccac

SEQ ID NO: 124124 - RNA, 64 nt, Homo Sapiens
aaaugugccuuuugaagcaaacuuauuuaaauugccacuggaauaucuuuuuuuuuccuucucu

SEQ ID NO: 124125 - RNA, 64 nt, Homo Sapiens
cuuugaaguagggagguuggaaagggaucccaacccacuggagggggaaaaaguucacugcuac

SEQ ID NO: 124126 - RNA, 64 nt, Homo Sapiens
uuuauuucucucaggugcguuccaggaagggaccccacuggaauccuggccuugagccgugacc

SEQ ID NO: 124127 - RNA, 64 nt, Homo Sapiens
guguacuaccccaggacgcacgcaugcagggcccccacuggagcgagcguguacuaccccagga

SEQ ID NO: 124128 - RNA, 64 nt, Homo Sapiens
ucccugggccggcauuuguagcaauaacuuguggccacuggaaacuuagaacagaccucucugu

SEQ ID NO: 124129 - RNA, 64 nt, Homo Sapiens
aagcuucugucucuguguguagaggcuggaggagccacuggacaaucucuaacaccacacagaa

SEQ ID NO: 124130 - RNA, 64 nt, Homo Sapiens
agguuggaguuccagggcugggcccugguggaguccacuggaagucccauuauggauguugaaa

SEQ ID NO: 124131 - RNA, 64 nt, Homo Sapiens
cugugcaauaaugucuguguuucucucccaccugccacuggaacuggagaaugcacuuuauucu

SEQ ID NO: 124132 - RNA, 64 nt, Homo Sapiens
acuuuggaugggucacuuguaucuucccacuuugccacuggauggaagccugguggcaauaagg

SEQ ID NO: 124133 - RNA, 64 nt, Homo Sapiens
auggccgucgcuguggggguacgggugcaugaaaccacuggaaccuugccgacaagggcaacuc

SEQ ID NO: 124134 - RNA, 64 nt, Homo Sapiens
ggcucccuuacuugugaguaagggaucaugcucaccacuggagaagcuuacaccgggacuuuuu

SEQ ID NO: 124135 - RNA, 64 nt, Homo Sapiens
ucuaauucuucuuuaaucuaaaguagauagcuucccacuggaaaguaaacaaaaccaucccucc

SEQ ID NO: 124136 - RNA, 64 nt, Homo Sapiens
ggaggccaggaaagggggagcggggcgcccagggccacuggaacagccccacuggagucaaggc

SEQ ID NO: 124137 - RNA, 64 nt, Homo Sapiens
ggggagcggggcgcccagggccacuggaacagccccacuggagucaaggcuccgagggaggaga

SEQ ID NO: 124138 - RNA, 64 nt, Homo Sapiens
uacuugaauacucucacaaguagggagcucacucccacuggaacagcccauuuuaucuuugaau

SEQ ID NO: 124139 - RNA, 64 nt, Homo Sapiens
uuuuccagauucuuccacuggcuccacauccaccccacuggaucuucagaaggcuagagggcga

SEQ ID NO: 124140 - RNA, 64 nt, Homo Sapiens
ccugcauugguuuuugguuuuccccucacuccacccacuggauuccccaucacuggaucccaga

SEQ ID NO: 124141 - RNA, 64 nt, Homo Sapiens
cugacaaccacaaugccugggucaacaaaccucaccacuggaucucagcugcuggauucuggau

SEQ ID NO: 124142 - RNA, 64 nt, Homo Sapiens
ccacacaaaucagugaauggccucuacgucuuaaccacuggaucgcccccuacuggauccugga

SEQ ID NO: 124143 - RNA, 64 nt, Homo Sapiens
cugaugauccaaccacaggacccccacaccucagccacuggagaccguccccccaaucccucac

SEQ ID NO: 124144 - RNA, 64 nt, Homo Sapiens
cagccccacccuaggcaggaccugagcccaggacccacuggagcccucccugccacccccccug

SEQ ID NO: 124145 - RNA, 61 nt, Homo Sapiens
agacccauugcugggaggaggugacugaccuccacuggaggugcugcggguccacuucuga

SEQ ID NO: 124146 - RNA, 64 nt, Homo Sapiens
aagcuguuuugagccaggguggucugccucugagccacuggaggguccuugacuugaugaauuu

SEQ ID NO: 124147 - RNA, 64 nt, Homo Sapiens
ugcaugacuucccuccacccgcgcaaagugcuagccacuggaaacagauacucgccaaggcaga

SEQ ID NO: 124148 - RNA, 64 nt, Homo Sapiens
ggaagaagaagaagaacuucuagguccuaaacuagaagaggaagaagaagaggaaguaguugaa

SEQ ID NO: 124149 - RNA, 64 nt, Homo Sapiens
agaacuucuagguccuaaacuagaagaggaagaagaagaggaaguaguugaaaaugaugaggag

SEQ ID NO: 124150 - RNA, 64 nt, Homo Sapiens
agaauuccaguuguuaggaagagaugaggaguuggaagaggagggauuagaaacaggaggaggc

SEQ ID NO: 124151 - RNA, 64 nt, Homo Sapiens
guuuccaugguaacacaucccuaauuuuaccagggaagaggagaguacucacuuuaccaucuuu

SEQ ID NO: 124152 - RNA, 64 nt, Homo Sapiens
ugacagagggacguucuaggagcaauuggggcaagaagaggacagugauauuuuaaaacaaagu

SEQ ID NO: 124153 - RNA, 64 nt, Homo Sapiens
caaguauaccccaccagggccugagugacuagaggaagaggacgaggccuuguuggcacuagau

SEQ ID NO: 124154 - RNA, 64 nt, Homo Sapiens
uugacaagcuaugguaggauuaggaaaguuugcugaagaggaucuuugacgccacagugggacu

SEQ ID NO: 124155 - RNA, 64 nt, Homo Sapiens
uacauccuaacauaugcauuuggucaagguugcagaagaggacugaagauugacugccaagcua

SEQ ID NO: 124156 - RNA, 64 nt, Homo Sapiens
aggaggaggaggaggaggaaaugagcaggaggaggaagaggagggagccuggaagaggaggagg

SEQ ID NO: 124157 - RNA, 64 nt, Homo Sapiens
aggaugagcaggaggaggaacccugcagagccuggaagaggagggcccccaggcagucagcagc

SEQ ID NO: 124158 - RNA, 64 nt, Homo Sapiens
cgagggaaucagaaauugaggcagcccugaggaggaagaggaggacugaccuucugcugggaaa

SEQ ID NO: 124159 - RNA, 64 nt, Homo Sapiens
aggaugaggaggacacagaaaccuugcagaggacgaagaggaggacagacaagauggaagaagg

SEQ ID NO: 124160 - RNA, 64 nt, Homo Sapiens
uacagaagccugaauaaucuaagacagcuaucaggaagaggaaagaguagugaaaugaugcgga

SEQ ID NO: 124161 - RNA, 64 nt, Homo Sapiens
ucauaaaaucauccuagaagacaucacauuuggagaagaggaaaucuaucacauauuuaagcaa

SEQ ID NO: 124162 - RNA, 64 nt, Homo Sapiens
agcauuucacuggcagccuccacuagaauuuggugaagaggaggaggaggagauugaugacaag

SEQ ID NO: 124163 - RNA, 64 nt, Homo Sapiens
aaaagauaauauucuaaaaacugagaaauccagugaagaggaccuuucagguaaacaugauaca

SEQ ID NO: 124164 - RNA, 64 nt, Homo Sapiens
acaggaacccaccaaaccaaguccuagcguuuuggaagaggaaaaacaagagucaaugguacuu

SEQ ID NO: 124165 - RNA, 64 nt, Homo Sapiens
cucugucacuccucaugccugauaccgucuccuugaagaggaaacuguguaugucaacagaagg

SEQ ID NO: 124166 - RNA, 64 nt, Homo Sapiens
augguguggauaugguucuguuccugcacaaugggaagaggagaagaccauuagggaaaagaaa

SEQ ID NO: 124167 - RNA, 64 nt, Homo Sapiens
ucaaggaucaauaauccaacgccuguacucuacagaagaggacccagaagaaaaguugauuacu

SEQ ID NO: 124168 - RNA, 64 nt, Homo Sapiens
guuuuauaggaauuugcuuccuaagucuacuuuugaagaggaaaacaggaacguaccauauauu

SEQ ID NO: 124169 - RNA, 64 nt, Homo Sapiens
aauuagaggugauuuucagauuucuuguucuauggaagaggaagcugagcucagggagauauga

SEQ ID NO: 124170 - RNA, 64 nt, Homo Sapiens
gcagucagugucacuucuggcuuggcugaugcuggaagaggaggccccaggcacugcacagcac

SEQ ID NO: 124171 - RNA, 64 nt, Homo Sapiens
gauguccuugcaaaugcauuagagccacccagaggaagaggauuuggaaaugcauccaucaaag

SEQ ID NO: 124172 - RNA, 64 nt, Homo Sapiens
gagcuacucaugacugaagggaaacugcagcugggaagaggagccuguuuuugugagagacuuu

SEQ ID NO: 124173 - RNA, 64 nt, Homo Sapiens
ucucuuuucaacuuauuuaaaugacagcaccugagaagaggaaccguuuuacacuggauguuuc

SEQ ID NO: 124174 - RNA, 64 nt, Homo Sapiens
gcccccuccuucccucucuucugccugauagagggaagaggaagaggaggacgaacagagaucc

SEQ ID NO: 124175 - RNA, 64 nt, Homo Sapiens
uccuucccucucuucugccugauagagggaagaggaagaggaggacgaacagagauccugaaau

SEQ ID NO: 124176 - RNA, 64 nt, Homo Sapiens
aaaguacagauugucucaguuauacaaguggcaagaagaggacaguggaccagcuccugggacc

SEQ ID NO: 124177 - RNA, 64 nt, Homo Sapiens
cauaugugucccuccuaaagcugcaugcucaguugaagaggacgagaggacgaccuucucugau

SEQ ID NO: 124178 - RNA, 62 nt, Homo Sapiens
gggauaguuuuaaaguguagcaucuccaggaagaagaggaaaaggagggaaccccggauugg

SEQ ID NO: 124179 - RNA, 64 nt, Homo Sapiens
gacagauggugagguaaagucaaaggcauggguagaagaggaccaggggggcaagagcaacaac

SEQ ID NO: 124180 - RNA, 64 nt, Homo Sapiens
ggcugcacacgaugacucauuggaugggacagaagaagaggaugaggaugagauggaagaggag

SEQ ID NO: 124181 - RNA, 64 nt, Homo Sapiens
ggaugggacagaagaagaggaugaggaugagauggaagaggaggaggaggaggagcuggaggag

SEQ ID NO: 124182 - RNA, 64 nt, Homo Sapiens
gaccuacugaacccagagucccaggaggguaacagaagaggagguaguuggugaacagagagaa

SEQ ID NO: 124183 - RNA, 64 nt, Homo Sapiens
aagacucuggagccaaggcaugcccagucuggaagaagaggaggaccaauaacaacagccaccc

SEQ ID NO: 124184 - RNA, 64 nt, Homo Sapiens
gaaugaggaaggacccugugucauaaacaaaaaggaagaggaaacagcagaagagccauucauc

SEQ ID NO: 124185 - RNA, 64 nt, Homo Sapiens
aucugggauuucuacagccuuggggagaggucuggaagaggacccugaaacugugagcuggagu

SEQ ID NO: 124186 - RNA, 64 nt, Homo Sapiens
ccagaggucgggccagcugcuacauucagccagggaagaggaggucuaaaugcugguaaauauu

SEQ ID NO: 124187 - RNA, 64 nt, Homo Sapiens
gauaacugauuuccguucuuuucucccugcccgggaagaggacaaaccuguggggaaggagguu

SEQ ID NO: 124188 - RNA, 60 nt, Homo Sapiens
ucugcgacucaguugauugagcugcucucugaagaggaagaggagaaagccagagaguca

SEQ ID NO: 124189 - RNA, 64 nt, Homo Sapiens
ugcgacucaguugauugagcugcucucugaagaggaagaggagaaagccagagagucacucuua

SEQ ID NO: 124190 - RNA, 64 nt, Homo Sapiens
uuuuguuuauuuuuuugauaaugacuggacaucagaagaggaaaaaaacucaaaacaaaagcga

SEQ ID NO: 124191 - RNA, 64 nt, Homo Sapiens
gaaagccccacaaacuaaaacagccuuuccuagggaagaggaaggggaggugggcuggaucugu

SEQ ID NO: 124192 - RNA, 64 nt, Homo Sapiens
uucaaagcugccugucccuaccccauggugcuaggaagaggagugggguggugucagacccugg

SEQ ID NO: 124193 - RNA, 64 nt, Homo Sapiens
uugcuuuuuguuuauuuaaugcuguggcaugggugaagaggaggggaagaggccuguuuggccu

SEQ ID NO: 124194 - RNA, 64 nt, Homo Sapiens
ucugacuugcuugagaguucacuugacuacuuaugaagaggaccugaaaucuccuguaaacuuu

SEQ ID NO: 124195 - RNA, 64 nt, Homo Sapiens
auaugagaaaguaagucucuuuguagaccaucaagaagaggaaggaccaaacuaaaggagauca

SEQ ID NO: 124196 - RNA, 64 nt, Homo Sapiens
uaaaugacugcgaagcuggacaaaaagauacacagaagaggaaccagccaguaaaaaacacuuc

SEQ ID NO: 124197 - RNA, 64 nt, Homo Sapiens
acuuuaaagcaccugaaacgggagacuggggagggaagaggauuaaaccuuccuaggacaaaaa

SEQ ID NO: 124198 - RNA, 64 nt, Homo Sapiens
aguggccuggccagcccacagcugaugaaaucaggaagaggacauugcugaaagcuuugguuuu

SEQ ID NO: 124199 - RNA, 64 nt, Homo Sapiens
ucacagaaaggagaaucuccucugaggccuuugagaagaggacaaagagcuacaagauggcugc

SEQ ID NO: 124200 - RNA, 64 nt, Homo Sapiens
acgaggaccaucgggggcagagucguuggagacugaagaggaagaggaggaggagaaggggagu

SEQ ID NO: 124201 - RNA, 64 nt, Homo Sapiens
accaucgggggcagagucguuggagacugaagaggaagaggaggaggagaaggggagugagcgg

SEQ ID NO: 124202 - RNA, 64 nt, Homo Sapiens
uagguggaauaaugacucgagcaggaaagcaguagaagaggauuccuucaccacaguuucaccu

SEQ ID NO: 124203 - RNA, 64 nt, Homo Sapiens
uuccugggguauauuaauuuaguuauauuuagcagaagaggaauauaaccaaaugugacuaaaa

SEQ ID NO: 124204 - RNA, 64 nt, Homo Sapiens
agguagagcucccaccugcugccggugggggccugaagaggauacgugaagaggaagcggaaga

SEQ ID NO: 124205 - RNA, 64 nt, Homo Sapiens
cggaagagccggugggggccuccgcagccaccgugaagaggaagcugcccccgggaagccagcc

SEQ ID NO: 124206 - RNA, 64 nt, Homo Sapiens
agagaggcuggcacuaggggaggcugcacuguuugaagaggagcgccuggccccuugcugacuc

SEQ ID NO: 124207 - RNA, 64 nt, Homo Sapiens
uugagcuucccucugccugcagagccccccacuugaagaggagcgagccagcucccaggggccc

SEQ ID NO: 124208 - RNA, 64 nt, Homo Sapiens
cuuugaaaagguccugcagauuuguuucucucuugaagaggauugugaagucgucagccuaaaa

SEQ ID NO: 124209 - RNA, 64 nt, Homo Sapiens
aaaauggcaauuuuugaguguguuuucugaacuagaagaggaaaggccuauuaaaaaaaaaagu

SEQ ID NO: 124210 - RNA, 64 nt, Homo Sapiens
gagaggaaggcggggggcgccuccgcgcuucuuagaagaggaguguaggugaaaaggcagaaca

SEQ ID NO: 124211 - RNA, 64 nt, Homo Sapiens
ggacuucuucaaaauuuaaaaacuugugauuuaagaagaggaaaagauaagcuacagauugaga

SEQ ID NO: 124212 - RNA, 64 nt, Homo Sapiens
aaaaugggcaaaagacaugaauagauguuucacugaagaggaucuauagauggcaaguaagcau

SEQ ID NO: 124213 - RNA, 64 nt, Homo Sapiens
caaguaauggaggucccagcuccguccuggcacagaagaggaguucuuggaaccaccagucuag

SEQ ID NO: 124214 - RNA, 64 nt, Homo Sapiens
ugugaucaggccccaccccucagguauccugggggaagaggagaucccaugagacugcccugcc

SEQ ID NO: 124215 - RNA, 64 nt, Homo Sapiens
cacagacacagagcaggaggccuuccaagagacagaagaggagacuaaaugccaugacaggugu

SEQ ID NO: 124216 - RNA, 64 nt, Homo Sapiens
cacagacacaaagcaggaggcccuaugagagacggaagaggagacaaugggcccaauccagugu

SEQ ID NO: 124217 - RNA, 64 nt, Homo Sapiens
aacaucugugcacaccauccauuccgcucgcugagcgauggaaaagcuugccuggaagacuaug

SEQ ID NO: 124218 - RNA, 64 nt, Homo Sapiens
uauugugcagcuguugguuuucauguagugcccugcgauggaaauuagauauauuucauguauu

SEQ ID NO: 124219 - RNA, 64 nt, Homo Sapiens; identical to SEQ ID NO: 107849

SEQ ID NO: 124220 - RNA, 64 nt, Homo Sapiens; identical to SEQ ID NO: 107850

SEQ ID NO: 124221 - RNA, 64 nt, Homo Sapiens; identical to SEQ ID NO: 107851

SEQ ID NO: 124222 - RNA, 64 nt, Homo Sapiens; identical to SEQ ID NO: 107852

SEQ ID NO: 124223 - RNA, 64 nt, Homo Sapiens; identical to SEQ ID NO: 107853

SEQ ID NO: 124224 - RNA, 64 nt, Homo Sapiens; identical to SEQ ID NO: 107854

SEQ ID NO: 124225 - RNA, 64 nt, Homo Sapiens; identical to SEQ ID NO: 107855

SEQ ID NO: 124226 - RNA, 64 nt, Homo Sapiens; identical to SEQ ID NO: 107856

SEQ ID NO: 124227 - RNA, 64 nt, Homo Sapiens; identical to SEQ ID NO: 107857

SEQ ID NO: 124228 - RNA, 64 nt, Homo Sapiens; identical to SEQ ID NO: 107858

SEQ ID NO: 124229 - RNA, 64 nt, Homo Sapiens; identical to SEQ ID NO: 107859

SEQ ID NO: 124230 - RNA, 64 nt, Homo Sapiens; identical to SEQ ID NO: 107860

SEQ ID NO: 124231 - RNA, 64 nt, Homo Sapiens; identical to SEQ ID NO: 107861

SEQ ID NO: 124232 - RNA, 64 nt, Homo Sapiens; identical to SEQ ID NO: 107862

SEQ ID NO: 124233 - RNA, 64 nt, Homo Sapiens; identical to SEQ ID NO: 107863

SEQ ID NO: 124234 - RNA, 63 nt, Homo Sapiens; identical to SEQ ID NO: 107864

SEQ ID NO: 124235 - RNA, 64 nt, Homo Sapiens; identical to SEQ ID NO: 107865

SEQ ID NO: 124236 - RNA, 64 nt, Homo Sapiens; identical to SEQ ID NO: 107866

SEQ ID NO: 124237 - RNA, 64 nt, Homo Sapiens; identical to SEQ ID NO: 107867

SEQ ID NO: 124238 - RNA, 64 nt, Homo Sapiens; identical to SEQ ID NO: 107868

SEQ ID NO: 124239 - RNA, 64 nt, Homo Sapiens; identical to SEQ ID NO: 107869

SEQ ID NO: 124240 - RNA, 64 nt, Homo Sapiens; identical to SEQ ID NO: 107870

SEQ ID NO: 124241 - RNA, 64 nt, Homo Sapiens; identical to SEQ ID NO: 107871

SEQ ID NO: 124242 - RNA, 64 nt, Homo Sapiens; identical to SEQ ID NO: 107872

SEQ ID NO: 124243 - RNA, 64 nt, Homo Sapiens; identical to SEQ ID NO: 107873

SEQ ID NO: 124244 - RNA, 64 nt, Homo Sapiens; identical to SEQ ID NO: 107874

SEQ ID NO: 124245 - RNA, 64 nt, Homo Sapiens; identical to SEQ ID NO: 107875

SEQ ID NO: 124246 - RNA, 64 nt, Homo Sapiens; identical to SEQ ID NO: 107876

SEQ ID NO: 124247 - RNA, 64 nt, Homo Sapiens; identical to SEQ ID NO: 107877

SEQ ID NO: 124248 - RNA, 64 nt, Homo Sapiens; identical to SEQ ID NO: 107878

SEQ ID NO: 124249 - RNA, 64 nt, Homo Sapiens; identical to SEQ ID NO: 107879

SEQ ID NO: 124250 - RNA, 64 nt, Homo Sapiens; identical to SEQ ID NO: 107880

SEQ ID NO: 124251 - RNA, 64 nt, Homo Sapiens; identical to SEQ ID NO: 107881

SEQ ID NO: 124252 - RNA, 64 nt, Homo Sapiens; identical to SEQ ID NO: 107882

SEQ ID NO: 124253 - RNA, 64 nt, Homo Sapiens; identical to SEQ ID NO: 107883

SEQ ID NO: 124254 - RNA, 64 nt, Homo Sapiens; identical to SEQ ID NO: 107884

SEQ ID NO: 124255 - RNA, 64 nt, Homo Sapiens; identical to SEQ ID NO: 107885

SEQ ID NO: 124256 - RNA, 64 nt, Homo Sapiens; identical to SEQ ID NO: 107886

SEQ ID NO: 124257 - RNA, 64 nt, Homo Sapiens; identical to SEQ ID NO: 107887

SEQ ID NO: 124258 - RNA, 64 nt, Homo Sapiens; identical to SEQ ID NO: 107888

SEQ ID NO: 124259 - RNA, 64 nt, Homo Sapiens; identical to SEQ ID NO: 107889

SEQ ID NO: 124260 - RNA, 64 nt, Homo Sapiens; identical to SEQ ID NO: 107890

SEQ ID NO: 124261 - RNA, 64 nt, Homo Sapiens; identical to SEQ ID NO: 107891

SEQ ID NO: 124262 - RNA, 64 nt, Homo Sapiens; identical to SEQ ID NO: 107892

SEQ ID NO: 124263 - RNA, 64 nt, Homo Sapiens; identical to SEQ ID NO: 107893

SEQ ID NO: 124264 - RNA, 64 nt, Homo Sapiens; identical to SEQ ID NO: 107894

SEQ ID NO: 124265 - RNA, 64 nt, Homo Sapiens; identical to SEQ ID NO: 107895

SEQ ID NO: 124266 - RNA, 64 nt, Homo Sapiens; identical to SEQ ID NO: 107896

SEQ ID NO: 124267 - RNA, 64 nt, Homo Sapiens; identical to SEQ ID NO: 107897

SEQ ID NO: 124268 - RNA, 64 nt, Homo Sapiens; identical to SEQ ID NO: 107898

SEQ ID NO: 124269 - RNA, 64 nt, Homo Sapiens; identical to SEQ ID NO: 107899

SEQ ID NO: 124270 - RNA, 64 nt, Homo Sapiens; identical to SEQ ID NO: 107900

SEQ ID NO: 124271 - RNA, 64 nt, Homo Sapiens; identical to SEQ ID NO: 107901

SEQ ID NO: 124272 - RNA, 64 nt, Homo Sapiens; identical to SEQ ID NO: 107902

SEQ ID NO: 124273 - RNA, 64 nt, Homo Sapiens; identical to SEQ ID NO: 107903

SEQ ID NO: 124274 - RNA, 64 nt, Homo Sapiens; identical to SEQ ID NO: 107904

SEQ ID NO: 124275 - RNA, 64 nt, Homo Sapiens; identical to SEQ ID NO: 107905

SEQ ID NO: 124276 - RNA, 64 nt, Homo Sapiens; identical to SEQ ID NO: 107906

SEQ ID NO: 124277 - RNA, 64 nt, Homo Sapiens; identical to SEQ ID NO: 107907

SEQ ID NO: 124278 - RNA, 64 nt, Homo Sapiens; identical to SEQ ID NO: 107908

SEQ ID NO: 124279 - RNA, 64 nt, Homo Sapiens; identical to SEQ ID NO: 107909

SEQ ID NO: 124280 - RNA, 64 nt, Homo Sapiens; identical to SEQ ID NO: 107910

SEQ ID NO: 124281 - RNA, 64 nt, Homo Sapiens; identical to SEQ ID NO: 107911

SEQ ID NO: 124282 - RNA, 64 nt, Homo Sapiens; identical to SEQ ID NO: 107912

SEQ ID NO: 124283 - RNA, 64 nt, Homo Sapiens; identical to SEQ ID NO: 107913

SEQ ID NO: 124284 - RNA, 64 nt, Homo Sapiens; identical to SEQ ID NO: 107914

SEQ ID NO: 124285 - RNA, 64 nt, Homo Sapiens; identical to SEQ ID NO: 107915

SEQ ID NO: 124286 - RNA, 64 nt, Homo Sapiens; identical to SEQ ID NO: 107916

SEQ ID NO: 124287 - RNA, 64 nt, Homo Sapiens; identical to SEQ ID NO: 107917

SEQ ID NO: 124288 - RNA, 64 nt, Homo Sapiens; identical to SEQ ID NO: 107918

SEQ ID NO: 124289 - RNA, 64 nt, Homo Sapiens; identical to SEQ ID NO: 107919

SEQ ID NO: 124290 - RNA, 64 nt, Homo Sapiens; identical to SEQ ID NO: 107920

SEQ ID NO: 124291 - RNA, 64 nt, Homo Sapiens; identical to SEQ ID NO: 107921

SEQ ID NO: 124292 - RNA, 64 nt, Homo Sapiens; identical to SEQ ID NO: 107922

SEQ ID NO: 124293 - RNA, 64 nt, Homo Sapiens; identical to SEQ ID NO: 107923

SEQ ID NO: 124294 - RNA, 64 nt, Homo Sapiens; identical to SEQ ID NO: 107924

SEQ ID NO: 124295 - RNA, 64 nt, Homo Sapiens; identical to SEQ ID NO: 107925

SEQ ID NO: 124296 - RNA, 64 nt, Homo Sapiens; identical to SEQ ID NO: 107926

SEQ ID NO: 124297 - RNA, 64 nt, Homo Sapiens; identical to SEQ ID NO: 107927

SEQ ID NO: 124298 - RNA, 64 nt, Homo Sapiens; identical to SEQ ID NO: 107928

SEQ ID NO: 124299 - RNA, 64 nt, Homo Sapiens; identical to SEQ ID NO: 107929

SEQ ID NO: 124300 - RNA, 64 nt, Homo Sapiens; identical to SEQ ID NO: 107930

SEQ ID NO: 124301 - RNA, 64 nt, Homo Sapiens; identical to SEQ ID NO: 107931

SEQ ID NO: 124302 - RNA, 64 nt, Homo Sapiens; identical to SEQ ID NO: 107932

SEQ ID NO: 124303 - RNA, 64 nt, Homo Sapiens; identical to SEQ ID NO: 107933

SEQ ID NO: 124304 - RNA, 64 nt, Homo Sapiens; identical to SEQ ID NO: 83366

SEQ ID NO: 124305 - RNA, 64 nt, Homo Sapiens; identical to SEQ ID NO: 83367

SEQ ID NO: 124306 - RNA, 64 nt, Homo Sapiens; identical to SEQ ID NO: 83368

SEQ ID NO: 124307 - RNA, 64 nt, Homo Sapiens; identical to SEQ ID NO: 83369

SEQ ID NO: 124308 - RNA, 64 nt, Homo Sapiens; identical to SEQ ID NO: 83370

SEQ ID NO: 124309 - RNA, 64 nt, Homo Sapiens; identical to SEQ ID NO: 83371

SEQ ID NO: 124310 - RNA, 64 nt, Homo Sapiens; identical to SEQ ID NO: 83372

SEQ ID NO: 124311 - RNA, 64 nt, Homo Sapiens; identical to SEQ ID NO: 83373

SEQ ID NO: 124312 - RNA, 64 nt, Homo Sapiens
ugugauuuguauaaugaaaugcauuucauuuggaagaauucaaugaaccauuuuuccaagugac

SEQ ID NO: 124313 - RNA, 64 nt, Homo Sapiens
ucaacaaaaaaguuuggauguagaagcagcuguaagaauucaacuguuuauuauaacaagauac

SEQ ID NO: 124314 - RNA, 64 nt, Homo Sapiens
cuuauuugguuccuaacacaaacugggaagagauagaauucaucuauacuuucuuuuuucuugg

SEQ ID NO: 124315 - RNA, 64 nt, Homo Sapiens
aacacagcuuaaaaauaaaauaacugaaagaaauagaauucagcaaauaguuauuuuuugcacu

SEQ ID NO: 124316 - RNA, 64 nt, Homo Sapiens
cuuuaccucauucucaaaccuugauaaacauaagagaauucauaccggagagaaacuguacaaa

SEQ ID NO: 124317 - RNA, 64 nt, Homo Sapiens
aacuuacauugagaagauaugaaagaugaauauaagaauucauccuagauauaaaaccauagaa

SEQ ID NO: 124318 - RNA, 64 nt, Homo Sapiens
acugaagauauuuauuaaaaaaguacuuguacauagaauucagacucuccagggaguagaugua

SEQ ID NO: 124319 - RNA, 64 nt, Homo Sapiens
ggaagaaaucaccaaagauuuugacucauuuaccagaauucauucauccuccuuuuguucugca

SEQ ID NO: 124320 - RNA, 64 nt, Homo Sapiens
gguaugugauggguuguagaagcguguguuugagagaauucagagacauuugaaggcugcugug

SEQ ID NO: 124321 - RNA, 64 nt, Homo Sapiens
gugcaugcaacacacuuaggggaggaguggccccagaauucagcacgcacacaacacacaaggg

SEQ ID NO: 124322 - RNA, 64 nt, Homo Sapiens
aaaagacugacaaugacaguuuuugucuuuaaaaagaauucaaaguucgaucuucuggguuuag

SEQ ID NO: 124323 - RNA, 64 nt, Homo Sapiens
gauaauucuaacucagacuuaagacaaaaaaaaaagaauucauuuaaaaucaagaaaauuuaaa

SEQ ID NO: 124324 - RNA, 64 nt, Homo Sapiens
ccggagaacaacuuuuuaaacuucucguuguaagagaauucacacuuucuacuaaugcucagcc

SEQ ID NO: 124325 - RNA, 64 nt, Homo Sapiens
ggggaccagagagccugcaauuugcucagagcucagaauucagugaugaggacaaaucucagac

SEQ ID NO: 124326 - RNA, 64 nt, Homo Sapiens
uuuauuugcuguuuagguuugugacugaauugugagaauucaguugugauuuuuaacauguguc

SEQ ID NO: 124327 - RNA, 64 nt, Homo Sapiens
uuuuauuugauauuucaucuauguuugaaaugugagaauucagauguaauuuuuuaccuugauu

SEQ ID NO: 124328 - RNA, 64 nt, Homo Sapiens
gaugacaaugauaaguaugacaugagcuucaaccagaauucagccucugguaaacaugaacacu

SEQ ID NO: 124329 - RNA, 64 nt, Homo Sapiens
cuucagauugaauucacaucuuauucagcaucaaagaauucacacaggagagaaagcacaugaa

SEQ ID NO: 124330 - RNA, 64 nt, Homo Sapiens
gcuauuaguauuuucauaccuuagucacauuuggagaauucacaugggaauaaaauuccauugc

SEQ ID NO: 124331 - RNA, 64 nt, Homo Sapiens
caggcuucuguuuucagaguucagaguguaucaaagaauucagauuguguccaaaaugcaaccu

SEQ ID NO: 124332 - RNA, 64 nt, Homo Sapiens
uaggaaagaaaccagaugaaucacugugaaucagagaauucacaacagucccagaaguaaaccc

SEQ ID NO: 124333 - RNA, 64 nt, Homo Sapiens; identical to SEQ ID NO: 124324

SEQ ID NO: 124334 - RNA, 64 nt, Homo Sapiens; identical to SEQ ID NO: 124325

SEQ ID NO: 124335 - RNA, 64 nt, Homo Sapiens
agcuugugaguagagcaaacaaacguuuuuccaaagaauucacagugcuccuuugcaauuuaua

SEQ ID NO: 124336 - RNA, 64 nt, Homo Sapiens
gaaacuauuggaugaaaugaggaaaaacaggaaaagaauucacuuuuuaaaugaagaaauuagu

SEQ ID NO: 124337 - RNA, 64 nt, Homo Sapiens
aaagaaugggugauuaaaguuuaacucacuuaggagaauucagaauuuugauauuuuggauaca

SEQ ID NO: 124338 - RNA, 64 nt, Homo Sapiens
ucaauuugaguugguucucuuuucacuauaacagagaauucauuagcaucuucucacuaauguu

SEQ ID NO: 124339 - RNA, 64 nt, Homo Sapiens
aaagauacccucucauggaauaaacaccuugcuuagaauucauauaacaaagaaguaaccuuau

SEQ ID NO: 124340 - RNA, 64 nt, Homo Sapiens
cucguuuggcacgcauguuagauggcagagaccaagaauucaagaugguugguggccagauuuu

SEQ ID NO: 124341 - RNA, 64 nt, Homo Sapiens
ggcaguccugcacuccuucuggaggcucuaggggagaauucauuucuggccuuuucauuuuuag

SEQ ID NO: 124342 - RNA, 64 nt, Homo Sapiens
acaggauccagguuuuuauagcuugauauaaaacagaauucaaaaguggcuguggagugauuua

SEQ ID NO: 124343 - RNA, 64 nt, Homo Sapiens
ugugcauaaauaacacuaauuuacuggcuuugcuagaauucauagaauugguuguuaauuucug

SEQ ID NO: 124344 - RNA, 64 nt, Homo Sapiens
gccaauaugugcuugcuuauaaauaggcacauuuagaauucagauuccuucgugaacaaaaaua

SEQ ID NO: 124345 - RNA, 64 nt, Homo Sapiens
caaugagcgccugauaaccaggguugguuccuggagaauucacucauugauucauuuguucaca

SEQ ID NO: 124346 - RNA, 64 nt, Homo Sapiens
gccaagaauuuuuagaauuuuugagaauuuuuuaagaauucauugguuauaagcaacaguugcc

SEQ ID NO: 124347 - RNA, 64 nt, Homo Sapiens
uucagaacagcgauugaccaguaacugugagaucagaauucacccaaaggaagacauuuucauc

SEQ ID NO: 124348 - RNA, 64 nt, Homo Sapiens
gaagcauguguaaaauuauacuuucaguaauuggagaauucagagauugcauuucuagcagaga

SEQ ID NO: 124349 - RNA, 64 nt, Homo Sapiens
cuaguaagcgaugcugcaacuuguuaucuuaacaagaauucaagucguuuuaauuaaaucccac

SEQ ID NO: 124350 - RNA, 64 nt, Homo Sapiens
uagauaauaauuucuaugggaccaaagacuagacagaauucaguaagucacaugaaguaauggu

SEQ ID NO: 124351 - RNA, 64 nt, Homo Sapiens
aagugaaaacacugggcucccuguuaaacgaugaagaauucaagacagugacagcauuacguca

SEQ ID NO: 124352 - RNA, 64 nt, Homo Sapiens
ccggccugggacucagcauuucugauaugccuuaagaauucauucuguuuuguacaauuauuuu

SEQ ID NO: 124353 - RNA, 64 nt, Homo Sapiens
guguggcagaaguuuauuuauuuuuauccaguauagaauucaauuauaugauuauaucacaauu

SEQ ID NO: 124354 - RNA, 64 nt, Homo Sapiens
uaaauuuuaucaauauggugcugguucaaaccagagaauucaugcugcagggaaacucaaucaa

SEQ ID NO: 124355 - RNA, 64 nt, Homo Sapiens
uuucagucacagaucacgccuuaaaagacauaggagaauucauacuggagagaaaccuuacaag

SEQ ID NO: 124356 - RNA, 64 nt, Homo Sapiens
cuucagucaagcuucauccuaugcaaaacauaggagaauucaugcaggagagaaaugucacaag

SEQ ID NO: 124357 - RNA, 64 nt, Homo Sapiens
cuuuagaugucgcuccacacuugauacacaucagagaauucacacuggugaaaggccuuaugag

SEQ ID NO: 124358 - RNA, 64 nt, Homo Sapiens
cuuuagauacaacuccagccucauuaaacaucggagaauucacacuggagagagaccuuaucag

SEQ ID NO: 124359 - RNA, 64 nt, Homo Sapiens
gauauuucucccauuugcuuccuugcugagaaaaagaauucaguuucucuuucucaaggauguu

SEQ ID NO: 124360 - RNA, 64 nt, Homo Sapiens
cuggggagaaauacuaugaauaaguaugcaugaaagaauucacaauuugcucuuuccucaugcc

SEQ ID NO: 124361 - RNA, 64 nt, Homo Sapiens
cuggaggaaaagcccuacaauuacuacucauaaaagaauucauacuucaacuguuccucacacc

SEQ ID NO: 124362 - RNA, 64 nt, Homo Sapiens
cuggagagaaacccuacaaauuguggaacauaagagaauucauacuucaaccgguccucaaacc

SEQ ID NO: 124363 - RNA, 64 nt, Homo Sapiens
cuggugagaaacccuuugaaacucuuaacaccagagaauucacaaauccuuuauugauuguuca

SEQ ID NO: 124364 - RNA, 64 nt, Homo Sapiens
cuagugagaaaccguaucaguuaauagaaaucagagaauucacagccuuugcuuguuuccuacc

SEQ ID NO: 124365 - RNA, 64 nt, Homo Sapiens
ccagugugaaacccuaugaauuacucaacaucaaagaauucauauuuuaauaauuauccaacuc

SEQ ID NO: 124366 - RNA, 64 nt, Homo Sapiens
aaggagagaaacccuaucaguuaauagacaucagagaauucacacuucauuuguuuuuuugauu

SEQ ID NO: 124367 - RNA, 61 nt, Homo Sapiens
guggggagaaacccuaugaaugagacaucagagaauucacacaagcauaaugcacaucuaa

SEQ ID NO: 124368 - RNA, 64 nt, Homo Sapiens
cuggagagaaaccuuacaaguggcacaccauacuagaauucacauuuugggagugauucacacc

SEQ ID NO: 124369 - RNA, 64 nt, Homo Sapiens
cuggagaaaaaacauacaaagcuugaaagacaggagaauucauaguugucagucacaaaucaca

SEQ ID NO: 124370 - RNA, 64 nt, Homo Sapiens
cuggagagaaaccuuacaaauggcaaaacauauuagaauucaaauuuugaauauaauucauacc

SEQ ID NO: 124371 - RNA, 64 nt, Homo Sapiens
cugcagagaaacuuuacaaauugcacgucaucauagaauucauauuuuaaucaaaaaacaaccc

SEQ ID NO: 124372 - RNA, 64 nt, Homo Sapiens
cuggagagaaaccuuacaaguggcaccccauacuagaauucacauuucgggaaugauucacacg

SEQ ID NO: 124373 - RNA, 64 nt, Homo Sapiens
cuggagaaaagccauagaaauucaaauacauaggagaauucacauuuucauucacaaauccagc

SEQ ID NO: 124374 - RNA, 64 nt, Homo Sapiens
cuggagagaaacucauuauauggcaaaacauacuagaauucacauuuugcauauaaugcauauc

SEQ ID NO: 124375 - RNA, 64 nt, Homo Sapiens
gccaucauuucauucgugggccugcugcucucuaagaauucaguagcauuuuaauaguuucuaa

SEQ ID NO: 124376 - RNA, 64 nt, Homo Sapiens
ugcccauuucacacaacuguggauaaauuuuggaagaauucaugaugcuaguucuuacgcuuga

SEQ ID NO: 124377 - RNA, 64 nt, Homo Sapiens
ucucagagaacucccccaccucuccguacaccccagcuccuaggaggcuccccagggccccgcu

SEQ ID NO: 124378 - RNA, 64 nt, Homo Sapiens
uuuuccuuccaagcacccagggcuggggccccuaagcuccuagggggccuggcucucccuggga

SEQ ID NO: 124379 - RNA, 64 nt, Homo Sapiens
agucuaggggguuccauucuggccaugcgagcccagcuccuaccaacgucgguaacuugagcag

SEQ ID NO: 124380 - RNA, 64 nt, Homo Sapiens
gagcgugaccccuccugcugggaccuguguuguaagcuccuauuugcuuaucuuguuuauuuca

SEQ ID NO: 124381 - RNA, 64 nt, Homo Sapiens
cacaugcaugcacacaaacguguacacaagugugagcuccuacacgcauacacacacacacgug

SEQ ID NO: 124382 - RNA, 64 nt, Homo Sapiens
cacacaugcauguacagguaagcacacauguacaagcuccuacaggcuugcucucacacacgug

SEQ ID NO: 124383 - RNA, 64 nt, Homo Sapiens
ucugaccccagcuucucucuccccccacagcgucagcuccuaccgccucaccuuucacccccca

SEQ ID NO: 124384 - RNA, 64 nt, Homo Sapiens
ucugaccccaacuucucuuucccaccugagccccagcuccuaccccuugccucaccuuuaaccc

SEQ ID NO: 124385 - RNA, 64 nt, Homo Sapiens
cuaugcuggguucccugaguaaugaggcaguuggaaucuagacaucaggcagcugagggcugag

SEQ ID NO: 124386 - RNA, 64 nt, Homo Sapiens
guguuauguaagugauguuauuccaaguauuuguaaucuagaaaguuguucacaaaaggccaca

SEQ ID NO: 124387 - RNA, 64 nt, Homo Sapiens
ucuaaaggguugaaugacaauucgggcauuaggaaaucuagagauuauucuguauuuggccuua

SEQ ID NO: 124388 - RNA, 64 nt, Homo Sapiens
aucuauuuuucucccaugauuggauaugcaauuuaaucuagauuaaacauuuuauaugcuccuu

SEQ ID NO: 124389 - RNA, 64 nt, Homo Sapiens
ucuuggaaguacauuauauucaaaaaaaaaaaaaaaucuagaaugugacgagugaaacugucuc

SEQ ID NO: 124390 - RNA, 64 nt, Homo Sapiens
uagccgggcauggucgcucaucuuuacucuauuaaaucuagaauucuguaacaaaaguacuuuc

SEQ ID NO: 124391 - RNA, 64 nt, Homo Sapiens
uguuuguuuugauuugcucuguuuuauucagucaaaucuagaguuugaauccucugcuaaagaa

SEQ ID NO: 124392 - RNA, 64 nt, Homo Sapiens
aaaaaaacuggcaaagugaaaagauacagucaaaaaucuagaauuucuuuaauuuugcuucucu

SEQ ID NO: 124393 - RNA, 64 nt, Homo Sapiens
aauuuucuuuuuuccacaagguaaagcuauuucaguuuaguaaauuucauuucaacugauaaua

SEQ ID NO: 124394 - RNA, 64 nt, Homo Sapiens
gaaauugccuuaaaaauugccuacucauuucaguguuuaguacaauaaauuacagaauuuauua

SEQ ID NO: 124395 - RNA, 64 nt, Homo Sapiens
uauguguguuuuaacuuaugauugucaggagaauggcucuuauucuuuuuaaugauguaagaaa

SEQ ID NO: 124396 - RNA, 54 nt, Homo Sapiens
auuaaguuaauuucuucucuauuuggcucuuagauuucuaaaccuucugaguaa

SEQ ID NO: 124397 - RNA, 64 nt, Homo Sapiens
caguguaagagugaaaauaucuaugagaaaauauggcucuuaagaugaacuaggaacgcauuua

SEQ ID NO: 124398 - RNA, 64 nt, Homo Sapiens
ccucucccaucaugccuugaaauucucuaagacuggcucuuagacacuaucucagaaauaccuu

SEQ ID NO: 124399 - RNA, 64 nt, Homo Sapiens
agcuccccgcuccacaagaccaccaaucccgaucggcucuuauuccugugaucuggaaaucuac

SEQ ID NO: 124400 - RNA, 64 nt, Homo Sapiens
agcuccccgcuccacaagaccaccaaucccgaucggcucuuauuccugugcuuuggaaauccac

SEQ ID NO: 124401 - RNA, 64 nt, Homo Sapiens
agcuccccgcuccacaagacgaccaaucccgaucggcucuuauuacggggaucuggaaauccac

SEQ ID NO: 124402 - RNA, 64 nt, Homo Sapiens
caugagcgucugcaaaacacuugccugaauacauaucacguauuuuagacucgaagccucaaag

SEQ ID NO: 124403 - RNA, 64 nt, Homo Sapiens
cacaacuuaauuugaaccacaaguauccagcuuaaucacguaucuuacucacgauaccacuggu

SEQ ID NO: 124404 - RNA, 64 nt, Homo Sapiens
aacucuugaaaucuccauuuucaaucccuucgaaaucacguaugguuuccacaaagccgagucg

SEQ ID NO: 124405 - RNA, 64 nt, Homo Sapiens
uuuccuucuagacuggcaucgccccuggaacacaaucacguaagacacuggguuaauucuguuu

SEQ ID NO: 124406 - RNA, 64 nt, Homo Sapiens
cauguaacccagcagcaguuaaacuguggaauggaucacguagaaaagaaaaaaaaaauuccua

SEQ ID NO: 124407 - RNA, 64 nt, Homo Sapiens
gcuagaaaugauccccagcuagagcguguagugaaucacguaaaaaaagggaacugaacauucc

SEQ ID NO: 124408 - RNA, 64 nt, Homo Sapiens
uugguuuuguuugcuauucuauaaagacaugggcaucacguaaauuguuccagaguguggaagu

SEQ ID NO: 124409 - RNA, 64 nt, Homo Sapiens
ugcugcuaccuguacagcagcaguggccuguuucaucacguaugucacauauugacauugagcu

SEQ ID NO: 124410 - RNA, 64 nt, Homo Sapiens
cuaggaguagaucuuauuccagaucauauacaagaucacguagucuagcuaguucacauucaag

SEQ ID NO: 124411 - RNA, 64 nt, Homo Sapiens
acaauacaguguauuuuguugauauggagauuucaucacguacuuugauuguacuauauugcag

SEQ ID NO: 124412 - RNA, 64 nt, Homo Sapiens
ggcacuucgggcaauaacucuguggcacgugggcaucacguaagcagcacacuaggaggcccag

SEQ ID NO: 124413 - RNA, 64 nt, Homo Sapiens
guucacagauaauucuuuuuggaaaucuuuauuaaucacguaugcgaccagccucugccuuaaa

SEQ ID NO: 124414 - RNA, 64 nt, Homo Sapiens
uuauacaaccuucauuuaaaaucugugaaauaucaucacguauguuauugauauucuaagaaau

SEQ ID NO: 124415 - RNA, 64 nt, Homo Sapiens
ugugugagugcagugcagaugaucagaccuguguaucacguaagagaucagaccuguguauuua

SEQ ID NO: 124416 - RNA, 64 nt, Homo Sapiens
aaauguauacuuaguguuuuaaaugugaaaaagaaucacguaguugaaauaaauacugcaccaa

SEQ ID NO: 124417 - RNA, 64 nt, Homo Sapiens
cacaguauggugaugaugacuuuuaagcauuuacaucacguacucauaaccuauuaugaaaaua

SEQ ID NO: 124418 - RNA, 64 nt, Homo Sapiens
ugcggagcucaauuugcccacaggugcguugggcaucacguaggcagugggauggccucaucca

SEQ ID NO: 124419 - RNA, 64 nt, Homo Sapiens
aaccagaaaacauucaaaagaacuucaacaaaucaucacguaacaggaucuucagaaaaacuac

SEQ ID NO: 124420 - RNA, 64 nt, Homo Sapiens
uuuucacuauaccucuaaaaccaauuguaccgacaucacguagacaaaaacuccagauaaaucc

SEQ ID NO: 124421 - RNA, 64 nt, Homo Sapiens
uuuccucugacuguuuccugucacaaagaacuauaucacguaccguuuuuagugaaauauuauu

SEQ ID NO: 124422 - RNA, 64 nt, Homo Sapiens
acugaaaggcagcggggagcagcccucuugauggaucacguaaacguguucacuuggcucccau

SEQ ID NO: 124423 - RNA, 64 nt, Homo Sapiens
cagugcauuuucauguuuugaaucugauuaguggaucacguagcuacuuucccugucgcgucca

SEQ ID NO: 124424 - RNA, 64 nt, Homo Sapiens
auuuuuuccaaaggguuacuuagugccuuuggguaucacguaaagccacaccccuuaugugaac

SEQ ID NO: 124425 - RNA, 64 nt, Homo Sapiens
ucgcagcagcauuucaccccgucuuacagaaaccaucacguaugugggauauuaaggcccuggu

SEQ ID NO: 124426 - RNA, 64 nt, Homo Sapiens
ccacugggccagcccugcagugaucacccaaugcaucacguaccguuugauugaggagcugcac

SEQ ID NO: 124427 - RNA, 64 nt, Homo Sapiens
cccacccaacacacuccugcuaguagcccguaugaucacguagaccgcauggagcccccgugau

SEQ ID NO: 124428 - RNA, 64 nt, Homo Sapiens
cugccccuucugggugacacagccgguaaacggaaucacguaugguucuuucugugggucugug

SEQ ID NO: 124429 - RNA, 64 nt, Homo Sapiens
acaucgauaugcuaagaagaccgaggugcccagcaucacguaaaacaacagccaucuuaggucc

SEQ ID NO: 124430 - RNA, 64 nt, Homo Sapiens
ccucagcacagacucuuucagauggaggugccauaucacguacaccauaugcaaguuucccgcc

SEQ ID NO: 124431 - RNA, 64 nt, Homo Sapiens
aaucugugcuucuaacugagaugagaguguauuaaucacguaucgcagggcuccagcuguuuua

SEQ ID NO: 124432 - RNA, 64 nt, Homo Sapiens
acuuccucagauugugcacuguuuguuuaaaauaaucacguauuuuagucugaugcuguuguau

SEQ ID NO: 124433 - RNA, 64 nt, Homo Sapiens
uucaucuuauaaaguauaugacaagugauucguuaucacguaagcaaaugucuauaauuuugaa

SEQ ID NO: 124434 - RNA, 64 nt, Homo Sapiens
ccuaugaaccuagaacuugaagugacuccuacuuaucacguaaauuuuuaugucugauaucaaa

SEQ ID NO: 124435 - RNA, 64 nt, Homo Sapiens
guggggaggggaguuccaagcuaaaauguaaauaaucacguauugagccgggauuguccaauua

SEQ ID NO: 124436 - RNA, 64 nt, Homo Sapiens; identical to SEQ ID NO: 121771

SEQ ID NO: 124437 - RNA, 64 nt, Homo Sapiens; identical to SEQ ID NO: 121772

SEQ ID NO: 124438 - RNA, 64 nt, Homo Sapiens; identical to SEQ ID NO: 121773

SEQ ID NO: 124439 - RNA, 64 nt, Homo Sapiens; identical to SEQ ID NO: 121774

SEQ ID NO: 124440 - RNA, 64 nt, Homo Sapiens; identical to SEQ ID NO: 121775

SEQ ID NO: 124441 - RNA, 64 nt, Homo Sapiens; identical to SEQ ID NO: 121776

SEQ ID NO: 124442 - RNA, 64 nt, Homo Sapiens; identical to SEQ ID NO: 121777

SEQ ID NO: 124443 - RNA, 64 nt, Homo Sapiens; identical to SEQ ID NO: 121778

SEQ ID NO: 124444 - RNA, 64 nt, Homo Sapiens; identical to SEQ ID NO: 121779

SEQ ID NO: 124445 - RNA, 64 nt, Homo Sapiens; identical to SEQ ID NO: 121780

SEQ ID NO: 124446 - RNA, 64 nt, Homo Sapiens; identical to SEQ ID NO: 121781

SEQ ID NO: 124447 - RNA, 64 nt, Homo Sapiens; identical to SEQ ID NO: 121782

SEQ ID NO: 124448 - RNA, 64 nt, Homo Sapiens; identical to SEQ ID NO: 121783

SEQ ID NO: 124449 - RNA, 64 nt, Homo Sapiens; identical to SEQ ID NO: 121784

SEQ ID NO: 124450 - RNA, 64 nt, Homo Sapiens; identical to SEQ ID NO: 121785

SEQ ID NO: 124451 - RNA, 64 nt, Homo Sapiens; identical to SEQ ID NO: 121786

SEQ ID NO: 124452 - RNA, 64 nt, Homo Sapiens; identical to SEQ ID NO: 121787

SEQ ID NO: 124453 - RNA, 64 nt, Homo Sapiens; identical to SEQ ID NO: 121788

SEQ ID NO: 124454 - RNA, 64 nt, Homo Sapiens; identical to SEQ ID NO: 121789

SEQ ID NO: 124455 - RNA, 64 nt, Homo Sapiens; identical to SEQ ID NO: 121790

SEQ ID NO: 124456 - RNA, 64 nt, Homo Sapiens
auggacuguaucuuaugcaucucuguauuucugcgccuagcacggugccuagcacacaguaggc

SEQ ID NO: 124457 - RNA, 64 nt, Homo Sapiens
uuaugcaucucuguauuucugcgccuagcacggugccuagcacacaguaggcgcucaauaaaug

SEQ ID NO: 124458 - RNA, 62 nt, Homo Sapiens
guuuuuuuaaaaauaucuuuuucuccucucagcucauacauaacacaaggcagaaaucugga

SEQ ID NO: 124459 - RNA, 62 nt, Homo Sapiens
aauuuucauuuuaaagcacaccugagaugauucucauacaaccgaaauuuuagauccauagc

SEQ ID NO: 124460 - RNA, 62 nt, Homo Sapiens
agagagggaaggcugccaggucuugcuuuuggcucauacagggcagggaggggugccaugag

SEQ ID NO: 124461 - RNA, 62 nt, Homo Sapiens
ccucgugcuuucccaucuccccgguuccucgacucauacauccacacccccacaccccuuug

SEQ ID NO: 124462 - RNA, 62 nt, Homo Sapiens
cuugaagaguagaaacaauuguauuuugaagucucauacaagcugucugauagagaacuuuc

SEQ ID NO: 124463 - RNA, 62 nt, Homo Sapiens
aauacugugguugccucuaugugcuguuuuuccucauacaaguaaacacagaaagucaaauu

SEQ ID NO: 124464 - RNA, 62 nt, Homo Sapiens
acuuugucuucuuucucccuuucccuccuucccucauacauugcuuucucucccucuccugc

SEQ ID NO: 124465 - RNA, 62 nt, Homo Sapiens
ggaaaacacuaagugaaacuguuuacaauaaccucauacaaccuucugucccaucuccuggu

SEQ ID NO: 124466 - RNA, 64 nt, Homo Sapiens
gauuccccaaguggaaacuaggucagccuccccaaaaucacaugccuuuggggaaaaggguggg

SEQ ID NO: 124467 - RNA, 64 nt, Homo Sapiens
aaaccuaauucaaacuggcugaucuuuugguuuuaaaucacagaugaugaauauauagguuagg

SEQ ID NO: 124468 - RNA, 64 nt, Homo Sapiens
uaguugcuuuauaugcuuuaccuucuaggucuuaaaaucacacauuggaaaaugacaauaucaa

SEQ ID NO: 124469 - RNA, 64 nt, Homo Sapiens
ugauaugguuacuucuauguugaaauaaaauuuaaaaucacaugcaaaaaaaaaaucagcaaaa

SEQ ID NO: 124470 - RNA, 64 nt, Homo Sapiens
aaacaguuacaagccuccaaauucaaauaaaauuaaaucacaguucagaugaaacugaauauca

SEQ ID NO: 124471 - RNA, 64 nt, Homo Sapiens
caaaacauggaaaauaaguuuagugcacauagcuaaaucacaaaacauccaauuucucuguuuc

SEQ ID NO: 124472 - RNA, 64 nt, Homo Sapiens
guauaaucagcacuuugccaugcucagaaaauucaaaucacauggaacuuuagagguagauuua

SEQ ID NO: 124473 - RNA, 64 nt, Homo Sapiens
agauaggagugaauacaccuaccuggugccuugaaaaucacaucaaguaguuaauuaucuaccc

SEQ ID NO: 124474 - RNA, 64 nt, Homo Sapiens
uaucauguuucaguaaaugcacccuaggacauaaaaaucacauacugaguaggcuuguauuggu

SEQ ID NO: 124475 - RNA, 64 nt, Homo Sapiens
ucuuuccucaaacuuuaaauucaggcuggcaaagaaaucacagggcugugccuagaacaaagaa

SEQ ID NO: 124476 - RNA, 64 nt, Homo Sapiens
guucaggacagaaacaagauaagugacuuccucaaaaucacaugaucugaagcucacaaagaug

SEQ ID NO: 124477 - RNA, 64 nt, Homo Sapiens
cuguccagauuccucuuguauuuucaaccugaacaaaucacauuccagggccuuaauuuuuccc

SEQ ID NO: 124478 - RNA, 64 nt, Homo Sapiens
cacacccuccccgccacagaaagacacagacacaaaaucacacacauacacagacacacacaga

SEQ ID NO: 124479 - RNA, 64 nt, Homo Sapiens
cacacccuccccgccacagacacacacagacacaaaaucacacacacagacacacacagaaaga

SEQ ID NO: 124480 - RNA, 64 nt, Homo Sapiens
cacccccuccccaccacagacccguccccaccucaaaucacacaugaguaacugaagccuaggc

SEQ ID NO: 124481 - RNA, 64 nt, Homo Sapiens
ucccaggagcugcccagaguugcugggagcugaaaaaucacauccuggccuggcacaucagaaa

SEQ ID NO: 124482 - RNA, 64 nt, Homo Sapiens
ccacaauauaaaacuguacuucacugucaggaagaaaucacagaaucauaugauucugcuuuua

SEQ ID NO: 124483 - RNA, 64 nt, Homo Sapiens
acuacaaaauggggagaaaauuuugcuaauaggaaaaucacauuuacaggggcuggugaccucu

SEQ ID NO: 124484 - RNA, 64 nt, Homo Sapiens
aagaauaaauagagcuuuuuuucaucugugcaucaaaucacaaauguuauuguguguuaaguuu

SEQ ID NO: 124485 - RNA, 64 nt, Homo Sapiens
guagcauaaaucaguaaauuagugauaacacgcaaaaucacaaaccccuuuuagagcauccgga

SEQ ID NO: 124486 - RNA, 64 nt, Homo Sapiens
ucauuacuuuugcaacaccauaauauggauuuuuaaaucacaugccugaaacuauggucuacau

SEQ ID NO: 124487 - RNA, 64 nt, Homo Sapiens
acacuccaaccacauuccaagcugagauaaaaucaaaucacaaauguuuaaccacuuugcugcu

SEQ ID NO: 124488 - RNA, 64 nt, Homo Sapiens
cacaaaguaguccauuccugaucucacuuaaaauaaaucacaaguaaauuugaauuuucgguuu

SEQ ID NO: 124489 - RNA, 64 nt, Homo Sapiens
uaguuccuuaagaauaaucuaguuauauuuuuugaaaucacauauaauuagacuuuauaauaua

SEQ ID NO: 124490 - RNA, 64 nt, Homo Sapiens
cacuaauacuguggugagugauuuuacucaaaggaaaucacacuauuaagcagcuugguuuuga

SEQ ID NO: 124491 - RNA, 64 nt, Homo Sapiens
aaaauugucauuuaggauaacacuuuuaugacccaaaucacaauacauauaaacaauuauuuau

SEQ ID NO: 124492 - RNA, 64 nt, Homo Sapiens
caaaaaggagaucuguauucuuaucaucauacaaaaaucacaaauuguagaggcagaggcaaag

SEQ ID NO: 124493 - RNA, 64 nt, Homo Sapiens
cgguuauauaaucauugagcauuguguugaaucuaaaucacauuuuauggggauuucuaugagu

SEQ ID NO: 124494 - RNA, 64 nt, Homo Sapiens
uugaaagacaggagaauucaaaguugucagucacaaaucacagccaaaugugaagacugugaca

SEQ ID NO: 124495 - RNA, 64 nt, Homo Sapiens
guugugcaccaggaacacaagcacuucccucuggaaaucacaguaguaucuuaaguuuaacugg

SEQ ID NO: 124496 - RNA, 64 nt, Homo Sapiens
uuugaugugugcuaauuauguagugauaucugugaaaucacagguauaucauuuucaucccaag

SEQ ID NO: 124497 - RNA, 64 nt, Homo Sapiens
ucacauuuaaauugcagacauaauggcucccaaauuccaucacauucucuuuaaaucagauuug

SEQ ID NO: 124498 - RNA, 64 nt, Homo Sapiens
ccuuugccaacucagguucaugaaaaccaguggcuuccaucaaaugauuacccagagauaucua

SEQ ID NO: 124499 - RNA, 64 nt, Homo Sapiens
ugggucauugaucccuggcucagaggauagcgguuuccaucauaaaccaagaugaugaguucag

SEQ ID NO: 124500 - RNA, 64 nt, Homo Sapiens
cuuccuccuguucccugggucagaggauagcgguuuccaucauaaaccaagaugaugaguucag

SEQ ID NO: 124501 - RNA, 64 nt, Homo Sapiens
ucaaaccacaaacaaaauuaagcagaggaguauuuuccaucauuuuccaucagcccugaaggac

SEQ ID NO: 124502 - RNA, 64 nt, Homo Sapiens
ccugaaggacagcagaggagcugagcacacaagauuccaucagcggucacaacacaacuguguc

SEQ ID NO: 124503 - RNA, 64 nt, Homo Sapiens
ccacagaaugucugaauucuugcauucuuuacccuuccaucacuauauugauucuuuuuuuaaa

SEQ ID NO: 124504 - RNA, 64 nt, Homo Sapiens
cuggcauugcgggaggugcucugcugcacagcuguuccaucaggcccuauuggccucuguuaga

SEQ ID NO: 124505 - RNA, 64 nt, Homo Sapiens
agagcuuaauuaaguuuuagaaauauguaauaccuuccaucauuccaucauccuuaaauucugu

SEQ ID NO: 124506 - RNA, 64 nt, Homo Sapiens
auuaaguuuuagaaauauguaauaccuuccaucauuccaucauccuuaaauucuguuaccaaau

SEQ ID NO: 124507 - RNA, 64 nt, Homo Sapiens
aaaugcucuauuuuacucuuaagcacuuuuguuauuccaucaauuuuugaagaauauuuaagaa

SEQ ID NO: 124508 - RNA, 64 nt, Homo Sapiens
uuacagugaccuuuucuucaucuacagauccuuuuuccaucauuuuugaaauacuaaaagcaaa

SEQ ID NO: 124509 - RNA, 64 nt, Homo Sapiens
uuccccuuuugacguaucagaaaaccugucagcauuccaucauugagaugguaaguuaacugau

SEQ ID NO: 124510 - RNA, 64 nt, Homo Sapiens
cccauaaaauuaugaaccuugaggaagguguuaguuccaucagcucauccugugcagaggauga

SEQ ID NO: 124511 - RNA, 64 nt, Homo Sapiens
ccaaccucuccuuucugugcacauauguaauucuuuccaucaccccaugguaaccagccacagu

SEQ ID NO: 124512 - RNA, 64 nt, Homo Sapiens
aucguuguuauuaaagaauccaaacaggcuguaauuccaucaucaaaguugaaaagccaaaggu

SEQ ID NO: 124513 - RNA, 64 nt, Homo Sapiens
auaaugauuugagauuugucuaugaaugguuucuuuccaucagccgucauguacuguguauucu

SEQ ID NO: 124514 - RNA, 64 nt, Homo Sapiens
ccagaagguucucuuguauaaagcuucagaauauuuccaucaccauguaaccaacacuccaguc

SEQ ID NO: 124515 - RNA, 64 nt, Homo Sapiens
uugaacaauagcuuuagcuuugcccccuacauauuuccaucaccgcagcugcaaaaugguuuaa

SEQ ID NO: 124516 - RNA, 64 nt, Homo Sapiens
cuguuuccuaaaggauguguagcccugcagaaaguuccaucaggcuccgagcucagacagagga

SEQ ID NO: 124517 - RNA, 64 nt, Homo Sapiens
ucuuaaacucauuucacuucguuauuaucaguuuuuaauuuaguaaaaauauuuacuaguugaa

SEQ ID NO: 124518 - RNA, 64 nt, Homo Sapiens
auaaugagagcauuuuuuuaaggauauaggagacuuaauuuauaccaaguuuuaggaacauguu

SEQ ID NO: 124519 - RNA, 63 nt, Homo Sapiens
aggcuuugcuggauucuuuuaauaaaguuaccaauuaauuuaaguauagaugcuauuguuauu

SEQ ID NO: 124520 - RNA, 64 nt, Homo Sapiens
cuuaccaccucauuugcuuuaaggagaggagcuuuuaauuuacacucaugguguuccccucuua

SEQ ID NO: 124521 - RNA, 64 nt, Homo Sapiens
gaagauuauuauuuaugucuguacuguauauuacuuaauuuauuauugucacugacauuuaaug

SEQ ID NO: 124522 - RNA, 64 nt, Homo Sapiens
aguccauaucacauugcaaauucuguuguacaguuuaauuuagcaugauauguuuucucagauu

SEQ ID NO: 124523 - RNA, 64 nt, Homo Sapiens
uauuuaauaauauuuauauuaugaaccaugucuauuaauuuaaugaucauauuuauuuauuuau

SEQ ID NO: 124524 - RNA, 64 nt, Homo Sapiens
gauuuguaaagugauguuccguuuguuuauuuguuuaauuuaauggguugguucuuuggguucu

SEQ ID NO: 124525 - RNA, 64 nt, Homo Sapiens
caaagacuaaaaucaaccauuauauuuuaauuuuuuaauuuaagguacaguauauauauguaua

SEQ ID NO: 124526 - RNA, 64 nt, Homo Sapiens
uuuggcauaccagugaaugaugaagaacaugagauuaauuuaauuuaucuucgguaacuugaca

SEQ ID NO: 124527 - RNA, 64 nt, Homo Sapiens
cauaccagugaaugaugaagaacaugagauuaauuuaauuuaucuucgguaacuugacauucug

SEQ ID NO: 124528 - RNA, 64 nt, Homo Sapiens
aacaguagcacuuugaaaacuuuuuaggccagcuuuaauuuaauggcccuacugauauucacau

SEQ ID NO: 124529 - RNA, 64 nt, Homo Sapiens
accauuucuguuagaacgaugucaauucaugcuuuuaauuuagcaucaauagaaaauugcugua

SEQ ID NO: 124530 - RNA, 64 nt, Homo Sapiens
agaagcaaagcaggccaauagaaaugcaauauuuuuaauuuauucuacugaaaugguuuaaaau

SEQ ID NO: 124531 - RNA, 64 nt, Homo Sapiens
aaagaaaaaaugguaguaauugagcagaaaaaaauuaauuuauauauguauugauuggcaacca

SEQ ID NO: 124532 - RNA, 64 nt, Homo Sapiens
cauucuuagaguagagcagaguuuuuaguuaguauuaauuuauuuuccuccauucauguacuuu

SEQ ID NO: 124533 - RNA, 64 nt, Homo Sapiens
auguaaccaaaucuagauaauuucaaaguugucauuaauuuaguaagccuaauauaaacaaaua

SEQ ID NO: 124534 - RNA, 64 nt, Homo Sapiens
uagauauuuucacaaugucaguauuucaguguaguuaauuuaucuaaauuaaagccuuuaguau

SEQ ID NO: 124535 - RNA, 64 nt, Homo Sapiens
gcuguguuuaauuugacuucucugccuuugacauuuaauuuagugaucuuagcauagcuuauua

SEQ ID NO: 124536 - RNA, 64 nt, Homo Sapiens
aauccagacuugggggucauguuuucuuagccuguuaauuuaaaucuauaucaauguguccuua

SEQ ID NO: 124537 - RNA, 64 nt, Homo Sapiens
uucuuggugcaaaugugugccagacaucuaugcauuaauuuaaauaacuucaugcagaauuuca

SEQ ID NO: 124538 - RNA, 64 nt, Homo Sapiens
uaaacuaaguaaauacuuuuauuuuuauuugcaauuaauuuauuaggcuauauauuguagcuua

SEQ ID NO: 124539 - RNA, 64 nt, Homo Sapiens
cuauuacaaaacuguucugagugguagcauaccuuuaauuuaucacuguagcaaaguuuuauau

SEQ ID NO: 124540 - RNA, 64 nt, Homo Sapiens
auacuugauucagaaacaaaguaguagguuggcuuuaauuuaauauauguagcuuucuauauau

SEQ ID NO: 124541 - RNA, 64 nt, Homo Sapiens
uuucuucaucuuuuauaacaaagggguuggcuuuuuaauuuauuucaaugugguggagaaaggg

SEQ ID NO: 124542 - RNA, 64 nt, Homo Sapiens
agaucacuuacaggaucaugcgguuucugauuauuuaauuuaaauauaagaauaaauuuggacc

SEQ ID NO: 124543 - RNA, 64 nt, Homo Sapiens
aauaaagugaguuuaccaaaagaagagggccagcuuaauuuaaaugacuguuguaauggaguaa

SEQ ID NO: 124544 - RNA, 64 nt, Homo Sapiens
guuuugaagaaauagucuccugauaaagcucuguuuaauuuagauauauugcuguaaacuuaau

SEQ ID NO: 124545 - RNA, 64 nt, Homo Sapiens
caacaagcauguuugugcaacacacaaaaaauguuuaauuuaugguagaauauugcaaauuaac

SEQ ID NO: 124546 - RNA, 64 nt, Homo Sapiens
gugcaaaugcugguauuucugggaagagggagaauuaauuuauuugguaaggacucugguacca

SEQ ID NO: 124547 - RNA, 64 nt, Homo Sapiens
uccucuaaucuuucuacaugggacaauuuccaauuuaauuuagagggagaagauugaugcaaua

SEQ ID NO: 124548 - RNA, 64 nt, Homo Sapiens
uaguuuuuaauuauuauuaauauaaaggaucaaauuaauuuaaauaugauucugaagucuacag

SEQ ID NO: 124549 - RNA, 64 nt, Homo Sapiens
auuggucuggugagauguuucauauuugugacaguuaauuuaaaaauuaugaguuaaugcugcc

SEQ ID NO: 124550 - RNA, 64 nt, Homo Sapiens
aaaaaaaaagaaguggguaagacuaccucggcuuuuaauuuaaauaggguuuuauuaucccagg

SEQ ID NO: 124551 - RNA, 64 nt, Homo Sapiens
caacuucaucaaucacuuuagauaauccauauguuuaauuuauuggaaggaaaggucuuugugg

SEQ ID NO: 124552 - RNA, 64 nt, Homo Sapiens
uaugaaauaaugguuuccaugcauuugugauuaauuaauuuauauuccuucuuagccauggaga

SEQ ID NO: 124553 - RNA, 64 nt, Homo Sapiens
uuacauguuucauauuuaaaaucaugccacuauauuaauuuauaugcaucgagaaccugaauaa

SEQ ID NO: 124554 - RNA, 64 nt, Homo Sapiens
auuagauuauugcagaacaacccucuguaaauuauuaauuuaucucucuagcaacuuaauuuug

SEQ ID NO: 124555 - RNA, 64 nt, Homo Sapiens
uauuaauagaugguuuauuuacuaugguaauguauuaauuuauuuuugguguuguucgauuguc

SEQ ID NO: 124556 - RNA, 64 nt, Homo Sapiens
acaggucaaaauaaaaguugaacuugaguuacauuuaauuuaaauauaaaugcauuuugagaaa

SEQ ID NO: 124557 - RNA, 64 nt, Homo Sapiens
uguauaauuauaugaaugugauguuuauugcuuauuaauuuauaauucagucauucucuauaua

SEQ ID NO: 124558 - RNA, 64 nt, Homo Sapiens
uccagaacuaaacaagucccuaaguuuccuuauuuuaauuuacugugacuagauuugaagcaaa

SEQ ID NO: 124559 - RNA, 64 nt, Homo Sapiens
cauauaauaaauagaaauuuuguuaacauggaauuuaauuuaugugaaagaguucuggauucaa

SEQ ID NO: 124560 - RNA, 64 nt, Homo Sapiens
uauauggaagauaauuuuauguguuauaguaggauuaauuuauuuaguugugcagucaguguca

SEQ ID NO: 124561 - RNA, 64 nt, Homo Sapiens
uauaauuuacuguguguuccuuuuaaauuuuuaauuaauuuauuuguauuggaaauaucuaguu

SEQ ID NO: 124562 - RNA, 64 nt, Homo Sapiens
uauauguuauuauaauuuuguacuuaaauuuucuuuaauuuacuuuaaaauacucacauauuuu

SEQ ID NO: 124563 - RNA, 64 nt, Homo Sapiens
uuuuugagacagagucuuguuaauuuuuaauuaauuaauuuauucauuuuacuuauggcuuuuc

SEQ ID NO: 124564 - RNA, 64 nt, Homo Sapiens
cugaaauuggauugacuuacagauuaugaagucauuaauuuauaagaaaaaucaaauaccuuag

SEQ ID NO: 124565 - RNA, 64 nt, Homo Sapiens
cuuaccuaagaagaugagaaaagaugaacaaagguuaauuuaaauaauuauuuaaaacucuaga

SEQ ID NO: 124566 - RNA, 64 nt, Homo Sapiens
cuaaucuucauauuuacuguucuaauacauuuuauuaauuuauaucuucucagagagccuaaau

SEQ ID NO: 124567 - RNA, 64 nt, Homo Sapiens
ucauagaggccacccagaugcuauggguaauuaauuaauuuauucaugccuccuagaaacuaca

SEQ ID NO: 124568 - RNA, 64 nt, Homo Sapiens
gcuaaaauauuuuuuaaaaucauuauggccauuuuuaauuuacagcugaagucugccaagggua

SEQ ID NO: 124569 - RNA, 64 nt, Homo Sapiens
uaggagauuuaacacuagggaagagcaccaaguuuuaauuuaaaccaucaguuucugaguaaca

SEQ ID NO: 124570 - RNA, 64 nt, Homo Sapiens
uuagagugaaaaauaaaugguaaauacauacauauuaauuuacauuuauguauguguauguacg

SEQ ID NO: 124571 - RNA, 64 nt, Homo Sapiens
uacgauaucuagagcuguguaucugcuuuuuaaauuaauuuauuuguucaacacagugaagauu

SEQ ID NO: 124572 - RNA, 64 nt, Homo Sapiens
ucuaauugagccaguuagacaaaggaugaacaaauuaauuuauuuauucagcuacuauacagaa

SEQ ID NO: 124573 - RNA, 64 nt, Homo Sapiens
uuuuacuauuuaacccuguaacaauuuuaauauuuuaauuuauuucuuuugaaaauauauauuc

SEQ ID NO: 124574 - RNA, 64 nt, Homo Sapiens
uuuuuuuuuugucuucuggaaugaauuuuauguuuuaauuuaugucaggacucugagucugauc

SEQ ID NO: 124575 - RNA, 64 nt, Homo Sapiens
ggaagaaaaaaaaucaacccuagucuagggccacuuaauuuagagaauaacugaacaaauauau

SEQ ID NO: 124576 - RNA, 64 nt, Homo Sapiens
aaaauucaucaucagguuucuguuauaaggguuauuaauuuaaugauaguauuacauuugaaau

SEQ ID NO: 124577 - RNA, 64 nt, Homo Sapiens
aaauauuguuaauuaaaauuugauaagaauaaauuuaauuuaccgacaaaauuaaaagaaggaa

SEQ ID NO: 124578 - RNA, 64 nt, Homo Sapiens
acauuggcuuuauuucauuugcagauuuacauauuuaauuuaaaggauauuaaauaagucccag

SEQ ID NO: 124579 - RNA, 64 nt, Homo Sapiens
uuuuugagagguugagucuccccauguuacuaaauuaauuuauguaaaaauaaaauccuuccuu

SEQ ID NO: 124580 - RNA, 64 nt, Homo Sapiens
gaacuauaagucaguuauauuguaccaauuucuuuuaauuuaaauugggauuauacuuccuuuc

SEQ ID NO: 124581 - RNA, 64 nt, Homo Sapiens
ugagcaugucccuaagauaaaccagaauuggcaguuaauuuaggcgucuagaaaaucucaguuc

SEQ ID NO: 124582 - RNA, 64 nt, Homo Sapiens
uucuagcaaaggaaggguagaaaggaauugaaaauuaauuuacacuaguugcuacuugggaaua

SEQ ID NO: 124583 - RNA, 64 nt, Homo Sapiens
uuuauggcauuugagauugaaacuaagaaauguuuuaauuuauuaccuuuacaacauuuauuua

SEQ ID NO: 124584 - RNA, 64 nt, Homo Sapiens
uauuuacauuacauacauacauuuacaacauuuauuaauuuauauuaaaauagcaugaauaagc

SEQ ID NO: 124585 - RNA, 64 nt, Homo Sapiens
uuuaaauuuguuaggucugaagaaucuaaaacuguuaauuuaacccuuaacuugugccuagaaa

SEQ ID NO: 124586 - RNA, 64 nt, Homo Sapiens
uagaaaauagaaaugccaguaaacaacauaauguuuaauuuacaacuuacauuagggguuuggg

SEQ ID NO: 124587 - RNA, 64 nt, Homo Sapiens
acaggaacaggcaugaagauauugccauacaauuuuaauuuauacaaguauuggccccucaagu

SEQ ID NO: 124588 - RNA, 64 nt, Homo Sapiens
gaaauucugcugguuaacuuuaucucucucucucuuaauuuagacuuucaaccuaugaaaaugu

SEQ ID NO: 124589 - RNA, 64 nt, Homo Sapiens
ugucuuuaaugucuucagacaaaaaagccuuacauuaauuuaauguuugcacucugaggugcaa

SEQ ID NO: 124590 - RNA, 64 nt, Homo Sapiens
ccuuugucuugugcaaacauguagaauaugcucuuuaauuuaguaaaauauuuuuuuaaaaggu

SEQ ID NO: 124591 - RNA, 64 nt, Homo Sapiens
aauuaauaauuacauaccuuuauagauuuugaaauuaauuuaaauauuaguauuugguacauga

SEQ ID NO: 124592 - RNA, 64 nt, Homo Sapiens
guguuuggauuguauauauggugcuaaaaauaaauuaauuuacuuuauaaaccuuaucuguaca

SEQ ID NO: 124593 - RNA, 64 nt, Homo Sapiens
uuucuaaacgcuuacaacuuaucugccacucauauuaauuuacuugaauuugucauaaagcuaa

SEQ ID NO: 124594 - RNA, 64 nt, Homo Sapiens
aacuuuuguagauaauuuuuguuaauuuguuuuguuaauuuauguuuuuccuaauuuuaagcau

SEQ ID NO: 124595 - RNA, 64 nt, Homo Sapiens
gaaauggcuuuaaauuaauacucuuauuuuuuauuuaauuuaauuacauaaauuaaaccuuacc

SEQ ID NO: 124596 - RNA, 64 nt, Homo Sapiens
cacaaauuauguuauugaaaagcauuauuaauguuuaauuuauuuaaaauuuuggaauuugcca

SEQ ID NO: 124597 - RNA, 64 nt, Homo Sapiens
cacuagguuuuuuucuaauaauguuaaaggcuauuuaauuuauuuaaucaacuuuaagcauuac

SEQ ID NO: 124598 - RNA, 64 nt, Homo Sapiens
aucauccuauccaccaaaaucuuauuccuuaguauuaauuuaucucauugggaagaaauuugua

SEQ ID NO: 124599 - RNA, 64 nt, Homo Sapiens
cuuuccuuucaauuauagugaggacuuaauuuucuuaauuuauuaagucuuugugcauuuuagc

SEQ ID NO: 124600 - RNA, 64 nt, Homo Sapiens
aaguuaacaaucuggaaacuggguagcuucacauuuaauuuauaaagaggccuuguuuauauau

SEQ ID NO: 124601 - RNA, 64 nt, Homo Sapiens
aguacuaaaugguauccuuaguggaauaaauuuauuaauuuaguuuuuggcugucauuucaaaa

SEQ ID NO: 124602 - RNA, 64 nt, Homo Sapiens
gaacagaauugagaagaacguaaauuuaguaauuuuaauuuagucaucauggcucuuggcaguu

SEQ ID NO: 124603 - RNA, 64 nt, Homo Sapiens
aaguaugagcguuaggacacuauuuuaauuauuuuuaauuuauuaauauuuaaauaugugaagc

SEQ ID NO: 124604 - RNA, 64 nt, Homo Sapiens
uuaauuuauuaauauuuaaauaugugaagcugaguuaauuuauguaagucauauuuauauuuuu

SEQ ID NO: 124605 - RNA, 64 nt, Homo Sapiens
ccuugggacuccacaacaacaacaacaacaaaauuuaauuuaauuuaaaaauagccccagucgu

SEQ ID NO: 124606 - RNA, 64 nt, Homo Sapiens
ggacuccacaacaacaacaacaacaaaauuuaauuuaauuuaaaaauagccccagucgucauca

SEQ ID NO: 124607 - RNA, 64 nt, Homo Sapiens
aaauaaauuguauauauucauauuuugaaugacauuaauuuauuugcaccauguucuggcacug

SEQ ID NO: 124608 - RNA, 64 nt, Homo Sapiens
aacaagcauuacuguagagucaggucauuacaucuuaauuuaauaagauuuagaguggguuaac

SEQ ID NO: 124609 - RNA, 64 nt, Homo Sapiens
gcauauccuuuuuauuaucuuuugagcugccuuuuuaauuuauuaacugcaugccugccccuua

SEQ ID NO: 124610 - RNA, 64 nt, Homo Sapiens
uucaguuuaaucuguggauuccaaaacugaagucuuaauuuacccacagaaaaguuggaaauaa

SEQ ID NO: 124611 - RNA, 64 nt, Homo Sapiens
gaaucugguuuuggacaaugaguauaguuugccauuaauuuauucuccccuggacuagaaaucc

SEQ ID NO: 124612 - RNA, 64 nt, Homo Sapiens
uucacugucacacgcauagacgucucacggcguuuuaauuuauuaggcaguucuucuuagguuc

SEQ ID NO: 124613 - RNA, 64 nt, Homo Sapiens
uagaguccuuuuuuccaaagaaugaauugucuaauuaauuuaugauuuugagauuuuauuuaga

SEQ ID NO: 124614 - RNA, 64 nt, Homo Sapiens
aaaaauuuccaaauauuuguaagugggaacauuuuuaauuuaaaauagcgagcucaaagcaauu

SEQ ID NO: 124615 - RNA, 58 nt, Homo Sapiens
gaaaagaauuccuuaccuauuuuucuacuuaauuuaaacuagagcuguagccacguag

SEQ ID NO: 124616 - RNA, 64 nt, Homo Sapiens
aaaucacagauugguaaauguuuaacaaauuugguuaauuuauagucuaugaauuucuucuuaa

SEQ ID NO: 124617 - RNA, 64 nt, Homo Sapiens
aaauuugguuaauuuauaaacuaugaauuucuucuuaauuuaacuaacaggaaaaaaauggugu

SEQ ID NO: 124618 - RNA, 64 nt, Homo Sapiens
ugcuuguaaaauuaaaccaucaucuagaauagaguuaauuuauuauaaucaagcuacaaauagg

SEQ ID NO: 124619 - RNA, 64 nt, Homo Sapiens
aucuauacuguuuuggcaaguuugcauuuuaguauuaauuuauaauuagggauuguucaaacuu

SEQ ID NO: 124620 - RNA, 64 nt, Homo Sapiens
aaacuaguuacauuauaaacgguuucaaacauguuuaauuuacauuagguuuuuauguaagagu

SEQ ID NO: 124621 - RNA, 64 nt, Homo Sapiens
gcguuuuccuaauuuuaguacuuaauuucucuuuuuaauuuaagugaucuuucuaauucgaaag

SEQ ID NO: 124622 - RNA, 64 nt, Homo Sapiens
cagacacuguguaacaacaccugggucaacucuuuuaauuuauauacaaagcaaagaacaacau

SEQ ID NO: 124623 - RNA, 64 nt, Homo Sapiens
cuuugguuguuuuccuguaauauaaaagaaaaaguuaauuuaucaauugauugaauacaguuuu

SEQ ID NO: 124624 - RNA, 64 nt, Homo Sapiens
cggacaccaccauaaaaauggaaucaaaagaaaguuaauuuaugaaauuaagaggucagcagaa

SEQ ID NO: 124625 - RNA, 64 nt, Homo Sapiens
uugggaaagucuuuuuaauagaacaagaacgaucuuaauuuaagaauauuauccugguuuaaca

SEQ ID NO: 124626 - RNA, 64 nt, Homo Sapiens
aauaaguauauuuagaacuuguuaaaaauacauuuuaauuuaugauauacauauuauuuuaauu

SEQ ID NO: 124627 - RNA, 64 nt, Homo Sapiens
agucuauaacaugaaaugauuauuaaauuguuuauuaauuuagagcuauaagaggaacuuauuu

SEQ ID NO: 124628 - RNA, 64 nt, Homo Sapiens
uguguuugcauaguuugagcgcuaugacuucagguuaauuuauucauauuuauuacuauaauuu

SEQ ID NO: 124629 - RNA, 64 nt, Homo Sapiens
agaaaucucuuaccaaccuaguuauauauuuuauuuaauuuaaacuaaauauuuuaacaaguuu

SEQ ID NO: 124630 - RNA, 64 nt, Homo Sapiens
uuccaauaggauuuaaauaguacaaguguguuuauuaauuuauuuuugaagucugccguauuuu

SEQ ID NO: 124631 - RNA, 64 nt, Homo Sapiens
ggcguuuuuuggggauguggcaaauguuguccuguuaauuuauagaccauuauucacaggugga

SEQ ID NO: 124632 - RNA, 64 nt, Homo Sapiens
ugcuuugaagcauagcuacaaauuggaauccuccuuaauuuaauauugcuaagagggcccaaag

SEQ ID NO: 124633 - RNA, 64 nt, Homo Sapiens
ccuaguaccuuuggcugcuaaggcagcagcauguuuaauuuauaacaacacaaaccucugagag

SEQ ID NO: 124634 - RNA, 64 nt, Homo Sapiens
uucaggugugcuugguuuauuauauuuagucaaguuaauuuagucgaaugugguaacauuuuuc

SEQ ID NO: 124635 - RNA, 64 nt, Homo Sapiens
aacagcauugauagguuaaagaagcuugguauuuuuaauuuacuucaaugauuagcucaguugc

SEQ ID NO: 124636 - RNA, 64 nt, Homo Sapiens
uguauauuguagauuuuuuucauucauguguuauuuaauuuacacugaucucugcuauuuuaac

SEQ ID NO: 124637 - RNA, 64 nt, Homo Sapiens
auuuuugugagugaccaccuuugcaauauguuuguuaauuuacuucauguuggguucuuucuga

SEQ ID NO: 124638 - RNA, 64 nt, Homo Sapiens
cugccauuuuuuccuacuauaauaaugcugaaucuuaauuuagaggguacaaggguaugguaau

SEQ ID NO: 124639 - RNA, 64 nt, Homo Sapiens
acauaguaaucuuuagcuuuuuauacaaauauauuuaauuuaggaguauaugugugucuauaca

SEQ ID NO: 124640 - RNA, 64 nt, Homo Sapiens
aacugcauuuuaagucagacaguaaauguuuuuuuuaauuuacagcaaaugaagcaguuuuauu

SEQ ID NO: 124641 - RNA, 64 nt, Homo Sapiens
uuuaaaaaauaaaaaccacuacuguuacauuuuauuaauuuaaaaagcuagaaaauucauguag

SEQ ID NO: 124642 - RNA, 64 nt, Homo Sapiens
uauuacucccaauugaauuaucuaccucauuuuguuaauuuaauuuaucaaagguaacauuguu

SEQ ID NO: 124643 - RNA, 64 nt, Homo Sapiens
cucccaauugaauuaucuaccucauuuuguuaauuuaauuuaucaaagguaacauuguuuucuc

SEQ ID NO: 124644 - RNA, 64 nt, Homo Sapiens
auuucaaaugaagauuccugccuuaaaauauuuuuuaauuuaauggucaguauauuuuguaaaa

SEQ ID NO: 124645 - RNA, 64 nt, Homo Sapiens
aauuuaauggucaguauauuuuguaaaaaucauguuaauuuauuucauaguugacauuaauauc

SEQ ID NO: 124646 - RNA, 64 nt, Homo Sapiens
cuuugcagauacauacuuaucgagcaaauaaaacuuaauuuaauagauuauuguaaaaugagag

SEQ ID NO: 124647 - RNA, 64 nt, Homo Sapiens
auuaaauuuaguucuaucauauuuaguucuaucauuaauuuaucgaaugacuuuuuccuuuuaa

SEQ ID NO: 124648 - RNA, 64 nt, Homo Sapiens
uggagccuuucauuauuuucaccaaaaaaccacauuaauuuaaacaaaacaaaaugaacacuug

SEQ ID NO: 124649 - RNA, 64 nt, Homo Sapiens
ccugaauuaguaccaggcagaauuguuggaaggguuaauuuauucaguuucuagacaauauccu

SEQ ID NO: 124650 - RNA, 64 nt, Homo Sapiens
aauucuuguuuuucaccuucaauuguugguggcauuaauuuaaucuugcuauuuauuuuuuuuc

SEQ ID NO: 124651 - RNA, 64 nt, Homo Sapiens
ugaagacauauuaaauaugauuguuguuguuuuuuuaauuuagguguuguuauuguuauuguug

SEQ ID NO: 124652 - RNA, 64 nt, Homo Sapiens
cuggcaaauuaagugagacucuucacuguuauuuuuaauuuaacugcaaugaauaauuuuccug

SEQ ID NO: 124653 - RNA, 64 nt, Homo Sapiens
aauuagaguauuugaaauagugacaucacagguauuaauuuacaguuaugaaaaagugucauug

SEQ ID NO: 124654 - RNA, 64 nt, Homo Sapiens
gaagaugcagaugauaaaacuaauuuugaacuuuuuaauuuauauaaauuauuuuauaucacuu

SEQ ID NO: 124655 - RNA, 64 nt, Homo Sapiens
ggauuagaauuuugaauuaauagcucuccuacuauuaauuuacaugugcuuuuuguguggcgcu

SEQ ID NO: 124656 - RNA, 64 nt, Homo Sapiens
ucuucccaggaauaguacuuaauagauuuuaauguuaauuuauauucauuguagaauugaauuu

SEQ ID NO: 124657 - RNA, 64 nt, Homo Sapiens
gcacaucagcugugaugacauuuugaggguaguuuuaauuuagcucgguucucuuguuggugcc

SEQ ID NO: 124658 - RNA, 64 nt, Homo Sapiens
aaccuuuaaaaauuuucucauuaagacaauguuuuuaauuuaauuugccucauuacaucuaaua

SEQ ID NO: 124659 - RNA, 64 nt, Homo Sapiens
aauuuuuuauauuuccuuacaauuuugguggccauuaauuuaacuuuaggcuuuugggcauaug

SEQ ID NO: 124660 - RNA, 64 nt, Homo Sapiens
cccauuuguaaacagaugaaauagcuugugcugauuaauuuaacgcagggcagacauacauaug

SEQ ID NO: 124661 - RNA, 64 nt, Homo Sapiens
auaucuaaaauaggauuuagcuaaaguuguucuuuuaauuuagcuuuugcaaauuuuuaucaua

SEQ ID NO: 124662 - RNA, 64 nt, Homo Sapiens
uaaacauuuucauuuuaaguuuaaacuggauggguuaauuuauaugaagcauagcaaaucuacu

SEQ ID NO: 124663 - RNA, 64 nt, Homo Sapiens
gcuguuuagaggggaaagcacaaggaaggcucuguuaauuuauaaaaaaucucagguaagaagg

SEQ ID NO: 124664 - RNA, 64 nt, Homo Sapiens
uuaccugggauguuucuuugucucaaaacugguguuaauuuaagaaugauaauaaaaaugguuu

SEQ ID NO: 124665 - RNA, 64 nt, Homo Sapiens
gaaaaauacaaauuuuuguaguguugcauugacuuuaauuuauuuagcacucuagcuugcaugg

SEQ ID NO: 124666 - RNA, 64 nt, Homo Sapiens
uguagcauauaggugauguuugcucuuguuuuuauuaauuuauauguauauuuuuuuaauuuaa

SEQ ID NO: 124667 - RNA, 64 nt, Homo Sapiens
gcucuuguuuuuauuaauuuauauguauauuuuuuuaauuuaacaugaacacccuuagaaaaug

SEQ ID NO: 124668 - RNA, 64 nt, Homo Sapiens
guguuauuccaggauauuuuacuuaaucuaaaaguuaauuuauguugcucauauauuacucaag

SEQ ID NO: 124669 - RNA, 64 nt, Homo Sapiens
gccauguaaguauuguauaaaaagauucacauuguuaauuuagccauuuugaaauucagaugag

SEQ ID NO: 124670 - RNA, 64 nt, Homo Sapiens
ccguguagguuguauacuuacauuuuuucuuuccuuaauuuauacaugauccuuuuuccuuaau

SEQ ID NO: 124671 - RNA, 64 nt, Homo Sapiens
uuucuuuccuuaauuuauacaugauccuuuuuccuuaauuuauacaugauccaggcacauuuga

SEQ ID NO: 124672 - RNA, 64 nt, Homo Sapiens
gccauucacuuaaauaauucaugaagggaaugguuuaauuuaaaggaagaccuaauaggaagaa

SEQ ID NO: 124673 - RNA, 64 nt, Homo Sapiens
uuuaaaaauuaauaacuuuuaguaauuacuuuuauuaauuuaaaauagaacgcuugagaggcac

SEQ ID NO: 124674 - RNA, 64 nt, Homo Sapiens
auagguuuuuuaaaauuaauauuaauaacuuuuauuaauuuaaaauagaaugcuuaaaauaaaa

SEQ ID NO: 124675 - RNA, 64 nt, Homo Sapiens
uuacauuguagaucauucuuuaauuuaaauuagguuaauuuauaaaguagguuaaauuaaaauc

SEQ ID NO: 124676 - RNA, 64 nt, Homo Sapiens
aguguuaacauuaaugcucaucguaagugaauacuuaauuuaaaugauaggacagugacaaaau

SEQ ID NO: 124677 - RNA, 64 nt, Homo Sapiens
accauacauuuuauuaaucaugauacauuuuauguuaauuuaccgcaguuacuuuguaucuaau

SEQ ID NO: 124678 - RNA, 64 nt, Homo Sapiens
uuuauuguuugaacaggaaguguuuucuuacuguuuaauuuauugcgcuaugaacugaaaaaua

SEQ ID NO: 124679 - RNA, 64 nt, Homo Sapiens
ggauuacaucugcaggauaagugcauauuucacauuaauuuaugaugcuguaaugaauauucuu

SEQ ID NO: 124680 - RNA, 64 nt, Homo Sapiens
cugcccuguccuaccugcucugaaugcuacuuucuuaauuuaauaugugacuggagcauggaag

SEQ ID NO: 124681 - RNA, 64 nt, Homo Sapiens
uuuuuaaaagcugugggucaaacuauaauaccucuuaauuuaccuuuuuuuuuuuuugcacugu

SEQ ID NO: 124682 - RNA, 64 nt, Homo Sapiens
uaaacuagcucauuauuuccugugauuuaggucauuaauuuagaugccguaauuuugauacauc

SEQ ID NO: 124683 - RNA, 64 nt, Homo Sapiens
ggcaauauuauuacuguuuacuccugacuuaccuuuaauuuagaguuaacaguugaguguucag

SEQ ID NO: 124684 - RNA, 64 nt, Homo Sapiens
uucuuaugaugguuuaaaccucaguuugcaauuuuuaauuuaugauauguauauuuuauugauu

SEQ ID NO: 124685 - RNA, 64 nt, Homo Sapiens
agauaacgugacuucaugagggagaaugucacuauuaauuuaucauaccauuuccaaaaagggc

SEQ ID NO: 124686 - RNA, 64 nt, Homo Sapiens
agcuuuagaguaaggaugagaaacuugaguguuuuuaauuuaaagauaaaagccuguguuuuac

SEQ ID NO: 124687 - RNA, 64 nt, Homo Sapiens
aaacuaucaacuguaaagcuccuuuucuuccacuuuaauuuaaaaguucaugucauuuaaaaac

SEQ ID NO: 124688 - RNA, 64 nt, Homo Sapiens
uugccaccauuggccauacuguguguuuguuuguuuaauuuacuuucacaauaaacuucugugu

SEQ ID NO: 124689 - RNA, 64 nt, Homo Sapiens
agaauugccuaauuuuuaguguuuuuugcugucuuuaauuuacuaaauugaaguucaaucuuaa

SEQ ID NO: 124690 - RNA, 64 nt, Homo Sapiens
uggcauuuuaggacauguacaaauuaaaaguuguuuaauuuacuacuuuuaauuuacacuuagu

SEQ ID NO: 124691 - RNA, 64 nt, Homo Sapiens
cuuaguaaauuaaaaguuguuucauuugauacuuuuaauuuacaaauuuuuuuaauucauguuu

SEQ ID NO: 124692 - RNA, 64 nt, Homo Sapiens
ggggaaggcgauguggugaccccacccccacccguuaauuuaaagcuguuucuaaacaguugag

SEQ ID NO: 124693 - RNA, 64 nt, Homo Sapiens
cuauucuuugaccaaacuguggguauuguuaauauuaauuuauauuugucucauuuuguaugua

SEQ ID NO: 124694 - RNA, 64 nt, Homo Sapiens
accagcagcauuguacagcaagggguaaauaagcuuaauuuauuaauuuaccaggcuuaauuaa

SEQ ID NO: 124695 - RNA, 64 nt, Homo Sapiens
cauuguacagcaagggguaaauaagcuuaauuuauuaauuuaccaggcuuaauuaagaucccau

SEQ ID NO: 124696 - RNA, 64 nt, Homo Sapiens
uuuucacaucauguaaugugaggccuuguacuuguuaauuuauaucucagaucauauuugaugg

SEQ ID NO: 124697 - RNA, 64 nt, Homo Sapiens
ugcuggcucagcauccucaggaccaaguuguugcuuaauuuauuguuuuuuaauaacuaaucca

SEQ ID NO: 124698 - RNA, 64 nt, Homo Sapiens
uggauccaccucugagugagucucugugggugauuuaauuuauuuugccacgugugcugugacu

SEQ ID NO: 124699 - RNA, 64 nt, Homo Sapiens
cuucagaauccuuuaagaacaccugcauuuuuuuuuaauuuauacuuuagaacuauuaauagca

SEQ ID NO: 124700 - RNA, 64 nt, Homo Sapiens
acugcuguguugagcuuuucuuuccugggguauauuaauuuaguuauauuuagcagaagaggaa

SEQ ID NO: 124701 - RNA, 64 nt, Homo Sapiens
auuguaacuuugcagcuuuuuuauuuagguagcuuuaauuuauuuaugaaaguuaauccauuuc

SEQ ID NO: 124702 - RNA, 64 nt, Homo Sapiens
ugaaaugcuaugauucacauguaacauuuaaacauuaauuuaaaaagggaaccuuggagaauuc

SEQ ID NO: 124703 - RNA, 64 nt, Homo Sapiens
cuuuuguucacuaguuccuuuuuucucuacauuuuuaauuuauuaaacuugcugugaaaacacu

SEQ ID NO: 124704 - RNA, 64 nt, Homo Sapiens
auaaaaggaaaaaaaacuuagccuagaauuagaauuaauuuaauugaauucaucuaaagauguc

SEQ ID NO: 124705 - RNA, 64 nt, Homo Sapiens
ugcagccugggaucucccuacuccauuuuuuccuuuaauuuaaguggccacauguauaugucuu

SEQ ID NO: 124706 - RNA, 64 nt, Homo Sapiens
acccaaacagcaaaacacagacuuguauucacgguuaauuuacauggagaggauuuucuugguu

SEQ ID NO: 124707 - RNA, 64 nt, Homo Sapiens
uauauauauauacacacacauauauacgugcagauuaauuuauagaauuucuccuuuuaguguu

SEQ ID NO: 124708 - RNA, 64 nt, Homo Sapiens
auagaauaucauaugcacugggaguuaaauauauuuaauuuaaugaucauuauauauguggggg

SEQ ID NO: 124709 - RNA, 64 nt, Homo Sapiens
cgauguauuuuuguacacuugaaauagaguacucuuaauuuacugggcaaaugugcuuggaauu

SEQ ID NO: 124710 - RNA, 64 nt, Homo Sapiens
agaaaacuaccuggugaugcaaucuuuuuuuuuuuuaauuuaauuuaauuuuaaaauaaaugcu

SEQ ID NO: 124711 - RNA, 64 nt, Homo Sapiens
acuaccuggugaugcaaucuuuuuuuuuuuuaauuuaauuuaauuuuaaaauaaaugcugcauu

SEQ ID NO: 124712 - RNA, 64 nt, Homo Sapiens
cagccaaccugugcaaccugcuggagcuuuauuuuuaauuuaauuuauauagaguaccuauuau

SEQ ID NO: 124713 - RNA, 64 nt, Homo Sapiens
aaccugugcaaccugcuggagcuuuauuuuuaauuuaauuuauauagaguaccuauuauuauau

SEQ ID NO: 124714 - RNA, 64 nt, Homo Sapiens
auuuucuuaauuaugguaccucugucuauaggacuuaauuuagcaguccauuuuugaguaaaac

SEQ ID NO: 124715 - RNA, 64 nt, Homo Sapiens
auguuauccacuacagguuuuaugagacuuccuauuaauuuauuaaauuuauuaaauguuggcu

SEQ ID NO: 124716 - RNA, 64 nt, Homo Sapiens
cuugaaauaagaaauuggucagucugguuuaguauuaauuuaacaugaagauguuuucauuaau

SEQ ID NO: 124717 - RNA, 64 nt, Homo Sapiens
auaauacaugucugaaauuugauggagccaguuauuaauuuauaccuucaucuuuaaccuggug

SEQ ID NO: 124718 - RNA, 64 nt, Homo Sapiens
uaccaauuaauauuuuugaaagagcucuuuuagguuaauuuaaguacagcaauuucucauguaa

SEQ ID NO: 124719 - RNA, 64 nt, Homo Sapiens
aacgguuuaaacaggaaggauugugcagcaggcuuuaauuuaauguagauucauacugcucugu

SEQ ID NO: 124720 - RNA, 64 nt, Homo Sapiens
aauauaauaaaaagaucacuggguuaauucacccagaguauauuguugucguuuuagggcuuaa

SEQ ID NO: 124721 - RNA, 64 nt, Homo Sapiens
ugccaagaugucuguaaaauuuauuagacaaaacagaguauagagagagaaauaacuuuaaagu

SEQ ID NO: 124722 - RNA, 64 nt, Homo Sapiens
guuuauggugacaaaauuaaguaagugagcaaucagaguauaaucggggugaauauuuuauacu

SEQ ID NO: 124723 - RNA, 64 nt, Homo Sapiens
ugugcuuggggaaucucacaccaucucagcccccagaguauaucgcgguuucccaagccuuugu

SEQ ID NO: 124724 - RNA, 64 nt, Homo Sapiens
ggaaucaaugggucccauggaguaaauuaguuccagaguauauucaugcccccgagaggaaauu

SEQ ID NO: 124725 - RNA, 64 nt, Homo Sapiens
aggcggccaaggcucuguuccaggaaauucuugaagaguauaaugaaagcaacaccaaaaugaa

SEQ ID NO: 124726 - RNA, 64 nt, Homo Sapiens
uguggauguacuguuuguauauauuguauauauuaaaacagagauaugugcaugaaaucaagaa

SEQ ID NO: 124727 - RNA, 64 nt, Homo Sapiens
cuaauacugcuuaagaaaauuaaguuacuuuugcaaaacagauaaucauaagaugaaucaguau

SEQ ID NO: 124728 - RNA, 64 nt, Homo Sapiens
ccaagagucuugcuaccaggagggcaagaagaccaaaacagacagacaaguccagcagaagcag

SEQ ID NO: 124729 - RNA, 64 nt, Homo Sapiens
auuguaguaaaaaagucuucuuuacuaucuuaauaaaacagauauugugagauucacauacaaa

SEQ ID NO: 124730 - RNA, 64 nt, Homo Sapiens
acaaaaaauagagaucagcagaaagcaaaacagaaaaacagaagacuggugccuaccauacacg

SEQ ID NO: 124731 - RNA, 64 nt, Homo Sapiens
aacagaagacaaaaaauagacauacacggaaagcaaaacagaaagugccuguacuggugccuac

SEQ ID NO: 124732 - RNA, 64 nt, Homo Sapiens
uaaauuuucuccuauguuaaauaaaauaaaaaggaaaacagacuguauaaaauaaaauacauuu

SEQ ID NO: 124733 - RNA, 64 nt, Homo Sapiens
cccauuucuuaaaaacggauguauaaaauuuaaaaaaacagacuuuuauaaugaaaauaaacau

SEQ ID NO: 124734 - RNA, 64 nt, Homo Sapiens
ggugaggugcuguguuucuuauuucauacgagauaaaacagagagaaguucucucuucuccagc

SEQ ID NO: 124735 - RNA, 64 nt, Homo Sapiens
cuggaacuuuugacuuuggguccccaaacagccaaaaacagauacagaaaucuuugguugugug

SEQ ID NO: 124736 - RNA, 64 nt, Homo Sapiens
uugccaacuagauacacugcuuaggaauacuccuaaaacagauaacucagcuaaauauuugcau

SEQ ID NO: 124737 - RNA, 64 nt, Homo Sapiens
uaauggugcucccaaauauuccaagaaccaguagaaaacagaaaauaaggaguauauuuucaag

SEQ ID NO: 124738 - RNA, 64 nt, Homo Sapiens
cacuuaauuugaucuuuuauuaugugcccuguucaaaacagaggagucacuauuuauuauugcu

SEQ ID NO: 124739 - RNA, 64 nt, Homo Sapiens
aaguuuauucuaucauuugggacaaauuaacagaaaaacagaacaagaaaaaaggccuugaauu

SEQ ID NO: 124740 - RNA, 64 nt, Homo Sapiens
aaauagacuuagauuuauuaugccuuuguugccuaaaacagacaauuucccacaaaguccauuu

SEQ ID NO: 124741 - RNA, 64 nt, Homo Sapiens
uugggcuuccuggcagugagguuguaccgagcauaaaacagaacagugaaucaacuuccacuua

SEQ ID NO: 124742 - RNA, 64 nt, Homo Sapiens
aaaaauguaugugcuugaaaugccgaaaagaaugaaaacagagagagaaacaggaaacaaagaa

SEQ ID NO: 124743 - RNA, 64 nt, Homo Sapiens
auaauuaagauacuagucaugacuuagucagaaaaaaacagaggugaaaaaugcuaaucucuuu

SEQ ID NO: 124744 - RNA, 64 nt, Homo Sapiens
aacagcuucucaguuaagugaaaauaaaccaguuaaaacagaaccuuuaagagcaaccauggca

SEQ ID NO: 124745 - RNA, 64 nt, Homo Sapiens
ggccaaauggaaagaacacauaauaaacaagaaaaaaacagaggugaagaaaaauccaagucug

SEQ ID NO: 124746 - RNA, 64 nt, Homo Sapiens
gcggacuaugcagagugcuugugaggguuucacuaaaacagaggcaaaacuguccauugaauuc

SEQ ID NO: 124747 - RNA, 64 nt, Homo Sapiens
agagacacaguccugcagccucauauggcucaauaaaacagaaaggggcaaguauagaagauua

SEQ ID NO: 124748 - RNA, 64 nt, Homo Sapiens
aaacaauccccaucagguagguuuaaaaaacagaaaaacagacacagaaaaauauauauuuuaa

SEQ ID NO: 124749 - RNA, 64 nt, Homo Sapiens
aacagacaaaacaauccccauauuuuaaguuuaaaaaacagaaaaacauauacagaaaaauaua

SEQ ID NO: 124750 - RNA, 64 nt, Homo Sapiens
uauauccagcuaacaagaucagaaaaaaaaagaaaaaacagaaacaaaaaaaaaaaaaaaaaaa

SEQ ID NO: 124751 - RNA, 64 nt, Homo Sapiens
gagagaauauuggagaugucaaagaugacaaagaaaaacagagaaauguuuauuuaaaaaaaaa

SEQ ID NO: 124752 - RNA, 60 nt, Homo Sapiens
auuuauuauaucguacauaaguuaguaugaaaaacagacuaucaccuuuauugagaaaca

SEQ ID NO: 124753 - RNA, 64 nt, Homo Sapiens
uacauuccuuggauaucugacaacguguuucugaaaaacagauuuucauaaguaauaauaaaaa

SEQ ID NO: 124754 - RNA, 64 nt, Homo Sapiens
cgacuuuuuaguuuggguccuacuguuguuauuaaaaacagaacaaaaacaaaacacacacaca

SEQ ID NO: 124755 - RNA, 64 nt, Homo Sapiens
aaaacagaacaaaaacaaaacacacacacacacaaaaacagaaacaaaaaaaaccagcauuaaa

SEQ ID NO: 124756 - RNA, 64 nt, Homo Sapiens
auuauuugguguggccaucuauuaucuaaggaaaaaaacagaaauaaaguauuacugauaaaaa

SEQ ID NO: 124757 - RNA, 64 nt, Homo Sapiens
cccauuuguuggcuguuuuuucuucaguguuaaaaaaacagauguuuuaaaaagugucuguaaa

SEQ ID NO: 124758 - RNA, 64 nt, Homo Sapiens
aaaaccuacccauugaauaaccagaugaguugcaaaaacagaaaauugggagcuaggucagcug

SEQ ID NO: 124759 - RNA, 64 nt, Homo Sapiens
uuguauuuuucuuguggaggagccuuacauuuuuaaaacagauuuuaauuguauuuuaaauuga

SEQ ID NO: 124760 - RNA, 64 nt, Homo Sapiens
acuugauggugacacuugggcuaaaaucuuaaauaaaacagaaacucuuucuucagaauuaaaa

SEQ ID NO: 124761 - RNA, 64 nt, Homo Sapiens
ccugguuauaaccugacgcuagacaggagaaaagaaaacagaaaacguuugugcaguauugaaa

SEQ ID NO: 124762 - RNA, 64 nt, Homo Sapiens
ucuguugcaacuaugaaugaaaacaaaacaccacaaaacagacuucacuaacacagaaaaacag

SEQ ID NO: 124763 - RNA, 64 nt, Homo Sapiens
caaaacaccacaaaacagacuucacuaacacagaaaaacagaaacugagugugagaguugugaa

SEQ ID NO: 124764 - RNA, 64 nt, Homo Sapiens
aaaaacguuucuuucuuauuuuuuuucuuuuccuaaaacagacuugaaaguauuauacagggau

SEQ ID NO: 124765 - RNA, 64 nt, Homo Sapiens
uugacuacuuuguucuuugguuaagauccaaaagaaaacagaaaacaauuccacgaggccaauc

SEQ ID NO: 124766 - RNA, 64 nt, Homo Sapiens
gugagcuuugaaguagguggcuugagcuagagauaaaacagaaucuucuggguaguccccuguu

SEQ ID NO: 124767 - RNA, 64 nt, Homo Sapiens
ggcagacaauaguauagaagucuggaaaaaaacaaaaacagaauuugagaaccuuggaccacuc

SEQ ID NO: 124768 - RNA, 64 nt, Homo Sapiens
aaauauauaugaucauugaaauacuuuuuaacaaaaaacagauucuauauuauuauauauauau

SEQ ID NO: 124769 - RNA, 64 nt, Homo Sapiens
aggaagcuccagauccaguaucuuguuuggccucaaaacagaagcagcuucuuuugucucccag

SEQ ID NO: 124770 - RNA, 64 nt, Homo Sapiens
agcauccaggcugaccucaaggaagcauagccacaaaacagaauagcaccugucuguacauauu

SEQ ID NO: 124771 - RNA, 64 nt, Homo Sapiens
uuagccauaguucugaaugcacuucaauuaagccaaaacagacagcuagugaucuuuuuauaug

SEQ ID NO: 124772 - RNA, 64 nt, Homo Sapiens
caaauuccauaaacagaacuacuuccacaccaggaaaacagaccuuucacccuacuucaaguac

SEQ ID NO: 124773 - RNA, 64 nt, Homo Sapiens
ugggaauuauugcacagaaaguaugaaucuaauuaaaacagaaaacuuauccagggccauagaa

SEQ ID NO: 124774 - RNA, 64 nt, Homo Sapiens
ucuucuucuguccuauugauacacagcuaauuggaaaacagaugacaaugaauggaaucuacug

SEQ ID NO: 124775 - RNA, 64 nt, Homo Sapiens
aacaguuguuccuguuguguacuccuugucacagaaaacagaaaggugagguugucccugcagu

SEQ ID NO: 124776 - RNA, 64 nt, Homo Sapiens
auuucaaagaaauuagcaaggaaugcuuucuaacaaaacagaauauuuucuaaauaaaaauauu

SEQ ID NO: 124777 - RNA, 64 nt, Homo Sapiens
cagaguuaagauaguuuaucuucuuuuaauuaauaaaacagacacagccugcauuaauuugcuu

SEQ ID NO: 124778 - RNA, 64 nt, Homo Sapiens
gggaaaacugagcaugugucaaugaaaacacuuuaaaacagauucacuuacagaagaguauccu

SEQ ID NO: 124779 - RNA, 64 nt, Homo Sapiens
gggaaugaauaaagcacuuauucagccaguaaucaaaacagacuaaaaugguuccugauuuauu

SEQ ID NO: 124780 - RNA, 64 nt, Homo Sapiens
uauagugaaacaaaaugagagugcagaucuaacuaaaacagagccuaccuggagcaaaacagau

SEQ ID NO: 124781 - RNA, 64 nt, Homo Sapiens
ugcagaucuaacuaaaacaguaacuaccuggagcaaaacagaugagaaacugaacuggcaaaau

SEQ ID NO: 124782 - RNA, 64 nt, Homo Sapiens
aaaugagaaaagaaaaaaaauaacuaaaacauugaaaacagaacuuguuaccauccuuuaauca

SEQ ID NO: 124783 - RNA, 64 nt, Homo Sapiens
aacuguguuuccuuuuacuucugcauguugggcgaaaacagaaccccauuuguuucaaagaggu

SEQ ID NO: 124784 - RNA, 64 nt, Homo Sapiens
aaaagcaaaggaaaaugcuuagacaaacuaaaacaaaacagaacaccaaaaacuagacaaauaa

SEQ ID NO: 124785 - RNA, 64 nt, Homo Sapiens
uuccgucugauagauggaaggguaacauugccuuaaaacagaaauaugcaggcguuggcuauuu

SEQ ID NO: 124786 - RNA, 64 nt, Homo Sapiens
cccaaaugccuacuggauccuacagccauacaggaaaacagacggacacagcccuuuccuuaaa

SEQ ID NO: 124787 - RNA, 64 nt, Homo Sapiens
gcaguauacugcuaucgagacauguuuguucggaaaaacagaaagauccauaaagaugcagagu

SEQ ID NO: 124788 - RNA, 64 nt, Homo Sapiens
aauucaccuuaccaauauuaaucccagcguguguaaaacagaacaguaacucuaugugacccca

SEQ ID NO: 124789 - RNA, 64 nt, Homo Sapiens
ucaacaucuauugauaaaacuuguauuuaauuaaaaaacagaaucucuuucugaaaucuaagcu

SEQ ID NO: 124790 - RNA, 64 nt, Homo Sapiens
ugcagaauuucuggggcugcgccuuaagaauacaaaaacagaaagagguuuacgagauuuggcu

SEQ ID NO: 124791 - RNA, 64 nt, Homo Sapiens
cuguaacucacccccaccaccauacacacacacaaaaacagaaacaaaaucaaaacagagaaag

SEQ ID NO: 124792 - RNA, 64 nt, Homo Sapiens
caccauacacacacacaaaaacagaaacaaaaucaaaacagagaaagcagaaaaucuaccaaga

SEQ ID NO: 124793 - RNA, 64 nt, Homo Sapiens
aaugagaugggaugaaauccuaugacaguaagcaaaaacagaaccaugaaaaaugauuggacau

SEQ ID NO: 124794 - RNA, 64 nt, Homo Sapiens
gauccuuguucuuugacaauuugugaugucugaaaaaacagaacccgaaaagcuauggugauau

SEQ ID NO: 124795 - RNA, 64 nt, Homo Sapiens
ugguacugauggccucucauaguagaugacuuugaaaacagaaacaucaaaauauacuuuugga

SEQ ID NO: 124796 - RNA, 64 nt, Homo Sapiens
acaaagaaaagcuuguauauccgaugcuaaauuaaaaacagaaacuucauuacucaucacaucc

SEQ ID NO: 124797 - RNA, 64 nt, Homo Sapiens
acuugguuaaguuuccacccccuccaauuugugaaaaacagagcagugaccuagcuguugcauc

SEQ ID NO: 124798 - RNA, 64 nt, Homo Sapiens
uuuaguauuuaauggucuuuggagaaaaaauaauaaaacagaguguuauauauauauuuuuugg

SEQ ID NO: 124799 - RNA, 64 nt, Homo Sapiens
uccggggaauuucgauguuuuuuacaaguuggcaaaaacagacuggaagucagcucuuucacuu

SEQ ID NO: 124800 - RNA, 64 nt, Homo Sapiens
aaaccccgccccgcccccaaggaaggugggucuuaaaacagaccugaugucuguaauaaaagug

SEQ ID NO: 124801 - RNA, 64 nt, Homo Sapiens
aaaagaggcagggguugcaauccuagucucugauaaaacagaauuuaaaccaacaaagaucaaa

SEQ ID NO: 124802 - RNA, 64 nt, Homo Sapiens
ggcuacauaaccaaaauagcaugguacugguaccaaaacagagauauagaucaauagaacagaa

SEQ ID NO: 124803 - RNA, 64 nt, Homo Sapiens
uacauugauaggauacauacugaaaucagcaaacaaaacagauguauagauuagaguguggaga

SEQ ID NO: 124804 - RNA, 64 nt, Homo Sapiens
caaacaaaacagauguauagauuagaguguggagaaaacagaggaaaacuugcaguuacgaaga

SEQ ID NO: 124805 - RNA, 64 nt, Homo Sapiens
acaaacuacccauccaugagcugccaggcagucaaaaacagaagcuuccccgacuugugagucc

SEQ ID NO: 124806 - RNA, 64 nt, Homo Sapiens
cccucccuuccuggagggauggccagggaaggagaaaacagagaacugacaccuuugaaaccac

SEQ ID NO: 124807 - RNA, 64 nt, Homo Sapiens
ucuguuuuucuuuuugauuuuuguuuuuuaaaccaaaacagacaauagcuuauuuucuuuccgc

SEQ ID NO: 124808 - RNA, 64 nt, Homo Sapiens
cccuacccccaccccucuagagacccuccagcuaaaaacagagccugaguucagggacccaagu

SEQ ID NO: 124809 - RNA, 64 nt, Homo Sapiens
gacccaggaaugaaucugcuugcagcccuccccaaaaacagauuacauggcaggccuggaaucc

SEQ ID NO: 124810 - RNA, 64 nt, Homo Sapiens
augccuuuuaugagcacaaauguugauacagaaaaaaacagaugaaacuugaacauucuacuuu

SEQ ID NO: 124811 - RNA, 64 nt, Homo Sapiens
aaguuuuuaaaggugauucugugcaguaagguauaaaacagauauauaauaaauagccuagcuu

SEQ ID NO: 124812 - RNA, 64 nt, Homo Sapiens
uuguauguuuggauuuucaauaucgacuuugcuuaaaacagagcccaccugcauaguaacugug

SEQ ID NO: 124813 - RNA, 64 nt, Homo Sapiens
uagcauccuacuucugcugggcugcaucauuauauaaugccacaggcaucuagucaagguaaag

SEQ ID NO: 124814 - RNA, 64 nt, Homo Sapiens
uuaauaguuguuuuugucccuuucuuggaaauguuaaugccaaaguugccugaacauugggcgg

SEQ ID NO: 124815 - RNA, 64 nt, Homo Sapiens
gacuagagagagguuucauuuuauacuuucaaacuaaugccaguaagugaaaaauguggguagc

SEQ ID NO: 124816 - RNA, 64 nt, Homo Sapiens
gcauaaucauuccauuuguuucuauauuaagcaauaaugccaguaaauacaggguauguucuaa

SEQ ID NO: 124817 - RNA, 64 nt, Homo Sapiens
aguugggggaaaguuacgcuguuggccguuugcuuaaugccagauuuaaugccaagauugacag

SEQ ID NO: 124818 - RNA, 64 nt, Homo Sapiens
auugacagguuggccguuuguuuuuuuuuuuuuuuaaugccaaggaaaaauggccauguugucu

SEQ ID NO: 124819 - RNA, 64 nt, Homo Sapiens
uuaagaucucucuuaacuugaaaugucuucaggguaaugccaauaaacauuuuaaauuuccuag

SEQ ID NO: 124820 - RNA, 64 nt, Homo Sapiens
aggaaaacacuauuuucauaauguaauuuacuuauaaugccagaugagacugacaaaaaccuua

SEQ ID NO: 124821 - RNA, 64 nt, Homo Sapiens
cuaugcuuggagagagcccugaauccuuuaacuuuaaugccaucuuaggccuggaaguuagagu

SEQ ID NO: 124822 - RNA, 64 nt, Homo Sapiens
aaugcuagugacugcacaauauugugacuguacuuaaugccacugaacuguacacuuuaaaaug

SEQ ID NO: 124823 - RNA, 64 nt, Homo Sapiens
gucaccuuggauuuaugaguuuuuuaaugccauuuaaugccauuguaguccuuuccuguagaua

SEQ ID NO: 124824 - RNA, 64 nt, Homo Sapiens
uaaugccauugucaccuuggccuguagauauuuuuaaugccauuguauuucgugguaguccuuu

SEQ ID NO: 124825 - RNA, 64 nt, Homo Sapiens
aagcaaugggccuuguaccaaaggaccucauggcuaaugccacuugcuucaggagugccucacg

SEQ ID NO: 124826 - RNA, 64 nt, Homo Sapiens
guuauugaggugaucaagaucuguuccacagggcuaaugccaccaucuccccucaaaauuuugu

SEQ ID NO: 124827 - RNA, 64 nt, Homo Sapiens
uauuagauaccuuggguugaauacacuuuuaacagcccuagaucgauagcccuagcccuagaua

SEQ ID NO: 124828 - RNA, 64 nt, Homo Sapiens
auacacuuuuaacagcccuagaucgauagcccuagcccuagauagauagcccuagcccuagaua

SEQ ID NO: 124829 - RNA, 64 nt, Homo Sapiens
gaucgauagcccuagcccuagauagauagcccuagcccuagauagauagcuauuagguuggugc

SEQ ID NO: 124830 - RNA, 59 nt, Homo Sapiens; identical to SEQ ID NO: 76155

SEQ ID NO: 124831 - RNA, 64 nt, Homo Sapiens; identical to SEQ ID NO: 76156

SEQ ID NO: 124832 - RNA, 64 nt, Homo Sapiens; identical to SEQ ID NO: 76157

SEQ ID NO: 124833 - RNA, 64 nt, Homo Sapiens; identical to SEQ ID NO: 76158

SEQ ID NO: 124834 - RNA, 64 nt, Homo Sapiens; identical to SEQ ID NO: 76159

SEQ ID NO: 124835 - RNA, 64 nt, Homo Sapiens; identical to SEQ ID NO: 76160

SEQ ID NO: 124836 - RNA, 64 nt, Homo Sapiens; identical to SEQ ID NO: 76161

SEQ ID NO: 124837 - RNA, 64 nt, Homo Sapiens; identical to SEQ ID NO: 76162

SEQ ID NO: 124838 - RNA, 64 nt, Homo Sapiens; identical to SEQ ID NO: 76163

SEQ ID NO: 124839 - RNA, 64 nt, Homo Sapiens; identical to SEQ ID NO: 76164

SEQ ID NO: 124840 - RNA, 64 nt, Homo Sapiens; identical to SEQ ID NO: 76165

SEQ ID NO: 124841 - RNA, 64 nt, Homo Sapiens; identical to SEQ ID NO: 76166

SEQ ID NO: 124842 - RNA, 64 nt, Homo Sapiens; identical to SEQ ID NO: 76167

SEQ ID NO: 124843 - RNA, 64 nt, Homo Sapiens; identical to SEQ ID NO: 76168

SEQ ID NO: 124844 - RNA, 64 nt, Homo Sapiens; identical to SEQ ID NO: 76169

SEQ ID NO: 124845 - RNA, 58 nt, Homo Sapiens; identical to SEQ ID NO: 76170

SEQ ID NO: 124846 - RNA, 64 nt, Homo Sapiens; identical to SEQ ID NO: 76171

SEQ ID NO: 124847 - RNA, 64 nt, Homo Sapiens; identical to SEQ ID NO: 76172

SEQ ID NO: 124848 - RNA, 64 nt, Homo Sapiens; identical to SEQ ID NO: 76173

SEQ ID NO: 124849 - RNA, 64 nt, Homo Sapiens; identical to SEQ ID NO: 76174

SEQ ID NO: 124850 - RNA, 64 nt, Homo Sapiens; identical to SEQ ID NO: 76175

SEQ ID NO: 124851 - RNA, 52 nt, Homo Sapiens; identical to SEQ ID NO: 76176

SEQ ID NO: 124852 - RNA, 64 nt, Homo Sapiens; identical to SEQ ID NO: 76177

SEQ ID NO: 124853 - RNA, 64 nt, Homo Sapiens; identical to SEQ ID NO: 76178

SEQ ID NO: 124854 - RNA, 64 nt, Homo Sapiens; identical to SEQ ID NO: 76179

SEQ ID NO: 124855 - RNA, 64 nt, Homo Sapiens; identical to SEQ ID NO: 76180

SEQ ID NO: 124856 - RNA, 64 nt, Homo Sapiens; identical to SEQ ID NO: 76181

SEQ ID NO: 124857 - RNA, 64 nt, Homo Sapiens; identical to SEQ ID NO: 76182

SEQ ID NO: 124858 - RNA, 64 nt, Homo Sapiens; identical to SEQ ID NO: 76183

SEQ ID NO: 124859 - RNA, 64 nt, Homo Sapiens; identical to SEQ ID NO: 76184

SEQ ID NO: 124860 - RNA, 64 nt, Homo Sapiens; identical to SEQ ID NO: 76185

SEQ ID NO: 124861 - RNA, 64 nt, Homo Sapiens; identical to SEQ ID NO: 76186

SEQ ID NO: 124862 - RNA, 64 nt, Homo Sapiens; identical to SEQ ID NO: 76187

SEQ ID NO: 124863 - RNA, 64 nt, Homo Sapiens; identical to SEQ ID NO: 76188

SEQ ID NO: 124864 - RNA, 64 nt, Homo Sapiens; identical to SEQ ID NO: 76189

SEQ ID NO: 124865 - RNA, 64 nt, Homo Sapiens; identical to SEQ ID NO: 76190

SEQ ID NO: 124866 - RNA, 64 nt, Homo Sapiens; identical to SEQ ID NO: 76191

SEQ ID NO: 124867 - RNA, 64 nt, Homo Sapiens; identical to SEQ ID NO: 76192

SEQ ID NO: 124868 - RNA, 64 nt, Homo Sapiens; identical to SEQ ID NO: 76193

SEQ ID NO: 124869 - RNA, 64 nt, Homo Sapiens; identical to SEQ ID NO: 76194

SEQ ID NO: 124870 - RNA, 64 nt, Homo Sapiens; identical to SEQ ID NO: 76195

SEQ ID NO: 124871 - RNA, 64 nt, Homo Sapiens; identical to SEQ ID NO: 76196

SEQ ID NO: 124872 - RNA, 64 nt, Homo Sapiens; identical to SEQ ID NO: 76197

SEQ ID NO: 124873 - RNA, 64 nt, Homo Sapiens; identical to SEQ ID NO: 76198

SEQ ID NO: 124874 - RNA, 64 nt, Homo Sapiens; identical to SEQ ID NO: 76199

SEQ ID NO: 124875 - RNA, 64 nt, Homo Sapiens; identical to SEQ ID NO: 76200

SEQ ID NO: 124876 - RNA, 64 nt, Homo Sapiens; identical to SEQ ID NO: 76201

SEQ ID NO: 124877 - RNA, 64 nt, Homo Sapiens; identical to SEQ ID NO: 76202

SEQ ID NO: 124878 - RNA, 64 nt, Homo Sapiens; identical to SEQ ID NO: 76203

SEQ ID NO: 124879 - RNA, 64 nt, Homo Sapiens; identical to SEQ ID NO: 76204

SEQ ID NO: 124880 - RNA, 64 nt, Homo Sapiens; identical to SEQ ID NO: 76205

SEQ ID NO: 124881 - RNA, 64 nt, Homo Sapiens; identical to SEQ ID NO: 76206

SEQ ID NO: 124882 - RNA, 64 nt, Homo Sapiens; identical to SEQ ID NO: 76207

SEQ ID NO: 124883 - RNA, 64 nt, Homo Sapiens; identical to SEQ ID NO: 76208

SEQ ID NO: 124884 - RNA, 64 nt, Homo Sapiens; identical to SEQ ID NO: 76209

SEQ ID NO: 124885 - RNA, 64 nt, Homo Sapiens; identical to SEQ ID NO: 76210

SEQ ID NO: 124886 - RNA, 64 nt, Homo Sapiens; identical to SEQ ID NO: 76211

SEQ ID NO: 124887 - RNA, 64 nt, Homo Sapiens; identical to SEQ ID NO: 76212

SEQ ID NO: 124888 - RNA, 64 nt, Homo Sapiens; identical to SEQ ID NO: 76213

SEQ ID NO: 124889 - RNA, 64 nt, Homo Sapiens; identical to SEQ ID NO: 76214

SEQ ID NO: 124890 - RNA, 64 nt, Homo Sapiens; identical to SEQ ID NO: 76215

SEQ ID NO: 124891 - RNA, 64 nt, Homo Sapiens; identical to SEQ ID NO: 76216

SEQ ID NO: 124892 - RNA, 64 nt, Homo Sapiens; identical to SEQ ID NO: 76217

SEQ ID NO: 124893 - RNA, 64 nt, Homo Sapiens; identical to SEQ ID NO: 76218

SEQ ID NO: 124894 - RNA, 64 nt, Homo Sapiens; identical to SEQ ID NO: 76219

SEQ ID NO: 124895 - RNA, 64 nt, Homo Sapiens; identical to SEQ ID NO: 55961

SEQ ID NO: 124896 - RNA, 64 nt, Homo Sapiens; identical to SEQ ID NO: 55962

SEQ ID NO: 124897 - RNA, 64 nt, Homo Sapiens; identical to SEQ ID NO: 55963

SEQ ID NO: 124898 - RNA, 64 nt, Homo Sapiens; identical to SEQ ID NO: 55964

SEQ ID NO: 124899 - RNA, 64 nt, Homo Sapiens; identical to SEQ ID NO: 55965

SEQ ID NO: 124900 - RNA, 64 nt, Homo Sapiens; identical to SEQ ID NO: 55966

SEQ ID NO: 124901 - RNA, 64 nt, Homo Sapiens; identical to SEQ ID NO: 55967

SEQ ID NO: 124902 - RNA, 64 nt, Homo Sapiens; identical to SEQ ID NO: 55968

SEQ ID NO: 124903 - RNA, 64 nt, Homo Sapiens; identical to SEQ ID NO: 55969

SEQ ID NO: 124904 - RNA, 64 nt, Homo Sapiens; identical to SEQ ID NO: 55970

SEQ ID NO: 124905 - RNA, 64 nt, Homo Sapiens; identical to SEQ ID NO: 93643

SEQ ID NO: 124906 - RNA, 64 nt, Homo Sapiens; identical to SEQ ID NO: 93644

SEQ ID NO: 124907 - RNA, 64 nt, Homo Sapiens; identical to SEQ ID NO: 93645

SEQ ID NO: 124908 - RNA, 64 nt, Homo Sapiens; identical to SEQ ID NO: 93646

SEQ ID NO: 124909 - RNA, 64 nt, Homo Sapiens; identical to SEQ ID NO: 93647

SEQ ID NO: 124910 - RNA, 64 nt, Homo Sapiens; identical to SEQ ID NO: 93648

SEQ ID NO: 124911 - RNA, 64 nt, Homo Sapiens; identical to SEQ ID NO: 93649

SEQ ID NO: 124912 - RNA, 64 nt, Homo Sapiens; identical to SEQ ID NO: 93650

SEQ ID NO: 124913 - RNA, 64 nt, Homo Sapiens; identical to SEQ ID NO: 93651

SEQ ID NO: 124914 - RNA, 64 nt, Homo Sapiens; identical to SEQ ID NO: 93652

SEQ ID NO: 124915 - RNA, 64 nt, Homo Sapiens; identical to SEQ ID NO: 93653

SEQ ID NO: 124916 - RNA, 64 nt, Homo Sapiens; identical to SEQ ID NO: 93654

SEQ ID NO: 124917 - RNA, 64 nt, Homo Sapiens; identical to SEQ ID NO: 93655

SEQ ID NO: 124918 - RNA, 64 nt, Homo Sapiens; identical to SEQ ID NO: 93656

SEQ ID NO: 124919 - RNA, 64 nt, Homo Sapiens; identical to SEQ ID NO: 93657

SEQ ID NO: 124920 - RNA, 64 nt, Homo Sapiens; identical to SEQ ID NO: 93658

SEQ ID NO: 124921 - RNA, 64 nt, Homo Sapiens; identical to SEQ ID NO: 93659

SEQ ID NO: 124922 - RNA, 64 nt, Homo Sapiens; identical to SEQ ID NO: 93660

SEQ ID NO: 124923 - RNA, 64 nt, Homo Sapiens; identical to SEQ ID NO: 93661

SEQ ID NO: 124924 - RNA, 64 nt, Homo Sapiens; identical to SEQ ID NO: 93662

SEQ ID NO: 124925 - RNA, 64 nt, Homo Sapiens; identical to SEQ ID NO: 93663

SEQ ID NO: 124926 - RNA, 64 nt, Homo Sapiens; identical to SEQ ID NO: 93664

SEQ ID NO: 124927 - RNA, 64 nt, Homo Sapiens
cuuucuucaggaauaacugauauaucuuuauuacaaacugaaagagagaagauuaucaaacaaa

SEQ ID NO: 124928 - RNA, 64 nt, Homo Sapiens
agaaaacaagcaguuucagauuuacgaacauugaaaacugaacuggcacagaaaaaaaaaauaa

SEQ ID NO: 124929 - RNA, 64 nt, Homo Sapiens
aacuacagaaauuuuuuagaucuucugaauuagcaaacugaauaaucucaugcaaugcacacuu

SEQ ID NO: 124930 - RNA, 64 nt, Homo Sapiens
auucugcauuucuuagaaauagauuuaauauucaaaacugaaauaagggguuuguaguuguaag

SEQ ID NO: 124931 - RNA, 64 nt, Homo Sapiens
uauauaggcuuuugacaaaaucauggauuugggcaaacugaaugauuuuacaauugugaaaacc

SEQ ID NO: 124932 - RNA, 64 nt, Homo Sapiens
uguguuacaagaaaaauauggcauuaaauuauacaaacugaaaaaaaggcaaacauaggucugg

SEQ ID NO: 124933 - RNA, 64 nt, Homo Sapiens
ugaaacacuaaugaauguugucaagugucaaucaaaacugaagauguuuaaaaauuugcaagca

SEQ ID NO: 124934 - RNA, 64 nt, Homo Sapiens
uacaaaucuuagugcuggugagucaauugcaaacaaacugaaugcacuauguaaauggcucaca

SEQ ID NO: 124935 - RNA, 64 nt, Homo Sapiens
aagauuauuuuccauuugaaguuaauguauaauaaaacugaaacuaaaaugagacuuuuuauau

SEQ ID NO: 124936 - RNA, 64 nt, Homo Sapiens
aucugaacauaauauaauuuucacaaauauuuuuaaacugaaauuauguuacauauguuuauau

SEQ ID NO: 124937 - RNA, 64 nt, Homo Sapiens
agaucuucucuggucagacuuggaagaauuuccaaaacugaaguuagccccaagacuucccuag

SEQ ID NO: 124938 - RNA, 64 nt, Homo Sapiens
uuuugguugauuuuuuugccuucccuucaauuuuaaacugaagcauuuuaauauggguagaaac

SEQ ID NO: 124939 - RNA, 64 nt, Homo Sapiens
cguuuucacaaaacuauuugaguagaauaaauggaaacugaauuccauuugugcccguuaaacc

SEQ ID NO: 124940 - RNA, 64 nt, Homo Sapiens
gagaagaaauugagggcaaaguaauaugucuccaaaacugaacugauugcuuguugagauuacc

SEQ ID NO: 124941 - RNA, 64 nt, Homo Sapiens
auuuaaagucagauuuauagacucgaggagacagaaacugaaucccacaccuggugcaauuaga

SEQ ID NO: 124942 - RNA, 64 nt, Homo Sapiens
auauuauuuuauaaaauguuuucuguauggcaauaaacugaaaacauggaucaacccuucuuuu

SEQ ID NO: 124943 - RNA, 64 nt, Homo Sapiens
guucucaauaucaacauauuguuagcaaaacugaaaacugaaauuaugauuaagcuuaaacccu

SEQ ID NO: 124944 - RNA, 64 nt, Homo Sapiens
cugaaauguucucaauaucaaaacccuguuagcaaaacugaaaacaauuguuaugauuaagcuu

SEQ ID NO: 124945 - RNA, 64 nt, Homo Sapiens
gagaucugccucuguauagauguugucaguuaggaaacugaagccauaggucaggcagacauca

SEQ ID NO: 124946 - RNA, 64 nt, Homo Sapiens
cauauccacaauuccaaaaucuccaaaccucugaaaacugaaauauuuuucauaaauuaggcgu

SEQ ID NO: 124947 - RNA, 64 nt, Homo Sapiens
aauuugauguuaugcaaacacaacucaaaagcuaaaacugaacauuuaagcaaacuacuacagc

SEQ ID NO: 124948 - RNA, 64 nt, Homo Sapiens
ccucuuuccaggaccucaguacucgugcaagacaaaacugaaaccaacgaauaguaaauaauga

SEQ ID NO: 124949 - RNA, 64 nt, Homo Sapiens
uaagaugaucccaauaaaagaaaaauugcucaggaaacugaaccuuuuucugaaccaagcacug

SEQ ID NO: 124950 - RNA, 64 nt, Homo Sapiens
aaugcugacaguuggagccaaugccucauaguguaaacugaaagaaaaauaguugcuuuuuaaa

SEQ ID NO: 124951 - RNA, 64 nt, Homo Sapiens
gccuuuuuaaaauuuuauguuuaggaugcauuauaaacugaaaaagggauggggcaggggacug

SEQ ID NO: 124952 - RNA, 64 nt, Homo Sapiens
gagaagguaagaaaagcaauauugagguacggagaaacugaacuggucauaccagaaaucauca

SEQ ID NO: 124953 - RNA, 64 nt, Homo Sapiens
acuaagguuauuugaauguuacuccuugauuguaaaacugaaaaaaaaaauagcaucuagucca

SEQ ID NO: 124954 - RNA, 64 nt, Homo Sapiens
auguugaauuuuaguuuuucugggaugcaaaaagaaacugaaugagcaacaaacauuuccuaaa

SEQ ID NO: 124955 - RNA, 64 nt, Homo Sapiens
ucacaauuuugcaccuggcuccaaagugaaagggaaacugaacuagcuuacuuugcagagcuuc

SEQ ID NO: 124956 - RNA, 64 nt, Homo Sapiens
ccaguccuucaagcaucagcuuuccuuaaaaggaaaacugaaacauguugcaaaagcuuacauu

SEQ ID NO: 124957 - RNA, 64 nt, Homo Sapiens
gucucaguauggcuauuaaaacauuuuucuuaauaaacugaagauuuaaaaugccugaggaaau

SEQ ID NO: 124958 - RNA, 64 nt, Homo Sapiens
uauuuuaaaauuauuugucuugugugccauuuaaaaacugaaaaaaugaugugccagcuaaaau

SEQ ID NO: 124959 - RNA, 64 nt, Homo Sapiens
aaagaaguggaaugaggagcucuaauauucacauaaacugaaaugaucucaccugucgcguagc

SEQ ID NO: 124960 - RNA, 64 nt, Homo Sapiens
agauguugcaugcucuugaguacaaugaagacuaaaacugaacauaacuaaaggguaguuguuu

SEQ ID NO: 124961 - RNA, 64 nt, Homo Sapiens
ugcaauauuuuugcaaaaaaaaaccuacaaaaauaaacugaacuuguuuugguauauuguacac

SEQ ID NO: 124962 - RNA, 64 nt, Homo Sapiens
gcagaugaaugacuccaggaagaagguuaucaugaaacugaacucaccauuucuauuaauuucu

SEQ ID NO: 124963 - RNA, 64 nt, Homo Sapiens
gaaaaaagggcaccuuugucacuugaaaggaaugaaacugaaugcaaaauaagcuaauuccaua

SEQ ID NO: 124964 - RNA, 64 nt, Homo Sapiens
gaaucacugaauggaauguuaauaacuuauuggaaaacugaaaaguaucuccccucccuucagg

SEQ ID NO: 124965 - RNA, 64 nt, Homo Sapiens
uggacucucuuugugacaaaucauaaacauauggaaacugaaaagagaacuugagaaaauuacu

SEQ ID NO: 124966 - RNA, 64 nt, Homo Sapiens
auuuccuaguggaguuuuauaaauuaaaaggucaaaacugaagcuuuuuauuuaggcuuuucca

SEQ ID NO: 124967 - RNA, 64 nt, Homo Sapiens
ccaaucuaaaauggcagagaagaugaaauuugauaaacugaauuuuuuuuaaaaauccauuuac

SEQ ID NO: 124968 - RNA, 63 nt, Homo Sapiens
cagacaccaauacugaaugaauacuuaaccguaaaacugaaagaggauucuaguucuucauaa

SEQ ID NO: 124969 - RNA, 64 nt, Homo Sapiens
aggaguaaaauaaggaaggaacguucaucacuuuaaacugaaccuggcaaguuaauuuccucag

SEQ ID NO: 124970 - RNA, 64 nt, Homo Sapiens
uuguauaauacuaguuuuauacagugaucauuagaaacugaauuugauuguaaguugcugaugg

SEQ ID NO: 124971 - RNA, 64 nt, Homo Sapiens
agguugaggagaaauagugcagaugauccauuaaaaacugaacaguuguggcuccuguugaaua

SEQ ID NO: 124972 - RNA, 64 nt, Homo Sapiens
uaagaaaauacauuagcaagaaaaauuuguauguaaacugaaaaaugaaugugaagcaaacaaa

SEQ ID NO: 124973 - RNA, 64 nt, Homo Sapiens
uuuugaccuuggaaaauauuaacugaaaaaauuuaaacugaauuaggcccauuauuuuuauuaa

SEQ ID NO: 124974 - RNA, 64 nt, Homo Sapiens
aauuuaaacugaauuuuuugcauuauuuuuauuaaaacugaaaaacaggauuugcuucuaggcc

SEQ ID NO: 124975 - RNA, 64 nt, Homo Sapiens
auuuguugaacuggaaauguuuuacaugauucuuaaacugaaacuugguguaaaaauagaauug

SEQ ID NO: 124976 - RNA, 64 nt, Homo Sapiens
uuuauuaauuguacucaacccucgcagaacaguaaaacugaagauuauuguuucugaauguuuu

SEQ ID NO: 124977 - RNA, 64 nt, Homo Sapiens
gugaaguggcuugauugcuuuucaugauguaaagaaacugaacagguuaauaccaaguauucau

SEQ ID NO: 124978 - RNA, 64 nt, Homo Sapiens; identical to SEQ ID NO: 124977

SEQ ID NO: 124979 - RNA, 64 nt, Homo Sapiens
uguauuucauuuuauugucaaauaauuaaagcuuaaacugaauuucacauaauuacacacguga

SEQ ID NO: 124980 - RNA, 64 nt, Homo Sapiens
guuucacauaauuacacacgauaguaugggaaaaaaacugaagacuucaggauugucugguuaa

SEQ ID NO: 124981 - RNA, 64 nt, Homo Sapiens
caaccuaauuguaaaugccuaaacagagguuuccaaacugaaggaucuguguugcagggaaacu

SEQ ID NO: 124982 - RNA, 64 nt, Homo Sapiens
uuuuuuauuauguauaauaaaagccagugcuggaaaacugaauuuuuuaaggccauuuuauauu

SEQ ID NO: 124983 - RNA, 64 nt, Homo Sapiens
acauaaagaccauguacaugaucuuccuuuaaccaaacugaaguggcaaaaugcuacaguucau

SEQ ID NO: 124984 - RNA, 64 nt, Homo Sapiens
uuggaaaaagaaauacuuuacauuuugagauggaaaacugaaaucaugugugaaaaguuugaug

SEQ ID NO: 124985 - RNA, 64 nt, Homo Sapiens
cuuuugaaauaccacuauaucaccuguaucaugaaaacugaaucaacguuugaaaggagucuua

SEQ ID NO: 124986 - RNA, 64 nt, Homo Sapiens
cuccugcagugccaaguaucuuauucuacuuuccaaacugaauuggcauauuucaggcuuuaaa

SEQ ID NO: 124987 - RNA, 64 nt, Homo Sapiens
gcaaagguggcaaugcuuaaacuaaauaaugaauaaacugaauauuuuggaaacugcuaaauuc

SEQ ID NO: 124988 - RNA, 64 nt, Homo Sapiens
auguaugcuuuuuaccuagcugguagcauaaauaaaacugaaucucaacauacaaaguugaauu

SEQ ID NO: 124989 - RNA, 64 nt, Homo Sapiens
ggcucaggaaauguuccuuuggccaaauuuccccaaacugaacgagaaacugaauuuugcaaag

SEQ ID NO: 124990 - RNA, 64 nt, Homo Sapiens
uugcaaagggccaaauuuccgauauccuuuugagaaacugaauucaggaaacuugcaucaguug

SEQ ID NO: 124991 - RNA, 64 nt, Homo Sapiens
cugcggucauauuguagagagaugcucaguguuaaaacugaaacacacaaacacacacacacac

SEQ ID NO: 124992 - RNA, 64 nt, Homo Sapiens
ccucauacacauuuaggaaaugguuaagaaguguaaacugaacccuuauccuugucuucaaucu

SEQ ID NO: 124993 - RNA, 64 nt, Homo Sapiens
ccuccuauguuguugaaggagggacuagggggagaaacugaaagcugauuaauuacaggagguu

SEQ ID NO: 124994 - RNA, 64 nt, Homo Sapiens
gcacuccugguuacagauacuggggcagcaaauaaaacugaaucuuguuuucagaccuuauacu

SEQ ID NO: 124995 - RNA, 64 nt, Homo Sapiens
ucaagauggugaugguagagaagcugcccggaauaaacugaauuucauauguucuaaaaugacu

SEQ ID NO: 124996 - RNA, 64 nt, Homo Sapiens
uuucaaacuaaauuguauuuucagagcuauccugaaacugaacagcugaaacuuuaaaaaauaa

SEQ ID NO: 124997 - RNA, 64 nt, Homo Sapiens
cauucauuagguaacaaggauuuagcauauuuugaaacugaaguacuacuggaaacugaaugca

SEQ ID NO: 124998 - RNA, 64 nt, Homo Sapiens
cauuuagcauauuuugaaaccccagaacuacuggaaacugaauggucuuagcauacagugugug

SEQ ID NO: 124999 - RNA, 64 nt, Homo Sapiens
acuuuggggggaauuuuguaaacugaaaaaaaaaaaacugaagauauuacuuuguaauuuaaaa

SEQ ID NO: 125000 - RNA, 64 nt, Homo Sapiens
aaaaaaaacugaagaacuuucuuuguaauuuaaaaaacugaaaaaagagcaaagcuuuuuauua

SEQ ID NO: 125001 - RNA, 64 nt, Homo Sapiens
uccuaguuaaauaaaauuagaaauuaaaucugguaaacugaauuuuggauuuacacuugagggu

SEQ ID NO: 125002 - RNA, 64 nt, Homo Sapiens
uuauaagcaagcaauaucauaaagcuaucaacaaaaacugaauaaaaagcgugcaauaugcuuu

SEQ ID NO: 125003 - RNA, 64 nt, Homo Sapiens
uccaguguccaaaauauauaaguaaauagcuguagagucacauauaugaagugaauagcauaug

SEQ ID NO: 125004 - RNA, 64 nt, Homo Sapiens
uuuucaacaguagaugaaggaaaugauacugaaugagucacaguguucccuggcaaguaagcug

SEQ ID NO: 125005 - RNA, 64 nt, Homo Sapiens
gaaguuacaugacaaagauauuuuuugaugaaaugagucacagaguagagaguagagucacacu

SEQ ID NO: 125006 - RNA, 64 nt, Homo Sapiens
uuuuuugaugaaaugagucaguagguagagaguagagucacacucucacaaaucuuguauuaaa

SEQ ID NO: 125007 - RNA, 64 nt, Homo Sapiens
guagaauuugaucagaaucacgcaaauuugaucagagucacagaagacuuaauagauuaacugu

SEQ ID NO: 125008 - RNA, 64 nt, Homo Sapiens
aaggccagagggucucaggagcucagcugagagagagucacagacuacaggaaguacccugggg

SEQ ID NO: 125009 - RNA, 64 nt, Homo Sapiens
uuugagauucccagagaggcuccccucucccacugagucacaggcccgccugguuccagcccca

SEQ ID NO: 125010 - RNA, 64 nt, Homo Sapiens
ugcaucauagacgagacaguaagacauuuguugggagucacauuauugcuagacgucucacuca

SEQ ID NO: 125011 - RNA, 64 nt, Homo Sapiens
agggaaguggaaggaagaaccuuauuuugcuacugagucacacaaaaugacccaagagaacuuu

SEQ ID NO: 125012 - RNA, 64 nt, Homo Sapiens
uuaaaguauuagaaaagguuuuagcugaaaugaggagucacaauuaaggauggaggugauauuu

SEQ ID NO: 125013 - RNA, 64 nt, Homo Sapiens
cuaauauguaaaagucugcaugacucuuaacaaugagucacauccauugauuuuacagggauuu

SEQ ID NO: 125014 - RNA, 64 nt, Homo Sapiens
gcauaggaauuuagaaccuaggcucuauuuaacugagucacacuguucccaaguaggcauucua

SEQ ID NO: 125015 - RNA, 64 nt, Homo Sapiens
agaaaugcccuacaucuuaugaaguuuucccacugagucacaucgcugcuguggauaucuccau

SEQ ID NO: 125016 - RNA, 64 nt, Homo Sapiens
ugucagugcagccauuugccgggaaccagugccugagucacagcggccuggguucuagaucucu

SEQ ID NO: 125017 - RNA, 64 nt, Homo Sapiens
ugucuaggccucggugcugggggaaccagcaccugagucacagcggccuggguucuagaccucu

SEQ ID NO: 125018 - RNA, 64 nt, Homo Sapiens
acuaaauugcuuauguuuauucccugucagcggaguggagaaugucauucaucaauaaaccaaa

SEQ ID NO: 125019 - RNA, 64 nt, Homo Sapiens
uuuuuaaagaucuggcaacuuuucaggauuauuuguggagaacucuaagguuaagaucaggaaa

SEQ ID NO: 125020 - RNA, 64 nt, Homo Sapiens
auuauugcggaccgugguacccaguuuuaggaauguggagaaaggaauucuguugauuccguug

SEQ ID NO: 125021 - RNA, 64 nt, Homo Sapiens
acacuacagguagguuggucuuugaaguccacuaguggagaaugucaagacaagauacuuauua

SEQ ID NO: 125022 - RNA, 64 nt, Homo Sapiens
aagaaaauucauacuggggagaaaccccacaaauguggagaaugcggaaaagccuuuaacuggu

SEQ ID NO: 125023 - RNA, 64 nt, Homo Sapiens
uccucaacucuuauuacacauaagauaauucacaguggagaaaaacccuacaaaugugaagaau

SEQ ID NO: 125024 - RNA, 64 nt, Homo Sapiens
ggaauucaaucugucaaauuuguuuuauucucaaguggagaacuucucccacauaauauauaua

SEQ ID NO: 125025 - RNA, 64 nt, Homo Sapiens
uggaggacaacuuaucuucacuaagcugaaucagguggagaaaguaaucuccuugcaaucaugu

SEQ ID NO: 125026 - RNA, 64 nt, Homo Sapiens
ucaaaccgagcagggcugugcaauuaucaaccacguggagaaaacacuuagcagcaacugaaga

SEQ ID NO: 125027 - RNA, 64 nt, Homo Sapiens
gugcccugcuuugcaaacaugguuuuggggaaauguggagaagauguggagucucccucugauu

SEQ ID NO: 125028 - RNA, 64 nt, Homo Sapiens
cacaucacuuucucuucuugcguguggggcagguguggagaagggcuuuaaggaggccaauuug

SEQ ID NO: 125029 - RNA, 64 nt, Homo Sapiens
ccuuuuaagccaugggugggucuaacuggcuuuuguggagaaauuagcacaccccaacuuuaau

SEQ ID NO: 125030 - RNA, 64 nt, Homo Sapiens
ugguaucaggaaggcauuuucaaucauucaaaauguggagaauuuaauggcuaaaucuuuaaaa

SEQ ID NO: 125031 - RNA, 64 nt, Homo Sapiens
gagggccguaccccacccucagcaccccuuccauguggagaaaggagugaaaccuuuagggcag

SEQ ID NO: 125032 - RNA, 64 nt, Homo Sapiens
ugguggcacugagcccccccaacacugugcccugguggagaaagcacugaccugucaugccccc

SEQ ID NO: 125033 - RNA, 64 nt, Homo Sapiens
cuagcauuaggcagauaggccacaggaagaagguguggagaacccaccugaaccagauugagac

SEQ ID NO: 125034 - RNA, 64 nt, Homo Sapiens
gccuuggauuccagaauguuucaugguaagcacuguggagaaccuacaugucagguucuggagu

SEQ ID NO: 125035 - RNA, 64 nt, Homo Sapiens
guuuucuuuuuuuagggagaagggcuuuucuuuaguggagaaauggaacucgccccccuacccc

SEQ ID NO: 125036 - RNA, 64 nt, Homo Sapiens
gagcaagccuuccuccauggcccaucacucggcuguggagaacaaagaccaaugugaagacacu

SEQ ID NO: 125037 - RNA, 64 nt, Homo Sapiens
aucaaaauuccuguguugugugccaagguauaaaguggagaaguuagaugagugcaaggagcuc

SEQ ID NO: 125038 - RNA, 64 nt, Homo Sapiens
gagcagcagccaacacguuuagcagacacugcgcguggagaagggcuuaucugcaguacacucu

SEQ ID NO: 125039 - RNA, 64 nt, Homo Sapiens
cgucacgggucuuucauccccgugaaaacaaugaguggagaaguugccuccuggaguaggucca

SEQ ID NO: 125040 - RNA, 64 nt, Homo Sapiens
aucuagccagauuggagauaagacaguagucauuguggagaaacgagcgcuucggugaaaguaa

SEQ ID NO: 125041 - RNA, 64 nt, Homo Sapiens
gagagcagggguacuuccgccuugccguuagcuuguggagaacgugcuucuuauuccuggcagg

SEQ ID NO: 125042 - RNA, 64 nt, Homo Sapiens
gggacgaagccuuagagggugacauagcuagaaaguggagaagcucacuguucacugugcaaag

SEQ ID NO: 125043 - RNA, 64 nt, Homo Sapiens
uagaggcuggcaggggggaugucacggaccaaauacuugcaaguuuacagagaggaaucuccca

SEQ ID NO: 125044 - RNA, 64 nt, Homo Sapiens
uuaggaaauggggagcuagggagauuaguaccucacuugcaaagugaagaaacagagccucaga

SEQ ID NO: 125045 - RNA, 64 nt, Homo Sapiens
aaagcaagaaggccaugaccaucccugccucgaaacuugcaagucacuugucugaguuaguuuc

SEQ ID NO: 125046 - RNA, 64 nt, Homo Sapiens
ugcuugaugacuucuuuugcucucaaaguuccauacuugcaaaauugguuuuucaagacugaaa

SEQ ID NO: 125047 - RNA, 64 nt, Homo Sapiens
cccgccucacugugccaacacccccgacgcguccacuugcaacaaggccagcccgugcagacca

SEQ ID NO: 125048 - RNA, 64 nt, Homo Sapiens
gcuccauaaacagccacaguuccccucgagggagacuugcaaauuguccgugagagacacgggc

SEQ ID NO: 125049 - RNA, 64 nt, Homo Sapiens
uguuuuuucuuccgaauaguaauguggcucuagcacuugcaaaucccccuucuaccaggcugca

SEQ ID NO: 125050 - RNA, 64 nt, Homo Sapiens
caaaagaaagugagggguuuacagaccuguaaggacuugcaaaagugccccagaguugcugugg

SEQ ID NO: 125051 - RNA, 64 nt, Homo Sapiens
ggucccuaauuuuggauuuuaaccaacuuaaagcaaacuauaggaauuuaagauuacuaccagu

SEQ ID NO: 125052 - RNA, 64 nt, Homo Sapiens
ucacaggacagagcagagcccaagugacaucuagaaacuauaguaucuguagcuggauuuacca

SEQ ID NO: 125053 - RNA, 64 nt, Homo Sapiens
auccuuauaaauacugaucaccuaccuaaaagguaaacuauacuugauggauccuuuagaauug

SEQ ID NO: 125054 - RNA, 64 nt, Homo Sapiens
ucuucaagagguauccuguuacauauuauaaaauaaacuauaccugaauguauuuggaauacuu

SEQ ID NO: 125055 - RNA, 64 nt, Homo Sapiens
ucagugucuauagcaucaaaauagugagaguuucaaacuauauaagacuuagccuaguaauuuu

SEQ ID NO: 125056 - RNA, 64 nt, Homo Sapiens
cacaaggaauuaaauacuauugccaauuuugaaaaaacuauaagcuuucagaacuuauagucua

SEQ ID NO: 125057 - RNA, 64 nt, Homo Sapiens
caaaaaugaguaugaggaaaauugaaaugccugcaaacuauaugaauauaugaaauuacuauac

SEQ ID NO: 125058 - RNA, 64 nt, Homo Sapiens
gucaagaggccagagaaaaugcacaaacuguaggaaacuauaggaaagcauuuacuaugagguu

SEQ ID NO: 125059 - RNA, 64 nt, Homo Sapiens
ccuaaaauugaaaaaaacaucuagccauauccauaaacuauaucaucaccaagagauguuuauu

SEQ ID NO: 125060 - RNA, 64 nt, Homo Sapiens
auauauucccaaaaaugucagaagcuugacucauaaacuauacuaaaguaaaacuuuugguuca

SEQ ID NO: 125061 - RNA, 64 nt, Homo Sapiens
auuauuggcauauacugacuacuacuagauguuaaaacuauaugaacagucaaguguacuucac

SEQ ID NO: 125062 - RNA, 64 nt, Homo Sapiens
aauguacuuuaggacauuaaaaaacacaaaauaaaaacuauaaacuauaccaaacauuauauua

SEQ ID NO: 125063 - RNA, 64 nt, Homo Sapiens
uuguuucccauuuauuuauucauguugauuacuaaaacuauacucagcuuuuguuagaaucuug

SEQ ID NO: 125064 - RNA, 64 nt, Homo Sapiens
gguuuauacaauuguuuguauagauuagggggaaaaacuauaaaugacacuggaauauguuuag

SEQ ID NO: 125065 - RNA, 64 nt, Homo Sapiens
uaucugagugaguccaagguuccauuacuucugaaaacuauauugauuuuugugaugaagagcu

SEQ ID NO: 125066 - RNA, 64 nt, Homo Sapiens
gaacaaagcuggaggcaucgcauuacccaacuucaaacuauacuacagggcuacaguaaccaaa

SEQ ID NO: 125067 - RNA, 64 nt, Homo Sapiens
ucaagauggauuaaagacuuaaauguaaaaccccaaacuauaaaaacucuggaagauaaccuag

SEQ ID NO: 125068 - RNA, 64 nt, Homo Sapiens
caauuaugugggaaaucauugaaaguauacagagaaacuauaagucuucauuaggaauuuauca

SEQ ID NO: 125069 - RNA, 64 nt, Homo Sapiens
uuaugaauauaggaaaaucuaagaugaaucuuauaaacuauauucaccuagaugucaacuccac

SEQ ID NO: 125070 - RNA, 64 nt, Homo Sapiens
guauuacccugauacuagacuagacaucacaagaaaacuauaagccaauauuccuuauuaauac

SEQ ID NO: 125071 - RNA, 64 nt, Homo Sapiens
auaaagaaaagagguuuauacugcaaaagaagugaaacuauauguauucacaguugauacauag

SEQ ID NO: 125072 - RNA, 64 nt, Homo Sapiens
uggccaccaugcuggccugcgaggugaccugcgugucacugagggacuccacgucugugucacu

SEQ ID NO: 125073 - RNA, 64 nt, Homo Sapiens
ugaccugcgugucacugagggacuccacgucugugucacugaggauuucacugcugcugucugu

SEQ ID NO: 125074 - RNA, 64 nt, Homo Sapiens
aauuuuuuaaagacaugguaccccucuaguaugugucacugagagcuuuaguaguuuguuuggu

SEQ ID NO: 125075 - RNA, 64 nt, Homo Sapiens
ugauugagggauaagugugauaggagaugauccagucacugacuaugcaaagcaggugaaaccu

SEQ ID NO: 125076 - RNA, 64 nt, Homo Sapiens
ggcuggguggcucuggggccaaccgaccacaggugucacugaucacaggugucaccguaguggc

SEQ ID NO: 125077 - RNA, 64 nt, Homo Sapiens
ucccuucaggcuucugacacacuaguggccucgagucacugauaguggugccuccuccuuaccu

SEQ ID NO: 125078 - RNA, 64 nt, Homo Sapiens
ucccuagggcucccaacugaccucaggccucugagucacugaaugucaccaggagagguggggg

SEQ ID NO: 125079 - RNA, 64 nt, Homo Sapiens
ccucccucagcacuuccccaucacaacaaccuaugucacugacucagaugcagggucugcucac

SEQ ID NO: 125080 - RNA, 64 nt, Homo Sapiens
auguuuaaguggucaagcaaggcucuaggagguagucacugagcuggaccuuaaacacaucugc

SEQ ID NO: 125081 - RNA, 64 nt, Homo Sapiens
guaacuggguuguuuaauguuuuaauugauaauugucacugaucguauuucuacuuguuaaaua

SEQ ID NO: 125082 - RNA, 64 nt, Homo Sapiens
guuguauucaguaaaaaagaauaguaaauauaaggucacugagauucuaaguaagauaguaaau

SEQ ID NO: 125083 - RNA, 64 nt, Homo Sapiens
ucacugagauucuaaguaagauaguaaaucuaaggucacugagccaaauccuuuucaauaggca

SEQ ID NO: 125084 - RNA, 64 nt, Homo Sapiens
ggcggagguuacauauggaugaaaaugaaucuuagucacugaauauucauauacauuuccccca

SEQ ID NO: 125085 - RNA, 64 nt, Homo Sapiens
ggcagagcagcugagggaggggcgcuggccacaugucacugauggucagauuccaaaguccuuu

SEQ ID NO: 125086 - RNA, 64 nt, Homo Sapiens
acguaaaguuaaccuuccaauugucugagcugucgucacugacuucaugacagucuggcccucc

SEQ ID NO: 125087 - RNA, 64 nt, Homo Sapiens
gccacagguuccucuaacauucugugcucucugugucacugaggagugcuuucccagccaaaug

SEQ ID NO: 125088 - RNA, 64 nt, Homo Sapiens
ccucacuaugguuggcgucugaggaugagugccugucacugagggcuggccaguguuuggaggg

SEQ ID NO: 125089 - RNA, 64 nt, Homo Sapiens
cuccuugggacucgccugccuugccccaugugcugucacugacugggucuucuguccagcuccc

SEQ ID NO: 125090 - RNA, 64 nt, Homo Sapiens
gcuucguuaccccugcugccggcuacugggaggagucacugagagacugucacugcucuccccu

SEQ ID NO: 125091 - RNA, 64 nt, Homo Sapiens
uuguuuaaauauaaacagaaguguaccuuuuauaauaaaaaaaagaaguugaguaaaaaaaaaa

SEQ ID NO: 125092 - RNA, 64 nt, Homo Sapiens
uaaauaguugaugcaauuuuuaacguuaauugauauaaaaaaaaaaacaacaaaauuaggcuug

SEQ ID NO: 125093 - RNA, 64 nt, Homo Sapiens
ugugagaucagcugaaccacuuaugauaauaauaauaaaaaagacugcuuugcccucacgucag

SEQ ID NO: 125094 - RNA, 64 nt, Homo Sapiens
aauaucuugauggacucuuuuauaaaauuauuuuauaaaaaacaauguuacacuaaaaucagcc

SEQ ID NO: 125095 - RNA, 64 nt, Homo Sapiens
ucaaaacuaguguauucacuuacccuaguucauuauaaaaaauaucuaggcauuguggauauaa

SEQ ID NO: 125096 - RNA, 64 nt, Homo Sapiens
gcuaaaacauaaucacaaagcuuuaucguguuguauaaaaaaauuaacaauauaauggcaauag

SEQ ID NO: 125097 - RNA, 64 nt, Homo Sapiens
uucaaguucaacuguuucuuucaucaaaccuacuauaaaaaacaucuacaucacuggcugcucu

SEQ ID NO: 125098 - RNA, 64 nt, Homo Sapiens
aacuauccaggaguggugguuugucuccacaaaaauaaaaaagacuggacaacauagugagacc

SEQ ID NO: 125099 - RNA, 64 nt, Homo Sapiens
ugcagaaggauguucuucugggauuugcagguacauaaaaaauguauggcaucuuuuccuugca

SEQ ID NO: 125100 - RNA, 64 nt, Homo Sapiens
aguuauggaucuucaaugccucugagucauuguuauaaaaaaucaguuaucacuauaccaugcu

SEQ ID NO: 125101 - RNA, 64 nt, Homo Sapiens
cucaacagggaugcaaauugguucuucaguaaggauaaaaaaaaaucacaagcaguuguuugug

SEQ ID NO: 125102 - RNA, 64 nt, Homo Sapiens
ccuucuccuuggauuguuuuggaaguuauucuucauaaaaaauguuaacgugggcugggcaugg

SEQ ID NO: 125103 - RNA, 64 nt, Homo Sapiens
uuugaauguauauuucuauuuaugauaccaauuuauaaaaaauaauuacacagaaaaaauggaa

SEQ ID NO: 125104 - RNA, 64 nt, Homo Sapiens
uuacuuguucuugauaagugaaaacugcagggaaauaaaaaauacauaucaaaacauggacaug

SEQ ID NO: 125105 - RNA, 64 nt, Homo Sapiens
aauggaauaauuauuaaugaaagauuuuugaaauauaaaaaauaaauuaggcccaauccaagaa

SEQ ID NO: 125106 - RNA, 64 nt, Homo Sapiens
caauauaaccagcaauuuagguggcaucuauaaaauaaaaaauuucuacuguggacauccccuu

SEQ ID NO: 125107 - RNA, 64 nt, Homo Sapiens
aauauuuuuagcagaacagguggguuuuguaaaaauaaaaaaaaguuaugaaauaaaaaaaaga

SEQ ID NO: 125108 - RNA, 64 nt, Homo Sapiens
gauggguuuuguaaaaauaaauuuuuguuaugaaauaaaaaaaagaaguacagacguacuuuaa

SEQ ID NO: 125109 - RNA, 64 nt, Homo Sapiens
gagcauguuuaaauugaaauccaaaagaccaucaauaaaaaagauuguguucacagucuaauuu

SEQ ID NO: 125110 - RNA, 64 nt, Homo Sapiens
uauagugauauuaaucuuucaugaaauaggaguuauaaaaaauuauaaaucugaaaaauccaua

SEQ ID NO: 125111 - RNA, 64 nt, Homo Sapiens
uuguaauuuucuugaugacugaaaucauguuaugauaaaaaauuaaaaaagcuggugggugaaa

SEQ ID NO: 125112 - RNA, 64 nt, Homo Sapiens
uggugggugaaagaaaucauuuaucuauuguaagauaaaaaagcaaaugagaacauguugguau

SEQ ID NO: 125113 - RNA, 64 nt, Homo Sapiens
guccuauaauucuauugaaagaugcucacauaugauaaaaaagucuaauggcuguggcauuguu

SEQ ID NO: 125114 - RNA, 64 nt, Homo Sapiens
uauuauguccauuauucaagguuaugacuccuugauaaaaaauuguguauggauauguguaaau

SEQ ID NO: 125115 - RNA, 64 nt, Homo Sapiens
aaaaagacgaacuauuggaguaaaaauaaaaaaaauaaaaaaaauuaucacacaaagagaccaa

SEQ ID NO: 125116 - RNA, 64 nt, Homo Sapiens
uaaaaaaaaaaaaagacgaaagagaccaauaaaaauaaaaaaaauguaggucauuaucacacaa

SEQ ID NO: 125117 - RNA, 64 nt, Homo Sapiens
gacuacauuuugugaggaucaaugaagacuaaauauaaaaaacauuuucuugaauggcaugcua

SEQ ID NO: 125118 - RNA, 64 nt, Homo Sapiens
ucaacugugucugauguuucuucucauguaagaaauaaaaaauaaaaauaaaauaaaauauauu

SEQ ID NO: 125119 - RNA, 64 nt, Homo Sapiens
auaaaauauauugguauguaacuacaggaaaaaaauaaaaaauauauaguggacaguaaccuuu

SEQ ID NO: 125120 - RNA, 64 nt, Homo Sapiens
ugguaaugaaaauggaaugcagcuacugcagcuaauaaaaaauuuuagauagcaauuguuacaa

SEQ ID NO: 125121 - RNA, 64 nt, Homo Sapiens
uuuccucccuuucucauguuuuuauaaauagguaauaaaaaauguuuugccugccaauugaaug

SEQ ID NO: 125122 - RNA, 64 nt, Homo Sapiens
accacccaccuuaacucuuucuugucaggaguauauaaaaaagaaagaaaacaaaacucgcccu

SEQ ID NO: 125123 - RNA, 64 nt, Homo Sapiens
gcaaagucuucuuugaauaucagggacugagucaauaaaaaaaauaguagaaagguggcuuuua

SEQ ID NO: 125124 - RNA, 64 nt, Homo Sapiens
ggacaacagagcaagacucugucucaaaaaaaaaauaaaaaauaaaaaauaaaaaauaaaagaa

SEQ ID NO: 125125 - RNA, 64 nt, Homo Sapiens
agagcaagacucugucucaaaaaaaaaauaaaaaauaaaaaauaaaaaauaaaagaaacauaag

SEQ ID NO: 125126 - RNA, 64 nt, Homo Sapiens
gacucugucucaaaaaaaaaauaaaaaauaaaaaauaaaaaauaaaagaaacauaagauaagua

SEQ ID NO: 125127 - RNA, 64 nt, Homo Sapiens
ugagcaacauggcaaaacccugugucuacaaaaaauaaaaaauuagcugggcaugacggccaga

SEQ ID NO: 125128 - RNA, 64 nt, Homo Sapiens
uugauuaauuaacugggccuuuauacuuaacuaaauaaaaaacuaagcagauaugaguuaaauu

SEQ ID NO: 125129 - RNA, 64 nt, Homo Sapiens
guugccauuguggaagaaauuauuugguacauuaauaaaaaaaguugguaaaacaugguuuuau

SEQ ID NO: 125130 - RNA, 64 nt, Homo Sapiens
ggaacaccaaacaggaaagaacuaugucugaaauauaaaaaauaaaaauaaaaaaacaacuaug

SEQ ID NO: 125131 - RNA, 64 nt, Homo Sapiens
ggaaagaacuaugucugaaauauaaaaaauaaaaauaaaaaaacaacuaugaauaugcacaagg

SEQ ID NO: 125132 - RNA, 64 nt, Homo Sapiens
aaauaauuuuagaaaguuuuuguguuagaaaauuauaaaaaauaaaauucauuuucuaacacca

SEQ ID NO: 125133 - RNA, 64 nt, Homo Sapiens
ucuccaacaaaaauacuuguccucuaucccgcuuauaaaaaaauugagugucuauguuaacuuc

SEQ ID NO: 125134 - RNA, 64 nt, Homo Sapiens
guuugauauuucuuaaugucuugaaaaacuuuuuauaaaaaauucuucacuuugggccaaacau

SEQ ID NO: 125135 - RNA, 64 nt, Homo Sapiens
aaucagaagcuaaaguaaagaaguaaaaauaaaaauaaaaaaguaaauaauaauaauaauaaua

SEQ ID NO: 125136 - RNA, 64 nt, Homo Sapiens
agccaggugugguggcacgcucucuacuaaaaauauaaaaaauugcuaacauggugaaacccca

SEQ ID NO: 125137 - RNA, 64 nt, Homo Sapiens
auuuccauguaaguuaccaguucuugauaaaaauauaaaaaauauuuaaaugccuggaacugac

SEQ ID NO: 125138 - RNA, 64 nt, Homo Sapiens
aaaaaacaaaaaaaaacucauauagcuuugaaagauaaaaaaaauacuggaccauaaaguuaau

SEQ ID NO: 125139 - RNA, 64 nt, Homo Sapiens
uuguauuuucuaauuuuuauuucuaaagaaaaaaauaaaaaaagucuuuuuaaaaaguuauauu

SEQ ID NO: 125140 - RNA, 64 nt, Homo Sapiens
gaaaccuugcacugauuuugagaacuuaaaguauauaaaaaaaaacguugugcacauguacccu

SEQ ID NO: 125141 - RNA, 64 nt, Homo Sapiens
guggcgaaacuccaucucuacaaaaaaugcaaaaauaaaaaauauaguacucaaguauucuuga

SEQ ID NO: 125142 - RNA, 64 nt, Homo Sapiens
acuagaauuuguaaugcaaauggagcucagucuaauaaaaaagagguuuugguauuaaaaguuc

SEQ ID NO: 125143 - RNA, 64 nt, Homo Sapiens
gccaaacauguuggcaucaauuuuauacagggauauaaaaaaguauauguggauaaauuuuuug

SEQ ID NO: 125144 - RNA, 64 nt, Homo Sapiens
auauguggauaaauuuuuuguaaucuuuagggauauaaaaaaguguauguggauaaauuuuuug

SEQ ID NO: 125145 - RNA, 64 nt, Homo Sapiens
auaggcuacaguucucucaccaugccaauucagcauaaaaaagaauaaaauugaaaucugcauu

SEQ ID NO: 125146 - RNA, 64 nt, Homo Sapiens
aaguaguaauaaagaauaaaucauuuaaggauaaauaaaaaauagauguuuugaaagugagcau

SEQ ID NO: 125147 - RNA, 64 nt, Homo Sapiens
cuguauuaguuuccuagaugaauuuuuauuaauuauaaaaaacuaucauuccaaauaagaguuu

SEQ ID NO: 125148 - RNA, 64 nt, Homo Sapiens
aagcccuuuaaacuuuguaaggaccuaaauaauaauaaaaaaaaauuuuuaaaaacuuuuuuuu

SEQ ID NO: 125149 - RNA, 64 nt, Homo Sapiens
ucauucagaaaacuuuauaaugugaauucagacuauaaaaaacauauaaauuaauguaauacug

SEQ ID NO: 125150 - RNA, 64 nt, Homo Sapiens
uaauuuauuuuuacagaaaaaagaacauuucaguauaaaaaaccuuuucuaaacacuuuacuag

SEQ ID NO: 125151 - RNA, 64 nt, Homo Sapiens
uaauaaaauuuuaugccuguuauacuugagugcaauaaaaaacuuuauucucuucagcuuuaac

SEQ ID NO: 125152 - RNA, 64 nt, Homo Sapiens
ggaagauuaaaaacucaaauaucaguccaaggauauaaaaaaaucauauuccggggaucaucac

SEQ ID NO: 125153 - RNA, 64 nt, Homo Sapiens
uuauacuuuguacuuuugcccaaacguguaaauaauaaaaaaguuuuggcuuuuuucuuuagaa

SEQ ID NO: 125154 - RNA, 64 nt, Homo Sapiens
uuuuccguuccuuuuauuuaagucuuuuuauuuaauaaaaaaguuagcuauuucacuuaacgcc

SEQ ID NO: 125155 - RNA, 64 nt, Homo Sapiens
aaaacuuagagcacaauaaugacaacucuaaaaaauaaaaaaaauucgugucauugugauauuu

SEQ ID NO: 125156 - RNA, 64 nt, Homo Sapiens
aagaccaguaacuuuguuuuuucuaguguuaggaauaaaaaaaaauuugaugagcaaaaucuac

SEQ ID NO: 125157 - RNA, 64 nt, Homo Sapiens
ucgagcuacaaagaaagaauuaaaauguucuaagauaaaaaaacaaagaaaacaccgacagcug

SEQ ID NO: 125158 - RNA, 64 nt, Homo Sapiens
auacauaguuucuguuaagguaggcgucaugagcauaaaaaauaaaauguaaugugauuuguac

SEQ ID NO: 125159 - RNA, 64 nt, Homo Sapiens
augcuaguuuauuuuuuuagcagugaaaaugaauauaaaaaaggugacauaggucaaguuuucc

SEQ ID NO: 125160 - RNA, 64 nt, Homo Sapiens
auuauugcuuuaauuagagcagcacauugcuaaaauaaaaaauacaccuuaauuuuuaagaaau

SEQ ID NO: 125161 - RNA, 64 nt, Homo Sapiens
uuaauucuuaaauauugaggccccauugugaguaauaaaaaauacgacauaaguagaagacuaa

SEQ ID NO: 125162 - RNA, 64 nt, Homo Sapiens
uugcuuuuuaaauaguuuguaagacccuucugaaauaaaaaaugauucagaaaaccacuuaagc

SEQ ID NO: 125163 - RNA, 64 nt, Homo Sapiens
ucaaguagcugaugugcaguccaaacacauauucauaaaaaaaaaagcaacuucccuggggaag

SEQ ID NO: 125164 - RNA, 64 nt, Homo Sapiens
cacugacuuguauuuuugcaugaguuauguaaggauaaaaaaucaggaaaaaaauagcaauauu

SEQ ID NO: 125165 - RNA, 64 nt, Homo Sapiens
auacaaaugcugaagugagaugaauguuuuucuuauaaaaaauuuuuagaucccauaauaaaaa

SEQ ID NO: 125166 - RNA, 64 nt, Homo Sapiens
aauuauguggucagugcauuuauaacuguguaaaauaaaaaaggauguguauuuagaauauuug

SEQ ID NO: 125167 - RNA, 64 nt, Homo Sapiens
uuauuccauuugcuuguuuugcaauacuuuaaaaauaaaaaauuuacaaaccugugggccuguu

SEQ ID NO: 125168 - RNA, 64 nt, Homo Sapiens
uuaaacagaagagcacccugcacaguuacacuuaauaaaaaaaacccuauauaaaaaucauugg

SEQ ID NO: 125169 - RNA, 64 nt, Homo Sapiens
agcauugcaaaugcuuuagaugauuuuugucugaauaaaaaaaauuuguuacguaaaguuaaaa

SEQ ID NO: 125170 - RNA, 64 nt, Homo Sapiens
cugaaauuaacauccagugggcaucaagcauacaauaaaaaaaaccuuggaauugucucuaaau

SEQ ID NO: 125171 - RNA, 64 nt, Homo Sapiens
aagaaaaucauucuguuuccggcagggaauaauaauaaaaaaaaguuagauggaaaaugcuauu

SEQ ID NO: 125172 - RNA, 64 nt, Homo Sapiens
aucaucaaccaggcaaauuagugaaucauuagguauaaaaaauaugggguuccuuuacuauugg

SEQ ID NO: 125173 - RNA, 64 nt, Homo Sapiens
auuguauuuuuaagaauguucucucuuaaauguuauaaaaaacauauucagagcauuuuuaccu

SEQ ID NO: 125174 - RNA, 64 nt, Homo Sapiens
uguuaauccuuguaucauacaacaaauaacugaaauaaaaaacaacaucaaguucauuugcaga

SEQ ID NO: 125175 - RNA, 64 nt, Homo Sapiens
uuaaaaaguauacauggccuugaacuuuucaagaauaaaaaagcagucuaucuuuguauaucuu

SEQ ID NO: 125176 - RNA, 64 nt, Homo Sapiens
gaagauauuuaggugacuuacuacaauaaaaaguauaaaaaagauguauguuauaccuauuuua

SEQ ID NO: 125177 - RNA, 64 nt, Homo Sapiens
acuaggggcaaauggguuuuucuaaauaaaugacauaaaaaagaacugguugucuuucuuuaaa

SEQ ID NO: 125178 - RNA, 64 nt, Homo Sapiens
caugaccuugauuguuaaauguaguuauauuugaauaaaaaaugaaucauuuccaaaauucuuu

SEQ ID NO: 125179 - RNA, 64 nt, Homo Sapiens
auuucaaagcucuuuuccuaacugguuaaguaaaauaaaaaauugagcuuucuagaauauuugc

SEQ ID NO: 125180 - RNA, 64 nt, Homo Sapiens
aaaagagagaguaacuacagaagaacuuuaaaaaauaaaaaauaagcuuaccuuggauucuugg

SEQ ID NO: 125181 - RNA, 64 nt, Homo Sapiens
guaggagugaagacaggaucccgugcuuaaaaaaauaaaaaauaaaaaaauaaaaaaaaaauaa

SEQ ID NO: 125182 - RNA, 64 nt, Homo Sapiens
ugaagacaggaucccgugcuuaaaaaaauaaaaaauaaaaaaauaaaaaaaaaauaagacuuua

SEQ ID NO: 125183 - RNA, 64 nt, Homo Sapiens
ggaucccgugcuuaaaaaaauaaaaaauaaaaaaauaaaaaaaaaauaagacuuuaacugcagu

SEQ ID NO: 125184 - RNA, 64 nt, Homo Sapiens
aaaaccccauuuuccuaaagaacaaaguaguaaaauaaaaaaaaauuuaaaaaauuaaaaaaua

SEQ ID NO: 125185 - RNA, 64 nt, Homo Sapiens
uaguaaaauaaaaaaaaauuuaaaaaauuaaaaaauaaaaaaaagaggucacuaaaagaccaag

SEQ ID NO: 125186 - RNA, 64 nt, Homo Sapiens
auuucuucacuuuuaacacaggacaaggcuucacauaaaaaauuucuugcacuugacugaguug

SEQ ID NO: 125187 - RNA, 64 nt, Homo Sapiens
gaaauguguauugauuucuaguugaaguaccagcauaaaaaaaucaaaugacuacuuugaaaua

SEQ ID NO: 125188 - RNA, 64 nt, Homo Sapiens
aaagcaugauauuuacuguuaacaaaauaaaauaauaaaaaaaguuccaaacucauauuacaaa

SEQ ID NO: 125189 - RNA, 64 nt, Homo Sapiens
aaauaauuauaaauaucauuacacuuugaagucuauaaaaaauauuccagugucuauaaaagaa

SEQ ID NO: 125190 - RNA, 58 nt, Homo Sapiens
agaugaaugccagacugugaaggaaaauauaaaaaaaaagucgacugcuaugcucaaa

SEQ ID NO: 125191 - RNA, 64 nt, Homo Sapiens
aagaaaaucuuauauaguacauuuuacaaaaauuauaaaaaaugaauuaguacuggcgaggacu

SEQ ID NO: 125192 - RNA, 64 nt, Homo Sapiens
uguguuuuuuucuggaacuacuucaagugagaaaauaaaaaaaaauggugacaaagcuguacag

SEQ ID NO: 125193 - RNA, 64 nt, Homo Sapiens
aaaggaaauaaaaaugcaugauuaaaaacuaagaauaaaaaaccuauuuuuauguuuccuaaag

SEQ ID NO: 125194 - RNA, 64 nt, Homo Sapiens
uucuaccauuacugaacauuaggacaaacacaaaauaaaaaacaaaacacagacaacggugcug

SEQ ID NO: 125195 - RNA, 64 nt, Homo Sapiens
cugaccauuucuuguucuguuuccaaugaaaucaauaaaaaaaaagaaguacuuuaaauggggu

SEQ ID NO: 125196 - RNA, 64 nt, Homo Sapiens
uauuccaaagagacacacuaauaaauacuucauuauaaaaaauaaaaaagaaucuuuguagaga

SEQ ID NO: 125197 - RNA, 64 nt, Homo Sapiens
aagagacacacuaauaaauacuucauuauaaaaaauaaaaaagaaucuuuguagagauuuugau

SEQ ID NO: 125198 - RNA, 64 nt, Homo Sapiens
cggccuacaagaacaaaacuccaucucaaaauaaauaaaaaaauaaauaaaaauaaaaauagac

SEQ ID NO: 125199 - RNA, 64 nt, Homo Sapiens
aauucauuuauuuuaaauaaaugaauaaaauaaaauaaaaaagaauauucagucguuggcacau

SEQ ID NO: 125200 - RNA, 64 nt, Homo Sapiens
uagugauaauuccugauuccaagaaugccaucugauaaaaaagaauagaaauggaaagugggac

SEQ ID NO: 125201 - RNA, 64 nt, Homo Sapiens
gguuccuguaaaauuucaaauugaugugguauuaauaaaaaaaaaaaaaacacaaacaaugacu

SEQ ID NO: 125202 - RNA, 64 nt, Homo Sapiens
guaaccuuauauuuaaaagaugauuuugcaaaaaauaaaaaauaaaaaauaugccuucuggagu

SEQ ID NO: 125203 - RNA, 64 nt, Homo Sapiens
uauauuuaaaagaugauuuugcaaaaaauaaaaaauaaaaaauaugccuucuggagugaugucu

SEQ ID NO: 125204 - RNA, 64 nt, Homo Sapiens
uuugucuuugagauucaauguucugugguaaccuauaaaaaaagaacaugagucacagcuuuug

SEQ ID NO: 125205 - RNA, 64 nt, Homo Sapiens
ccagucaauuauuccucaacacuacuuuaaagaaauaaaaaauuucuuaacuugaccugggaua

SEQ ID NO: 125206 - RNA, 64 nt, Homo Sapiens
cuuauugugaaaguugugcuguuuucuaaguaaaauaaaaaauaaaaaauuagcaauuuaugau

SEQ ID NO: 125207 - RNA, 64 nt, Homo Sapiens
ugaaaguugugcuguuuucuaaguaaaauaaaaaauaaaaaauuagcaauuuaugauagccagu

SEQ ID NO: 125208 - RNA, 64 nt, Homo Sapiens
cugucaugcucaugcaugaauagaauuuagucaaauaaaaaauuuuggucauuugguacugacu

SEQ ID NO: 125209 - RNA, 64 nt, Homo Sapiens
auggaugaaaguauucaucacaauauuauuuauaauaaaaaauugcaaauguuauaaaugaaca

SEQ ID NO: 125210 - RNA, 64 nt, Homo Sapiens
acuagccugggcaacauggcaagacccugucccuauaaaaaauacaaaaauuagccaggcaugg

SEQ ID NO: 125211 - RNA, 64 nt, Homo Sapiens
aguaugauggaauaaacuuguauaugaaguuaaaauaaaaaaucaaaauaauauaaaagugauu

SEQ ID NO: 125212 - RNA, 64 nt, Homo Sapiens
guccuucaagucuucucugugcugaagacaguggauaaaaaacaacacacgaugaaauaucucu

SEQ ID NO: 125213 - RNA, 64 nt, Homo Sapiens
acucuuaucaaaaaacccauuggauuucauuucaauaaaaaaaaauggaugauuuuauguuaug

SEQ ID NO: 125214 - RNA, 64 nt, Homo Sapiens
aaccaaccucauuggaacaaaucugaugaugaauauaaaaaaguaauacauaaaaauacauaaa

SEQ ID NO: 125215 - RNA, 64 nt, Homo Sapiens
aaaacgggcuagucccuaugaggucacauuguuaauaaaaaaaagacuuuaaagaauugugauc

SEQ ID NO: 125216 - RNA, 64 nt, Homo Sapiens
ccaaacugaaauucuauauaaaagaaaaaaaaggauaaaaaaacgaaaacauacuuauuuuaaa

SEQ ID NO: 125217 - RNA, 64 nt, Homo Sapiens
cuuagcuaggcauguugccaaauaaaaaauaaaaauaaaaaaaauuagaccucaucucuacaaa

SEQ ID NO: 125218 - RNA, 64 nt, Homo Sapiens
aaaauaaaaaaaacuuagcuucaucucuacaaaaauaaaaaauaccuggaaacauaguuagacc

SEQ ID NO: 125219 - RNA, 64 nt, Homo Sapiens
uucuguuucuuucguuagauaaauuaaccuagcaauaaaaaauaacuauuauuaucuuuguaau

SEQ ID NO: 125220 - RNA, 64 nt, Homo Sapiens
gaauaccacaaaagauguuuccagacaucaagcaauaaaaaaaugucuaguuucgguaacuguu

SEQ ID NO: 125221 - RNA, 64 nt, Homo Sapiens
ccuacaaaaaaacuuuaaaaaaaaaacacaaaaaauaaaaaaccaauucuaagcagaaaaagaa

SEQ ID NO: 125222 - RNA, 64 nt, Homo Sapiens
ugauauaucaaaccauuuguucgcaauguauaggauaaaaaaucguugaaggggggguugacuu

SEQ ID NO: 125223 - RNA, 64 nt, Homo Sapiens
augaaaaaaaaaaaggcuuuuguauuuucuuacaauaaaaaauguuauucacacuuucaaacug

SEQ ID NO: 125224 - RNA, 64 nt, Homo Sapiens
caaaguuuuauuaaagauuguuuauucaucaggaauaaaaaaaauuuauuuuauuuuuuuggua

SEQ ID NO: 125225 - RNA, 64 nt, Homo Sapiens
cagugaacuuaaagcaaagaccucuuaguaaaaaauaaaaaaaaauaaaaaauaaaaauaaaaa

SEQ ID NO: 125226 - RNA, 64 nt, Homo Sapiens
aaagcaaagaccucuuaguaaaaaauaaaaaaaaauaaaaaauaaaaauaaaaaaaguuaaauu

SEQ ID NO: 125227 - RNA, 64 nt, Homo Sapiens
cuuaguaaaaaauaaaaaaaaauaaaaaauaaaaauaaaaaaaguuaaauuuauuuauagaaau

SEQ ID NO: 125228 - RNA, 64 nt, Homo Sapiens
agaaacuaugggaaaaaaaauugcaaaaucuaaaauaaaaaaugcaaaaucuaaaauaaaaaau

SEQ ID NO: 125229 - RNA, 64 nt, Homo Sapiens
ugcaaaaucuaaaauaaaaaaugcaaaaucuaaaauaaaaaauggaaaggaaacuuugaaccuu

SEQ ID NO: 125230 - RNA, 64 nt, Homo Sapiens
uuccggagucuuugaagcugaaaauauaaaacaaauaaaaaauaaaaaaauaaaaacccacaaa

SEQ ID NO: 125231 - RNA, 64 nt, Homo Sapiens
gucuuugaagcugaaaauauaaaacaaauaaaaaauaaaaaaauaaaaacccacaaaaauguug

SEQ ID NO: 125232 - RNA, 64 nt, Homo Sapiens
auaacuuuaaggaugugcaauguucuuuacuuauauaaaaaaaguucaagugaauuuauuugug

SEQ ID NO: 125233 - RNA, 64 nt, Homo Sapiens
uuucuugucuuaguuauaaaucugccuagaucugauaaaaaaauuguaaaugaagaucaguauu

SEQ ID NO: 125234 - RNA, 64 nt, Homo Sapiens
uucuuagccauucuuugcagcagaagauuucuugauaaaaaaggauuaccuuuccuuguaaaga

SEQ ID NO: 125235 - RNA, 64 nt, Homo Sapiens
augugagguuccaaaauauguaaaaaugauaauaauaaaaaaagauuaacaucccuugucaucu

SEQ ID NO: 125236 - RNA, 64 nt, Homo Sapiens
aaaaacaaaauaaggaauccucaaaaaauaaaaaauaaaaaaauagagagagccagaccuuguc

SEQ ID NO: 125237 - RNA, 64 nt, Homo Sapiens
aaaaaauaaaaacaaaauaaccuugucucaaaaaauaaaaaauacugagagagagagagccaga

SEQ ID NO: 125238 - RNA, 64 nt, Homo Sapiens
gcaaacaaguacucugguuaaaauauuuucacagauaaaaaauuuaaguuuuguaagagcuuua

SEQ ID NO: 125239 - RNA, 64 nt, Homo Sapiens
ugguugcagcacauucacacccuaaagcaguaaaauaaaaaaccuguugagauuuacguggaac

SEQ ID NO: 125240 - RNA, 64 nt, Homo Sapiens
aauaaaauggauagaaaaaaccauuaauaacugaauaaaaaauacaaaggaucuuuuguccauu

SEQ ID NO: 125241 - RNA, 64 nt, Homo Sapiens
augaaucacucacacucacuauguauguauauauauaaaaaacuuauuugggauccucuuuucu

SEQ ID NO: 125242 - RNA, 64 nt, Homo Sapiens
caaaaaaaaaaaaaucuagcgaaacuccauuucuauaaaaaauaaccagccugggcaacauggc

SEQ ID NO: 125243 - RNA, 64 nt, Homo Sapiens
acgaguuagacauaugaaauuacugaguuaaaaaauaaaaaagugcauucugugauccccuggu

SEQ ID NO: 125244 - RNA, 64 nt, Homo Sapiens
guucuugccuuaaaagugaaccacauagucuugcauaaaaaaggcacauuuuaguuuucugaug

SEQ ID NO: 125245 - RNA, 64 nt, Homo Sapiens
uauuaucaggucuccuaacuuuggugccaagaaaauaaaaaagcgaacacauaaguaaguugcu

SEQ ID NO: 125246 - RNA, 64 nt, Homo Sapiens
uugcuagcuuaguaaaacgauuacucuuuuugguauaaaaaauuaaggagcauuuguuuugauu

SEQ ID NO: 125247 - RNA, 64 nt, Homo Sapiens
agauaaagacuacagaaggagagagcuagucuagauaaaaaaagggaagaaguaaggaaaagga

SEQ ID NO: 125248 - RNA, 64 nt, Homo Sapiens
uacgagugauagaaguagcaaagaaguucuggagauaaaaaaaaaaugaugaaaagaguaguuc

SEQ ID NO: 125249 - RNA, 64 nt, Homo Sapiens
ggugcgggaagaagcagaagcaaaaaaaauaaaaauaaaaaaauaaauaaaaauaaaaaaaaua

SEQ ID NO: 125250 - RNA, 64 nt, Homo Sapiens
agcaaaaaaaauaaaaauaaaaaaauaaauaaaaauaaaaaaaauaaaaaaggaaaaaaaaaaa

SEQ ID NO: 125251 - RNA, 64 nt, Homo Sapiens
aauaaaaauaaaaaaauaaauaaaaauaaaaaaaauaaaaaaggaaaaaaaaaaaagaagaaac

SEQ ID NO: 125252 - RNA, 64 nt, Homo Sapiens
uuugaaagagaaugacucuguuauugucauuucaauaaaaaauaaucacuguucuuuuuuuauu

SEQ ID NO: 125253 - RNA, 64 nt, Homo Sapiens
uuagagcaaaggaguuugcuucaaauuugggggaauaaaaaauaaaaauacugauaaauucgga

SEQ ID NO: 125254 - RNA, 64 nt, Homo Sapiens
gugagagacccuguaucugaaaguaauaauaaaaauaaaaaauauaaaugaggucucguugaug

SEQ ID NO: 125255 - RNA, 64 nt, Homo Sapiens
uggccaacauggugaaaccccgucucuacuaaagauaaaaaaauuagcugaguguguugguggg

SEQ ID NO: 125256 - RNA, 64 nt, Homo Sapiens
caacaaagcaagacucugucucaaaaaaauaaaaauaaaaaaaaaaucuuaguuccauggaauu

SEQ ID NO: 125257 - RNA, 64 nt, Homo Sapiens
uauuuuaaaaguuggauauuaucagcuuuuaaggauaaaaaagguuaagugacaucuauuguuu

SEQ ID NO: 125258 - RNA, 64 nt, Homo Sapiens
aagugaacagugaggugguaccagguuagaccgcauaaaaaauaaaggagcucuuacgaaaaac

SEQ ID NO: 125259 - RNA, 64 nt, Homo Sapiens
uuauaguugguuauguaguaaacacugucauuuuauaaaaaaugagaauuauuuuggaucuuag

SEQ ID NO: 125260 - RNA, 64 nt, Homo Sapiens
aaaaaggaaauuggaugggauacuguggcaaaucauaaaaaaccagauaauugaacuuugaagu

SEQ ID NO: 125261 - RNA, 64 nt, Homo Sapiens
ugaaguuuugguaaaaauucuuuuuucuuuuuuaauaaaaaauuagguuauuacuuuuuuuaua

SEQ ID NO: 125262 - RNA, 64 nt, Homo Sapiens
aaauaaaaucuauucuguguuuauguagggugguauaaaaaagaggucuucauuuagacaugug

SEQ ID NO: 125263 - RNA, 64 nt, Homo Sapiens
cuuugguugucccuauuaacaaaaaaguauuuuaauaaaaaauugaaaugagugagucauauuu

SEQ ID NO: 125264 - RNA, 64 nt, Homo Sapiens
uucauccuuacaauccugucccaugguauuuaacauaaaaaaaaauaaaacuguuaacagauuc

SEQ ID NO: 125265 - RNA, 64 nt, Homo Sapiens
acagugugugcacuucaggcaauuuuuggaaaauauaaaaaauuccaaauucugccuuucagca

SEQ ID NO: 125266 - RNA, 64 nt, Homo Sapiens
gguauuaauguuuuaugaaagaaagaacuguaguauaaaaaagacuacuuuaugguauaccagu

SEQ ID NO: 125267 - RNA, 64 nt, Homo Sapiens
uguuugcagguauuugucauuuucaagagcuucaauaaaaaaaguagacagucaggguguauua

SEQ ID NO: 125268 - RNA, 64 nt, Homo Sapiens
gggaccacaggcugcaccauaagacccacucacaauaaaaaaauaaaaggccgagccgggcaug

SEQ ID NO: 125269 - RNA, 64 nt, Homo Sapiens
aaggccgagccgggcaugguugcucacucccguaauaaaaaaauaaaagaacaggcugagccgg

SEQ ID NO: 125270 - RNA, 64 nt, Homo Sapiens
aaggcuacagcaacuaaaacagcaugguacugguauaaaaaaagacacauagaucaauggaaua

SEQ ID NO: 125271 - RNA, 64 nt, Homo Sapiens
uugguacauauacaccauggaauacuaugcagccauaaaaaagaacaagacuguguccuuuaca

SEQ ID NO: 125272 - RNA, 64 nt, Homo Sapiens
uaggcaacauaguaagaccucaucucuacuaaaaauaaaaaaaaacagccagguguguuagucc

SEQ ID NO: 125273 - RNA, 64 nt, Homo Sapiens
aaucaaguugcugcagccuaugcacuggcccagaauaaaaaacguggugauucugcuaaagcuu

SEQ ID NO: 125274 - RNA, 64 nt, Homo Sapiens
agaaaaagaaauaaacucuaccaucucaaaaaaaauaaaaaaaaccuggcaacagagugagacu

SEQ ID NO: 125275 - RNA, 64 nt, Homo Sapiens
cauacagcagaaaaaccuuaguaccuuucucuucauaaaaaaauaaagcauuugguuguuucca

SEQ ID NO: 125276 - RNA, 64 nt, Homo Sapiens
uaagggcucaggaaccaguucaaaaaaauaaaaaauaaaaaaucgacagaaugagacucugugu

SEQ ID NO: 125277 - RNA, 64 nt, Homo Sapiens
aaaaaucuaagggcucaggaucugugucaaaaaaauaaaaaauaccugggugacagaaugagac

SEQ ID NO: 125278 - RNA, 64 nt, Homo Sapiens
uguugguauguagccuggauaaaugcucuuaauuauaaaaaauucugucgaggaguguuccaua

SEQ ID NO: 125279 - RNA, 64 nt, Homo Sapiens
uaaaacuuuuuguuauggaagaauucaaauauaaauaaaaaauugugaguaauaaaaugaacuc

SEQ ID NO: 125280 - RNA, 63 nt, Homo Sapiens
cauuuuuuucaagcagggaguaaaaaaaauaaaaauaaaaaaauccccucaaaaaaauaaaaa

SEQ ID NO: 125281 - RNA, 64 nt, Homo Sapiens
uaaaaauaaaaaaacauuuuucaaaaaaauaaaaauaaaaaaaaaaauaaacugugcaaucccc

SEQ ID NO: 125282 - RNA, 64 nt, Homo Sapiens
gcuuaaagagaaaaauggccaauaauuaauuaaaauaaaaaacaagacucugucucaauaaaua

SEQ ID NO: 125283 - RNA, 64 nt, Homo Sapiens
uagucagguguggcggugcgcgucucuacuaaacauaaaaaaauuggccaacauggcgaaaccc

SEQ ID NO: 125284 - RNA, 64 nt, Homo Sapiens
ucguauuauucacuuguaaaaaugauuguaacagauaaaaaauguaucugcagcaacucugcag

SEQ ID NO: 125285 - RNA, 64 nt, Homo Sapiens
uacaugauuuucaaguuguaaugcagauggacagauaaaaaagauuuuacguuugucuuuuggc

SEQ ID NO: 125286 - RNA, 64 nt, Homo Sapiens
uuucuacuccaggacugguuuuguuuuuauauauauaaaaaaaaaaagugaaaacaccaaugug

SEQ ID NO: 125287 - RNA, 64 nt, Homo Sapiens
cacuguuuuguuagcgagcaccuuuugaccaguaauaaaaaaccuuggcuuuggaguuuuccac

SEQ ID NO: 125288 - RNA, 64 nt, Homo Sapiens
caauagaucgcccuuaaagacccauuguaaggucauaaaaaaccucggccaccugcacaaagau

SEQ ID NO: 125289 - RNA, 64 nt, Homo Sapiens
gcaacaagaaaccuuaaggugucuuaccgacgaaauaaaaaacauaaaugauuguucuccaagg

SEQ ID NO: 125290 - RNA, 64 nt, Homo Sapiens
auaaggagaaaagagaaugggagagugagagaaaauaaaaaaggcaaaagggagagagagggga

SEQ ID NO: 125291 - RNA, 64 nt, Homo Sapiens
uagagagaucugcccuguguuauccaguuaugagauaaaaaaugaauauaagagugcuugucau

SEQ ID NO: 125292 - RNA, 64 nt, Homo Sapiens
aagcuggaaaauuacuuaaaacaggaaagugucaauaaaaaaacuugagcaacaccaacauauu

SEQ ID NO: 125293 - RNA, 64 nt, Homo Sapiens
agcugcugaauuugugccccuggauuggaagcaaauaaaaaaaaaaaacaacacauaaacuaaa

SEQ ID NO: 125294 - RNA, 64 nt, Homo Sapiens
uacaaauagcugacccgggucucaaaacauaaaaauaaaaaaaagccacagagcaagacuccgu

SEQ ID NO: 125295 - RNA, 64 nt, Homo Sapiens
agauguuaaaacagugaaaugaccccaucucuauauaaaaaaaacgaccugggcagcauagcga

SEQ ID NO: 125296 - RNA, 64 nt, Homo Sapiens
uuggauuuuuguguaugucuuauuuauguauguaauaaaaaaagggucauuuaaagucaauauu

SEQ ID NO: 125297 - RNA, 64 nt, Homo Sapiens
uguguuucucuuauggauuucuauuaaugggcuaauaaaaaacaguguuauuggaagaaaaaug

SEQ ID NO: 125298 - RNA, 64 nt, Homo Sapiens
cauaugagauagcuauuuuguucuaaaaacaaaugcuguuuauaugcaguuuaugauauuguuu

SEQ ID NO: 125299 - RNA, 64 nt, Homo Sapiens
aaacugcugcccaaauuuauguugcauuuacauggcuguuuagaauuaacuacuccucguaagu

SEQ ID NO: 125300 - RNA, 64 nt, Homo Sapiens
ggauuauaugauguacaucauaacaccagagcuugcuguuuaaaugcuuucugaaacugaggua

SEQ ID NO: 125301 - RNA, 64 nt, Homo Sapiens
ugugacuaccggguuuuuaaauauuguaugucaugcuguuuaugucaugucacuauauauaaga

SEQ ID NO: 125302 - RNA, 64 nt, Homo Sapiens
gucugccaggugaggguuacgagaauguguuuacgcuguuuaaucugaaugugacuggcgugcu

SEQ ID NO: 125303 - RNA, 64 nt, Homo Sapiens
gucuucuccccucacccauggacuaacaaagacagcuguuuaggaucccggccaggugggcggg

SEQ ID NO: 125304 - RNA, 64 nt, Homo Sapiens
ggauguguagugguaugcccugcuguuuaaagcagcuguuuacacccuuuggucaaucauaaca

SEQ ID NO: 125305 - RNA, 64 nt, Homo Sapiens
gcagcuguuuacaggauguggucaaucauaacaugcuguuuaaaucuuaagggaccacccuuug

SEQ ID NO: 125306 - RNA, 64 nt, Homo Sapiens
augauuuuaauagagaaagaccaaagagaauugggcuguuuauaagaauugaacuguuguacuu

SEQ ID NO: 125307 - RNA, 64 nt, Homo Sapiens
gcuuuggaccuuuuuagugucuuuguuuuagaaagcuguuuauaguguuuauucuucauaagga

SEQ ID NO: 125308 - RNA, 64 nt, Homo Sapiens
caaugaaaaguagauauagauauugugaaaauaggcuguuuaacaaacagauuggaauaaagcc

SEQ ID NO: 125309 - RNA, 64 nt, Homo Sapiens
uuuaaagaucugaagugugaguagaauguauucagcuguuuaacauguaguuuagauauucaaa

SEQ ID NO: 125310 - RNA, 64 nt, Homo Sapiens
uauuccacuaacugaaauauggcaacuuagaggcgcuguuuauuuacuguauacgucgaccuau

SEQ ID NO: 125311 - RNA, 64 nt, Homo Sapiens
gucauaaucauauuguguauaacuuggaaauggugcuguuuaaaaaaauuguguauuuauacag

SEQ ID NO: 125312 - RNA, 64 nt, Homo Sapiens
gaaauccuuauucaguugguucucucaaauugaggcuguuuaggagagaagguccucugguuag

SEQ ID NO: 125313 - RNA, 64 nt, Homo Sapiens
guguuuuggucaaacguaacaaaggcaagcuaaugcuguuuaccacaggugguaugggagagca

SEQ ID NO: 125314 - RNA, 64 nt, Homo Sapiens
aauacaauuucagaaaagguucugauacucuuguuuuugauaaagcauuuuuucaacuaaccau

SEQ ID NO: 125315 - RNA, 64 nt, Homo Sapiens
gacaucacugaaaugaacuucaguaagcuuucaauuuugauacacaguucauuauucauaacuu

SEQ ID NO: 125316 - RNA, 64 nt, Homo Sapiens
aaucguuggugccaucagugauuuacaaacaauauuuugauauugcagaugacuugcuuacugu

SEQ ID NO: 125317 - RNA, 64 nt, Homo Sapiens
ugugaaaaagccuaagaaaaaggaaauuggacaguuuugauacaaacuuuguuugcuaaugcac

SEQ ID NO: 125318 - RNA, 64 nt, Homo Sapiens
acauuagaagaaaacauauauuuuauuuucauacuuuugauaugauuguaacauauuucuugag

SEQ ID NO: 125319 - RNA, 64 nt, Homo Sapiens
uuauagaagcuacuuuuaaaucagaauauuuaauuuuugauauucauauaauuaauagaaguug

SEQ ID NO: 125320 - RNA, 64 nt, Homo Sapiens
ucucaaaaauuuaguuaccaaaguagaaaagguauuuugauacuagauauuaaaaacuacauau

SEQ ID NO: 125321 - RNA, 64 nt, Homo Sapiens
ugagauaaaaguguuuuaaaauucuguuuauaguuuuugauaugcauauauaauuauguguaua

SEQ ID NO: 125322 - RNA, 64 nt, Homo Sapiens
agauuuaacaaucuuauaaucuauugaaugccauuuuugauaaagcacuggaggucuuauugcc

SEQ ID NO: 125323 - RNA, 64 nt, Homo Sapiens
gauuguuucuggaccaguuuucuugagugucuccuuuugauaggcaaaacuaccuaggcuuuac

SEQ ID NO: 125324 - RNA, 64 nt, Homo Sapiens
ucacaaacuaucaugcaaauagaguuaaguuguauuuugauaauauauuauuaauauuuuaaaa

SEQ ID NO: 125325 - RNA, 64 nt, Homo Sapiens
aaauaaugcaaacuuuuaaaauaagcaucuagguuuuugauaauucugucuacuuacaacaaac

SEQ ID NO: 125326 - RNA, 64 nt, Homo Sapiens
acccugcaaauggcuauugaguuggaaguauuguuuuugauauguaagagauauucagaaugcu

SEQ ID NO: 125327 - RNA, 64 nt, Homo Sapiens
acugauauauucccaguauuuucauaaugccauguuuugauaaaguacugaaucaccacuuuau

SEQ ID NO: 125328 - RNA, 64 nt, Homo Sapiens
acauacaguaaaaaaguagaaauuuaugaaauacuuuugauaaaaaguuuauuuugugcuuacc

SEQ ID NO: 125329 - RNA, 64 nt, Homo Sapiens
uacuuuccacaguuaaauuuacauuaauggcaauuuuugauaguuuuauggcuuuuuacuguua

SEQ ID NO: 125330 - RNA, 64 nt, Homo Sapiens
agaucucauaacuuuauacagcauguuguaagcauuuugauaacuaaaauccuguucuagugaa

SEQ ID NO: 125331 - RNA, 64 nt, Homo Sapiens
cugaaucaagauucauguuuuuuauuuuuauuuuuuuugauacagagucucacucugucacuca

SEQ ID NO: 125332 - RNA, 64 nt, Homo Sapiens
cccacaguagguauugaaacugguaaaaucaguuuuuugauaguguguguauauaagaaaaaau

SEQ ID NO: 125333 - RNA, 64 nt, Homo Sapiens
cuuugguuggaacgcauuggcuuuuuuuuucuuguuuugauagaaauggaauuaagcaaaagua

SEQ ID NO: 125334 - RNA, 64 nt, Homo Sapiens
gucauuuguuucaaugugacugaaacaaaauguuuuuugauaggaaggaaacuggaauucuuug

SEQ ID NO: 125335 - RNA, 64 nt, Homo Sapiens
aggaaacuucugauguuuauuaaaaaaacuggccuuuugauagagguaacuuaauuugggaauu

SEQ ID NO: 125336 - RNA, 64 nt, Homo Sapiens
ucaguucuaccaaauaggaugucauguuugacauuuuugauagugacuuuggggucuucuucac

SEQ ID NO: 125337 - RNA, 64 nt, Homo Sapiens
ugcaggguuuuaaacuuuauaauuacuuuaauauuuuugauaacuagaaaucuaguauugccau

SEQ ID NO: 125338 - RNA, 64 nt, Homo Sapiens
uuuaaaauuaaucuuugcauauaaaagaacugacuuuugauaguuuuucucagugaccucugga

SEQ ID NO: 125339 - RNA, 64 nt, Homo Sapiens
aacaccagauuugaaaguucuaaugaaaaucacauuuugauacaaggacuagcuuaccugauuu

SEQ ID NO: 125340 - RNA, 64 nt, Homo Sapiens
gaggucuuguugagaaggcaaaauuuucuaaauauuuugauaucaauuuggguaaagaaaggaa

SEQ ID NO: 125341 - RNA, 64 nt, Homo Sapiens
gcuuaugcuaguucaguauuuggucuaggcuucauuuugauaugacugaauugcaaucuauauu

SEQ ID NO: 125342 - RNA, 64 nt, Homo Sapiens
ucuguuuuuuuuuaauuuguuguuguuguuacuguuuugauaccucggaaacaccuccguugac

SEQ ID NO: 125343 - RNA, 64 nt, Homo Sapiens
uguauuugcaccaucauuuacuuuucuggcuuacuuuugauagaaaucuagguugguucaaacc

SEQ ID NO: 125344 - RNA, 64 nt, Homo Sapiens
auuaaauuuaaauuuguccuuccuccaacuaaauuuuugauagauagaauuaaauuuaaauuua

SEQ ID NO: 125345 - RNA, 64 nt, Homo Sapiens
auuaaauuuaaauuuauccuuaaauuugauaaauuuuugauagaguuggaguguuugcacaauu

SEQ ID NO: 125346 - RNA, 64 nt, Homo Sapiens
ccaguccagcagaauuacauuuugaugaccuccauuuugauacuuguagaccagaucuaauccg

SEQ ID NO: 125347 - RNA, 64 nt, Homo Sapiens
aguagguacguuuauuuuuacuuuuuuauuauaauuuugauauuaaaaagaacagagauggggu

SEQ ID NO: 125348 - RNA, 64 nt, Homo Sapiens
ggcauuuugaaaacuuuuagaaaaaaguaguacuuuuugauacuuuaguauuuauggaaacuag

SEQ ID NO: 125349 - RNA, 64 nt, Homo Sapiens
uguuugcuugagaaaagcaaaaaugcuaacaagguuuugauagauuggcccaaaauucuaacuu

SEQ ID NO: 125350 - RNA, 64 nt, Homo Sapiens
ccauguauucacacuuuaaauacugauacauccauuuugauauaucagauuuuaguuuuuaaaa

SEQ ID NO: 125351 - RNA, 64 nt, Homo Sapiens
aaauucuuuggaacuuuaauaaguuuuguuuuaguuuugauaauuauuacuuuauguacaacug

SEQ ID NO: 125352 - RNA, 64 nt, Homo Sapiens
uuuaauuauauucucuacaccuuaaaagauauauuuuugauauaaaaggcauccauuuucuagg

SEQ ID NO: 125353 - RNA, 64 nt, Homo Sapiens
aauaagaaagggagugagugaguuuuccaucuguuuuugauaagauccugaagaaauaagccuc

SEQ ID NO: 125354 - RNA, 64 nt, Homo Sapiens
uuugaguucauuuuuuccacuagugcuuugugcauuuugauauaaagcgguaauggaggaagac

SEQ ID NO: 125355 - RNA, 64 nt, Homo Sapiens
uuuguuuucaccucuugacaagugcaacaggguguuuugauacccagucuauaacuaucaacgu

SEQ ID NO: 125356 - RNA, 64 nt, Homo Sapiens
aacauuuccaguuggucauucuaagcauuuacccuuuugauacucuagcuagucagguacucca

SEQ ID NO: 125357 - RNA, 64 nt, Homo Sapiens
caauguaaaugaaauaaauauauucaaauuggcuuuuugauaugcaucaaguggcauuuuguuc

SEQ ID NO: 125358 - RNA, 64 nt, Homo Sapiens
guuuucagaaaaagaaaugauccauuacucugauuuuugauacaagugugugguagaaacaaac

SEQ ID NO: 125359 - RNA, 64 nt, Homo Sapiens
aauuuagaacagcauuguccauacuguugcacaauuuugauaaaugcaaaccuacuaacaaauu

SEQ ID NO: 125360 - RNA, 64 nt, Homo Sapiens
auuguacuguguuuuuaaauuuggcugugcuguauuuugauauaaaaggaaguuuuaaaggccg

SEQ ID NO: 125361 - RNA, 64 nt, Homo Sapiens
ugauaauuuuuuuuuuuuaguaacuuauggacuguuuugauagauucuuucaaccuauacaacc

SEQ ID NO: 125362 - RNA, 64 nt, Homo Sapiens
gcagaagaaaugaagaaagugaugaugauuuagauuuugauauugauuuagaagacacaggagg

SEQ ID NO: 125363 - RNA, 64 nt, Homo Sapiens
acauugccucaaaaauugguccucgguaagugccuuuugauaaaugaucucaaauaaaugacuc

SEQ ID NO: 125364 - RNA, 64 nt, Homo Sapiens
auauuugcuuccuuaauuccgugcacuuuugauauuuugauauuuuuuuuuauccgaucaaccu

SEQ ID NO: 125365 - RNA, 64 nt, Homo Sapiens
uugauauuauauuugcuuccaucaaccugugcacuuuugauauuacauguucuuuuuuuauccg

SEQ ID NO: 125366 - RNA, 64 nt, Homo Sapiens
aaaaacagaaaacccauccacucccaacucauauuuuugauaggcuacuuuagagccucuuuuu

SEQ ID NO: 125367 - RNA, 64 nt, Homo Sapiens
acuccccgaucuagauuuauucuaggguuguagcuuuugauacacguaacacagaacgagguua

SEQ ID NO: 125368 - RNA, 64 nt, Homo Sapiens
acacaguaucauugcaaaugcaguuuacagggauuuuugauauacuggcuugggaccuauaaga

SEQ ID NO: 125369 - RNA, 64 nt, Homo Sapiens
uaaauaacuacauaauagccugagaauaaugggauuuugauagugccauuuauuguuaaagauu

SEQ ID NO: 125370 - RNA, 64 nt, Homo Sapiens
agcaaguuuuuaaaucauuugugugcucuggcucuuuugauagaagaaagcaacacaaaagcuc

SEQ ID NO: 125371 - RNA, 64 nt, Homo Sapiens
acaaccuuuccaauaaucccuuaaucagaucacauuuugauaaacccugggaacaucuggcugc

SEQ ID NO: 125372 - RNA, 64 nt, Homo Sapiens
ucguuaugaguguauuuuugcaaaauuuuaaggcuuuugauacuuugcuggguuaccaaauaug

SEQ ID NO: 125373 - RNA, 64 nt, Homo Sapiens
uaucauuuguccuuuuacuuaaccaauguuaauauuuugauaaaucauccuacuauguugaaag

SEQ ID NO: 125374 - RNA, 64 nt, Homo Sapiens
gggcaaaugaauuagccaacuguuaacuggaagcuuuugauaauuuuuuuuuuuagaacaauuu

SEQ ID NO: 125375 - RNA, 64 nt, Homo Sapiens
ccuuugcugaguuauacauuccuuuaucaaucucuuuugauacaacauuuaaaacaaguagcuu

SEQ ID NO: 125376 - RNA, 64 nt, Homo Sapiens
auuggugaauguuccuaaacaagaacuacaucauuuuugauagaccucucccaucauuuugaua

SEQ ID NO: 125377 - RNA, 64 nt, Homo Sapiens
gaacuacaucauuuuugauauuccucucccaucauuuugauaaaaucaagaacccuaugaagaa

SEQ ID NO: 125378 - RNA, 64 nt, Homo Sapiens
uuuuuuccaaguagcagacgucauguugcaugguuuuugauauuuauauguaaguuuuucaaau

SEQ ID NO: 125379 - RNA, 64 nt, Homo Sapiens
gauuaauuuuaugaaauaaauucugagcugcugcuuuugauauagucagacuuaagacugaacc

SEQ ID NO: 125380 - RNA, 64 nt, Homo Sapiens
gggucaguguuauaaauaaugaaaagcauauucuuuuugauagauuuuugucacuuccccauca

SEQ ID NO: 125381 - RNA, 64 nt, Homo Sapiens
gaaggcagaaauugcguuuacucauucacucaccuuuugauauccuuccuucaacuaaucuugu

SEQ ID NO: 125382 - RNA, 64 nt, Homo Sapiens
aggaaaaacuuaugcgguagccugcauuagggcuuuuugauacuugcagauugggggaaaacaa

SEQ ID NO: 125383 - RNA, 64 nt, Homo Sapiens
aaaauuggcgacuugaaauuaaaucaugccaagguuuugauacacuugucuuaagauauuaaug

SEQ ID NO: 125384 - RNA, 64 nt, Homo Sapiens
auguucuuuucauagucguauauuuuuauacugauuuugauaucauauuuaaguagccuguggc

SEQ ID NO: 125385 - RNA, 64 nt, Homo Sapiens
auuugagggaggcagaagucauauucccuugagauuuugauacauguauauuccaguuaccuag

SEQ ID NO: 125386 - RNA, 64 nt, Homo Sapiens
aaacaugaauuuucaguucccuccaaguguuuauuuuugauaccucuuccugccgccuccccca

SEQ ID NO: 125387 - RNA, 64 nt, Homo Sapiens
auaaucuauuuuuaaaugggcucccccgcugccauuuugauaguuacuccaggucucccugucu

SEQ ID NO: 125388 - RNA, 64 nt, Homo Sapiens
acuuagaaaccgauguuauuaaaaaaaaaaaaaaucaacucauaagcgaaacuccgucucaaaa

SEQ ID NO: 125389 - RNA, 64 nt, Homo Sapiens
gccuguaaucccagcacuuuccaguaguuaaaaaucaacucauuugggccugccuggccuaaac

SEQ ID NO: 125390 - RNA, 64 nt, Homo Sapiens
auuuuaggaauuuauuucugauugaacuauuugcucaacucaacgguaguuugauagggauagc

SEQ ID NO: 125391 - RNA, 64 nt, Homo Sapiens
gucccaagaauuuggaaugguaguaauucucaacucaacucaaagguuuccuaaccuccucuug

SEQ ID NO: 125392 - RNA, 64 nt, Homo Sapiens
ucaaagucccaagaauuuggucuuguaguaauucucaacucaacauccugguuuccuaaccucc

SEQ ID NO: 125393 - RNA, 64 nt, Homo Sapiens
uguaugaaucuggaguguaacuuuaaauguaacaucaacucaguauacaaccccaaaucuacua

SEQ ID NO: 125394 - RNA, 64 nt, Homo Sapiens
ggacaacaguggcaaagcugaaauuuuuauacauucaacucaugauucacauguggcaucaguc

SEQ ID NO: 125395 - RNA, 64 nt, Homo Sapiens
gcaaugcaucccaaugguuguggggauugugggcucaacucaagagaaguuuaggagggggagc

SEQ ID NO: 125396 - RNA, 64 nt, Homo Sapiens
ugaaaaaacugguccuuuggcuccaacaaaggagucaacucagucacccuccacccacuaccuc

SEQ ID NO: 125397 - RNA, 64 nt, Homo Sapiens
gaguauuuauuaauggcugcagcauuaguuuagaucaacucaagagagcugcaccucuccuccu

SEQ ID NO: 125398 - RNA, 64 nt, Homo Sapiens
ggcuuauuuccaauuuaauuguaagaaugagcuuucaacucauauaaaagaacaguaaacauug

SEQ ID NO: 125399 - RNA, 64 nt, Homo Sapiens
agaguuccuucaaaugaugacauagaaaguuucuucaacucaaauuuuaggcauauguuuuaaa

SEQ ID NO: 125400 - RNA, 64 nt, Homo Sapiens
gcaaggccagccuuucuggcagaaggagcuguccucaacucagggccgcugugagcaaagcuga

SEQ ID NO: 125401 - RNA, 64 nt, Homo Sapiens
agaaggggacaggcaguccgcggucucuggacaaucaacucaagguacgcccacugcaaggccu

SEQ ID NO: 125402 - RNA, 64 nt, Homo Sapiens
ggccccucguuuuaucauucccaguccauugucaucacgucagagaaaaaucuucaggggugcu

SEQ ID NO: 125403 - RNA, 64 nt, Homo Sapiens
auuuuaaugaguuauaaaauuauucugcaucucaucacgucacaguauuucuguacuauuuauu

SEQ ID NO: 125404 - RNA, 64 nt, Homo Sapiens
cuucaagcugauccaguaggugcagcugccgcagccgggggaggccugcccgggaaggcugcug

SEQ ID NO: 125405 - RNA, 64 nt, Homo Sapiens
ggccuuccugaacugggaagucccuggcuggcccccgggggagaggggcaaaugccuccgggac

SEQ ID NO: 125406 - RNA, 64 nt, Homo Sapiens
ucauuggccugcccuucaacaauggccucaugggccgggggaacaucccuacccuuggcagugu

SEQ ID NO: 125407 - RNA, 64 nt, Homo Sapiens
uaucuuuauacuauauaauaugguaacuuggguaccgggggaacuuuaaaauuucaucucaaaa

SEQ ID NO: 125408 - RNA, 64 nt, Homo Sapiens
gguggguguggacacauugggacuuccacggcacccgggggagugcagagaaacagauguugca

SEQ ID NO: 125409 - RNA, 57 nt, Homo Sapiens
cgggcacugcuccuggcucuacacagaccgggggacuccaugugggugaaaggauag

SEQ ID NO: 125410 - RNA, 64 nt, Homo Sapiens
caggagugagcgagggcagcggaaaggaguucuuccgggggacacgaauugccuggcugaguag

SEQ ID NO: 125411 - RNA, 64 nt, Homo Sapiens
cugcagaugccacaccugcuccuucuugcuuuccccgggggaggaaggggguuguggucgggga

SEQ ID NO: 125412 - RNA, 64 nt, Homo Sapiens
ugaggcuggcucacccugaagaggugggauaggaccgggggaccccagagggaggccuaggagg

SEQ ID NO: 125413 - RNA, 64 nt, Homo Sapiens
uggcuguguuaaagaaagacacacuguuucaaacccgggggagucacaagcaagagagaauuua

SEQ ID NO: 125414 - RNA, 64 nt, Homo Sapiens
uggcagggcaggggguggugggccagacugguccccgggggacuucuucacaggggcugcuggc

SEQ ID NO: 125415 - RNA, 64 nt, Homo Sapiens
cccagcauggcuggagugggaagaggcuugggccccgggggaaugguuagggggacugaacccc

SEQ ID NO: 125416 - RNA, 64 nt, Homo Sapiens
guuuggucuugucagaccuguagccuggaccucgccgggggaccagggagugcacgucuguaga

SEQ ID NO: 125417 - RNA, 63 nt, Homo Sapiens
gggaggagagggaggggaggcacgggcgccuucccgggggaguucucggccauguccggcuga

SEQ ID NO: 125418 - RNA, 64 nt, Homo Sapiens
cagaggcuggggguagccauugugcagucauggcccgggggaaacuugccaaccuucgugucag

SEQ ID NO: 125419 - RNA, 64 nt, Homo Sapiens
aguuucugccauagccccaugcccagccugugcgccgggggaccuggggacucgggugcuggga

SEQ ID NO: 125420 - RNA, 64 nt, Homo Sapiens
ccuguccuccaggcuguaggggaggagagccuggccgggggagacagacuggacauuucccugu

SEQ ID NO: 125421 - RNA, 64 nt, Homo Sapiens
acgaccucguaucccgcgucccgaggcccagcggccgggggaggcgcggcgcgguaggcgagcg

SEQ ID NO: 125422 - RNA, 53 nt, Homo Sapiens
ggacccgagagccgcucugagcaccgggggaugugacugccucagcggcagag

SEQ ID NO: 125423 - RNA, 64 nt, Homo Sapiens
guuugcccaguccuggguuguuuccaggagaaagccgggggaggggcccucaggccauucccca

SEQ ID NO: 125424 - RNA, 64 nt, Homo Sapiens
aagcucagcuccgugugacccacauggccccaggccgggggacaccagaggcuccuccaugggc

SEQ ID NO: 125425 - RNA, 64 nt, Homo Sapiens
ucugaauuuaacaaaugcuuagucucagcagccuccgggggaaaaaagcuuagccuagcaguca

SEQ ID NO: 125426 - RNA, 64 nt, Homo Sapiens
aaccgcaguguccccugucaccagccaaggagacccgggggaggccgccacguugcagaaagag

SEQ ID NO: 125427 - RNA, 64 nt, Homo Sapiens
caaauccuaggcccugcauuccugucauccucauccgggggaaacaccaucaucccaguagcug

SEQ ID NO: 125428 - RNA, 64 nt, Homo Sapiens
acgcagggcggucuucugcugccccgcggcccagccgggggauacgcagcgggagcgcacaggu

SEQ ID NO: 125429 - RNA, 64 nt, Homo Sapiens
aggaauccccagcccuugagggcacacuagcauuccgggggauggaggugguccccaugucccu

SEQ ID NO: 125430 - RNA, 56 nt, Homo Sapiens
gacggcaaacagguaaggaguuaccuccgggggaugcaacaggcccacuccucuga

SEQ ID NO: 125431 - RNA, 64 nt, Homo Sapiens
gagguuguagugagccaagaagaaucacuugaacccgggggacaacuggggaggcugaggcagg

SEQ ID NO: 125432 - RNA, 60 nt, Homo Sapiens
ggcgcgggagggggcggggcagccggggggccgggggagguggcggucaaguccagcuga

SEQ ID NO: 125433 - RNA, 64 nt, Homo Sapiens
uggggcugagagaguauaaauuuaggucuuuaguccgggggacucaggaaugagucaaucagcc

SEQ ID NO: 125434 - RNA, 64 nt, Homo Sapiens
ccugaaaggcugcuccuggccagaggacucugucccgggggaccguguccucccccauguccug

SEQ ID NO: 125435 - RNA, 64 nt, Homo Sapiens
guagggacucuaccccccucccugacaccacaggccgggggagagccaaagggcuccuguccac

SEQ ID NO: 125436 - RNA, 64 nt, Homo Sapiens
ccagugaagccucugagggagccccuccauccacccgggggagcccccacagugagcaugccgg

SEQ ID NO: 125437 - RNA, 60 nt, Homo Sapiens
uggguguggguggaagggcugauccgcuggccgggggaggaggguugguuucaggccuga

SEQ ID NO: 125438 - RNA, 64 nt, Homo Sapiens
auguggacucuggaagagccaggggcccagaaugccgggggaggcuucugaguggcacucaugg

SEQ ID NO: 125439 - RNA, 64 nt, Homo Sapiens
cugagacuaagacguggacaggggccgcgcagauccgggggaggcucccaaauuggaaccaggc

SEQ ID NO: 125440 - RNA, 64 nt, Homo Sapiens
gucaccuggcaccacuggggugcacuaauguauuccgggggacuacacauggagucuuagcaaa

SEQ ID NO: 125441 - RNA, 64 nt, Homo Sapiens
gggugacugaacugggaguccucuuugaauucuuccgggggaagugacauagacccugcccuuc

SEQ ID NO: 125442 - RNA, 64 nt, Homo Sapiens
acuggugccuugcuuagagccagaagggaugaagccgggggaucuauggaacagaggaggagcg

SEQ ID NO: 125443 - RNA, 64 nt, Homo Sapiens
auguggaacccagccacacuuggugcgggacacuccgggggagagaacaugaccuucuggcugc

SEQ ID NO: 125444 - RNA, 64 nt, Homo Sapiens
cugcggccaggccuggugccuagcaacagcaauaccgggggaccaucgcugccccccaaccucg

SEQ ID NO: 125445 - RNA, 64 nt, Homo Sapiens
gcuggggcugggaagcccggcugcggccaguggcccgggggaaacccugagaggcgcccgcggu

SEQ ID NO: 125446 - RNA, 64 nt, Homo Sapiens
cuuccuuggcauuuggcaucacugccuucuguucccgggggagcauggaucuuuuguccucacu

SEQ ID NO: 125447 - RNA, 64 nt, Homo Sapiens
ggcccagggcgggaaauggacucagccgcagccuccgggggacaaauggcugaguggaucaaac

SEQ ID NO: 125448 - RNA, 64 nt, Homo Sapiens
cccagggaccggagcauuucccccgccccuccugccgggggaggggccucacugcaggcaggag

SEQ ID NO: 125449 - RNA, 64 nt, Homo Sapiens
auugaauuguucagaaccugaguguggccacagaccgggggaugcaguuuggaucuauuggggg

SEQ ID NO: 125450 - RNA, 64 nt, Homo Sapiens
gggacacuccuccucggaagacugaagcacagcaccgggggagagcccgcgugcuggagaauug

SEQ ID NO: 125451 - RNA, 64 nt, Homo Sapiens
ccugcccugcccagguggccugccgggcacaugcccgggggacgccuaccagcuccuccagccc

SEQ ID NO: 125452 - RNA, 64 nt, Homo Sapiens
ugcaacggcucuccuuugccaugauguucuguccccgggggagaucuccuaccuuuccucaggu

SEQ ID NO: 125453 - RNA, 64 nt, Homo Sapiens
cucugagggcccagcccuccccggggcgcucugcccgggggacuccggacacugacagccgcgu

SEQ ID NO: 125454 - RNA, 64 nt, Homo Sapiens
uucaugcgcugcgaguggcggggcugcccagaggccgggggagcagacagggccggugcucccu

SEQ ID NO: 125455 - RNA, 64 nt, Homo Sapiens
ugagugccauacucccaacagcuccagguacccaccgggggaugugccugcucaggaaaccucu

SEQ ID NO: 125456 - RNA, 64 nt, Homo Sapiens
gcccguggggugagcagcuggcuuggccggaaacccgggggaggcccagccacggcacauccug

SEQ ID NO: 125457 - RNA, 64 nt, Homo Sapiens
uugaacauucaucuguacugaaguguuacuugaaccgggggaaucucggaccugggggagccgg

SEQ ID NO: 125458 - RNA, 64 nt, Homo Sapiens
acugaccgcuucauaagccauuaguguuugggggccgggggagguuaaagaaaaaugaaaaagg

SEQ ID NO: 125459 - RNA, 64 nt, Homo Sapiens
ggaccgccggccucagcuaccaucugccugcuccccgggggagaacaccaccccuugccaaagu

SEQ ID NO: 125460 - RNA, 64 nt, Homo Sapiens
cacugccccguccaaggccgcggcacuccucaggccgggggagcggcagcguggccacaagggg

SEQ ID NO: 125461 - RNA, 59 nt, Homo Sapiens
gcauggugcacgucuacugaaaugggggcccgggggacuuuuuuaaaaaaccagaucgg

SEQ ID NO: 125462 - RNA, 64 nt, Homo Sapiens
gccauuuggguaagccgguggcuggucucgucugccgggggaaggguggggaggugcaauggga

SEQ ID NO: 125463 - RNA, 64 nt, Homo Sapiens
gaugcggguggcccaaggaccacgaucaagggguccgggggaccgaggucccagaucagugagg

SEQ ID NO: 125464 - RNA, 64 nt, Homo Sapiens
gggggagcuggauccagagcuggaggggguggguccgggggagggaguggcucggaaggggccc

SEQ ID NO: 125465 - RNA, 64 nt, Homo Sapiens
gaggcccggaccaguugggaggagugagcaggccccgggggagggggaugagcgcaguuugcuc

SEQ ID NO: 125466 - RNA, 64 nt, Homo Sapiens
aaggagcaacucuguccccugagcguugggggucccgggggagagguggacagacaccucccuc

SEQ ID NO: 125467 - RNA, 64 nt, Homo Sapiens
ugaccucacagcucugcagaggauggagcuugcuccgggggaccgggacugucuguucucaggg

SEQ ID NO: 125468 - RNA, 64 nt, Homo Sapiens
ggggaguugggggcuggauaccgggguggcgcgcccgggggaggugagcugcccuccgcucccu

SEQ ID NO: 125469 - RNA, 64 nt, Homo Sapiens
caccagccccucacuggguuuugagggggucaugccgggggagcgcaacaucuccccuucguuu

SEQ ID NO: 125470 - RNA, 64 nt, Homo Sapiens
cgggcugcugggcagcagguccaccagggcagccccgggggaucgcuagcuccaccugccuugg

SEQ ID NO: 125471 - RNA, 64 nt, Homo Sapiens
ugugccagcccccuccagucugccacugccgugcccgggggacauccugcgcccaggcuggagg

SEQ ID NO: 125472 - RNA, 64 nt, Homo Sapiens
guacggccuugucuucaggucucgaggccugacuccgggggacagguggcagcaggucggccgc

SEQ ID NO: 125473 - RNA, 64 nt, Homo Sapiens
aaaaaacaauaaaggacuguccccucaaaaccagccgggggacuguuaaauuggcucagggcua

SEQ ID NO: 125474 - RNA, 64 nt, Homo Sapiens
caucggcgugagcccgcuccccucuccccgcgggccgggggacgccccccagacucacacgggg

SEQ ID NO: 125475 - RNA, 55 nt, Homo Sapiens
uggccugugcugaaagcuagguccuccgggggaggaggguguagcuggcauguca

SEQ ID NO: 125476 - RNA, 64 nt, Homo Sapiens
ggaacaugugccucccguuccagcaucuggcugcccgggggaggaaggacacccggggcgggcg

SEQ ID NO: 125477 - RNA, 64 nt, Homo Sapiens
ucuucccauuuccuggcacacucugccccucuguccgggggacacgcgcauguguuugccaggg

SEQ ID NO: 125478 - RNA, 64 nt, Homo Sapiens
gcuggcacagcaguucugagcccuggacucugccccgggggauguggccggcacugggcagccc

SEQ ID NO: 125479 - RNA, 64 nt, Homo Sapiens
gugcuggucugagccccacgaagaguggcuggagccgggggacuccucugugugguccaagggc

SEQ ID NO: 125480 - RNA, 64 nt, Homo Sapiens
ggaaggaagggccgcugucgccugacgguugcguccgggggaggccugcuuuugacccaaaggu

SEQ ID NO: 125481 - RNA, 64 nt, Homo Sapiens
gggggagggaguugggagaaccggagcccccagcccgggggagaacugcgcucaggaucccgcc

SEQ ID NO: 125482 - RNA, 64 nt, Homo Sapiens
ggugaaauugggguucaggcccugggcccuaugcccgggggaagcauucgggugagcguccugg

SEQ ID NO: 125483 - RNA, 64 nt, Homo Sapiens
ccucuucacacccaaagaugcccuccccaccggcccgggggagacagaggccugucucccccuu

SEQ ID NO: 125484 - RNA, 64 nt, Homo Sapiens
gacaucgagcgagucaacauaccaaucuguuuggccgggggaugagcggcggauccugguggcc

SEQ ID NO: 125485 - RNA, 64 nt, Homo Sapiens
aggcugaguccaccgcuguggugaucgugccagcccgggggaaagaaggaagcagaaguucaag

SEQ ID NO: 125486 - RNA, 64 nt, Homo Sapiens
cuaguccgccuggggcuggcuccuccgacuacacccgggggaaccuccgcccgcagacucuggc

SEQ ID NO: 125487 - RNA, 64 nt, Homo Sapiens
ucucagagaagccauagccccgagugacagggcuccgggggaagccccuucccccgugugaaca

SEQ ID NO: 125488 - RNA, 64 nt, Homo Sapiens
uucugcagucugcgccuuuccacgcccuccagccccgggggagauaaggucaugggagaguggg

SEQ ID NO: 125489 - RNA, 64 nt, Homo Sapiens
gguccauauuaaagaagcaagggucuucccauacccgggggaccccugacaaaccuaccaggcc

SEQ ID NO: 125490 - RNA, 64 nt, Homo Sapiens
auggccuguuccgggacacuucuuuguguagggaccgggggacccaggagccaagcccaccccu

SEQ ID NO: 125491 - RNA, 64 nt, Homo Sapiens
uugugggcaacgguggaggaaggaggugacaucgccgggggaggggcugacggccgacccuggg

SEQ ID NO: 125492 - RNA, 64 nt, Homo Sapiens
cgaggcucggagcacccuugccagcugcccccggccgggggaugaugcaccuucugaggcaccu

SEQ ID NO: 125493 - RNA, 64 nt, Homo Sapiens
ccacggcccuuuggggaccugcacacccaccucuccgggggacuugacaaggggcccugaggcc

SEQ ID NO: 125494 - RNA, 64 nt, Homo Sapiens
cugagccccucccuccugugccuggccccagugaccgggggaagaaccggcuggaccacgucuc

SEQ ID NO: 125495 - RNA, 64 nt, Homo Sapiens
ggccggggcgcggcgugcaacguguccgggggcaccgggggauuccgacggcccggaaguuccg

SEQ ID NO: 125496 - RNA, 64 nt, Homo Sapiens
caccaaugggccugcccccaccccaggaguuuggccgggggaacccauucaugcuguuccucug

SEQ ID NO: 125497 - RNA, 64 nt, Homo Sapiens
uccauaauauaucuaauuacaggagaauuuacaacaucucaaguacguaaauuaaguugucauu

SEQ ID NO: 125498 - RNA, 64 nt, Homo Sapiens
auagcauggcccuuaugucuugaguugagguuaucaucucaaugaggcuuaagcuccuagagua

SEQ ID NO: 125499 - RNA, 64 nt, Homo Sapiens
acugcacuccacccugggcaacagagcaagaccccaucucaaaaauaaauaaauauauauaaaa

SEQ ID NO: 125500 - RNA, 64 nt, Homo Sapiens
ugguaacuuggguaccgggggaacuuuaaaauuucaucucaaaaauaauuuuuaaaaagccuga

SEQ ID NO: 125501 - RNA, 64 nt, Homo Sapiens
aacauuauuuuuaaaauuagacauagugagaucccaucucaaaaguuugagaccagccugggca

SEQ ID NO: 125502 - RNA, 64 nt, Homo Sapiens
acaaaaaaacaaaauucaugacagagcaagacgccaucucaaaaauugcacuccagccugggcg

SEQ ID NO: 125503 - RNA, 64 nt, Homo Sapiens
cauccuucagugauaucaccacuugcucagucaccaucucaaccuuaugucaccucagcccuca

SEQ ID NO: 125504 - RNA, 64 nt, Homo Sapiens
agucaccaucucaaccuuaugucaccucagcccucaucucaaugcccaaaccccuuacacacac

SEQ ID NO: 125505 - RNA, 64 nt, Homo Sapiens
cauuguguguuuuguuccggguuucagucuuuuccaucucaaggcggauauagucauucuaggg

SEQ ID NO: 125506 - RNA, 64 nt, Homo Sapiens
uaaaaagaaaaaaagugguuacacagugaaacuccaucucaauuguuugagaccagccucauca

SEQ ID NO: 125507 - RNA, 64 nt, Homo Sapiens
aaauuuacuucagguuuguguauuguaaauugcucaucucaauacaaugugcuguaaaguguuu

SEQ ID NO: 125508 - RNA, 64 nt, Homo Sapiens
aacccaucguaaguccaaaaagcuccuugacuuacaucucaauaagggugucuaggaauacaga

SEQ ID NO: 125509 - RNA, 64 nt, Homo Sapiens
agccccgucuggugccaguguggaagcugccucccaucucaacucccugagagccacaggugcc

SEQ ID NO: 125510 - RNA, 64 nt, Homo Sapiens
acugcacuccaggcugggugacagagcgagacuccaucucaaaaaaaaaaaaaagaaaaaaaaa

SEQ ID NO: 125511 - RNA, 64 nt, Homo Sapiens
agagcaugccgcugcacuccagccugggagacugcaucucaaaaaagaaaaauaaacgaaguaa

SEQ ID NO: 125512 - RNA, 64 nt, Homo Sapiens
cugcucuccagccugcaugacgggagugagacaccaucucaaaaaauacauauaauaauauaaa

SEQ ID NO: 125513 - RNA, 64 nt, Homo Sapiens
aaguuuaaucaaugaucaucgacguuugacuagccaucucaagcagccaucucaagcaaguuuc

SEQ ID NO: 125514 - RNA, 64 nt, Homo Sapiens
aaguuucgacguuugacuaggacguuugacuagccaucucaagccuacuuuuucuuugauuuuc

SEQ ID NO: 125515 - RNA, 64 nt, Homo Sapiens
caaaacaaaaaaaauuagccacagagagagacuccaucucaaaacacugcacuccagccuggcg

SEQ ID NO: 125516 - RNA, 64 nt, Homo Sapiens
cacuuagggguguauuguuuuuguuucaaagaaacaucucaauaaugcauaaaauuaaauauuu

SEQ ID NO: 125517 - RNA, 64 nt, Homo Sapiens
aaaaaaaaaaaauauuaagaacagagccagacuccaucucaaagacugcacuccagccugggug

SEQ ID NO: 125518 - RNA, 64 nt, Homo Sapiens
aaaaaaauaagaggccggguacagugugagacuccaucucaaaaacugcacuccagcccaggug

SEQ ID NO: 125519 - RNA, 64 nt, Homo Sapiens
auauauguccuauaaauggauauuuccaucagcccaucucaacagucuguggcacauucuuaaa

SEQ ID NO: 125520 - RNA, 64 nt, Homo Sapiens
accugaaugucccaacccaguugcaucccugaaacaucucaacaggcuugcagucucccagaug

SEQ ID NO: 125521 - RNA, 64 nt, Homo Sapiens; identical to SEQ ID NO: 91204

SEQ ID NO: 125522 - RNA, 64 nt, Homo Sapiens; identical to SEQ ID NO: 91205

SEQ ID NO: 125523 - RNA, 64 nt, Homo Sapiens; identical to SEQ ID NO: 91206

SEQ ID NO: 125524 - RNA, 64 nt, Homo Sapiens; identical to SEQ ID NO: 91207

SEQ ID NO: 125525 - RNA, 64 nt, Homo Sapiens; identical to SEQ ID NO: 91208

SEQ ID NO: 125526 - RNA, 64 nt, Homo Sapiens; identical to SEQ ID NO: 91209

SEQ ID NO: 125527 - RNA, 64 nt, Homo Sapiens; identical to SEQ ID NO: 91210

SEQ ID NO: 125528 - RNA, 64 nt, Homo Sapiens; identical to SEQ ID NO: 91211

SEQ ID NO: 125529 - RNA, 64 nt, Homo Sapiens; identical to SEQ ID NO: 91212

SEQ ID NO: 125530 - RNA, 64 nt, Homo Sapiens; identical to SEQ ID NO: 91213

SEQ ID NO: 125531 - RNA, 64 nt, Homo Sapiens; identical to SEQ ID NO: 91214

SEQ ID NO: 125532 - RNA, 64 nt, Homo Sapiens; identical to SEQ ID NO: 91215

SEQ ID NO: 125533 - RNA, 64 nt, Homo Sapiens
cagcagucuccugccuuguugggugagguggccaaaaccagaacgccggaggggacguggccaa

SEQ ID NO: 125534 - RNA, 64 nt, Homo Sapiens
caaucaaaccucagcccgagcccucaccuucuccaaaccagaucgcagccaccuccucugagau

SEQ ID NO: 125535 - RNA, 64 nt, Homo Sapiens
ucuuuagggcacaauuuuuuaccgcaccuggccuaaaccagauuugggauuacaggugugagcc

SEQ ID NO: 125536 - RNA, 64 nt, Homo Sapiens
ucucuuuuuuuuuccugagacauuccuaucuucuaaaccagauuucaggucaauguucaaugaa

SEQ ID NO: 125537 - RNA, 64 nt, Homo Sapiens
uuacagaauaacauguuuuaagauaauuaaguuuaaaccagagaauuugauuguuacucauuuu

SEQ ID NO: 125538 - RNA, 64 nt, Homo Sapiens
aaaaacauauuacuuugaauucaaauugucaugaaaaccagaacaguguuuguccauguugcau

SEQ ID NO: 125539 - RNA, 64 nt, Homo Sapiens
ugaacauguauuuguugagucauguuuugaagagaaaccagaucguuuguuaaaaaaacaaaca

SEQ ID NO: 125540 - RNA, 64 nt, Homo Sapiens
uuaaaauguagaagucguuggaacgagcugcagaaaaccagauugcuggucccuggagaacugc

SEQ ID NO: 125541 - RNA, 64 nt, Homo Sapiens
uguuuucugcccucugacucauacagugggagcaaaaccagaugugugccaagccauguuagag

SEQ ID NO: 125542 - RNA, 64 nt, Homo Sapiens
guuaggaauaguuauucuagauuacagaggauuuaaaccagaauugaagaauuugucuugagaa

SEQ ID NO: 125543 - RNA, 64 nt, Homo Sapiens
acuccuuguaaaauguauuuguccuucucaaagcaaaccagaggcccuccacugucacccuaaa

SEQ ID NO: 125544 - RNA, 64 nt, Homo Sapiens
aaugguugcugaacccaaaacauguuuaggaggaaaaccagaagaacagagcaguggcacugga

SEQ ID NO: 125545 - RNA, 64 nt, Homo Sapiens
aagagaagacauuugccuuuuguuaaaagaugguaaaccagaucugucuccaagaccuuggccu

SEQ ID NO: 125546 - RNA, 64 nt, Homo Sapiens
gagaaguuugaagcacaacucccuuaaggucuccaaaccagacggugacgccugcgggaccauc

SEQ ID NO: 125547 - RNA, 64 nt, Homo Sapiens
ugaaacauucaccugguagcggaagacuaaacagaaaccagaacuaaagaaaaaagaaaaaaaa

SEQ ID NO: 125548 - RNA, 64 nt, Homo Sapiens
gugucccacaaucagaaacccaggaagaaaacaaaaaccagacuugucuuuuuuaauuagaaga

SEQ ID NO: 125549 - RNA, 64 nt, Homo Sapiens
cggaauaauguuacuuuggauaagccacagagacaaaccagaaacuuaucauuaguagauuuua

SEQ ID NO: 125550 - RNA, 64 nt, Homo Sapiens
gccaaguggaucugcuggcaaaagagaguugaggaaaccagaagugcgcacacauacuagguug

SEQ ID NO: 125551 - RNA, 64 nt, Homo Sapiens
guuaacacauuaaagagucucugugccuggcccaaaaccagaccgggauuacaggccugagcaa

SEQ ID NO: 125552 - RNA, 64 nt, Homo Sapiens
uuuaaauuuuuauuuauuuauaggaaaguacuuaaaaccagacuuuuuuucauucuuccauccc

SEQ ID NO: 125553 - RNA, 64 nt, Homo Sapiens
gagaugguaaguuaacugauuccucugaaaguggaaaccagacugaagggaacauuuucccuca

SEQ ID NO: 125554 - RNA, 64 nt, Homo Sapiens
aggaaaaagaaggcacacuuucccacgaugucugaaaccagagcaacacaaaagggcaucacca

SEQ ID NO: 125555 - RNA, 64 nt, Homo Sapiens
ugguguuuaacuaaugcugcuggcggacauccuaaaaccagaugcauccucagaggacgagucu

SEQ ID NO: 125556 - RNA, 64 nt, Homo Sapiens
cuguaucuucagccagcaaacgaaaccauaucgcaaaccagagcugcuggaaaccagcacacgc

SEQ ID NO: 125557 - RNA, 64 nt, Homo Sapiens
aacaguuuuagaaagugaaaaaauacaggggucaaaaccagacuagaugaaagccacagaagau

SEQ ID NO: 125558 - RNA, 64 nt, Homo Sapiens
agacuauauucuucaucugacuuuauuguguauaaaaccagauuuuuuuuacauuuuaaauugu

SEQ ID NO: 125559 - RNA, 64 nt, Homo Sapiens
gcagaccccugcuccgaggacucuuaguuuuucaaaaccagaaucugggacuuaccaggguuag

SEQ ID NO: 125560 - RNA, 64 nt, Homo Sapiens
acucccaaagcgcaugauugcugggaaacaguagaaaccagacuugccuugaaaguguuuaagu

SEQ ID NO: 125561 - RNA, 64 nt, Homo Sapiens
acugaaggcaaaucuccuuuguccauuuaccuggaaaccagaaugauuuugacauacaggagag

SEQ ID NO: 125562 - RNA, 64 nt, Homo Sapiens
uugcauuucuuuauuucugucucauaauugucaaaaaccagaauuaggucaaguucauaguuuc

SEQ ID NO: 125563 - RNA, 64 nt, Homo Sapiens
uuuuauacuguccaaaaugaagcauccccgugacaaaccagagugggcagaagcaucgagagcg

SEQ ID NO: 125564 - RNA, 64 nt, Homo Sapiens
agccccucuucugcuguccuugaggacagacaccaaaccagagguggaggaagaacgguaggaa

SEQ ID NO: 125565 - RNA, 64 nt, Homo Sapiens
gaggacaauggaguuuuguaaccuugaccauuaaaaaccagaauaaaaacuguacacuguuguc

SEQ ID NO: 125566 - RNA, 64 nt, Homo Sapiens
cagaaucagugcugacucaguucccguauuaaacaaaccagagagggcucuuggauggaacccu

SEQ ID NO: 125567 - RNA, 64 nt, Homo Sapiens
ggugagaacaagcccaauguaaggaggaauggccaaaccagaugguaccuggaugauucccacc

SEQ ID NO: 125568 - RNA, 64 nt, Homo Sapiens
ccuuuugggagccacaggcuacugagauuacaaaaaaccagaggaaccuaagaaauggcuguaa

SEQ ID NO: 125569 - RNA, 64 nt, Homo Sapiens
uuguuuuguuuuuuuuuuuuaaugggggacaaaagagagggaaagaccccuauaaaucuauaua

SEQ ID NO: 125570 - RNA, 64 nt, Homo Sapiens
gaacugguuugugggacaggggcagcuugcucaggagagggaauaacgcaggucccuuuucuug

SEQ ID NO: 125571 - RNA, 64 nt, Homo Sapiens
ucuggacggcaggcucacugccaggccagccuccgagagggagagagagagagagaggacagcu

SEQ ID NO: 125572 - RNA, 64 nt, Homo Sapiens
ggagguugaagccaaguggggugcugggaggagggagagggaggucacuggaaaggggagagcc

SEQ ID NO: 125573 - RNA, 64 nt, Homo Sapiens
gaagagccugcccuccuauagagagagagggagggagagggaguggauucugaggguggggagg

SEQ ID NO: 125574 - RNA, 64 nt, Homo Sapiens
gagagggagugaagagccuggguggggagggagagagagggagggacugcuguuggauucugag

SEQ ID NO: 125575 - RNA, 64 nt, Homo Sapiens
aaccugugcugccugggacccaagggaggugcuggagagggauuuugauaucagaaugaacugu

SEQ ID NO: 125576 - RNA, 64 nt, Homo Sapiens
gaguuaacggugugggccacgcuccuugcccagggagagggaaaccacuccugggccugcccca

SEQ ID NO: 125577 - RNA, 64 nt, Homo Sapiens
auuacccaagagagguauccgagcugcuucagccgagagggacugugaucgccuggcccagcag

SEQ ID NO: 125578 - RNA, 64 nt, Homo Sapiens
cacccggaggagcagguggggaucccggcugcgagagagggagaucgagaugagacgccaugca

SEQ ID NO: 125579 - RNA, 64 nt, Homo Sapiens
gguucuguugggggugacacgggugacaccaggagagagggacaagagggacagguucugucag

SEQ ID NO: 125580 - RNA, 64 nt, Homo Sapiens
gguucugucaggggugacacgggugacaccaggagagagggacaacagggacagguucugucgg

SEQ ID NO: 125581 - RNA, 64 nt, Homo Sapiens
gguucuguugggggugacaagggugacaccaggagagagggacaacagggacagguucuaucau

SEQ ID NO: 125582 - RNA, 64 nt, Homo Sapiens
gguucugucaggggugacacccugcaaaccaggagagagggacagugaauaacaaacugcacaa

SEQ ID NO: 125583 - RNA, 64 nt, Homo Sapiens
cuguggugggucacaguguggcuauguuaucuaugagagggagaaugagaaagagagggacaga

SEQ ID NO: 125584 - RNA, 64 nt, Homo Sapiens
uggcuauguuaucuaugagagggagaaugagaaagagagggacagagagauaaaagaaauuggg

SEQ ID NO: 125585 - RNA, 64 nt, Homo Sapiens
acugcugcccuccuggcccuugggccaggaccgggagagggagcccacucacccaggagcuggc

SEQ ID NO: 125586 - RNA, 64 nt, Homo Sapiens
ugaaagcuggugugagcccaccauccuuccuggagagagggaggccauccccucaugggugcug

SEQ ID NO: 125587 - RNA, 64 nt, Homo Sapiens
uggcagcaugcaugcuguuuugccuugggcacgggagagggaagccgagauagauagccauguc

SEQ ID NO: 125588 - RNA, 64 nt, Homo Sapiens
cugaaugaucaauauagcuuuccuggaauguguugagagggauuaggcuaugucacccuaacua

SEQ ID NO: 125589 - RNA, 64 nt, Homo Sapiens
uccaugcuuuuaagaacuaacagucugaggcccugagagggaaaggagcgcuggauucguggca

SEQ ID NO: 125590 - RNA, 64 nt, Homo Sapiens
cggcccgcagcagaacagccgcugcugcuguguggagagggagggcugccagaccccaggccug

SEQ ID NO: 125591 - RNA, 64 nt, Homo Sapiens
aggaacuuugccugucccacgagggaguaugggagagagggacugccacacagaagcugaagac

SEQ ID NO: 125592 - RNA, 64 nt, Homo Sapiens
gcuacuguuggccugggagcugagagaaggcacugagagggacaguaggcggaggaccagguga

SEQ ID NO: 125593 - RNA, 64 nt, Homo Sapiens
uacaaggagggccucuggugauuaccugauaagggagagggaaaugggaccugcuaagugugga

SEQ ID NO: 125594 - RNA, 64 nt, Homo Sapiens
acaaagacagggaauaguggggaaagaggagaaggagagggaguuuauacaaaugggggcggcu

SEQ ID NO: 125595 - RNA, 64 nt, Homo Sapiens
uccccuacauagagcccugaccuucuccauucuggagagggacuguucagagucacuuuuguuc

SEQ ID NO: 125596 - RNA, 64 nt, Homo Sapiens
agggccuucucagaagcuuggagcaaauuuucaggagagggagagggugggaccagaaauucuu

SEQ ID NO: 125597 - RNA, 64 nt, Homo Sapiens
guauauuuaauguugauuguugaauuuuaguuacgagagggaagaacaauuuuacuucuguccu

SEQ ID NO: 125598 - RNA, 64 nt, Homo Sapiens
cugccuauaagaggaaauaagagagaaaguggaggagagggacaaaaggaguaauuauuuggua

SEQ ID NO: 125599 - RNA, 64 nt, Homo Sapiens
aagcauuaaaaugcaugguguugagaagaaucaggagagggauacaagagaggagauggggucc

SEQ ID NO: 125600 - RNA, 64 nt, Homo Sapiens
cccccucacugaagcuggguagccuauugggguugagagggaaaaugugaaaucucagaauuua

SEQ ID NO: 125601 - RNA, 64 nt, Homo Sapiens
uuuguuguuuuacucuaaagcugggaaaggaaaugagagggaaaagaccccggagagggaagaa

SEQ ID NO: 125602 - RNA, 64 nt, Homo Sapiens
agcugggaaaggaaaugagagggaaaagaccccggagagggaagaaaaucucaguauuuugaaa

SEQ ID NO: 125603 - RNA, 64 nt, Homo Sapiens
aggggaagaucugggcaauuuaagcaaugggagggagagggaggcccacaauucuggccauacu

SEQ ID NO: 125604 - RNA, 64 nt, Homo Sapiens
auuggguucauuuaugcccuggaaagggagaagugagagggacaauauaggaauaaugccuagg

SEQ ID NO: 125605 - RNA, 64 nt, Homo Sapiens
ugagaaugggcuuccuuuuugguucaguauuagugagagggagagggagauggaugguggggua

SEQ ID NO: 125606 - RNA, 64 nt, Homo Sapiens
ugggcuuccuuuuugguucaguauuagugagagggagagggagauggauggugggguagguuuu

SEQ ID NO: 125607 - RNA, 64 nt, Homo Sapiens
uucucucccccguccccguggacguaagcgcucugagagggaacgggggggguguccaggcgcg

SEQ ID NO: 125608 - RNA, 64 nt, Homo Sapiens
ugcggacucugcagcuccgcggccccggcgcagggagagggagggcacgggcgcgggccgggcc

SEQ ID NO: 125609 - RNA, 64 nt, Homo Sapiens
gagagagauagagcaggagggagacagagagggagagagggacacagagagggagagaggcaga

SEQ ID NO: 125610 - RNA, 64 nt, Homo Sapiens
gagggacagagagagauagagaggcagagagacagagagggagagagagaggcagagagggaga

SEQ ID NO: 125611 - RNA, 64 nt, Homo Sapiens
gaggcagagagacagagagggagggagagaggcagagagggagacagagaaggagagaggcaga

SEQ ID NO: 125612 - RNA, 64 nt, Homo Sapiens
gaggcagagagggagagagggaaggagagaggcagagagggagagaaggaaagagacaggcaga

SEQ ID NO: 125613 - RNA, 64 nt, Homo Sapiens
gaggcagagaaggaaagagaggggaagagaggcagagagggaaacagagggagagagagacaga

SEQ ID NO: 125614 - RNA, 64 nt, Homo Sapiens
gagagacagagggagagagaaaacagaggagacagagagggagagaggaggcagagagggagag

SEQ ID NO: 125615 - RNA, 64 nt, Homo Sapiens
gaaacagaggagacagagagagacagaggaggcagagagggagaagagagauaugaggagagag

SEQ ID NO: 125616 - RNA, 64 nt, Homo Sapiens
uucacucuuguugcccaggcguacuuuuuuuuuugagagggagugacaauuucaucaucccacu

SEQ ID NO: 125617 - RNA, 64 nt, Homo Sapiens
gucccuugaguuucucaacuuccuccagccccgugagagggacuagggauggcuguccacagga

SEQ ID NO: 125618 - RNA, 64 nt, Homo Sapiens
acguggaagaccuggggccauuggggacuugguggagagggacucucucagagucaagggugac

SEQ ID NO: 125619 - RNA, 64 nt, Homo Sapiens
ccucucagagucaagggugaaagaacuggugugggagagggauagggaggagaagugacuggaa

SEQ ID NO: 125620 - RNA, 64 nt, Homo Sapiens
aacaggcgcggggucucaggagcaggcggagcgagagagggagaaggggaaggaagagagaggg

SEQ ID NO: 125621 - RNA, 64 nt, Homo Sapiens
aggcggagcgagagagggagaaggggaaggaagagagagggagcucagaggagggaggaggaau

SEQ ID NO: 125622 - RNA, 64 nt, Homo Sapiens
uggcgacuguccccauccgccuggcugagcaggagagagggagcuggcggugcccagcgcaagg

SEQ ID NO: 125623 - RNA, 64 nt, Homo Sapiens
guuuacagugcacggaguguggaagggggucuaggagagggagagcuggaaaaggagcugaugg

SEQ ID NO: 125624 - RNA, 64 nt, Homo Sapiens
aauauuagggacuggggaggggaccaccagaggggagagggaagcugcuuacuuuggggguaga

SEQ ID NO: 125625 - RNA, 64 nt, Homo Sapiens
cggcuucaugugauaugacaguggaugcuaaggugagagggaugcaggcauggguugggggugg

SEQ ID NO: 125626 - RNA, 64 nt, Homo Sapiens
gccuggccuggcuucacacacauagccgacucaggagagggaugcccaugggggaacaugugac

SEQ ID NO: 125627 - RNA, 64 nt, Homo Sapiens
gugaugacuuaaauggcaggcucugugaucacaugagagggaagauuaagcacaaggucacauu

SEQ ID NO: 125628 - RNA, 64 nt, Homo Sapiens
aggguucuccagguucaccaucugucuguguuuagagagggaagugccagggagcagccacacg

SEQ ID NO: 125629 - RNA, 64 nt, Homo Sapiens
cuggcgucccggcaggcgagagcaacgaggaaaggagagggacuguaguccgcgccaggaagag

SEQ ID NO: 125630 - RNA, 64 nt, Homo Sapiens
aagggcgcgcgggccgcggguguuugacuugagcgagagggaggccgcggccccagccuugacc

SEQ ID NO: 125631 - RNA, 64 nt, Homo Sapiens
gcucacgaggcuuggaccugagcagacguggugugagagggacaaccugccauggagggugccc

SEQ ID NO: 125632 - RNA, 64 nt, Homo Sapiens
guucacaaggcuuggaccugcccggcagacgugugagagggacgcuuggaccugguggagggug

SEQ ID NO: 125633 - RNA, 64 nt, Homo Sapiens
gcucacgaggcuuggaccugagcagacgugguaugagagggaugaccugccguggagggugccc

SEQ ID NO: 125634 - RNA, 64 nt, Homo Sapiens
gcucacagggcuuggaccugagcagacguggugugagagggacgggaccugguggagggugccc

SEQ ID NO: 125635 - RNA, 64 nt, Homo Sapiens
gcucacgaggcuuggaccugggcagacguggcgugagagggacgaccugccguggagggugccc

SEQ ID NO: 125636 - RNA, 64 nt, Homo Sapiens
guucacaaagcucggaccugcucaaagcagacgugagagggacgcagccccauugacacaaacc

SEQ ID NO: 125637 - RNA, 64 nt, Homo Sapiens
ccggggcaggcuuagggcacaguuaggggccaaggagagggaaggccagggccccuguucuagg

SEQ ID NO: 125638 - RNA, 64 nt, Homo Sapiens
uaagaucacgccauugcacuccagccugggcaacgagagggaaacucuguuucaaaaaaaaaaa

SEQ ID NO: 125639 - RNA, 64 nt, Homo Sapiens
aguaaccgggagacaaauugacauuuuaaagggggagagggaaaucucuucuucuccuuccucu

SEQ ID NO: 125640 - RNA, 64 nt, Homo Sapiens
cauagcacugggguggcaggaguggcucugggcagagagggacaccccgagagccaggggaagg

SEQ ID NO: 125641 - RNA, 64 nt, Homo Sapiens
gggaagggagcauugcagccuaagaagaaggccagagagggaaaaggcaggugcuuuuggcaga

SEQ ID NO: 125642 - RNA, 64 nt, Homo Sapiens
uccacccuguuacuuauguagaaacugaggcccagagagggaagaugaccugccccaaguggug

SEQ ID NO: 125643 - RNA, 64 nt, Homo Sapiens
caguuugcaguucacugcaaaucuuuuacauuaaggcaaagauugaaaacaugcuuaaccacua

SEQ ID NO: 125644 - RNA, 64 nt, Homo Sapiens
auugugugucaccccuguuuauucuugaacagagggcaaagagggcacugggcacuucucacaa

SEQ ID NO: 125645 - RNA, 64 nt, Homo Sapiens
uagguggauccagggaaaagcaguggggacggaaggcaaagagaccacucaacccccaccugga

SEQ ID NO: 125646 - RNA, 64 nt, Homo Sapiens
aggcaaagagaccacucaacccccaccuggaaggggcaaagaaaagccagaguuccauguuugu

SEQ ID NO: 125647 - RNA, 64 nt, Homo Sapiens
uacugguugguguucuugaugggucugagaauuuggcaaagacuuagagacucguguccugagu

SEQ ID NO: 125648 - RNA, 64 nt, Homo Sapiens
gaaaaggaagcaucucuuucaggcugacagggagggcaaagaguguaaccucaugguugugcuc

SEQ ID NO: 125649 - RNA, 64 nt, Homo Sapiens
uucuauuuuccucuuugaacacucaagauugcauggcaaagacccagucaaaaugauuuacccc

SEQ ID NO: 125650 - RNA, 64 nt, Homo Sapiens
cauauacuguuuaccuuuuuccauggagucuccuggcaaagaauaaaauauauuuauuuuaaag

SEQ ID NO: 125651 - RNA, 64 nt, Homo Sapiens
agagaaagaaauuuauuuuauacaucaugauuauggcaaagagguucaauucugaaaaaaagca

SEQ ID NO: 125652 - RNA, 64 nt, Homo Sapiens
cuucaaauugaagacugagaacauauguuagcacggcaaagaaccuauguggucauucucuaca

SEQ ID NO: 125653 - RNA, 64 nt, Homo Sapiens
ucuuuuucuccuuuauaugacuuucucugaguugggcaaagaagaagcugacacaccguauguu

SEQ ID NO: 125654 - RNA, 64 nt, Homo Sapiens
uuauguauuaugucugcuuaaaucauuuaaaaacggcaaagaauuauauagacuaugagguacc

SEQ ID NO: 125655 - RNA, 64 nt, Homo Sapiens
gagccagcagcugcgcugggggcuggaguguuccggcaaagacaagcaaagagaagagcauugg

SEQ ID NO: 125656 - RNA, 64 nt, Homo Sapiens
gaagacaaacaugggaggagcagggauaaauaaaggcaaagacuagcccggggguugggaggga

SEQ ID NO: 125657 - RNA, 64 nt, Homo Sapiens
agaucauaaggcaaugcaugaaccacagaagcugcaugguuaaaauagcggccugugcccagua

SEQ ID NO: 125658 - RNA, 64 nt, Homo Sapiens
cgauuuuucugucauuaguucuagauauguacuucaugguuaaauucuaaaucugaaaaugcua

SEQ ID NO: 125659 - RNA, 64 nt, Homo Sapiens
uguucuacaucaugcauaguagcugaugagguuacaugguuacaaaagucaaaagggaaaaggu

SEQ ID NO: 125660 - RNA, 64 nt, Homo Sapiens
gcuacaaagaacagugauuuguugcuuuuacuuucaugguuagaauucacugggggauauuuuu

SEQ ID NO: 125661 - RNA, 64 nt, Homo Sapiens
ucccagcuccauccccuaguugcagacucaucaccaugguuaccauagugacugcuucauugcc

SEQ ID NO: 125662 - RNA, 64 nt, Homo Sapiens
aucaccaugguuaccauagugacugcuucauugccaugguuacauacuaauugcugcagcucug

SEQ ID NO: 125663 - RNA, 64 nt, Homo Sapiens
gcaucuauaauaaacuauaaaaaaugggaguacccaugguuaggauauagcuaugccuuuaugg

SEQ ID NO: 125664 - RNA, 64 nt, Homo Sapiens
gaauauaugauccauaaaaauuuaaagugagaggcaugguuagugugugauacaauaaaaagua

SEQ ID NO: 125665 - RNA, 64 nt, Homo Sapiens
uugaaaggacaaugguuauucugaauaaaacugucaugguuaccaaugaaaaguauuugccaaa

SEQ ID NO: 125666 - RNA, 64 nt, Homo Sapiens
agaggaaaggggagucucaaugggcaauucagagcaugguuagagcagggucaaagcacaauac

SEQ ID NO: 125667 - RNA, 64 nt, Homo Sapiens
uguuuuugcaacuagguauuucuaacgccagcacacuauuuacaagauggacuuaccuggcaga

SEQ ID NO: 125668 - RNA, 64 nt, Homo Sapiens
guuucuaaaaacacacacaaagcacauugggccaacuauuuaguaagcccggauagacuuauug

SEQ ID NO: 125669 - RNA, 64 nt, Homo Sapiens
uccgaaugaaccuuaugauggccuuuuucucugcacuauuuagauuuauuuuugaagaagaaua

SEQ ID NO: 125670 - RNA, 64 nt, Homo Sapiens
caauccacuggucugugagugacucuuuucugagacuauuuaucuuaggcgggaacugcaaaca

SEQ ID NO: 125671 - RNA, 64 nt, Homo Sapiens
gucucagcuacuagggaggcguggcacuguauauacuauuuauaaauguaggauagaggguaca

SEQ ID NO: 125672 - RNA, 64 nt, Homo Sapiens
ggugagcuuuuaaaaauguacuauaauaauuaguacuauuuaauuaauugucugugacuauuuu

SEQ ID NO: 125673 - RNA, 64 nt, Homo Sapiens
gaaacaaaugugaaagcagucaaauuaaguagauacuauuuagaaauguaaaauacucuccaga

SEQ ID NO: 125674 - RNA, 64 nt, Homo Sapiens
cagaugggacuaaguguuuaugggacaauuauguacuauuuaacuuaaauauauuuuguuuaau

SEQ ID NO: 125675 - RNA, 64 nt, Homo Sapiens
auaauacaaauuuaaaaaccaauacaguauaacaacuauuuacauagugcuuacauuguauuag

SEQ ID NO: 125676 - RNA, 64 nt, Homo Sapiens
guauucagagauuguaaaugaaaaaaauauagaaacuauuuaguuuugguagauuuuuuuucug

SEQ ID NO: 125677 - RNA, 64 nt, Homo Sapiens
cauguuguguuuuguaaaucaacugaauugagguacuauuuacuuagauuuauugcacccuuuu

SEQ ID NO: 125678 - RNA, 64 nt, Homo Sapiens
uuaaagcucacauuuuauaguaucacugcuacaaacuauuuaaugaaauguggcaucgggugaa

SEQ ID NO: 125679 - RNA, 64 nt, Homo Sapiens
gccucaguacuuuuuucacaucucagcucaugacacuauuuagugcacagauauucucaaacuu

SEQ ID NO: 125680 - RNA, 64 nt, Homo Sapiens
uagaaaauuucuaggugaaacccuuuuuuguaugacuauuuauuuguacguuuguauauauuuu

SEQ ID NO: 125681 - RNA, 64 nt, Homo Sapiens
aagugcuaacaucagaaucaaacuuaaagcuuccacuauuuaugucuuugagaaguauguagua

SEQ ID NO: 125682 - RNA, 64 nt, Homo Sapiens
ugaauaagguaagaaaacuauuuugaauaaauaaacuauuuauuuaaaaugucuuuguauuuuu

SEQ ID NO: 125683 - RNA, 64 nt, Homo Sapiens
uuuagaccuugguuugguagagaauagguguaggacuauuuaaguuccuauuacuaguguuugc

SEQ ID NO: 125684 - RNA, 64 nt, Homo Sapiens
auaaaauuuaaaaguagaguaaaaguaauuuaugacuauuuaaacacauauuuauuaagagaaa

SEQ ID NO: 125685 - RNA, 64 nt, Homo Sapiens
ugaacuaaaccuuccacuucaggguuuggaugaaacuauuuaaaggacaaauagaauauauaac

SEQ ID NO: 125686 - RNA, 64 nt, Homo Sapiens
aauauauaacacuuggaaaauuucaauuuuuuuaacuauuuaaaguuaugaaaaaauagacguc

SEQ ID NO: 125687 - RNA, 64 nt, Homo Sapiens
agaucagcuauugguagcuuuuugauuuccccaaacuauuuaauuucuuagcagaaacauuagu

SEQ ID NO: 125688 - RNA, 64 nt, Homo Sapiens
aguucuuauuuuguuuuuguuguaauguuugaauacuauuuaauauccgguuuuaauauugcug

SEQ ID NO: 125689 - RNA, 64 nt, Homo Sapiens
ucguggguuacaaccaaugguagagugauuuuagacuauuuacauuucccugcaguuuugccaa

SEQ ID NO: 125690 - RNA, 64 nt, Homo Sapiens
gguagaacuaggauuugaacugaacugcuauccaacuauuuaguaaccacauaaccaagcauug

SEQ ID NO: 125691 - RNA, 64 nt, Homo Sapiens
cguaacucaacauggcaugccuuucucuccguaaacuauuuagugagauuuuuagggacuauuu

SEQ ID NO: 125692 - RNA, 64 nt, Homo Sapiens
gcauuaaaucccuugccaguuaccauuaacuguaacuauuuagcuuuuguuuagggaucuuucu

SEQ ID NO: 125693 - RNA, 64 nt, Homo Sapiens
augaguuucucagaaacauguuuuuaacaauuguacuauuuagucauuguccauuuacuauaau

SEQ ID NO: 125694 - RNA, 64 nt, Homo Sapiens
cuguaaaauacuuaagacgguuucugauuuuuccacuauuuaaauaaugcugugaugaauaucu

SEQ ID NO: 125695 - RNA, 64 nt, Homo Sapiens
accgggaucacaggccuggccgcguugcguuuagacuauuuauuaaaacccaacaagaacacuu

SEQ ID NO: 125696 - RNA, 64 nt, Homo Sapiens
cuccucguugcccuguaagguuauugcuauguuaacuauuuauuuagcuucuuguaguuuuaac

SEQ ID NO: 125697 - RNA, 64 nt, Homo Sapiens
aaugcaucauagauuuaaugaaucacauuuugcuacuauuuaagggauuuacauuaacugcugg

SEQ ID NO: 125698 - RNA, 64 nt, Homo Sapiens
acuuccaaccagaacuuugcuuauugaaaaggcuacuauuuauauuuguugaaguauuuaagau

SEQ ID NO: 125699 - RNA, 64 nt, Homo Sapiens
uaagaugucuaaaauagggaccuagaagcuuaacacuauuuaaguaaauacaguagaagcucac

SEQ ID NO: 125700 - RNA, 64 nt, Homo Sapiens
guguuaggauugcuacugaugcugucauguggaaacuauuuaaaggcacuauuauaaauuuauc

SEQ ID NO: 125701 - RNA, 64 nt, Homo Sapiens; identical to SEQ ID NO: 24611

SEQ ID NO: 125702 - RNA, 64 nt, Homo Sapiens; identical to SEQ ID NO: 24612

SEQ ID NO: 125703 - RNA, 64 nt, Homo Sapiens; identical to SEQ ID NO: 24613

SEQ ID NO: 125704 - RNA, 64 nt, Homo Sapiens; identical to SEQ ID NO: 24614

SEQ ID NO: 125705 - RNA, 64 nt, Homo Sapiens; identical to SEQ ID NO: 24615

SEQ ID NO: 125706 - RNA, 64 nt, Homo Sapiens; identical to SEQ ID NO: 24616

SEQ ID NO: 125707 - RNA, 64 nt, Homo Sapiens; identical to SEQ ID NO: 24617

SEQ ID NO: 125708 - RNA, 64 nt, Homo Sapiens; identical to SEQ ID NO: 24618

SEQ ID NO: 125709 - RNA, 64 nt, Homo Sapiens; identical to SEQ ID NO: 24619

SEQ ID NO: 125710 - RNA, 64 nt, Homo Sapiens; identical to SEQ ID NO: 24620

SEQ ID NO: 125711 - RNA, 64 nt, Homo Sapiens; identical to SEQ ID NO: 24621

SEQ ID NO: 125712 - RNA, 64 nt, Homo Sapiens; identical to SEQ ID NO: 24622

SEQ ID NO: 125713 - RNA, 64 nt, Homo Sapiens; identical to SEQ ID NO: 24623

SEQ ID NO: 125714 - RNA, 64 nt, Homo Sapiens; identical to SEQ ID NO: 24624

SEQ ID NO: 125715 - RNA, 64 nt, Homo Sapiens; identical to SEQ ID NO: 24625

SEQ ID NO: 125716 - RNA, 64 nt, Homo Sapiens; identical to SEQ ID NO: 24626

SEQ ID NO: 125717 - RNA, 64 nt, Homo Sapiens; identical to SEQ ID NO: 24627

SEQ ID NO: 125718 - RNA, 64 nt, Homo Sapiens; identical to SEQ ID NO: 24628

SEQ ID NO: 125719 - RNA, 64 nt, Homo Sapiens; identical to SEQ ID NO: 24629

SEQ ID NO: 125720 - RNA, 64 nt, Homo Sapiens; identical to SEQ ID NO: 24630

SEQ ID NO: 125721 - RNA, 64 nt, Homo Sapiens; identical to SEQ ID NO: 24631

SEQ ID NO: 125722 - RNA, 64 nt, Homo Sapiens; identical to SEQ ID NO: 24632

SEQ ID NO: 125723 - RNA, 64 nt, Homo Sapiens; identical to SEQ ID NO: 24633

SEQ ID NO: 125724 - RNA, 64 nt, Homo Sapiens; identical to SEQ ID NO: 24634

SEQ ID NO: 125725 - RNA, 64 nt, Homo Sapiens; identical to SEQ ID NO: 24635

SEQ ID NO: 125726 - RNA, 64 nt, Homo Sapiens; identical to SEQ ID NO: 24636

SEQ ID NO: 125727 - RNA, 64 nt, Homo Sapiens; identical to SEQ ID NO: 24637

SEQ ID NO: 125728 - RNA, 64 nt, Homo Sapiens; identical to SEQ ID NO: 24638

SEQ ID NO: 125729 - RNA, 64 nt, Homo Sapiens; identical to SEQ ID NO: 24639

SEQ ID NO: 125730 - RNA, 64 nt, Homo Sapiens; identical to SEQ ID NO: 24640

SEQ ID NO: 125731 - RNA, 64 nt, Homo Sapiens; identical to SEQ ID NO: 24641

SEQ ID NO: 125732 - RNA, 64 nt, Homo Sapiens; identical to SEQ ID NO: 24642

SEQ ID NO: 125733 - RNA, 64 nt, Homo Sapiens; identical to SEQ ID NO: 24643

SEQ ID NO: 125734 - RNA, 64 nt, Homo Sapiens; identical to SEQ ID NO: 24644

SEQ ID NO: 125735 - RNA, 63 nt, Homo Sapiens; identical to SEQ ID NO: 24645

SEQ ID NO: 125736 - RNA, 64 nt, Homo Sapiens; identical to SEQ ID NO: 24646

SEQ ID NO: 125737 - RNA, 64 nt, Homo Sapiens; identical to SEQ ID NO: 24647

SEQ ID NO: 125738 - RNA, 64 nt, Homo Sapiens; identical to SEQ ID NO: 24648

SEQ ID NO: 125739 - RNA, 64 nt, Homo Sapiens; identical to SEQ ID NO: 24649

SEQ ID NO: 125740 - RNA, 64 nt, Homo Sapiens; identical to SEQ ID NO: 24650

SEQ ID NO: 125741 - RNA, 64 nt, Homo Sapiens; identical to SEQ ID NO: 24651

SEQ ID NO: 125742 - RNA, 64 nt, Homo Sapiens; identical to SEQ ID NO: 24652

SEQ ID NO: 125743 - RNA, 64 nt, Homo Sapiens; identical to SEQ ID NO: 24653

SEQ ID NO: 125744 - RNA, 64 nt, Homo Sapiens; identical to SEQ ID NO: 24654

SEQ ID NO: 125745 - RNA, 64 nt, Homo Sapiens; identical to SEQ ID NO: 24655

SEQ ID NO: 125746 - RNA, 64 nt, Homo Sapiens; identical to SEQ ID NO: 24656

SEQ ID NO: 125747 - RNA, 64 nt, Homo Sapiens; identical to SEQ ID NO: 24657

SEQ ID NO: 125748 - RNA, 64 nt, Homo Sapiens; identical to SEQ ID NO: 24658

SEQ ID NO: 125749 - RNA, 64 nt, Homo Sapiens; identical to SEQ ID NO: 24659

SEQ ID NO: 125750 - RNA, 64 nt, Homo Sapiens; identical to SEQ ID NO: 24660

SEQ ID NO: 125751 - RNA, 64 nt, Homo Sapiens; identical to SEQ ID NO: 24661

SEQ ID NO: 125752 - RNA, 64 nt, Homo Sapiens; identical to SEQ ID NO: 24662

SEQ ID NO: 125753 - RNA, 64 nt, Homo Sapiens; identical to SEQ ID NO: 24663

SEQ ID NO: 125754 - RNA, 64 nt, Homo Sapiens; identical to SEQ ID NO: 24664

SEQ ID NO: 125755 - RNA, 64 nt, Homo Sapiens; identical to SEQ ID NO: 24665

SEQ ID NO: 125756 - RNA, 64 nt, Homo Sapiens; identical to SEQ ID NO: 24666

SEQ ID NO: 125757 - RNA, 64 nt, Homo Sapiens; identical to SEQ ID NO: 24667

SEQ ID NO: 125758 - RNA, 64 nt, Homo Sapiens; identical to SEQ ID NO: 24668

SEQ ID NO: 125759 - RNA, 64 nt, Homo Sapiens
auugucaaagaguagccgauuuuagaguucuuuuggaucauaaacuggaaauacugauggaagc

SEQ ID NO: 125760 - RNA, 64 nt, Homo Sapiens
uauuuucuguguaagcuuuuaaaauuauuuuuggggaucauagcuuguuuuauuuugugcuaua

SEQ ID NO: 125761 - RNA, 64 nt, Homo Sapiens
gaggauauaaacugcaucauuagugaaauuauugguuguguaauccuuugugaaauauaauucu

SEQ ID NO: 125762 - RNA, 64 nt, Homo Sapiens
cauguaauucagugggguuagguacauucacaauguuguguaaugaucaccgcugucuacuugu

SEQ ID NO: 125763 - RNA, 64 nt, Homo Sapiens
aucaauaugaacuuuuuaucugcuugcacugcugguuguguauccuauagccaauguauuugaa

SEQ ID NO: 125764 - RNA, 64 nt, Homo Sapiens
gaaaggaccaccaaaauaauguauagugggagugguuguguaauccauuauuuccugcucuaau

SEQ ID NO: 125765 - RNA, 64 nt, Homo Sapiens
uuuguuuguuugggaaaaggagacuuggggaagaguuguguauguggguguuucucccccuagu

SEQ ID NO: 125766 - RNA, 64 nt, Homo Sapiens
uguauguggguguuucucccccuaguuaauuccuguuguguaaggguaggcuuuguugaaaaag

SEQ ID NO: 125767 - RNA, 64 nt, Homo Sapiens
ucucuucauuuccucucaaacuuuucccuuugguguuguguaugcugaacuugauuccagcccc

SEQ ID NO: 125768 - RNA, 64 nt, Homo Sapiens
acuuucacuuuacacuugcacccccgcaccauugguuguguaucuguuuucuuccucccccccc

SEQ ID NO: 125769 - RNA, 64 nt, Homo Sapiens
gcuucccuguauuaccuccccuacucccuuauguguuguguauuccacuuaggaagaaaugccc

SEQ ID NO: 125770 - RNA, 64 nt, Homo Sapiens
gucucucuugagcuacaguagaggggaagggauuguuguguagucaagucaccaugcugaaugu

SEQ ID NO: 125771 - RNA, 64 nt, Homo Sapiens
gcauuucaaguacauguguguguguuuuauucagguuguguaaugcucccguagaauuauagaa

SEQ ID NO: 125772 - RNA, 64 nt, Homo Sapiens
aaacugauggauuucauuauagaauuaucugugaguuguguagacacagucuuaauguuucugg

SEQ ID NO: 125773 - RNA, 50 nt, Homo Sapiens
auaaagaagaaaaacuguagguuguguagcuggagaagugacagucaggg

SEQ ID NO: 125774 - RNA, 64 nt, Homo Sapiens
cccacagcaguggagauuuguauucuuauuuacaguuguguacuauaaaguguguguuacauag

SEQ ID NO: 125775 - RNA, 64 nt, Homo Sapiens
agccuuuuuauuauugccugaaacucacugaauuguuguguaauauuauucuugaaacuaggua

SEQ ID NO: 125776 - RNA, 64 nt, Homo Sapiens
acuugguuucuuuuacuuacggaaugguuccuacguuguguauuguuaacuuaauaucccucca

SEQ ID NO: 125777 - RNA, 64 nt, Homo Sapiens
gguaugggccaaguguaaaauacuggagucugugguuguguacacuuaaauuccagcucccuuu

SEQ ID NO: 125778 - RNA, 64 nt, Homo Sapiens
uuaagaguggcaacaguuucacugaaauacagcgguuguguaauguguugugagucaguggaac

SEQ ID NO: 125779 - RNA, 64 nt, Homo Sapiens
ucaucauaaacuuuuuaaaggaaaauaagcaaacuaaaaagaacauugguuuagauaaauacuu

SEQ ID NO: 125780 - RNA, 64 nt, Homo Sapiens
augaggguuuacauuuguuuuguuuuguaaccguuaaaaagaaguuguuuccagcuaauuauug

SEQ ID NO: 125781 - RNA, 64 nt, Homo Sapiens
uuuucaugguauuuucuuccauaauaucucauuuuaaaaagaaguucuuuaugaacuuaguguc

SEQ ID NO: 125782 - RNA, 64 nt, Homo Sapiens
uagguauauuuccaacuuuauauaucacaguauuuaaaaagacauguuugcauugagaaauuaa

SEQ ID NO: 125783 - RNA, 64 nt, Homo Sapiens
acuaaauguuuugucacuuuguauauuaauauaauaaaaagaucuaaggguuaauucacccaga

SEQ ID NO: 125784 - RNA, 64 nt, Homo Sapiens
ucauuuuuagugauugacaaaaagaaaauacuuauaaaaagacuccuucuauauauuguaacuu

SEQ ID NO: 125785 - RNA, 64 nt, Homo Sapiens
gauauuuaagaggcauaaccuuuuauagacaaaguaaaaagacaggaauacuaaggacaauuau

SEQ ID NO: 125786 - RNA, 64 nt, Homo Sapiens
uacauuucccucuuaggccccacucauaguaguauaaaaagagaccagagagugauuucauuua

SEQ ID NO: 125787 - RNA, 64 nt, Homo Sapiens
acaaauauuccagccccaaaugaaguaaaaaaauuaaaaagaauuuagaaacucuucuaauaaa

SEQ ID NO: 125788 - RNA, 64 nt, Homo Sapiens
ggaagaaggaaugccuuauaguucuguggagauauaaaaagaaugacagggucccaugagagca

SEQ ID NO: 125789 - RNA, 64 nt, Homo Sapiens
aaauauggucaagucuaaaaagauggcuauaugcuaaaaagagaagucucccaccuaaauauca

SEQ ID NO: 125790 - RNA, 64 nt, Homo Sapiens
uaaaaccaaaggguuaccgguugcccaucaagaauaaaaagaaauguuuuuuaaaggaggcuuu

SEQ ID NO: 125791 - RNA, 64 nt, Homo Sapiens
aagaggguucugcauuggcacugacaggagcaauuaaaaagagccuaacaacuuguggcuuuaa

SEQ ID NO: 125792 - RNA, 64 nt, Homo Sapiens
ugcacgggcuuuaggguaaacuaaaacguggauuuaaaaagaaccucacaaauaggaaauaaaa

SEQ ID NO: 125793 - RNA, 64 nt, Homo Sapiens
auuuuccagaaaguuugugcuauauguaaguguuuaaaaagauuugauucuauaagauuauuua

SEQ ID NO: 125794 - RNA, 64 nt, Homo Sapiens
uaauaauucuccuauauuugaggggggcaugggauaaaaagauuuaauaauaccuggauagaga

SEQ ID NO: 125795 - RNA, 64 nt, Homo Sapiens
cauaacagacuuugacucuaugaccuaugaagaauaaaaagauaaucugaagguguuugaguca

SEQ ID NO: 125796 - RNA, 64 nt, Homo Sapiens
auuuugugacaugcauacagauagcauguguuauuaaaaagaguugccuauugaaaugaucaug

SEQ ID NO: 125797 - RNA, 64 nt, Homo Sapiens
uggagaaauuaagcuuauagacagcauguguuauuaaaaagaguuaccuauugaaaugauagug

SEQ ID NO: 125798 - RNA, 64 nt, Homo Sapiens
ccuucaaaaauauuuauauugucacucauuuacguaaaaagauauuucuaauuuacuguugccc

SEQ ID NO: 125799 - RNA, 64 nt, Homo Sapiens
ugucauucuuacaaaacauuuuuuuguucucuuguaaaaagaguaguuauuaguucugcuuuag

SEQ ID NO: 125800 - RNA, 64 nt, Homo Sapiens
uuagugacccagagcuauaauauucauguuuucauaaaaagaagcuuugaguuauaacuaguau

SEQ ID NO: 125801 - RNA, 64 nt, Homo Sapiens
auguaaagguguguuuugggcaaaucaacauuuuuaaaaagaaaggacaguagccacuuacaaa

SEQ ID NO: 125802 - RNA, 64 nt, Homo Sapiens
ggaaacauaagaggaggccaaaaguuaaacguucuaaaaagaggcgaaaggaagcaagcaguuc

SEQ ID NO: 125803 - RNA, 64 nt, Homo Sapiens
auaaaaaacgcagaaaagaaaaaaagguuaagcauaaaaagaaagggaaaaagcagaaacacug

SEQ ID NO: 125804 - RNA, 64 nt, Homo Sapiens
ugaaguacucacacaugccaacauuauuagacucuaaaaagaaauggucuguccacgcaaugga

SEQ ID NO: 125805 - RNA, 64 nt, Homo Sapiens
gacaagaacgagugucgguguaggauggcuacaauaaaaagaugagauuccaguuuacaaucac

SEQ ID NO: 125806 - RNA, 64 nt, Homo Sapiens
gcccgggucugcagagaauggaaagcaguuuuuauaaaaagaaaguggugucucuaugcccuuu

SEQ ID NO: 125807 - RNA, 64 nt, Homo Sapiens
cccaaaugauucuggacacuaggauuccagauuguaaaaagaucuugaagcuguuauaagaauu

SEQ ID NO: 125808 - RNA, 64 nt, Homo Sapiens
auucuaauauaaagcauuuccccuguuuauggauuaaaaagaaagagauucugugauuuauuug

SEQ ID NO: 125809 - RNA, 64 nt, Homo Sapiens
ugacaucucuuguacacugauauguuaaugaagauaaaaagaaguauuucaggaggagaaugag

SEQ ID NO: 125810 - RNA, 64 nt, Homo Sapiens
uaucauauuuaucacaugaccacuuuugauuccuuaaaaagacauuacaggcuuaaauuccauu

SEQ ID NO: 125811 - RNA, 64 nt, Homo Sapiens
gaauauacacaacucagagaugcaauggauaauauaaaaagaguaccugagauguauuuuuuua

SEQ ID NO: 125812 - RNA, 64 nt, Homo Sapiens
uuaaugcucuuaagauauaucacugucuuucauuuaaaaagaaauuucuaacacagacuuucuu

SEQ ID NO: 125813 - RNA, 64 nt, Homo Sapiens
aaaaggacuaacaagcuucaguugauuuggucacuaaaaagaaggaugguuagauacacagcau

SEQ ID NO: 125814 - RNA, 64 nt, Homo Sapiens
uuuacuggaaaaaaaucacuaagauuucccacaauaaaaagauuuuuuaaauaaaaauaaagaa

SEQ ID NO: 125815 - RNA, 64 nt, Homo Sapiens
gaauaagaccugguauuugaaaguuggaaauuuuuaaaaagaauuguacccuggaacuuaauaa

SEQ ID NO: 125816 - RNA, 64 nt, Homo Sapiens
aaagacuacuacagguuaaguuuuauaaaaauuuuaaaaagaaauauuuugggaaauuagugua

SEQ ID NO: 125817 - RNA, 64 nt, Homo Sapiens
cuuuaugugguugaagaugaagguuucauggucuuaaaaagauaaaaagucuugcaaugacaag

SEQ ID NO: 125818 - RNA, 64 nt, Homo Sapiens
uagagaacgcuuucagggaaaaauacuuuaauaguaaaaagauucucugcgagcaacagugccc

SEQ ID NO: 125819 - RNA, 64 nt, Homo Sapiens
ucccccacggggugcaccgaacuuggguuugcgcuaaaaagaacucaaaaggagaacugugcuc

SEQ ID NO: 125820 - RNA, 64 nt, Homo Sapiens
aacagagguauuaaaggcuagccuaacuguugucuaaaaagauuguacaguauuuaagggauuu

SEQ ID NO: 125821 - RNA, 64 nt, Homo Sapiens
ccuuuuagcuuuucaucuccaguggcauuaaacauaaaaagacccuggcauuuuuucacauacu

SEQ ID NO: 125822 - RNA, 64 nt, Homo Sapiens
uuucacuagcagggaaguuuccuugagccuaaaauaaaaagaaaaaauuaaaaagaaucaguuu

SEQ ID NO: 125823 - RNA, 64 nt, Homo Sapiens
aaguuuccuugagccuaaaauaaaaagaaaaaauuaaaaagaaucaguuuuuuuaauuaaaaaa

SEQ ID NO: 125824 - RNA, 64 nt, Homo Sapiens
ucaaaaaaagacugacaauguuuaguuuugucuuuaaaaagaauuuccaguucgaucuucuggg

SEQ ID NO: 125825 - RNA, 64 nt, Homo Sapiens
aaaaaaaaagaauucauugaaaaucaagaaaauuuaaaaagacaaaacacaaauacauuuuuua

SEQ ID NO: 125826 - RNA, 64 nt, Homo Sapiens
aaaggaacaguguaaauuugguuuuuuuaauaacuaaaaagaaacaguauuuugagguuuuauu

SEQ ID NO: 125827 - RNA, 64 nt, Homo Sapiens
uuguaccaggaugugcuauuuugcuuuagucauuuaaaaagauaacaaugaauugauguuuagu

SEQ ID NO: 125828 - RNA, 64 nt, Homo Sapiens
acacauuucacuuuucuguaaauauacauaaacuuaaaaagaaaaccucauggagucaucuugc

SEQ ID NO: 125829 - RNA, 64 nt, Homo Sapiens
uacagaaaacccagcuagacuauuggguaugaacuaaaaagagacugugccauggugagaaaaa

SEQ ID NO: 125830 - RNA, 64 nt, Homo Sapiens
cccuuguacauauaucuuuagagagaagauauuuuaaaaagaaauaccuuuuuaaaaauuauuu

SEQ ID NO: 125831 - RNA, 64 nt, Homo Sapiens
caacaucuaggaaagugagcucuuaaagacagacuaaaaagaguaauaaaucaauacaacaaca

SEQ ID NO: 125832 - RNA, 64 nt, Homo Sapiens
uuuuuugguuuuugaguuguucuugucauagacauaaaaagacaauucauuuucuuguuuuauu

SEQ ID NO: 125833 - RNA, 64 nt, Homo Sapiens
aaguugagauucggcaguugcccaauuccuuuaauaaaaagaaacuaaauaauuugggccccaa

SEQ ID NO: 125834 - RNA, 64 nt, Homo Sapiens
ucucucagcacuucccucucguuggagagcuuuuuaaaaagacauggacagaagcaccuggaga

SEQ ID NO: 125835 - RNA, 64 nt, Homo Sapiens
gaucucccugagccuuugacuugguccuuggcaauaaaaagaaugcauuucuacacuuuguuuc

SEQ ID NO: 125836 - RNA, 64 nt, Homo Sapiens
auuugaaucccuuccuauacaacaagaauuuuguuaaaaagagauaaaaucuccucuauauaga

SEQ ID NO: 125837 - RNA, 64 nt, Homo Sapiens
uaugguaacugguuucuuacuacauuuaucuuuguaaaaagauuuuaaaaguaguaagccacau

SEQ ID NO: 125838 - RNA, 64 nt, Homo Sapiens
ucagauguuaaaauaaaugguuuggugcuuuuuauaaaaagauaaucucagugcuuuccuccuu

SEQ ID NO: 125839 - RNA, 64 nt, Homo Sapiens
aguaaugaauccaacugcuuaaaguugguauuaauaaaaagacaaccacauaguucguuuaccu

SEQ ID NO: 125840 - RNA, 64 nt, Homo Sapiens
augaagcaaugugauuauaugaagagacacaaauuaaaaagacaaauuaaaccugaaauuauau

SEQ ID NO: 125841 - RNA, 64 nt, Homo Sapiens
ccacguagguacuacugaauccaacugccaacaauaaaaagacuuuuauuuaguagaggcuacc

SEQ ID NO: 125842 - RNA, 64 nt, Homo Sapiens
aacaauuuaugaauugaauuaucuugguugaaaauaaaaagaucacuuucucaguuuucauaag

SEQ ID NO: 125843 - RNA, 64 nt, Homo Sapiens
uugcccagaaagaagaugggggaggaggcaguaauaaaaagauugaaguauuuugcuggaauaa

SEQ ID NO: 125844 - RNA, 64 nt, Homo Sapiens
aauaaacuucagcugaagauuuuauauaggacuuuaaaaagaagagaagagaaagaagaaacaa

SEQ ID NO: 125845 - RNA, 64 nt, Homo Sapiens
aaugguugcaaaaaaaaaaaaaagucagugcuucuaaaaagaauuuaagauaaugguuuuuaaa

SEQ ID NO: 125846 - RNA, 64 nt, Homo Sapiens
aaacagguuugccuuggcaugucucuugaaaauauaaaaagacacauuuuucacagauccaccu

SEQ ID NO: 125847 - RNA, 64 nt, Homo Sapiens
aucuuuguugccaacugaaguuuccucauaagcauaaaaagaaaacaguuuauuagaaauagca

SEQ ID NO: 125848 - RNA, 64 nt, Homo Sapiens
aagaauuuacuuacuuuaugauuauuuuccuaaauaaaaagacauacaacuugcuuuuagcaug

SEQ ID NO: 125849 - RNA, 64 nt, Homo Sapiens
aggaaaaaauugcuucuuuuuagguagaugugaguaaaaagaacgaaggaaauagccgcucuga

SEQ ID NO: 125850 - RNA, 64 nt, Homo Sapiens
aggcaaguuucccuaaguuugaguugauaguuauuaaaaagaaaacaaaacaaaaaaaaaaggc

SEQ ID NO: 125851 - RNA, 64 nt, Homo Sapiens
ugaaacuggguauauuuaugauuucuuucagcguuaaaaagaaacauaguguugcccuuuuucu

SEQ ID NO: 125852 - RNA, 64 nt, Homo Sapiens
ucucaaaugauauacauuuaaagggcagauuuuuuaaaaagauacuacuauaauaaacauuucc

SEQ ID NO: 125853 - RNA, 64 nt, Homo Sapiens
gaaaagcuuuaguuuaaaauaaggagauccagaauaaaaagaagagacugaucucuucaauuau

SEQ ID NO: 125854 - RNA, 64 nt, Homo Sapiens
uuguagauaauugaauguuuguuuuccccguuuguaaaaagacaaugugccuguaaaccaagga

SEQ ID NO: 125855 - RNA, 64 nt, Homo Sapiens
uuuggauauauuugaguauuauaaaucaaaguuuuaaaaagaugaacauaacuuucuaggagcu

SEQ ID NO: 125856 - RNA, 64 nt, Homo Sapiens
cuugaaagcuucaccuggccuacaacuuuuauuuuaaaaagaugaucaagaaaacuucaucuuc

SEQ ID NO: 125857 - RNA, 64 nt, Homo Sapiens
caagaaagauaaaccccugucucaaggaacauuuuaaaaagaacgucuguccccugugaugcug

SEQ ID NO: 125858 - RNA, 64 nt, Homo Sapiens
uuugaaacaaaagaaaauaaugcauuguguuuuuuaaaaagaguaucuuauacauguauccuaa

SEQ ID NO: 125859 - RNA, 64 nt, Homo Sapiens
uguuuuuuaaaaagaguaucuuauacauguauccuaaaaagagaagcucaugugcaauuggugc

SEQ ID NO: 125860 - RNA, 64 nt, Homo Sapiens
gaaaaguuguuuuaucuaaucuauugcagguguuuaaaaagaaacaaacugaauuuuugaaaga

SEQ ID NO: 125861 - RNA, 64 nt, Homo Sapiens
auggauuuaacuuaugaaaaauuacuuuuuauauuaaaaagaccaacacuaaaacuaugaaaca

SEQ ID NO: 125862 - RNA, 64 nt, Homo Sapiens
augaagacaauuucuguaaugguuuuaagagauuuaaaaagaaauucacugguucuuuacaaaa

SEQ ID NO: 125863 - RNA, 64 nt, Homo Sapiens
aaaaauaccguuaauucaaauugacagagauugauaaaaagaaacugauuuaccuaaguuuacu

SEQ ID NO: 125864 - RNA, 64 nt, Homo Sapiens
aaaauggaaaaaaauuacaauuauauuuuuucuauaaaaagaaauggucacucuccccaaaaua

SEQ ID NO: 125865 - RNA, 64 nt, Homo Sapiens
aaaaagaagucaaagacaaaaugagcaaagaugguaaaaagaaguucgaaaacauaaagaaaag

SEQ ID NO: 125866 - RNA, 64 nt, Homo Sapiens
aaaaaagucuagcgaaaaaaauuuuuaauaagguuaaaaagaaaauauuuuuaggaccaaucuc

SEQ ID NO: 125867 - RNA, 64 nt, Homo Sapiens
acccacccccugcccuuuugaagcagguuuaaaauaaaaagacaacaagaguauuugguaggga

SEQ ID NO: 125868 - RNA, 64 nt, Homo Sapiens
uuaagugaauucuagguagcgaaugguugugguuuaaaaagacacuaaggcaaauugaaaauua

SEQ ID NO: 125869 - RNA, 64 nt, Homo Sapiens
aauaaaaacaguguuuuauaugugcuuacauuuuuaaaaagacagaaaagugacacuucaaaag

SEQ ID NO: 125870 - RNA, 64 nt, Homo Sapiens
augagucuucuguaauucauuuuccaggaaaaaauaaaaagaguguaaagcuuuucuuuuuuaa

SEQ ID NO: 125871 - RNA, 64 nt, Homo Sapiens
uuuugccugccauuuucagaguaauugccuacaauaaaaagaaaaagccaaauuuccaguuuaa

SEQ ID NO: 125872 - RNA, 64 nt, Homo Sapiens
uagcucuuuccuucaaauucaacuagagccuuuuuaaaaagacauuugccugcuagucagauac

SEQ ID NO: 125873 - RNA, 64 nt, Homo Sapiens
uugaguccacguuugguagcaucaguuguugaguuaaaaagaaaauuauugcauuugaucugga

SEQ ID NO: 125874 - RNA, 64 nt, Homo Sapiens
auucacauuugccaccauaauguucuuuuuuauguaaaaagaagaacuuggagacauuaacaug

SEQ ID NO: 125875 - RNA, 64 nt, Homo Sapiens
gagaugugacugucuacaguucuauuuguauauauaaaaagaagacugaaagucuuuugacaug

SEQ ID NO: 125876 - RNA, 64 nt, Homo Sapiens
auguuuugucuauucuuuugcuguuugugccucauaaaaagagaaugaggucuucugcuagagc

SEQ ID NO: 125877 - RNA, 64 nt, Homo Sapiens
cuauguagaaugacuauucuaaauauuaauguauuaaaaagaaaauacaacaaaauguauauuu

SEQ ID NO: 125878 - RNA, 64 nt, Homo Sapiens
aaaaacuggugaaaaagaaauauaaaaaggacccuaaaaagaauucugcaaaauaagagaagaa

SEQ ID NO: 125879 - RNA, 64 nt, Homo Sapiens
cugaaauaaauuguauaguugugauuuucuacauuaaaaagagauguagagaucuuauuacaaa

SEQ ID NO: 125880 - RNA, 64 nt, Homo Sapiens
uauauauuuugucuauuuuuccuuaauuucauuguaaaaagauacucaguauuccacaggcaca

SEQ ID NO: 125881 - RNA, 64 nt, Homo Sapiens
ggcauuauuuuccucaucagaauacaauuugcauuaaaaagauucuaauaaaucaaguguucca

SEQ ID NO: 125882 - RNA, 64 nt, Homo Sapiens
caagaacauuuuucacucuguuuucucaugaaaguaaaaagaacaccacaugaacacugucauc

SEQ ID NO: 125883 - RNA, 64 nt, Homo Sapiens
auuauuacauccuuuacauuaaauauaauacuuuuaaaaagaaaacaugugccagcugaauuua

SEQ ID NO: 125884 - RNA, 64 nt, Homo Sapiens
uuuauuuuuaaaucaaugggauuucuauucuuucuaaaaagagauaaaaaugagcucacucaga

SEQ ID NO: 125885 - RNA, 64 nt, Homo Sapiens
cuuuuucugauuaaaacccuuaaauuauacaaauuaaaaagauuaguuccuaagaagcuucuaa

SEQ ID NO: 125886 - RNA, 64 nt, Homo Sapiens
aaccacucccaguccccagcuguacauuuuguuguaaaaagaaaaugccuaguuuuuaguaauc

SEQ ID NO: 125887 - RNA, 64 nt, Homo Sapiens
uuugucuaagaagaauauuacuuuuaacuucauuuaaaaagacuuuuuccuuaaauuaucucag

SEQ ID NO: 125888 - RNA, 64 nt, Homo Sapiens
acagcgucaucugguugaacggugcuuuuguggcuaaaaagauugaguagagaagagaccuuca

SEQ ID NO: 125889 - RNA, 64 nt, Homo Sapiens
ucauggaaguauaacuuauuuuaagcacuggggauaaaaagacaaauaauaaaaacaaauuuuu

SEQ ID NO: 125890 - RNA, 64 nt, Homo Sapiens
auaccugggccucugauggggaauucuggucuucuaaaaagauguuagaaauuccugguggcac

SEQ ID NO: 125891 - RNA, 64 nt, Homo Sapiens
aaaagauaggacucuaaaccuagucaucuuggaauaaaaagaagagcugguuuguuuuagagca

SEQ ID NO: 125892 - RNA, 64 nt, Homo Sapiens
uuuguggugguuguauguguccuuacauagaccuuaaaaagagcucacccuuccaggccaaugc

SEQ ID NO: 125893 - RNA, 64 nt, Homo Sapiens
guuugccuuuugugugugugugucccuuauuugauaaaaagauguuuugaguuguuuuuuuuuu

SEQ ID NO: 125894 - RNA, 64 nt, Homo Sapiens
auauauauuuuugugaauuauacuuuguuguuuuuaaaaagaaaaucaguugauuaaguuaaua

SEQ ID NO: 125895 - RNA, 64 nt, Homo Sapiens
aaugagcaucucaaauguuuucugcagaaaaaaauaaaaagauucuaauaaaauguauucucuu

SEQ ID NO: 125896 - RNA, 64 nt, Homo Sapiens
cauccuucaauuucuguauaaaagcagaucuuuuuaaaaagauacuucuguaacuuaagaaacc

SEQ ID NO: 125897 - RNA, 64 nt, Homo Sapiens
guauauuauuguuuacaauaaauauacauugcauuaaaaagaaaguggcccuguggauuuauuc

SEQ ID NO: 125898 - RNA, 64 nt, Homo Sapiens
acuaggacggggcccugaccuggauauugaauaauaaaaagauguguuugcccagccacuguga

SEQ ID NO: 125899 - RNA, 64 nt, Homo Sapiens
cucagaaagucuuuauaaccgaguuucauugcuuuaaaaagaagcaugggguuucuuuuggaaa

SEQ ID NO: 125900 - RNA, 64 nt, Homo Sapiens
agcauaaaguaauuacucaaaccauaauguaaaguaaaaagauaaccauacuauacauagaaag

SEQ ID NO: 125901 - RNA, 64 nt, Homo Sapiens
aagccaaucaucucagccaugauuaucucagaaauaaaaagagaugcagcagcucaggacugag

SEQ ID NO: 125902 - RNA, 64 nt, Homo Sapiens
auaucaugggauuuaaauuuaucauaaccauguguaaaaagaaauuaauguaugaugacaucuc

SEQ ID NO: 125903 - RNA, 64 nt, Homo Sapiens
caugggauuuggcuugugagucuguaacaguucuuaaaaagaauaucugagaaacuacucuguu

SEQ ID NO: 125904 - RNA, 64 nt, Homo Sapiens
gacacuuguauuuuguauguguccaaacuaagaauaaaaagaauuguagaagaauggacuaucu

SEQ ID NO: 125905 - RNA, 64 nt, Homo Sapiens
uagccaaaaaguacaauugugcaaaagaggggaguaaaaagaaauuuacaacaacagggacagg

SEQ ID NO: 125906 - RNA, 64 nt, Homo Sapiens
agaaaguggcagguuuuccaucgaaacugcauuguaaaaagagauuuacucuaccaauguuaug

SEQ ID NO: 125907 - RNA, 64 nt, Homo Sapiens
cugagacauauuuaagaauuucuuugccaugugguaaaaagagguuuacuugaaguuuuacugc

SEQ ID NO: 125908 - RNA, 64 nt, Homo Sapiens
cuagaguaucuagaagggugaaaacaaaaaaaaauaaaaagaaacacagacgcccaggugucag

SEQ ID NO: 125909 - RNA, 64 nt, Homo Sapiens
auaugguaguacccacccgguauuccuaaaauccuaaaaagauacaccuugcaguagcagaggc

SEQ ID NO: 125910 - RNA, 64 nt, Homo Sapiens
aaaauugcaauuuguuuaauucagaauguguauuuaaaaagaaaaggaauuuaacaauuugcau

SEQ ID NO: 125911 - RNA, 64 nt, Homo Sapiens
acacacgugcacacacacacacauuuaaaugauauaaaaagaagagguugaaagauuauuaaau

SEQ ID NO: 125912 - RNA, 64 nt, Homo Sapiens
ugggugcauuugguggcuuaaaagcaaagcuuccuaaaaagauuuuucuuggcagcuccagguc

SEQ ID NO: 125913 - RNA, 64 nt, Homo Sapiens
aauauguucccgcuauguggauaacucuucuuuuuaaaaagaaaauagagaauagcaaaucuuc

SEQ ID NO: 125914 - RNA, 64 nt, Homo Sapiens
auugggcccuuagaaugugaaaaaaaaaaguaauuaaaaagacacuuuuaccgaacucgggauu

SEQ ID NO: 125915 - RNA, 64 nt, Homo Sapiens
gaagaaggacugaagaaaauccuucagcaauccuuaaaaagaccaugcauucagaucugaagua

SEQ ID NO: 125916 - RNA, 64 nt, Homo Sapiens
uuguuauucaguuacuaaauuugaggugaauaauuaaaaagaaaaggacauuaggagagugaaa

SEQ ID NO: 125917 - RNA, 64 nt, Homo Sapiens
cauccugcuuucuauuuuacauugaguaaaguuuuaaaaagacaacagucaaguugauuuugau

SEQ ID NO: 125918 - RNA, 64 nt, Homo Sapiens
uguauggauauaauauaaaaugaauucauauaauuaaaaagaauuugguuaauaagaauuugga

SEQ ID NO: 125919 - RNA, 64 nt, Homo Sapiens; identical to SEQ ID NO: 125910

SEQ ID NO: 125920 - RNA, 64 nt, Homo Sapiens
acacacacgugcacacacacacauuuaaaggauauaaaaagaagagguugaaagauuauuaaau

SEQ ID NO: 125921 - RNA, 64 nt, Homo Sapiens
cucacauugcagaacaauuccgaaaauggcaaacuacuacuacuacuguucaguuuuuuaaaag

SEQ ID NO: 125922 - RNA, 64 nt, Homo Sapiens
acauugcagaacaauuccgaaaauggcaaacuacuacuacuacuguucaguuuuuuaaaaguuu

SEQ ID NO: 125923 - RNA, 64 nt, Homo Sapiens
ucuacuauaucaugaauauuuuaaaacuugguacuacuacuaaaaaaucuguaucaguggacuu

SEQ ID NO: 125924 - RNA, 64 nt, Homo Sapiens
aaaucuacuauaucaugaaucuuuuaaaacuugguacuacuacuguuaaaucuguaucagugga

SEQ ID NO: 125925 - RNA, 64 nt, Homo Sapiens
auguaaaccaaaaguuaaauuuuauaguuaauacuacuacuaauuauggcaagauguuacagca

SEQ ID NO: 125926 - RNA, 64 nt, Homo Sapiens
aauauguaaaccaaaaguuagcauuuauaguuaauacuacuacugguuauggcaagauguuaca

SEQ ID NO: 125927 - RNA, 64 nt, Homo Sapiens
cuaaauacuaugcauacauuuuuccuguuguuacuacuacuaugguauuuucuacucugacuac

SEQ ID NO: 125928 - RNA, 64 nt, Homo Sapiens
augcuaaauacuaugcauacuacuuuccuguuguuacuacuacuguaguauuuucuacucugac

SEQ ID NO: 125929 - RNA, 64 nt, Homo Sapiens
ucacagugacugaguacgguggugguaguggugguacuacuacuacugguauuuagucagcagg

SEQ ID NO: 125930 - RNA, 64 nt, Homo Sapiens
cagugacugaguacgguggugguaguggugguacuacuacuacugguauuuagucagcagggau

SEQ ID NO: 125931 - RNA, 64 nt, Homo Sapiens
cuuaacuguuauauuaugauugugacauagauuauacuacuacuaauuuuuggauguuucaaaa

SEQ ID NO: 125932 - RNA, 64 nt, Homo Sapiens
aacuguuauauuaugauugugacauagauuauacuacuacuaauuuuuggauguuucaaaaggu

SEQ ID NO: 125933 - RNA, 64 nt, Homo Sapiens
aaggaaaaacacaagcaaaaaaaaaaaaaagcaucuaucucaucuaucucaauccuaauuucuc

SEQ ID NO: 125934 - RNA, 64 nt, Homo Sapiens
cacaagcaaaaaaaaaaaaaagcaucuaucucaucuaucucaauccuaauuucuccucccuucc

SEQ ID NO: 125935 - RNA, 64 nt, Homo Sapiens
agcaaguauggaaaaaagaugaucuagaagucaacuaucucaaccuccauuguuacccacuagg

SEQ ID NO: 125936 - RNA, 64 nt, Homo Sapiens
auaaauaaucaagcuuaggacuaaaugaaagauacuaucucauguaugcuuuaaauagagaauu

SEQ ID NO: 125937 - RNA, 64 nt, Homo Sapiens
cucgcucuguugcccagcccagaguacaguggcacuaucucagcucacugcaaucuccgccucc

SEQ ID NO: 125938 - RNA, 64 nt, Homo Sapiens
ugcaaucuccgccucccugguucaagugauucuccuaucucagccucccaaguagcugggacua

SEQ ID NO: 125939 - RNA, 64 nt, Homo Sapiens
acauagauuuauguaaugcuuuauguuuaaaaacauuccccaauuaucuuauuuaauuuuugca

SEQ ID NO: 125940 - RNA, 64 nt, Homo Sapiens
guggaggaagauccaaacagaaaagugcaaaguuauuccccaucuuccaaggguugaauucugg

SEQ ID NO: 125941 - RNA, 64 nt, Homo Sapiens
uguguucaucugcacccaccuggauuugacagugauuccccacguuuuuuguggggcacaguac

SEQ ID NO: 125942 - RNA, 64 nt, Homo Sapiens
cagacauuuuuuagaaaucacaugugcauauuucauuccccaggagaucugugaauaugaaaua

SEQ ID NO: 125943 - RNA, 64 nt, Homo Sapiens
cccagcucugaaagggcacgaguucucucagcccauuccccaccuccccuuccauaccccuucc

SEQ ID NO: 125944 - RNA, 64 nt, Homo Sapiens
agggagaggagggcccuguccggcauguguggguauuccccagaagcauuugccuccugcugag

SEQ ID NO: 125945 - RNA, 64 nt, Homo Sapiens
gccaagggaguuuaaguuugcccacacccuuuacauuccccagacuggccacaggugcacccuu

SEQ ID NO: 125946 - RNA, 64 nt, Homo Sapiens
cauuuuucccuucuuagguugcccccuguggcccauuccccauuccucauggacugaggccaga

SEQ ID NO: 125947 - RNA, 64 nt, Homo Sapiens
aauuaguaguaaguggggucaacgaguaaacgaaauuccccagagauuuuuuaauauuagauaa

SEQ ID NO: 125948 - RNA, 64 nt, Homo Sapiens
acuugucaugcccucagcacaugugacauuugggauuccccaucggcagaaauuugugacugag

SEQ ID NO: 125949 - RNA, 64 nt, Homo Sapiens
cauaauccccaagcccagcccgggccugucugggauuccccacuugugccugggguccucuggg

SEQ ID NO: 125950 - RNA, 64 nt, Homo Sapiens
caagagcuucucugggauuuucuugugauaucugauuccccagugaggccugggacguuuuuaa

SEQ ID NO: 125951 - RNA, 64 nt, Homo Sapiens
uucugaaagcuucuuccagucccugaucuggcucauuccccaccuucaacucccaccuuacaug

SEQ ID NO: 125952 - RNA, 64 nt, Homo Sapiens
gagucccaguuacaucaaacagugacuuccaguuauuccccaguaagucugagugguuccuuca

SEQ ID NO: 125953 - RNA, 64 nt, Homo Sapiens
aaccuucaugguagguagagcaguuccaauuauuuggcaucaaaucucuuuucaucuuugaugu

SEQ ID NO: 125954 - RNA, 64 nt, Homo Sapiens
guuucaguucuaguuuguauguuuuaaaaggaaguggcaucauucuuuuauacuaggcuucuua

SEQ ID NO: 125955 - RNA, 64 nt, Homo Sapiens
auuccccaaauugaauaucaccagaugcaugugguggcaucaccacgccucccugcugccuccc

SEQ ID NO: 125956 - RNA, 64 nt, Homo Sapiens
caaucauucagagcugaggccccaaggccaaggcuggcaucagcacaggccgggacaggccuca

SEQ ID NO: 125957 - RNA, 64 nt, Homo Sapiens
cagcccaagacccccagggggaagccuugacagcuggcaucaauaagauucuccaaaaagucca

SEQ ID NO: 125958 - RNA, 64 nt, Homo Sapiens
ugggcuaauggccaccgggcugacuggccauguguggcaucaucugugaagacucuggccaugg

SEQ ID NO: 125959 - RNA, 64 nt, Homo Sapiens
gagauuggaaugggcagcucaucucugucccacuuggcaucagcuggcgucaugcaaagucaug

SEQ ID NO: 125960 - RNA, 64 nt, Homo Sapiens
gcaucuuguuuauaccuuugccuuggaaguugcauggcaucaccuccaccauacuccaucaguu

SEQ ID NO: 125961 - RNA, 64 nt, Homo Sapiens
acauauuccauauugauuuugacgcucuguauauuggcaucagguggcagcugaauaucuuuug

SEQ ID NO: 125962 - RNA, 64 nt, Homo Sapiens
cuccucugccugagugugucuuuguaaugucagcuggcaucauacaaagagcaggagaagcaaa

SEQ ID NO: 125963 - RNA, 64 nt, Homo Sapiens
cacucaccugcacaagaaucccugcaucagguucuccuuugaggguacccacccaggacagucc

SEQ ID NO: 125964 - RNA, 64 nt, Homo Sapiens
gagcuuccaggccugcucuaagaugccuugcuuguccuuugacccaucagcauggagcucagug

SEQ ID NO: 125965 - RNA, 64 nt, Homo Sapiens
agcugauguggcccaaguccaucucuuggucuucuccuuugaagcacagccuauuucugagcca

SEQ ID NO: 125966 - RNA, 64 nt, Homo Sapiens
gaaugccaccugccacaguugauggugaggaagcuccuuugacguggugcaauuuugaugagau

SEQ ID NO: 125967 - RNA, 64 nt, Homo Sapiens
uuuggguaaaaaauuguacaucaauacauacugcuccuuugaaaaacauuauaaaacauuaaau

SEQ ID NO: 125968 - RNA, 64 nt, Homo Sapiens
ucauuuauuauuuuauaaaucaugaauucauuucuccuuugaagacugguuucuuuaucccuaa

SEQ ID NO: 125969 - RNA, 64 nt, Homo Sapiens
uuuccuucuuugucuuagcuauaaaauaaucgucuccuuugacauuuuaugguguguuccuaac

SEQ ID NO: 125970 - RNA, 64 nt, Homo Sapiens
uauaguuugcuuugcuuuuucccuucugguacaauccuuugaguauuauaaaaccauguugauu

SEQ ID NO: 125971 - RNA, 64 nt, Homo Sapiens
uaguacauauacacagacauccauaugcagcguuuccuuugaaggugaccaguuguuuguagcu

SEQ ID NO: 125972 - RNA, 64 nt, Homo Sapiens
uuuuacucgccaccuuccgguggagcugccucguuccuuugaacuaugcccucacccuucugcc

SEQ ID NO: 125973 - RNA, 64 nt, Homo Sapiens
guucugucuggcugugugaguggcgucucucccuuccuuugagggaagcucagcuuucuuacgc

SEQ ID NO: 125974 - RNA, 64 nt, Homo Sapiens
uuucugugcugcuguaauuguugguuugccugucuccuuugagcugugggcauugccgggguag

SEQ ID NO: 125975 - RNA, 64 nt, Homo Sapiens
aaggauguggaucuccaaauuuacucaugagccuuccuuugagggcuuuauacugcauacaaau

SEQ ID NO: 125976 - RNA, 64 nt, Homo Sapiens
cugauuuuucuuuuuuuuaaaaaaaaccagcccauccuuugaggcucaaaggggguuuaaaaaa

SEQ ID NO: 125977 - RNA, 64 nt, Homo Sapiens
uucuucucuuaauugcuuuuugauuagagguugguccuuugaccauguuagagaccaaacuuag

SEQ ID NO: 125978 - RNA, 64 nt, Homo Sapiens
uuuccuacucaaugguaggauggagaccucuacuuccuuugagcagaaaacaucucaucacaau

SEQ ID NO: 125979 - RNA, 64 nt, Homo Sapiens
uggaugggaacucaaggugcucccacuuugucccuccuuugaaggaacccaguggguuggagcc

SEQ ID NO: 125980 - RNA, 64 nt, Homo Sapiens
gagggucaaaauacaaagacgugaguucugccuuuccuuugaucucaaagucucacauggaaaa

SEQ ID NO: 125981 - RNA, 64 nt, Homo Sapiens
uucuuaaaaagucaauuauaauuuguaacucacauccuuugagcuaaacuaaauuaaaauuaca

SEQ ID NO: 125982 - RNA, 64 nt, Homo Sapiens
gauuacaauuuaauacauuguaaaaaguauuaaauccuuugaaacaucuuuuguugcuuauuua

SEQ ID NO: 125983 - RNA, 64 nt, Homo Sapiens
uguugaucagagagcguguccguugugaucccaguccuuugaaacugugaagccucgccccgcg

SEQ ID NO: 125984 - RNA, 64 nt, Homo Sapiens
aaaaaaagauucaauguucauuguuauuuguugcuccuuugaagguaaugggucuuuuuucuuu

SEQ ID NO: 125985 - RNA, 64 nt, Homo Sapiens
ggcuauugaacccuucuggguuguguucaugguuuccuuugauuuggacaccuggugcugcuaa

SEQ ID NO: 125986 - RNA, 64 nt, Homo Sapiens
auuagacacacagguaccagcaaugauguauccuuccuuugacaacaacuuggccauuauuuua

SEQ ID NO: 125987 - RNA, 64 nt, Homo Sapiens
cugguuaacuuuuauuucuuuugaugaaaauuuuuccuuugauaguacuuguauuauugugcca

SEQ ID NO: 125988 - RNA, 64 nt, Homo Sapiens
aguccauagaggucccuggcuaccaaacacauucuccuuugaauuguuaaaauucagaacauuc

SEQ ID NO: 125989 - RNA, 64 nt, Homo Sapiens
uugguggaaaugauaaacguuuuaaguguuaacauccuuugaaugcguuggauuucagagaaua

SEQ ID NO: 125990 - RNA, 64 nt, Homo Sapiens
aaagagaauuuauuuucaaguugugaguaaauccuccuuugaaauucaccugauuauuagauaa

SEQ ID NO: 125991 - RNA, 64 nt, Homo Sapiens
ggaaauaauugccguuaggcgcuggacacaaaccuccuuugaaguccaccaggccuucucucca

SEQ ID NO: 125992 - RNA, 64 nt, Homo Sapiens
uaguacugacuugcacugaggggaguccccugaguccuuugacucagggcucaagaagucugcu

SEQ ID NO: 125993 - RNA, 64 nt, Homo Sapiens
aaaucuggcaggauuuuaaaacucaaucagucuuuccuuugagcuagugacuugaaaagaaaga

SEQ ID NO: 125994 - RNA, 64 nt, Homo Sapiens
gaauucaccacucugguuacccaacuacagaaccuccuuugaucaggccaguagguugugaugc

SEQ ID NO: 125995 - RNA, 64 nt, Homo Sapiens
uccuaugauugugguuucucagcuucuuuaccucuccuuugaguuagguccaccucaguuuucu

SEQ ID NO: 125996 - RNA, 64 nt, Homo Sapiens
aaggcccccccaaaaauacaguauguagcugaauuccuuugaaagaucaugauaaacucagaag

SEQ ID NO: 125997 - RNA, 64 nt, Homo Sapiens
ucaaaaacugcacggacauacaaaaucaaucuuuuccuuugaucuuguggcuaaaccagcauuu

SEQ ID NO: 125998 - RNA, 64 nt, Homo Sapiens
cccgggccaaauucaggggucuagugcccugcauuccuuugaggcaaaaaauaaaugggcuaug

SEQ ID NO: 125999 - RNA, 64 nt, Homo Sapiens
aauuccuuuauucuuugggaaccuucuaauuuuaggcugucagaaauaaaaguaugaguuccau

SEQ ID NO: 126000 - RNA, 64 nt, Homo Sapiens
aggguaugucauggaccaaaacguuucagcuuugggcugucaaaaguaaccccagauagaguug

SEQ ID NO: 126001 - RNA, 64 nt, Homo Sapiens
auucuucaaggagaaugaauggaaggugacugaaggcugucaggcuuuugggagacuggaaaag

SEQ ID NO: 126002 - RNA, 64 nt, Homo Sapiens
ccaugugcaccugccccccaucucccagacucugggcugucagccaaucaaggccacugcuaca

SEQ ID NO: 126003 - RNA, 64 nt, Homo Sapiens
gcucuugcagauacuguguuauuggaggguggauggcugucagaugguuguaaagugaaguaag

SEQ ID NO: 126004 - RNA, 64 nt, Homo Sapiens
caagccccggggggcagcaggcccugcccugucaggcugucagacggcacgggggcagcgugca

SEQ ID NO: 126005 - RNA, 64 nt, Homo Sapiens
ugcuacgagcugcuggcccuaaccgcccaaccgaggcugucagguccugcgcuacuacagcaag

SEQ ID NO: 126006 - RNA, 64 nt, Homo Sapiens
accagccccgagcggggaggcggcacgucauccaggcugucaacugugcauagaggcgcuggag

SEQ ID NO: 126007 - RNA, 64 nt, Homo Sapiens
aaacauagcaaauugugcugcacaugaggaaauaggcugucacuaucacauuguccugaaaaca

SEQ ID NO: 126008 - RNA, 64 nt, Homo Sapiens
cuucagcgucuuuuccuagagcuggucaccacuaggcugucacuauaaauuccuugaauauaag

SEQ ID NO: 126009 - RNA, 64 nt, Homo Sapiens
ugaucacaucagagaggucugcguggcaguuuggggcugucacgugaccagugacccacacucu

SEQ ID NO: 126010 - RNA, 64 nt, Homo Sapiens
uccagcguggccuuugauccagacuuagggacgaggcugucacuggugggcacccucuguuccu

SEQ ID NO: 126011 - RNA, 64 nt, Homo Sapiens
uguagcaauaacgacauuagcugcguggcuguuuggcugucacuucauacccaccucugggacu

SEQ ID NO: 126012 - RNA, 64 nt, Homo Sapiens
gcaggagccgugggccugggcagccuucuccagaggcugucacuccuuaagaagguucagagac

SEQ ID NO: 126013 - RNA, 64 nt, Homo Sapiens
ggguccagauuuuaaaggugauuacuggguuaaauugugggaaauucaacaguaauguuugaga

SEQ ID NO: 126014 - RNA, 64 nt, Homo Sapiens
uaggaauuguuuuaaugcauuccuuuacuuuuguuugugggaggcacagugacugucagcagau

SEQ ID NO: 126015 - RNA, 64 nt, Homo Sapiens
aggaaaggagacaaguccaaagcucguuuguggauugugggacugagcgaaggaguacaaauau

SEQ ID NO: 126016 - RNA, 64 nt, Homo Sapiens
uagggagccaggccgaaggggccucacugaccaauugugggacaauuugaacaucaggaugaau

SEQ ID NO: 126017 - RNA, 64 nt, Homo Sapiens
gaaauagcuuauuguuuaguaaaauggcccuugguugugggaagaaagagaauuauuuuuaacu

SEQ ID NO: 126018 - RNA, 64 nt, Homo Sapiens
uaauauguauguugucauuguuucaugcuauacuuugugggauaaaacuugggaaugagugugg

SEQ ID NO: 126019 - RNA, 64 nt, Homo Sapiens
cuucacaaccccugcuuuccugucccuggcaggauugugggagguugaagcagcacaucuccac

SEQ ID NO: 126020 - RNA, 64 nt, Homo Sapiens
aaagcuugugugaaauucccuuuuuagagcuugauugugggagaccucuucugagacuguuguu

SEQ ID NO: 126021 - RNA, 64 nt, Homo Sapiens
guucaucuccuaugugaugcccugcugcuccuguuugugggacuaucccacuggcugcaggccu

SEQ ID NO: 126022 - RNA, 64 nt, Homo Sapiens
acuuguugguuauugcuuaaaggauauuuuuuucuugugggaaaugauauuugugaaggccuuu

SEQ ID NO: 126023 - RNA, 64 nt, Homo Sapiens
uacccuccacucuaaagagacuucccccggauuguugugggagccaacagucucccccuuuccc

SEQ ID NO: 126024 - RNA, 64 nt, Homo Sapiens
gagacauauggcuugagaagggggcugucucuguuugugggagaguagagaaugcuggagggaa

SEQ ID NO: 126025 - RNA, 64 nt, Homo Sapiens
aauuuucuucuuccccagaacugcacuccugcuuuugugggaaagagaaagucauuacuuacua

SEQ ID NO: 126026 - RNA, 64 nt, Homo Sapiens
uucugagaguauuacagagugagguguugggcaguugugggaacgcagcaggaaacggguaggu

SEQ ID NO: 126027 - RNA, 64 nt, Homo Sapiens
uagaaaggugguucugaaauggcaccugguacucuugugggaccuggggaauauaaggaacucu

SEQ ID NO: 126028 - RNA, 64 nt, Homo Sapiens
cggccccucauuggccaagggcacuguggauguuuugugggaggcagcauggcaccguggaaag

SEQ ID NO: 126029 - RNA, 64 nt, Homo Sapiens
ugcacagaggagaggcgcccuaagaauguaagcauugugggaaagcauucauaucugccaagau

SEQ ID NO: 126030 - RNA, 64 nt, Homo Sapiens
cucauacgagagagaauccguaugaauguaaggauugugggaaagcauucagcuugcuuaauug

SEQ ID NO: 126031 - RNA, 61 nt, Homo Sapiens
auacuggagagaaaccuuaggagugcagucauugugggaaagcuuucauccagaggucucc

SEQ ID NO: 126032 - RNA, 64 nt, Homo Sapiens
cauauccuggagaaaagcccuacgaaugcauugauugugggaaagccuucaaugaucgcucaac

SEQ ID NO: 126033 - RNA, 64 nt, Homo Sapiens
cagaaagggaagcagaacuguccacaucuggcuuuugugggacugggaugggaacccaaggcug

SEQ ID NO: 126034 - RNA, 64 nt, Homo Sapiens
gcugcccacagauccaggugccccaagggggauuuugugggacccacaaguccuccucagggag

SEQ ID NO: 126035 - RNA, 64 nt, Homo Sapiens
aacugaguccaacuagauuagagaaaauagagcauugugggaaauaaauuugucaaaacuaggu

SEQ ID NO: 126036 - RNA, 64 nt, Homo Sapiens
auaauuuuauaauccauuuagaaacugucauguuuugugggaaagacuucuaguccaaauauaa

SEQ ID NO: 126037 - RNA, 64 nt, Homo Sapiens
acucgaauccacccaggaacucccuggcaguggauugugggaggcucuugcuuacacuaaucag

SEQ ID NO: 126038 - RNA, 64 nt, Homo Sapiens
ugguaugugaaauauuguacauagaccugaugaguugugggaccagaugucaucucuggucaga

SEQ ID NO: 126039 - RNA, 64 nt, Homo Sapiens
cagugucuuggugcaccaagaugccuucuaaaggcugacauaccuuggacccuaauggggcaga

SEQ ID NO: 126040 - RNA, 64 nt, Homo Sapiens
cuuccuccuugagggaauagaaauggaccuuucucugacauaguucuuggcaugggagccagcc

SEQ ID NO: 126041 - RNA, 64 nt, Homo Sapiens
aaagucuugcaaaauggggcaguggacugacaggcugacauagaaaauaaacuuugcccaauca

SEQ ID NO: 126042 - RNA, 64 nt, Homo Sapiens
acaacucucuugaugaccauucugucuggaucuacugacauaagauggccuguagcaaugaggc

SEQ ID NO: 126043 - RNA, 64 nt, Homo Sapiens
aaaaucaaccaacacaagaucaaaaaggaaaaggacgagagaaaaauuauuuuuaagauaauua

SEQ ID NO: 126044 - RNA, 64 nt, Homo Sapiens
ccccacccugaccgugcugaacagacccccccacacgagagaaaauaaaggagcaauaaaguca

SEQ ID NO: 126045 - RNA, 64 nt, Homo Sapiens; identical to SEQ ID NO: 61424

SEQ ID NO: 126046 - RNA, 64 nt, Homo Sapiens; identical to SEQ ID NO: 61425

SEQ ID NO: 126047 - RNA, 64 nt, Homo Sapiens; identical to SEQ ID NO: 61426

SEQ ID NO: 126048 - RNA, 64 nt, Homo Sapiens; identical to SEQ ID NO: 61427

SEQ ID NO: 126049 - RNA, 64 nt, Homo Sapiens; identical to SEQ ID NO: 61428

SEQ ID NO: 126050 - RNA, 64 nt, Homo Sapiens; identical to SEQ ID NO: 61429

SEQ ID NO: 126051 - RNA, 64 nt, Homo Sapiens; identical to SEQ ID NO: 61430

SEQ ID NO: 126052 - RNA, 64 nt, Homo Sapiens; identical to SEQ ID NO: 61431

SEQ ID NO: 126053 - RNA, 64 nt, Homo Sapiens; identical to SEQ ID NO: 61432

SEQ ID NO: 126054 - RNA, 64 nt, Homo Sapiens; identical to SEQ ID NO: 61433

SEQ ID NO: 126055 - RNA, 64 nt, Homo Sapiens
uuuacuuggauugauaauuagcuccuaaccuaacaaaguuuaaguugcucaauacagcaaauua

SEQ ID NO: 126056 - RNA, 64 nt, Homo Sapiens
uacaguuaaaaauguauaauccuuacauuaaagaaaaguuuaaucuuucugucacuuuuuuccu

SEQ ID NO: 126057 - RNA, 64 nt, Homo Sapiens
uaccuauauauucucugaauguaaaauuauugucaaaguuuaaaucaaacuuggauguaucaag

SEQ ID NO: 126058 - RNA, 64 nt, Homo Sapiens
acaguuggcuccccccccacuccuuuguuuuuuaaaaguuuauguuagguuuuugaccuuuucu

SEQ ID NO: 126059 - RNA, 64 nt, Homo Sapiens
cuuauaaaaaggcagauaguuaagcuaauguagaaaaguuuagaaauguagccugccuuacaua

SEQ ID NO: 126060 - RNA, 64 nt, Homo Sapiens
caauuaguaauggcggaaacaaguuuuaaugaauaaaguuuaauaaaucacaaauaaaacagug

SEQ ID NO: 126061 - RNA, 64 nt, Homo Sapiens
ugaaauuaauaagccaauggguggugccaaguagaaaguuuaacgcaaccuuucugaauauucu

SEQ ID NO: 126062 - RNA, 64 nt, Homo Sapiens
ucuaacagaacaacugaaauuuaaacuuuauccuaaaguuuaaaaaauauaguaaaagucauau

SEQ ID NO: 126063 - RNA, 64 nt, Homo Sapiens
gacuucuuuuaacuuggauuccuuuguauauaguaaaguuuaguauauauauauuuuuuucuuu

SEQ ID NO: 126064 - RNA, 64 nt, Homo Sapiens
uuuguaucuaaucucugauuauuaaaauguuuauaaaguuuauuuuuaccaaagagaugcaauu

SEQ ID NO: 126065 - RNA, 64 nt, Homo Sapiens
uucaguauaaaacuuuaguauaauuguaguuugcaaaguuuauuucaguucacauguaagguau

SEQ ID NO: 126066 - RNA, 64 nt, Homo Sapiens
aaauacagcuuuugaucuguaaugcuuuuauacaaaaguuuauuuuaauaauaaaauguuuguu

SEQ ID NO: 126067 - RNA, 64 nt, Homo Sapiens
ugaauuuuacaacaaacuagcauuuguauacauaaaaguuuacaaaaaccugugcuugaucuga

SEQ ID NO: 126068 - RNA, 64 nt, Homo Sapiens
guuaauucuuuuuacaaaacuuuugcacaaaccaaaaguuuaauacaugauauaaauuuuuguu

SEQ ID NO: 126069 - RNA, 64 nt, Homo Sapiens
uagcacuugugacauaccaaucauauuaagaaaaaaaguuuaucaaggacuacuuaaacauuug

SEQ ID NO: 126070 - RNA, 64 nt, Homo Sapiens
ggguagcuucugaaauuaacuuucggaguuugguaaaguuuacaaggagggacccagagccgag

SEQ ID NO: 126071 - RNA, 64 nt, Homo Sapiens
acccacaacuccacagucucuaaaacuggugcuuaaaguuuauuuaauacaaaacaaacuugau

SEQ ID NO: 126072 - RNA, 64 nt, Homo Sapiens
cacugcuugauauuauaaauuuaaaacacaagugaaaguuuagccaugguuuugugcggcauca

SEQ ID NO: 126073 - RNA, 64 nt, Homo Sapiens
ccaugguuuugugcggcaucauaguuaugucaauaaaguuuauuuaggucauagaauauccuaa

SEQ ID NO: 126074 - RNA, 64 nt, Homo Sapiens
auaguguucaaauugcaaaacuuuaaggacauucaaaguuuaaauuagaaaguaaguuuaaaga

SEQ ID NO: 126075 - RNA, 64 nt, Homo Sapiens
ucuuccacguacuuaaauuuuuucuucauccaaaaaaguuuauuaccacucaaaauuaacuugu

SEQ ID NO: 126076 - RNA, 64 nt, Homo Sapiens
ugugguuuggggcuucauuuuucuaguuuagccaaaaguuuaugcuguuaggccauucucuaaa

SEQ ID NO: 126077 - RNA, 64 nt, Homo Sapiens
ggcucugaggaacugagaaauaacugucagacaaaaaguuuauuuuugcucuguguucucccgg

SEQ ID NO: 126078 - RNA, 64 nt, Homo Sapiens
uuaucauuaagacacugcuacucaggaucuaaauaaaguuuaaaggauuuaacuugauauagcu

SEQ ID NO: 126079 - RNA, 64 nt, Homo Sapiens
cauauaaacuuuuuauuuuucaaacaauauucagaaaguuuaaguauuuaaauaggaaaucaga

SEQ ID NO: 126080 - RNA, 64 nt, Homo Sapiens
uauuccaugcuuguuuucuccauuuuuuaauguuaaaguuuauagauuuuauuacaaaauaaaa

SEQ ID NO: 126081 - RNA, 64 nt, Homo Sapiens
uagcuuaauaucaauagaauugguuugcaaaggaaaaguuuaaaguuuaaagagggggaagagu

SEQ ID NO: 126082 - RNA, 64 nt, Homo Sapiens
gagggggaagaguugguuuguaaguaacgaauugaaaguuuaaagggucgucaaacgcuaaauc

SEQ ID NO: 126083 - RNA, 64 nt, Homo Sapiens
uuuacaaauauuucuguuuacuugauaaugcuguaaaguuuauugucaguguugucuuaauauc

SEQ ID NO: 126084 - RNA, 64 nt, Homo Sapiens
uucuaugagggcuaauaucuauucagaauuucuaaaaguuuaaguauguagaauauauuuccuu

SEQ ID NO: 126085 - RNA, 64 nt, Homo Sapiens
ggauuuaguacugauauuuauauauacacaacagaaaguuuauuauauguuacauacuaacaua

SEQ ID NO: 126086 - RNA, 64 nt, Homo Sapiens
ggugcaucugccuccucuuccucuuaagaugaauaaaguuuauaauuuuuuuuaaauuuguugg

SEQ ID NO: 126087 - RNA, 64 nt, Homo Sapiens
guuugauguuuuuaaagguugucacuuuuuuauaaaaguuuauugcugauuuaacuuguauuuu

SEQ ID NO: 126088 - RNA, 64 nt, Homo Sapiens
gccuagcagagaacugccuugauucaaauguuuuaaaguuuaaugugaagcauuauggucuaau

SEQ ID NO: 126089 - RNA, 64 nt, Homo Sapiens
uggagaaggcgguuccguucuaaaguuuacgucaaaaguuuacaaggccagauacccugaagca

SEQ ID NO: 126090 - RNA, 64 nt, Homo Sapiens
ucaaaaguuuacauggagaaauacccugaagcauaaaguuuacgcucggagcagaagaggccag

SEQ ID NO: 126091 - RNA, 64 nt, Homo Sapiens
caaugugaagaauuuguuuaaaaacauccuguagaaaguuuauaagaaaaccaguauuugaaca

SEQ ID NO: 126092 - RNA, 64 nt, Homo Sapiens
uuuggaccacuauuuuacuggccuuugaaagaacaaaguuuacuucaacuaaaauguuucuucc

SEQ ID NO: 126093 - RNA, 64 nt, Homo Sapiens
uggugaaauaauacuggggauaugacaggaaguaaaaguuuacacuguacagcacuaguuacau

SEQ ID NO: 126094 - RNA, 64 nt, Homo Sapiens
ucauuguuucaccaaaaaaagcaauguguacaacaaaguuuacaauuuuccaaaaucacaaaaa

SEQ ID NO: 126095 - RNA, 64 nt, Homo Sapiens
aauuuggcaauaaaauauuauuaugacuucuugaaaaguuuaacggaacccagaaaaggugaug

SEQ ID NO: 126096 - RNA, 64 nt, Homo Sapiens
caaugcuaauuugaaagaaaaaucaaacccaaagaaaguuuauuaaauuuauuauaggaaaaua

SEQ ID NO: 126097 - RNA, 64 nt, Homo Sapiens
ucugaacaaauaagucaauucacaggggccuuacaaaguuuaugauagaaccacaaacacagau

SEQ ID NO: 126098 - RNA, 64 nt, Homo Sapiens
gguaucuugauguauauauauucuuuacuaucuaaaaguuuaucgaauaacaaucuccauuuuu

SEQ ID NO: 126099 - RNA, 64 nt, Homo Sapiens
uaaagaaguuuuuuuaaguugaaugcacauguauaaaguuuacaaaacauauagaaaagagcaa

SEQ ID NO: 126100 - RNA, 64 nt, Homo Sapiens
uaguauccaaagacuguuuagacacuuguuagggaaaguuuauuaaucuaaauaacauagcuag

SEQ ID NO: 126101 - RNA, 64 nt, Homo Sapiens
uuccucugccauccuugcuaccaugauauaaaguaaaguuuauuaauguuaugaucacuuucac

SEQ ID NO: 126102 - RNA, 64 nt, Homo Sapiens
aguuuuuuuuuucuuuuuuaaacacuaaacuuuuaaaguuuacacuuauauaaaaauuuuuauc

SEQ ID NO: 126103 - RNA, 64 nt, Homo Sapiens
acuacagucuuuaacacauugggauuuagugcaaaaaguuuacaauuuauuuuguuccugaaau

SEQ ID NO: 126104 - RNA, 64 nt, Homo Sapiens
ugucuuaacucauuuaauaaauuugucuauuuguaaaguuuauuuagccacugagccuuuuauu

SEQ ID NO: 126105 - RNA, 64 nt, Homo Sapiens
aggacugcuacuauaacugaccucaggcugacauaaaguuuacggauuucaccagauacacaau

SEQ ID NO: 126106 - RNA, 64 nt, Homo Sapiens
augcuuuuaggacagaauggagacuuauacacccaaaguuuaucuguguuuguuuguaaguauu

SEQ ID NO: 126107 - RNA, 64 nt, Homo Sapiens
uuagcagucuuauauguacuagaaaagauuuuuuaaaguuuauuuaaagcuguguagaugaagg

SEQ ID NO: 126108 - RNA, 64 nt, Homo Sapiens
gagaccagcugugauguuuaaagacauaaaggauaaaguuuacuuuuaaaggguuucuaaacau

SEQ ID NO: 126109 - RNA, 64 nt, Homo Sapiens
gauacaauuaaauuuuguucagaaaguuuguuuuaaaguuuauuuuaagcacuaucguaccaaa

SEQ ID NO: 126110 - RNA, 64 nt, Homo Sapiens
gaagaguaacacuugaaaagccuuaacauauauaaaaguuuaaaauugaaaagaaaaagaagag

SEQ ID NO: 126111 - RNA, 64 nt, Homo Sapiens
uuuuaaaauucuaaguagagagguaccaaaaaagaaaguuuauuaggcuaauacaggaaacaag

SEQ ID NO: 126112 - RNA, 64 nt, Homo Sapiens
acugaguauucauauuaaguauaaaacuuagagcaaaguuuaaaccaucucaaaauaaaauaaa

SEQ ID NO: 126113 - RNA, 64 nt, Homo Sapiens
ugucuuguuauuuuuuauuagcaucucauuagggaaaguuuauaaacaaccguuuuuauuaacu

SEQ ID NO: 126114 - RNA, 64 nt, Homo Sapiens
guaaaaaaaucaaaaacaaacgguuuguaguugaaaaguuuacugaacaucuuucgcguauuca

SEQ ID NO: 126115 - RNA, 64 nt, Homo Sapiens
cauauuguaaaauaucuauuuugaggccauguguaaaguuuaacauuaaaauuguccuucaguu

SEQ ID NO: 126116 - RNA, 64 nt, Homo Sapiens
ccaguuuaaagcaauaacuuucauaguuucuuucaaaguuuaauacauccaauaugucaaguua

SEQ ID NO: 126117 - RNA, 64 nt, Homo Sapiens
ccaauaugucaaguuaaaccauucugggauuugcaaaguuuaauacauccaauaugucaaguua

SEQ ID NO: 126118 - RNA, 64 nt, Homo Sapiens; identical to SEQ ID NO: 126117

SEQ ID NO: 126119 - RNA, 64 nt, Homo Sapiens
cuuuacagauuuauggaaauuaaauuuauggggaaaaguuuauuuuuaauauuacuuauagcug

SEQ ID NO: 126120 - RNA, 64 nt, Homo Sapiens
ccauauucaaauaauuccuauaugaauaaaaggaaaaguuuaucacuuacaaugugaaguaacu

SEQ ID NO: 126121 - RNA, 64 nt, Homo Sapiens
acacaaauaguacacuuauuauccauuuaaagugaaaguuuaucugugggaaaauaauuuuaua

SEQ ID NO: 126122 - RNA, 64 nt, Homo Sapiens
ucuuuguacucugucucuguagucucuccauucuaaaguuuaauuuggaaaggucuguccugaa

SEQ ID NO: 126123 - RNA, 64 nt, Homo Sapiens
cuggaauguuucaaugagcaaaauaaauuagacaaaaguuuacuuucuuuuuuuccaaaauaca

SEQ ID NO: 126124 - RNA, 64 nt, Homo Sapiens
ugagcuagccaaaugugggcauacuauuacagggaaaguuuaaaggucugauaacuugaaauag

SEQ ID NO: 126125 - RNA, 64 nt, Homo Sapiens
uauuuauuuuuguaagccuaaaagugauucuuugaaaguuuaaagaaacuugaccaaaagacag

SEQ ID NO: 126126 - RNA, 64 nt, Homo Sapiens
auuagcaaugguuuuuacuaaugcuaaaacuuuuaaaguuuauuuuuuaauaaauuguugagua

SEQ ID NO: 126127 - RNA, 64 nt, Homo Sapiens
auaugauauucuuauuagaaaacagaaguagcuaaaaguuuauuauuuuaauccuauuuaaaug

SEQ ID NO: 126128 - RNA, 64 nt, Homo Sapiens
gcaagcacuucucauugcuaaaaauaaauaaaccaaaguuuaaccgaaucaguuagggaaagug

SEQ ID NO: 126129 - RNA, 64 nt, Homo Sapiens
gacauagcaguaacacuguuuuuuaacaacaacaaaaguuuagguucuaauuuauguaaauacc

SEQ ID NO: 126130 - RNA, 64 nt, Homo Sapiens
uuacaggcucugaguaaucuaauagauaugaaauaaaguuuaaacugauuuuguguaauuuaac

SEQ ID NO: 126131 - RNA, 64 nt, Homo Sapiens
uguugccuuuacaguugccuggaaguuuuaaaaaaaaguuuagacauccugcuuccuucauugg

SEQ ID NO: 126132 - RNA, 64 nt, Homo Sapiens
uuaugaacugcaucaagacuucaauccugauuagugucuccagucaagcucuggguacugaauu

SEQ ID NO: 126133 - RNA, 64 nt, Homo Sapiens
gauaguuuguccuguguccuuagugaugugugugugucuccaugcacaugcacgccgggauucc

SEQ ID NO: 126134 - RNA, 64 nt, Homo Sapiens
ccugaguuucuucuggaacaucucccuagugcagugucuccaggcacucuuguuaccaaaucua

SEQ ID NO: 126135 - RNA, 64 nt, Homo Sapiens
ugaagauguacugaugacgcggugccccccaaauugucuccacagcuugacccaggaaauagau

SEQ ID NO: 126136 - RNA, 64 nt, Homo Sapiens
gugugauccagcccugguucacuguccuggaaccugucuccauucucaucccacuuccuuuccu

SEQ ID NO: 126137 - RNA, 64 nt, Homo Sapiens
gucucauccuccuuucaguucaauaaaaacugucugucuccaucagccacucggggcaggccag

SEQ ID NO: 126138 - RNA, 64 nt, Homo Sapiens
cagguggugagcugguggcucucuggugagcuagugucuccacagccugucuccaaggccuccc

SEQ ID NO: 126139 - RNA, 64 nt, Homo Sapiens
gguggcucucuggugagcuagugucuccacagccugucuccaaggccuccccuauguacauuuc

SEQ ID NO: 126140 - RNA, 64 nt, Homo Sapiens
uucauuagacaaugcuucuuuccaagaaagaccuugucuccauuuaucuacuugggcacucucu

SEQ ID NO: 126141 - RNA, 64 nt, Homo Sapiens
gguauguuugaaagcuucucuugggagacaucccugucuccagagaaacagagugaccagcuca

SEQ ID NO: 126142 - RNA, 64 nt, Homo Sapiens
ugaaggaaggccuuuaucaggcaacaucccaaauugucuccaguggcuucccaaaccuuguuuu

SEQ ID NO: 126143 - RNA, 64 nt, Homo Sapiens
ccuccgggagcugugucccucugggacagagaccugucuccacgcugggugagcuugaaguccu

SEQ ID NO: 126144 - RNA, 64 nt, Homo Sapiens
agaccuuggggaggaagcugagcaucccccgggaugucuccaguccugacacagucccucagag

SEQ ID NO: 126145 - RNA, 64 nt, Homo Sapiens
cagcguccaacucaguagcuccaguguaugaaaaugucuccagggcuaaaggcuggagaucuca

SEQ ID NO: 126146 - RNA, 64 nt, Homo Sapiens
gcccucaguccccaccccagcuucaccaugguacugucuccacaacucccauugccaugggguc

SEQ ID NO: 126147 - RNA, 64 nt, Homo Sapiens
gcccuuuuggagauauacuuuuccauucuuguguugucuccaagcucuguggauaccauuucau

SEQ ID NO: 126148 - RNA, 64 nt, Homo Sapiens
uucacaccuuucuccaaggaucgaaccaaagaugugucuccaguauugugucugugccccugug

SEQ ID NO: 126149 - RNA, 64 nt, Homo Sapiens
acugcacuccagcuuagguggcaaagugagacccugucuccaaaaaaagaaaauagagcuuuau

SEQ ID NO: 126150 - RNA, 64 nt, Homo Sapiens
ccugcaucccagcucuggggugugcagagguuugugucuccagggaacccacggcuggagagaa

SEQ ID NO: 126151 - RNA, 64 nt, Homo Sapiens
cuuggcuuagccacgcugaugaguaagugagggaugucuccaucuugagaucaccaggcaagag

SEQ ID NO: 126152 - RNA, 64 nt, Homo Sapiens
gacuucagaggcccugccaagucuagcauguuccugucuccaacaccgccuccugcacaugcag

SEQ ID NO: 126153 - RNA, 64 nt, Homo Sapiens
ccccccccccgccacauuagcugcgccccugaagugucuccagcagaagagauggaugaaugga

SEQ ID NO: 126154 - RNA, 64 nt, Homo Sapiens
aaaacagcaguaguaaucugugucaguauuuucuuagucugaaaaggagaaaaaaauccaauuu

SEQ ID NO: 126155 - RNA, 64 nt, Homo Sapiens
aguauacauuggauaggaaauagaaagagugcauuagucugaaguaacaguuuagaaggcuuga

SEQ ID NO: 126156 - RNA, 64 nt, Homo Sapiens
ucagggaccacaaagaauuuucagugggaaugucuagucugaggggucugagguuguuuuuacu

SEQ ID NO: 126157 - RNA, 64 nt, Homo Sapiens
guguguacuguauuauuuucagaaaaaaauauaauagucugaguccaaguuaucuugauuuaaa

SEQ ID NO: 126158 - RNA, 64 nt, Homo Sapiens
caacauaaaucacuuuuuaaauuccaggaacggguagucugacacggugauuauccuuuugagg

SEQ ID NO: 126159 - RNA, 64 nt, Homo Sapiens
cuauucaaaucaacugccugaaugacauuucuaguagucugauguauuuuucugaggaauaguu

SEQ ID NO: 126160 - RNA, 64 nt, Homo Sapiens; identical to SEQ ID NO: 68831

SEQ ID NO: 126161 - RNA, 64 nt, Homo Sapiens; identical to SEQ ID NO: 68832

SEQ ID NO: 126162 - RNA, 64 nt, Homo Sapiens; identical to SEQ ID NO: 68833

SEQ ID NO: 126163 - RNA, 64 nt, Homo Sapiens; identical to SEQ ID NO: 68834

SEQ ID NO: 126164 - RNA, 64 nt, Homo Sapiens; identical to SEQ ID NO: 68835

SEQ ID NO: 126165 - RNA, 64 nt, Homo Sapiens; identical to SEQ ID NO: 68836

SEQ ID NO: 126166 - RNA, 64 nt, Homo Sapiens; identical to SEQ ID NO: 68837

SEQ ID NO: 126167 - RNA, 64 nt, Homo Sapiens; identical to SEQ ID NO: 68838

SEQ ID NO: 126168 - RNA, 64 nt, Homo Sapiens; identical to SEQ ID NO: 68839

SEQ ID NO: 126169 - RNA, 64 nt, Homo Sapiens; identical to SEQ ID NO: 68840

SEQ ID NO: 126170 - RNA, 64 nt, Homo Sapiens; identical to SEQ ID NO: 68841

SEQ ID NO: 126171 - RNA, 64 nt, Homo Sapiens; identical to SEQ ID NO: 68842

SEQ ID NO: 126172 - RNA, 64 nt, Homo Sapiens; identical to SEQ ID NO: 68843

SEQ ID NO: 126173 - RNA, 64 nt, Homo Sapiens; identical to SEQ ID NO: 68844

SEQ ID NO: 126174 - RNA, 64 nt, Homo Sapiens; identical to SEQ ID NO: 68845

SEQ ID NO: 126175 - RNA, 64 nt, Homo Sapiens; identical to SEQ ID NO: 68846

SEQ ID NO: 126176 - RNA, 64 nt, Homo Sapiens; identical to SEQ ID NO: 68847

SEQ ID NO: 126177 - RNA, 64 nt, Homo Sapiens; identical to SEQ ID NO: 68848

SEQ ID NO: 126178 - RNA, 64 nt, Homo Sapiens; identical to SEQ ID NO: 68849

SEQ ID NO: 126179 - RNA, 64 nt, Homo Sapiens; identical to SEQ ID NO: 68850

SEQ ID NO: 126180 - RNA, 64 nt, Homo Sapiens; identical to SEQ ID NO: 68851

SEQ ID NO: 126181 - RNA, 64 nt, Homo Sapiens; identical to SEQ ID NO: 68852

SEQ ID NO: 126182 - RNA, 64 nt, Homo Sapiens; identical to SEQ ID NO: 68853

SEQ ID NO: 126183 - RNA, 64 nt, Homo Sapiens; identical to SEQ ID NO: 68854

SEQ ID NO: 126184 - RNA, 64 nt, Homo Sapiens; identical to SEQ ID NO: 68855

SEQ ID NO: 126185 - RNA, 64 nt, Homo Sapiens; identical to SEQ ID NO: 68856

SEQ ID NO: 126186 - RNA, 64 nt, Homo Sapiens; identical to SEQ ID NO: 68857

SEQ ID NO: 126187 - RNA, 64 nt, Homo Sapiens; identical to SEQ ID NO: 68858

SEQ ID NO: 126188 - RNA, 64 nt, Homo Sapiens; identical to SEQ ID NO: 68859

SEQ ID NO: 126189 - RNA, 64 nt, Homo Sapiens; identical to SEQ ID NO: 68860

SEQ ID NO: 126190 - RNA, 64 nt, Homo Sapiens; identical to SEQ ID NO: 68861

SEQ ID NO: 126191 - RNA, 64 nt, Homo Sapiens; identical to SEQ ID NO: 68862

SEQ ID NO: 126192 - RNA, 64 nt, Homo Sapiens; identical to SEQ ID NO: 68863

SEQ ID NO: 126193 - RNA, 64 nt, Homo Sapiens; identical to SEQ ID NO: 68864

SEQ ID NO: 126194 - RNA, 64 nt, Homo Sapiens; identical to SEQ ID NO: 68865

SEQ ID NO: 126195 - RNA, 64 nt, Homo Sapiens; identical to SEQ ID NO: 68866

SEQ ID NO: 126196 - RNA, 64 nt, Homo Sapiens; identical to SEQ ID NO: 68867

SEQ ID NO: 126197 - RNA, 64 nt, Homo Sapiens; identical to SEQ ID NO: 68868

SEQ ID NO: 126198 - RNA, 64 nt, Homo Sapiens; identical to SEQ ID NO: 68869

SEQ ID NO: 126199 - RNA, 64 nt, Homo Sapiens; identical to SEQ ID NO: 68870

SEQ ID NO: 126200 - RNA, 64 nt, Homo Sapiens; identical to SEQ ID NO: 68871

SEQ ID NO: 126201 - RNA, 64 nt, Homo Sapiens; identical to SEQ ID NO: 68872

SEQ ID NO: 126202 - RNA, 64 nt, Homo Sapiens; identical to SEQ ID NO: 68873

SEQ ID NO: 126203 - RNA, 64 nt, Homo Sapiens; identical to SEQ ID NO: 68874

SEQ ID NO: 126204 - RNA, 64 nt, Homo Sapiens; identical to SEQ ID NO: 68875

SEQ ID NO: 126205 - RNA, 64 nt, Homo Sapiens; identical to SEQ ID NO: 68876

SEQ ID NO: 126206 - RNA, 64 nt, Homo Sapiens; identical to SEQ ID NO: 68877

SEQ ID NO: 126207 - RNA, 64 nt, Homo Sapiens; identical to SEQ ID NO: 68877

SEQ ID NO: 126208 - RNA, 64 nt, Homo Sapiens; identical to SEQ ID NO: 68879

SEQ ID NO: 126209 - RNA, 64 nt, Homo Sapiens; identical to SEQ ID NO: 68880

SEQ ID NO: 126210 - RNA, 64 nt, Homo Sapiens; identical to SEQ ID NO: 68881

SEQ ID NO: 126211 - RNA, 64 nt, Homo Sapiens; identical to SEQ ID NO: 68882

SEQ ID NO: 126212 - RNA, 64 nt, Homo Sapiens; identical to SEQ ID NO: 68883

SEQ ID NO: 126213 - RNA, 64 nt, Homo Sapiens; identical to SEQ ID NO: 68884

SEQ ID NO: 126214 - RNA, 64 nt, Homo Sapiens; identical to SEQ ID NO: 68885

SEQ ID NO: 126215 - RNA, 64 nt, Homo Sapiens; identical to SEQ ID NO: 68886

SEQ ID NO: 126216 - RNA, 64 nt, Homo Sapiens; identical to SEQ ID NO: 68887

SEQ ID NO: 126217 - RNA, 64 nt, Homo Sapiens; identical to SEQ ID NO: 68888

SEQ ID NO: 126218 - RNA, 64 nt, Homo Sapiens; identical to SEQ ID NO: 68889

SEQ ID NO: 126219 - RNA, 64 nt, Homo Sapiens; identical to SEQ ID NO: 68890

SEQ ID NO: 126220 - RNA, 64 nt, Homo Sapiens; identical to SEQ ID NO: 68891

SEQ ID NO: 126221 - RNA, 64 nt, Homo Sapiens; identical to SEQ ID NO: 68892

SEQ ID NO: 126222 - RNA, 64 nt, Homo Sapiens; identical to SEQ ID NO: 68893

SEQ ID NO: 126223 - RNA, 64 nt, Homo Sapiens; identical to SEQ ID NO: 68894

SEQ ID NO: 126224 - RNA, 64 nt, Homo Sapiens; identical to SEQ ID NO: 68895

SEQ ID NO: 126225 - RNA, 64 nt, Homo Sapiens; identical to SEQ ID NO: 68896

SEQ ID NO: 126226 - RNA, 64 nt, Homo Sapiens; identical to SEQ ID NO: 68897

SEQ ID NO: 126227 - RNA, 64 nt, Homo Sapiens; identical to SEQ ID NO: 68898

SEQ ID NO: 126228 - RNA, 64 nt, Homo Sapiens; identical to SEQ ID NO: 68899

SEQ ID NO: 126229 - RNA, 64 nt, Homo Sapiens; identical to SEQ ID NO: 68900

SEQ ID NO: 126230 - RNA, 64 nt, Homo Sapiens; identical to SEQ ID NO: 68901

SEQ ID NO: 126231 - RNA, 64 nt, Homo Sapiens; identical to SEQ ID NO: 68902

SEQ ID NO: 126232 - RNA, 64 nt, Homo Sapiens; identical to SEQ ID NO: 68903

SEQ ID NO: 126233 - RNA, 64 nt, Homo Sapiens; identical to SEQ ID NO: 68904

SEQ ID NO: 126234 - RNA, 64 nt, Homo Sapiens; identical to SEQ ID NO: 68905

SEQ ID NO: 126235 - RNA, 64 nt, Homo Sapiens; identical to SEQ ID NO: 68906

SEQ ID NO: 126236 - RNA, 64 nt, Homo Sapiens; identical to SEQ ID NO: 68907

SEQ ID NO: 126237 - RNA, 64 nt, Homo Sapiens; identical to SEQ ID NO: 68908

SEQ ID NO: 126238 - RNA, 64 nt, Homo Sapiens; identical to SEQ ID NO: 68909

SEQ ID NO: 126239 - RNA, 64 nt, Homo Sapiens; identical to SEQ ID NO: 68910

SEQ ID NO: 126240 - RNA, 64 nt, Homo Sapiens; identical to SEQ ID NO: 68911

SEQ ID NO: 126241 - RNA, 64 nt, Homo Sapiens; identical to SEQ ID NO: 68912

SEQ ID NO: 126242 - RNA, 64 nt, Homo Sapiens; identical to SEQ ID NO: 68913

SEQ ID NO: 126243 - RNA, 64 nt, Homo Sapiens; identical to SEQ ID NO: 68914

SEQ ID NO: 126244 - RNA, 64 nt, Homo Sapiens; identical to SEQ ID NO: 68915

SEQ ID NO: 126245 - RNA, 64 nt, Homo Sapiens; identical to SEQ ID NO: 68916

SEQ ID NO: 126246 - RNA, 64 nt, Homo Sapiens; identical to SEQ ID NO: 68917

SEQ ID NO: 126247 - RNA, 64 nt, Homo Sapiens; identical to SEQ ID NO: 68918

SEQ ID NO: 126248 - RNA, 64 nt, Homo Sapiens; identical to SEQ ID NO: 68919

SEQ ID NO: 126249 - RNA, 64 nt, Homo Sapiens; identical to SEQ ID NO: 68920

SEQ ID NO: 126250 - RNA, 64 nt, Homo Sapiens; identical to SEQ ID NO: 68921

SEQ ID NO: 126251 - RNA, 64 nt, Homo Sapiens; identical to SEQ ID NO: 68922

SEQ ID NO: 126252 - RNA, 64 nt, Homo Sapiens; identical to SEQ ID NO: 68923

SEQ ID NO: 126253 - RNA, 64 nt, Homo Sapiens; identical to SEQ ID NO: 68924

SEQ ID NO: 126254 - RNA, 64 nt, Homo Sapiens; identical to SEQ ID NO: 68925

SEQ ID NO: 126255 - RNA, 64 nt, Homo Sapiens; identical to SEQ ID NO: 68926

SEQ ID NO: 126256 - RNA, 64 nt, Homo Sapiens; identical to SEQ ID NO: 68927

SEQ ID NO: 126257 - RNA, 64 nt, Homo Sapiens; identical to SEQ ID NO: 68928

SEQ ID NO: 126258 - RNA, 64 nt, Homo Sapiens; identical to SEQ ID NO: 68929

SEQ ID NO: 126259 - RNA, 64 nt, Homo Sapiens; identical to SEQ ID NO: 68930

SEQ ID NO: 126260 - RNA, 64 nt, Homo Sapiens; identical to SEQ ID NO: 68931

SEQ ID NO: 126261 - RNA, 64 nt, Homo Sapiens; identical to SEQ ID NO: 68932

SEQ ID NO: 126262 - RNA, 64 nt, Homo Sapiens; identical to SEQ ID NO: 68933

SEQ ID NO: 126263 - RNA, 64 nt, Homo Sapiens; identical to SEQ ID NO: 68934

SEQ ID NO: 126264 - RNA, 64 nt, Homo Sapiens; identical to SEQ ID NO: 68935

SEQ ID NO: 126265 - RNA, 64 nt, Homo Sapiens
aacuaaccuugagaccugaggguuuccacagugggaaccccaauagggcuagggcucucaggua

SEQ ID NO: 126266 - RNA, 64 nt, Homo Sapiens
gugcuucaguguuaagaguggggcaaugaagagugaaccccaaugaagagugaucccaacuuug

SEQ ID NO: 126267 - RNA, 64 nt, Homo Sapiens
uggccugcccacaggacaagaggggaagaagccagaaccccaccuaacaccucccaagaaagau

SEQ ID NO: 126268 - RNA, 64 nt, Homo Sapiens
ccacuggagccgcuccggcaugagggcccucugggaaccccaccuccgcugcagcuggccacac

SEQ ID NO: 126269 - RNA, 64 nt, Homo Sapiens
aggugaaggggcccgggaacaccugcucucaccugaaccccaggugaaggggcccggaacaccu

SEQ ID NO: 126270 - RNA, 64 nt, Homo Sapiens
aggugaaggggcccgggaacaccugcucucaccugaaccccaggugaaggggcccagaacaccu

SEQ ID NO: 126271 - RNA, 64 nt, Homo Sapiens
ccguccugccgugacacccuucauccuacccuuggaaccccaaggccaaguugguucaaacugu

SEQ ID NO: 126272 - RNA, 64 nt, Homo Sapiens
gagugaucugaauuaucuggcacccuccugaauggaaccccagaguaccuccuguguggaaggg

SEQ ID NO: 126273 - RNA, 64 nt, Homo Sapiens
ggcccacauuggaagagcagcaccuccucagccugaaccccagggcuguaacugccaggcucuc

SEQ ID NO: 126274 - RNA, 64 nt, Homo Sapiens
cugguggggauaggccagccgcgcaucagacugugaaccccacgaaggagcccauuguggccua

SEQ ID NO: 126275 - RNA, 64 nt, Homo Sapiens
cuuacagcgaagacuugaguuccuccaagucccagaaccccaagaaugggcaagaaggaucagg

SEQ ID NO: 126276 - RNA, 64 nt, Homo Sapiens
uggcaaccuggagaauccacauaccuuguguauugaaccccaggaaaaggaagaggucgaacca

SEQ ID NO: 126277 - RNA, 64 nt, Homo Sapiens
uggagggauguuccccugagccaggcugagacuagaaccccaucuucccugagccaggcugaga

SEQ ID NO: 126278 - RNA, 64 nt, Homo Sapiens
agaaccccaucuucccugagccaggcugagacuagaaccccaucuuccccaccacgccaccccu

SEQ ID NO: 126279 - RNA, 64 nt, Homo Sapiens
acucgccccucaccuggcgucguggcaaacacaggaaccccauggcguggggagccaugcucac

SEQ ID NO: 126280 - RNA, 64 nt, Homo Sapiens
gugagaacuuuguacucacuccgugguaugugaggaaccccaaggaagggagagaaccuggaag

SEQ ID NO: 126281 - RNA, 64 nt, Homo Sapiens
acuucuuccagacaccagaagaaauggccuucaauuauuugaaaagagacacagagacaccucu

SEQ ID NO: 126282 - RNA, 64 nt, Homo Sapiens
gaacaguucaaaugggaaaguguucuaaaacauauuauuugagauuugucauauucaucuuugg

SEQ ID NO: 126283 - RNA, 64 nt, Homo Sapiens
guuuuuaggauuugggaaaauaaacuguaaauguuuauuugauagguaaauauaguuuuauugu

SEQ ID NO: 126284 - RNA, 64 nt, Homo Sapiens
cagguaaacauuuuucauuuggcaaauggcauaauuauuugaaagugacaggaaucuccucaga

SEQ ID NO: 126285 - RNA, 64 nt, Homo Sapiens
cccugguucuguucugccuccaacauguauaauuuuauuugaaauacauaaucuuuucacuaug

SEQ ID NO: 126286 - RNA, 64 nt, Homo Sapiens
gaggacuguguagacuuuaugucaguuuuugucauuauuugaaaaucuauucugacaacuuuuu

SEQ ID NO: 126287 - RNA, 64 nt, Homo Sapiens
gaacaagaaaugcaucugucuuagaaacuggagauuauuugauguuagguaaaacauguaauug

SEQ ID NO: 126288 - RNA, 64 nt, Homo Sapiens
uuugaaucuaguuuucagugaucagaagcagcaguuauuugaguguaugaauggaaugaugauc

SEQ ID NO: 126289 - RNA, 64 nt, Homo Sapiens
cuaccucuuuuauuuucugaaauaggcauuuucuuuauuugaacuaaugaaaaucuaaugaugu

SEQ ID NO: 126290 - RNA, 64 nt, Homo Sapiens
gauuccguuuauccugccaucaacacaaggcaauuuauuugaaaguauauuacuguuaaauuac

SEQ ID NO: 126291 - RNA, 64 nt, Homo Sapiens
aaguaugauuuuaauguaaaaucugcuauaccaguuauuugagaggauuuuaaaacugaauuuu

SEQ ID NO: 126292 - RNA, 64 nt, Homo Sapiens
uugagucugacaacuguuaguuucccaaauuccauuauuugacagaaagugauauuaagaaugc

SEQ ID NO: 126293 - RNA, 64 nt, Homo Sapiens
gaucuuuuuauuuccccgagcugagaaggguauauuauuugaagguauuacauaaccuggaaga

SEQ ID NO: 126294 - RNA, 64 nt, Homo Sapiens
cauacuccccgucguccuggagugaugauuguacuuauuugacagugauuacaggcaccagugc

SEQ ID NO: 126295 - RNA, 64 nt, Homo Sapiens
uugagauggaguuuugcucuuaaugauauuauuauuauuugagacagaguuuugcucuuauugc

SEQ ID NO: 126296 - RNA, 64 nt, Homo Sapiens
aacaaaggcaguggagcauacaauacaauucuauuuauuugagguuaauugaaguuaauaauuu

SEQ ID NO: 126297 - RNA, 64 nt, Homo Sapiens
auaugucaggaaauaaggucacuuuaugucaaaauuauuugaguacuaugggaccuggcgcagu

SEQ ID NO: 126298 - RNA, 64 nt, Homo Sapiens
acaacaacaacaacaacaacaacaaaccacaaaauuauuugaguacugugaaggauuauuuguc

SEQ ID NO: 126299 - RNA, 64 nt, Homo Sapiens
ccuaggauuuaguaaacucuaaaacauuuauuuuuuauuugauuagccuuccccuucagugaag

SEQ ID NO: 126300 - RNA, 64 nt, Homo Sapiens
uuguuuucauaucuaucuaauuauuuuuugaucuuuauuugagaaaguuauuuuuacagggacu

SEQ ID NO: 126301 - RNA, 64 nt, Homo Sapiens
uacucaaaccuguggcaaauucauccuagcaacguuauuugacgaggggcaugaacauuuauag

SEQ ID NO: 126302 - RNA, 64 nt, Homo Sapiens
cacugaaaaaauuugauuaauguauuuaaauguauuauuugaagcaucauucacuuguugauuu

SEQ ID NO: 126303 - RNA, 64 nt, Homo Sapiens
uaguaaaauuaauagccauaaaguccuagacuucuuauuugaaguuaaaauuucuuauuugaaa

SEQ ID NO: 126304 - RNA, 64 nt, Homo Sapiens
aaguccuagacuucuuauuugaaguuaaaauuucuuauuugaaaaguugaaauuuaugagcuuu

SEQ ID NO: 126305 - RNA, 64 nt, Homo Sapiens
uugggaggggaguuuaauuacucagauuggccuguuauuugauuuccuccuuugggaaaagaau

SEQ ID NO: 126306 - RNA, 64 nt, Homo Sapiens
gucaaugacauuuggauguuuucuucaaagaauuuuauuugacccagauuucuuauaaaguuau

SEQ ID NO: 126307 - RNA, 64 nt, Homo Sapiens
uacuauuaaaacagaauaccauagaguaauugcauuauuugaaaauucucucauuuuacaaugc

SEQ ID NO: 126308 - RNA, 64 nt, Homo Sapiens
uagugucuauuugcauauaacccugaaaacauuauuauuugaaaacuuuucuauaucucaaauu

SEQ ID NO: 126309 - RNA, 64 nt, Homo Sapiens
cuucagccaaacacaauaugggcucaagucacuuuuauuugaaaugucauuuggugccaguauu

SEQ ID NO: 126310 - RNA, 64 nt, Homo Sapiens
caguauuuuuuaacugcauaauagccuaacaugauuauuugaacuuauuuacacauaguuugaa

SEQ ID NO: 126311 - RNA, 64 nt, Homo Sapiens
aguaagugcaacaugaaaaaaaucuaugaaaagauuauuugaccuaauuauucacugauaguac

SEQ ID NO: 126312 - RNA, 64 nt, Homo Sapiens
agguauuucuuuccauuguaaauuaaaagucauuuuauuugacagacuuuacugguucaucgaa

SEQ ID NO: 126313 - RNA, 64 nt, Homo Sapiens
gagcacaugaguuaagauugugacugaucaugauuuauuugaagauggagcacugcugauuuau

SEQ ID NO: 126314 - RNA, 64 nt, Homo Sapiens
gacuuuacccaauucaguugucagacauaaugauuuauuugaaggcuuguuuuauuugaagaaa

SEQ ID NO: 126315 - RNA, 64 nt, Homo Sapiens
uugucagacauaaugauuuauuugaaggcuuguuuuauuugaagaaaagcauauugccaaaaau

SEQ ID NO: 126316 - RNA, 64 nt, Homo Sapiens
uuuacuuuauugcccuaacaauuuuuuauuaaauuuauuugaaaaugcaucacaugaugaaaaa

SEQ ID NO: 126317 - RNA, 64 nt, Homo Sapiens
uguaugguaggggcuuaaaagaaacuauaaaguuuuauuugaaugaacacuaugcacugcugua

SEQ ID NO: 126318 - RNA, 64 nt, Homo Sapiens
uuuuaauuuauuuuuugauuaucacuguacaguguuauuugauacccuuuuuuuuugguuuuaa

SEQ ID NO: 126319 - RNA, 64 nt, Homo Sapiens
acuguguuagaauuucauaauuuauuaaaccauauuauuugauuggcuuguuuuuaaagcuuua

SEQ ID NO: 126320 - RNA, 64 nt, Homo Sapiens
uuaugcaggaugaucacaauuuaguggagaguauuuauuugagccuaaauuguagguagcccuu

SEQ ID NO: 126321 - RNA, 64 nt, Homo Sapiens
agcaggggaaccuuaguuaauaauaaaauacuacuuauuugaguuacugauacagauucauuua

SEQ ID NO: 126322 - RNA, 64 nt, Homo Sapiens
uauuuugauaaaaauuaacuaguaauacuuguauuuauuugaaacacugggcuguuugcacagc

SEQ ID NO: 126323 - RNA, 64 nt, Homo Sapiens
uuuuuuuuaaacugggcaucugguuucuaaaaauuuauuugaaacaaucuagaauuuucuuggu

SEQ ID NO: 126324 - RNA, 64 nt, Homo Sapiens
uuuaagaacuuuaagacgauuaauuguaaauaauuuauuugauuggugcaguucuaaucccuaa

SEQ ID NO: 126325 - RNA, 64 nt, Homo Sapiens
gcaaccacgaauuucacccuggagauauuuuuucuuauuugaguccaccaaaggauaaugccaa

SEQ ID NO: 126326 - RNA, 64 nt, Homo Sapiens
gaauauuaaaauuaucauuaauaauauaaaacacuuauuugagauuaaauuaaauuuuucauga

SEQ ID NO: 126327 - RNA, 64 nt, Homo Sapiens
uauuuaugcuggugaaacguauaaucacauccaauuauuugaacacaugcaaaauaauuuuuua

SEQ ID NO: 126328 - RNA, 64 nt, Homo Sapiens
acaaacuuauggguaauaaaauuacugguaaaaauuauuugaaauaaauugucaaaauuuccag

SEQ ID NO: 126329 - RNA, 64 nt, Homo Sapiens
uuuucacuuuagucaaauuaaucugccaguggacuuauuugaaauaauuuuuugcuuuauuuuc

SEQ ID NO: 126330 - RNA, 64 nt, Homo Sapiens
augcuuaugguauuuguauauagugccaguuauuuuauuugauacauuaauaugcuuauaacac

SEQ ID NO: 126331 - RNA, 64 nt, Homo Sapiens
auuuugcuguguuguuuuccuuuuaauggccuaguuauuugaggugccuuugggaucgacuggg

SEQ ID NO: 126332 - RNA, 64 nt, Homo Sapiens
aaauugccauaaauuuggugccacuuucuuuuauuuauuugacugaguuaauauuauuguauua

SEQ ID NO: 126333 - RNA, 64 nt, Homo Sapiens
gggaaauuaaucaggcuauacauaaguauuguauuuauuugaauaaaaauaaaaagagcaaccc

SEQ ID NO: 126334 - RNA, 64 nt, Homo Sapiens
guuuccuugauaaaacaaauguaaaugaggaauuuuauuugaauuggaauauuguuuuucuaga

SEQ ID NO: 126335 - RNA, 64 nt, Homo Sapiens
ucaguaaauccaguccaaauucucaucacauguauuauuugauacuaaauuuucaauuauuacu

SEQ ID NO: 126336 - RNA, 64 nt, Homo Sapiens
aacauuuguucaaaaacuaaccaagguaaaauauuuauuugaaagcccaacuuugauguuaaau

SEQ ID NO: 126337 - RNA, 64 nt, Homo Sapiens
uguuacuuaaaaaacuacauggcuuuccuugaauuuauuugacgguauuauguaauagacuuga

SEQ ID NO: 126338 - RNA, 64 nt, Homo Sapiens
uuuuuuuuuguuuucuaaaagcuacauaaaggccuuauuugacauuuucacugauaacugaucg

SEQ ID NO: 126339 - RNA, 64 nt, Homo Sapiens
uuugcuacgaugaaggugacauuucucuggucauuuauuugagaguucgaagucaaagucgagg

SEQ ID NO: 126340 - RNA, 64 nt, Homo Sapiens
uuuuacauuucugguuaccacauuauuuuauccguuauuugaaacuuucucuauaaaaauaaca

SEQ ID NO: 126341 - RNA, 64 nt, Homo Sapiens
cuucuaauggauuuuugaguagcaagaaagcaauuuauuugaaaaaguaggaaggaauacagcu

SEQ ID NO: 126342 - RNA, 64 nt, Homo Sapiens
uguuucaauagcauaaugaauauucuuuuaauuuuuauuugagcaaacugucuuuaucuuugau

SEQ ID NO: 126343 - RNA, 64 nt, Homo Sapiens
uuguuggugcuguugguauucugaagaaaguggcuuauuugaggaguaggucacuccccaaccc

SEQ ID NO: 126344 - RNA, 64 nt, Homo Sapiens
aaaagcucuaaaccuagguuugcauuugcuuaguuuauuugaauuauaauaggaaaaaaaaaua

SEQ ID NO: 126345 - RNA, 64 nt, Homo Sapiens
ugcucagcaguugaaagcaacuuuuaagggcauguuauuugaagugaaguaaaucacuugacaa

SEQ ID NO: 126346 - RNA, 64 nt, Homo Sapiens
cuuagauuuaagaaaaagagaaaaucagauguauuuauuugacuucauuccguauuugaaagca

SEQ ID NO: 126347 - RNA, 64 nt, Homo Sapiens
aauccccuuuuuaaaaaguuguuguuguuguuguuuauuugauuuugaguuaggagggauaaua

SEQ ID NO: 126348 - RNA, 64 nt, Homo Sapiens
uuuucguuuugaauauauauuauaguggcuuagguuauuugagguuuguucaucuugaagaaug

SEQ ID NO: 126349 - RNA, 64 nt, Homo Sapiens
gcuuuaauauaaugcaacauugaagaaaacaguuuuauuugaguucaugacugucauucuauua

SEQ ID NO: 126350 - RNA, 64 nt, Homo Sapiens
gucuaacuuuugaauuacauaaggagcucugaauuuauuugacagaaaaaaaucugaacugaga

SEQ ID NO: 126351 - RNA, 64 nt, Homo Sapiens
uugugggcuggggagaaacaauacuuuuccugcauuauuugaaaguauuuucuuccuuacguca

SEQ ID NO: 126352 - RNA, 64 nt, Homo Sapiens
ugacuaauuugugcuaucuuaguaguuggaaagauuauuugaaaauauauauauauaaaccaaa

SEQ ID NO: 126353 - RNA, 64 nt, Homo Sapiens
ggauguauaauuuugggcgaaguuaaauuacaauuuauuugagguuauuccuaaaccuauuuau

SEQ ID NO: 126354 - RNA, 64 nt, Homo Sapiens
agucaccuugaauuauuuucugagucaccuugaguuauuugaucucucagccugcuuucucauc

SEQ ID NO: 126355 - RNA, 64 nt, Homo Sapiens
gcucuacuuuuauuuuuuauguugcuuaacuguuuuauuugaaggaaaccugugugauuuaaaa

SEQ ID NO: 126356 - RNA, 64 nt, Homo Sapiens
uguuuaauggggcugauguguaaagcuguucaaguuauuugauguuuacaccucagggaaaguc

SEQ ID NO: 126357 - RNA, 64 nt, Homo Sapiens
ucaguauuuccaaguaccauuuuuauauaguagcuuauuugaccauaagucacacaucaaaaaa

SEQ ID NO: 126358 - RNA, 64 nt, Homo Sapiens
uuuuuucauucauauuuuuguuguuuccaggaauuuauuugauauuaaugggcguaaaacagca

SEQ ID NO: 126359 - RNA, 64 nt, Homo Sapiens
aaaaucugccaaauagcauccuuuugagcuacuauuauuugaaaguacaaguaucauacacgua

SEQ ID NO: 126360 - RNA, 64 nt, Homo Sapiens
aacauucagugcaggaaacuuguuugauacauuuuuauuugauaggagauacacuacccaguau

SEQ ID NO: 126361 - RNA, 64 nt, Homo Sapiens
uuuuuaagaugaggcaguucauaauauuaaaguauuauuugaacuucuguucucucuuccccaa

SEQ ID NO: 126362 - RNA, 64 nt, Homo Sapiens
ugagcaccucaagcaugcuucucucaguccaacauuauuugaauucagucaacaaguauuuuaa

SEQ ID NO: 126363 - RNA, 64 nt, Homo Sapiens
ugauuuuuucaucuaauguaggauaugacaacucuuauuugaauuuuuuuuguuaaucauagca

SEQ ID NO: 126364 - RNA, 64 nt, Homo Sapiens
ugguuauggaaggugacuuuuaaaagacaguaguuuauuugaacuguuccugaaaagauccuau

SEQ ID NO: 126365 - RNA, 64 nt, Homo Sapiens
ugaacuacgcuaggccuaaaugcuuuguuauauuuuauuugaauuucaauuagcuuaaauaagu

SEQ ID NO: 126366 - RNA, 64 nt, Homo Sapiens
uuauaaugguaauuuucauggauuuguuuaggaauuauuugauuuaaggcagauuuauuuuuau

SEQ ID NO: 126367 - RNA, 64 nt, Homo Sapiens
uauuacuuuguuaauaauagggaguuugagugaauuauuugauagaugacacguuucuuaagua

SEQ ID NO: 126368 - RNA, 64 nt, Homo Sapiens
ucaaugaaugcacugcagagaauuucuuauugaauuauuugaauuugguaaugaaguuaaauua

SEQ ID NO: 126369 - RNA, 64 nt, Homo Sapiens
ucaaaauguacuauguguuaaguaauauuggcuauuauuugacuuguugcugguuuggaguuua

SEQ ID NO: 126370 - RNA, 64 nt, Homo Sapiens
uuggcuauuauuugacuuguugcugguuuggaguuuauuugaguauugcugaucuuuucuaaag

SEQ ID NO: 126371 - RNA, 64 nt, Homo Sapiens
uuagggacagaugaguuuuccagauagugucagcuuauuugaagauuaauuuucuuuguuaacu

SEQ ID NO: 126372 - RNA, 64 nt, Homo Sapiens
cucuaccuauugcacuguugugacucguuggccauuauuugauuuuuguacgaaaaaaagcuuu

SEQ ID NO: 126373 - RNA, 64 nt, Homo Sapiens
caacagccggauuaguuacaguucagcguuugccuuauuugaauaugguuugaacaguucgcug

SEQ ID NO: 126374 - RNA, 64 nt, Homo Sapiens
ggguucuuugagaauaaaagagaaaagaccuacuuuauuugacagcaaaacuguucuaauuguu

SEQ ID NO: 126375 - RNA, 64 nt, Homo Sapiens
agaauuagcuugagaguaaugcugcacccugugauuauuugaaaucagaaccuguuagauuaaa

SEQ ID NO: 126376 - RNA, 64 nt, Homo Sapiens
caauuuuaucauaagaguaaaguuugguuuguaauuauuugauguaaaaguaucuggucauuuc

SEQ ID NO: 126377 - RNA, 64 nt, Homo Sapiens
guuuguauacauguuaagagaaugcuuugaaagcuuauuugauagauaauguuuagagcauuuc

SEQ ID NO: 126378 - RNA, 64 nt, Homo Sapiens
aaguaugugucucuaaaggaagaaauacauauuuuuauuugacuauguuuggaguuuaauuaau

SEQ ID NO: 126379 - RNA, 64 nt, Homo Sapiens
guuauaccauaugugcccauaguaauuaauguuauuauuugauuugauacauuuuuguggugca

SEQ ID NO: 126380 - RNA, 64 nt, Homo Sapiens
cauuuuuguggugcaaguaauaaauaauauguuguuauuugauaguacauaagugucuguggcu

SEQ ID NO: 126381 - RNA, 64 nt, Homo Sapiens
agauaauaaaccagucucuuggagggcacaacccuuauuugacaaaacuuggauguuggcuuga

SEQ ID NO: 126382 - RNA, 64 nt, Homo Sapiens
ugaaauugcaaaaguacuuuuagggagcaggaguuuauuugacaucuaguuaucugucugucug

SEQ ID NO: 126383 - RNA, 64 nt, Homo Sapiens
uauuuaaccuaauuauauucuucuucuggauuccuuauuugauuuggcuuaacucaagaacagu

SEQ ID NO: 126384 - RNA, 64 nt, Homo Sapiens
aaucagugguaggagcagugcuucuguacuuugcuuauuugaagacauuuucaagggauaaggc

SEQ ID NO: 126385 - RNA, 64 nt, Homo Sapiens
agggaaguccaguaaagaaaccuauuuuccgaauuuauuugaucaugaacuccuuuuuuuuuca

SEQ ID NO: 126386 - RNA, 64 nt, Homo Sapiens
cccaucuucuuucauuaaccccuccuaaggcauguuauuugaaagcaauugagacgcaaccgaa

SEQ ID NO: 126387 - RNA, 64 nt, Homo Sapiens
aaaagcaccucuuuuggcucaauguuuuccaaacuuauuugaccccaaaaccuuuuucauauac

SEQ ID NO: 126388 - RNA, 64 nt, Homo Sapiens
uaugugcucuuccugcuucacuugcacuaauuaauuauuugaacaacuuagagcuucuucccug

SEQ ID NO: 126389 - RNA, 64 nt, Homo Sapiens
aguauuuuauuucuguauugucuuuuaaaauguauuauuugaagaauuuugugaaacuuaauca

SEQ ID NO: 126390 - RNA, 64 nt, Homo Sapiens
ugauuucaaauauuucaaauguguauaguuucauuuauuugaagauaacauuuuaaaauucuaa

SEQ ID NO: 126391 - RNA, 64 nt, Homo Sapiens
gcuaguuuuuuuguuuuuuuauaaaugaccauauuuauuugacuaaacacauacuuuuuuggau

SEQ ID NO: 126392 - RNA, 64 nt, Homo Sapiens
gagauugcauuuaugcauauacuuuugacgguuuuuauuugaaaagaaauauagcuuauuuuaa

SEQ ID NO: 126393 - RNA, 62 nt, Homo Sapiens
uggaggcggaucaucuaauucucuguggaaugaauacacacauauauauuacaagggauaau

SEQ ID NO: 126394 - RNA, 62 nt, Homo Sapiens
cucugucuucagcacccucauaagucgucacuaauacacaguuuuguacauguaacauuaaa

SEQ ID NO: 126395 - RNA, 62 nt, Homo Sapiens
guguaugaauaaauauuaccugucuaccucaaaauacacauacugcugaagcauucuguaca

SEQ ID NO: 126396 - RNA, 62 nt, Homo Sapiens
gacuuugcaauggugcuaagcugauagauuuaaauacacagacgggcgaguggcgcccgugu

SEQ ID NO: 126397 - RNA, 62 nt, Homo Sapiens
gguugguaagagugacuaaccagccuaacuuuaauacacauguauaaagauguucacagaga

SEQ ID NO: 126398 - RNA, 62 nt, Homo Sapiens
uauauuuuucuuuuaauuuccagugacuuuagaauacacacaguuuuuccgacuuuucaaaa

SEQ ID NO: 126399 - RNA, 62 nt, Homo Sapiens
ccauugcuuaaaauauaacauguuuuggauccaauacacacauuguuacaacuaacacaaau

SEQ ID NO: 126400 - RNA, 62 nt, Homo Sapiens
cccacagucuuuuauauaauuaaauauaugucaauacacauuagaaucagauuugaaaaagu

SEQ ID NO: 126401 - RNA, 62 nt, Homo Sapiens
uuauaggccaauauuuuuuucaucuagugagcaauacacauauacauauuuucaggaucguu

SEQ ID NO: 126402 - RNA, 62 nt, Homo Sapiens
cacacacacaugcacacauaauauauauauauaauacacacauaauguaaaugggggcuuca

SEQ ID NO: 126403 - RNA, 62 nt, Homo Sapiens
aaaguauuuugagguaaaggcuauucuuggaaaauacacaauugauuaaguaaaaaaaaucc

SEQ ID NO: 126404 - RNA, 62 nt, Homo Sapiens
cauuuaugugcguguguguauaugugugugauaauacacauguacacaugccuccaugcaua

SEQ ID NO: 126405 - RNA, 62 nt, Homo Sapiens
cacaacccccuauaccuggaguguguguguguaauacacacaaaaaaauuuauauauacauu

SEQ ID NO: 126406 - RNA, 62 nt, Homo Sapiens
auacaaacauacaugcaugcagaggaggaaaaaauacacauaagagcgagcaagagagggag

SEQ ID NO: 126407 - RNA, 62 nt, Homo Sapiens
gaucucccuuguaagcuccuaaaaaaagcagaaauacacaaucaugaagauaacuuuuuuua

SEQ ID NO: 126408 - RNA, 62 nt, Homo Sapiens
ucuuuacuucucuaccaauuacauuugaguugaauacacaaaggagacuuauaagaaggagu

SEQ ID NO: 126409 - RNA, 62 nt, Homo Sapiens
cuuauucuugaaccuucugauuucucacuguaaauacacauucgcaccugccucacauuuuc

SEQ ID NO: 126410 - RNA, 62 nt, Homo Sapiens
uaccagaugggaaugcagcacccagccucugcaauacacaguagaaacaagagccccuaagu

SEQ ID NO: 126411 - RNA, 62 nt, Homo Sapiens
aaguauuuagggauaaaguaaaguuuuuaggaaauacacacuuuuuaaggaaauacacagug

SEQ ID NO: 126412 - RNA, 62 nt, Homo Sapiens
gaaguuuuuaggaaauacacuuguuuuaaggaaauacacaguauguaagagaauaaaugcca

SEQ ID NO: 126413 - RNA, 62 nt, Homo Sapiens
uauuuuuacauagcuaugaugcuuucucaaugaauacacacacccucuaaauuaguucccua

SEQ ID NO: 126414 - RNA, 62 nt, Homo Sapiens
ucuuauaaagucuuuaacauuuuacacugauaaauacacagaucuuuauugcugguuuuuca

SEQ ID NO: 126415 - RNA, 62 nt, Homo Sapiens
uuuugaccaguguuuuacaacauguacauaagaauacacauaauucaacuagagauuugaag

SEQ ID NO: 126416 - RNA, 62 nt, Homo Sapiens
gaguauuuggagcaagaagcugcaaugcgccaaauacacaauaggccuuuucuuuaucauuc

SEQ ID NO: 126417 - RNA, 62 nt, Homo Sapiens
cuguuuagagagauagaaguuaugacauauguaauacacaucuguguacacagaaaccggca

SEQ ID NO: 126418 - RNA, 62 nt, Homo Sapiens
aaagccaccaauucuagaucuugauuugaauuaauacacacaauaucugagacacuuacacu

SEQ ID NO: 126419 - RNA, 62 nt, Homo Sapiens
ugccagauaucccauacagaauuagcagagaaaauacacacaggcuucuauucaaauuuucu

SEQ ID NO: 126420 - RNA, 62 nt, Homo Sapiens
agacuuuaaaauguaagcauuguaauucugaaaauacacauuuuaagaagaaacuauuuugc

SEQ ID NO: 126421 - RNA, 62 nt, Homo Sapiens
uuuuuuguuguuguuagugagucucccuucaaaauacacaguagguaguguaaauacugcuu

SEQ ID NO: 126422 - RNA, 62 nt, Homo Sapiens
ucaugguauuacugaagguguguauacucccuaauacacauuuaugaaaaucuacuuguuua

SEQ ID NO: 126423 - RNA, 64 nt, Homo Sapiens
cuuugcauacauuuaaguaauuaaccaacuguaaagauaguagugguccuuaugccagcaagau

SEQ ID NO: 126424 - RNA, 64 nt, Homo Sapiens
uauauauuuauauacauguaacuuauaaaaaggcagauaguauagcuaauguagaaaaguuuag

SEQ ID NO: 126425 - RNA, 64 nt, Homo Sapiens
aguuuuggauucuuauuguuuuuaguagaguacuagauaguaucuuugccaauauaguaaugcu

SEQ ID NO: 126426 - RNA, 64 nt, Homo Sapiens
ugcagaauaguuuuugaauaaugucuugcuuuaaagauaguacccaagacuucauaaugauuuu

SEQ ID NO: 126427 - RNA, 64 nt, Homo Sapiens
ccuuuaagguaauuuuuaaaaaaaaucugaguagagauaguacuaauauuggcaagaagguccc

SEQ ID NO: 126428 - RNA, 64 nt, Homo Sapiens
gcugccacagcuccugccaucacauuuacauuuaagauaguagagaggaaguggagggaaguug

SEQ ID NO: 126429 - RNA, 64 nt, Homo Sapiens
uuuuugauauaguacuuuauaguacuuuuuaaagagauaguacucuauuuuucuuuuuugagau

SEQ ID NO: 126430 - RNA, 64 nt, Homo Sapiens
uuuuaaagagauaguacuuuauuuuucuuuuuugagauaguacuuuuuuugauucuuauuuucu

SEQ ID NO: 126431 - RNA, 64 nt, Homo Sapiens
ccagucuacuucuuuaaaaaccauuuaaacugcuagauaguauuagaauaguccaauagaaaau

SEQ ID NO: 126432 - RNA, 64 nt, Homo Sapiens
gcauaacuguauuuuauguguuuauucuuuauauagauaguauuuuauauuuuauucucacccg

SEQ ID NO: 126433 - RNA, 64 nt, Homo Sapiens
cucguguaauuuacuuuaagauuaucugccugcucuucuucaaagcugaccuugcuuuagaaau

SEQ ID NO: 126434 - RNA, 64 nt, Homo Sapiens
aauacauuggacauugguuuccaaaucucccuuucuucuucaguuccuuccuuguucaauauau

SEQ ID NO: 126435 - RNA, 64 nt, Homo Sapiens
cccuuuggcucaccuuguaucagcaaacaaaguacuucuucagggaaaccugaaauuucuaaug

SEQ ID NO: 126436 - RNA, 64 nt, Homo Sapiens
ucauguuugacauuuuugauagugacuuuggggucuucuucacugaaagcaccuuagaacugua

SEQ ID NO: 126437 - RNA, 64 nt, Homo Sapiens
cucugcucacauuguuggccucuggauucuggcccuucuucauuggcuguugcuuuggacugga

SEQ ID NO: 126438 - RNA, 64 nt, Homo Sapiens
gcccuuucacucccaggccaagcccuggagcaaucuucuucaggcagcugucuccaccuccagg

SEQ ID NO: 126439 - RNA, 64 nt, Homo Sapiens
guguuagggauauauugucaaucauaauugucaucuucuucauggugcaaaauacucuauggaa

SEQ ID NO: 126440 - RNA, 64 nt, Homo Sapiens
ugaggcuaagucuucauauacaacagaaagcugccuucuucacugaccuaaggcucaguguggu

SEQ ID NO: 126441 - RNA, 64 nt, Homo Sapiens
acaccacacacagucaugauuuuguuaaaguagccuucuucagaugcuuuucuaagggcuaguu

SEQ ID NO: 126442 - RNA, 64 nt, Homo Sapiens
ggaauauuggcuugauuuaucuagaaaguuuuuccuucuucaauuuuacuauauucauucuaca

SEQ ID NO: 126443 - RNA, 64 nt, Homo Sapiens
ugggaaaagaauuccuaaugugcuacuagaauuccuucuucaguuuuaacgaguaauuggauaa

SEQ ID NO: 126444 - RNA, 64 nt, Homo Sapiens
gaggcucaggacgcgcccucugaaucgaguguuucuucuucacaagucaccaagagaggacaug

SEQ ID NO: 126445 - RNA, 64 nt, Homo Sapiens
gaccuuuaguaaauggggaaauuaacaggacuuucuucuucaucuucaaacucuucagaagcag

SEQ ID NO: 126446 - RNA, 64 nt, Homo Sapiens
aaaguuuuuuuaccuucucuucuaagagaauauucuucuucacuucuuccuuguaauuauacuu

SEQ ID NO: 126447 - RNA, 64 nt, Homo Sapiens
cagcccucuucagcccuccccaguccuccccagccuucuucagccuucuucagcucagcccucu

SEQ ID NO: 126448 - RNA, 64 nt, Homo Sapiens
cagcccuccccaguccuccccagccuucuucagccuucuucagcucagcccucuucuauuucuu

SEQ ID NO: 126449 - RNA, 64 nt, Homo Sapiens
cauuaaagauccacaaagcaaguuagaagaauuccuucuucaaaacuuuuucauauuuuagugu

SEQ ID NO: 126450 - RNA, 64 nt, Homo Sapiens
uucgaaguauuuggcuuuugagaaaaacuguuuacuucuucacuuuucuagccaacuaacucac

SEQ ID NO: 126451 - RNA, 64 nt, Homo Sapiens
cuuauugaugaugcuuuuuggcacaguccguggccuucuucaggcuuucucugagccagcggau

SEQ ID NO: 126452 - RNA, 64 nt, Homo Sapiens
uucaccagaggaaucacucucucuccaucuucagcuucuucauccacaaucgugaccccgcgac

SEQ ID NO: 126453 - RNA, 64 nt, Homo Sapiens
uauaugauaucauuuauuuugcagcuucucuugucuucuucauauuauaguuacuccugguuau

SEQ ID NO: 126454 - RNA, 64 nt, Homo Sapiens
uuaauucuccuuuuaauguacuaguggacgucagcuucuucauucuuacuggugugggcaggca

SEQ ID NO: 126455 - RNA, 64 nt, Homo Sapiens
caccugcagauucugauuuuuguguagacuccugcuucuucaagaagccuccgguuuccacuac

SEQ ID NO: 126456 - RNA, 64 nt, Homo Sapiens
cgcugcagccguuccguccccccaagacagcagucuucuucaccaacacccccaccccaacacc

SEQ ID NO: 126457 - RNA, 64 nt, Homo Sapiens
cucccgaguagcugggauuauucaagcaauucuccuucuucagcugcaaccuccaccuccuggg

SEQ ID NO: 126458 - RNA, 64 nt, Homo Sapiens
cucccgaguagcugagauuauucaagcaauucuccuucuucagcugcaaccuccaccucccggg

SEQ ID NO: 126459 - RNA, 64 nt, Homo Sapiens
auuuuugauaacuguguacuucuggugacuguacaguuugaaauacuauuuuuuaucaaguuuu

SEQ ID NO: 126460 - RNA, 64 nt, Homo Sapiens
gcuuucugauuuuugguaguccauugaagaagggaguuugaaaguuguuguauacuguuaacga

SEQ ID NO: 126461 - RNA, 64 nt, Homo Sapiens
auggguuaccuuaaaaaguugauuuccuugaagcaguuugaaaauuugaauugagucuuaacuu

SEQ ID NO: 126462 - RNA, 64 nt, Homo Sapiens
ggcaggcaguaucgauuuuaugaagagaaagugaaguuugaaaacuuuucaaacuuuucuaguu

SEQ ID NO: 126463 - RNA, 64 nt, Homo Sapiens
aacauaaacacguuuuuugguguaaauguggagaaguuugaaucguacauuuguauaccuguaa

SEQ ID NO: 126464 - RNA, 64 nt, Homo Sapiens
guaguuaaaugaccccaaacaaaaaaaccugagaaguuugaauuaguaaaaaacaaacaaaaac

SEQ ID NO: 126465 - RNA, 64 nt, Homo Sapiens
cugacaccacauuuuccuucugugugugugugccaguuugaacucacuuugccuuagauaacug

SEQ ID NO: 126466 - RNA, 60 nt, Homo Sapiens
acaaugaaaaaugguuuugugauucuucucaguuugaaagaggagaagcgugcugaauag

SEQ ID NO: 126467 - RNA, 64 nt, Homo Sapiens
auaccaaauucuaugcccuuauuaggaccuggucaguuugaaauucugcuaguucaaaauguga

SEQ ID NO: 126468 - RNA, 64 nt, Homo Sapiens
ccugaguuccaguccuguggcacacuugucugugaguuugaagcagcuuuauacagaggagggg

SEQ ID NO: 126469 - RNA, 64 nt, Homo Sapiens
ucggauucucacuaacuuuuguuacuauucuaaaaguuugaauuugcugggguguuuauucuga

SEQ ID NO: 126470 - RNA, 64 nt, Homo Sapiens
ggaggccgaggcagguggaucacuugaggccaggaguuugaaaccagccuggccaacaugguga

SEQ ID NO: 126471 - RNA, 64 nt, Homo Sapiens
ccacuguguauagaaguagauuaagagccauauaaguuugaaggaaacaguuaauaccauuuuu

SEQ ID NO: 126472 - RNA, 64 nt, Homo Sapiens
cauuuuuuaaggaaacaauauaaccacaaagcacaguuugaacaaaaucuccucuuuuagcuga

SEQ ID NO: 126473 - RNA, 64 nt, Homo Sapiens
acugaagauauuggcacaaauguuuuauacaaagaguuugaacaaaaaaucccuguaagaccag

SEQ ID NO: 126474 - RNA, 64 nt, Homo Sapiens
cuugagaccacuuuaguguacuuacauuuagaugaguuugaaaucucaauggugucuaauuauu

SEQ ID NO: 126475 - RNA, 64 nt, Homo Sapiens
gaaguucuaguguuuucaauuuuaaacauauccaaguuugaauuccuaaaauuauggaaacaga

SEQ ID NO: 126476 - RNA, 64 nt, Homo Sapiens
auguuucacacaaacaaggccugucagcuaaagaaguuugaacauuuggguuacuauuucuugu

SEQ ID NO: 126477 - RNA, 64 nt, Homo Sapiens
uugccucuuccaggcauacugcauucuguggaucaguuugaacagcuucuccaccuuauuugga

SEQ ID NO: 126478 - RNA, 64 nt, Homo Sapiens
aguuuagggcauguuuucuguuuuaaagaccagaaguuugaaggcacccaaauccuugucgcca

SEQ ID NO: 126479 - RNA, 64 nt, Homo Sapiens
uuuucccaucaaacauuaucuuguuaucucuacaaguuugaaaggaagaguuguguauaguuag

SEQ ID NO: 126480 - RNA, 64 nt, Homo Sapiens
uauaaucaguaguguuuacauccacuaagaauacaguuugaaugggguccuaguaagugccacu

SEQ ID NO: 126481 - RNA, 64 nt, Homo Sapiens
acauacacuuuuugaguaggcaauauguucacauaguuugaaauuaaagguacaaaauggcgua

SEQ ID NO: 126482 - RNA, 64 nt, Homo Sapiens
aucaauacaacaacauuaaaagccagacuagcggaguuugaaucuuggcccugcuguuaguaac

SEQ ID NO: 126483 - RNA, 64 nt, Homo Sapiens
cauaaacaguuacuuggggaucuuugaauugaggaguuugaagguccucaucuuuccaaguugu

SEQ ID NO: 126484 - RNA, 64 nt, Homo Sapiens
caugaaaauccuguuucugaccagugcugcuuacaguuugaauacuaacacauuuucuaagucg

SEQ ID NO: 126485 - RNA, 64 nt, Homo Sapiens
caaaggcucuauggaagaaaaaaaggaaaaaaacaguuugaacaaaaaaaaaggaaaaaaagaa

SEQ ID NO: 126486 - RNA, 64 nt, Homo Sapiens
cuuaaaaaaagaaaaaaugaccaguguguaacccaguuugaaauggcccuuaacccagccuuuu

SEQ ID NO: 126487 - RNA, 64 nt, Homo Sapiens
acauucugguguaguuuaaaaugccuuugggggcaguuugaagcaguucuucaugccacuuagu

SEQ ID NO: 126488 - RNA, 64 nt, Homo Sapiens
ugggggcaguuugaagcaguucuucaugccacuuaguuugaaaauaaaauucuagauaugcaaa

SEQ ID NO: 126489 - RNA, 64 nt, Homo Sapiens
gauuagaauguuccuuaaauaaauaauaauauaaaguuugaacuuagagaauuuauuucauaua

SEQ ID NO: 126490 - RNA, 64 nt, Homo Sapiens
gaaauggucuagagggaaaucuaaacaaaguauaaguuugaaauuuuuuggucaacuggcuaga

SEQ ID NO: 126491 - RNA, 64 nt, Homo Sapiens
uuucaaauaagcauaauuugcucaauuaaguaugaguuugaauuuaguuugaaaucuggaauug

SEQ ID NO: 126492 - RNA, 64 nt, Homo Sapiens
cauaauuugcucaauuaaguaugaguuugaauuuaguuugaaaucuggaauuggccagacugug

SEQ ID NO: 126493 - RNA, 64 nt, Homo Sapiens
acugaauguaauacuugaguagauuuuuuuuucuaguuugaaauuuagucugucuuuuugaccu

SEQ ID NO: 126494 - RNA, 64 nt, Homo Sapiens
uguuuuaugacaugguauacuacuauauuuacucaguuugaaacuauucauuucuacacacuau

SEQ ID NO: 126495 - RNA, 64 nt, Homo Sapiens
cuuuuguuuggcugcuguaauuuuuaaguauuugaguuugaacagauuagcucuggggggaggg

SEQ ID NO: 126496 - RNA, 64 nt, Homo Sapiens
acaggggugggaauaaaauggauuuaggacacccaguuugaauugcaguuuuuuuuuuucugac

SEQ ID NO: 126497 - RNA, 64 nt, Homo Sapiens
guugauuuccuaaguguggcugaugguagccucuaguuugaagugagggaagaaugaguaguca

SEQ ID NO: 126498 - RNA, 64 nt, Homo Sapiens
uguuuacauuuuauaacuuccuguccuucaaaagaguuugaaaugucauuuugggaaaagagag

SEQ ID NO: 126499 - RNA, 64 nt, Homo Sapiens
aaaaaaaaaaguguggcaauauaaagcuggauacaguuugaaagguuuauggaaaguaucuuua

SEQ ID NO: 126500 - RNA, 64 nt, Homo Sapiens
uuguauacuguuaaugacugccauugaagaagagaguuugaaagagcggcugauuuuugguagu

SEQ ID NO: 126501 - RNA, 64 nt, Homo Sapiens
auucuuuaucaaguuuuauaucuggugacuguacaguuugaaaugcauuuuuuauaacuguacu

SEQ ID NO: 126502 - RNA, 56 nt, Homo Sapiens
uaacuguguacuucuggugacuguacaguuugaaauacuauuuuuuaaucaaguuu

SEQ ID NO: 126503 - RNA, 64 nt, Homo Sapiens; identical to SEQ ID NO: 126460

SEQ ID NO: 126504 - RNA, 64 nt, Homo Sapiens
cacauuuuccacuuuguuuuccccaaaacauaucaguuugaauacuugaaucaugcaggccaau

SEQ ID NO: 126505 - RNA, 64 nt, Homo Sapiens
uuucauguuguaaaacuaaagaauuucgcucugcaguuugaaaaacuguggccacagcugugac

SEQ ID NO: 126506 - RNA, 64 nt, Homo Sapiens
gaguauaaauucacuugucaccucagugcuuuacaguuugaaguggucacuuaccugaugguuc

SEQ ID NO: 126507 - RNA, 64 nt, Homo Sapiens
uaugaggaggaucagccacacaauccagugcuucaguuugaaaauguaaaauucuaacccuaaa

SEQ ID NO: 126508 - RNA, 64 nt, Homo Sapiens
ugggagugggagcaaaauugugaucuuuccuaggaguuugaaugccccauauuuguguccucgc

SEQ ID NO: 126509 - RNA, 64 nt, Homo Sapiens
ggggcugcgagguaguagacaggaugcccaguuaaguuugaauuucagauagaaaauaauuuua

SEQ ID NO: 126510 - RNA, 64 nt, Homo Sapiens
cagagcgggcuucuucauggcugcguuguugcugaguuugaacugcuccucccuggccugcgug

SEQ ID NO: 126511 - RNA, 64 nt, Homo Sapiens
gugccuuucuguuuaccagcuacuucaaucccaaaguuugaaucugcagauaccuuacucccag

SEQ ID NO: 126512 - RNA, 64 nt, Homo Sapiens
uucuuaucacuguguacacagagaauacguguccaguuugaauuuuuaccuauaaaguucagau

SEQ ID NO: 126513 - RNA, 64 nt, Homo Sapiens
uguugagacagcacagcagcacuucuggggaaacaguuugaaaagcacaauacaaauguucuuu

SEQ ID NO: 126514 - RNA, 64 nt, Homo Sapiens
uguguugagaaaauuaaaaauucauuguuccagcaguuugaaaauaaauuguugucgaugauag

SEQ ID NO: 126515 - RNA, 64 nt, Homo Sapiens
ucagcuuuuuaagcuuccccaugugauugaggacaguuugaaguuaguguuucagccauagcuc

SEQ ID NO: 126516 - RNA, 64 nt, Homo Sapiens
ugacacuuugaggcaucguguucaauucagagcgaguuugaagaagcuggcugaagauuauacu

SEQ ID NO: 126517 - RNA, 64 nt, Homo Sapiens
uuauacuuuuuuugagacagcaaugaagagcuugaguuugaagaucagauuucagccccauccc

SEQ ID NO: 126518 - RNA, 64 nt, Homo Sapiens; identical to SEQ ID NO: 74296

SEQ ID NO: 126519 - RNA, 64 nt, Homo Sapiens; identical to SEQ ID NO: 74297

SEQ ID NO: 126520 - RNA, 64 nt, Homo Sapiens; identical to SEQ ID NO: 74298

SEQ ID NO: 126521 - RNA, 64 nt, Homo Sapiens; identical to SEQ ID NO: 74299

SEQ ID NO: 126522 - RNA, 64 nt, Homo Sapiens; identical to SEQ ID NO: 74300

SEQ ID NO: 126523 - RNA, 64 nt, Homo Sapiens; identical to SEQ ID NO: 74301

SEQ ID NO: 126524 - RNA, 64 nt, Homo Sapiens; identical to SEQ ID NO: 74302

SEQ ID NO: 126525 - RNA, 64 nt, Homo Sapiens; identical to SEQ ID NO: 74303

SEQ ID NO: 126526 - RNA, 64 nt, Homo Sapiens; identical to SEQ ID NO: 74304

SEQ ID NO: 126527 - RNA, 64 nt, Homo Sapiens; identical to SEQ ID NO: 74305

SEQ ID NO: 126528 - RNA, 64 nt, Homo Sapiens; identical to SEQ ID NO: 74306

SEQ ID NO: 126529 - RNA, 64 nt, Homo Sapiens; identical to SEQ ID NO: 74307

SEQ ID NO: 126530 - RNA, 64 nt, Homo Sapiens; identical to SEQ ID NO: 74308

SEQ ID NO: 126531 - RNA, 64 nt, Homo Sapiens; identical to SEQ ID NO: 74309

SEQ ID NO: 126532 - RNA, 64 nt, Homo Sapiens; identical to SEQ ID NO: 74310

SEQ ID NO: 126533 - RNA, 64 nt, Homo Sapiens; identical to SEQ ID NO: 74311

SEQ ID NO: 126534 - RNA, 64 nt, Homo Sapiens; identical to SEQ ID NO: 74312

SEQ ID NO: 126535 - RNA, 64 nt, Homo Sapiens; identical to SEQ ID NO: 74313

SEQ ID NO: 126536 - RNA, 64 nt, Homo Sapiens; identical to SEQ ID NO: 81134

SEQ ID NO: 126537 - RNA, 64 nt, Homo Sapiens; identical to SEQ ID NO: 81135

SEQ ID NO: 126538 - RNA, 64 nt, Homo Sapiens; identical to SEQ ID NO: 81136

SEQ ID NO: 126539 - RNA, 64 nt, Homo Sapiens; identical to SEQ ID NO: 81137

SEQ ID NO: 126540 - RNA, 64 nt, Homo Sapiens; identical to SEQ ID NO: 81138

SEQ ID NO: 126541 - RNA, 64 nt, Homo Sapiens; identical to SEQ ID NO: 81139

SEQ ID NO: 126542 - RNA, 64 nt, Homo Sapiens; identical to SEQ ID NO: 81140

SEQ ID NO: 126543 - RNA, 64 nt, Homo Sapiens; identical to SEQ ID NO: 81141

SEQ ID NO: 126544 - RNA, 64 nt, Homo Sapiens; identical to SEQ ID NO: 81142

SEQ ID NO: 126545 - RNA, 64 nt, Homo Sapiens; identical to SEQ ID NO: 81143

SEQ ID NO: 126546 - RNA, 64 nt, Homo Sapiens; identical to SEQ ID NO: 81144

SEQ ID NO: 126547 - RNA, 64 nt, Homo Sapiens; identical to SEQ ID NO: 81145

SEQ ID NO: 126548 - RNA, 64 nt, Homo Sapiens; identical to SEQ ID NO: 81146

SEQ ID NO: 126549 - RNA, 64 nt, Homo Sapiens; identical to SEQ ID NO: 81147

SEQ ID NO: 126550 - RNA, 64 nt, Homo Sapiens; identical to SEQ ID NO: 81148

SEQ ID NO: 126551 - RNA, 64 nt, Homo Sapiens; identical to SEQ ID NO: 81149

SEQ ID NO: 126552 - RNA, 64 nt, Homo Sapiens; identical to SEQ ID NO: 81150

SEQ ID NO: 126553 - RNA, 64 nt, Homo Sapiens; identical to SEQ ID NO: 81151

SEQ ID NO: 126554 - RNA, 64 nt, Homo Sapiens; identical to SEQ ID NO: 81152

SEQ ID NO: 126555 - RNA, 64 nt, Homo Sapiens; identical to SEQ ID NO: 81153

SEQ ID NO: 126556 - RNA, 64 nt, Homo Sapiens; identical to SEQ ID NO: 81154

SEQ ID NO: 126557 - RNA, 64 nt, Homo Sapiens; identical to SEQ ID NO: 81155

SEQ ID NO: 126558 - RNA, 64 nt, Homo Sapiens; identical to SEQ ID NO: 81156

SEQ ID NO: 126559 - RNA, 64 nt, Homo Sapiens; identical to SEQ ID NO: 81157

SEQ ID NO: 126560 - RNA, 64 nt, Homo Sapiens; identical to SEQ ID NO: 81158

SEQ ID NO: 126561 - RNA, 64 nt, Homo Sapiens; identical to SEQ ID NO: 81159

SEQ ID NO: 126562 - RNA, 64 nt, Homo Sapiens; identical to SEQ ID NO: 81160

SEQ ID NO: 126563 - RNA, 64 nt, Homo Sapiens; identical to SEQ ID NO: 81161

SEQ ID NO: 126564 - RNA, 64 nt, Homo Sapiens; identical to SEQ ID NO: 81162

SEQ ID NO: 126565 - RNA, 64 nt, Homo Sapiens; identical to SEQ ID NO: 81163

SEQ ID NO: 126566 - RNA, 64 nt, Homo Sapiens; identical to SEQ ID NO: 81164

SEQ ID NO: 126567 - RNA, 64 nt, Homo Sapiens; identical to SEQ ID NO: 81165

SEQ ID NO: 126568 - RNA, 64 nt, Homo Sapiens; identical to SEQ ID NO: 81166

SEQ ID NO: 126569 - RNA, 64 nt, Homo Sapiens; identical to SEQ ID NO: 81167

SEQ ID NO: 126570 - RNA, 64 nt, Homo Sapiens; identical to SEQ ID NO: 81168

SEQ ID NO: 126571 - RNA, 64 nt, Homo Sapiens; identical to SEQ ID NO: 81169

SEQ ID NO: 126572 - RNA, 64 nt, Homo Sapiens; identical to SEQ ID NO: 81170

SEQ ID NO: 126573 - RNA, 64 nt, Homo Sapiens; identical to SEQ ID NO: 81171

SEQ ID NO: 126574 - RNA, 64 nt, Homo Sapiens; identical to SEQ ID NO: 81172

SEQ ID NO: 126575 - RNA, 64 nt, Homo Sapiens; identical to SEQ ID NO: 81173

SEQ ID NO: 126576 - RNA, 64 nt, Homo Sapiens
ggggguucccgaggcccagggccaaggcacucccaccgccuaccuuagcacagggucucugcag

SEQ ID NO: 126577 - RNA, 63 nt, Homo Sapiens
aucugcauuugccuuacucagccuggucggcucaccgccuaucccucgucauuccugguguga

SEQ ID NO: 126578 - RNA, 64 nt, Homo Sapiens
cuuagucauguugcuacuaaaaguagggcauaugaccgccuaagaaacagaacuucgagaaguc

SEQ ID NO: 126579 - RNA, 64 nt, Homo Sapiens
ccaaaccuacaagaacuaauuugcuccuaacuccaccgccuauccacccccugcccacaaaaaa

SEQ ID NO: 126580 - RNA, 64 nt, Homo Sapiens
uccacccugcccacaaaacauugcucuuaacuucaccgccuaacccaaaaccuauaagaacuaa

SEQ ID NO: 126581 - RNA, 64 nt, Homo Sapiens
ucagagacucagcaaaaacaauagcccucuggagaccgccuagaaucgaagaaguacaacccac

SEQ ID NO: 126582 - RNA, 64 nt, Homo Sapiens
ggagagaaaggaggaaaaaauaaggagaccagagaccgccuacucccgcccgccccacuaucuu

SEQ ID NO: 126583 - RNA, 64 nt, Homo Sapiens
ucucuuugacccccagggacccuugccccaggacaccgccuaccccguacagaccccuucacuc

SEQ ID NO: 126584 - RNA, 64 nt, Homo Sapiens
gcagucuccaucugcggcccugucccauggcuuaaccgccuauugguaucuguguauauuuacg

SEQ ID NO: 126585 - RNA, 64 nt, Homo Sapiens
gugaaugcuaggucagaagcagcaggagaacgccaccgccuaguuugagaauuguuaaauguuc

SEQ ID NO: 126586 - RNA, 64 nt, Homo Sapiens
uuacuguuuugaaaucaauggcuucuccaaggaaaccgccuagucugucuucuggacaggcucu

SEQ ID NO: 126587 - RNA, 64 nt, Homo Sapiens
uacucccaaaugaauaaaacaccauuguuuaaauaccgccuauguauuugguguuuaagauagc

SEQ ID NO: 126588 - RNA, 64 nt, Homo Sapiens
aggcuggucucgaacuccugaccucaggugauccaccgccuaggccucccaaaaccauuagggc

SEQ ID NO: 126589 - RNA, 64 nt, Homo Sapiens
cauuacauuuuuaggagaaaguaaguugcuuugcaccgccuacuuaauucuuuuccauauauug

SEQ ID NO: 126590 - RNA, 64 nt, Homo Sapiens
gaacaguucauaggaguggcgacaugcccaugccaccgccuauucugggccgcuguguagccag

SEQ ID NO: 126591 - RNA, 64 nt, Homo Sapiens
acucugaguggggcuaaauaaguuauuuucucugaccgccuacuggaaauauuuuuaaguggaa

SEQ ID NO: 126592 - RNA, 64 nt, Homo Sapiens
caguaggggcaguagcccccacuauggggagcccaccgccuacaacggcagcagggcagaggag

SEQ ID NO: 126593 - RNA, 64 nt, Homo Sapiens
agaguauacuuuuucuuuccagaaauaauuucauaccgccuaugaaauaucagauaaauuaccu

SEQ ID NO: 126594 - RNA, 64 nt, Homo Sapiens
ccugccaccccacugcccuccugaguggcccagcaccgccuagcugcacuuccccaagucggca

SEQ ID NO: 126595 - RNA, 64 nt, Homo Sapiens
uguuaauaaagccguaggcccuugucuaagugcaaccgccuagacuuucuuucagauacauguc

SEQ ID NO: 126596 - RNA, 64 nt, Homo Sapiens
uguucacuggcgcugggacagucagggugaccccaccgccuaccucucuacaucuaaagagccc

SEQ ID NO: 126597 - RNA, 64 nt, Homo Sapiens
gguguccugugggagggcgaucuccacugagggcaccgccuauugcacgccccccagaacgcag

SEQ ID NO: 126598 - RNA, 64 nt, Homo Sapiens
cgacucgguuucuggauaucauucaaccagccccaccgccuaccguccauacccgaggguggau

SEQ ID NO: 126599 - RNA, 64 nt, Homo Sapiens
uuauuuucccagccgcuuucauacgaaaaauguguuagaacacucugggaaagaacgucauaaa

SEQ ID NO: 126600 - RNA, 64 nt, Homo Sapiens
ugaaaaaauuaaaaacucaauuauucuaguuucauuagaacacgaaguguguuaaagcuuucag

SEQ ID NO: 126601 - RNA, 64 nt, Homo Sapiens
cugcucugggcucucucagaaacuucaggagauguuagaacaagucuuuccaguuagagaagag

SEQ ID NO: 126602 - RNA, 64 nt, Homo Sapiens
aauacaucaagccagcuucauucacucacuuuacuuagaacagagauauaagggccugggaugc

SEQ ID NO: 126603 - RNA, 64 nt, Homo Sapiens
agccucuccccaacccugccgcauugucuaauuuuuagaacacuaggcuucuucuuucauguag

SEQ ID NO: 126604 - RNA, 64 nt, Homo Sapiens
guuuuuggguuccuggaacagcgcucaccuuuguuuagaacacugguuuaaagggauaaucauc

SEQ ID NO: 126605 - RNA, 64 nt, Homo Sapiens
guauguugguuacccuccuagcuuuccauuugguuuagaacauaaagcaaauagacacagucau

SEQ ID NO: 126606 - RNA, 64 nt, Homo Sapiens
guguucuaaguauuugaaacuccaacuguguucauuagaacagcaaguuuuguuuuuguuuuuu

SEQ ID NO: 126607 - RNA, 64 nt, Homo Sapiens
gcauuagagcccauuucaaugcucuuacacuacauuagaacacuggagucacaguugacaaaaa

SEQ ID NO: 126608 - RNA, 64 nt, Homo Sapiens
guaccaauccuaggaacuguauacuaguuccuacuuagaacaaaaguaucaaguuugcacacaa

SEQ ID NO: 126609 - RNA, 64 nt, Homo Sapiens
cuaaguacuuuacuuguauuaucccauuuaauacuuagaacaaccccgugagauaaguaguuau

SEQ ID NO: 126610 - RNA, 64 nt, Homo Sapiens
aaugucauaaagggcacuaauuuaaaaacucagguuagaacaaacuucuuuccagcacauuuuu

SEQ ID NO: 126611 - RNA, 64 nt, Homo Sapiens
uguuacagugugugguuuugagcauuucuguaguuuagaacagaguauuugaaauaggauauuu

SEQ ID NO: 126612 - RNA, 64 nt, Homo Sapiens
uuuucauuuuuuccauuauugauauucuacuuauuuagaacaucauguuuuccuaaaugucccu

SEQ ID NO: 126613 - RNA, 64 nt, Homo Sapiens
guaaauguauuugcugaaaguauggcuacuguuauuagaacaauuaggacuuuaacacuuuauc

SEQ ID NO: 126614 - RNA, 64 nt, Homo Sapiens
uuacuaugcauuaagaccucugauucaaaacuuauuagaacaguagcuucugcuggaauuugca

SEQ ID NO: 126615 - RNA, 64 nt, Homo Sapiens
uaaaguacuuauucauauaccuuguaacuaaaaauuagaacagcucccuagaauugugaacuuu

SEQ ID NO: 126616 - RNA, 64 nt, Homo Sapiens
uguucuaugaggaauuuaguaccucuucacugugaaauucgaaauaaugauuuuuauaaaagca

SEQ ID NO: 126617 - RNA, 64 nt, Homo Sapiens
aaucuuccaccaugcgggaaagaugccagcacaaaaauucgagaccuaaggacaggggauauca

SEQ ID NO: 126618 - RNA, 64 nt, Homo Sapiens
uucuucagagcuuucuggcucucuuucccccacaaaauucgacauauuuaaaaaucuccgugug

SEQ ID NO: 126619 - RNA, 64 nt, Homo Sapiens
ugaacauauacuuguaauucuggggggaggaggcaaauucgauugcccauuuuuguggcugggc

SEQ ID NO: 126620 - RNA, 64 nt, Homo Sapiens
acugaaaaauaaggcuaguggcaacuuagaguaaaaauucgaaacuuaaagauaaucacuguga

SEQ ID NO: 126621 - RNA, 64 nt, Homo Sapiens
acuauuccaggacuaauucuaucuacagaguuagaaauucgaaacauuuacaauuguguuuuag

SEQ ID NO: 126622 - RNA, 64 nt, Homo Sapiens
ccagucauuucccauaaaauuugucucugcaagaaaauucgauuugucuuacaagcacuuuguc

SEQ ID NO: 126623 - RNA, 64 nt, Homo Sapiens
cuaacaauuauguauauucaaacuugauuauuuuaaauucgaucuucagcuguacuguaaauag

SEQ ID NO: 126624 - RNA, 64 nt, Homo Sapiens
auuuaaacaaaaagauacuaaauauacagaaguuaaauucgaacuagccacagaaucauuuguu

SEQ ID NO: 126625 - RNA, 64 nt, Homo Sapiens
gguauccaagguucuguauuuuuaagguauuuuaaaauucgaagaaauaagauuaauggaagac

SEQ ID NO: 126626 - RNA, 64 nt, Homo Sapiens
aauacauuuucuucauaaccuuggaaaacucaucaaauucgaugcauaucuucauuaagaguuu

SEQ ID NO: 126627 - RNA, 64 nt, Homo Sapiens
ucagauugaacuuguuaaggaacuguuugaaugcaaauucgauuagaccuacuugguggcauua

SEQ ID NO: 126628 - RNA, 64 nt, Homo Sapiens
uaaagugagacuaugguucaucuguucaguccuaaaauucgaaaagaaauaucugaaccuucuu

SEQ ID NO: 126629 - RNA, 64 nt, Homo Sapiens
ugauuuacaguuucaaaaacaggaaaugugcacaaaauucgaccuucugagggcaucuuggucc

SEQ ID NO: 126630 - RNA, 64 nt, Homo Sapiens
auccaggcgugggcccgugucugucccugguuguaaauucgagggucugcauaucugauguuca

SEQ ID NO: 126631 - RNA, 64 nt, Homo Sapiens
aauuaaaaucgaacaaaacaauugaugaaaaacuaaauucgagggaaaaaaaugaaacuucaaa

SEQ ID NO: 126632 - RNA, 64 nt, Homo Sapiens
uacauaaguauauggaaaauuuagauacauaauaaaauucgagcuuaaaacugacagaggacau

SEQ ID NO: 126633 - RNA, 64 nt, Homo Sapiens
agaaguggagauauauuauucacugaggguuucaaaauucgacuucaagugaaguuauaauuua

SEQ ID NO: 126634 - RNA, 64 nt, Homo Sapiens
auggagaaggacgcugccggucuaagcgucaugcaaauucgagaguuuugcugccuccuaccuu

SEQ ID NO: 126635 - RNA, 64 nt, Homo Sapiens
aauccuuguucauugaagcauuugugucgguuaaaaauucgaaggcuuaugggucuccagaaac

SEQ ID NO: 126636 - RNA, 64 nt, Homo Sapiens
uguauuccuuguuucuguauagauguaagcacauaaauucgauggaauagaauuacguuaacaa

SEQ ID NO: 126637 - RNA, 64 nt, Homo Sapiens
agaaggacgaggagucugguccaagaugauuaaaaaauucgacaucugggcgcugggaagucgu

SEQ ID NO: 126638 - RNA, 64 nt, Homo Sapiens
acuuguaacucuaugaacuuuagccugcaugguuaaauucgacagauuucuuauuauuauaugu

SEQ ID NO: 126639 - RNA, 64 nt, Homo Sapiens
cacuuugauauuaaaauuuugcuuauguuuugcuaaauucgaauaauguuugaagauuuuuagg

SEQ ID NO: 126640 - RNA, 64 nt, Homo Sapiens
caauuagauuugaacugcuguccuccaauccuggaaauucgacaggcugaaagggagcaacuuu

SEQ ID NO: 126641 - RNA, 64 nt, Homo Sapiens
auaaaguggggcugggacacugacccugaguuuuaaauucgaaaugccugggaaccccaggaau

SEQ ID NO: 126642 - RNA, 64 nt, Homo Sapiens
accugaguacuagucuucuuacauuuacaaguagaaauucgauuaauggcuucuucccuuguaa

SEQ ID NO: 126643 - RNA, 64 nt, Homo Sapiens
acauaaagaaaagaugagcauacauuaguucgagaaauucgaaagguguugaugaugccuucua

SEQ ID NO: 126644 - RNA, 64 nt, Homo Sapiens
cuaaugggggaagcaggguggcaauuuugccaauaaauucgacuacuuuucuuaaugggucuca

SEQ ID NO: 126645 - RNA, 64 nt, Homo Sapiens
ugauuauuaucagcuuaauuauuguauuguauuaaaauucgaagcuaggaaauuugggaacaug

SEQ ID NO: 126646 - RNA, 64 nt, Homo Sapiens
auucuuaggagguuuuuguugugcaaacaaauccaaauucgaacuaauaagaucucaguugcac

SEQ ID NO: 126647 - RNA, 64 nt, Homo Sapiens
aguuagucaccaagagagccagauaauugcuuccaaauucgaagguaagcaaaacuuuccuccc

SEQ ID NO: 126648 - RNA, 64 nt, Homo Sapiens
ggaaagugaaggcagagugagcaggcaaaguagaaaauucgaaaagguccucaacgaguuugua

SEQ ID NO: 126649 - RNA, 64 nt, Homo Sapiens
uaaccaguccauuuuuccuucugccuucugggccaaauucgaaauggcacaucaagaguuaacu

SEQ ID NO: 126650 - RNA, 64 nt, Homo Sapiens
aauuugcccagguaggcgugagaguguggguuuuaaauucgaagcucaggccauaguuucagag

SEQ ID NO: 126651 - RNA, 64 nt, Homo Sapiens
ccugaccuagcaacugauguaagccugguaguuaaaauucgaccggccugggccggccugaccu

SEQ ID NO: 126652 - RNA, 64 nt, Homo Sapiens
cagucaccagugcgauucuggauaaagccacugaaaauucgaaccaggaaauggaaccccacca

SEQ ID NO: 126653 - RNA, 64 nt, Homo Sapiens
uaccuacguuccuguguuuacauacacaaguagcaaauucgaguaugcauaguguagauggaca

SEQ ID NO: 126654 - RNA, 64 nt, Homo Sapiens
ccauuuugcaagacugugccaaaacucagcagagaaauucgagaggauccaagcagggggauga

SEQ ID NO: 126655 - RNA, 64 nt, Homo Sapiens
acuuuggggaacgaaugcaauuugaacuuuuuaaaaauucgaaauccugcgcuucgaauccuug

SEQ ID NO: 126656 - RNA, 64 nt, Homo Sapiens
uuauuuggcucauuucagaaaauugugaaaguucaaauucgagaagauuuaacucaaguggaac

SEQ ID NO: 126657 - RNA, 64 nt, Homo Sapiens
cuccccuccugcuaaagaaccaguuaccccaggaaaauucgacuccuguuuuucuuuaauuaac

SEQ ID NO: 126658 - RNA, 64 nt, Homo Sapiens
ccagcguggucaacauggugucauuugaggucagaaauucgagacaaggugcaaggcaggcaga

SEQ ID NO: 126659 - RNA, 64 nt, Homo Sapiens
aggaaacuuuauuuaaaauuagcaucaacaaugaaaauucgauuuuuguacuccaaguugucaa

SEQ ID NO: 126660 - RNA, 64 nt, Homo Sapiens
uuagaaaguaacuuaauuuuaauaccacuacuaaaaauucgaaaauuucuucuuuaaucacauu

SEQ ID NO: 126661 - RNA, 64 nt, Homo Sapiens
uuuacuucuuaccauuuuuuaaaaguaugcagcuaaauucgaagcuuuuggucuauauuguuaa

SEQ ID NO: 126662 - RNA, 64 nt, Homo Sapiens
aaaaauuuugcuguuuuguaaaacagauugagaaaaauucgaucuuauuuagugaucuguugca

SEQ ID NO: 126663 - RNA, 64 nt, Homo Sapiens
uccuaaccuugcugcuuucacagggugggaaacgaaauucgagggaaauuccccggaaauauga

SEQ ID NO: 126664 - RNA, 64 nt, Homo Sapiens; identical to SEQ ID NO: 45862

SEQ ID NO: 126665 - RNA, 64 nt, Homo Sapiens; identical to SEQ ID NO: 45863

SEQ ID NO: 126666 - RNA, 64 nt, Homo Sapiens; identical to SEQ ID NO: 45864

SEQ ID NO: 126667 - RNA, 64 nt, Homo Sapiens; identical to SEQ ID NO: 45865

SEQ ID NO: 126668 - RNA, 64 nt, Homo Sapiens; identical to SEQ ID NO: 45866

SEQ ID NO: 126669 - RNA, 64 nt, Homo Sapiens; identical to SEQ ID NO: 45867

SEQ ID NO: 126670 - RNA, 64 nt, Homo Sapiens; identical to SEQ ID NO: 45868

SEQ ID NO: 126671 - RNA, 64 nt, Homo Sapiens; identical to SEQ ID NO: 45869

SEQ ID NO: 126672 - RNA, 64 nt, Homo Sapiens; identical to SEQ ID NO: 45870

SEQ ID NO: 126673 - RNA, 64 nt, Homo Sapiens; identical to SEQ ID NO: 45871

SEQ ID NO: 126674 - RNA, 64 nt, Homo Sapiens; identical to SEQ ID NO: 45872

SEQ ID NO: 126675 - RNA, 64 nt, Homo Sapiens; identical to SEQ ID NO: 45873

SEQ ID NO: 126676 - RNA, 64 nt, Homo Sapiens; identical to SEQ ID NO: 45874

SEQ ID NO: 126677 - RNA, 64 nt, Homo Sapiens; identical to SEQ ID NO: 45875

SEQ ID NO: 126678 - RNA, 64 nt, Homo Sapiens
aauuuaauuuuauaaauauacaagaauauuugcaaugacacauguccuucaggaggaucuuagc

SEQ ID NO: 126679 - RNA, 64 nt, Homo Sapiens
uugagcguuacuuccuccuuuacagggaagaacaaugacacagcaacguuuaauaguccggguc

SEQ ID NO: 126680 - RNA, 64 nt, Homo Sapiens
uguugcaccaauuaaguguucuguuuaugacacaaugacacauuaaucugaauuuuaaaacaug

SEQ ID NO: 126681 - RNA, 64 nt, Homo Sapiens
gacacauuuguugcaccaauaaaacaugcuguuuaugacacaauguuuauuaaaucugaauuuu

SEQ ID NO: 126682 - RNA, 64 nt, Homo Sapiens
uaguagccugcuacuccauaguauggcucaauagaugacacaucauuuugacauuaucaauagg

SEQ ID NO: 126683 - RNA, 64 nt, Homo Sapiens
cuagucucuauauaugugguuaguagucauggaaaugacacauaaaguacgccagaaguuugau

SEQ ID NO: 126684 - RNA, 64 nt, Homo Sapiens
uuccucgcugcuuaugcccacaggguuuuucuguaugacacaccucagaggagccugugcuuaa

SEQ ID NO: 126685 - RNA, 64 nt, Homo Sapiens
ggcaggggaaagaaacgcguuaaagggccaugacaugacacaguucccuggccggguuuggacu

SEQ ID NO: 126686 - RNA, 64 nt, Homo Sapiens
uugcuguaaaugaacugugccaaaauaacugugaaugacacaccuacaugacacaugucaagac

SEQ ID NO: 126687 - RNA, 64 nt, Homo Sapiens
ucaagaccaaaauaacugugauaaauguaucuacaugacacaugacaaccuaguaauaaugugg

SEQ ID NO: 126688 - RNA, 64 nt, Homo Sapiens
agcagagaugacucagcacugucccuuagcagggaugacacagcaaggaugacucagcacugcc

SEQ ID NO: 126689 - RNA, 64 nt, Homo Sapiens
ugcagagaugacucagcacugucccuuagcagggaugacacagcaaggaugacucagcacugcc

SEQ ID NO: 126690 - RNA, 64 nt, Homo Sapiens
agcagggaugacucagcacugucccuuagcagugaugacacagcaaggaugacucagcacugcc

SEQ ID NO: 126691 - RNA, 64 nt, Homo Sapiens
agcagggaugacucagcagugucccuuagcagcgaugacacagcaaggaugacucagcacugcc

SEQ ID NO: 126692 - RNA, 64 nt, Homo Sapiens
caguuccuuugaucucgcuguaagauuugucaaggcugacuacucacuucuccuuuaaauucuu

SEQ ID NO: 126693 - RNA, 64 nt, Homo Sapiens
ucaggaaguucacuguuagaaauaggcuuuguuagcugacuagggucagggaaacuuuucucuu

SEQ ID NO: 126694 - RNA, 64 nt, Homo Sapiens
acucugccaaucggcuaccccugacugcacuguugcugacuacuuuaugagaaagaggcaugac

SEQ ID NO: 126695 - RNA, 64 nt, Homo Sapiens
augaugcacauaaccaaaugguggaauggcuacugcugacuaacgcacuacccaugaggaauuc

SEQ ID NO: 126696 - RNA, 64 nt, Homo Sapiens
uuuacucaaauuagggcauuuaauaccaagaaccgcugacuaaauauguauuuaguguuuugua

SEQ ID NO: 126697 - RNA, 64 nt, Homo Sapiens
gacuguguguguugugguaaaacaugaauagucagcugacuaaauauuuucaugcuuuucaaac

SEQ ID NO: 126698 - RNA, 64 nt, Homo Sapiens
ucauccucugucugguagaguuucccuccaaacugcugacuagggagccagcacccucagauga

SEQ ID NO: 126699 - RNA, 64 nt, Homo Sapiens
cugguugcccggacacucaacccaucagaaaggugcugacuaaaugggagagccugggcaggau

SEQ ID NO: 126700 - RNA, 64 nt, Homo Sapiens
acuuggccuuguggaugggccccuuacaguauuugcugacuagucucauuuuuaggugauaaau

SEQ ID NO: 126701 - RNA, 64 nt, Homo Sapiens
uaccuuucacagcuuuuaucaggccaaguuaaaggcugacuacauuuuuucaucaugaggaaag

SEQ ID NO: 126702 - RNA, 64 nt, Homo Sapiens
ucuuuugauguguguacauauagacuaaauaugagcugacuaucauauaaauauauuuuuuucu

SEQ ID NO: 126703 - RNA, 64 nt, Homo Sapiens
cucccaauagggauaaauuuagggugacuguguggcugacuauucugcuuccucaggcaacacu

SEQ ID NO: 126704 - RNA, 64 nt, Homo Sapiens
gaggaaagauuuuuguuguuuuccugaaccugaugcugacuaguugucuacagagaaccuggag

SEQ ID NO: 126705 - RNA, 64 nt, Homo Sapiens
cuuuuuuucuguaccaguuacucucuucucuccagcugacuaaaucucauggguggcacucagu

SEQ ID NO: 126706 - RNA, 64 nt, Homo Sapiens
ggccacagcugagccuggaacaaauugaucugcagcugacuaaauuuuccccugaauuacccau

SEQ ID NO: 126707 - RNA, 64 nt, Homo Sapiens
augccucuccuuaaaugcuugcaugcaucccacugcugacuauacaucaucaauaaaacaguug

SEQ ID NO: 126708 - RNA, 64 nt, Homo Sapiens
ugcuacaaaacuugaauauaacacauuuuggaaggcugacuaaccucgauucuguguugugaug

SEQ ID NO: 126709 - RNA, 64 nt, Homo Sapiens
uuaacuguguuaaaguacuugaaauguauugacugcugacuauauuuuaaaaacaaaaugaaau

SEQ ID NO: 126710 - RNA, 64 nt, Homo Sapiens
aauaguucaguauaaauugucguuuuuuucuugugcugacuaacuauaagcaugaucuuguuaa

SEQ ID NO: 126711 - RNA, 64 nt, Homo Sapiens
guaugaugucuuucaaacuuagacauauuugagagcugacuacaaacauuaaaucgcacuuuua

SEQ ID NO: 126712 - RNA, 64 nt, Homo Sapiens
ugaucuguuuuaaaguuggggggugggaaauuuagcugacuagggacaaacauguaaaccuauu

SEQ ID NO: 126713 - RNA, 56 nt, Homo Sapiens
cgcuguccacggaccugugagcugcugcugacuagggcugcaugggagagccaggg

SEQ ID NO: 126714 - RNA, 64 nt, Homo Sapiens
uaucaccucuucagcuuggagaauugucuacuaggcugacuaugccugcguaugcacaugcuca

SEQ ID NO: 126715 - RNA, 64 nt, Homo Sapiens
aauuaaaguugaggagguuuguuccauugccauagcugacuacaaaguucccuaugaaaaaugu

SEQ ID NO: 126716 - RNA, 64 nt, Homo Sapiens
cacugccaggacccaccacuggaagcaggauggagcugacuacggaacugcacacucagugggc

SEQ ID NO: 126717 - RNA, 64 nt, Homo Sapiens
auuuaaucaugugaaacuuuuccuagaugcaaaugcugacuaauaaagacaaagccacccugaa

SEQ ID NO: 126718 - RNA, 64 nt, Homo Sapiens
gcuaccugauggaauuccugcacuuaaaguucuggcugacuaaacaagauauaucauuuucuuu

SEQ ID NO: 126719 - RNA, 64 nt, Homo Sapiens
ugugguuuaaaauaaaagguaguuguggccaccugcugacuauugauuuuaaugaaacauggau

SEQ ID NO: 126720 - RNA, 64 nt, Homo Sapiens
ucucuggauucuaauuuugguaguagaaaggccagcugacuagaggucuuacaucuguguggua

SEQ ID NO: 126721 - RNA, 64 nt, Homo Sapiens
caugauuuuuuuggucuuaauauaaaagaaaugggcugacuaggaaaagacaagagaauuuggu

SEQ ID NO: 126722 - RNA, 64 nt, Homo Sapiens
agggguucuuagucucagcacuaugacauuuugggcugacuacuuauuuguuaggcgggagcuc

SEQ ID NO: 126723 - RNA, 64 nt, Homo Sapiens
cuccacgcccugcccccugcauccccuagagacagcugacuagcagcugcccagcugucaaggu

SEQ ID NO: 126724 - RNA, 64 nt, Homo Sapiens
aaagaaccguuaagugaacuauuauaauauuuuugcugacuacccaguugaagaaaaguuuguu

SEQ ID NO: 126725 - RNA, 64 nt, Homo Sapiens
gcagacauuuccaaguuuguugaaauaauacgaagcugacuagcuuacgugaaugauguugccc

SEQ ID NO: 126726 - RNA, 64 nt, Homo Sapiens
aauucucuguuaucuuuacgagguaaaacugcaagcugacuagcauguucugugaaucugccau

SEQ ID NO: 126727 - RNA, 64 nt, Homo Sapiens
aagauuccagaugagcuguucaugugggccccuugcugacuauauuccagccacuucaggguug

SEQ ID NO: 126728 - RNA, 64 nt, Homo Sapiens
uccuggaagcauuuuuauacgugaacgugaauaugcugacuauacaucugugaauggaacugaa

SEQ ID NO: 126729 - RNA, 64 nt, Homo Sapiens
ugacccccacaacaaugggucaacauccaguccugcugacuauuggccacucaacagagaggac

SEQ ID NO: 126730 - RNA, 64 nt, Homo Sapiens
aaucccuaagccuagcuggggcuggauuuccuaggcugacuaaggggacugagagacaggacua

SEQ ID NO: 126731 - RNA, 64 nt, Homo Sapiens
gagaauucuggaaaacaaggggcacuacaaaagagcugacuacuucccacccaugagggcugca

SEQ ID NO: 126732 - RNA, 64 nt, Homo Sapiens
ucacagauguguuaauuuuugaagcaaugugggugcugacuacuaguaguaucaaaaauauguu

SEQ ID NO: 126733 - RNA, 64 nt, Homo Sapiens
ccgaaguuuuguaagguacauguuuuuuagcagugcugacuaagcugccauguguuuuuuauuu

SEQ ID NO: 126734 - RNA, 64 nt, Homo Sapiens
acccucuccuguuuacugaauaaguguguuuccugcugacuacagagucuauacaaaggcuugc

SEQ ID NO: 126735 - RNA, 64 nt, Homo Sapiens
uugucagaaucuuccuuuggacaaaacaucacuagcugacuauaaaaacaaaagugucaucauu

SEQ ID NO: 126736 - RNA, 64 nt, Homo Sapiens
agugggaucaaugccggcggccucugugaugguugcugacuaauccgggauuucaugagucaga

SEQ ID NO: 126737 - RNA, 64 nt, Homo Sapiens
ccccuacuguuaauaucacuguguguguuuccaugcugacuagugcaacgugacucuguuuuuu

SEQ ID NO: 126738 - RNA, 64 nt, Homo Sapiens
guccgcaucucaucuccaaauuccacgcucucaggcugacuagaagauggcuacagaccagaga

SEQ ID NO: 126739 - RNA, 64 nt, Homo Sapiens
auucauggaccacuguuucuugcuuguaccucuggcugacuaaauuuggggacagauucagucu

SEQ ID NO: 126740 - RNA, 64 nt, Homo Sapiens
gacaugguucccuacuagggauuauacaguauuugcugacuacuuccuaagagccaaaaauaaa

SEQ ID NO: 126741 - RNA, 64 nt, Homo Sapiens
aggaaggccaagccauuacgggagcacagcaugugcugacuacuguacuuccagaccccugccc

SEQ ID NO: 126742 - RNA, 64 nt, Homo Sapiens
ucaagugcuuaaaauuaauguaauuaaaagcuuagcugacuacagaauaggugaggguuucuua

SEQ ID NO: 126743 - RNA, 64 nt, Homo Sapiens
uuguaugucugugugccccuccugccccgaaagugcugacuauggggaaaucuuuuagcugcug

SEQ ID NO: 126744 - RNA, 64 nt, Homo Sapiens
ggugcuggaccaccuggucggggaggagaccauggcugacuaccugcuguacacccucaacaaa

SEQ ID NO: 126745 - RNA, 64 nt, Homo Sapiens
aguagugauaguggguauucaccuccagcagaaugcugacuauauacaaauugcaguggcuagg

SEQ ID NO: 126746 - RNA, 58 nt, Homo Sapiens
guagaaaaaaaggucaugaugacaaaaugcugacuacugaccugaguuugugcuguaa

SEQ ID NO: 126747 - RNA, 64 nt, Homo Sapiens
ccugccaggcacaggcagggcaggaccagcccacgcugacuacagggccgccggcaauaaaagc

SEQ ID NO: 126748 - RNA, 64 nt, Homo Sapiens
ugauggggcugcccucaguccucuagaucaagaugcugacuauuagggggcagugauugccauc

SEQ ID NO: 126749 - RNA, 64 nt, Homo Sapiens
ucugauccaagcauauuugcuuggggaacuaagugcugacuaguuuguuuucuaugucaagggg

SEQ ID NO: 126750 - RNA, 64 nt, Homo Sapiens
cuugagcucacuacucaauugugcagcuuaauaugcugacuagggacauuccccuauggauuau

SEQ ID NO: 126751 - RNA, 64 nt, Homo Sapiens
gggacauauaaacauuaagucuguaguagcagcagcugacuaacgagggagauagggagauucu

SEQ ID NO: 126752 - RNA, 64 nt, Homo Sapiens
ucauucuuagaaauguguuaugaacccauauacagcugacuaauuuauuuaauauuuucuaauc

SEQ ID NO: 126753 - RNA, 64 nt, Homo Sapiens
gauuggauuuuaccuauggcguuucuugcccucugcugacuacuugaucauuggcauccugggc

SEQ ID NO: 126754 - RNA, 64 nt, Homo Sapiens
ggccaccucauuuccccccugaaauggcuccagcgcugacuagccaaacagaaagcaccgucga

SEQ ID NO: 126755 - RNA, 64 nt, Homo Sapiens
agguaggggacuaguggaucuuaucauaguuuuggcugacuaugcagggcuuaaaaggccagcg

SEQ ID NO: 126756 - RNA, 64 nt, Homo Sapiens
agaccucagccucaaaaggcuaguugggacaucagcugacuaaucuuuaacuguuagucuuaaa

SEQ ID NO: 126757 - RNA, 64 nt, Homo Sapiens
gccacugacaugguuggcugguuuugucuuaaaugcugacuacaugcuaaaucgauaggaguca

SEQ ID NO: 126758 - RNA, 64 nt, Homo Sapiens
aaugguauucuaauaaaauuaucugaauucaacugcugacuauaucggauuaacuggaaaauau

SEQ ID NO: 126759 - RNA, 64 nt, Homo Sapiens
ucccagaagccccucaugccuggaggaggugugggcugacuacccuggcucaggagcucauaga

SEQ ID NO: 126760 - RNA, 63 nt, Homo Sapiens
auuuugugucucuuuuuuuaaaccuaauuaaauagcugacuacgguguucuaaaugucuuaag

SEQ ID NO: 126761 - RNA, 64 nt, Homo Sapiens
uugguguauccagauugcuucaagcacaaggcaugcugacuacaguacucagaggguuaacaga

SEQ ID NO: 126762 - RNA, 64 nt, Homo Sapiens
guggccucacugccccaggcagggagggccgaacgcugacuaguagcccagcugggauuggugu

SEQ ID NO: 126763 - RNA, 64 nt, Homo Sapiens
uuucuugaagugguguaaaaucuauacaaagagggcugacuauaacgcucuugcuuccuaaugc

SEQ ID NO: 126764 - RNA, 64 nt, Homo Sapiens
acagggcuuguuuaaucacacucuuuuuaacccugcugacuauugaguuuauccuuuccguaau

SEQ ID NO: 126765 - RNA, 64 nt, Homo Sapiens
ggccauuuggccggcucugguggccacugagcuggcugacuaagccccgucugaccccagccca

SEQ ID NO: 126766 - RNA, 64 nt, Homo Sapiens
cuuuaauauaauauuauacugcuauauuuaaaaagcugacuacuugauauaauuacuuaaugug

SEQ ID NO: 126767 - RNA, 64 nt, Homo Sapiens
uuuuaggaauucaggaagcaacaguggcugcucugcugacuaucacacaguagauuuuugacaa

SEQ ID NO: 126768 - RNA, 64 nt, Homo Sapiens
cuggcccagucccagguuggagucccucugcauagcugacuacucaugcauugcucaaagcugg

SEQ ID NO: 126769 - RNA, 64 nt, Homo Sapiens
gauggggguggcaagggggagacgggugggggucgcugacuauagacuguagcugggaggaggg

SEQ ID NO: 126770 - RNA, 64 nt, Homo Sapiens
cuugagccacauguauuucuguauuuaaagaauugcugacuaacuuucagguaaccagacccau

SEQ ID NO: 126771 - RNA, 64 nt, Homo Sapiens
cacaugggacgcaaaggagggccuccccgaccuugcugacuaggugggcgaagcuaacaucggu

SEQ ID NO: 126772 - RNA, 64 nt, Homo Sapiens
auaggucccuggcauccugguucauaucuguguugcugacuacagugucugugauguccgcaug

SEQ ID NO: 126773 - RNA, 64 nt, Homo Sapiens
accaggagucacugagccaaugacuuuaccagcugcugacuaaucuucaucaccacuguagauu

SEQ ID NO: 126774 - RNA, 64 nt, Homo Sapiens
gcaccccacccccaccaaccaggggagccacuaagcugacuaacaacuguccccucacccacca

SEQ ID NO: 126775 - RNA, 64 nt, Homo Sapiens
ccccacucuugcccaugggugacucuuacccacagcugacuagggccagcgcaaauacuggaac

SEQ ID NO: 126776 - RNA, 64 nt, Homo Sapiens
auugauggaaguguaggguuuaugaauuauugcagcugacuaccauaccucacacagcguuggu

SEQ ID NO: 126777 - RNA, 64 nt, Homo Sapiens
aggacacauggagugggauugaccauucuucugugcugacuauuacugcaggcccacaguugua

SEQ ID NO: 126778 - RNA, 64 nt, Homo Sapiens
cuacaggcaguggaccuuggcccggcagcaccacgcugacuauagcaaccagcuggacccggcc

SEQ ID NO: 126779 - RNA, 64 nt, Homo Sapiens
agcugggacaaacugcguuuggagcugugguuaagcugacuaaggaggcgguggcucuuucuua

SEQ ID NO: 126780 - RNA, 64 nt, Homo Sapiens
guuaugaugacucuugauaacuuguuaaucuguugcugacuagcauuagacuguuacacgaaga

SEQ ID NO: 126781 - RNA, 64 nt, Homo Sapiens
cucauuuuucagucuuacagaagauugugugaaggcugacuauacauaaagugacuggaauuuu

SEQ ID NO: 126782 - RNA, 64 nt, Homo Sapiens
aguguuucauuuugaacacauuuuggauuauuaagcugacuaagcaaugaucuaauacacauuu

SEQ ID NO: 126783 - RNA, 64 nt, Homo Sapiens
cagcuuccuggacaagaucgacgugaucaagcaggcugacuaugugccgagcgaucaggugugc

SEQ ID NO: 126784 - RNA, 64 nt, Homo Sapiens
agggccaguccugccuggccuggggugggguagggcugacuagaaggaaggagagccugcugca

SEQ ID NO: 126785 - RNA, 64 nt, Homo Sapiens
agacuaacauaaaagauauaauuuugggcagaaugcugacuaguucccaugggaguggcuuucc

SEQ ID NO: 126786 - RNA, 64 nt, Homo Sapiens
caccgcguuucauucuauuggucaauuccauguggcugacuaggucaauuuuuuuucugaacaa

SEQ ID NO: 126787 - RNA, 64 nt, Homo Sapiens
uucaaacuaccugguuaaccaaaauacaaaagcagcugacuaugugugauuucauaauagcaca

SEQ ID NO: 126788 - RNA, 64 nt, Homo Sapiens
ucaauggugcuacuauauaugaucaagauaacaugcugacuaguaaccaugaagauucagaugu

SEQ ID NO: 126789 - RNA, 64 nt, Homo Sapiens
auagcacuuuaccuuuugguuggcuagauaaguggcugacuaccuguuuuucucacuguggugu

SEQ ID NO: 126790 - RNA, 64 nt, Homo Sapiens
ugccauuuucuucccagaaauauguaauccccuggcugacuaggacuguuaaacauagugugga

SEQ ID NO: 126791 - RNA, 64 nt, Homo Sapiens
aaaauaaaucauaguaauaauaagucucauguuugcugacuauagagcuagaaggaaaagcuuu

SEQ ID NO: 126792 - RNA, 64 nt, Homo Sapiens
acccucuuuucuacucguccgggagagguuuccagcugacuagaccacugaggagcagguaaau

SEQ ID NO: 126793 - RNA, 64 nt, Homo Sapiens
uagaaugggguugagagaagcaccauucacuggugcugacuacaccuguuuugaaugccaaacc

SEQ ID NO: 126794 - RNA, 64 nt, Homo Sapiens
gaugaacggaagcaaauacaacuuucucuagagagcugacuaauccgagagccacacagauuug

SEQ ID NO: 126795 - RNA, 56 nt, Homo Sapiens
cccuggauucuucuccagacgaggaagcugacuagccuaaggccgauggucaguga

SEQ ID NO: 126796 - RNA, 64 nt, Homo Sapiens
ggagcuagaaggaaaagcaugaagucucauguuugcugacuauaaaaauaaaucauaguaauaa

SEQ ID NO: 126797 - RNA, 64 nt, Homo Sapiens
uuacacuccuaaaucaagcucgugggcugagugcugaguguaacccugugggcaucagacucag

SEQ ID NO: 126798 - RNA, 64 nt, Homo Sapiens
uuuucuuccaggagacaucaggcaggaaggcaugugaguguacgcacucccgccaucugcugca

SEQ ID NO: 126799 - RNA, 64 nt, Homo Sapiens
aacaauuuagaauggauauuuugacgaaucggcaugaguguaacagugauaaccugaucuguuu

SEQ ID NO: 126800 - RNA, 64 nt, Homo Sapiens
uuuaaagugccacauuuggcaguacaaaugagucugaguguaauagcccagagauuuauauaua

SEQ ID NO: 126801 - RNA, 64 nt, Homo Sapiens
uacaugaaaaaucuuacacuggagagaaacccuaugaguguaagcaaugugggaaagccuuugu

SEQ ID NO: 126802 - RNA, 64 nt, Homo Sapiens
aucaugaaaggacucacacuggagagaaccccuaugaguguaagcaauuugggaaagccuucag

SEQ ID NO: 126803 - RNA, 64 nt, Homo Sapiens
aucaugaaaggacucacaugggagagaaacccuaugaguguaugccaagugggaaagccuucau

SEQ ID NO: 126804 - RNA, 64 nt, Homo Sapiens
aucaugaaaggacucacacuggagagaaacccuaugaguguaagcaaugugggaaagccuucag

SEQ ID NO: 126805 - RNA, 64 nt, Homo Sapiens
aaggcaugguaggacucacuggagagaaacccuaugaguguaaggaaugugggaaagccuucag

SEQ ID NO: 126806 - RNA, 64 nt, Homo Sapiens
accaugaaaggacucacacuggagagaaacccuaugaguguaagcaaugugggaaagccuucag

SEQ ID NO: 126807 - RNA, 64 nt, Homo Sapiens
uccaugguagaacucacacuggagagaaacccuaugaguguaaggaaugugggaaagccuucag

SEQ ID NO: 126808 - RNA, 64 nt, Homo Sapiens
uaccugaaaaaucuuacacuggagagaaacccuaugaguguaagcaaugugggaaagccuuuau

SEQ ID NO: 126809 - RNA, 64 nt, Homo Sapiens
aacaugaaaggacucacacuggagagaaacccuaugaguguaagcaauguggaaaaaccuucag

SEQ ID NO: 126810 - RNA, 64 nt, Homo Sapiens
cagggagaacuuacaggauguuagagacaaaacaagcagacaccugaaacaaucaacgcccaau

SEQ ID NO: 126811 - RNA, 64 nt, Homo Sapiens
uucacucauagaaacauuauuaauugguaggguaagcagacacucugaaacaaugagaaaaaua

SEQ ID NO: 126812 - RNA, 64 nt, Homo Sapiens
cacccuacuuuucagcagcaucaaguucuaccagagcagacaguucugcuucugagcaaauggc

SEQ ID NO: 126813 - RNA, 64 nt, Homo Sapiens
gaugaggucuacacuguccugaaaggcagcggggagcagacaaauugauggaucacguaaaacu

SEQ ID NO: 126814 - RNA, 64 nt, Homo Sapiens
ggcagggagcccuucuccccacagagcuuucaggagcagacaguggccuccccuuccccucccu

SEQ ID NO: 126815 - RNA, 64 nt, Homo Sapiens
aagguggcaggagaggcuuuggggaggaucagccagcagacaugagcacugcuggcccgugugg

SEQ ID NO: 126816 - RNA, 64 nt, Homo Sapiens
gccuccgcaggaacccccaaagugcagauuccggagcagacacauccgggcggagagacucagc

SEQ ID NO: 126817 - RNA, 64 nt, Homo Sapiens
auuccggagcagacacauccgggcggagagacucagcagacaagugcugcaguugcacgguggg

SEQ ID NO: 126818 - RNA, 64 nt, Homo Sapiens
gaagaguccaagggagcagccgcaccugcucuguagcagacacgguucuagcagacacugacug

SEQ ID NO: 126819 - RNA, 64 nt, Homo Sapiens
gacugcgcaccugcucuguacagugacgcguucuagcagacacuccaggcauccuggguuucac

SEQ ID NO: 126820 - RNA, 64 nt, Homo Sapiens
gcgagggccgggagacagauacuuggcugugaugagcagacauccucuguccccguggaggggu

SEQ ID NO: 126821 - RNA, 64 nt, Homo Sapiens
acaccaaagaugaggguagcgagcaacuggcuugagcagacagaacggggaagacuccacucug

SEQ ID NO: 126822 - RNA, 64 nt, Homo Sapiens
cagggaaaagagaggguccuuugcacagacucuuagcagacaagcgccaggucccagggaaguc

SEQ ID NO: 126823 - RNA, 64 nt, Homo Sapiens
uucuccauguguuuucccacagaguucuuucaccagcagacagauguccagcauaaggagcccc

SEQ ID NO: 126824 - RNA, 64 nt, Homo Sapiens
cagcaccguucugugcacaaaacccagaccuguuagcagacaggccccgugaggcaaugggagc

SEQ ID NO: 126825 - RNA, 64 nt, Homo Sapiens
gccucccaaaugagccaugagaugauacauccaaagcagacagcuccacccuggccgaguccaa

SEQ ID NO: 126826 - RNA, 64 nt, Homo Sapiens
gccccgucucaccuucuuuaccucaggagccaggagcagacagcaauacuucguccacaccugg

SEQ ID NO: 126827 - RNA, 64 nt, Homo Sapiens
ccuggcugacccugagcucucgcaguuggagggaagcagacagacuugacuuuuugcaaguccg

SEQ ID NO: 126828 - RNA, 64 nt, Homo Sapiens
aaccuccccuuacccugaaccgugugacucugcaagcagacaccucgaggcagguguucuaggc

SEQ ID NO: 126829 - RNA, 64 nt, Homo Sapiens
ugaaguauaaacuauuuuauaucagguuucuacugcuaggcaauagaagccgaaauuccuagaa

SEQ ID NO: 126830 - RNA, 64 nt, Homo Sapiens
caauuccugcagaaaccggaguuauggaaggcgugcuaggcauuaugucagcaauaugaaggau

SEQ ID NO: 126831 - RNA, 64 nt, Homo Sapiens
agccauacuuuucacaauuauuguagccaguucagcuaggcaaagcuuuaaauuacuuuuugga

SEQ ID NO: 126832 - RNA, 64 nt, Homo Sapiens
ggcugcuccaugagcccuuuguuuuguggcccaugcuaggcagucaugggccaggccaggcacu

SEQ ID NO: 126833 - RNA, 64 nt, Homo Sapiens; identical to SEQ ID NO: 85128

SEQ ID NO: 126834 - RNA, 64 nt, Homo Sapiens; identical to SEQ ID NO: 85129

SEQ ID NO: 126835 - RNA, 64 nt, Homo Sapiens; identical to SEQ ID NO: 85130

SEQ ID NO: 126836 - RNA, 58 nt, Homo Sapiens; identical to SEQ ID NO: 85131

SEQ ID NO: 126837 - RNA, 64 nt, Homo Sapiens; identical to SEQ ID NO: 85132

SEQ ID NO: 126838 - RNA, 64 nt, Homo Sapiens; identical to SEQ ID NO: 85133

SEQ ID NO: 126839 - RNA, 64 nt, Homo Sapiens; identical to SEQ ID NO: 85134

SEQ ID NO: 126840 - RNA, 64 nt, Homo Sapiens; identical to SEQ ID NO: 85135

SEQ ID NO: 126841 - RNA, 64 nt, Homo Sapiens; identical to SEQ ID NO: 85136

SEQ ID NO: 126842 - RNA, 64 nt, Homo Sapiens; identical to SEQ ID NO: 85137

SEQ ID NO: 126843 - RNA, 64 nt, Homo Sapiens; identical to SEQ ID NO: 85138

SEQ ID NO: 126844 - RNA, 64 nt, Homo Sapiens; identical to SEQ ID NO: 85139

SEQ ID NO: 126845 - RNA, 64 nt, Homo Sapiens; identical to SEQ ID NO: 85140

SEQ ID NO: 126846 - RNA, 64 nt, Homo Sapiens; identical to SEQ ID NO: 85141

SEQ ID NO: 126847 - RNA, 64 nt, Homo Sapiens; identical to SEQ ID NO: 85142

SEQ ID NO: 126848 - RNA, 64 nt, Homo Sapiens; identical to SEQ ID NO: 85141

SEQ ID NO: 126849 - RNA, 64 nt, Homo Sapiens; identical to SEQ ID NO: 85144

SEQ ID NO: 126850 - RNA, 64 nt, Homo Sapiens; identical to SEQ ID NO: 85145

SEQ ID NO: 126851 - RNA, 64 nt, Homo Sapiens; identical to SEQ ID NO: 85146

SEQ ID NO: 126852 - RNA, 64 nt, Homo Sapiens; identical to SEQ ID NO: 85147

SEQ ID NO: 126853 - RNA, 64 nt, Homo Sapiens; identical to SEQ ID NO: 85148

SEQ ID NO: 126854 - RNA, 64 nt, Homo Sapiens; identical to SEQ ID NO: 85149

SEQ ID NO: 126855 - RNA, 64 nt, Homo Sapiens; identical to SEQ ID NO: 85150

SEQ ID NO: 126856 - RNA, 64 nt, Homo Sapiens; identical to SEQ ID NO: 85151

SEQ ID NO: 126857 - RNA, 64 nt, Homo Sapiens; identical to SEQ ID NO: 85152

SEQ ID NO: 126858 - RNA, 64 nt, Homo Sapiens; identical to SEQ ID NO: 85153

SEQ ID NO: 126859 - RNA, 64 nt, Homo Sapiens; identical to SEQ ID NO: 85154

SEQ ID NO: 126860 - RNA, 64 nt, Homo Sapiens; identical to SEQ ID NO: 85155

SEQ ID NO: 126861 - RNA, 53 nt, Homo Sapiens
gcagucugcccaaaauuuaaggggacaaguagcuccccccacgacaugucucc

SEQ ID NO: 126862 - RNA, 64 nt, Homo Sapiens
aucucccaggauuccuguugcuuuacccacaacagacaaguaauugucuaaguguuuuucuucg

SEQ ID NO: 126863 - RNA, 64 nt, Homo Sapiens
aggcucagaccccucccugcccuucagagcucaagacaaguaauacacccaggucuugacugca

SEQ ID NO: 126864 - RNA, 64 nt, Homo Sapiens
agaaauaacccagaugcccaugagcaagagaguggacaaguaaacuggaauauucacauaauag

SEQ ID NO: 126865 - RNA, 64 nt, Homo Sapiens
gaaagugucugggcuucuucugggguuccacccugacaaguagggucacagaggcuggugcaca

SEQ ID NO: 126866 - RNA, 64 nt, Homo Sapiens
cauuaccacauguagccuuggagacccaggcaaggacaaguacacguguacucacagagggaga

SEQ ID NO: 126867 - RNA, 64 nt, Homo Sapiens
ccuugaaggucuggcaaucccuguucuuucauuugacaaguacuuacugaguacucacuauaua

SEQ ID NO: 126868 - RNA, 64 nt, Homo Sapiens
cugguuuucguucaagauauucuugguaguaacugacaaguauguugcacauguauugggggag

SEQ ID NO: 126869 - RNA, 64 nt, Homo Sapiens
ccccucaugggggauggggagccuacacaugacagacaaguaaccugccgaugcccuguccacu

SEQ ID NO: 126870 - RNA, 64 nt, Homo Sapiens
aggggaagaggggugcugaaugugaaguaggugggacaaguauacauuuuaucuucauuauccc

SEQ ID NO: 126871 - RNA, 64 nt, Homo Sapiens
aauuaggcugaguuggguggccuuuucagggagugacaaguagucugugagucaaagaaaaggu

SEQ ID NO: 126872 - RNA, 64 nt, Homo Sapiens
gggcccucuuggcuugauuuuaacuuagcaagaggacaaguaaaccauccaccagucuauuuau

SEQ ID NO: 126873 - RNA, 64 nt, Homo Sapiens
uuucuucuuuuguucauaggauuugccacaucuggacaaguaacacauuauacaaaaguuuaua

SEQ ID NO: 126874 - RNA, 64 nt, Homo Sapiens
acugugcuggccugcuguacgccaaaaacagaaggacaaguacacuuccagcuuuuacgaguga

SEQ ID NO: 126875 - RNA, 64 nt, Homo Sapiens
ucauuuacucacauugagcuaacuuuaaauuacugacaaguagaaucaaaggugcagcugacug

SEQ ID NO: 126876 - RNA, 64 nt, Homo Sapiens
uggcauaugccacauaaaaaaugaaccugauauagacaaguacuaccuuuucaaauucugaaag

SEQ ID NO: 126877 - RNA, 64 nt, Homo Sapiens
aaaggcccuccuuugagcuacaaacaucugguaagacaaguacauccacucaugaaugcagaca

SEQ ID NO: 126878 - RNA, 53 nt, Homo Sapiens
auuccacucaacagauguagugugacaaguauaauaugugcaauaaucauugu

SEQ ID NO: 126879 - RNA, 64 nt, Homo Sapiens
gaauacuacauugagaaacucaauuuuagaaaaugacaaguagauggcacaggcauuaucucug

SEQ ID NO: 126880 - RNA, 64 nt, Homo Sapiens
uucaguguaaagugugugauguugaagagacagagacaaguaauacaaaguuucagaguauauu

SEQ ID NO: 126881 - RNA, 64 nt, Homo Sapiens
uauacagcccuauacaguuucugcauuaagcugagacaaguauacuggaaauuaaaccaauuuc

SEQ ID NO: 126882 - RNA, 64 nt, Homo Sapiens
aggcuuucucagccacaaccauguugguguucuugacaaguaccauccucauggcaagguuaau

SEQ ID NO: 126883 - RNA, 64 nt, Homo Sapiens
gguuaucaaguuugcacuuacaauggagaguugugacaaguacaccuauauuuucgccauuuua

SEQ ID NO: 126884 - RNA, 64 nt, Homo Sapiens
acaaacuguauaacgguuuagcacuauuuuggaggacaaguagcggcggguaaauuaggaaucu

SEQ ID NO: 126885 - RNA, 64 nt, Homo Sapiens
gauaucaaugcaguaugaacuaagaguuaaaauggacaaguauuaacaaagaucuguucugcug

SEQ ID NO: 126886 - RNA, 64 nt, Homo Sapiens
ccuugaaacugagccccauuagaagagggacagggacaaguagucugccgaacucaaugcagug

SEQ ID NO: 126887 - RNA, 64 nt, Homo Sapiens
ccguucuaaaaguuuauuuacaauaucaaaaucugacaaguaaaucagcauuguuguuugguuc

SEQ ID NO: 126888 - RNA, 64 nt, Homo Sapiens
aagauuuuuguucaauacauuuuagauuaggauugacaaguaaagauacugcuauggaaugaua

SEQ ID NO: 126889 - RNA, 64 nt, Homo Sapiens
gauaguugacugaguuucuuuagggcauugaauagacaaguaaagcuaaugaauuuaaaagccu

SEQ ID NO: 126890 - RNA, 64 nt, Homo Sapiens
gacauugaaggcuuauuuuccccaauggcuuuuugacaaguauaaagcuauuauuacauuguau

SEQ ID NO: 126891 - RNA, 64 nt, Homo Sapiens
uucucugaagacaaccaagagaaaauugcaaaaagacaaguaugacuuuuauaugaaccccuuc

SEQ ID NO: 126892 - RNA, 64 nt, Homo Sapiens
uguuccuuuuggaaagaagcacaaaagcuagggugacaaguacacuguaccagugcucuaaaua

SEQ ID NO: 126893 - RNA, 64 nt, Homo Sapiens
auugcaggugauuugauaauuauccauugugacagacaaguaaauuaaaaccuucauaucuagg

SEQ ID NO: 126894 - RNA, 64 nt, Homo Sapiens
gcuaccucauucuuuuuaauucauuuuauaucaugacaaguagaaauaauauaagucuuagaga

SEQ ID NO: 126895 - RNA, 64 nt, Homo Sapiens
uguuauuuaaggaggaaaaaaauagcugccucaugacaaguacaaaugugguuauugaaaaccu

SEQ ID NO: 126896 - RNA, 64 nt, Homo Sapiens
aggcaacaaagauuuaagaaucugcuaacauucagacaaguaacuaguuuucaagccuuuuuuu

SEQ ID NO: 126897 - RNA, 64 nt, Homo Sapiens
uguuaauauauucggcccauauuuuguguguuuggacaaguacaucucccuuuugccuaaugaa

SEQ ID NO: 126898 - RNA, 64 nt, Homo Sapiens
agagagaaaaaaauaaaccaauaaccuaccuacugacaaguaaauuuauacaggacugaaaacc

SEQ ID NO: 126899 - RNA, 64 nt, Homo Sapiens
augauuugcuaucaaaauaauaucuucauacaaugacaaguaugucuacuuuuucuagcuacaa

SEQ ID NO: 126900 - RNA, 64 nt, Homo Sapiens
ucuguguuaaacaaguaguaucuuacuugucuaagacaaguaaaagagcauagauucuauaaau

SEQ ID NO: 126901 - RNA, 64 nt, Homo Sapiens
gagaauggcaugguaggcuacuuuucagggccuugacaaguacaucacccagugguauccuaca

SEQ ID NO: 126902 - RNA, 64 nt, Homo Sapiens
gggccacugccaucccuuccugugugcucuuuuugacaaguaaaucacuccaguuagcugaugu

SEQ ID NO: 126903 - RNA, 64 nt, Homo Sapiens
gugauggacuucacaacaacuagccaggaagggugacaaguaccuucugccuccuccauucuuc

SEQ ID NO: 126904 - RNA, 64 nt, Homo Sapiens
cuccgagccucuguuucuccaaguguaagaugaggacaaguauaaaaccuccuuuauggguuug

SEQ ID NO: 126905 - RNA, 64 nt, Homo Sapiens
ucaggccauguauuaacagaugccagugcgcucugacaaguauuccaaaguguucuguagcuag

SEQ ID NO: 126906 - RNA, 64 nt, Homo Sapiens
aaauugacuuuacuagacaucuagacuuucaauugacaaguaaacugugucccagauugugacc

SEQ ID NO: 126907 - RNA, 64 nt, Homo Sapiens
aagauuugaaacaguuggcauccagguacugagggacaaguagaucugcagcagaugcuuuugg

SEQ ID NO: 126908 - RNA, 64 nt, Homo Sapiens
caauguauuuuagcuauuuuacugaugcacucaugacaaguaccuuuguaacagugugaucuuu

SEQ ID NO: 126909 - RNA, 64 nt, Homo Sapiens
ugaaucucuccgugccacagguucugugauccuggacaaguaacccccacccccacuuacuaua

SEQ ID NO: 126910 - RNA, 64 nt, Homo Sapiens
aaauuaagaugacacuuaaaccuaauuaucuuaugacaaguaucgaaccacugauuuuaauuug

SEQ ID NO: 126911 - RNA, 64 nt, Homo Sapiens
uauggcuaaggacaugaaaugauucaagagagaggacaaguaguggaaggcaaaaagaucuuaa

SEQ ID NO: 126912 - RNA, 64 nt, Homo Sapiens
uaugccuaaauaacaguauucuuaaaaucugacagacaaguaacaugucaauuacuugauauuc

SEQ ID NO: 126913 - RNA, 64 nt, Homo Sapiens
guguuuaaauuaaaauagaaaaauaagggcucaugacaaguacauuauuugauucuacuuagga

SEQ ID NO: 126914 - RNA, 64 nt, Homo Sapiens
auuuauacagaaaguggcuauugacuuucuauuugacaaguaguuauaauuggcaagcaguuug

SEQ ID NO: 126915 - RNA, 64 nt, Homo Sapiens
aacucauugucuguuuggaagaccagaaugugaagacaaguaguagaagaaaaugaaugcugcu

SEQ ID NO: 126916 - RNA, 64 nt, Homo Sapiens
guuggguuccaaauuugcauuuuauuuggaaacagacaaguagaagaugcuacagaaaaguauu

SEQ ID NO: 126917 - RNA, 64 nt, Homo Sapiens
aaagacauuuaggcaacuuaucauugaagaaaaugacaaguaucagaaaaccacugcaacagac

SEQ ID NO: 126918 - RNA, 64 nt, Homo Sapiens
aguccuuuuuuuguuuguuuauaaacagcaacaagacaaguaauucauagccuguggucuccac

SEQ ID NO: 126919 - RNA, 64 nt, Homo Sapiens
uaagagcuaagagcaguacuagcuuaggcugauagacaaguaguaggagagagucuaagauaaa

SEQ ID NO: 126920 - RNA, 64 nt, Homo Sapiens
cccaauacaaacuacugaauuuucaaaaaaucaagacaaguaggguuauucaaaauuauacagu

SEQ ID NO: 126921 - RNA, 64 nt, Homo Sapiens
ugccaguugcugguuguacacucgaacgaagacugacaaguauccucaucaugaugugacucac

SEQ ID NO: 126922 - RNA, 64 nt, Homo Sapiens
uguagaguuucuaugugccuacauacauuucugugacaaguauuugucguaaauuaauuuuaau

SEQ ID NO: 126923 - RNA, 64 nt, Homo Sapiens
uucguaacagaagggaggggaaagcgcagcuacugacaaguagaacacugcuacuuuuuuuaag

SEQ ID NO: 126924 - RNA, 64 nt, Homo Sapiens
uguguguauuuuuuuaaaugaaaacucaaaauaagacaaguaauuuguugauaaauauuuuuaa

SEQ ID NO: 126925 - RNA, 64 nt, Homo Sapiens
acuccauuagaaaaauucagaaacucaauacaaagacaaguacaaaaccaaaacggaagaggag

SEQ ID NO: 126926 - RNA, 64 nt, Homo Sapiens
aauuuauaaauauuaagaauaauacuagacuauagacaaguaaaacaagaccacaugguauaac

SEQ ID NO: 126927 - RNA, 64 nt, Homo Sapiens
aauaacaaugaauguuuaauacacaaguauaaaugacaaguacauaccguuuugucuauaagau

SEQ ID NO: 126928 - RNA, 64 nt, Homo Sapiens
uaacacgcaucgcugucccgguaaaggggauauggacaaguaaguccuucugugacuuaacuuu

SEQ ID NO: 126929 - RNA, 64 nt, Homo Sapiens
uaaugaugauaacaauggugauugcaauaacacagacaaguagucauaaauaguuaucauuuua

SEQ ID NO: 126930 - RNA, 64 nt, Homo Sapiens
aauucugugguugguguuccucuguagauuucaagacaaguagugaugucauuuucucccugag

SEQ ID NO: 126931 - RNA, 64 nt, Homo Sapiens
ucauggaaaggugccaaacuguuuugaauggaaggacaaguaagagugaggccacaguucccac

SEQ ID NO: 126932 - RNA, 64 nt, Homo Sapiens
ucaugaguauuccuagcaaacaggaccccaaugcgacaaguaguuuuugcaaacccaacuaagc

SEQ ID NO: 126933 - RNA, 64 nt, Homo Sapiens
uuuuauauauuccauaaaaacaaauguaccaaucgacaaguauaaagucauaucugucuuugca

SEQ ID NO: 126934 - RNA, 64 nt, Homo Sapiens
acuuuuugggcaaaacuacuaacuugggcaauaugacaaguauuaaaacaccagaaguuugguu

SEQ ID NO: 126935 - RNA, 64 nt, Homo Sapiens
uuucacuucaaggcucaaugcuauucuaacuaaugacaaguauuuucuacuaaaccagaaauug

SEQ ID NO: 126936 - RNA, 64 nt, Homo Sapiens
acaauguuucuaaauugucucuccaaagugugaagacaaguaaauaauguuucaugauuucuac

SEQ ID NO: 126937 - RNA, 64 nt, Homo Sapiens
uuauggauuuaaacauuagauggugauguuagaagacaaguaguaggguugaugcuuacugacc

SEQ ID NO: 126938 - RNA, 64 nt, Homo Sapiens
uaagaggacgccuucaggcaguguuuaggugaaggacaaguaggaugcugccaggggcagugaa

SEQ ID NO: 126939 - RNA, 64 nt, Homo Sapiens
ugggggccguugggacggcgggugacaagagagagacaaguaaagcgccuuugucugucuaucu

SEQ ID NO: 126940 - RNA, 55 nt, Homo Sapiens
acaaaccuuaccucagcugaaaauggacaaguauuuucaaugacugaaauauagc

SEQ ID NO: 126941 - RNA, 64 nt, Homo Sapiens
gcugggacugccuggagauuugucaggagcugcagacaaguaccuuggagcauucuguuauuuu

SEQ ID NO: 126942 - RNA, 64 nt, Homo Sapiens
cuucagagacagggacucuuuuuggaucucuauugacaaguaauaaaagucuggcccucauaac

SEQ ID NO: 126943 - RNA, 64 nt, Homo Sapiens
cacuaacccguuuuauucuacucacucagccgcagacaaguaauugccuggucuaguagcggau

SEQ ID NO: 126944 - RNA, 64 nt, Homo Sapiens
uugagaguugcugguguaaaugacauaucugaaagacaaguaugugccuguuagacaugacuga

SEQ ID NO: 126945 - RNA, 64 nt, Homo Sapiens
auauuuaaaacuagaucuauaucuuuaaaucugagacaaguauuauaacucaaucaaaauuuuu

SEQ ID NO: 126946 - RNA, 64 nt, Homo Sapiens
uauaagagaacuuucggagccugccuccuucagugacaaguagggcacaaaauucuagaagcag

SEQ ID NO: 126947 - RNA, 64 nt, Homo Sapiens
agaaucuguggcugggagaaaauuucaucaaauagacaaguaaaaggcucaucaguuuuagcau

SEQ ID NO: 126948 - RNA, 64 nt, Homo Sapiens
agcacauucacugacaugauauuauuugcagauugacaaguaggaaguggggaauuuuauuaag

SEQ ID NO: 126949 - RNA, 64 nt, Homo Sapiens
aaauguacgauagguagaauugugguucccuaaagacaaguacauaaaggugacccugaugaaa

SEQ ID NO: 126950 - RNA, 64 nt, Homo Sapiens
accuuccugggccucagcuuccugugugacccuggacaaguacuuggguccuagaccaggacuu

SEQ ID NO: 126951 - RNA, 64 nt, Homo Sapiens
aaaacaauguugggcacaaagaaaauuuagaucugacaaguauaauuuucuaaagacauuauuu

SEQ ID NO: 126952 - RNA, 64 nt, Homo Sapiens
acacuugucagccucagagcauuuaaggaaacuagacaaguaaaauuauccucuuuguaauuua

SEQ ID NO: 126953 - RNA, 64 nt, Homo Sapiens
ccuuugcaauuuauacuugaauauuugucaucuugacaaguagcuaguugaaacaguaggauag

SEQ ID NO: 126954 - RNA, 64 nt, Homo Sapiens
auucuuuagaauucuauaauucauagcaauuuuugacaaguaagauugcaaaauagaaauaucu

SEQ ID NO: 126955 - RNA, 64 nt, Homo Sapiens
uucaaaaauauaaagguguuguaccaggaaguaggacaaguaauucaacagaaugguuuaagua

SEQ ID NO: 126956 - RNA, 64 nt, Homo Sapiens
gaggaaaugacugugccuggaacaggaugaaauagacaaguagagauuuaauuagcaaaaauuu

SEQ ID NO: 126957 - RNA, 64 nt, Homo Sapiens
ccgcuuugugagaugaauacuuccugagaaacuugacaaguaucucuccauuuuaccauuauga

SEQ ID NO: 126958 - RNA, 64 nt, Homo Sapiens
gagaugaaagcuaucacacugauggccaugaaaggacaaguaugcuaaucugcaacagccuucu

SEQ ID NO: 126959 - RNA, 64 nt, Homo Sapiens
aauauuacucucaaaaucuugacugagguauaaagacaaguauggacuuggccccagacgcaua

SEQ ID NO: 126960 - RNA, 64 nt, Homo Sapiens
cuucagaaacaaaucucagaagacaagcugaccugacaaguacuaugugugugcaugucuguau

SEQ ID NO: 126961 - RNA, 64 nt, Homo Sapiens
gccuuguaaacagcucacugucuaauacucgaaggacaaguaacaauuuauauuggaugagagu

SEQ ID NO: 126962 - RNA, 64 nt, Homo Sapiens
aucuaaauauuaugccuugauuuuaauugaaagggacaaguaucaaagucauaguuuuuuucuu

SEQ ID NO: 126963 - RNA, 64 nt, Homo Sapiens
uucuucgacugaggaaucuauucccaagggcucugacaaguagaugugucugugauggugagaa

SEQ ID NO: 126964 - RNA, 64 nt, Homo Sapiens
caggugugaggacaagaaugguguuuuaacuugugacaaguacucugagguggugauuuggcca

SEQ ID NO: 126965 - RNA, 64 nt, Homo Sapiens
aaaacaacugcuugaguuuucuccugugguuugggacaaguaauuccugaccacgauagaacug

SEQ ID NO: 126966 - RNA, 64 nt, Homo Sapiens
gaggcccuucuaccaggguccggugggcgacccugacaaguaccgccugucucaggaugaccgc

SEQ ID NO: 126967 - RNA, 64 nt, Homo Sapiens
agauaaugucuauauauuggccaaacuggugcaugacaaguacuguauuuuuuuauaccuaaau

SEQ ID NO: 126968 - RNA, 64 nt, Homo Sapiens
gauucacugcuuucucugucuagaacagacgggugacaaguaugggcaggaggcauggggcagg

SEQ ID NO: 126969 - RNA, 64 nt, Homo Sapiens
gccccgacacaggcagccuggagaagcugggcaggacaaguaggacaucccuggagccuccaga

SEQ ID NO: 126970 - RNA, 64 nt, Homo Sapiens
cuuaguccuggguuuuugaaaaagugcuaaaacggacaaguagaauaaauguugcuguggaaug

SEQ ID NO: 126971 - RNA, 64 nt, Homo Sapiens
aggaaggaggcuggaauaaauaaaaauaaaaauagacaaguaagacagcauaaauaauacauuu

SEQ ID NO: 126972 - RNA, 64 nt, Homo Sapiens
agacaugacagcgauacuuuaagccaaaugaacagacaaguaaacuggagccaagaagaguaac

SEQ ID NO: 126973 - RNA, 64 nt, Homo Sapiens
aauuggaaggcaaauuuuuguccaaaaaccuacagacaaguacuuugagagaauuuccaauaua

SEQ ID NO: 126974 - RNA, 64 nt, Homo Sapiens
aacaauuucaacugauauucgaacuugguuuuuggacaaguacaugaugacugaacuucagggu

SEQ ID NO: 126975 - RNA, 64 nt, Homo Sapiens
auuaaaccugcgaauccgugaaagaugcucuguagacaaguagauaaaugcgguagauucaaac

SEQ ID NO: 126976 - RNA, 64 nt, Homo Sapiens
cauguagccacaucucuccacuucuugccuuuuggacaaguagacaugauuucuagaccuagag

SEQ ID NO: 126977 - RNA, 64 nt, Homo Sapiens
guauuuugaugccaaggagcgggcagcagccaaagacaaguaucagcuagguaccugcuucccu

SEQ ID NO: 126978 - RNA, 64 nt, Homo Sapiens
gauccgugcccuugcuucugacuuucgccucugggacaaguaagucaaugugggcaguucaguc

SEQ ID NO: 126979 - RNA, 64 nt, Homo Sapiens
uggcaauaggugugaacagggaacucagaauacagacaaguagaaagauucucgcuuaaaaaaa

SEQ ID NO: 126980 - RNA, 64 nt, Homo Sapiens
uguaauuauacugaaggaguacaccugugagagagacaaguaccugauuuggaagccccaacau

SEQ ID NO: 126981 - RNA, 64 nt, Homo Sapiens
ugugggucuaugaugauguuuucacuuuuugaaggacaaguauacaggaaugggagugagaaca

SEQ ID NO: 126982 - RNA, 64 nt, Homo Sapiens
aacauggcuuggguccccuguuccugccuuaagugacaaguagcucaucacuuccuuugugcgc

SEQ ID NO: 126983 - RNA, 64 nt, Homo Sapiens
gaguucuauaauauaagcugccauauauuuuguagacaaguauggcuccuccauaucucccucu

SEQ ID NO: 126984 - RNA, 64 nt, Homo Sapiens
auuugcucaccauuugauauauaaugaauuauaggacaaguauaagcugaucugcuauagcugu

SEQ ID NO: 126985 - RNA, 64 nt, Homo Sapiens
uuauguggguggcuucuaguuugcaacuucaagggacaaguauuaauaguucaguguauggcgu

SEQ ID NO: 126986 - RNA, 64 nt, Homo Sapiens
cuaucuccuaacuuuggaccuauuaucagaaggugacaaguacuggcucuuuauucauuaagcu

SEQ ID NO: 126987 - RNA, 64 nt, Homo Sapiens
auguugcuuuaucaguauaugcuuagcuguaagugacaaguauuuuuucugaacagaaguuuac

SEQ ID NO: 126988 - RNA, 60 nt, Homo Sapiens
caccugaguuccugaggugaagaggaaggggacaaguagcagagagaccuaaaaaccuga

SEQ ID NO: 126989 - RNA, 64 nt, Homo Sapiens
cuggcggggggugggggagacugccaagcagggggacaaguauuacucagagagcccagggcaa

SEQ ID NO: 126990 - RNA, 64 nt, Homo Sapiens
auuuuggggcagcuuuccgguuauauaacacauugacaaguauauguauuaagaguccuugcau

SEQ ID NO: 126991 - RNA, 64 nt, Homo Sapiens
uucccaagucuguccucucaauuucaccugcauugacaaguauuaauugaaccccaacuguaua

SEQ ID NO: 126992 - RNA, 64 nt, Homo Sapiens
agccacuggguggaggggcagggaggcaaaaugagacaaguagccuugguuagucuuagaguug

SEQ ID NO: 126993 - RNA, 64 nt, Homo Sapiens
aggggcaguuuuguuugccugaauaaacguaaaggacaaguaaacaauuugaugauaagcuaca

SEQ ID NO: 126994 - RNA, 64 nt, Homo Sapiens
aaugauguuggugcugcuuccuucuaagagcucagacaaguaaaguaugaaacauucuuauuuc

SEQ ID NO: 126995 - RNA, 64 nt, Homo Sapiens
ggcaguauuggcauuguucuagcaucccugaauaaucaaaaauuaauaaucuauggguuagaaa

SEQ ID NO: 126996 - RNA, 64 nt, Homo Sapiens
acuuuuauuuaggaguuugauaaaugauagguaaaucaaaaauucuggauagauaaucugguaa

SEQ ID NO: 126997 - RNA, 64 nt, Homo Sapiens
aaucugaagauuaaccauuuuuuugucuuagaauaucaaaaagaaaaagaaaaagguguucuag

SEQ ID NO: 126998 - RNA, 64 nt, Homo Sapiens
gguaauuaauccauuccuggcauaaaaagucuuuaucaaaaaaaauuguagaugcuugcuuuuu

SEQ ID NO: 126999 - RNA, 64 nt, Homo Sapiens
aaaauggugggauuuuuuuuuaucaugauuaaauaucaaaaaauugcccuaugaaaacuuuaaa

SEQ ID NO: 127000 - RNA, 64 nt, Homo Sapiens
gaaaaacaccuaaaauuugaaaaaugauuguaggaucaaaaaaggcagaugaaauuacuuaaua

SEQ ID NO: 127001 - RNA, 64 nt, Homo Sapiens
uucaugguagguagaguuuuuccaauuauuuggcaucaaaaaccuuuucaucuuugaugucagu

SEQ ID NO: 127002 - RNA, 64 nt, Homo Sapiens
uauaaaacaugaugaucauuagccaacauuuuuaaucaaaaacuuaaggcauacagccuucaga

SEQ ID NO: 127003 - RNA, 64 nt, Homo Sapiens
guuauuugccauguaaaugaaaacgucuuuauuuaucaaaaaaacacagaggcuauuuuuauau

SEQ ID NO: 127004 - RNA, 64 nt, Homo Sapiens
uuaacaagaaaugcacuacuguuguguauaguagaucaaaaauuauuuauuacuaagaggaugu

SEQ ID NO: 127005 - RNA, 64 nt, Homo Sapiens
uuugauaguuuuauggcuuuuuacuguuagacuaaucaaaaauaacuuuaaaaggaacaaagaa

SEQ ID NO: 127006 - RNA, 64 nt, Homo Sapiens
agcacuaugcuugggggccauuuuaaacagugaaaucaaaaaaagaacagaaaugcaaaaacca

SEQ ID NO: 127007 - RNA, 64 nt, Homo Sapiens
uaugagucucuuaauauacucaaaaaguugugauaucaaaaauguuagaauauugaaaagccau

SEQ ID NO: 127008 - RNA, 64 nt, Homo Sapiens
ugugauaucaaaaauguaugaauauugaaaagccaucaaaaagucaccaggaacccaaauuuag

SEQ ID NO: 127009 - RNA, 64 nt, Homo Sapiens
aaagauacuaauuuuuuaaguacccacugccagcaucaaaaagcuccacacacaacucugagaa

SEQ ID NO: 127010 - RNA, 62 nt, Homo Sapiens
acaucagauaaguaaccuauuaucuacccaucaucaaaaaucacaaagaaugugaaguauaa

SEQ ID NO: 127011 - RNA, 64 nt, Homo Sapiens
uggagugcucaauuggaaguauauugggacacacaucaaaaaccuucuaaguaagaacacugag

SEQ ID NO: 127012 - RNA, 64 nt, Homo Sapiens
gguaauuuucuuugacucuguguaauguaaauacaucaaaaaugacauauggaaauauaggcua

SEQ ID NO: 127013 - RNA, 64 nt, Homo Sapiens
gacuuacccuuucauguacuuccaaagaaagguaaucaaaaagaaucuucuuaagugauauaau

SEQ ID NO: 127014 - RNA, 64 nt, Homo Sapiens
uuuauauguuauagauuaaaauauguugcaaaauaucaaaaauuuguguuauuucagcaguaag

SEQ ID NO: 127015 - RNA, 64 nt, Homo Sapiens
aaguaaggugcacaguuagccuaaaggaaaaaugaucaaaaacaauuggcauuccaaaauucag

SEQ ID NO: 127016 - RNA, 64 nt, Homo Sapiens
aaaaacuaaacauuuaaacaugauuuaaaaucaaaucaaaaagauuacaaaacagaaaaauaaa

SEQ ID NO: 127017 - RNA, 64 nt, Homo Sapiens
ggagauuaaccucuuguuuuauggucaauuaacaaucaaaaagacagccuuuggaggaauagag

SEQ ID NO: 127018 - RNA, 64 nt, Homo Sapiens
uaaauauauauaaauaaaggaagaugaacuugcaaucaaaaacuccuuacaugagaagaugagc

SEQ ID NO: 127019 - RNA, 64 nt, Homo Sapiens
cccacuuaacacuuugauuagcaugaacuugccaaucaaaaaaugacaaucaauuugagaaaau

SEQ ID NO: 127020 - RNA, 64 nt, Homo Sapiens
uggacaacauagugagauccuaucucuauaaaaaaucaaaaauuagccaggcaugguggugcau

SEQ ID NO: 127021 - RNA, 64 nt, Homo Sapiens
uguccagauuccacgugcagcagccuuaaaguuuaucaaaaaauaguuucuguaaauuauuuag

SEQ ID NO: 127022 - RNA, 64 nt, Homo Sapiens
aaauugagcuuaaggcaaaacuaauuuuuuucuaaucaaaaagauuuagauuuuauuuuuuaau

SEQ ID NO: 127023 - RNA, 64 nt, Homo Sapiens
ugaagauacagugaaguucuacagagaugcugauaucaaaaacuuauagcacacugcuuucucc

SEQ ID NO: 127024 - RNA, 64 nt, Homo Sapiens
guaaggcuuuuguucagaaaauggcuuuuggacuaucaaaaacaaggauauucauuauuuucaa

SEQ ID NO: 127025 - RNA, 64 nt, Homo Sapiens
uugcgcuuaauccaauauuuugccuuuuuucuauaucaaaaaaccuuuacaguuagcagggaug

SEQ ID NO: 127026 - RNA, 64 nt, Homo Sapiens
uuucucuuguaccauagaaaaauguauaaaaauuaucaaaaagcuaaugugcagggauauugcc

SEQ ID NO: 127027 - RNA, 64 nt, Homo Sapiens
aagaagugaccaugagcuguucauguacauuuguaucaaaaauagggugggcugucaagacgug

SEQ ID NO: 127028 - RNA, 64 nt, Homo Sapiens
acuucccuccaucuccuccucucuaugaacuuaaaucaaaaaccccuccccacucucgccccuu

SEQ ID NO: 127029 - RNA, 64 nt, Homo Sapiens
caauaaaauacuggcaaaccgaauccagcagcacaucaaaaagcuuauccaccaugaucaagug

SEQ ID NO: 127030 - RNA, 64 nt, Homo Sapiens
gaacucaaacaaauuuacaggaacaaacaaccccaucaaaaagucggcaaaggacaugaacaga

SEQ ID NO: 127031 - RNA, 64 nt, Homo Sapiens
auuaagauuuaaaacaaugugcauguauuuuauaaucaaaaauaauuugaauuuguuacacuaa

SEQ ID NO: 127032 - RNA, 64 nt, Homo Sapiens
uuacaaacacugcaagacaacaauaacaguauacaucaaaaaauauauggaguauguaaguugg

SEQ ID NO: 127033 - RNA, 64 nt, Homo Sapiens
uaauaaacuucauuuuaaccaaaaaaaucaaaaaaucaaaaaaaauuuaaaaaaacaaaaaaca

SEQ ID NO: 127034 - RNA, 64 nt, Homo Sapiens
caaaaaaauaauaaacuucaaaaaaacaaaaaaaaucaaaaaauacaguuuuauuuaaaaaaac

SEQ ID NO: 127035 - RNA, 64 nt, Homo Sapiens
guauuuacaggagaaagaggugauuauggagggaaucaaaaauacugcuuucaguuaguagcua

SEQ ID NO: 127036 - RNA, 64 nt, Homo Sapiens
uaagugcgcauaucuuuucuguauacagcuuaaaaucaaaaauguauguuaagagaauuuuuuc

SEQ ID NO: 127037 - RNA, 64 nt, Homo Sapiens
uugucaucaaauacagguggaaaaaauugagcucaucaaaaauaaguaauaguauugacuguuu

SEQ ID NO: 127038 - RNA, 64 nt, Homo Sapiens
uaguuauaauuuuuugaauuguauuauucaaaugaucaaaaauaauggauuuuaauaagcucca

SEQ ID NO: 127039 - RNA, 64 nt, Homo Sapiens
guugcugucauuacauaucuauuaaaugucaucaaauauguaguagacaaugcuguaauuaggu

SEQ ID NO: 127040 - RNA, 64 nt, Homo Sapiens
cauauugauagcaucuaauucuuuugacaaucuuaauauguagguucauuuaaauuuuaagaca

SEQ ID NO: 127041 - RNA, 64 nt, Homo Sapiens
cuuacagauaacuaaggcaaaaagcuaaauaaacaauauguaaccucuaacauuugguaaaagg

SEQ ID NO: 127042 - RNA, 64 nt, Homo Sapiens
cauuacagaaaaaguuugauaauuccugcuuuauaauauguaaggcauugucccauuuugcaua

SEQ ID NO: 127043 - RNA, 64 nt, Homo Sapiens
guguuuauacaugaugcugauuuaaguauagcaaaauauguauaggcauuauugaguaaugaau

SEQ ID NO: 127044 - RNA, 64 nt, Homo Sapiens
ggccuuuucaaggccuagucaugcaugucacacuaauauguaguuuuuuuaauugcagacagua

SEQ ID NO: 127045 - RNA, 64 nt, Homo Sapiens
uguuugaaauacuucauaauucagcaugaaaccuaauauguauaaauuuggggggauuauuuau

SEQ ID NO: 127046 - RNA, 64 nt, Homo Sapiens
ccugccuaagaauaacuuguuaccaugggauaaaaauauguaucagauaagcucaguaauaugu

SEQ ID NO: 127047 - RNA, 64 nt, Homo Sapiens
gcuaaauacuuuccucuccaguaaauucacaguaaauauguaaaaauguguuucuuauuaauau

SEQ ID NO: 127048 - RNA, 64 nt, Homo Sapiens
uucacaguaaauauguaaagauguguuucuuauuaauauguaaauguggcagggcaagguuuaa

SEQ ID NO: 127049 - RNA, 64 nt, Homo Sapiens
ucauaauucucccauaauaaacaauuuggaucuaaauauguauuuguaaugcauauuuuuaaag

SEQ ID NO: 127050 - RNA, 64 nt, Homo Sapiens
acaguguaugugucuuuugccuucuauuaaaucaaauauguaccauauauagccugauaaacaa

SEQ ID NO: 127051 - RNA, 64 nt, Homo Sapiens
augccugccucguagugaaguuguagcucuccguaauauguauauuuuacucaguuuucaacau

SEQ ID NO: 127052 - RNA, 64 nt, Homo Sapiens
ggauucagaggguuccuugaaaguuuuauguauaaauauguaaaauaaaaauuaaaacuuuguu

SEQ ID NO: 127053 - RNA, 64 nt, Homo Sapiens
cacauuuaauauuuuucuuauaucuacauuucugaauauguaaagcaaguuauugaaauaggac

SEQ ID NO: 127054 - RNA, 64 nt, Homo Sapiens
gaauuaccuauuaaaaagaaaucugauauauaaaaauauguacuauuuuaaggaaaaauuucca

SEQ ID NO: 127055 - RNA, 64 nt, Homo Sapiens
aaacucucauuuauuuggggaaguuguaccuuuuaauauguaguguaaaauuuuuuauaaacua

SEQ ID NO: 127056 - RNA, 64 nt, Homo Sapiens
cacaaauauauacguauaucuucuugaaaaaaaaaauauguauagcauacuagcaagacagcuc

SEQ ID NO: 127057 - RNA, 64 nt, Homo Sapiens
uaaagcuuuuucuuauuuuuauaaaauuuuauaaaauauguauuugaaggaccuuauuuggcau

SEQ ID NO: 127058 - RNA, 55 nt, Homo Sapiens
cuuagacucagccaguuuccgcagaaauauguaacaccauggauacccuuacuga

SEQ ID NO: 127059 - RNA, 64 nt, Homo Sapiens
accaauaauaaauuaucaaugcaugccaguaaauaauauguaggcuauuucucuauggucuaca

SEQ ID NO: 127060 - RNA, 64 nt, Homo Sapiens
uacacagaguaauaauaauaugacaugauagauaaauauguaucacugcuuugcuucuuuuuau

SEQ ID NO: 127061 - RNA, 64 nt, Homo Sapiens
uaccugagcauauguacacaagaauaguugucagaauauguaugccacauucccaugaauauca

SEQ ID NO: 127062 - RNA, 64 nt, Homo Sapiens
ugucuagauaaaaggagagaacagaugauguaaaaauauguauauggguucaaauucucuaugu

SEQ ID NO: 127063 - RNA, 64 nt, Homo Sapiens
aaaauaucccaagcaauccagucauuuucucuugaauauguauuuuuucuauuaagauauauuu

SEQ ID NO: 127064 - RNA, 64 nt, Homo Sapiens
uaugucuuuugcuauggagccaauuuauaauuacaauauguauucaacuuauaauuacaaugca

SEQ ID NO: 127065 - RNA, 64 nt, Homo Sapiens
uuguaagucuuuucaccauucaugaauaauaauaaauauguacugcuggcauguaaugcuuagu

SEQ ID NO: 127066 - RNA, 64 nt, Homo Sapiens
uguaacaugugauacauacaaaagaauauaguuuaauauguauugaaauaaaacacaauaaaau

SEQ ID NO: 127067 - RNA, 64 nt, Homo Sapiens
cugugauuugguccucuggaagcuuuuagaauguaauauguaaauauguaacugccauaaguau

SEQ ID NO: 127068 - RNA, 64 nt, Homo Sapiens
ugccauaaguauagcuuuuauccuauccauaaguaauauguaaccagaaaucaggagauuuuua

SEQ ID NO: 127069 - RNA, 64 nt, Homo Sapiens
gaaaagaaaagauuuaguaauuucuuaccaugcuaauauguaaaguucaugccauccaggcauu

SEQ ID NO: 127070 - RNA, 64 nt, Homo Sapiens
ccaggcauuuaagagcgauccucaucccuucagcaauauguauuugaguucacacuauuucugu

SEQ ID NO: 127071 - RNA, 64 nt, Homo Sapiens
auaauuguaaagauagaaauuauauugauaaguaaauauguaaaauuguaaauauguaaaaaaa

SEQ ID NO: 127072 - RNA, 64 nt, Homo Sapiens
aaauuauauugauaaguaaauauguaaaauuguaaauauguaaaaaaaagaauggugucugcug

SEQ ID NO: 127073 - RNA, 64 nt, Homo Sapiens
ccucacuaauaacuaaccuuugaauaacucucuaaauauguagacuaccaauacuaucugcuac

SEQ ID NO: 127074 - RNA, 64 nt, Homo Sapiens
auuuguuggcugggccacgugaauguuuauugugaauauguaauauuagaggcuaauaaaggca

SEQ ID NO: 127075 - RNA, 64 nt, Homo Sapiens
uaauggauuuuuuuuuuuuagaguuuucgguauaaauauguagaucaugugccgugccuuaucu

SEQ ID NO: 127076 - RNA, 64 nt, Homo Sapiens
ucacugagacaaucauguacuaauuuaaacguauaauauguacaauaguaguuuuaaguauguc

SEQ ID NO: 127077 - RNA, 64 nt, Homo Sapiens
ucucugaaauaaugaaauauuuacaucuuuuacaaauauguauauaugcagagaaauuaagaau

SEQ ID NO: 127078 - RNA, 64 nt, Homo Sapiens
aaguuauacuaauguuucaacagguauuugacauaauauguauuaauggauucucauauuaaca

SEQ ID NO: 127079 - RNA, 64 nt, Homo Sapiens
uucauacacguuuggaaauguuagcucugccaccaauauguaucauggaguugcuucuguugaa

SEQ ID NO: 127080 - RNA, 64 nt, Homo Sapiens
cauucacuuucaagauuuguguauuuaacaaagcaauauguauuacaccauauaagucaaauau

SEQ ID NO: 127081 - RNA, 64 nt, Homo Sapiens
uaacaaagcaauauguauuccaccauauaagucaaauauguauuuauauauauauuuauauaaa

SEQ ID NO: 127082 - RNA, 64 nt, Homo Sapiens
cuuacaguuaaaaacaaaggcagucauuauuuaaaauauguaaaugugagccaguuauuaaaag

SEQ ID NO: 127083 - RNA, 64 nt, Homo Sapiens
agcuuucaagaaaaauuaaaugacuucuuguuugaauauguaaaugucagaaauuuguagaaaa

SEQ ID NO: 127084 - RNA, 64 nt, Homo Sapiens
cuccuaacugaaauauuuacaaaauaaaaauaaaaauauguauuagacuccaucucaaaaacug

SEQ ID NO: 127085 - RNA, 64 nt, Homo Sapiens
cuggccgguugcaguggcucauuccaaauuuuaaaauauguacucuaaaacaagagcuauccuc

SEQ ID NO: 127086 - RNA, 64 nt, Homo Sapiens
acagaaaauucaauccuuuauuuuuuucucuguaaauauguacagugcacgggcuaugagauag

SEQ ID NO: 127087 - RNA, 64 nt, Homo Sapiens
uuguuucuguugucuuuuaaaaugucaaauauauaauauguaauuuuuuuaaaaaccaccagau

SEQ ID NO: 127088 - RNA, 64 nt, Homo Sapiens
guggaauagugaauacuuacuauaauuugacuugaauauguagcucauccuuuacaccaacucc

SEQ ID NO: 127089 - RNA, 64 nt, Homo Sapiens
uuaaaugagaaguacuugguuuuuuuuuuucuuaaauauguauaugacauuuaaauguaacuua

SEQ ID NO: 127090 - RNA, 64 nt, Homo Sapiens
aaauacuuuaauuguuaaaagucagaagagacagaauauguaggaaauguuuuuuguuuauuau

SEQ ID NO: 127091 - RNA, 64 nt, Homo Sapiens
aacagggcuucaguauauucacaucuaauagguuaauauguacauuuggaugaugauuuuucuu

SEQ ID NO: 127092 - RNA, 64 nt, Homo Sapiens
acaccuuaagggucuaacuuguaaugaagacagaaauauguaugaggaugaucacugaaauauu

SEQ ID NO: 127093 - RNA, 64 nt, Homo Sapiens
auauccguguaauggaagauuaugcaggcauuaaaauauguacacaaaaaguuugguaaaggaa

SEQ ID NO: 127094 - RNA, 64 nt, Homo Sapiens
cuaggaacugagaacuguauuggaauagguucaaaauauguaagaaaugcuaaugugggagaua

SEQ ID NO: 127095 - RNA, 64 nt, Homo Sapiens
gaucaaacauuuuaauaugugcauguuauauauaaauauguaaauucugugauacucuaugauc

SEQ ID NO: 127096 - RNA, 64 nt, Homo Sapiens
uccuuuauauuguguuagaggcugaggauauagaaauauguaacucagagucccauuccacaag

SEQ ID NO: 127097 - RNA, 64 nt, Homo Sapiens
gaaggcacaacaccauauggaaaagcaagacagaaauauguacagggcagagaggcugcacugu

SEQ ID NO: 127098 - RNA, 64 nt, Homo Sapiens
ugagucuucaucacagcaucaccaaaauuugcuaaauauguacaaugacaggcacauguaagaa

SEQ ID NO: 127099 - RNA, 64 nt, Homo Sapiens
uccuaggauggcugugaggaugcaggaugaaaacaauauguaucuucauuucuuuuucuguaaa

SEQ ID NO: 127100 - RNA, 64 nt, Homo Sapiens
uuuuccuguggaaaccugucauagaauuuugugcaauauguaugugucuaugaagcugucuugu

SEQ ID NO: 127101 - RNA, 64 nt, Homo Sapiens
uguuaacgagacugauauucaacaggcuucuaagaauauguaucuucauaaacugaucacuauc

SEQ ID NO: 127102 - RNA, 64 nt, Homo Sapiens
uauguguggucuucccauuaaaugugaacauuuuaauauguaugcauucaccuugccucuugca

SEQ ID NO: 127103 - RNA, 64 nt, Homo Sapiens
auaccuuguaaacuuguauuguggauguguaaauaauauguacuuuggguuuuuaacaccgcau

SEQ ID NO: 127104 - RNA, 64 nt, Homo Sapiens
ugcuuacaauagaugucucacacagaacaauacaaauauguaaaaaaucuuucaccacauauuc

SEQ ID NO: 127105 - RNA, 64 nt, Homo Sapiens
ugguaguauaagucaccuaaaaaagacuucuagaaauauguacuuuaauuauuuguuuuucucc

SEQ ID NO: 127106 - RNA, 64 nt, Homo Sapiens
uuuuuugguugaaccuuuagaaaaaauacucaaaaauauguaagagauaaacuauuaaaacuuu

SEQ ID NO: 127107 - RNA, 64 nt, Homo Sapiens
auucaauauuuuuauauuccucucaagacucugaaauauguaaaaaaauacugcacuuuaaguu

SEQ ID NO: 127108 - RNA, 64 nt, Homo Sapiens
aauaaguaucuguguguuuguguauugaaaacucaauauguaaucuuguguuuuuauauguaua

SEQ ID NO: 127109 - RNA, 64 nt, Homo Sapiens
cuggccaacauggugaaaccccaucacuacuaaaaauauguaaauuagucgggcguggugucac

SEQ ID NO: 127110 - RNA, 64 nt, Homo Sapiens
uaggguuuuaacccuuccauguucuuguaaaaugaauauguaugcagcaaucgaaagucagugu

SEQ ID NO: 127111 - RNA, 64 nt, Homo Sapiens
gaacaugcacuuuauugguuaaaggggcagguguaauauguaaguucuagaagaaauguuugua

SEQ ID NO: 127112 - RNA, 64 nt, Homo Sapiens
gcauuauguguggacuacugaaugguuuguuuuuaauauguagaguucuuauccacaguacaaa

SEQ ID NO: 127113 - RNA, 64 nt, Homo Sapiens
uaugacuuuguuacaacuguaaaauguagagaaaaauauguagcauuaguuugucucaauaaac

SEQ ID NO: 127114 - RNA, 64 nt, Homo Sapiens
aauucacaccaauuuuauuaaguaguuccaucaaaauauguaauuauauguauacauucuguac

SEQ ID NO: 127115 - RNA, 64 nt, Homo Sapiens
ugguauauacucaaauguauaugugaguggaaaaaauauguauguuguuuuacuaaagagaaaa

SEQ ID NO: 127116 - RNA, 64 nt, Homo Sapiens
uauauauauauugacuuguuauauauauauauauaauauguauauauauuuuauauauauauau

SEQ ID NO: 127117 - RNA, 64 nt, Homo Sapiens
acuuaaauaaacaugaccacaacaaaggaaugagaauauguaauugguuguuuucguuguuguu

SEQ ID NO: 127118 - RNA, 64 nt, Homo Sapiens
ucuuuguuaguugcaagauggauuucauaugcagaauauguaaaugaagaggacucauaaguaa

SEQ ID NO: 127119 - RNA, 64 nt, Homo Sapiens
aaacaugcuaauuagaaaaaguccugcuuuaaguaauauguagccacauuugaauccucuacca

SEQ ID NO: 127120 - RNA, 64 nt, Homo Sapiens
uuucuaagucaaacacuuguuaaaaauuuacuacaauauguacacaucaacuaaaguuguacuu

SEQ ID NO: 127121 - RNA, 64 nt, Homo Sapiens
aacacuacucaaagcaaaaguaagcaugacagaaaauauguauuuauuucagaaguuuaaauau

SEQ ID NO: 127122 - RNA, 64 nt, Homo Sapiens
cgacacagugagacucugucucaaaaaaacaaaacaaacaaacaaaaauacaaaaaauuagccg

SEQ ID NO: 127123 - RNA, 64 nt, Homo Sapiens
acagugagacucugucucaaaaaaacaaaacaaacaaacaaaaauacaaaaaauuagccgggcg

SEQ ID NO: 127124 - RNA, 64 nt, Homo Sapiens
cuccggccuaggcaacgagagcaaaacuccaauacaaacaaacaaacaaacaccugugcuaggu

SEQ ID NO: 127125 - RNA, 64 nt, Homo Sapiens
ggccuaggcaacgagagcaaaacuccaauacaaacaaacaaacaaacaccugugcuaggucagu

SEQ ID NO: 127126 - RNA, 64 nt, Homo Sapiens
uaggcaacgagagcaaaacuccaauacaaacaaacaaacaaacaccugugcuaggucagucugg

SEQ ID NO: 127127 - RNA, 64 nt, Homo Sapiens
auuucuucaucugcuggggggaaaaaguaaauuacaaacaaacaaacaaagcagaacuaaaaua

SEQ ID NO: 127128 - RNA, 64 nt, Homo Sapiens
cuucaucugcuggggggaaaaaguaaauuacaaacaaacaaacaaagcagaacuaaaauauugg

SEQ ID NO: 127129 - RNA, 64 nt, Homo Sapiens
aucugcuggggggaaaaaguaaauuacaaacaaacaaacaaagcagaacuaaaauauugggacc

SEQ ID NO: 127130 - RNA, 64 nt, Homo Sapiens
ucuguaaaagguaaaaaugaaaaacaaaaacaagcaaacaaacaaaaaacaauggaaaagauga

SEQ ID NO: 127131 - RNA, 64 nt, Homo Sapiens
uaaaagguaaaaaugaaaaacaaaaacaagcaaacaaacaaaaaacaauggaaaagaugaagcu

SEQ ID NO: 127132 - RNA, 64 nt, Homo Sapiens
auguguguuaauuuggcuguaauggcauuuaaagcaaacaaacaaacaaaaaaagcugugaaaa

SEQ ID NO: 127133 - RNA, 64 nt, Homo Sapiens
guguuaauuuggcuguaauggcauuuaaagcaaacaaacaaacaaaaaaagcugugaaaauggc

SEQ ID NO: 127134 - RNA, 64 nt, Homo Sapiens
uaauuuggcuguaauggcauuuaaagcaaacaaacaaacaaaaaaagcugugaaaauggccuug

SEQ ID NO: 127135 - RNA, 64 nt, Homo Sapiens
cacagacagaaguaguuaaaaacaaacaaacaaacaaacaaauacagagcaaacccuguuucca

SEQ ID NO: 127136 - RNA, 64 nt, Homo Sapiens
aauacacagacagaaguaguuccaaacaaacaaacaaacaaacagcgacagagcaaacccuguu

SEQ ID NO: 127137 - RNA, 64 nt, Homo Sapiens
aacaaauacacagacagaaguguuuccaaacaaacaaacaaacacugggcgacagagcaaaccc

SEQ ID NO: 127138 - RNA, 64 nt, Homo Sapiens
aacaaacaaauacacagacaacccuguuuccaaacaaacaaacacagccugggcgacagagcaa

SEQ ID NO: 127139 - RNA, 64 nt, Homo Sapiens
aacaaacaaacaaauacacagcaaacccuguuuccaaacaaacaacuccagccugggcgacaga

SEQ ID NO: 127140 - RNA, 64 nt, Homo Sapiens
aaaaaaacucuugucuccuucucaaacaaacaaacaaacaaaaagcaacagaacaagaacccau

SEQ ID NO: 127141 - RNA, 64 nt, Homo Sapiens
aaaaaaaaaaacucuugucuccaucucaaacaaacaaacaaacacugggcaacagaacaagaac

SEQ ID NO: 127142 - RNA, 64 nt, Homo Sapiens
aacaaaaaaaaaaaacucuugaacccaucucaaacaaacaaacacaaccugggcaacagaacaa

SEQ ID NO: 127143 - RNA, 64 nt, Homo Sapiens
aacaaacaaaaaaaaaaaacacaagaacccaucucaaacaaacaacuccaaccugggcaacaga

SEQ ID NO: 127144 - RNA, 64 nt, Homo Sapiens
ugugacugcuugcugacuuuaucauaauuuucuucaaacaaaaaaauguauagaaaaaucaugu

SEQ ID NO: 127145 - RNA, 64 nt, Homo Sapiens
ccuauaaucuauagacaugugauagcaaaagaaacaaacaaaagccaggaaaacacucauuuuc

SEQ ID NO: 127146 - RNA, 64 nt, Homo Sapiens
acuuagugaaauaaaauaagaggaaagccaaaaacaaacaaacaaaaagcauauggggagcugg

SEQ ID NO: 127147 - RNA, 64 nt, Homo Sapiens
agugaaauaaaauaagaggaaagccaaaaacaaacaaacaaaaagcauauggggagcugguauu

SEQ ID NO: 127148 - RNA, 64 nt, Homo Sapiens
ugauuaaugcaaggggaaauuuuuauacugaaaacaaacaaacaaacuagcagcuacuaaaaua

SEQ ID NO: 127149 - RNA, 64 nt, Homo Sapiens
uaaugcaaggggaaauuuuuauacugaaaacaaacaaacaaacuagcagcuacuaaaauagaga

SEQ ID NO: 127150 - RNA, 64 nt, Homo Sapiens
acacaaaacauaauaaaacacaaaguuaaacaaacaaacaaaaaggcaaacugagguagcgaca

SEQ ID NO: 127151 - RNA, 64 nt, Homo Sapiens
aaaaacacaaaacauaauaagacacaaaguuaaacaaacaaacaugggggcaaacugagguagc

SEQ ID NO: 127152 - RNA, 64 nt, Homo Sapiens
gguggaagcuuuuuaauaaaaaauuguacacaaacaaacaaaaacgcuuucagaauaguuuugc

SEQ ID NO: 127153 - RNA, 64 nt, Homo Sapiens
aaaagguggaagcuuuuuaauugcaaauuguacacaaacaaacaauuccgcuuucagaauaguu

SEQ ID NO: 127154 - RNA, 64 nt, Homo Sapiens
gaaguaacgaagcuaagaauuuuaaacaaacaaacaaacaaacauuuuuucuagucccauguga

SEQ ID NO: 127155 - RNA, 64 nt, Homo Sapiens
aacagaaguaacgaagcuaagugauuuaaacaaacaaacaaacaggauuuuuuucuagucccau

SEQ ID NO: 127156 - RNA, 64 nt, Homo Sapiens
aacaaacagaaguaacgaagccaugugauuuaaacaaacaaacauguaggauuuuuuucuaguc

SEQ ID NO: 127157 - RNA, 64 nt, Homo Sapiens
cuguugcuauuuccuaaccuagaaaacaaacaaacaaacaaaaacuagcccccuugaucccuaa

SEQ ID NO: 127158 - RNA, 64 nt, Homo Sapiens
aaaacuguugcuauuuccuacuaaagaaaacaaacaaacaaacaccuccuagcccccuugaucc

SEQ ID NO: 127159 - RNA, 64 nt, Homo Sapiens
aacaaaaacuguugcuauuuaucccuaaagaaaacaaacaaacauaacccuccuagcccccuug

SEQ ID NO: 127160 - RNA, 64 nt, Homo Sapiens
uggcaagaucacuaaaaaauuaauacaaugaugacaaacaaaacucuucuauaaaccaggcugu

SEQ ID NO: 127161 - RNA, 64 nt, Homo Sapiens
cuuaugcagaacaucucuguuggaacucuuucuucaaacaaaagccaaccccguuuuuaagcaa

SEQ ID NO: 127162 - RNA, 64 nt, Homo Sapiens
aauuagccgggcaugguggcgacuucgucucaaacaaacaaaaacagccugggcgacagagcga

SEQ ID NO: 127163 - RNA, 64 nt, Homo Sapiens
aaaaaauuagccgggcaugggcgagacuucgucucaaacaaacaacuccagccugggcgacaga

SEQ ID NO: 127164 - RNA, 64 nt, Homo Sapiens
agugaaugcuuagaaccuuccggggacaaaaaaucaaacaaaaaagcuagcaaaugaguuuuag

SEQ ID NO: 127165 - RNA, 64 nt, Homo Sapiens
aacauuuuuaaaaagaaaauacaguagccacuuacaaacaaauccagcgcugucucgugaaugg

SEQ ID NO: 127166 - RNA, 64 nt, Homo Sapiens
gcuuuuuguucuguuggugugauucaaagcaaaacaaacaaacaaaaacaaauuuuaagaacac

SEQ ID NO: 127167 - RNA, 64 nt, Homo Sapiens
uuuguucuguuggugugauucaaagcaaaacaaacaaacaaaaacaaauuuuaagaacacaaca

SEQ ID NO: 127168 - RNA, 64 nt, Homo Sapiens
uucuuugacaaaaauguguacuguguaagccuugcaaacaaaaaacaacaaaaaagaagcagca

SEQ ID NO: 127169 - RNA, 64 nt, Homo Sapiens
ugaagucucuuuaugguuagagaagaccaaaaaacaaacaaacaaacuuagaaacauaaaagga

SEQ ID NO: 127170 - RNA, 64 nt, Homo Sapiens
gucucuuuaugguuagagaagaccaaaaaacaaacaaacaaacuuagaaacauaaaaggaaaug

SEQ ID NO: 127171 - RNA, 64 nt, Homo Sapiens
agaaagggaaaaagcagaaacacugcagaagacacaaacaaacaaagaagagaaggauucuuau

SEQ ID NO: 127172 - RNA, 64 nt, Homo Sapiens
agggaaaaagcagaaacacugcagaagacacaaacaaacaaagaagagaaggauucuuauaccg

SEQ ID NO: 127173 - RNA, 64 nt, Homo Sapiens
ucugaaccagcuaucccucuggaaugcagcugaccaaacaaauucccacuaauguaacugguag

SEQ ID NO: 127174 - RNA, 64 nt, Homo Sapiens
acuuccaguauaguggggacaaucaguuaauaagcaaacaaacacauuucuauuuauaaauggu

SEQ ID NO: 127175 - RNA, 64 nt, Homo Sapiens
gccuuguuucucuagucacacucuaacaaacaaacaaacaaacaccgcagggccagccuuguuu

SEQ ID NO: 127176 - RNA, 64 nt, Homo Sapiens
aacagccuuguuucucuaguguuucucuaacaaacaaacaaacaggggccgcagggccagccuu

SEQ ID NO: 127177 - RNA, 64 nt, Homo Sapiens
aacaaacagccuuguuucucccuuguuucucuaacaaacaaacagggcggggccgcagggccag

SEQ ID NO: 127178 - RNA, 64 nt, Homo Sapiens
cuguuaauauauuagccauauacuaucaaacaaacaaacaaaaaaucagaccaucugagcccac

SEQ ID NO: 127179 - RNA, 64 nt, Homo Sapiens
aaaacuguuaauauauuagcccacuacuaucaaacaaacaaacaccaaaucagaccaucugagc

SEQ ID NO: 127180 - RNA, 64 nt, Homo Sapiens
aacaaaaacuguuaauauaugagcccacuacuaucaaacaaacauaccccaaaucagaccaucu

SEQ ID NO: 127181 - RNA, 64 nt, Homo Sapiens
guucuauauauaauaguuucaacaaacaaacaaacaaacaaacacuaucccuguaagcuaaaca

SEQ ID NO: 127182 - RNA, 64 nt, Homo Sapiens
aacaguucuauauauaauagaacaaacaaacaaacaaacaaacaccaccuaucccuguaagcua

SEQ ID NO: 127183 - RNA, 64 nt, Homo Sapiens
aacaaacaguucuauauauagcuaaacaaacaaacaaacaaacaaaugccaccuaucccuguaa

SEQ ID NO: 127184 - RNA, 64 nt, Homo Sapiens
aacaaacaaacaguucuauaguaagcuaaacaaacaaacaaacauuauaaugccaccuaucccu

SEQ ID NO: 127185 - RNA, 64 nt, Homo Sapiens
aacaaacaaacaaacaguuccccuguaagcuaaacaaacaaacauuucuuauaaugccaccuau

SEQ ID NO: 127186 - RNA, 64 nt, Homo Sapiens
agcuauggcacuagaauuuacaacaaaaaacaaacaaacaaaaauuaugaacaaaacaaaacaa

SEQ ID NO: 127187 - RNA, 64 nt, Homo Sapiens
aaaaagcuauggcacuagaaacaacaacaaaaaacaaacaaacauuucuuaugaacaaaacaaa

SEQ ID NO: 127188 - RNA, 64 nt, Homo Sapiens
acccauguguuaaaauacucacaaaacaaacaaacaaacaaaaaguaaucugaaguaugguauu

SEQ ID NO: 127189 - RNA, 64 nt, Homo Sapiens
aaaaacccauguguuaaaauuauuacaaaacaaacaaacaaacauauuguaaucugaaguaugg

SEQ ID NO: 127190 - RNA, 64 nt, Homo Sapiens
aacaaaaaacccauguguuaaugguauuacaaaacaaacaaacauggguauuguaaucugaagu

SEQ ID NO: 127191 - RNA, 64 nt, Homo Sapiens
ggucgcggcagcagugauggauuuauaguuccuccaaacaaagaugggaccccucccgagggaa

SEQ ID NO: 127192 - RNA, 64 nt, Homo Sapiens
aguaacaaugcugcaucuagauuggagugcugcacaaacaaacauaagagcaaagcaaaacugu

SEQ ID NO: 127193 - RNA, 64 nt, Homo Sapiens
acuaucacuuuauaagaaucauuuucuaguaaugcaaacaaauuauuuuuuacaaaaaaacaaa

SEQ ID NO: 127194 - RNA, 64 nt, Homo Sapiens
cugggugacagagucagacuccgucccaaaaaaacaaacaaacaaaacaaaacaaaaaaaaaca

SEQ ID NO: 127195 - RNA, 64 nt, Homo Sapiens
gugacagagucagacuccgucccaaaaaaacaaacaaacaaaacaaaacaaaaaaaaacagaag

SEQ ID NO: 127196 - RNA, 64 nt, Homo Sapiens
ucccuggcuucgcaccugccacccccaaacaaaacaaacaaacucacuccuacccccuuccuca

SEQ ID NO: 127197 - RNA, 64 nt, Homo Sapiens
aaacaaacuucccuggcuucccuuccucaacccccaaacaaaacuuucaaccccacuccuaccc

SEQ ID NO: 127198 - RNA, 64 nt, Homo Sapiens
gaaugaaacagucaaauggugcgucacaugcaaacaaacaaaauauucaguuuuuguaguaaag

SEQ ID NO: 127199 - RNA, 64 nt, Homo Sapiens
aaaugaaugaaacagucaaaaaaggcgucacaugcaaacaaacaaacuauucaguuuuuguagu

SEQ ID NO: 127200 - RNA, 64 nt, Homo Sapiens
aaaucaaaauacauuaggguuuacuugguuguggcaaacaaacaaaaaaugcuuucaguguuga

SEQ ID NO: 127201 - RNA, 64 nt, Homo Sapiens
caaaauacauuaggguuuacuugguuguggcaaacaaacaaaaaaugcuuucaguguugaaaua

SEQ ID NO: 127202 - RNA, 64 nt, Homo Sapiens
acuccagccugggugacagagcgagacuccgucucaaacaaacaaacaaaaaacuguuuucauu

SEQ ID NO: 127203 - RNA, 64 nt, Homo Sapiens
cagccugggugacagagcgagacuccgucucaaacaaacaaacaaaaaacuguuuucauuugcu

SEQ ID NO: 127204 - RNA, 64 nt, Homo Sapiens
cugggugacagagcgagacuccgucucaaacaaacaaacaaaaaacuguuuucauuugcucucu

SEQ ID NO: 127205 - RNA, 64 nt, Homo Sapiens
aaacaaggguggguggggagaagaucaaaacaaacaaacaaaaagauaauaaacaucauuuuaa

SEQ ID NO: 127206 - RNA, 64 nt, Homo Sapiens
aaaaaaacaagggugggugguuaaaagaucaaaacaaacaaacauccugauaauaaacaucauu

SEQ ID NO: 127207 - RNA, 64 nt, Homo Sapiens
gagaccgaacccccucaccugaaucccccucuaucaaacaaacaaaaaagcagcaguaaagagc

SEQ ID NO: 127208 - RNA, 64 nt, Homo Sapiens
ccgaacccccucaccugaaucccccucuaucaaacaaacaaaaaagcagcaguaaagagcuaga

SEQ ID NO: 127209 - RNA, 64 nt, Homo Sapiens
uuuauuguauguaaggaaaaauuuuaccugaaaacaaacaaacaaacccuaaaacucagcacca

SEQ ID NO: 127210 - RNA, 64 nt, Homo Sapiens
uuguauguaaggaaaaauuuuaccugaaaacaaacaaacaaacccuaaaacucagcaccacuac

SEQ ID NO: 127211 - RNA, 64 nt, Homo Sapiens
cacuccagccuggcaacagagcuagaauccgucucaaacaaacaaacaaaaaaucccacagcua

SEQ ID NO: 127212 - RNA, 64 nt, Homo Sapiens
ccagccuggcaacagagcuagaauccgucucaaacaaacaaacaaaaaaucccacagcuauugg

SEQ ID NO: 127213 - RNA, 64 nt, Homo Sapiens
ccuggcaacagagcuagaauccgucucaaacaaacaaacaaaaaaucccacagcuauuggauca

SEQ ID NO: 127214 - RNA, 64 nt, Homo Sapiens
gauuuuauuaaagauauuuucaaaacaaaacaaacaaacaaaaaugggugacagacucugucuc

SEQ ID NO: 127215 - RNA, 64 nt, Homo Sapiens
aaaagauuuuauuaaagauaucuccaaaacaaaacaaacaaacaaaccugggugacagacucug

SEQ ID NO: 127216 - RNA, 64 nt, Homo Sapiens
acagaaacaaaaucuguaaacauccacaaacaaacaaacaaauagucuuguuugauaauguggg

SEQ ID NO: 127217 - RNA, 64 nt, Homo Sapiens
aauaacagaaacaaaaucugugggcauccacaaacaaacaaacaauuggucuuguuugauaaug

SEQ ID NO: 127218 - RNA, 64 nt, Homo Sapiens
aacaaauaacagaaacaaaaaaugugggcauccacaaacaaacacauaauuggucuuguuugau

SEQ ID NO: 127219 - RNA, 64 nt, Homo Sapiens
acaaccuuagcauuaagaaauguaaacaaacaaacaaacaaaaaacuaagaagccuuaauacuc

SEQ ID NO: 127220 - RNA, 64 nt, Homo Sapiens
aaaaacaaccuuagcauuaaacucuguaaacaaacaaacaaacacuuuacuaagaagccuuaau

SEQ ID NO: 127221 - RNA, 64 nt, Homo Sapiens
aacaaaaaacaaccuuagcauaauacucuguaaacaaacaaacacaagcuuuacuaagaagccu

SEQ ID NO: 127222 - RNA, 64 nt, Homo Sapiens
ggaaauaguuguugaauagucugaauuauaucugcaaacaaaauauucaaauggaaggaaccac

SEQ ID NO: 127223 - RNA, 64 nt, Homo Sapiens
uggaaauguacauauccaauaugaaauacuaaaacaaacaaacaaacaaaaaaccagaaugcau

SEQ ID NO: 127224 - RNA, 64 nt, Homo Sapiens
aauguacauauccaauaugaaauacuaaaacaaacaaacaaacaaaaaaccagaaugcauugua

SEQ ID NO: 127225 - RNA, 64 nt, Homo Sapiens
uacauauccaauaugaaauacuaaaacaaacaaacaaacaaaaaaccagaaugcauuguauagg

SEQ ID NO: 127226 - RNA, 64 nt, Homo Sapiens
gaaagacugcaguugugcuaaaaacaaaacaaaacaaacaaacaaacaaaaaaguaaaaaaaga

SEQ ID NO: 127227 - RNA, 64 nt, Homo Sapiens
gacugcaguugugcuaaaaacaaaacaaaacaaacaaacaaacaaaaaaguaaaaaaagauuac

SEQ ID NO: 127228 - RNA, 64 nt, Homo Sapiens
gcaguugugcuaaaaacaaaacaaaacaaacaaacaaacaaaaaaguaaaaaaagauuacuuuc

SEQ ID NO: 127229 - RNA, 64 nt, Homo Sapiens
aagggugggggagggagggaaacaaacaaacaaacaaacaaaaauguaugacacccagcuuuaa

SEQ ID NO: 127230 - RNA, 64 nt, Homo Sapiens
aaaaaagggugggggagggauuaaaacaaacaaacaaacaaacagaaauguaugacacccagcu

SEQ ID NO: 127231 - RNA, 64 nt, Homo Sapiens
aacaaaaaaagggugggggaagcuuuaaaacaaacaaacaaacacucugaaauguaugacaccc

SEQ ID NO: 127232 - RNA, 64 nt, Homo Sapiens
aacaaacaaaaaaaggguggacccagcuuuaaaacaaacaaacaugcucucugaaauguaugac

SEQ ID NO: 127233 - RNA, 64 nt, Homo Sapiens
gaugaacuuugauuugaacaaacaaaaguuguuccaaacaaaauacgugaccauuugauucuca

SEQ ID NO: 127234 - RNA, 64 nt, Homo Sapiens
uuguuccaaacaaaaugauggaccauuugauucucaaacaaaagauuuguuuugucauuuacgu

SEQ ID NO: 127235 - RNA, 64 nt, Homo Sapiens
agauauugcaguuguguugucaaaaacaaacaaacaaacaaaaauggcgaaauccccgucuuua

SEQ ID NO: 127236 - RNA, 64 nt, Homo Sapiens
aaaaagauauugcaguuguguuuacaaaaacaaacaaacaaacaaacguggcgaaauccccguc

SEQ ID NO: 127237 - RNA, 64 nt, Homo Sapiens
aacaaaaaagauauugcagucgucuuuacaaaaacaaacaaacagggcaacguggcgaaauccc

SEQ ID NO: 127238 - RNA, 64 nt, Homo Sapiens
accuucaacugccuuaugccaaaacaaacacaaacaaacaaaaauugaaagaacaaaacaaaac

SEQ ID NO: 127239 - RNA, 64 nt, Homo Sapiens
aaaaaccuucaacugccuuaaaacaaaacaaacacaaacaaacacugauugaaagaacaaaaca

SEQ ID NO: 127240 - RNA, 64 nt, Homo Sapiens
agccauagagagcagaacuuaauuuuaaaacaaacaaacaaaaauguauuuucucuggcuuuaa

SEQ ID NO: 127241 - RNA, 64 nt, Homo Sapiens
aaaaagccauagagagcagauuaaaauuuuaaaacaaacaaacauguguguauuuucucuggcu

SEQ ID NO: 127242 - RNA, 64 nt, Homo Sapiens
uaggaguauaggaacugcugguucuacaagcaaacaaacaaaaacacuuacaucucucuaugcu

SEQ ID NO: 127243 - RNA, 64 nt, Homo Sapiens
aaaauaggaguauaggaacuugcuguucuacaagcaaacaaacacuagcacuuacaucucucua

SEQ ID NO: 127244 - RNA, 64 nt, Homo Sapiens
accagccugggugacagagugaaacucguaucuccaaacaaacaaacaaaaaguccuuaaacau

SEQ ID NO: 127245 - RNA, 64 nt, Homo Sapiens
gccugggugacagagugaaacucguaucuccaaacaaacaaacaaaaaguccuuaaacauaugu

SEQ ID NO: 127246 - RNA, 64 nt, Homo Sapiens
gggugacagagugaaacucguaucuccaaacaaacaaacaaaaaguccuuaaacauaugugaac

SEQ ID NO: 127247 - RNA, 64 nt, Homo Sapiens
cuugcaaagcgcuggguucuuuccugcugucaaacaaacaaaacgggggacccuccccagccca

SEQ ID NO: 127248 - RNA, 64 nt, Homo Sapiens
aaaccuugcaaagcgcugggcccauuccugcugucaaacaaacauugcgggggacccuccccag

SEQ ID NO: 127249 - RNA, 64 nt, Homo Sapiens
uguuaagacuaaaauuuugccuauaccuuuaagacaaacaaacaaacacacacacaaacaagcu

SEQ ID NO: 127250 - RNA, 64 nt, Homo Sapiens
aagacuaaaauuuugccuauaccuuuaagacaaacaaacaaacacacacacaaacaagcucuaa

SEQ ID NO: 127251 - RNA, 64 nt, Homo Sapiens
uagcuucuugucuuaggccugaaccaaaaaacaacaaacaaacaaaaaacaagaaugaaaaaca

SEQ ID NO: 127252 - RNA, 64 nt, Homo Sapiens
uucuugucuuaggccugaaccaaaaaacaacaaacaaacaaaaaacaagaaugaaaaacagaaa

SEQ ID NO: 127253 - RNA, 64 nt, Homo Sapiens
acuucaggucuuaagugcaaaucaaagcaaaaaacaaacaaaacuuacauggaaaaacuguaag

SEQ ID NO: 127254 - RNA, 64 nt, Homo Sapiens
ggucucagaccuacaaagaguuaaaacaaacagacaaacaaaaaaaaacacuacuauuuuaaau

SEQ ID NO: 127255 - RNA, 64 nt, Homo Sapiens
uaccaauuccauacagagauggaaaaauacucagcaaacaaaguauggaagcuggagugugacu

SEQ ID NO: 127256 - RNA, 64 nt, Homo Sapiens
ucuuugugucuggacaccuguucaguaauuccuacaaacaaaaagggcugaaaacagcagcauu

SEQ ID NO: 127257 - RNA, 64 nt, Homo Sapiens
acccaaucugagucuuaucgucaaaacaaacaaacaaacaaaagcgacggagcgagacucuguc

SEQ ID NO: 127258 - RNA, 64 nt, Homo Sapiens
aaagacccaaucugagucuuugucucaaaacaaacaaacaaacaugggcgacggagcgagacuc

SEQ ID NO: 127259 - RNA, 64 nt, Homo Sapiens
aacaaaagacccaaucugagacucugucucaaaacaaacaaacaagccugggcgacggagcgag

SEQ ID NO: 127260 - RNA, 64 nt, Homo Sapiens
cucacugcaucgggacuuuuaaaauccaaacaaacaaacaaacaaacauaaaauauaaacaauc

SEQ ID NO: 127261 - RNA, 64 nt, Homo Sapiens
aacacucacugcaucgggacaaucaaaauccaaacaaacaaacaacaaaacauaaaauauaaac

SEQ ID NO: 127262 - RNA, 64 nt, Homo Sapiens
aacaaacacucacugcaucgaaacaaucaaaauccaaacaaacacaaaacaaaacauaaaauau

SEQ ID NO: 127263 - RNA, 64 nt, Homo Sapiens
cccuuuggcuucugauuuuucucuuuuuuaaaaacaaacaaacaaacuguugcagauuaugagu

SEQ ID NO: 127264 - RNA, 64 nt, Homo Sapiens
uuggcuucugauuuuucucuuuuuuaaaaacaaacaaacaaacuguugcagauuaugagugaac

SEQ ID NO: 127265 - RNA, 64 nt, Homo Sapiens
guuuuuccaauuauaaauaacucagaaaaacaaacaaacaaacagugcuuguggucugugcuug

SEQ ID NO: 127266 - RNA, 64 nt, Homo Sapiens
aacaguuuuuccaauuauaacuugcucagaaaaacaaacaaacaugacgugcuuguggucugug

SEQ ID NO: 127267 - RNA, 64 nt, Homo Sapiens
gaaagcaccgucgagaaaugaaaacaaaaacaaacaaacaaacaacagagagagacuccaucuc

SEQ ID NO: 127268 - RNA, 64 nt, Homo Sapiens
aacagaaagcaccgucgagaucucaaaacaaaaacaaacaaacaggcgacagagagagacucca

SEQ ID NO: 127269 - RNA, 64 nt, Homo Sapiens
uaauuuuuaaaacuugcacaaaucaaaacaaacacaaacaaaauuguauuuuauccuguuggug

SEQ ID NO: 127270 - RNA, 64 nt, Homo Sapiens
agguguuucacuugcugagauuuccuguacauugcaaacaaauacagaaugcaaacccucaaag

SEQ ID NO: 127271 - RNA, 64 nt, Homo Sapiens
aaacauagacuucuuuauauuuuaaaaaaacaaacaaacaaaaagcaauuuuaaaacagacucc

SEQ ID NO: 127272 - RNA, 64 nt, Homo Sapiens
aaaaaaacauagacuucuuucuccuuuaaaaaaacaaacaaacaauaggcaauuuuaaaacaga

SEQ ID NO: 127273 - RNA, 64 nt, Homo Sapiens
aaacaccucaccaugagugcaaaacaaaaacaaacaaacaaaaagacucugucucaaaaaaaaa

SEQ ID NO: 127274 - RNA, 64 nt, Homo Sapiens
aaaaaaacaccucaccaugaaaaaaaaacaaaaacaaacaaacaguaagacucugucucaaaaa

SEQ ID NO: 127275 - RNA, 64 nt, Homo Sapiens
gccuguccacccuugagaauaaaaaacaaacaaacaaacaaaaaacuuccuugaaaauuuuauu

SEQ ID NO: 127276 - RNA, 64 nt, Homo Sapiens
aaaagccuguccacccuugauauuaaaaaacaaacaaacaaacaaaucacuuccuugaaaauuu

SEQ ID NO: 127277 - RNA, 64 nt, Homo Sapiens
aacaaaaagccuguccacccauuuuauuaaaaaacaaacaaacaaagaaaucacuuccuugaaa

SEQ ID NO: 127278 - RNA, 64 nt, Homo Sapiens
caaauucgaacauucuuaggcucaguugcacgugcaaacaaaucacaacuaauguuaauaagau

SEQ ID NO: 127279 - RNA, 64 nt, Homo Sapiens
uuaaagagauaagcauuaaauugacauuauacugcaaacaaaacuugugcugggacugcuauac

SEQ ID NO: 127280 - RNA, 64 nt, Homo Sapiens
acauucccuagauucaaaggcaaaacagaagaaacaaacaaacaaacaaaaaaagcuugcaaaa

SEQ ID NO: 127281 - RNA, 64 nt, Homo Sapiens
ucccuagauucaaaggcaaaacagaagaaacaaacaaacaaacaaaaaaagcuugcaaaauauu

SEQ ID NO: 127282 - RNA, 64 nt, Homo Sapiens
uagauucaaaggcaaaacagaagaaacaaacaaacaaacaaaaaaagcuugcaaaauauuuuau

SEQ ID NO: 127283 - RNA, 64 nt, Homo Sapiens
guguucuuuugccuucaaucuguugucuucaaaacaaacaaacaaaaaaagcuucuugcgccuu

SEQ ID NO: 127284 - RNA, 64 nt, Homo Sapiens
ucuuuugccuucaaucuguugucuucaaaacaaacaaacaaaaaaagcuucuugcgccuuuccc

SEQ ID NO: 127285 - RNA, 64 nt, Homo Sapiens
aaacaauucuucauucagaaauccuaaaaacaaacaaacaaaaaaaaaaaaaaaaaaaaaaaaa

SEQ ID NO: 127286 - RNA, 64 nt, Homo Sapiens
aaaaaaacaauucuucauucaaaaauccuaaaaacaaacaaacaaaaaaaaaaaaaaaaaaaaa

SEQ ID NO: 127287 - RNA, 64 nt, Homo Sapiens
caggauaauuuuuaaaccaaucaaaugaaaaaaacaaacaaacaaaaaaggaaaugucauguga

SEQ ID NO: 127288 - RNA, 64 nt, Homo Sapiens
auaauuuuuaaaccaaucaaaugaaaaaaacaaacaaacaaaaaaggaaaugucaugugagguu

SEQ ID NO: 127289 - RNA, 64 nt, Homo Sapiens
augacagagugagacccuguuucuaaaaacaaaacaaacaaacaaacaaacaacguaucuuacu

SEQ ID NO: 127290 - RNA, 64 nt, Homo Sapiens
cagagugagacccuguuucuaaaaacaaaacaaacaaacaaacaaacaacguaucuuacugacu

SEQ ID NO: 127291 - RNA, 64 nt, Homo Sapiens
gugagacccuguuucuaaaaacaaaacaaacaaacaaacaaacaacguaucuuacugacuaaac

SEQ ID NO: 127292 - RNA, 64 nt, Homo Sapiens
acuccuccuaccccccaagguaagaaacaaaaaacaaacaaacaaacaaaaauagaagacaaaa

SEQ ID NO: 127293 - RNA, 64 nt, Homo Sapiens
cuccuaccccccaagguaagaaacaaaaaacaaacaaacaaacaaaaauagaagacaaaagaaa

SEQ ID NO: 127294 - RNA, 64 nt, Homo Sapiens
uaccccccaagguaagaaacaaaaaacaaacaaacaaacaaaaauagaagacaaaagaaagaca

SEQ ID NO: 127295 - RNA, 64 nt, Homo Sapiens
gugacagagcaagaccccaucucaaaaaaaaaaacaaacaaacaaaaaaaaaaccauauauaua

SEQ ID NO: 127296 - RNA, 64 nt, Homo Sapiens
cagagcaagaccccaucucaaaaaaaaaaacaaacaaacaaaaaaaaaaccauauauauacaua

SEQ ID NO: 127297 - RNA, 64 nt, Homo Sapiens
acaagacaaacaacuacaaaaacaaagaaacaaacaaacaaaaauauauaucuauauaaauuaa

SEQ ID NO: 127298 - RNA, 64 nt, Homo Sapiens
aaaaacaagacaaacaacuauuaaaacaaagaaacaaacaaacaaauauauauaucuauauaaa

SEQ ID NO: 127299 - RNA, 64 nt, Homo Sapiens
gcacuccggccugggcaacagaggaagacugccucaaacaaacaaaaaacaacaaaccaaacca

SEQ ID NO: 127300 - RNA, 64 nt, Homo Sapiens
uccggccugggcaacagaggaagacugccucaaacaaacaaaaaacaacaaaccaaaccaaacc

SEQ ID NO: 127301 - RNA, 64 nt, Homo Sapiens
gucauuuuguuuuaugacagacacacguaucuaacaaacaaacaaacagugaccuucuccaugg

SEQ ID NO: 127302 - RNA, 64 nt, Homo Sapiens
uuuuguuuuaugacagacacacguaucuaacaaacaaacaaacagugaccuucuccauggguca

SEQ ID NO: 127303 - RNA, 64 nt, Homo Sapiens
uaagguuuucuggcuuauugaggaaauuuccuaacaaacaaacaaacaaacaaacagaagagaa

SEQ ID NO: 127304 - RNA, 64 nt, Homo Sapiens
guuuucuggcuuauugaggaaauuuccuaacaaacaaacaaacaaacaaacagaagagaagauc

SEQ ID NO: 127305 - RNA, 64 nt, Homo Sapiens
ucuggcuuauugaggaaauuuccuaacaaacaaacaaacaaacaaacagaagagaagaucauua

SEQ ID NO: 127306 - RNA, 64 nt, Homo Sapiens
gcuuauugaggaaauuuccuaacaaacaaacaaacaaacaaacagaagagaagaucauuaacca

SEQ ID NO: 127307 - RNA, 64 nt, Homo Sapiens
ugggcgacagaucaagacucugucacacacaaaacaaacaaacaaauuuucccguuucucucug

SEQ ID NO: 127308 - RNA, 64 nt, Homo Sapiens
cgacagaucaagacucugucacacacaaaacaaacaaacaaauuuucccguuucucucuguccc

SEQ ID NO: 127309 - RNA, 64 nt, Homo Sapiens
aaacccaacaacaacccagaaaaaccaaaacaaacaaacaaaaagcaccacggcaagaaaacca

SEQ ID NO: 127310 - RNA, 64 nt, Homo Sapiens
aaaaaaacccaacaacaaccaccaaaaaccaaaacaaacaaacauuuugcaccacggcaagaaa

SEQ ID NO: 127311 - RNA, 64 nt, Homo Sapiens
guguguauuugauggcucuaagggcuauaaauuacaaacaaaacacaucccagacauuaggagu

SEQ ID NO: 127312 - RNA, 64 nt, Homo Sapiens
augggguguaccuguuuaucuguuaacuauuauccaaacaaauuaaauacugugguugccucua

SEQ ID NO: 127313 - RNA, 64 nt, Homo Sapiens
aaauacuguggaugccuuuacuguaacuguuauccaaacaaauuuaugggguguaccuguuuau

SEQ ID NO: 127314 - RNA, 64 nt, Homo Sapiens
acaucccagacauuaggaguagggcuauaaauuacaaacaaaacguguguauuugauggcucca

SEQ ID NO: 127315 - RNA, 64 nt, Homo Sapiens
accuugaaucaaguuuguuuuuaaaaaaacaaaacaaacaaaacucuuucuuuuuccuuuuuuu

SEQ ID NO: 127316 - RNA, 64 nt, Homo Sapiens
agggacauuuaugugcaguucacaaccaauaacucaaacaaaaauaugcaaaaaggaaaacaca

SEQ ID NO: 127317 - RNA, 64 nt, Homo Sapiens
ucagucuuagucucuugcuagaagguaaaacaaacaaacaaacacaauuuaagacuaagacuuu

SEQ ID NO: 127318 - RNA, 64 nt, Homo Sapiens
aacaucagucuuagucucuucuuugaagguaaaacaaacaaacauugucaauuuaagacuaaga

SEQ ID NO: 127319 - RNA, 64 nt, Homo Sapiens
aggggggagcagguuuuauguuuacauucacaaacaaacaaagggaaagagacuuugccucacu

SEQ ID NO: 127320 - RNA, 64 nt, Homo Sapiens
aaggaggggggagcagguuucacuuuuacauucacaaacaaacacacggaaagagacuuugccu

SEQ ID NO: 127321 - RNA, 64 nt, Homo Sapiens
aggauggaggaagaucuacgaagcaaauggaaaacaaacaaaaaaagaggcagggguugcaauc

SEQ ID NO: 127322 - RNA, 64 nt, Homo Sapiens
acaaagggcuaauauccagaaucuacaaugaacucaaacaaauuuacaggaacaaacaacccca

SEQ ID NO: 127323 - RNA, 64 nt, Homo Sapiens
aguuccaaaauuuaaucacuaauuaaaaaucuaucaaacaaaacucuggaccagacagauuuau

SEQ ID NO: 127324 - RNA, 64 nt, Homo Sapiens
ugacaaagaucuaauccagaaucuauaaagaacucaaacaaaucaacaaugagaaaaacaaccc

SEQ ID NO: 127325 - RNA, 64 nt, Homo Sapiens
gagccagugggggagggaggcccgucucaacaaacaaacaaaaaccugggcaacagagggagcc

SEQ ID NO: 127326 - RNA, 64 nt, Homo Sapiens
aaaagagccagugggggaggagcccccgucucaacaaacaaacaccagccugggcaacagaggg

SEQ ID NO: 127327 - RNA, 64 nt, Homo Sapiens
gaaagccuggcgauaccccaucucuauuuagaaacaaacaaacaaacaaauaaaaaaccuggca

SEQ ID NO: 127328 - RNA, 63 nt, Homo Sapiens
gccuggcgauaccccaucucuauuuagaaacaaacaaacaaacaaauaaaaaaccuggcaccu

SEQ ID NO: 127329 - RNA, 64 nt, Homo Sapiens
ccugagugacagagcgagacccugucucaaaaaacaaacaaacaaacaaacaaaaacagaacau

SEQ ID NO: 127330 - RNA, 64 nt, Homo Sapiens
agugacagagcgagacccugucucaaaaaacaaacaaacaaacaaacaaaaacagaacauucug

SEQ ID NO: 127331 - RNA, 64 nt, Homo Sapiens
acagagcgagacccugucucaaaaaacaaacaaacaaacaaacaaaaacagaacauucugggca

SEQ ID NO: 127332 - RNA, 64 nt, Homo Sapiens
agcgagacccugucucaaaaaacaaacaaacaaacaaacaaaaacagaacauucugggcacggu

SEQ ID NO: 127333 - RNA, 64 nt, Homo Sapiens
acuuucauauugcaacaauccuugauauuucuaucaaacaaaugcaguguguuugacaagacag

SEQ ID NO: 127334 - RNA, 64 nt, Homo Sapiens
gaucccugcauuuccugaaggugucuuaaaauuccaaacaaaauuaaauacuauguguucuggu

SEQ ID NO: 127335 - RNA, 64 nt, Homo Sapiens
acacaaaaaaaaccacucuuucucaaaaaacaaacaaacaaaaagcuucaauuagaauuauuuu

SEQ ID NO: 127336 - RNA, 64 nt, Homo Sapiens
aaaaacacaaaaaaaaccacuuuuucucaaaaaacaaacaaacaugaggcuucaauuagaauua

SEQ ID NO: 127337 - RNA, 64 nt, Homo Sapiens
aagaagacauugcuggaguugacuuucuucuguccaaacaaacaaacaaaaacuaaacacacac

SEQ ID NO: 127338 - RNA, 64 nt, Homo Sapiens
agacauugcuggaguugacuuucuucuguccaaacaaacaaacaaaaacuaaacacacacacaa

SEQ ID NO: 127339 - RNA, 64 nt, Homo Sapiens
auugcuggaguugacuuucuucuguccaaacaaacaaacaaaaacuaaacacacacacaaaccc

SEQ ID NO: 127340 - RNA, 64 nt, Homo Sapiens
agccuggugacagaacgagacucugucuuaaaaacaaacaaacaaaaaaaaaaucuguuagaua

SEQ ID NO: 127341 - RNA, 64 nt, Homo Sapiens
uggugacagaacgagacucugucuuaaaaacaaacaaacaaaaaaaaaaucuguuagauaagcu

SEQ ID NO: 127342 - RNA, 64 nt, Homo Sapiens
aagaaagaacauuggacaugaacaaacaaacaaacaaacaaauaccagacuccgucucuaaaca

SEQ ID NO: 127343 - RNA, 64 nt, Homo Sapiens
aauaaagaaagaacauuggaaacaaacaaacaaacaaacaaacaagagccagacuccgucucua

SEQ ID NO: 127344 - RNA, 64 nt, Homo Sapiens
aacaaauaaagaaagaacauucuaaacaaacaaacaaacaaacacaacagagccagacuccguc

SEQ ID NO: 127345 - RNA, 64 nt, Homo Sapiens
aacaaacaaauaaagaaagacgucucuaaacaaacaaacaaacaugggcaacagagccagacuc

SEQ ID NO: 127346 - RNA, 64 nt, Homo Sapiens
aacaaacaaacaaauaaagaacuccgucucuaaacaaacaaacaagccugggcaacagagccag

SEQ ID NO: 127347 - RNA, 64 nt, Homo Sapiens
gagaaaaaucccagccagggcaguguuuugcaaacaaacaaaaaaggaggcaauaaucuuuuaa

SEQ ID NO: 127348 - RNA, 64 nt, Homo Sapiens
aaaagagaaaaaucccagccuuaacaguguuuugcaaacaaacaauauaggaggcaauaaucuu

SEQ ID NO: 127349 - RNA, 64 nt, Homo Sapiens
aaaacacaaaaaaagaaagagaaaaacaaacaaacaaacaaaaacucuauagcaagaugaagag

SEQ ID NO: 127350 - RNA, 64 nt, Homo Sapiens
aaaaaaaacacaaaaaaagaagaggaaaaacaaacaaacaaacaggaacucuauagcaagauga

SEQ ID NO: 127351 - RNA, 64 nt, Homo Sapiens
aacaaaaaaaaacacaaaaaaugaagaggaaaaacaaacaaacauagaggaacucuauagcaag

SEQ ID NO: 127352 - RNA, 64 nt, Homo Sapiens
uguugauaaugggcuuuguuagcacuuuuuaaaacaaacaaacaaacaaaacaaaaaagcaaac

SEQ ID NO: 127353 - RNA, 64 nt, Homo Sapiens
gauaaugggcuuuguuagcacuuuuuaaaacaaacaaacaaacaaaacaaaaaagcaaaccaca

SEQ ID NO: 127354 - RNA, 64 nt, Homo Sapiens
augggcuuuguuagcacuuuuuaaaacaaacaaacaaacaaaacaaaaaagcaaaccacauuug

SEQ ID NO: 127355 - RNA, 64 nt, Homo Sapiens
auuccaucugaaaaacaaaaacaaaaacagaaaacaaacaaacaaaaaacaaaaaauccccaca

SEQ ID NO: 127356 - RNA, 64 nt, Homo Sapiens
caucugaaaaacaaaaacaaaaacagaaaacaaacaaacaaaaaacaaaaaauccccacaacuu

SEQ ID NO: 127357 - RNA, 64 nt, Homo Sapiens
aaaaaacucagccaacagguaguauugguaaaaacaaacaaacaaaaauccuuugcccucagaa

SEQ ID NO: 127358 - RNA, 64 nt, Homo Sapiens
aacucagccaacagguaguauugguaaaaacaaacaaacaaaaauccuuugcccucagaagugc

SEQ ID NO: 127359 - RNA, 64 nt, Homo Sapiens
uugcucaaaaaagaggagaaaauauauaaacaaacaaacaaaaauugguggauuagacagguua

SEQ ID NO: 127360 - RNA, 64 nt, Homo Sapiens
aaaauugcucaaaaaagaggguuaaauauauaaacaaacaaacacuucuugguggauuagacag

SEQ ID NO: 127361 - RNA, 64 nt, Homo Sapiens
uugcaucuaaccaaaaagucacaaaacaaacaaacaaacaaaacccaucucaaaacaaaacaaa

SEQ ID NO: 127362 - RNA, 64 nt, Homo Sapiens
aaacuugcaucuaaccaaaacaaaacaaaacaaacaaacaaacaaacuccaucucaaaacaaaa

SEQ ID NO: 127363 - RNA, 64 nt, Homo Sapiens
aacaaaacuugcaucuaaccaaaacaaaacaaaacaaacaaacaacgaaacuccaucucaaaac

SEQ ID NO: 127364 - RNA, 64 nt, Homo Sapiens
uaugugaauuguguuguuuuauguuuugucggggcaaacaaaauaaacaaaauuaacugcuuaa

SEQ ID NO: 127365 - RNA, 64 nt, Homo Sapiens
aaaacaaaacaaaauuaacuuuguucuucaaaaacaaacaaaacgaaaauguaaaagaccacaa

SEQ ID NO: 127366 - RNA, 64 nt, Homo Sapiens
ggcagaguucacuauucuauucagugacauuuaccaaacaaacacacccaaaaguucaaauuug

SEQ ID NO: 127367 - RNA, 64 nt, Homo Sapiens
uauugucggcaggcggugagggguagaaaaaaaacaaacaaacaaacagaaaaaaaaaccaaaa

SEQ ID NO: 127368 - RNA, 64 nt, Homo Sapiens
gucggcaggcggugagggguagaaaaaaaacaaacaaacaaacagaaaaaaaaaccaaaaaaaa

SEQ ID NO: 127369 - RNA, 64 nt, Homo Sapiens
uuguaaaaaauaaaaauguauauagcugugagcucaaacaaaaacugcagacaaacaaaaaaga

SEQ ID NO: 127370 - RNA, 64 nt, Homo Sapiens
guauauagcugugagcucaaacaaaaacugcagacaaacaaaaaagagaaaagcuuuuauuugu

SEQ ID NO: 127371 - RNA, 64 nt, Homo Sapiens
gaaauuuugccuuuccacgcuucccucaguucaccaaaguuaccaaaauguaaaauaaaauaag

SEQ ID NO: 127372 - RNA, 64 nt, Homo Sapiens
ugguuaucaccuucaauaguuucaauaugucccccaaaguuauguguuugaaacuugcaauagu

SEQ ID NO: 127373 - RNA, 64 nt, Homo Sapiens
cuguauuguaauaaguauacucuguuauagucaacaaaguuaaauccaaauucaaaauuaucca

SEQ ID NO: 127374 - RNA, 64 nt, Homo Sapiens
uguuauaaugugguguaucacauggauuauaaagcaaaguuauggucgauuucuauucuugaaa

SEQ ID NO: 127375 - RNA, 64 nt, Homo Sapiens
uggcauuguacucaauggauuugaugcuguuugacaaaguuacugauucacugcauggcuccca

SEQ ID NO: 127376 - RNA, 64 nt, Homo Sapiens
auuugcacuggaguucuaugcucucgcaccuuuccaaaguuaacagauuuugggguuguguugu

SEQ ID NO: 127377 - RNA, 64 nt, Homo Sapiens
cccgcacgccaggcccaguucgcuaguguuaugucaaaguuaaguuuccugggucuaaaauaau

SEQ ID NO: 127378 - RNA, 64 nt, Homo Sapiens
ucaaaaagaggcgcuagaucgaaagcacagaggacaaaguuaauagccaagaccuuaauuccag

SEQ ID NO: 127379 - RNA, 64 nt, Homo Sapiens
ggacaugcggucugcagugccacauccagcuacgcaaaguuacuaaacaggaccaaugagaggc

SEQ ID NO: 127380 - RNA, 64 nt, Homo Sapiens
uuuccccucaccucuggaauuaaagaaggaacuccaaaguuacugaaaucucagggcaugaaca

SEQ ID NO: 127381 - RNA, 64 nt, Homo Sapiens
cacaaucaacagugguuuuauuuuuuccucuacucaaaguuaaaacugaccaaaguuacuggcu

SEQ ID NO: 127382 - RNA, 64 nt, Homo Sapiens
uuuauuuuuuccucuacucaaaguuaaaacugaccaaaguuacuggcuuuuuacuuugcuagaa

SEQ ID NO: 127383 - RNA, 64 nt, Homo Sapiens
agggacacucugcuaguuuugaauaaguaaccaucaaaguuacuaaaacauggccaggcgcagu

SEQ ID NO: 127384 - RNA, 64 nt, Homo Sapiens
acagagcgagaaccugucucaaaaaaaacaaaaacaaaguuacuaaaaugucaccuucacagaa

SEQ ID NO: 127385 - RNA, 64 nt, Homo Sapiens
uguucauuaaaugcagucaugugacaacuguguucaaaguuagaaauaguggucggggaggcuu

SEQ ID NO: 127386 - RNA, 64 nt, Homo Sapiens
ccuagagcaauuuagagcuaaaaccaguaauaagcaaaguuauugguuauaagcaagguauaag

SEQ ID NO: 127387 - RNA, 64 nt, Homo Sapiens
uuauugguuauaagcaagguauaagcaguuaaagcaaaguuauuaauuauuaauauaugagaau

SEQ ID NO: 127388 - RNA, 64 nt, Homo Sapiens
uuuuugcuucucagcuuuuugcuguuuaacaaaucaaaguuagcgguuuuguggcauaugaaua

SEQ ID NO: 127389 - RNA, 64 nt, Homo Sapiens
gcuguuggaacugaacaauaugugucaaguuacucaaaguuauuuguaguguauuuaugugaua

SEQ ID NO: 127390 - RNA, 64 nt, Homo Sapiens
uuuacacaacccggauauguuguauauuuugacccaaaguuacagguagguuuaagagaauuuu

SEQ ID NO: 127391 - RNA, 64 nt, Homo Sapiens
uugacaaaggaggaggaaacgauuacucuguaaacaaaguuauccuuacuugggagauugccac

SEQ ID NO: 127392 - RNA, 64 nt, Homo Sapiens
acuggaaaaacacuauaaguuuucuucuggguggcaaaguuacuuuguagccuugcugcuugcu

SEQ ID NO: 127393 - RNA, 64 nt, Homo Sapiens
uuaaauuaggggccuuugguuucuggagguucagcaaaguuaugccuggccaacuuaaagauuu

SEQ ID NO: 127394 - RNA, 64 nt, Homo Sapiens
uguauuuauguauguaaauaaagaguugcaucaacaaaguuaauggcucuuuuuuuccuuccag

SEQ ID NO: 127395 - RNA, 64 nt, Homo Sapiens
uguaucacauugaagaaggcuucuugauaguagccaaaguuaaaaaguacuacauuuucuuuug

SEQ ID NO: 127396 - RNA, 64 nt, Homo Sapiens
ugacagccuuucuauauuaaaggcucaggaugucacggagaaucuaucuaaucccacuguauua

SEQ ID NO: 127397 - RNA, 64 nt, Homo Sapiens
cugugucuggcaccucucuccugcaggauugcuuacggagaacuucugcacccagggggcggcu

SEQ ID NO: 127398 - RNA, 64 nt, Homo Sapiens
cccgucucuacuaaaaauacccagccugaccaacacggagaaaccugaguucgggaguucaaga

SEQ ID NO: 127399 - RNA, 64 nt, Homo Sapiens
auagagguccucauggguccagagaaccucagguacggagaagacuugcaacuucuuucuguug

SEQ ID NO: 127400 - RNA, 64 nt, Homo Sapiens
caaguuuacaucaagauaaacccugagaagaacuacggagaaaucaaauaaaauccugucauau

SEQ ID NO: 127401 - RNA, 64 nt, Homo Sapiens
guugcccaaacuugguucuccaguucaaauaagcacggagaaguaaaucccauauguugggcaa

SEQ ID NO: 127402 - RNA, 64 nt, Homo Sapiens
gucugacucagagaaagugguccuagaaaauaugacggagaaaacaaaagauggaauuugcccu

SEQ ID NO: 127403 - RNA, 64 nt, Homo Sapiens
ugaaaaaaauuauuccuaaacucucuaaguguggacggagaaugagcaagccccagaaguauuu

SEQ ID NO: 127404 - RNA, 64 nt, Homo Sapiens
cagaaggagagauugauccaugucuguuuguaggacggagaaaccgcuuggguaacuuguucaa

SEQ ID NO: 127405 - RNA, 64 nt, Homo Sapiens
agucaguauucuuaugccaugagggcuuucuuaaacggagaauaaaugaccugguaucuugcca

SEQ ID NO: 127406 - RNA, 64 nt, Homo Sapiens
cuagcugcuccuuuuucaccuggugugcaggucaacggagaauaccuugccgccugcugaaaca

SEQ ID NO: 127407 - RNA, 64 nt, Homo Sapiens
uuagaauuuccagucuaaauggcacaggguaguuacggagaaaaggggauggagaaggagaaac

SEQ ID NO: 127408 - RNA, 64 nt, Homo Sapiens
ugaacugagaagguaagaaaucaucaauugagguacggagaaacuugcuaggucauaccagaaa

SEQ ID NO: 127409 - RNA, 64 nt, Homo Sapiens
guggauuggagaaauuggggggaaauagaagaguacggagaaaggaagagauugaaaauguuac

SEQ ID NO: 127410 - RNA, 64 nt, Homo Sapiens
uacagaaaaaguuuucuaaccccugcucuagguuacggagaaaaaaaaaauggaauaauguucu

SEQ ID NO: 127411 - RNA, 64 nt, Homo Sapiens
cagggcagcaguacccccguuuggcacuugaggcacggagaagggaagggaaguccgcccagcc

SEQ ID NO: 127412 - RNA, 64 nt, Homo Sapiens
aggagaacaaccaaagcagcuuacagacgccugaacggagaaugaaguguuucaaguaagcgag

SEQ ID NO: 127413 - RNA, 64 nt, Homo Sapiens
ucaucauuuuuauacaggaccuguuguacguacuacggagaaacgccuacguucucuuuaaaag

SEQ ID NO: 127414 - RNA, 64 nt, Homo Sapiens
aaagggggggcuauggaagagcgguagggaguccacggagaagaugcagugaaugcuugcaugc

SEQ ID NO: 127415 - RNA, 64 nt, Homo Sapiens
cuucggagaagugaaauauaacauuacucaguggacggagaaaucuguuuuguuacagagacau

SEQ ID NO: 127416 - RNA, 64 nt, Homo Sapiens
ccagauccacaguugccaaacguugcaggaccgcacggagaagaugaaggagaucguagggugg

SEQ ID NO: 127417 - RNA, 64 nt, Homo Sapiens
ccuaucucuacuaaaaauacccagccugaccaacacggagaaaccugagguugggaguucgaga

SEQ ID NO: 127418 - RNA, 64 nt, Homo Sapiens
cuccaggagggccuguccauagacgcgggagcccacggagaacgccaaguccaaauccugaagg

SEQ ID NO: 127419 - RNA, 62 nt, Homo Sapiens
ugucuuuguucuuggagagguggagugacuguucacggagaaugcacggcauggggaugaac

SEQ ID NO: 127420 - RNA, 64 nt, Homo Sapiens
guccacucuucugcaguauccucccuggcagaacacggagaaucaggauuucuuaaauacucaa

SEQ ID NO: 127421 - RNA, 64 nt, Homo Sapiens
uucugggaguucucuggcuucacgaagcauguuuacggagaaaacuacaaccuaucaguaccca

SEQ ID NO: 127422 - RNA, 51 nt, Homo Sapiens
cagagccugagcgugagugccacggagaagccggcccuugagaguagguga

SEQ ID NO: 127423 - RNA, 64 nt, Homo Sapiens
caaacuccgcaucuguggguucucccgcacgaggacggagaacaacccacugcacuggccuugc

SEQ ID NO: 127424 - RNA, 64 nt, Homo Sapiens
uggauaugaagaacuauugacuucuugggaaaaaacggagaaauauuaauuggaaaguugauuu

SEQ ID NO: 127425 - RNA, 64 nt, Homo Sapiens
guggggagggcugccucagcagguuucucagaccacggagaagugacuuuugggcccggggcca

SEQ ID NO: 127426 - RNA, 64 nt, Homo Sapiens
auaagcuauagacccgaggaaacucagagucggaacggagaaagguggacuggaaggggcccgu

SEQ ID NO: 127427 - RNA, 64 nt, Homo Sapiens
aguuguagcagagggaaaugcuggggauuggagaacggagaagaguggcuggaguauuaggggc

SEQ ID NO: 127428 - RNA, 60 nt, Homo Sapiens
aaaggaaucagcaacugcccaggcugaggcacggagaagacuuguuguaauuucaacuaa

SEQ ID NO: 127429 - RNA, 64 nt, Homo Sapiens
aaguauguaaaucccagcuuugaaaugaccaggaacggagaauggacaacagucaagcugugga

SEQ ID NO: 127430 - RNA, 64 nt, Homo Sapiens
cacucuuuauuuguuugggggcuggaggggggagacggagaaacagugaaaaguucggacucuc

SEQ ID NO: 127431 - RNA, 64 nt, Homo Sapiens
uaagguuaccuuugauguauuaaaacauucacuuacggagaauguccucuuccuuaauucuagu

SEQ ID NO: 127432 - RNA, 64 nt, Homo Sapiens
ugugcuagggagaaucugccugugaacugaacagacggagaagaccgcagaacuggcugcugcg

SEQ ID NO: 127433 - RNA, 64 nt, Homo Sapiens
ccagaacauaaauggccuccuuuugaaacaacucacggagaaaaagauuuuaagaucaaucccu

SEQ ID NO: 127434 - RNA, 64 nt, Homo Sapiens
gaggagcaugaagaguuguaagaugaggccaagaacggagaaggacaaccugugaugugggcag

SEQ ID NO: 127435 - RNA, 64 nt, Homo Sapiens
aggucccuauauugaccaaggggggcuggggcgcacggagaagcaggagagugcauggugcaga

SEQ ID NO: 127436 - RNA, 64 nt, Homo Sapiens
ucccggaccccagugcuggggugggggaagggggacggagaaugacucaggcagggccccaggg

SEQ ID NO: 127437 - RNA, 64 nt, Homo Sapiens
gucugguccugcuucuggcuacagccacccuggaacggagaaggcagcugacggggauugccuu

SEQ ID NO: 127438 - RNA, 64 nt, Homo Sapiens
uuuccuucccauggcugcaucuuaagauggaugcacggagaaaccgucugccuggcucccuguc

SEQ ID NO: 127439 - RNA, 64 nt, Homo Sapiens
gccacugggagugaggaagccagacuccagagacacggagaagaucaaacuggagcugcguuca

SEQ ID NO: 127440 - RNA, 64 nt, Homo Sapiens
gcucucuuuaauuauuucaauccugaaggccaaaacggagaacuuuccaugggcagauuucccu

SEQ ID NO: 127441 - RNA, 64 nt, Homo Sapiens
uagcagucucucuggauggcggagagugaaggagacggagaaacgcgccccaucccuuccgccg

SEQ ID NO: 127442 - RNA, 64 nt, Homo Sapiens
acaaacaccacccaggaacauuggacaccaggucacggagaaacuagauauuuggacaucaaau

SEQ ID NO: 127443 - RNA, 64 nt, Homo Sapiens
ggaagaggcugggauggucucagcucaguuagagacggagaaaggcaguaaugagggcaccgcg

SEQ ID NO: 127444 - RNA, 64 nt, Homo Sapiens
ggggagaggagcaggugggacccucaagaaaaugacggagaacaucccagacagaugggacuca

SEQ ID NO: 127445 - RNA, 64 nt, Homo Sapiens
cggcgcccgucaugaacgucucaggggccugcucacggagaaggguaccugcacaaggccgucu

SEQ ID NO: 127446 - RNA, 64 nt, Homo Sapiens
uuuuuucuacaauguauuugucaaacaauaaccagcaauuaaacgaagaauuguauuucaagau

SEQ ID NO: 127447 - RNA, 64 nt, Homo Sapiens
accaccaaucuuguuugucccuuuucugucgccagcaauuaaaguuuaaguacuaaacugcagc

SEQ ID NO: 127448 - RNA, 64 nt, Homo Sapiens
cauggagaaaaguagaaauauuaaagugcaggcugcaauuaaaauaaaaauuauugggaaagau

SEQ ID NO: 127449 - RNA, 64 nt, Homo Sapiens
ugugauuggcuuagguaauccuuaaaauaggguugcaauuaaaaauuuacugucuggcuuugcc

SEQ ID NO: 127450 - RNA, 64 nt, Homo Sapiens
gaaaucaucuaaagaguuaaaauuucagugaucugcaauuaauuacauuguggaagauuauuuu

SEQ ID NO: 127451 - RNA, 64 nt, Homo Sapiens
uauauuugcagacuauacauguuggauuaaaugggcaauuaaguuuuauaggaauuugcuuccu

SEQ ID NO: 127452 - RNA, 64 nt, Homo Sapiens
aauuuauggcucuauuuuguaguugcuuaauugggcaauuaaacuguugacuaaagaaucuggu

SEQ ID NO: 127453 - RNA, 64 nt, Homo Sapiens
aaguuaauuacugggccaaccuggaagacacucagcaauuaaugcuuauauauacaauuccaca

SEQ ID NO: 127454 - RNA, 64 nt, Homo Sapiens
ccacaucguuuucuguaguuaacagggcaaugcagcaauuaacccaagaugugggaaucagcau

SEQ ID NO: 127455 - RNA, 64 nt, Homo Sapiens
agcuaccuguagccagguaugcucuaaggauauugcaauuaagcuauaucagaugacacuggug

SEQ ID NO: 127456 - RNA, 61 nt, Homo Sapiens
aaaaaaaaauagcaaauuaguugaagauauggaaccuuauguuuguacauuauauaguauu

SEQ ID NO: 127457 - RNA, 59 nt, Homo Sapiens
auuguccacauccuucaugccaaaacgcagaaccuuaaguucauauccugucugacuag

SEQ ID NO: 127458 - RNA, 64 nt, Homo Sapiens
cacuugacgagagggugacuuaaaauagguauaauugggucauaaugugaugccuugcuuuuca

SEQ ID NO: 127459 - RNA, 64 nt, Homo Sapiens
aguuaccuucuuaaaauauggucccaguaugucuuugggucaccaguuaucucuguaauguucu

SEQ ID NO: 127460 - RNA, 64 nt, Homo Sapiens
ccacuguuugagucucauaguaaggccaguucaguugggucaugguacaaccauaugagccuug

SEQ ID NO: 127461 - RNA, 64 nt, Homo Sapiens
uuagauggucccccauggcaccccuagggccauguugggucaaggauucugugguuuggugggu

SEQ ID NO: 127462 - RNA, 64 nt, Homo Sapiens
ggggugggguggguuggugaacauucacuugaagagcaaggauuuagugaugguggaucuagag

SEQ ID NO: 127463 - RNA, 64 nt, Homo Sapiens
ucccuggccccgcccugcacccaccauguggaaaagcaaggauuuaaauccggcauugauguuu

SEQ ID NO: 127464 - RNA, 64 nt, Homo Sapiens
gcuguguguggguguguucccauauuuauuacacagcaaggacuugugugaacaaaugugacuc

SEQ ID NO: 127465 - RNA, 64 nt, Homo Sapiens
uuaucuucaggugaagaagacagagcucaucucuagcaaggaaucugccuaggaggcuguaugc

SEQ ID NO: 127466 - RNA, 64 nt, Homo Sapiens
uuaaaugagacuaguuuagauuauuuuauaucugagcaaggagugaagagccaucuuggcaggg

SEQ ID NO: 127467 - RNA, 64 nt, Homo Sapiens
ucauuuggagcucuugggucgacuuggaucccaaagcaaggagacaaggugcuggacuguuacu

SEQ ID NO: 127468 - RNA, 64 nt, Homo Sapiens
gauauuuucacaccuuaccucauuuaauacaacaagcaaggagguagacaauauugucuaccuu

SEQ ID NO: 127469 - RNA, 64 nt, Homo Sapiens
gccucaacggaauuuacaguucagaguccaaaauagcaaggaaguggugggaagaaggugagag

SEQ ID NO: 127470 - RNA, 64 nt, Homo Sapiens
uauuuuccagaaugacacccaaggagcaaggaacagcaaggaauccaggcaagcugugaucuga

SEQ ID NO: 127471 - RNA, 64 nt, Homo Sapiens
agcaaggaauuauuuuccagugugaucugaaaggagcaaggaacaggggucugaccaggcaagc

SEQ ID NO: 127472 - RNA, 64 nt, Homo Sapiens
aacuucaacucaaucccagggaagaugucagaucagcaaggagagaagcaaggaugagcagcau

SEQ ID NO: 127473 - RNA, 64 nt, Homo Sapiens
agcagcaugaagaugucagagcaaguguuugugaagcaaggauguaccucaguauuucagggca

SEQ ID NO: 127474 - RNA, 64 nt, Homo Sapiens
cauagaucacguuacaagcacuuggcucagguccagcaaggacagaugaacaaauuccugaguc

SEQ ID NO: 127475 - RNA, 64 nt, Homo Sapiens
aauuugcugccccccaccaguggcuucuagggaaagcaaggaccucacaugccaggugcccuag

SEQ ID NO: 127476 - RNA, 64 nt, Homo Sapiens
augacucagcacugucccuuagcagggaugacacagcaaggaugacucagcacugccccucagc

SEQ ID NO: 127477 - RNA, 64 nt, Homo Sapiens
augacacagcaaggaugacucagcacugccccucagcaaggaugacucagcacugccgcucaac

SEQ ID NO: 127478 - RNA, 64 nt, Homo Sapiens; identical to SEQ ID NO: 127476

SEQ ID NO: 127479 - RNA, 64 nt, Homo Sapiens; identical to SEQ ID NO: 127477

SEQ ID NO: 127480 - RNA, 64 nt, Homo Sapiens
augacucagcacugucccuuagcagugaugacacagcaaggaugacucagcacugccccucagc

SEQ ID NO: 127481 - RNA, 64 nt, Homo Sapiens; identical to SEQ ID NO: 127477

SEQ ID NO: 127482 - RNA, 64 nt, Homo Sapiens
augacucagcagugucccuuagcagcgaugacacagcaaggaugacucagcacugccccucacc

SEQ ID NO: 127483 - RNA, 64 nt, Homo Sapiens
augacucagcagggaugacucagcaccgccccucagcaaggaugacucagcagggaugauucag

SEQ ID NO: 127484 - RNA, 64 nt, Homo Sapiens
gaugcugggccgggcagacauuuaugcucugagcagcaaggaccauugggauggaggugggcac

SEQ ID NO: 127485 - RNA, 64 nt, Homo Sapiens
ccuggcacuuggcagguacuccuggauguugaugagcaaggaagagcaacggcccugucagcug

SEQ ID NO: 127486 - RNA, 64 nt, Homo Sapiens
ugcggccugcauggugggagcaguacugacagaaagcaaggacaggcucucucugccuagucua

SEQ ID NO: 127487 - RNA, 64 nt, Homo Sapiens
gcccuucauucagccuugcuccagucuuccagaaagcaaggacuuucacauaggcucucaggug

SEQ ID NO: 127488 - RNA, 64 nt, Homo Sapiens
augugaaggggagccagggaacguuucugaacuaagcaaggacaaauucagagacccugagcuu

SEQ ID NO: 127489 - RNA, 64 nt, Homo Sapiens
guuuggaggaggcaagacuggaggugggaaaauuagcaaggaggucugugaaauaauccaggag

SEQ ID NO: 127490 - RNA, 64 nt, Homo Sapiens
uaagcuggagccacaaugcaugaggcacacacacagcaaggaugacgcuguaaacauagcccac

SEQ ID NO: 127491 - RNA, 64 nt, Homo Sapiens
gacaugggggaugcgcucgggauuggugugaagaagcaaggacuguuagaggcaggcuuuauag

SEQ ID NO: 127492 - RNA, 64 nt, Homo Sapiens
gaauacauagccaccauugguaguacaccccaaaagcaaggauggcaugaugcuggugacucaa

SEQ ID NO: 127493 - RNA, 64 nt, Homo Sapiens
uuaaaagauuguguggucaaauauucaauuuaagagcaaggaaauucuuauaaauauaacaaua

SEQ ID NO: 127494 - RNA, 64 nt, Homo Sapiens
aagggcaguuuagggagagggguccacuugaagcagcaaggacaucauauuaaaaacaaaaagu

SEQ ID NO: 127495 - RNA, 64 nt, Homo Sapiens
cuaaauuucccuuuggcucaaaauaggcauucugagcaaggaucuguaggcaggcuguaccugc

SEQ ID NO: 127496 - RNA, 64 nt, Homo Sapiens
uaugcuauggauuuuuaauugcuccagacuagagccuccuuaccauugcuggaaacucagcugu

SEQ ID NO: 127497 - RNA, 64 nt, Homo Sapiens
uugcuggaaacucagcugugaagaaacuuucgagccuccuuauagcuagcaggcauucuuauaa

SEQ ID NO: 127498 - RNA, 64 nt, Homo Sapiens
guucucugcacacaauagguucaccaccccagggccuccuuauagcugaggcugagcuucugau

SEQ ID NO: 127499 - RNA, 64 nt, Homo Sapiens
cuaagcuaaaucuaggugagagggugggggucuuccuccuuacuuuguguuuugugaccucagc

SEQ ID NO: 127500 - RNA, 64 nt, Homo Sapiens
cuaugcguccuguuaauaaugauuugaugugguuccuccuuaaggcuagauaugucuggcugaa

SEQ ID NO: 127501 - RNA, 64 nt, Homo Sapiens
cucuguaagucgugacagccgccugccauuggguccuccuuaggugguguucagcugugcugau

SEQ ID NO: 127502 - RNA, 64 nt, Homo Sapiens
ccagacuguuucagcccagcccaucucagccaacccuccuuagacugagcugucagagcaagca

SEQ ID NO: 127503 - RNA, 64 nt, Homo Sapiens
uugcucugugcgccuuuuauuuguccuuaaacuaccuccuuagagcucugaaggggucuccuag

SEQ ID NO: 127504 - RNA, 64 nt, Homo Sapiens
cguuucaggacauggggcauagaaacugaggaguagcugagaggaagaugaagagaagcugaga

SEQ ID NO: 127505 - RNA, 64 nt, Homo Sapiens
aaacugaggaguagcugagaggaagaugaagagaagcugagaagaagcugaggauccucacagg

SEQ ID NO: 127506 - RNA, 64 nt, Homo Sapiens
gaacucuggauuuuuagagcuuuagaaauuuguaagcugagagaacaauguuucacuuaauagg

SEQ ID NO: 127507 - RNA, 64 nt, Homo Sapiens
cuaaccaauaguuuauuuguuucauaaaucuaaaagcugagaaguccaagaugguggggcugcc

SEQ ID NO: 127508 - RNA, 64 nt, Homo Sapiens
gacuugccgcaaagcacaagcccgucccugcaccagcugagagauugagaagagacacaggucu

SEQ ID NO: 127509 - RNA, 64 nt, Homo Sapiens
cagagaggaagcaucccuugucucuagacuuggaagcugagauugugaggauuuucacuucuuu

SEQ ID NO: 127510 - RNA, 64 nt, Homo Sapiens
agaggaucaauugagcccagccagcuacucaggaagcugagacagguggugugcaccuauaguc

SEQ ID NO: 127511 - RNA, 64 nt, Homo Sapiens
gugcuauugcacuccagccuuggagguugcagugagcugagaucaaucgcuugaaccugggagg

SEQ ID NO: 127512 - RNA, 64 nt, Homo Sapiens
acgugaaccugggaccaccacugcuggauuuccaagcugagagggggagugagacaucuucuug

SEQ ID NO: 127513 - RNA, 64 nt, Homo Sapiens
gaagcgcugaucuucuauuuacucauaaggcaagagcugagaaggagaaaugauguuauaaaaa

SEQ ID NO: 127514 - RNA, 64 nt, Homo Sapiens
ccuuuugcuuuucagugucuucucagaaacaaccagcugagaagguaauuaaagucucauuuau

SEQ ID NO: 127515 - RNA, 64 nt, Homo Sapiens; identical to SEQ ID NO: 127514

SEQ ID NO: 127516 - RNA, 64 nt, Homo Sapiens
uuagauuuuauguaguauuauucuguauuccaagagcugagaucaauacacuuugaaacuauuu

SEQ ID NO: 127517 - RNA, 64 nt, Homo Sapiens
ucauucgauugucaugccuccugucucaggaaucagcugagaauguaucucuucuuucccuuuc

SEQ ID NO: 127518 - RNA, 64 nt, Homo Sapiens
ccaccagucagggacagcagccucccugucacucagcugagaaggccagcccucccuggcugug

SEQ ID NO: 127519 - RNA, 64 nt, Homo Sapiens
caccugucccucuccuauguggcagcuggggagcagcugagauguggacuuguaugcugcccac

SEQ ID NO: 127520 - RNA, 64 nt, Homo Sapiens
gcccucggagccaaugaacagcuccuccucuuggagcugagaugagccccacguggagcucggg

SEQ ID NO: 127521 - RNA, 64 nt, Homo Sapiens
gcucaagugauccuccugacucagccucuugaauagcugagaccacaggcuugugucaccaugc

SEQ ID NO: 127522 - RNA, 64 nt, Homo Sapiens
aaucgcuugaacccaggaggcagagguugcagugagcugagaucgugccacugcacucuagccg

SEQ ID NO: 127523 - RNA, 64 nt, Homo Sapiens
aauugcuuuaaccuuggaggcggagguugcauugagcugagaucaugcuagugcgcuccagccu

SEQ ID NO: 127524 - RNA, 64 nt, Homo Sapiens
aaucacuugaacccaggaggcagagguuggagugagcugagaucgcgccaccgcacuccagccu

SEQ ID NO: 127525 - RNA, 64 nt, Homo Sapiens
acaucauugcacuccagccuuggagguugcagugagcugagaucaaucgcuugagccagggagg

SEQ ID NO: 127526 - RNA, 64 nt, Homo Sapiens
uuucagguaauuuuguuguuuagcuaaaagcaccagcugagauuuagggcacuugcuuccuucu

SEQ ID NO: 127527 - RNA, 64 nt, Homo Sapiens
uuggcacugcgcacacauacacagcuggggagguagcugagaacaaaaccacauuuuucuacau

SEQ ID NO: 127528 - RNA, 64 nt, Homo Sapiens
ucaccugcuuuauuucuggcggucuggggucaccagcugagaugccagaacuuccuguucugug

SEQ ID NO: 127529 - RNA, 64 nt, Homo Sapiens
aacagcacucgcugcaggguauuuuuagagucauagcugagagcuuguuagcuaagacccauug

SEQ ID NO: 127530 - RNA, 64 nt, Homo Sapiens
ggcuccaggaagggcucuggcucagguugcagacagcugagaaaagauggcccugucagccacc

SEQ ID NO: 127531 - RNA, 64 nt, Homo Sapiens
acuucagucaauagccauaucagggguacauucuagcugagaagcaaugggucacucauuaaug

SEQ ID NO: 127532 - RNA, 64 nt, Homo Sapiens
ugacaagaacaaagccacugacugagauggagugagcugagacagauaagagaauaccuugguc

SEQ ID NO: 127533 - RNA, 64 nt, Homo Sapiens
agagcagacucacaggugcuuuuacuugggagccagcugagaagagaagaggcaaagcuacagg

SEQ ID NO: 127534 - RNA, 64 nt, Homo Sapiens
ugguggccucaggacugagaccugcuguggaggcagcugagaagagagaacgcagagcucccag

SEQ ID NO: 127535 - RNA, 64 nt, Homo Sapiens
acaccacugcacuccagccuucaagccugcagcgagcugagaucgaucacuugggcccaggagg

SEQ ID NO: 127536 - RNA, 64 nt, Homo Sapiens
acgccauuguacuccagccuuggagguugcagugagcugagaucaaucgcuugaaccggggagg

SEQ ID NO: 127537 - RNA, 64 nt, Homo Sapiens
cuuuuggcuugcagacugccuucuaucccagaacagcugagaaaucuaugaagcugagauucug

SEQ ID NO: 127538 - RNA, 64 nt, Homo Sapiens
gccuucuaucccagaacagcugagaaaucuaugaagcugagauucugaaggacccagcuuaggu

SEQ ID NO: 127539 - RNA, 64 nt, Homo Sapiens
ucuauccucauaccaccacugcugcuucccacccagcugagaaugcccccuccucccugacucc

SEQ ID NO: 127540 - RNA, 64 nt, Homo Sapiens
uuaucuucugaaggguuuuaaagaauggccaauuagcugagaagaauuaucuaaucaauuagug

SEQ ID NO: 127541 - RNA, 64 nt, Homo Sapiens
cugaagauaaaggaagaaccaaaagccaaguuaaagcugagagcacaagugcugcauggaaagg

SEQ ID NO: 127542 - RNA, 64 nt, Homo Sapiens
accuaaccugcaucccauuuccagccucuuuucaagcugagaaaaaaaaaaaaaaacacguuug

SEQ ID NO: 127543 - RNA, 64 nt, Homo Sapiens
ucaguuuccuacugcaguuuggaaugggagagaaagcugagauuaguuaaaaaaaaggggggag

SEQ ID NO: 127544 - RNA, 64 nt, Homo Sapiens
gagugucaguauugcuaagcaaacuguaagggacagcugagauucuuuggcccagagguggguu

SEQ ID NO: 127545 - RNA, 64 nt, Homo Sapiens
aggaagagcgaucuacuuuaaaugaggcagcaucagcugagagcagagugaaaacacaugcuac

SEQ ID NO: 127546 - RNA, 64 nt, Homo Sapiens
cagcaaugaacagaaagcugaugaagccagugcuagcugagaaguauuuccaagauuuuccaag

SEQ ID NO: 127547 - RNA, 64 nt, Homo Sapiens
cuucaagcaauccuccugugucagccaccagaguagcugagacuacagggguaugccaccaugc

SEQ ID NO: 127548 - RNA, 64 nt, Homo Sapiens
gcucaagugauccucccaccucagccuccugaguagcugagaccacaggcgugugccaccacgc

SEQ ID NO: 127549 - RNA, 64 nt, Homo Sapiens
uccagguagcucuccugaaccuccuccuuccccaagcugagaagcugagagcuggaggacaaua

SEQ ID NO: 127550 - RNA, 64 nt, Homo Sapiens
gcucuccugaaccuccuccuuccccaagcugagaagcugagagcuggaggacaauauccaggga

SEQ ID NO: 127551 - RNA, 64 nt, Homo Sapiens
uaaacaucacagcagauaaugaagcugauuuuuuagcugagauagaagcuuuggagaaaaugaa

SEQ ID NO: 127552 - RNA, 64 nt, Homo Sapiens
aaucgcuugaacccgggaggcagagguugcagugagcugagaucaugccacugcacuccggccu

SEQ ID NO: 127553 - RNA, 64 nt, Homo Sapiens
cuuuuuuguauacucauggggcugauugcaccauagcugagaacguggaaugcagaaugagccc

SEQ ID NO: 127554 - RNA, 64 nt, Homo Sapiens
aaggguuugcccaguuugcagaugagaaacccaaagcugagagagguguggggaaccgcccaag

SEQ ID NO: 127555 - RNA, 64 nt, Homo Sapiens
gcauaaagguauugagagggaacaaaaaacauaaagcugagaaucuugagagagcucaucuacc

SEQ ID NO: 127556 - RNA, 64 nt, Homo Sapiens
aauaacuuaaacccgggaggcggagguuacagugagcugagaucgugccacugcacuccagccu

SEQ ID NO: 127557 - RNA, 66 nt, Homo Sapiens
aaauccacauaaaagugcucuccugccugggcagcaacaaccaagaacaaagccccgggacuguuu

SEQ ID NO: 127558 - RNA, 66 nt, Homo Sapiens
cagcucuuuaaauagcugcccaucuccugugauugcacaaccaagcacuuugacauuugcaccuua

SEQ ID NO: 127559 - RNA, 66 nt, Homo Sapiens
ggcuccugucccugcugcuccucuaggccucacucaacaaccaagcgccuggaggacgggacagau

SEQ ID NO: 127560 - RNA, 66 nt, Homo Sapiens
guuguguaauacuaaaaucacgagaacaccuaaacaacaaccaaaaaucuauugugguaugcacuu

SEQ ID NO: 127561 - RNA, 66 nt, Homo Sapiens
ugcccacuagacaucagaagcacucccccaguugugacaaccaaaaauaucuccagaccuuggcaa

SEQ ID NO: 127562 - RNA, 66 nt, Homo Sapiens
aguugccaaaaagagcuuauagccggaagcccugggacaaccaacagcagacaguggccaaaauuu

SEQ ID NO: 127563 - RNA, 66 nt, Homo Sapiens
aauuuaaaguuaguaucuacagauggaauuguaucuacaaccaaaugccucuuaucccugaauuca

SEQ ID NO: 127564 - RNA, 66 nt, Homo Sapiens
ugcccucccagacgcugacugggaaacacaagaaguacaaccaacaggaaccagcgccaagggcag

SEQ ID NO: 127565 - RNA, 66 nt, Homo Sapiens
cccccucggugaaugauggcugcuucuaaaacaaauacaaccaaaacucagcagugugaucuauag

SEQ ID NO: 127566 - RNA, 66 nt, Homo Sapiens
uccauaguucccuccacgaaagcauucagaaacccuacaaccaaaaguccauccacagcuucauga

SEQ ID NO: 127567 - RNA, 66 nt, Homo Sapiens
gcuaauugugccaggggcuguuauauacauauauacacaaccaaggugugaucugaauuuaaucca

SEQ ID NO: 127568 - RNA, 66 nt, Homo Sapiens
gucaauugcuaauacccaguuacuuaugauuuaaaaacaaccaacagaaaacaucccacugacugu

SEQ ID NO: 127569 - RNA, 66 nt, Homo Sapiens
ucccacugaugcccaucaugccugcccaccccuggcacaaccaaaaggccuuugcucacggguggc

SEQ ID NO: 127570 - RNA, 66 nt, Homo Sapiens
ggcagcaggugggggcauucaggagaggcagccuagacaaccaaguagcagggcaaguucugaacc

SEQ ID NO: 127571 - RNA, 66 nt, Homo Sapiens
aauaaaugauucaugguuuuuuaagugucuguguagacaaccaaaggcaugacagcgauacaguac

SEQ ID NO: 127572 - RNA, 66 nt, Homo Sapiens
gaaaauggggaggcuugggaggauuugaugaaaaagacaaccaaaguuagguuuugugauagaaug

SEQ ID NO: 127573 - RNA, 66 nt, Homo Sapiens
ccaaguuuuaauuuuuaacauguaacgaaugguacuacaaccaauucagcauuagucacuuugaaa

SEQ ID NO: 127574 - RNA, 66 nt, Homo Sapiens
augucucuauacauugccaggcccacucuaguuaugacaaccaaaagauauuuagcagcaacccug

SEQ ID NO: 127575 - RNA, 66 nt, Homo Sapiens
auccaucugggcuucucuucccuuugacaucugaaaacaaccaaggagcuuggccagcuuugugaa

SEQ ID NO: 127576 - RNA, 66 nt, Homo Sapiens
aaaaagcaggaaaaacaaauaagaaaugguuuuuaaacaaccaaacggagggggcaaaugagccuu

SEQ ID NO: 127577 - RNA, 66 nt, Homo Sapiens
gccaccgcugcccuguggguugguacaaagaccaaaacaaccaaaugccucgggagugggaauugc

SEQ ID NO: 127578 - RNA, 66 nt, Homo Sapiens
uccuuuuguuaguuucaguagacagaauaaucaaggacaaccaaaaguagauuuuauucaucacag

SEQ ID NO: 127579 - RNA, 66 nt, Homo Sapiens
cuuaacuuuccacuauaaagauuggucuuuaauauuacaaccaaucuaugaguucagaucuaucuu

SEQ ID NO: 127580 - RNA, 66 nt, Homo Sapiens
aauaccgcgauccaugagggugcuccccaaaucaccacaaccaaccaccugcauugcucucccucg

SEQ ID NO: 127581 - RNA, 66 nt, Homo Sapiens
cauaacauauagcagaccaaucaccaauacacggacacaaccaaauguguucagccugaccccgcc

SEQ ID NO: 127582 - RNA, 66 nt, Homo Sapiens
aaggaccacauugcuuacuugaaacagacaaugaaaacaaccaaagugauauauaaaauaguugau

SEQ ID NO: 127583 - RNA, 66 nt, Homo Sapiens
cuuuucacagcaagaacaguccauguuguauauaauacaaccaacauuauagaacuuuuaggguug

SEQ ID NO: 127584 - RNA, 66 nt, Homo Sapiens
ucuuucuucugcuuucuucaccauaauaaacuuuggacaaccaagcaagcucuaaccgcaaugcca

SEQ ID NO: 127585 - RNA, 66 nt, Homo Sapiens
gccaaaaugauguacaguuaaaaagagugcguggaaacaaccaaacaauauaaccuaaaacuaaca

SEQ ID NO: 127586 - RNA, 66 nt, Homo Sapiens
gcuagggugagaugucagaaagcgcuuguauuuuaaacaaccaaaaagaauuguaaggguggcuug

SEQ ID NO: 127587 - RNA, 66 nt, Homo Sapiens
uucuuuuuguuauuuuuauuguuuguacuaauguugacaaccaaaauuugcaaaaaaauuaaaguu

SEQ ID NO: 127588 - RNA, 66 nt, Homo Sapiens
cacccuucacagauaaaauaguuuuuauaguuuuccacaaccaagcgcauuuuacuuuugcaucca

SEQ ID NO: 127589 - RNA, 66 nt, Homo Sapiens
cauaucagcauccuuucaagagauuuguggggggacacaaccaaacgggagauacaauucaaguug

SEQ ID NO: 127590 - RNA, 66 nt, Homo Sapiens
gaacacauugagacuacaaaagggacaauuaaagagacaaccaaggugaguaggcugacccugaga

SEQ ID NO: 127591 - RNA, 66 nt, Homo Sapiens
ccuacagacgguaucagaaacuucaaugaaguguuaacaaccaaacugagaagaauuaagaaaacu

SEQ ID NO: 127592 - RNA, 66 nt, Homo Sapiens
cccucgguuauugguuugugaggcuucauuccuacaacaaccaaggaagaaugauaccauuuuuaa

SEQ ID NO: 127593 - RNA, 66 nt, Homo Sapiens
aaaaacagaaacuucucaggauuuuuaaagucacuaacaaccaaacgaagaagauccagaaguuga

SEQ ID NO: 127594 - RNA, 66 nt, Homo Sapiens
uaugggugacagaggcucucagcaggggagggacaaacaaccaagcaggguuggugguggcagugc

SEQ ID NO: 127595 - RNA, 66 nt, Homo Sapiens
cccggguugcuccuuugauuguuugccauuugcuggacaaccaacauagugauagagugcagugau

SEQ ID NO: 127596 - RNA, 66 nt, Homo Sapiens
uggaguuccuuuucuuucuguuguuguuucccagcuacaaccaacuaaagacacaaauggcguucu

SEQ ID NO: 127597 - RNA, 66 nt, Homo Sapiens
ucagagguuagugaaauucacaucaaagucaaacccacaaccaagucguccacaaauacuucacug

SEQ ID NO: 127598 - RNA, 66 nt, Homo Sapiens
agcuggucaagacggucacgggagcucuaggugggcacaaccaaccccucuccugggaggccccug

SEQ ID NO: 127599 - RNA, 66 nt, Homo Sapiens
gagaguuuuagccgucuuguguuucuuguuuacuucacaaccaaauuuguccccucuucucucugu

SEQ ID NO: 127600 - RNA, 66 nt, Homo Sapiens
gggcaggugucacaaagaagagggcccuaagggcucacaaccaaagugauccgccaagcagggcag

SEQ ID NO: 127601 - RNA, 66 nt, Homo Sapiens
aauucauuuuucugauuugauaacuacccaaaccaaacaaccaauacauacaugggaagagaggcc

SEQ ID NO: 127602 - RNA, 66 nt, Homo Sapiens
ucugcugucgcuaccacugugcacaucugaaaacucacaaccaagaaaauccauucuauuuucuua

SEQ ID NO: 127603 - RNA, 66 nt, Homo Sapiens
aagaguuaucggcccauagcuaauaaguagugacagacaaccaagcuucaauauuuuucuaaagaa

SEQ ID NO: 127604 - RNA, 66 nt, Homo Sapiens
accugaaugaaagaagcaaaugacuauucucugaagacaaccaagagaaaauugcaaaaagacaag

SEQ ID NO: 127605 - RNA, 66 nt, Homo Sapiens
agagugacuuaagcugaacagcuuuaacuacuguugacaaccaagugaccucugguuuaagauacu

SEQ ID NO: 127606 - RNA, 66 nt, Homo Sapiens
ugcuccaaaagacuuacugauauuccuuucuacacuacaaccaaaugucucccuguuuuuuauuuu

SEQ ID NO: 127607 - RNA, 66 nt, Homo Sapiens
caaagaaaggaggggaaaaagauucccuccauuaaaacaaccaagagauaagagcacuggguuuga

SEQ ID NO: 127608 - RNA, 55 nt, Homo Sapiens
ugagcuggaucuuugaagcagaaggacaaccaaagaugagcaguuugccaacuga

SEQ ID NO: 127609 - RNA, 66 nt, Homo Sapiens
aaagcccaucaucaaucaucucuuuuuuuaugaccaacaaccaaauaaaaucuaauauuuuaucuu

SEQ ID NO: 127610 - RNA, 66 nt, Homo Sapiens
caucacuguauacucuugcuugcaagcugagcagauacaaccaaugagcaugugcucugcgcuccc

SEQ ID NO: 127611 - RNA, 52 nt, Homo Sapiens
ggcuuaugagaucuaaugugagacaaccaagauacaggaaacugaaagcuga

SEQ ID NO: 127612 - RNA, 66 nt, Homo Sapiens
aagucaccagcaguauuacucggggcacuaaacaaaacaaccaauacgaacucaaggcuuaauuaa

SEQ ID NO: 127613 - RNA, 66 nt, Homo Sapiens
accuuuccagccauagagauaaaagcuuaauuaaguacaaccaaccugcauagcuuugcacuucaa

SEQ ID NO: 127614 - RNA, 66 nt, Homo Sapiens
ugaugauguggagucuucugguuaacaccccuaauuacaaccaaagguguuuccuuaauuuauuuu

SEQ ID NO: 127615 - RNA, 66 nt, Homo Sapiens
gaucauccucuuggagagaaccucuugucuucacaaacaaccaagacaacagaagaggcugcuggg

SEQ ID NO: 127616 - RNA, 66 nt, Homo Sapiens
aauucuacaacacacacuguucugaguagagcagccacaaccaaaaacaaaaaaaccucuaugcaa

SEQ ID NO: 127617 - RNA, 66 nt, Homo Sapiens
uaaagcuaugugaaaguugaauuggaaaaguuuuaaacaaccaagcuauucucauugcuguauuau

SEQ ID NO: 127618 - RNA, 66 nt, Homo Sapiens
gagauuacaggcaugaaccacugugcccagccgaaaacaaccaagaauuuuuuaacaauaaaauga

SEQ ID NO: 127619 - RNA, 66 nt, Homo Sapiens
aaaguauuuaaauguuugccaaaaacaacagccaaaacaaccaaacuauuuucuaaauaaaccuuu

SEQ ID NO: 127620 - RNA, 66 nt, Homo Sapiens
ugcauuuccugcuaauuuauuuugaguuuuaagaaaacaaccaaaacaauuccaaugaaaauuuua

SEQ ID NO: 127621 - RNA, 66 nt, Homo Sapiens
cauagucaugugcgaggucaaaacugagucaccaccacaaccaaguuccagcuggcaagaagagga

SEQ ID NO: 127622 - RNA, 66 nt, Homo Sapiens
uguuguggcucuuauuucugcucccauuuuuacuuaacaaccaacuaaaguuuuccuuuguaauca

SEQ ID NO: 127623 - RNA, 66 nt, Homo Sapiens
aaccaaccaaccaaccacaaaaaggaaagaaaacuaacaaccaaccuauauauauauauaaauuaa

SEQ ID NO: 127624 - RNA, 66 nt, Homo Sapiens
aaaauugguacuuacccuucaauguugaaaaagaaaacaaccaaagcuacaauuacuuugaacauu

SEQ ID NO: 127625 - RNA, 66 nt, Homo Sapiens
acuacauauugucacugacaagacaguauauaacuaacaaccaaaguuaccuugcaucucacaggu

SEQ ID NO: 127626 - RNA, 59 nt, Homo Sapiens
ucaggggccuucagaacugcacuuuguaaacaaccaaagaucacaauaaacaggauuga

SEQ ID NO: 127627 - RNA, 66 nt, Homo Sapiens
ucagugggacaaacuccagcucuuguagagagauggacaaccaaaguaaguuucagaauguucccu

SEQ ID NO: 127628 - RNA, 66 nt, Homo Sapiens
ucucauuugacccuuauagguagaaauaaugaauuaacaaccaauaaaauuaaucauuuggcauua

SEQ ID NO: 127629 - RNA, 66 nt, Homo Sapiens
cucuuuugucuacaaaaugcuucuaguccaggaggcacaaccaagaacugggauuaaugaagcauu

SEQ ID NO: 127630 - RNA, 66 nt, Homo Sapiens
uguaaauuauauggcuuaucacuucuuagacaaauaacaaccaauagagaucauuguuaagaauac

SEQ ID NO: 127631 - RNA, 66 nt, Homo Sapiens
auauuuuaguuaagaaaauuguuuaaauauagcaauacaaccaauaauuuguuuuauguuucacug

SEQ ID NO: 127632 - RNA, 66 nt, Homo Sapiens
cugacccugcaggaagcaaagaggugagcuuaaagaacaaccaaacucugccaggggucccagaaa

SEQ ID NO: 127633 - RNA, 66 nt, Homo Sapiens
ugcugcuuuuacuuugaugugaucucauugauguacacaaccaaguuccaauaaagugcuagaaug

SEQ ID NO: 127634 - RNA, 66 nt, Homo Sapiens
cuuuggaguuauucaguuaaugacccuuuaauucucacaaccaaccagucauguugcuugaagcca

SEQ ID NO: 127635 - RNA, 66 nt, Homo Sapiens
uuuagauuaacaguuuuguacuuuacauuuuuuuauacaaccaaccaguuucuuuucuagccaauc

SEQ ID NO: 127636 - RNA, 66 nt, Homo Sapiens
cauaaccuauggcaguugguuauaauuuucucacaaacaaccaauagaggucccuggaaaaaaaua

SEQ ID NO: 127637 - RNA, 66 nt, Homo Sapiens
cccagcaggccacugaaauuuggucauuauguccugacaaccaacaaggaaguuaaagguugucuu

SEQ ID NO: 127638 - RNA, 66 nt, Homo Sapiens
aaauacaaucuaacuuuuacaacaaaacaaaacaaaacaaccaaaccaaguccugugaggcaaaaa

SEQ ID NO: 127639 - RNA, 66 nt, Homo Sapiens
cuucacugaagauuuauuccgugaacucccagcuaaacaaccaagaggggggaaaaacccaacuug

SEQ ID NO: 127640 - RNA, 66 nt, Homo Sapiens
cgugcucucacaaaccccugcauccugaccaaugcgacaaccaacaaggauacagagugaugggug

SEQ ID NO: 127641 - RNA, 66 nt, Homo Sapiens
ucuauaaucacaugcaaauacacagaauggauuguuacaaccaaaaugcaggcucuauuguuuuca

SEQ ID NO: 127642 - RNA, 66 nt, Homo Sapiens
ucacugccauuuuuacacacuugacuuuuuaaaaauacaaccaaccaaccaccacaacuucuuaua

SEQ ID NO: 127643 - RNA, 66 nt, Homo Sapiens
uuagaaaauauggguccauuccuuucuagaaaggggacaaccaagugucucaguuugccuugcggg

SEQ ID NO: 127644 - RNA, 66 nt, Homo Sapiens
guuaccugggaugaagaauaaagagagcaaacuaccacaaccaaugguugagccccugucaagugc

SEQ ID NO: 127645 - RNA, 66 nt, Homo Sapiens
acagucucacaaguaaacaccagcagcucauagauuacaaccaagaaagugacuguaucagaugau

SEQ ID NO: 127646 - RNA, 66 nt, Homo Sapiens
cuaucuuagaaggugcuuuuagaaagaaccaggagaacaaccaaagcagcuuacagacgccugaac

SEQ ID NO: 127647 - RNA, 66 nt, Homo Sapiens
aaagucugagcucuguugcagauaaccagagacccaacaaccaaaggcaaagcguaagccuugauu

SEQ ID NO: 127648 - RNA, 66 nt, Homo Sapiens
uggugcacccgaacauuaggagaaaaugaaaaauauacaaccaaccguucgugagucaucaaaaag

SEQ ID NO: 127649 - RNA, 66 nt, Homo Sapiens
guggagugaacaaagagcaugaaaauguugaagaccacaaccaaaauuuacucaaaucaaaguuaa

SEQ ID NO: 127650 - RNA, 66 nt, Homo Sapiens
guugggacucugucuuacaucuuagauaguccuccaacaaccaaaguuuuuauuaaucucuguauc

SEQ ID NO: 127651 - RNA, 66 nt, Homo Sapiens
cauuggaacagaaaaggauuagcuugcuuguuuuaaacaaccaaauauauaugccugacugaauua

SEQ ID NO: 127652 - RNA, 66 nt, Homo Sapiens
acugccuagaucuuugcagugggacagagggaaccuacaaccaaaacuaauaaaaagacaagcggu

SEQ ID NO: 127653 - RNA, 66 nt, Homo Sapiens
aauaguauuuaagaaaaugugcaaaauaaaaauuuaacaaccaaggaccuucauucuucuaauaca

SEQ ID NO: 127654 - RNA, 66 nt, Homo Sapiens
uggaguuuugccucucuagaggggauuauuuguaggacaaccaaccuguguucauaucauuuucuu

SEQ ID NO: 127655 - RNA, 66 nt, Homo Sapiens
gcuggccacguacuuaaaaucuuuaaugaccacaagacaaccaacacuccugauucuuaacauugu

SEQ ID NO: 127656 - RNA, 66 nt, Homo Sapiens
ugauuauagaaccacuauuacgugaaaaggcuugaaacaaccaacauauacaaauaaaacccugcc

SEQ ID NO: 127657 - RNA, 66 nt, Homo Sapiens
acgacuuuaguggacugguuucuuggcaaaaguuagacaaccaaagauugaaauagacugaaauua

SEQ ID NO: 127658 - RNA, 66 nt, Homo Sapiens
uuuuuguuuuucaguuguuguguacagacaugggaaacaaccaauuuuccagucagauaauggcau

SEQ ID NO: 127659 - RNA, 66 nt, Homo Sapiens
ggguggggcaaaauuagcaaaaaacaaaaaccaaugacaaccaaacugaaaccgaaacgaaaaauc

SEQ ID NO: 127660 - RNA, 66 nt, Homo Sapiens
ucugguggauauuuuaacuugcuauucacaaucaggacaaccaaagucaaggacccagaugaacca

SEQ ID NO: 127661 - RNA, 66 nt, Homo Sapiens
uuccucugaaugaaauuaucacagguugucucaagcacaaccaacugaaugucucuuaacuguggg

SEQ ID NO: 127662 - RNA, 66 nt, Homo Sapiens
ccccauuuuuaaccucagccuucccuacugucaccaacaaccaagcuaaauaaagucaacagccug

SEQ ID NO: 127663 - RNA, 66 nt, Homo Sapiens
ucuuuuuuauaauucuuuguacuaacucagcauguaacaaccaauuuacauggaaauaaaucgaaa

SEQ ID NO: 127664 - RNA, 66 nt, Homo Sapiens
auguuaugugcaaguuuaucuacagacgcugcugucacaaccaagaugagaaucagacugacaguu

SEQ ID NO: 127665 - RNA, 66 nt, Homo Sapiens
ggcgggggggggggugggggaagucagucaacauuuacaaccaaagacuguuuggagucuuuuaug

SEQ ID NO: 127666 - RNA, 66 nt, Homo Sapiens
aguucagaaugauacggaacagagggagggugucucacaaccaacccagcggguagggcacaggga

SEQ ID NO: 127667 - RNA, 54 nt, Homo Sapiens
gccgacugccugugaaguggaaagacaaccaacgcaccacaucgacuacuauaa

SEQ ID NO: 127668 - RNA, 66 nt, Homo Sapiens
uaaucuucuuaaaggucuaacuuuuccucacauuagacaaccaacaauucacugaauaauuauagg

SEQ ID NO: 127669 - RNA, 66 nt, Homo Sapiens
aaaaucuugucgguggcuguuuugcugacguacuuuacaaccaaauuguuuaaaggauucaguuuc

SEQ ID NO: 127670 - RNA, 66 nt, Homo Sapiens
cgaaaccaauuccucauccuucggaggaaagacaacacaaccaacguagacgugaacucagaacug

SEQ ID NO: 127671 - RNA, 66 nt, Homo Sapiens
gauaaccaaucacauaguuuaaaauguugucucuuuacaaccaauuauguguguauauguacagug

SEQ ID NO: 127672 - RNA, 66 nt, Homo Sapiens
acaacugggccaauauaaacaaaauagccaauuaacacaaccaaauucugacacauuugagugucc

SEQ ID NO: 127673 - RNA, 66 nt, Homo Sapiens
acaugaccauuagaacagcauagcuuugaaauaaugacaaccaagggugacgggaaauacacagca

SEQ ID NO: 127674 - RNA, 66 nt, Homo Sapiens
aguaacagcuccaggaaagguauuacacuuaaagcaacaaccaacuauugggaauuuucuuagggu

SEQ ID NO: 127675 - RNA, 66 nt, Homo Sapiens
acucuauuuugugguuuaagaacuagugauguuuguacaaccaaagcgagaccucggcgagacugu

SEQ ID NO: 127676 - RNA, 66 nt, Homo Sapiens
guguuauuuuugcuugaaacaacgcacacauuuucaacaaccaaaaaaugacaauuucuaguuuag

SEQ ID NO: 127677 - RNA, 66 nt, Homo Sapiens
cagaugccgcaacuccacacaguguguaaaauauauacaaccaaaaaucagcuuuugcaggucuuu

SEQ ID NO: 127678 - RNA, 66 nt, Homo Sapiens
uccaagaugguagaacuagguuaggaaaaauuccacacaaccaaacagucugccuuaaaagugacc

SEQ ID NO: 127679 - RNA, 66 nt, Homo Sapiens
uugucaugugacuaaaccguacagcauacuaaaucgacaaccaaauaauuuagauagauaagggcu

SEQ ID NO: 127680 - RNA, 66 nt, Homo Sapiens
uauaccuaaaagguauagucacuaacacacagaugaacaaccaaaauaugcuagucaaccugauuc

SEQ ID NO: 127681 - RNA, 66 nt, Homo Sapiens
uucauuagucuuaaauuucacauugggcuccgugccacaaccaagcggggccucuccguauuugug

SEQ ID NO: 127682 - RNA, 66 nt, Homo Sapiens
uggaaaucagaacacuaggguacgaacauggauaugacaaccaaacauaaucuauuuugguauugu

SEQ ID NO: 127683 - RNA, 66 nt, Homo Sapiens
cucacacuacuguauuucauaauucauuguuaaaaaacaaccaaacuauacauaaaugcccagcac

SEQ ID NO: 127684 - RNA, 66 nt, Homo Sapiens
ugaugcuggcuggaaccagagacugagaauuuggccacaaccaaaugcccugggccagggugauug

SEQ ID NO: 127685 - RNA, 66 nt, Homo Sapiens
acuacuccuguaauuccuaccucccugcaaccaacuacaaccaagcucucugcaucuacucccaag

SEQ ID NO: 127686 - RNA, 66 nt, Homo Sapiens
uaaaagaagcugaaaacuuaaugcaggaagaacaugacaaccaagcaaaugugaggagucugguga

SEQ ID NO: 127687 - RNA, 66 nt, Homo Sapiens
caaccucagaaaguaacuaucuugaagguuugaaaaacaaccaaagaaagggagugaggacuaugg

SEQ ID NO: 127688 - RNA, 66 nt, Homo Sapiens
guccucagaaauucucggcacacccuagaguauuguacaaccaacacccccacauaacuuuguccc

SEQ ID NO: 127689 - RNA, 66 nt, Homo Sapiens
aaaagaaaaugaggggucagugacaaaucaguaaauacaaccaagacauggccgaacucuugauag

SEQ ID NO: 127690 - RNA, 66 nt, Homo Sapiens
cucccauuugauuguaaucuucauaguugaaauuuuacaaccaaaggaugaguuuucaaugaguag

SEQ ID NO: 127691 - RNA, 66 nt, Homo Sapiens
gaaaaagacuagagggauuacuagggcuggucacacacaaccaacuuucagcaggguauuuaagug

SEQ ID NO: 127692 - RNA, 66 nt, Homo Sapiens
caugcaggguuggguuuucuaggccauagguacuagacaaccaauaaaguuauugcuacugcugug

SEQ ID NO: 127693 - RNA, 66 nt, Homo Sapiens
gaaugugauguucauggguauaugcuugcaaaaacuacaaccaauguaacaauuaggcagacucuu

SEQ ID NO: 127694 - RNA, 66 nt, Homo Sapiens
uccuugcuuuucucuacuuccaaaucacaauuucuuacaaccaagcuuugugcucccgaguaagca

SEQ ID NO: 127695 - RNA, 66 nt, Homo Sapiens
uuucaaagauaaauuggaauugcuguuggugaaauaacaaccaaaauacugaaucugauguacaua

SEQ ID NO: 127696 - RNA, 66 nt, Homo Sapiens
ggaaucaagaggacaaucuagcucuccauacuuugaacaaccaaaugugcauugaauacucugaaa

SEQ ID NO: 127697 - RNA, 66 nt, Homo Sapiens
uuguggagaagcuuuuuggaucagcauuuuguaaaaacaaccaaaaucaggaagguaaauugguug

SEQ ID NO: 127698 - RNA, 66 nt, Homo Sapiens
aaaugccacuuucagaaaacugucaucaguauaauaacaaccaacacaauacaaaguguuaauaug

SEQ ID NO: 127699 - RNA, 66 nt, Homo Sapiens
ggcacacaaaaccguuuccagggggccugugaaacuacaaccaaaacauggguaccacaggaaccu

SEQ ID NO: 127700 - RNA, 66 nt, Homo Sapiens
aaaaauaaaaagggcagcccuccagcauucucagccacaaccaaaagagggagagaacugagcauc

SEQ ID NO: 127701 - RNA, 66 nt, Homo Sapiens
auauuuacccacaaacaccuguauaugcgugcauauacaaccaaguggguagaccuagguguucuc

SEQ ID NO: 127702 - RNA, 66 nt, Homo Sapiens
cuuccccaagcccccacagcuacuccaacccaaacaacaaccaagccaguuuaaugguaggaauuu

SEQ ID NO: 127703 - RNA, 66 nt, Homo Sapiens
accuguuuggggcagcagggagcaaaaucuccuuuaacaaccaagcaguuccucauucacaucaac

SEQ ID NO: 127704 - RNA, 66 nt, Homo Sapiens
ucuuaaaaguccuucauacaccuucuggguagggaaacaaccaacuaauugacuaacaccaccaac

SEQ ID NO: 127705 - RNA, 66 nt, Homo Sapiens
cucuaaggguaaaucagggauagggccaaggagaaaacaaccaagaacucuuuccuguaauaagca

SEQ ID NO: 127706 - RNA, 66 nt, Homo Sapiens
gcuaaagaaaaggaauaagcccugcccaguauguagacaaccaauucaaaugauugugcuaacuua

SEQ ID NO: 127707 - RNA, 66 nt, Homo Sapiens
ccuaaaccauugguaauuuccacugucuuuucauuuacaaccaagcaacaccaguuaacauaguag

SEQ ID NO: 127708 - RNA, 66 nt, Homo Sapiens
cacaccuuuaugacacacauuucuuauccccauuuuacaaccaaggcaucuaaagcaacaagaaau

SEQ ID NO: 127709 - RNA, 66 nt, Homo Sapiens
ccugugaagaauucccuugcguauucucucucuaaaacaaccaaaaaaaaauggagaggcuuuuua

SEQ ID NO: 127710 - RNA, 66 nt, Homo Sapiens
cagaucagcuggguccagaguuuaaugggcaacuggacaaccaaguuaaccccaauugaaagcacc

SEQ ID NO: 127711 - RNA, 66 nt, Homo Sapiens
uacccaguagaugccacuagcccuccucucccagugacaaccaaaagucuucagacauugucaaac

SEQ ID NO: 127712 - RNA, 66 nt, Homo Sapiens
uuuauuuccuucucuguuuuugggaaaugagaggcuacaaccaagacagcugaaggagaaugaaac

SEQ ID NO: 127713 - RNA, 66 nt, Homo Sapiens
guacacgcaggcaugcacggauaaccaggacaaaacacaaccaaggacuuuccuaagaaaccgcug

SEQ ID NO: 127714 - RNA, 66 nt, Homo Sapiens
cucgggggaaaugguaagugugccuguguggggcugacaaccaagcuccauugagugguuccauuu

SEQ ID NO: 127715 - RNA, 66 nt, Homo Sapiens
uccgcucucuccuguccauugaaggagccccugagaacaaccaaucaugaaagaagcaggcaaagg

SEQ ID NO: 127716 - RNA, 66 nt, Homo Sapiens
gccaagauguugaguggguuuguugaaaaguuaaaaacaaccaaguggggagugaacagugccuau

SEQ ID NO: 127717 - RNA, 66 nt, Homo Sapiens
ucucuuaaaaugauugguaguuuuguucuuugaaauacaaccaaaugcaggacagaaauuguguug

SEQ ID NO: 127718 - RNA, 66 nt, Homo Sapiens
aagcagaaggagggcucaccaggcauagguccagcaacaaccaacaagagggguucuugggagaag

SEQ ID NO: 127719 - RNA, 66 nt, Homo Sapiens
guggcccaguccccacccccgaggacugaaggacaaacaaccaagaggcucuguguuuaagaaaag

SEQ ID NO: 127720 - RNA, 66 nt, Homo Sapiens
ucaugggaauuuuguguaaacagguuaagaauccacacaaccaagucuuucuuagguaauucacug

SEQ ID NO: 127721 - RNA, 66 nt, Homo Sapiens
uuacuccugaggggcaaagacuacaaauguuccaguacaaccaauauuuuggagauuuuccuucag

SEQ ID NO: 127722 - RNA, 66 nt, Homo Sapiens
gagaaaaaucagggaugagcucauguuucaacuccuacaaccaaauaaaauucuaccauuuuaaau

SEQ ID NO: 127723 - RNA, 66 nt, Homo Sapiens
agcuauguguuguuuuguucgaaagauggcaaguguacaaccaaaccaauccacuugcuuacagaa

SEQ ID NO: 127724 - RNA, 66 nt, Homo Sapiens
guuuugguuguaauauucaguucacucacccaauguacaaccaaugaaauaaaagaagcauuuaaa

SEQ ID NO: 127725 - RNA, 66 nt, Homo Sapiens
aaugccuugcugauucacuaaauacuuuuuuaaacaacaaccaaaaaacuguuucuauaaggaaau

SEQ ID NO: 127726 - RNA, 66 nt, Homo Sapiens
aagcauuaaggcagguugauagaacuagcugaagagacaaccaaagauaucaugugcuguaaaaua

SEQ ID NO: 127727 - RNA, 66 nt, Homo Sapiens
aaaaagaaaacacaaagaaauagaaccuuucaacaaacaaccaaacuauacugggccagguccugg

SEQ ID NO: 127728 - RNA, 66 nt, Homo Sapiens
ggaacaacaaaaagaaaaagagaaaauaguacaguuacaaccaauauccccugaaggcuucuuguu

SEQ ID NO: 127729 - RNA, 66 nt, Homo Sapiens
uuguguaaacagcagcagucacguuccucggccgccacaaccaacaccaaagcaggaaaaccauuu

SEQ ID NO: 127730 - RNA, 66 nt, Homo Sapiens
uucucaauaagucccagucuacugaucauuuccuagacaaccaagacucuuacuuuuuucuuagua

SEQ ID NO: 127731 - RNA, 66 nt, Homo Sapiens
aagcaagagcgagagagaguaaaaaaaaacugaaacacaaccaaaacaaauccaaaguucuuucaa

SEQ ID NO: 127732 - RNA, 66 nt, Homo Sapiens
gcauccaaucucaaggaaucaaaaagaaaaugaaaaacaaccaagcuuguggguuuuuuuuuuuaa

SEQ ID NO: 127733 - RNA, 66 nt, Homo Sapiens
guaagucaugaauuuagcguauuuacaucguggguuacaaccaaugcaauagagugauuuuagacu

SEQ ID NO: 127734 - RNA, 66 nt, Homo Sapiens
ccauuucuaccacuagacccuuggaccaccauuggaacaaccaagcagaauguacuugauauuauu

SEQ ID NO: 127735 - RNA, 55 nt, Homo Sapiens
gcagggcaaagcacaacuagagcucacaaccaaaacugcacuucagccucugcug

SEQ ID NO: 127736 - RNA, 66 nt, Homo Sapiens
cugugaaaauaucuugaaauuguacaccaaaaccuuacaaccaacuuauuugaacauuuauuacac

SEQ ID NO: 127737 - RNA, 66 nt, Homo Sapiens
acucacuauuuucaugaacaguuacccucuguccccacaaccaaagacaacucauggccuccuuug

SEQ ID NO: 127738 - RNA, 66 nt, Homo Sapiens
aucuagugaagaggucgccauaaaauauuagagucaacaaccaaaauuauuaagcucugugcgagg

SEQ ID NO: 127739 - RNA, 66 nt, Homo Sapiens
cggcuacuaagugacuaaggauguuuuuucagucugacaaccaagguacugaacccuuuaucaacu

SEQ ID NO: 127740 - RNA, 66 nt, Homo Sapiens
cccacacugaaaccaaaacauaaaaaccaaacccagacaaccaaaacauauucaaagcagcagcca

SEQ ID NO: 127741 - RNA, 66 nt, Homo Sapiens
gagaggcuggggcagggccuuaugucuucuccuaguacaaccaaacagguaccuccuuuuuuuucu

SEQ ID NO: 127742 - RNA, 66 nt, Homo Sapiens
gaaagaaguccuuucucuuuauugaguucgaggacuacaaccaauuuacacugccaucugaugccg

SEQ ID NO: 127743 - RNA, 66 nt, Homo Sapiens
uguuagcaggugggaggaggccacagaacaauaaaaacaaccaaauaagaugccgagucucuggug

SEQ ID NO: 127744 - RNA, 66 nt, Homo Sapiens
gucucguaagguuccacugagacgagaugucugagaacaaccaaagaaggccugcucuuugcugcu

SEQ ID NO: 127745 - RNA, 66 nt, Homo Sapiens
uggcuauuuguuuuagaggcgucacuccccuuagauacaaccaauggcauucuguaauauucuagg

SEQ ID NO: 127746 - RNA, 66 nt, Homo Sapiens
uggagcugggggcucucagugguuaaacaaugcccaacaaccaaccagcuggcccuuggucuccuc

SEQ ID NO: 127747 - RNA, 66 nt, Homo Sapiens
guccaaaugugaucaacuguucagggucucucucuuacaaccaagaacauuaucuuaguggaagau

SEQ ID NO: 127748 - RNA, 66 nt, Homo Sapiens
uuuauauuucaaaaauauuuuauagcuuuaaaaaauacaaccaauucacagaaugucuacaagaau

SEQ ID NO: 127749 - RNA, 66 nt, Homo Sapiens
ucuuaucauggucucagucaagacaguugggugagaacaaccaaaaagguuugaguagaggcuuag

SEQ ID NO: 127750 - RNA, 66 nt, Homo Sapiens
gccagucaggcacagcagaaauaaagaaaaaaaaguacaaccaaauguuguucuagcagugaagag

SEQ ID NO: 127751 - RNA, 66 nt, Homo Sapiens
uauggaguggcugccagcaauacgaauauuuuuuacacaaccaagugagaacuuucagacagguuu

SEQ ID NO: 127752 - RNA, 66 nt, Homo Sapiens
acucuuccauauauaaaucuaaagccaaaacaaaaaacaaccaagcuuuuuuuuuugcuuguuuuu

SEQ ID NO: 127753 - RNA, 66 nt, Homo Sapiens
cagagccuuucugaagagaauuauaucaaacuaauuacaaccaagaaauaauaguaugaagcggau

SEQ ID NO: 127754 - RNA, 66 nt, Homo Sapiens
acucaaacaaaaaagggacaaaaaaggaaaacacacacaaccaauaaauggacauauuucuuaugc

SEQ ID NO: 127755 - RNA, 66 nt, Homo Sapiens
uuaaccgugugucaagauuuuaguuaccuuucauuaacaaccaauuaaauauauaccuauuuuauc

SEQ ID NO: 127756 - RNA, 66 nt, Homo Sapiens
ucagauuuuuuuugugaguccuuaaauuuaacaacaacaaccaaaacuguaugguagauucuugac

SEQ ID NO: 127757 - RNA, 66 nt, Homo Sapiens
ucugcagaugcuaguguuuuuuuggauacaauuuugacaaccaaguuaguaaacaaaauaucuuaa

SEQ ID NO: 127758 - RNA, 66 nt, Homo Sapiens
gguauuucuagaagcagaaauagacugggaagaugcacaaccaagggguuacaggcaucgcccaug

SEQ ID NO: 127759 - RNA, 66 nt, Homo Sapiens
aggaagucuguaccaaaucuguaggggguuuuucccacaaccaagcaauagacaccagcugggugu

SEQ ID NO: 127760 - RNA, 66 nt, Homo Sapiens
ucuaugaaaaguugaaaagaaacauguuuacaaguuacaaccaacuaucuuaauucuuaauuuaaa

SEQ ID NO: 127761 - RNA, 66 nt, Homo Sapiens
cuuuaaauaaauuuuaaaauaaccccuaggaccugaacaaccaagacaaggugacuggggacuugg

SEQ ID NO: 127762 - RNA, 66 nt, Homo Sapiens
aaaaaaaaaaaaaaaaaggaaggaaagaccaaaaaaacaaccaacccagagcaggagugacaaggg

SEQ ID NO: 127763 - RNA, 66 nt, Homo Sapiens
ugggcuucagccacaucagugaccucuaauuugaccacaaccaaccccuaagggcuucucucucag

SEQ ID NO: 127764 - RNA, 66 nt, Homo Sapiens
ucgcaauuuuaacaauaugccauaaugucuggggaaacaaccaaaacccucuucucccuagcuuag

SEQ ID NO: 127765 - RNA, 66 nt, Homo Sapiens
ucacucgaaauaauuuuuuuuuucaaaagcaccuuaacaaccaauugcgaugcuguccuguuccuu

SEQ ID NO: 127766 - RNA, 66 nt, Homo Sapiens
aaauugaaggaauaucaccagaaaaaaaaaauaaaaacaaccaaaagaugaucaauggacuuuaau

SEQ ID NO: 127767 - RNA, 66 nt, Homo Sapiens
cacuuugacacuacccccuggugucugggucuugugacaaccaaagcagccaaacugggaaccuag

SEQ ID NO: 127768 - RNA, 66 nt, Homo Sapiens
accauguuuuaugucaaagccaccaccaacaacaaaacaaccaaaaggaauucucuuuaaagaaac

SEQ ID NO: 127769 - RNA, 66 nt, Homo Sapiens
auugagugguacuuauaucuuugcuucuaaguuguaacaaccaaccugaaggucuucccaacccua

SEQ ID NO: 127770 - RNA, 66 nt, Homo Sapiens
uugaugcgaucugcucaguagaauucugguguuuacacaaccaaaucacauuaccauucauaguaa

SEQ ID NO: 127771 - RNA, 66 nt, Homo Sapiens
uuggccuuuuucucccucuuacaggcaaggauuggcacaaccaaaaucaguaccuggcguugguac

SEQ ID NO: 127772 - RNA, 66 nt, Homo Sapiens
auucauuuuuccuuaaccaguugugcaaggacagcaacaaccaaucuaaugaugagaauguacuua

SEQ ID NO: 127773 - RNA, 66 nt, Homo Sapiens
gcugggauuacaggcgugagccacuggcccggcggcacaaccaaaucuuauuaaacucacccuagg

SEQ ID NO: 127774 - RNA, 66 nt, Homo Sapiens
uugcucaaaggcuggugacuugugggccauucaucuacaaccaaguccugauggagcaagaggccc

SEQ ID NO: 127775 - RNA, 66 nt, Homo Sapiens
caggucugcagagcaaaggcuugggcauugguggggacaaccaaaaaguagaauuuucucacugcg

SEQ ID NO: 127776 - RNA, 66 nt, Homo Sapiens
ucuggguuuuuuucuucuuugugggcauuguuuucuacaaccaaauuaagcacuggccagucuguu

SEQ ID NO: 127777 - RNA, 66 nt, Homo Sapiens
acauucggauggauuuggaaguuggaauuccucuuaacaaccaagggguuuauuuucaaagcaaua

SEQ ID NO: 127778 - RNA, 56 nt, Homo Sapiens
aagggaaaccacagcuuuaaacgaagacaaccaaaagaaugcaaacuggauuuauc

SEQ ID NO: 127779 - RNA, 66 nt, Homo Sapiens
guuuuguucaguaauuauaggucaaaucuaauuacaacaaccaagauggauugccaaacucuucug

SEQ ID NO: 127780 - RNA, 66 nt, Homo Sapiens
guccuucccugggaaucaccacucgguccaaccuagacaaccaagaccgcuauaccuaaagaccuc

SEQ ID NO: 127781 - RNA, 66 nt, Homo Sapiens
aguauacacugucucuacugggaaggaaauaaagucacaaccaaaucauaggcauugauaaagcca

SEQ ID NO: 127782 - RNA, 66 nt, Homo Sapiens
augucuccagauauugccagccucccccaaguugagacaaccaaaaucaccagaugccaguugcac

SEQ ID NO: 127783 - RNA, 66 nt, Homo Sapiens
augaaucuauuugugggugucaugcaugcaaauuagacaaccaagucauggagaaugcaccauacu

SEQ ID NO: 127784 - RNA, 66 nt, Homo Sapiens
ggugagguggggacaggccuauguuccacaccaucgacaaccaagggcauuuugccccucacccca

SEQ ID NO: 127785 - RNA, 66 nt, Homo Sapiens
cagacuuguauuauaagucaaaguuuauauuccaucacaaccaaguaaucaaauuacaagcuauuu

SEQ ID NO: 127786 - RNA, 66 nt, Homo Sapiens
caucucagcuuucuguggcugcuccuugaauuaccaacaaccaaggguuggugucacaguucaggc

SEQ ID NO: 127787 - RNA, 66 nt, Homo Sapiens
gguaaccaccacuuccccacagaaauucacgcuuaaacaaccaaccagcuucagagcugcuuuccc

SEQ ID NO: 127788 - RNA, 64 nt, Homo Sapiens; identical to SEQ ID NO: 120595

SEQ ID NO: 127789 - RNA, 64 nt, Homo Sapiens; identical to SEQ ID NO: 120596

SEQ ID NO: 127790 - RNA, 64 nt, Homo Sapiens; identical to SEQ ID NO: 120626

SEQ ID NO: 127791 - RNA, 64 nt, Homo Sapiens; identical to SEQ ID NO: 120627

SEQ ID NO: 127792 - RNA, 64 nt, Homo Sapiens; identical to SEQ ID NO: 120650

SEQ ID NO: 127793 - RNA, 64 nt, Homo Sapiens; identical to SEQ ID NO: 120651

SEQ ID NO: 127794 - RNA, 64 nt, Homo Sapiens; identical to SEQ ID NO: 120660

SEQ ID NO: 127795 - RNA, 64 nt, Homo Sapiens; identical to SEQ ID NO: 120661

SEQ ID NO: 127796 - RNA, 64 nt, Homo Sapiens; identical to SEQ ID NO: 120680

SEQ ID NO: 127797 - RNA, 64 nt, Homo Sapiens; identical to SEQ ID NO: 120681

SEQ ID NO: 127798 - RNA, 64 nt, Homo Sapiens; identical to SEQ ID NO: 120750

SEQ ID NO: 127799 - RNA, 64 nt, Homo Sapiens; identical to SEQ ID NO: 120751

SEQ ID NO: 127800 - RNA, 64 nt, Homo Sapiens; identical to SEQ ID NO: 120802

SEQ ID NO: 127801 - RNA, 64 nt, Homo Sapiens; identical to SEQ ID NO: 120803

SEQ ID NO: 127802 - RNA, 64 nt, Homo Sapiens
cuaaaauacaccuggaucugucuagucaaucaacauagcagagacagucuuaaaccuaccauug

SEQ ID NO: 127803 - RNA, 64 nt, Homo Sapiens
aucccuucggagccaacaagaccgccccagggcuauagcagaaagaacuuuaaagcucaggagg

SEQ ID NO: 127804 - RNA, 64 nt, Homo Sapiens
ucuggggccuggacacacugaggacaaugcggcuauagcagauggccauggcagucaguggcag

SEQ ID NO: 127805 - RNA, 64 nt, Homo Sapiens
agccgggcccuuuccauaggaacugcccuuggagauagcagaguguggcugccccuccuugcuc

SEQ ID NO: 127806 - RNA, 64 nt, Homo Sapiens
caucauuuagaaaugguuugccuuaauggagacaauagcagauccuguaguauuuccaguagac

SEQ ID NO: 127807 - RNA, 64 nt, Homo Sapiens
cucuauuaguucuauaggagugaucucaagugagauagcagagcaagaugccaaaagaccauaa

SEQ ID NO: 127808 - RNA, 64 nt, Homo Sapiens
augccucuguaauugggguugacacaugaacagaauagcagacacaaugcauaugaaaguuaca

SEQ ID NO: 127809 - RNA, 64 nt, Homo Sapiens
aaggggaucagaaguaggaaggaaaaaauaagagauagcagaggaaaaagaaaaacauuuccuc

SEQ ID NO: 127810 - RNA, 64 nt, Homo Sapiens
ucauagcugaaaauaaugauacugucaauuugagauagcagaaguuucacacaucaaaguaaaa

SEQ ID NO: 127811 - RNA, 64 nt, Homo Sapiens
auauuaugaauuauuuucagaaauggaucuuugaauagcagaucaggauuuaaauaauaaaauu

SEQ ID NO: 127812 - RNA, 64 nt, Homo Sapiens
ucgaaauuacuaaucaguuggggaaaaaaauacuauagcagacagcacuaaugucaucaacaaa

SEQ ID NO: 127813 - RNA, 64 nt, Homo Sapiens
agcucccaccauuuucuuuugcggaauucucugcauagcagaaaucugggcaaaggagugcuau

SEQ ID NO: 127814 - RNA, 64 nt, Homo Sapiens
uuguguucugacaagacugagaaauauuuccuccauagcagaagaacuuggcccuuuccugaug

SEQ ID NO: 127815 - RNA, 64 nt, Homo Sapiens
uacaguguauuccugcauuaggggcaugggcuuaauagcagauguucucacguucuagugauuu

SEQ ID NO: 127816 - RNA, 64 nt, Homo Sapiens
ggcuuggagggucacauaggugagcaggggagaaauagcagaggggagacaacggcagagggag

SEQ ID NO: 127817 - RNA, 64 nt, Homo Sapiens
uuucacccggcaggaugacagagcugcucaagcaauagcagaggccagccagacuggguuaagg

SEQ ID NO: 127818 - RNA, 64 nt, Homo Sapiens
gcaaaccaaucagucccucagcuuggggaauugaauagcagagagacgcugcaggaacaagugg

SEQ ID NO: 127819 - RNA, 64 nt, Homo Sapiens
gcacaugagcagagugacauaaagucugggucuaauagcagacugaaauuauuucaucaggugg

SEQ ID NO: 127820 - RNA, 64 nt, Homo Sapiens
uuuaaauguacccuccccuucagcaguuugugauauagcagagguaauaaaacaacaacaaaaa

SEQ ID NO: 127821 - RNA, 64 nt, Homo Sapiens
uuaauuuugaauaaauaaauguuugucugucuucauagcagauuuccucugggaauguuacauu

SEQ ID NO: 127822 - RNA, 64 nt, Homo Sapiens
agcucuuguuggucugagaacucucgguugauugauagcagaacauacgucccuguaacccaau

SEQ ID NO: 127823 - RNA, 64 nt, Homo Sapiens
gcauaacacugaguguuaauagaguauuccugggauagcagaauuaugcagcauuuaccagaaa

SEQ ID NO: 127824 - RNA, 64 nt, Homo Sapiens
aaucuauuuuugugugcuguccaaaucauaacauauagcagaccuuuguuuucuagggacacaa

SEQ ID NO: 127825 - RNA, 64 nt, Homo Sapiens
caguucuuauuguauggcauaggacuggcauuauauagcagaaaucaacuacuguacaauuucu

SEQ ID NO: 127826 - RNA, 64 nt, Homo Sapiens
aacaauuuauuuucacaauucauauuuauuauagauagcagaaguaauccauuuuaauauggcc

SEQ ID NO: 127827 - RNA, 64 nt, Homo Sapiens
agggaauggcuccuuauaccaaagaugcuggcacauagcagaacccagugcacguccuccccuu

SEQ ID NO: 127828 - RNA, 64 nt, Homo Sapiens
gugauauucucuuugaauaaaccuauaauagaaaauagcagacaacauaaacaucuuuguaaau

SEQ ID NO: 127829 - RNA, 64 nt, Homo Sapiens
accugaauuggaaaggaugugauuaauauaaauaauagcagauauaaauugugguuauguuacc

SEQ ID NO: 127830 - RNA, 64 nt, Homo Sapiens
uaguauucccugugccccuggaugcacuuucauuauagcagagaguuuuuguugguucuuagac

SEQ ID NO: 127831 - RNA, 64 nt, Homo Sapiens
cuuagaaaagcuaagagaagauaaggucugaauaauagcagaaaaaccaacaucuacaaaacau

SEQ ID NO: 127832 - RNA, 64 nt, Homo Sapiens
ugggugaugucuuuccuuauguugcuuuuucaacauagcagaauuaauguagggagcuaaaucc

SEQ ID NO: 127833 - RNA, 64 nt, Homo Sapiens
uguuuugugguuuggaauauaaaaagucuacaacauagcagaucaaaucucaaauaggcuauua

SEQ ID NO: 127834 - RNA, 64 nt, Homo Sapiens
uccaggccucccuuccagucgggaaggauuggugauagcagagcaggauguggaguagagggaa

SEQ ID NO: 127835 - RNA, 64 nt, Homo Sapiens
guguuuucugggauaaguaaaggcauccuccacaauagcagacauucauccucugagugugacc

SEQ ID NO: 127836 - RNA, 64 nt, Homo Sapiens
uguucaccuuuuccuugcugacauuaaaggaaaaauagcagagaggauuuugaauaugccaaac

SEQ ID NO: 127837 - RNA, 64 nt, Homo Sapiens
uccuuuugaacacuaaugauucuguuuuccuggaauagcagacauccugaacagaugcuucugg

SEQ ID NO: 127838 - RNA, 64 nt, Homo Sapiens
aauaucaagaacacagaaacgucuaagacugauaauagcagaaguaaagaagaacucuggagug

SEQ ID NO: 127839 - RNA, 64 nt, Homo Sapiens
aaggagacuggcugaagcugaaugaggaggcccuauagcagaagucugauucuaagagcaguag

SEQ ID NO: 127840 - RNA, 64 nt, Homo Sapiens
cccuagcaagaagucugcucuguaucaccuuuauauagcagacaugucacccugcuucuacaca

SEQ ID NO: 127841 - RNA, 64 nt, Homo Sapiens
uucccugugccacuuugacucagaggcugggagcauagcagaggggccaggcccaggcagagcu

SEQ ID NO: 127842 - RNA, 64 nt, Homo Sapiens
ugaggucauccuugaaaaguggcagaaaaagaaaauagcagagauggguccagugcaguggcuu

SEQ ID NO: 127843 - RNA, 64 nt, Homo Sapiens
gcuggcuucuuuuuccaugcguuaacuuuucccaauagcagaggaggcaaauaugagcauacaa

SEQ ID NO: 127844 - RNA, 64 nt, Homo Sapiens
augaaguuuccccacaugugaagacagguacaaaauagcagagccaagcagacagugggucuau

SEQ ID NO: 127845 - RNA, 64 nt, Homo Sapiens
gagagcaaaaccacauguucugucuugaggagccauagcagaaagagcaaauuagucauuauuu

SEQ ID NO: 127846 - RNA, 64 nt, Homo Sapiens
uaaauauauacauacauaugagaaaaugauguuuauagcagagcuucacuagacaugguaugua

SEQ ID NO: 127847 - RNA, 64 nt, Homo Sapiens
uuuggccauguccaguuuauacaguuuacaaaauauagcagaugcaagauuaugggggaaaucc

SEQ ID NO: 127848 - RNA, 64 nt, Homo Sapiens
ccauaugguucuaggucccucuuacgucaucugcauagcagacuauaccucuucuguccgcuga

SEQ ID NO: 127849 - RNA, 64 nt, Homo Sapiens
uggagguccugcagcaggagugagcauuguguauauagcagacaaagcgacaccagcaagccug

SEQ ID NO: 127850 - RNA, 64 nt, Homo Sapiens
aaauugguguuucccuguuguuuauaaagaccugauagcagaauuccuccacagguguugccuu

SEQ ID NO: 127851 - RNA, 64 nt, Homo Sapiens
gaaaccaucaagaaguggaaggacaugcgcauucauagcagaaggcucuaagaagcagacaacc

SEQ ID NO: 127852 - RNA, 64 nt, Homo Sapiens
aaauacucugaauaagagacucaaauaugacgcuauagcagaguuauucaagccacuagaauua

SEQ ID NO: 127853 - RNA, 64 nt, Homo Sapiens
ggcuaaaaucuauuuaucgaaagaaaaaaaaacuauagcagagaaaacuuauuucuaaaauuaa

SEQ ID NO: 127854 - RNA, 64 nt, Homo Sapiens
uaugccaucauggaagggguaggaacgagacuccauagcagagggaaagaagguugcuguggug

SEQ ID NO: 127855 - RNA, 64 nt, Homo Sapiens
uauucauaauggccaaaagcguacacaaauauuuauagcagaaugcuggucaauacaaaaacuu

SEQ ID NO: 127856 - RNA, 64 nt, Homo Sapiens
caaggggaauauauucaggucuagucuucuuauaauagcagaggucuugguaaaauaacuacca

SEQ ID NO: 127857 - RNA, 64 nt, Homo Sapiens
agaucuuagggaugauuaaaggcagcauuugaugauagcagacauuguuacaaggacaugguga

SEQ ID NO: 127858 - RNA, 64 nt, Homo Sapiens
gugaccaaugcguuggagaacgagggagggcuucauagcagaagacauuggaguuggaagguug

SEQ ID NO: 127859 - RNA, 64 nt, Homo Sapiens
uucaauucaguuaagacuucugugauagauguuuauagcagagaagaaaugucucaucaauaga

SEQ ID NO: 127860 - RNA, 64 nt, Homo Sapiens
ggaugcaagugauucuaaguuuguggauuuguggauagcagagggaucgggaccucuuggagga

SEQ ID NO: 127861 - RNA, 64 nt, Homo Sapiens
ccuuagaacuuaucuguuaugcuccugauagccaauagcagauagaagcuugcaaucaagaggg

SEQ ID NO: 127862 - RNA, 64 nt, Homo Sapiens
gggggcugcgggcggggcgaucaggagcacagccauagcagacgggcgccugucgggcccgcac

SEQ ID NO: 127863 - RNA, 64 nt, Homo Sapiens
cccgccauccucgcagagugcccccgcaaaccacauagcagaccgcucccgcauaccaggauaa

SEQ ID NO: 127864 - RNA, 64 nt, Homo Sapiens
cuuggugauuuuguuggcuccugaauccuccuuaauagcagaacgaaaguaaugcccagucuuc

SEQ ID NO: 127865 - RNA, 64 nt, Homo Sapiens
ccauugaauugcuguaaaaaggaguaggcacugcauagcagauauuugcccuguuuucaacauu

SEQ ID NO: 127866 - RNA, 64 nt, Homo Sapiens
aaccuagacccaccuagugauuuuccaucugaccauagcagaaauucuuuucuguaaguuuaag

SEQ ID NO: 127867 - RNA, 64 nt, Homo Sapiens
ucuugcuucauaugacaaaggauuuuuuaaaauaauagcagauuuuuauggucgauauacaauu

SEQ ID NO: 127868 - RNA, 64 nt, Homo Sapiens
ggguuuuaugcaaacgcacuaggauaccaacuugauagcagaggugauugggacaguugccagg

SEQ ID NO: 127869 - RNA, 64 nt, Homo Sapiens
uuuaauaaccuugggauuuaaacuuaaggucugcauagcagacucuccauugaacacauuuuuc

SEQ ID NO: 127870 - RNA, 64 nt, Homo Sapiens
cagcucaauuguuugguuggauauauuuaguuuuauagcagaagugaacaaaauguauuuagaa

SEQ ID NO: 127871 - RNA, 64 nt, Homo Sapiens
agcuaaaaacccugauaugguaauauuauggugcauagcagaggucucggaaaaaaaauauuuc

SEQ ID NO: 127872 - RNA, 64 nt, Homo Sapiens
aaaaaaauuguauuaugugauccuaaggacaggaauagcagaccagccaacgggauggccuugg

SEQ ID NO: 127873 - RNA, 64 nt, Homo Sapiens
ucuguuguucuguggucacagugaccuuagcuacauagcagacuuucccaaauguauugauuac

SEQ ID NO: 127874 - RNA, 64 nt, Homo Sapiens
cagugcuggggacaaguuucuguugaaacuuuagauagcagaauuauuugcaauuuguagcaua

SEQ ID NO: 127875 - RNA, 64 nt, Homo Sapiens
aaaauagcacagcucaugugcacuggaagacaauauagcagauuggaguccuugaagcagaggg

SEQ ID NO: 127876 - RNA, 64 nt, Homo Sapiens
uuuuguuaucuuaauagcggauaauauuaugguaauagcagaaguguauagcuuucuaauauau

SEQ ID NO: 127877 - RNA, 64 nt, Homo Sapiens
auuggcaagauguauuuuuacuuguaacugcacaauagcagaaaugccccacacuucucuuucu

SEQ ID NO: 127878 - RNA, 64 nt, Homo Sapiens
uggaaugggaacugagaacccucccggugucuaaauagcagagcucaaggggcuguuuccaggu

SEQ ID NO: 127879 - RNA, 52 nt, Homo Sapiens
uuuugaagccagaaggacaauaauagcagaaaaaaaggaggaaaaacaguaa

SEQ ID NO: 127880 - RNA, 64 nt, Homo Sapiens
ucccgggaagguaaaugccacuugcgaaugccccauagcagaagucaaagcugagucaguggcu

SEQ ID NO: 127881 - RNA, 64 nt, Homo Sapiens
ccuugaguaaaugagcugaaguguaaagcaaagaauagcagaagcagcuugguaggauggaagg

SEQ ID NO: 127882 - RNA, 64 nt, Homo Sapiens
gcuuggagaggagaucaugaucuuuauacugugaauagcagaaugucacagaugaagaauauua

SEQ ID NO: 127883 - RNA, 64 nt, Homo Sapiens
ccaacgaacccucugcccuuggcucagaaugguuauagcagaaauacaaaaaaaaaaaaaaagu

SEQ ID NO: 127884 - RNA, 64 nt, Homo Sapiens
auauuaaacauucuugcugcugcgcugcaaaaccauagcagauuugaggcacuguugaggacug

SEQ ID NO: 127885 - RNA, 64 nt, Homo Sapiens
ccuaacagaccaucacagauuggaaacuugguagauagcagagcaugguauuagugaaaaaggu

SEQ ID NO: 127886 - RNA, 64 nt, Homo Sapiens
cuggauggcuauucagauaacauggcaaaaaaugauagcagaagaucauuaaaaacuuaaaaua

SEQ ID NO: 127887 - RNA, 64 nt, Homo Sapiens
guuuuauauucauuccauuugaaaucgauacguaauagcagauuuauaauuauauccuaucaaa

SEQ ID NO: 127888 - RNA, 64 nt, Homo Sapiens
uucugcuuacucaugucucccagaaauaugugaaauagcagacacaguaaauauaugacugcac

SEQ ID NO: 127889 - RNA, 64 nt, Homo Sapiens
ccccagccaucacugcuggcgcuuggugcugaggauagcagagccgugggcacccacggacgug

SEQ ID NO: 127890 - RNA, 64 nt, Homo Sapiens
aauuggugcuuguaaacauucgguaauggcaggaauagcagaauauacucuaccaugaaggaug

SEQ ID NO: 127891 - RNA, 64 nt, Homo Sapiens
uaauuguacaguuccugauugaacaaaccaaaauauagcagaugugaggaaccguaacucuuug

SEQ ID NO: 127892 - RNA, 64 nt, Homo Sapiens
uaacagugugacauaaagugaacaacaaauaacaauagcagaaaaauguaaagaguauugaagg

SEQ ID NO: 127893 - RNA, 64 nt, Homo Sapiens
gaggauauaagagcacuaaugcccucuuauuuucauagcagagacuugauacugucucaacuuu

SEQ ID NO: 127894 - RNA, 64 nt, Homo Sapiens
uguuguuuucuuguaacaugauauggaauaaaguauagcagaaucuccguacauguucuaggua

SEQ ID NO: 127895 - RNA, 64 nt, Homo Sapiens
ccaaccaugucuucagugauggcgugggaugggaauagcagaaagcagaggcauggaggaggga

SEQ ID NO: 127896 - RNA, 64 nt, Homo Sapiens
uugaagggauauacuuuccuuuagaugggagggcauagcagaucuugcccucucccaucuggac

SEQ ID NO: 127897 - RNA, 64 nt, Homo Sapiens
cuccgggcucacuccuuccuacaccgccuugcacauagcagaggaagcugcagccggugcuugc

SEQ ID NO: 127898 - RNA, 64 nt, Homo Sapiens
cuccgggcugacuccuuccuacaccgccuugcacauagcagagggagccgcagccggugcuugc

SEQ ID NO: 127899 - RNA, 64 nt, Homo Sapiens
aucggaaaguauguaccaaauuuaaaaaauacacauagcagagugauauaccauguauucacac

SEQ ID NO: 127900 - RNA, 64 nt, Homo Sapiens
uagccaauccuaaaaccuuccagccaauaagauaauagcagaauucuguguucuuuuuuugccg

SEQ ID NO: 127901 - RNA, 64 nt, Homo Sapiens
agaacgaaguuuaaaauugugacucugauucauuauagcagaacuuuaaauuucccagcuuuuu

SEQ ID NO: 127902 - RNA, 64 nt, Homo Sapiens
agguuaauguaacccaacaagagcacauuuuaucauagcagagacaucuguaugcauuccuguc

SEQ ID NO: 127903 - RNA, 64 nt, Homo Sapiens
cgggacuuucacugugauuuccaccagagaaauuauagcagaguggcugagcaugugcucugag

SEQ ID NO: 127904 - RNA, 64 nt, Homo Sapiens
uuguaaaaauuaugaauuauauguuuguuccaaaauagcagaaacuuaaaucgugggaauuuua

SEQ ID NO: 127905 - RNA, 64 nt, Homo Sapiens
ucacgacagauuuaaccucuguguguuuaaauugauagcagauacaaaaugggagaaaacgcca

SEQ ID NO: 127906 - RNA, 64 nt, Homo Sapiens
ggccuguucuaagaaggccaaccaauuuuuuauaauagcagaguugauacaauuucuugcuguc

SEQ ID NO: 127907 - RNA, 64 nt, Homo Sapiens
ggugaauguacaaacuguugauugucugccuccuauagcagaaaccaagaaagaagacuaguaa

SEQ ID NO: 127908 - RNA, 64 nt, Homo Sapiens
ucugagauucuccuuuuauuccuucucaaacucaauagcagaucuuuggaaucauuaaacuugg

SEQ ID NO: 127909 - RNA, 64 nt, Homo Sapiens
aagauaaacauggguuaagaucuuugcucauggaauagcagaacucacagcuuuguguuuauuc

SEQ ID NO: 127910 - RNA, 64 nt, Homo Sapiens
uuucauguuuaagaaaugagaaauugugccaaagauagcagaagaguagauaagugcucaguau

SEQ ID NO: 127911 - RNA, 64 nt, Homo Sapiens; identical to SEQ ID NO: 127826

SEQ ID NO: 127912 - RNA, 64 nt, Homo Sapiens
ucccaaagguguugauuuacaaagaggccagcuaauagcagaaaucaugacccugaaagagaga

SEQ ID NO: 127913 - RNA, 64 nt, Homo Sapiens
cucaucauuuguggcagucccuuauaauuggugcauagcagaugguuuccacauuuagauccug

SEQ ID NO: 127914 - RNA, 64 nt, Homo Sapiens
ucugugccuuggucucuccuuccucuuggcugagauagcagaggggcuccccgggucucucacu

SEQ ID NO: 127915 - RNA, 64 nt, Homo Sapiens
acguggguucccugcggcuccuuagucaccucugauagcagauugagggaggaaaacagguaag

SEQ ID NO: 127916 - RNA, 64 nt, Homo Sapiens
uaauccauuuuaauauggcccauauuuauuauagauagcagaagcucaauuuauuuucacaauu

SEQ ID NO: 127917 - RNA, 64 nt, Homo Sapiens
gguaagagaggaugugcaagcccaacuccaccagauagcagaggggaagcccuggagacccucg

SEQ ID NO: 127918 - RNA, 64 nt, Homo Sapiens
gucucauauuuaggaaaacuacuuagucugagaaauagcagauagcuauuuuauuaaauuuuuc

SEQ ID NO: 127919 - RNA, 64 nt, Homo Sapiens
uaaacauugaguuguacgaguggaaaaagcccuaauagcagaaaaaacaguggggaacuacugc

SEQ ID NO: 127920 - RNA, 64 nt, Homo Sapiens
uuuuuuauacaggguuaauaagauucacuugggaauagcagaauaauguauaaaguaacaauuc

SEQ ID NO: 127921 - RNA, 64 nt, Homo Sapiens
uguaauacuugaaauuuauuuuuuuauuauuuugauagcagaugugcuauuuauuuauuuaaua

SEQ ID NO: 127922 - RNA, 64 nt, Homo Sapiens
uauuauggagaugaacaugaugauguaacuuguaauagcagaauaguuaaugaaugaaacuagu

SEQ ID NO: 127923 - RNA, 64 nt, Homo Sapiens
uuuacacauauccuggagucuaccuaugucacugauagcagauauuuuucuucaacauauauua

SEQ ID NO: 127924 - RNA, 64 nt, Homo Sapiens
gaaguuaccacaggggucagguuacuuucuucaaauagcagauuucaguacuuuauccucauug

SEQ ID NO: 127925 - RNA, 64 nt, Homo Sapiens
auuucauggccgaacucuugaaauauuucucguaauagcagaaugauccaccaugcccgggcug

SEQ ID NO: 127926 - RNA, 64 nt, Homo Sapiens
guugcaccucccccaaccuuagcagaggggcugaauagcagaagagaaaaaagguuccgcuugg

SEQ ID NO: 127927 - RNA, 64 nt, Homo Sapiens
aauaccuuaaaggaacaaaacaagugaggaauaaauagcagaaacccaaacaggauuauaaagu

SEQ ID NO: 127928 - RNA, 64 nt, Homo Sapiens
ugguugaugaguucaucugauggguuaaaucugcauagcagaagggagccccucuuggacugcc

SEQ ID NO: 127929 - RNA, 64 nt, Homo Sapiens
cccacuuaacuccauaaacuccuucuugggggaaauagcagagcggaaucaacaucuuccgagu

SEQ ID NO: 127930 - RNA, 64 nt, Homo Sapiens
aucucagcaguaagcacaccguucucaguuuaagauagcagaucguggaucagugcuauugugu

SEQ ID NO: 127931 - RNA, 64 nt, Homo Sapiens
acacccuccaaacacugguuuggaugcccuucagauagcagaggggaggggggcacccccccca

SEQ ID NO: 127932 - RNA, 64 nt, Homo Sapiens
auuucuccugccccucguuguugauuggagaggaauagcagaacgaauguccguccucuguuga

SEQ ID NO: 127933 - RNA, 64 nt, Homo Sapiens
gugcuucucucuggcagcugccuuaguugaaaugauagcagaauauccauuccuugaggacaga

SEQ ID NO: 127934 - RNA, 64 nt, Homo Sapiens
gcuaguggcuucaaaauagagaaucccacuuucuauagcagauuguguaacaauuuuaaugcua

SEQ ID NO: 127935 - RNA, 64 nt, Homo Sapiens
auuuuguugcuuucuuaccuacuauuggcccuaaauagcagaaagaagagaagugaccgagaga

SEQ ID NO: 127936 - RNA, 64 nt, Homo Sapiens
uguuguuccuucauuuuuuucuuuuuaauaagacauagcagaauuccuuagguaugggauuuau

SEQ ID NO: 127937 - RNA, 64 nt, Homo Sapiens
aguuuuuaaaaauugcgcuacuugccugggaaacauagcagaccucguuucuacuaaaaauuuu

SEQ ID NO: 127938 - RNA, 64 nt, Homo Sapiens
uuuacaaaggugaugggggauauuuuguuaggugauagcagaagcuuuucauuuuuaaacauag

SEQ ID NO: 127939 - RNA, 64 nt, Homo Sapiens
cuuuuucaaucucaaauauaauuauuucugauuaauagcagaaauaagccagaaaauagaaaug

SEQ ID NO: 127940 - RNA, 64 nt, Homo Sapiens
ucugaaauaauauucugacaaugcguauuuguguauagcagaaccuggaaguacccauugaaac

SEQ ID NO: 127941 - RNA, 64 nt, Homo Sapiens
uucuuguuuaaaaaaaaauaccuaaauuuuuguuauagcagagugaaaguaccaucauaauuaa

SEQ ID NO: 127942 - RNA, 64 nt, Homo Sapiens
cuuacugugcuggacucuuucuagcguaaacaguauagcagaaauaguauauaaaagcugugcc

SEQ ID NO: 127943 - RNA, 64 nt, Homo Sapiens
cagaauggacacucuacaacggacacuuggggaaauagcagacugagccugcugccugcugagg

SEQ ID NO: 127944 - RNA, 64 nt, Homo Sapiens
cuaaagacuggguuacauauagccuuugugcucuauagcagacaauugcaggagccauaugaca

SEQ ID NO: 127945 - RNA, 64 nt, Homo Sapiens
agauauaagaaagugccucccuccugcaguuccuauagcagauacucuccuucugugaguauaa

SEQ ID NO: 127946 - RNA, 64 nt, Homo Sapiens
acugcaggaguuugccaacgccauucuucagcagauagcagaccauugucccgacauccuagag

SEQ ID NO: 127947 - RNA, 64 nt, Homo Sapiens
cugagacaugaugggaaucucauucccaccucucauagcagagccaaaccuuuaguguuggugg

SEQ ID NO: 127948 - RNA, 64 nt, Homo Sapiens
aaaccaaaaacaacagugacaauagagucucaggauagcagagucugaaaauaccuuggucucc

SEQ ID NO: 127949 - RNA, 64 nt, Homo Sapiens
uuuguguuugaaagugaaaccaacauccagaucuauagcagaguccuuauucuucucauaaauc

SEQ ID NO: 127950 - RNA, 64 nt, Homo Sapiens
aaucucugaaauuuccuuaaauuauauacuuaacauagcagagaaacuggauuguuuuuguaua

SEQ ID NO: 127951 - RNA, 64 nt, Homo Sapiens
uuccccaucuuuuagagcuguuaauagaaauuauauagcagauucuuuguugggaagacugaaa

SEQ ID NO: 127952 - RNA, 64 nt, Homo Sapiens
gagccaggcggugccaaagccucugcaacuacaaauagcagagugcgaaggugacugauucgcc

SEQ ID NO: 127953 - RNA, 64 nt, Homo Sapiens
auacaguaaaaacacaggagcuuaaaagucuaagauagcagaaacagauacuacaaauaauuuu

SEQ ID NO: 127954 - RNA, 64 nt, Homo Sapiens
uauauuguaucauuugagugguuuguggaagaauauagcagacgauagacuuaggcauuaacau

SEQ ID NO: 127955 - RNA, 64 nt, Homo Sapiens
aaaauauggauaaugaaaguacuacacauuuggaauagcagagcuguucagguuauucuuagag

SEQ ID NO: 127956 - RNA, 64 nt, Homo Sapiens
augaaacaugcaacaaaagcauuuauugccauguauagcagaaauacagaccaaagcaacaaau

SEQ ID NO: 127957 - RNA, 64 nt, Homo Sapiens
gaucaauauuaguaaccccaggccacuuuuguugauagcagauguccauggggccagguuuccu

SEQ ID NO: 127958 - RNA, 64 nt, Homo Sapiens
ugaggcggcgccaggccaagaacagcaggaguuaauagcagaguaucccagcggaacaaguggc

SEQ ID NO: 127959 - RNA, 64 nt, Homo Sapiens
uguacuuuauuauuaaauuuuuaaaaccacaaacauagcagaaagauguuuacagugaauaauu

SEQ ID NO: 127960 - RNA, 64 nt, Homo Sapiens
gagagccaaggacuagaaaaaagaaguaaaauauauagcagaauaguuuuguuuugccuuuaac

SEQ ID NO: 127961 - RNA, 64 nt, Homo Sapiens
cauugccuuucugcaucaauguguuuguuaccaaauagcagaaauuucgcuuagaaggggaaaa

SEQ ID NO: 127962 - RNA, 64 nt, Homo Sapiens
gccaaaucugaccuaaaaguaagcauuuaggagaauagcagagacauuuuauuaaacacaggga

SEQ ID NO: 127963 - RNA, 64 nt, Homo Sapiens
uggagaugcuuuuuacuuucaaccauaagcgguaauagcagaggaaagggugaagggagucugg

SEQ ID NO: 127964 - RNA, 64 nt, Homo Sapiens
caggacaauuuauuguaccauucuuucauauaccauagcagauuauccauuucaauuuuuuuuu

SEQ ID NO: 127965 - RNA, 64 nt, Homo Sapiens
gauugcuugagccauguuguuugaauugcugccaauagcagaccauaucccuaucauguuguug

SEQ ID NO: 127966 - RNA, 64 nt, Homo Sapiens
uagauucucucuggaaacugacuuugucaaauaaauagcagauuguagugucugguuugguuug

SEQ ID NO: 127967 - RNA, 64 nt, Homo Sapiens
gagaggucaagggucucuaguucaauggccagucauagcagaagggaggccaagcaccagucca

SEQ ID NO: 127968 - RNA, 64 nt, Homo Sapiens
ggcaggucugggccaggcucacagggacuccggcauagcagacccugccccagcaggcccccuu

SEQ ID NO: 127969 - RNA, 64 nt, Homo Sapiens
ucuuuaaaugaaauacauguucugauacaugcagauagcagauguuugcuucucaguuuacauu

SEQ ID NO: 127970 - RNA, 64 nt, Homo Sapiens
aauaaugcaucuuacuucuacauuacuaugacugauagcagaauaaaaacaugggacuguaugu

SEQ ID NO: 127971 - RNA, 64 nt, Homo Sapiens
ugagugguugcaacacacacugcuuucuugaacaauagcagagugcugaagugaggacugcagc

SEQ ID NO: 127972 - RNA, 64 nt, Homo Sapiens
ccaacccugaccuuccuggagcugaguaggaaggauagcagaggugcugggcucuggaccauga

SEQ ID NO: 127973 - RNA, 64 nt, Homo Sapiens
auguaagcaauauuauuguuugugcacauuacguauagcagagggucaucagcugugauauguu

SEQ ID NO: 127974 - RNA, 64 nt, Homo Sapiens
uuuuggaagacuuacgaugcauguauacaaacgaauagcagauaaugaugacuaguucacacau

SEQ ID NO: 127975 - RNA, 64 nt, Homo Sapiens
gcuguaacacaguaaauauguacuuguagccuggauagcagacuguguucaacuuuuuaaaaag

SEQ ID NO: 127976 - RNA, 64 nt, Homo Sapiens
uuguauaguauauguuuugccauauuuaauauuaauagcagaggaagacuccuuuuuucaucac

SEQ ID NO: 127977 - RNA, 64 nt, Homo Sapiens
uggcccagggaccccucacggggccaggggaggcauagcagaaagacuggccccuuccuagggu

SEQ ID NO: 127978 - RNA, 64 nt, Homo Sapiens
guauuaggccacacaguggaaccccauuuauaucauagcagaagaaauaggauuaucaauguga

SEQ ID NO: 127979 - RNA, 64 nt, Homo Sapiens
uauuuuuacuuagauuacuuuuaguuguuacaugauagcagagaaaaagaugggcucuuucugg

SEQ ID NO: 127980 - RNA, 64 nt, Homo Sapiens
cugcugcugauuaagagaauccaguguuuacagcauagcagauguugcaguguuuacaacauag

SEQ ID NO: 127981 - RNA, 64 nt, Homo Sapiens
uguccaagggguugggggaauuuccaauaauaccauagcagaaacuaaaauacaauuuugaggu

SEQ ID NO: 127982 - RNA, 64 nt, Homo Sapiens
aucucauuugacuuuguuuuaaagggcucuuuguauagcagaggauuaguauuuauaacuuuuu

SEQ ID NO: 127983 - RNA, 64 nt, Homo Sapiens
gaggauuuugauccaagcuggucccacucaguccauagcagagaaugaaagggcccagagaggg

SEQ ID NO: 127984 - RNA, 64 nt, Homo Sapiens
ggcauaaccuuuaacuauuuucaagccuuacacaauagcagagaauauaaacugaaaaaaucca

SEQ ID NO: 127985 - RNA, 64 nt, Homo Sapiens
uaaguuaggaacgaacaugugagccuacccgauuauagcagaggaaauaguuacugugcccacg

SEQ ID NO: 127986 - RNA, 64 nt, Homo Sapiens
agcugcagauuuccugcuugguguucugaggcacauagcagaggauugaccagaaaaauugaaa

SEQ ID NO: 127987 - RNA, 64 nt, Homo Sapiens
uccaaaagauugcauuuagguuaaaggcuuuuuaauagcagacugacucgaaguuaguaaaucc

SEQ ID NO: 127988 - RNA, 64 nt, Homo Sapiens
aaagcacuugaaaggaaacaauuuugacuguuccauagcagaauccacaaagcuuuacaucuuc

SEQ ID NO: 127989 - RNA, 64 nt, Homo Sapiens
ugacuuugaaggaaggaagcuuagguccacaugaauagcagaacggcacaagguccuagagaca

SEQ ID NO: 127990 - RNA, 64 nt, Homo Sapiens
ccucuccucuggccugugggguuauaagugauggauagcagaaagggagaacugacuccugucc

SEQ ID NO: 127991 - RNA, 64 nt, Homo Sapiens
cucuuguggccacacuagguggcacuggacaggcauagcagacuacaguuuucugucacuggug

SEQ ID NO: 127992 - RNA, 64 nt, Homo Sapiens
aaguacagguguguauuucuggcuggacagacugauagcagaaagaacagaauugauacuggcu

SEQ ID NO: 127993 - RNA, 64 nt, Homo Sapiens
ugugccaccauggcuuugacauuuaaucuucauuauagcagaaauauccuggaacuguuauucu

SEQ ID NO: 127994 - RNA, 64 nt, Homo Sapiens
auuauauuuugcauuauaugguuuguguuuuucuauagcagagcagaaauuaagccauuuacau

SEQ ID NO: 127995 - RNA, 64 nt, Homo Sapiens
cuuucuugccucgguucucauuacacuuucacccauagcagaaaacacuuugugcggcugccga

SEQ ID NO: 127996 - RNA, 64 nt, Homo Sapiens
auuuuguauaugcaaaacuguuugcuaaagcaaaauagcagaaaaacacaaaaguuuauugcug

SEQ ID NO: 127997 - RNA, 64 nt, Homo Sapiens
aaccagaugaggcuguggcuuacaauaugagaauauagcagaaauuggaaggcauuaugugauu

SEQ ID NO: 127998 - RNA, 64 nt, Homo Sapiens
ucuccugcugagaugggggaaauccggcugcggcauagcagaugcucguucuugccuccuucag

SEQ ID NO: 127999 - RNA, 64 nt, Homo Sapiens
uuguuucccugcuagccucagccuccauugugguauagcagaacuucacccacuuguaagccag

SEQ ID NO: 128000 - RNA, 64 nt, Homo Sapiens
guguauacacacggugcaccaaucuacaguauauauagcagagaaucagaggcuaaaaauauua

SEQ ID NO: 128001 - RNA, 64 nt, Homo Sapiens
gcagaagaggaauauaaccaaaugugacuaaaauauagcagaaauucagguuguuuguaaaaau

SEQ ID NO: 128002 - RNA, 64 nt, Homo Sapiens
gaucuuucuuugggcaagguuaagccuuuacugcauagcagaccacacagaagggugugggcca

SEQ ID NO: 128003 - RNA, 64 nt, Homo Sapiens
ggguuaugggggcgggagggcccagaguaugucuauagcagagggccgaguagaguaauauaua

SEQ ID NO: 128004 - RNA, 64 nt, Homo Sapiens
gaauggggggcgggccagggugggaagagaagaaauagcagagccuauuuuggugagguuuuuu

SEQ ID NO: 128005 - RNA, 64 nt, Homo Sapiens
agcgaguccuugagcuccacaacaucuaccagauauagcagacaagcacccauggaggcagguu

SEQ ID NO: 128006 - RNA, 64 nt, Homo Sapiens
uguuuaugaggaugauugcugguuucccuuacacauagcagagcucacucaguucucacaguag

SEQ ID NO: 128007 - RNA, 64 nt, Homo Sapiens
ggagggaaagagaguaacuaauaggggaugaaauauagcagaagcuagaagaaagcggugaggu

SEQ ID NO: 128008 - RNA, 64 nt, Homo Sapiens
ugaggcgcuguugaggacugugcgcugcaaagccauagcagauuauauuaaacauucuugcugc

SEQ ID NO: 128009 - RNA, 64 nt, Homo Sapiens
uuggaaaucaguguuuuccauaauguuauugacuauagcagauuuacaagguuuuauuccuauu

SEQ ID NO: 128010 - RNA, 64 nt, Homo Sapiens
gaccauuuacggggagaaacuugauucugggaagauagcagaguacaaaccagcugccucacuu

SEQ ID NO: 128011 - RNA, 64 nt, Homo Sapiens
ucggacaaacucagaauauaucuagagaagagcuauagcagaucauguugucaggucguucuua

SEQ ID NO: 128012 - RNA, 64 nt, Homo Sapiens
uauauacgugugguucauccaucaucugcugcacauagcagacuagaauucugggaacccugug

SEQ ID NO: 128013 - RNA, 64 nt, Homo Sapiens
uuccugaauguuucagagaaacaggaaucagaaaauagcagauaucauguaggaaagagaggau

SEQ ID NO: 128014 - RNA, 64 nt, Homo Sapiens
cuugggcucaggccugagguuuugcaucuguucaauagcagaggagagagggguguacugucug

SEQ ID NO: 128015 - RNA, 64 nt, Homo Sapiens
agccugucuguacuucauucacacugccuggaggauagcagagaugcccuuuuccuugacuauu

SEQ ID NO: 128016 - RNA, 64 nt, Homo Sapiens
gacccagaaagaauuuucuguuuaccaagacuuuauagcagaugccucuucaugguaaugcugu

SEQ ID NO: 128017 - RNA, 64 nt, Homo Sapiens
uuuaugcugcuccugauauaacacuuuccagccuauagcagaagcacauuuucagacugcaaua

SEQ ID NO: 128018 - RNA, 64 nt, Homo Sapiens
augucauagaaacuguaugaacaaccagauuuacauagcagagaaaucauacauugaaugcuua

SEQ ID NO: 128019 - RNA, 64 nt, Homo Sapiens
auaguuuuacuuauuuuguuuacucuaaaaaucuauagcagaguuucucuauuuuauauuucau

SEQ ID NO: 128020 - RNA, 64 nt, Homo Sapiens
gaaguauuguucauauuugucaccucuuggaaugauagcagauccuguaaguugauguauuaau

SEQ ID NO: 128021 - RNA, 64 nt, Homo Sapiens
ucacuccccauguucuaguauuauuuuguaacaaauagcagacaucugaucauuuuauccauaa

SEQ ID NO: 128022 - RNA, 64 nt, Homo Sapiens
auccugaaaaaugagucuccauugcuuuuauaaaauagcagaauuagcuuugcuucaaaagaaa

SEQ ID NO: 128023 - RNA, 64 nt, Homo Sapiens
uguguggcuuuuguuuuagaauuuuguucaaauuauagcagaauuuaggcaaaaauaaaacaga

SEQ ID NO: 128024 - RNA, 64 nt, Homo Sapiens
aucccuguuauuuugugaauugggacaagauaacauagcagaggaauuaauaauuuuuuugaaa

SEQ ID NO: 128025 - RNA, 64 nt, Homo Sapiens
ccgguguuugcugguuucagggaaggaguuugauauagcagauuaaccacccuccuuguagcua

SEQ ID NO: 128026 - RNA, 64 nt, Homo Sapiens
ggaaaucccuuucaacagaguguggaaggaguguauagcagagacguuucuacccaaaguugug

SEQ ID NO: 128027 - RNA, 64 nt, Homo Sapiens
uuuggugguucagaguuauauguagcaaggcuugauagcagaggucuuucuggacagccaugac

SEQ ID NO: 128028 - RNA, 64 nt, Homo Sapiens
ccaauucaauagaaucaguuagaaaacaagaugaauagcagagggccaaacaguaaccuccagg

SEQ ID NO: 128029 - RNA, 64 nt, Homo Sapiens
uuuccccucucucuaacucuaacugcugaagaaaauagcagacgaagcccuucccauaaaacac

SEQ ID NO: 128030 - RNA, 64 nt, Homo Sapiens
ugucagucuccugucuccuuuugcucugucugugcgcugguaaaguccagguccucauccgucc

SEQ ID NO: 128031 - RNA, 64 nt, Homo Sapiens
caggucuaggcaccacacagcccgacccccagagcgcugguacaggcccgugccuuagacuucu

SEQ ID NO: 128032 - RNA, 64 nt, Homo Sapiens
agaaaaguagguccagccuuaagcagcacagaugcgcugguagaugcauagucaggaacuuuuu

SEQ ID NO: 128033 - RNA, 64 nt, Homo Sapiens
aaagguaggaaaacaauagacucauuacagcuaacgcugguaaucagcucuuuuuucuagaauc

SEQ ID NO: 128034 - RNA, 64 nt, Homo Sapiens
agaaggauucuuuuuucaauguacuguauugggacgcugguaacuguuaacccaguguucagca

SEQ ID NO: 128035 - RNA, 64 nt, Homo Sapiens
guagcucagugguguggggaaucacaaucaugaucgcugguaaauaacuuaauaagccuauucc

SEQ ID NO: 128036 - RNA, 64 nt, Homo Sapiens
aaaaucaguuacucuaauuccaggugaagcaagccgcugguagcaucacccuuaugagaaguga

SEQ ID NO: 128037 - RNA, 64 nt, Homo Sapiens
ggccauccagacggugcaggcugugagaacaugacgcugguagaguccuggccuuccucaugau

SEQ ID NO: 128038 - RNA, 64 nt, Homo Sapiens
auacuaugaagccucugauacuuaaacagcauggcgcugguacguaaauagaccaaugcaguua

SEQ ID NO: 128039 - RNA, 64 nt, Homo Sapiens
guacacuaaaagacuuugauuaacuacaguauagcgcugguacagugaaguucauuuaaaaaaa

SEQ ID NO: 128040 - RNA, 64 nt, Homo Sapiens
gggcucugcacuugaaggcaggacccucagaccucgcugguaaaggucaaauggggucaucugc

SEQ ID NO: 128041 - RNA, 64 nt, Homo Sapiens
cacgcaacguacugggcaaaugacaauccucagccgcugguauuuucuaaggggucucuucacu

SEQ ID NO: 128042 - RNA, 64 nt, Homo Sapiens
aauaagcccaugugaugucccuucacguaaccuucgcugguaaacuggcugagugcguuuuguc

SEQ ID NO: 128043 - RNA, 64 nt, Homo Sapiens
cuuuuguuaaaagagagagaccugagccugaggccgcugguagacgcuuuuaccugagacaggc

SEQ ID NO: 128044 - RNA, 64 nt, Homo Sapiens
ccaggccugguggacacaggaagccuacccaacacgcugguauuuggccaacacugaggaugug

SEQ ID NO: 128045 - RNA, 64 nt, Homo Sapiens
ggggcucggaccccucacugcuugucuauucagacgcugguaugggggugguggcaccagagcu

SEQ ID NO: 128046 - RNA, 64 nt, Homo Sapiens
gauggaggaggaggcaauugcagacuggaggggacgcugguagacccaggaggacugccccgug

SEQ ID NO: 128047 - RNA, 64 nt, Homo Sapiens
cuggagcccuccccaggaugugagccaguccccucgcugguacggaaugccgcugggugcccgg

SEQ ID NO: 128048 - RNA, 64 nt, Homo Sapiens
gacacuucaagguucacuguagcugagccauggccgcugguaacagacaucaggguuccagacu

SEQ ID NO: 128049 - RNA, 64 nt, Homo Sapiens
uggagaccaccuccgaggccugauucuggggguccgcugguaugucucccucuuuccugcaggg

SEQ ID NO: 128050 - RNA, 64 nt, Homo Sapiens
ggugugaaugaacuucccuccuaguugcugauggcgcugguaccugcuggcccauggcccgggu

SEQ ID NO: 128051 - RNA, 64 nt, Homo Sapiens
caugugagccgcacaggucacacuagagaagcugcgcugguaucuuuccuggucgugugcugag

SEQ ID NO: 128052 - RNA, 64 nt, Homo Sapiens
gaggcagagggcaaagagaguggcaucuuaacugcaguuucaauucuggacccugggacugucu

SEQ ID NO: 128053 - RNA, 64 nt, Homo Sapiens
auugggugagacagagacaaucuugguuacacugcaguuucaggagugcuucucuuuggcuuuu

SEQ ID NO: 128054 - RNA, 64 nt, Homo Sapiens
acacuaaucugauuuucacuucuauuuuucuacucaguuucagagacauucuuuuuuuuauaag

SEQ ID NO: 128055 - RNA, 64 nt, Homo Sapiens
ccuaccuuguucacauaccauuuucagacaucugcaguuucauccugucaggaugcuuaagcuc

SEQ ID NO: 128056 - RNA, 64 nt, Homo Sapiens
cuucugcauauggcuagccaguaagcugggggcccaguuucaauaguugauuuuuguaugcaga

SEQ ID NO: 128057 - RNA, 64 nt, Homo Sapiens
caagaaaaguuuaaaauuaauauauguguuauagcaguuucauuacuguugcucauuuuguaag

SEQ ID NO: 128058 - RNA, 64 nt, Homo Sapiens
agauggucauauuuaaacagaaguauacguuuuucaguuucaacaugaauuuuuuuauuucugu

SEQ ID NO: 128059 - RNA, 64 nt, Homo Sapiens
auuuggguuuuguucuuguauugcuuucuuucaacaguuucaaaauaaaauaucauauaaauau

SEQ ID NO: 128060 - RNA, 64 nt, Homo Sapiens
guccuggcuuuguggcaaccccagggaggugcagcaguuucacuccuuccuccacuguguccag

SEQ ID NO: 128061 - RNA, 64 nt, Homo Sapiens
gacaccaucaaaauuuaagaccaugaugaaauuucaguuucauucaaauguuaccuaaaauuua

SEQ ID NO: 128062 - RNA, 64 nt, Homo Sapiens
auucauuuuacuuuuucauuuuggggugaagauucaguuucagucuuuugaauauagguuucca

SEQ ID NO: 128063 - RNA, 64 nt, Homo Sapiens
ccaccacuuccuaaaucuuaagaacuuuaauugacaguuucaauugaaggugcuguuuguagac

SEQ ID NO: 128064 - RNA, 64 nt, Homo Sapiens
uuccaugaaggcuuauaacuggucuuucuaugggcaguuucaccgcgcugugcuuuguauaagu

SEQ ID NO: 128065 - RNA, 64 nt, Homo Sapiens
uugcaucagcuuucccccaucucaugagggauggcaguuucacucauaagaauuacuugguggc

SEQ ID NO: 128066 - RNA, 64 nt, Homo Sapiens
uuuuuuuugcaugaagaaaaaugucuaucauuuacaguuucaauagcacauaauuuauuuucua

SEQ ID NO: 128067 - RNA, 64 nt, Homo Sapiens
gaaacauucagaucccucuuccuuuacucaaauacaguuucaaaaggaagacucaugagaaauu

SEQ ID NO: 128068 - RNA, 64 nt, Homo Sapiens
ucugcuuuuggggaauuguguuuuauuaaagcuacaguuucaguucaaaagaauuguuggagcu

SEQ ID NO: 128069 - RNA, 64 nt, Homo Sapiens
cugaaaccacccuucacccugaccugagguguaacaguuucaucaugagaaucuaaugcuugau

SEQ ID NO: 128070 - RNA, 64 nt, Homo Sapiens
uaguagauuuuuggccuuuccuguuuuuaaaaaucaguuucauuuucauauuucauagaucagc

SEQ ID NO: 128071 - RNA, 64 nt, Homo Sapiens
uuuugauguacaucgagcugaauucuguuuuuaccaguuucaaaaccuucaagugauaugugga

SEQ ID NO: 128072 - RNA, 64 nt, Homo Sapiens
uguccucuacauuggaaagcuaauccuaccuugucaguuucaaccaacugaguuuuuucuuuaa

SEQ ID NO: 128073 - RNA, 64 nt, Homo Sapiens
agguuccaaacuaauauggcauauaucaacucuacaguuucaaauaaaugacuuuuuaauugua

SEQ ID NO: 128074 - RNA, 64 nt, Homo Sapiens
gguacgcagacaaacacaugaacaucgacuuugacaguuucaucugcugcuucguuaggcugga

SEQ ID NO: 128075 - RNA, 64 nt, Homo Sapiens
cucauccaaagccaugcaggaucacucaggauuucaguuucacccucuauuuccaaagccauuu

SEQ ID NO: 128076 - RNA, 64 nt, Homo Sapiens
aguacaguguuuucaaucuaaaaagaaguauuggcaguuucacuugcaaaauuacacagcuggu

SEQ ID NO: 128077 - RNA, 64 nt, Homo Sapiens
auauuuugaaacugucugcuuuuugcuauuucugcaguuucaaguuaguuagaagcauguuguc

SEQ ID NO: 128078 - RNA, 64 nt, Homo Sapiens
agccuagaucuuguuaacccaucaggugcagugucaguuucaaaucaaauuaucuaagaaaaca

SEQ ID NO: 128079 - RNA, 64 nt, Homo Sapiens
ugaaggugcuguuuguagacagaacuuuaauugacaguuucaauccaccacuuccuaaaucuua

SEQ ID NO: 128080 - RNA, 64 nt, Homo Sapiens
cuuuuggauauagguuuccauuggggugaagauucaguuucagucauuuuauuuuguuuucauu

SEQ ID NO: 128081 - RNA, 64 nt, Homo Sapiens
cuaagagacuggugacauccagcaugggcaguuucaguuucagcccauacuucgccaagguugu

SEQ ID NO: 128082 - RNA, 64 nt, Homo Sapiens
uucagccuaagagacugguggguuguagcaugggcaguuucagugugucuccauacuucgccaa

SEQ ID NO: 128083 - RNA, 64 nt, Homo Sapiens
caguuccagcuuccuaaaauagacaguggguaucgggcagcagucacuggggcucaagggcagu

SEQ ID NO: 128084 - RNA, 64 nt, Homo Sapiens
uaguuguuuacauuucuugaaaaaauaggaacucgggcagcagaaucagauuggcagaaucuuu

SEQ ID NO: 128085 - RNA, 64 nt, Homo Sapiens
auucagcaccagugaaaggcuuugagaaggacgugggcagcaaaacgacacugcgcaucaccua

SEQ ID NO: 128086 - RNA, 64 nt, Homo Sapiens
cagacccagagaaggacggugccaagggccccaggggcagcaaggccuugguggagcagccaga

SEQ ID NO: 128087 - RNA, 64 nt, Homo Sapiens
cccagcaggcccagcaugcagguggugggacacugggcagcaaggcugcugccggaaucacuuc

SEQ ID NO: 128088 - RNA, 64 nt, Homo Sapiens
ugucuguguuguuagaacucagaggaagaggcaggggcagcagccgacagggggcagcaugacc

SEQ ID NO: 128089 - RNA, 64 nt, Homo Sapiens
cucagaggaagaggcaggggcagcagccgacagggggcagcaugacccaagcaaggggccugag

SEQ ID NO: 128090 - RNA, 64 nt, Homo Sapiens
uacgggguucuuggagagucggccagacggcggggggcagcaggaacuuugccucauaccccac

SEQ ID NO: 128091 - RNA, 64 nt, Homo Sapiens
ugacuccauauggaggccucacacccagaggguagggcagcagaucuucuuuauaacuauuuau

SEQ ID NO: 128092 - RNA, 64 nt, Homo Sapiens
agcacagggagaauguugacuuagaagcaauagggggcagcaggccaccaagagcacaacccca

SEQ ID NO: 128093 - RNA, 64 nt, Homo Sapiens
gggaauguggcacugucuauccauccgguggacugggcagcauuccuccccagggcucuucccu

SEQ ID NO: 128094 - RNA, 64 nt, Homo Sapiens
caccaccuccauaucccggcuuuuggggccuccagggcagcaggugugcucuuucaggugggag

SEQ ID NO: 128095 - RNA, 64 nt, Homo Sapiens
cagccacuucacccugggggggccuuguuagcaugggcagcaugcuuugcagggcccaguugau

SEQ ID NO: 128096 - RNA, 64 nt, Homo Sapiens
ggugcccaaaucuggcuggugccuggggcaugcugggcagcaccggcgacucccauacccugaa

SEQ ID NO: 128097 - RNA, 64 nt, Homo Sapiens
gaguagggcagggcuacgggccacuugagacugggggcagcaugggugaaggcaaguucaagca

SEQ ID NO: 128098 - RNA, 64 nt, Homo Sapiens
uccuuagucccagcucaggcgaagaaccaagucagggcagcaucuaaccuaacgaaauuuccau

SEQ ID NO: 128099 - RNA, 64 nt, Homo Sapiens
ugucccccagccucgauggagcugucuccagugggggcagcagccuucuacugaaggacagucc

SEQ ID NO: 128100 - RNA, 64 nt, Homo Sapiens
ccacugucuugcaguggacggagagccuuggcgagggcagcaggguagagaggacaaagaaugu

SEQ ID NO: 128101 - RNA, 64 nt, Homo Sapiens
acagagaucacacacaccaaaccagacagaggcagggcagcauggagacagguagacagaccuc

SEQ ID NO: 128102 - RNA, 64 nt, Homo Sapiens
cccaucauuuuuuugaauuuagaggcccagcagagggcagcaccaaguugaagucgacugccaa

SEQ ID NO: 128103 - RNA, 64 nt, Homo Sapiens
aaaauaauacaaaacuuaaguaaaggauguuugagggcagcagggaccugucuuugggaaacau

SEQ ID NO: 128104 - RNA, 64 nt, Homo Sapiens
gcgcuggggagagggaugaaggcucggcggcccagggcagcacccaaggucugggcaaacucag

SEQ ID NO: 128105 - RNA, 64 nt, Homo Sapiens
cugagccgauggggccccccaggcccaggcgaaagggcagcagcauguggcccauggcaccacc

SEQ ID NO: 128106 - RNA, 64 nt, Homo Sapiens
uaguguccaagcaucuuagcuguucaagaggagagggcagcauaacuuccugaccaccgguguc

SEQ ID NO: 128107 - RNA, 64 nt, Homo Sapiens
uuccaaggguuugccuugugucucagcucauucugggcagcacguuugucuucugucccuagag

SEQ ID NO: 128108 - RNA, 64 nt, Homo Sapiens
cgugggagucagggcugcauggcacccccucccggggcagcaggcaacauagcuuccccaccca

SEQ ID NO: 128109 - RNA, 64 nt, Homo Sapiens
gcugacaguugcugcaugcccagugcgcaagcuggggcagcaaggagagcagccuggcccucac

SEQ ID NO: 128110 - RNA, 64 nt, Homo Sapiens
aaggcugccuucauggccaucuagccccaguucagggcagcauccauagcccacaagccagcgu

SEQ ID NO: 128111 - RNA, 64 nt, Homo Sapiens
accaguaucaggauuucuguucugagagcagcgugggcagcaaggcagggcagcccagaggugg

SEQ ID NO: 128112 - RNA, 64 nt, Homo Sapiens
aggcugggaguuaggagggaagggucccagaagggggcagcagcuucucaaaguccagaaaauu

SEQ ID NO: 128113 - RNA, 64 nt, Homo Sapiens
accauuuuucagaaucaagacugugguucuccaugggcagcaggugcaugagaaaucuaucuua

SEQ ID NO: 128114 - RNA, 64 nt, Homo Sapiens
aaauguggugagcaucauuagcauagaccccacagggcagcagcccuggaugaaccaucuacgg

SEQ ID NO: 128115 - RNA, 64 nt, Homo Sapiens
agugauuacaagguaagaaaccuuauaucaccaugggcagcaucugguucuauguagcauuucu

SEQ ID NO: 128116 - RNA, 64 nt, Homo Sapiens
cuggccggggguuggggagccacacagggugaacgggcagcagccggcuccaugccccacugcc

SEQ ID NO: 128117 - RNA, 64 nt, Homo Sapiens
uggcaucagcccuggggccuccuggguggcaggggggcagcagcucuccuccccacucacaggc

SEQ ID NO: 128118 - RNA, 64 nt, Homo Sapiens
gcaagacccugucucuaaaaaaaaugaccagccugggcagcauaacacgugggaacuaaagaga

SEQ ID NO: 128119 - RNA, 64 nt, Homo Sapiens
gcuggggagaggggcuccugcggggggacuaggagggcagcauuucuuacuuucagaauuucca

SEQ ID NO: 128120 - RNA, 64 nt, Homo Sapiens
agagccuauuugggacagcauuaggaagaggggggggcagcaaguagacacuggcauuaucccu

SEQ ID NO: 128121 - RNA, 64 nt, Homo Sapiens
auaacaggaggaagagaucccucauuaagaugcugggcagcaguugcuugccuauaccuggcac

SEQ ID NO: 128122 - RNA, 64 nt, Homo Sapiens; identical to SEQ ID NO: 72441

SEQ ID NO: 128123 - RNA, 64 nt, Homo Sapiens; identical to SEQ ID NO: 72442

SEQ ID NO: 128124 - RNA, 64 nt, Homo Sapiens; identical to SEQ ID NO: 72443

SEQ ID NO: 128125 - RNA, 64 nt, Homo Sapiens; identical to SEQ ID NO: 72444

SEQ ID NO: 128126 - RNA, 64 nt, Homo Sapiens; identical to SEQ ID NO: 72445

SEQ ID NO: 128127 - RNA, 64 nt, Homo Sapiens; identical to SEQ ID NO: 72446

SEQ ID NO: 128128 - RNA, 64 nt, Homo Sapiens; identical to SEQ ID NO: 72447

SEQ ID NO: 128129 - RNA, 64 nt, Homo Sapiens; identical to SEQ ID NO: 72448

SEQ ID NO: 128130 - RNA, 64 nt, Homo Sapiens; identical to SEQ ID NO: 72449

SEQ ID NO: 128131 - RNA, 64 nt, Homo Sapiens; identical to SEQ ID NO: 72450

SEQ ID NO: 128132 - RNA, 64 nt, Homo Sapiens; identical to SEQ ID NO: 72451

SEQ ID NO: 128133 - RNA, 64 nt, Homo Sapiens; identical to SEQ ID NO: 72452

SEQ ID NO: 128134 - RNA, 64 nt, Homo Sapiens; identical to SEQ ID NO: 72453

SEQ ID NO: 128135 - RNA, 64 nt, Homo Sapiens; identical to SEQ ID NO: 72454

SEQ ID NO: 128136 - RNA, 64 nt, Homo Sapiens; identical to SEQ ID NO: 72455

SEQ ID NO: 128137 - RNA, 64 nt, Homo Sapiens; identical to SEQ ID NO: 72456

SEQ ID NO: 128138 - RNA, 64 nt, Homo Sapiens; identical to SEQ ID NO: 72457

SEQ ID NO: 128139 - RNA, 64 nt, Homo Sapiens; identical to SEQ ID NO: 72458

SEQ ID NO: 128140 - RNA, 64 nt, Homo Sapiens; identical to SEQ ID NO: 72459

SEQ ID NO: 128141 - RNA, 64 nt, Homo Sapiens; identical to SEQ ID NO: 72460

SEQ ID NO: 128142 - RNA, 64 nt, Homo Sapiens; identical to SEQ ID NO: 72461

SEQ ID NO: 128143 - RNA, 64 nt, Homo Sapiens; identical to SEQ ID NO: 72462

SEQ ID NO: 128144 - RNA, 64 nt, Homo Sapiens; identical to SEQ ID NO: 72463

SEQ ID NO: 128145 - RNA, 64 nt, Homo Sapiens; identical to SEQ ID NO: 72464

SEQ ID NO: 128146 - RNA, 64 nt, Homo Sapiens; identical to SEQ ID NO: 72465

SEQ ID NO: 128147 - RNA, 64 nt, Homo Sapiens; identical to SEQ ID NO: 72466

SEQ ID NO: 128148 - RNA, 64 nt, Homo Sapiens; identical to SEQ ID NO: 72467

SEQ ID NO: 128149 - RNA, 64 nt, Homo Sapiens; identical to SEQ ID NO: 72468

SEQ ID NO: 128150 - RNA, 64 nt, Homo Sapiens; identical to SEQ ID NO: 72469

SEQ ID NO: 128151 - RNA, 64 nt, Homo Sapiens; identical to SEQ ID NO: 72470

SEQ ID NO: 128152 - RNA, 64 nt, Homo Sapiens; identical to SEQ ID NO: 72471

SEQ ID NO: 128153 - RNA, 64 nt, Homo Sapiens; identical to SEQ ID NO: 72472

SEQ ID NO: 128154 - RNA, 64 nt, Homo Sapiens; identical to SEQ ID NO: 72473

SEQ ID NO: 128155 - RNA, 64 nt, Homo Sapiens; identical to SEQ ID NO: 72474

SEQ ID NO: 128156 - RNA, 64 nt, Homo Sapiens; identical to SEQ ID NO: 72475

SEQ ID NO: 128157 - RNA, 64 nt, Homo Sapiens; identical to SEQ ID NO: 72476

SEQ ID NO: 128158 - RNA, 64 nt, Homo Sapiens; identical to SEQ ID NO: 72477

SEQ ID NO: 128159 - RNA, 64 nt, Homo Sapiens; identical to SEQ ID NO: 72478

SEQ ID NO: 128160 - RNA, 64 nt, Homo Sapiens; identical to SEQ ID NO: 72479

SEQ ID NO: 128161 - RNA, 64 nt, Homo Sapiens; identical to SEQ ID NO: 72480

SEQ ID NO: 128162 - RNA, 64 nt, Homo Sapiens; identical to SEQ ID NO: 72481

SEQ ID NO: 128163 - RNA, 64 nt, Homo Sapiens; identical to SEQ ID NO: 72482

SEQ ID NO: 128164 - RNA, 64 nt, Homo Sapiens; identical to SEQ ID NO: 72483

SEQ ID NO: 128165 - RNA, 64 nt, Homo Sapiens; identical to SEQ ID NO: 72484

SEQ ID NO: 128166 - RNA, 64 nt, Homo Sapiens; identical to SEQ ID NO: 72485

SEQ ID NO: 128167 - RNA, 64 nt, Homo Sapiens; identical to SEQ ID NO: 72486

SEQ ID NO: 128168 - RNA, 64 nt, Homo Sapiens; identical to SEQ ID NO: 72487

SEQ ID NO: 128169 - RNA, 64 nt, Homo Sapiens; identical to SEQ ID NO: 72488

SEQ ID NO: 128170 - RNA, 64 nt, Homo Sapiens; identical to SEQ ID NO: 72489

SEQ ID NO: 128171 - RNA, 64 nt, Homo Sapiens; identical to SEQ ID NO: 72490

SEQ ID NO: 128172 - RNA, 64 nt, Homo Sapiens; identical to SEQ ID NO: 72491

SEQ ID NO: 128173 - RNA, 64 nt, Homo Sapiens; identical to SEQ ID NO: 72492

SEQ ID NO: 128174 - RNA, 64 nt, Homo Sapiens; identical to SEQ ID NO: 72493

SEQ ID NO: 128175 - RNA, 64 nt, Homo Sapiens
aaugaauugaggaagugaaaagagaggaagggagaagggagaggcagaaaggaaaaaaaggaag

SEQ ID NO: 128176 - RNA, 64 nt, Homo Sapiens
ggagaggaaugaauugaggaaaggaagagagaggaagggagaagggaaaagcagaaaggaaaaa

SEQ ID NO: 128177 - RNA, 64 nt, Homo Sapiens
gagacucaucugacacuucuaaaacuuuggggacaagggagagaaacaaaagggagagccccac

SEQ ID NO: 128178 - RNA, 64 nt, Homo Sapiens
cccacaaaacuuuggggacacuagagggaaacaaaagggagagcaggggcaacacaguuccauu

SEQ ID NO: 128179 - RNA, 64 nt, Homo Sapiens
ggcagugggaaaagaggugaacugugagcuggaaaagggagaaaaaaaggcccggcccaggacc

SEQ ID NO: 128180 - RNA, 64 nt, Homo Sapiens
aaaagcaagccagaagcagaaucaacucuaggacaagggagaacaccccauucccucuuuaucu

SEQ ID NO: 128181 - RNA, 64 nt, Homo Sapiens
accaauaaaaaaaugacuccuaguuguguuuggaaagggagagaagagaugucugaggaagguc

SEQ ID NO: 128182 - RNA, 64 nt, Homo Sapiens
uggccaccacgcagccuuggcuccuacagcccaaaagggagaauggagggaggcuccaggcuuu

SEQ ID NO: 128183 - RNA, 64 nt, Homo Sapiens
aaacucuucugaggaucauugcugugaagggagaaagggagagaauaaugaucuuggaauauuu

SEQ ID NO: 128184 - RNA, 64 nt, Homo Sapiens
gggagagaaaacucuucugagaauauuugcugugaagggagaaaguacugaaauaaugaucuug

SEQ ID NO: 128185 - RNA, 64 nt, Homo Sapiens
aaaaaaacaaaaaaacaaaaagagcaaagcccaaaagggagaaacugaagauuaaugcagagaa

SEQ ID NO: 128186 - RNA, 64 nt, Homo Sapiens
auuucaaagcuacuguuccuugcuagggaggguaaagggagacuacgcucuggguccuguuauu

SEQ ID NO: 128187 - RNA, 64 nt, Homo Sapiens
accucuuagcaaagcccugugagcagaaaagaaaaagggagaaagcaaccgccaaauuguuuca

SEQ ID NO: 128188 - RNA, 64 nt, Homo Sapiens
guggcauaacuuuuuggaaccaggggugagaaggaagggagaagggcugguggcugggacccuc

SEQ ID NO: 128189 - RNA, 64 nt, Homo Sapiens
aaggucugugugguugucuucacgggcaaucaggaagggagagagcuggggaccauauucugca

SEQ ID NO: 128190 - RNA, 64 nt, Homo Sapiens
cugcaaugcagccaaauccgaggaagagaaacugaagggagaaguagauggcaaugguuaugau

SEQ ID NO: 128191 - RNA, 64 nt, Homo Sapiens
aggggucgccaacacuugugguggacagagggagaagggagaacucuuuuaucauugcaggcca

SEQ ID NO: 128192 - RNA, 64 nt, Homo Sapiens
gaaauacaaggagggccucuuggaauuaccugauaagggagagggguaugggaccugcuaagug

SEQ ID NO: 128193 - RNA, 64 nt, Homo Sapiens
gugucagugacacaguuuccaacacugcaaacagaagggagaaauucaagcacuugauuaacac

SEQ ID NO: 128194 - RNA, 64 nt, Homo Sapiens
cuaacagauaggccaaaguauauccuauccacccaagggagacaguggacucuuuaaaaucugg

SEQ ID NO: 128195 - RNA, 64 nt, Homo Sapiens
uaaauucuccauuauguucgauuugauugugaagaagggagaguccauuugauaagagaaaugc

SEQ ID NO: 128196 - RNA, 64 nt, Homo Sapiens
gagcaguaugccacuucuuaaaagaaauuauccaaagggagaaauuuuuccuuugaugggcuua

SEQ ID NO: 128197 - RNA, 64 nt, Homo Sapiens
aaguguccucagccgacacucacgagggcagugcaagggagaaccugccagcccagccccacca

SEQ ID NO: 128198 - RNA, 64 nt, Homo Sapiens
ugaaagcgugguucuguaagaaaucagagggagaaagggagagaagggggagggagacaaccca

SEQ ID NO: 128199 - RNA, 64 nt, Homo Sapiens
ggaagaagaagucuaaaagaaaacaucauuugcaaagggagagaggggcaagcaugauauguug

SEQ ID NO: 128200 - RNA, 64 nt, Homo Sapiens
aguucugaucuuugggcauggccaggggaagcagaagggagacucuaggaguugaaauggguca

SEQ ID NO: 128201 - RNA, 64 nt, Homo Sapiens
uacugggaggugcaagacaggggcuguucaugaaaagggagacugaccauuguaccuggcacaa

SEQ ID NO: 128202 - RNA, 64 nt, Homo Sapiens
gagcuagagggacaaagagauugguggggaugagaagggagagagcagguucaaguuccacuuc

SEQ ID NO: 128203 - RNA, 64 nt, Homo Sapiens
uuuuagucaguaagacgauaaggaguuuuauauuaagggagacagagaccuucagaaacuaagg

SEQ ID NO: 128204 - RNA, 64 nt, Homo Sapiens
aaaccugaauauuauuaccaucccacagaugcaaaagggagaauccucucucuaacucugggua

SEQ ID NO: 128205 - RNA, 64 nt, Homo Sapiens
caagcuggcugugaacugucugggaggggaagggaagggagaggaggcuggggcuggggguggc

SEQ ID NO: 128206 - RNA, 64 nt, Homo Sapiens
uagagaggggcccgugaagugcguuugcucaguuaagggagagggugaaguggguggagcauca

SEQ ID NO: 128207 - RNA, 64 nt, Homo Sapiens
gcugcguggaaagugggggaucuccuccccagaauggauuaacagugagcagauggcuaaguuc

SEQ ID NO: 128208 - RNA, 64 nt, Homo Sapiens
gaaguuuuccauuugauaccuuaaguucuuauuuuggauuaaaaaugaugcuuugugugauaca

SEQ ID NO: 128209 - RNA, 64 nt, Homo Sapiens
ugacuaauggugucacugcuggcaauggugauaauggauuaauuccucaaaggaagagcagaac

SEQ ID NO: 128210 - RNA, 64 nt, Homo Sapiens
ugacuaauggugccacugcuggcaauggugaugauggauuaauuccuccaaggaagagcagaac

SEQ ID NO: 128211 - RNA, 64 nt, Homo Sapiens
aucagcugccucucgaauggaagaacagugguaauggauuaacauccuauuuuguuguacuaaa

SEQ ID NO: 128212 - RNA, 64 nt, Homo Sapiens
guuuguugucuuauuugugguggcacucguuuaauggauuaacugagguugcucaauguucagu

SEQ ID NO: 128213 - RNA, 64 nt, Homo Sapiens
uuacuuccugccucagucugcuuucucuacugucuggauuaauuaggcagccugcuauaaaguu

SEQ ID NO: 128214 - RNA, 64 nt, Homo Sapiens
guuuuugguuucuuauucaaagaugauaauuuaguggauuaaccaguccagacgcacugaucuu

SEQ ID NO: 128215 - RNA, 64 nt, Homo Sapiens
aaaugugguacauacacacccaucagugacagacuggauuaaaaauguucguugcagcacugcc

SEQ ID NO: 128216 - RNA, 64 nt, Homo Sapiens
acuuaauguaaaacccaaaaaaauuaacucaagauggauuaaagcuuccuuaugccauauacaa

SEQ ID NO: 128217 - RNA, 64 nt, Homo Sapiens
uauguauuaugcuuuguauccgaaagggucuaaguggauuaauauuaaaacuauguauauuaau

SEQ ID NO: 128218 - RNA, 64 nt, Homo Sapiens
uuaaauguuauuuuugccuuucaauguaaucaauuggauuaacaaugcugcaauauaauuuagc

SEQ ID NO: 128219 - RNA, 64 nt, Homo Sapiens
uaucugauaaugugucucacuauucaugugucacuggauuaauucuuuaaaaacucuaaaucuu

SEQ ID NO: 128220 - RNA, 64 nt, Homo Sapiens
ggccuuucaaaagaaugggugguuuacaugaaaguggauuaaaaaaacuuuuuaaauuuaaauu

SEQ ID NO: 128221 - RNA, 64 nt, Homo Sapiens
ccaaucugacaauaauguguucaucaggugccuauggauuaaaucacauacuggcauauuuaag

SEQ ID NO: 128222 - RNA, 64 nt, Homo Sapiens
agagugcaauauauaauaaucauuuuuaaaguauuggauuaaaucugauagguuuuccagaaau

SEQ ID NO: 128223 - RNA, 64 nt, Homo Sapiens
cugauagguuuuccagaaaucauuuuuaaaguauuggauuaaauagauugcaauauauaauaau

SEQ ID NO: 128224 - RNA, 64 nt, Homo Sapiens
cacauacuggcauauuuaagucaucaggugccuguggauuaaauccaaucugacaauaaugugu

SEQ ID NO: 128225 - RNA, 64 nt, Homo Sapiens
ucugaaacaugugcuguguccacucaggguuaaauggauuaaggguggugcaagaugugcuuug

SEQ ID NO: 128226 - RNA, 64 nt, Homo Sapiens
gucauuguuuccauuuuuuuuuuaauucuucccuuggauuaauauuuucuacugaaaagaaaug

SEQ ID NO: 128227 - RNA, 64 nt, Homo Sapiens
auuguggagcacauuucaaugauuaagaaugcuuuggauuaagguagacauaucugaagagaug

SEQ ID NO: 128228 - RNA, 64 nt, Homo Sapiens
augcuuuggauuaaggauugcauaucugaagagauggauuaagauucaugugucuuucuguaga

SEQ ID NO: 128229 - RNA, 64 nt, Homo Sapiens
ggugauugggccaugaggucugugcccuccugaauggauuaauccauucauggauuaauggauu

SEQ ID NO: 128230 - RNA, 64 nt, Homo Sapiens
ggucugugcccuccugaauggauuaauccauucauggauuaauggauuauuaugagugggggac

SEQ ID NO: 128231 - RNA, 64 nt, Homo Sapiens
uagucaaagacauuuuauccacauuucuaauaguggacuugauuaaguagauaagaucagcauc

SEQ ID NO: 128232 - RNA, 64 nt, Homo Sapiens
uuauuuuguaaucuuguuuaacuuguugcuacugggacuugauuuacuguggcacuaguuaagu

SEQ ID NO: 128233 - RNA, 64 nt, Homo Sapiens
uauuucucagguuauaaauucugauaaucacagaggacuugauccuuauagcaugauuugaugc

SEQ ID NO: 128234 - RNA, 64 nt, Homo Sapiens
uccuucuugcucuguuggucuuccugcuaugcugggacuugauuggggaaccuggccagccagc

SEQ ID NO: 128235 - RNA, 64 nt, Homo Sapiens
caaaugguuaacgcaggcagaacuccuuauugugggacuugaaggaaucauuuucucaucauua

SEQ ID NO: 128236 - RNA, 64 nt, Homo Sapiens
auguuuuuaacccugagaucaaguuuaguaggcaggacuugaucucaaguggucacaaaguuuu

SEQ ID NO: 128237 - RNA, 53 nt, Homo Sapiens
cgaccaaaggcaaucacuagaccggacuugaggcacgcggugcacccccagac

SEQ ID NO: 128238 - RNA, 64 nt, Homo Sapiens
cugccguucauguugcuuucuccuuuguccucuuggacuugagggcauugugaaaagcuuugcu

SEQ ID NO: 128239 - RNA, 64 nt, Homo Sapiens
gcaaugcucaucucucaugcuguggcagcuguggggacuugacagaaagcagcacaugcguuuc

SEQ ID NO: 128240 - RNA, 64 nt, Homo Sapiens
aggugcuaugcaucaguagcgaacugcagccuggggacuugauugacguagcuuccuccgagug

SEQ ID NO: 128241 - RNA, 64 nt, Homo Sapiens
guucucuuagcugguggaauacuuguuucucaggggacuugauuccaagugggcaagaacccca

SEQ ID NO: 128242 - RNA, 64 nt, Homo Sapiens
acucagcccaguuguucucaauguccuuuuuguuggacuugaguuaauguugccacguguuuuu

SEQ ID NO: 128243 - RNA, 64 nt, Homo Sapiens
cugggaguacaggcgucugccaccaugccuaauuuuuuucuauuuuuaggagagaccgguuuuc

SEQ ID NO: 128244 - RNA, 64 nt, Homo Sapiens
gugcuuggugcaugauaguaggccuucaauaaauuuuuucuaaaugaaugaaaucuuucuggac

SEQ ID NO: 128245 - RNA, 64 nt, Homo Sapiens
aaaagucccauucgguucuacauuauuaacuuuuuuuuucuauauccugaugaccaguaaauua

SEQ ID NO: 128246 - RNA, 64 nt, Homo Sapiens
guuuuuuuuucuuuacauaaauauugauauauucuuuuucuacucaaagugccaaaggcuacag

SEQ ID NO: 128247 - RNA, 64 nt, Homo Sapiens
ucguagauuaauugauuugcuaucuuuuaguuuuuuuuucuaugcauguagauguauuaaauau

SEQ ID NO: 128248 - RNA, 64 nt, Homo Sapiens
uaagccauucccauauucaacauuuuguguacuguuuuucuaauuacauauauuacaaugaaca

SEQ ID NO: 128249 - RNA, 64 nt, Homo Sapiens
gaugaaacauuaauuagggaucuugcugcuuuucuuuuucuacacgaaguuuucauuaaagcca

SEQ ID NO: 128250 - RNA, 64 nt, Homo Sapiens
agaaaggcacauguuuaagaggaauaccuaaagguuuuucuaaauuccaacauuuaaaaggcaa

SEQ ID NO: 128251 - RNA, 64 nt, Homo Sapiens
uauauaaauaugucagauguacauagagaucuauuuuuucuaaaacauuccccuccccacuccu

SEQ ID NO: 128252 - RNA, 63 nt, Homo Sapiens
gaggcagagaccuccaauaaagugccuucugggcuuuuucuaaccuuugucuuagcuaccugu

SEQ ID NO: 128253 - RNA, 64 nt, Homo Sapiens
uucgacucuucugugcgcuacugcugcgcacugcuuuuucuacaggcauuacaucaacuccuaa

SEQ ID NO: 128254 - RNA, 64 nt, Homo Sapiens
uguaucagcaaguuaaaugguuccauuucugugauuuuucuauuauuugaggggaguuggcaga

SEQ ID NO: 128255 - RNA, 64 nt, Homo Sapiens
uuguaguuuaagugcaaagaaacaguagugguuuuuuuucuauuguuuuguagucuuccugucc

SEQ ID NO: 128256 - RNA, 64 nt, Homo Sapiens
augugcaauacuguauuuaguguuucuauuucaauuuuucuaggauguuaauuuauaugaaaau

SEQ ID NO: 128257 - RNA, 64 nt, Homo Sapiens
uuuauggacuugguuacuguguuauacagugcuuuuuuucuaguagcuucuaaaaggccuuuuu

SEQ ID NO: 128258 - RNA, 64 nt, Homo Sapiens
caguuucagaacacuaaucuuuuuuauaagucuauuuuucuacucacuuaaugagacauucuuu

SEQ ID NO: 128259 - RNA, 64 nt, Homo Sapiens
ugacccuguuuaauaggcuuuuauaaacuuguuuuuuuucuagguaaaaugaggggaaauggau

SEQ ID NO: 128260 - RNA, 64 nt, Homo Sapiens
auuugcaugagggauuuuuucaaggaaagaaaauuuuuucuacauuauuuuucacugccagcuu

SEQ ID NO: 128261 - RNA, 64 nt, Homo Sapiens
uggaaaagacuuuauaaaugugaauucagguugguuuuucuauuacccauuauuccucuguacc

SEQ ID NO: 128262 - RNA, 64 nt, Homo Sapiens
uccuccuaaagaaaguacacaauaaauauuuugauuuuucuauuaauucauuguucuacaagua

SEQ ID NO: 128263 - RNA, 64 nt, Homo Sapiens
uuaacuuaaggagacggguaaaggaucuuaaauuuuuuucuaauagaaagaugugcuacacugu

SEQ ID NO: 128264 - RNA, 64 nt, Homo Sapiens
acagugcaaaaguucuuuaaaaugcauaugucuuuuuuucuaauuccguuuuguuuuaaagcac

SEQ ID NO: 128265 - RNA, 64 nt, Homo Sapiens
cauuaaacaauuguuguguucuuuuuaccuuuuauuuuucuauuaccuugcuaccaaacaguuu

SEQ ID NO: 128266 - RNA, 64 nt, Homo Sapiens
uguagaucagucuucaugugaccugcaguauuuuuuuuucuaauguauuugucagaaaucuguu

SEQ ID NO: 128267 - RNA, 64 nt, Homo Sapiens
uuuaaaaaaacugaauuuuuauacauggcauacauuuuucuaguuccuucugcuugcuuuauua

SEQ ID NO: 128268 - RNA, 64 nt, Homo Sapiens
guauuucaacagugugacuaauguuugaaauuauuuuuucuaagaguuuuucuauaaccuucca

SEQ ID NO: 128269 - RNA, 64 nt, Homo Sapiens
ugugacuaauguuugaaauuauuuuuucuaagaguuuuucuauaaccuuccaaaagucgugaug

SEQ ID NO: 128270 - RNA, 64 nt, Homo Sapiens
aucucuuaacuguagauuuuauuggccuguuuuuuuuuucuaaauaauucuuuaaaacuugacu

SEQ ID NO: 128271 - RNA, 64 nt, Homo Sapiens
acaaaggcaauaaaaauaaauuugacuuuagcuuuuuuucuauacuuuccucuuuuuguaauuc

SEQ ID NO: 128272 - RNA, 64 nt, Homo Sapiens
ugaucucacuguuauuauuaacauuuauuuauuauuuuucuaaaugugaaagcaauacauaauu

SEQ ID NO: 128273 - RNA, 64 nt, Homo Sapiens
gcguuaacauuuucauauuuuuuucuuucagucauuuuucuauuugugguauauguauauaugu

SEQ ID NO: 128274 - RNA, 64 nt, Homo Sapiens
ugaauguaguuauaaugcuuuugaaaaauuuuccuuuuucuauauccccuuaguccagccucuc

SEQ ID NO: 128275 - RNA, 64 nt, Homo Sapiens
gggggaccacuggaucauuccagauuucuugugauuuuucuauuguguaauucuuggugggcuc

SEQ ID NO: 128276 - RNA, 64 nt, Homo Sapiens
uuguuaucacauacagcaaauuccuuuuuuuuucuuuuucuaugagcacacucugcugcuucua

SEQ ID NO: 128277 - RNA, 64 nt, Homo Sapiens
acaucaaauauuagccauuucccauuuuauuuuauuuuucuauguagguucauguuccauguuc

SEQ ID NO: 128278 - RNA, 64 nt, Homo Sapiens
uuuaaauaaagcacuuucugucaaauaauggacuuuuuucuaaacagaaauuauuuucuauuaa

SEQ ID NO: 128279 - RNA, 64 nt, Homo Sapiens
aacaaaugcuguuuauacauaguuuaugauauuguuuuucuaaauauuuuuguacagauucugc

SEQ ID NO: 128280 - RNA, 64 nt, Homo Sapiens
aguuuuauugcaagagguaagcauauuugucuauuuuuucuauaaaaagcuguaaauugcaugu

SEQ ID NO: 128281 - RNA, 64 nt, Homo Sapiens
uauuucuuucugacuagacuaaaauucuaucuuguuuuucuauguucccuugcaaauuauuuuu

SEQ ID NO: 128282 - RNA, 64 nt, Homo Sapiens
agaagacaauauuuuagaacauuccagucuuaaauuuuucuaaaugcaggaaaaacaaucuguu

SEQ ID NO: 128283 - RNA, 64 nt, Homo Sapiens
uaaguacacauuuggaaauuugaaauuuguaauuuuuuucuauuggcagacacuuuauugcaca

SEQ ID NO: 128284 - RNA, 64 nt, Homo Sapiens
ucuacuuauuaaauaacuuauaguuuacuaguaauuuuucuaagagaaaauuuuccaaaaaugu

SEQ ID NO: 128285 - RNA, 64 nt, Homo Sapiens
uucucuugaaucugcuucuauaauggugaacacauuuuucuauucuaaaaauuaguauugaguu

SEQ ID NO: 128286 - RNA, 64 nt, Homo Sapiens
gcuaaagaaaagauuuaagcaauuaaaaccuacuuuuuucuagugaugaaaugaaaagagguuc

SEQ ID NO: 128287 - RNA, 64 nt, Homo Sapiens
auuugaccaaaaggaaaagaagcagcaagucacauuuuucuacuaggugugaagagcagggcuc

SEQ ID NO: 128288 - RNA, 64 nt, Homo Sapiens
aacacaaaaucaguguuuaucaacuucaaauaguuuuuucuauacaaacucaaauuccuguuuc

SEQ ID NO: 128289 - RNA, 64 nt, Homo Sapiens
ucauauguauuugaguggaggauuuuuuuucucauuuuucuaguguuaaauuuuaaccagcauu

SEQ ID NO: 128290 - RNA, 64 nt, Homo Sapiens
ugucgaauguauguuuauacaucaguggaacccauuuuucuagccuagcaagucccaaacacau

SEQ ID NO: 128291 - RNA, 64 nt, Homo Sapiens
gggccugucccucaaugccaguuuaggauuucuuuuuuucuauaccuugaaaugauuauaaaau

SEQ ID NO: 128292 - RNA, 64 nt, Homo Sapiens
ucccaaacacuggcaacaaccacuuccucaacaauuuuucuauuugcuucagccuacucagauu

SEQ ID NO: 128293 - RNA, 64 nt, Homo Sapiens
ucuauuugcuucagccuacucagauuuuuucagguuuuucuagcuccuccauaaccucacuccc

SEQ ID NO: 128294 - RNA, 64 nt, Homo Sapiens
gagggagagaagguggaaaugguuuuuuuuuuuuuuuuucuauuuucuuucuuuuuuuuuuuuu

SEQ ID NO: 128295 - RNA, 64 nt, Homo Sapiens
cuuuuuuuuuuuuuuuuuuuuuggucaacagccguuuuucuaguuccaaguuuuaaauacaugg

SEQ ID NO: 128296 - RNA, 64 nt, Homo Sapiens
agagcuaaaauguuuauugcuguuuugucuuucuuuuuucuaaaaaaagaaaaaaaagaaaaaa

SEQ ID NO: 128297 - RNA, 64 nt, Homo Sapiens
aagaacaaagaaacaugacugucucaaagaguaauuuuucuagauuagaccagucagguuuuug

SEQ ID NO: 128298 - RNA, 64 nt, Homo Sapiens
gugcacagaauauuagucucuucuacauguuuuauuuuucuauuuauaauucccuuuuuuguug

SEQ ID NO: 128299 - RNA, 64 nt, Homo Sapiens
uuuuguuguuauauuuuauacacagaauagaucuuuuuucuaacacauauuugaacugaauaac

SEQ ID NO: 128300 - RNA, 64 nt, Homo Sapiens
agguagcuuuuuaauguuuacagaaauuuuaauuuuuuucuauuuugaaauuugaggcuuguuu

SEQ ID NO: 128301 - RNA, 64 nt, Homo Sapiens
uuuaaauuucaaggaaauaugaaggcacuuccuuuuuuucuaagaaggaaguugcuagaugauu

SEQ ID NO: 128302 - RNA, 64 nt, Homo Sapiens
cuaauaaguagugacagacaaccaagcuucaauauuuuucuaaagaaauuacaggugggauaug

SEQ ID NO: 128303 - RNA, 64 nt, Homo Sapiens
cauuauugugaagugauguucagauuucuaguuuuuuuucuaguuuuuaauuuuaacaucagaa

SEQ ID NO: 128304 - RNA, 64 nt, Homo Sapiens
aguuauuuuuccuuuuucuuccaaaguuguuacuuuuuucuaguagaccaaguagauaauggaa

SEQ ID NO: 128305 - RNA, 64 nt, Homo Sapiens
auuaccaaagauauuacacacuuucuuuguaccuuuuuucuaaauucgaagcuuaauuuauauu

SEQ ID NO: 128306 - RNA, 64 nt, Homo Sapiens
uuuuguugaaaaaaggaauugggaguauuuuugauuuuucuacuugccaucaagaaccccauuu

SEQ ID NO: 128307 - RNA, 64 nt, Homo Sapiens
uuauaaguuguaugcauaaagaaaaauagcagcuuuuuucuauuagugugaugcuauacuauug

SEQ ID NO: 128308 - RNA, 64 nt, Homo Sapiens
ucuugguguuaaaagauuucugaauuucuaaacuuuuuucuauguuucauuuuaagcaucaucu

SEQ ID NO: 128309 - RNA, 64 nt, Homo Sapiens
uggaggggcucuagugcuaaauuuaaaagaauuguuuuucuaacaaaccucaaaucauaaagac

SEQ ID NO: 128310 - RNA, 64 nt, Homo Sapiens
acuaaauaaauagcaaacuuuuuuucuuucaguguuuuucuaagugcguacuacauuuccugcc

SEQ ID NO: 128311 - RNA, 64 nt, Homo Sapiens
ugccaaauugagauaaugauaucuuucuaccucuuuuuucuaucagcuguaagcaagucacuua

SEQ ID NO: 128312 - RNA, 64 nt, Homo Sapiens
aaaaauagacaguaaaauacuguauauauacauguuuuucuauuuccuuaaauauauauagaua

SEQ ID NO: 128313 - RNA, 64 nt, Homo Sapiens
uagaccuggaaacauaaauuuaaauccuuagacauuuuucuagaaaaaaaugcaaaguuuauaa

SEQ ID NO: 128314 - RNA, 64 nt, Homo Sapiens
uugcuuaggugauccacugccaugugauccauaauuuuucuacauaaaaaaucaaaguuaaaag

SEQ ID NO: 128315 - RNA, 64 nt, Homo Sapiens
uuuguauaaaacaauagaacagaaauuugggacauuuuucuaggaaauaaaauuccucggugua

SEQ ID NO: 128316 - RNA, 64 nt, Homo Sapiens
uguguguguguauaccugggggugggcagugcucuuuuucuaaaacuaauauggcuuauauauc

SEQ ID NO: 128317 - RNA, 64 nt, Homo Sapiens
auuuaucuuugcuugcacaucugcucuguuuugguuuuucuacaggaaaugaaaaucaacuugu

SEQ ID NO: 128318 - RNA, 64 nt, Homo Sapiens
cccgccccacaacaucuauaaggggcaaaaagucuuuuucuaauaaguauucuucuaugguagu

SEQ ID NO: 128319 - RNA, 64 nt, Homo Sapiens
uuugaauuuuuuuucaguauauauauguuucuuguuuuucuauuuuucuacuucauacuguuaa

SEQ ID NO: 128320 - RNA, 64 nt, Homo Sapiens
uuuuuucaguauauauauguuucuuguuuuucuauuuuucuacuucauacuguuaaugucaaau

SEQ ID NO: 128321 - RNA, 64 nt, Homo Sapiens
caaugugaauaucccuggccucaaaugacgauuauuuuucuacucacuuuucaguuguuuguau

SEQ ID NO: 128322 - RNA, 64 nt, Homo Sapiens
uugaacagaggcacccuaugccugagggggcgccuuuuucuaauggcagcugggcugagucugc

SEQ ID NO: 128323 - RNA, 64 nt, Homo Sapiens
uaugggcaaguucauaagucuccaguaagcuauuuuuuucuaccucuuaugaagcagauauaaa

SEQ ID NO: 128324 - RNA, 64 nt, Homo Sapiens
uggugauuuuucaauuucuuuaugccuagcuuuuuuuuucuaggcuacuuggugcugaugaauu

SEQ ID NO: 128325 - RNA, 64 nt, Homo Sapiens
acuuuaucauuuucaagauguccucuaggaauuuuuuuucuaguaauuuugcaaucuaccuaau

SEQ ID NO: 128326 - RNA, 64 nt, Homo Sapiens
agaauuucaagcucuggguaauaacugcugauauuuuuucuaauuucaaauuuaccucuuuugg

SEQ ID NO: 128327 - RNA, 64 nt, Homo Sapiens
cugcccucacauuuuguuugaaauuucagaacuguuuuucuauguaaauauugaaaacuuauga

SEQ ID NO: 128328 - RNA, 64 nt, Homo Sapiens
auggaagcuaaaauugacauauuuuuauguaaaguuuuucuauucuuugauuuuuaauaaacuu

SEQ ID NO: 128329 - RNA, 64 nt, Homo Sapiens
aaauaagagcaguauccuuagcucuagccaagcauuuuucuaauuccugccuuuggucacaaag

SEQ ID NO: 128330 - RNA, 64 nt, Homo Sapiens
aagacuuauaaaggauuucaucagaaguuuucauuuuuucuaaauccuccccuacaaaauuuuc

SEQ ID NO: 128331 - RNA, 64 nt, Homo Sapiens
aaugaguaguaacccaauuuagcuuuacaaagauuuuuucuauuacuuuuuuuuuuuauugugg

SEQ ID NO: 128332 - RNA, 64 nt, Homo Sapiens
uucccuuaggcauuuuauaaaaauuuaaaaauuauuuuucuauuuuguuuaaaagacaaugcau

SEQ ID NO: 128333 - RNA, 64 nt, Homo Sapiens
acacuguuaaaauuuuggcauauuuccugcugauuuuuucuacugcugauuuuugcacagguga

SEQ ID NO: 128334 - RNA, 64 nt, Homo Sapiens
caaaaacaaaagauauaaaaauggaucauaaacauuuuucuaaauccugaaaaaugcauagaca

SEQ ID NO: 128335 - RNA, 64 nt, Homo Sapiens
gagcuuacauugaaaacagauauuacagcuuauuuuuuucuacauaauugugaccaauacauuu

SEQ ID NO: 128336 - RNA, 64 nt, Homo Sapiens
ucugauguaccaauuuagaucuauuucuuuauacuuuuucuaaucaauugcuuaauaguacuuu

SEQ ID NO: 128337 - RNA, 64 nt, Homo Sapiens
auuuuuuaaaauuacaauagugugcauugacauauuuuucuaugccuuugucauagcaguugaa

SEQ ID NO: 128338 - RNA, 64 nt, Homo Sapiens
ugccugcugaagcuuuggagcaaaucgcuucgccuuuuucuacugagucucuccuuguuuggaa

SEQ ID NO: 128339 - RNA, 64 nt, Homo Sapiens
ugugaaggauuacaacacaagacugcagaguuuguuuuucuauauacguuuuuuuguaacguga

SEQ ID NO: 128340 - RNA, 64 nt, Homo Sapiens
auauuaaaaaauguacagugauggaagaaccaaguuuuucuaugucaagaauuuaaaggauuuc

SEQ ID NO: 128341 - RNA, 64 nt, Homo Sapiens
gagaauacuguuuuucauuauuuggauuuuuguguuuuucuaauacguuugcugcgauaaaucu

SEQ ID NO: 128342 - RNA, 64 nt, Homo Sapiens
uuugccagacucuugauacuuuuuuuuuuuuuuuuuuuucuauucgacgucacuacagcuucuu

SEQ ID NO: 128343 - RNA, 64 nt, Homo Sapiens
uuacuuagauguuggauaugugagauuguucugcuuuuucuaaguacuucugguagaugucuua

SEQ ID NO: 128344 - RNA, 64 nt, Homo Sapiens
agucccucccuuccaaaaguaaaauuauucucuuuuuuucuaaguuacacuauucauaacucuu

SEQ ID NO: 128345 - RNA, 64 nt, Homo Sapiens
uuuaagauuagaggaaaauguacccacuccauuuuuuuucuauuuuuauccucuucaccaccac

SEQ ID NO: 128346 - RNA, 64 nt, Homo Sapiens
gaaaacaauuuagaaagaagcuccauauacuauuuuuuucuacuguaaaccuuuacacuaaggu

SEQ ID NO: 128347 - RNA, 64 nt, Homo Sapiens
auuuuaauuacuugugauuuagauguauccauccuuuuucuauuaagaauacaaaugcugggcu

SEQ ID NO: 128348 - RNA, 64 nt, Homo Sapiens
uaaaguuuugcuuuuaaaacguggacauaacucauuuuucuaguuuuugacaauuguguguuuu

SEQ ID NO: 128349 - RNA, 64 nt, Homo Sapiens
ccuugguggaugggauggcuguaucuagacaaaauuuuucuaaaacuccaucaaggcucuuauu

SEQ ID NO: 128350 - RNA, 64 nt, Homo Sapiens
cagagcucagccuucucacucuaaaagaaagauauuuuucuauuuauuuucuacaucuggccag

SEQ ID NO: 128351 - RNA, 64 nt, Homo Sapiens
ccuggugugagagguagggagccuuccuaguugguuuuucuagggguuuccuuuguaugcuuca

SEQ ID NO: 128352 - RNA, 64 nt, Homo Sapiens
cagcuaauaagagguuggguucaguaccccuucuuuuuucuaagcucuuuugggaccuccuuug

SEQ ID NO: 128353 - RNA, 64 nt, Homo Sapiens
aacaguugaaugaaccagugaauuuuaagccacuuuuuucuauugcuauacuuucagacuucac

SEQ ID NO: 128354 - RNA, 64 nt, Homo Sapiens
cuuuuccuuaaaauuaauaguauuauuuuuuuccuuuuucuaauauacuuagagguaagucauu

SEQ ID NO: 128355 - RNA, 64 nt, Homo Sapiens
cuuguauaacagaaauaccuucuauacaaaccuuuuuuucuacuuuuagauagaaaugucuacu

SEQ ID NO: 128356 - RNA, 64 nt, Homo Sapiens
gaagaaaaauuccugugauaguucaguucuuuaguuuuucuauuugaaaaaaaaaaaucauuua

SEQ ID NO: 128357 - RNA, 64 nt, Homo Sapiens
uaauuuucacaaaugucauguuugccaauaugaauuuuucuagucaacauauuauuguaauuua

SEQ ID NO: 128358 - RNA, 64 nt, Homo Sapiens
auuuaguagaggcuaccuuucccaccagugacucuuuuucuacaacugccuugucaguuuggua

SEQ ID NO: 128359 - RNA, 64 nt, Homo Sapiens
acauggaauacauuuuguuguaggcauaccuccuuuuuucuaauuuuggaacgugacacaaugu

SEQ ID NO: 128360 - RNA, 64 nt, Homo Sapiens
guuuuuuauuuggacacuuauuuguaucuauuuuuuuuucuacuauauacuuaaaauauuccca

SEQ ID NO: 128361 - RNA, 64 nt, Homo Sapiens
guaaaaauauuucuuccaagcuuauacugaguccuuuuucuaauacugggaauuuuguuuucac

SEQ ID NO: 128362 - RNA, 64 nt, Homo Sapiens
cccuuuuguaagcuguaauuucuggccugccucauuuuucuagguuguguucuauuuccacucg

SEQ ID NO: 128363 - RNA, 64 nt, Homo Sapiens
ccucaauuuccaccucccaagggaaguuuauguauuuuucuaggcccuuuucuaugucuuuaca

SEQ ID NO: 128364 - RNA, 64 nt, Homo Sapiens
aauuucaguagccucaguuauucaaccuaggagauuuuucuaccucuuuacuacccugcugaag

SEQ ID NO: 128365 - RNA, 64 nt, Homo Sapiens
cccauuucaauauugcacuuauuaauggucuuuauuuuucuagcauagauaacaauugauucuu

SEQ ID NO: 128366 - RNA, 64 nt, Homo Sapiens
caaguguuuaaaacacugauaggagcuguuaucuuuuuucuaauacauaagcuagaucacuaca

SEQ ID NO: 128367 - RNA, 64 nt, Homo Sapiens
caaaaacguguuucccccaggaugcuuuauuuuauuuuucuaguaguacuugaagucaguuuua

SEQ ID NO: 128368 - RNA, 64 nt, Homo Sapiens
cuuuuaauuauucuagaauuuuaacugcaucucauuuuucuagcauggugagaacuaauaugua

SEQ ID NO: 128369 - RNA, 64 nt, Homo Sapiens
uuggcucuucucagcuuuuuuuguacauauuuuuuuuuucuaaagagaagaaaaaguuaucaca

SEQ ID NO: 128370 - RNA, 64 nt, Homo Sapiens
uuuuuuuucuuaucuaccuguuauauugugcuaauuuuucuauguaugugaugugaaaugaaga

SEQ ID NO: 128371 - RNA, 64 nt, Homo Sapiens
agcauauccguucaaaaauuuuuccacuaugucuuuuuucuaguggcuacuguuuuaguuuucu

SEQ ID NO: 128372 - RNA, 64 nt, Homo Sapiens
aguuguuacugauaugcuuuuuaucauucauuucuuuuucuaaagaggucauaucuguuuuucu

SEQ ID NO: 128373 - RNA, 64 nt, Homo Sapiens
ugacuguuuuuaaugauuuuuuuugguguauugcuuuuucuaauccuggaaacacuaccauuau

SEQ ID NO: 128374 - RNA, 64 nt, Homo Sapiens
guuauguuaccugagaaauuuguauuagaauuguuuuuucuaaacaaccagacaggaguuaacu

SEQ ID NO: 128375 - RNA, 64 nt, Homo Sapiens
guuauguuaccugaaaaaucguauuagaauuguuuuuuucuaaaaacaggauaagguuacacuu

SEQ ID NO: 128376 - RNA, 64 nt, Homo Sapiens
gaaauggguuuuaaacuuuguaauacauugauuuuuuuucuaaauugggauaaacuccaauguu

SEQ ID NO: 128377 - RNA, 64 nt, Homo Sapiens
ucuccuccccacaccaucaacucuaucucguauuuuuuucuauuuuauguaguguaugcguagc

SEQ ID NO: 128378 - RNA, 64 nt, Homo Sapiens
gucaaauauguaccuuuucuauucacugaaaucauuuuucuacuugcaaacuuuagacauugug

SEQ ID NO: 128379 - RNA, 64 nt, Homo Sapiens
uuuguggguuuuuuuucaucugguuuuguuuguuuuuuucuauggcuuuuuuccagcccaggug

SEQ ID NO: 128380 - RNA, 64 nt, Homo Sapiens
auucacccuugggcugcagacacuagcguggacauuuuucuagccuagaaugaaggccugcuag

SEQ ID NO: 128381 - RNA, 64 nt, Homo Sapiens
uucuuaugauacagguucaugcaacauaacuaaauuuuucuagucuaaagacuacuuugaguag

SEQ ID NO: 128382 - RNA, 64 nt, Homo Sapiens
uauugaauuagauguuauccuuaaugaaugucuuuuuuucuauauuuacuaaggauuagauuau

SEQ ID NO: 128383 - RNA, 64 nt, Homo Sapiens
uuguuggauuuuuuacagugauuuuagagccaaauuuuucuaucucuguaaccaaaggaacuua

SEQ ID NO: 128384 - RNA, 64 nt, Homo Sapiens
aauugcuucucagaugaugauugaagcaaacauuuuuuucuaagucacuggauuucuuuagaca

SEQ ID NO: 128385 - RNA, 64 nt, Homo Sapiens
ccauccucucucugugcccuugcuuauuccaugcuuuuucuaucuuggugucucaguggcuucu

SEQ ID NO: 128386 - RNA, 64 nt, Homo Sapiens
auuuaggaaauggaagcuuuuaauuuuaauuucuuuuuucuaagacagagucucacucugucgc

SEQ ID NO: 128387 - RNA, 64 nt, Homo Sapiens
gccaacuacagauggcauaugccuuaaagaugcauuuuucuauguauuuaauauuuuguguaca

SEQ ID NO: 128388 - RNA, 64 nt, Homo Sapiens
ggauauauugguacaacaugacuuaaaacuuuuuuuuuucuauuaaaacuuaaaggggaacaaa

SEQ ID NO: 128389 - RNA, 64 nt, Homo Sapiens
gcuaauaugcacaguaaauccaugucuuuguuuguuuuucuauuaaaaagcaaucaagaaagau

SEQ ID NO: 128390 - RNA, 64 nt, Homo Sapiens
gcuugcuauauaagauucaaaagagcuuuuuaaauuuuucuaauaauaucuuacauuuguacag

SEQ ID NO: 128391 - RNA, 64 nt, Homo Sapiens
uugccagacuuucuccaaaugaaaccugaaucaauuuuucuaaaucuagguuucauagaguccu

SEQ ID NO: 128392 - RNA, 64 nt, Homo Sapiens
auuguuguauuuucaugacugaccuuaacuguacuuuuucuagcaagagaugcuuuauucugca

SEQ ID NO: 128393 - RNA, 64 nt, Homo Sapiens
uaauuuacuuguacaauucauuguuacuguucuguuuuucuauuaaucuuuugucaacuuccug

SEQ ID NO: 128394 - RNA, 64 nt, Homo Sapiens
agcauuuucuuagaccucuucagcugauuguuuauuuuucuaugaauuccuacacaugguuauu

SEQ ID NO: 128395 - RNA, 64 nt, Homo Sapiens
uuaacuagguugcuacuuuauuugccuaaauacuuuuuucuauuuuguuagauuuugccuuucu

SEQ ID NO: 128396 - RNA, 64 nt, Homo Sapiens
ccaugaaggccaucuuguaguguggucugauuccuuuuucuaauaccagcaauuucuuuuuccu

SEQ ID NO: 128397 - RNA, 64 nt, Homo Sapiens
uuuucugucccucccucaguuuuaguaugguuuauuuuucuaggaaacaaaauacccuuuuucu

SEQ ID NO: 128398 - RNA, 64 nt, Homo Sapiens
uuuggugacuuagugauuuuccauuucauuuuuuuuuuucuaguuaacugucuuuucucaguuu

SEQ ID NO: 128399 - RNA, 64 nt, Homo Sapiens
aacuauaacauucuguuggaaagcaguaaguucauuuuucuaaagggucuuaaaagguucugga

SEQ ID NO: 128400 - RNA, 64 nt, Homo Sapiens
aguacuuacguguuuaucuaacaguucacuuccauuuuucuagucuggauuuuuugaguauuua

SEQ ID NO: 128401 - RNA, 64 nt, Homo Sapiens
aaaacuggggauuucucaaugugacuaacucuaauuuuucuaauuauaacugccuuuaauuaac

SEQ ID NO: 128402 - RNA, 64 nt, Homo Sapiens
uaaaagaguuuuauuauaaaccguguguuuuugguuuuucuaaguauauagaaagcuuguauaa

SEQ ID NO: 128403 - RNA, 64 nt, Homo Sapiens
uagcaccuggaugaacauuaggagugcuuagucuuuuuucuacuugcuuuuccaaacacucaca

SEQ ID NO: 128404 - RNA, 64 nt, Homo Sapiens
cuccacuugccucuuauugucuuauuuuuauauauuuuucuaaauauauguauauauacaguac

SEQ ID NO: 128405 - RNA, 64 nt, Homo Sapiens
uauauauauacacacacauauauaaaaaguauaauuuuucuauuuuuguuuuugguuuuaauuu

SEQ ID NO: 128406 - RNA, 64 nt, Homo Sapiens
uuugaaaacugaauguaauacuugaguagauuuuuuuuucuaguuugaaauuuagucugucuuu

SEQ ID NO: 128407 - RNA, 64 nt, Homo Sapiens
cauucucauuuagagaaaccuauuuucuuuuuucuuuuucuauuuuaguguuucauuuaugugc

SEQ ID NO: 128408 - RNA, 64 nt, Homo Sapiens
uuuucuuucacccaagaaugugcuuuccuggaaauuuuucuagauagaauauuauguaauuugu

SEQ ID NO: 128409 - RNA, 64 nt, Homo Sapiens
cuuuucccuugacguuuacuguguuagugauagauuuuucuauuauucauuugaguuaacagug

SEQ ID NO: 128410 - RNA, 64 nt, Homo Sapiens
acuuuuagguaggaugagagcuaaagugucaacguuuuucuaugcugcaggaccugggagcauc

SEQ ID NO: 128411 - RNA, 64 nt, Homo Sapiens
auuuuuaggaaaauauuaaguuuuguucugauuuuuuuucuaauguacuacauguaaacugauu

SEQ ID NO: 128412 - RNA, 64 nt, Homo Sapiens
ggggggcgcugucuagcacucuaccggagccuuguuuuucuaaauggaaguagaucugaauagg

SEQ ID NO: 128413 - RNA, 64 nt, Homo Sapiens
aacguguuuuggauccuguauugggcacuuuauauuuuucuaaaucaccuguguaaguugguau

SEQ ID NO: 128414 - RNA, 64 nt, Homo Sapiens
augugaaacacagauuucaacauuugaauuuauuuuuuucuaauaagcuaaugguaauuagaau

SEQ ID NO: 128415 - RNA, 64 nt, Homo Sapiens
aauccauagcagcaccguucauucuaugagucuauuuuucuaaugaugcaguaauuaaauugca

SEQ ID NO: 128416 - RNA, 64 nt, Homo Sapiens
gacuauuuucaaaaucauuuucaucaagacaccuuuuuucuaaaauaggcauugcauacacaua

SEQ ID NO: 128417 - RNA, 64 nt, Homo Sapiens
aaauguguaaagaacaaucaauauacuuuauuuuuuuuucuauuuuauaaaauaaauauauaug

SEQ ID NO: 128418 - RNA, 64 nt, Homo Sapiens
cauuuuaaguguguggcuuauaaauauuuugguauuuuucuauacuacguaaauucugaguuua

SEQ ID NO: 128419 - RNA, 64 nt, Homo Sapiens
cuggaagcccugcgguagcuagcacugaagacuauuuuucuauugguauaacccgcccaccuga

SEQ ID NO: 128420 - RNA, 64 nt, Homo Sapiens
accucauagcaguaaaugacuugcuguuguuuaauuuuucuaaggcaucuuaauagacuucugu

SEQ ID NO: 128421 - RNA, 64 nt, Homo Sapiens
aaaacuguuguuaaaauauuaagucaguugauuuuuuuucuauucaagaacacuggcuuaauuc

SEQ ID NO: 128422 - RNA, 64 nt, Homo Sapiens
ugauugcauauagcauauguuucugcaaauacgguuuuucuaccgacaccuaucuauuaaacca

SEQ ID NO: 128423 - RNA, 64 nt, Homo Sapiens
guagccuaguuauuugagccgcaagaauuggaaauuuuucuaugaucuguuuuuacaucauaau

SEQ ID NO: 128424 - RNA, 64 nt, Homo Sapiens
ggaaugaaccauuuuccucugaccuagcuuuguuuuuuucuaauuuaaaggcaggucugaauaa

SEQ ID NO: 128425 - RNA, 64 nt, Homo Sapiens
cuaauuauugcuuccuuucuuauuacuuuccuaauuuuucuauauuuuaaaaacuacaguuucc

SEQ ID NO: 128426 - RNA, 64 nt, Homo Sapiens
uaaauagaaucuaauaaaccaauguagcauuauuuuuuucuaaaugaagccccaaaaaagaaaa

SEQ ID NO: 128427 - RNA, 64 nt, Homo Sapiens
uaauauuuuauuuuucuuuuuaugccacuuuggauuuuucuacaaaggcagugguguccaaaau

SEQ ID NO: 128428 - RNA, 64 nt, Homo Sapiens
aaaaucucugcccuaaauuuuacuaauaaauccauuuuucuagugauacacaaauuguuuaagg

SEQ ID NO: 128429 - RNA, 64 nt, Homo Sapiens
cugaagcuuuacaggacauacucccacucccauuuuuuucuaagccuacagcaucuugauucau

SEQ ID NO: 128430 - RNA, 64 nt, Homo Sapiens
ggacgagagcacgccugggagcgaaagcuggccuuuuuucuacgaaugcacuacauuaaagaug

SEQ ID NO: 128431 - RNA, 64 nt, Homo Sapiens
uuaaauuuauaguugugaacauugcuuguguguguuuuucuaaguagauucacaagauaauuaa

SEQ ID NO: 128432 - RNA, 64 nt, Homo Sapiens
acucuuacuaaauccagauucaguguuuuauuuauuuuucuaaagaaggggagaaguagaacca

SEQ ID NO: 128433 - RNA, 64 nt, Homo Sapiens
uagacccuuaugggaguuuguuuaucauaauuaguuuuucuaaacaacacaacuggaguuucca

SEQ ID NO: 128434 - RNA, 64 nt, Homo Sapiens
guuaaauuuagugcacucuggaacaacggcuaauuuuuucuaaagcaaaacaaaaacaauucag

SEQ ID NO: 128435 - RNA, 64 nt, Homo Sapiens
gccauucaauuugaugugagaauuuauaggacaguuuuucuacuaaagaacaaaauaaaauaau

SEQ ID NO: 128436 - RNA, 64 nt, Homo Sapiens
cgaucuaaaaacuuaauuuuauaaaauugacuuauuuuucuagacuaaaauuguauaugcuuuu

SEQ ID NO: 128437 - RNA, 64 nt, Homo Sapiens
ugcugauuguugccaucacguuccuacaaaauuguuuuucuaugggauguucuggcagcugugu

SEQ ID NO: 128438 - RNA, 64 nt, Homo Sapiens
gaaauguuaaauacaauuucugaaaguuauguuuuuuuucuaucaucugguauaccauugcuuu

SEQ ID NO: 128439 - RNA, 64 nt, Homo Sapiens
uuuugaccucccauuuuuacuauuugccaauaccuuuuucuaggaaugugcuuuuuuuuguaca

SEQ ID NO: 128440 - RNA, 64 nt, Homo Sapiens
cucuguuaacauuuugauguuguguuuuugcuuauuuuucuaugcauaguuaugcauuuauauu

SEQ ID NO: 128441 - RNA, 64 nt, Homo Sapiens
uugugucuuaggccaauuucugggccuucuggguuuuuucuacacugucaauaauuaucgcuuu

SEQ ID NO: 128442 - RNA, 64 nt, Homo Sapiens
cgggaugccaagguaaguggagguauacuucgaauuuuucuagaagguaaagccuaguuugcug

SEQ ID NO: 128443 - RNA, 64 nt, Homo Sapiens
uuuuuuaauauaugucaaguuugaauuggaauaauuuuucuaugauuagguacaauuuaucaaa

SEQ ID NO: 128444 - RNA, 64 nt, Homo Sapiens
aaggaauuuggguaauuuuucagguaauugucucuuuuucuaauacacagauccuaaguagaac

SEQ ID NO: 128445 - RNA, 64 nt, Homo Sapiens
ggagagaaagacuuagaacaucagauuaucucuuuuuuucuaaauacacagauccaaaauagaa

SEQ ID NO: 128446 - RNA, 64 nt, Homo Sapiens
guaaugcucuuacggauauauugcuaaagggaaauuuuucuaugguggcugaggucucuugaaa

SEQ ID NO: 128447 - RNA, 64 nt, Homo Sapiens
uaagauacaaaaaauuuucaaauaucaacuuaauuuuuucuaaguaaaaaucaaaauucuuuua

SEQ ID NO: 128448 - RNA, 64 nt, Homo Sapiens
uuuuaagcauguagccaguaauaauuugaaguuuuuuuucuaugcaagcuuaccuuguuggcau

SEQ ID NO: 128449 - RNA, 64 nt, Homo Sapiens
auuaaaauuguaucagaggguuuucucuaaucauuuuuucuauuuuuuuuuuuguacuucuaga

SEQ ID NO: 128450 - RNA, 64 nt, Homo Sapiens
aaaugaaauuuggcuaauaggagcaauucagcuauuuuucuauacaguaauuggugugugguau

SEQ ID NO: 128451 - RNA, 64 nt, Homo Sapiens
aguuuuuuucaucacuaugauuuuauaaaacaauuuuuucuaugaaccuuuacuuacuugacug

SEQ ID NO: 128452 - RNA, 64 nt, Homo Sapiens
guugaaggcuacuuuucuguucuuuuuuuuuuuuuuuuucuauccuguacauuuaguugaacug

SEQ ID NO: 128453 - RNA, 64 nt, Homo Sapiens
caaaucuguaaguuauuuuugaauuuucugaacuuuuuucuaagagauuacauaggagacuaaa

SEQ ID NO: 128454 - RNA, 64 nt, Homo Sapiens
uucccacuuuucuaaaagguguauuuauuauuuauuuuucuacuauuuacaggucucuauuuau

SEQ ID NO: 128455 - RNA, 64 nt, Homo Sapiens
agggaagucaauggcuggcccuuguugguugugguuuuucuauccagaccagccccagcgagga

SEQ ID NO: 128456 - RNA, 64 nt, Homo Sapiens
gaauguauuuuaaccacaguugaaugugucuauuuuuuucuaguagaacuaggggaaaggaguu

SEQ ID NO: 128457 - RNA, 64 nt, Homo Sapiens
gguucccccaauguuugaaauagggagcccugccuuuuucuacuggaaauguaauaauggacau

SEQ ID NO: 128458 - RNA, 64 nt, Homo Sapiens
ugccugauucuuuaauauugccuaaaucggaaccuuuuucuauguugcacacaugguuuucaga

SEQ ID NO: 128459 - RNA, 64 nt, Homo Sapiens
uguuucauuugacggucucuuuuugaucaaccaauuuuucuaaaaguucagucgaaagcuuuua

SEQ ID NO: 128460 - RNA, 64 nt, Homo Sapiens
ggguagggggagacuaaaauugagaugugcagguuuuuucuaggaaaaguuucagcuccgugug

SEQ ID NO: 128461 - RNA, 64 nt, Homo Sapiens
ccaggcaguagagucucucucauacacugauuuauuuuucuaugcguuugccuuggcuugguuu

SEQ ID NO: 128462 - RNA, 64 nt, Homo Sapiens
auuugaaaccuuuuuagcuacuuacccagauauguuuuucuauccacaaaaaguugugucauaa

SEQ ID NO: 128463 - RNA, 64 nt, Homo Sapiens
cuucuuugucuuaaauuuuaauauguugggguuuuuuuucuaagaaagacuguuauaauggugu

SEQ ID NO: 128464 - RNA, 64 nt, Homo Sapiens
aguuuuggcaugaauauacuaaagcuuuuuuuuuuuuuucuagcauguguuuucuccucuuugg

SEQ ID NO: 128465 - RNA, 64 nt, Homo Sapiens
ggcugcuuuuuguuuuucauuuucuuucagaagauuuuucuaacuuagggucugucuugcaugu

SEQ ID NO: 128466 - RNA, 64 nt, Homo Sapiens
cauauucaaaagggugacaacuaugauauuguaauuuuucuaaguuuuaagggcuuuaugugaa

SEQ ID NO: 128467 - RNA, 64 nt, Homo Sapiens
uuaaacagucaguaugcaauuuauucucaaaaguuuuuucuaaguuuaaaguuucuugcauuua

SEQ ID NO: 128468 - RNA, 64 nt, Homo Sapiens
ggaguuuauguuccauuaaacaccuagcugaauguuuuucuaaauuuuuuucuauggguguuau

SEQ ID NO: 128469 - RNA, 64 nt, Homo Sapiens
gguguuaucaccuagcugaaacaagauugguguuuuuuucuaugccaaauuaaaaaagauaaac

SEQ ID NO: 128470 - RNA, 64 nt, Homo Sapiens
uacaaagguuuaaaugaacauuuaacauaagcuauuuuucuaaccucaaugagcauguuuagac

SEQ ID NO: 128471 - RNA, 64 nt, Homo Sapiens
uguaguuuugccuuuuaucuacuuaucacugaccuuuuucuaugaaaaaacugacuguauaaac

SEQ ID NO: 128472 - RNA, 64 nt, Homo Sapiens
uuuugcaggcaugaaauaguaaggagcuucuuuuuuuuucuagguugacagguuaucuggaaca

SEQ ID NO: 128473 - RNA, 64 nt, Homo Sapiens
caggucuguacuucugccacgcugcuuggguguauuuuucuacaaggaauuacugcuuagaaca

SEQ ID NO: 128474 - RNA, 64 nt, Homo Sapiens
uugucggagcugcguaccuccagguaaagaaauauuuuucuaggccaaaucuuucauacagaua

SEQ ID NO: 128475 - RNA, 64 nt, Homo Sapiens
uuuguauuuuuuuucuuuugaaaggguuuguuaauuuuucuaauuuuaccaaaguuugcagccu

SEQ ID NO: 128476 - RNA, 64 nt, Homo Sapiens
guauuagggaagaaugagacaauuuuguguaggcuuuuucuaaaguccaguacuuuguccagau

SEQ ID NO: 128477 - RNA, 64 nt, Homo Sapiens
accuuucagugacaucguucauggcuggauccuauuuuucuacauugauuuccccugaccucua

SEQ ID NO: 128478 - RNA, 64 nt, Homo Sapiens
uuagucggauuuuguuuuggugagcgcuuagaccuuuuucuauuauuucucgcaucccuucucg

SEQ ID NO: 128479 - RNA, 64 nt, Homo Sapiens
cugggggguggaggggugccaauacagaugucuauuuuucuaaaagggagaacagaaaugcaaa

SEQ ID NO: 128480 - RNA, 64 nt, Homo Sapiens
ccugugccucccucuccucggagaagcaaaaucuuuuuucuaaagagucuauuuuuguacaaaa

SEQ ID NO: 128481 - RNA, 64 nt, Homo Sapiens
uuuaggcaauuaucucucuuccagggaguaccuuuuuuucuaguugagaauuaauaauggucca

SEQ ID NO: 128482 - RNA, 64 nt, Homo Sapiens
uaaaauuuaaauagcuaccauuggcaaucugcuuuuuuucuaaaaucugauuugcagccaggaa

SEQ ID NO: 128483 - RNA, 64 nt, Homo Sapiens
cagacugacuuucuuacaaaugauuuuuaaacccuuuuucuaaaagaacuuuguaccuuucccc

SEQ ID NO: 128484 - RNA, 64 nt, Homo Sapiens
cuguauaccaggcuuuucccgaguuuuuacucucuuuuucuagcgcuucagggcugcguggaaa

SEQ ID NO: 128485 - RNA, 64 nt, Homo Sapiens
aagaaguggccugcagaaguuuaauaauuugacuuuuuucuaauauuuuaguuugaaagaaaau

SEQ ID NO: 128486 - RNA, 64 nt, Homo Sapiens
ucugcagguuugugaaauaggaugaaacucaaucuuuuucuauuguggguuugcauuugaaaag

SEQ ID NO: 128487 - RNA, 64 nt, Homo Sapiens
uuaugccuauuuuaacauuaacuucuaaagaaguuuuuucuaagaaaauguuucaaggcaauau

SEQ ID NO: 128488 - RNA, 64 nt, Homo Sapiens
gaagauucuugucacagaaucagcaauaccauaguuuuucuacaugugcucagcugggggugug

SEQ ID NO: 128489 - RNA, 64 nt, Homo Sapiens
uuuuuuuuuuuuaaguuucauucuuccuagaauauuuuucuaacaauuuuuauuucagcuuuaa

SEQ ID NO: 128490 - RNA, 64 nt, Homo Sapiens
gcccuguuuccagagcaaaguaacagagaccagguuuuucuagagagcuaagugggauguguag

SEQ ID NO: 128491 - RNA, 64 nt, Homo Sapiens
ggcgucagccaccgcgcccggcccugugccuugcuuuuucuacucacuaagauauaaaacagcu

SEQ ID NO: 128492 - RNA, 64 nt, Homo Sapiens
uuaugcaaaaugcccagggacauguuuggccuuuuuuuucuacgguuuacauugagcacuagaa

SEQ ID NO: 128493 - RNA, 64 nt, Homo Sapiens
aaaaguuaugaaugugacuaggaauauauuuauauuuuucuauguuuuuugucuuacaauucag

SEQ ID NO: 128494 - RNA, 64 nt, Homo Sapiens
gcuccuuuaacaucugcuaauuaagugcaauaaauuuuucuagaaaauggcaaagaugacuucc

SEQ ID NO: 128495 - RNA, 64 nt, Homo Sapiens
gguguuggggaugccagaacaccacuugguuuuauuuuucuaagugcaugugaugugauagagu

SEQ ID NO: 128496 - RNA, 64 nt, Homo Sapiens
gauaccucuauauauuuuuaaggagcuuucucuguuuuucuauuuuaauauagugaguucuuuc

SEQ ID NO: 128497 - RNA, 64 nt, Homo Sapiens
uacagaauucauagaauuuuagcuugaaagcucuuuuuucuauagguauuucauguuacuccua

SEQ ID NO: 128498 - RNA, 64 nt, Homo Sapiens
aacuguggagauuugagggacauggauuuuaauguuuuucuaacauggaaaugagagcccggcg

SEQ ID NO: 128499 - RNA, 64 nt, Homo Sapiens
ucaaaccuagcaaaaauggauuaaauuucaaauauuuuucuacauuuuauuggauuuuuguauu

SEQ ID NO: 128500 - RNA, 64 nt, Homo Sapiens
ccccuugaggucaguaauaaauacaaaaaaaucauuuuucuagagcagagucuuaaaaucaggu

SEQ ID NO: 128501 - RNA, 64 nt, Homo Sapiens
acagcuuaaaaucaaaaauguauguuaagagaauuuuuucuauuacuuauggaucaugcuuuaa

SEQ ID NO: 128502 - RNA, 64 nt, Homo Sapiens
gugaggauacuuucaguaccacuccuaccauucauuuuucuaaauuccuuaguacauauacuug

SEQ ID NO: 128503 - RNA, 64 nt, Homo Sapiens
ccucauugccugccuuccauucauauuacacuuauuuuucuauuuuuuguauuaccuuuuuaaa

SEQ ID NO: 128504 - RNA, 64 nt, Homo Sapiens
aauccuaauugcaguuuagugaaauuacuagauuuuuuucuaaucuucaguauguagugagcau

SEQ ID NO: 128505 - RNA, 64 nt, Homo Sapiens
uaaagaacagaguggaguggauauauucacuuuuuuuuucuaaaacauacaaagugauaaaaua

SEQ ID NO: 128506 - RNA, 64 nt, Homo Sapiens
aguagaaagugcgaagagcugaguuccccaccuuuuuuucuauugaugcuucuuuuuuaacaaa

SEQ ID NO: 128507 - RNA, 64 nt, Homo Sapiens
aaaugccagcugcagauaacucaaagccaucccuuuuuucuaaagggcacauugagaaugucac

SEQ ID NO: 128508 - RNA, 64 nt, Homo Sapiens; identical to SEQ ID NO: 102117

SEQ ID NO: 128509 - RNA, 64 nt, Homo Sapiens; identical to SEQ ID NO: 102118

SEQ ID NO: 128510 - RNA, 64 nt, Homo Sapiens; identical to SEQ ID NO: 102119

SEQ ID NO: 128511 - RNA, 64 nt, Homo Sapiens; identical to SEQ ID NO: 102120

SEQ ID NO: 128512 - RNA, 64 nt, Homo Sapiens; identical to SEQ ID NO: 102121

SEQ ID NO: 128513 - RNA, 64 nt, Homo Sapiens; identical to SEQ ID NO: 102122

SEQ ID NO: 128514 - RNA, 64 nt, Homo Sapiens; identical to SEQ ID NO: 102123

SEQ ID NO: 128515 - RNA, 64 nt, Homo Sapiens; identical to SEQ ID NO: 102124

SEQ ID NO: 128516 - RNA, 64 nt, Homo Sapiens; identical to SEQ ID NO: 102125

SEQ ID NO: 128517 - RNA, 64 nt, Homo Sapiens; identical to SEQ ID NO: 102126

SEQ ID NO: 128518 - RNA, 64 nt, Homo Sapiens; identical to SEQ ID NO: 102127

SEQ ID NO: 128519 - RNA, 64 nt, Homo Sapiens; identical to SEQ ID NO: 102128

SEQ ID NO: 128520 - RNA, 64 nt, Homo Sapiens; identical to SEQ ID NO: 102129

SEQ ID NO: 128521 - RNA, 64 nt, Homo Sapiens; identical to SEQ ID NO: 102130

SEQ ID NO: 128522 - RNA, 64 nt, Homo Sapiens; identical to SEQ ID NO: 102131

SEQ ID NO: 128523 - RNA, 64 nt, Homo Sapiens; identical to SEQ ID NO: 102132

SEQ ID NO: 128524 - RNA, 64 nt, Homo Sapiens; identical to SEQ ID NO: 102133

SEQ ID NO: 128525 - RNA, 64 nt, Homo Sapiens; identical to SEQ ID NO: 102134

SEQ ID NO: 128526 - RNA, 64 nt, Homo Sapiens; identical to SEQ ID NO: 102135

SEQ ID NO: 128527 - RNA, 64 nt, Homo Sapiens; identical to SEQ ID NO: 102136

SEQ ID NO: 128528 - RNA, 64 nt, Homo Sapiens; identical to SEQ ID NO: 102137

SEQ ID NO: 128529 - RNA, 64 nt, Homo Sapiens; identical to SEQ ID NO: 102138

SEQ ID NO: 128530 - RNA, 64 nt, Homo Sapiens; identical to SEQ ID NO: 102139

SEQ ID NO: 128531 - RNA, 64 nt, Homo Sapiens; identical to SEQ ID NO: 102140

SEQ ID NO: 128532 - RNA, 64 nt, Homo Sapiens; identical to SEQ ID NO: 102141

SEQ ID NO: 128533 - RNA, 64 nt, Homo Sapiens; identical to SEQ ID NO: 102142

SEQ ID NO: 128534 - RNA, 64 nt, Homo Sapiens; identical to SEQ ID NO: 102143

SEQ ID NO: 128535 - RNA, 64 nt, Homo Sapiens; identical to SEQ ID NO: 102144

SEQ ID NO: 128536 - RNA, 64 nt, Homo Sapiens; identical to SEQ ID NO: 102145

SEQ ID NO: 128537 - RNA, 64 nt, Homo Sapiens; identical to SEQ ID NO: 102146

SEQ ID NO: 128538 - RNA, 64 nt, Homo Sapiens; identical to SEQ ID NO: 102147

SEQ ID NO: 128539 - RNA, 64 nt, Homo Sapiens; identical to SEQ ID NO: 102148

SEQ ID NO: 128540 - RNA, 64 nt, Homo Sapiens; identical to SEQ ID NO: 102149

SEQ ID NO: 128541 - RNA, 64 nt, Homo Sapiens; identical to SEQ ID NO: 102150

SEQ ID NO: 128542 - RNA, 64 nt, Homo Sapiens; identical to SEQ ID NO: 102151

SEQ ID NO: 128543 - RNA, 64 nt, Homo Sapiens; identical to SEQ ID NO: 102152

SEQ ID NO: 128544 - RNA, 64 nt, Homo Sapiens; identical to SEQ ID NO: 102153

SEQ ID NO: 128545 - RNA, 64 nt, Homo Sapiens; identical to SEQ ID NO: 102154

SEQ ID NO: 128546 - RNA, 64 nt, Homo Sapiens; identical to SEQ ID NO: 102155

SEQ ID NO: 128547 - RNA, 64 nt, Homo Sapiens; identical to SEQ ID NO: 102156

SEQ ID NO: 128548 - RNA, 64 nt, Homo Sapiens; identical to SEQ ID NO: 102157

SEQ ID NO: 128549 - RNA, 64 nt, Homo Sapiens; identical to SEQ ID NO: 102158

SEQ ID NO: 128550 - RNA, 64 nt, Homo Sapiens; identical to SEQ ID NO: 102159

SEQ ID NO: 128551 - RNA, 64 nt, Homo Sapiens; identical to SEQ ID NO: 102160

SEQ ID NO: 128552 - RNA, 64 nt, Homo Sapiens; identical to SEQ ID NO: 102161

SEQ ID NO: 128553 - RNA, 64 nt, Homo Sapiens; identical to SEQ ID NO: 102162

SEQ ID NO: 128554 - RNA, 64 nt, Homo Sapiens; identical to SEQ ID NO: 102163

SEQ ID NO: 128555 - RNA, 64 nt, Homo Sapiens; identical to SEQ ID NO: 102164

SEQ ID NO: 128556 - RNA, 64 nt, Homo Sapiens; identical to SEQ ID NO: 102165

SEQ ID NO: 128557 - RNA, 64 nt, Homo Sapiens; identical to SEQ ID NO: 102166

SEQ ID NO: 128558 - RNA, 64 nt, Homo Sapiens; identical to SEQ ID NO: 102167

SEQ ID NO: 128559 - RNA, 64 nt, Homo Sapiens; identical to SEQ ID NO: 102168

SEQ ID NO: 128560 - RNA, 64 nt, Homo Sapiens; identical to SEQ ID NO: 102169

SEQ ID NO: 128561 - RNA, 64 nt, Homo Sapiens; identical to SEQ ID NO: 102170

SEQ ID NO: 128562 - RNA, 64 nt, Homo Sapiens; identical to SEQ ID NO: 102171

SEQ ID NO: 128563 - RNA, 64 nt, Homo Sapiens; identical to SEQ ID NO: 102172

SEQ ID NO: 128564 - RNA, 64 nt, Homo Sapiens; identical to SEQ ID NO: 102173

SEQ ID NO: 128565 - RNA, 64 nt, Homo Sapiens; identical to SEQ ID NO: 102174

SEQ ID NO: 128566 - RNA, 64 nt, Homo Sapiens; identical to SEQ ID NO: 102175

SEQ ID NO: 128567 - RNA, 64 nt, Homo Sapiens; identical to SEQ ID NO: 102176

SEQ ID NO: 128568 - RNA, 64 nt, Homo Sapiens; identical to SEQ ID NO: 102177

SEQ ID NO: 128569 - RNA, 64 nt, Homo Sapiens; identical to SEQ ID NO: 102178

SEQ ID NO: 128570 - RNA, 64 nt, Homo Sapiens; identical to SEQ ID NO: 102179

SEQ ID NO: 128571 - RNA, 64 nt, Homo Sapiens; identical to SEQ ID NO: 102180

SEQ ID NO: 128572 - RNA, 64 nt, Homo Sapiens; identical to SEQ ID NO: 102181

SEQ ID NO: 128573 - RNA, 64 nt, Homo Sapiens; identical to SEQ ID NO: 102182

SEQ ID NO: 128574 - RNA, 64 nt, Homo Sapiens; identical to SEQ ID NO: 102183

SEQ ID NO: 128575 - RNA, 64 nt, Homo Sapiens; identical to SEQ ID NO: 102184

SEQ ID NO: 128576 - RNA, 64 nt, Homo Sapiens; identical to SEQ ID NO: 102185

SEQ ID NO: 128577 - RNA, 64 nt, Homo Sapiens; identical to SEQ ID NO: 102186

SEQ ID NO: 128578 - RNA, 64 nt, Homo Sapiens; identical to SEQ ID NO: 102187

SEQ ID NO: 128579 - RNA, 64 nt, Homo Sapiens; identical to SEQ ID NO: 102188

SEQ ID NO: 128580 - RNA, 64 nt, Homo Sapiens; identical to SEQ ID NO: 102189

SEQ ID NO: 128581 - RNA, 64 nt, Homo Sapiens; identical to SEQ ID NO: 102190

SEQ ID NO: 128582 - RNA, 64 nt, Homo Sapiens; identical to SEQ ID NO: 102191

SEQ ID NO: 128583 - RNA, 64 nt, Homo Sapiens; identical to SEQ ID NO: 102192

SEQ ID NO: 128584 - RNA, 64 nt, Homo Sapiens; identical to SEQ ID NO: 102193

SEQ ID NO: 128585 - RNA, 64 nt, Homo Sapiens; identical to SEQ ID NO: 102194

SEQ ID NO: 128586 - RNA, 64 nt, Homo Sapiens; identical to SEQ ID NO: 102195

SEQ ID NO: 128587 - RNA, 64 nt, Homo Sapiens; identical to SEQ ID NO: 102196

SEQ ID NO: 128588 - RNA, 64 nt, Homo Sapiens; identical to SEQ ID NO: 102197

SEQ ID NO: 128589 - RNA, 64 nt, Homo Sapiens; identical to SEQ ID NO: 102198

SEQ ID NO: 128590 - RNA, 64 nt, Homo Sapiens; identical to SEQ ID NO: 102199

SEQ ID NO: 128591 - RNA, 64 nt, Homo Sapiens; identical to SEQ ID NO: 102200

SEQ ID NO: 128592 - RNA, 64 nt, Homo Sapiens; identical to SEQ ID NO: 102201

SEQ ID NO: 128593 - RNA, 64 nt, Homo Sapiens; identical to SEQ ID NO: 102202

SEQ ID NO: 128594 - RNA, 64 nt, Homo Sapiens; identical to SEQ ID NO: 102203

SEQ ID NO: 128595 - RNA, 64 nt, Homo Sapiens; identical to SEQ ID NO: 102204

SEQ ID NO: 128596 - RNA, 64 nt, Homo Sapiens; identical to SEQ ID NO: 102205

SEQ ID NO: 128597 - RNA, 64 nt, Homo Sapiens; identical to SEQ ID NO: 102206

SEQ ID NO: 128598 - RNA, 64 nt, Homo Sapiens; identical to SEQ ID NO: 102207

SEQ ID NO: 128599 - RNA, 64 nt, Homo Sapiens; identical to SEQ ID NO: 102208

SEQ ID NO: 128600 - RNA, 64 nt, Homo Sapiens; identical to SEQ ID NO: 102209

SEQ ID NO: 128601 - RNA, 64 nt, Homo Sapiens
uaaagaacuugcuguucaaaaagcuccagcuucucagaaagaaucaacaauguucucuaguuuc

SEQ ID NO: 128602 - RNA, 64 nt, Homo Sapiens
auucagagucugaagugguggccacagucaauaccagaaagauggacauugugaccaugaccca

SEQ ID NO: 128603 - RNA, 64 nt, Homo Sapiens
gaaaaacuaugguguaauuugaaagaaugauuugcagaaagaaauuggaaaaaacugcaaauca

SEQ ID NO: 128604 - RNA, 64 nt, Homo Sapiens
gauuugcagaaagaaagaaaaaaaaacugcaaaucagaaagaauacuaauauggcucuguuugg

SEQ ID NO: 128605 - RNA, 64 nt, Homo Sapiens
agaggauuaguuauacaauuacauauaauguagucagaaagaugauaaagaugacuuucaagga

SEQ ID NO: 128606 - RNA, 64 nt, Homo Sapiens
ggcguacaaaucuuauuauuuuuaaaugugugaucagaaagaauugguauuuugaucaguuuua

SEQ ID NO: 128607 - RNA, 64 nt, Homo Sapiens
ucauuuuguuucaacgguccaaacgcccaaccuucagaaagaggaagucagauagaaauagucc

SEQ ID NO: 128608 - RNA, 64 nt, Homo Sapiens
agguguauuucuugguacccccaagauaucaggccagaaagagaugagucaguugcugugcucu

SEQ ID NO: 128609 - RNA, 64 nt, Homo Sapiens
aauggucaucugagaauacuccacaucccacagccagaaagaacucucggggguggucacaacc

SEQ ID NO: 128610 - RNA, 64 nt, Homo Sapiens
cucuccgagguccaacuauacaaaugcuaguaagcagaaagaugaaaaaaaaauuuuauaaucu

SEQ ID NO: 128611 - RNA, 64 nt, Homo Sapiens
ccuggguugucguuuucuugcccuggaaccacaccagaaagagacugaaccugcaguccacccu

SEQ ID NO: 128612 - RNA, 64 nt, Homo Sapiens
gcucugagcaggugaggggguuaccugacccucacagaaagagaucucucucuggucacugccc

SEQ ID NO: 128613 - RNA, 64 nt, Homo Sapiens
aaaugagggaacagguggugucuaucuuguauaucagaaagauuaucuagggucuauccuagug

SEQ ID NO: 128614 - RNA, 64 nt, Homo Sapiens
uaaauacaguuccagauggguuauugcagauuaacagaaagacacucaacuggacucauguccc

SEQ ID NO: 128615 - RNA, 64 nt, Homo Sapiens
gucaaaucagaugaaguuauaagauaucaaaucucagaaagaauaacuaagguaacuucucaga

SEQ ID NO: 128616 - RNA, 64 nt, Homo Sapiens
ucaaaucucagaaagaaugucuaagguaacuucucagaaagauaacucacuguggaaauaaaaa

SEQ ID NO: 128617 - RNA, 64 nt, Homo Sapiens
uuaugugauucuaccaaauggaaagacgacguaucagaaagaggguuguucacuuccagaaaga

SEQ ID NO: 128618 - RNA, 64 nt, Homo Sapiens
aagacgacguaucagaaagaagguuguucacuuccagaaagagagcagcuugaaaaauuaaagg

SEQ ID NO: 128619 - RNA, 64 nt, Homo Sapiens
cucaagaccgcacagcagcgcaaguugaaaaacucagaaagaagggauucaucagcuagaacag

SEQ ID NO: 128620 - RNA, 64 nt, Homo Sapiens
agugagccacaugcaggcuggucuccggcuauuccagaaagaaaagcuggagugaggaguagag

SEQ ID NO: 128621 - RNA, 64 nt, Homo Sapiens
gacaucaugaccaggagaaaaagaagaggaaccacagaaagagaugcugccaagccacuugcca

SEQ ID NO: 128622 - RNA, 64 nt, Homo Sapiens
uggacagcuugauguuuuaguucccaucaugaaucagaaagaugugugaaaggucauaauagcu

SEQ ID NO: 128623 - RNA, 64 nt, Homo Sapiens
gugagcuugaacauaggaugugauuucaauuccacagaaagaaaugaaaacuagagccuuuaaa

SEQ ID NO: 128624 - RNA, 64 nt, Homo Sapiens
cacacagacacaaaaucacauacacagacacacacagaaagacacacagagacacaccauuaca

SEQ ID NO: 128625 - RNA, 64 nt, Homo Sapiens
cacacagacacacaaucacauacacacacauacacagaaagacacggccacagaaacacaccau

SEQ ID NO: 128626 - RNA, 64 nt, Homo Sapiens
cagacacaaaaucacacacauacacagacacacacagaaagacagccacagagacaccauuaca

SEQ ID NO: 128627 - RNA, 64 nt, Homo Sapiens
cacacagacacaaaaucacauacacagacacacacagaaagacaaccacagagacaccauuaca

SEQ ID NO: 128628 - RNA, 64 nt, Homo Sapiens
ccguggauccugguccuaggcuggacacaggauucagaaagacaccaggcugcacagaaagagc

SEQ ID NO: 128629 - RNA, 64 nt, Homo Sapiens
cuggacacaggauucagaaagacaccaggcugcacagaaagagccagauggaccugagugucgg

SEQ ID NO: 128630 - RNA, 64 nt, Homo Sapiens
agaaugucaaggaagacuuuugguagagaaggagcagaaagauguguuuuugggaagaagaaga

SEQ ID NO: 128631 - RNA, 64 nt, Homo Sapiens
uguugcuuucuuaccuacuauuggcccuaaauagcagaaagaagagaagugaccgagagaaccu

SEQ ID NO: 128632 - RNA, 64 nt, Homo Sapiens
auaauugacucuaaggcuuuuauuaagaaaacagcagaaagauuaaaucuugaauuaagucugg

SEQ ID NO: 128633 - RNA, 64 nt, Homo Sapiens
cauauuaaauacaugccuucuauauggaacauggcagaaagacugaaaaauaacaguaauuaau

SEQ ID NO: 128634 - RNA, 64 nt, Homo Sapiens
guugguguguagguagauucggggcacagaacaccagaaagaguugggggggagguggggguag

SEQ ID NO: 128635 - RNA, 64 nt, Homo Sapiens
gaauaagauccugugauuuugcuggaauuucaaacagaaagaggauugcccggugcucugcagg

SEQ ID NO: 128636 - RNA, 64 nt, Homo Sapiens
gagcaauaauaauuaauucacccaacaauguggccagaaagaaagaugguacaguaaaccaaaa

SEQ ID NO: 128637 - RNA, 64 nt, Homo Sapiens
aaggcuguuuuugaaaaucaucaggagggaguaacagaaagagccacuggaaacauuuaaauga

SEQ ID NO: 128638 - RNA, 64 nt, Homo Sapiens
aaugugugguuaguguuuuuuuauuccccuaagacagaaagaacaaaaaauguuuuaaauuucu

SEQ ID NO: 128639 - RNA, 64 nt, Homo Sapiens
augacauacacugaauugaaaaucuauuuuauuacagaaagaucaguuucuaacaaaugaaaau

SEQ ID NO: 128640 - RNA, 64 nt, Homo Sapiens
ggagaagggggucaaagcaaggaucuuucacccacagaaagagagcacugaccccgauggcgau

SEQ ID NO: 128641 - RNA, 64 nt, Homo Sapiens
auucaguugguaagcuuccaggaaaaaggacaggcagaaagaguuugagaccugaauagcuccc

SEQ ID NO: 128642 - RNA, 64 nt, Homo Sapiens
guauuauagagucuuuugaagaguggaaauucuccagaaagauaaaagaaucauuagaaauuau

SEQ ID NO: 128643 - RNA, 64 nt, Homo Sapiens
cauuagaaaaauuacuuuaauuuuggcccucuugcagaaagaagacuaaaacaguauguucugg

SEQ ID NO: 128644 - RNA, 64 nt, Homo Sapiens
ucugcaugaguugcuuuuguuuuccuggggcaaacagaaagaaaaaaaauugaggaucucuguu

SEQ ID NO: 128645 - RNA, 64 nt, Homo Sapiens
ggagauagcucuguagaaacccaaaaacuuguuucagaaagauaagaaagccagaggacuagag

SEQ ID NO: 128646 - RNA, 64 nt, Homo Sapiens
agagagaacucuguggauacccaaagacuuguuucagaaagaugagaaagccagaggacuagau

SEQ ID NO: 128647 - RNA, 64 nt, Homo Sapiens
gaagagaguucuuuggaaacgccaagacuuguuucagaaagaugagaaagccagaggacuagag

SEQ ID NO: 128648 - RNA, 64 nt, Homo Sapiens
caugcagggaagggucugccccugcccuggcacacacaggcacccauucccucccccugcugac

SEQ ID NO: 128649 - RNA, 64 nt, Homo Sapiens
gcuaagagucccucccugccacgcccuggcaggacacaggcacuuuuccaaugggcaagcccag

SEQ ID NO: 128650 - RNA, 64 nt, Homo Sapiens
uauuaucaaguaguaguauuuuaugacuagagaucacaggcacaaguugaaacaaacuaacaug

SEQ ID NO: 128651 - RNA, 64 nt, Homo Sapiens
guuucaucaccaacauaaggaaugaaguuggaaccacaggcagaucugaaaaagaaccaaauag

SEQ ID NO: 128652 - RNA, 64 nt, Homo Sapiens
gcaaacagaaccacagggcccaggaggcauuccacacaggcacugccccaggacaacacaacaa

SEQ ID NO: 128653 - RNA, 64 nt, Homo Sapiens
ucacuccuccucaagcucacaccaauugguuuggcacaggcacagagcuggucccuaguuaagu

SEQ ID NO: 128654 - RNA, 64 nt, Homo Sapiens
auuauaacacacuacucucuaugcagugguuauucacaggcaugguuauauugccuaggcugga

SEQ ID NO: 128655 - RNA, 64 nt, Homo Sapiens
gguaguuuugaagcucuccacuuuggugacgggucacaggcauucaggccuauuaaaucacaau

SEQ ID NO: 128656 - RNA, 64 nt, Homo Sapiens
cgcacaugcacacauacacaugcaugcacacauacacaggcauacaugcaugcacacacacaug

SEQ ID NO: 128657 - RNA, 64 nt, Homo Sapiens
cacacacacaugcacacauacacgugcacacauacacaggcacacaugcaugcacacauacaca

SEQ ID NO: 128658 - RNA, 64 nt, Homo Sapiens
cauacacaugcacacacacaugcacacauauaugcacaggcacacacauguacgcacacacaca

SEQ ID NO: 128659 - RNA, 64 nt, Homo Sapiens
auuugauuuggcuaaaauagcuauuggugugucucacaggcaaauauauugagauucuuugugg

SEQ ID NO: 128660 - RNA, 64 nt, Homo Sapiens
gaucucccaagcuuuugucagggaagggucuccacacaggcacuccuuugccugaagcuguuuu

SEQ ID NO: 128661 - RNA, 64 nt, Homo Sapiens
gcuccucauugcucccaucugccucugcugcacacacaggcaccagcagggaugccacaggagu

SEQ ID NO: 128662 - RNA, 64 nt, Homo Sapiens
agcccugccugugaagcucuuguuucugacauuucacaggcagagaggugccaucaguucgccu

SEQ ID NO: 128663 - RNA, 64 nt, Homo Sapiens
ugagcccaccccaaguaugccugccaccuacgcccacaggcagggcacacugggcagccagccu

SEQ ID NO: 128664 - RNA, 64 nt, Homo Sapiens
gcgaaccaccuccggguuuccaucaugucaaggucacaggcauccaugugugcaaaccaucugc

SEQ ID NO: 128665 - RNA, 64 nt, Homo Sapiens
ggacucaguggcucacauuuccugccagcuacaccacaggcagaugggagucgggguggcacaa

SEQ ID NO: 128666 - RNA, 64 nt, Homo Sapiens
ccggccccgagauccucugcuguaacugcagggucacaggcaucccgggagaaugggccuccac

SEQ ID NO: 128667 - RNA, 64 nt, Homo Sapiens
caacaucacucaggauaagcaaacaguuuguuaacacaggcagcgagccacuguaccuggcgaa

SEQ ID NO: 128668 - RNA, 64 nt, Homo Sapiens
cauggcaaaacucggaagugcacauacauaugcacacaggcacaggcuccagaggucuguacau

SEQ ID NO: 128669 - RNA, 64 nt, Homo Sapiens
cguccucaguaaaagcagccaccccuucaagagucacaggcauccauccagucguaucuuucag

SEQ ID NO: 128670 - RNA, 64 nt, Homo Sapiens
gccgccaugaaaagacugcucuugagccccaaggcacaggcacgugcucugggaaauagacagg

SEQ ID NO: 128671 - RNA, 64 nt, Homo Sapiens
cugcuuggggcucccaggcugggugugccuuagccacaggcagggcugucaauaacccccuucc

SEQ ID NO: 128672 - RNA, 64 nt, Homo Sapiens
ugggauaagcacucccagccccguuuaucagaaacacaggcaaggaaauuggaacugccaccca

SEQ ID NO: 128673 - RNA, 64 nt, Homo Sapiens
cccagagcggcccccuugguacccgcagugaugacacaggcacuggcccccggagggagcgacc

SEQ ID NO: 128674 - RNA, 64 nt, Homo Sapiens
gcccccggagggagcgacccagccggcggcugaccacaggcaccccggccucuccgagacggcc

SEQ ID NO: 128675 - RNA, 64 nt, Homo Sapiens
agguuucauuuaaaagugcugggagcaggugagccacaggcaacucuucucucggaaccugcac

SEQ ID NO: 128676 - RNA, 64 nt, Homo Sapiens
uucuguagucaagcaccugaacaggcccugagcucacaggcagccaauguaaagagggaaacac

SEQ ID NO: 128677 - RNA, 64 nt, Homo Sapiens
cuaauuagaauucucugggugauaaagaaaaaugcaccuaaaaugaugauguauuaaauaccaa

SEQ ID NO: 128678 - RNA, 64 nt, Homo Sapiens
auacccaucaguauaaggcauggagaaaauuuaucaccuaaaauucauuuuaagugauagauag

SEQ ID NO: 128679 - RNA, 64 nt, Homo Sapiens
ucaaaacuaaauggcuauuucaugcaugcaccaacaccuaaaaccauuguacacagguguacac

SEQ ID NO: 128680 - RNA, 64 nt, Homo Sapiens
aaaaugacuagcucguauuuucuggaaucacauccaccuaaauuguuucuugggcaagucaaau

SEQ ID NO: 128681 - RNA, 64 nt, Homo Sapiens
uuugaugaggauauuuagcuaucaaucuaauagucaccuaaaauaucuuuuuuguuggaaaaaa

SEQ ID NO: 128682 - RNA, 64 nt, Homo Sapiens
gcauuguuccucaaacuuggcuacguauuggaaucaccuaaaaaguuaaaacaaaacauggaug

SEQ ID NO: 128683 - RNA, 64 nt, Homo Sapiens
uuuauguuucuuggcucaaacgcuuggcuaagaacaccuaaauuauuacaggcaugagccacca

SEQ ID NO: 128684 - RNA, 64 nt, Homo Sapiens
uuuuuauuuuugagaagugguucacuguugagaacaccuaaaugaucaaaucuauucagguuuc

SEQ ID NO: 128685 - RNA, 64 nt, Homo Sapiens
augcuggaucccaugggaucgaugucugaggucccaccuaaagucccuaaccgggaggcaucgc

SEQ ID NO: 128686 - RNA, 64 nt, Homo Sapiens
uacugagugccaguuguaaauguuuuucaaccagcaccuaaaaagacucuuuucaaaaaaucac

SEQ ID NO: 128687 - RNA, 64 nt, Homo Sapiens
ucagaagcaauuuacuaauuuauucuucgacuacauacugcagcagaaccagcaauacacuuga

SEQ ID NO: 128688 - RNA, 64 nt, Homo Sapiens
ggauucaaaguugucucugaaacuccucuuugucauacugcacauauaaaacgucuuuuguuuc

SEQ ID NO: 128689 - RNA, 64 nt, Homo Sapiens
gauccuaugucauaauuuuuugagaaaauguuugauacugcaagaucauuguuuaguggucugu

SEQ ID NO: 128690 - RNA, 64 nt, Homo Sapiens
aaaagaacuuuaugauuacgguccucuuucucacauacugcaaacuuaaaagauacauacacca

SEQ ID NO: 128691 - RNA, 64 nt, Homo Sapiens
aauaugcagcaaugguaagcuaaguguguguuuuauacugcaaccguauucucaugaucccaga

SEQ ID NO: 128692 - RNA, 64 nt, Homo Sapiens
aagguuuuuuaaacuucccauauauaguacucuaauacugcaagcacacacauauauauauaua

SEQ ID NO: 128693 - RNA, 64 nt, Homo Sapiens
uguauauuuuaagaauucuuuauacaauuuuaauauacugcaauacugcaguuuuugacaauuu

SEQ ID NO: 128694 - RNA, 64 nt, Homo Sapiens
uuaagaauucuuuauacaauuuuaauauacugcaauacugcaguuuuugacaauuuggauucca

SEQ ID NO: 128695 - RNA, 64 nt, Homo Sapiens
cagcugcuuugaaggcugaagauuguuuuguaugauacugcacagcaucaggcauuuuaaagca

SEQ ID NO: 128696 - RNA, 64 nt, Homo Sapiens
auacuuuauggugguucuucuccuccgaaauaauauacugcagaaaucccagacagagcuccuu

SEQ ID NO: 128697 - RNA, 64 nt, Homo Sapiens
gaaaucuuacaaaugugaagucaucauagucuucauacugcagacaacagucacaccuugcaag

SEQ ID NO: 128698 - RNA, 64 nt, Homo Sapiens
gaaacuuuacaaauaggaagucaucauagaauucauacugcagacaaaaaacaacccuugcacg

SEQ ID NO: 128699 - RNA, 64 nt, Homo Sapiens
ucugaaauugaguuuauucaaaguguaaaagcacauacugcauuuucugcugaaagaucauuau

SEQ ID NO: 128700 - RNA, 64 nt, Homo Sapiens
aaaguguaaugaguacuguggaaaccaaauuugaauacugcaaauuuguaggaguuacuagguu

SEQ ID NO: 128701 - RNA, 64 nt, Homo Sapiens; identical to SEQ ID NO: 45668

SEQ ID NO: 128702 - RNA, 64 nt, Homo Sapiens; identical to SEQ ID NO: 45669

SEQ ID NO: 128703 - RNA, 64 nt, Homo Sapiens; identical to SEQ ID NO: 45670

SEQ ID NO: 128704 - RNA, 64 nt, Homo Sapiens; identical to SEQ ID NO: 45671

SEQ ID NO: 128705 - RNA, 64 nt, Homo Sapiens; identical to SEQ ID NO: 45672

SEQ ID NO: 128706 - RNA, 64 nt, Homo Sapiens; identical to SEQ ID NO: 45673

SEQ ID NO: 128707 - RNA, 64 nt, Homo Sapiens; identical to SEQ ID NO: 45674

SEQ ID NO: 128708 - RNA, 64 nt, Homo Sapiens; identical to SEQ ID NO: 45675

SEQ ID NO: 128709 - RNA, 64 nt, Homo Sapiens; identical to SEQ ID NO: 45676

SEQ ID NO: 128710 - RNA, 64 nt, Homo Sapiens; identical to SEQ ID NO: 45677

SEQ ID NO: 128711 - RNA, 64 nt, Homo Sapiens; identical to SEQ ID NO: 45678

SEQ ID NO: 128712 - RNA, 64 nt, Homo Sapiens; identical to SEQ ID NO: 45679

SEQ ID NO: 128713 - RNA, 64 nt, Homo Sapiens; identical to SEQ ID NO: 45680

SEQ ID NO: 128714 - RNA, 64 nt, Homo Sapiens; identical to SEQ ID NO: 45681

SEQ ID NO: 128715 - RNA, 64 nt, Homo Sapiens; identical to SEQ ID NO: 45682

SEQ ID NO: 128716 - RNA, 64 nt, Homo Sapiens; identical to SEQ ID NO: 45683

SEQ ID NO: 128717 - RNA, 64 nt, Homo Sapiens; identical to SEQ ID NO: 45684

SEQ ID NO: 128718 - RNA, 64 nt, Homo Sapiens; identical to SEQ ID NO: 45685

SEQ ID NO: 128719 - RNA, 64 nt, Homo Sapiens; identical to SEQ ID NO: 45686

SEQ ID NO: 128720 - RNA, 64 nt, Homo Sapiens; identical to SEQ ID NO: 45687

SEQ ID NO: 128721 - RNA, 64 nt, Homo Sapiens; identical to SEQ ID NO: 45688

SEQ ID NO: 128722 - RNA, 64 nt, Homo Sapiens; identical to SEQ ID NO: 45689

SEQ ID NO: 128723 - RNA, 64 nt, Homo Sapiens; identical to SEQ ID NO: 45690

SEQ ID NO: 128724 - RNA, 64 nt, Homo Sapiens; identical to SEQ ID NO: 45691

SEQ ID NO: 128725 - RNA, 64 nt, Homo Sapiens; identical to SEQ ID NO: 45692

SEQ ID NO: 128726 - RNA, 64 nt, Homo Sapiens; identical to SEQ ID NO: 45693

SEQ ID NO: 128727 - RNA, 64 nt, Homo Sapiens; identical to SEQ ID NO: 45694

SEQ ID NO: 128728 - RNA, 64 nt, Homo Sapiens; identical to SEQ ID NO: 45695

SEQ ID NO: 128729 - RNA, 64 nt, Homo Sapiens; identical to SEQ ID NO: 45696

SEQ ID NO: 128730 - RNA, 64 nt, Homo Sapiens; identical to SEQ ID NO: 45697

SEQ ID NO: 128731 - RNA, 64 nt, Homo Sapiens; identical to SEQ ID NO: 45698

SEQ ID NO: 128732 - RNA, 64 nt, Homo Sapiens; identical to SEQ ID NO: 45699

SEQ ID NO: 128733 - RNA, 64 nt, Homo Sapiens; identical to SEQ ID NO: 45700

SEQ ID NO: 128734 - RNA, 64 nt, Homo Sapiens; identical to SEQ ID NO: 45701

SEQ ID NO: 128735 - RNA, 64 nt, Homo Sapiens; identical to SEQ ID NO: 45702

SEQ ID NO: 128736 - RNA, 64 nt, Homo Sapiens; identical to SEQ ID NO: 45702

SEQ ID NO: 128737 - RNA, 64 nt, Homo Sapiens; identical to SEQ ID NO: 45704

SEQ ID NO: 128738 - RNA, 64 nt, Homo Sapiens; identical to SEQ ID NO: 45705

SEQ ID NO: 128739 - RNA, 64 nt, Homo Sapiens; identical to SEQ ID NO: 45706

SEQ ID NO: 128740 - RNA, 64 nt, Homo Sapiens; identical to SEQ ID NO: 45707

SEQ ID NO: 128741 - RNA, 64 nt, Homo Sapiens; identical to SEQ ID NO: 45708

SEQ ID NO: 128742 - RNA, 64 nt, Homo Sapiens; identical to SEQ ID NO: 45709

SEQ ID NO: 128743 - RNA, 64 nt, Homo Sapiens; identical to SEQ ID NO: 45710

SEQ ID NO: 128744 - RNA, 64 nt, Homo Sapiens; identical to SEQ ID NO: 45711

SEQ ID NO: 128745 - RNA, 64 nt, Homo Sapiens; identical to SEQ ID NO: 45712

SEQ ID NO: 128746 - RNA, 64 nt, Homo Sapiens; identical to SEQ ID NO: 45713

SEQ ID NO: 128747 - RNA, 64 nt, Homo Sapiens; identical to SEQ ID NO: 45714

SEQ ID NO: 128748 - RNA, 64 nt, Homo Sapiens; identical to SEQ ID NO: 45715

SEQ ID NO: 128749 - RNA, 64 nt, Homo Sapiens; identical to SEQ ID NO: 45716

SEQ ID NO: 128750 - RNA, 64 nt, Homo Sapiens; identical to SEQ ID NO: 45717

SEQ ID NO: 128751 - RNA, 64 nt, Homo Sapiens
gaacugcucccacguccugcuuccacgucuuuuucuccugcaauccauucagagguguggcuuu

SEQ ID NO: 128752 - RNA, 64 nt, Homo Sapiens
gauggugggaaagaaaaauugagaacacuuugggcuccugcaguguggguggguggguuugauu

SEQ ID NO: 128753 - RNA, 64 nt, Homo Sapiens
uacuugcuuauuugacaacgcccccagcccagggcuccugcacuccggcugcagaggccagagg

SEQ ID NO: 128754 - RNA, 64 nt, Homo Sapiens
ccacgcccguccugccugugggggccuggagauccuccugcagaggacuguagggagggcggca

SEQ ID NO: 128755 - RNA, 64 nt, Homo Sapiens
guuuaauuuguuaucauguaggacaguuuaaguucuccugcaagaucacaggaagacuuuguaa

SEQ ID NO: 128756 - RNA, 64 nt, Homo Sapiens
gucucaagcaaccauauauuacagcagcaguacucuccugcacaaaccaacagucugucagugu

SEQ ID NO: 128757 - RNA, 64 nt, Homo Sapiens
acuuuuuccuucugaaaauauacaaaucugauggcuccugcagcgagggagcuguauuccuuua

SEQ ID NO: 128758 - RNA, 64 nt, Homo Sapiens
gcaacaaaaugugugucaccuuugaacuaugagucuccugcaugugaaaaaagcaagauugaaa

SEQ ID NO: 128759 - RNA, 64 nt, Homo Sapiens
ucggggccccugcguguguuugcgccugcgccuccuccugcauguguccucuguccgucugucc

SEQ ID NO: 128760 - RNA, 64 nt, Homo Sapiens
cggacuccgggguucggaucgggccugggucccccuccugcacgcgggcggggcgagggcggcg

SEQ ID NO: 128761 - RNA, 64 nt, Homo Sapiens
ggccaggaccgagcucuuccugcuguuugccggccuccugcagagguaccgccugcugcccccg

SEQ ID NO: 128762 - RNA, 64 nt, Homo Sapiens
agcgugcgagcccugcaccccccagguccugggacuccugcagaccccacuccauucccgcucc

SEQ ID NO: 128763 - RNA, 64 nt, Homo Sapiens
uuggguuccuaagucagcaaauaggcugaaauggcuccugcacuaaaaauucgcugggaggcca

SEQ ID NO: 128764 - RNA, 64 nt, Homo Sapiens
gauuggagaagguagaggaggaagggggacuuaucuccugcagacaguauaacugauaugauau

SEQ ID NO: 128765 - RNA, 64 nt, Homo Sapiens
cugaccccaggcagcucgaguccagucaaguucccuccugcagcgggaucccagcaucucagag

SEQ ID NO: 128766 - RNA, 64 nt, Homo Sapiens
aauggaacuccccagggccucucuguccagccagcuccugcacacacagcuuccugagucaccc

SEQ ID NO: 128767 - RNA, 64 nt, Homo Sapiens
gcacuucugccguccacauccugcccagcaccaccuccugcacucccucccgucugugagcucc

SEQ ID NO: 128768 - RNA, 64 nt, Homo Sapiens
cugacaagcucaucacugaaacuuccgucauuaccuccugcaguuacagaacuccacauauaca

SEQ ID NO: 128769 - RNA, 64 nt, Homo Sapiens
ugcacaaaaacaaguggugggcaugauuccuucucuccugcaaugaaucaaacucaaccaggag

SEQ ID NO: 128770 - RNA, 64 nt, Homo Sapiens
agcuguaggacucuugaauugugcuggaaacacacuccugcagaucucacacaugaucuucaga

SEQ ID NO: 128771 - RNA, 64 nt, Homo Sapiens
uuggaagcacaauuuuccccugauccggcucauucuccugcaagccagccgggcucucuagugg

SEQ ID NO: 128772 - RNA, 64 nt, Homo Sapiens
cuggaaagaggagggaggccgggcaaggugggaccuccugcagcugggcaaggcgguggguggu

SEQ ID NO: 128773 - RNA, 64 nt, Homo Sapiens
acauauguacauguacccaccacaaacgugcaagcuccugcacacaugcaugcacacaaacgug

SEQ ID NO: 128774 - RNA, 64 nt, Homo Sapiens
acacgcacacguacauucacuacaaacgugcagccuccugcacacgugcacauucauguguaca

SEQ ID NO: 128775 - RNA, 64 nt, Homo Sapiens
augcacauguacgcaccacaaacacaugcgcaggcuccugcaggcgugaauacacacaugcaca

SEQ ID NO: 128776 - RNA, 64 nt, Homo Sapiens
uucuccucuccccuccuucccccaccacaggucucuccugcauaggcagccacuguccguucuu

SEQ ID NO: 128777 - RNA, 64 nt, Homo Sapiens
ugccaaccacggagaugugccaagcaucucaucucuccugcacacuuuagucagaaggacuucu

SEQ ID NO: 128778 - RNA, 64 nt, Homo Sapiens
gcugcccacguguggccuccgcuggcucugccugcuccugcaacagugcggucccugcccggag

SEQ ID NO: 128779 - RNA, 64 nt, Homo Sapiens
cacacaugcugucacgcauacacacacgcacauacuccugcacauguucccaugcaugugugug

SEQ ID NO: 128780 - RNA, 64 nt, Homo Sapiens
uaccugccccccuucacacagcugggacugaggccuccugcagguuguuccucaauagcugggg

SEQ ID NO: 128781 - RNA, 64 nt, Homo Sapiens
guugugggguggaacaggguaggugggcuagggccuccugcaggacaguccccugggugucaga

SEQ ID NO: 128782 - RNA, 64 nt, Homo Sapiens
gcccugccucccaagccccgacagagaacauggucuccugcaggcagcugggaucugccugagg

SEQ ID NO: 128783 - RNA, 64 nt, Homo Sapiens
ccacggagccccugcugccaacccccugcugggucuccugcauucuccguccacacuggccggc

SEQ ID NO: 128784 - RNA, 64 nt, Homo Sapiens
gcuccuuuccaaacacuguaagucauagucaucccuccugcacuguacuccaggcuugcuucgg

SEQ ID NO: 128785 - RNA, 64 nt, Homo Sapiens
ccuuugaucggggacuuacucuuccaccuaccaccuccugcacccaaaccuaccaucuguucaa

SEQ ID NO: 128786 - RNA, 64 nt, Homo Sapiens
cagaacccgaguagugcaagaccacccucugccccuccugcaguacacagggacuaggacaucg

SEQ ID NO: 128787 - RNA, 64 nt, Homo Sapiens
gaguugcucucaguuccuucugaggcuggcagcccuccugcaaucucuugccuugggacacucu

SEQ ID NO: 128788 - RNA, 64 nt, Homo Sapiens
auggagcaaucagucaugugcaccugcuccuuuucuccugcagcaacagguaacugacuguucc

SEQ ID NO: 128789 - RNA, 64 nt, Homo Sapiens
gugcguccggccgccugagcccucucgccagccacuccugcaguguucaugucccugcggcugg

SEQ ID NO: 128790 - RNA, 64 nt, Homo Sapiens
ccagcaggcccagggaucccugaccugcaccagguggcaccaaggguccugaguccuggagaug

SEQ ID NO: 128791 - RNA, 64 nt, Homo Sapiens
gcaggguccuccauggguuuccaacccccaucacuggcaccaggaucucccacaggcacuggug

SEQ ID NO: 128792 - RNA, 64 nt, Homo Sapiens
acacuggccucugauggcaaauaccccguagcucuggcaccaccccuaggucagggguccugga

SEQ ID NO: 128793 - RNA, 64 nt, Homo Sapiens
ugggcagugguagguggggucggcagugcugggguggcaccagggagcugcugggccaggucug

SEQ ID NO: 128794 - RNA, 64 nt, Homo Sapiens
ggaaguguccuccuguucucuccagccccucucauggcaccaauagaaguaaaacuuggccucc

SEQ ID NO: 128795 - RNA, 64 nt, Homo Sapiens
uuaggucucagaggaaagaaccaggcucaaguauuggcaccaagcgcgguaagaggagggggag

SEQ ID NO: 128796 - RNA, 64 nt, Homo Sapiens
ggacaagcaggacugagggaacugcuggcucgccuggcaccaccacacggccacagccagccau

SEQ ID NO: 128797 - RNA, 64 nt, Homo Sapiens
acacggccacagccagccaucugcucugccaggguggcaccagcucagcuggcgcauguccugu

SEQ ID NO: 128798 - RNA, 64 nt, Homo Sapiens
caugcugcugccccuggucccagguggggugagcuggcaccagcuccuguggaauguuugguug

SEQ ID NO: 128799 - RNA, 64 nt, Homo Sapiens
uuuuauacugauauuaguuuggaugugccacuuuuggcaccaaacguguaugucauuuuuauuu

SEQ ID NO: 128800 - RNA, 64 nt, Homo Sapiens
cucuguccaaucagguaggcccuaugaggggguuuggcaccaagccacaggcucugaccagcag

SEQ ID NO: 128801 - RNA, 64 nt, Homo Sapiens
ucgucugggcucccugcgccacgaauuaauuaccuggcaccaccccgucguauacccuggauga

SEQ ID NO: 128802 - RNA, 64 nt, Homo Sapiens
cuucucuggucccacaggacuggcccugcuaggguggcaccagagacguccagaagaagucccu

SEQ ID NO: 128803 - RNA, 64 nt, Homo Sapiens
cugcaccucagccaguaggggcagcaugcucucuuggcaccagccacugccucaugcugacaga

SEQ ID NO: 128804 - RNA, 64 nt, Homo Sapiens
acggggaguagcuuuguggaaacugauuugauggacacugcaccagcuuccuucagguucuaga

SEQ ID NO: 128805 - RNA, 64 nt, Homo Sapiens
ccuuggugacagcagcgcagugccaaugcugaucacacugcaugggagauuuuguuaacgucug

SEQ ID NO: 128806 - RNA, 64 nt, Homo Sapiens
ugaacaguguguaguauuuucgucucuaauugccacacugcagcuggggacauuuauguaaaua

SEQ ID NO: 128807 - RNA, 64 nt, Homo Sapiens
agccacauccauacacacacucccccugccgcccacacugcagccugccggguagacucuccac

SEQ ID NO: 128808 - RNA, 64 nt, Homo Sapiens
augaaguuaucuuuuuuguuuaaaaaaaaaaaaaacacugcauuaaaaaaguaucuguugcauu

SEQ ID NO: 128809 - RNA, 64 nt, Homo Sapiens
uuuauuggaaacuuuaacugcaguguuaauauauacacugcaaaagaccaaggaugcaguugaa

SEQ ID NO: 128810 - RNA, 64 nt, Homo Sapiens
ugcauucauagccacgaguuguuauucuaugagaacacugcaucucuguaaaagugcaggaaca

SEQ ID NO: 128811 - RNA, 64 nt, Homo Sapiens
uuguuagacuagagcugagguuuaucuucucugaacacugcaguacucuaccaaucacgggcau

SEQ ID NO: 128812 - RNA, 64 nt, Homo Sapiens
acccagaacagaaggccacacaaucaauacacacacacugcagaguuuucuuacccacauuccc

SEQ ID NO: 128813 - RNA, 64 nt, Homo Sapiens
cucaagcagguacgcuguacacccccuaguccugacacugcagcagagcccugggccaaggaac

SEQ ID NO: 128814 - RNA, 64 nt, Homo Sapiens
gauccccuaguuggcaagacuauuuuaacuugauacacugcagauucagaugugcugaaagcuc

SEQ ID NO: 128815 - RNA, 64 nt, Homo Sapiens
cuuuggugcaggucuugggagcgugaucuagauuacacugcaccauucccaaguuaauccccug

SEQ ID NO: 128816 - RNA, 64 nt, Homo Sapiens
aaugauaugagaaaaauuuuguuaggccacaaaaacacugcacugugaacauuuuagaaaaggu

SEQ ID NO: 128817 - RNA, 64 nt, Homo Sapiens
acaggacuacacacuuguauauacauucuugagaacacugcaaugugaaaaucacguuugcuau

SEQ ID NO: 128818 - RNA, 64 nt, Homo Sapiens
ugucacacgcuuucaucuucgcagagacacagagacacugcagaguucugauuugcucucagcu

SEQ ID NO: 128819 - RNA, 64 nt, Homo Sapiens
auggaacuuuggcauuggagucugcaauuuuggaacacugcagugcaaaaugccugcuuggagg

SEQ ID NO: 128820 - RNA, 64 nt, Homo Sapiens
uuccauguuagcacuguggaucacaucacagaucacacugcaguggagagcccugauuggacaa

SEQ ID NO: 128821 - RNA, 64 nt, Homo Sapiens
cucgggcacuguggggaguggaggucaggagucuacacugcagcguccgaguugccucccacug

SEQ ID NO: 128822 - RNA, 64 nt, Homo Sapiens
aacaaauauuaaagcaaggaaaaguguaacugaaacacugcacuuuacuguuuuauacuuuugu

SEQ ID NO: 128823 - RNA, 64 nt, Homo Sapiens
uggagucaguggauacaaguagugcagaagguucacacugcaaauaguguucucaucucaaagc

SEQ ID NO: 128824 - RNA, 64 nt, Homo Sapiens
gaaacaguaugaauguaaaaacaugaaaggaugcacacugcaaauguugcaguucugcccgaag

SEQ ID NO: 128825 - RNA, 64 nt, Homo Sapiens
gaaacacuaugaauguaaacacaugagaggaaucacacugcacauaccacuguacugcucaaaa

SEQ ID NO: 128826 - RNA, 64 nt, Homo Sapiens
uagugcuuaaaauuaaguuuuaaaaugaaaucagacacugcagguuuguauauaaaaugaaaag

SEQ ID NO: 128827 - RNA, 64 nt, Homo Sapiens
ugugacuggaaaaggugacaaguuggugacuuugacacugcagguauuccauuuucaugguuua

SEQ ID NO: 128828 - RNA, 63 nt, Homo Sapiens
auauauaaaaaauaaaaagcuauuucuaguuuauuucacuauaaaguuuugcuuuauuaaaaa

SEQ ID NO: 128829 - RNA, 63 nt, Homo Sapiens
ucacaguguauuaguauuuguuacauuuuuguauuucacuaucuuuauacuauauaauauggu

SEQ ID NO: 128830 - RNA, 63 nt, Homo Sapiens
uagagcaacauugucuuauuaaagcauaguuuauuucacuagaaaaaauuuaauaucaaggac

SEQ ID NO: 128831 - RNA, 63 nt, Homo Sapiens
gaggccauauauauugccuccuuauccuugagauuucacuaccuuuauguuaaaaguugugua

SEQ ID NO: 128832 - RNA, 63 nt, Homo Sapiens
gugggggacaaaaugaacacgucaggcucuuaauuucacuaugaccaguaggaaccaggcugg

SEQ ID NO: 128833 - RNA, 57 nt, Homo Sapiens; identical to SEQ ID NO: 123938

SEQ ID NO: 128834 - RNA, 63 nt, Homo Sapiens
ggguaugcaguuuacccaaguccaaauaaagcauuucacuagguuacacguuauguauaugug

SEQ ID NO: 128835 - RNA, 63 nt, Homo Sapiens
uuaaggucugagugcaugugugcauuaaaaacauuucacuaccuauucucucauggacuucuc

SEQ ID NO: 128836 - RNA, 63 nt, Homo Sapiens
cauuaguuaagacugugcuaugugguuguauuauuucacuaaucucaagcuccuauuacuauu

SEQ ID NO: 128837 - RNA, 63 nt, Homo Sapiens
uuugcuaaacuuuguaaugcaacuugcuucccuuuucacuaauaaaaguguaacacuaaggug

SEQ ID NO: 128838 - RNA, 63 nt, Homo Sapiens
aggaacagcuaaggaauaauauauuuguagguguuucacuauauuuugauauuauacugauga

SEQ ID NO: 128839 - RNA, 63 nt, Homo Sapiens
guauaaguagcugccaauuuguaauggagcucuuuucacuaggacaaauaaagugagaguaau

SEQ ID NO: 128840 - RNA, 63 nt, Homo Sapiens
ugaugccaaaauauuuugcuccacaucgucuguuuucacuaggaugagauggcugaaaaaaua

SEQ ID NO: 128841 - RNA, 63 nt, Homo Sapiens
uuggcuaggcuggucuugaaguagagacggggguuucacuauggcuaauuuuuuguauuuuua

SEQ ID NO: 128842 - RNA, 63 nt, Homo Sapiens
uaacacugggccuuacugcaacuaaaaucaaaguuucacuacacaaauacacacccccacaaa

SEQ ID NO: 128843 - RNA, 63 nt, Homo Sapiens
ggccaugugguucccugcaggcucggcauuugguuucacuaaggaagaaaugcuagccuggaa

SEQ ID NO: 128844 - RNA, 63 nt, Homo Sapiens
uaaaacucucaguuucuuggaaguaguggaagguuucacuaagcaugauauuugacuuuucau

SEQ ID NO: 128845 - RNA, 63 nt, Homo Sapiens
uaaagaucugaguuucuuggaaguaguggaagguuucacuaagaaugguauuugacuuuucau

SEQ ID NO: 128846 - RNA, 63 nt, Homo Sapiens
uaguauuaggucgguacuaagaaauaagcauguuuucacuaauuuaaguacuugagacucuug

SEQ ID NO: 128847 - RNA, 63 nt, Homo Sapiens
cucauuauugagauucauccauauuguugaauguuucacuaguuaauguuuauuguucaauau

SEQ ID NO: 128848 - RNA, 63 nt, Homo Sapiens
guagcuuaaacucuguuugguaaaaucuucuucuuucacuaucuacaauuuuuucaggauuau

SEQ ID NO: 128849 - RNA, 63 nt, Homo Sapiens
agcccaaaccucagcauucuaaaaucauuacacuuucacuagaaaagagcaaggcuguuuuug

SEQ ID NO: 128850 - RNA, 63 nt, Homo Sapiens
uaugacauuagcuuuaaagguguaaaaaagauguuucacuaauguaacggugaaagagaaucc

SEQ ID NO: 128851 - RNA, 63 nt, Homo Sapiens
gugauauagugagaaagauucuaccaaccacuguuucacuacuuuuuaguuaaaauuggguau

SEQ ID NO: 128852 - RNA, 63 nt, Homo Sapiens
ucuccuccccgcugccccuaacugcagcucagcuuucacuauagcagugcuucccaaacgggu

SEQ ID NO: 128853 - RNA, 63 nt, Homo Sapiens
cuuggguguuugauuugaagaguuacgcauuuauuucacuauuuauugggaaaaaaaugcauu

SEQ ID NO: 128854 - RNA, 64 nt, Homo Sapiens
caggcucuuguggggaggccucugauucuccugaauuucccagcuggacacauugguucggcaa

SEQ ID NO: 128855 - RNA, 64 nt, Homo Sapiens
acggcugaaagacagguuuugaaauucaacccaaauuucccaagugaccauggaaggaaauaag

SEQ ID NO: 128856 - RNA, 64 nt, Homo Sapiens
aauagaacaaaauacaggacaucaaauauuagccauuucccauuuuauuuuauuuuucuaugua

SEQ ID NO: 128857 - RNA, 64 nt, Homo Sapiens
ccucuaucuuaucacuuagcuaaagacagccuaaauuucccaauuuucuguccaaaauauuugu

SEQ ID NO: 128858 - RNA, 64 nt, Homo Sapiens
auguaauacugucacuguucuuauacucagugaaauuucccagacagaagacuuaagucuuccu

SEQ ID NO: 128859 - RNA, 64 nt, Homo Sapiens
uguguguuuguuuuauauuuuuaauuuugaagcaauuucccaagccuuuuaaauugcccacccu

SEQ ID NO: 128860 - RNA, 64 nt, Homo Sapiens
uaaaugauauuuaacaccuguuuuuauugcuuucauuucccaguguaguucauguuugagaauu

SEQ ID NO: 128861 - RNA, 64 nt, Homo Sapiens
uuaagucuuauaaugauuaguguuguaauuugagauuucccaaaauccugauuugguuucuccc

SEQ ID NO: 128862 - RNA, 64 nt, Homo Sapiens
uaucuugcucugaagacauucaaaagaaaugcagauuucccaguaaguuggguaacaaaaaugg

SEQ ID NO: 128863 - RNA, 64 nt, Homo Sapiens
uccacaaauagucgggggaacagccccuucaauuauuucccaucuuacucacauuguccuacuc

SEQ ID NO: 128864 - RNA, 64 nt, Homo Sapiens
uucccaugaauaucaagaauaccauccaguagagauuucccacaggagcucuucuagcuaaaug

SEQ ID NO: 128865 - RNA, 64 nt, Homo Sapiens
auaggaagugugugggcugccuuccugggcaaguauuucccagugggaaguuggagggggcuuu

SEQ ID NO: 128866 - RNA, 64 nt, Homo Sapiens
caggagaggagaggggcugugccccaggcuccccauuucccagcuccucacagaggccugguuu

SEQ ID NO: 128867 - RNA, 64 nt, Homo Sapiens
auugugacucugauucauuauagcagaacuuuaaauuucccagcuuuuugaagauuuaagcuac

SEQ ID NO: 128868 - RNA, 64 nt, Homo Sapiens
agacuuaauuugucaugacugaacgaauuuguuuauuucccauuagguuuaguggagcuacaca

SEQ ID NO: 128869 - RNA, 64 nt, Homo Sapiens
uuuaaguaguuacuaaguuaacuuuuuuuuuuucauuucccauugccuuuugcuaaaguuuugc

SEQ ID NO: 128870 - RNA, 64 nt, Homo Sapiens
gcaaucauugcagacuaacuagagacagcuguuaauuucccacauauaaaaaggcucacugaca

SEQ ID NO: 128871 - RNA, 64 nt, Homo Sapiens
uaaccuauuucaagucugaguuuugaaaauuuacauuucccaaguauugcauuauugagguauu

SEQ ID NO: 128872 - RNA, 64 nt, Homo Sapiens
uuuucucuguuucacugugugaaaaaaagaagauauuucccauaaaugggaaguuugcccauug

SEQ ID NO: 128873 - RNA, 64 nt, Homo Sapiens
caugaaaaucccuugcuauggcuugucucucaguauuucccaauuagcccuuaacaaaucuuca

SEQ ID NO: 128874 - RNA, 64 nt, Homo Sapiens
guucugaagugccuugagaauccgguacaaaaugauuucccaaaccauaaaugcuuucugagga

SEQ ID NO: 128875 - RNA, 64 nt, Homo Sapiens
acagaccacugacaaauacacagauagacaaggaauuucccaugguaaaaagggauaucaguaa

SEQ ID NO: 128876 - RNA, 64 nt, Homo Sapiens
guuaauucacuauuaaaaacagcaaggcccugcuauuucccaagaauaaagaaauuuaaaauuc

SEQ ID NO: 128877 - RNA, 64 nt, Homo Sapiens
cugcaugaauuguuuauuugcagugaugcuucauauuucccagcacuguucaugguaucuuauu

SEQ ID NO: 128878 - RNA, 64 nt, Homo Sapiens
gcuucauauuucccagcacuguucaugguaucuuauuucccagguccuucauuguagccauggg

SEQ ID NO: 128879 - RNA, 64 nt, Homo Sapiens
cauguccggcuuguguugugacauuuaacacaagauuucccaaagaagaaaggccuuauauaug

SEQ ID NO: 128880 - RNA, 64 nt, Homo Sapiens
cucugaugugacucauguauccaaacauccauggauuucccauaaauuugagguaugugggaag

SEQ ID NO: 128881 - RNA, 64 nt, Homo Sapiens
gcaacucacauuuuucacugacucagcugggaacauuucccaguuacagagcauugcuuuguca

SEQ ID NO: 128882 - RNA, 64 nt, Homo Sapiens
cagacgccccucucccaugcaugacgagggucagauuucccauuucuauaaaaucugguacacu

SEQ ID NO: 128883 - RNA, 64 nt, Homo Sapiens
aucugagacgcaggaggcaucugcuggagcagcaauuucccaauuuauugaaagugaucgcuuu

SEQ ID NO: 128884 - RNA, 64 nt, Homo Sapiens
cacggccacagagaggcaggacggcagagccaugauuucccaccgagcgauuacgagaaccucu

SEQ ID NO: 128885 - RNA, 64 nt, Homo Sapiens
cuuaguggacaauggagucauugccauauuauuuauuucccaaaauguaucuccaguagcaaug

SEQ ID NO: 128886 - RNA, 64 nt, Homo Sapiens
ucugccacucaugauuauauacagacuugaguucauuucccagcuuuuucaugucuucagaguc

SEQ ID NO: 128887 - RNA, 64 nt, Homo Sapiens
ucuugcaggacucacuggauugcuggagguaguagagccugaaguuccaggcucagcagggagc

SEQ ID NO: 128888 - RNA, 64 nt, Homo Sapiens
ucuugcaggacucacuggauugcuggcugagaaagagccugaaguuccaggcucagcagggagc

SEQ ID NO: 128889 - RNA, 54 nt, Homo Sapiens
ucuugcaggacucacuggaugaaagagccugaagagcagggagcugcuggauga

SEQ ID NO: 128890 - RNA, 64 nt, Homo Sapiens
gggacacuaaugaagauacgguugcuucaccuuggagccugaacaugacauuucuaaguggggu

SEQ ID NO: 128891 - RNA, 64 nt, Homo Sapiens
ugucagagaucugggaggucuccacugaggaugugagccugauuauccuauaggcagacguggg

SEQ ID NO: 128892 - RNA, 64 nt, Homo Sapiens
aaguguguugggaauugcaugccaucuccacccugagccugaccuuucugagugacaugggugu

SEQ ID NO: 128893 - RNA, 64 nt, Homo Sapiens
cggcugugggggaggucccugccaguguuuagaagagccugacuguguucagugccuuggagca

SEQ ID NO: 128894 - RNA, 64 nt, Homo Sapiens
cucuaagggcauuugaaagacugccagguagugcgagccugagauggucuggaggauucucucu

SEQ ID NO: 128895 - RNA, 64 nt, Homo Sapiens
cauugcaccuggccaagaagagacaucuugacuugagccugaagacuauguacagagacugacc

SEQ ID NO: 128896 - RNA, 64 nt, Homo Sapiens
gaaauuuccagaugucucaugcugcauagggcaggagccugaaaagcuaauuugagaagauaau

SEQ ID NO: 128897 - RNA, 64 nt, Homo Sapiens
gauuccuagucagagauugggagaaauacaagaugagccugaaucaucucauguaccugacagu

SEQ ID NO: 128898 - RNA, 64 nt, Homo Sapiens
ggugccucuggaugcccgggauggcaaugagguggagccugaugaugaccacuucuccauugug

SEQ ID NO: 128899 - RNA, 64 nt, Homo Sapiens
ccuuucacgucagcuaccuggauauugaggagcugagccugaguggacucugccagugccuggu

SEQ ID NO: 128900 - RNA, 64 nt, Homo Sapiens
agauuuguauuuaauacacaagucucuaaacucugagccugaaacagcagcauuucaccccuga

SEQ ID NO: 128901 - RNA, 64 nt, Homo Sapiens
cuucuguacgugucugacacggauaugguauaacgagccugagcgaaagagcuggauuggcugg

SEQ ID NO: 128902 - RNA, 64 nt, Homo Sapiens
cugccucaccuaccccagggaacuuccaaggaaggagccugagccacuggggacuaagugggca

SEQ ID NO: 128903 - RNA, 64 nt, Homo Sapiens
cggugggagaggcccgggucagagcccugggggugagccugaaggccacagagaaagaaccuug

SEQ ID NO: 128904 - RNA, 64 nt, Homo Sapiens
aagaagaggcuggggaggguucucccacaguguggagccugaacugccucccugucuccaaaga

SEQ ID NO: 128905 - RNA, 64 nt, Homo Sapiens
ccccaugccccaccuuugcuugggagaccaugaugagccugacuuccuggaggaccuggagagc

SEQ ID NO: 128906 - RNA, 64 nt, Homo Sapiens
cccaagcaggacccgggggucccagaugggaggagagccugagggcucucucucccaccuccuc

SEQ ID NO: 128907 - RNA, 64 nt, Homo Sapiens
cugacucuugaggguugggguccauauuccagcugagccugaaucaagcugcugaaguggccuc

SEQ ID NO: 128908 - RNA, 64 nt, Homo Sapiens
accugagccucagauuccaauagcucacucccuagagccugacgccggggccccugaccccuga

SEQ ID NO: 128909 - RNA, 64 nt, Homo Sapiens
cccugagccucagauuccaauaccucacuccccagagccugaugccggggccccugaccccuga

SEQ ID NO: 128910 - RNA, 64 nt, Homo Sapiens
agagcaucuguuugcagaggucccugugucuuucuucucuuacccugucuugcucucucugccu

SEQ ID NO: 128911 - RNA, 64 nt, Homo Sapiens
auacccuuuacugauuuaauuuccaaguuguccuuucucuuaaauggacucugaagucucuauu

SEQ ID NO: 128912 - RNA, 64 nt, Homo Sapiens
cauucgugugcuuccauggacaaaccugauuuuuuucucuuaguucuaaagaaucuuggguuau

SEQ ID NO: 128913 - RNA, 64 nt, Homo Sapiens
agaguuuaguuuucaguugcugaaguagcucauuuucucuuacuaauguuugguuccucaggga

SEQ ID NO: 128914 - RNA, 64 nt, Homo Sapiens
acacaguggcuacaauauucacaaaauucuuauguucucuuaugaaaaauauacacuuuucauu

SEQ ID NO: 128915 - RNA, 64 nt, Homo Sapiens
auugugagcuuugguucuuugaacaggugaucuauucucuuacauuuugugcuuuuuaucuugg

SEQ ID NO: 128916 - RNA, 64 nt, Homo Sapiens
gugaaaagaucaagaaacgugugaaaacucccuauucucuuaagcgguggcgccccuccaccug

SEQ ID NO: 128917 - RNA, 64 nt, Homo Sapiens
gcacauacugaaugcugaaguauacauaugcuauuucucuuaaaccucagagcaaccauaugag

SEQ ID NO: 128918 - RNA, 64 nt, Homo Sapiens
uuugccaaacccauucuuguugacaugcuccucauucucuuaaccuuauugauuggagagggac

SEQ ID NO: 128919 - RNA, 64 nt, Homo Sapiens
gauuggagagggacugacaucucuuuccuuagccuucucuuauuacagucuacauagggaagga

SEQ ID NO: 128920 - RNA, 64 nt, Homo Sapiens
cacccgguggcccuccgaggucaccccccucacauucucuuaagccgcgcugcgccaccugcac

SEQ ID NO: 128921 - RNA, 64 nt, Homo Sapiens
auugaagaggugcugccaagcgcgcccggccugauucucuuaaaggauuacaggcgugagccac

SEQ ID NO: 128922 - RNA, 64 nt, Homo Sapiens
augcgcuccuggcuuuuaaaccuguuccugacuguucucuuacugccgaaacccuugacuguua

SEQ ID NO: 128923 - RNA, 64 nt, Homo Sapiens
cuacuggggaaacuuccuauaccggagcuccaguuucucuuaagcugcccaauuucacagagua

SEQ ID NO: 128924 - RNA, 64 nt, Homo Sapiens
cagcucugcuccguaugccaagaggagacuuuaauucucuuacugcuucuuuucacuucagagc

SEQ ID NO: 128925 - RNA, 64 nt, Homo Sapiens
aauuuaggaccaauaccuccuccagaucagauucuucucuuaauuucauagauuguguuuuuuu

SEQ ID NO: 128926 - RNA, 64 nt, Homo Sapiens
auaaaauccauuauucuuaaaauccauuuccuauuucucuuaaauccuguuucucuuaaaauaa

SEQ ID NO: 128927 - RNA, 64 nt, Homo Sapiens
auaaaauccauuuccuauuucagcuguuuccuguuucucuuaaacaaaaugugauuaugcuuaa

SEQ ID NO: 128928 - RNA, 64 nt, Homo Sapiens
aguuccagagacuaaaugucacaacagaaauuuauucucuuaaccacaaacuggguggcuuuaa

SEQ ID NO: 128929 - RNA, 64 nt, Homo Sapiens
ucuguugugauuuuuaaaaaaagaacauuuuauuuucucuuauuauauagaauauugaaauugg

SEQ ID NO: 128930 - RNA, 64 nt, Homo Sapiens
aaaaaauaguaaaguaggcagagcuagguuuauuuucucuuaaacaauuuuuaaaauucagaau

SEQ ID NO: 128931 - RNA, 64 nt, Homo Sapiens
cuagucauggaaguaacuuuuauuuuaauugacauucucuuauuaaaugcccuauccaucauua

SEQ ID NO: 128932 - RNA, 64 nt, Homo Sapiens
gaauuaauauucacuucugaaauacauuuuaugguucucuuaaguuuuaagagaauuuuuuaaa

SEQ ID NO: 128933 - RNA, 64 nt, Homo Sapiens
aaaaugcuuuuauaaagaaacuccauauugcugguucucuuaccgggguuagggagaaaucugu

SEQ ID NO: 128934 - RNA, 64 nt, Homo Sapiens
gauuuugugugcaucuuuaaaaacaauuaucuuuuucucuuaaucaauacaguauucacucuag

SEQ ID NO: 128935 - RNA, 64 nt, Homo Sapiens
uaacucgaucuguacccagcccaaggugguuuucuucucuuaaauuuuuagacguuuuuuuccu

SEQ ID NO: 128936 - RNA, 64 nt, Homo Sapiens
uugccuuaggcguucuaaucacuguaacuggccuuucucuuaccaaaauugcacuucucuuaaa

SEQ ID NO: 128937 - RNA, 64 nt, Homo Sapiens
acuguaacuggccuuucucucucgaaaauugcacuucucuuaaaggggguacccccagcagccu

SEQ ID NO: 128938 - RNA, 64 nt, Homo Sapiens
gagagagaggucauauguccaauaguugccuuucuucucuuaggcagcucugcacuucauguuc

SEQ ID NO: 128939 - RNA, 64 nt, Homo Sapiens
auccuaccaaauauuuauccuucucuguccucuauucucuuacucuccucucucccuuuuuccu

SEQ ID NO: 128940 - RNA, 64 nt, Homo Sapiens
uuuaaaaggcccuugacauuuugcguuuuaauauuucucuuaacccuauucucagggaagaugg

SEQ ID NO: 128941 - RNA, 64 nt, Homo Sapiens
guccuuuuuuuuuguuuuuuuuuuuuuuaauuauuucucuuagcagaucagcaaucccucuagg

SEQ ID NO: 128942 - RNA, 64 nt, Homo Sapiens
ugccugauuuaagugucugagaaacaaaucuuuguucucuuaggcugcaauggaacaacuuuac

SEQ ID NO: 128943 - RNA, 64 nt, Homo Sapiens
cccuaagacagaaagaacaaaaaauguuuuaaauuucucuuauauaggaaauaauaggaacguc

SEQ ID NO: 128944 - RNA, 64 nt, Homo Sapiens
uuuaaaggaguugcuccuuugaaauauuuaugcgacucucaaaccuuagguuuaagcuguauau

SEQ ID NO: 128945 - RNA, 64 nt, Homo Sapiens
ucuaauucaccaugucacagaaaaguuuuuaaacacucucaauuacagcaacauugaaaugcua

SEQ ID NO: 128946 - RNA, 64 nt, Homo Sapiens
uacucacagaucuguuuaacuauucuacaugacaacucucaaggacucugcccucuuagcaucu

SEQ ID NO: 128947 - RNA, 64 nt, Homo Sapiens
gaacugaaacauaaucaauguucauuuagcuuggacucucaagauucagauaagcaguuuaaac

SEQ ID NO: 128948 - RNA, 64 nt, Homo Sapiens
agugaggcaaaacccgaccucaggccuccugggacuggagcagccaggcacagggacugaaccc

SEQ ID NO: 128949 - RNA, 64 nt, Homo Sapiens
agguuccccagauaggccccuauggaaaagagcccuggagcaucgaccuccguugaacauucug

SEQ ID NO: 128950 - RNA, 64 nt, Homo Sapiens
agaaauuugagaggaaaaguggaagaaguguuuucuggagcagaagauuccacuucuuuggucc

SEQ ID NO: 128951 - RNA, 64 nt, Homo Sapiens
uuuauugguacaacuguagggaagaaucuacaaccuggagcauuucagguuugcucuuuaaaua

SEQ ID NO: 128952 - RNA, 64 nt, Homo Sapiens
uccgguacagcccgggcuccgcgugccccgcccgcuggagcaccugccaccgaggcgcgcgugg

SEQ ID NO: 128953 - RNA, 64 nt, Homo Sapiens
cagggcuuuguggcguggguguuuuccagucugccuggagcagcgagaagcagcugugcagacu

SEQ ID NO: 128954 - RNA, 64 nt, Homo Sapiens
cuggggcgggggguggguaacguaaacggcggcacuggagcaagugcaggccacguacccauga

SEQ ID NO: 128955 - RNA, 64 nt, Homo Sapiens
ccuuacaauuugccuuuagaguuucccccagucccuggagcaaaguuaggugggcaugaaauuu

SEQ ID NO: 128956 - RNA, 64 nt, Homo Sapiens
uuugcaguuggaugaauagagaagggaaaaguugcuggagcacggagugaagaugggaggagcu

SEQ ID NO: 128957 - RNA, 64 nt, Homo Sapiens
aggcccacugcugcuccugggugagaagggagcucuggagcaggaccagcugggggccggcacu

SEQ ID NO: 128958 - RNA, 64 nt, Homo Sapiens
gucugaagaugaggaaucaucuuacagucccacucuggagcacuucugggauggggaauuuguc

SEQ ID NO: 128959 - RNA, 64 nt, Homo Sapiens
gagcaugggccuuggguaaagccaucaagaugaccuggagcagauuuacagccccaugcuacag

SEQ ID NO: 128960 - RNA, 64 nt, Homo Sapiens
cugacuuacaugcuccacaucgagggcugcggcacuggagcaggcagcccuggagcaggcaggc

SEQ ID NO: 128961 - RNA, 64 nt, Homo Sapiens
caggccgagggcugcggcacagacaggcacagcccuggagcaggcagggagucugcaggagcgc

SEQ ID NO: 128962 - RNA, 64 nt, Homo Sapiens
auaauuuaguuugcuguauuaacugcuccugggccuggagcaguauucccaccuuaagauuccc

SEQ ID NO: 128963 - RNA, 64 nt, Homo Sapiens
aggaaagucaccugcaagagaucccggcacugaucuggagcagcugacagggugggucucccuu

SEQ ID NO: 128964 - RNA, 64 nt, Homo Sapiens
aagacccuggcuuucauuuuaucugggccuuggccuggagcacacuggggagcaggcagccagc

SEQ ID NO: 128965 - RNA, 64 nt, Homo Sapiens
agcagcaacuuguccuagcaccuaucugggcuuccuggagcagauggucuaaguccaguccagu

SEQ ID NO: 128966 - RNA, 64 nt, Homo Sapiens
ccaccuagagcuggccgcggagaacuccagaaagcuggagcagcgccuagaacccagucuaaug

SEQ ID NO: 128967 - RNA, 64 nt, Homo Sapiens
ccgccuagaacccagucuaagcuuccuuauggagcuggagcagcccucuaugacgacaucgagu

SEQ ID NO: 128968 - RNA, 64 nt, Homo Sapiens
caaggccgccagcguguggaagcagcggauugcucuggagcagcggucccauggcugaagcugg

SEQ ID NO: 128969 - RNA, 64 nt, Homo Sapiens
ggauugcucuggagcagccaucccauggcugaagcuggagcagccugcuccuuuacccucuugg

SEQ ID NO: 128970 - RNA, 64 nt, Homo Sapiens
ggaauggaaggggcuugggauguuucaucaacuccuggagcauuguuccgcacuguucuugcag

SEQ ID NO: 128971 - RNA, 64 nt, Homo Sapiens
uccuuccccuuugcugauaacucucuugugcuagcuggagcagccccagcuggaggccagacuc

SEQ ID NO: 128972 - RNA, 64 nt, Homo Sapiens
caguguggaggcagccauccguggacucgagucccuggagcaggugggcaaggcucuccgugga

SEQ ID NO: 128973 - RNA, 64 nt, Homo Sapiens
cacuugcagccgggaaagccggcugggacuggagcuggagcagggagcuggagccaugaggagg

SEQ ID NO: 128974 - RNA, 64 nt, Homo Sapiens
gggggauucagugcauccaggucuggcugaguugcuggagcaaaauuagugcuccugccuaaau

SEQ ID NO: 128975 - RNA, 64 nt, Homo Sapiens
ggagaguagggaggaggggucagcagcagagacccuggagcacaauaccccaggaccccuuccc

SEQ ID NO: 128976 - RNA, 64 nt, Homo Sapiens
cauaaugaauuacagucaugcccauuagcccuuccuggagcaguacaggcaauaauauauuggc

SEQ ID NO: 128977 - RNA, 64 nt, Homo Sapiens
uuaaaugucuuuagaaaugauuuuucagaaaucccuggagcaaccuaggaagaagccugugucu

SEQ ID NO: 128978 - RNA, 64 nt, Homo Sapiens
uugcagagcugggcugggcacagcccugugacgucuggagcauuggcugcauucucuuugagua

SEQ ID NO: 128979 - RNA, 64 nt, Homo Sapiens
ugucccugagcagaguuacaugcuccaagacucccuggagcacgugcagcuguuugaccugaug

SEQ ID NO: 128980 - RNA, 64 nt, Homo Sapiens
ucgccuggcgguggcuccaggguucucugguucucuggagcagaguucucugaauaccccaucc

SEQ ID NO: 128981 - RNA, 64 nt, Homo Sapiens
uguuuauagcuuugucaaguaaauuuggacgcagcuggagcacaggcccuguuuguuugcacau

SEQ ID NO: 128982 - RNA, 64 nt, Homo Sapiens
aggagaggcugcuggagcuuaagaggagaggaugcuggagcaagcaggaagagguugcuggagc

SEQ ID NO: 128983 - RNA, 64 nt, Homo Sapiens
aggagaggaugcuggagcaagcaggaagagguugcuggagcaaguugagucgccugaaccaaga

SEQ ID NO: 128984 - RNA, 64 nt, Homo Sapiens
aggagagguugcuggagcugaagaggagagguugcuggagcaagagacgagagguuguuggagc

SEQ ID NO: 128985 - RNA, 64 nt, Homo Sapiens
aggagaggcuacuggagcugaagaggagagguugcuggagcaagagaggagagguugcuggagc

SEQ ID NO: 128986 - RNA, 64 nt, Homo Sapiens
aggagagguugcuggagcaaaagaggagagguugcuggagcaagagaggagaaguugcuggagc

SEQ ID NO: 128987 - RNA, 64 nt, Homo Sapiens
aggagagguugcuggagcaaaagaggagaaguugcuggagcaagguugcucagguuguuggagc

SEQ ID NO: 128988 - RNA, 64 nt, Homo Sapiens
ggggcacuaacccaggcugacagaugugagccaucuggagcagaacccuagaagaaugauugga

SEQ ID NO: 128989 - RNA, 64 nt, Homo Sapiens
ugcccaguggggagagucugaccccuggguggaccuggagcacacuuccaggacuuuuuugcgc

SEQ ID NO: 128990 - RNA, 64 nt, Homo Sapiens
gagugggugcgguguagaggaugcucuuggccggcuggagcaagaccuggcucccaccagaggg

SEQ ID NO: 128991 - RNA, 64 nt, Homo Sapiens
cccuaggcuguuccgcguggguuaccuuaucacccuggagcacuugguauuccagaccccugac

SEQ ID NO: 128992 - RNA, 64 nt, Homo Sapiens
ggcauagggggcaagcucuuggggcaucaggacccuggagcaccagguccuuccuggaauauua

SEQ ID NO: 128993 - RNA, 64 nt, Homo Sapiens
gagcaccagguccuuccuggaauauuagauccaccuggagcaccgggucucucuaagucucacc

SEQ ID NO: 128994 - RNA, 64 nt, Homo Sapiens
aacggcagaacguggaagggcuuccucacagaagcuggagcaagccgucucugucacggucucu

SEQ ID NO: 128995 - RNA, 56 nt, Homo Sapiens
cagggccuuugcguggagccucauuccuggagcacaucacucagaaagccucuuag

SEQ ID NO: 128996 - RNA, 58 nt, Homo Sapiens
uaccaauuccaauuucaaaaugucucaauggugcuauaauaaauaaacuucaacacuc

SEQ ID NO: 128997 - RNA, 58 nt, Homo Sapiens
uuugggaaggcuuuaaagacgcauguuauggugcuaauguacuuucacuuuuaaacuc

SEQ ID NO: 128998 - RNA, 58 nt, Homo Sapiens
uacuaaagauuuuggcagaaugacuacuuggugcuaacaaggaaaaaaaguagaagcc

SEQ ID NO: 128999 - RNA, 58 nt, Homo Sapiens
aaucagauucaacccgaaggaugagaucuggugcuagcucacauaccccucuccaugu

SEQ ID NO: 129000 - RNA, 58 nt, Homo Sapiens
ccccgcugcccccuccacaguuccugaauggugcuaaggaucugcagcaguuggcaac

SEQ ID NO: 129001 - RNA, 58 nt, Homo Sapiens
ugcagcggaccacuugcccaguuugcuguggugcuagccuuccccaucauccaccggg

SEQ ID NO: 129002 - RNA, 58 nt, Homo Sapiens
aauaaggugcuucugcuucuucuagagauggugcuaaagaaaggacuagcauaugaga

SEQ ID NO: 129003 - RNA, 58 nt, Homo Sapiens
ggggcuggugggcaugcuguccacuguguggugcuaggacugccaaugccaggcccaa

SEQ ID NO: 129004 - RNA, 58 nt, Homo Sapiens
aauaauaggcuugaaaauugauauccuguggugcuaaaguacaguagaaagagaggag

SEQ ID NO: 129005 - RNA, 58 nt, Homo Sapiens
uaauagcauugggauauagucacuguaauggugcuauuaacaaacagucaacaccauu

SEQ ID NO: 129006 - RNA, 58 nt, Homo Sapiens
guuucuuuaagaaaguacuuugccaauguggugcuauuauuuauuguuuggccagcua

SEQ ID NO: 129007 - RNA, 58 nt, Homo Sapiens
uuguaguuuguuauaugaaauaguauaauggugcuauuguauguaaaacucuguuuuu

SEQ ID NO: 129008 - RNA, 58 nt, Homo Sapiens
gaggccgggugugaccucaucuuucucauggugcuauccuggugcuauuggggugggg

SEQ ID NO: 129009 - RNA, 58 nt, Homo Sapiens
ugaccucaucuuucucauggugcuauccuggugcuauugggguggggagcucccuccc

SEQ ID NO: 129010 - RNA, 64 nt, Homo Sapiens
ggagaggcccaucacuggugugguggggugggcucucccuuaggcuugggcaaggcagccaccu

SEQ ID NO: 129011 - RNA, 64 nt, Homo Sapiens
uuaggcuugggcaaggcagccaccugcccuugcucucccuuaguguucccuggccucccugcca

SEQ ID NO: 129012 - RNA, 63 nt, Homo Sapiens
cauacaaugccugaucaugcugcuccugucacccuccacgauuccacagaccaggacauucca

SEQ ID NO: 129013 - RNA, 54 nt, Homo Sapiens
guggucaaagcguuccauaguucccuccacgaaagcauucagaaacccuacaac

SEQ ID NO: 129014 - RNA, 63 nt, Homo Sapiens
agcuaccuguugaagugauaaggaugccacuuccuccacgaauuucagugcuucuugguuccc

SEQ ID NO: 129015 - RNA, 63 nt, Homo Sapiens
cgcauggggagcccgcgggcagacgugguugcucuccacgaggagggccgcuggcuuccgaac

SEQ ID NO: 129016 - RNA, 63 nt, Homo Sapiens
uuggguuccuaauuccugguguuuaauaauucucuccacgaucauguuuuucugauuuuuuuu

SEQ ID NO: 129017 - RNA, 63 nt, Homo Sapiens
acgugaauaaaaugauggaaaaucagauggauccuccacgauuuagcccucagcuucccacgg

SEQ ID NO: 129018 - RNA, 63 nt, Homo Sapiens
accgcaucguaaacagagagugcauaacccacacuccacgaaaguacaguauacucaaggucu

SEQ ID NO: 129019 - RNA, 63 nt, Homo Sapiens
aucucguggccuucccccucagacuacccaugucuccacgaaggcguccuggagucacucccc

SEQ ID NO: 129020 - RNA, 63 nt, Homo Sapiens
aggacaaguuacaccuccacucagcacucuggacuccacgaugccuuugagucuguuuuccca

SEQ ID NO: 129021 - RNA, 63 nt, Homo Sapiens
cuaugcaacugaaaaacugaggaugauuguuagcuccacgagugcaaacugcagucaccaagu

SEQ ID NO: 129022 - RNA, 56 nt, Homo Sapiens
cugccacccuguagcgccagugcugacuccacgaucgcagcauggacaccaacuaa

SEQ ID NO: 129023 - RNA, 63 nt, Homo Sapiens
ccuugauuuucacucaucaucuggaggagguggcuccacgaugcugagauuguggcucccccu

SEQ ID NO: 129024 - RNA, 63 nt, Homo Sapiens
gagcucugaggccagugccuacgacuccagaggcuccacgacucccagaguggccucagcugc

SEQ ID NO: 129025 - RNA, 63 nt, Homo Sapiens
acaggcaucccuggguggccuuuccugcugacacuccacgagcugacccagcagaauucucug

SEQ ID NO: 129026 - RNA, 63 nt, Homo Sapiens
auuagaguguuauugguagugucuagccuuuuccuccacgacauuccuugacuuaauccauuu

SEQ ID NO: 129027 - RNA, 63 nt, Homo Sapiens
auggaugcuuguuucaaaggguuuccucucccucuccacgaaggcaguaccagccaguacucc

SEQ ID NO: 129028 - RNA, 63 nt, Homo Sapiens
ccaaucuccuuccaccucccucccucccgccagcuccacgauuuuucgguguuucucuguaca

SEQ ID NO: 129029 - RNA, 63 nt, Homo Sapiens
aacuucugccuuccccaacacuguuguauccagcuccacgacacccaucugucucacccucuc

SEQ ID NO: 129030 - RNA, 63 nt, Homo Sapiens
acuagguucuugauucccuugucccugagaguacuccacgauuuguccucucuuccuacauuu

SEQ ID NO: 129031 - RNA, 63 nt, Homo Sapiens
accacaacauaauaguugaaagaucaagauuggcuccacgaaagugauacggagguuaggaug

SEQ ID NO: 129032 - RNA, 63 nt, Homo Sapiens
auuuauugagcgccuguugugcccuccccccaccuccacgacucccugcucgcaugccgcccc

SEQ ID NO: 129033 - RNA, 63 nt, Homo Sapiens
uuugcagggauagcugggaguauggccacccugcuccacgaugcgguaaugaauccagcagaa

SEQ ID NO: 129034 - RNA, 62 nt, Homo Sapiens
acucaaaaggaaaagccauuuccagcucacagcuccacgaagaugccccggggaccuuguga

SEQ ID NO: 129035 - RNA, 63 nt, Homo Sapiens
gagagcguuucugucuuuugggagaguacuuuucuccacgagcccucuggccacugugggagg

SEQ ID NO: 129036 - RNA, 63 nt, Homo Sapiens
ccugcagaacacagaaugaaacaugcugguagacuccacgagggcagggccucuccugucgcc

SEQ ID NO: 129037 - RNA, 63 nt, Homo Sapiens
guggaaacaguggggaacuaggacgauuucugucuccacgauguucuagucauguguuuuuua

SEQ ID NO: 129038 - RNA, 63 nt, Homo Sapiens
augugaaacgguucuuuaaaggaccacucuccacuccacgaggcugaccucaccaagucaagu

SEQ ID NO: 129039 - RNA, 63 nt, Homo Sapiens
cuggcugcucaggagaggcgacacauuucaaaucuccacgagauauucuccacacagaaaauc

SEQ ID NO: 129040 - RNA, 63 nt, Homo Sapiens
guuugcgggggaagccacacaucgcacguuuuacuccacgacgcacggggcucugcugucggg

SEQ ID NO: 129041 - RNA, 58 nt, Homo Sapiens
gaauuaucccgaaaaguuaacaugucaccuccacgaggccauccucugugaccgaagg

SEQ ID NO: 129042 - RNA, 63 nt, Homo Sapiens
agcucugggggaggcacaggccucccagggacccuccacgaccgguccccagacccccugagc

SEQ ID NO: 129043 - RNA, 63 nt, Homo Sapiens
ucucucuuacuccgaccauugaggaaguggagccuccacgaaccuuuagguccuucugguuug

SEQ ID NO: 129044 - RNA, 63 nt, Homo Sapiens
cugcuguuuccaggaaauuagucccccguuugccuccacgagcguaccuagaauagucucacu

SEQ ID NO: 129045 - RNA, 63 nt, Homo Sapiens
gugaaaacaaaugaaaacaacagagaguucucccuccacgauugguccaccuucccaagccuc

SEQ ID NO: 129046 - RNA, 63 nt, Homo Sapiens
cagaagaaaagguaagguguugcugcaacugugcuccacgaaaagcacugcgcauggcuguuc

SEQ ID NO: 129047 - RNA, 63 nt, Homo Sapiens
uucagaauccggagcaguaaguggagaagagcucuccacgagugcucagucuuagaacuauua

SEQ ID NO: 129048 - RNA, 63 nt, Homo Sapiens
cauugcccuuggcuuuuucugguaugugcugugcuccacgaccaagccgagaaaggaccuagg

SEQ ID NO: 129049 - RNA, 63 nt, Homo Sapiens
ggguuuaauuuuaaagacuuucugguuacacuacuccacgaacuccuccaaagauccguuauu

SEQ ID NO: 129050 - RNA, 63 nt, Homo Sapiens
uuguuauaagauauugauuucauuuagauuucccuccacgaggucagcaaacuaucauguucu

SEQ ID NO: 129051 - RNA, 63 nt, Homo Sapiens
cacguggacgugggcaccucaguagcggagcaucuccacgaaacggggcaccacaggaucccu

SEQ ID NO: 129052 - RNA, 63 nt, Homo Sapiens
uuccugaagaagagaaaugguugacuggagaaacuccacgaucuaacucacucuagugggacc

SEQ ID NO: 129053 - RNA, 63 nt, Homo Sapiens
cuuaggcccgccucaacaacguugcuuuggguccuccacgacuuaaucucccacaaggcaucu

SEQ ID NO: 129054 - RNA, 63 nt, Homo Sapiens
auaaagacgggaguccugcaauuguacugcggacuccacgaguucuuuucuggugggaggacu

SEQ ID NO: 129055 - RNA, 63 nt, Homo Sapiens
ggcuguguccuccccuagggaugagggucgggccuccacgaugcccugggcugugugcucuua

SEQ ID NO: 129056 - RNA, 63 nt, Homo Sapiens
aagcucaggccugcacaggcugccuaccugcugcuccacgaggccaggucccugggaaugagc

SEQ ID NO: 129057 - RNA, 63 nt, Homo Sapiens
uucacgcacauauccguggccaccugagaccugcuccacgacccuuccaggcagagccgagag

SEQ ID NO: 129058 - RNA, 63 nt, Homo Sapiens
cugccuccagcuuuccugguuagcgcaacgcggcuccacgaccacacgcacuucaggguggaa

SEQ ID NO: 129059 - RNA, 63 nt, Homo Sapiens
aaacuccggagggucggacgggaccugggcucucuccacgauucuggcuguuugcccaggaac

SEQ ID NO: 129060 - RNA, 63 nt, Homo Sapiens
cuguuuuaccauccugggagcaaggcccugcagcuccacgagaccuuuaccccgggaagaagc

SEQ ID NO: 129061 - RNA, 63 nt, Homo Sapiens
gggcagccucugggcccugaaccccugcuggggcuccacgacccugagagaaggggugagaag

SEQ ID NO: 129062 - RNA, 63 nt, Homo Sapiens
ucacgcugguguuugaggcauuuccacugugaucuccacgaggggauguuuuccgggacacau

SEQ ID NO: 129063 - RNA, 63 nt, Homo Sapiens
gagaaucuguccagaaguugcauaggggauggccuccacgauaaggacaugcaacacguguuu

SEQ ID NO: 129064 - RNA, 63 nt, Homo Sapiens
ccgccaccccuccuaggccugccggacccgucccuccacgaccccacccgugggccaggggcg

SEQ ID NO: 129065 - RNA, 63 nt, Homo Sapiens
aagcugaugggcuuccucuggcccucccuuuuccuccacgaggauuaaaggauacaagcugac

SEQ ID NO: 129066 - RNA, 63 nt, Homo Sapiens
ccuuaauuucuuaguccucaucaucugugacaacuccacgagcccccacagagcauccuccuc

SEQ ID NO: 129067 - RNA, 63 nt, Homo Sapiens
ugggggcucacagcacagaaccagagcccuacacuccacgaccuaucccguguacagagagau

SEQ ID NO: 129068 - RNA, 63 nt, Homo Sapiens
caccagaacuuccacagacgcccccacuagcuacuccacgaagcccccgagccucgccagacc

SEQ ID NO: 129069 - RNA, 63 nt, Homo Sapiens
cggaguaggggggcucgggacccccucggccgccuccacgaccgccacgugggcccccagccu

SEQ ID NO: 129070 - RNA, 63 nt, Homo Sapiens
gcagccccuccacucugcccgcgaggacacacacuccacgagaacccauccccgaggucccca

SEQ ID NO: 129071 - RNA, 63 nt, Homo Sapiens
acacacccccccacaaggaacccucaggccacccuccacgaggugugacuaacuaugcaauaa

SEQ ID NO: 129072 - RNA, 63 nt, Homo Sapiens
guaggguguguauauauaaaagguuguguacaacuccacgaggugaaaaauauucaguaacuu

SEQ ID NO: 129073 - RNA, 63 nt, Homo Sapiens
ccuuaagccauaggcccagggguccacucccugcuccacgaagagccuuguaaauaaccacaa

SEQ ID NO: 129074 - RNA, 63 nt, Homo Sapiens
uagcauuauguacauagaugacuacuguaauuucuccacgacagcuaaagacugcauuauuuu

SEQ ID NO: 129075 - RNA, 63 nt, Homo Sapiens
ugccagcuguuuccaggaucgagcgaaucaagacuccacgacccuaaguguguaggagccagu

SEQ ID NO: 129076 - RNA, 63 nt, Homo Sapiens
gaaggacagucguggcagccccuccuccgccuccuccacgagagcccaucccgauggaagccg

SEQ ID NO: 129077 - RNA, 63 nt, Homo Sapiens
gagaccagccuggccaacauggugaaaccccgucuccacgaaaaagauaaaaauaagcugggc

SEQ ID NO: 129078 - RNA, 63 nt, Homo Sapiens
cagggauugccgaguccacguaacugaccuguacuccacgaggcccugugggaacgguccagg

SEQ ID NO: 129079 - RNA, 63 nt, Homo Sapiens
ucccgguggaacagaugacaggaagccauuagucuccacgaguccuguuuuugugaccaaaga

SEQ ID NO: 129080 - RNA, 63 nt, Homo Sapiens
cacugcucuccccauuggcaaggccucuggccucuccacgagugagaggaugccagggacacc

SEQ ID NO: 129081 - RNA, 63 nt, Homo Sapiens
accagcccaaacugaagugcgggccggggccgacuccacgaacgcgaggccacucgacucccg

SEQ ID NO: 129082 - RNA, 64 nt, Homo Sapiens
aauaugagaguuuuaacuagaaacugaaaauguguuacaagaaagucugggcauuaaauuauac

SEQ ID NO: 129083 - RNA, 64 nt, Homo Sapiens
gccuuggauauuucuguguuuuaggaauuugaauuuacaagaauacaaauuuuuaaaauugaaa

SEQ ID NO: 129084 - RNA, 64 nt, Homo Sapiens
aacaguccacuucagggcagacggcaauaaucucuuacaagaaugaagccauauucaaccccag

SEQ ID NO: 129085 - RNA, 64 nt, Homo Sapiens
gcaaaugaauagauguagagaauaacaauauuacuuacaagaugaaaugauuagauuagaagug

SEQ ID NO: 129086 - RNA, 64 nt, Homo Sapiens
uagagacaugcuuguguuuuggaauuucacacccuuacaagaauaccacauuuugaaacccaga

SEQ ID NO: 129087 - RNA, 64 nt, Homo Sapiens
guccaucuuuucaaagauacaacaaaagcagaaguuacaagaauauugcggagagguuggaaag

SEQ ID NO: 129088 - RNA, 64 nt, Homo Sapiens
uugguuaagacugcugaggccaagugcuauuuuguuacaagaaaggaagaacuuggcuauuuuc

SEQ ID NO: 129089 - RNA, 64 nt, Homo Sapiens
gaaucaaguaugaaaaucugcacaaaugcaauguuuacaagaacugguugauucugggaggcau

SEQ ID NO: 129090 - RNA, 64 nt, Homo Sapiens
gccaaguacuaaagcaccuugcagagcgugucuauuacaagaugucauuuccaccagcaguucc

SEQ ID NO: 129091 - RNA, 64 nt, Homo Sapiens
ugggucgaguggggccuuggagaacuuuucugucuuacaagaggauuguaaaaugcacccauca

SEQ ID NO: 129092 - RNA, 64 nt, Homo Sapiens
ugggacaugccugucuuccuaauaccauuuggagcuggacaacauuugacaccaaccaaucaua

SEQ ID NO: 129093 - RNA, 64 nt, Homo Sapiens
ggagcuggacaacauuugacaccaaccaaucauacuggacaaggcccuuagaggacuugaaaua

SEQ ID NO: 129094 - RNA, 64 nt, Homo Sapiens
ucacaccuuagcuauucccaucugucauaggacucuggacaaucggaacuuaaaaccuugaagg

SEQ ID NO: 129095 - RNA, 64 nt, Homo Sapiens
uccaagucuguggaacuuaacguugguuguggaccuggacaaagcugaaaggaagguuucuauu

SEQ ID NO: 129096 - RNA, 64 nt, Homo Sapiens
agagaccaugagaaggagagcccaggccagccugcuggacaagccgccucugcccgggagaaag

SEQ ID NO: 129097 - RNA, 64 nt, Homo Sapiens
cuggaaggaggcaauaagugcagaguuuaucaugcuggacaagcgaggcugugaaugcugagac

SEQ ID NO: 129098 - RNA, 64 nt, Homo Sapiens
gaggauugcuugaguccaggaauuugagaccagccuggacaacacagugagaccucaucucuau

SEQ ID NO: 129099 - RNA, 64 nt, Homo Sapiens
gagagcaucauggggcagacagaugguggauggucuggacaagaagcgaguaagccacugcggu

SEQ ID NO: 129100 - RNA, 64 nt, Homo Sapiens
cggcugccauuggagccaauguguggcucagugccuggacaaaugaugccauggcagacaguag

SEQ ID NO: 129101 - RNA, 64 nt, Homo Sapiens
uaacacuaucauggacuacaccaggguccugguccuggacaaaggaguaguagcugaauuugau

SEQ ID NO: 129102 - RNA, 64 nt, Homo Sapiens
uggcaaaaccccaucuauuaugcuugagcucagccuggacaacaggaggccgaggcagguggau

SEQ ID NO: 129103 - RNA, 64 nt, Homo Sapiens
uauagcaagacucugccucuaguuugaaaccagccuggacaacagaagauugcuugagcucagg

SEQ ID NO: 129104 - RNA, 64 nt, Homo Sapiens
cuguuugucuacccagaggaaggaggcacugcugaauggcuauggccuggcuaagaaggugauu

SEQ ID NO: 129105 - RNA, 64 nt, Homo Sapiens
ggccagccagccuguacucugggcaagagcccaaaauggcuaggaauguuugacucccuuaauc

SEQ ID NO: 129106 - RNA, 64 nt, Homo Sapiens
ucagaugaaaauaaaauaaacgaaacauuuagacaauggcuauauuaaucugggaaggcaacac

SEQ ID NO: 129107 - RNA, 64 nt, Homo Sapiens
acgaauauaagcuuaaaauaagugaaucuaauaaaauggcuauuccucuuuuuacuuggaaaua

SEQ ID NO: 129108 - RNA, 64 nt, Homo Sapiens
guuucaguuacuuccauuuuagaaaaagaauuguaauggcuacauaaaauuuuugcucaaaacc

SEQ ID NO: 129109 - RNA, 64 nt, Homo Sapiens
uagacuauagggauaguugucugaggagaaacccaauggcuaccuuuauuaccagcugacacug

SEQ ID NO: 129110 - RNA, 64 nt, Homo Sapiens
cacccauuuucacauucccaucuaauauggcaaaaauggcuagacuuuacccaaaaacuaaauc

SEQ ID NO: 129111 - RNA, 64 nt, Homo Sapiens
uggcaagaaagcugguaaaccgcccuauuuuugcaauggcuauagaggcccugucuguaccuaa

SEQ ID NO: 129112 - RNA, 64 nt, Homo Sapiens
acuucgcuuaaauaguccaaguauauucucugagaggaaguacugaaagaugaauugacauaca

SEQ ID NO: 129113 - RNA, 64 nt, Homo Sapiens
aaaccagccaacugcuuuuugugcggucuccuauaggaaguaucgcaauuguuuuguuuucauu

SEQ ID NO: 129114 - RNA, 64 nt, Homo Sapiens
aauaaaaaauaaauaauggaacacagcaaguccuaggaaguagguuaaaacuaauucuuuaaaa

SEQ ID NO: 129115 - RNA, 64 nt, Homo Sapiens
ucucacugagacagcaacauuuaaaccaaaccagaggaaguauuuguggaacucacugccucag

SEQ ID NO: 129116 - RNA, 64 nt, Homo Sapiens
ugucagaugucacauaauuauucagugucacaugaggaaguagcuaaacagaagcagaggcuaa

SEQ ID NO: 129117 - RNA, 64 nt, Homo Sapiens
agcacuagaaauugggcaguuccauacugggcuaaggaaguaucccauacucagacgugugacc

SEQ ID NO: 129118 - RNA, 64 nt, Homo Sapiens
uucuuuuguauccuggcaaauacuccugcaggccaggaaguauaauagcaaaaaguugaacaaa

SEQ ID NO: 129119 - RNA, 64 nt, Homo Sapiens
aauugacaggacaauaaauacuucaaauacuuuuaggaaguaaaugaguaggaguuuaggaggg

SEQ ID NO: 129120 - RNA, 64 nt, Homo Sapiens
uucacuuuaaaguuugagaaacagauugcaagcaaggaaguauguaggcagaagagauccauca

SEQ ID NO: 129121 - RNA, 64 nt, Homo Sapiens
acuuagcauucaugcauauuagggaguugauuugaggaaguauuugauaaaguggcuguuaaaa

SEQ ID NO: 129122 - RNA, 64 nt, Homo Sapiens
uuauagugauguaaucuugaaacauguaggaaguaggaaguaaaucaaagcaaggaaacuaugu

SEQ ID NO: 129123 - RNA, 64 nt, Homo Sapiens
aaguaaauuauagugauguaacuauguaacauguaggaaguaggaaggaagucaaagcaaggaa

SEQ ID NO: 129124 - RNA, 64 nt, Homo Sapiens
agggauuguccuacaacaggguaugggggggauuaggaaguagguuuggcuaucuuaagccauu

SEQ ID NO: 129125 - RNA, 64 nt, Homo Sapiens
augugaggcucuccccuccuuaguuuauaaaauaaggaaguaaccauuagauuugaaagaguaa

SEQ ID NO: 129126 - RNA, 64 nt, Homo Sapiens
ucuggcagauugauauuuaugcuguguuggggauaggaaguauaccccauuagucaguguuaca

SEQ ID NO: 129127 - RNA, 64 nt, Homo Sapiens
auuugcuucauggucaugacacacauuucuauuuaggaaguaaaaaauacgcuuucugccaccu

SEQ ID NO: 129128 - RNA, 64 nt, Homo Sapiens
auaugcagguucguuuucauucuagggcagugccaggaaguauauugauagcuuuguagguaca

SEQ ID NO: 129129 - RNA, 64 nt, Homo Sapiens
augccugugguacuugauggccuguuggucaaauaggaaguacaagugugugauguuagaaccu

SEQ ID NO: 129130 - RNA, 64 nt, Homo Sapiens
agauuuaauguuacagcaucuacucuuuggcacuuuuucacauaagccagccuuagagacuaga

SEQ ID NO: 129131 - RNA, 64 nt, Homo Sapiens
guguauguguaaugauuuguguccauuucaaguguuuucacaccagucacacauuauagaaauu

SEQ ID NO: 129132 - RNA, 64 nt, Homo Sapiens
cagaacuauauuauaccaaguacuuuauuuaucguuuucacaaaacuauuugaguagaauaaau

SEQ ID NO: 129133 - RNA, 64 nt, Homo Sapiens
uaaaggaugaaauugcaccuauuuuacacuuauauuuucacaguuaauugaacauauuuuuaaa

SEQ ID NO: 129134 - RNA, 64 nt, Homo Sapiens
uaauccuauuuucauaauuuuuccuuuugccaguuuuucacauuaucuuugauaugugagcaac

SEQ ID NO: 129135 - RNA, 64 nt, Homo Sapiens
cuuaaucuauuuucagucuucuggcacguaauuuuuuucacaguuauuauucuucuauuaacaa

SEQ ID NO: 129136 - RNA, 64 nt, Homo Sapiens
cacacacacacacacacacaacauacauucacuauuuucacacaccugaaauacucacauuccc

SEQ ID NO: 129137 - RNA, 64 nt, Homo Sapiens
aaauuucaaaacaaaaacaaaaauauaaggcacguuuucacacagccuuauuuucaaaaaugug

SEQ ID NO: 129138 - RNA, 64 nt, Homo Sapiens
guagauaugaacuuacauuucugugcaaguuguuuuuucacaaaauaucuuccuaagaggcagc

SEQ ID NO: 129139 - RNA, 64 nt, Homo Sapiens
gauugacuuaucaaaagaagaucugauuaagggcuuuucacaaugguaagugugcccuuucauu

SEQ ID NO: 129140 - RNA, 64 nt, Homo Sapiens
ugcuuuucuuuuuucuuucuguaucuaugccuuuuuuucacaguaguccuuggcucugcacgga

SEQ ID NO: 129141 - RNA, 64 nt, Homo Sapiens
gacuaaauauauuuaaaaggccacauuuauauuuuuuucacaagaaccacauaauaaauuccac

SEQ ID NO: 129142 - RNA, 64 nt, Homo Sapiens
aaucaagaaaguuagucauguuuuauguaccauguuuucacacgugucucuucucuucgacuuc

SEQ ID NO: 129143 - RNA, 64 nt, Homo Sapiens
aacuuuucaaauugguuacauuaauuuuaguuuauuuucacaaguaaaaauggcuuuuuauuua

SEQ ID NO: 129144 - RNA, 64 nt, Homo Sapiens
cgcucauuuuauguaauauuuguauuuucugauuuuuucacauacugauuaacuugucaguguc

SEQ ID NO: 129145 - RNA, 64 nt, Homo Sapiens
ugauaaugugcaaagauauauuauaucuugggauuuuucacaacauacuaugauuaaaaaagcu

SEQ ID NO: 129146 - RNA, 64 nt, Homo Sapiens
gauguagauaacagcuuaacuuuugacaaauucuuuuucacacugcagcugcaacucuauagac

SEQ ID NO: 129147 - RNA, 64 nt, Homo Sapiens
acguaaaauuuuaugugcuuuccuuuuauucauauuuucacauguuuccagggcucaaaaaguu

SEQ ID NO: 129148 - RNA, 64 nt, Homo Sapiens
aacacauacauugccaauuuuguuguuguggguuuuuucacauauuaaccacccccuucuuuuu

SEQ ID NO: 129149 - RNA, 64 nt, Homo Sapiens
ccuguuggaaucaugaugauaaucauagcagcacuuuucacagcaucagcagucaucucacuag

SEQ ID NO: 129150 - RNA, 64 nt, Homo Sapiens
ccaguggcauuaaacauaaaaagacccuggcauuuuuucacauacuugaaucccuaaaugcacc

SEQ ID NO: 129151 - RNA, 64 nt, Homo Sapiens
acacccaccagauuguacauacuguguuuggcuguuuucacauauguuggauguaguguucuuu

SEQ ID NO: 129152 - RNA, 64 nt, Homo Sapiens
cuccugggggagcuuaaaacgggggaaacacugguuuucacagaugcuccacauggcugucuuu

SEQ ID NO: 129153 - RNA, 64 nt, Homo Sapiens
acuuugucaccauauccuuugugccuuuuuagcuuuuucacauuucucauagaugcauugagua

SEQ ID NO: 129154 - RNA, 64 nt, Homo Sapiens
uuuugcauuacauaauaauuuucauuugaaauguuuuucacaccuuucaaacucauacuuuauu

SEQ ID NO: 129155 - RNA, 64 nt, Homo Sapiens
cccaucugucaccaauugguuggcuagacacccauuuucacauuaaucucuaauauggcaaaaa

SEQ ID NO: 129156 - RNA, 64 nt, Homo Sapiens
uggcuggaugaaauuuucuaucucuucauacuuuuuuucacaguaaagucugugugaugaacuu

SEQ ID NO: 129157 - RNA, 64 nt, Homo Sapiens
uaauauucacugaucugcaguuuaugagaacacauuuucacaguuauguuucuucauaggaaaa

SEQ ID NO: 129158 - RNA, 64 nt, Homo Sapiens
agaccauagacaugauauagacuaacuuccccauuuuucacaagaggaaaccauccuuaugacu

SEQ ID NO: 129159 - RNA, 64 nt, Homo Sapiens
guggagcggugcagauguggaagugagaaagcccuuuucacacuagcccccagggaucauguga

SEQ ID NO: 129160 - RNA, 64 nt, Homo Sapiens
uguagaccuccaugaacucaaccggggggucaccuuuucacaaagaacaaugauacacagcugc

SEQ ID NO: 129161 - RNA, 64 nt, Homo Sapiens
gacuggcacagauuacucaguuaaaauaaagacuuuuucacaauuuguuaacuaaauuuuuuuc

SEQ ID NO: 129162 - RNA, 64 nt, Homo Sapiens
cagccaacaagcaauuaagaaguuacuucaaucauuuucacaggaguuuuguuaggaacauuug

SEQ ID NO: 129163 - RNA, 64 nt, Homo Sapiens
auuucucaaaaggagauucgaaauaaugaggguuuuuucacaccgccauuucgcuguguugucu

SEQ ID NO: 129164 - RNA, 64 nt, Homo Sapiens
agaugagggagcaggcuuucgaaacauuguucuguuuucacaaggcacaaaaacaagugguggu

SEQ ID NO: 129165 - RNA, 64 nt, Homo Sapiens
auuuuuggggauuugucgacucauuuugucugaauuuucacaacugguauuaugucacuagcua

SEQ ID NO: 129166 - RNA, 64 nt, Homo Sapiens
aacuagcaaaaaucugcauaaugcaacaacacaguuuucacacuucaaauuuuacaugaggggu

SEQ ID NO: 129167 - RNA, 64 nt, Homo Sapiens
caugauucuuuugcccacacaaagggaaaccgaauuuucacagcaagaacuuuccaggaaggcu

SEQ ID NO: 129168 - RNA, 64 nt, Homo Sapiens
ucucuccuucuuccccccgcaccaucucuccuccuuuucacagugggcaacccuggugaccagc

SEQ ID NO: 129169 - RNA, 64 nt, Homo Sapiens
ucaucuucaagguuaaaccucuuggcaguuacccuuuucacaaagugcacagugggaaucgaga

SEQ ID NO: 129170 - RNA, 64 nt, Homo Sapiens
aaugagaccuuaauaacaaauaggcguaaaaaaauuuucacauugaaaugauagaaacauuuga

SEQ ID NO: 129171 - RNA, 64 nt, Homo Sapiens
agaaagagaccaaauauuuuuuccagcuugauaauuuucacaauugguauuauuuuauauacuu

SEQ ID NO: 129172 - RNA, 64 nt, Homo Sapiens
acaggucuucucauuuucuugagauuuuuaaaauuuuucacagcgauuuuuuauuuaaaaauuu

SEQ ID NO: 129173 - RNA, 64 nt, Homo Sapiens
uaacuuguaaauauauuuuagcagugaaaaugauuuuucacaacgaccauuguauuuuccacua

SEQ ID NO: 129174 - RNA, 64 nt, Homo Sapiens
uaugauucccagugggagaaccaaaaucagauuguuuucacagugauucucuugauuccuggca

SEQ ID NO: 129175 - RNA, 64 nt, Homo Sapiens
aggcuguucuuuuuuuuuuugaaauuauaaauguuuuucacaucgauacacacuguaacuacaa

SEQ ID NO: 129176 - RNA, 64 nt, Homo Sapiens
gauggcaagccuuaugucuuuguaccaucacaacuuuucacaacaaaaaaaaaaaaaauuauuc

SEQ ID NO: 129177 - RNA, 64 nt, Homo Sapiens
uuucaacauuagugauuuuuuaaugguugggguuuuuucacaauaaaaauaguagacaacugcu

SEQ ID NO: 129178 - RNA, 64 nt, Homo Sapiens
uuuuagugaacuuaaggaauucauaugccggaaauuuucacagucugcguuugauauucaaaca

SEQ ID NO: 129179 - RNA, 64 nt, Homo Sapiens
cagucacauugagguuuggacccgcccccuucucuuuucacauagucggucggucuccccccuc

SEQ ID NO: 129180 - RNA, 64 nt, Homo Sapiens
auggagaccaacaaauaggucccacuuccucauguuuucacacgcucuuccuggcauguaagug

SEQ ID NO: 129181 - RNA, 64 nt, Homo Sapiens
aaaaauuuucauuuauuuaauggaaacuugcccauuuucacaugucugcuuauuuauuuuauau

SEQ ID NO: 129182 - RNA, 64 nt, Homo Sapiens
guuucuauauuauuuagaauauuuguuguugcaauuuucacauaagaaaauuuaacaguugugu

SEQ ID NO: 129183 - RNA, 64 nt, Homo Sapiens
aauaguccuuugucauuacaguuuuaaaaaacacuuuucacaaauugcacugaaaucuaaagau

SEQ ID NO: 129184 - RNA, 64 nt, Homo Sapiens
acagacgucugucccgcugcgcacuggcuuucuguuuucacaagcuuggggacuuccuucguca

SEQ ID NO: 129185 - RNA, 64 nt, Homo Sapiens
uggagagaugagaagcaauuccaccaaacucauguuuucacaggaggguucaguguggagagca

SEQ ID NO: 129186 - RNA, 64 nt, Homo Sapiens
caagcuccucaaacaggguucaguccacguuguguuuucacaccuuucuccaaggaucgaacca

SEQ ID NO: 129187 - RNA, 64 nt, Homo Sapiens
aaauguacauacuauguucaugauagugugauuuuuuucacauuuaagcaggaaugcaauauaa

SEQ ID NO: 129188 - RNA, 64 nt, Homo Sapiens
uaugguauuguauuguaaaccauuaaugaaaacuuuuucacaguugagugaaauuaaaaucacu

SEQ ID NO: 129189 - RNA, 64 nt, Homo Sapiens
uuucaaaucggcgugcuuacgaggcuuaaugauguuuggauauaggaccaaguuuuaugaccca

SEQ ID NO: 129190 - RNA, 64 nt, Homo Sapiens
agauuguccucauuacaguucacacuugaaugaauuuggauaccguugcuaaacagcucaguaa

SEQ ID NO: 129191 - RNA, 64 nt, Homo Sapiens
aacugugguucaucuguucauggcaaguuuauuuuuuggauauauuuuuaguaucagcagcauu

SEQ ID NO: 129192 - RNA, 64 nt, Homo Sapiens
caauuuaaucuagauuaucuauuuuauaugcuccuuuggauaugaaaacuuaaugcuaagaaac

SEQ ID NO: 129193 - RNA, 64 nt, Homo Sapiens
aguguuagugguggugucacgauuuguaucagaguuuggauacuuacugacucaauaccuuuag

SEQ ID NO: 129194 - RNA, 64 nt, Homo Sapiens
gguuauuaauucuuugagacaauguuauaauauuuuuggauaaccuguauuucacucagccuua

SEQ ID NO: 129195 - RNA, 64 nt, Homo Sapiens
aaaugacagccuuguuucucuacauguaccaguuuuuggauacuuacauuauaaaagcagaaca

SEQ ID NO: 129196 - RNA, 64 nt, Homo Sapiens
aaaaacagaagagagaaaaauagcauuuagaaguuuuggauaugaaucugcugugccccuaaaa

SEQ ID NO: 129197 - RNA, 64 nt, Homo Sapiens
cuccaugccuucucucucccccacuuacuuagcguuuggauagaccagucuguaaaauaaccaa

SEQ ID NO: 129198 - RNA, 64 nt, Homo Sapiens
uuucaagugcauuucaagcccuucagagucgaaguuuggauacagacugcccauguuucugagg

SEQ ID NO: 129199 - RNA, 64 nt, Homo Sapiens
uuuucuuuuaauaaacuaauauuuuauagcuuauuuuggauauuagcagauguuuaaauagauu

SEQ ID NO: 129200 - RNA, 64 nt, Homo Sapiens
ucagaaacccauagcaauuccuucagguuaauuuuuuggauauuugaugucauuuuucccccug

SEQ ID NO: 129201 - RNA, 64 nt, Homo Sapiens
ugagcuuuuacuuaaaauuuagauagaacuuuuuuuuggauacagcacaaacuccaguugacag

SEQ ID NO: 129202 - RNA, 64 nt, Homo Sapiens
uuuaagaagccaugguacuuuuuucuugaguuacuuuggauauguuuuuucaaugccaucugaa

SEQ ID NO: 129203 - RNA, 64 nt, Homo Sapiens
uggcaaccucuguauuuggguuacagucaaccuauuuggauacuuggcaaaagauucuugcugu

SEQ ID NO: 129204 - RNA, 64 nt, Homo Sapiens
auuuuauaugccuuuugagcuguguaacuuaauauuuggauacuugacaauuuguuuuauuaug

SEQ ID NO: 129205 - RNA, 64 nt, Homo Sapiens
uaucugauaguguucuaaaauuugguuacuuggguuuggauacccuuagugggaugauguaaau

SEQ ID NO: 129206 - RNA, 64 nt, Homo Sapiens
aagcuaauaagcacuuuaaauaaaaaccauuguuuuuggauauacuuucaguauuauguauuug

SEQ ID NO: 129207 - RNA, 64 nt, Homo Sapiens
uuuaauuuccaggcauagcauucuuucuaacagauuuggauauuauuuuucuuuccuuuuccac

SEQ ID NO: 129208 - RNA, 64 nt, Homo Sapiens
gcaauuuggggaauaucaaacuuagcauuauacauuuggauauucuaguuguauuguaaauuuu

SEQ ID NO: 129209 - RNA, 64 nt, Homo Sapiens
ucauaugcuuuuccugcauacauuauuuugaucauuuggauaacaucaaugaacacuggcuuuu

SEQ ID NO: 129210 - RNA, 64 nt, Homo Sapiens
ucucuuaagaaacccugagauuaaaaaaagacuauuuggauaacuuauaggaaagccuagaacc

SEQ ID NO: 129211 - RNA, 64 nt, Homo Sapiens
uauuguguguucugugaaugcuagcucucuugaauuuggauauugguuauuuuuuauagagugu

SEQ ID NO: 129212 - RNA, 64 nt, Homo Sapiens
uuuaccuaccaccuucccacuuggcuagcuguccuuuggauaugugcuguuaacuggggaaggc

SEQ ID NO: 129213 - RNA, 64 nt, Homo Sapiens
auugaugcuaaauauaucuuacauuugaauuccuuuuggauaaaguuauuucuugaugugacag

SEQ ID NO: 129214 - RNA, 64 nt, Homo Sapiens
ucaucccuucugagugaaauuugcucauaaagcauuuggauacuaagccauuauuugccauuuu

SEQ ID NO: 129215 - RNA, 64 nt, Homo Sapiens
aaguucauuucaucuugagaucauggugaaauauuuuggauauauaaauuccuuaagcuauugu

SEQ ID NO: 129216 - RNA, 64 nt, Homo Sapiens
agagaaagucauuugcuugugagccagcgcagguuuuggauacuucuuguuucuagccaaggga

SEQ ID NO: 129217 - RNA, 64 nt, Homo Sapiens
acuagcuauauuuugcuuuugguuuuauuuaaaguuuggauaccgcagccauacuuaccuuuga

SEQ ID NO: 129218 - RNA, 64 nt, Homo Sapiens
ggcacuaggcagcauuuguaaaaugguugugcuauuuggauaauagaagugaauuguggacgua

SEQ ID NO: 129219 - RNA, 64 nt, Homo Sapiens
uggaacugcuaaauuauuuuauuugaaaaugcccuuuggauacuuaaccauuucuuuuauguac

SEQ ID NO: 129220 - RNA, 64 nt, Homo Sapiens
ugagguaaaauuucauuuugauuucauuauuggauuuggauauuagugaggugaacgacuucag

SEQ ID NO: 129221 - RNA, 64 nt, Homo Sapiens
gcccuuuuuuuuuucuuuuuucgaguuguuuuuguuuggauacauauagaccaauucucugauc

SEQ ID NO: 129222 - RNA, 64 nt, Homo Sapiens
aucagaaauccccuugggggagcaggaugagaccuuuggauagaacagaagcugagcaagagaa

SEQ ID NO: 129223 - RNA, 64 nt, Homo Sapiens
gauagaacagaagcugagcaagagaacauguugguuuggauaaccgguugcacuauaucuguga

SEQ ID NO: 129224 - RNA, 64 nt, Homo Sapiens
uugacuggcucccucaguccuauucuguagccuuuuuggauaaaauuggguuuuaacauaccuc

SEQ ID NO: 129225 - RNA, 64 nt, Homo Sapiens
uagcacuugaaaacaugacaagggcccguaguuguuuggauaagagaacuccagcauagagccu

SEQ ID NO: 129226 - RNA, 64 nt, Homo Sapiens
ucuguuaaauuaagcauuaucuucuaagaccuuuuuuggauagucaaauauaagagauaaauag

SEQ ID NO: 129227 - RNA, 64 nt, Homo Sapiens
uaagagauaaauaguuuaauuuuuucagaccuuuuuuggauaguccaauauuagagauaaauag

SEQ ID NO: 129228 - RNA, 64 nt, Homo Sapiens
gauuucagcaacuaaacauuugagaaauaugauauuuggauaggugcauauugucagagcagca

SEQ ID NO: 129229 - RNA, 64 nt, Homo Sapiens
uuaauuauaaacauauuuuuguuuaauauacaaauuuggauagcugcaaacuuguguuaauucu

SEQ ID NO: 129230 - RNA, 64 nt, Homo Sapiens; identical to SEQ ID NO: 129130

SEQ ID NO: 129231 - RNA, 64 nt, Homo Sapiens; identical to SEQ ID NO: 129131

SEQ ID NO: 129232 - RNA, 64 nt, Homo Sapiens; identical to SEQ ID NO: 129132

SEQ ID NO: 129233 - RNA, 64 nt, Homo Sapiens; identical to SEQ ID NO: 129133

SEQ ID NO: 129234 - RNA, 64 nt, Homo Sapiens; identical to SEQ ID NO: 129134

SEQ ID NO: 129235 - RNA, 64 nt, Homo Sapiens; identical to SEQ ID NO: 129135

SEQ ID NO: 129236 - RNA, 64 nt, Homo Sapiens; identical to SEQ ID NO: 129136

SEQ ID NO: 129237 - RNA, 64 nt, Homo Sapiens; identical to SEQ ID NO: 129137

SEQ ID NO: 129238 - RNA, 64 nt, Homo Sapiens; identical to SEQ ID NO: 129138

SEQ ID NO: 129239 - RNA, 64 nt, Homo Sapiens; identical to SEQ ID NO: 129139

SEQ ID NO: 129240 - RNA, 64 nt, Homo Sapiens; identical to SEQ ID NO: 129140

SEQ ID NO: 129241 - RNA, 64 nt, Homo Sapiens; identical to SEQ ID NO: 129141

SEQ ID NO: 129242 - RNA, 64 nt, Homo Sapiens; identical to SEQ ID NO: 129142

SEQ ID NO: 129243 - RNA, 64 nt, Homo Sapiens; identical to SEQ ID NO: 129143

SEQ ID NO: 129244 - RNA, 64 nt, Homo Sapiens; identical to SEQ ID NO: 129144

SEQ ID NO: 129245 - RNA, 64 nt, Homo Sapiens; identical to SEQ ID NO: 129145

SEQ ID NO: 129246 - RNA, 64 nt, Homo Sapiens; identical to SEQ ID NO: 129146

SEQ ID NO: 129247 - RNA, 64 nt, Homo Sapiens; identical to SEQ ID NO: 129147

SEQ ID NO: 129248 - RNA, 64 nt, Homo Sapiens; identical to SEQ ID NO: 129148

SEQ ID NO: 129249 - RNA, 64 nt, Homo Sapiens; identical to SEQ ID NO: 129149

SEQ ID NO: 129250 - RNA, 64 nt, Homo Sapiens; identical to SEQ ID NO: 129150

SEQ ID NO: 129251 - RNA, 64 nt, Homo Sapiens; identical to SEQ ID NO: 129151

SEQ ID NO: 129252 - RNA, 64 nt, Homo Sapiens; identical to SEQ ID NO: 129152

SEQ ID NO: 129253 - RNA, 64 nt, Homo Sapiens; identical to SEQ ID NO: 129153

SEQ ID NO: 129254 - RNA, 64 nt, Homo Sapiens; identical to SEQ ID NO: 129154

SEQ ID NO: 129255 - RNA, 64 nt, Homo Sapiens; identical to SEQ ID NO: 129155

SEQ ID NO: 129256 - RNA, 64 nt, Homo Sapiens; identical to SEQ ID NO: 129156

SEQ ID NO: 129257 - RNA, 64 nt, Homo Sapiens; identical to SEQ ID NO: 129157

SEQ ID NO: 129258 - RNA, 64 nt, Homo Sapiens; identical to SEQ ID NO: 129158

SEQ ID NO: 129259 - RNA, 64 nt, Homo Sapiens; identical to SEQ ID NO: 129159

SEQ ID NO: 129260 - RNA, 64 nt, Homo Sapiens; identical to SEQ ID NO: 129160

SEQ ID NO: 129261 - RNA, 64 nt, Homo Sapiens; identical to SEQ ID NO: 129161

SEQ ID NO: 129262 - RNA, 64 nt, Homo Sapiens; identical to SEQ ID NO: 129162

SEQ ID NO: 129263 - RNA, 64 nt, Homo Sapiens; identical to SEQ ID NO: 129163

SEQ ID NO: 129264 - RNA, 64 nt, Homo Sapiens; identical to SEQ ID NO: 129164

SEQ ID NO: 129265 - RNA, 64 nt, Homo Sapiens; identical to SEQ ID NO: 129165

SEQ ID NO: 129266 - RNA, 64 nt, Homo Sapiens; identical to SEQ ID NO: 129166

SEQ ID NO: 129267 - RNA, 64 nt, Homo Sapiens; identical to SEQ ID NO: 129167

SEQ ID NO: 129268 - RNA, 64 nt, Homo Sapiens; identical to SEQ ID NO: 129168

SEQ ID NO: 129269 - RNA, 64 nt, Homo Sapiens; identical to SEQ ID NO: 129169

SEQ ID NO: 129270 - RNA, 64 nt, Homo Sapiens; identical to SEQ ID NO: 129170

SEQ ID NO: 129271 - RNA, 64 nt, Homo Sapiens; identical to SEQ ID NO: 129171

SEQ ID NO: 129272 - RNA, 64 nt, Homo Sapiens; identical to SEQ ID NO: 129172

SEQ ID NO: 129273 - RNA, 64 nt, Homo Sapiens; identical to SEQ ID NO: 129173

SEQ ID NO: 129274 - RNA, 64 nt, Homo Sapiens; identical to SEQ ID NO: 129174

SEQ ID NO: 129275 - RNA, 64 nt, Homo Sapiens; identical to SEQ ID NO: 129175

SEQ ID NO: 129276 - RNA, 64 nt, Homo Sapiens; identical to SEQ ID NO: 129176

SEQ ID NO: 129277 - RNA, 64 nt, Homo Sapiens; identical to SEQ ID NO: 129177

SEQ ID NO: 129278 - RNA, 64 nt, Homo Sapiens; identical to SEQ ID NO: 129178

SEQ ID NO: 129279 - RNA, 64 nt, Homo Sapiens; identical to SEQ ID NO: 129179

SEQ ID NO: 129280 - RNA, 64 nt, Homo Sapiens; identical to SEQ ID NO: 129180

SEQ ID NO: 129281 - RNA, 64 nt, Homo Sapiens; identical to SEQ ID NO: 129181

SEQ ID NO: 129282 - RNA, 64 nt, Homo Sapiens; identical to SEQ ID NO: 129182

SEQ ID NO: 129283 - RNA, 64 nt, Homo Sapiens; identical to SEQ ID NO: 129183

SEQ ID NO: 129284 - RNA, 64 nt, Homo Sapiens; identical to SEQ ID NO: 129184

SEQ ID NO: 129285 - RNA, 64 nt, Homo Sapiens; identical to SEQ ID NO: 129185

SEQ ID NO: 129286 - RNA, 64 nt, Homo Sapiens; identical to SEQ ID NO: 129186

SEQ ID NO: 129287 - RNA, 64 nt, Homo Sapiens; identical to SEQ ID NO: 129187

SEQ ID NO: 129288 - RNA, 64 nt, Homo Sapiens; identical to SEQ ID NO: 129188

SEQ ID NO: 129289 - RNA, 64 nt, Homo Sapiens; identical to SEQ ID NO: 129189

SEQ ID NO: 129290 - RNA, 64 nt, Homo Sapiens; identical to SEQ ID NO: 129190

SEQ ID NO: 129291 - RNA, 64 nt, Homo Sapiens; identical to SEQ ID NO: 129191

SEQ ID NO: 129292 - RNA, 64 nt, Homo Sapiens; identical to SEQ ID NO: 129192

SEQ ID NO: 129293 - RNA, 64 nt, Homo Sapiens; identical to SEQ ID NO: 129193

SEQ ID NO: 129294 - RNA, 64 nt, Homo Sapiens; identical to SEQ ID NO: 129194

SEQ ID NO: 129295 - RNA, 64 nt, Homo Sapiens; identical to SEQ ID NO: 129195

SEQ ID NO: 129296 - RNA, 64 nt, Homo Sapiens; identical to SEQ ID NO: 129196

SEQ ID NO: 129297 - RNA, 64 nt, Homo Sapiens; identical to SEQ ID NO: 129197

SEQ ID NO: 129298 - RNA, 64 nt, Homo Sapiens; identical to SEQ ID NO: 129198

SEQ ID NO: 129299 - RNA, 64 nt, Homo Sapiens; identical to SEQ ID NO: 129199

SEQ ID NO: 129300 - RNA, 64 nt, Homo Sapiens; identical to SEQ ID NO: 129200

SEQ ID NO: 129301 - RNA, 64 nt, Homo Sapiens; identical to SEQ ID NO: 129201

SEQ ID NO: 129302 - RNA, 64 nt, Homo Sapiens; identical to SEQ ID NO: 129202

SEQ ID NO: 129303 - RNA, 64 nt, Homo Sapiens; identical to SEQ ID NO: 129203

SEQ ID NO: 129304 - RNA, 64 nt, Homo Sapiens; identical to SEQ ID NO: 129204

SEQ ID NO: 129305 - RNA, 64 nt, Homo Sapiens; identical to SEQ ID NO: 129205

SEQ ID NO: 129306 - RNA, 64 nt, Homo Sapiens; identical to SEQ ID NO: 129206

SEQ ID NO: 129307 - RNA, 64 nt, Homo Sapiens; identical to SEQ ID NO: 129207

SEQ ID NO: 129308 - RNA, 64 nt, Homo Sapiens; identical to SEQ ID NO: 129208

SEQ ID NO: 129309 - RNA, 64 nt, Homo Sapiens; identical to SEQ ID NO: 129209

SEQ ID NO: 129310 - RNA, 64 nt, Homo Sapiens; identical to SEQ ID NO: 129210

SEQ ID NO: 129311 - RNA, 64 nt, Homo Sapiens; identical to SEQ ID NO: 129211

SEQ ID NO: 129312 - RNA, 64 nt, Homo Sapiens; identical to SEQ ID NO: 129212

SEQ ID NO: 129313 - RNA, 64 nt, Homo Sapiens; identical to SEQ ID NO: 129213

SEQ ID NO: 129314 - RNA, 64 nt, Homo Sapiens; identical to SEQ ID NO: 129214

SEQ ID NO: 129315 - RNA, 64 nt, Homo Sapiens; identical to SEQ ID NO: 129215

SEQ ID NO: 129316 - RNA, 64 nt, Homo Sapiens; identical to SEQ ID NO: 129216

SEQ ID NO: 129317 - RNA, 64 nt, Homo Sapiens; identical to SEQ ID NO: 129217

SEQ ID NO: 129318 - RNA, 64 nt, Homo Sapiens; identical to SEQ ID NO: 129218

SEQ ID NO: 129319 - RNA, 64 nt, Homo Sapiens; identical to SEQ ID NO: 129219

SEQ ID NO: 129320 - RNA, 64 nt, Homo Sapiens; identical to SEQ ID NO: 129220

SEQ ID NO: 129321 - RNA, 64 nt, Homo Sapiens; identical to SEQ ID NO: 129221

SEQ ID NO: 129322 - RNA, 64 nt, Homo Sapiens; identical to SEQ ID NO: 129222

SEQ ID NO: 129323 - RNA, 64 nt, Homo Sapiens; identical to SEQ ID NO: 129223

SEQ ID NO: 129324 - RNA, 64 nt, Homo Sapiens; identical to SEQ ID NO: 129224

SEQ ID NO: 129325 - RNA, 64 nt, Homo Sapiens; identical to SEQ ID NO: 129225

SEQ ID NO: 129326 - RNA, 64 nt, Homo Sapiens; identical to SEQ ID NO: 129226

SEQ ID NO: 129327 - RNA, 64 nt, Homo Sapiens; identical to SEQ ID NO: 129227

SEQ ID NO: 129328 - RNA, 64 nt, Homo Sapiens; identical to SEQ ID NO: 129228

SEQ ID NO: 129329 - RNA, 64 nt, Homo Sapiens; identical to SEQ ID NO: 129229

SEQ ID NO: 129330 - RNA, 64 nt, Homo Sapiens
gggcuuuguuguggugggguuaucaugaagauagcauuuagaaaugcugccuaccucacagagg

SEQ ID NO: 129331 - RNA, 64 nt, Homo Sapiens
guguguugucuuccagagucacuccagcagugagcauuuagagaucuuaagagcaucuuccaag

SEQ ID NO: 129332 - RNA, 64 nt, Homo Sapiens
aaagauguuuggcguagcagauucaaagcauggacauuuagaaguaauuaauuuggagcacaaa

SEQ ID NO: 129333 - RNA, 64 nt, Homo Sapiens
agugaauugaaguuucaaguaauguaugcauucacauuuagaaaaaagcauaaagcucaaauga

SEQ ID NO: 129334 - RNA, 64 nt, Homo Sapiens
auuccuucucccuaucugcuuauaucgcauugcucauuuagaguuugcaggaggcuccauacua

SEQ ID NO: 129335 - RNA, 64 nt, Homo Sapiens
auuaauugauuuccuacuauauucccagcagacacauuuagaaacuaagcuauguuaaccucag

SEQ ID NO: 129336 - RNA, 64 nt, Homo Sapiens
uuaucuagagagcuugguuaugguggaacuugaacauuuagagucauaaccaguuccaucaucc

SEQ ID NO: 129337 - RNA, 64 nt, Homo Sapiens
aauguuuuuuucuucaagagagugaaucuguuuacauuuagaaucuacaacaaaaaaagaguug

SEQ ID NO: 129338 - RNA, 64 nt, Homo Sapiens
cugcuagaguuauccagugugggggaaaugauuacauuuagaagugcccuguugagagaaauua

SEQ ID NO: 129339 - RNA, 64 nt, Homo Sapiens
aaaugcauacuuuuaaaacauugcuuuuauaaagcauuuagaaauaugguccuuagaaaagacu

SEQ ID NO: 129340 - RNA, 64 nt, Homo Sapiens
acaaaaacaaaaaaaauguguuucucuuguaaaacauuuagaaaacugauuaugcuuuugaaau

SEQ ID NO: 129341 - RNA, 64 nt, Homo Sapiens
uuagaaugucugggaaaauagucuacucaaauggcauuuagacaggcauggauugaagaagauu

SEQ ID NO: 129342 - RNA, 64 nt, Homo Sapiens
aaagaaaggaacuucuuuuugccuucuaauugaucauuuagacuauucuggcuaagucugccca

SEQ ID NO: 129343 - RNA, 64 nt, Homo Sapiens
uuaccggcuaauucaagcgaggaaaaauguaagucauuuagaccaaagccaagcaguuucuuug

SEQ ID NO: 129344 - RNA, 64 nt, Homo Sapiens
uuguagaauaaauuaaaaggauaaucuaaaucaccauuuagauuaagcuugacuugcaaacuag

SEQ ID NO: 129345 - RNA, 64 nt, Homo Sapiens
uauuauuuuaccaauuuuuuuuuaguauuaaguccauuuagaacuaaccauauuauuuauggaa

SEQ ID NO: 129346 - RNA, 64 nt, Homo Sapiens
acauucugugguuucucauuauacuuacuuccugcauuuagagggaguuuauuuaaaagaaaua

SEQ ID NO: 129347 - RNA, 64 nt, Homo Sapiens
caguauggaguucagauuacaguguuuuccauuacauuuagauucauagaaucugaauggcuga

SEQ ID NO: 129348 - RNA, 64 nt, Homo Sapiens
aguuuaguuugaaggagagguuuucugaaaaauacauuuagauuuacauggaguauggaggaaa

SEQ ID NO: 129349 - RNA, 64 nt, Homo Sapiens
ucuauagagucaaaacuauagauuuucaaaagaacauuuagaauagaaaaagaaccgcuuguau

SEQ ID NO: 129350 - RNA, 64 nt, Homo Sapiens
ucaaccucagaaacaggaacuuguaauuuucuugcauuuagauguugugcaguaugaaaucgua

SEQ ID NO: 129351 - RNA, 64 nt, Homo Sapiens
aacauauauguauguaugaauauaaauuguuaaacauuuagacaacuaaaugaguuuucagcuu

SEQ ID NO: 129352 - RNA, 64 nt, Homo Sapiens
acagugcagauaagaguugaauauugauaucauacauuuagacugcuguucugauugcauuuau

SEQ ID NO: 129353 - RNA, 64 nt, Homo Sapiens
ugcuguucugauugcauuuaucuuuuuccuacaucauuuagaauuuuauuucccugauucaguu

SEQ ID NO: 129354 - RNA, 64 nt, Homo Sapiens
uuagcaauagggaugguaggauucaaaugugugucauuuagaaguggaagcuauuagcaccaau

SEQ ID NO: 129355 - RNA, 64 nt, Homo Sapiens
cuuaguuuaaaaaaaaaaucaagucuaaacauugcauuuagaaagcuuuuguucuuggauaaaa

SEQ ID NO: 129356 - RNA, 64 nt, Homo Sapiens
uugcugcccgcuuaggggcuuagaaggagaagccagugagcaggcucacacuaaguuguaaaca

SEQ ID NO: 129357 - RNA, 64 nt, Homo Sapiens
ggaggaucacuugagcacaggaguuugaggcugcagugagcagccugggcaagagagugagacu

SEQ ID NO: 129358 - RNA, 64 nt, Homo Sapiens
gaugccgggguguguguguggcagucugccugugagugagcacaagaaaggugcaagaaaguga

SEQ ID NO: 129359 - RNA, 64 nt, Homo Sapiens
cugccugugagugagcacaggaaaggugcaagaaagugagcaguuguggccgaggugauggcaa

SEQ ID NO: 129360 - RNA, 64 nt, Homo Sapiens
cccacccugggagacagaccccaccuccuuggguagugagcagugagcagaaagcugugaacag

SEQ ID NO: 129361 - RNA, 64 nt, Homo Sapiens
ugggagacagaccccaccuccuuggguagugagcagugagcagaaagcugugaacaggcugggc

SEQ ID NO: 129362 - RNA, 64 nt, Homo Sapiens
ggaauuuuccugccauccuaaauggcauuucagaagugagcaguccuucuuuuugaaaccuccc

SEQ ID NO: 129363 - RNA, 64 nt, Homo Sapiens
cuguguacacuggaaaacacaaaggucaaacaucagugagcaaggcuccauaaaauaggguaau

SEQ ID NO: 129364 - RNA, 64 nt, Homo Sapiens
aaugacaaguuuuacuagcuaaugaucauacuuaagugagcaaaugcuauuuaaaggaaucaca

SEQ ID NO: 129365 - RNA, 64 nt, Homo Sapiens
uuguauguacagagaaaauguuuuucccuucaguagugagcaguacaccauggauuauauucuu

SEQ ID NO: 129366 - RNA, 64 nt, Homo Sapiens
cccuacauuacacaguucagccuuuaucaagcuuagugagcagugagcacugaaacauuauuuu

SEQ ID NO: 129367 - RNA, 64 nt, Homo Sapiens
uuacacaguucagccuuuaucaagcuuagugagcagugagcacugaaacauuauuuuuuaaugu

SEQ ID NO: 129368 - RNA, 64 nt, Homo Sapiens
ucccaggcaugcagcugccuggggcccaaguugcagugagcaggguggggucugggagggggug

SEQ ID NO: 129369 - RNA, 64 nt, Homo Sapiens
aaaggggagccagaaaugggcaguucucccagggagugagcagcuacuguaacuuuuuuaaauu

SEQ ID NO: 129370 - RNA, 64 nt, Homo Sapiens
gagggaguuucgaguauaaggcaucacagugagcagugagcacagaugucaggacuaaaaaaag

SEQ ID NO: 129371 - RNA, 64 nt, Homo Sapiens
gagcacagagggaguuucgaaaaaaaggcaucacagugagcaguauggauggaugucaggacua

SEQ ID NO: 129372 - RNA, 64 nt, Homo Sapiens
aaaucaauggaacaucccaaagcacauguaucccagugagcaguaaacugacaaagucuaaaug

SEQ ID NO: 129373 - RNA, 55 nt, Homo Sapiens
uuacacuuaaaaguacuucaggguuagugagcaggauagcugggugucaggcuga

SEQ ID NO: 129374 - RNA, 64 nt, Homo Sapiens
acagcuucuagugauuucuggggccccaccguaaagugagcaugcuuucugaacucgcuucucu

SEQ ID NO: 129375 - RNA, 64 nt, Homo Sapiens
ucacuccccuccuuucccaacacuucagacugcaagugagcaaaccugccccaucccgugcaaa

SEQ ID NO: 129376 - RNA, 64 nt, Homo Sapiens
caguguugaaucacaguuacccaccuccuuuccaagugagcacuucugaguuggaaguugagcu

SEQ ID NO: 129377 - RNA, 64 nt, Homo Sapiens
ucuggcaugguguuugucucccagugucaucaacagugagcaaaucauuaggauacaagacagc

SEQ ID NO: 129378 - RNA, 64 nt, Homo Sapiens
ucaaguugucugacacugugccaggcugagugugagugagcauggggaaggggcucacaugggc

SEQ ID NO: 129379 - RNA, 64 nt, Homo Sapiens
gcacugggugagagggagaagagaagcaugaagcagugagcagagaagaagcucagaggguggg

SEQ ID NO: 129380 - RNA, 63 nt, Homo Sapiens
uaaaauaauagcaaguauuugaaagggcauauuuaggucaauacaagaauauaacugauugau

SEQ ID NO: 129381 - RNA, 63 nt, Homo Sapiens
acaaaacaaaacagugacacuauuuaauaaaacuaggucaaaaaacacaccccaaggaagcaa

SEQ ID NO: 129382 - RNA, 64 nt, Homo Sapiens; identical to SEQ ID NO: 53437

SEQ ID NO: 129383 - RNA, 64 nt, Homo Sapiens; identical to SEQ ID NO: 53438

SEQ ID NO: 129384 - RNA, 64 nt, Homo Sapiens; identical to SEQ ID NO: 53439

SEQ ID NO: 129385 - RNA, 64 nt, Homo Sapiens; identical to SEQ ID NO: 53440

SEQ ID NO: 129386 - RNA, 64 nt, Homo Sapiens; identical to SEQ ID NO: 53441

SEQ ID NO: 129387 - RNA, 64 nt, Homo Sapiens; identical to SEQ ID NO: 53442

SEQ ID NO: 129388 - RNA, 64 nt, Homo Sapiens; identical to SEQ ID NO: 53443

SEQ ID NO: 129389 - RNA, 64 nt, Homo Sapiens; identical to SEQ ID NO: 53444

SEQ ID NO: 129390 - RNA, 64 nt, Homo Sapiens; identical to SEQ ID NO: 53445

SEQ ID NO: 129391 - RNA, 64 nt, Homo Sapiens; identical to SEQ ID NO: 53446

SEQ ID NO: 129392 - RNA, 64 nt, Homo Sapiens; identical to SEQ ID NO: 53447

SEQ ID NO: 129393 - RNA, 64 nt, Homo Sapiens; identical to SEQ ID NO: 53448

SEQ ID NO: 129394 - RNA, 64 nt, Homo Sapiens; identical to SEQ ID NO: 53449

SEQ ID NO: 129395 - RNA, 64 nt, Homo Sapiens; identical to SEQ ID NO: 53450

SEQ ID NO: 129396 - RNA, 64 nt, Homo Sapiens; identical to SEQ ID NO: 53451

SEQ ID NO: 129397 - RNA, 64 nt, Homo Sapiens; identical to SEQ ID NO: 53452

SEQ ID NO: 129398 - RNA, 64 nt, Homo Sapiens; identical to SEQ ID NO: 53453

SEQ ID NO: 129399 - RNA, 64 nt, Homo Sapiens; identical to SEQ ID NO: 53454

SEQ ID NO: 129400 - RNA, 64 nt, Homo Sapiens
agcagcugcuucaucaaucccaugacacaugccuuguuagcaugcccaucaaauaaucagauca

SEQ ID NO: 129401 - RNA, 64 nt, Homo Sapiens
agacucaaaauagagaggagacuuuaaacuuacauguuagcauaaaacagacuucucucucauu

SEQ ID NO: 129402 - RNA, 64 nt, Homo Sapiens
uucuagauguuuaucuucauuugccacuuuauuuuguuagcaacuuucuuucgucuuguauucc

SEQ ID NO: 129403 - RNA, 64 nt, Homo Sapiens
agcguucccugccuccugcagcauccauccucgguguuagcagcguuuccauggcucacccuug

SEQ ID NO: 129404 - RNA, 64 nt, Homo Sapiens
uuuuauuuuuguuuuauuaauuuggggaaagggguguuagcauuagugccaugauaucuacugg

SEQ ID NO: 129405 - RNA, 64 nt, Homo Sapiens
cuuucuaaauaccagcagaagaggcucccgccucuguuagcaugaucaguacuauugugacauu

SEQ ID NO: 129406 - RNA, 64 nt, Homo Sapiens
ucaggaaugcaagccuuguuagaaauccuuaaaauguuagcaaauuuccagugaacacagaugc

SEQ ID NO: 129407 - RNA, 64 nt, Homo Sapiens
uacacugaggagaaaauuguuacaaauaggauuauguuagcauugugaaaguuuuuggcaaaac

SEQ ID NO: 129408 - RNA, 64 nt, Homo Sapiens
cagacgcuucuuuccugauuaucuuauuucauuguguuagcaaaauaugaccucccuaaaacac

SEQ ID NO: 129409 - RNA, 64 nt, Homo Sapiens
gucucuguccccaaaauagcugcccuuaaagaguuguuagcagagagaaaaauaacagugaaug

SEQ ID NO: 129410 - RNA, 64 nt, Homo Sapiens
ccucuagcauuccaaaagguuuuugcuuugaaaguguuagcagaagcauguugaugugaauuau

SEQ ID NO: 129411 - RNA, 64 nt, Homo Sapiens
uguugaugugaauuaugauuucuucaugugcuacuguuagcacacugaguuuuuauaguugcac

SEQ ID NO: 129412 - RNA, 64 nt, Homo Sapiens
auaaaagauccuuucuuauaguaagacuugugcuuguuagcagguuuuucuguuaguuuuuccc

SEQ ID NO: 129413 - RNA, 64 nt, Homo Sapiens
gaugacggggccuccuucuucaaacaggaauuucuguuagcaauauguuagcaagagagggcac

SEQ ID NO: 129414 - RNA, 64 nt, Homo Sapiens
cuccuucuucaaacaggaauuucuguuagcaauauguuagcaagagagggcacucccaggcccc

SEQ ID NO: 129415 - RNA, 64 nt, Homo Sapiens
aaugcaucauuccuuuguuguugauaaugggcuuuguuagcacuuuuuaaaacaaacaaacaaa

SEQ ID NO: 129416 - RNA, 64 nt, Homo Sapiens
cauuacaccaaguccauuuagagauaaugggcuuuguuagcacuuucaaaaaaaaaaaaagcaa

SEQ ID NO: 129417 - RNA, 64 nt, Homo Sapiens
uucaggcacuuuagaaauauccuuuuagaagcagcgagugcaugggcuaauuaucaucaaucuu

SEQ ID NO: 129418 - RNA, 64 nt, Homo Sapiens
gcuuggagagcagaauguggugcagcccuucccccgagugcauguacccuucgcuugaggcaga

SEQ ID NO: 129419 - RNA, 64 nt, Homo Sapiens
uuccaugccacuaugagucaacucaggaaaacugcgagugcauuugaggcuuagggguagucau

SEQ ID NO: 129420 - RNA, 64 nt, Homo Sapiens
ccccccgagucucucccugaaggggagcaccgggcgagugcaugugcuacugcugcuacaggcc

SEQ ID NO: 129421 - RNA, 64 nt, Homo Sapiens
gcccaccacugccacggccuuuccacaucaaggccgagugcaccgguuccccauauuauuacag

SEQ ID NO: 129422 - RNA, 64 nt, Homo Sapiens
gcuaaacacuuccagguggggguaccaauccucccgagugcaauaagucagauaguaaggaugu

SEQ ID NO: 129423 - RNA, 64 nt, Homo Sapiens
gcaacugaaaaacugaggaugauuguuagcuccacgagugcaaacugcagucaccaaguaaaac

SEQ ID NO: 129424 - RNA, 64 nt, Homo Sapiens
cagcagagaguuagacagcaucccuacccucuggcgagugcauggcuggcacagaaggcauugu

SEQ ID NO: 129425 - RNA, 64 nt, Homo Sapiens
ucucaucaacgggaaaguacuuccucugagagugcgagugcaccaugcucacuguugcugcgug

SEQ ID NO: 129426 - RNA, 64 nt, Homo Sapiens
gagacuuccagaucauuacugugagucuguaacucgagugcauuccccuugaccugagacugcg

SEQ ID NO: 129427 - RNA, 64 nt, Homo Sapiens
ugcuuuauaagugaggguaggcugugaugggagucgagugcauuugagccccccgaccggcuua

SEQ ID NO: 129428 - RNA, 64 nt, Homo Sapiens
cagcaggggauggggccgugcagggagaugcaugcgagugcaugcccucucccuuguggacagg

SEQ ID NO: 129429 - RNA, 64 nt, Homo Sapiens
gcccccucggggacgcccccaccagcucaaauuccgagugcagaaaagaaaccggaccccccag

SEQ ID NO: 129430 - RNA, 64 nt, Homo Sapiens
cagcagcaguagcagggccggggugggacccccgcgagugcaucaccgcgaacagccucugucu

SEQ ID NO: 129431 - RNA, 64 nt, Homo Sapiens
cucaguuguaacuuggggaaguuaacgauccgcccgagugcagaggaaaaccagaaacgccuug

SEQ ID NO: 129432 - RNA, 64 nt, Homo Sapiens
cugguaaggagugacaaggaagcucacagcugggcgagugcauuuugaauaguuuuuuguaagu

SEQ ID NO: 129433 - RNA, 64 nt, Homo Sapiens
uagagggcacgcagcgugagaacccuggcugugccgagugcacccgaucccuccuggcagcugg

SEQ ID NO: 129434 - RNA, 64 nt, Homo Sapiens
gaaugaugcuuuucugaaaaucuguuggacaaaccgagugcaauaaaaaaacccuugauuauac

SEQ ID NO: 129435 - RNA, 64 nt, Homo Sapiens
ggcaaagcggaaugcggcggccaaaaugcugcuucgagugcacacggugccucuggaugcccgg

SEQ ID NO: 129436 - RNA, 64 nt, Homo Sapiens
gacagcacccuccucuccguucccacuccuacugcgagugcacagucaugugugccggaggccu

SEQ ID NO: 129437 - RNA, 64 nt, Homo Sapiens
uaucccaaaacgaggcaucugcuuuucagaggcccgagugcauuucagggaccaggggccuccu

SEQ ID NO: 129438 - RNA, 64 nt, Homo Sapiens
gacagaaaacugucagcucugaaaugccucugugcgagugcacccugcaucauccacccacaga

SEQ ID NO: 129439 - RNA, 64 nt, Homo Sapiens
accugcauccugcugcacccccacccacgacacucgagugcaagaucgccucacuccuaacccu

SEQ ID NO: 129440 - RNA, 64 nt, Homo Sapiens
uuuccauuauugcauuacauguuguggaaucucucgagugcaaagacugucuaguuauuuauca

SEQ ID NO: 129441 - RNA, 64 nt, Homo Sapiens
gugccaccgccagcaagcccagaggcacacaguccgagugcacccgcuuagccuuuacauuccu

SEQ ID NO: 129442 - RNA, 64 nt, Homo Sapiens
ccagcccucaugcccaggauaugcacagaauggacgagugcagcuaugaaaaauucaaggcagu

SEQ ID NO: 129443 - RNA, 64 nt, Homo Sapiens
uuaggggccccuacggccggcauccuugccgcaccgagugcacuugacucucuaugcaacaccc

SEQ ID NO: 129444 - RNA, 64 nt, Homo Sapiens
agcccccugccccaucuucuggcacaggccaucccgagugcaugucccuguugcccacugcacu

SEQ ID NO: 129445 - RNA, 64 nt, Homo Sapiens
cacaggagggccagcgcuguggaccuuacaacgccgagugcacugcauuccugugcccuagaug

SEQ ID NO: 129446 - RNA, 64 nt, Homo Sapiens
ugaugguggagcuaagguccaggccucucccucccgagugcauuuuuggggagauaguaaaugu

SEQ ID NO: 129447 - RNA, 64 nt, Homo Sapiens
uggagcuugcucccccuuguccacccccaaaucacgagugcagccccagagauccggggccccc

SEQ ID NO: 129448 - RNA, 64 nt, Homo Sapiens
ccaugugagcccugccucuuggagcugcaccuuccgagugcagggccagaaaccccaaagucug

SEQ ID NO: 129449 - RNA, 64 nt, Homo Sapiens
uggagauggagucucgcucuguugcccaggcuggcgagugcaauggcgcgaucuuggcucacug

SEQ ID NO: 129450 - RNA, 64 nt, Homo Sapiens
caccgaccgccacaugugcugcagacguggcacccgagugcacaacacuguggaaaauaccuuu

SEQ ID NO: 129451 - RNA, 64 nt, Homo Sapiens
ugagaaugcacacuggagaguccuuacaggcuuucgagugcacaauguggaaaacccuucaguu

SEQ ID NO: 129452 - RNA, 64 nt, Homo Sapiens
uaacgagaacaaaacaaaagaaccaauuuugggucgagugcauugucuccuuuucgauaugcca

SEQ ID NO: 129453 - RNA, 64 nt, Homo Sapiens
gcccacugaaagacaaacuuucaaaaauauguuccgagugcaaugguaaggcaaaaauuguuua

SEQ ID NO: 129454 - RNA, 64 nt, Homo Sapiens
gaaggugggaccagggccagugcgaccucuagugcgagugcagauccagugccaugaucccacc

SEQ ID NO: 129455 - RNA, 64 nt, Homo Sapiens
uccuaugccuuugacaaagauugcaguggccccucgagugcagaggucaucccagguguugcug

SEQ ID NO: 129456 - RNA, 64 nt, Homo Sapiens
uggagggaucugagcgcaggacucggcaccuuuccgagugcagcagcuggucauuucgccuggg

SEQ ID NO: 129457 - RNA, 64 nt, Homo Sapiens
aucgccaccaguaucaauugugugagcuugggugcgagugcacgcgugcgugaguacggagagu

SEQ ID NO: 129458 - RNA, 64 nt, Homo Sapiens
guaggaacgcuuugaugcgcuuguagagcuggaacgagugcagaauccuccgaaucuggagaug

SEQ ID NO: 129459 - RNA, 64 nt, Homo Sapiens
cugccuaccuuagcuaaccacuguuauuuguaaagaguucuauauacauggcauaauugaaaua

SEQ ID NO: 129460 - RNA, 64 nt, Homo Sapiens
aagcagcaucuguuuuuuguauuucaugacaauggaguucuagacuuauuuuagcaaauauuau

SEQ ID NO: 129461 - RNA, 64 nt, Homo Sapiens
uuuauuauguuuagugugguauuuuuaacaaagcgaguucuauauacuugaauguauacuguag

SEQ ID NO: 129462 - RNA, 64 nt, Homo Sapiens
ugaaggaaaaugauacgcaacauaauuaaauuuugaguucuacauaaguaauucaagaaaacaa

SEQ ID NO: 129463 - RNA, 64 nt, Homo Sapiens
uaacugugaaguuuacauuguaaauaguauuugagaguucuaaauuuugucuuuaacucauaaa

SEQ ID NO: 129464 - RNA, 64 nt, Homo Sapiens
ccaggagcgguggcucacacucucaaaaaaaaaagaguucuagcggcaacagagcaagacucca

SEQ ID NO: 129465 - RNA, 64 nt, Homo Sapiens
cggggcgugguggcucacacuucauucucuauaagaguucuaggaagaaaaucaaaacgcauuc

SEQ ID NO: 129466 - RNA, 64 nt, Homo Sapiens
gacugcuuucaaucucgguuuacguuuagaaauugaguucuacugaguagggcuuccuuaaguu

SEQ ID NO: 129467 - RNA, 64 nt, Homo Sapiens
cccgaggccagugguugcucggggccuuccgugugaguucuaguguucacuugaugccggggaa

SEQ ID NO: 129468 - RNA, 64 nt, Homo Sapiens
agaccauccaagccagaaauuauuuaauaaaucagaguucuagcaauagaguccucucccaagu

SEQ ID NO: 129469 - RNA, 64 nt, Homo Sapiens
gguccaagcagacaggauuccgucaguugugauagaguucuagauuggcaaugcaguuacauug

SEQ ID NO: 129470 - RNA, 64 nt, Homo Sapiens
uggcagaauaaaucuaaaguaauuaaaugagguggcuucagaaaccauuuauauccuauguaua

SEQ ID NO: 129471 - RNA, 64 nt, Homo Sapiens
uguuauuucaugaaucauucaugauucugggguugcuucagaagccuuuaacccuuacauuuau

SEQ ID NO: 129472 - RNA, 64 nt, Homo Sapiens
ucuaagucuagugaagguacuuuggccaguuugggcuucagaagauaauguaaagcuggugaag

SEQ ID NO: 129473 - RNA, 64 nt, Homo Sapiens
auucacuuauaaagaaaccccccuucaggucucagcuucagaacguauuuuaacuccuaauuua

SEQ ID NO: 129474 - RNA, 64 nt, Homo Sapiens
gauuggccuguccccuuuccuguucugacuuacugcuucagagguugaguucuguaagucuucg

SEQ ID NO: 129475 - RNA, 64 nt, Homo Sapiens
aaacccaggaaaugcccuuaacuauuucuccucugcuucagagguccagcagccuggcugaccc

SEQ ID NO: 129476 - RNA, 64 nt, Homo Sapiens
uggcuuggggaggagucccucuagguagaacacagcuucagaaacuagcuuuaagaaauaauuc

SEQ ID NO: 129477 - RNA, 64 nt, Homo Sapiens
ugcuuauuagaggacaagaucaggacugcuuucagcuucagaacacuuuugguucagaacagcg

SEQ ID NO: 129478 - RNA, 64 nt, Homo Sapiens
gguggucacaugcuuugcucuguccacaaagauggcuucagagauuuugaguuccuacaucauu

SEQ ID NO: 129479 - RNA, 64 nt, Homo Sapiens
cugcucccugagggggagcggcugugcucagcuggcuucagaaagcucccucuggccagugcca

SEQ ID NO: 129480 - RNA, 64 nt, Homo Sapiens; identical to SEQ ID NO: 45744

SEQ ID NO: 129481 - RNA, 64 nt, Homo Sapiens; identical to SEQ ID NO: 45745

SEQ ID NO: 129482 - RNA, 64 nt, Homo Sapiens; identical to SEQ ID NO: 45746

SEQ ID NO: 129483 - RNA, 64 nt, Homo Sapiens; identical to SEQ ID NO: 45747

SEQ ID NO: 129484 - RNA, 64 nt, Homo Sapiens; identical to SEQ ID NO: 45748

SEQ ID NO: 129485 - RNA, 64 nt, Homo Sapiens; identical to SEQ ID NO: 45749

SEQ ID NO: 129486 - RNA, 64 nt, Homo Sapiens; identical to SEQ ID NO: 45750

SEQ ID NO: 129487 - RNA, 64 nt, Homo Sapiens; identical to SEQ ID NO: 45751

SEQ ID NO: 129488 - RNA, 64 nt, Homo Sapiens; identical to SEQ ID NO: 45752

SEQ ID NO: 129489 - RNA, 64 nt, Homo Sapiens; identical to SEQ ID NO: 45753

SEQ ID NO: 129490 - RNA, 64 nt, Homo Sapiens; identical to SEQ ID NO: 45754

SEQ ID NO: 129491 - RNA, 64 nt, Homo Sapiens; identical to SEQ ID NO: 45755

SEQ ID NO: 129492 - RNA, 64 nt, Homo Sapiens; identical to SEQ ID NO: 45756

SEQ ID NO: 129493 - RNA, 64 nt, Homo Sapiens; identical to SEQ ID NO: 45757

SEQ ID NO: 129494 - RNA, 64 nt, Homo Sapiens; identical to SEQ ID NO: 45758

SEQ ID NO: 129495 - RNA, 64 nt, Homo Sapiens; identical to SEQ ID NO: 45759

SEQ ID NO: 129496 - RNA, 64 nt, Homo Sapiens; identical to SEQ ID NO: 45760

SEQ ID NO: 129497 - RNA, 64 nt, Homo Sapiens; identical to SEQ ID NO: 45761

SEQ ID NO: 129498 - RNA, 64 nt, Homo Sapiens; identical to SEQ ID NO: 45762

SEQ ID NO: 129499 - RNA, 64 nt, Homo Sapiens; identical to SEQ ID NO: 45763

SEQ ID NO: 129500 - RNA, 64 nt, Homo Sapiens; identical to SEQ ID NO: 45764

SEQ ID NO: 129501 - RNA, 64 nt, Homo Sapiens; identical to SEQ ID NO: 45765

SEQ ID NO: 129502 - RNA, 64 nt, Homo Sapiens; identical to SEQ ID NO: 45766

SEQ ID NO: 129503 - RNA, 64 nt, Homo Sapiens; identical to SEQ ID NO: 45767

SEQ ID NO: 129504 - RNA, 64 nt, Homo Sapiens; identical to SEQ ID NO: 45768

SEQ ID NO: 129505 - RNA, 64 nt, Homo Sapiens; identical to SEQ ID NO: 45769

SEQ ID NO: 129506 - RNA, 64 nt, Homo Sapiens; identical to SEQ ID NO: 45770

SEQ ID NO: 129507 - RNA, 64 nt, Homo Sapiens; identical to SEQ ID NO: 45771

SEQ ID NO: 129508 - RNA, 64 nt, Homo Sapiens; identical to SEQ ID NO: 45772

SEQ ID NO: 129509 - RNA, 64 nt, Homo Sapiens; identical to SEQ ID NO: 45773

SEQ ID NO: 129510 - RNA, 64 nt, Homo Sapiens; identical to SEQ ID NO: 45774

SEQ ID NO: 129511 - RNA, 64 nt, Homo Sapiens; identical to SEQ ID NO: 45775

SEQ ID NO: 129512 - RNA, 64 nt, Homo Sapiens; identical to SEQ ID NO: 45776

SEQ ID NO: 129513 - RNA, 64 nt, Homo Sapiens; identical to SEQ ID NO: 45777

SEQ ID NO: 129514 - RNA, 64 nt, Homo Sapiens; identical to SEQ ID NO: 45778

SEQ ID NO: 129515 - RNA, 64 nt, Homo Sapiens; identical to SEQ ID NO: 45779

SEQ ID NO: 129516 - RNA, 64 nt, Homo Sapiens
uuaggagugaucagaaccagugcuuauuaagaucacccagcaagcaggauggagaagggcaacu

SEQ ID NO: 129517 - RNA, 64 nt, Homo Sapiens
caguacacaugccugggccaauuuuaaccagcccacccagcaguccauguguacuucugaaaau

SEQ ID NO: 129518 - RNA, 64 nt, Homo Sapiens
caugaaauaaaagauucaucuaaaaagaccacauacccagcaccaugcuguagaauuuuugucu

SEQ ID NO: 129519 - RNA, 64 nt, Homo Sapiens
auguaauucaguauuuguuuagagccuuuaaaaaacccagcagaacaagauguuuuuauagucu

SEQ ID NO: 129520 - RNA, 64 nt, Homo Sapiens
cuguuggguuuuccuaugauuuugauguguccugacccagcauauggaugcccuccccuuggag

SEQ ID NO: 129521 - RNA, 64 nt, Homo Sapiens
aggcccagagaggggcaaccacuggccaagggucacccagcaaguuuuggcuaagagccuggcc

SEQ ID NO: 129522 - RNA, 64 nt, Homo Sapiens
uggggaugguugguccccuaaaaacugggacaguacccagcaaggacauggaacuuucaaugcu

SEQ ID NO: 129523 - RNA, 64 nt, Homo Sapiens
gggcagaggccacaggccugcccuccucaugcccacccagcaagagccccccuaccuuaggcca

SEQ ID NO: 129524 - RNA, 64 nt, Homo Sapiens
uaccuagggcggcucaacuccucccacagcaccaacccagcauggucccacugaaguccuacua

SEQ ID NO: 129525 - RNA, 64 nt, Homo Sapiens
aacagucucucccauucucuaguacugcuccccuacccagcagucacuuccaguucauucagcu

SEQ ID NO: 129526 - RNA, 59 nt, Homo Sapiens
cagccauaguugagcccugauugccacagacccagcacccagcaaaucccucucuaccu

SEQ ID NO: 129527 - RNA, 64 nt, Homo Sapiens
gccauaguugagcccugauugccacagacccagcacccagcaaaucccucucuaccucccaagg

SEQ ID NO: 129528 - RNA, 64 nt, Homo Sapiens
guugacucaucugccuccaucaagcucacuucucacccagcaagucuucuugcccuaugcagug

SEQ ID NO: 129529 - RNA, 64 nt, Homo Sapiens
aaagauguauuuucaggagaaggauucaggaucuacccagcaccgagcagaaacuuguauucuc

SEQ ID NO: 129530 - RNA, 64 nt, Homo Sapiens
ggccaagaaaguucuaguagugcugcaaacacuaacccagcaguugccccacccuguguaguug

SEQ ID NO: 129531 - RNA, 64 nt, Homo Sapiens
ggaccaaguccaaggccaggucucagucggugucacccagcaagcaggcagcgccccggcccgc

SEQ ID NO: 129532 - RNA, 64 nt, Homo Sapiens
acaaaagcuguguggcucccugcuugcacaccucacccagcaaagcuguucugaaugcucuaag

SEQ ID NO: 129533 - RNA, 53 nt, Homo Sapiens
caccuccuuccugaacacaugcgacccagcagcagacauccaucaccuacuga

SEQ ID NO: 129534 - RNA, 64 nt, Homo Sapiens
uccucuugcccuccuggcuugcugggucuuuguaacccagcacugagggucgucuggccugcuu

SEQ ID NO: 129535 - RNA, 64 nt, Homo Sapiens
uguguagagccucgaucguccauguccuacggaaacccagcacggcaccgcguuuccauagcag

SEQ ID NO: 129536 - RNA, 64 nt, Homo Sapiens
ucuccaccccccugccucagucaugaagcagcaaacccagcagaugaccuccgaaggcccaaau

SEQ ID NO: 129537 - RNA, 64 nt, Homo Sapiens
caagccagaugaguaccacagcucagccccagacacccagcaauacuuucgcagccaucuuccc

SEQ ID NO: 129538 - RNA, 64 nt, Homo Sapiens
gcacugaggugccgugugacgguggccuuggaggacccagcacugacccauagagggcuccucu

SEQ ID NO: 129539 - RNA, 64 nt, Homo Sapiens
gaggaucuucauguaccugcucuucuguuugcacacccagcauagccuccuugcaggcagaagg

SEQ ID NO: 129540 - RNA, 64 nt, Homo Sapiens
ugaggguugcaauggggaaaugacuuauaaagucacccagcaggucaacaaugggcccacgacc

SEQ ID NO: 129541 - RNA, 64 nt, Homo Sapiens
ggagaaugagaacuggaagccacugcuaccgucuacccagcaccaguagugccgaugugccaca

SEQ ID NO: 129542 - RNA, 64 nt, Homo Sapiens
caugcgguagccuccgcagaggcugggggccuccacccagcagcagaccaaccaggaagcagcu

SEQ ID NO: 129543 - RNA, 64 nt, Homo Sapiens
ccagcucuggguccucauguaugggcucccaaggacccagcagccuggauccuuccagagcauc

SEQ ID NO: 129544 - RNA, 64 nt, Homo Sapiens
aucacagcugccugugcacggggcaugcucuggaacccagcaggagcuuccagcuaggccagaa

SEQ ID NO: 129545 - RNA, 64 nt, Homo Sapiens
gcuucggccaggggcuuuccgucacauugcuuuaacccagcaggugggggccgugauccugaug

SEQ ID NO: 129546 - RNA, 64 nt, Homo Sapiens
gucuccugugagccggggacugcaccaaggaaacacccagcagggugccagaccuggacuaaac

SEQ ID NO: 129547 - RNA, 64 nt, Homo Sapiens
ccagacucgagggaagccaguagaaaacucccaaacccagcacuucagacuugaaagacugcaa

SEQ ID NO: 129548 - RNA, 64 nt, Homo Sapiens
ggcccugugugggacagcagcuguuuggugugugacccagcaagugcugaauuuuuccuugagg

SEQ ID NO: 129549 - RNA, 64 nt, Homo Sapiens
gccacauguccaccaaggaacccagggcgucagcacccagcacucggucacucuccgcugagga

SEQ ID NO: 129550 - RNA, 64 nt, Homo Sapiens
ccaccacagggcuagaggccgcuccaccuggggcacccagcaccucaacagccccaugacuuca

SEQ ID NO: 129551 - RNA, 64 nt, Homo Sapiens
gguagcuccggggcuuccugcccccagcaaggguacccagcaagcaaacugggauggcccaggu

SEQ ID NO: 129552 - RNA, 64 nt, Homo Sapiens
uccaacuaacaagaaacucaggcacccacccagcacccagcaaccaguaucaggccugccagac

SEQ ID NO: 129553 - RNA, 64 nt, Homo Sapiens
cagcaacuccaacuaacaaggccagacggcacccacccagcaccgcuccgucaguaucaggccu

SEQ ID NO: 129554 - RNA, 64 nt, Homo Sapiens
uggcagcagccucaccgaagagaggaaccaccacacccagcagcuccugacagacccccacccc

SEQ ID NO: 129555 - RNA, 64 nt, Homo Sapiens
ccagauuuacuuuuggggccuguucuaagugcaaacccagcaaguuucacuuguccuguccauu

SEQ ID NO: 129556 - RNA, 64 nt, Homo Sapiens
ggccagugaugauuucccccgccauguugggguaacccagcaaggcaaaaaaaaaaaaucucag

SEQ ID NO: 129557 - RNA, 64 nt, Homo Sapiens
caccuugaaaaaggccauuguccuuccuaaagaaacccagcagcuuggauguccaaauuugaac

SEQ ID NO: 129558 - RNA, 64 nt, Homo Sapiens; identical to SEQ ID NO: 97314

SEQ ID NO: 129559 - RNA, 64 nt, Homo Sapiens; identical to SEQ ID NO: 97315

SEQ ID NO: 129560 - RNA, 64 nt, Homo Sapiens; identical to SEQ ID NO: 97316

SEQ ID NO: 129561 - RNA, 64 nt, Homo Sapiens; identical to SEQ ID NO: 97317

SEQ ID NO: 129562 - RNA, 64 nt, Homo Sapiens; identical to SEQ ID NO: 97318

SEQ ID NO: 129563 - RNA, 64 nt, Homo Sapiens; identical to SEQ ID NO: 97319

SEQ ID NO: 129564 - RNA, 64 nt, Homo Sapiens; identical to SEQ ID NO: 97320

SEQ ID NO: 129565 - RNA, 64 nt, Homo Sapiens; identical to SEQ ID NO: 97321

SEQ ID NO: 129566 - RNA, 64 nt, Homo Sapiens; identical to SEQ ID NO: 97322

SEQ ID NO: 129567 - RNA, 64 nt, Homo Sapiens; identical to SEQ ID NO: 97323

SEQ ID NO: 129568 - RNA, 64 nt, Homo Sapiens; identical to SEQ ID NO: 97324

SEQ ID NO: 129569 - RNA, 64 nt, Homo Sapiens; identical to SEQ ID NO: 97325

SEQ ID NO: 129570 - RNA, 64 nt, Homo Sapiens; identical to SEQ ID NO: 97326

SEQ ID NO: 129571 - RNA, 64 nt, Homo Sapiens; identical to SEQ ID NO: 97327

SEQ ID NO: 129572 - RNA, 64 nt, Homo Sapiens; identical to SEQ ID NO: 97328

SEQ ID NO: 129573 - RNA, 64 nt, Homo Sapiens; identical to SEQ ID NO: 97329

SEQ ID NO: 129574 - RNA, 64 nt, Homo Sapiens; identical to SEQ ID NO: 97330

SEQ ID NO: 129575 - RNA, 64 nt, Homo Sapiens; identical to SEQ ID NO: 97331

SEQ ID NO: 129576 - RNA, 61 nt, Homo Sapiens
aacagaggaggccagugaggcagagacagagcucucccacucucagacccucuuuugucuu

SEQ ID NO: 129577 - RNA, 61 nt, Homo Sapiens
cacucucagacccucuuuugucuucauuuuccucucccacuuagcacaugugugcuugagg

SEQ ID NO: 129578 - RNA, 61 nt, Homo Sapiens
ucuagguggcucaguccaugcauaccaacuucucucccaucaaauauauuuauuuuuuuac

SEQ ID NO: 129579 - RNA, 61 nt, Homo Sapiens
ccccugccacagccucuuucccuccucccugcucucccaggaggccccagagcgagcuucc

SEQ ID NO: 129580 - RNA, 61 nt, Homo Sapiens
aaauccaggugcuuuccagaaauccaggcuccucucccaagacagcccuccucucccaaga

SEQ ID NO: 129581 - RNA, 61 nt, Homo Sapiens
aaauccaggcuccucucccaccacagcccuccucucccaagagaagaacugauuggggcuu

SEQ ID NO: 129582 - RNA, 61 nt, Homo Sapiens
gcuaccuacugcaggagggcaagcucaggaucucucccaagauaaaacgguagaauaugaa

SEQ ID NO: 129583 - RNA, 61 nt, Homo Sapiens
uuucugaaaguggcugaugugcaaaaaaugucucucccauugcuuuguuuccuguucacca

SEQ ID NO: 129584 - RNA, 61 nt, Homo Sapiens
cccuguucuggaggcuaaccaacugccacugcucucccaggcuucuuccuccagcagcggg

SEQ ID NO: 129585 - RNA, 61 nt, Homo Sapiens
ucccacaaggguuccaggaacucugcccugccucucccagccacugaaaacaaagccaagc

SEQ ID NO: 129586 - RNA, 61 nt, Homo Sapiens
gcccacgugagcaccugucucccacucaaaccucucccaucucccaacaacugcacuuuag

SEQ ID NO: 129587 - RNA, 61 nt, Homo Sapiens
auccuugccacugucuugcuuuuauuuuuuacucucccacugagcaagcgucugugguccu

SEQ ID NO: 129588 - RNA, 61 nt, Homo Sapiens
agcugccaguguugcuuuucuguugguagagcucucccauuuggugacauggaaaauaccu

SEQ ID NO: 129589 - RNA, 61 nt, Homo Sapiens
uacuaaauccaguagaugggcuguguagcaacucucccagggaacacacuaggguacuuag

SEQ ID NO: 129590 - RNA, 61 nt, Homo Sapiens
cugggcguguaguguaacuggaaucuuuugccucucccagccaccuccucccagcccccca

SEQ ID NO: 129591 - RNA, 61 nt, Homo Sapiens
uguuuuuuugggugguggcuggaaacagccccucucccacguggcagaggcucagccuggc

SEQ ID NO: 129592 - RNA, 61 nt, Homo Sapiens
uaccuuagaguagggacacucucucccaagucucucccaaagugagacaguccacccagag

SEQ ID NO: 129593 - RNA, 61 nt, Homo Sapiens
ucucucccaaauaccuuagauccacccagagcucucccaagauuugaacagggugagacag

SEQ ID NO: 129594 - RNA, 61 nt, Homo Sapiens
accucggaugaccauacucauucaaaaaacucucucccaggugcauuuucuaagugggaca

SEQ ID NO: 129595 - RNA, 61 nt, Homo Sapiens
gggcacaccccuggggcugacacauagccaacucucccaaauuuuuuuuuuaaguuucacu

SEQ ID NO: 129596 - RNA, 61 nt, Homo Sapiens
cuucuuguggcacaggaaagcugcccucucccucucccaccacacuccugacuaauggccu

SEQ ID NO: 129597 - RNA, 61 nt, Homo Sapiens
aggucagcacugggggaaacuugcugguggucucucccacaaccuugcccagaguccuuuc

SEQ ID NO: 129598 - RNA, 61 nt, Homo Sapiens
uccaucuggcaucccacgcggcacuuccauccucucccacugggugaccuuucuggucuuu

SEQ ID NO: 129599 - RNA, 61 nt, Homo Sapiens
caacaucacccaguggauggacuggaagaaacucucccaucacaauugucacaugaccggu

SEQ ID NO: 129600 - RNA, 61 nt, Homo Sapiens
ugcucuguuaugggagagaaucuuuucuugacucucccacauuaauuguuaugaaaaugga

SEQ ID NO: 129601 - RNA, 61 nt, Homo Sapiens
ucgcugcugcagccaacccaccugcaccuuccucucccaggcucgccucucccgccucgau

SEQ ID NO: 129602 - RNA, 61 nt, Homo Sapiens
gagccccagcccccuuugggccugcccgucucucucccaugagccccacacuggggugccg

SEQ ID NO: 129603 - RNA, 61 nt, Homo Sapiens
cuacccagagaagccccuucccagucagccucucucccagucuugcuggggacggggggcc

SEQ ID NO: 129604 - RNA, 61 nt, Homo Sapiens
ccugggcaggcugcagccucaugccaugucucucucccacuaccugaugggcacauggaca

SEQ ID NO: 129605 - RNA, 61 nt, Homo Sapiens
guccucucagcccugccugcccuggccugggcucucccagccucccagcccucugcccccu

SEQ ID NO: 129606 - RNA, 61 nt, Homo Sapiens
ucgugggaaacagcaaaacacuaagccugaccucucccaaauugggaagaccagaggagaa

SEQ ID NO: 129607 - RNA, 61 nt, Homo Sapiens
uccugcaucuuuccuuaagggaagccccauccucucccaggaccaggaguuuaugaccagg

SEQ ID NO: 129608 - RNA, 61 nt, Homo Sapiens
gguccagucaucccagugggcuucucuuugucucucccagauuagaccuuugggugagauu

SEQ ID NO: 129609 - RNA, 61 nt, Homo Sapiens
uuucauuucuuccuccaggcccaccagauugcucucccaccgcuccuuuuccccuucccuc

SEQ ID NO: 129610 - RNA, 61 nt, Homo Sapiens
ccauugauaccaacucuuucgaucuccucaccucucccacugggcuccaaauuccucuugu

SEQ ID NO: 129611 - RNA, 61 nt, Homo Sapiens
augagugaggagcugugcuguaaguguccuucucucccaggucauuuuuuuggucacccuu

SEQ ID NO: 129612 - RNA, 61 nt, Homo Sapiens
aacucccuucguggggacaaacuacucgcuccucucccaacccugucccaucugcagccac

SEQ ID NO: 129613 - RNA, 61 nt, Homo Sapiens
ugcccuuggugggguuuccauucagugagaacucucccaguggggcagcuuucuuuggggc

SEQ ID NO: 129614 - RNA, 61 nt, Homo Sapiens
uuggcaggacggcuacgagcagcuuaggcagcucucccagcacgccaugaagggggucauc

SEQ ID NO: 129615 - RNA, 61 nt, Homo Sapiens
uguuuguggucuguguugacagccacccacccucucccaccucaugcuccugcaccugcac

SEQ ID NO: 129616 - RNA, 61 nt, Homo Sapiens
ccagaauguagaagccuguccccaacccagacucucccacucccccaccaccaccgacucu

SEQ ID NO: 129617 - RNA, 61 nt, Homo Sapiens
ccagacucucccacuccagaaccaccaccgacucucccaacuuagauaaagaugagccccc

SEQ ID NO: 129618 - RNA, 61 nt, Homo Sapiens
cacccuguguaacaggaccccuaaucccuuccucucccauuaaagguggggagaagggauc

SEQ ID NO: 129619 - RNA, 61 nt, Homo Sapiens
cacaagaacuccucccacccggggcacagaccucucccaccuggcaggaucggcuuccuca

SEQ ID NO: 129620 - RNA, 61 nt, Homo Sapiens
gugccugccauccaggcagcucagagcauuacucucccacugcuucaucacauugggaggu

SEQ ID NO: 129621 - RNA, 61 nt, Homo Sapiens
accgcugccaccaccgccaccugggguuucccucucccagacggcccauagacaaguggcg

SEQ ID NO: 129622 - RNA, 61 nt, Homo Sapiens
caucugucccugaccucuaaccuuucucugccucucccacacucucccagagcucacugau

SEQ ID NO: 129623 - RNA, 61 nt, Homo Sapiens
ugaccucuaaccuuucucugccucucccacacucucccagagcucacugauuagacagcac

SEQ ID NO: 129624 - RNA, 61 nt, Homo Sapiens
gugguuggaggucuguggagucaaggucccccucucccaggcaggcucucugagggcauuc

SEQ ID NO: 129625 - RNA, 61 nt, Homo Sapiens
cuccacaucuucugccccaguguguccccaccucucccagccuguauacccagauuacuuu

SEQ ID NO: 129626 - RNA, 61 nt, Homo Sapiens
ucccugacucugggaauaacacccaggcuuucucucccacuaucacuucccucacugcccu

SEQ ID NO: 129627 - RNA, 61 nt, Homo Sapiens
gaggugaaggagcaccuggcggacagcuuggcucucccagaauccuggggauccagcggau

SEQ ID NO: 129628 - RNA, 61 nt, Homo Sapiens
cuaugucaucuuguucuccuaucucucacaccucucccagaccuguuuuccuuccucugcu

SEQ ID NO: 129629 - RNA, 61 nt, Homo Sapiens
accagugcccuucuccugcucagucaccucgcucucccagcugcucuaguguucugucucc

SEQ ID NO: 129630 - RNA, 61 nt, Homo Sapiens
gagggggcucgcuucccccaccauggccacccucucccaaagcuuugacucaugccuuacu

SEQ ID NO: 129631 - RNA, 61 nt, Homo Sapiens
auaccaugcuguccucuuagggucucccuggcucucccagguucccugcuuggaagcgugg

SEQ ID NO: 129632 - RNA, 61 nt, Homo Sapiens
agggcccugccuucagcugggugccaacuuccucucccacuacagcugcagggggacccca

SEQ ID NO: 129633 - RNA, 61 nt, Homo Sapiens
cccuuccagggccucugcucccccaugcacucucucccacccauaucagcuuucacacuuu

SEQ ID NO: 129634 - RNA, 61 nt, Homo Sapiens
cccuccccaaagccacuggaagaccugucgucucucccacccuugaagacucccugauccc

SEQ ID NO: 129635 - RNA, 61 nt, Homo Sapiens
ccugguaggguuccccaaccccccaaccccccucucccagcggcuuggcuuuacuuugagc

SEQ ID NO: 129636 - RNA, 61 nt, Homo Sapiens
aaaugugcuagagcucugccucccaggcuuacucucccaaugccaccacucccuuagucuu

SEQ ID NO: 129637 - RNA, 61 nt, Homo Sapiens
ccaaccuccccagacucugcaacuguacagacucucccaccaacuagaacacccaacacca

SEQ ID NO: 129638 - RNA, 61 nt, Homo Sapiens
ugggaccugcaucugaugcuggggccagggacucucccacgcacgagcuagugaguggcac

SEQ ID NO: 129639 - RNA, 61 nt, Homo Sapiens
aaauuuaagagggugggacaguccccugcuccucucccagagggcacugcuuggaaauugu

SEQ ID NO: 129640 - RNA, 61 nt, Homo Sapiens
uguggcaguuugcguuuacuuauuaccacuccucucccauuugggacaucuucagcccuuu

SEQ ID NO: 129641 - RNA, 61 nt, Homo Sapiens
ucaucugccugcccacacgcccaaacgccuccucucccaggaaccuuccccacacucagcu

SEQ ID NO: 129642 - RNA, 61 nt, Homo Sapiens
uccagccugggugacagaguuagauuccacccucucccaccccggcaaaaaaaaaaaaaaa

SEQ ID NO: 129643 - RNA, 61 nt, Homo Sapiens
uuguccaggggagccuggcggcgcaucccuccucucccaccuccuggcacuuccagcuggg

SEQ ID NO: 129644 - RNA, 61 nt, Homo Sapiens
acacacucagauagcacaaaggucaggcugccucucccaacuccccaggccuugccugagg

SEQ ID NO: 129645 - RNA, 61 nt, Homo Sapiens
uggacuccugcaugcuccucgacuggccccacucucccagcuccuugcccuagcacacugg

SEQ ID NO: 129646 - RNA, 64 nt, Homo Sapiens; identical to SEQ ID NO: 117329

SEQ ID NO: 129647 - RNA, 64 nt, Homo Sapiens; identical to SEQ ID NO: 117330

SEQ ID NO: 129648 - RNA, 64 nt, Homo Sapiens; identical to SEQ ID NO: 117331

SEQ ID NO: 129649 - RNA, 64 nt, Homo Sapiens; identical to SEQ ID NO: 117332

SEQ ID NO: 129650 - RNA, 64 nt, Homo Sapiens; identical to SEQ ID NO: 117333

SEQ ID NO: 129651 - RNA, 64 nt, Homo Sapiens; identical to SEQ ID NO: 117334

SEQ ID NO: 129652 - RNA, 64 nt, Homo Sapiens; identical to SEQ ID NO: 117335

SEQ ID NO: 129653 - RNA, 64 nt, Homo Sapiens; identical to SEQ ID NO: 117336

SEQ ID NO: 129654 - RNA, 64 nt, Homo Sapiens; identical to SEQ ID NO: 117337

SEQ ID NO: 129655 - RNA, 64 nt, Homo Sapiens; identical to SEQ ID NO: 117338

SEQ ID NO: 129656 - RNA, 64 nt, Homo Sapiens; identical to SEQ ID NO: 117339

SEQ ID NO: 129657 - RNA, 64 nt, Homo Sapiens; identical to SEQ ID NO: 117340

SEQ ID NO: 129658 - RNA, 64 nt, Homo Sapiens; identical to SEQ ID NO: 117341

SEQ ID NO: 129659 - RNA, 64 nt, Homo Sapiens; identical to SEQ ID NO: 117342

SEQ ID NO: 129660 - RNA, 64 nt, Homo Sapiens; identical to SEQ ID NO: 117343

SEQ ID NO: 129661 - RNA, 64 nt, Homo Sapiens; identical to SEQ ID NO: 117344

SEQ ID NO: 129662 - RNA, 64 nt, Homo Sapiens; identical to SEQ ID NO: 117345

SEQ ID NO: 129663 - RNA, 64 nt, Homo Sapiens; identical to SEQ ID NO: 117346

SEQ ID NO: 129664 - RNA, 64 nt, Homo Sapiens; identical to SEQ ID NO: 117347

SEQ ID NO: 129665 - RNA, 64 nt, Homo Sapiens; identical to SEQ ID NO: 117348

SEQ ID NO: 129666 - RNA, 64 nt, Homo Sapiens; identical to SEQ ID NO: 117349

SEQ ID NO: 129667 - RNA, 64 nt, Homo Sapiens; identical to SEQ ID NO: 117350

SEQ ID NO: 129668 - RNA, 64 nt, Homo Sapiens; identical to SEQ ID NO: 117351

SEQ ID NO: 129669 - RNA, 64 nt, Homo Sapiens; identical to SEQ ID NO: 117352

SEQ ID NO: 129670 - RNA, 64 nt, Homo Sapiens; identical to SEQ ID NO: 117353

SEQ ID NO: 129671 - RNA, 64 nt, Homo Sapiens; identical to SEQ ID NO: 117354

SEQ ID NO: 129672 - RNA, 64 nt, Homo Sapiens; identical to SEQ ID NO: 117355

SEQ ID NO: 129673 - RNA, 64 nt, Homo Sapiens; identical to SEQ ID NO: 117356

SEQ ID NO: 129674 - RNA, 64 nt, Homo Sapiens; identical to SEQ ID NO: 117357

SEQ ID NO: 129675 - RNA, 64 nt, Homo Sapiens; identical to SEQ ID NO: 117358

SEQ ID NO: 129676 - RNA, 64 nt, Homo Sapiens; identical to SEQ ID NO: 117359

SEQ ID NO: 129677 - RNA, 64 nt, Homo Sapiens; identical to SEQ ID NO: 117360

SEQ ID NO: 129678 - RNA, 64 nt, Homo Sapiens; identical to SEQ ID NO: 117361

SEQ ID NO: 129679 - RNA, 64 nt, Homo Sapiens; identical to SEQ ID NO: 117362

SEQ ID NO: 129680 - RNA, 62 nt, Homo Sapiens
auccaugauucugcuuugguccaauugcuuccucucugcagaggaacaacccuaaaaccaga

SEQ ID NO: 129681 - RNA, 62 nt, Homo Sapiens
ggagaagguugcuucauuggcccugggacuucucucugcaggaggagagaacgcugccucuc

SEQ ID NO: 129682 - RNA, 62 nt, Homo Sapiens
uguccaccccauguguauauuagcuuugaguuucucugcaucuuucauccuucaguuguauu

SEQ ID NO: 129683 - RNA, 62 nt, Homo Sapiens
uggagauucguggagaaccucucuuccugaagucucugcauuccagggcgugcuccaggcac

SEQ ID NO: 129684 - RNA, 62 nt, Homo Sapiens
ccaaccuggccaaggccccuccugccuguuuuucucugcaucaugcuauagauugacacccu

SEQ ID NO: 129685 - RNA, 62 nt, Homo Sapiens
ccuaggggaaaacugcaggucugcacuguuucucucugcagacuugacuguggcauugcacu

SEQ ID NO: 129686 - RNA, 62 nt, Homo Sapiens
gggaccuuugauugucuuuccagagaugcugcucucugcagggcaccaccuucaaggcacag

SEQ ID NO: 129687 - RNA, 62 nt, Homo Sapiens
uagcaaaucuuacagaagguccugugugacccucucugcaucuguccccaggaccuaugcuc

SEQ ID NO: 129688 - RNA, 62 nt, Homo Sapiens
uuugaaugugaaagcuuauauaauguugggauucucugcacuuuuguggaaccauuguuugu

SEQ ID NO: 129689 - RNA, 62 nt, Homo Sapiens
uguuacaauucaguuauuuccacuugaaauaaucucugcauguucuaauagguauuuagaag

SEQ ID NO: 129690 - RNA, 62 nt, Homo Sapiens
cccagggguccugaggguuucagcaccaggguucucugcagccacacaaucagcccggcucg

SEQ ID NO: 129691 - RNA, 62 nt, Homo Sapiens
cucacaacccgagauagguacuguuaccauccucucugcagacgaggaaaccgaggaccagg

SEQ ID NO: 129692 - RNA, 62 nt, Homo Sapiens
acuuugaggacauuuaugaucggauucuuaauucucugcaacuuaauuucuucccccaaagc

SEQ ID NO: 129693 - RNA, 62 nt, Homo Sapiens
uuuucccaaguacccugagaaaaagcaaaacaucucugcaguccauccagcgagagaguuuc

SEQ ID NO: 129694 - RNA, 51 nt, Homo Sapiens; identical to SEQ ID NO: 83452

SEQ ID NO: 129695 - RNA, 62 nt, Homo Sapiens
aacaaacuccuaguccuuuagaaauaacagauucucugcacaaaaccacccauucauucauu

SEQ ID NO: 129696 - RNA, 62 nt, Homo Sapiens
cuuccuccugcgccugguugauucagcccaccucucugcaucccgcuucccgcgucucuucu

SEQ ID NO: 129697 - RNA, 62 nt, Homo Sapiens
ccaccucucugcaucccgcuucccgcgucucuucucugcacuccugccgaccuucccaccug

SEQ ID NO: 129698 - RNA, 62 nt, Homo Sapiens
gagaggaggccgcacucucccugucucucccgucucugcacccagcuccucucugcaugcug

SEQ ID NO: 129699 - RNA, 62 nt, Homo Sapiens
ucccugucucucccgucucugcacccagcuccucucugcaugcugagggcuaaauugggauc

SEQ ID NO: 129700 - RNA, 62 nt, Homo Sapiens
cuccuccacuggcuucucugagagcuagcugcucucugcagcugagggguuuuuuuaaccuc

SEQ ID NO: 129701 - RNA, 62 nt, Homo Sapiens
agaauguccguccucuguugggcuccucugccucucugcagcaagagucaccccagcugcug

SEQ ID NO: 129702 - RNA, 62 nt, Homo Sapiens
aacgccaauaaacauguugcgacuuguguaagucucugcaucauuuuucucuuaaaaaagaa

SEQ ID NO: 129703 - RNA, 62 nt, Homo Sapiens
ugcuagcucagacaccaaagauucagagggccucucugcagcgauagcaaaauauacugugu

SEQ ID NO: 129704 - RNA, 62 nt, Homo Sapiens
uggcuggagaaagggugugcugcaccaaccacucucugcagaagaagagcagaggucuucuc

SEQ ID NO: 129705 - RNA, 62 nt, Homo Sapiens
aaccacucucugcagauggcgagcagaggucuucucugcaccccuugucaaggugggcagaa

SEQ ID NO: 129706 - RNA, 62 nt, Homo Sapiens
gcaaaggguguaagggacucacggacucugcuucucugcagugcugcacugcaaagggagua

SEQ ID NO: 129707 - RNA, 62 nt, Homo Sapiens
uugcugaggcccaggaggggaauggaagauuuucucugcagugaggcaguuccuaccuuggg

SEQ ID NO: 129708 - RNA, 62 nt, Homo Sapiens
gucuuuucuuggcguuccugccaggcucucccucucugcaccugucucauagccucgaauau

SEQ ID NO: 129709 - RNA, 62 nt, Homo Sapiens
cucauucauauuccugccuuucuuccaucagcucucugcaaagaugauuuugcuuuucccua

SEQ ID NO: 129710 - RNA, 62 nt, Homo Sapiens
gcccaccccaagcuccgacauugagguuuucaucucugcagggagagguuccaauguccacc

SEQ ID NO: 129711 - RNA, 62 nt, Homo Sapiens
cuccagcccaaaaccgugaggaaggugauauaucucugcauuuucccuuguuguugcuugaa

SEQ ID NO: 129712 - RNA, 62 nt, Homo Sapiens
gcaacuuccuaagcugccccugccccagcuccucucugcaacccagcccucuccugagcucu

SEQ ID NO: 129713 - RNA, 62 nt, Homo Sapiens
ucccaccgcggccccugccuggccaccuggccucucugcaccagggugacaagggguccucg

SEQ ID NO: 129714 - RNA, 62 nt, Homo Sapiens
cccuagccgccaccccacguuucuguaccgggucucugcaguguuaaacggacguguaaaua

SEQ ID NO: 129715 - RNA, 62 nt, Homo Sapiens
gucccagccugggacaggcccccuuuccccucucucugcaggccaggagggccuccuuccug

SEQ ID NO: 129716 - RNA, 62 nt, Homo Sapiens
ggucucccccucuucucugcccuccacccccgucucugcacugagauacauaagaaacaagg

SEQ ID NO: 129717 - RNA, 62 nt, Homo Sapiens
gaccaugggaccaccaagcucuaggucauccaucucugcauccaaauaguagggaaacgugg

SEQ ID NO: 129718 - RNA, 62 nt, Homo Sapiens
uggcuuuugcugcucuguucucccucuacauuucucugcagaacucgcguuagaaacacaga

SEQ ID NO: 129719 - RNA, 62 nt, Homo Sapiens
ugcacuugcugucugcggagccagugugccauucucugcacaugggcagccagccugagcug

SEQ ID NO: 129720 - RNA, 62 nt, Homo Sapiens
caaguccacaccuggccuuggcugcugcccgcucucugcagcguggauuuccuuugcccauu

SEQ ID NO: 129721 - RNA, 62 nt, Homo Sapiens
acuguauccacacgagccaaagaguggaucuuucucugcagucaugcugcucaaaucuucac

SEQ ID NO: 129722 - RNA, 62 nt, Homo Sapiens
cacugaccaugcugcucaaaaucaugccucauucucugcauuguuuggagauuacagguccu

SEQ ID NO: 129723 - RNA, 62 nt, Homo Sapiens
ccugagcgccgccucugugcccaggucccauuucucugcagcacuggccccuuggugcacac

SEQ ID NO: 129724 - RNA, 62 nt, Homo Sapiens
ggugggagggccucccuggcuugggagaccgcucucugcaagggagggggagagaagcagag

SEQ ID NO: 129725 - RNA, 62 nt, Homo Sapiens
ccucagucuccagccugggcugccgagggcuaucucugcagaaugaguugugaucauuguca

SEQ ID NO: 129726 - RNA, 62 nt, Homo Sapiens
gucugcauggguagcaggcugcaggaguggggucucugcacagccugggauggggcuugggg

SEQ ID NO: 129727 - RNA, 62 nt, Homo Sapiens
cuuuucccuuauggcucugaggccaucggcugucucugcauuucauuggcuguggaggagag

SEQ ID NO: 129728 - RNA, 62 nt, Homo Sapiens
uuuacacuacuuuuucuuccccuuccucuugcucucugcacaccccauucuuaaacuccucc

SEQ ID NO: 129729 - RNA, 62 nt, Homo Sapiens
uauuagggugcuguuuguuauugagagcccaaucucugcaugaauaacagaaagguggacau

SEQ ID NO: 129730 - RNA, 64 nt, Homo Sapiens
ccuggcucccucugggucauauggugcagacugugaccagcaccaggcaggcaguccugucugc

SEQ ID NO: 129731 - RNA, 64 nt, Homo Sapiens
acccugcuugaagcgcagaaggcacagccuuacugaccagcacgcccacugacuggcaucugcc

SEQ ID NO: 129732 - RNA, 64 nt, Homo Sapiens
acugcuccacuccacacucacaccucuauucacagaccagcaucuccucuccuuaucaggaaca

SEQ ID NO: 129733 - RNA, 64 nt, Homo Sapiens
auuguuuuuguaacuugcauuuuacaagaguucugaccagcaccagauaagcuucagugcucuc

SEQ ID NO: 129734 - RNA, 64 nt, Homo Sapiens
auuccccacucucacuaacauugcuuccuuuuuugaccagcaggaaacagcaggucuggccaga

SEQ ID NO: 129735 - RNA, 64 nt, Homo Sapiens
aagagucuggccucccuccagcccugggcagacugaccagcaagguggaccuuuacauucaagc

SEQ ID NO: 129736 - RNA, 64 nt, Homo Sapiens
ggauggaggggugguccugacucaacauguuacugaccagcaacuugucuuuuucuggacugaa

SEQ ID NO: 129737 - RNA, 64 nt, Homo Sapiens
gccugggaauguauuauucugcagcaugaccugugaccagcacugucucaguuucacuuucaca

SEQ ID NO: 129738 - RNA, 64 nt, Homo Sapiens
guucugccaggccucgagcaucccacccuacagagaccagcaagguuuaauguugcuucacuua

SEQ ID NO: 129739 - RNA, 64 nt, Homo Sapiens
guucugccaggccccaagcaucccauccuucagagaccagcaagauuuacuguugcuucauuua

SEQ ID NO: 129740 - RNA, 64 nt, Homo Sapiens
ggcagugacaccugggagcuaaguguggucuguggaccagcagcgaccagagccuugcaacuca

SEQ ID NO: 129741 - RNA, 64 nt, Homo Sapiens
cugggaauggggagcaagucuguaggagcccgaggaccagcaggcugcagggcaagaacauuca

SEQ ID NO: 129742 - RNA, 64 nt, Homo Sapiens
uucaagagaaguauucugcugagagagagagagagaccagcaucgugugugugugagagagaga

SEQ ID NO: 129743 - RNA, 64 nt, Homo Sapiens
gcuuuuuaauacaagaaaacccucccacccacccgaccagcagaccgccugcccuccugcccac

SEQ ID NO: 129744 - RNA, 64 nt, Homo Sapiens
ccaaggccaagcccugcccccucaacgccuccaagaccagcagguccaccccuuccagaccaag

SEQ ID NO: 129745 - RNA, 64 nt, Homo Sapiens
caccacgggcccugccagccgacaccaaagucaagaccagcacccugagccucgggacucagug

SEQ ID NO: 129746 - RNA, 64 nt, Homo Sapiens
uuuucuaccuaaggaccagaauuuuuuaucuagagaccagcauguucuccccaaagaccaagau

SEQ ID NO: 129747 - RNA, 64 nt, Homo Sapiens
uuuucuaccuaaggaccagaauuuuuugucuagagaccagcauguucuccccaaagaccagaau

SEQ ID NO: 129748 - RNA, 64 nt, Homo Sapiens
uuuucuaccuaaagaccaggacuuuuuaucuagagaccagcauguucuccccaaagacuggaau

SEQ ID NO: 129749 - RNA, 64 nt, Homo Sapiens
uucauuggguuuuauaguggcuuucugauuuuugguaguccauugaagaagggaguuugaaagu

SEQ ID NO: 129750 - RNA, 64 nt, Homo Sapiens
cccaggaaggccgggguggaucccucuuuguguuguaguccaugcuauuaaaaguguggcccac

SEQ ID NO: 129751 - RNA, 64 nt, Homo Sapiens
cauaucagcugaagucugccuguggauucuccuuguaguccagaucuacuaucugcaacucuuu

SEQ ID NO: 129752 - RNA, 64 nt, Homo Sapiens
ggagaagcuucugcuacuucucuguguucaaucaguaguccaggacgccacgcgcaucucuugu

SEQ ID NO: 129753 - RNA, 64 nt, Homo Sapiens
ccuucucacucagcauuuaguaauccagaauuuaguaguccaugucuuuuugaaauuuuaucag

SEQ ID NO: 129754 - RNA, 64 nt, Homo Sapiens
uagggcccagaaauaggaaauccacacacucccuguaguccagguauuucguuagauugacacu

SEQ ID NO: 129755 - RNA, 64 nt, Homo Sapiens
auagucuaagggagguguuccugagaaauagcagguaguccaggugggaccaaugaaagcaugg

SEQ ID NO: 129756 - RNA, 64 nt, Homo Sapiens
ggaaaugccugaccucucagucuggcucugcuguguaguccauagcccagccagaugagcuugc

SEQ ID NO: 129757 - RNA, 64 nt, Homo Sapiens
ucauauuuggaacuuuguaauagcgggaguagcaguaguccaaaccuaguauagggaaaggaua

SEQ ID NO: 129758 - RNA, 64 nt, Homo Sapiens
ugacucagccccuuguguuuacagacaaggacauguaguccaagguugcauggugaguucacag

SEQ ID NO: 129759 - RNA, 64 nt, Homo Sapiens
gaugcuccaucugcuucucccccuuucucuugcuguaguccaaugugcuaugagcaucagcuua

SEQ ID NO: 129760 - RNA, 64 nt, Homo Sapiens
aacagaacuguaugaccccuaaauaaauucugaaguaguccaaucucauuauagucuaaaagca

SEQ ID NO: 129761 - RNA, 64 nt, Homo Sapiens
aggaaaugauaaggaagaccaggaggagcucuucguaguccagaaagguagaagugggaguugu

SEQ ID NO: 129762 - RNA, 64 nt, Homo Sapiens
gaccccaacucugcccuggcugcccugagcccugguaguccagagcgagccaaccccaccucua

SEQ ID NO: 129763 - RNA, 64 nt, Homo Sapiens
augucaacuaucuguagcugauaaaauaguuuuaguaguccaaacuuaaagaagaaaaacaugu

SEQ ID NO: 129764 - RNA, 64 nt, Homo Sapiens
accacaauaucauuuauaauugaugucaauauuaguaguccacuuuaugcuuaaaauaaaauca

SEQ ID NO: 129765 - RNA, 64 nt, Homo Sapiens
uuugucauuaaaaaaaaaucuuaacaaucuccauguaguccaaauuucucaaugcuucuaauau

SEQ ID NO: 129766 - RNA, 64 nt, Homo Sapiens
uuaaagaaaauguuuuucuccugcauuuuauucaguaguccaaaguaacaugaaaaugauuauu

SEQ ID NO: 129767 - RNA, 64 nt, Homo Sapiens
uaaaugcccucauccguauuagucagagucacuuguaguccauuagaggcuucccuaguuuaca

SEQ ID NO: 129768 - RNA, 64 nt, Homo Sapiens
agcauggugauuugguuucagcuuagguccuuuuguaguccauagagacagucuaguuuaaaag

SEQ ID NO: 129769 - RNA, 64 nt, Homo Sapiens
agcacaaugaaggagacuugggcccugccagcugguaguccaucuucacgcccacccacccccu

SEQ ID NO: 129770 - RNA, 64 nt, Homo Sapiens
gaugcuauggcaagaaucuuuuuguguuuggaguguaguccauuugcaauagaaauaaaaaaau

SEQ ID NO: 129771 - RNA, 64 nt, Homo Sapiens
ugaaugcuaaggcugaaaucccaaccugagauuuguaguccaggauuacaaccagaaggaaagu

SEQ ID NO: 129772 - RNA, 64 nt, Homo Sapiens
cauugcccuuugggggugcccugggaucccugggguaguccagcucuucuucauuucccagcgu

SEQ ID NO: 129773 - RNA, 64 nt, Homo Sapiens
caccccuuagaugucuucauuguugguugcuaggguaguccagaauagaucucaaauagagacc

SEQ ID NO: 129774 - RNA, 64 nt, Homo Sapiens
gccucaggacaaaugucguuaauuaacuugaguuguaguccacauucauguaugaccuacuugu

SEQ ID NO: 129775 - RNA, 64 nt, Homo Sapiens
cagcuuuccauguaacuguaugcauaaagccaauguaguccaguuucuaagaucauguuccaag

SEQ ID NO: 129776 - RNA, 64 nt, Homo Sapiens
augucuguagucccagcuacuugggcacacgccuguaguccaggccacucgagcacacaccugu

SEQ ID NO: 129777 - RNA, 64 nt, Homo Sapiens
aaacuuagccggguaugguggugcaugugugccuguaguccaagcuacuugaaggcugagacag

SEQ ID NO: 129778 - RNA, 64 nt, Homo Sapiens
ucugauaaauccugugaagcgucugauaaauccuguaguccaagcucaggcauaauucagcaua

SEQ ID NO: 129779 - RNA, 64 nt, Homo Sapiens
uaauuuuaaaaauagauaccuguuugacuuugagguaguccagaccuuuucuuuuuuuuuuuuu

SEQ ID NO: 129780 - RNA, 64 nt, Homo Sapiens
ucaacuguacuuggagaaaucguguuuuaaagcaguaguccacaaaguauucugcucaugugcc

SEQ ID NO: 129781 - RNA, 64 nt, Homo Sapiens
ugagggacacacaucccuggaaaacuccuucccuguaguccagcaggcuuuucuuccccugacc

SEQ ID NO: 129782 - RNA, 64 nt, Homo Sapiens
cuugauuuggagggugaaugaagggugaauacuaguaguccagggacgcuagauuuuuuuuucu

SEQ ID NO: 129783 - RNA, 64 nt, Homo Sapiens
guucugggaaaauaccacauucuuuuugacugcuguaguccauaugugaauacuaaauguuaaa

SEQ ID NO: 129784 - RNA, 64 nt, Homo Sapiens
gcuugccaaugcaaauugcccagugaugaauucuguaguccaguaauuauauuuuuucagaaaa

SEQ ID NO: 129785 - RNA, 64 nt, Homo Sapiens
cuuccagguggcgugagaggguugggaggaggaaguaguccagcaggauuucugggaccccgca

SEQ ID NO: 129786 - RNA, 64 nt, Homo Sapiens
gugugauuuaaauguuaucuucaacuuuaaaauuguaguccaaaaauaucaacucauuuuagca

SEQ ID NO: 129787 - RNA, 64 nt, Homo Sapiens
ccaaagaucgaggaaaucuaccaagacuaguaggguaguccagaagaagcuguuucagggccug

SEQ ID NO: 129788 - RNA, 64 nt, Homo Sapiens
uuguaaccugugugaagcagcagccagccuuaaaguaguccauucuugcuaaugguuagaacag

SEQ ID NO: 129789 - RNA, 64 nt, Homo Sapiens
guuugccuugaaaccauuacggguugugacugaaguaguccaggucagaaucauguuaacuauu

SEQ ID NO: 129790 - RNA, 64 nt, Homo Sapiens
uccaaggccucugccccuaaggauuugaacccauguaguccaaccacagaaaacagccaagcug

SEQ ID NO: 129791 - RNA, 64 nt, Homo Sapiens
ucccagacuugugacuauggggcuuccucuucuuguaguccaucccggaagguguaaaacccca

SEQ ID NO: 129792 - RNA, 64 nt, Homo Sapiens
cagcugaaauuaaaucacuuugccuugugaauucguaguccaauccaaaugaccuugacuuuuc

SEQ ID NO: 129793 - RNA, 64 nt, Homo Sapiens
acauaugugaacauuccagccuucagcauaagugguaguccaaauuuucuuuaagcagcugcuc

SEQ ID NO: 129794 - RNA, 64 nt, Homo Sapiens
cuucugaugugggggaggcuggagcuccaugcacguaguccagaugccugggaaggaacaucuc

SEQ ID NO: 129795 - RNA, 64 nt, Homo Sapiens
uuccccaucugaggcagguuucuaggaggugucuguaguccauguggcaccuuugugagaauua

SEQ ID NO: 129796 - RNA, 64 nt, Homo Sapiens
ucucuggagcugaaggggccagcuuggggauucaguaguccagagggggcuggagggauccaag

SEQ ID NO: 129797 - RNA, 64 nt, Homo Sapiens
ccaaagccuguuagccaccauccaugcuaccuagguaguccauaggaaccacccccaugaccac

SEQ ID NO: 129798 - RNA, 64 nt, Homo Sapiens
accaguugaggaggaauugaacucaggacucagaguaguccagguguucuccuccuauucaguu

SEQ ID NO: 129799 - RNA, 64 nt, Homo Sapiens
uuucucugccucugccacaagguuucagaguaguguaguccaaguagaggguggggcacccuuu

SEQ ID NO: 129800 - RNA, 64 nt, Homo Sapiens
agaacacggggagguuuguuugugugaaaggaaaguaguccaggcugucccugaaacugagucu

SEQ ID NO: 129801 - RNA, 64 nt, Homo Sapiens
cacacaauuucuuauggaaacgguuuuaauuccuguaguccaaucucccaagacugagguuguu

SEQ ID NO: 129802 - RNA, 64 nt, Homo Sapiens
agcuugaacccaaugacugauaaaaaugguacuuguaguccauguaguaaaaaugauaccagua

SEQ ID NO: 129803 - RNA, 64 nt, Homo Sapiens
uuuccaucuuguuuguuuuccuaccuuaugcugaguaguccagagaguuaaaaaaauucucugc

SEQ ID NO: 129804 - RNA, 64 nt, Homo Sapiens
agaaauuggcagucacuuccucucugacagucaaguaguccaucacauugagguaacauccuuu

SEQ ID NO: 129805 - RNA, 64 nt, Homo Sapiens
ggccuagcugguaccacaucgcagcugaacucggguaguccagugagguggcucugauuuccug

SEQ ID NO: 129806 - RNA, 64 nt, Homo Sapiens
uaaacugcuugcuaggcucacuggaaugaggaauguaguccauccuugugagaucucuccucag

SEQ ID NO: 129807 - RNA, 64 nt, Homo Sapiens
aggcuucuacugaaaguccugaaaagaccuugcaguaguccaagcuacaccaaacauuaacaca

SEQ ID NO: 129808 - RNA, 64 nt, Homo Sapiens
cuaauaauuucugaucuucuuaguuuucauagcuguaguccauuugaauuuaagagauugguau

SEQ ID NO: 129809 - RNA, 64 nt, Homo Sapiens
uuccacucuuuaaaguucugcaguucaccaacugguaguccauuaaauucuccugucuagaaug

SEQ ID NO: 129810 - RNA, 64 nt, Homo Sapiens
cagguaaguaaagagaaacaauuuuugucacaaaguaguccauuccugaucucacuuaaaauaa

SEQ ID NO: 129811 - RNA, 64 nt, Homo Sapiens
uugggcucucaccacuucaguuuauaccuugccuguaguccagucucuccagcaucaauuccau

SEQ ID NO: 129812 - RNA, 64 nt, Homo Sapiens
gacgguguccucgcagugucgccgccaccccagcguaguccaagucagacuauuucacaaaguc

SEQ ID NO: 129813 - RNA, 64 nt, Homo Sapiens
caauguuuggaaaaacauggccuaauuuucuggaguaguccaaacacucugcugccauucacag

SEQ ID NO: 129814 - RNA, 64 nt, Homo Sapiens
gaagaagagaguuugaaagugcggcugauuuuugguaguccauuggacuucauuggguuuuaua

SEQ ID NO: 129815 - RNA, 64 nt, Homo Sapiens
ccagaaaucaugcucgcuucuccagaccaugcauguaguccacuaacuuuccaguuuacugaac

SEQ ID NO: 129816 - RNA, 64 nt, Homo Sapiens
uucaugccaaaaauggcuggcugcauuaaacgcuguaguccaugaaaaauguguggcuuugggu

SEQ ID NO: 129817 - RNA, 64 nt, Homo Sapiens
uucauuggguuuuacaguggcuuucugauuuuugguaguccauugaagaagggaguuugaaagu

SEQ ID NO: 129818 - RNA, 64 nt, Homo Sapiens
ggcccagaaaacugaacgauuauuuuguuccuccguaguccaaagggcagaguugcggaaggcc

SEQ ID NO: 129819 - RNA, 64 nt, Homo Sapiens
gccgucccaaggagugcccagcacuacucagcauguaguccaggaccugcggcaucagcauccc

SEQ ID NO: 129820 - RNA, 64 nt, Homo Sapiens
aagauagcagcuguacaaaaaaaaaauauuuacuguaguccaauccccucauugguguccuuuu

SEQ ID NO: 129821 - RNA, 64 nt, Homo Sapiens
gaaauguuucuguuucauauaauucaggaauaaaguaguccauacucagauaagcuuuuuucau

SEQ ID NO: 129822 - RNA, 64 nt, Homo Sapiens
gaugaaauggggcaccccuggccaucacucauguguaguccagguuugagaggaacuggaaggg

SEQ ID NO: 129823 - RNA, 64 nt, Homo Sapiens
aguaggacagugaaaaauguuuccuugcaaacuuguaguccaguaucaguuacuuccuauuuuu

SEQ ID NO: 129824 - RNA, 64 nt, Homo Sapiens
uacaaaaauuagcugggcaugguggcacccgccuguaguccagcuacuugaggcugagauggga

SEQ ID NO: 129825 - RNA, 64 nt, Homo Sapiens
ggcgguggcucacgccuguauaaaaccuccauaaguaguccaggccuggacuuaaaagauuuuu

SEQ ID NO: 129826 - RNA, 64 nt, Homo Sapiens
cagccuuuacguucaucaccugcuagaaccucucguaguccaucaccauuucuuggcauuggaa

SEQ ID NO: 129827 - RNA, 64 nt, Homo Sapiens
gcuugguacuucccagggcuaccggcaguccucuguaguccagagaggugagauuagaucuucu

SEQ ID NO: 129828 - RNA, 64 nt, Homo Sapiens
aguuauauccuggcucagugaaacucauguaucuguaguccaugaagcauuguuugacagguag

SEQ ID NO: 129829 - RNA, 64 nt, Homo Sapiens
uacuguuuuaacaucauuguugaaaccagacccuguaguccaguggugcugcccuguugugcaa

SEQ ID NO: 129830 - RNA, 64 nt, Homo Sapiens
uugaggcagagucuucuuugugccugaguggccuguaguccaucuccagcauguaacuggccuu

SEQ ID NO: 129831 - RNA, 64 nt, Homo Sapiens
uucaacaguaucaugcuaauauuccauuugaucgguaguccaaguucuuuggccagauagugca

SEQ ID NO: 129832 - RNA, 64 nt, Homo Sapiens
cuauuuuaguugguuuguaucuugccuaaggugcguaguccaacucuugguauuacccuccuaa

SEQ ID NO: 129833 - RNA, 64 nt, Homo Sapiens
aucacucaaaccugaaacuuugugacaauguauuguaguccaucguuuuauaccauuaaaagag

SEQ ID NO: 129834 - RNA, 64 nt, Homo Sapiens
cuacuugggaggcugaagugaguaguacacaccuguaguccaaguacaaaaguuagccagguac

SEQ ID NO: 129835 - RNA, 64 nt, Homo Sapiens
cugcagacucucaaacuugcuaucaauucucaugguaguccaaagccugggacucccaccuucc

SEQ ID NO: 129836 - RNA, 64 nt, Homo Sapiens
cgccucugccucccaaagugacucuugaccucauguaguccaccguuggccaggcuggucuuga

SEQ ID NO: 129837 - RNA, 64 nt, Homo Sapiens
aaaggagaggagcuggggccuuggggacccccagguaguccaugcggcccauuccuccccuucc

SEQ ID NO: 129838 - RNA, 64 nt, Homo Sapiens
cuuuagaaaccaaacacaaccuggcaguucuauaguaguccagagccacauuuaaauuguuuua

SEQ ID NO: 129839 - RNA, 64 nt, Homo Sapiens
uuagcuagguagaguuagugcugcuguguagggcguaguccaggugccacucuuuaccuagucc

SEQ ID NO: 129840 - RNA, 64 nt, Homo Sapiens
uaaaccugcagagugauuuugauaugaucuccauguaguccauauagcuuucacuacacuacag

SEQ ID NO: 129841 - RNA, 64 nt, Homo Sapiens
uucauuuaacucuuugaaacuuugaugucuccaaguaguccaccgugcuccuggaaacuuagcu

SEQ ID NO: 129842 - RNA, 64 nt, Homo Sapiens
cauuguccaccaccccagccuagagccuagaacuguaguccagcugaggaaggaggcagagcug

SEQ ID NO: 129843 - RNA, 64 nt, Homo Sapiens
ggcagaugccagacaagacagcuguagcaagaggguaguccaaaagcagccacaggcccaggga

SEQ ID NO: 129844 - RNA, 64 nt, Homo Sapiens
ucagaaauaaagcuguaucugccauuuuaagccuguaguccauuauuacuugggucuuuacuuc

SEQ ID NO: 129845 - RNA, 64 nt, Homo Sapiens
ccugccugccuuguuugauuguugcccugugacuguaguccaccgcuggggggcuucaacuaua

SEQ ID NO: 129846 - RNA, 64 nt, Homo Sapiens
ucagaaauaaaacuguaucugacauuuuaagccuguaguccauuauuacuugggucuuuacuuc

SEQ ID NO: 129847 - RNA, 64 nt, Homo Sapiens
gccugugggccaaaucuagcucacuaucuguuuuuguaaauaaaauuuuauaauaguacacagc

SEQ ID NO: 129848 - RNA, 64 nt, Homo Sapiens
aaaucuuuccaaauguucugguaucuuugaaaaauguaaauaguuuauuuauagagaacccuac

SEQ ID NO: 129849 - RNA, 64 nt, Homo Sapiens
gucuugguuauguaaaaaugcuuuuguauauaguuguaaauauugguuaugcacaggugggagu

SEQ ID NO: 129850 - RNA, 64 nt, Homo Sapiens
uaacacucaaauauuaacauccaacacaaaaagauguaaauacugguacuugugcauuuaaaaa

SEQ ID NO: 129851 - RNA, 64 nt, Homo Sapiens
ugucgcucagauguccuuuguucauguguguucuuguaaauacgguuuuugaaauguaaaugua

SEQ ID NO: 129852 - RNA, 64 nt, Homo Sapiens
uguacaaaaauuacugaaaguaaagauacauauguguaaauauauuugcugcaagcaguuuaua

SEQ ID NO: 129853 - RNA, 64 nt, Homo Sapiens
aggaaaaacuccggguauauuugguuuacugcuuuguaaauaaaauuuauguucacacaggaau

SEQ ID NO: 129854 - RNA, 64 nt, Homo Sapiens
augauuaugcuuuguggcuagggcauuuguuuuuuguaaauaaggggggcuuuuuuagguuuug

SEQ ID NO: 129855 - RNA, 64 nt, Homo Sapiens
caugaaugaaaauacaucuuacaaauaugaaaaauguaaauacuaguuauaugauauucuuuaa

SEQ ID NO: 129856 - RNA, 64 nt, Homo Sapiens
agaguuuaaaagcaugaaacccaugucagauaaguguaaauagaugaccauuuuaguuuuaauu

SEQ ID NO: 129857 - RNA, 64 nt, Homo Sapiens
auguaauauauauaaaauauggaaggggcuuuguuguaaauacuagcuuuauuguaaauacuau

SEQ ID NO: 129858 - RNA, 64 nt, Homo Sapiens
auggaaggggcuuuguuguaggaaggagcuuuauuguaaauacuagaagccucuuggugauuuu

SEQ ID NO: 129859 - RNA, 64 nt, Homo Sapiens
uacacaagugacuagguggucuuuuguaaauaaauguaaauauguuuuacugaugauguagaua

SEQ ID NO: 129860 - RNA, 64 nt, Homo Sapiens
uguaaauauguacacaaguggauguagauacuuuuguaaauaaaaguaaauuguuuuuacugau

SEQ ID NO: 129861 - RNA, 64 nt, Homo Sapiens
acaucacuaucaauuuuaagaauauauaauuuaauguaaauaaauagauuaagcuuuucauuuu

SEQ ID NO: 129862 - RNA, 64 nt, Homo Sapiens
gcuaaaagcauguauaguuaucaaaugugcaauuuguaaauauuuuagaaaagacaauuuuuuu

SEQ ID NO: 129863 - RNA, 64 nt, Homo Sapiens
cuguaauaaucuuucuuugggcacaaagaaguacuguaaauaaaugcuuguaaauauuuccucc

SEQ ID NO: 129864 - RNA, 64 nt, Homo Sapiens
cuuugggcacaaagaaguacuguaaauaaaugcuuguaaauauuuccuccaucaccauugaacu

SEQ ID NO: 129865 - RNA, 64 nt, Homo Sapiens
aaaauauuaaauaagcucaaauauauauauuugguguaaauaaagaguccaugguaaaugguuu

SEQ ID NO: 129866 - RNA, 64 nt, Homo Sapiens
uuauguccugucuguguaaagauucaucuuuuauuguaaauauuuagacuuuaccacagaaaua

SEQ ID NO: 129867 - RNA, 56 nt, Homo Sapiens
acuucugcauggaacucugagcaagauguaaauaaaauuaaaagguggauggcaag

SEQ ID NO: 129868 - RNA, 64 nt, Homo Sapiens
uguauaugagcuucaaauaagcaccuuuuuauuauguaaauaaauaaaaguuaucuguaucccc

SEQ ID NO: 129869 - RNA, 64 nt, Homo Sapiens
uugucccaucauggcccaccugguuuccugauguuguaaauaacaucaaugcaucugcuguggg

SEQ ID NO: 129870 - RNA, 64 nt, Homo Sapiens
cucuuuaauucccaccuaagccucuggguaauauuguaaauauuguuuuaaaaugcaucagccu

SEQ ID NO: 129871 - RNA, 64 nt, Homo Sapiens
uaauuuucaguaauuguuuugcacuuucaaagauuguaaauaguucauucaaucaaugguaugg

SEQ ID NO: 129872 - RNA, 64 nt, Homo Sapiens
uuaauguguaggaauuguauguauguauaucuucuguaaauaacaucuaguaucuucacuaaau

SEQ ID NO: 129873 - RNA, 64 nt, Homo Sapiens
aacacauccuaucagaucgcuuuaaaauguaccguguaaauauaaugaccaauguagccauugc

SEQ ID NO: 129874 - RNA, 64 nt, Homo Sapiens
ucucuaauugccacacugcacauggggacauuuauguaaauacgguuaagggcacaaagacagc

SEQ ID NO: 129875 - RNA, 64 nt, Homo Sapiens
cagugugcuuaugagucaguuaguagauuaccgguguaaauaccacaagcucaucgauuuucuu

SEQ ID NO: 129876 - RNA, 64 nt, Homo Sapiens
uuucuaagacaguuuuuauacacuaugauaaaguuguaaauaauuuuuacauuuagaguauuua

SEQ ID NO: 129877 - RNA, 64 nt, Homo Sapiens
aagaguuuuuuucuguuuauucauaccauuauuauguaaauauguauauuauuccaaaguuauu

SEQ ID NO: 129878 - RNA, 64 nt, Homo Sapiens
ccauuauuuuauuuuauagugugaaaaaugagcuuguaaauacugaauuuuguaaaaagaaauu

SEQ ID NO: 129879 - RNA, 64 nt, Homo Sapiens
aauuuugucccuuccauuucagggaauuccuagcuguaaauauacugucuuaccaaacaguggg

SEQ ID NO: 129880 - RNA, 64 nt, Homo Sapiens
uuuacauuuuaagacauaugacaaauacaacaaauguaaauaugcuaaccuuaaaggcucaaua

SEQ ID NO: 129881 - RNA, 64 nt, Homo Sapiens
uaucuguguauguguguauauuaggaauacauguuguaaauauaugaguggcacuucuuuuguc

SEQ ID NO: 129882 - RNA, 64 nt, Homo Sapiens
gagaauucagauauacuuuaucuuuuuaaaaaaguguaaauaaaaucaaagaauguaaagucua

SEQ ID NO: 129883 - RNA, 64 nt, Homo Sapiens
caauaggguaaguaaauauagccaccuguuaacauguaaauaagcauaauuuguuccaaagaug

SEQ ID NO: 129884 - RNA, 64 nt, Homo Sapiens
guaaaauacugauuuucauucuuucaagcuuauuuguaaauaccuauuugaaugcuguguauuu

SEQ ID NO: 129885 - RNA, 64 nt, Homo Sapiens
uguucaaaauccaacaaguaaugugaauuuuagauguaaauaucugccacuugauuuuuuuucc

SEQ ID NO: 129886 - RNA, 64 nt, Homo Sapiens
cuggggcuucggcuucuuuuuuucuuuguuuucuuguaaauacagaauuauuagcuuaaaacug

SEQ ID NO: 129887 - RNA, 64 nt, Homo Sapiens
agaauuauuagcuuaaaacuguacuguugaauucuguaaauaguuauaucucgguuggagcggg

SEQ ID NO: 129888 - RNA, 64 nt, Homo Sapiens
aaggaugaccugugcaaaaugagcucccugcaaguguaaauauuaaacagcuaaguaccuagaa

SEQ ID NO: 129889 - RNA, 64 nt, Homo Sapiens
gcaugaggaacucaucugugaauuuagacggccuuguaaauaggugugguagcuaaaggcacgg

SEQ ID NO: 129890 - RNA, 64 nt, Homo Sapiens
auaaucuguuuauuaauaagccaugauauguguauguaaauauucuuacaguacuuguuuuuag

SEQ ID NO: 129891 - RNA, 64 nt, Homo Sapiens
ugcaauaccauauggaaaucuuuuaauaaauauauguaaauaaaauaaaaaauauuugucucca

SEQ ID NO: 129892 - RNA, 64 nt, Homo Sapiens
uucaaaagaacuauuuaaaacucuugaaaacucauguaaauaaaaaucauagggugaaaauugu

SEQ ID NO: 129893 - RNA, 64 nt, Homo Sapiens
aaaagguggaggcauuguaaaaaggaaauagugauguaaauaaacauguucucuuucaaguaug

SEQ ID NO: 129894 - RNA, 64 nt, Homo Sapiens
ucuguaguagagguuaacucuauuuacagugcaguguaaauaguaggguggacacacauaugug

SEQ ID NO: 129895 - RNA, 64 nt, Homo Sapiens
ggugguaauguaaaaucauugguaggaauguuaauguaaauaguuuauuuuggagacggcuaau

SEQ ID NO: 129896 - RNA, 64 nt, Homo Sapiens
ugaucaagcauuuuuauaagauauuugcaauuuuuguaaauauuuuuggccugcaacugggaag

SEQ ID NO: 129897 - RNA, 64 nt, Homo Sapiens
aauuagaacaaugcacaucugucuuccaagauuuuguaaauauuuuugauuuuuuucauuaaau

SEQ ID NO: 129898 - RNA, 64 nt, Homo Sapiens
uuuagacccagaagagaggaguuugcucugaauuuguaaauaagucuuccccauuccucauacu

SEQ ID NO: 129899 - RNA, 64 nt, Homo Sapiens
augucaaguauuauaagcugguauuuaagaugcuuguaaauacuauuuauguuuuuaauuuugu

SEQ ID NO: 129900 - RNA, 64 nt, Homo Sapiens
ggaagaaaauuuccuccacauucauguacaaugauguaaauauuucaauaacuuagaaugcuuc

SEQ ID NO: 129901 - RNA, 64 nt, Homo Sapiens
uauaucagugcuccaguauauaaccucaaacaaauguaaauagaacgaauuauuuucuuguuuu

SEQ ID NO: 129902 - RNA, 64 nt, Homo Sapiens
ucuguuaauaacccacuguucuuguaaauaugcauguaaauaguaacuguguacaaaaggauug

SEQ ID NO: 129903 - RNA, 64 nt, Homo Sapiens
cauguaaauaguucuguuaaacaaaaggauugcuuguaaauaugcagcuaacuaaaaacugugu

SEQ ID NO: 129904 - RNA, 64 nt, Homo Sapiens
gccacugcacccacccaagacaagugauuuucauuguaaauauuugacuuuagugaaagcgucc

SEQ ID NO: 129905 - RNA, 64 nt, Homo Sapiens
gggguguuuauucuuccaacacauuucacuuuucuguaaauauacauaaacuuaaaaagaaaac

SEQ ID NO: 129906 - RNA, 64 nt, Homo Sapiens
gcucuuguuuucauuuuuguuguacguguagaucuguaaauaaaauugcaguauuuaaagcuua

SEQ ID NO: 129907 - RNA, 64 nt, Homo Sapiens
aaaaaaaacaaaaaaaagcuuuuaugauggauuuuguaaauagauuuguuacagggugaccugu

SEQ ID NO: 129908 - RNA, 64 nt, Homo Sapiens
ugaaauuugcuuuuuauccaaauauuuuguaucuuguaaauauggcuaauuauaggaaugccua

SEQ ID NO: 129909 - RNA, 64 nt, Homo Sapiens
gguuacuuggguuuggauacccuuagugggaugauguaaauagaggcuagcuaccuaggcuugu

SEQ ID NO: 129910 - RNA, 64 nt, Homo Sapiens
ugugacauguuuauauucacccauguacauuuucuguaaauaccaaacgcuacugauucccaug

SEQ ID NO: 129911 - RNA, 64 nt, Homo Sapiens
aaauacuguuaguuuuaauacaagagaaugcauuuguaaauaugguauagaguuuauuaauaua

SEQ ID NO: 129912 - RNA, 64 nt, Homo Sapiens
aaaugaaguagagaaauguuaugagccucuguacuguaaauaagaaaccauauugugacaagag

SEQ ID NO: 129913 - RNA, 64 nt, Homo Sapiens
agaaauggcaggacucauauugcugagucaagaguguaaauaaauggacuucugucauaauucu

SEQ ID NO: 129914 - RNA, 64 nt, Homo Sapiens
ggauuuuuuuaccagcuuuguuuacagacccaaauguaaauauuaaaaauaaauauuugcaauu

SEQ ID NO: 129915 - RNA, 64 nt, Homo Sapiens
auauaauuuaucugcuauuuuuaauuacuuaccuuguaaauaacuuuaauaauauucaaaaguu

SEQ ID NO: 129916 - RNA, 64 nt, Homo Sapiens
guuugcuagaaauauaacuuuuaauacaguagccuguaaauaaaacacucuuccauaugauauu

SEQ ID NO: 129917 - RNA, 64 nt, Homo Sapiens
uauucaccuaaaguagaaauaaucuguuacuuauuguaaauacugcccuagugucuccauggac

SEQ ID NO: 129918 - RNA, 64 nt, Homo Sapiens
aucggaacugcucaggauugauacauuucaagucuguaaauacggacaccaacgccauuuaccc

SEQ ID NO: 129919 - RNA, 64 nt, Homo Sapiens
uuggguuuuguuuuaaguuuuacuaauuucuauauguaaauaaaagauauaaugauugugcaaa

SEQ ID NO: 129920 - RNA, 64 nt, Homo Sapiens
aguguccuucagaacccagagaaggccgccguucuguaaauagcgacgucgguguugcugccca

SEQ ID NO: 129921 - RNA, 64 nt, Homo Sapiens
gggggcgcaaacccuuuuccucccagccuauuuuuguaaauaaaauguuuaaacuugaaauaca

SEQ ID NO: 129922 - RNA, 64 nt, Homo Sapiens
cuugcaccauuguaauaaaagcuguuagaauauuuguaaauaucuuucugcuguaguguggugg

SEQ ID NO: 129923 - RNA, 64 nt, Homo Sapiens
caucacaaugaucaaaucacuaaauagauagcauuguaaauaauaggauuauuuauugcuaacg

SEQ ID NO: 129924 - RNA, 64 nt, Homo Sapiens
uuaagagcaugcagccaucuauggcagagcuauguguaaauauuucuuaaugggagagcuauaa

SEQ ID NO: 129925 - RNA, 64 nt, Homo Sapiens
uuaaggaaaguauagcuuugaucuuaaaacuauguguaaauauagcuuccauagccaugagaac

SEQ ID NO: 129926 - RNA, 64 nt, Homo Sapiens
cuauuuuuuauaaucuuuacgguauacuaugccauguaaauagaccuuguuuauauaucacuga

SEQ ID NO: 129927 - RNA, 64 nt, Homo Sapiens
ucugacuaugaaaaaugucucuuucaguuuguucuguaaauauuuagaaaagugacagcuguca

SEQ ID NO: 129928 - RNA, 64 nt, Homo Sapiens
cagcugucaaccucagaguaacuauuucuaaaaauguaaauauguauuaauccuuguaucuuuu

SEQ ID NO: 129929 - RNA, 64 nt, Homo Sapiens
uuuaaaaaauuuuaagauuuacacaauguuucucuguaaauauugccauuaaauguaaauaacu

SEQ ID NO: 129930 - RNA, 64 nt, Homo Sapiens
uacacaauguuucucuguaaauauugccauuaaauguaaauaacuuuaauaaaacguuuauagc

SEQ ID NO: 129931 - RNA, 64 nt, Homo Sapiens
agaaaacacaucaucaauaaacaguaaaaacaaauguaaauaaaguugaaauucaauaccaaau

SEQ ID NO: 129932 - RNA, 64 nt, Homo Sapiens
aucuauguuacacucuccuaagucauagcaaguuuguaaauagcuuuaaauggcuugauguagc

SEQ ID NO: 129933 - RNA, 64 nt, Homo Sapiens
aguguuguuuucaaagccauuaccaucuauuuguuguaaauaaaauccacgagugcuguugcac

SEQ ID NO: 129934 - RNA, 64 nt, Homo Sapiens
cuuuaguuuuaauucaguuggagaaaaaaugcacuguaaauauguagaauugggaaauuuuagu

SEQ ID NO: 129935 - RNA, 64 nt, Homo Sapiens
cuuuuuuucuaacaauuugcgaaaagcaaaauacuguaaauaaauucucacuagaauugguaug

SEQ ID NO: 129936 - RNA, 64 nt, Homo Sapiens
guacauuuuaaacauuggcuuuggacacuucauuuguaaauagugagagcugggaauauggcau

SEQ ID NO: 129937 - RNA, 64 nt, Homo Sapiens
aagcuuguguacuugaccguuuuuauauuacuuuuguaaauauucuuguccacauucuacuuca

SEQ ID NO: 129938 - RNA, 64 nt, Homo Sapiens
guauaccaccuguacauacauuguauaggccaucuguaaauaucccagagaacaaucacuauuc

SEQ ID NO: 129939 - RNA, 64 nt, Homo Sapiens
gcguucuacuuccagaagauggucacuuuaaccuuguaaauauuuaucuaaaaugauauuuaca

SEQ ID NO: 129940 - RNA, 64 nt, Homo Sapiens
guaauauauuauuauuugauuguauauguacaacuguaaauacauuuguaccucucuuguauuc

SEQ ID NO: 129941 - RNA, 64 nt, Homo Sapiens
aaaagccauguacagagggagcuauauuguauuauguaaauaauucaugcuauucagcauugau

SEQ ID NO: 129942 - RNA, 64 nt, Homo Sapiens
uaaguauguacacgaggcacugccuguuuucaucuguaaauaguuauaguuaguguugugguaa

SEQ ID NO: 129943 - RNA, 64 nt, Homo Sapiens
aaagaaaucaaguuuuguuucuugaaacaaaaaauguaaauacacuuuuagcauuuugcuaaga

SEQ ID NO: 129944 - RNA, 64 nt, Homo Sapiens
guaccuguaucuagauuaaauuaaucuaaauauuuguaaauaaauuugauguaacaaaaugcua

SEQ ID NO: 129945 - RNA, 64 nt, Homo Sapiens
uguacagaagccauguuauuauaagucucuguucuguaaauagaaggccuccaucucacuguaa

SEQ ID NO: 129946 - RNA, 64 nt, Homo Sapiens
ucucuguucuguaaauagauggccuccaucucacuguaaauaagcugucccucaccaacaccaa

SEQ ID NO: 129947 - RNA, 64 nt, Homo Sapiens
uugucuuucucuuaauauuuuauuaaaucuuguuuguaaauauaaacucuauucuugugagcau

SEQ ID NO: 129948 - RNA, 64 nt, Homo Sapiens
gccuuccucucccuauauccugugcagagugggauguaaauaucaugaauaggcgguacugagu

SEQ ID NO: 129949 - RNA, 64 nt, Homo Sapiens
auacucuguacgguucuguaaaccgaaaaacuuuuguaaauauauaaauauacauagacauaaa

SEQ ID NO: 129950 - RNA, 64 nt, Homo Sapiens
aaaaagcaacaaguuugcacagcuagaguguuuuuguaaauaaauguauuuguauaacacaguc

SEQ ID NO: 129951 - RNA, 64 nt, Homo Sapiens
aagggcagcccugccugcccuccccaucccccgcuguaaauauacacuauuuuugauagcacac

SEQ ID NO: 129952 - RNA, 64 nt, Homo Sapiens
uuccugugccuaacagcauaauugccuuuuccuauguaaauauuaugaugguggaucaagacau

SEQ ID NO: 129953 - RNA, 64 nt, Homo Sapiens
auuuuugggagaucugauuuucuuauccaaguuuuguaaauaguuguuauuucuauauuuggau

SEQ ID NO: 129954 - RNA, 64 nt, Homo Sapiens
uuauuuaauuauuuuaaaacguacacacuuuucuuguaaauaugucacaucugaguucaaaaaa

SEQ ID NO: 129955 - RNA, 64 nt, Homo Sapiens
uuuaacucaaauaaaauugcugucuuuggguuuuuguaaauaauuguaccaguuucaugaagua

SEQ ID NO: 129956 - RNA, 64 nt, Homo Sapiens
accaauuggaaauuagaacaauuguaaauauuucuguaaauacuuuuaaaguaaccuuuuuucc

SEQ ID NO: 129957 - RNA, 64 nt, Homo Sapiens
ucuguaaauacuaccaauugaaccuuuuuuccauuguaaauauuuuaacuaaaaguuuuaaagu

SEQ ID NO: 129958 - RNA, 64 nt, Homo Sapiens
auuuagucaucacaaauaaagcccauaaaaucauuguaaauauuguacaaguguaaauauaugu

SEQ ID NO: 129959 - RNA, 64 nt, Homo Sapiens
ugugcccauaaaaucauugucuuuaauguacaaguguaaauauagacuuuccuuuucaaaaaua

SEQ ID NO: 129960 - RNA, 64 nt, Homo Sapiens
gcuucuguuuuguuucuccuauguaguuuaaauuuguaaauacuaagauuguucacaacaucuc

SEQ ID NO: 129961 - RNA, 64 nt, Homo Sapiens
uaaauuguucucugcauauaagauuucucaauaauguaaauaacaugauucuaggcuguuaaau

SEQ ID NO: 129962 - RNA, 64 nt, Homo Sapiens
guguaaaucuuguugaaauaugacaauuccauauuguaaauacuucugcaaaacuguauagcuu

SEQ ID NO: 129963 - RNA, 64 nt, Homo Sapiens
cuuacuugguauauuuuuauacagcuuccuaguuuguaaauagauaaaucaugcuguuucugaa

SEQ ID NO: 129964 - RNA, 64 nt, Homo Sapiens
uuuuuuuucuggguucauauuacuuguauaacuuuguaaauaagcauagaaaauugggugugua

SEQ ID NO: 129965 - RNA, 64 nt, Homo Sapiens
uguauuuaaaaaaacaaucccaguucauccgcacuguaaauacagaggaguugauaugcaacug

SEQ ID NO: 129966 - RNA, 64 nt, Homo Sapiens
auuaucauaaaaauuuaccagucugaauagaucuuguaaauauuugugaauagaaugaauaccu

SEQ ID NO: 129967 - RNA, 64 nt, Homo Sapiens
auucuaugcaguggaugaauguucuuuaaauuuguguaaauacuucugcaaagguacugaugcu

SEQ ID NO: 129968 - RNA, 64 nt, Homo Sapiens
ugcaugcuguaguucuagcuuuucugcuauaauauguaaauaugacuguagccuuuuaagcuuc

SEQ ID NO: 129969 - RNA, 64 nt, Homo Sapiens
ugauuuacaguauuguuauuuuugucuaaaguucuguaaauacaugcuuuaauguuaucuuuga

SEQ ID NO: 129970 - RNA, 64 nt, Homo Sapiens
aauacaugcuuuaauguuaucuuugagaaaucuauguaaauaauauagucuacaacauagagac

SEQ ID NO: 129971 - RNA, 64 nt, Homo Sapiens
uccuaccccuuccuguccugccuccucaucaguguguaaauaauuugcacugaaacguggauac

SEQ ID NO: 129972 - RNA, 64 nt, Homo Sapiens
ugaaacguggauacagagccacgaguuuggauguuguaaauaaaacuauuuauugugcuggguc

SEQ ID NO: 129973 - RNA, 64 nt, Homo Sapiens
agaaugguucucuuugacccacucuggucuauuguguaaauauuuauuuagacuauuuuaauaa

SEQ ID NO: 129974 - RNA, 64 nt, Homo Sapiens
uuaggguauaggcaucuagagaugcacuguccacuguaaauacuauaaugagagccacaucugu

SEQ ID NO: 129975 - RNA, 64 nt, Homo Sapiens
acuuguuucuacaauucaguauuugauguggucguguaaauauguacaauauuguaaauacaua

SEQ ID NO: 129976 - RNA, 64 nt, Homo Sapiens
guauuugauguggucguguaaauauguacaauauuguaaauacauaaaaaauauacaaauuuuu

SEQ ID NO: 129977 - RNA, 64 nt, Homo Sapiens
auacauauuuuacguuugaacaaggagauuuaauuguaaauaugaaagccaaaguauuccugaa

SEQ ID NO: 129978 - RNA, 64 nt, Homo Sapiens
aagaauuaagauuuuucuuuguuccauuguacaguguaaauaacuaaguuguuaacugucaagu

SEQ ID NO: 129979 - RNA, 64 nt, Homo Sapiens
gugcaacccagucgggcuuugaagccaguaaacauguaaauauaagaguggugcuagccaggaa

SEQ ID NO: 129980 - RNA, 64 nt, Homo Sapiens
cuaucuucuuuaagaaauuaauguguuagauguguguaaauaugguauaaaauagaguauuuuc

SEQ ID NO: 129981 - RNA, 64 nt, Homo Sapiens
cccacuguacuguuagaggccuuuguguauauaguguaaauaucugagaaccuggguguauuaa

SEQ ID NO: 129982 - RNA, 64 nt, Homo Sapiens
uuguauauaaugucagguuuuguccauauguauuuguaaauaggaucuauguacauauauuguc

SEQ ID NO: 129983 - RNA, 64 nt, Homo Sapiens
uuugcuuguguugucgcaaacuaugccuuaccuuuguaaauauuuuucucuuuauguaguuuga

SEQ ID NO: 129984 - RNA, 64 nt, Homo Sapiens
ugaucuugaaucacuugacacuccauuugauuauuguaaauauuuuggaaaaaaaaaucugaua

SEQ ID NO: 129985 - RNA, 64 nt, Homo Sapiens
auugcaacugucagguuuuguguacauagcucuguguaaauagaaaacuuuaauuuauugacau

SEQ ID NO: 129986 - RNA, 64 nt, Homo Sapiens
uggaauaugaaugcuuggaauauuugauaacucuuguaaauaggagacaaaguauuuauguaau

SEQ ID NO: 129987 - RNA, 64 nt, Homo Sapiens
gccuuuauuaauuguucuugugugaacacauauuuguaaauaguacugguugggugucuuuaau

SEQ ID NO: 129988 - RNA, 64 nt, Homo Sapiens
aaguagaggaaaacauaagaauuaaaagagcuauuguaaauauauggaauuaguagacaaggau

SEQ ID NO: 129989 - RNA, 64 nt, Homo Sapiens
uauaugaguugccuauauuugcuauucaaaauuuuguaaauaugcaaaucagcuuuauagguuu

SEQ ID NO: 129990 - RNA, 64 nt, Homo Sapiens
aguuuuguuuguuagaaaaguugcucuuaaaagauguaaauagaugacaaacgauguaaauaau

SEQ ID NO: 129991 - RNA, 64 nt, Homo Sapiens
uugcucuuaaaagauguaaauagaugacaaacgauguaaauaauuuuguaagaggcuucaaaau

SEQ ID NO: 129992 - RNA, 64 nt, Homo Sapiens
uaauugccaaggcaaauaaauaucaaucaucaauuguaaauaaaauuuuuaccucaauuguuga

SEQ ID NO: 129993 - RNA, 64 nt, Homo Sapiens
uguauguauagcauauguacagcguauaccuaacuguaaauaaacuauuuaaaggcuucuaaga

SEQ ID NO: 129994 - RNA, 64 nt, Homo Sapiens
guacauuuaaugucacaagaauuacuuuuucaacuguaaauaaucugaaaugaaauguuuuuag

SEQ ID NO: 129995 - RNA, 64 nt, Homo Sapiens
gaacuuaaauagaaggcaacuuuucugauucuuuuguaaauacauaauuuuacauuguauuaga

SEQ ID NO: 129996 - RNA, 64 nt, Homo Sapiens
cuaugaguuuuggguggguaauauggucaauauuuguaaauauugguuucuacuuuauggaauu

SEQ ID NO: 129997 - RNA, 64 nt, Homo Sapiens
ccuuauuuaagacauguuuaagaagguuucgaaauguaaauauucagaucaaauuaauacaauc

SEQ ID NO: 129998 - RNA, 64 nt, Homo Sapiens
aguucacauuuuuccacaguaaauaaaauuacuuuguaaauagcguuaauuuguucuuaccaaa

SEQ ID NO: 129999 - RNA, 64 nt, Homo Sapiens
agcaagcuauuauuaacaacaguguuaaaguauuuguaaauagauggacacuuguaagucaauc

SEQ ID NO: 130000 - RNA, 64 nt, Homo Sapiens
acaauucaugaaauguuauuucuuacuaacauguuguaaauauuagcuguauguuaagagagac

SEQ ID NO: 130001 - RNA, 64 nt, Homo Sapiens
ugucuggagucacaguauuaaacgcaugcaggcauguaaauauuaaagaugucuuucugguuuu

SEQ ID NO: 130002 - RNA, 64 nt, Homo Sapiens
caauagaaaaguuugcuugauuuuguauuauuuuuguaaauagccuguaaagcuuauuacuaau

SEQ ID NO: 130003 - RNA, 64 nt, Homo Sapiens
uaccuacauacacugcauguuugguuuugucaucuguaaauacuuaucguagcuuaaacucugu

SEQ ID NO: 130004 - RNA, 64 nt, Homo Sapiens
acuagagaauauauuggguuuacugagauucugcuguaaauauguugggauauuuuaaaaaugc

SEQ ID NO: 130005 - RNA, 64 nt, Homo Sapiens
ugccuuacgugagugugucauuaaguccauaccuuguaaauaagagaaaugcugugauucuguu

SEQ ID NO: 130006 - RNA, 64 nt, Homo Sapiens
uauauacuacugaccaagaugccuauuuuuucauuguaaauauuugaagauuuccuuuuuccuu

SEQ ID NO: 130007 - RNA, 64 nt, Homo Sapiens
agugacgagaaaguuaauggcagcuaaagcagcguguaaauaggcccaaauaccgcgaaugcau

SEQ ID NO: 130008 - RNA, 64 nt, Homo Sapiens
gcuuaauggaauuauaauucucaggauaguauuuuguaaauaaagaugauuuaaauaugaaucu

SEQ ID NO: 130009 - RNA, 64 nt, Homo Sapiens
uucaauuauguuaugacaaaugugcucucuuucuuguaaauagacaugaguggcccaaagcaac

SEQ ID NO: 130010 - RNA, 64 nt, Homo Sapiens
cuuuuagcuuaggaagucuuauguguuguaaauauguaaauauaaguucuucaguuauauuuac

SEQ ID NO: 130011 - RNA, 64 nt, Homo Sapiens
uaaauauacuuuuagcuuagauauuuacauguguuguaaauauguuugaaguaguucuucaguu

SEQ ID NO: 130012 - RNA, 64 nt, Homo Sapiens
uaauuuugcaaacaugccuuaugugagcuuaagauguaaauaaaucuauccuagaaagauuuua

SEQ ID NO: 130013 - RNA, 64 nt, Homo Sapiens
acuuucuggaaaguuuagacaaauguacaaugaauguaaauauguuuguauuuauguguauaua

SEQ ID NO: 130014 - RNA, 64 nt, Homo Sapiens
ucaugaugcugacuggcguuagcugauuaacccauguaaauaggcacuuaaauagaagcaggaa

SEQ ID NO: 130015 - RNA, 64 nt, Homo Sapiens
ucaucuuuguugagagucuucgugacuguaagauuguaaauacagauuauuuauuaacucuguu

SEQ ID NO: 130016 - RNA, 64 nt, Homo Sapiens
uuucuccuaagucaugcagguaaugacaauauacuguaaauaccacaugugaguuuaccugaau

SEQ ID NO: 130017 - RNA, 64 nt, Homo Sapiens
ugaauagauaccuuguaaacuuguauuguggauguguaaauaauauguacuuuggguuuuuaac

SEQ ID NO: 130018 - RNA, 64 nt, Homo Sapiens
uucauauucuuuauuuauaaaggaucaaugcugcuguaaauacagguauuuuuaauuuuaaaau

SEQ ID NO: 130019 - RNA, 64 nt, Homo Sapiens
agcuuucuaauggugucuucagaaauuuauaaaauguaaauacugauuugacuggucuuuaaga

SEQ ID NO: 130020 - RNA, 64 nt, Homo Sapiens
uaggucucuaaacacagacuuuuuaaauugcaacuguaaauaugaaauggucaucacaucugac

SEQ ID NO: 130021 - RNA, 64 nt, Homo Sapiens
guaauuuguaaccauuuucuauuugugcaaacucuguaaauauguguuuaaacaaauguaauau

SEQ ID NO: 130022 - RNA, 64 nt, Homo Sapiens
uaauacaguauuaacauuuuuugcuuucagcccauguaaauaaagugaagggacucauuuuucu

SEQ ID NO: 130023 - RNA, 64 nt, Homo Sapiens
uuugcccuaguugaauuaaguucugguggcuuuguguaaauaugagcucuuuaagugauccucg

SEQ ID NO: 130024 - RNA, 64 nt, Homo Sapiens
gacaucacuuuuuuuuucuugauuuguucaacuuuguaaauaugcguuucuuaaguauugcgca

SEQ ID NO: 130025 - RNA, 64 nt, Homo Sapiens
gcucagcauauuaaucccgacugauauuuggagauguaaauauucguauaauagggauugugac

SEQ ID NO: 130026 - RNA, 64 nt, Homo Sapiens
cagaauguuuuuucuuacuuuuuagaauuuuuuauguaaauauaauuuuucccccagugaauga

SEQ ID NO: 130027 - RNA, 64 nt, Homo Sapiens
uuaaacuuuucugguuucugaauuuguuuaaaauuguaaauaaaaguuccuguccaauuugugu

SEQ ID NO: 130028 - RNA, 64 nt, Homo Sapiens
aagaaaggaaagaucucuaaauucaaagcuagauuguaaauaggcauucaagaaguauugucuu

SEQ ID NO: 130029 - RNA, 64 nt, Homo Sapiens
uuccuggaaaugaugacuuuauugcuuagaaaguuguaaauaauuaaaagcuucccaagaguua

SEQ ID NO: 130030 - RNA, 64 nt, Homo Sapiens
caugaaaauuauaugaaauuuaaguuuuggugucuguaaauaaaguuuuguuggcuucagccac

SEQ ID NO: 130031 - RNA, 64 nt, Homo Sapiens
gcccauggaccaaauccuaucugcugcuuguuuuuguaaauagaguuuuaucaaaccacagcca

SEQ ID NO: 130032 - RNA, 64 nt, Homo Sapiens
uguuauacuguauuuuucaacaauguaaauacuauguaaauaguuagaucacuuauaccuauca

SEQ ID NO: 130033 - RNA, 64 nt, Homo Sapiens
auguaaauaguuguuauacuuauaccuaucacaauguaaauacuuaaauuaucuuuagaucacu

SEQ ID NO: 130034 - RNA, 64 nt, Homo Sapiens
aucuguaauuguuauuauuguauagcauguauucuguaaauauuacuuggaggaaucacaguca

SEQ ID NO: 130035 - RNA, 64 nt, Homo Sapiens
uuguuauaauuuuuuucuuacccuggcccccggguguaaauagaagcccgucuccucuucccuu

SEQ ID NO: 130036 - RNA, 64 nt, Homo Sapiens
accagcccagcccgucuccuccuccugugucccuuguaaauagaaccuccuccagacccccucc

SEQ ID NO: 130037 - RNA, 64 nt, Homo Sapiens
agaaucucgcaguguuucugugaauagauuuuuuuguaaauaugaccuuuaagauauuguauua

SEQ ID NO: 130038 - RNA, 64 nt, Homo Sapiens
ugccacuuuucuaaacugcaucuggauugaaagguguaaauaucaauaacagugcuacuuaguu

SEQ ID NO: 130039 - RNA, 64 nt, Homo Sapiens
cugugacugcuuugcugaccauuuuggaugucauuguaaauaaagguuucuauuuaaaauugga

SEQ ID NO: 130040 - RNA, 64 nt, Homo Sapiens
gauuugguguuuugcaaucuauuauauguggaaguguaaauauauuucagcuuaaaguuauguu

SEQ ID NO: 130041 - RNA, 64 nt, Homo Sapiens
uaaguuguaaaccugcuugucucagguaaaaaucuguaaauaucaaaguauauaaugcuugcac

SEQ ID NO: 130042 - RNA, 64 nt, Homo Sapiens
uuacuuucagaaaugaaguuguuacuuguucauauguaaauauuuuucauguaaauuuugcaca

SEQ ID NO: 130043 - RNA, 64 nt, Homo Sapiens
cuggcuuucuccgugugaauaguacuuuuaugacuguaaauacuguaugaaauugucuauugau

SEQ ID NO: 130044 - RNA, 64 nt, Homo Sapiens
uguguuuguuuuuacaggugugaaagucacagcuuguaaauaaguguuguauguauuaaaccuu

SEQ ID NO: 130045 - RNA, 64 nt, Homo Sapiens
aauuugcagccguuuuacaaauaucuguggaacauguaaauacugucaaauggaaaauaaaaua

SEQ ID NO: 130046 - RNA, 64 nt, Homo Sapiens
uuaaaauuugacauacccuaguuuugucuuuaaguguaaauauuauuguaauaauuguggaaau

SEQ ID NO: 130047 - RNA, 64 nt, Homo Sapiens
accuaaaguuuaaauguuuuauaagauaaauauuuguaaauaaaacgucaaauaggagaggaag

SEQ ID NO: 130048 - RNA, 64 nt, Homo Sapiens
aucagacagguuuaaaaguuauuccauguauaaguguaaauauaaaucucuuugguuccuguau

SEQ ID NO: 130049 - RNA, 64 nt, Homo Sapiens
gauuuccuuaaugaaaaauaguuuuuaaaggugauguaaauaguacaugaagauguuaaaaucg

SEQ ID NO: 130050 - RNA, 64 nt, Homo Sapiens
uacuggaaauauuauacaguuccucagaaugauuuguaaauagcaaacccuaaaugguuauuuu

SEQ ID NO: 130051 - RNA, 64 nt, Homo Sapiens
cuaaagcaaaauuuagaagaaagaacuacacauauguaaauaccauauuuuugauaaaaaugug

SEQ ID NO: 130052 - RNA, 64 nt, Homo Sapiens
cacauauguaaauaccauauuuuugauaaaaauguguaaauagauuuaucaaugaugaguggac

SEQ ID NO: 130053 - RNA, 64 nt, Homo Sapiens
uggacuugcauccauuuuguauuuuuguaauauuuguaaauaugaacuuuuuaaauugcugcaa

SEQ ID NO: 130054 - RNA, 64 nt, Homo Sapiens
gggcagccccagucaccacgagcuguuucauuuguguaaauacgaugcugaauuuuaugaggcu

SEQ ID NO: 130055 - RNA, 64 nt, Homo Sapiens
ccacuguaauuuucaagccuauuuuauuuguaccuguaaauacuguacagcuaauauauauaua

SEQ ID NO: 130056 - RNA, 64 nt, Homo Sapiens
uauauacaaaucuucauuuucauacauaguacaauguaaauauauaacuuuguuaacacuuuug

SEQ ID NO: 130057 - RNA, 64 nt, Homo Sapiens
caguucagaaauaccacaauuaauauuuucaauguguaaauaucuuuucauaauuuuuccuacg

SEQ ID NO: 130058 - RNA, 64 nt, Homo Sapiens
auacaauuccaaugaguauucugauuaucagauuuguaaauaacuauguaaauagaaacagaua

SEQ ID NO: 130059 - RNA, 64 nt, Homo Sapiens
ugaguauucugauuaucagauuuguaaauaacuauguaaauagaaacagauaccagaauaaauc

SEQ ID NO: 130060 - RNA, 64 nt, Homo Sapiens
uagugagucucccuucaaaauacgcaguagguaguguaaauacugcuuguuugugucucucugc

SEQ ID NO: 130061 - RNA, 64 nt, Homo Sapiens
ucugaagaagaaaaagaaauuuuauguauguauguguaaauauguguauauauuucuaucucuu

SEQ ID NO: 130062 - RNA, 64 nt, Homo Sapiens
uuuuaacaacaacaaaaguuuagguucuaauuuauguaaauaccuaguauguguauuuuugacu

SEQ ID NO: 130063 - RNA, 56 nt, Homo Sapiens
uucgagaaauuaaaucuuaaaaucuguguaaauagaaaacuugaaccauuaguaau

SEQ ID NO: 130064 - RNA, 64 nt, Homo Sapiens
aaccauugcauucuuguacacugauuugaaaugcuguaaauaugucccaauuuguauugauucu

SEQ ID NO: 130065 - RNA, 64 nt, Homo Sapiens
ucccaauuuguauugauucucuuuaaauauaaaauguaaauaaaauauuccaauaaaaguuugu

SEQ ID NO: 130066 - RNA, 64 nt, Homo Sapiens
acaccuaagagucucuauuucacaauuauauuuuuguaaauaguauaugcauuuuuaauacauu

SEQ ID NO: 130067 - RNA, 64 nt, Homo Sapiens
aucauagccuaugaugauaaacacugccuauauauguaaauagcuuuucaucaauucuuaaauu

SEQ ID NO: 130068 - RNA, 64 nt, Homo Sapiens
gaauggugguuucagagaucucucuucccaaauguguaaauauucuauaccagauaaguuuaaa

SEQ ID NO: 130069 - RNA, 64 nt, Homo Sapiens
uuuuuuauucugucggguuacugaccucacuuuauguaaauacuucgcaugacaaauucaguaa

SEQ ID NO: 130070 - RNA, 64 nt, Homo Sapiens
aaagcacuacuuuguaaagaugacuacccaagauuguaaauacaaaauuuaaaaagguacuuaa

SEQ ID NO: 130071 - RNA, 64 nt, Homo Sapiens
uauugcaauaaaugucaaaugaaacaagcucuuguguaaauagacuucugugccuaauagugac

SEQ ID NO: 130072 - RNA, 64 nt, Homo Sapiens
auguuuacuucaugcugaauaaaccgaguacugcuguaaauacuuugucaguguguugaauugc

SEQ ID NO: 130073 - RNA, 64 nt, Homo Sapiens
cugcuuuuaaaggagggcauuauucagaaucacuuguaaauaguugacuggcauguguucaugc

SEQ ID NO: 130074 - RNA, 64 nt, Homo Sapiens; identical to SEQ ID NO: 130058

SEQ ID NO: 130075 - RNA, 64 nt, Homo Sapiens; identical to SEQ ID NO: 130059

SEQ ID NO: 130076 - RNA, 64 nt, Homo Sapiens
uagugagucucccuucaaaauacacaguagguaguguaaauacugcuuguuugugucucucugc

SEQ ID NO: 130077 - RNA, 64 nt, Homo Sapiens
ccguuucuacuaaaaauacacauccuggccaacaugaugaaacccgaggucaagagaucgagac

SEQ ID NO: 130078 - RNA, 64 nt, Homo Sapiens
guaagaauuuuugugaccacagcuguugaaauauugaugaaaauaggcccaacauuaaacacaa

SEQ ID NO: 130079 - RNA, 64 nt, Homo Sapiens
agaaaugucagacacucuuuggauuugauucagaugaugaaagugccugaugaaaacgguucag

SEQ ID NO: 130080 - RNA, 64 nt, Homo Sapiens
acucuuuggauuugauucagaugaugaaagugccugaugaaaacgguucagaaagaucugucaa

SEQ ID NO: 130081 - RNA, 64 nt, Homo Sapiens
aaaauuugagacuauuuaaacuuauaaaucauauugaugaaaagauuuaagcacaaacuuuagg

SEQ ID NO: 130082 - RNA, 64 nt, Homo Sapiens
aaguuuagaagcugagacacaaaggguugggagcugaugaaacucacaaaugaugguaggaaga

SEQ ID NO: 130083 - RNA, 64 nt, Homo Sapiens
agucacagagaaguuacaugagucacacuuuuuuugaugaaauguuaaaguagguagagaguag

SEQ ID NO: 130084 - RNA, 64 nt, Homo Sapiens
gcugguuuuguuguuguuguauaguucacuauucugaugaaaagaggaacuaugcuggaaacug

SEQ ID NO: 130085 - RNA, 64 nt, Homo Sapiens
gcagaaugucuuuuuaaaugaguuugcuaaaagaugaugaaaauuguaauuucguugcuauagu

SEQ ID NO: 130086 - RNA, 64 nt, Homo Sapiens
cucugaaggcaaauauaagcugggaaaaaaguuuugaugaaauucuugaaguucauggugauca

SEQ ID NO: 130087 - RNA, 64 nt, Homo Sapiens
caguugaaaauggauuuuuaaauuauacuguagcugaugaaacuccugauuuuguaguuaauuu

SEQ ID NO: 130088 - RNA, 64 nt, Homo Sapiens
cuuacaauuauuaauuauuuaaaauuauaaaauuugaugaaauugaauauugugagguguuuau

SEQ ID NO: 130089 - RNA, 64 nt, Homo Sapiens
aaaagacagaaggaaggaagcuuaaugaugcucuugaugaaagaauaacucuuuaaaaagcccu

SEQ ID NO: 130090 - RNA, 64 nt, Homo Sapiens
aaauccaaauaaagcccaccuuauuauuuguauuugaugaaagauuuuaaaaauugagugaggg

SEQ ID NO: 130091 - RNA, 64 nt, Homo Sapiens
ccugcaaagugcucuaaaaaaaucgacuaccagcugaugaaauaaauaaaggacguucaugaga

SEQ ID NO: 130092 - RNA, 64 nt, Homo Sapiens
agcguuacuucugaccgugcugagagguuagccgugaugaaagcugugaauacuucucucagug

SEQ ID NO: 130093 - RNA, 64 nt, Homo Sapiens
uacaugguuuccuuugagaccuuugaccuucucuugaugaaauuuuucaguggcgauauauccc

SEQ ID NO: 130094 - RNA, 64 nt, Homo Sapiens
gagaaaguauuugaagaaacuguugcacaacauaugaugaaauuuugauuucucugaaucucag

SEQ ID NO: 130095 - RNA, 64 nt, Homo Sapiens
ccaacacuuaaucauggcagccaggaugggugaaugaugaaagcucuucugcaugagccgguuu

SEQ ID NO: 130096 - RNA, 64 nt, Homo Sapiens
ucuuacacauaauuuaaauguuaucauacuuuuuugaugaaaacauaaugccuuaguaaaauag

SEQ ID NO: 130097 - RNA, 64 nt, Homo Sapiens
ugucuaauauuuaaacauguacuggcacaauuugugaugaaaauauuagcacauuugcaauaau

SEQ ID NO: 130098 - RNA, 64 nt, Homo Sapiens
auuggccuggcaaaauaaaaauuuaauuggauauugaugaaaucaauguaguugucacacuaaa

SEQ ID NO: 130099 - RNA, 64 nt, Homo Sapiens
gucauaauggugaauguucaaauagauuuuagcaugaugaaacuuuccaaaguguaaguuugug

SEQ ID NO: 130100 - RNA, 64 nt, Homo Sapiens
gcccugugaaagauaggaugcagacagaggcaacugaugaaaaaggagcuggugugacuguuac

SEQ ID NO: 130101 - RNA, 64 nt, Homo Sapiens
cuccgguuacgagacaaagaaaauaaaauucuuuugaugaaacucauauggaugauaaagcugu

SEQ ID NO: 130102 - RNA, 64 nt, Homo Sapiens
agauucaacucuaaguugcaagcgaagucaaaacugaugaaaauuuauuuagaaaaaucuaaaa

SEQ ID NO: 130103 - RNA, 64 nt, Homo Sapiens
gagauaaagcuuacuugacuuucaaauggagagaugaugaaaacccacucauucacucuuucag

SEQ ID NO: 130104 - RNA, 64 nt, Homo Sapiens
caauaaucucucaauaccuuacuuaagucugcucugaugaaaccaaucuaaaaucaaccaggcu

SEQ ID NO: 130105 - RNA, 64 nt, Homo Sapiens
cagucucucaauaccuuccuacuuaaguccgcucugaugaaaccauucuaagaucaaccagguu

SEQ ID NO: 130106 - RNA, 64 nt, Homo Sapiens
gcuuuauaugcaguagaucucauuguuaaugcuuugaugaaaaguguaaucauguuauuuuauu

SEQ ID NO: 130107 - RNA, 64 nt, Homo Sapiens
aauuuuuuuuccuuuaagacacucaguagagggcugaugaaacuaaaaugugccuguuuaaagc

SEQ ID NO: 130108 - RNA, 64 nt, Homo Sapiens
ugugcucgcucucugcguucagaguggagauuuuugaugaaaggguuaccgaggcugugccuag

SEQ ID NO: 130109 - RNA, 64 nt, Homo Sapiens
uccaaccaugaggauggguguaccccucaagauuugaugaaaaucaucccacucagccccuccc

SEQ ID NO: 130110 - RNA, 64 nt, Homo Sapiens
uugaucuuguuuugaaauuguguuuagcaaagagugaugaaaaacaucaaagagcaauaccugu

SEQ ID NO: 130111 - RNA, 64 nt, Homo Sapiens
aaacaaauguaauaugcaucaagauuuauaucuuugaugaaacgcucgcagguuacuaggcauc

SEQ ID NO: 130112 - RNA, 64 nt, Homo Sapiens
uacagagcugaaggacggggggcgguaggggucuugaugaaaccucuugaacgaagcacaguuu

SEQ ID NO: 130113 - RNA, 64 nt, Homo Sapiens
gacggguggcugacaucuguaaagaauccuccugugaugaaacugaggaaucggguggccgggc

SEQ ID NO: 130114 - RNA, 64 nt, Homo Sapiens
aguaccugucaugcagaauucucuaagauggggaugaugaaaaccucagcuucagguucuucac

SEQ ID NO: 130115 - RNA, 64 nt, Homo Sapiens
acacaggguaauaaaccuucggggaacuuuucagugaugaaaaucuuuuauuuuauuagucacc

SEQ ID NO: 130116 - RNA, 64 nt, Homo Sapiens
acuuuaaaaagaaauguaaaggcaccuaaacucuugaugaaagacagcuuaugagggcaauggg

SEQ ID NO: 130117 - RNA, 64 nt, Homo Sapiens
uuguuuuagguaauuuccuuuacuuuuaaucaucugaugaaauuuguaucuuugaccuccauuu

SEQ ID NO: 130118 - RNA, 64 nt, Homo Sapiens
uggcacauguauauuacuaaaguagauaauuccaaugagaaauacuaccagauuauuguuauaa

SEQ ID NO: 130119 - RNA, 64 nt, Homo Sapiens
uagaagcaguguaguucuaccucucauuuuacagaugagaaaaccgaagcccagaaaaacucuc

SEQ ID NO: 130120 - RNA, 64 nt, Homo Sapiens
cuggaugugcuuugaucguuaaugagguggucacaugagaaaugauaccuguuacuacuguauu

SEQ ID NO: 130121 - RNA, 64 nt, Homo Sapiens
auaucuuuuacuacuugaacauuuaaauuucuaaaugagaaagguauauauauuacuguaacug

SEQ ID NO: 130122 - RNA, 64 nt, Homo Sapiens
gguaaguggccuggugaguggagguagaaaaaugaugagaaaugaacugagagcauuaagcaga

SEQ ID NO: 130123 - RNA, 64 nt, Homo Sapiens
cuauuuagggacaaagaagguauaaaguccagagaugagaaaacugggucagcccucagaaacu

SEQ ID NO: 130124 - RNA, 64 nt, Homo Sapiens
auauuuauuagaauaaaaugggaauauuaagaaaaugagaaauucccaaauguuguggaaaacu

SEQ ID NO: 130125 - RNA, 64 nt, Homo Sapiens
cuuuuagaauggauuuauuuguacagaaugcuauaugagaaacaaguuugucacuugagcuuau

SEQ ID NO: 130126 - RNA, 64 nt, Homo Sapiens
uuuuuuuuaaauaaauuauuuaugaaacagauuuaugagaaaagaugauguuauuauauaugcu

SEQ ID NO: 130127 - RNA, 64 nt, Homo Sapiens
gcuuuaguuccaauugacagauuuagguggagaaaugagaaaaauguuauauuuguuuuccugu

SEQ ID NO: 130128 - RNA, 64 nt, Homo Sapiens
gaggcaguguaacaaccuauagugccauugauccaugagaaaaagauuuucugguacuacucca

SEQ ID NO: 130129 - RNA, 64 nt, Homo Sapiens
uaacuuuuaauuuuuauuuuggcaaaacugucaaaugagaaaaaugauuuuaaaaacuuuuuuu

SEQ ID NO: 130130 - RNA, 64 nt, Homo Sapiens
aaaguuuauuuuuaccaaagagaugcaauucauuaugagaaaguauugcauaauaaauuuuguu

SEQ ID NO: 130131 - RNA, 64 nt, Homo Sapiens
uuggggccagaccuuugccugauuccugauucccaugagaaaucagaacugcuuucugcagcaa

SEQ ID NO: 130132 - RNA, 64 nt, Homo Sapiens
auaaaaccuaccucaggguugcuucaaggauuaaaugagaaaauaugucaacaauaaagaccug

SEQ ID NO: 130133 - RNA, 64 nt, Homo Sapiens
ucucagaaacaaccagccuugaaggcuacaacugaugagaaagauucuguuucgaacauagcca

SEQ ID NO: 130134 - RNA, 64 nt, Homo Sapiens
ucugagaaaccaccaggcuugaaggcuacaagugaugagaaagauucuguuuugaauauagcca

SEQ ID NO: 130135 - RNA, 64 nt, Homo Sapiens
ccaagcuauuaaguaccauuuaagacuaguauaaaugagaaaauaauguccuauuucugauuau

SEQ ID NO: 130136 - RNA, 64 nt, Homo Sapiens
ucuuugaaagaaauauggagcucaaacagauaguaugagaaauaccucagagaaauuugauaga

SEQ ID NO: 130137 - RNA, 64 nt, Homo Sapiens
uuugaaauugcauuacaguucauaaaaauugaaaaugagaaauuaaaccugcaagugaaacauu

SEQ ID NO: 130138 - RNA, 64 nt, Homo Sapiens
ccucaguaaaaauagugaagacaugcaucauggaaugagaaaaugagaaaggaaugaguugucu

SEQ ID NO: 130139 - RNA, 64 nt, Homo Sapiens
aaaauagugaagacaugcaucauggaaugagaaaaugagaaaggaaugaguugucuaacaucac

SEQ ID NO: 130140 - RNA, 64 nt, Homo Sapiens
ucaaauccuaaucaggaaaaagacucaucuaguaaugagaaacaaacuauuagucugccaguuu

SEQ ID NO: 130141 - RNA, 64 nt, Homo Sapiens
gauuaauagcagcagcauguucaguuucgcuuauaugagaaacauguuuaggcaacuagucaga

SEQ ID NO: 130142 - RNA, 64 nt, Homo Sapiens
ucucuuacaagaaugaagccauauucaaccccagaugagaaaacccaacagauccaucccuuga

SEQ ID NO: 130143 - RNA, 64 nt, Homo Sapiens
cuucauaauaaauagcaaaauaauugaagcuuccaugagaaagaaaacacuauuuugauaaauu

SEQ ID NO: 130144 - RNA, 64 nt, Homo Sapiens
uggaggcauuucauacacaccaaguauauauaguaugagaaacuaauaauuuccuucuuuaaag

SEQ ID NO: 130145 - RNA, 64 nt, Homo Sapiens
auuuccuucuuuaaagcaagauuuggaaaaugaaaugagaaauagaauuuaggcaauguuucuc

SEQ ID NO: 130146 - RNA, 64 nt, Homo Sapiens
gcaugcacacacacaaaaaauaccuaaauuuuggaugagaaaaugauaaaauaugcuaaguucu

SEQ ID NO: 130147 - RNA, 64 nt, Homo Sapiens
cuggugggaugguaauggggauuagagaacugacaugagaaaagaggagcuguuuugguauuaa

SEQ ID NO: 130148 - RNA, 64 nt, Homo Sapiens
gccuucaauccuggccaaguuggaguagacugguaugagaaaacuaugauuaguucacauuuac

SEQ ID NO: 130149 - RNA, 64 nt, Homo Sapiens
auacuuguacuucuaauaacauuuuucaugaaucaugagaaaauuuccacagauacuucccuua

SEQ ID NO: 130150 - RNA, 64 nt, Homo Sapiens
ggcccuugauucuggcaaggcaaauaaagccagaaugagaaauuaccaucuucuacuagagaaa

SEQ ID NO: 130151 - RNA, 64 nt, Homo Sapiens
acaacuacauguauguguggcauuuuuguuagagaugagaaaaggauugagaaggauaaacugg

SEQ ID NO: 130152 - RNA, 64 nt, Homo Sapiens
ugucgcuguuuaaguagaacaaugccaacgauguaugagaaacagggaauaaaucaggauuugu

SEQ ID NO: 130153 - RNA, 64 nt, Homo Sapiens
aauuucuauuguuuaagucacagccuccaaaacuaugagaaauaacaccuugaucuuggacuuc

SEQ ID NO: 130154 - RNA, 64 nt, Homo Sapiens
aaagauugguccggguuaauuuaaaaaaugauggaugagaaaagucuuuuuuauuugggauaau

SEQ ID NO: 130155 - RNA, 64 nt, Homo Sapiens
ccugaagugaaggcuagagaacaauucuggacuaaugagaaagaagcaaguagcuuacaagggg

SEQ ID NO: 130156 - RNA, 64 nt, Homo Sapiens
aaaucuaugcuggugcagcuagucauaaagaauaaugagaaaaugagauggugagcacaaggua

SEQ ID NO: 130157 - RNA, 64 nt, Homo Sapiens
gugaaaagagccaaguguuauuuaaaacuuaguaaugagaaacuauuaucaguuaggcaauguu

SEQ ID NO: 130158 - RNA, 64 nt, Homo Sapiens
acaaggccugccucugacugccccuugaaggauaaugagaaaccaagaauuaguccaaauggaa

SEQ ID NO: 130159 - RNA, 64 nt, Homo Sapiens
gacagagcucuaauugauaaaugacuccaaguauaugagaaaaguggauugagagagacacuac

SEQ ID NO: 130160 - RNA, 64 nt, Homo Sapiens
auggaagaugguaaacaaucgagauaaauggucaaugagaaagagguuaccaagauuaaaaagu

SEQ ID NO: 130161 - RNA, 64 nt, Homo Sapiens
ggcuuaucagaacuccuuucuaaggagcacuagaaugagaaaucauguuguucgaucguuucac

SEQ ID NO: 130162 - RNA, 64 nt, Homo Sapiens
agccaacuuaaaccugugcuuucauguuuaagaaaugagaaauugugccaaagauagcagaaga

SEQ ID NO: 130163 - RNA, 64 nt, Homo Sapiens
ggguauucaauaauugggugcccuaaauuucuggaugagaaaauuuucaauucuggccaugaga

SEQ ID NO: 130164 - RNA, 64 nt, Homo Sapiens
aaauuucuggaugagaaaauuuucaauucuggccaugagaaagaaaaaaaaauaaacagccuuc

SEQ ID NO: 130165 - RNA, 64 nt, Homo Sapiens
uuuaauacaacagguguccauaauuuuuguuugaaugagaaaaguauuuuacugccuuuccuuu

SEQ ID NO: 130166 - RNA, 64 nt, Homo Sapiens
ccuucuuccuuugcuucaggucccagugaauggaaugagaaaaggaauacuccauccccuuccc

SEQ ID NO: 130167 - RNA, 64 nt, Homo Sapiens
aaaagcacuucuuacauggcggcagcaagagaaaaugagaaagaagcaaaaguggaaaccccua

SEQ ID NO: 130168 - RNA, 64 nt, Homo Sapiens
ucaugcaguugcuuagaauaaucauuacuguuauaugagaaacauuuuaguaauuuaauaaaag

SEQ ID NO: 130169 - RNA, 64 nt, Homo Sapiens
cuuaaaacuugagaauauauuuuaugucuuugagaugagaaaggugauaguacauauugcuuug

SEQ ID NO: 130170 - RNA, 64 nt, Homo Sapiens
aaugguaauuauuucacgcauguauauaacuuuuaugagaaaaaucacugguugggguccauuu

SEQ ID NO: 130171 - RNA, 64 nt, Homo Sapiens
cuucuuuugggggucaacagacucugaguguuuuaugagaaagcugacaacaguuacauaauuc

SEQ ID NO: 130172 - RNA, 64 nt, Homo Sapiens
caaaaauacucagauaagguaagugacuaauggcaugagaaauacauguuucacaaggucuuua

SEQ ID NO: 130173 - RNA, 64 nt, Homo Sapiens
aaugauguuuuguauauuuuaauagacugauaggaugagaaagauuuauauuauuagauuucag

SEQ ID NO: 130174 - RNA, 64 nt, Homo Sapiens
uaauuugaaaaauauugucauaucuggcccuuugaugagaaaaggaaauuacaauaauaaaguu

SEQ ID NO: 130175 - RNA, 64 nt, Homo Sapiens
cugugguuucacuuauuuauuaaaaugcucuaaaaugagaaagcaggccuucuaaaaagcaggu

SEQ ID NO: 130176 - RNA, 64 nt, Homo Sapiens
auuuuguaaaacuuaacaaagaauuccaagaaaaaugagaaauagcuuuguaaaaugaagagua

SEQ ID NO: 130177 - RNA, 64 nt, Homo Sapiens
aaacuucccugugauucccccgaauacccccaaaaugagaaacaaaauuuuuuuucuuacucca

SEQ ID NO: 130178 - RNA, 64 nt, Homo Sapiens
caguaccagcaagucaugagauuuuuuaguaaagaugagaaagaugguugaagaaaauuagugc

SEQ ID NO: 130179 - RNA, 64 nt, Homo Sapiens
guuucuucucuaaggguuuaccagggcagauauuaugagaaacuuuuuaauaaugcacuauuac

SEQ ID NO: 130180 - RNA, 64 nt, Homo Sapiens
ccauacagauaccuuaaaugggaaaaagaucaauaugagaaauauuaucccacuuaugagauug

SEQ ID NO: 130181 - RNA, 64 nt, Homo Sapiens
acaaagcuuucuuuguaucuugaacuaucuaagcaugagaaaauuuauuuaaauauuauguuug

SEQ ID NO: 130182 - RNA, 64 nt, Homo Sapiens
aaaaaguacuuuguaaaguggaaguuccagacagaugagaaagcauugucaugccagauuguca

SEQ ID NO: 130183 - RNA, 64 nt, Homo Sapiens
ugcucuuuuuccaaaaauuaaugagcaacucaagaugagaaaacugauaaaaaauacagacuua

SEQ ID NO: 130184 - RNA, 64 nt, Homo Sapiens
aaggagucaggggccugauaccaaaaaaccauggaugagaaagaagcuguacuugccccccucc

SEQ ID NO: 130185 - RNA, 64 nt, Homo Sapiens
uuucaguaacccagcugcaauaccugucuguaauaugagaaaaaaaaaaugaaucuauuuaauc

SEQ ID NO: 130186 - RNA, 64 nt, Homo Sapiens
cuagcuuacaagggcuagaucuaagauuauucccaugagaaauguugaauuuaugaagaauaga

SEQ ID NO: 130187 - RNA, 64 nt, Homo Sapiens
ugaguuacucugcuacucuuaggcugcauaguuuaugagaaaaugaacacaugcauuuauggau

SEQ ID NO: 130188 - RNA, 64 nt, Homo Sapiens
ugaucucuuucaccuuuauuucaucuucauaagaaugagaaaggcucaaaaggaagcacuuuua

SEQ ID NO: 130189 - RNA, 64 nt, Homo Sapiens
agccccgguaacuggaggaaugggagccguuuugaugagaaaaaugggcuggagagaaggagaa

SEQ ID NO: 130190 - RNA, 64 nt, Homo Sapiens
auaaaauuggcaaccagccacuauuuuguugacuaugagaaaguuaaaaguuuauguuaauuuu

SEQ ID NO: 130191 - RNA, 64 nt, Homo Sapiens
uuuaauuucaaauagaauauggacuuaaauguuaaugagaaaauggcuuuaaucaauucuagca

SEQ ID NO: 130192 - RNA, 64 nt, Homo Sapiens
cuauuggaagauaaacuugucaaacuugucaagaaugagaaaagccaaauuagaaaauccuaug

SEQ ID NO: 130193 - RNA, 64 nt, Homo Sapiens
caacuccauuuguugagggucuuuguguucuucaaugagaaaucaaauuugagacguugaaauu

SEQ ID NO: 130194 - RNA, 64 nt, Homo Sapiens
aucugccuguuauaaagaugaacaaaaaaacuuaaugagaaagaucacagauacguaauaauuu

SEQ ID NO: 130195 - RNA, 64 nt, Homo Sapiens
aguaagaaaaaaaaaaauccaaaaaagaaaaaaaaugagaaaaauugcuaucuauaaaaaagag

SEQ ID NO: 130196 - RNA, 64 nt, Homo Sapiens
auauacuugcuaucuauaaacuucauagaguucuaugagaaaaaauggaaagaaguuauagaau

SEQ ID NO: 130197 - RNA, 63 nt, Homo Sapiens
uacuggccaaguucaagugaguaagccgcgucccccaacuacagcuggagacggggccagcuc

SEQ ID NO: 130198 - RNA, 63 nt, Homo Sapiens
cgugcugacggcaaggggcaauggagugaguuucccaacuaagaaaccacuauuauauauuuu

SEQ ID NO: 130199 - RNA, 63 nt, Homo Sapiens
accagcacagaacugaggaacaucugcaggaggcccaacuagugaaaggcuuugccuccgggg

SEQ ID NO: 130200 - RNA, 63 nt, Homo Sapiens
uguggcagcccauggguaugacauaggccaaggcccaacuaacagucaagaaacagcuccucg

SEQ ID NO: 130201 - RNA, 63 nt, Homo Sapiens
aucuuuuuaaucauaaucaacaucaguuuuugacccaacuaaccuugacuguauucaaacuua

SEQ ID NO: 130202 - RNA, 63 nt, Homo Sapiens
uacuuauuguuuuuagaauuacuuuuacauuuucccaacuagauggccuagaguccaacauua

SEQ ID NO: 130203 - RNA, 63 nt, Homo Sapiens
aauuagcugggcaugguggccugugccuauagucccaacuacuuagaggaggaucgcuugauc

SEQ ID NO: 130204 - RNA, 63 nt, Homo Sapiens
gcauuuaaaaggaauaaccuccuucucccuuuccccaacuacaaaaauguuuggcaacuuugu

SEQ ID NO: 130205 - RNA, 63 nt, Homo Sapiens
aauuagcuggacaugguggcaaucagcucuagucccaacuacuuggaggcugaagcaggaaga

SEQ ID NO: 130206 - RNA, 63 nt, Homo Sapiens
aggaaccucuguuuucaagaacacuaccccacccccaacuagggggaaguuuauaauagccua

SEQ ID NO: 130207 - RNA, 63 nt, Homo Sapiens
auucagucaguauguuuguuuacugcaaauagucccaacuaagcucucaaaaauaaucuuaaa

SEQ ID NO: 130208 - RNA, 63 nt, Homo Sapiens
cuggagcccccgaaggaugguucucugaucucccccaacuagaccuagaguggcaaauggaac

SEQ ID NO: 130209 - RNA, 63 nt, Homo Sapiens
agggacagugaggcagaaggaugugccuguaaucccaacuacuauuuagcugggcaugguggc

SEQ ID NO: 130210 - RNA, 63 nt, Homo Sapiens
ugggacuacaggcacgugccccugccucagucucccaacuaagcuccagggcucaaggauccu

SEQ ID NO: 130211 - RNA, 63 nt, Homo Sapiens
cugauuugaucuuuacaaauaggugacagauaucccaacuacgaaagaaaagacgaauauuua

SEQ ID NO: 130212 - RNA, 63 nt, Homo Sapiens
uuuuguauuuuuaguagagagugccuggccacgcccaacuaaugauuacaggcgugagccacc

SEQ ID NO: 130213 - RNA, 63 nt, Homo Sapiens
uucuaagugccaucaaagcaugugauuucuguucccaacuagggauuucuaaaauauucuaug

SEQ ID NO: 130214 - RNA, 63 nt, Homo Sapiens
caugccaagggguuaaugaaaaaugagaaaauccccaacuaugauuuaaccccuugguacuga

SEQ ID NO: 130215 - RNA, 63 nt, Homo Sapiens
cauuucauuuaagauaaggcucauauaguauuacccaacuaguugguaaugugauuauguggu

SEQ ID NO: 130216 - RNA, 55 nt, Homo Sapiens
uuacaggaagugaagaaugagauggcccaacuaaaccaauuuggaaucauuaacu

SEQ ID NO: 130217 - RNA, 63 nt, Homo Sapiens
uuuuuaaaaaggaucacgucuaaugcccauuuucccaacuauucuuuccaaaguaagauauaa

SEQ ID NO: 130218 - RNA, 63 nt, Homo Sapiens
aauuagcugggcaugguggcauauaccuguaaccccaacuacuuggguggcugaggcaggaga

SEQ ID NO: 130219 - RNA, 63 nt, Homo Sapiens
uuuuguguuuuuaauaaagacaugugccacccacccaacuaaucugaguagcuggauuacagg

SEQ ID NO: 130220 - RNA, 63 nt, Homo Sapiens
aaaaucuucuugcgucaaucgauugaccacauucccaacuagaguuuagaaagaggaacacca

SEQ ID NO: 130221 - RNA, 63 nt, Homo Sapiens
cagaaggccgaggcaggagaauaugccuguaaucccaacuacuaauuagccaagugugguggc

SEQ ID NO: 130222 - RNA, 63 nt, Homo Sapiens
caaccccaccauggccaggaccggagcaacuuucccaacuaccagcuuuggaagcugucaauc

SEQ ID NO: 130223 - RNA, 63 nt, Homo Sapiens
gacacaggagcuccuccaggagcaggcugggaucccaacuaucgcuuguugccucuuuuucaa

SEQ ID NO: 130224 - RNA, 63 nt, Homo Sapiens
aauuagccaggugugguggcgggcgccuguaaucccaacuacucaggaggcugaggcuagaga

SEQ ID NO: 130225 - RNA, 63 nt, Homo Sapiens
cacccacaccuaagucacagaauuucuaaguuccccaacuacucucacacccuuuuaaagaua

SEQ ID NO: 130226 - RNA, 63 nt, Homo Sapiens
ccccugcacacucccacccaggacagcccccagcccaacuaggaaagggccaugggcagaggg

SEQ ID NO: 130227 - RNA, 63 nt, Homo Sapiens
agagcaugguccuucagaaaaggcaauaaacggcccaacuagugcuucuggcgaugacauuuc

SEQ ID NO: 130228 - RNA, 63 nt, Homo Sapiens
gggcagcagcgcccccacggggcucgcugggcgcccaacuacgacccgcucugcucacucugc

SEQ ID NO: 130229 - RNA, 63 nt, Homo Sapiens
guuugcaaccccaaaccacauacaaaaaauugccccaacuacagguccaggaccagaccucuc

SEQ ID NO: 130230 - RNA, 63 nt, Homo Sapiens
ggguccuagcugggggccugaucaugccacggucccaacuacauggugggcccagguccuugu

SEQ ID NO: 130231 - RNA, 63 nt, Homo Sapiens
cacuugauuauguauuucagaaggcaucauccucccaacuaccuucauuucagggcauaguca

SEQ ID NO: 130232 - RNA, 63 nt, Homo Sapiens
agccuagugugugugcuuucagauuuuaauuagcccaacuagaaaccaccuuuccagccauag

SEQ ID NO: 130233 - RNA, 63 nt, Homo Sapiens
gucucgagugccugcaguggccgggaagaaaggcccaacuacccugcaguucuacaggcuaca

SEQ ID NO: 130234 - RNA, 63 nt, Homo Sapiens
ugaguauauauuuuaucucuuauaccuguaucucccaacuagaaacagcuccaguguuuuuaa

SEQ ID NO: 130235 - RNA, 63 nt, Homo Sapiens
agugaugcccuucaccccagggaggugucuguucccaacuaguuuauguggcacugagacauc

SEQ ID NO: 130236 - RNA, 63 nt, Homo Sapiens
aggguaucgcauacucaaaugguagacaaugaccccaacuaaaucuuccugauguuacacugc

SEQ ID NO: 130237 - RNA, 63 nt, Homo Sapiens
gcaaucauaaaacccuaguucuuauggcaaugucccaacuauucagccaaauagcuuauaagg

SEQ ID NO: 130238 - RNA, 63 nt, Homo Sapiens
auuguagaguggucuauuucggguguugaagaccccaacuacugugauuaauuauugaaagug

SEQ ID NO: 130239 - RNA, 63 nt, Homo Sapiens
gcaugaagaaauucuacuuccucucuucuccuucccaacuacuguuaggaagugauaaaacau

SEQ ID NO: 130240 - RNA, 63 nt, Homo Sapiens
auucucuucuccacacuuaagaagauccaaauucccaacuaguuaacauuccuucaaccacuu

SEQ ID NO: 130241 - RNA, 63 nt, Homo Sapiens
gucaucgugagguuuucaucccauuuccagugucccaacuacuugcgccucuggacgugcuag

SEQ ID NO: 130242 - RNA, 63 nt, Homo Sapiens
aauuagcugggcgugguggcgcaugccuguagucccaacuacuagggaggcugaggcaggaga

SEQ ID NO: 130243 - RNA, 63 nt, Homo Sapiens
auccagugaccucucucucugggacuugguuuccccaacuaaaauuugaaguaguugaauggg

SEQ ID NO: 130244 - RNA, 63 nt, Homo Sapiens
uuuuuccuuuuagccaucuuuuguucuuguaaucccaacuagauaggcuuuaugcucacauca

SEQ ID NO: 130245 - RNA, 63 nt, Homo Sapiens
uuuauuuuuuauuuuuugcaaugcaccaccauacccaacuaauaaguaacuaagacuacaggc

SEQ ID NO: 130246 - RNA, 63 nt, Homo Sapiens
aauagccaggggcuacaggcauauaccaccaugcccaacuaauuuuuuaauuuuuuguagaga

SEQ ID NO: 130247 - RNA, 63 nt, Homo Sapiens
aucacguugacauuagaccaaauacuuuugauucccaacuacucguuuguucuuuuucuccuu

SEQ ID NO: 130248 - RNA, 63 nt, Homo Sapiens
gcauuuaguugaaugaagucuucuuggauuucacccaacuaaaaggauuuuuaaaaauaaaua

SEQ ID NO: 130249 - RNA, 63 nt, Homo Sapiens
aauaagccaggugugguggugcaugacuguaaucccaacuacucagcaggagaagcacuugaa

SEQ ID NO: 130250 - RNA, 63 nt, Homo Sapiens
uuuuuuuuuugagacggagucccacucuugucgcccaacuagaguguaguggcacaaucucgg

SEQ ID NO: 130251 - RNA, 63 nt, Homo Sapiens
cugugagcuccuccucugagcagaguccauugccccaacuagaccuuaacugucccaucugug

SEQ ID NO: 130252 - RNA, 63 nt, Homo Sapiens
aaggauuugucccaggccaaaauaguccguauccccaacuauuugccugguacugguggggga

SEQ ID NO: 130253 - RNA, 63 nt, Homo Sapiens
aaaaaaaaaauaaagaaaaacucgauucucguacccaacuaaaggguuuuguucccccuccau

SEQ ID NO: 130254 - RNA, 63 nt, Homo Sapiens
cccaccaugaagagaaagcaaacaaacagaaaccccaacuaggucacaccauuuuucuucuug

SEQ ID NO: 130255 - RNA, 63 nt, Homo Sapiens
cuccucuucuugaaggccaaccuggagcaguuccccaacuacaccccgccuccccucaucugc

SEQ ID NO: 130256 - RNA, 63 nt, Homo Sapiens
aaguaaaaaugaaaaagacgaauuuaguuaccucccaacuaaaaugauaucaaaagaauaauc

SEQ ID NO: 130257 - RNA, 63 nt, Homo Sapiens
guuacugguuauagaggucuuuccuucuuuucucccaacuacucagaaaacucaguuucuuua

SEQ ID NO: 130258 - RNA, 63 nt, Homo Sapiens
gaugugaaaaaggacuauggccacauucaaucgcccaacuacccagacgauuaccggcccagc

SEQ ID NO: 130259 - RNA, 63 nt, Homo Sapiens
gagaagaaaacaucuauucucuccaaaaaugcacccaacuagcucuauguuuacaaauggaca

SEQ ID NO: 130260 - RNA, 63 nt, Homo Sapiens
ccaggaccccaaugcgacaauccauuuugcaaacccaacuaagauuaaaguuuguguguugug

SEQ ID NO: 130261 - RNA, 63 nt, Homo Sapiens
cacacacgcccacaugacaaucaucugaaaguccccaacuauacacauucuguucaaccaacu

SEQ ID NO: 130262 - RNA, 63 nt, Homo Sapiens
uuugcauuaaauuacagaaauuuaauucagaaccccaacuacuguguuaugcaaaagcaagcu

SEQ ID NO: 130263 - RNA, 63 nt, Homo Sapiens
gucucugaagacaaauaauuaaaccuuuuuuuucccaacuaaagaauggauuuaauuaaacua

SEQ ID NO: 130264 - RNA, 63 nt, Homo Sapiens
gccaggauugauggcagcugagggaaauucuugcccaacuaaacccagaacucaaacuuaaca

SEQ ID NO: 130265 - RNA, 63 nt, Homo Sapiens
cagucacugugcuauccuuguggagucuuguggcccaacuaccagagaacgcugucccccgac

SEQ ID NO: 130266 - RNA, 63 nt, Homo Sapiens
cagccuagcacaggcuggcaggcagggcguggucccaacuacugugacugauucccagccugu

SEQ ID NO: 130267 - RNA, 63 nt, Homo Sapiens
agaggagaaaauuaauaaaucuuaaacuuggugcccaacuauuguaagaaauauuuaauuaca

SEQ ID NO: 130268 - RNA, 63 nt, Homo Sapiens
cccuuagguagaaagauuugcuuauuccaagaacccaacuaugccgacuucuccuauguguca

SEQ ID NO: 130269 - RNA, 63 nt, Homo Sapiens
cggaaggcugaggcaggagagcgugccuguagucccaacuacuaauuagccaggcgugacggu

SEQ ID NO: 130270 - RNA, 63 nt, Homo Sapiens
gaauccaggaguaccaaauaaaacuuuuuuuaccccaacuacuguagauauguuugaauauag

SEQ ID NO: 130271 - RNA, 63 nt, Homo Sapiens
cuggaagcugaagcagcaagacaccuggccaaucccaacuacuggauuacagcgugaucuacc

SEQ ID NO: 130272 - RNA, 63 nt, Homo Sapiens
cccagcugugcuuaugguacuggaaagcagucccccaacuacccuuucugaucaaggccuuau

SEQ ID NO: 130273 - RNA, 63 nt, Homo Sapiens
acugacccugccuugggccuugcugcugcugcacccaacuacugagcugagaccacugaguac

SEQ ID NO: 130274 - RNA, 63 nt, Homo Sapiens
aaguagcugggauuacaggcacccaccaccaugcccaacuaauuuuuguauuuuuauagagau

SEQ ID NO: 130275 - RNA, 63 nt, Homo Sapiens
aggccagccccaucuugguccugucacccuggccccaacuauuaaagugccauuuccugucug

SEQ ID NO: 130276 - RNA, 63 nt, Homo Sapiens
acacuuaggacuagaagauuagaaacuaccaaucccaacuacguaauaggaaaauguaggauc

SEQ ID NO: 130277 - RNA, 63 nt, Homo Sapiens
accugcauuucccacaugacuuucuggaagccucccaacuauucuugcuuuucccagacagcu

SEQ ID NO: 130278 - RNA, 63 nt, Homo Sapiens
cuggaaaucccugcccuguucagccccacagcucccaacuauuugguuccugcuccauggucg

SEQ ID NO: 130279 - RNA, 63 nt, Homo Sapiens
cucagcugccuccccagcucuaucccaaccucucccaacuauaaaacuaggugcugcagcccc

SEQ ID NO: 130280 - RNA, 63 nt, Homo Sapiens
aaaaagcuauuuucauugguacauuuaaagucccccaacuauggggagguaccaauucuggac

SEQ ID NO: 130281 - RNA, 63 nt, Homo Sapiens
uuggacuucucugcuuuaucagagugagaauuccccaacuaaaccucauccggggcuuuggau

SEQ ID NO: 130282 - RNA, 62 nt, Homo Sapiens
accucuuuucaggcacagacuggcggccccaccccaacuaccacccagcaauugagguguga

SEQ ID NO: 130283 - RNA, 63 nt, Homo Sapiens
uaugcacuuucuugguuguguuggaggggaaaacccaacuacauguucuugcgcuuugugcac

SEQ ID NO: 130284 - RNA, 63 nt, Homo Sapiens
ucagauauacaugucuagauguuacagcaaagccccaacuaaucuuuagaagcauauuggaac

SEQ ID NO: 130285 - RNA, 63 nt, Homo Sapiens
auagcuuacauuuccucuuuuugccuuuaucuccccaacuaaaauacaauggggaagaagucu

SEQ ID NO: 130286 - RNA, 63 nt, Homo Sapiens
accuccuccaccugcuucaaccugcucaagcugcccaacuacagcaagaagagcguccuccgc

SEQ ID NO: 130287 - RNA, 63 nt, Homo Sapiens
gccucucaccucugugccucugucuccuuguugcccaacuacuaucucagagauauugugagg

SEQ ID NO: 130288 - RNA, 63 nt, Homo Sapiens
gcauagauuccccaaagugaggcaagaauaugccccaacuaaaaaaugcagagaugaggcuaa

SEQ ID NO: 130289 - RNA, 63 nt, Homo Sapiens
cuguaagugccuugcggucauugugucucccuucccaacuagacaccauacuuucuuguacau

SEQ ID NO: 130290 - RNA, 63 nt, Homo Sapiens
ggaccgauuuggacuugucuaccuugcuccuuccccaacuagggcuagaaacucucaguccaa

SEQ ID NO: 130291 - RNA, 63 nt, Homo Sapiens
aauaaagaauaggcuauaagcguccuuuggcaucccaacuaacacuuccaaaggucaauaugu

SEQ ID NO: 130292 - RNA, 63 nt, Homo Sapiens
aauaaagaguaggcuauaagcauccuuuggcaucccaacuaacacuucuaaaggucaauauau

SEQ ID NO: 130293 - RNA, 63 nt, Homo Sapiens
cccuaaugaagggccuggagggccaaacagaaacccaacuacccuauggggcccagggggaaa

SEQ ID NO: 130294 - RNA, 63 nt, Homo Sapiens
ugggaggcugaggcgggagagcacgcuuguagucccaacuaccaauuauccuggcggaguuau

SEQ ID NO: 130295 - RNA, 63 nt, Homo Sapiens
uuuauuaaaaugugugaaaccucugaaguuaaacccaacuaugaguaaacacaauugaagccu

SEQ ID NO: 130296 - RNA, 63 nt, Homo Sapiens
auugccgaguucuuauuuucaccuuuucauaaucccaacuacaauaacaagaauuuuauugac

SEQ ID NO: 130297 - RNA, 63 nt, Homo Sapiens
gugcuugaggcuaccucuaccuuguuuaacaaacccaacuaaauguaguuuccgcuuugcuug

SEQ ID NO: 130298 - RNA, 63 nt, Homo Sapiens
guguuucugguuacuaacagccccuuacugaugcccaacuaauggaaccauuccuuuauguug

SEQ ID NO: 130299 - RNA, 63 nt, Homo Sapiens
aaaauauauagagcauuuuaugaaacaaaaugucccaacuaagaacauaaccaaaaauuaaau

SEQ ID NO: 130300 - RNA, 63 nt, Homo Sapiens
guuaaguagcagagccagaauggacuucagaaucccaacuacaauacaaauguuuauuuaaau

SEQ ID NO: 130301 - RNA, 63 nt, Homo Sapiens
aaaauuuaccuccuuugcaggccauaggacuagcccaacuaugagaaauagcuguucugugaa

SEQ ID NO: 130302 - RNA, 63 nt, Homo Sapiens
aaaagccaggcauugguggugugugccuauagucccaacuacuagggaggcugaggugggagg

SEQ ID NO: 130303 - RNA, 63 nt, Homo Sapiens
cuaauuugcuuuggugggguccuuaaaacauuucccaacuaaagaauagaauuguaaaggaaa

SEQ ID NO: 130304 - RNA, 63 nt, Homo Sapiens
aaccucuauccuggaaccuguccucccuuucuccccaacuaugcaucuguugucugcuccucu

SEQ ID NO: 130305 - RNA, 63 nt, Homo Sapiens
ugggacuacagguacaccacucugccucagccucccaacuagcuccuggguucaagugauucu

SEQ ID NO: 130306 - RNA, 63 nt, Homo Sapiens
ugcuuguuggccacgggaaggauaucacugguucccaacuagauauuuaguguguucagugau

SEQ ID NO: 130307 - RNA, 63 nt, Homo Sapiens
uugagaaguggaaaaaaaccauguuuccauguucccaacuaugugggaauuguguggguauua

SEQ ID NO: 130308 - RNA, 63 nt, Homo Sapiens
gaagagaggcuaacuagcaacaagacaacauuacccaacuauaagagauggcaaacacagugg

SEQ ID NO: 130309 - RNA, 63 nt, Homo Sapiens
caagugucucuugacuggcucaagaauuagggccccaacuacacacccccaagccacagggaa

SEQ ID NO: 130310 - RNA, 63 nt, Homo Sapiens
cgcuggcuccuucuagacauuucuugccacuuccccaacuagaccacuccuagugauuacuga

SEQ ID NO: 130311 - RNA, 63 nt, Homo Sapiens
uucugugauaaaaugaauucaccacucugguuacccaacuacagaaccuccuuugaucaggcc

SEQ ID NO: 130312 - RNA, 63 nt, Homo Sapiens
uuauugcuuuaaacaaguuugugcuuaaucugucccaacuaaaauggagcuuauaaacuuacu

SEQ ID NO: 130313 - RNA, 63 nt, Homo Sapiens
ugggaggcugaggcaggagaaaacgccuguaaucccaacuacuaauuagccaggcaugguggc

SEQ ID NO: 130314 - RNA, 63 nt, Homo Sapiens
guugggaucagccuccugucuguggguaucugccccaacuacuacuuucccagcccuuugguu

SEQ ID NO: 130315 - RNA, 63 nt, Homo Sapiens
cuauuggagacaauccuuugaucauaaauucuccccaacuauaaaucauuuuaugucuuuauc

SEQ ID NO: 130316 - RNA, 63 nt, Homo Sapiens
gucuuuugcccaccccccuggcauucagcuggacccaacuaggccaucaugaguggcuucucc

SEQ ID NO: 130317 - RNA, 63 nt, Homo Sapiens
aaguagcugggacuacaggcacacgccaccacacccaacuaauuuuuguauuuuuaguagaga

SEQ ID NO: 130318 - RNA, 63 nt, Homo Sapiens
ugugacaaaugguugaaaaggagucaacauggccccaacuauagugccggaaccuuuucauca

SEQ ID NO: 130319 - RNA, 63 nt, Homo Sapiens
cggcaggcugaggcaguagagcacaccuguagucccaacuauuaauuagccagaugugguggu

SEQ ID NO: 130320 - RNA, 63 nt, Homo Sapiens
gccuagaagagcuucugaggaacaaaaagcuuccccaacuaaagacuccgucacaacaacaac

SEQ ID NO: 130321 - RNA, 63 nt, Homo Sapiens
ccagacuguccugcucacccagccuguagccuccccaacuacucagccaagaaacucacccaa

SEQ ID NO: 130322 - RNA, 63 nt, Homo Sapiens
cccaccccaaucccaccuucacugagcccccuacccaacuaccuggaggaaaaaugacuaagg

SEQ ID NO: 130323 - RNA, 63 nt, Homo Sapiens
gauaggaaggaaaaugaagagccucaugacaggcccaacuagguuggcaggacauggaauuug

SEQ ID NO: 130324 - RNA, 63 nt, Homo Sapiens
accaaugaaaacaccauuccauuaaccucuucccccaacuaaccaggcccuggcucuguaacc

SEQ ID NO: 130325 - RNA, 63 nt, Homo Sapiens
ggguguggcuuuuuuucucuccuuuuuaccaaccccaacuaaacugggaguaagacuuaguca

SEQ ID NO: 130326 - RNA, 63 nt, Homo Sapiens
aaaucuugcagagguagcuccgaaaccaucuggcccaacuagccucaacugacagcugaggaa

SEQ ID NO: 130327 - RNA, 63 nt, Homo Sapiens
aaguagccgggcgugguggugggcgccuguagucccaacuacucaggaggcugaggcaggaga

SEQ ID NO: 130328 - RNA, 63 nt, Homo Sapiens
cacauccaccuccauccccaacccauccucauccccaacuacagccccaaacccagccccaga

SEQ ID NO: 130329 - RNA, 63 nt, Homo Sapiens
ucuuaaaggaagcaggggcuggaugccuuucaucccaacuauucucugugguaucaaaaagaa

SEQ ID NO: 130330 - RNA, 63 nt, Homo Sapiens
ggccugggacccccgcccagcugcccagggcuccccaacuauagagcagccagcccucugccc

SEQ ID NO: 130331 - RNA, 63 nt, Homo Sapiens
uuuuauauuuuuaguagagaacaugccaccacgcccaacuaauuaguagcuggcauuacaggc

SEQ ID NO: 130332 - RNA, 63 nt, Homo Sapiens
cgggccugacccggccccuauuccccaccuucccccaacuaccccuuuccccucuucccuguc

SEQ ID NO: 130333 - RNA, 63 nt, Homo Sapiens
cccauaacuuucugcuucccgccccuaggaugacccaacuacccagugccacccacuccuugg

SEQ ID NO: 130334 - RNA, 63 nt, Homo Sapiens
guuauggucaaucccaaaagucaccacuccauucccaacuagacauuaccaaagugaccuacc

SEQ ID NO: 130335 - RNA, 63 nt, Homo Sapiens
gaguagcugggauuacaggcaugcgccaccacgcccaacuaauuuuguauuuuuaguagagac

SEQ ID NO: 130336 - RNA, 63 nt, Homo Sapiens
ccugagucaggcgugguggugcgugcaucuagucccaacuauuugggaggcugaggcaggagg

SEQ ID NO: 130337 - RNA, 63 nt, Homo Sapiens
aucagggguguuucaugggaggucuauaaaucacccaacuaagugaucaccaccaacaucaua

SEQ ID NO: 130338 - RNA, 63 nt, Homo Sapiens
uaucagauaagauucuuugauuucccgugcucccccaacuaugauauccucucuugccagcuu

SEQ ID NO: 130339 - RNA, 63 nt, Homo Sapiens
aauggaacccuugauuuccuaccucaguguacacccaacuauugguuguaucaguuuguguau

SEQ ID NO: 130340 - RNA, 59 nt, Homo Sapiens
uaucuacagaugcauuccauacacgcauucccaacuauaucacagagccaagugacuga

SEQ ID NO: 130341 - RNA, 63 nt, Homo Sapiens
uuuuguauuuuuaguagagagcccgccaccacacccaacuaaucaguagcugggaccacaggu

SEQ ID NO: 130342 - RNA, 63 nt, Homo Sapiens
caaucuggaacaaugucccuccucuuagaaugucccaacuaaagaccaguuaaaauauuaggg

SEQ ID NO: 130343 - RNA, 63 nt, Homo Sapiens
guuucuuugcuuuuuguuuuucaggcuuucccccccaacuaugacaucacauuuuggugucuc

SEQ ID NO: 130344 - RNA, 63 nt, Homo Sapiens
gucugccaagaucuuucuuuugaauguuuugaacccaacuacuugucauagauguuugacugu

SEQ ID NO: 130345 - RNA, 63 nt, Homo Sapiens
agcccaggguucccauuuggcuucuggcaguggcccaacuagccaagucugguguucccucau

SEQ ID NO: 130346 - RNA, 63 nt, Homo Sapiens
cuggagggaugccacaccccucacagggcagcccccaacuacaucuucccugcuuacucucug

SEQ ID NO: 130347 - RNA, 63 nt, Homo Sapiens
uugccagauuguggucuauguuugaucuguguccccaacuagacagggaguucucugaggaca

SEQ ID NO: 130348 - RNA, 63 nt, Homo Sapiens
uagaugucagucucguuaccagcagccuuuugacccaacuacggcgcucuauauuuuaguaga

SEQ ID NO: 130349 - RNA, 63 nt, Homo Sapiens
gagcauguuuaaaucuuugccaaaugaaaaaaucccaacuauuauucacaaaacuucuugcuu

SEQ ID NO: 130350 - RNA, 63 nt, Homo Sapiens
gcgcucuauauuuuaguagaagcagccuuuugacccaacuacauagaugucaaucucguuacc

SEQ ID NO: 130351 - RNA, 63 nt, Homo Sapiens
gugcucugucuuuuaguagaagcagacuuuugacccaacuacauaggugucacucuuguuacc

SEQ ID NO: 130352 - RNA, 63 nt, Homo Sapiens
uuuaccgaaccuaaaacccacagccauuaagaucccaacuaaucugucucuuccugcuuuaga

SEQ ID NO: 130353 - RNA, 63 nt, Homo Sapiens
cugugugguaacagaaagcuucuuaccaauuuccccaacuauguugcacaucagccucauuuu

SEQ ID NO: 130354 - RNA, 64 nt, Homo Sapiens; identical to SEQ ID NO: 76226

SEQ ID NO: 130355 - RNA, 64 nt, Homo Sapiens; identical to SEQ ID NO: 76227

SEQ ID NO: 130356 - RNA, 64 nt, Homo Sapiens; identical to SEQ ID NO: 76228

SEQ ID NO: 130357 - RNA, 64 nt, Homo Sapiens; identical to SEQ ID NO: 76229

SEQ ID NO: 130358 - RNA, 64 nt, Homo Sapiens; identical to SEQ ID NO: 76230

SEQ ID NO: 130359 - RNA, 64 nt, Homo Sapiens; identical to SEQ ID NO: 76231

SEQ ID NO: 130360 - RNA, 64 nt, Homo Sapiens; identical to SEQ ID NO: 76232

SEQ ID NO: 130361 - RNA, 64 nt, Homo Sapiens; identical to SEQ ID NO: 76233

SEQ ID NO: 130362 - RNA, 64 nt, Homo Sapiens; identical to SEQ ID NO: 76234

SEQ ID NO: 130363 - RNA, 64 nt, Homo Sapiens; identical to SEQ ID NO: 76235

SEQ ID NO: 130364 - RNA, 64 nt, Homo Sapiens; identical to SEQ ID NO: 76236

SEQ ID NO: 130365 - RNA, 64 nt, Homo Sapiens; identical to SEQ ID NO: 76237

SEQ ID NO: 130366 - RNA, 64 nt, Homo Sapiens; identical to SEQ ID NO: 76238

SEQ ID NO: 130367 - RNA, 64 nt, Homo Sapiens; identical to SEQ ID NO: 76239

SEQ ID NO: 130368 - RNA, 64 nt, Homo Sapiens; identical to SEQ ID NO: 76240

SEQ ID NO: 130369 - RNA, 64 nt, Homo Sapiens; identical to SEQ ID NO: 76241

SEQ ID NO: 130370 - RNA, 64 nt, Homo Sapiens; identical to SEQ ID NO: 76242

SEQ ID NO: 130371 - RNA, 64 nt, Homo Sapiens; identical to SEQ ID NO: 76243

SEQ ID NO: 130372 - RNA, 64 nt, Homo Sapiens
caaaacacaccaaaaccuagguuuauucacuaaaguagcugacagcugaguuccuuuauguuuc

SEQ ID NO: 130373 - RNA, 64 nt, Homo Sapiens
uccuuuauguuucguuuauuucucaugaauucaaguagcugaguugcuuuuuuugaaagcugau

SEQ ID NO: 130374 - RNA, 64 nt, Homo Sapiens
ggcuucaagcaauccuccugugucagccaccagaguagcugagacuacagggguaugccaccau

SEQ ID NO: 130375 - RNA, 64 nt, Homo Sapiens
gggcucaagugauccucccaccucagccuccugaguagcugagaccacaggcgugugccaccac

SEQ ID NO: 130376 - RNA, 64 nt, Homo Sapiens
gggcuaaggaaguaucagcaacucagacgugugaccuccauacuccaggaccucggaugaccau

SEQ ID NO: 130377 - RNA, 64 nt, Homo Sapiens
gacacccuuucuguuuggacacuuccaaagacucccuccauagcgugccgaggacaugcaugac

SEQ ID NO: 130378 - RNA, 64 nt, Homo Sapiens
auuuucugcuaaaggagugaaucucauccuaacaccuccauaauaacugguugcugucagguuu

SEQ ID NO: 130379 - RNA, 64 nt, Homo Sapiens
gguccccuauccuuaaauaauaagccaaccaugcccuccauagauugcccacccugaaggugga

SEQ ID NO: 130380 - RNA, 64 nt, Homo Sapiens
cugcagacauucucaaagccucuuauuuuucuagcgaacguauuucuccagacccagaggcccu

SEQ ID NO: 130381 - RNA, 64 nt, Homo Sapiens
uaauuuggccuuuucagcuuaaaguagacuccuucgaacguauuuuuuaaaucucugcaacucc

SEQ ID NO: 130382 - RNA, 64 nt, Homo Sapiens
cagaggccccaucagcacagagggccucguuccacgaacguagaguuugacugccuaagggaca

SEQ ID NO: 130383 - RNA, 64 nt, Homo Sapiens
uaagucucuuuguauccuuaacaaaauaacaaaagacaggaaaaauucagaacaaaauaaguag

SEQ ID NO: 130384 - RNA, 64 nt, Homo Sapiens
uguaacugagcacaaaguacuaaguaaaugagaugacaggaagcuuaguugagcuauuuaugua

SEQ ID NO: 130385 - RNA, 64 nt, Homo Sapiens
ucaguucaguaccauaacuauucuaguuuuggcugacaggaagcaggugguggucauguuuccc

SEQ ID NO: 130386 - RNA, 64 nt, Homo Sapiens
ucccugccugguacuggugguaggggaaagguaggacaggaaugaguuuggaccuugccuccuu

SEQ ID NO: 130387 - RNA, 64 nt, Homo Sapiens
cccucacagugggcgacagagaggcaaugggugagacaggaaucguccaaaaagcacccacaga

SEQ ID NO: 130388 - RNA, 64 nt, Homo Sapiens
gcucuguggcuaaaacaaguuucccgauugugcugacaggaaguaguaaguacagcauaguagu

SEQ ID NO: 130389 - RNA, 64 nt, Homo Sapiens
gccuuuggccgccuuggguagucaaggcucuggagacaggaaggauggggggauuucugguuau

SEQ ID NO: 130390 - RNA, 64 nt, Homo Sapiens
ggcaccugcuucugaguccaacccuucgccuugggacaggaaugggcaggaagcggccuccaag

SEQ ID NO: 130391 - RNA, 64 nt, Homo Sapiens
augucccccccuaacuuucuuccauuuuucccaggacaggaaauuucuuaauaucacuuugguc

SEQ ID NO: 130392 - RNA, 64 nt, Homo Sapiens
cuggagacuguccacuucuauaacuacagagucugacaggaagaggcugacugggaacacccca

SEQ ID NO: 130393 - RNA, 64 nt, Homo Sapiens
gcucacucggggagcucggcgagcccuuaaaagggacaggaauuguggacccccuuagaguugu

SEQ ID NO: 130394 - RNA, 64 nt, Homo Sapiens
cgcauguguguauauaugugagaagugaacgccagacaggaacaccuccaaucucuguagcccc

SEQ ID NO: 130395 - RNA, 64 nt, Homo Sapiens
aacuguauuaccugcuuugccuugaauucugcaggacaggaaauacaggaacugcauaaagguu

SEQ ID NO: 130396 - RNA, 64 nt, Homo Sapiens
gcauaaagguucuugaauucucuuuaaaucauaggacaggaacugaguagcggagucacugacc

SEQ ID NO: 130397 - RNA, 62 nt, Homo Sapiens
ccuuggcacuguggaacugcuucucuugaaggugcugccaccaggcaucuuucugaauuuca

SEQ ID NO: 130398 - RNA, 62 nt, Homo Sapiens
cccaccaucggguguagguggaaugcugacaaugcugccaugacuuccugccccaacugcag

SEQ ID NO: 130399 - RNA, 62 nt, Homo Sapiens
cugugcugcugaggugcguaaauguggcucucugcugccaccguuucuguugcugccaaagu

SEQ ID NO: 130400 - RNA, 62 nt, Homo Sapiens
guaauguggcucucugcugcgccaguuucuguugcugccaaaauggggcugccgggcuggcc

SEQ ID NO: 130401 - RNA, 62 nt, Homo Sapiens
ucccagcggggcucccugagcucucaaggagaugcugccaucacugggaggcucagaggacc

SEQ ID NO: 130402 - RNA, 62 nt, Homo Sapiens
uuuaaugagcgugggccuggaccuuccccagaugcugccaggcagccccuccccaagccuca

SEQ ID NO: 130403 - RNA, 62 nt, Homo Sapiens
ugccugcugcucccuuuuucugucucuguccaugcugccauguuucucugcugccaaauugg

SEQ ID NO: 130404 - RNA, 62 nt, Homo Sapiens
uuucugucucuguccaugcugccauguuucucugcugccaaauugggccccuuggccccuuc

SEQ ID NO: 130405 - RNA, 62 nt, Homo Sapiens
ggaccccagggacuugccuuccccacccacucugcugccagcaggcccagggaucccugacc

SEQ ID NO: 130406 - RNA, 62 nt, Homo Sapiens
ccacaguucugggagccuucaacccuggcucaugcugccauagucuccacggugcccuucac

SEQ ID NO: 130407 - RNA, 62 nt, Homo Sapiens
cuguggcauguuugaccuguggcaggacucgcugcugccaggugagucaccgccuguccugc

SEQ ID NO: 130408 - RNA, 62 nt, Homo Sapiens
gccaucucugucucccugggugccagcagcccugcugccaugugcacugggguggcacugga

SEQ ID NO: 130409 - RNA, 62 nt, Homo Sapiens
ccugugggcagccgcgccagcugccgggacacugcugccagaccugcccccaggguaagucu

SEQ ID NO: 130410 - RNA, 62 nt, Homo Sapiens
ggcaggccagggcugcgcaucaguggacacauugcugccaggaagagcugcgacggugaggc

SEQ ID NO: 130411 - RNA, 62 nt, Homo Sapiens
uguacaaugguggagugaguuccgggccucagugcugccauccucccaaguuccagagccuc

SEQ ID NO: 130412 - RNA, 62 nt, Homo Sapiens
ucucaucuacguggugucgcccauggacgaccugcugccacugggccgggaguacaagcugc

SEQ ID NO: 130413 - RNA, 62 nt, Homo Sapiens
uaaggucacugcuguggcgaggacagcuuggaugcugccacgcacagaccuaauauaugucc

SEQ ID NO: 130414 - RNA, 62 nt, Homo Sapiens
ucugggcauacagugucuggcagcuggacggaugcugccacaagaccuggagggcagccaca

SEQ ID NO: 130415 - RNA, 62 nt, Homo Sapiens
caugacuugggggugcuacuagaagccaggaaugcugccaaacauucuaccaugcacagcac

SEQ ID NO: 130416 - RNA, 62 nt, Homo Sapiens
gaaaaugaacuuuuguuucuaaaguuggaccuugcugccaugacuguuuaguuuacagaaac

SEQ ID NO: 130417 - RNA, 62 nt, Homo Sapiens
gaauacuuuuacuacucagaaaugaauuuaugugcugccauuugcuauaaaguugaacuuug

SEQ ID NO: 130418 - RNA, 62 nt, Homo Sapiens
cagaaaaccuaccaaacaaaaacaucagaagcugcugccauaaugacuauuuucuacuguag

SEQ ID NO: 130419 - RNA, 62 nt, Homo Sapiens
uggcucugauuugaaaucgggagaaacagagcugcugccaaugggaucuuuuagguaacucc

SEQ ID NO: 130420 - RNA, 62 nt, Homo Sapiens
agcuuccgugugucugugcagugcccaugagcugcugccaaugggaucuuucagguaccccc

SEQ ID NO: 130421 - RNA, 62 nt, Homo Sapiens
gaucgcccugcuggcugccggcaccgcccuccugcugccagagacgaggcaggcacagcugc

SEQ ID NO: 130422 - RNA, 62 nt, Homo Sapiens
ggaguaucgaacccucugccuagggccggaguugcugccaguacccgcucccucugcucauc

SEQ ID NO: 130423 - RNA, 62 nt, Homo Sapiens
ccguaccgccaacucgggucacaccugaacgcugcugccagccgaugccccagcccugcacg

SEQ ID NO: 130424 - RNA, 62 nt, Homo Sapiens
cgccacaccuacuggggcaucuggcuggugccugcugccauggccagcccccacucucaccc

SEQ ID NO: 130425 - RNA, 62 nt, Homo Sapiens
ucccuucuuuaccuucauuucauccuguuggcugcugccaccaaaucugucuagaauccugc

SEQ ID NO: 130426 - RNA, 62 nt, Homo Sapiens
aauaaauauuuguuugggugguuugugagccuugcugccaaguccugccuuugggucgacau

SEQ ID NO: 130427 - RNA, 62 nt, Homo Sapiens
guggaguggguaauccaggcucuaaccuugaaugcugccaguuugugcugccauuugauuuu

SEQ ID NO: 130428 - RNA, 62 nt, Homo Sapiens
ugauuuuucuaaccuugaaugcugaccaauugugcugccauuauuccagaagaagagaagcu

SEQ ID NO: 130429 - RNA, 62 nt, Homo Sapiens
gccauccucccacuugcagugcaggaucccacugcugccaaagagaugggacaaggaaccuc

SEQ ID NO: 130430 - RNA, 62 nt, Homo Sapiens
cagaccuggacuccaaggccggccugcgcacuugcugccaccagaaacuggaggacaugauc

SEQ ID NO: 130431 - RNA, 62 nt, Homo Sapiens
cagagaaaggggcuguggugcuuguugguugaugcugccauguaagcuggacuccugggacu

SEQ ID NO: 130432 - RNA, 62 nt, Homo Sapiens
caacagcgcucaugucucuuggcccagucaggugcugccagguuuagauaggaaaguacaug

SEQ ID NO: 130433 - RNA, 62 nt, Homo Sapiens
agaugcuuccaugguccgugucaguucucuggugcugccaaaaugccugaccuuugagaugc

SEQ ID NO: 130434 - RNA, 62 nt, Homo Sapiens
uagauagaaaaagaagcaugcagaagaacucaugcugccagagucaacccacgcagaagaaa

SEQ ID NO: 130435 - RNA, 62 nt, Homo Sapiens
agaucugaacuaaugcuaacauuaguuucuguugcugccaacuucaaagucuacuagcucgc

SEQ ID NO: 130436 - RNA, 62 nt, Homo Sapiens
gccugugacuuucuaaccugaggcucucugccugcugccaaggcucuucacuaugacaguaa

SEQ ID NO: 130437 - RNA, 62 nt, Homo Sapiens
uucuaaaggcuugauauuuuuccgcuuucucuugcugccacaaacuccccguuccugcguag

SEQ ID NO: 130438 - RNA, 62 nt, Homo Sapiens
aagcuggcgugugccagggcucgagucccacgugcugccaacucaaacauagccuccuuccc

SEQ ID NO: 130439 - RNA, 62 nt, Homo Sapiens
cggcuccccuaaagguagaagauacucgagcaugcugccaggggagcuggauggugaaacac

SEQ ID NO: 130440 - RNA, 62 nt, Homo Sapiens
cacagccuaauuuucuggagauccauccacucugcugccauugugccuguuaugaaugaaaa

SEQ ID NO: 130441 - RNA, 62 nt, Homo Sapiens
caucacagagcccuucuuggaauuaugguaccugcugccacuccuuuucagcugcacuauuu

SEQ ID NO: 130442 - RNA, 62 nt, Homo Sapiens
augggccaagggaaggcuaucagagacccuggugcugccaccugccccuacucaagugucua

SEQ ID NO: 130443 - RNA, 62 nt, Homo Sapiens
agggagggccuggggagccccacccuagcccuugcugccacaccacauugccucaacaaccg

SEQ ID NO: 130444 - RNA, 62 nt, Homo Sapiens
aacguggugucaucugaugcauuuggaccauaugcugccagacugcagaacgggggagccgg

SEQ ID NO: 130445 - RNA, 62 nt, Homo Sapiens
gccuagcgaugccgcuggccagaccgugaccaugcugccagugugcucgccaugagcugggu

SEQ ID NO: 130446 - RNA, 62 nt, Homo Sapiens
uccaugucagggaagucgcuuccugcuugaacugcugccaacagucuccuuggugauuaagg

SEQ ID NO: 130447 - RNA, 62 nt, Homo Sapiens
uuagcuauugggagcaaucuaaaaaugccugcugcugccaagaggucuauggcucaugucug

SEQ ID NO: 130448 - RNA, 62 nt, Homo Sapiens
cacaaccugucucccaguccugcucucaccccugcugccacacacaugcccugagcagccag

SEQ ID NO: 130449 - RNA, 62 nt, Homo Sapiens
cugcacuagggcucugugcuggaacccaggcaugcugccagccuuuucucuggaucugucag

SEQ ID NO: 130450 - RNA, 62 nt, Homo Sapiens
ccaugugcugccgcccaaccugccgccccaacugcugccagaccugcugcaucuccaguugc

SEQ ID NO: 130451 - RNA, 62 nt, Homo Sapiens
cuuccugcaguaucucuagcugcauuuccagcugcugccagcccugcugccaccccagcuau

SEQ ID NO: 130452 - RNA, 62 nt, Homo Sapiens
ccagcuauugcauuuccagcuacaggaccaccugcugccaccucugcuggcaaaccaccugc

SEQ ID NO: 130453 - RNA, 62 nt, Homo Sapiens
cacugugcugaggcccugcagugucugcucacugcugccaucuucgcugcuagucaggguuc

SEQ ID NO: 130454 - RNA, 62 nt, Homo Sapiens
auuccuguguggggagaagcucaguggccguuugcugccacugacaaggauuucacaugcag

SEQ ID NO: 130455 - RNA, 62 nt, Homo Sapiens
cccucuccccacugccccaauggcguaaacccugcugccaggcggaaaacagaccucggggc

SEQ ID NO: 130456 - RNA, 62 nt, Homo Sapiens
agccaaaacaaagucuuuuugauuuugccaagugcugccaguaguaaccaaacacauacaug

SEQ ID NO: 130457 - RNA, 62 nt, Homo Sapiens
agccuacugcugcucuccacucaacuggccucugcugccaggccacugccugucucugcuuc

SEQ ID NO: 130458 - RNA, 62 nt, Homo Sapiens
ugagccucccuggagaagguauuuuauaugucugcugccagcugcuggucuccacacccuca

SEQ ID NO: 130459 - RNA, 62 nt, Homo Sapiens
agguuggggugguuaagucucaggggcccuccugcugccagcggggagaugcugccagcaca

SEQ ID NO: 130460 - RNA, 62 nt, Homo Sapiens
acacaggggcccuccugcugguccuggggagaugcugccagcgggugcaggugagccggcgu

SEQ ID NO: 130461 - RNA, 62 nt, Homo Sapiens
ucacauccacucaccacauccccagagaacuaugcugccacuugcugccaggcuuacaucuu

SEQ ID NO: 130462 - RNA, 62 nt, Homo Sapiens
cuuacaucuucccagagaacugccaccugcccugcugccaggaccacccauagcccugcugc

SEQ ID NO: 130463 - RNA, 62 nt, Homo Sapiens
ugcccugcugccaggcuuacccauagcccugcugcugccaccuuacaaacugcgcagaccac

SEQ ID NO: 130464 - RNA, 62 nt, Homo Sapiens
aacugucaaguguguguuguucccaugugagcugcugccaugcagaaacacccacaggcaug

SEQ ID NO: 130465 - RNA, 62 nt, Homo Sapiens
accagccccacccuguuuugccuuuguccuccugcugccaguguccccagaacucugccugc

SEQ ID NO: 130466 - RNA, 64 nt, Homo Sapiens
gcugaguucucacagaagcauuuuccccauguggcucucucacugugcguugcuaccuugcuuc

SEQ ID NO: 130467 - RNA, 64 nt, Homo Sapiens
gaccugaccucaaaccagcuuaaggcuuuaaguccucucucagaacuuggcauuuccaacuucu

SEQ ID NO: 130468 - RNA, 64 nt, Homo Sapiens
cugucuuuucucacugcuuuccuggacccacuuucucucucaaauccauccuuagcuuuggcgc

SEQ ID NO: 130469 - RNA, 64 nt, Homo Sapiens
uuucuccaggcucccuaccucugccugcccuucucucucucaccccugccugcugucccccagu

SEQ ID NO: 130470 - RNA, 64 nt, Homo Sapiens
gcccugggaaugggaauggaauacauagggauggcucucucagggucccccucccaccuguuga

SEQ ID NO: 130471 - RNA, 64 nt, Homo Sapiens
ugcaguggggcaucgucuguucucuccuccugaacucucucaucggaccuauugcugccugccc

SEQ ID NO: 130472 - RNA, 64 nt, Homo Sapiens
cacugcacuccagccugggcgacagagcaggacucucucucaaaaaaacacaaaaaaacaaaaa

SEQ ID NO: 130473 - RNA, 64 nt, Homo Sapiens
auuaggauugcagauaaauguuugaauucugcuccucucucaucaauccaggacaguauuugaa

SEQ ID NO: 130474 - RNA, 64 nt, Homo Sapiens
uccagcacuccagccugggugacagagcaagacucucucucaaaaaaaaaaaaaaaaaaaaauu

SEQ ID NO: 130475 - RNA, 64 nt, Homo Sapiens
acugauguuuacagaacccaaaugaugucuuccucucucucaaaauaaacuaaccuauucauau

SEQ ID NO: 130476 - RNA, 64 nt, Homo Sapiens
aaugaucaccuuugacuccacgucucacaaucaucucucucaaguucgaaguuccacaaaucuc

SEQ ID NO: 130477 - RNA, 64 nt, Homo Sapiens
aaucuagaaagaccuuagagaaccagccaaccaacucucucauuuuaaaagugaaggauucaua

SEQ ID NO: 130478 - RNA, 64 nt, Homo Sapiens
auugagauucuaggaugagaacaguuuuggaagccucucucaggcuccagaaagccaggagucg

SEQ ID NO: 130479 - RNA, 64 nt, Homo Sapiens
uggaacgcuuucauaaacuuaguauaugagcauccucucucacaucuuuggaggguggggcagg

SEQ ID NO: 130480 - RNA, 64 nt, Homo Sapiens
cuccuggguagcugggauuauucaagcgauucuccucucucagcugcaaccuccgccucccaag

SEQ ID NO: 130481 - RNA, 64 nt, Homo Sapiens
auacucuuguuucuuagaaacaaggcugggauggcucucucaucgacagugacagauguguuug

SEQ ID NO: 130482 - RNA, 64 nt, Homo Sapiens
uuaguaggagcucaaauuguuggggccccucuaccucucucagggcuagaacugccugacucuu

SEQ ID NO: 130483 - RNA, 64 nt, Homo Sapiens
aaauccgaaccauugcccuuguuucccccacguucucucucagaucuuugucucgaagggaaaa

SEQ ID NO: 130484 - RNA, 64 nt, Homo Sapiens
auccuccucaugccagauagucaucuuucucucucucucucaucaccuaggcugucagucucuc

SEQ ID NO: 130485 - RNA, 64 nt, Homo Sapiens
uuucucucucucucucaucaccuaggcugucagucucucucaucaucuauaccuccccaugaca

SEQ ID NO: 130486 - RNA, 64 nt, Homo Sapiens
ccccucuccuccccuuccuggccugaacagcccucucucucacuucucaccugcucccaguccu

SEQ ID NO: 130487 - RNA, 64 nt, Homo Sapiens
ugcucccaguccugccugaauauuguccaccaugcucucucacccuaugggccagaguugucuu

SEQ ID NO: 130488 - RNA, 64 nt, Homo Sapiens
uaagccauuuuauaaaacaaugaauaauacaugccucucucaggauugauguucccucuugcac

SEQ ID NO: 130489 - RNA, 64 nt, Homo Sapiens
caugccccauucacagcugauguaggagcccggacucucucaggcugaggaagccccacuucuc

SEQ ID NO: 130490 - RNA, 64 nt, Homo Sapiens
gccacucggcuacucaggacaaaucucacugggucucucucaagcacgauguauccgggugugg

SEQ ID NO: 130491 - RNA, 64 nt, Homo Sapiens
uacucucguuuugcccguugaaggcccuguaauucucucucauuucagguaucaugucucaauu

SEQ ID NO: 130492 - RNA, 64 nt, Homo Sapiens
aaggaaacaaucuauuacuuuuuuccuuaaaaggagaauuuauagcacuguaauacagcuuaaa

SEQ ID NO: 130493 - RNA, 64 nt, Homo Sapiens
uuuauaaaguaggaaguuaagugaaucauagauuagaauuuaauacucuuauggaaauaauuuu

SEQ ID NO: 130494 - RNA, 64 nt, Homo Sapiens
uauauuuauuuacaaaacacuucauuauuuauaaagaauuuacuaacaguuuaucuuauuuaua

SEQ ID NO: 130495 - RNA, 64 nt, Homo Sapiens
aaacuuuuucuuuaaaauucaauuaaguuacaccagaauuuacaggcaagauuuuuuuuuucau

SEQ ID NO: 130496 - RNA, 64 nt, Homo Sapiens
uaccuuacaguuaaucguuucuuaauaaagaagcagaauuuagaaaccacaggauaguguaccc

SEQ ID NO: 130497 - RNA, 64 nt, Homo Sapiens
uaaaauuugaauccauaauauaucuaauuacaggagaauuuacaacaucucaaguacguaaauu

SEQ ID NO: 130498 - RNA, 64 nt, Homo Sapiens
cuuagcaagaauggccauggugaauauuuuuaugagaauuuaaacauuuacugauuugcaguga

SEQ ID NO: 130499 - RNA, 64 nt, Homo Sapiens
gauaagacacucagagagacuacuuuucuugauaagaauuuacacacugcgccuggcccagcgu

SEQ ID NO: 130500 - RNA, 64 nt, Homo Sapiens
aauacuaaggacaauuauuugcuuuauuuggaaaagaauuuaggaccauauaaaaacgauaauu

SEQ ID NO: 130501 - RNA, 64 nt, Homo Sapiens
aaaacuugagaaaaccuaauaucagaaacaggaaagaauuuagauuuucugagcucuaagaauu

SEQ ID NO: 130502 - RNA, 64 nt, Homo Sapiens
guguucaguuucuacacaacuuuaucauccgcuaagaauuuaaaaaucacauucucuguucagc

SEQ ID NO: 130503 - RNA, 64 nt, Homo Sapiens
uguuaauaaauuucaguuuaguucuguaaugucaagaauuuaagaauuaaaaaacggauugguu

SEQ ID NO: 130504 - RNA, 64 nt, Homo Sapiens
caaacuuaaauggaagaauucugaaagagaggauagaauuuaaagaacaagaguauauaaaguu

SEQ ID NO: 130505 - RNA, 64 nt, Homo Sapiens
uuucucccauaaccuuuguacacuaaaaaaugaaagaauuuagaauguauuugaugauagcauu

SEQ ID NO: 130506 - RNA, 64 nt, Homo Sapiens
guauuugaugauagcauucucacuaagacacaugagaauuuaacuuuauaaccgcgugaguuaa

SEQ ID NO: 130507 - RNA, 64 nt, Homo Sapiens
gguauugauaaagaacaagagcuacugcuuuaagagaauuuacacucuugcuacagucgccuuu

SEQ ID NO: 130508 - RNA, 64 nt, Homo Sapiens
uuuugaaacugaaggaagucccaaaccggaagggagaauuuauuggccucgagccugcaacagu

SEQ ID NO: 130509 - RNA, 64 nt, Homo Sapiens
ugcucacuuauucugaaagccugucccuacuuuaagaauuuaaugucuagagccuguugguguu

SEQ ID NO: 130510 - RNA, 64 nt, Homo Sapiens
auuuauaguaauuuuuugaugaagaaaaguuaccagaauuuauauguuguggcuuuuaaugcca

SEQ ID NO: 130511 - RNA, 64 nt, Homo Sapiens
gggaaaugcacaauuuuuuuuuguuaggcuguaaagaauuuaagcuguaaauuacauaaguuag

SEQ ID NO: 130512 - RNA, 64 nt, Homo Sapiens
uggucauauuauuauuaauuuugccaaaagaagaagaauuuauugaauauuuauacuauaaaau

SEQ ID NO: 130513 - RNA, 64 nt, Homo Sapiens
uggaauugaugucugggcaaccaggcuaugacuaagaauuuaggaauccagcaaauucaaggaa

SEQ ID NO: 130514 - RNA, 64 nt, Homo Sapiens
ucuaaaagcaaaaauugguuugaaaaacucaacaagaauuuaauaaggcuuuguaguacaagau

SEQ ID NO: 130515 - RNA, 64 nt, Homo Sapiens
ggcaaaugacaagcgauaggucaaaggaggcaaaagaauuuagaaaauauccucuuauuguuga

SEQ ID NO: 130516 - RNA, 64 nt, Homo Sapiens
gauuccaauggacgaccuauccaagccuuugcccagaauuuaaguugugcaccuaagcugcaga

SEQ ID NO: 130517 - RNA, 64 nt, Homo Sapiens
caauuuugaucuuuuuauaugaaauuguuacaauagaauuuaucuauggcccaaaaugaccaac

SEQ ID NO: 130518 - RNA, 64 nt, Homo Sapiens
acaaaucagaacuuuggagguucuaaagccaagaagaauuuauuuucauagccuacauuuuagu

SEQ ID NO: 130519 - RNA, 64 nt, Homo Sapiens
gguguauaugguccacugguuucaggccaaaucuagaauuuagugauacuggcucagaagaauu

SEQ ID NO: 130520 - RNA, 64 nt, Homo Sapiens
ggccaaaucuagaauuuagugauacuggcucagaagaauuuaaguucuauucagccuuccuggg

SEQ ID NO: 130521 - RNA, 64 nt, Homo Sapiens
auuugucauuuuuuuuuuuuugccucggaaauguagaauuuauuacuucugaaguucaaauuag

SEQ ID NO: 130522 - RNA, 64 nt, Homo Sapiens
aaauguaaauggccucuacauaagguguaauuacagaauuuacgacuacuagggcaugauacag

SEQ ID NO: 130523 - RNA, 64 nt, Homo Sapiens
aaacucgaaguuuagguuuaugauuuuacuagaaagaauuuaauuuaacagauuguuuauagag

SEQ ID NO: 130524 - RNA, 64 nt, Homo Sapiens
aaagaauauauuugucaaauuaaaauguacauaaagaauuuaaguuuuugucuuauagacuuuu

SEQ ID NO: 130525 - RNA, 64 nt, Homo Sapiens
uuucuggacuuuaaaucuccggaagaaccaagguagaauuuaaucagaaacguggcaucauuug

SEQ ID NO: 130526 - RNA, 64 nt, Homo Sapiens
uucucgagcuguuuuucucauucccuggguggacagaauuuaaugucugcauguuuauuuuuac

SEQ ID NO: 130527 - RNA, 64 nt, Homo Sapiens
acaguacauucuaguuggaaucguuuacucugcuagaauuuaggugugagauuuuuuguuuccc

SEQ ID NO: 130528 - RNA, 64 nt, Homo Sapiens
ugacaaagcaguugaacaaaaauuauggcauuuaagaauuuaacaugucuuagcuguaaaaaug

SEQ ID NO: 130529 - RNA, 64 nt, Homo Sapiens
agugaguggugugacucuuacuccuuaggugcccagaauuuaccaucaucucugaaggaguuac

SEQ ID NO: 130530 - RNA, 64 nt, Homo Sapiens
uccuuauguccugucauauaauuaaagacucaagagaauuuaugugaaaugcuuucuguaugcc

SEQ ID NO: 130531 - RNA, 64 nt, Homo Sapiens
cuugggggaagggcuugaauugaagcuuuacuuuagaauuuagcccugguuugaaauuuuccau

SEQ ID NO: 130532 - RNA, 64 nt, Homo Sapiens
aacugguaguucauuguaaaugaacauaaugaacagaauuuaugacuccacuguggaaaaugcu

SEQ ID NO: 130533 - RNA, 64 nt, Homo Sapiens
ucacaaaacaauuuuuguguacuccauaucuagaagaauuuagcaaaaguaacauuuggguuuc

SEQ ID NO: 130534 - RNA, 64 nt, Homo Sapiens
ucauauaaaauaauaauauaagcacuguaauuagagaauuuauuacaaauugcuuaugggagau

SEQ ID NO: 130535 - RNA, 64 nt, Homo Sapiens
auuuaaaaagaaauucacugguucuuuacaaaauagaauuuaucaucaaguuauuacacaaacu

SEQ ID NO: 130536 - RNA, 64 nt, Homo Sapiens
ucugucuuuugcugaucuacaaauaaaugaauugagaauuuaguccauagaggucccuggcuac

SEQ ID NO: 130537 - RNA, 64 nt, Homo Sapiens
uuuuccacucuuauuagcacugcaaaagcuccugagaauuuaaaaacacaguaauucucuggau

SEQ ID NO: 130538 - RNA, 64 nt, Homo Sapiens
uguuauuuaauugaaaucugcuugugugcuuauaagaauuuacugaguucucacuucccuuaca

SEQ ID NO: 130539 - RNA, 64 nt, Homo Sapiens
aggcacugauggggagaaagcaauauuugaagaaagaauuuaacggaaaagacuaguauuuggg

SEQ ID NO: 130540 - RNA, 64 nt, Homo Sapiens
guuggcucuucucucugccggcuggaucauagcaagaauuuacuaaagcucuccacaucucuug

SEQ ID NO: 130541 - RNA, 64 nt, Homo Sapiens
uuugcuccaacaagggcuuuauguugcugguaagagaauuuauuuacuaaaugcacuauguaua

SEQ ID NO: 130542 - RNA, 64 nt, Homo Sapiens
cugucaccagcacaagagaauuagagcuucagugagaauuuagaaaaauuauacuaaagugaga

SEQ ID NO: 130543 - RNA, 64 nt, Homo Sapiens
auaauauucaauacaauuguaauguagaaauauaagaauuuagaaaaaaguaaacuugccauuu

SEQ ID NO: 130544 - RNA, 64 nt, Homo Sapiens
caguuaaagcaaaguuauuaauuauuaauauaugagaauuuaaaauuuuauaaauaaguuagaa

SEQ ID NO: 130545 - RNA, 64 nt, Homo Sapiens
gggauagaaacuacaaaugcaacaaaugcgucaaagaauuuagugugcacucaagccuuacuac

SEQ ID NO: 130546 - RNA, 64 nt, Homo Sapiens
ucuucaaacacaaguuuuucuaauaacucauuagagaauuuauacuggagagacuucacaauua

SEQ ID NO: 130547 - RNA, 64 nt, Homo Sapiens
uacucuauaacggugugaaucugaugucuuucccagaauuuauguuacauuuuaauuuuugaaa

SEQ ID NO: 130548 - RNA, 64 nt, Homo Sapiens
acuauauauuaacauggcuugaacuuacauuaagagaauuuacaggggagaaaaaaugaccacu

SEQ ID NO: 130549 - RNA, 64 nt, Homo Sapiens
uggaaaucaccaguuuuaacauacuguuaacuacagaauuuauuaggaaagugaaauuguuaca

SEQ ID NO: 130550 - RNA, 64 nt, Homo Sapiens
gaaggaaagaagccuuggcauaggaaaauaucagagaauuuaaucauucaauguagaagacuuu

SEQ ID NO: 130551 - RNA, 64 nt, Homo Sapiens
caggagagaaaccucacaagaugcaaaacauaggagaauuuauacuucagucaagcuucauccu

SEQ ID NO: 130552 - RNA, 64 nt, Homo Sapiens
cuggagagaaagcuuacaaacuuaaagacauaggagaauuuauauuuccauuuggaaaucacac

SEQ ID NO: 130553 - RNA, 64 nt, Homo Sapiens
cggggaauggguuuuuguuuuuccuucauuguugagaauuuaaggaccuuugauacugcugcac

SEQ ID NO: 130554 - RNA, 64 nt, Homo Sapiens
uuuuccaguugaaaacaaacuaagaaguccuuuaagaauuuauaauccguuccccauuaacuua

SEQ ID NO: 130555 - RNA, 64 nt, Homo Sapiens
aggauuuucuguauagauuacucaugucagaccaagaauuuaaauuauuuugagagaggcauuu

SEQ ID NO: 130556 - RNA, 64 nt, Homo Sapiens
uucuuugcuuuguuuuuauaaaugaauuuuucauagaauuuacaguauauucaaaggaagaaag

SEQ ID NO: 130557 - RNA, 64 nt, Homo Sapiens
aauuauuggucaucauuuguaccuuagaaguacaagaauuuaaguaaaagaaauguucauuuuu

SEQ ID NO: 130558 - RNA, 64 nt, Homo Sapiens
uuagaaaaguuuguuuugugaaguuaggaauauuagaauuuagguacuguuaaguaaguaaugu

SEQ ID NO: 130559 - RNA, 64 nt, Homo Sapiens
auuagaauuuagguacuguuaaguaaguaauguuagaauuuaagauucauguuauuaacgauga

SEQ ID NO: 130560 - RNA, 57 nt, Homo Sapiens
ccaucggccgcuucacguagcucggagcccuuccacuccucccagguaagaacccuc

SEQ ID NO: 130561 - RNA, 64 nt, Homo Sapiens
ugaggccuucuugucuucaaccuggccuguccagcccuuccagauauggccaaacccauggccu

SEQ ID NO: 130562 - RNA, 64 nt, Homo Sapiens
gccuaagugucuuucuccuggccauauguaaaaacccuuccaauauacuuggggaaaaaacaag

SEQ ID NO: 130563 - RNA, 64 nt, Homo Sapiens
ccaaggagcgaggagggcaaucuucucccccgcucccuuccacuucgucucuuacauacucuca

SEQ ID NO: 130564 - RNA, 64 nt, Homo Sapiens
aacuuuauauggguagaggacucucuacucagaucccuuccagacccacuacguguccuggguu

SEQ ID NO: 130565 - RNA, 64 nt, Homo Sapiens
ugcaucaacuaacucucgggcucagugcacuucucccuuccaacgauggauuuaggagccacug

SEQ ID NO: 130566 - RNA, 64 nt, Homo Sapiens
uugcccaucaucccuucuuccauccuuagagggacccuuccaaggucccgaccccaucccuauc

SEQ ID NO: 130567 - RNA, 64 nt, Homo Sapiens
ccccagaaacuccaaccccugcccuuccucuucccccuuccacccucacauccccauccccuuc

SEQ ID NO: 130568 - RNA, 64 nt, Homo Sapiens
gucuccugagcccugagggauggaugucuccugacccuuccaccccgccucacucccuccgucc

SEQ ID NO: 130569 - RNA, 64 nt, Homo Sapiens
acggcccccagaacaacauucucccugcuggcagcccuuccaugucuccaaaccugggucagag

SEQ ID NO: 130570 - RNA, 64 nt, Homo Sapiens
cuguagugaccggcagggcuggggugagaccccucccuuccagaauccaggccccaucuccccc

SEQ ID NO: 130571 - RNA, 64 nt, Homo Sapiens
gcccacccaccuccgguuccccugugccuccugucccuuccacgcuuaaacaggguucucuguc

SEQ ID NO: 130572 - RNA, 64 nt, Homo Sapiens
gcuuaguuugguaccuggagcgagagcuucuccgcccuuccaccaaccccacaggccgcuucgc

SEQ ID NO: 130573 - RNA, 64 nt, Homo Sapiens
uugcacauggaggacuuuucaagaugucaggauacccuuccaucaccccaccaccgccacccca

SEQ ID NO: 130574 - RNA, 64 nt, Homo Sapiens
cuggaccuuggcaccugcuaggaagagccuuggacccuuccaguugcguaaagcaaaccuaccc

SEQ ID NO: 130575 - RNA, 64 nt, Homo Sapiens
cugacucccgcuuagcacacccuuaggcaggcgccccuuccaccuuuccccgagaccgucgucg

SEQ ID NO: 130576 - RNA, 64 nt, Homo Sapiens
cuagcccucugcaggcaugcagaaggccaaagggcccuuccaucagcaaagcccacugccagua

SEQ ID NO: 130577 - RNA, 64 nt, Homo Sapiens
acuggaacaccuagcuaacagggcccagacaugccccuuccaaaugacuguaacugaaguggcc

SEQ ID NO: 130578 - RNA, 64 nt, Homo Sapiens
uguuuucuauaugguuuuuccagcuagcaguacucccuuccauaccugugacugggcagugcuu

SEQ ID NO: 130579 - RNA, 64 nt, Homo Sapiens
gaaaauaauucuuugagacagauuucagcuaccucccuuccagguucgauuuaacuugguugua

SEQ ID NO: 130580 - RNA, 64 nt, Homo Sapiens
caaucccaucucgcaggagaaggagcccuggagccccuuccaccauucccacauggggagcacc

SEQ ID NO: 130581 - RNA, 64 nt, Homo Sapiens
cugcacuggucauugggaauuugcgagccucagucccuuccaaggagccgacugugccacccac

SEQ ID NO: 130582 - RNA, 64 nt, Homo Sapiens
ugcacguaguccagaugccugggaaggaacaucucccuuccagcaucugcugguagcaggcugg

SEQ ID NO: 130583 - RNA, 64 nt, Homo Sapiens
cuggucagcugguccaggcugguccccgccgguccccuuccaguccagccaccaagaguccacu

SEQ ID NO: 130584 - RNA, 64 nt, Homo Sapiens
gugugaucgucugacugguguggaucucauuggacccuuccauggauguucuaagucuuuccau

SEQ ID NO: 130585 - RNA, 64 nt, Homo Sapiens
gagggcagucgauagagcugcauuuggaguguuccccuuccacugaguaagucaaccugccuga

SEQ ID NO: 130586 - RNA, 64 nt, Homo Sapiens
acuagaaccuuaggcauuggaauucugcagcuaacccuuccacguccguuggcuucugaacugg

SEQ ID NO: 130587 - RNA, 64 nt, Homo Sapiens
aaacucaacucggcaauccaacgccgccccauuucccuuccagccaggccugucgggccccccg

SEQ ID NO: 130588 - RNA, 64 nt, Homo Sapiens
cuuccucccgcucucugcuggcacgcgaggcuuccccuuccaccccauguggguauucccacaa

SEQ ID NO: 130589 - RNA, 64 nt, Homo Sapiens
agucugugugcacagaguggguguuccuucgagccccuuccacucagagggccacacccagcga

SEQ ID NO: 130590 - RNA, 64 nt, Homo Sapiens
uacuuuaaacuuuuuugcucugcagccuuccuugcccuuccaccuccuccuccuaauauucacu

SEQ ID NO: 130591 - RNA, 64 nt, Homo Sapiens
cuuuccccccaggcucuuuguuucccuccacccacccuuccauauccucuggagcaggagacaa

SEQ ID NO: 130592 - RNA, 64 nt, Homo Sapiens
cugcgcaaaaggggacggcccccacccuccuucccccuuccacccaucguggagcccauggagu

SEQ ID NO: 130593 - RNA, 64 nt, Homo Sapiens
cuccucugcccucacccccgaugaagugugcucacccuuccagcgaguaugucccaucacuacc

SEQ ID NO: 130594 - RNA, 64 nt, Homo Sapiens
aacugcaauaccaguaaccuucuccccucucuuccccuuccacguauuucgguugauuucauuu

SEQ ID NO: 130595 - RNA, 64 nt, Homo Sapiens
cggugccggcggggcucgccaccugggcggaggccccuuccacgcccccugcggcggcugucag

SEQ ID NO: 130596 - RNA, 64 nt, Homo Sapiens
acuuacccaucauccccccaacaaacgcuucuaccccuuccagacaccaugcuccaacucccac

SEQ ID NO: 130597 - RNA, 64 nt, Homo Sapiens
cugggcaaaacugaaagggacaacucccuguugucccuuccauccucacuguuauuuccccguu

SEQ ID NO: 130598 - RNA, 64 nt, Homo Sapiens
gaguggggaagauuuccccuuuagaucaaacugccccuuccauggaaaagcuggaaaaaaacuc

SEQ ID NO: 130599 - RNA, 64 nt, Homo Sapiens
cagagggugugacccaguuacccuuuaacccccacccuuccagucgggugugagggccugaccg

SEQ ID NO: 130600 - RNA, 64 nt, Homo Sapiens
uccuacugugaagaacagacaagaacuuagucaucccuuccaccuuuuuuguaggucugugaua

SEQ ID NO: 130601 - RNA, 64 nt, Homo Sapiens
cugaaaccucgugccuggcuguccucaucuuggucccuuccaauagucaggcagccacaccuug

SEQ ID NO: 130602 - RNA, 64 nt, Homo Sapiens
ccagcccuuccugcugccucccaauagaacucagcccuuccaugucccuugcccgcgugggacc

SEQ ID NO: 130603 - RNA, 64 nt, Homo Sapiens
ugggugugggacaccugggaugcuccagcaacugcccuuccaggcuccauuucccaaaguccuc

SEQ ID NO: 130604 - RNA, 64 nt, Homo Sapiens
agcgggucuccucccagcggcacguguccguccacccuuccaucuggugcuucccccaccccuc

SEQ ID NO: 130605 - RNA, 64 nt, Homo Sapiens
gaggcuuauccuggcaaugggguagucacugccacccuuccacacacacacacacacacacaca

SEQ ID NO: 130606 - RNA, 64 nt, Homo Sapiens
agugccaggugggagagggagcagaacagccagccccuuccagguggcagucggaaggguuuuu

SEQ ID NO: 130607 - RNA, 64 nt, Homo Sapiens
caccuccccccauggcccgccaccccgcacucaccccuuccacccuccccccacccuccccuca

SEQ ID NO: 130608 - RNA, 64 nt, Homo Sapiens
ugccaccaccgccaacaggcagcggggcaaggggcccuuccagagggcucccuauuuggaagca

SEQ ID NO: 130609 - RNA, 64 nt, Homo Sapiens
uuauuccagagcugccagugugcccagccucuuucccuuccaguagcucccucaaagaggcagu

SEQ ID NO: 130610 - RNA, 64 nt, Homo Sapiens
ugcucugcugaugacccccccccugaucccugaucccuuccacccaaacucccaucagcccaau

SEQ ID NO: 130611 - RNA, 64 nt, Homo Sapiens
ucugccuuuuguucauuucaugguuucucuucuccccuuccauuuuuuauaaggacuuccugau

SEQ ID NO: 130612 - RNA, 64 nt, Homo Sapiens; identical to SEQ ID NO: 73390

SEQ ID NO: 130613 - RNA, 64 nt, Homo Sapiens; identical to SEQ ID NO: 73391

SEQ ID NO: 130614 - RNA, 64 nt, Homo Sapiens; identical to SEQ ID NO: 73392

SEQ ID NO: 130615 - RNA, 64 nt, Homo Sapiens; identical to SEQ ID NO: 73393

SEQ ID NO: 130616 - RNA, 64 nt, Homo Sapiens; identical to SEQ ID NO: 73394

SEQ ID NO: 130617 - RNA, 64 nt, Homo Sapiens; identical to SEQ ID NO: 73395

SEQ ID NO: 130618 - RNA, 64 nt, Homo Sapiens; identical to SEQ ID NO: 73396

SEQ ID NO: 130619 - RNA, 64 nt, Homo Sapiens; identical to SEQ ID NO: 73397

SEQ ID NO: 130620 - RNA, 64 nt, Homo Sapiens; identical to SEQ ID NO: 73398

SEQ ID NO: 130621 - RNA, 64 nt, Homo Sapiens; identical to SEQ ID NO: 73399

SEQ ID NO: 130622 - RNA, 64 nt, Homo Sapiens; identical to SEQ ID NO: 73400

SEQ ID NO: 130623 - RNA, 64 nt, Homo Sapiens; identical to SEQ ID NO: 73401

SEQ ID NO: 130624 - RNA, 64 nt, Homo Sapiens; identical to SEQ ID NO: 73402

SEQ ID NO: 130625 - RNA, 64 nt, Homo Sapiens; identical to SEQ ID NO: 73403

SEQ ID NO: 130626 - RNA, 64 nt, Homo Sapiens; identical to SEQ ID NO: 73404

SEQ ID NO: 130627 - RNA, 64 nt, Homo Sapiens; identical to SEQ ID NO: 73405

SEQ ID NO: 130628 - RNA, 64 nt, Homo Sapiens; identical to SEQ ID NO: 73406

SEQ ID NO: 130629 - RNA, 64 nt, Homo Sapiens; identical to SEQ ID NO: 73407

SEQ ID NO: 130630 - RNA, 64 nt, Homo Sapiens; identical to SEQ ID NO: 73408

SEQ ID NO: 130631 - RNA, 64 nt, Homo Sapiens; identical to SEQ ID NO: 73409

SEQ ID NO: 130632 - RNA, 64 nt, Homo Sapiens
gccuucagggaaagacuaccagcucugucuuucuacccucuaauuuaacaaugcauaagaguca

SEQ ID NO: 130633 - RNA, 64 nt, Homo Sapiens
cuaugacuuuuuauuucucuuccugggauccaccacccucuacucucagcugacugcugcauuu

SEQ ID NO: 130634 - RNA, 64 nt, Homo Sapiens
aaugccuucugaccuucugacagccucccccggaacccucuaccacuccggggggagguagucc

SEQ ID NO: 130635 - RNA, 58 nt, Homo Sapiens
cuguuccucagcauggagcuaagcccacacccucuaccggcagaccccugggugcuag

SEQ ID NO: 130636 - RNA, 64 nt, Homo Sapiens
gguacaccaaagaggaagaagagcuguggaggccacccucuacaaagcuuuauagaacuucugg

SEQ ID NO: 130637 - RNA, 64 nt, Homo Sapiens
uuuggaagauuuaaaaaccuagcauccuguucucacccucuaagcugcauugagaaaugacucg

SEQ ID NO: 130638 - RNA, 64 nt, Homo Sapiens
ugauccagccccaccaaggggccuccagagaccccaggaacaauaagugucuccucccaccaga

SEQ ID NO: 130639 - RNA, 64 nt, Homo Sapiens
ccucuauucacagaccagcaucuccucuccuuaucaggaacauuccuuccugaacauauucugc

SEQ ID NO: 130640 - RNA, 64 nt, Homo Sapiens
uggcuugcuucccccagggcagcacaggcuaagucaggaacaucggaugccagggagggaggag

SEQ ID NO: 130641 - RNA, 64 nt, Homo Sapiens
gaaugggugcccuacggggcccuccuucccccaccaggaacagauggaaccugccacccaggau

SEQ ID NO: 130642 - RNA, 64 nt, Homo Sapiens
aacccaggaccaagcugugccugggcuccaaggacaggaacacugguccccccaucacacucac

SEQ ID NO: 130643 - RNA, 64 nt, Homo Sapiens
gcuggagggauggccuaggacaccagggucacaccaggaacaugggagggccgugcuugucucu

SEQ ID NO: 130644 - RNA, 64 nt, Homo Sapiens
ccuuccacuccccucucuaccagggaagcaacuccaggaacacuacccugcugcucagcuuucu

SEQ ID NO: 130645 - RNA, 64 nt, Homo Sapiens
aucccuaguuuucauugauauuuugcuaaaguuacaggaacacgaaauggagaccucccacugu

SEQ ID NO: 130646 - RNA, 64 nt, Homo Sapiens
guuucaaugcugcugagagucacaggcaaugcuacaggaacaaaucccuuuuauagcacuuuag

SEQ ID NO: 130647 - RNA, 64 nt, Homo Sapiens
cauuaucuugccaguuagaaugacagaauccuggcaggaacagaaauuaccuucagaggccaac

SEQ ID NO: 130648 - RNA, 64 nt, Homo Sapiens
acagacccagacgaggggauuauguuaugaagugcaggaacagcuuaaggaauaagaggaaaau

SEQ ID NO: 130649 - RNA, 64 nt, Homo Sapiens
ccuguagcccagcaaaguugaaacacugggccaccaggaacacaagcuguggaaagaagucaca

SEQ ID NO: 130650 - RNA, 64 nt, Homo Sapiens
uguugcuauucagaguuuaaguuucaggagaaaacaggaacaauagaacacucugccuguuauu

SEQ ID NO: 130651 - RNA, 64 nt, Homo Sapiens
ccacaguucuugaaaaguacuauguuucaaauuucaggaacaccagcguuagcuguaaaaguug

SEQ ID NO: 130652 - RNA, 64 nt, Homo Sapiens
uuguauugauaaccacugggguuccgcauugaagcaggaacaaauugccucuuuuucuggccuu

SEQ ID NO: 130653 - RNA, 64 nt, Homo Sapiens
cagcaguugaagccugacaggccucaguggugaccaggaacagaagcagccuuccuguuaguag

SEQ ID NO: 130654 - RNA, 64 nt, Homo Sapiens
gggugaaagggacagauagacugcauuucuggggcaggaacagaaggugggggcaggcugggcc

SEQ ID NO: 130655 - RNA, 64 nt, Homo Sapiens
agagaccaaaaaggggacaaucucugagagcaaacaggaacacuuccucugccaggugcuuggc

SEQ ID NO: 130656 - RNA, 64 nt, Homo Sapiens
uaugguaguaugagggguuguucgcuucucucaccaggaacauucgcuucucucaccaggaaca

SEQ ID NO: 130657 - RNA, 64 nt, Homo Sapiens
cgcuucucucaccaggaacauucgcuucucucaccaggaacauuugagccaggagaugcacacc

SEQ ID NO: 130658 - RNA, 64 nt, Homo Sapiens
aagaugagucaaaucuuuauacaguguugugcaccaggaacacaggcacuucccucuggaaauc

SEQ ID NO: 130659 - RNA, 64 nt, Homo Sapiens
ugugcuacaaaggagcuuugaaggcccuggcacacaggaacacauacaugagaugccuuaggcu

SEQ ID NO: 130660 - RNA, 64 nt, Homo Sapiens
auauuacacacaugugcgcauuacacacacacaauacacauacaugcauauagacgcaucuauu

SEQ ID NO: 130661 - RNA, 64 nt, Homo Sapiens
uuuguguguguauauauauguuuguguauauauauacacauaugcauacauaugauuuuuuuuu

SEQ ID NO: 130662 - RNA, 64 nt, Homo Sapiens
uguuuucauuauucugauagauuguauacauauguacacauacauauacacauaugcacaguca

SEQ ID NO: 130663 - RNA, 64 nt, Homo Sapiens
ucugauagauuguauacauauguacacauacauauacacauaugcacagucaaggucaugaugu

SEQ ID NO: 130664 - RNA, 64 nt, Homo Sapiens
uguguguauguauacacacauauacauauauauauacacauacauacacauacauacauacaua

SEQ ID NO: 130665 - RNA, 64 nt, Homo Sapiens
uauacacacauauacauauauauauacacauacauacacauacauacauacauacauauauauc

SEQ ID NO: 130666 - RNA, 64 nt, Homo Sapiens
ucuucuaaaacauauacauauauacauacacacauacacauauucuucaggucucuaagccccu

SEQ ID NO: 130667 - RNA, 64 nt, Homo Sapiens
ccaugcugcuucagccuugagagaccuagguucuuacacauaugcacacacgcauacacacaug

SEQ ID NO: 130668 - RNA, 64 nt, Homo Sapiens
uaaaaauaguuaacacagauucaauagauuguaauacacauaucgaguauuauugaagauguga

SEQ ID NO: 130669 - RNA, 64 nt, Homo Sapiens
acuucauauaacugagaugauuguacaagguauuuacacauacacuuauuacugagagugcaaa

SEQ ID NO: 130670 - RNA, 64 nt, Homo Sapiens
uguguguauguagauauguauacacauacauauauacacauauacauauacauauauacauauc

SEQ ID NO: 130671 - RNA, 64 nt, Homo Sapiens
uauauacacauauaugugugcauauauacauaucuacacauacauguaaauguguguacauaua

SEQ ID NO: 130672 - RNA, 64 nt, Homo Sapiens
uauuauugcaauuaagugauuauacauguacacauacacauaaauauauacauguagauguaca

SEQ ID NO: 130673 - RNA, 64 nt, Homo Sapiens
cauaaauauuauugcaauuauguacauauacauguacacauacacaaacauauauacauguaga

SEQ ID NO: 130674 - RNA, 64 nt, Homo Sapiens
caaauauaugcauauuucaauauacacauauauauacacauacacguguguauauguguauaua

SEQ ID NO: 130675 - RNA, 64 nt, Homo Sapiens
uauacacauacacaaauauauauguguauauauauacacauauaaauauguguguacgugugua

SEQ ID NO: 130676 - RNA, 64 nt, Homo Sapiens
caaauguauauuuuugcaaauacacauacauauauacacauauauuuccuaguagauauauaua

SEQ ID NO: 130677 - RNA, 64 nt, Homo Sapiens
uauauacacauauacaaaugaguagauauauauauacacauacacuuaagcaauauauuuuccu

SEQ ID NO: 130678 - RNA, 64 nt, Homo Sapiens
guauggcaaaacuuaauugauccuacaagcuuacuacacauaggaaaauucauacuggagagaa

SEQ ID NO: 130679 - RNA, 64 nt, Homo Sapiens
guggcaaugccuuuaaucaguccucacaccuuucuacacauaagauaauuuauacuggagagga

SEQ ID NO: 130680 - RNA, 64 nt, Homo Sapiens
guggcaaagccuuuaaccaguuuucaacccuuauuacacauaagauaauucauagcggagagaa

SEQ ID NO: 130681 - RNA, 64 nt, Homo Sapiens
guggaaaagcuuuucaccgauacucaauccuuaguacacauaagaaaauucauacuggggagaa

SEQ ID NO: 130682 - RNA, 64 nt, Homo Sapiens
gcggaaaagccuuuaacugguccucaacucuuauuacacauaagauaauucacaguggagaaaa

SEQ ID NO: 130683 - RNA, 64 nt, Homo Sapiens
uaaaguuuaaauuaacuaaaaauaugcauuuucuuacacauaauuuaaauguuaucauacuuuu

SEQ ID NO: 130684 - RNA, 64 nt, Homo Sapiens
uagcaaacuuuugaaucuuucuuuuauugcuauuuacacauacauacacacauacaaaaccuuu

SEQ ID NO: 130685 - RNA, 64 nt, Homo Sapiens
acgcauauaggguuuuacugauagcuauacuguguacacauaagcaaaauaagaucuguuccuc

SEQ ID NO: 130686 - RNA, 64 nt, Homo Sapiens
cucuagucaguuuugucuccauucacaacuuggcuacacauagacucugcaaggcuaaacuguc

SEQ ID NO: 130687 - RNA, 64 nt, Homo Sapiens
caguaauaauaaaacucagcaaaggagauuucuguacacauaguaggauauucuaaagcaaauu

SEQ ID NO: 130688 - RNA, 64 nt, Homo Sapiens
aaacaguauugaaaaaucccuuucuuuuguuuuuuacacauaagguaaaaacaaaaagaaaacc

SEQ ID NO: 130689 - RNA, 64 nt, Homo Sapiens
cacaucucuguccaaaauuuuggauauguguguauacacauauacacauauacacaucuaugua

SEQ ID NO: 130690 - RNA, 64 nt, Homo Sapiens
cacaucuauguauggauaugugaguguacauauauacacauauacauaucuguacauauacaug

SEQ ID NO: 130691 - RNA, 64 nt, Homo Sapiens
acaagauauagcacuuucaagucaaccucuauacuacacauauuuuuuuaaaaaauagagcuug

SEQ ID NO: 130692 - RNA, 64 nt, Homo Sapiens
auaggccaauauuuuuuuaacaucuagugagcaauacacauauuuacauauuuucaggaucguu

SEQ ID NO: 130693 - RNA, 64 nt, Homo Sapiens
aagggagagaggccuuuuaaaauauauauauauauacacauauauauguauauauacacauaua

SEQ ID NO: 130694 - RNA, 64 nt, Homo Sapiens
aauauauauauauauacacauauauauguauauauacacauauauguauguauacacauauaca

SEQ ID NO: 130695 - RNA, 64 nt, Homo Sapiens
cauauauauguauauauacacauauauguauguauacacauauacacauguauauauacaugug

SEQ ID NO: 130696 - RNA, 64 nt, Homo Sapiens
cauguguguauguauacauguauauauauauacauacacauauauguauacauauauacacaua

SEQ ID NO: 130697 - RNA, 64 nt, Homo Sapiens
uauauauauacauacacauauauguauacauauauacacauauauguauacauauauacacaua

SEQ ID NO: 130698 - RNA, 64 nt, Homo Sapiens
uguauacauauauacacauauauguauacauauauacacauauguauacauauauauauauucu

SEQ ID NO: 130699 - RNA, 64 nt, Homo Sapiens
uuugugcaugaaacagaguuguguauaugccucauacacauaauguggaauucaccuguguuuc

SEQ ID NO: 130700 - RNA, 64 nt, Homo Sapiens
gagaccuuggggaugggaccuuugaauauuuguauacacauaauaccagaauuguuuugcauuu

SEQ ID NO: 130701 - RNA, 64 nt, Homo Sapiens
gaaccuuugaacuauauguauguguauaaggguauacacauacauauauggcauauaacaagug

SEQ ID NO: 130702 - RNA, 64 nt, Homo Sapiens
gguauacacauacauauauggcauauaacaaguguacacauauacacauaacaaguguagaagu

SEQ ID NO: 130703 - RNA, 64 nt, Homo Sapiens
cauacauauauggcauauaacaaguguacacauauacacauaacaaguguagaaguauauauua

SEQ ID NO: 130704 - RNA, 64 nt, Homo Sapiens
gugguggccagcuuggaggauggacauuucuggauacacauacacauacaaaacagaaaacauu

SEQ ID NO: 130705 - RNA, 64 nt, Homo Sapiens
gccagcuuggaggauggacauuucuggauacacauacacauacaaaacagaaaacauuuuuuaa

SEQ ID NO: 130706 - RNA, 64 nt, Homo Sapiens
caagugcacagaccacacacgcucacacacaguauacacauacacacacaugcacacacgugua

SEQ ID NO: 130707 - RNA, 64 nt, Homo Sapiens
ugcauacacaugccugcauauagaccaugcacaguacacauacggugcacugaccacaccugua

SEQ ID NO: 130708 - RNA, 64 nt, Homo Sapiens
ggcuauuguaaaauuuaaaagaaauauuuauauauacacauauauacacauacacacauguaua

SEQ ID NO: 130709 - RNA, 64 nt, Homo Sapiens
aaauuuaaaagaaauauuuauauauacacauauauacacauacacacauguauauauauauucu

SEQ ID NO: 130710 - RNA, 64 nt, Homo Sapiens
aucuugacaccugacuuuccaggaugcacauuuucauacguagaccaguuuccucuugguuucu

SEQ ID NO: 130711 - RNA, 64 nt, Homo Sapiens
gauacacacacacacacacauauauauacacacacauacguauacacacacauacauauauaua

SEQ ID NO: 130712 - RNA, 64 nt, Homo Sapiens
aaaaacaaaaaccuacuagucuugaacaaacugucauacguaugggaccuacacuuaaucuaua

SEQ ID NO: 130713 - RNA, 64 nt, Homo Sapiens
gaaaaccagaguuuuugaaaaggcuuauuuuauacauacguauuauauagagaaacaaauguuu

SEQ ID NO: 130714 - RNA, 64 nt, Homo Sapiens
ucauuuuuuauguauuguuuuacuccuuuuuauucauacguaaaauuuuggauuaauuugugaa

SEQ ID NO: 130715 - RNA, 64 nt, Homo Sapiens
uucauuuuuaaguauuguuuuacuccuuuuuauucauacguaaaauuuuggauuaauuugugaa

SEQ ID NO: 130716 - RNA, 64 nt, Homo Sapiens
ucugccuaucuucuuucacauauguguuuuuuuacauacguacuuuucccccuuaguuuguuuc

SEQ ID NO: 130717 - RNA, 64 nt, Homo Sapiens
aguaaguuaauuuguuucugcauauaugcacauacauacguaaggaucuuaaacccagucuuga

SEQ ID NO: 130718 - RNA, 64 nt, Homo Sapiens
aaaacaagcaaaaccaaagaauauguagucuaagcauacguauacaauaaaacuaugcuauuaa

SEQ ID NO: 130719 - RNA, 64 nt, Homo Sapiens
uuuuuaacuauuuggaacucgucaugggaaauggcauacguagcuaaguuauuuuagugugaag

SEQ ID NO: 130720 - RNA, 64 nt, Homo Sapiens
ccauccugcucagcugcgucaugggccccccaugcauacguacauuccuggacacccucaccac

SEQ ID NO: 130721 - RNA, 64 nt, Homo Sapiens
caaugacugcuuucaaaaaacaccagaauaaauacauacguaguguaagcaagcgaccacuguu

SEQ ID NO: 130722 - RNA, 64 nt, Homo Sapiens
gaaaaggccuagcgaggcaacuaggccucaaaaacauacguaacuuuucguaacagucgucgaa

SEQ ID NO: 130723 - RNA, 64 nt, Homo Sapiens
cccagugccagcuggugaauccaugaucaaaaugcauacguauuguuaaaugauaagguuuaga

SEQ ID NO: 130724 - RNA, 64 nt, Homo Sapiens
uguguguguauaucgaugugcgacauucucucuacauacguauaucacuggaaacuuccucucu

SEQ ID NO: 130725 - RNA, 64 nt, Homo Sapiens
agauaggcacaugcaucuucuguguuuguaugugcauacguauguuuuuaccuguuuguggaug

SEQ ID NO: 130726 - RNA, 64 nt, Homo Sapiens
uauaaguggccucucuuagcucaguuacucaauucauacguaguauuuuuuaaaauaauuuuau

SEQ ID NO: 130727 - RNA, 64 nt, Homo Sapiens
accaaacccucucuaccaugugagguggccuuuacauacguaggcccagacaaaucuaauaucc

SEQ ID NO: 130728 - RNA, 64 nt, Homo Sapiens
uaaacuggcauagguuacauuaugauauguauaucauacguauacuuaucaagaaguuagcagg

SEQ ID NO: 130729 - RNA, 64 nt, Homo Sapiens
uugcauucuucuuggccaccugcauagucugacacauacguauguacaguuagacuugcaggcu

SEQ ID NO: 130730 - RNA, 64 nt, Homo Sapiens
ugagggaccagcacucagucuaacauguaaacaucauacguaauaaagguuguguuucaaaccu

SEQ ID NO: 130731 - RNA, 64 nt, Homo Sapiens
ucauaaaaugcuauuuuaaaauucauggaacuuucauacguaaaggugcaguugcucauuguag

SEQ ID NO: 130732 - RNA, 64 nt, Homo Sapiens
uucauucuuucuuugcacguucauaaacauucuacauacguauucucuuuugucucuucauuua

SEQ ID NO: 130733 - RNA, 64 nt, Homo Sapiens
aauggugcuguguuuuaaacuuacacaauugggacauacguauguguuuucuuaguaaaauggu

SEQ ID NO: 130734 - RNA, 64 nt, Homo Sapiens
aucauaaaguuugguaaugccuaauauauacuuacauacguaaauguuaaugcacaaaugaucu

SEQ ID NO: 130735 - RNA, 64 nt, Homo Sapiens
uaucuguaagugaaauguuauuauaguuuuacaacauacguauguuguguuugucauuugucua

SEQ ID NO: 130736 - RNA, 64 nt, Homo Sapiens
ggugugcuuucuguguuuuaucauauuuaaauaacauacguaaaauaauaugcuaaaaauauuu

SEQ ID NO: 130737 - RNA, 64 nt, Homo Sapiens
uauagagcuggcauguaauuccaugucuuggauacauacguaucuuacaauugauuaaaaguau

SEQ ID NO: 130738 - RNA, 64 nt, Homo Sapiens
cuggggacugugcucacuaccugggugacaggaucauacguaccccaaaccucaacaucacaca

SEQ ID NO: 130739 - RNA, 64 nt, Homo Sapiens
ucccugagaccuggccucaaagggcugacccagccauacguagauccuggggucuuucuaggac

SEQ ID NO: 130740 - RNA, 64 nt, Homo Sapiens
ugcucauuuugacaaagugcaagaguucagugcucauacguaucuaguucugguugauucacuc

SEQ ID NO: 130741 - RNA, 64 nt, Homo Sapiens
uucaucccuuaauguucucaagugugaggcugugcauacguacacaggacacauacauuuauag

SEQ ID NO: 130742 - RNA, 64 nt, Homo Sapiens
ccaaccaagcacuucaugaauccagccugccacccauacguaggagaaagacgauucagcugug

SEQ ID NO: 130743 - RNA, 64 nt, Homo Sapiens
acagcagaagugcuucagucacuaauaaacuugccauacguauugaagacuuuguuagaaaauu

SEQ ID NO: 130744 - RNA, 64 nt, Homo Sapiens
gcauccucucaguuacuccugaauauucugauuucauacguacccagggagcaugcuguuuugu

SEQ ID NO: 130745 - RNA, 64 nt, Homo Sapiens
gcgaauucccucaaacucuauuugaccugacagccauacguauuccccucugguagccacagac

SEQ ID NO: 130746 - RNA, 64 nt, Homo Sapiens
gcuauacuauacauuagcuuguauuugugcuauacauacguacucuuaauuuccaauaaaugau

SEQ ID NO: 130747 - RNA, 64 nt, Homo Sapiens
uauauauauauaaacacacagcacgguuuuuauacauacguacauguguuggcagugaacaagg

SEQ ID NO: 130748 - RNA, 64 nt, Homo Sapiens
aagacggauuaucuagagaauaaucauauauaugcauacguaaaaauggaccacagugacuuau

SEQ ID NO: 130749 - RNA, 64 nt, Homo Sapiens
uuccguagugcucugggugggcguuuaccauacacauacguauuugugauacuugaaggaggaa

SEQ ID NO: 130750 - RNA, 64 nt, Homo Sapiens
caaauauuauaguauaauagaauacauauauacacauacguauguuuacuuuuuuaaaaaagca

SEQ ID NO: 130751 - RNA, 64 nt, Homo Sapiens
aaguuauuacugcaucauuucagauauaaaaugacauacguaagaccuucagauauauuuucac

SEQ ID NO: 130752 - RNA, 64 nt, Homo Sapiens
ucuucccaauuuaguaacuuagaugcuuccagcacauacguagguagcuaccccagccgguuug

SEQ ID NO: 130753 - RNA, 64 nt, Homo Sapiens
cauuuuauuuuauuaugcauuggcccuggccuagcauacguacacacuguuucaaacuuuacua

SEQ ID NO: 130754 - RNA, 64 nt, Homo Sapiens
ggcagccaggagaccccaggugaguuucugagcgcauacguaguugguucuuacccccaggugu

SEQ ID NO: 130755 - RNA, 64 nt, Homo Sapiens
agauguaagugcuuuugggcuccaauuacugaggcauacguaacccucagcccaauucgggccc

SEQ ID NO: 130756 - RNA, 64 nt, Homo Sapiens
aguuguaagugcuuuugggcuccaauuacugaggcauacguaaccuucagcccaauucgggucc

SEQ ID NO: 130757 - RNA, 64 nt, Homo Sapiens
auggugcuugcucuauuuggagagaaacuaaacacauacguaaguugccuuguaaucaacagag

SEQ ID NO: 130758 - RNA, 64 nt, Homo Sapiens
ccggcaccgugaugcaaguuauccaugagcuacacauacguagcagcauuuucaugccauggua

SEQ ID NO: 130759 - RNA, 64 nt, Homo Sapiens
guuuauucaaggauguguggcaacuuucaacuuccauacguauauauguauguauggaaggcca

SEQ ID NO: 130760 - RNA, 64 nt, Homo Sapiens
ucaugccagugcgagggcgucccgugcccacguacauacguaugucuccaugaguucugggcuc

SEQ ID NO: 130761 - RNA, 64 nt, Homo Sapiens
uuuuaugaccaugagcuaagauacuuuauuuacccauacguauaugaaucucuaguaugugugu

SEQ ID NO: 130762 - RNA, 64 nt, Homo Sapiens
ucuuccuucucgccgucuugcaguugaagagcuacauacguagucaguuucgauuuguuacaga

SEQ ID NO: 130763 - RNA, 64 nt, Homo Sapiens
auucaguaacugccauauuaauuagcauaagcugcauacguaaugguuggaagauagcaguauu

SEQ ID NO: 130764 - RNA, 64 nt, Homo Sapiens
aaucucucauuuguguggagugauagugggaccacauacguaaauuaacugcuuccuauaauuu

SEQ ID NO: 130765 - RNA, 64 nt, Homo Sapiens; identical to SEQ ID NO: 46370

SEQ ID NO: 130766 - RNA, 64 nt, Homo Sapiens; identical to SEQ ID NO: 46371

SEQ ID NO: 130767 - RNA, 64 nt, Homo Sapiens; identical to SEQ ID NO: 46372

SEQ ID NO: 130768 - RNA, 64 nt, Homo Sapiens; identical to SEQ ID NO: 46373

SEQ ID NO: 130769 - RNA, 64 nt, Homo Sapiens; identical to SEQ ID NO: 46374

SEQ ID NO: 130770 - RNA, 64 nt, Homo Sapiens; identical to SEQ ID NO: 46375

SEQ ID NO: 130771 - RNA, 64 nt, Homo Sapiens; identical to SEQ ID NO: 46376

SEQ ID NO: 130772 - RNA, 64 nt, Homo Sapiens; identical to SEQ ID NO: 46377

SEQ ID NO: 130773 - RNA, 64 nt, Homo Sapiens; identical to SEQ ID NO: 46378

SEQ ID NO: 130774 - RNA, 64 nt, Homo Sapiens; identical to SEQ ID NO: 46379

SEQ ID NO: 130775 - RNA, 64 nt, Homo Sapiens; identical to SEQ ID NO: 46380

SEQ ID NO: 130776 - RNA, 64 nt, Homo Sapiens; identical to SEQ ID NO: 46381

SEQ ID NO: 130777 - RNA, 64 nt, Homo Sapiens; identical to SEQ ID NO: 46382

SEQ ID NO: 130778 - RNA, 64 nt, Homo Sapiens; identical to SEQ ID NO: 46383

SEQ ID NO: 130779 - RNA, 64 nt, Homo Sapiens; identical to SEQ ID NO: 46384

SEQ ID NO: 130780 - RNA, 64 nt, Homo Sapiens; identical to SEQ ID NO: 46385

SEQ ID NO: 130781 - RNA, 64 nt, Homo Sapiens; identical to SEQ ID NO: 46386

SEQ ID NO: 130782 - RNA, 64 nt, Homo Sapiens; identical to SEQ ID NO: 46387

SEQ ID NO: 130783 - RNA, 64 nt, Homo Sapiens; identical to SEQ ID NO: 46388

SEQ ID NO: 130784 - RNA, 64 nt, Homo Sapiens; identical to SEQ ID NO: 46389

SEQ ID NO: 130785 - RNA, 64 nt, Homo Sapiens; identical to SEQ ID NO: 46390

SEQ ID NO: 130786 - RNA, 64 nt, Homo Sapiens; identical to SEQ ID NO: 46391

SEQ ID NO: 130787 - RNA, 64 nt, Homo Sapiens; identical to SEQ ID NO: 46392

SEQ ID NO: 130788 - RNA, 64 nt, Homo Sapiens; identical to SEQ ID NO: 46393

SEQ ID NO: 130789 - RNA, 64 nt, Homo Sapiens; identical to SEQ ID NO: 46394

SEQ ID NO: 130790 - RNA, 64 nt, Homo Sapiens; identical to SEQ ID NO: 46395

SEQ ID NO: 130791 - RNA, 64 nt, Homo Sapiens; identical to SEQ ID NO: 46396

SEQ ID NO: 130792 - RNA, 64 nt, Homo Sapiens; identical to SEQ ID NO: 46397

SEQ ID NO: 130793 - RNA, 64 nt, Homo Sapiens; identical to SEQ ID NO: 46398

SEQ ID NO: 130794 - RNA, 64 nt, Homo Sapiens; identical to SEQ ID NO: 46399

SEQ ID NO: 130795 - RNA, 64 nt, Homo Sapiens; identical to SEQ ID NO: 46400

SEQ ID NO: 130796 - RNA, 64 nt, Homo Sapiens; identical to SEQ ID NO: 46401

SEQ ID NO: 130797 - RNA, 64 nt, Homo Sapiens; identical to SEQ ID NO: 46402

SEQ ID NO: 130798 - RNA, 64 nt, Homo Sapiens; identical to SEQ ID NO: 46403

SEQ ID NO: 130799 - RNA, 64 nt, Homo Sapiens; identical to SEQ ID NO: 46404

SEQ ID NO: 130800 - RNA, 64 nt, Homo Sapiens; identical to SEQ ID NO: 46405

SEQ ID NO: 130801 - RNA, 64 nt, Homo Sapiens; identical to SEQ ID NO: 46406

SEQ ID NO: 130802 - RNA, 64 nt, Homo Sapiens; identical to SEQ ID NO: 46407

SEQ ID NO: 130803 - RNA, 64 nt, Homo Sapiens; identical to SEQ ID NO: 46408

SEQ ID NO: 130804 - RNA, 64 nt, Homo Sapiens; identical to SEQ ID NO: 46409

SEQ ID NO: 130805 - RNA, 64 nt, Homo Sapiens; identical to SEQ ID NO: 46410

SEQ ID NO: 130806 - RNA, 64 nt, Homo Sapiens; identical to SEQ ID NO: 46411

SEQ ID NO: 130807 - RNA, 64 nt, Homo Sapiens; identical to SEQ ID NO: 46412

SEQ ID NO: 130808 - RNA, 64 nt, Homo Sapiens; identical to SEQ ID NO: 46413

SEQ ID NO: 130809 - RNA, 64 nt, Homo Sapiens; identical to SEQ ID NO: 46414

SEQ ID NO: 130810 - RNA, 64 nt, Homo Sapiens; identical to SEQ ID NO: 46415

SEQ ID NO: 130811 - RNA, 64 nt, Homo Sapiens; identical to SEQ ID NO: 46416

SEQ ID NO: 130812 - RNA, 64 nt, Homo Sapiens; identical to SEQ ID NO: 46417

SEQ ID NO: 130813 - RNA, 64 nt, Homo Sapiens; identical to SEQ ID NO: 46418

SEQ ID NO: 130814 - RNA, 64 nt, Homo Sapiens; identical to SEQ ID NO: 46419

SEQ ID NO: 130815 - RNA, 64 nt, Homo Sapiens; identical to SEQ ID NO: 46420

SEQ ID NO: 130816 - RNA, 64 nt, Homo Sapiens; identical to SEQ ID NO: 46421

SEQ ID NO: 130817 - RNA, 64 nt, Homo Sapiens; identical to SEQ ID NO: 46422

SEQ ID NO: 130818 - RNA, 64 nt, Homo Sapiens; identical to SEQ ID NO: 46423

SEQ ID NO: 130819 - RNA, 64 nt, Homo Sapiens; identical to SEQ ID NO: 46424

SEQ ID NO: 130820 - RNA, 64 nt, Homo Sapiens; identical to SEQ ID NO: 46425

SEQ ID NO: 130821 - RNA, 64 nt, Homo Sapiens; identical to SEQ ID NO: 46426

SEQ ID NO: 130822 - RNA, 64 nt, Homo Sapiens; identical to SEQ ID NO: 46427

SEQ ID NO: 130823 - RNA, 64 nt, Homo Sapiens; identical to SEQ ID NO: 46428

SEQ ID NO: 130824 - RNA, 64 nt, Homo Sapiens; identical to SEQ ID NO: 46429

SEQ ID NO: 130825 - RNA, 64 nt, Homo Sapiens; identical to SEQ ID NO: 46430

SEQ ID NO: 130826 - RNA, 64 nt, Homo Sapiens; identical to SEQ ID NO: 46431

SEQ ID NO: 130827 - RNA, 64 nt, Homo Sapiens; identical to SEQ ID NO: 46432

SEQ ID NO: 130828 - RNA, 64 nt, Homo Sapiens; identical to SEQ ID NO: 46433

SEQ ID NO: 130829 - RNA, 64 nt, Homo Sapiens; identical to SEQ ID NO: 46434

SEQ ID NO: 130830 - RNA, 64 nt, Homo Sapiens; identical to SEQ ID NO: 46435

SEQ ID NO: 130831 - RNA, 64 nt, Homo Sapiens; identical to SEQ ID NO: 46436

SEQ ID NO: 130832 - RNA, 64 nt, Homo Sapiens; identical to SEQ ID NO: 46437

SEQ ID NO: 130833 - RNA, 64 nt, Homo Sapiens; identical to SEQ ID NO: 46438

SEQ ID NO: 130834 - RNA, 64 nt, Homo Sapiens; identical to SEQ ID NO: 46439

SEQ ID NO: 130835 - RNA, 64 nt, Homo Sapiens; identical to SEQ ID NO: 46440

SEQ ID NO: 130836 - RNA, 64 nt, Homo Sapiens; identical to SEQ ID NO: 46441

SEQ ID NO: 130837 - RNA, 64 nt, Homo Sapiens; identical to SEQ ID NO: 46442

SEQ ID NO: 130838 - RNA, 64 nt, Homo Sapiens; identical to SEQ ID NO: 46443

SEQ ID NO: 130839 - RNA, 64 nt, Homo Sapiens; identical to SEQ ID NO: 46444

SEQ ID NO: 130840 - RNA, 64 nt, Homo Sapiens; identical to SEQ ID NO: 46445

SEQ ID NO: 130841 - RNA, 64 nt, Homo Sapiens; identical to SEQ ID NO: 46446

SEQ ID NO: 130842 - RNA, 64 nt, Homo Sapiens; identical to SEQ ID NO: 46447

SEQ ID NO: 130843 - RNA, 64 nt, Homo Sapiens; identical to SEQ ID NO: 46448

SEQ ID NO: 130844 - RNA, 64 nt, Homo Sapiens; identical to SEQ ID NO: 46449

SEQ ID NO: 130845 - RNA, 64 nt, Homo Sapiens; identical to SEQ ID NO: 46450

SEQ ID NO: 130846 - RNA, 64 nt, Homo Sapiens; identical to SEQ ID NO: 46451

SEQ ID NO: 130847 - RNA, 64 nt, Homo Sapiens; identical to SEQ ID NO: 46452

SEQ ID NO: 130848 - RNA, 64 nt, Homo Sapiens; identical to SEQ ID NO: 46453

SEQ ID NO: 130849 - RNA, 64 nt, Homo Sapiens; identical to SEQ ID NO: 46454

SEQ ID NO: 130850 - RNA, 64 nt, Homo Sapiens; identical to SEQ ID NO: 46455

SEQ ID NO: 130851 - RNA, 64 nt, Homo Sapiens; identical to SEQ ID NO: 46456

SEQ ID NO: 130852 - RNA, 64 nt, Homo Sapiens; identical to SEQ ID NO: 46457

SEQ ID NO: 130853 - RNA, 64 nt, Homo Sapiens; identical to SEQ ID NO: 46458

SEQ ID NO: 130854 - RNA, 64 nt, Homo Sapiens; identical to SEQ ID NO: 46459

SEQ ID NO: 130855 - RNA, 64 nt, Homo Sapiens; identical to SEQ ID NO: 46460

SEQ ID NO: 130856 - RNA, 64 nt, Homo Sapiens; identical to SEQ ID NO: 46461

SEQ ID NO: 130857 - RNA, 64 nt, Homo Sapiens; identical to SEQ ID NO: 46462

SEQ ID NO: 130858 - RNA, 64 nt, Homo Sapiens; identical to SEQ ID NO: 46463

SEQ ID NO: 130859 - RNA, 64 nt, Homo Sapiens; identical to SEQ ID NO: 46464

SEQ ID NO: 130860 - RNA, 64 nt, Homo Sapiens; identical to SEQ ID NO: 46465

SEQ ID NO: 130861 - RNA, 64 nt, Homo Sapiens; identical to SEQ ID NO: 46466

SEQ ID NO: 130862 - RNA, 64 nt, Homo Sapiens; identical to SEQ ID NO: 46467

SEQ ID NO: 130863 - RNA, 64 nt, Homo Sapiens; identical to SEQ ID NO: 46468

SEQ ID NO: 130864 - RNA, 64 nt, Homo Sapiens; identical to SEQ ID NO: 46469

SEQ ID NO: 130865 - RNA, 64 nt, Homo Sapiens; identical to SEQ ID NO: 46470

SEQ ID NO: 130866 - RNA, 64 nt, Homo Sapiens; identical to SEQ ID NO: 46471

SEQ ID NO: 130867 - RNA, 64 nt, Homo Sapiens; identical to SEQ ID NO: 46472

SEQ ID NO: 130868 - RNA, 64 nt, Homo Sapiens; identical to SEQ ID NO: 46473

SEQ ID NO: 130869 - RNA, 64 nt, Homo Sapiens; identical to SEQ ID NO: 46474

SEQ ID NO: 130870 - RNA, 60 nt, Homo Sapiens; identical to SEQ ID NO: 46475

SEQ ID NO: 130871 - RNA, 64 nt, Homo Sapiens; identical to SEQ ID NO: 46476

SEQ ID NO: 130872 - RNA, 64 nt, Homo Sapiens; identical to SEQ ID NO: 46477

SEQ ID NO: 130873 - RNA, 64 nt, Homo Sapiens; identical to SEQ ID NO: 46478

SEQ ID NO: 130874 - RNA, 64 nt, Homo Sapiens; identical to SEQ ID NO: 46479

SEQ ID NO: 130875 - RNA, 64 nt, Homo Sapiens; identical to SEQ ID NO: 46480

SEQ ID NO: 130876 - RNA, 64 nt, Homo Sapiens; identical to SEQ ID NO: 46481

SEQ ID NO: 130877 - RNA, 64 nt, Homo Sapiens; identical to SEQ ID NO: 46482

SEQ ID NO: 130878 - RNA, 64 nt, Homo Sapiens; identical to SEQ ID NO: 46483

SEQ ID NO: 130879 - RNA, 64 nt, Homo Sapiens; identical to SEQ ID NO: 46484

SEQ ID NO: 130880 - RNA, 64 nt, Homo Sapiens; identical to SEQ ID NO: 46485

SEQ ID NO: 130881 - RNA, 64 nt, Homo Sapiens; identical to SEQ ID NO: 46486

SEQ ID NO: 130882 - RNA, 64 nt, Homo Sapiens; identical to SEQ ID NO: 46487

SEQ ID NO: 130883 - RNA, 64 nt, Homo Sapiens; identical to SEQ ID NO: 46488

SEQ ID NO: 130884 - RNA, 64 nt, Homo Sapiens; identical to SEQ ID NO: 46489

SEQ ID NO: 130885 - RNA, 64 nt, Homo Sapiens; identical to SEQ ID NO: 46490

SEQ ID NO: 130886 - RNA, 64 nt, Homo Sapiens; identical to SEQ ID NO: 46491

SEQ ID NO: 130887 - RNA, 64 nt, Homo Sapiens; identical to SEQ ID NO: 46492

SEQ ID NO: 130888 - RNA, 64 nt, Homo Sapiens; identical to SEQ ID NO: 46493

SEQ ID NO: 130889 - RNA, 64 nt, Homo Sapiens; identical to SEQ ID NO: 46494

SEQ ID NO: 130890 - RNA, 64 nt, Homo Sapiens; identical to SEQ ID NO: 46495

SEQ ID NO: 130891 - RNA, 64 nt, Homo Sapiens; identical to SEQ ID NO: 46496

SEQ ID NO: 130892 - RNA, 64 nt, Homo Sapiens; identical to SEQ ID NO: 46497

SEQ ID NO: 130893 - RNA, 64 nt, Homo Sapiens; identical to SEQ ID NO: 46498

SEQ ID NO: 130894 - RNA, 64 nt, Homo Sapiens; identical to SEQ ID NO: 46499

SEQ ID NO: 130895 - RNA, 64 nt, Homo Sapiens; identical to SEQ ID NO: 46500

SEQ ID NO: 130896 - RNA, 64 nt, Homo Sapiens; identical to SEQ ID NO: 46501

SEQ ID NO: 130897 - RNA, 64 nt, Homo Sapiens; identical to SEQ ID NO: 46502

SEQ ID NO: 130898 - RNA, 64 nt, Homo Sapiens; identical to SEQ ID NO: 46503

SEQ ID NO: 130899 - RNA, 64 nt, Homo Sapiens; identical to SEQ ID NO: 46504

SEQ ID NO: 130900 - RNA, 64 nt, Homo Sapiens; identical to SEQ ID NO: 46505

SEQ ID NO: 130901 - RNA, 64 nt, Homo Sapiens; identical to SEQ ID NO: 46506

SEQ ID NO: 130902 - RNA, 64 nt, Homo Sapiens; identical to SEQ ID NO: 46507

SEQ ID NO: 130903 - RNA, 64 nt, Homo Sapiens; identical to SEQ ID NO: 46508

SEQ ID NO: 130904 - RNA, 64 nt, Homo Sapiens; identical to SEQ ID NO: 46509

SEQ ID NO: 130905 - RNA, 64 nt, Homo Sapiens; identical to SEQ ID NO: 46510

SEQ ID NO: 130906 - RNA, 64 nt, Homo Sapiens; identical to SEQ ID NO: 46511

SEQ ID NO: 130907 - RNA, 64 nt, Homo Sapiens; identical to SEQ ID NO: 46512

SEQ ID NO: 130908 - RNA, 64 nt, Homo Sapiens; identical to SEQ ID NO: 46513

SEQ ID NO: 130909 - RNA, 64 nt, Homo Sapiens; identical to SEQ ID NO: 46514

SEQ ID NO: 130910 - RNA, 64 nt, Homo Sapiens; identical to SEQ ID NO: 46515

SEQ ID NO: 130911 - RNA, 64 nt, Homo Sapiens; identical to SEQ ID NO: 46516

SEQ ID NO: 130912 - RNA, 64 nt, Homo Sapiens; identical to SEQ ID NO: 46517

SEQ ID NO: 130913 - RNA, 64 nt, Homo Sapiens; identical to SEQ ID NO: 46518

SEQ ID NO: 130914 - RNA, 64 nt, Homo Sapiens; identical to SEQ ID NO: 46519

SEQ ID NO: 130915 - RNA, 64 nt, Homo Sapiens; identical to SEQ ID NO: 46520

SEQ ID NO: 130916 - RNA, 64 nt, Homo Sapiens; identical to SEQ ID NO: 46521

SEQ ID NO: 130917 - RNA, 64 nt, Homo Sapiens; identical to SEQ ID NO: 46522

SEQ ID NO: 130918 - RNA, 64 nt, Homo Sapiens; identical to SEQ ID NO: 46523

SEQ ID NO: 130919 - RNA, 64 nt, Homo Sapiens; identical to SEQ ID NO: 46524

SEQ ID NO: 130920 - RNA, 64 nt, Homo Sapiens; identical to SEQ ID NO: 46525

SEQ ID NO: 130921 - RNA, 64 nt, Homo Sapiens; identical to SEQ ID NO: 46526

SEQ ID NO: 130922 - RNA, 64 nt, Homo Sapiens; identical to SEQ ID NO: 46527

SEQ ID NO: 130923 - RNA, 64 nt, Homo Sapiens; identical to SEQ ID NO: 46528

SEQ ID NO: 130924 - RNA, 64 nt, Homo Sapiens; identical to SEQ ID NO: 46529

SEQ ID NO: 130925 - RNA, 50 nt, Homo Sapiens; identical to SEQ ID NO: 46530

SEQ ID NO: 130926 - RNA, 64 nt, Homo Sapiens; identical to SEQ ID NO: 46531

SEQ ID NO: 130927 - RNA, 62 nt, Homo Sapiens
agcagauggccuauuugaggaagagggugucugcccuucacaaacaccucucucuccccugc

SEQ ID NO: 130928 - RNA, 62 nt, Homo Sapiens
cugcacuagcugucccaagcuuacauacagaggcccuucaggagggccuccugugccgcagg

SEQ ID NO: 130929 - RNA, 62 nt, Homo Sapiens
uacuacccuggagggacagcucugcccuugaggcccuucagaaauuugugcugauuuggucc

SEQ ID NO: 130930 - RNA, 62 nt, Homo Sapiens
acugcaguguagggaauaggucaccaggaggagcccuucauccuggcaggccggauugugga

SEQ ID NO: 130931 - RNA, 62 nt, Homo Sapiens
ccuuucccaucuggagagaagcuuccagaccagcccuucacacaccacagccaggaggggcc

SEQ ID NO: 130932 - RNA, 62 nt, Homo Sapiens
ccguuccugccuggagagaagcuuccagaccagcccuucacaccacagccaggagaggccuu

SEQ ID NO: 130933 - RNA, 62 nt, Homo Sapiens
agacuugcccuuguuacugccaaggugaacuugcccuucaaucgagacucagcuuaucugau

SEQ ID NO: 130934 - RNA, 62 nt, Homo Sapiens
aagaguuagcugccagcucuucauucuauuucgcccuucacauagaagucagucaugacucu

SEQ ID NO: 130935 - RNA, 62 nt, Homo Sapiens
ggccaagccuggcccuuaaacaacugcagaaagcccuucaacuucagaaggccucacucaag

SEQ ID NO: 130936 - RNA, 62 nt, Homo Sapiens
uggguucagccucucccacaauaagaguucuugcccuucauacccucuaccuggauggaugg

SEQ ID NO: 130937 - RNA, 62 nt, Homo Sapiens
aggacccuguucacugcugcgacuuagaaagugcccuucaaacugugucaucucagucauuu

SEQ ID NO: 130938 - RNA, 62 nt, Homo Sapiens
guagagaaccauguaaacauguccauguuggugcccuucagauuccauguuaagaaggugag

SEQ ID NO: 130939 - RNA, 62 nt, Homo Sapiens
uucacaaagucagagcgauaggaaagcacccugcccuucaucuucauguucucccaaaugga

SEQ ID NO: 130940 - RNA, 62 nt, Homo Sapiens
cagauuucguuuccgucaacuuaaacauuguugcccuucaacaaggcucuugaauuaauaaa

SEQ ID NO: 130941 - RNA, 62 nt, Homo Sapiens
cuuaaaaaccuauacaacaauaagaggagugcgcccuucagcagcauguauacaaaaauugc

SEQ ID NO: 130942 - RNA, 62 nt, Homo Sapiens
aauaggaggagcacuucgagucgaguguaagggcccuucacaaaagcagaaggaacacuggc

SEQ ID NO: 130943 - RNA, 64 nt, Homo Sapiens
aauuuauuuaaacuaaguaaguagcuuaauuuuuauuugcaauuuuuuauucaggcuauauauu

SEQ ID NO: 130944 - RNA, 64 nt, Homo Sapiens
uuaggaagaaggacgagagaaaccuagcucaaggauuugcaaagugaaugguagcuuagugagc

SEQ ID NO: 130945 - RNA, 64 nt, Homo Sapiens
aaaacacauugccuaacuacuaguuuuuacuuuuauuugcaacauuuacaguccuucaaaaucc

SEQ ID NO: 130946 - RNA, 64 nt, Homo Sapiens
cuauucugccacuccugacagggugaccuuggguauuugcaauauuccuuugggccucugcuuc

SEQ ID NO: 130947 - RNA, 64 nt, Homo Sapiens
uucccauuguuuuaacagcucauuauauauuugcauuugcaaauaaaugugauagcugugcaug

SEQ ID NO: 130948 - RNA, 64 nt, Homo Sapiens
aaugaacaaguuaaugaacaaaaaaauucucauuauuugcaaagcauaggacaauuaauggaaa

SEQ ID NO: 130949 - RNA, 64 nt, Homo Sapiens
aauguacauauuguuguuuguuuaguuuaauauaauuugcaauaauauuuugauuuccccucau

SEQ ID NO: 130950 - RNA, 64 nt, Homo Sapiens
aguaaacaguucauauuuugaauuaaaauuauugauuugcaagugauuuuuaucagagugagaa

SEQ ID NO: 130951 - RNA, 56 nt, Homo Sapiens
ggagaaaaugaaggccaaacaaaugcauuugcaaaguauucuuaacccuaagguaa

SEQ ID NO: 130952 - RNA, 64 nt, Homo Sapiens
uggaauuugugugaguugauuuguccuuaauuauauuugcaauuauaaggcaaagcagaaucug

SEQ ID NO: 130953 - RNA, 64 nt, Homo Sapiens
gaccuaauuuuugguuacuucagaagaaucaugaauuugcaacaguucuuuugguuuccccccu

SEQ ID NO: 130954 - RNA, 64 nt, Homo Sapiens
uaugccugacugaauuaagcggaaacauguuuuuauuugcaauaauuuuuauuccagccuacuu

SEQ ID NO: 130955 - RNA, 64 nt, Homo Sapiens
guucaccuuccaaaucaugagggaagcauaguuuauuugcaaguagccuggcacucccaaaucu

SEQ ID NO: 130956 - RNA, 64 nt, Homo Sapiens
uuguuuacuuuaaaagguugguuggaauacuaaaauuugcaaccucuccauaggucaaaauauu

SEQ ID NO: 130957 - RNA, 64 nt, Homo Sapiens
uuuugcuguuuuggaagugucaguguuugcacauauuugcaauugcaguacucugaauggacca

SEQ ID NO: 130958 - RNA, 64 nt, Homo Sapiens
uagagaugacuguuuuuugccacagcccuauggaauuugcaaucugugauugccuuguaaaaag

SEQ ID NO: 130959 - RNA, 64 nt, Homo Sapiens
uauucauuuaauggcauagaccauaccagaccuaauuugcaaguauugggucuuaaacuucaag

SEQ ID NO: 130960 - RNA, 64 nt, Homo Sapiens
aaaaguucauguaauauuucugauuuuucagaauauuugcaauaagagucuggauuuuaaaaaa

SEQ ID NO: 130961 - RNA, 64 nt, Homo Sapiens
auuuggaagcuaccaggaaugcuuucuaauuaucauuugcaacuagaacuguaaucagaaagaa

SEQ ID NO: 130962 - RNA, 64 nt, Homo Sapiens
gcuucugacaucaccagagcaaacuccuuguuuuauuugcaaguuaacagaagaugugauuugc

SEQ ID NO: 130963 - RNA, 64 nt, Homo Sapiens
uccuuguuuuauuugcaaguuaacagaagaugugauuugcaaacugcugcccacuccuccccua

SEQ ID NO: 130964 - RNA, 64 nt, Homo Sapiens
augggacucuuaugaaaaacucaccauauggccaauuugcaacaacacacagcuucaacaauug

SEQ ID NO: 130965 - RNA, 64 nt, Homo Sapiens
ugugcaaagaccucuuaugaccaauucaaacugcauuugcaaaaacaccuggacuccuugacau

SEQ ID NO: 130966 - RNA, 64 nt, Homo Sapiens
ccagaaaauaacugugccccaagaagugcuccagauuugcaaggaauagccccaagagaauacc

SEQ ID NO: 130967 - RNA, 64 nt, Homo Sapiens
agaggcugguuauaaauuugaacucccucagcccauuugcaacucugccucuguucucuugcau

SEQ ID NO: 130968 - RNA, 64 nt, Homo Sapiens
ugcaauaaaacacauuuuagaucaccugcaauucauuugcaaauucaauuggcuuauuuuuuag

SEQ ID NO: 130969 - RNA, 64 nt, Homo Sapiens
cagagcaagagcucuuucucuuguuuaucacgccauuugcaaauugagaugaucacgguuucuu

SEQ ID NO: 130970 - RNA, 64 nt, Homo Sapiens
guauuuuuuuccuuguaucaagaugcaaaacauaauuugcaaaauuuuauaauugaaauaaaac

SEQ ID NO: 130971 - RNA, 64 nt, Homo Sapiens
uagcguacaauuuaucauaaauauaugagguaaaauuugcaaaacuuuccacaguacuuucuug

SEQ ID NO: 130972 - RNA, 64 nt, Homo Sapiens
auacauccaauaugucaaguuaaaccauucugggauuugcaaaguuuaauacauccaauauguc

SEQ ID NO: 130973 - RNA, 64 nt, Homo Sapiens; identical to SEQ ID NO: 130972

SEQ ID NO: 130974 - RNA, 64 nt, Homo Sapiens
auuucucccuaugauaauguauuuuaaaaguuacauuugcaaaugccauuuaaauuauauccuc

SEQ ID NO: 130975 - RNA, 64 nt, Homo Sapiens
gaagcuugaaaaauaugagaauagccuuggguuuauuugcaaagcuuuaguucuuacauuucua

SEQ ID NO: 130976 - RNA, 64 nt, Homo Sapiens
uucaaaacuuauuagaacaguagcuucugcuggaauuugcaaucacugaagucauagaaaauag

SEQ ID NO: 130977 - RNA, 64 nt, Homo Sapiens
cuagaauugugaacuuuuaagagucugacuagaaauuugcaacuuauaaaaaaguuacuuuuaa

SEQ ID NO: 130978 - RNA, 64 nt, Homo Sapiens
uaacaguuugagacugucucagaaaccccaagaaauuugcaacuuaucaaggaaauaauaaagc

SEQ ID NO: 130979 - RNA, 64 nt, Homo Sapiens
agguaccaaaaaaauccauaccauguuuaccaucauuugcaaaaucuguucucagguuuuaacu

SEQ ID NO: 130980 - RNA, 64 nt, Homo Sapiens
uugaugauucuauguccagcgggaaaggcuucauauuugcaacuuaggccugucaggucuccuu

SEQ ID NO: 130981 - RNA, 64 nt, Homo Sapiens
accauggcuggguaaccaccaguuucccugagguauuugcaaccuuccaguucugguugcuguu

SEQ ID NO: 130982 - RNA, 64 nt, Homo Sapiens
ucagaaaugguagcuauucuauaccuaugguuuaaguaaauauuucugaauaaggcuucaccau

SEQ ID NO: 130983 - RNA, 64 nt, Homo Sapiens
ggaggucaguaaacuuucuguggaagggccagagaguaaauauuuuaggcuuugcagcccauac

SEQ ID NO: 130984 - RNA, 64 nt, Homo Sapiens
gguuugaaaugaagacuuugucguguacuuaggaaguaaauaucuuuugaauuagagaaagugu

SEQ ID NO: 130985 - RNA, 64 nt, Homo Sapiens
agcuauaugaauuuuggcauguuucagagagaucaguaaauaaaauauuagauaaaauauauau

SEQ ID NO: 130986 - RNA, 64 nt, Homo Sapiens
uaaaagagauaauuucaagcaaaauaagguaagaaguaaauaugugaauaaacaaauaaguagu

SEQ ID NO: 130987 - RNA, 64 nt, Homo Sapiens
acuuagcauguaaacucauucuuuuaaagggaaaaguaaauauauuaauaagauagcacauuga

SEQ ID NO: 130988 - RNA, 64 nt, Homo Sapiens
uucagugaaggaaaggaauugagagauuuuucuuaguaaauagauuauuguuaaguaaauaguu

SEQ ID NO: 130989 - RNA, 64 nt, Homo Sapiens
ugagagauuuuucuuaguaaauagauuauuguuaaguaaauaguuauuaaaaauauaucucacu

SEQ ID NO: 130990 - RNA, 64 nt, Homo Sapiens
uucaaggggaacuugggaccaaaaagaccauuguaguaaauaagagaaggaaauaaauaggagu

SEQ ID NO: 130991 - RNA, 64 nt, Homo Sapiens
cagggaacccugcccagacuaaaaaaaaaaaaaaaguaaauaucuaguuugucuuuggcaaaaa

SEQ ID NO: 130992 - RNA, 64 nt, Homo Sapiens
aaacauuaaaauggucacuugugccaauaagagaaguaaauaucccaucuaucuuauuagucuu

SEQ ID NO: 130993 - RNA, 64 nt, Homo Sapiens
uugaccacuauuuucaacaauuaaauuuugauaaaguaaauauugggugaguuuuauagauuua

SEQ ID NO: 130994 - RNA, 64 nt, Homo Sapiens
uuuagaucucauaaugcuuuguuaaauguuuacaaguaaauaguuugaauucaguaaauauuau

SEQ ID NO: 130995 - RNA, 64 nt, Homo Sapiens
uuguuaaauguuuacaaguaaauaguuugaauucaguaaauauuauugguuguuguauugauca

SEQ ID NO: 130996 - RNA, 64 nt, Homo Sapiens
uuuuaaaaauuuaaaaguaggucaguuuauaacgaguaaauaccuaacacaccaagaaugugca

SEQ ID NO: 130997 - RNA, 64 nt, Homo Sapiens
ucaaugccaucugaagauuuuguaauugaguagcaguaaauauacagauuuacaauguuuuaac

SEQ ID NO: 130998 - RNA, 64 nt, Homo Sapiens
auuaaugcauuucuagagggcugcugcccuguuuaguaaauaaaccggucuugagaccugugaa

SEQ ID NO: 130999 - RNA, 64 nt, Homo Sapiens
aauguauuacauuucaaauaaaacuuauuuuucuaguaaauauugagaacaaauaggaaaaaaa

SEQ ID NO: 131000 - RNA, 64 nt, Homo Sapiens
caaccaacccugaggaacauuaaguaaauaaauaaguaaauaaccucuaaaaaaugaaguguau

SEQ ID NO: 131001 - RNA, 64 nt, Homo Sapiens
uaaguaaauaaccaaccaacaaugaaguguauuaaguaaauaaaacccuaaagcugcucuaaaa

SEQ ID NO: 131002 - RNA, 64 nt, Homo Sapiens
gugcgucauaauugcuaaaagcuaaugugacagaaguaaauauacccaguccaccacagaauca

SEQ ID NO: 131003 - RNA, 64 nt, Homo Sapiens
gaaaauaaguauuuaguuggacugcaauauuuguaguaaauagguuauuggcauauacugacug

SEQ ID NO: 131004 - RNA, 64 nt, Homo Sapiens
ugcauugucauaauaaaauguuauuguuuuuaugaguaaauacauaguguagaauugucugugu

SEQ ID NO: 131005 - RNA, 64 nt, Homo Sapiens
uaccagcaacuuaacuuuuaaaaauauggguaaaaguaaauauuguaaacaguauuauaaaauc

SEQ ID NO: 131006 - RNA, 64 nt, Homo Sapiens
cagguucugaauaacaauauuuuuccaaauugaaaguaaauauuccagaaguugauagccuggu

SEQ ID NO: 131007 - RNA, 64 nt, Homo Sapiens
aaaauggagaaaagaaaguuuucugaaaaaaugcaguaaauauaagccacauuucuaaaguuua

SEQ ID NO: 131008 - RNA, 64 nt, Homo Sapiens
aaauauguaauguuuggaaugcucaccauacacaaguaaauaaaccuggccuugccuucacagg

SEQ ID NO: 131009 - RNA, 64 nt, Homo Sapiens
uuuuuuuggagacagggucuugaaggaggagaugaguaaauauaggcgauuguggagggccucc

SEQ ID NO: 131010 - RNA, 64 nt, Homo Sapiens
cacgucgcucuuccugcggguucuuggcgagacacagcuugagaacagaagggcgucgggggaa

SEQ ID NO: 131011 - RNA, 64 nt, Homo Sapiens
uuggaaaaaaauaaauaaauaaauaaauaaaaggcagcuugaguuuccaaacgugugauucacu

SEQ ID NO: 131012 - RNA, 64 nt, Homo Sapiens
ugauggggagggagguaagagauuucucuuaauucagcuugaauguaucuguguauccacauag

SEQ ID NO: 131013 - RNA, 64 nt, Homo Sapiens
aaaugccgaaagaggguauugugaccaaguugugcagcuugagccaccucuccccucaaauucc

SEQ ID NO: 131014 - RNA, 64 nt, Homo Sapiens
uggggcugcaucccuauaaaccuaaggagcuccucagcuugaaaaagagguaugauuccuaagc

SEQ ID NO: 131015 - RNA, 64 nt, Homo Sapiens
uaacaauuuuccaacuuuaccuccuaauuaaugacagcuugacuaacguuagcaacacagcagu

SEQ ID NO: 131016 - RNA, 64 nt, Homo Sapiens
uuaaguaaugaauauauaagaacuguacucuucucagcuugagcuuacauagguaaauaucacc

SEQ ID NO: 131017 - RNA, 64 nt, Homo Sapiens
ucuggcaaccauauuucuggaaguugagauguuucagcuugaagaaccaaaacagaaggaauau

SEQ ID NO: 131018 - RNA, 64 nt, Homo Sapiens; identical to SEQ ID NO: 77261

SEQ ID NO: 131019 - RNA, 64 nt, Homo Sapiens; identical to SEQ ID NO: 77262

SEQ ID NO: 131020 - RNA, 64 nt, Homo Sapiens; identical to SEQ ID NO: 77263

SEQ ID NO: 131021 - RNA, 64 nt, Homo Sapiens; identical to SEQ ID NO: 77264

SEQ ID NO: 131022 - RNA, 64 nt, Homo Sapiens; identical to SEQ ID NO: 77265

SEQ ID NO: 131023 - RNA, 64 nt, Homo Sapiens; identical to SEQ ID NO: 77266

SEQ ID NO: 131024 - RNA, 64 nt, Homo Sapiens; identical to SEQ ID NO: 77267

SEQ ID NO: 131025 - RNA, 64 nt, Homo Sapiens; identical to SEQ ID NO: 77268

SEQ ID NO: 131026 - RNA, 64 nt, Homo Sapiens; identical to SEQ ID NO: 77269

SEQ ID NO: 131027 - RNA, 64 nt, Homo Sapiens; identical to SEQ ID NO: 77270

SEQ ID NO: 131028 - RNA, 64 nt, Homo Sapiens; identical to SEQ ID NO: 77271

SEQ ID NO: 131029 - RNA, 64 nt, Homo Sapiens; identical to SEQ ID NO: 77272

SEQ ID NO: 131030 - RNA, 64 nt, Homo Sapiens; identical to SEQ ID NO: 77273

SEQ ID NO: 131031 - RNA, 64 nt, Homo Sapiens; identical to SEQ ID NO: 77274

SEQ ID NO: 131032 - RNA, 64 nt, Homo Sapiens; identical to SEQ ID NO: 77275

SEQ ID NO: 131033 - RNA, 64 nt, Homo Sapiens; identical to SEQ ID NO: 77276

SEQ ID NO: 131034 - RNA, 64 nt, Homo Sapiens
cuuaugagaaaaccuguguggacaucccuugguguacacuaagacagagcagagcccagcgcuc

SEQ ID NO: 131035 - RNA, 64 nt, Homo Sapiens
ccuugugccggccaggcccaguuuccuugugugauacacuaauguauuugcuuuuuuuggaaau

SEQ ID NO: 131036 - RNA, 64 nt, Homo Sapiens
acaaacuaaauugugauuuauuaaugugaguauauacacuaagaugguauauguucuuuauauu

SEQ ID NO: 131037 - RNA, 64 nt, Homo Sapiens
auuuauguagauaauguacuuauugcugaagacauacacuaagaauuuuuucugugaaacuuca

SEQ ID NO: 131038 - RNA, 64 nt, Homo Sapiens
uucugaaguuaaagcucugcuggacuuuuguacauacacuaaaaggggccuucagcuggagcug

SEQ ID NO: 131039 - RNA, 64 nt, Homo Sapiens
gaaacuuggcacuccugugcuaaaucaaucauguuacacuaauaguuuuguuuuguuuuguuuu

SEQ ID NO: 131040 - RNA, 64 nt, Homo Sapiens
guaacaggccuugagcacaaugaaacacaagaauuacacuaauauaugcucguuucucucaauu

SEQ ID NO: 131041 - RNA, 64 nt, Homo Sapiens
gauauucauauucaagcaaccuucuacauuuuauuacacuaaaucuggaacacaauaauguguc

SEQ ID NO: 131042 - RNA, 64 nt, Homo Sapiens
aaaagcuaaaauggcuuaacaucaugcuacacuuuacacuaaaaaucuauuacugugagugguc

SEQ ID NO: 131043 - RNA, 64 nt, Homo Sapiens
gauguugaaaggaugaaaaaagguauaguagacauacacuaaccaaaaauguagcucuuugaau

SEQ ID NO: 131044 - RNA, 64 nt, Homo Sapiens
cacaugacaguguuuaguuaugcauaacuugagcuacacuaaacaaccuauguuauaugauaca

SEQ ID NO: 131045 - RNA, 64 nt, Homo Sapiens
gagauguguuaaauaaacugauaugucacuccucuacacuaacuccuuguggaaagacauguuc

SEQ ID NO: 131046 - RNA, 64 nt, Homo Sapiens; identical to SEQ ID NO: 24182

SEQ ID NO: 131047 - RNA, 64 nt, Homo Sapiens; identical to SEQ ID NO: 24183

SEQ ID NO: 131048 - RNA, 64 nt, Homo Sapiens; identical to SEQ ID NO: 24184

SEQ ID NO: 131049 - RNA, 64 nt, Homo Sapiens; identical to SEQ ID NO: 24185

SEQ ID NO: 131050 - RNA, 64 nt, Homo Sapiens; identical to SEQ ID NO: 24186

SEQ ID NO: 131051 - RNA, 64 nt, Homo Sapiens; identical to SEQ ID NO: 24187

SEQ ID NO: 131052 - RNA, 64 nt, Homo Sapiens; identical to SEQ ID NO: 24188

SEQ ID NO: 131053 - RNA, 64 nt, Homo Sapiens; identical to SEQ ID NO: 24189

SEQ ID NO: 131054 - RNA, 64 nt, Homo Sapiens; identical to SEQ ID NO: 24190

SEQ ID NO: 131055 - RNA, 64 nt, Homo Sapiens; identical to SEQ ID NO: 24191

SEQ ID NO: 131056 - RNA, 64 nt, Homo Sapiens; identical to SEQ ID NO: 24192

SEQ ID NO: 131057 - RNA, 64 nt, Homo Sapiens; identical to SEQ ID NO: 24193

SEQ ID NO: 131058 - RNA, 64 nt, Homo Sapiens; identical to SEQ ID NO: 24194

SEQ ID NO: 131059 - RNA, 64 nt, Homo Sapiens; identical to SEQ ID NO: 24195

SEQ ID NO: 131060 - RNA, 64 nt, Homo Sapiens; identical to SEQ ID NO: 24196

SEQ ID NO: 131061 - RNA, 64 nt, Homo Sapiens; identical to SEQ ID NO: 24197

SEQ ID NO: 131062 - RNA, 64 nt, Homo Sapiens; identical to SEQ ID NO: 24198

SEQ ID NO: 131063 - RNA, 64 nt, Homo Sapiens; identical to SEQ ID NO: 24199

SEQ ID NO: 131064 - RNA, 64 nt, Homo Sapiens; identical to SEQ ID NO: 24200

SEQ ID NO: 131065 - RNA, 64 nt, Homo Sapiens; identical to SEQ ID NO: 24201

SEQ ID NO: 131066 - RNA, 64 nt, Homo Sapiens; identical to SEQ ID NO: 24202

SEQ ID NO: 131067 - RNA, 64 nt, Homo Sapiens; identical to SEQ ID NO: 24203

SEQ ID NO: 131068 - RNA, 64 nt, Homo Sapiens; identical to SEQ ID NO: 24204

SEQ ID NO: 131069 - RNA, 64 nt, Homo Sapiens; identical to SEQ ID NO: 24205

SEQ ID NO: 131070 - RNA, 64 nt, Homo Sapiens; identical to SEQ ID NO: 24206

SEQ ID NO: 131071 - RNA, 64 nt, Homo Sapiens; identical to SEQ ID NO: 24207

SEQ ID NO: 131072 - RNA, 64 nt, Homo Sapiens; identical to SEQ ID NO: 24208

SEQ ID NO: 131073 - RNA, 64 nt, Homo Sapiens; identical to SEQ ID NO: 24209

SEQ ID NO: 131074 - RNA, 64 nt, Homo Sapiens; identical to SEQ ID NO: 24210

SEQ ID NO: 131075 - RNA, 64 nt, Homo Sapiens; identical to SEQ ID NO: 24211

SEQ ID NO: 131076 - RNA, 64 nt, Homo Sapiens; identical to SEQ ID NO: 24212

SEQ ID NO: 131077 - RNA, 64 nt, Homo Sapiens; identical to SEQ ID NO: 24213

SEQ ID NO: 131078 - RNA, 64 nt, Homo Sapiens; identical to SEQ ID NO: 24214

SEQ ID NO: 131079 - RNA, 64 nt, Homo Sapiens; identical to SEQ ID NO: 24215

SEQ ID NO: 131080 - RNA, 64 nt, Homo Sapiens; identical to SEQ ID NO: 24216

SEQ ID NO: 131081 - RNA, 64 nt, Homo Sapiens; identical to SEQ ID NO: 24217

SEQ ID NO: 131082 - RNA, 64 nt, Homo Sapiens; identical to SEQ ID NO: 24218

SEQ ID NO: 131083 - RNA, 64 nt, Homo Sapiens; identical to SEQ ID NO: 24219

SEQ ID NO: 131084 - RNA, 64 nt, Homo Sapiens; identical to SEQ ID NO: 24220

SEQ ID NO: 131085 - RNA, 64 nt, Homo Sapiens; identical to SEQ ID NO: 24221

SEQ ID NO: 131086 - RNA, 64 nt, Homo Sapiens; identical to SEQ ID NO: 24222

SEQ ID NO: 131087 - RNA, 64 nt, Homo Sapiens; identical to SEQ ID NO: 24223

SEQ ID NO: 131088 - RNA, 64 nt, Homo Sapiens; identical to SEQ ID NO: 24224

SEQ ID NO: 131089 - RNA, 64 nt, Homo Sapiens; identical to SEQ ID NO: 24225

SEQ ID NO: 131090 - RNA, 64 nt, Homo Sapiens; identical to SEQ ID NO: 24226

SEQ ID NO: 131091 - RNA, 64 nt, Homo Sapiens; identical to SEQ ID NO: 24227

SEQ ID NO: 131092 - RNA, 64 nt, Homo Sapiens; identical to SEQ ID NO: 24228

SEQ ID NO: 131093 - RNA, 64 nt, Homo Sapiens; identical to SEQ ID NO: 24229

SEQ ID NO: 131094 - RNA, 64 nt, Homo Sapiens; identical to SEQ ID NO: 24230

SEQ ID NO: 131095 - RNA, 64 nt, Homo Sapiens; identical to SEQ ID NO: 24231

SEQ ID NO: 131096 - RNA, 64 nt, Homo Sapiens; identical to SEQ ID NO: 24232

SEQ ID NO: 131097 - RNA, 64 nt, Homo Sapiens; identical to SEQ ID NO: 24233

SEQ ID NO: 131098 - RNA, 64 nt, Homo Sapiens; identical to SEQ ID NO: 24234

SEQ ID NO: 131099 - RNA, 64 nt, Homo Sapiens; identical to SEQ ID NO: 24235

SEQ ID NO: 131100 - RNA, 64 nt, Homo Sapiens; identical to SEQ ID NO: 24236

SEQ ID NO: 131101 - RNA, 64 nt, Homo Sapiens; identical to SEQ ID NO: 24237

SEQ ID NO: 131102 - RNA, 64 nt, Homo Sapiens; identical to SEQ ID NO: 24238

SEQ ID NO: 131103 - RNA, 64 nt, Homo Sapiens; identical to SEQ ID NO: 24239

SEQ ID NO: 131104 - RNA, 64 nt, Homo Sapiens; identical to SEQ ID NO: 24240

SEQ ID NO: 131105 - RNA, 64 nt, Homo Sapiens; identical to SEQ ID NO: 24241

SEQ ID NO: 131106 - RNA, 64 nt, Homo Sapiens; identical to SEQ ID NO: 24242

SEQ ID NO: 131107 - RNA, 64 nt, Homo Sapiens; identical to SEQ ID NO: 24243

SEQ ID NO: 131108 - RNA, 64 nt, Homo Sapiens; identical to SEQ ID NO: 24244

SEQ ID NO: 131109 - RNA, 64 nt, Homo Sapiens; identical to SEQ ID NO: 24245

SEQ ID NO: 131110 - RNA, 64 nt, Homo Sapiens; identical to SEQ ID NO: 24246

SEQ ID NO: 131111 - RNA, 64 nt, Homo Sapiens; identical to SEQ ID NO: 24247

SEQ ID NO: 131112 - RNA, 64 nt, Homo Sapiens; identical to SEQ ID NO: 24248

SEQ ID NO: 131113 - RNA, 64 nt, Homo Sapiens; identical to SEQ ID NO: 24249

SEQ ID NO: 131114 - RNA, 64 nt, Homo Sapiens; identical to SEQ ID NO: 24250

SEQ ID NO: 131115 - RNA, 64 nt, Homo Sapiens; identical to SEQ ID NO: 24251

SEQ ID NO: 131116 - RNA, 64 nt, Homo Sapiens; identical to SEQ ID NO: 24252

SEQ ID NO: 131117 - RNA, 64 nt, Homo Sapiens; identical to SEQ ID NO: 24253

SEQ ID NO: 131118 - RNA, 64 nt, Homo Sapiens; identical to SEQ ID NO: 24254

SEQ ID NO: 131119 - RNA, 64 nt, Homo Sapiens; identical to SEQ ID NO: 24255

SEQ ID NO: 131120 - RNA, 64 nt, Homo Sapiens; identical to SEQ ID NO: 24256

SEQ ID NO: 131121 - RNA, 64 nt, Homo Sapiens; identical to SEQ ID NO: 24257

SEQ ID NO: 131122 - RNA, 64 nt, Homo Sapiens; identical to SEQ ID NO: 24258

SEQ ID NO: 131123 - RNA, 64 nt, Homo Sapiens; identical to SEQ ID NO: 24259

SEQ ID NO: 131124 - RNA, 64 nt, Homo Sapiens; identical to SEQ ID NO: 24260

SEQ ID NO: 131125 - RNA, 64 nt, Homo Sapiens; identical to SEQ ID NO: 24261

SEQ ID NO: 131126 - RNA, 64 nt, Homo Sapiens; identical to SEQ ID NO: 24262

SEQ ID NO: 131127 - RNA, 64 nt, Homo Sapiens; identical to SEQ ID NO: 24263

SEQ ID NO: 131128 - RNA, 64 nt, Homo Sapiens; identical to SEQ ID NO: 24264

SEQ ID NO: 131129 - RNA, 64 nt, Homo Sapiens; identical to SEQ ID NO: 24265

SEQ ID NO: 131130 - RNA, 64 nt, Homo Sapiens; identical to SEQ ID NO: 24266

SEQ ID NO: 131131 - RNA, 64 nt, Homo Sapiens; identical to SEQ ID NO: 24267

SEQ ID NO: 131132 - RNA, 64 nt, Homo Sapiens; identical to SEQ ID NO: 24268

SEQ ID NO: 131133 - RNA, 64 nt, Homo Sapiens; identical to SEQ ID NO: 24269

SEQ ID NO: 131134 - RNA, 64 nt, Homo Sapiens; identical to SEQ ID NO: 24270

SEQ ID NO: 131135 - RNA, 64 nt, Homo Sapiens; identical to SEQ ID NO: 24271

SEQ ID NO: 131136 - RNA, 64 nt, Homo Sapiens; identical to SEQ ID NO: 24272

SEQ ID NO: 131137 - RNA, 64 nt, Homo Sapiens; identical to SEQ ID NO: 24273

SEQ ID NO: 131138 - RNA, 64 nt, Homo Sapiens; identical to SEQ ID NO: 24274

SEQ ID NO: 131139 - RNA, 64 nt, Homo Sapiens; identical to SEQ ID NO: 24275

SEQ ID NO: 131140 - RNA, 64 nt, Homo Sapiens; identical to SEQ ID NO: 24276

SEQ ID NO: 131141 - RNA, 64 nt, Homo Sapiens; identical to SEQ ID NO: 24277

SEQ ID NO: 131142 - RNA, 64 nt, Homo Sapiens; identical to SEQ ID NO: 24278

SEQ ID NO: 131143 - RNA, 64 nt, Homo Sapiens; identical to SEQ ID NO: 24279

SEQ ID NO: 131144 - RNA, 64 nt, Homo Sapiens; identical to SEQ ID NO: 24280

SEQ ID NO: 131145 - RNA, 64 nt, Homo Sapiens; identical to SEQ ID NO: 24281

SEQ ID NO: 131146 - RNA, 64 nt, Homo Sapiens; identical to SEQ ID NO: 24282

SEQ ID NO: 131147 - RNA, 64 nt, Homo Sapiens; identical to SEQ ID NO: 24283

SEQ ID NO: 131148 - RNA, 64 nt, Homo Sapiens; identical to SEQ ID NO: 24284

SEQ ID NO: 131149 - RNA, 64 nt, Homo Sapiens; identical to SEQ ID NO: 24285

SEQ ID NO: 131150 - RNA, 64 nt, Homo Sapiens; identical to SEQ ID NO: 24286

SEQ ID NO: 131151 - RNA, 64 nt, Homo Sapiens; identical to SEQ ID NO: 24287

SEQ ID NO: 131152 - RNA, 64 nt, Homo Sapiens; identical to SEQ ID NO: 24288

SEQ ID NO: 131153 - RNA, 64 nt, Homo Sapiens; identical to SEQ ID NO: 24289

SEQ ID NO: 131154 - RNA, 64 nt, Homo Sapiens; identical to SEQ ID NO: 24290

SEQ ID NO: 131155 - RNA, 64 nt, Homo Sapiens; identical to SEQ ID NO: 24291

SEQ ID NO: 131156 - RNA, 64 nt, Homo Sapiens; identical to SEQ ID NO: 24292

SEQ ID NO: 131157 - RNA, 64 nt, Homo Sapiens; identical to SEQ ID NO: 24293

SEQ ID NO: 131158 - RNA, 64 nt, Homo Sapiens; identical to SEQ ID NO: 24294

SEQ ID NO: 131159 - RNA, 64 nt, Homo Sapiens; identical to SEQ ID NO: 24295

SEQ ID NO: 131160 - RNA, 64 nt, Homo Sapiens; identical to SEQ ID NO: 24296

SEQ ID NO: 131161 - RNA, 64 nt, Homo Sapiens; identical to SEQ ID NO: 24297

SEQ ID NO: 131162 - RNA, 64 nt, Homo Sapiens; identical to SEQ ID NO: 24298

SEQ ID NO: 131163 - RNA, 64 nt, Homo Sapiens; identical to SEQ ID NO: 24299

SEQ ID NO: 131164 - RNA, 64 nt, Homo Sapiens; identical to SEQ ID NO: 24300

SEQ ID NO: 131165 - RNA, 64 nt, Homo Sapiens; identical to SEQ ID NO: 24301

SEQ ID NO: 131166 - RNA, 64 nt, Homo Sapiens; identical to SEQ ID NO: 24302

SEQ ID NO: 131167 - RNA, 64 nt, Homo Sapiens; identical to SEQ ID NO: 24303

SEQ ID NO: 131168 - RNA, 64 nt, Homo Sapiens; identical to SEQ ID NO: 24304

SEQ ID NO: 131169 - RNA, 64 nt, Homo Sapiens; identical to SEQ ID NO: 24305

SEQ ID NO: 131170 - RNA, 64 nt, Homo Sapiens; identical to SEQ ID NO: 24306

SEQ ID NO: 131171 - RNA, 64 nt, Homo Sapiens; identical to SEQ ID NO: 24307

SEQ ID NO: 131172 - RNA, 64 nt, Homo Sapiens; identical to SEQ ID NO: 24308

SEQ ID NO: 131173 - RNA, 64 nt, Homo Sapiens; identical to SEQ ID NO: 24309

SEQ ID NO: 131174 - RNA, 64 nt, Homo Sapiens; identical to SEQ ID NO: 24310

SEQ ID NO: 131175 - RNA, 64 nt, Homo Sapiens; identical to SEQ ID NO: 24311

SEQ ID NO: 131176 - RNA, 64 nt, Homo Sapiens; identical to SEQ ID NO: 24312

SEQ ID NO: 131177 - RNA, 64 nt, Homo Sapiens; identical to SEQ ID NO: 24313

SEQ ID NO: 131178 - RNA, 64 nt, Homo Sapiens; identical to SEQ ID NO: 24314

SEQ ID NO: 131179 - RNA, 64 nt, Homo Sapiens; identical to SEQ ID NO: 24315

SEQ ID NO: 131180 - RNA, 64 nt, Homo Sapiens; identical to SEQ ID NO: 24316

SEQ ID NO: 131181 - RNA, 64 nt, Homo Sapiens; identical to SEQ ID NO: 24317

SEQ ID NO: 131182 - RNA, 64 nt, Homo Sapiens; identical to SEQ ID NO: 24318

SEQ ID NO: 131183 - RNA, 64 nt, Homo Sapiens; identical to SEQ ID NO: 24319

SEQ ID NO: 131184 - RNA, 64 nt, Homo Sapiens; identical to SEQ ID NO: 24320

SEQ ID NO: 131185 - RNA, 64 nt, Homo Sapiens; identical to SEQ ID NO: 24321

SEQ ID NO: 131186 - RNA, 64 nt, Homo Sapiens; identical to SEQ ID NO: 24322

SEQ ID NO: 131187 - RNA, 64 nt, Homo Sapiens; identical to SEQ ID NO: 24323

SEQ ID NO: 131188 - RNA, 64 nt, Homo Sapiens; identical to SEQ ID NO: 24324

SEQ ID NO: 131189 - RNA, 64 nt, Homo Sapiens; identical to SEQ ID NO: 24325

SEQ ID NO: 131190 - RNA, 64 nt, Homo Sapiens; identical to SEQ ID NO: 24326

SEQ ID NO: 131191 - RNA, 64 nt, Homo Sapiens; identical to SEQ ID NO: 24327

SEQ ID NO: 131192 - RNA, 64 nt, Homo Sapiens
uguuaacuuugugaaauaacuuccacauuucaacacacuucacaguacaggaaauaaaguaaua

SEQ ID NO: 131193 - RNA, 64 nt, Homo Sapiens
gcgugaacucaacggugugaacaggucaagaauaacacuucaaagucaucuugccagccaggcg

SEQ ID NO: 131194 - RNA, 64 nt, Homo Sapiens
uuuucuugagggggaaaaaaugagaagguagacaacacuucaguuugugguggugauuuucuca

SEQ ID NO: 131195 - RNA, 64 nt, Homo Sapiens
gcuauacaugaaggggcacugaauugcuugacugacacuucauuuccccaguuggcugaaguua

SEQ ID NO: 131196 - RNA, 64 nt, Homo Sapiens
uauacugacauuuauaaaugaaccuuuauuaaagacacuucaaugccauuuguuagacacuuca

SEQ ID NO: 131197 - RNA, 64 nt, Homo Sapiens
ccuuuauuaaagacacuucaaugccauuuguuagacacuucaauauuuuacaugguuuucaaug

SEQ ID NO: 131198 - RNA, 64 nt, Homo Sapiens
gacauuaagugagagugaaucccuuaggacuggaacacuucaagcucaaccaacugacucaguu

SEQ ID NO: 131199 - RNA, 64 nt, Homo Sapiens
ugcagccacuguuacuuuuaauugacauuaagagacacuucauagguucccacaauucaguaug

SEQ ID NO: 131200 - RNA, 64 nt, Homo Sapiens
uguaaauaguguacauuuuaaauauggcauuuggacacuucauucugcugacuggagagcuggg

SEQ ID NO: 131201 - RNA, 64 nt, Homo Sapiens
agggucccccugcugacuggcccagcacaugacaacacuucagaaacuuguucaaguucugaau

SEQ ID NO: 131202 - RNA, 64 nt, Homo Sapiens
cugaagagugagauaaagccuuuaaaugguugucacacuucauuguagguaagauaauucauac

SEQ ID NO: 131203 - RNA, 64 nt, Homo Sapiens
cagagaauuuaugguagaaauauauaagguacugacacuucagauauacuaaaucagagugcua

SEQ ID NO: 131204 - RNA, 64 nt, Homo Sapiens
accauuguaacagauguggaaagacuuuuuacguacacuucagucaacauccaagaauuccuau

SEQ ID NO: 131205 - RNA, 64 nt, Homo Sapiens
aaggauguacauaugaaugggcacauuuuacugcacacuucagacgcuuugacuuuuuuaaaaa

SEQ ID NO: 131206 - RNA, 64 nt, Homo Sapiens
aacucgucaaacagcucgauaucacugauccagaacacuucaaggaacuaaaguucacaggcag

SEQ ID NO: 131207 - RNA, 64 nt, Homo Sapiens
gucaugaaaacugagaagacugcguuccauuuucacacuucacagcagcaccuaagaucaagga

SEQ ID NO: 131208 - RNA, 64 nt, Homo Sapiens
ugcugauggauaaccuauauuauuuuuuguaggggucaaagaaauuuuaucaugacauguuaua

SEQ ID NO: 131209 - RNA, 64 nt, Homo Sapiens
gauggcaccuaaaccaccagacguaaucuccacagucaaagaaguuagaaaccuuaauaugugg

SEQ ID NO: 131210 - RNA, 64 nt, Homo Sapiens
cacuaacgauguagacucuggaaaugccuaauaagucaaagaagacguauuaaagcucuuuucu

SEQ ID NO: 131211 - RNA, 64 nt, Homo Sapiens
guucuacaucccuaagauuaucuagguaggacaugucaaagaugacuguugucauucuggaggu

SEQ ID NO: 131212 - RNA, 64 nt, Homo Sapiens
aacuuaacuauugcugcaacuuauauguauacaagucaaagaacgagaauugugaaacagauag

SEQ ID NO: 131213 - RNA, 64 nt, Homo Sapiens
gagaaaaaagauaaaguagagugccuccuacacagucaaagaaaagcagguuacucagcaguuu

SEQ ID NO: 131214 - RNA, 64 nt, Homo Sapiens; identical to SEQ ID NO: 117533

SEQ ID NO: 131215 - RNA, 64 nt, Homo Sapiens; identical to SEQ ID NO: 117534

SEQ ID NO: 131216 - RNA, 64 nt, Homo Sapiens; identical to SEQ ID NO: 117535

SEQ ID NO: 131217 - RNA, 64 nt, Homo Sapiens; identical to SEQ ID NO: 117536

SEQ ID NO: 131218 - RNA, 64 nt, Homo Sapiens; identical to SEQ ID NO: 117537

SEQ ID NO: 131219 - RNA, 64 nt, Homo Sapiens; identical to SEQ ID NO: 117538

SEQ ID NO: 131220 - RNA, 64 nt, Homo Sapiens; identical to SEQ ID NO: 117539

SEQ ID NO: 131221 - RNA, 64 nt, Homo Sapiens; identical to SEQ ID NO: 117540

SEQ ID NO: 131222 - RNA, 64 nt, Homo Sapiens; identical to SEQ ID NO: 117541

SEQ ID NO: 131223 - RNA, 64 nt, Homo Sapiens; identical to SEQ ID NO: 117542

SEQ ID NO: 131224 - RNA, 64 nt, Homo Sapiens; identical to SEQ ID NO: 117543

SEQ ID NO: 131225 - RNA, 64 nt, Homo Sapiens; identical to SEQ ID NO: 117544

SEQ ID NO: 131226 - RNA, 64 nt, Homo Sapiens; identical to SEQ ID NO: 117545

SEQ ID NO: 131227 - RNA, 64 nt, Homo Sapiens; identical to SEQ ID NO: 117546

SEQ ID NO: 131228 - RNA, 64 nt, Homo Sapiens; identical to SEQ ID NO: 117547

SEQ ID NO: 131229 - RNA, 64 nt, Homo Sapiens; identical to SEQ ID NO: 117548

SEQ ID NO: 131230 - RNA, 64 nt, Homo Sapiens; identical to SEQ ID NO: 117549

SEQ ID NO: 131231 - RNA, 64 nt, Homo Sapiens; identical to SEQ ID NO: 117550

SEQ ID NO: 131232 - RNA, 64 nt, Homo Sapiens; identical to SEQ ID NO: 117551

SEQ ID NO: 131233 - RNA, 64 nt, Homo Sapiens; identical to SEQ ID NO: 117552

SEQ ID NO: 131234 - RNA, 64 nt, Homo Sapiens; identical to SEQ ID NO: 117553

SEQ ID NO: 131235 - RNA, 64 nt, Homo Sapiens; identical to SEQ ID NO: 117554

SEQ ID NO: 131236 - RNA, 64 nt, Homo Sapiens; identical to SEQ ID NO: 117555

SEQ ID NO: 131237 - RNA, 64 nt, Homo Sapiens; identical to SEQ ID NO: 117556

SEQ ID NO: 131238 - RNA, 64 nt, Homo Sapiens; identical to SEQ ID NO: 117557

SEQ ID NO: 131239 - RNA, 64 nt, Homo Sapiens; identical to SEQ ID NO: 117558

SEQ ID NO: 131240 - RNA, 64 nt, Homo Sapiens; identical to SEQ ID NO: 117559

SEQ ID NO: 131241 - RNA, 64 nt, Homo Sapiens; identical to SEQ ID NO: 117560

SEQ ID NO: 131242 - RNA, 64 nt, Homo Sapiens; identical to SEQ ID NO: 117561

SEQ ID NO: 131243 - RNA, 64 nt, Homo Sapiens; identical to SEQ ID NO: 117562

SEQ ID NO: 131244 - RNA, 64 nt, Homo Sapiens; identical to SEQ ID NO: 117563

SEQ ID NO: 131245 - RNA, 64 nt, Homo Sapiens; identical to SEQ ID NO: 117564

SEQ ID NO: 131246 - RNA, 64 nt, Homo Sapiens; identical to SEQ ID NO: 117565

SEQ ID NO: 131247 - RNA, 64 nt, Homo Sapiens; identical to SEQ ID NO: 117566

SEQ ID NO: 131248 - RNA, 64 nt, Homo Sapiens; identical to SEQ ID NO: 117567

SEQ ID NO: 131249 - RNA, 64 nt, Homo Sapiens; identical to SEQ ID NO: 117568

SEQ ID NO: 131250 - RNA, 64 nt, Homo Sapiens; identical to SEQ ID NO: 117569

SEQ ID NO: 131251 - RNA, 64 nt, Homo Sapiens; identical to SEQ ID NO: 117570

SEQ ID NO: 131252 - RNA, 64 nt, Homo Sapiens; identical to SEQ ID NO: 117571

SEQ ID NO: 131253 - RNA, 64 nt, Homo Sapiens; identical to SEQ ID NO: 117572

SEQ ID NO: 131254 - RNA, 64 nt, Homo Sapiens; identical to SEQ ID NO: 117573

SEQ ID NO: 131255 - RNA, 64 nt, Homo Sapiens; identical to SEQ ID NO: 117574

SEQ ID NO: 131256 - RNA, 64 nt, Homo Sapiens; identical to SEQ ID NO: 117575

SEQ ID NO: 131257 - RNA, 64 nt, Homo Sapiens; identical to SEQ ID NO: 117576

SEQ ID NO: 131258 - RNA, 64 nt, Homo Sapiens; identical to SEQ ID NO: 117577

SEQ ID NO: 131259 - RNA, 64 nt, Homo Sapiens; identical to SEQ ID NO: 117578

SEQ ID NO: 131260 - RNA, 64 nt, Homo Sapiens; identical to SEQ ID NO: 117579

SEQ ID NO: 131261 - RNA, 64 nt, Homo Sapiens; identical to SEQ ID NO: 117580

SEQ ID NO: 131262 - RNA, 64 nt, Homo Sapiens; identical to SEQ ID NO: 117581

SEQ ID NO: 131263 - RNA, 64 nt, Homo Sapiens; identical to SEQ ID NO: 117582

SEQ ID NO: 131264 - RNA, 64 nt, Homo Sapiens; identical to SEQ ID NO: 117583

SEQ ID NO: 131265 - RNA, 64 nt, Homo Sapiens; identical to SEQ ID NO: 117584

SEQ ID NO: 131266 - RNA, 64 nt, Homo Sapiens; identical to SEQ ID NO: 117585

SEQ ID NO: 131267 - RNA, 64 nt, Homo Sapiens; identical to SEQ ID NO: 117586

SEQ ID NO: 131268 - RNA, 64 nt, Homo Sapiens; identical to SEQ ID NO: 117587

SEQ ID NO: 131269 - RNA, 64 nt, Homo Sapiens; identical to SEQ ID NO: 117588

SEQ ID NO: 131270 - RNA, 64 nt, Homo Sapiens; identical to SEQ ID NO: 117589

SEQ ID NO: 131271 - RNA, 64 nt, Homo Sapiens; identical to SEQ ID NO: 117590

SEQ ID NO: 131272 - RNA, 64 nt, Homo Sapiens; identical to SEQ ID NO: 117591

SEQ ID NO: 131273 - RNA, 64 nt, Homo Sapiens; identical to SEQ ID NO: 117592

SEQ ID NO: 131274 - RNA, 64 nt, Homo Sapiens; identical to SEQ ID NO: 117593

SEQ ID NO: 131275 - RNA, 64 nt, Homo Sapiens; identical to SEQ ID NO: 117594

SEQ ID NO: 131276 - RNA, 64 nt, Homo Sapiens; identical to SEQ ID NO: 117595

SEQ ID NO: 131277 - RNA, 64 nt, Homo Sapiens; identical to SEQ ID NO: 117596

SEQ ID NO: 131278 - RNA, 64 nt, Homo Sapiens; identical to SEQ ID NO: 117597

SEQ ID NO: 131279 - RNA, 64 nt, Homo Sapiens; identical to SEQ ID NO: 117598

SEQ ID NO: 131280 - RNA, 64 nt, Homo Sapiens; identical to SEQ ID NO: 117599

SEQ ID NO: 131281 - RNA, 64 nt, Homo Sapiens; identical to SEQ ID NO: 117600

SEQ ID NO: 131282 - RNA, 64 nt, Homo Sapiens; identical to SEQ ID NO: 117601

SEQ ID NO: 131283 - RNA, 64 nt, Homo Sapiens; identical to SEQ ID NO: 117602

SEQ ID NO: 131284 - RNA, 64 nt, Homo Sapiens; identical to SEQ ID NO: 117603

SEQ ID NO: 131285 - RNA, 64 nt, Homo Sapiens; identical to SEQ ID NO: 117604

SEQ ID NO: 131286 - RNA, 64 nt, Homo Sapiens; identical to SEQ ID NO: 117605

SEQ ID NO: 131287 - RNA, 64 nt, Homo Sapiens; identical to SEQ ID NO: 117606

SEQ ID NO: 131288 - RNA, 64 nt, Homo Sapiens; identical to SEQ ID NO: 117607

SEQ ID NO: 131289 - RNA, 64 nt, Homo Sapiens; identical to SEQ ID NO: 117608

SEQ ID NO: 131290 - RNA, 64 nt, Homo Sapiens; identical to SEQ ID NO: 117609

SEQ ID NO: 131291 - RNA, 64 nt, Homo Sapiens; identical to SEQ ID NO: 117610

SEQ ID NO: 131292 - RNA, 64 nt, Homo Sapiens; identical to SEQ ID NO: 117611

SEQ ID NO: 131293 - RNA, 64 nt, Homo Sapiens; identical to SEQ ID NO: 117612

SEQ ID NO: 131294 - RNA, 64 nt, Homo Sapiens; identical to SEQ ID NO: 117613

SEQ ID NO: 131295 - RNA, 64 nt, Homo Sapiens; identical to SEQ ID NO: 117614

SEQ ID NO: 131296 - RNA, 64 nt, Homo Sapiens; identical to SEQ ID NO: 117615

SEQ ID NO: 131297 - RNA, 64 nt, Homo Sapiens; identical to SEQ ID NO: 117616

SEQ ID NO: 131298 - RNA, 64 nt, Homo Sapiens; identical to SEQ ID NO: 117617

SEQ ID NO: 131299 - RNA, 64 nt, Homo Sapiens; identical to SEQ ID NO: 117618

SEQ ID NO: 131300 - RNA, 64 nt, Homo Sapiens; identical to SEQ ID NO: 117619

SEQ ID NO: 131301 - RNA, 64 nt, Homo Sapiens; identical to SEQ ID NO: 117620

SEQ ID NO: 131302 - RNA, 64 nt, Homo Sapiens; identical to SEQ ID NO: 117621

SEQ ID NO: 131303 - RNA, 64 nt, Homo Sapiens; identical to SEQ ID NO: 117622

SEQ ID NO: 131304 - RNA, 64 nt, Homo Sapiens; identical to SEQ ID NO: 117623

SEQ ID NO: 131305 - RNA, 64 nt, Homo Sapiens; identical to SEQ ID NO: 117624

SEQ ID NO: 131306 - RNA, 64 nt, Homo Sapiens; identical to SEQ ID NO: 117625

SEQ ID NO: 131307 - RNA, 64 nt, Homo Sapiens; identical to SEQ ID NO: 117626

SEQ ID NO: 131308 - RNA, 64 nt, Homo Sapiens; identical to SEQ ID NO: 117627

SEQ ID NO: 131309 - RNA, 64 nt, Homo Sapiens; identical to SEQ ID NO: 117628

SEQ ID NO: 131310 - RNA, 64 nt, Homo Sapiens; identical to SEQ ID NO: 117629

SEQ ID NO: 131311 - RNA, 64 nt, Homo Sapiens; identical to SEQ ID NO: 117630

SEQ ID NO: 131312 - RNA, 64 nt, Homo Sapiens; identical to SEQ ID NO: 117631

SEQ ID NO: 131313 - RNA, 64 nt, Homo Sapiens; identical to SEQ ID NO: 117632

SEQ ID NO: 131314 - RNA, 64 nt, Homo Sapiens; identical to SEQ ID NO: 117633

SEQ ID NO: 131315 - RNA, 64 nt, Homo Sapiens; identical to SEQ ID NO: 117634

SEQ ID NO: 131316 - RNA, 64 nt, Homo Sapiens; identical to SEQ ID NO: 117635

SEQ ID NO: 131317 - RNA, 64 nt, Homo Sapiens; identical to SEQ ID NO: 117636

SEQ ID NO: 131318 - RNA, 64 nt, Homo Sapiens; identical to SEQ ID NO: 117637

SEQ ID NO: 131319 - RNA, 64 nt, Homo Sapiens; identical to SEQ ID NO: 117638

SEQ ID NO: 131320 - RNA, 64 nt, Homo Sapiens; identical to SEQ ID NO: 117639

SEQ ID NO: 131321 - RNA, 64 nt, Homo Sapiens; identical to SEQ ID NO: 117640

SEQ ID NO: 131322 - RNA, 64 nt, Homo Sapiens; identical to SEQ ID NO: 117641

SEQ ID NO: 131323 - RNA, 64 nt, Homo Sapiens; identical to SEQ ID NO: 117642

SEQ ID NO: 131324 - RNA, 64 nt, Homo Sapiens; identical to SEQ ID NO: 117643

SEQ ID NO: 131325 - RNA, 64 nt, Homo Sapiens; identical to SEQ ID NO: 117644

SEQ ID NO: 131326 - RNA, 64 nt, Homo Sapiens; identical to SEQ ID NO: 117645

SEQ ID NO: 131327 - RNA, 64 nt, Homo Sapiens; identical to SEQ ID NO: 117646

SEQ ID NO: 131328 - RNA, 64 nt, Homo Sapiens; identical to SEQ ID NO: 117647

SEQ ID NO: 131329 - RNA, 64 nt, Homo Sapiens; identical to SEQ ID NO: 117648

SEQ ID NO: 131330 - RNA, 64 nt, Homo Sapiens; identical to SEQ ID NO: 117649

SEQ ID NO: 131331 - RNA, 64 nt, Homo Sapiens; identical to SEQ ID NO: 117650

SEQ ID NO: 131332 - RNA, 64 nt, Homo Sapiens; identical to SEQ ID NO: 117651

SEQ ID NO: 131333 - RNA, 64 nt, Homo Sapiens; identical to SEQ ID NO: 117652

SEQ ID NO: 131334 - RNA, 64 nt, Homo Sapiens; identical to SEQ ID NO: 117653

SEQ ID NO: 131335 - RNA, 64 nt, Homo Sapiens; identical to SEQ ID NO: 117654

SEQ ID NO: 131336 - RNA, 64 nt, Homo Sapiens; identical to SEQ ID NO: 117655

SEQ ID NO: 131337 - RNA, 64 nt, Homo Sapiens; identical to SEQ ID NO: 117656

SEQ ID NO: 131338 - RNA, 64 nt, Homo Sapiens; identical to SEQ ID NO: 117657

SEQ ID NO: 131339 - RNA, 64 nt, Homo Sapiens; identical to SEQ ID NO: 117658

SEQ ID NO: 131340 - RNA, 64 nt, Homo Sapiens; identical to SEQ ID NO: 117659

SEQ ID NO: 131341 - RNA, 64 nt, Homo Sapiens; identical to SEQ ID NO: 117660

SEQ ID NO: 131342 - RNA, 64 nt, Homo Sapiens; identical to SEQ ID NO: 117661

SEQ ID NO: 131343 - RNA, 64 nt, Homo Sapiens
gcugacugcuguucacccuucuguagcccagggucugggguagaauuuccagguccguauuucu

SEQ ID NO: 131344 - RNA, 64 nt, Homo Sapiens
gccuggugagugagucacuguuugccuuugagcccugggguaaggggccccaggccauccagcc

SEQ ID NO: 131345 - RNA, 64 nt, Homo Sapiens
gacuaagagugcccguaggagacucuuaaaggggcugggguagagcuccuuccuccagcugggg

SEQ ID NO: 131346 - RNA, 64 nt, Homo Sapiens
uccccugcugaggagugacacccagcagcgcagucugggguauuacccuugcuccuguacugcc

SEQ ID NO: 131347 - RNA, 64 nt, Homo Sapiens
cacugggagugaaaaugacuacaacccaaggcaacugggguacuguaaagacaacaaaguaaau

SEQ ID NO: 131348 - RNA, 64 nt, Homo Sapiens
gacaacaaaguaaauacaacugauccucaucugucugggguaaaagggagagaaaugcuacagu

SEQ ID NO: 131349 - RNA, 64 nt, Homo Sapiens
aagacaaagaguagccaccgcaagcugcacagaacugggguaaggaagcccagaagggcuucug

SEQ ID NO: 131350 - RNA, 64 nt, Homo Sapiens
ggcacugcccaucucuucucgucuuugagccuagcugggguagaaggagcuccugauagcaggc

SEQ ID NO: 131351 - RNA, 64 nt, Homo Sapiens; identical to SEQ ID NO: 50739

SEQ ID NO: 131352 - RNA, 64 nt, Homo Sapiens; identical to SEQ ID NO: 50740

SEQ ID NO: 131353 - RNA, 64 nt, Homo Sapiens; identical to SEQ ID NO: 50741

SEQ ID NO: 131354 - RNA, 64 nt, Homo Sapiens; identical to SEQ ID NO: 50742

SEQ ID NO: 131355 - RNA, 64 nt, Homo Sapiens; identical to SEQ ID NO: 50743

SEQ ID NO: 131356 - RNA, 64 nt, Homo Sapiens; identical to SEQ ID NO: 50744

SEQ ID NO: 131357 - RNA, 64 nt, Homo Sapiens; identical to SEQ ID NO: 50745

SEQ ID NO: 131358 - RNA, 64 nt, Homo Sapiens; identical to SEQ ID NO: 50746

SEQ ID NO: 131359 - RNA, 64 nt, Homo Sapiens; identical to SEQ ID NO: 50747

SEQ ID NO: 131360 - RNA, 64 nt, Homo Sapiens; identical to SEQ ID NO: 50748

SEQ ID NO: 131361 - RNA, 64 nt, Homo Sapiens
uuuccuaugaggaaagccagaugagggaaacaugugacuauaccauaaauucccagugcucauc

SEQ ID NO: 131362 - RNA, 64 nt, Homo Sapiens
cuccuuuuaagaagcaggaauuguuagcacaaaaugacuauauaaaacuguuccucagauccaa

SEQ ID NO: 131363 - RNA, 64 nt, Homo Sapiens
ccuuuugaaaggaauguaaugaagauucagcaucugacuauaugugugucuauccugaaauaau

SEQ ID NO: 131364 - RNA, 64 nt, Homo Sapiens
gguuuuagaaacuaaacuuucuagagcaauaaaaugacuauaauguuaaguaaacauaauguug

SEQ ID NO: 131365 - RNA, 64 nt, Homo Sapiens
augccacuuacccaagcuuuuuaaaugaacauugaugagagaaguugguuuauuucacuuuuca

SEQ ID NO: 131366 - RNA, 64 nt, Homo Sapiens
caaaugagcuagaggaagauaaauaugccaaaaaaugagagauaguuuuuaagugugacuugaa

SEQ ID NO: 131367 - RNA, 64 nt, Homo Sapiens
uaaguacucucaucaacuuaauuuuccuugguacaugagagaaacuauaugcuuuuuucuguga

SEQ ID NO: 131368 - RNA, 64 nt, Homo Sapiens
agaacuggccccuguacaggagaagggaagggugaugagagaacuuuuuugagcauugcucuau

SEQ ID NO: 131369 - RNA, 64 nt, Homo Sapiens
guuuuguguggagggggagguaggacugggcuggaugagagagcacagcugugacuuccuccua

SEQ ID NO: 131370 - RNA, 64 nt, Homo Sapiens
gguagaucacaggggucuguguaccucugaauucaugagagaugaaugacagaugcucucaugg

SEQ ID NO: 131371 - RNA, 64 nt, Homo Sapiens
guucuuguguuuuggaguccuagucauauuaaacaugagagauacucuuaauuucaguaguaca

SEQ ID NO: 131372 - RNA, 64 nt, Homo Sapiens
guauugcaaaaugaauugaacggauggugcuuuaaugagagaaguaaaggaauauaugccuccu

SEQ ID NO: 131373 - RNA, 64 nt, Homo Sapiens
gugucuauaacuggguucuuaaggaucacauuggaugagagaaguaccuccuuauagaagccag

SEQ ID NO: 131374 - RNA, 64 nt, Homo Sapiens
ccaucuguugguuuccagggauuagaacuuggcaaugagagauccgagcaugaacaugaaauac

SEQ ID NO: 131375 - RNA, 64 nt, Homo Sapiens
aaaaauccauuuugccuuacaucuccuuuacaucaugagagauccuucccuuccuuaccuuugu

SEQ ID NO: 131376 - RNA, 64 nt, Homo Sapiens
aaaaugccaaucccaagggauggucuugagcugaaugagagaaugccagcagaguuccugccca

SEQ ID NO: 131377 - RNA, 64 nt, Homo Sapiens
gaaaugcuaaccuuguagcauacucuguguguguaugagagagaugugugugugugugugugug

SEQ ID NO: 131378 - RNA, 64 nt, Homo Sapiens
gacuguguguguguguguguaagagagagagagaaugagagagagggguguuguauggcugagc

SEQ ID NO: 131379 - RNA, 64 nt, Homo Sapiens
auuguauaaccauccugcugauuuucaaaacugaaugagagaaaagaauuugcagguacuacag

SEQ ID NO: 131380 - RNA, 64 nt, Homo Sapiens
ucccauauuuccaucagaguuguauauugcaugaaugagagauucuucgcuugaauauuauccc

SEQ ID NO: 131381 - RNA, 64 nt, Homo Sapiens
aaauuuguguauuuuuugugugccugggcuggagaugagagacugagucauaacugauuuaaaa

SEQ ID NO: 131382 - RNA, 64 nt, Homo Sapiens
agcuuaccuuggaguaugaaucuacccaugaaggaugagagauguuuugaaaaacuagccagga

SEQ ID NO: 131383 - RNA, 64 nt, Homo Sapiens
ucuacuaaccaaagcuuguauggauuugacaguacauaaucagucuugaacaacuuuggaaaaa

SEQ ID NO: 131384 - RNA, 64 nt, Homo Sapiens
uuuuucaguaaauauugcucgacauauuuaaguucauaaucauaaaacagcaaauuuuaaagag

SEQ ID NO: 131385 - RNA, 64 nt, Homo Sapiens
uuuuagcauaucuccaaccuugcaauuugauuggcauaaucacuccaguuugcuuucuaggucc

SEQ ID NO: 131386 - RNA, 64 nt, Homo Sapiens
aguuugcuuucuagguccucaagugcucgugacacauaaucauuccauccaaugaucgccuuug

SEQ ID NO: 131387 - RNA, 64 nt, Homo Sapiens
uuugcuuugcaaaccuuaugucaccaagccuuuucauaaucaaggaaggugaggggcuguauuu

SEQ ID NO: 131388 - RNA, 64 nt, Homo Sapiens
acauuuguaucagaaaaacaggaaaauucauuaccauaaucacaaucacugcgcaaaaugugga

SEQ ID NO: 131389 - RNA, 64 nt, Homo Sapiens
auuaaaccaaguccauuuugaaugaccuaaaaugaaguaacacaaucagaaaucccaugugccc

SEQ ID NO: 131390 - RNA, 64 nt, Homo Sapiens
aacuugauauaaagauuuuauuugucccuugaaaaaguaacaaaugugcauagaucaauuugua

SEQ ID NO: 131391 - RNA, 64 nt, Homo Sapiens
gcucaaguugauaaucucuucaucgcucaaguuuaaguaacauccacaaauauguuuuaaguaa

SEQ ID NO: 131392 - RNA, 64 nt, Homo Sapiens
gcucaaguuuaaguaacauccacaaauauguuuuaaguaacaucgcuuuaguuuuagcaaacac

SEQ ID NO: 131393 - RNA, 64 nt, Homo Sapiens
aauuggaauaacuuuauucugcagaucauuuaagaaguaacaggccgggcgcgguggcucacgc

SEQ ID NO: 131394 - RNA, 64 nt, Homo Sapiens
agagugaaacuccaucuccaaaaaaaaaaagaaaaaguaacaaaaggaaauuauuuguuuuuga

SEQ ID NO: 131395 - RNA, 64 nt, Homo Sapiens
uaaagcauuauugcuuuagaugucugggacacuuaaguaacaucacacuuaauuuuguuaaucc

SEQ ID NO: 131396 - RNA, 64 nt, Homo Sapiens
uauuuccauugauccuagguucgucgguggcuuaaaguaacaucguacuuugugggucucucuu

SEQ ID NO: 131397 - RNA, 64 nt, Homo Sapiens
accacuaggcugucacuauaaauuccuugaauauaaguaacaguuauuaaugaacuucuaaauu

SEQ ID NO: 131398 - RNA, 64 nt, Homo Sapiens
uaucuguuuguauaucuuacuauagauuauguacaaguaacaucuaaauaaaauuacacuuuua

SEQ ID NO: 131399 - RNA, 64 nt, Homo Sapiens
aucaacaugauggugacugggaaaaaauuacuucaaguaacaugcuuagcuuucccuccuuaau

SEQ ID NO: 131400 - RNA, 64 nt, Homo Sapiens
ggagaguggaguucccguagggcauaggccugugaaguaacacuggggcagauauguauguuau

SEQ ID NO: 131401 - RNA, 64 nt, Homo Sapiens
gaagaacguggacguuuuuaccaagcugcuuuagaaguaacaaugcuccacgugguaagauccu

SEQ ID NO: 131402 - RNA, 64 nt, Homo Sapiens
agaagugacaucuucagcaaggggaacuauaaagaaguaacaaauuaaaaaaaaaaucaauggu

SEQ ID NO: 131403 - RNA, 64 nt, Homo Sapiens
uuuucaucauugcuucauacuuugguguugcaaaaaguaacauauugcuuugggaccuuuuuau

SEQ ID NO: 131404 - RNA, 64 nt, Homo Sapiens
uugguauguuuauuguagauaacucuuuuuuuuaaaguaacaguuuuccaaagcaaugucuaaa

SEQ ID NO: 131405 - RNA, 64 nt, Homo Sapiens
aggaaccacgguuccuucguccauuaguuggaaaaaguaacagaccuaaaacucuaccaagcua

SEQ ID NO: 131406 - RNA, 64 nt, Homo Sapiens
aucguguaaauacauuagcuaaacugaaaaguauaaguaacaugcuuuguugcagccaaaaaau

SEQ ID NO: 131407 - RNA, 64 nt, Homo Sapiens; identical to SEQ ID NO: 50725

SEQ ID NO: 131408 - RNA, 64 nt, Homo Sapiens; identical to SEQ ID NO: 50726

SEQ ID NO: 131409 - RNA, 64 nt, Homo Sapiens; identical to SEQ ID NO: 50727

SEQ ID NO: 131410 - RNA, 64 nt, Homo Sapiens; identical to SEQ ID NO: 50728

SEQ ID NO: 131411 - RNA, 64 nt, Homo Sapiens; identical to SEQ ID NO: 50729

SEQ ID NO: 131412 - RNA, 64 nt, Homo Sapiens; identical to SEQ ID NO: 50730

SEQ ID NO: 131413 - RNA, 64 nt, Homo Sapiens; identical to SEQ ID NO: 50731

SEQ ID NO: 131414 - RNA, 64 nt, Homo Sapiens; identical to SEQ ID NO: 50732

SEQ ID NO: 131415 - RNA, 64 nt, Homo Sapiens; identical to SEQ ID NO: 50733

SEQ ID NO: 131416 - RNA, 64 nt, Homo Sapiens; identical to SEQ ID NO: 50734

SEQ ID NO: 131417 - RNA, 51 nt, Homo Sapiens; identical to SEQ ID NO: 50735

SEQ ID NO: 131418 - RNA, 64 nt, Homo Sapiens; identical to SEQ ID NO: 50736

SEQ ID NO: 131419 - RNA, 64 nt, Homo Sapiens; identical to SEQ ID NO: 50737

SEQ ID NO: 131420 - RNA, 64 nt, Homo Sapiens; identical to SEQ ID NO: 50738

SEQ ID NO: 131421 - RNA, 64 nt, Homo Sapiens
ggugggucucaauccuuaacagcgaaauauuacaguagugcauuuagguggaagaaauuuagga

SEQ ID NO: 131422 - RNA, 64 nt, Homo Sapiens
uaauuggaguaucuaaagccagaccagugaaagaguagugcauuuguuucaccauacuucauuc

SEQ ID NO: 131423 - RNA, 64 nt, Homo Sapiens
aagcauuaauauccauaaacguguuuaggauuuaguagugcauaaguagauucccccuuuuccu

SEQ ID NO: 131424 - RNA, 64 nt, Homo Sapiens
ggacucauuuuuugcgaacucagagaucuugaguguagugcaaguuccacagaaggccucuagc

SEQ ID NO: 131425 - RNA, 64 nt, Homo Sapiens
ucucuacuaaaaauacaaaaauuagcuaggcgggguagugcaugccuguaaucccagcuacuca

SEQ ID NO: 131426 - RNA, 64 nt, Homo Sapiens
aauugccaccugcacuuuguuucugcacuauuauguagugcauuuuaacuuaaauuuuuuccag

SEQ ID NO: 131427 - RNA, 64 nt, Homo Sapiens
auauggugugugacuuucacuaaccuauaccuuuguagugcaccauguuucaagcuucagccuu

SEQ ID NO: 131428 - RNA, 64 nt, Homo Sapiens
uggaauaauaaagguugggucaugucucuugacaguagugcacuauuguccuuagcggcuguaa

SEQ ID NO: 131429 - RNA, 64 nt, Homo Sapiens; identical to SEQ ID NO: 53626

SEQ ID NO: 131430 - RNA, 64 nt, Homo Sapiens; identical to SEQ ID NO: 53627

SEQ ID NO: 131431 - RNA, 64 nt, Homo Sapiens; identical to SEQ ID NO: 53628

SEQ ID NO: 131432 - RNA, 64 nt, Homo Sapiens; identical to SEQ ID NO: 53629

SEQ ID NO: 131433 - RNA, 64 nt, Homo Sapiens; identical to SEQ ID NO: 53630

SEQ ID NO: 131434 - RNA, 64 nt, Homo Sapiens; identical to SEQ ID NO: 53631

SEQ ID NO: 131435 - RNA, 64 nt, Homo Sapiens; identical to SEQ ID NO: 53632

SEQ ID NO: 131436 - RNA, 64 nt, Homo Sapiens; identical to SEQ ID NO: 53633

SEQ ID NO: 131437 - RNA, 64 nt, Homo Sapiens; identical to SEQ ID NO: 53634

SEQ ID NO: 131438 - RNA, 64 nt, Homo Sapiens; identical to SEQ ID NO: 53635

SEQ ID NO: 131439 - RNA, 64 nt, Homo Sapiens; identical to SEQ ID NO: 53636

SEQ ID NO: 131440 - RNA, 64 nt, Homo Sapiens; identical to SEQ ID NO: 53637

SEQ ID NO: 131441 - RNA, 64 nt, Homo Sapiens; identical to SEQ ID NO: 53638

SEQ ID NO: 131442 - RNA, 64 nt, Homo Sapiens; identical to SEQ ID NO: 53639

SEQ ID NO: 131443 - RNA, 64 nt, Homo Sapiens; identical to SEQ ID NO: 53640

SEQ ID NO: 131444 - RNA, 64 nt, Homo Sapiens; identical to SEQ ID NO: 53641

SEQ ID NO: 131445 - RNA, 64 nt, Homo Sapiens; identical to SEQ ID NO: 53642

SEQ ID NO: 131446 - RNA, 64 nt, Homo Sapiens; identical to SEQ ID NO: 53643

SEQ ID NO: 131447 - RNA, 64 nt, Homo Sapiens; identical to SEQ ID NO: 53644

SEQ ID NO: 131448 - RNA, 64 nt, Homo Sapiens; identical to SEQ ID NO: 53645

SEQ ID NO: 131449 - RNA, 64 nt, Homo Sapiens; identical to SEQ ID NO: 53646

SEQ ID NO: 131450 - RNA, 64 nt, Homo Sapiens; identical to SEQ ID NO: 53647

SEQ ID NO: 131451 - RNA, 64 nt, Homo Sapiens; identical to SEQ ID NO: 53648

SEQ ID NO: 131452 - RNA, 64 nt, Homo Sapiens; identical to SEQ ID NO: 53649

SEQ ID NO: 131453 - RNA, 64 nt, Homo Sapiens; identical to SEQ ID NO: 53650

SEQ ID NO: 131454 - RNA, 64 nt, Homo Sapiens; identical to SEQ ID NO: 53651

SEQ ID NO: 131455 - RNA, 64 nt, Homo Sapiens; identical to SEQ ID NO: 53652

SEQ ID NO: 131456 - RNA, 64 nt, Homo Sapiens; identical to SEQ ID NO: 53653

SEQ ID NO: 131457 - RNA, 64 nt, Homo Sapiens; identical to SEQ ID NO: 53654

SEQ ID NO: 131458 - RNA, 64 nt, Homo Sapiens; identical to SEQ ID NO: 53655

SEQ ID NO: 131459 - RNA, 64 nt, Homo Sapiens; identical to SEQ ID NO: 53656

SEQ ID NO: 131460 - RNA, 64 nt, Homo Sapiens; identical to SEQ ID NO: 53657

SEQ ID NO: 131461 - RNA, 64 nt, Homo Sapiens; identical to SEQ ID NO: 53658

SEQ ID NO: 131462 - RNA, 64 nt, Homo Sapiens; identical to SEQ ID NO: 53659

SEQ ID NO: 131463 - RNA, 64 nt, Homo Sapiens; identical to SEQ ID NO: 53660

SEQ ID NO: 131464 - RNA, 64 nt, Homo Sapiens; identical to SEQ ID NO: 53661

SEQ ID NO: 131465 - RNA, 64 nt, Homo Sapiens; identical to SEQ ID NO: 53662

SEQ ID NO: 131466 - RNA, 64 nt, Homo Sapiens; identical to SEQ ID NO: 53663

SEQ ID NO: 131467 - RNA, 64 nt, Homo Sapiens; identical to SEQ ID NO: 53664

SEQ ID NO: 131468 - RNA, 64 nt, Homo Sapiens; identical to SEQ ID NO: 53665

SEQ ID NO: 131469 - RNA, 64 nt, Homo Sapiens; identical to SEQ ID NO: 53666

SEQ ID NO: 131470 - RNA, 64 nt, Homo Sapiens; identical to SEQ ID NO: 53667

SEQ ID NO: 131471 - RNA, 64 nt, Homo Sapiens; identical to SEQ ID NO: 53668

SEQ ID NO: 131472 - RNA, 64 nt, Homo Sapiens; identical to SEQ ID NO: 53669

SEQ ID NO: 131473 - RNA, 64 nt, Homo Sapiens; identical to SEQ ID NO: 53670

SEQ ID NO: 131474 - RNA, 64 nt, Homo Sapiens; identical to SEQ ID NO: 53671

SEQ ID NO: 131475 - RNA, 64 nt, Homo Sapiens; identical to SEQ ID NO: 53672

SEQ ID NO: 131476 - RNA, 64 nt, Homo Sapiens
gacaaggaaccugcagaauguggacaugaagauugggguguaacaccuacaccauuaucuugga

SEQ ID NO: 131477 - RNA, 64 nt, Homo Sapiens
cccugggcauugcuuuccacugagguuggggguugggguguacuaguuacacaucuucaacaga

SEQ ID NO: 131478 - RNA, 64 nt, Homo Sapiens
cugcugcugagggcagugcagugaacagcauggauuaacucaucugacuuggcuguacugaaaa

SEQ ID NO: 131479 - RNA, 64 nt, Homo Sapiens
uguucuagcugcaguacugcaauacauggcguaauuaacucagcgugguugugcauagaaagua

SEQ ID NO: 131480 - RNA, 64 nt, Homo Sapiens
uugaaacuuuuguagcaaucuggucuauagacuuuuaacucaagaagcuaaggcuagacuuguu

SEQ ID NO: 131481 - RNA, 64 nt, Homo Sapiens
gacacuuuuaaaagaaaagacaaguuuguuguguuuaacucaccaacacgugguguauaaugaa

SEQ ID NO: 131482 - RNA, 64 nt, Homo Sapiens
aguccccaaccuuuuuugcauuaaacccuacccuuuaacucagcauuauuguuuaauuagaaua

SEQ ID NO: 131483 - RNA, 64 nt, Homo Sapiens
aauuccaggagguaauuugucacauauuuucacuuuaacucaagagaaacaucagcauuguaua

SEQ ID NO: 131484 - RNA, 64 nt, Homo Sapiens
ccaugcguccuuucuuuuaagggcauuuuuagaauuaacucagaccuggaagacuccucaguuc

SEQ ID NO: 131485 - RNA, 64 nt, Homo Sapiens
uccaagguaacuggguaggaaaucuuuugacaucuuaacucauguugaguuugugcuguggugu

SEQ ID NO: 131486 - RNA, 64 nt, Homo Sapiens
cuccccacccaccaugguucauuccgacuuuuccaauggaaacucagaucccaaaagucccuaa

SEQ ID NO: 131487 - RNA, 64 nt, Homo Sapiens
gcuaacuccuuggauugucaacccccaucccccaaauggaaauuccgaaggaggccuccucgca

SEQ ID NO: 131488 - RNA, 64 nt, Homo Sapiens
ugagggaaaguaaauccucaugaggaaaaguacaaauggaaaucguauuaauuugugaggcagg

SEQ ID NO: 131489 - RNA, 64 nt, Homo Sapiens
ugccuuugcugaacuccaaguuaguggauugcagaauggaaacuuggcuuuugcggcacugggu

SEQ ID NO: 131490 - RNA, 64 nt, Homo Sapiens
agauaccacuuuaucagggaaguuagucaaaugaaauggaaauugguaaauggacaaaagcuag

SEQ ID NO: 131491 - RNA, 64 nt, Homo Sapiens
ugguagacaguucaugcaguauaugaauugccauaauggaaauaaucugauuuuauuuuuacaa

SEQ ID NO: 131492 - RNA, 64 nt, Homo Sapiens
acuuaaaaucuaugaguuuuuacuuuuuacugggaauggaaaguguggugaagaucauucaaca

SEQ ID NO: 131493 - RNA, 64 nt, Homo Sapiens
agagauugaaauuucaaacuaucucuaguuuuucaauggaaauauaucagcuagggaaaaacca

SEQ ID NO: 131494 - RNA, 64 nt, Homo Sapiens
accacagggcucagacuuacuagauaaaaccagaaauggaaauaaggaauucaggggaguucca

SEQ ID NO: 131495 - RNA, 64 nt, Homo Sapiens
uuuuauucauaaauuaaaugucuacaugugccagaauggaaaggaaacaaggggagacaacuuu

SEQ ID NO: 131496 - RNA, 64 nt, Homo Sapiens
cuggcuguuggaaaccugaaugcuuuuagacccaaauggaaaauuucugaaaugcuggauuauc

SEQ ID NO: 131497 - RNA, 64 nt, Homo Sapiens
guaaacauagccuauuuuugugcuuaagauacugaauggaaaacuccauuguguguugcuggac

SEQ ID NO: 131498 - RNA, 64 nt, Homo Sapiens
ugauuuugucuguauuugaaaacauucaaacuugaauggaaaguuuuuccauacuuguauauug

SEQ ID NO: 131499 - RNA, 64 nt, Homo Sapiens
aaaacaaaucagguccugauaaaaagugacauuuaauggaaagcaugucaguuacauucagcag

SEQ ID NO: 131500 - RNA, 64 nt, Homo Sapiens
uguuuguaugugguggcuuugaguggcuguucuuaauggaaaacuguggcuaggcgaggagcug

SEQ ID NO: 131501 - RNA, 64 nt, Homo Sapiens
uauacaucguugguggcucugagugugugcucugaauggaaaguuuuauuuuauacuuacauag

SEQ ID NO: 131502 - RNA, 64 nt, Homo Sapiens
aagaaauauuaauaacugcugaaauuaauaagccaauggaaagagccaaguagaaaguuuaacu

SEQ ID NO: 131503 - RNA, 64 nt, Homo Sapiens
ggaaaaauuagucgaaaauaguauagccgaauauaauggaaauaaucagaaguugcaaaagaug

SEQ ID NO: 131504 - RNA, 64 nt, Homo Sapiens
uacaaaugcuuugaaggaauuuuuaaagaacauaaauggaaagaaaaggaagacugaaaaaagg

SEQ ID NO: 131505 - RNA, 64 nt, Homo Sapiens
agauuuggucucucauuuuauuuucauuuuuuuuaauggaaauaaaagaucaauuuggcacuuu

SEQ ID NO: 131506 - RNA, 64 nt, Homo Sapiens
uauaauuuauagaauuucagugcaguucauucuuaauggaaaaucugaaaccuaaauugcagau

SEQ ID NO: 131507 - RNA, 64 nt, Homo Sapiens
augcuuuuauguauuucaaaacuuucauauguuaaauggaaauuguuuuaaauguguuugaguu

SEQ ID NO: 131508 - RNA, 64 nt, Homo Sapiens
aguagaucuguuuuuucucagacacaggcuaagaaauggaaagagauuucagcauucagcaguu

SEQ ID NO: 131509 - RNA, 64 nt, Homo Sapiens
aaauugggaugagcccuaauagggggaauggaggaauggaaauaacaaggguugugaaugugaa

SEQ ID NO: 131510 - RNA, 64 nt, Homo Sapiens
ucaccaggacuccauucuuaggacucuaagccagaauggaaaauaacaccugaccaccauuuaa

SEQ ID NO: 131511 - RNA, 64 nt, Homo Sapiens
cucugucucccuaacucaacacauuuuuugggggaauggaaaagacaaaccuccuugggaaucc

SEQ ID NO: 131512 - RNA, 64 nt, Homo Sapiens
gugauccaguuuuucauaagauauuuuauuuugaaauggaaauuaauguccucucaaaguaaaa

SEQ ID NO: 131513 - RNA, 64 nt, Homo Sapiens
augccaaaauuguccaucugccucugaguagggcaauggaaauaccaaaccuucugacuuugcc

SEQ ID NO: 131514 - RNA, 64 nt, Homo Sapiens
uagguaaauuggacuuaaucagacacaagcaaccaauggaaaaauuucuuagauaugauaccaa

SEQ ID NO: 131515 - RNA, 64 nt, Homo Sapiens
cauccuguguucauggaucaagaaggcuuaaauaaauggaaagacaaaauuggaaagaaauuaa

SEQ ID NO: 131516 - RNA, 64 nt, Homo Sapiens
uaugguuuaauguguccaaaugaauuaacuacauaauggaaaaggcaggcaggcacucaagaaa

SEQ ID NO: 131517 - RNA, 64 nt, Homo Sapiens
gacaaaaaaaaucaagugcgugaauaaacuugauaauggaaacgauuaauaucaaauucacuua

SEQ ID NO: 131518 - RNA, 64 nt, Homo Sapiens
uuuguuggcguaauuuuugaagggaauggaaaggaauggaaagaauuugauuuuauucuugcag

SEQ ID NO: 131519 - RNA, 64 nt, Homo Sapiens
aauggaaagauuuguuggcgauucuugcagagggaauggaaaggccuaacaguuauuugauuuu

SEQ ID NO: 131520 - RNA, 64 nt, Homo Sapiens
gaaaaaaccuaagaaauuuccccuuuuuuuaaaaaauggaaauauucaauugagacuugagggg

SEQ ID NO: 131521 - RNA, 64 nt, Homo Sapiens
cucuuccaacccuccauuagcucaauuuugagauaauggaaaauugacuggaaauucaaaacuc

SEQ ID NO: 131522 - RNA, 64 nt, Homo Sapiens
ucaguauuuugagaauugccauauuaauuuuuauaauggaaaacuuaauaaauugcuacuguuu

SEQ ID NO: 131523 - RNA, 64 nt, Homo Sapiens
agagacaugaaauguacuagaggagcccuuuuccaauggaaauauuauauaccacauuuuuugu

SEQ ID NO: 131524 - RNA, 64 nt, Homo Sapiens
uccaauggaaauauuauauaccacauuuuuuguuaauggaaauaaaugucuucauucccauguu

SEQ ID NO: 131525 - RNA, 64 nt, Homo Sapiens
gacgugauaggcugcaugcaagaggcauacagaaaauggaaauaguauuucgcuguccugaaac

SEQ ID NO: 131526 - RNA, 64 nt, Homo Sapiens
gucauaauauucucucccucccuaaguauucuacaauggaaagaauggaggaagcacuucaagu

SEQ ID NO: 131527 - RNA, 64 nt, Homo Sapiens
uugacagugcugcugccuucggugacuauaugagaauggaaacuucuaaggaagccagguuguu

SEQ ID NO: 131528 - RNA, 64 nt, Homo Sapiens
acauuuauuuucuucagccugugcaaaacaaagcaauggaaaaggaaacuaaaaaauauacaua

SEQ ID NO: 131529 - RNA, 64 nt, Homo Sapiens
ugauacuauaauagaaugagacauaaaaugaauuaauggaaacauauccacacuguacugugau

SEQ ID NO: 131530 - RNA, 64 nt, Homo Sapiens
cguaauucuucauaguuuuuuuaaucuauggauaaauggaaaccuaauuauuuguaaugaauua

SEQ ID NO: 131531 - RNA, 64 nt, Homo Sapiens
ggggaaaacauuuuuuaucauuuucuauuaagaaaauggaaaacuuaaauaugguguuaaaaau

SEQ ID NO: 131532 - RNA, 64 nt, Homo Sapiens
uuaagaaaauggaaaacuuaaauaugguguuaaaaauggaaauauaugugauauuugcauuauu

SEQ ID NO: 131533 - RNA, 64 nt, Homo Sapiens
aauagauguaaauaaaauuggaugugauacacugaauggaaauacuguuaucaccuauccugaa

SEQ ID NO: 131534 - RNA, 64 nt, Homo Sapiens
auuucugguuuuaucuucaaugucaagaugcuacaauggaaaccaacuuuacauauuugucuau

SEQ ID NO: 131535 - RNA, 64 nt, Homo Sapiens
cccggaccaguuacauucguuccuggcaaaagcaaauggaaauggucuccugucuccagccugc

SEQ ID NO: 131536 - RNA, 64 nt, Homo Sapiens
auuugaaauaauuucaccaggcuaaauaaaggaaaauggaaaccaguuaagaggcacaguguac

SEQ ID NO: 131537 - RNA, 64 nt, Homo Sapiens
ugaaucaaacugaaaaaguauuuccuuauagcuuaauggaaaggcuacuaggaaaaaccagaag

SEQ ID NO: 131538 - RNA, 64 nt, Homo Sapiens
agcuuuccagucacacaucaaggcgcuugaucacaauggaaaaggugaagaaauuugagguaaa

SEQ ID NO: 131539 - RNA, 64 nt, Homo Sapiens
ggaugaauuaugaaguauuccuuccaaagaugucaauggaaacuaaucgagucuuacaccuaau

SEQ ID NO: 131540 - RNA, 64 nt, Homo Sapiens
auuuuaaauuuauauuugaacacagucaaaucugaauggaaauacauuuaaauaagcauuucuu

SEQ ID NO: 131541 - RNA, 64 nt, Homo Sapiens
guuuuggaaugucccccacuuggagaguuugaggaauggaaaugagaaucggaggagaaauaag

SEQ ID NO: 131542 - RNA, 64 nt, Homo Sapiens
uuuuggaaaguacuuaaaaguuaccagaauuuucaauggaaaaugagggguuucuccccacuga

SEQ ID NO: 131543 - RNA, 64 nt, Homo Sapiens
cugcuuucauuuuucugaccuaauaauuacgggaaauggaaagucugggccagcaucaauaaaa

SEQ ID NO: 131544 - RNA, 64 nt, Homo Sapiens
auccuugaaaauaguuuuugaaaccuauuagguaaauggaaauauuuauaacuuuuaaauggaa

SEQ ID NO: 131545 - RNA, 64 nt, Homo Sapiens
ccuauuagguaaauggaaauuuuuauaacuuuuaaauggaaaaacuguuuucucuuuuuaaaua

SEQ ID NO: 131546 - RNA, 64 nt, Homo Sapiens
uagaugcuauuguucugauggcccggcugaauaaaauggaaauucuaguuuguuagaauuaugc

SEQ ID NO: 131547 - RNA, 64 nt, Homo Sapiens
gccuaacuuauuggagcacaucaguuucuuggguaauggaaaacauuaccuagaguugccagug

SEQ ID NO: 131548 - RNA, 64 nt, Homo Sapiens
agguuuuaaucauucuucuauaaaauacauuuaaaauggaaaaauacuuaauaucacuaaauau

SEQ ID NO: 131549 - RNA, 64 nt, Homo Sapiens
aaaacugaaauagccucccuauuuauauaauacaaauggaaaucaaauguuguauuucauauuu

SEQ ID NO: 131550 - RNA, 64 nt, Homo Sapiens
uagucacagagaaauuuagucaaauuacuuaagaaauggaaaagauugacuuuuggaaaccaac

SEQ ID NO: 131551 - RNA, 64 nt, Homo Sapiens
ccaguauucuuuuauaaaauguuguuugaauggaaauggaaaagucagggacccccacgccuuu

SEQ ID NO: 131552 - RNA, 64 nt, Homo Sapiens
gaaaagccaguauucuuuuagccuuuguuguuugaauggaaaugcccuucucagggacccccac

SEQ ID NO: 131553 - RNA, 64 nt, Homo Sapiens
aauuuauuggaguaacucaaauugccugaggaaaaauggaaaaauuauccaccagucgauucaa

SEQ ID NO: 131554 - RNA, 64 nt, Homo Sapiens
gucagccagaaaucacagauacugcuuucacuuaaauggaaacaauucuccgauaaugcuuugc

SEQ ID NO: 131555 - RNA, 64 nt, Homo Sapiens
gauuugagaaaagggaggaggggaagauagucugaauggaaaucugaaauacggaauguuuuag

SEQ ID NO: 131556 - RNA, 64 nt, Homo Sapiens
uaacuagcuuuaaguuuaaagauggaagcuaagcaauggaaaugcuauacguuuuugacauuua

SEQ ID NO: 131557 - RNA, 64 nt, Homo Sapiens
guagcuagaaauaauuauguggaaaaaaaugaauaauggaaaauagugagucucaaauuguucu

SEQ ID NO: 131558 - RNA, 64 nt, Homo Sapiens
gcagccauugggaaauugggagaaaugauaaacaaauggaaaaagaagaugucccuaaccuaca

SEQ ID NO: 131559 - RNA, 64 nt, Homo Sapiens
uugauuaucuucagcccaggcuuuugcuagauggaauggaaaagcaacuucauuugacacaaag

SEQ ID NO: 131560 - RNA, 64 nt, Homo Sapiens
uuuuuuuggguuaaaagaugguuguagcauuuaaaauggaaaauuuucuccuugguuugcuagu

SEQ ID NO: 131561 - RNA, 64 nt, Homo Sapiens
ucccaggagccgcggaggaggacagugagggaggaauggaaacgagagaugugaaguuggcagc

SEQ ID NO: 131562 - RNA, 64 nt, Homo Sapiens
cuuguuaacccaagaugcugcuacacagaugccaaauggaaaucuuccacagggcuuuuucagu

SEQ ID NO: 131563 - RNA, 64 nt, Homo Sapiens
agugaacggaaaacacagaggucaaaaugcagagaauggaaaacucuguaggguacuguaauuu

SEQ ID NO: 131564 - RNA, 64 nt, Homo Sapiens
gagucugagaucuguacugucaauuaguuuacagaauggaaaagcauuugaguaaccaucaaca

SEQ ID NO: 131565 - RNA, 64 nt, Homo Sapiens
cauuuauucuuuuaaauaauuuuauaagauuggcaauggaaaaacacagccuggauugagaauu

SEQ ID NO: 131566 - RNA, 64 nt, Homo Sapiens
ggcaauaagaaauuaauaccgcaugggauaugggaauggaaaaggcuaugcaugcucuaagucu

SEQ ID NO: 131567 - RNA, 64 nt, Homo Sapiens
gaaauaacauuugugaaaucguaaguagaaacgaaauggaaacauuggcaaaagcuggugccug

SEQ ID NO: 131568 - RNA, 64 nt, Homo Sapiens
uauuuauuuucacaguugaaaccagcucuuaauaaauggaaacuguauuuugaucugcauugac

SEQ ID NO: 131569 - RNA, 64 nt, Homo Sapiens
cauagggaagaaugggcuguugaagaaauaaaugaauggaaagaguaguaugaaaacuauuugu

SEQ ID NO: 131570 - RNA, 64 nt, Homo Sapiens
acuccccucucccucuuucuaggugcucuauuuuaauggaaaacugucuggaggggcaguguac

SEQ ID NO: 131571 - RNA, 64 nt, Homo Sapiens
uaaguaaaacuaagcucauuaaaaggguuucaugaauggaaaccgaaaauguugccuuguauuu

SEQ ID NO: 131572 - RNA, 64 nt, Homo Sapiens
aaauauaugugcuuauuaaaguuaguugcuuagaaauggaaauauagguauucuaauguauuuu

SEQ ID NO: 131573 - RNA, 64 nt, Homo Sapiens
gaauuuuuaaaauauaugcacuuuaaaauaguaaaauggaaaguggaaaagaauuuuacaugca

SEQ ID NO: 131574 - RNA, 64 nt, Homo Sapiens
aauuuuacaugcacuuuaaaauuaccuaccaaaaaauggaaaaguauuucccuucuucaaauua

SEQ ID NO: 131575 - RNA, 64 nt, Homo Sapiens
uauauuuguauaaguaaaugggugggugcuauacaauggaaagaugaaaauggaaaggaagagc

SEQ ID NO: 131576 - RNA, 64 nt, Homo Sapiens
uaaaugggugggugcuauacaauggaaagaugaaaauggaaaggaagagcuuauuuaagagacg

SEQ ID NO: 131577 - RNA, 64 nt, Homo Sapiens
uaugguggaccuauuacccuauggguaagaaauaaauggaaauaugacaucggauguuucagca

SEQ ID NO: 131578 - RNA, 64 nt, Homo Sapiens
caccacucagugugauaauugugucuacagcuaaaauggaaauaguuuuaucuguacaguugug

SEQ ID NO: 131579 - RNA, 64 nt, Homo Sapiens
acaaauguuuuaugucaaguuaucauaccaaccaaauggaaauggcucuagagagaggucauga

SEQ ID NO: 131580 - RNA, 64 nt, Homo Sapiens
agaggauaccaacuguaugcaaaauagaggauacaauggaaaauaauugugcuauccugaaugg

SEQ ID NO: 131581 - RNA, 64 nt, Homo Sapiens
auuauaaggccauuuccuuuaaaaauuacaaggcaauggaaacuauaaaaagaaaaaaauggaa

SEQ ID NO: 131582 - RNA, 64 nt, Homo Sapiens
aauuacaaggcaauggaaacuauaaaaagaaaaaaauggaaaaaccaaaauauuauauuuuuuc

SEQ ID NO: 131583 - RNA, 64 nt, Homo Sapiens
guacaaaugccuaguuguguaguguucuccacauaauggaaaauuaaaagguagagaaacuugu

SEQ ID NO: 131584 - RNA, 64 nt, Homo Sapiens
ugugguuaauucugaauuucucuugaacaagaugaauggaaaauuaucccaaaaggaagaacug

SEQ ID NO: 131585 - RNA, 64 nt, Homo Sapiens
aaguaugauauugcauuuaaauuguuaucuugccaauggaaauaaauaccacaguauuuuauuc

SEQ ID NO: 131586 - RNA, 64 nt, Homo Sapiens
uuaagaaguuggaauguugggguuaaugccuaaaaauggaaacgaaagaggaacugaaggacgc

SEQ ID NO: 131587 - RNA, 64 nt, Homo Sapiens
aauggguaggggugcauugcuuuuuccacaguauaauggaaaauuuuguaaauagcaguucaca

SEQ ID NO: 131588 - RNA, 64 nt, Homo Sapiens
uguuauccaucaaaagugauuuaagugagagaguaauggaaaacaaaucacuuaauuaguacca

SEQ ID NO: 131589 - RNA, 64 nt, Homo Sapiens
gaauguauccccugccuauuuuccuuguguaacaaauggaaaacauucuccccugugagaaaua

SEQ ID NO: 131590 - RNA, 64 nt, Homo Sapiens
ugcaugggaaagcaaagcagaaaacagugccccaaauggaaaaaagauacucacacagaacaaa

SEQ ID NO: 131591 - RNA, 64 nt, Homo Sapiens
ucacugagcaguuguuuauacucaaaguaaaauaaauggaaauaagauagaaaaauuuuuauua

SEQ ID NO: 131592 - RNA, 64 nt, Homo Sapiens
gcuggagaaacaaaauugcuaugacuguuuggcaaauggaaaccaccauguucaaccaucuguc

SEQ ID NO: 131593 - RNA, 64 nt, Homo Sapiens
gguggcugcgacucaagaaugaaugaagaauggaaauggaaaagcaaagucaacagcccaauaa

SEQ ID NO: 131594 - RNA, 64 nt, Homo Sapiens
gaaaaggguggcugcgacuccaauaagaaugaagaauggaaaugaugucucaaagucaacagcc

SEQ ID NO: 131595 - RNA, 64 nt, Homo Sapiens
uuacuuugacauaggaauugacuucuuuuccuugaauggaaaacacuuugaaauaauaauaaac

SEQ ID NO: 131596 - RNA, 64 nt, Homo Sapiens
auauuugucauauauuuaagaaaaagcuaaaaagaauggaaaucgcaugacuauaacuuaaguc

SEQ ID NO: 131597 - RNA, 64 nt, Homo Sapiens
uuauggaaaagaggugagccuuugugaagaacauaauggaaaagugcauguacgggaaauaaca

SEQ ID NO: 131598 - RNA, 64 nt, Homo Sapiens
acaaacaaacaacguaucuuacugacuaaacuggaauggaaaucuuauaauuaguguuguauuu

SEQ ID NO: 131599 - RNA, 64 nt, Homo Sapiens
gcaugacuauaacuuaagucaaaaagcuaaaaagaauggaaaucauauuugucguauauugaag

SEQ ID NO: 131600 - RNA, 64 nt, Homo Sapiens
acuuugaaauaauaauaaacacuucuuuuccuugaauggaaaacuuacuuugacauaggaauug

SEQ ID NO: 131601 - RNA, 64 nt, Homo Sapiens
uuggcuguugacucuugucaugcgucagccugaaaauggaaauaagacaaguccugugucuacc

SEQ ID NO: 131602 - RNA, 64 nt, Homo Sapiens
ggaagaaaguauaauagaaacauuugaccauaugaauggaaaagaaaaaaacaagcaagaagac

SEQ ID NO: 131603 - RNA, 64 nt, Homo Sapiens
gccauguguuaauauaaaguaggcauggcuucccaauggaaaucucugagaaugacaguggagu

SEQ ID NO: 131604 - RNA, 64 nt, Homo Sapiens
acuaacuuuuagcuaacaauaagggcugugccccaauggaaacugaguucauuuucugagaaag

SEQ ID NO: 131605 - RNA, 64 nt, Homo Sapiens
auguuguaauaaaauaaucuaggaaaugacugguaauggaaaaauuaugaauguaacugugcac

SEQ ID NO: 131606 - RNA, 64 nt, Homo Sapiens
uucucuuuccucugaagcaguaaggcacaugugaaauggaaauguuuaucuaccaucaaccuga

SEQ ID NO: 131607 - RNA, 64 nt, Homo Sapiens
agcuucacucacugucaaugauuauuuucauuacaauggaaacaaucuuuuuuacucuaugccc

SEQ ID NO: 131608 - RNA, 64 nt, Homo Sapiens
cuuuuuaaaccaguuuagauuucaagaaaaaauaaauggaaaucaucgaaaauucauuucacau

SEQ ID NO: 131609 - RNA, 64 nt, Homo Sapiens
gggcuuuuauuuuuucuuuuguaauuguguaaaaaauggaaaaaaacauaaaaagcagaauuuu

SEQ ID NO: 131610 - RNA, 62 nt, Homo Sapiens
acuguagguuauuuaaaauaaauuccuacaacuuaauggaaacuuaagugucugccucuuug

SEQ ID NO: 131611 - RNA, 64 nt, Homo Sapiens
auaaaaguaaaugaaaaacaauuaaauuugguuuaauggaaagaaagcaaaaggauguuauuuc

SEQ ID NO: 131612 - RNA, 64 nt, Homo Sapiens
gaagggaauuuccccccaccucugcuacaaaaggaauggaaaggagccgaggcaguuccugcgu

SEQ ID NO: 131613 - RNA, 64 nt, Homo Sapiens
cuggagaauaguaguucuggucacugcuuauuaaaauggaaaucuuauuuucuuuuugcuuugu

SEQ ID NO: 131614 - RNA, 64 nt, Homo Sapiens
guccuaccgugcagccacacgacacucgugauggaauggaaaucguggagaugagaagguggug

SEQ ID NO: 131615 - RNA, 64 nt, Homo Sapiens
acagcaagcacaggugagucagugugcucgugggaauggaaaggggagcgggggugaggggggc

SEQ ID NO: 131616 - RNA, 64 nt, Homo Sapiens
gucuccaagaaguuuuauuuauuuaaucauaaauaauggaaauggaaauuguauaguuucauug

SEQ ID NO: 131617 - RNA, 64 nt, Homo Sapiens
aagaguacguauucaugguuacauuaaguugaagaauggaaauuaaaaucugaaguacuauaga

SEQ ID NO: 131618 - RNA, 64 nt, Homo Sapiens; identical to SEQ ID NO: 100733

SEQ ID NO: 131619 - RNA, 64 nt, Homo Sapiens; identical to SEQ ID NO: 100734

SEQ ID NO: 131620 - RNA, 64 nt, Homo Sapiens; identical to SEQ ID NO: 100735

SEQ ID NO: 131621 - RNA, 64 nt, Homo Sapiens; identical to SEQ ID NO: 100736

SEQ ID NO: 131622 - RNA, 64 nt, Homo Sapiens; identical to SEQ ID NO: 100737

SEQ ID NO: 131623 - RNA, 64 nt, Homo Sapiens; identical to SEQ ID NO: 100738

SEQ ID NO: 131624 - RNA, 64 nt, Homo Sapiens; identical to SEQ ID NO: 100739

SEQ ID NO: 131625 - RNA, 64 nt, Homo Sapiens; identical to SEQ ID NO: 100740

SEQ ID NO: 131626 - RNA, 64 nt, Homo Sapiens; identical to SEQ ID NO: 100741

SEQ ID NO: 131627 - RNA, 64 nt, Homo Sapiens; identical to SEQ ID NO: 100742

SEQ ID NO: 131628 - RNA, 64 nt, Homo Sapiens; identical to SEQ ID NO: 100743

SEQ ID NO: 131629 - RNA, 64 nt, Homo Sapiens; identical to SEQ ID NO: 100744

SEQ ID NO: 131630 - RNA, 64 nt, Homo Sapiens; identical to SEQ ID NO: 100745

SEQ ID NO: 131631 - RNA, 64 nt, Homo Sapiens; identical to SEQ ID NO: 100746

SEQ ID NO: 131632 - RNA, 64 nt, Homo Sapiens; identical to SEQ ID NO: 100747

SEQ ID NO: 131633 - RNA, 64 nt, Homo Sapiens; identical to SEQ ID NO: 100748

SEQ ID NO: 131634 - RNA, 64 nt, Homo Sapiens; identical to SEQ ID NO: 100749

SEQ ID NO: 131635 - RNA, 64 nt, Homo Sapiens; identical to SEQ ID NO: 100750

SEQ ID NO: 131636 - RNA, 64 nt, Homo Sapiens; identical to SEQ ID NO: 100751

SEQ ID NO: 131637 - RNA, 64 nt, Homo Sapiens; identical to SEQ ID NO: 100752

SEQ ID NO: 131638 - RNA, 64 nt, Homo Sapiens; identical to SEQ ID NO: 100753

SEQ ID NO: 131639 - RNA, 64 nt, Homo Sapiens; identical to SEQ ID NO: 100754

SEQ ID NO: 131640 - RNA, 64 nt, Homo Sapiens; identical to SEQ ID NO: 100755

SEQ ID NO: 131641 - RNA, 64 nt, Homo Sapiens; identical to SEQ ID NO: 100756

SEQ ID NO: 131642 - RNA, 64 nt, Homo Sapiens; identical to SEQ ID NO: 100757

SEQ ID NO: 131643 - RNA, 64 nt, Homo Sapiens; identical to SEQ ID NO: 100758

SEQ ID NO: 131644 - RNA, 64 nt, Homo Sapiens; identical to SEQ ID NO: 100759

SEQ ID NO: 131645 - RNA, 64 nt, Homo Sapiens; identical to SEQ ID NO: 100760

SEQ ID NO: 131646 - RNA, 64 nt, Homo Sapiens; identical to SEQ ID NO: 100761

SEQ ID NO: 131647 - RNA, 64 nt, Homo Sapiens; identical to SEQ ID NO: 100762

SEQ ID NO: 131648 - RNA, 64 nt, Homo Sapiens; identical to SEQ ID NO: 100763

SEQ ID NO: 131649 - RNA, 64 nt, Homo Sapiens; identical to SEQ ID NO: 100764

SEQ ID NO: 131650 - RNA, 64 nt, Homo Sapiens; identical to SEQ ID NO: 100765

SEQ ID NO: 131651 - RNA, 64 nt, Homo Sapiens; identical to SEQ ID NO: 100766

SEQ ID NO: 131652 - RNA, 64 nt, Homo Sapiens; identical to SEQ ID NO: 100767

SEQ ID NO: 131653 - RNA, 64 nt, Homo Sapiens; identical to SEQ ID NO: 100768

SEQ ID NO: 131654 - RNA, 64 nt, Homo Sapiens; identical to SEQ ID NO: 100769

SEQ ID NO: 131655 - RNA, 64 nt, Homo Sapiens; identical to SEQ ID NO: 100770

SEQ ID NO: 131656 - RNA, 64 nt, Homo Sapiens; identical to SEQ ID NO: 100771

SEQ ID NO: 131657 - RNA, 64 nt, Homo Sapiens; identical to SEQ ID NO: 100772

SEQ ID NO: 131658 - RNA, 64 nt, Homo Sapiens; identical to SEQ ID NO: 100773

SEQ ID NO: 131659 - RNA, 64 nt, Homo Sapiens; identical to SEQ ID NO: 100774

SEQ ID NO: 131660 - RNA, 64 nt, Homo Sapiens; identical to SEQ ID NO: 100775

SEQ ID NO: 131661 - RNA, 64 nt, Homo Sapiens; identical to SEQ ID NO: 100776

SEQ ID NO: 131662 - RNA, 64 nt, Homo Sapiens; identical to SEQ ID NO: 100777

SEQ ID NO: 131663 - RNA, 64 nt, Homo Sapiens
cucagcauuguguuaaauaaaaauuauucaccuaagaauagaaugacuuacuaaaaauaguuga

SEQ ID NO: 131664 - RNA, 64 nt, Homo Sapiens
gccuuuauuuccugguuugaagauuuuaaaaaaaagaauagaaauuagggaguguaccucagau

SEQ ID NO: 131665 - RNA, 64 nt, Homo Sapiens
gaccaagaugguucacaguuuauaaacauagaauagaauagacugauugcuugagaaaauaaca

SEQ ID NO: 131666 - RNA, 64 nt, Homo Sapiens
agacugaccaagaugguucauaacauauaaacauagaauagaaugaagcgauugcuugagaaaa

SEQ ID NO: 131667 - RNA, 64 nt, Homo Sapiens
acgcugaaaacccguuugauucuauacccaaucaagaauagacccuucacacaggaaaugugaa

SEQ ID NO: 131668 - RNA, 64 nt, Homo Sapiens
uuaccaccaaaaggcaauggcaguccuacauuuaagaauagagcuaugcaaacucuguuaaaaa

SEQ ID NO: 131669 - RNA, 64 nt, Homo Sapiens
acuggguaugcguuucaugucagacucacuguuaagaauagaaaucucugagaccacagaggcu

SEQ ID NO: 131670 - RNA, 64 nt, Homo Sapiens
gauucagucauaaagagguaaucuuucauuaaaaagaauagaagaacuuggcuuuccuguuucu

SEQ ID NO: 131671 - RNA, 64 nt, Homo Sapiens
uaagucgcuguguuuucuguggauaugacacugcagaauagauuauucuggggacaaucugacu

SEQ ID NO: 131672 - RNA, 64 nt, Homo Sapiens
ucagaaagcuucgguggaaggccgaacggagaucagaauagacuuuuuagggauagagucagcu

SEQ ID NO: 131673 - RNA, 64 nt, Homo Sapiens
aucccaaccucuuggauguauacagagauuuuauagaauagaaccuauagcuucuaccaugagu

SEQ ID NO: 131674 - RNA, 64 nt, Homo Sapiens
cuuaagaauaagaccugagauuaacacuaacccuagaauagaaauguaauagggagaugguaau

SEQ ID NO: 131675 - RNA, 64 nt, Homo Sapiens
uuuacugaauagugguauaugcuucccaaaaacuagaauagauuagauaguuugugacacauaa

SEQ ID NO: 131676 - RNA, 64 nt, Homo Sapiens
acaaagcucaaggaauuuaagguuuuccaaagacagaauagaucaaaaaauuacuuuuuuacca

SEQ ID NO: 131677 - RNA, 64 nt, Homo Sapiens
uagaaguguaugaauugcugcgacaauuuugaaaagaauagaggaaacacccucacuguaugau

SEQ ID NO: 131678 - RNA, 64 nt, Homo Sapiens
uuaguacauuaguagguaaaugagcagauuuuaaagaauagaauauccagaagcagauucauga

SEQ ID NO: 131679 - RNA, 64 nt, Homo Sapiens
auuauugaaaauuguauguaaaacuauuuaaaauagaauagaaggauacacacccaauuauuga

SEQ ID NO: 131680 - RNA, 64 nt, Homo Sapiens
ucagcucccugggagcugaaagugaggauacuccgugcuccaggccacagggugaauguggcca

SEQ ID NO: 131681 - RNA, 64 nt, Homo Sapiens
auaaaauauuucaugggaaucgaaccuagggauagugcuccacuucugacgauggagugaagac

SEQ ID NO: 131682 - RNA, 64 nt, Homo Sapiens
uguguuugccuugcagcugagggauuuucacagugugcuccagauggugcuagaggaaguccca

SEQ ID NO: 131683 - RNA, 64 nt, Homo Sapiens
ugaggaggagacagccucagcggacaagcagcuggugcuccaagcacaggagaacaugcugguc

SEQ ID NO: 131684 - RNA, 64 nt, Homo Sapiens
acuugggugaccagucuccgucuuccuccugcuagugcuccaccccccggacuuggaugaccag

SEQ ID NO: 131685 - RNA, 64 nt, Homo Sapiens
cuuggaugaccaguuucccaccuuccuccugcuggugcuccaucccccaauaccaggcugggcc

SEQ ID NO: 131686 - RNA, 64 nt, Homo Sapiens
cacagaaaagaaaguucaugcaugaugcgggccagugcuccagcaccuccugcugggcaggggg

SEQ ID NO: 131687 - RNA, 64 nt, Homo Sapiens
gcugccaucucaccuccugccagcggaaagcccugugcuccaugccugacuuuucagugacuga

SEQ ID NO: 131688 - RNA, 64 nt, Homo Sapiens
aggaguuugaggcucuggaacucucacauauucaagucuuuaacuuaguggugaugggugauuu

SEQ ID NO: 131689 - RNA, 64 nt, Homo Sapiens
cugaaaguauccaugcugacuuucaugauuuagaagucuuuaacugaauuauuaaaauugccuu

SEQ ID NO: 131690 - RNA, 64 nt, Homo Sapiens
cccagcaacaaaccucccggcuaggagcuuuagaagucuuuauguucuuccugccaucauuccu

SEQ ID NO: 131691 - RNA, 64 nt, Homo Sapiens
acaaauaacuugucacaccuuuuguuucauucugagucuuuaguuuuagucaugggcuuucuuc

SEQ ID NO: 131692 - RNA, 64 nt, Homo Sapiens
uuauaaauguuuuuaauuguguucuguuuuuugcagucuuuaagugccaugccaauuguucuua

SEQ ID NO: 131693 - RNA, 64 nt, Homo Sapiens
auuucuguaccuuuuuuuuuuuuuuuuacuuugaagucuuuaaauaaaauguauaauacccauu

SEQ ID NO: 131694 - RNA, 64 nt, Homo Sapiens
agggauguauuucauuguauugcucuuuuuauuaagucuuuaacaaauuguaaaauguaaagau

SEQ ID NO: 131695 - RNA, 64 nt, Homo Sapiens
uucaaaaacuucaaauuagccaugaaaguauuccagucuuuaauugugcgucuaccucugucag

SEQ ID NO: 131696 - RNA, 64 nt, Homo Sapiens
gagcaaaaugcuucacaugcgaagaauguggcacagucuuuaccacauccucaaacuuuguuaa

SEQ ID NO: 131697 - RNA, 64 nt, Homo Sapiens
uggaggaaagucuuacaaaugugaagaauguggcagucuuuaaaucuuccucagucuuuucuaa

SEQ ID NO: 131698 - RNA, 64 nt, Homo Sapiens
augugguuuaucuuuacauuuuaaagaucaaagaagucuuuacaaccugaauccaggucuaaaa

SEQ ID NO: 131699 - RNA, 64 nt, Homo Sapiens
guuuguuuaacuaaguuguguuuaacuuaugugcagucuuuauaauguauguauguuauuacag

SEQ ID NO: 131700 - RNA, 64 nt, Homo Sapiens
caaaucucugcauuguuucaaauuauuaaauguuagucuuuaguacugaagggcuguaacugaa

SEQ ID NO: 131701 - RNA, 64 nt, Homo Sapiens
cccuaaaucugagucaguaauccuauuucucaauagucuuuaaaccaauaaucucucaauaccu

SEQ ID NO: 131702 - RNA, 64 nt, Homo Sapiens
cccuaaaucugagucaguaauccuauuucucaauagucuuuaagaacccagucucucaauaccu

SEQ ID NO: 131703 - RNA, 64 nt, Homo Sapiens
auauuugaagcaauuuuuuuugaauguguacuuaagucuuuauucuguaacagaaaauaaauuu

SEQ ID NO: 131704 - RNA, 64 nt, Homo Sapiens
acuacuauucuguuauuuuuauucauauagaguuagucuuuacaacugcgcuaugauuaaaacc

SEQ ID NO: 131705 - RNA, 64 nt, Homo Sapiens
gcagaagacaguguguugccacacacacacacacagucuuuauuacacacacacacacacacac

SEQ ID NO: 131706 - RNA, 64 nt, Homo Sapiens
gcagaagacaguguguugccauacacacacacagagucuuuauuacagacacacauacacacac

SEQ ID NO: 131707 - RNA, 64 nt, Homo Sapiens
ccauuugcauuaucugcagagaaauuauguuaagagucuuuaacaccuuuuuuuaacugcaucu

SEQ ID NO: 131708 - RNA, 64 nt, Homo Sapiens
cucugaucuuuuuggaacaaaaaccuucauggauagucuuuaauggguucuugccuuaaaagug

SEQ ID NO: 131709 - RNA, 64 nt, Homo Sapiens
gagaaaagccuuaugagugcagugaaugugggaaagucuuuagauacaacuccagccucauuaa

SEQ ID NO: 131710 - RNA, 64 nt, Homo Sapiens
gagagagaccuuaucagugcagugaauguggaagagucuuuaaccaaaauucucaucucauuca

SEQ ID NO: 131711 - RNA, 64 nt, Homo Sapiens
uauauauacacaacagaaaguacuauauauguuacauacuaacauauuuaaaaaguauauaaca

SEQ ID NO: 131712 - RNA, 64 nt, Homo Sapiens
uuuguuucuauaaaucaaauucucuaagaauaugcauacuaauguaggugcaucugccuccucu

SEQ ID NO: 131713 - RNA, 64 nt, Homo Sapiens
ucuuucuugcaacucuuaguugggagauagaaguugaauugaguguggaaaguuauagcuugau

SEQ ID NO: 131714 - RNA, 64 nt, Homo Sapiens
ccagguuuuccuguggaaagugaacaauucggcaugaauugaaaauuuagcuuuuucuuuucuu

SEQ ID NO: 131715 - RNA, 64 nt, Homo Sapiens
gaauuguaaguuucaguugcgucucugcucugacugaauugaagcccuccagacuacuuuaaau

SEQ ID NO: 131716 - RNA, 64 nt, Homo Sapiens
ucucagcugucaauauuucuuucaugccuccuuuugaauugauacuucuguuccucuguucccc

SEQ ID NO: 131717 - RNA, 64 nt, Homo Sapiens
auuccuuuaugauauucacuaggugauacaguucugaauugagccuuugggaguuuguaaaaug

SEQ ID NO: 131718 - RNA, 64 nt, Homo Sapiens
gaguaaaagguccaauuuugugaaagauugaaaaugaauugaaugccuaguagaguauaggaga

SEQ ID NO: 131719 - RNA, 64 nt, Homo Sapiens
uugcuuuguauauuuggugauuuuguaauguaagugaauugauucuuauuucacugauacuauu

SEQ ID NO: 131720 - RNA, 64 nt, Homo Sapiens
uuuggcaaugagaacacagccagugguguugcauugaauugaacaaaaaacauucuguugcaaa

SEQ ID NO: 131721 - RNA, 64 nt, Homo Sapiens
auuaaaauucugcuucuuaauaauaaauuauuuuugaauugaacauuuaaugcaggcaggugug

SEQ ID NO: 131722 - RNA, 64 nt, Homo Sapiens
cucucuugcaaaaaaagaaauggguuucugcuaaugaauugagcagacaucuaauauuuuauau

SEQ ID NO: 131723 - RNA, 64 nt, Homo Sapiens
uaauauguuuguguguauauaugugccucacaccugaauugaaaauuaaagacugguuuaaaag

SEQ ID NO: 131724 - RNA, 64 nt, Homo Sapiens
acugcuuccuugcaaaaaaagucgaauccugcauugaauugaauaugaauuucucuaacucucu

SEQ ID NO: 131725 - RNA, 64 nt, Homo Sapiens
gcuucaaggggagcucuucuccagguucacuaggugaauugauuuauuauuaucauauugauaa

SEQ ID NO: 131726 - RNA, 64 nt, Homo Sapiens
uacuuugaaauuccaaguguuagucaaagcuuucugaauugagaugugggcuggggagaaacag

SEQ ID NO: 131727 - RNA, 64 nt, Homo Sapiens
uuuaacuaauacuugaacauugaaacagaagccuugaauugaaauauguuaaauguagcuuuuu

SEQ ID NO: 131728 - RNA, 64 nt, Homo Sapiens
accucaagcaugcuuagcaaaguccaacauuauuugaauugagccaacaaguauuuuaacucuc

SEQ ID NO: 131729 - RNA, 64 nt, Homo Sapiens
gcuccugacaucucaguucuuagcuagagauuggugaauugaauuaaauaacccauucauagca

SEQ ID NO: 131730 - RNA, 64 nt, Homo Sapiens
agacaggacuggcaguugggacaauaaaucucgcugaauugaaguugcaguucagggaagggaa

SEQ ID NO: 131731 - RNA, 64 nt, Homo Sapiens
agucaagagucacuaagcagcuguugaaaaagcuugaauugaggaaacccuauugaggcaguga

SEQ ID NO: 131732 - RNA, 64 nt, Homo Sapiens
gaaaaauuugcucuguaauauuuauuuaaagcauugaauugauaaguuuaugguauuauguugu

SEQ ID NO: 131733 - RNA, 64 nt, Homo Sapiens
uacauaaacuacugccaaugccagucacugaccuugaauugacuguuucucuuaauauaguucu

SEQ ID NO: 131734 - RNA, 62 nt, Homo Sapiens
cgacacagugagacucugucucaaaaaaacaaaacaaacaaacaaaaauacaaaaaauuagc

SEQ ID NO: 131735 - RNA, 62 nt, Homo Sapiens
acagugagacucugucucaaaaaaacaaaacaaacaaacaaaaauacaaaaaauuagccggg

SEQ ID NO: 131736 - RNA, 62 nt, Homo Sapiens
ggccuaggcaacgagagcaaaacuccaauacaaacaaacaaacaaacaccugugcuagguca

SEQ ID NO: 131737 - RNA, 62 nt, Homo Sapiens
uaggcaacgagagcaaaacuccaauacaaacaaacaaacaaacaccugugcuaggucagucu

SEQ ID NO: 131738 - RNA, 62 nt, Homo Sapiens
caacgagagcaaaacuccaauacaaacaaacaaacaaacaccugugcuaggucagucuggca

SEQ ID NO: 131739 - RNA, 62 nt, Homo Sapiens
cuucaucugcuggggggaaaaaguaaauuacaaacaaacaaacaaagcagaacuaaaauauu

SEQ ID NO: 131740 - RNA, 62 nt, Homo Sapiens
aucugcuggggggaaaaaguaaauuacaaacaaacaaacaaagcagaacuaaaauauuggga

SEQ ID NO: 131741 - RNA, 62 nt, Homo Sapiens
cccuauaacaaaagacagauugacaagagaaaaacaaacauaaauuuauuagcggguauaug

SEQ ID NO: 131742 - RNA, 62 nt, Homo Sapiens
aaaauacuauagcagacagcacuaaugucaucaacaaacauuguucuucuccguguccuggg

SEQ ID NO: 131743 - RNA, 62 nt, Homo Sapiens
guguuaauuuggcuguaauggcauuuaaagcaaacaaacaaacaaaaaaagcugugaaaaug

SEQ ID NO: 131744 - RNA, 62 nt, Homo Sapiens
uaauuuggcuguaauggcauuuaaagcaaacaaacaaacaaaaaaagcugugaaaauggccu

SEQ ID NO: 131745 - RNA, 62 nt, Homo Sapiens
uacacagacagaaguaguuaaacaaacaaacaaacaaacaaacagagcaaacccuguuucca

SEQ ID NO: 131746 - RNA, 62 nt, Homo Sapiens
caaauacacagacagaaguauccaaacaaacaaacaaacaaagcgacagagcaaacccuguu

SEQ ID NO: 131747 - RNA, 62 nt, Homo Sapiens
caaacaaauacacagacagauguuuccaaacaaacaaacaaacugggcgacagagcaaaccc

SEQ ID NO: 131748 - RNA, 62 nt, Homo Sapiens
caaacaaacaaauacacagaacccuguuuccaaacaaacaaacagccugggcgacagagcaa

SEQ ID NO: 131749 - RNA, 62 nt, Homo Sapiens
aaaaaaaaacucuugucucccucaaacaaacaaacaaacaaagcaacagaacaagaacccau

SEQ ID NO: 131750 - RNA, 62 nt, Homo Sapiens
caaaaaaaaaaaacucuuguccaucucaaacaaacaaacaaacugggcaacagaacaagaac

SEQ ID NO: 131751 - RNA, 62 nt, Homo Sapiens
caaacaaaaaaaaaaaacucgaacccaucucaaacaaacaaacaaccugggcaacagaacaa

SEQ ID NO: 131752 - RNA, 62 nt, Homo Sapiens
cuggugucuugguuacccauuuauuaaaaaaaaacaaacauguagauuuuucacacaccuca

SEQ ID NO: 131753 - RNA, 62 nt, Homo Sapiens
gauaaucucaaguuagaaaaggugucuuauaaaacaaacaguucggucuuauaaaacucguu

SEQ ID NO: 131754 - RNA, 62 nt, Homo Sapiens
ccugaaaaccucugugaaaaucauuguuaacaaacaaacaucauaacauuauuacauauagg

SEQ ID NO: 131755 - RNA, 62 nt, Homo Sapiens
caucccugaaaaccucuguguaggucauuguuaacaaacaaaacaaauaacauuauuacaua

SEQ ID NO: 131756 - RNA, 62 nt, Homo Sapiens
ugaaaaccucagagaaggcauauuuuuaaaaaaacaaacagaacuaaagcauuugcuauaau

SEQ ID NO: 131757 - RNA, 62 nt, Homo Sapiens
acuuagugaaauaaaauaagaggaaagccaaaaacaaacaaacaaaaagcauauggggagcu

SEQ ID NO: 131758 - RNA, 62 nt, Homo Sapiens
agugaaauaaaauaagaggaaagccaaaaacaaacaaacaaaaagcauauggggagcuggua

SEQ ID NO: 131759 - RNA, 62 nt, Homo Sapiens
ugauuaaugcaaggggaaauuuuuauacugaaaacaaacaaacaaacuagcagcuacuaaaa

SEQ ID NO: 131760 - RNA, 62 nt, Homo Sapiens
uaaugcaaggggaaauuuuuauacugaaaacaaacaaacaaacuagcagcuacuaaaauaga

SEQ ID NO: 131761 - RNA, 62 nt, Homo Sapiens
aguaacuagaugcagugugaauuuuuuccauuaacaaacaaacaagucaguggcuuaaaugu

SEQ ID NO: 131762 - RNA, 62 nt, Homo Sapiens
acuagaugcagugugaauuuuuuccauuaacaaacaaacaagucaguggcuuaaaugugauu

SEQ ID NO: 131763 - RNA, 62 nt, Homo Sapiens
cagacugccuugguacugccgaguccucucaaaacaaacacccucuugcaaccagcuuugga

SEQ ID NO: 131764 - RNA, 62 nt, Homo Sapiens
acaucugcuccuagcagugcaucagccaguaaaacaaacacauuuacaagaaaaauguuuua

SEQ ID NO: 131765 - RNA, 62 nt, Homo Sapiens
cagauacugaagaccaacggacugaaaaaaagaacaaacauuagcuauuuuaugcugcaaga

SEQ ID NO: 131766 - RNA, 62 nt, Homo Sapiens
guguuuucuguacccaaccagacuuuaaauaaaacaaacaugaaaccuaauguacguauuua

SEQ ID NO: 131767 - RNA, 62 nt, Homo Sapiens
aaacacaaaacauaauaaaacaaaguuaaacaaacaaacaaaggcaaacugagguagcgaca

SEQ ID NO: 131768 - RNA, 62 nt, Homo Sapiens
caaaaaacacaaaacauaaugacacaaaguuaaacaaacaaaugggggcaaacugagguagc

SEQ ID NO: 131769 - RNA, 62 nt, Homo Sapiens
aguaacgaagcuaagaauauaacaaacaaacaaacaaacagauucuagucccaugugauuua

SEQ ID NO: 131770 - RNA, 62 nt, Homo Sapiens
cagaaguaacgaagcuaagauuuaaacaaacaaacaaacaaauuuuuucuagucccauguga

SEQ ID NO: 131771 - RNA, 62 nt, Homo Sapiens
caaacagaaguaacgaagcugugauuuaaacaaacaaacaaaggauuuuuuucuagucccau

SEQ ID NO: 131772 - RNA, 62 nt, Homo Sapiens
caaacaaacagaaguaacgaccaugugauuuaaacaaacaaauguaggauuuuuuucuaguc

SEQ ID NO: 131773 - RNA, 62 nt, Homo Sapiens
aacuguugcuauuuccuaacagaaaacaaacaaacaaacaaacuagcccccuugaucccuaa

SEQ ID NO: 131774 - RNA, 62 nt, Homo Sapiens
caaaaacuguugcuauuucccuaaagaaaacaaacaaacaaaccuccuagcccccuugaucc

SEQ ID NO: 131775 - RNA, 62 nt, Homo Sapiens
caaacaaaaacuguugcuauaucccuaaagaaaacaaacaaauaacccuccuagcccccuug

SEQ ID NO: 131776 - RNA, 62 nt, Homo Sapiens
guuacaccucaagccccucagggguaacaacuaacaaacacccaaacuguuuggauugauug

SEQ ID NO: 131777 - RNA, 62 nt, Homo Sapiens
acacaaugcaaagugagcgcagcauagcuguuaacaaacauacaacuuuuuucuagggcuuu

SEQ ID NO: 131778 - RNA, 62 nt, Homo Sapiens
gcuuuuuguucuguuggugugauucaaagcaaaacaaacaaacaaaaacaaauuuuaagaac

SEQ ID NO: 131779 - RNA, 62 nt, Homo Sapiens
uuuguucuguuggugugauucaaagcaaaacaaacaaacaaaaacaaauuuuaagaacacaa

SEQ ID NO: 131780 - RNA, 62 nt, Homo Sapiens
ugaagucucuuuaugguuagagaagaccaaaaaacaaacaaacaaacuuagaaacauaaaag

SEQ ID NO: 131781 - RNA, 62 nt, Homo Sapiens
gucucuuuaugguuagagaagaccaaaaaacaaacaaacaaacuuagaaacauaaaaggaaa

SEQ ID NO: 131782 - RNA, 62 nt, Homo Sapiens
ggagcuggggccuggccuuucugcccauucucaacaaacacucuugucuggagacaggcagg

SEQ ID NO: 131783 - RNA, 62 nt, Homo Sapiens
ccaguauaguggggacaaucaguuaauaagcaaacaaacacauuucuauuuauaaaugguga

SEQ ID NO: 131784 - RNA, 62 nt, Homo Sapiens
cuuguuucucuagucacaucaacaaacaaacaaacaaacagcagggccagccuuguuucucu

SEQ ID NO: 131785 - RNA, 62 nt, Homo Sapiens
cagccuuguuucucuagucacucuaacaaacaaacaaacaaaccgcagggccagccuuguuu

SEQ ID NO: 131786 - RNA, 62 nt, Homo Sapiens
caaacagccuuguuucucuaguuucucuaacaaacaaacaaaggggccgcagggccagccuu

SEQ ID NO: 131787 - RNA, 62 nt, Homo Sapiens
caaacaaacagccuuguuucccuuguuucucuaacaaacaaagggcggggccgcagggccag

SEQ ID NO: 131788 - RNA, 62 nt, Homo Sapiens
aacuguuaauauauuagccauacuaucaaacaaacaaacaaaaucagaccaucugagcccac

SEQ ID NO: 131789 - RNA, 62 nt, Homo Sapiens
caaaaacuguuaauauauuaccacuacuaucaaacaaacaaaccaaaucagaccaucugagc

SEQ ID NO: 131790 - RNA, 62 nt, Homo Sapiens
ucuauauauaauaguuucaaaacaaacaaacaaacaaacagucccuguaagcuaaacaaaca

SEQ ID NO: 131791 - RNA, 62 nt, Homo Sapiens
caguucuauauauaauaguuaacaaacaaacaaacaaacaaacuaucccuguaagcuaaaca

SEQ ID NO: 131792 - RNA, 62 nt, Homo Sapiens
caaacaguucuauauauaauaacaaacaaacaaacaaacaaaccaccuaucccuguaagcua

SEQ ID NO: 131793 - RNA, 62 nt, Homo Sapiens
caaacaaacaguucuauauagcuaaacaaacaaacaaacaaaaaugccaccuaucccuguaa

SEQ ID NO: 131794 - RNA, 62 nt, Homo Sapiens
caaacaaacaaacaguucuaguaagcuaaacaaacaaacaaauuauaaugccaccuaucccu

SEQ ID NO: 131795 - RNA, 62 nt, Homo Sapiens
caaacaaacaaacaaacagucccuguaagcuaaacaaacaaauuucuuauaaugccaccuau

SEQ ID NO: 131796 - RNA, 62 nt, Homo Sapiens
aaagcuauggcacuagaauucaacaaaaaacaaacaaacaaauuaugaacaaaacaaaacaa

SEQ ID NO: 131797 - RNA, 62 nt, Homo Sapiens
caaaaaagcuauggcacuagacaacaacaaaaaacaaacaaauuucuuaugaacaaaacaaa

SEQ ID NO: 131798 - RNA, 62 nt, Homo Sapiens
aaacagaaaacaaaaaaacccugaccaaaacaaacaaacagaaugaagauguuucaaaaaau

SEQ ID NO: 131799 - RNA, 62 nt, Homo Sapiens
cagaaaacagaaaacaaaaaaaaucugaccaaaacaaacaaacacuaugaagauguuucaaa

SEQ ID NO: 131800 - RNA, 62 nt, Homo Sapiens
aaacccauguguuaaaauacacaaaacaaacaaacaaacaaaguaaucugaaguaugguauu

SEQ ID NO: 131801 - RNA, 62 nt, Homo Sapiens
caaaaaacccauguguuaaauauuacaaaacaaacaaacaaauauuguaaucugaaguaugg

SEQ ID NO: 131802 - RNA, 62 nt, Homo Sapiens
caaacaaaaaacccauguguaugguauuacaaaacaaacaaauggguauuguaaucugaagu

SEQ ID NO: 131803 - RNA, 62 nt, Homo Sapiens
uuagauaaauuucaaucaggguuuuuagauuaaacaaacaaacaauuggguacccaguuaaa

SEQ ID NO: 131804 - RNA, 62 nt, Homo Sapiens
auaaauuucaaucaggguuuuuagauuaaacaaacaaacaauuggguacccaguuaaauuuu

SEQ ID NO: 131805 - RNA, 62 nt, Homo Sapiens
cugggugacagagucagacuccgucccaaaaaaacaaacaaacaaaacaaaacaaaaaaaaa

SEQ ID NO: 131806 - RNA, 62 nt, Homo Sapiens
gugacagagucagacuccgucccaaaaaaacaaacaaacaaaacaaaacaaaaaaaaacaga

SEQ ID NO: 131807 - RNA, 62 nt, Homo Sapiens
uccauguuaggacauuucugcacaauuauuaaaacaaacagagaugauaagccuaaaaaaag

SEQ ID NO: 131808 - RNA, 62 nt, Homo Sapiens
augaagaacaaucaucuauugaacacagagccaacaaacagaaaggaaucugaagcacagga

SEQ ID NO: 131809 - RNA, 62 nt, Homo Sapiens
cacaaauacuuuuuuuucaaaaauaaauaacaaacaaacagcaggaaggccuuuaggaagac

SEQ ID NO: 131810 - RNA, 62 nt, Homo Sapiens
cagccacaaauacuuuuuuuagacaaauaaauaacaaacaaaguuuaggaaggccuuuagga

SEQ ID NO: 131811 - RNA, 62 nt, Homo Sapiens
auacaagaugugacacacccuucuuuauuugaaacaaacaaacauuuagcuagaccuuugcu

SEQ ID NO: 131812 - RNA, 62 nt, Homo Sapiens
aagaugugacacacccuucuuuauuugaaacaaacaaacauuuagcuagaccuuugcuuccu

SEQ ID NO: 131813 - RNA, 62 nt, Homo Sapiens
cuacuacaucuugccagaagguuucccucgccaacaaacaguugaaauuuaagggaagaagc

SEQ ID NO: 131814 - RNA, 62 nt, Homo Sapiens
cagccugggugacagagcgagacuccgucucaaacaaacaaacaaaaaacuguuuucauuug

SEQ ID NO: 131815 - RNA, 62 nt, Homo Sapiens
cugggugacagagcgagacuccgucucaaacaaacaaacaaaaaacuguuuucauuugcucu

SEQ ID NO: 131816 - RNA, 62 nt, Homo Sapiens
acuaucacacaggauagauauuaaaaaacaacaacaaacaaaucugaaguaggacuuuuacc

SEQ ID NO: 131817 - RNA, 62 nt, Homo Sapiens
cccuuuuucuaaaauugauaugaaaauagcaaaacaaacaugugugauacgcacaaacccuu

SEQ ID NO: 131818 - RNA, 62 nt, Homo Sapiens
aaaaacaaggguggguggggaagaucaaaacaaacaaacaaagauaauaaacaucauuuuaa

SEQ ID NO: 131819 - RNA, 62 nt, Homo Sapiens
caaaaaaaacaaggguggguuuaaaagaucaaaacaaacaaauccugauaauaaacaucauu

SEQ ID NO: 131820 - RNA, 62 nt, Homo Sapiens
uuuauuguauguaaggaaaaauuuuaccugaaaacaaacaaacaaacccuaaaacucagcac

SEQ ID NO: 131821 - RNA, 62 nt, Homo Sapiens
uuguauguaaggaaaaauuuuaccugaaaacaaacaaacaaacccuaaaacucagcaccacu

SEQ ID NO: 131822 - RNA, 62 nt, Homo Sapiens
ccagccuggcaacagagcuagaauccgucucaaacaaacaaacaaaaaaucccacagcuauu

SEQ ID NO: 131823 - RNA, 62 nt, Homo Sapiens
ccuggcaacagagcuagaauccgucucaaacaaacaaacaaaaaaucccacagcuauuggau

SEQ ID NO: 131824 - RNA, 62 nt, Homo Sapiens
aagauuuuauuaaagauauucaaaacaaaacaaacaaacaaaugggugacagacucugucuc

SEQ ID NO: 131825 - RNA, 62 nt, Homo Sapiens
caaaaagauuuuauuaaagaucuccaaaacaaaacaaacaaaaaccugggugacagacucug

SEQ ID NO: 131826 - RNA, 62 nt, Homo Sapiens
aaagcuauuccaagacucagcuuuuugcagauaacaaacaagauacuaaaaaggccaccuag

SEQ ID NO: 131827 - RNA, 62 nt, Homo Sapiens
aaugacugugguguggagggcacuccagguggaacaaacagaacugagggguggcacgggac

SEQ ID NO: 131828 - RNA, 62 nt, Homo Sapiens
uaacagaaacaaaaucuguacauccacaaacaaacaaacaaagucuuguuugauaauguggg

SEQ ID NO: 131829 - RNA, 62 nt, Homo Sapiens
caaauaacagaaacaaaaucugggcauccacaaacaaacaaaauuggucuuguuugauaaug

SEQ ID NO: 131830 - RNA, 62 nt, Homo Sapiens
aaaaaaaaaauuaaaaaaaacaaacaacaaaaaacaaacaacaaguccugcuauguuaaaaa

SEQ ID NO: 131831 - RNA, 62 nt, Homo Sapiens
aaaaaacaaacaacaaaaaaugcuauguuaaaaacaaacaacaaauaucaccaaagaagucc

SEQ ID NO: 131832 - RNA, 62 nt, Homo Sapiens
aaacaaccuuagcauuaagauguaaacaaacaaacaaacaaaacuaagaagccuuaauacuc

SEQ ID NO: 131833 - RNA, 62 nt, Homo Sapiens
caaaaaacaaccuuagcauuacucuguaaacaaacaaacaaacuuuacuaagaagccuuaau

SEQ ID NO: 131834 - RNA, 62 nt, Homo Sapiens
caaacaaaaaacaaccuuaguaauacucuguaaacaaacaaacaagcuuuacuaagaagccu

SEQ ID NO: 131835 - RNA, 62 nt, Homo Sapiens
uaauaaguauauaauccuguauaauuucuagaaacaaacaucccuaguaacacauauguagu

SEQ ID NO: 131836 - RNA, 62 nt, Homo Sapiens
cuugcaaaugggugugacgcguuucaucaaagaacaaacaucucaugugcaguagagaugca

SEQ ID NO: 131837 - RNA, 62 nt, Homo Sapiens
uggaaauguacauauccaauaugaaauacuaaaacaaacaaacaaacaaaaaaccagaaugc

SEQ ID NO: 131838 - RNA, 62 nt, Homo Sapiens
aauguacauauccaauaugaaauacuaaaacaaacaaacaaacaaaaaaccagaaugcauug

SEQ ID NO: 131839 - RNA, 62 nt, Homo Sapiens
uacauauccaauaugaaauacuaaaacaaacaaacaaacaaaaaaccagaaugcauuguaua

SEQ ID NO: 131840 - RNA, 62 nt, Homo Sapiens
gaaagacugcaguugugcuaaaaacaaaacaaaacaaacaaacaaacaaaaaaguaaaaaaa

SEQ ID NO: 131841 - RNA, 62 nt, Homo Sapiens
gacugcaguugugcuaaaaacaaaacaaaacaaacaaacaaacaaaaaaguaaaaaaagauu

SEQ ID NO: 131842 - RNA, 62 nt, Homo Sapiens
gcaguugugcuaaaaacaaaacaaaacaaacaaacaaacaaaaaaguaaaaaaagauuacuu

SEQ ID NO: 131843 - RNA, 62 nt, Homo Sapiens
aaaagggugggggagggaggaacaaacaaacaaacaaacaaauguaugacacccagcuuuaa

SEQ ID NO: 131844 - RNA, 62 nt, Homo Sapiens
caaaaaaagggugggggagguuaaaacaaacaaacaaacaaagaaauguaugacacccagcu

SEQ ID NO: 131845 - RNA, 62 nt, Homo Sapiens
caaacaaaaaaaggguggggagcuuuaaaacaaacaaacaaacucugaaauguaugacaccc

SEQ ID NO: 131846 - RNA, 62 nt, Homo Sapiens
caaacaaacaaaaaaaggguacccagcuuuaaaacaaacaaaugcucucugaaauguaugac

SEQ ID NO: 131847 - RNA, 62 nt, Homo Sapiens
aaagauauugcaguuguguucaaaaacaaacaaacaaacaaauggcgaaauccccgucuuua

SEQ ID NO: 131848 - RNA, 62 nt, Homo Sapiens
caaaaaagauauugcaguuguuuacaaaaacaaacaaacaaaaacguggcgaaauccccguc

SEQ ID NO: 131849 - RNA, 62 nt, Homo Sapiens
caaacaaaaaagauauugcacgucuuuacaaaaacaaacaaagggcaacguggcgaaauccc

SEQ ID NO: 131850 - RNA, 62 nt, Homo Sapiens
gaauucuuacuucauuaugaauguauuuaaaaaacaaacaccaaauaauuggaauauauugc

SEQ ID NO: 131851 - RNA, 62 nt, Homo Sapiens
gcagguaugcguaaguguguaugcuuguuuuaaacaaacacucaacguacauauguacauaa

SEQ ID NO: 131852 - RNA, 62 nt, Homo Sapiens
aaaccuucaacugccuuaugaaaacaaacacaaacaaacaaauugaaagaacaaaacaaaac

SEQ ID NO: 131853 - RNA, 62 nt, Homo Sapiens
aacaaacaaaaaaccuucaaaaaacaaaacaaaacaaacacauuggugcugauugaaagaac

SEQ ID NO: 131854 - RNA, 62 nt, Homo Sapiens
aaagccauagagagcagaacaauuuuaaaacaaacaaacaaauguauuuucucuggcuuuaa

SEQ ID NO: 131855 - RNA, 62 nt, Homo Sapiens
caaaaaagccauagagagcauuaaaauuuuaaaacaaacaaauguguguauuuucucuggcu

SEQ ID NO: 131856 - RNA, 62 nt, Homo Sapiens
ucuuuccaucaguaacacuggaaaaaaaaacaaacaaacacuaugguguaagucuuugacaa

SEQ ID NO: 131857 - RNA, 62 nt, Homo Sapiens
cacuucuuuccaucaguaacacaagaaaaaaaaacaaacaaaaacuaugguguaagucuuug

SEQ ID NO: 131858 - RNA, 62 nt, Homo Sapiens
gccugggugacagagugaaacucguaucuccaaacaaacaaacaaaaaguccuuaaacauau

SEQ ID NO: 131859 - RNA, 62 nt, Homo Sapiens
gggugacagagugaaacucguaucuccaaacaaacaaacaaaaaguccuuaaacauauguga

SEQ ID NO: 131860 - RNA, 62 nt, Homo Sapiens
gugucaagggucccucgcauucuuuuacuguaaacaaacaaugccuuaaauugugucuuguu

SEQ ID NO: 131861 - RNA, 62 nt, Homo Sapiens
ucugaucccugcccucauggaccugaccacucaacaaacaguccccaccacaccuaucuccu

SEQ ID NO: 131862 - RNA, 62 nt, Homo Sapiens
caguaaucacucuguacacagagucaacugccaacaaacacacauuucuagccuucuuuuua

SEQ ID NO: 131863 - RNA, 62 nt, Homo Sapiens
guggguauaaucauggaucggaguggagaagaaacaaacauauacagggaaugaguaacuuu

SEQ ID NO: 131864 - RNA, 62 nt, Homo Sapiens
aagacuaaaauuuugccuauaccuuuaagacaaacaaacaaacacacacacaaacaagcucu

SEQ ID NO: 131865 - RNA, 62 nt, Homo Sapiens
cuaaaauuuugccuauaccuuuaagacaaacaaacaaacacacacacaaacaagcucuaagc

SEQ ID NO: 131866 - RNA, 62 nt, Homo Sapiens
uagcuucuugucuuaggccugaaccaaaaaacaacaaacaaacaaaaaacaagaaugaaaaa

SEQ ID NO: 131867 - RNA, 62 nt, Homo Sapiens
uucuugucuuaggccugaaccaaaaaacaacaaacaaacaaaaaacaagaaugaaaaacaga

SEQ ID NO: 131868 - RNA, 62 nt, Homo Sapiens
acuucaggucuuaagugcaaaucaaagcaaaaaacaaacaaaacuuacauggaaaaacugua

SEQ ID NO: 131869 - RNA, 62 nt, Homo Sapiens
uucucaaaggucucagaccuacaaagaguuaaaacaaacagacaaacaaaaaaaaacacuac

SEQ ID NO: 131870 - RNA, 62 nt, Homo Sapiens
cuuuucuuuguuuguuuguuuuuuucucuaaaaacaaacagcaaaagacagcugaaaacaag

SEQ ID NO: 131871 - RNA, 62 nt, Homo Sapiens
ggaaaaucugaauggaggcagcaaacagccaaaacaaacauuccccacccggcccugugcau

SEQ ID NO: 131872 - RNA, 62 nt, Homo Sapiens
acgaagcauugauguuauggaagaaagaaagaaacaaacaaaauauauauauauauguccaa

SEQ ID NO: 131873 - RNA, 62 nt, Homo Sapiens
agacccaaucugagucuuauucaaaacaaacaaacaaacaaacgacggagcgagacucuguc

SEQ ID NO: 131874 - RNA, 62 nt, Homo Sapiens
caaaagacccaaucugagucugucucaaaacaaacaaacaaaugggcgacggagcgagacuc

SEQ ID NO: 131875 - RNA, 62 nt, Homo Sapiens
caaacaaaagacccaaucugacucugucucaaaacaaacaaaagccugggcgacggagcgag

SEQ ID NO: 131876 - RNA, 62 nt, Homo Sapiens
cacugcaucgggacuuuuuauccaaacaaacaaacaaacacuuaaaauauaaacaaucaaaa

SEQ ID NO: 131877 - RNA, 62 nt, Homo Sapiens
cacucacugcaucgggacuuaaaauccaaacaaacaaacaaaaacauaaaauauaaacaauc

SEQ ID NO: 131878 - RNA, 62 nt, Homo Sapiens
caaacacucacugcaucgggaaucaaaauccaaacaaacaaaacaaaacauaaaauauaaac

SEQ ID NO: 131879 - RNA, 62 nt, Homo Sapiens
cccuuuggcuucugauuuuucucuuuuuuaaaaacaaacaaacaaacuguugcagauuauga

SEQ ID NO: 131880 - RNA, 62 nt, Homo Sapiens
uuggcuucugauuuuucucuuuuuuaaaaacaaacaaacaaacuguugcagauuaugaguga

SEQ ID NO: 131881 - RNA, 62 nt, Homo Sapiens
uuuuccaauuauaaauaaaugaaaaacaaacaaacaaacaguuuguggucugugcuugcuca

SEQ ID NO: 131882 - RNA, 62 nt, Homo Sapiens
caguuuuuccaauuauaaaucucagaaaaacaaacaaacaaagugcuuguggucugugcuug

SEQ ID NO: 131883 - RNA, 62 nt, Homo Sapiens
caaacaguuuuuccaauuaucuugcucagaaaaacaaacaaaugacgugcuuguggucugug

SEQ ID NO: 131884 - RNA, 62 nt, Homo Sapiens
uuuguagguucuuacuggacaaaacaaaaacaaacaaacacguaaucacaaccucaaguguu

SEQ ID NO: 131885 - RNA, 62 nt, Homo Sapiens
cacguuuguagguucuuacuuguuaaaacaaaaacaaacaaauguuuaaucacaaccucaag

SEQ ID NO: 131886 - RNA, 62 nt, Homo Sapiens
ccagauguauaaguacuaggucugaagaucaaaacaaacaauauuccuugagaauguauuua

SEQ ID NO: 131887 - RNA, 62 nt, Homo Sapiens
aaaauauuuuagaauaaauuuuuuuauacuaaaacaaacaccucagauuuggggaaaugaca

SEQ ID NO: 131888 - RNA, 62 nt, Homo Sapiens
aagcaccgucgagaaauggccaaaaacaaacaaacaaacagaagagagacuccaucucaaaa

SEQ ID NO: 131889 - RNA, 62 nt, Homo Sapiens
cagaaagcaccgucgagaaaaaaacaaaaacaaacaaacaaaacagagagagacuccaucuc

SEQ ID NO: 131890 - RNA, 62 nt, Homo Sapiens
caaacagaaagcaccgucgaucucaaaacaaaaacaaacaaaggcgacagagagagacucca

SEQ ID NO: 131891 - RNA, 62 nt, Homo Sapiens
guaaagagaaaugccuagugucuauuuuauuaaacaaacaaacacagaguuugaacuauaau

SEQ ID NO: 131892 - RNA, 62 nt, Homo Sapiens
agagaaaugccuagugucuauuuuauuaaacaaacaaacacagaguuugaacuauaauacua

SEQ ID NO: 131893 - RNA, 62 nt, Homo Sapiens
aaaaaaaacugucagagcgaauucaugcauucaacaaacacuuaugagugccuggaguaugc

SEQ ID NO: 131894 - RNA, 62 nt, Homo Sapiens
aagugcugagaagguuauggguaccaggaagaaacaaacagaagucuuaagauuagaaugag

SEQ ID NO: 131895 - RNA, 62 nt, Homo Sapiens
aaaaacauagacuucuuuauuuuaaaaaaacaaacaaacaaagcaauuuuaaaacagacucc

SEQ ID NO: 131896 - RNA, 62 nt, Homo Sapiens
caaaaaaaacauagacuucucuccuuuaaaaaaacaaacaaaauaggcaauuuuaaaacaga

SEQ ID NO: 131897 - RNA, 62 nt, Homo Sapiens
aaaaacaccucaccaugaguaaaacaaaaacaaacaaacaaagacucugucucaaaaaaaaa

SEQ ID NO: 131898 - RNA, 62 nt, Homo Sapiens
caaaaaaaacaccucaccauaaaaaaaacaaaaacaaacaaaguaagacucugucucaaaaa

SEQ ID NO: 131899 - RNA, 62 nt, Homo Sapiens
aagccuguccacccuugagaaaaaaacaaacaaacaaacaaaacuuccuugaaaauuuuauu

SEQ ID NO: 131900 - RNA, 62 nt, Homo Sapiens
caaaaagccuguccacccuuuauuaaaaaacaaacaaacaaaaaucacuuccuugaaaauuu

SEQ ID NO: 131901 - RNA, 62 nt, Homo Sapiens
caaacaaaaagccuguccacauuuuauuaaaaaacaaacaaaaagaaaucacuuccuugaaa

SEQ ID NO: 131902 - RNA, 62 nt, Homo Sapiens
ugaaaaugagccuuuggaccagucuuuauuaaaacaaacaaacaugaguagucugcauaucg

SEQ ID NO: 131903 - RNA, 62 nt, Homo Sapiens
aaugagccuuuggaccagucuuuauuaaaacaaacaaacaugaguagucugcauaucgaaua

SEQ ID NO: 131904 - RNA, 62 nt, Homo Sapiens
ucugaauaaguugguuuuagagggaaagguucaacaaacagggagaauccaguguuucugcu

SEQ ID NO: 131905 - RNA, 62 nt, Homo Sapiens
uuuguaauucuggaugaaagauaacuguguugaacaaacaggugcuccaggcuuugauuaua

SEQ ID NO: 131906 - RNA, 62 nt, Homo Sapiens
acauucccuagauucaaaggcaaaacagaagaaacaaacaaacaaacaaaaaaagcuugcaa

SEQ ID NO: 131907 - RNA, 62 nt, Homo Sapiens
ucccuagauucaaaggcaaaacagaagaaacaaacaaacaaacaaaaaaagcuugcaaaaua

SEQ ID NO: 131908 - RNA, 62 nt, Homo Sapiens
uagauucaaaggcaaaacagaagaaacaaacaaacaaacaaaaaaagcuugcaaaauauuuu

SEQ ID NO: 131909 - RNA, 62 nt, Homo Sapiens
guguucuuuugccuucaaucuguugucuucaaaacaaacaaacaaaaaaagcuucuugcgcc

SEQ ID NO: 131910 - RNA, 62 nt, Homo Sapiens
ucuuuugccuucaaucuguugucuucaaaacaaacaaacaaaaaaagcuucuugcgccuuuc

SEQ ID NO: 131911 - RNA, 62 nt, Homo Sapiens
aaaaacaauucuucauucagauccuaaaaacaaacaaacaaaaaaaaaaaaaaaaaaaaaaa

SEQ ID NO: 131912 - RNA, 62 nt, Homo Sapiens
caaaaaaaacaauucuucauaaaaauccuaaaaacaaacaaaaaaaaaaaaaaaaaaaaaaa

SEQ ID NO: 131913 - RNA, 62 nt, Homo Sapiens
aauaucauaaaaggagcugggagaaauugugaaacaaacacaacugagcugcuuuaguccuu

SEQ ID NO: 131914 - RNA, 62 nt, Homo Sapiens
cugccauaauauauuuuuuuaaaaaaaacaaaaacaaacagggaauuuggaaauaaaaagaa

SEQ ID NO: 131915 - RNA, 62 nt, Homo Sapiens
caggauaauuuuuaaaccaaucaaaugaaaaaaacaaacaaacaaaaaaggaaaugucaugu

SEQ ID NO: 131916 - RNA, 62 nt, Homo Sapiens
auaauuuuuaaaccaaucaaaugaaaaaaacaaacaaacaaaaaaggaaaugucaugugagg

SEQ ID NO: 131917 - RNA, 62 nt, Homo Sapiens
augacagagugagacccuguuucuaaaaacaaaacaaacaaacaaacaaacaacguaucuua

SEQ ID NO: 131918 - RNA, 62 nt, Homo Sapiens
cagagugagacccuguuucuaaaaacaaaacaaacaaacaaacaaacaacguaucuuacuga

SEQ ID NO: 131919 - RNA, 62 nt, Homo Sapiens
gugagacccuguuucuaaaaacaaaacaaacaaacaaacaaacaacguaucuuacugacuaa

SEQ ID NO: 131920 - RNA, 62 nt, Homo Sapiens
gacccuguuucuaaaaacaaaacaaacaaacaaacaaacaacguaucuuacugacuaaacug

SEQ ID NO: 131921 - RNA, 62 nt, Homo Sapiens
acuccuccuaccccccaagguaagaaacaaaaaacaaacaaacaaacaaaaauagaagacaa

SEQ ID NO: 131922 - RNA, 62 nt, Homo Sapiens
cuccuaccccccaagguaagaaacaaaaaacaaacaaacaaacaaaaauagaagacaaaaga

SEQ ID NO: 131923 - RNA, 62 nt, Homo Sapiens
uaccccccaagguaagaaacaaaaaacaaacaaacaaacaaaaauagaagacaaaagaaaga

SEQ ID NO: 131924 - RNA, 62 nt, Homo Sapiens
gugacagagcaagaccccaucucaaaaaaaaaaacaaacaaacaaaaaaaaaaccauauaua

SEQ ID NO: 131925 - RNA, 62 nt, Homo Sapiens
cagagcaagaccccaucucaaaaaaaaaaacaaacaaacaaaaaaaaaaccauauauauaca

SEQ ID NO: 131926 - RNA, 62 nt, Homo Sapiens
aaacaagacaaacaacuacaaacaaagaaacaaacaaacaaauauauaucuauauaaauuaa

SEQ ID NO: 131927 - RNA, 62 nt, Homo Sapiens
caaaaaacaagacaaacaacuuaaaacaaagaaacaaacaaaaauauauauaucuauauaaa

SEQ ID NO: 131928 - RNA, 62 nt, Homo Sapiens
gucauuuuguuuuaugacagacacacguaucuaacaaacaaacaaacagugaccuucuccau

SEQ ID NO: 131929 - RNA, 62 nt, Homo Sapiens
uuuuguuuuaugacagacacacguaucuaacaaacaaacaaacagugaccuucuccaugggu

SEQ ID NO: 131930 - RNA, 62 nt, Homo Sapiens
guuuuaugacagacacacguaucuaacaaacaaacaaacagugaccuucuccaugggucaag

SEQ ID NO: 131931 - RNA, 62 nt, Homo Sapiens
uaagguuuucuggcuuauugaggaaauuuccuaacaaacaaacaaacaaacaaacagaagag

SEQ ID NO: 131932 - RNA, 62 nt, Homo Sapiens
guuuucuggcuuauugaggaaauuuccuaacaaacaaacaaacaaacaaacagaagagaaga

SEQ ID NO: 131933 - RNA, 62 nt, Homo Sapiens
ucuggcuuauugaggaaauuuccuaacaaacaaacaaacaaacaaacagaagagaagaucau

SEQ ID NO: 131934 - RNA, 62 nt, Homo Sapiens
gcuuauugaggaaauuuccuaacaaacaaacaaacaaacaaacagaagagaagaucauuaac

SEQ ID NO: 131935 - RNA, 62 nt, Homo Sapiens
auugaggaaauuuccuaacaaacaaacaaacaaacaaacagaagagaagaucauuaaccacu

SEQ ID NO: 131936 - RNA, 62 nt, Homo Sapiens
ugggcgacagaucaagacucugucacacacaaaacaaacaaacaaauuuucccguuucucuc

SEQ ID NO: 131937 - RNA, 62 nt, Homo Sapiens
cgacagaucaagacucugucacacacaaaacaaacaaacaaauuuucccguuucucucuguc

SEQ ID NO: 131938 - RNA, 62 nt, Homo Sapiens
aaaaacccaacaacaacccaaaaaccaaaacaaacaaacaaagcaccacggcaagaaaacca

SEQ ID NO: 131939 - RNA, 62 nt, Homo Sapiens
caaaaaaaacccaacaacaaaccaaaaaccaaaacaaacaaauuuugcaccacggcaagaaa

SEQ ID NO: 131940 - RNA, 62 nt, Homo Sapiens
caaaaaaaaaaaaaaaaaaauuuuuuuaaacaaacaaacauaaauccguuuuucccuuuucc

SEQ ID NO: 131941 - RNA, 62 nt, Homo Sapiens
cauacaaaaaaaaaaaaaaauuccuuuuuuuaaacaaacaaacuagaauccguuuuucccuu

SEQ ID NO: 131942 - RNA, 62 nt, Homo Sapiens
uuuaaaauuaaaauggauaaaaugaaaccaacaacaaacauuuuuuuuuuuuaacauggaac

SEQ ID NO: 131943 - RNA, 62 nt, Homo Sapiens
uguaagacuacaaaaucguuuguuacuuaaccaacaaacaaauuacauugccagauaaaaag

SEQ ID NO: 131944 - RNA, 62 nt, Homo Sapiens
agucuuagucucuugcuaguguaaaacaaacaaacaaacaucuuaagacuaagacuuugaag

SEQ ID NO: 131945 - RNA, 62 nt, Homo Sapiens
caucagucuuagucucuugcgaagguaaaacaaacaaacaaacaauuuaagacuaagacuuu

SEQ ID NO: 131946 - RNA, 62 nt, Homo Sapiens
caaacaucagucuuagucuccuuugaagguaaaacaaacaaauugucaauuuaagacuaaga

SEQ ID NO: 131947 - RNA, 62 nt, Homo Sapiens
aggauggaggaagaucuacgaagcaaauggaaaacaaacaaaaaaagaggcagggguugcaa

SEQ ID NO: 131948 - RNA, 62 nt, Homo Sapiens
gaaucuacaaugaacucaaacaaauuuacaggaacaaacaaccccaucaaaaagucggcaaa

SEQ ID NO: 131949 - RNA, 62 nt, Homo Sapiens
cuccucgcucugugaacucuuuagacacacaaaacaaacaaacacaugggggagagagacuu

SEQ ID NO: 131950 - RNA, 62 nt, Homo Sapiens
ucgcucugugaacucuuuagacacacaaaacaaacaaacacaugggggagagagacuuggaa

SEQ ID NO: 131951 - RNA, 62 nt, Homo Sapiens
aagagccagugggggagggacccgucucaacaaacaaacaaaccugggcaacagagggagcc

SEQ ID NO: 131952 - RNA, 62 nt, Homo Sapiens
caaaaagagccagugggggaagcccccgucucaacaaacaaaccagccugggcaacagaggg

SEQ ID NO: 131953 - RNA, 62 nt, Homo Sapiens
caaaaaaccacaauuagacucaaaacaaaacaaacaaacaagagacuccaacucagaaaaag

SEQ ID NO: 131954 - RNA, 62 nt, Homo Sapiens
caagcaaaaaaccacaauuaaaagcaaaacaaaacaaacaaaagcgagacuccaacucagaa

SEQ ID NO: 131955 - RNA, 62 nt, Homo Sapiens
gaaagccuggcgauaccccaucucuauuuagaaacaaacaaacaaacaaauaaaaaaccugg

SEQ ID NO: 131956 - RNA, 62 nt, Homo Sapiens
gccuggcgauaccccaucucuauuuagaaacaaacaaacaaacaaauaaaaaaccuggcacc

SEQ ID NO: 131957 - RNA, 62 nt, Homo Sapiens
ccugagugacagagcgagacccugucucaaaaaacaaacaaacaaacaaacaaaaacagaac

SEQ ID NO: 131958 - RNA, 62 nt, Homo Sapiens
agugacagagcgagacccugucucaaaaaacaaacaaacaaacaaacaaaaacagaacauuc

SEQ ID NO: 131959 - RNA, 62 nt, Homo Sapiens
acagagcgagacccugucucaaaaaacaaacaaacaaacaaacaaaaacagaacauucuggg

SEQ ID NO: 131960 - RNA, 62 nt, Homo Sapiens
agcgagacccugucucaaaaaacaaacaaacaaacaaacaaaaacagaacauucugggcacg

SEQ ID NO: 131961 - RNA, 62 nt, Homo Sapiens
aaacacaaaaaaaaccacucucucaaaaaacaaacaaacaaagcuucaauuagaauuauuuu

SEQ ID NO: 131962 - RNA, 62 nt, Homo Sapiens
caaaaaacacaaaaaaaaccuuuuucucaaaaaacaaacaaaugaggcuucaauuagaauua

SEQ ID NO: 131963 - RNA, 62 nt, Homo Sapiens
agacauugcuggaguugacuuucuucuguccaaacaaacaaacaaaaacuaaacacacacac

SEQ ID NO: 131964 - RNA, 62 nt, Homo Sapiens
auugcuggaguugacuuucuucuguccaaacaaacaaacaaaaacuaaacacacacacaaac

SEQ ID NO: 131965 - RNA, 62 nt, Homo Sapiens
agccuggugacagaacgagacucugucuuaaaaacaaacaaacaaaaaaaaaaucuguuaga

SEQ ID NO: 131966 - RNA, 62 nt, Homo Sapiens
uggugacagaacgagacucugucuuaaaaacaaacaaacaaaaaaaaaaucuguuagauaag

SEQ ID NO: 131967 - RNA, 62 nt, Homo Sapiens
uaaagaaagaacauuggacaaacaaacaaacaaacaaacaaaccagacuccgucucuaaaca

SEQ ID NO: 131968 - RNA, 62 nt, Homo Sapiens
caaauaaagaaagaacauugaacaaacaaacaaacaaacaaaagagccagacuccgucucua

SEQ ID NO: 131969 - RNA, 62 nt, Homo Sapiens
caaacaaauaaagaaagaacucuaaacaaacaaacaaacaaacaacagagccagacuccguc

SEQ ID NO: 131970 - RNA, 62 nt, Homo Sapiens
caaacaaacaaauaaagaaacgucucuaaacaaacaaacaaaugggcaacagagccagacuc

SEQ ID NO: 131971 - RNA, 62 nt, Homo Sapiens
caaacaaacaaacaaauaaaacuccgucucuaaacaaacaaaagccugggcaacagagccag

SEQ ID NO: 131972 - RNA, 62 nt, Homo Sapiens
aaaaaacacaaaaaaagaaagaaaaacaaacaaacaaacaaacucuauagcaagaugaagag

SEQ ID NO: 131973 - RNA, 62 nt, Homo Sapiens
caaaaaaaaacacaaaaaaaagaggaaaaacaaacaaacaaaggaacucuauagcaagauga

SEQ ID NO: 131974 - RNA, 62 nt, Homo Sapiens
caaacaaaaaaaaacacaaaaugaagaggaaaaacaaacaaauagaggaacucuauagcaag

SEQ ID NO: 131975 - RNA, 62 nt, Homo Sapiens
uguugauaaugggcuuuguuagcacuuuuuaaaacaaacaaacaaacaaaacaaaaaagcaa

SEQ ID NO: 131976 - RNA, 62 nt, Homo Sapiens
gauaaugggcuuuguuagcacuuuuuaaaacaaacaaacaaacaaaacaaaaaagcaaacca

SEQ ID NO: 131977 - RNA, 62 nt, Homo Sapiens
augggcuuuguuagcacuuuuuaaaacaaacaaacaaacaaaacaaaaaagcaaaccacauu

SEQ ID NO: 131978 - RNA, 62 nt, Homo Sapiens
auuccaucugaaaaacaaaaacaaaaacagaaaacaaacaaacaaaaaacaaaaaaucccca

SEQ ID NO: 131979 - RNA, 62 nt, Homo Sapiens
caucugaaaaacaaaaacaaaaacagaaaacaaacaaacaaaaaacaaaaaauccccacaac

SEQ ID NO: 131980 - RNA, 62 nt, Homo Sapiens
aucuucuauaguagguuaauggaaaauacaaaaacaaacaaacauacaaugaaacugccucc

SEQ ID NO: 131981 - RNA, 62 nt, Homo Sapiens
ucuauaguagguuaauggaaaauacaaaaacaaacaaacauacaaugaaacugccuccucuc

SEQ ID NO: 131982 - RNA, 62 nt, Homo Sapiens
aaaaaacucagccaacagguaguauugguaaaaacaaacaaacaaaaauccuuugcccucag

SEQ ID NO: 131983 - RNA, 62 nt, Homo Sapiens
aacucagccaacagguaguauugguaaaaacaaacaaacaaaaauccuuugcccucagaagu

SEQ ID NO: 131984 - RNA, 62 nt, Homo Sapiens
aauugcucaaaaaagaggagaauauauaaacaaacaaacaaauugguggauuagacagguua

SEQ ID NO: 131985 - RNA, 62 nt, Homo Sapiens
caaaaauugcucaaaaaagaguuaaauauauaaacaaacaaacuucuugguggauuagacag

SEQ ID NO: 131986 - RNA, 62 nt, Homo Sapiens
cacacacacacauacacacacccuaaaaacaaaacaaacacaaaaaaguuguuuauaaaaac

SEQ ID NO: 131987 - RNA, 62 nt, Homo Sapiens
acuugcaucuaaccaaaaagacaaaacaaacaaacaaacaaaccaucucaaaacaaaacaaa

SEQ ID NO: 131988 - RNA, 62 nt, Homo Sapiens
caaaacuugcaucuaaccaacaaaacaaaacaaacaaacaaaaacuccaucucaaaacaaaa

SEQ ID NO: 131989 - RNA, 62 nt, Homo Sapiens
caaacaaaacuugcaucuaaaaaacaaaacaaaacaaacaaaacgaaacuccaucucaaaac

SEQ ID NO: 131990 - RNA, 62 nt, Homo Sapiens
acaaaacaaaacaaaauuaauuguucuucaaaaacaaacaaagaaaauguaaaagaccacaa

SEQ ID NO: 131991 - RNA, 62 nt, Homo Sapiens
cagaguucacuauucuaucuugacauuuaccaaacaaacaggcaaaaguucaaauuugucag

SEQ ID NO: 131992 - RNA, 62 nt, Homo Sapiens
uauugucggcaggcggugagggguagaaaaaaaacaaacaaacaaacagaaaaaaaaaccaa

SEQ ID NO: 131993 - RNA, 62 nt, Homo Sapiens
gucggcaggcggugagggguagaaaaaaaacaaacaaacaaacagaaaaaaaaaccaaaaaa

SEQ ID NO: 131994 - RNA, 62 nt, Homo Sapiens
gcaggcggugagggguagaaaaaaaacaaacaaacaaacagaaaaaaaaaccaaaaaaaacc

SEQ ID NO: 131995 - RNA, 64 nt, Homo Sapiens
uguugauaaauuccacuggacuugagcuuggcagcugaacuauuggagggugggagagcccagc

SEQ ID NO: 131996 - RNA, 64 nt, Homo Sapiens
ccacucagacaguguacaaacuaagaaggccuaacugaacuaagccauauuuaucacccgugga

SEQ ID NO: 131997 - RNA, 64 nt, Homo Sapiens
uuccugccacuguguaacauagcugagguaaaaacugaacuauguaaaugacucuacuaaaagu

SEQ ID NO: 131998 - RNA, 64 nt, Homo Sapiens
cccuugcccugccaagcucccugcccuguugaugcugaacuacagccuugggacaggcaggcuu

SEQ ID NO: 131999 - RNA, 64 nt, Homo Sapiens
auucauucauucagcaaauaaucugaaauccagucugaacuaaggccugagcuguggauaccau

SEQ ID NO: 132000 - RNA, 64 nt, Homo Sapiens
uauaagaauuuugcuuuagagaaugccacuuuggcugaacuacaaguguaggccaccauuauaa

SEQ ID NO: 132001 - RNA, 64 nt, Homo Sapiens
aucacugugcucccugggggucacaucccacucucugaacuacagcacuagaugauuacgaaga

SEQ ID NO: 132002 - RNA, 64 nt, Homo Sapiens
aaccucuauucuaaacuaauacuuugaacauuuucugaacuaaaauuagccaugacuguauugg

SEQ ID NO: 132003 - RNA, 64 nt, Homo Sapiens
agacguguggaaaaagaaucugauaaauaguuuacugaacuagcaaaaugaccagacaccuguu

SEQ ID NO: 132004 - RNA, 64 nt, Homo Sapiens
uugagauuagacccaaacaucuauuucuguuccccugaacuaauacauauacauaaauuuucag

SEQ ID NO: 132005 - RNA, 64 nt, Homo Sapiens
ugggagguggggagggguacucccaccccauccccugaacuacuucuuuauuuuuauucgcaca

SEQ ID NO: 132006 - RNA, 64 nt, Homo Sapiens
gcaaaaggcagagaauuacaagacucaauaauaacugaacuacauucaaauuaaguagaaagug

SEQ ID NO: 132007 - RNA, 64 nt, Homo Sapiens
uggaccugguuaaucauagaccuuaaagacucuucugaacuaguguguuuuuugacaaucacuu

SEQ ID NO: 132008 - RNA, 64 nt, Homo Sapiens
aaauagaaaauuuaaaugcuugacuucaagaauucugaacuauuucaucagaaagacacuaauc

SEQ ID NO: 132009 - RNA, 64 nt, Homo Sapiens
caaugaggguauuuuugagugaauuuuaacugcucugaacuaaguauaagcucaugggccugca

SEQ ID NO: 132010 - RNA, 64 nt, Homo Sapiens
acuacauaggucuuaccauugaccuaagaucaaucugaacuaucuuagcccagucagggagcuc

SEQ ID NO: 132011 - RNA, 64 nt, Homo Sapiens
gacuuugccauaaugauagacucaauuuagcucucugaacuaguugguaauuuuuuuuuuuuaa

SEQ ID NO: 132012 - RNA, 64 nt, Homo Sapiens
augugucuugcggcagcugcagcaaguggaggggcugaacuacuggccagcucacuggaugaug

SEQ ID NO: 132013 - RNA, 64 nt, Homo Sapiens
uuucuguagucaaaguauaccaaaaccaauuuaucugaacuaaauucuaaaguaugguuauaca

SEQ ID NO: 132014 - RNA, 64 nt, Homo Sapiens
gccuacaacaggcagguacugcugccagggggcucugaacuagugccugcuacccaggacaccc

SEQ ID NO: 132015 - RNA, 64 nt, Homo Sapiens
gagggggguggccacaggagauggggagaggagucugaacuaaaccccuggcuuuugugcacac

SEQ ID NO: 132016 - RNA, 64 nt, Homo Sapiens
gggggccacauuucaccuccuuagucccccuggucugaacuaguugagagaguaguuuugaaca

SEQ ID NO: 132017 - RNA, 64 nt, Homo Sapiens
ugaacaaauccacagaauggguaaagaguagaaucugaacuauaucuugacaaauauuauucaa

SEQ ID NO: 132018 - RNA, 64 nt, Homo Sapiens
uccgcgcugccccugcccugccucuguccuggcucugaacuaguagaugauggugccagagggc

SEQ ID NO: 132019 - RNA, 64 nt, Homo Sapiens
auuaacuugagcauaagauaugagauacaugaaccugaacuauuaaaauaaaauauuauauuua

SEQ ID NO: 132020 - RNA, 64 nt, Homo Sapiens
ucuguggaaugcauugugaaugguuuaagcuguacugaacuaaaaaugaagauuuauaccauug

SEQ ID NO: 132021 - RNA, 64 nt, Homo Sapiens
ugcuggcaugucugggucgugcuggucucuaggccugaacuagggccagugacugcugcgcugu

SEQ ID NO: 132022 - RNA, 64 nt, Homo Sapiens
caggcaggaaaaaagcccagaaguuguaugugcacugaacuaauaaacccagauccucuggucc

SEQ ID NO: 132023 - RNA, 64 nt, Homo Sapiens
cacugaaaugguuaagaugguauacauaacaauacugaacuauacaguugugcaacaauaugaa

SEQ ID NO: 132024 - RNA, 64 nt, Homo Sapiens
auuaaccucugcaugugaaaacuuuuaacaguuacugaacuauguaaauaugugaauuuuuuua

SEQ ID NO: 132025 - RNA, 64 nt, Homo Sapiens
ugugccugacuaagaugugaccagcucaggcagacugaacuaagcaccccucccauccugcgac

SEQ ID NO: 132026 - RNA, 64 nt, Homo Sapiens
ugaaagagaaaagaaaacucagaaagggaugaaucugaacuauaugauuacuuguagucagaau

SEQ ID NO: 132027 - RNA, 64 nt, Homo Sapiens
cuuuucucuggcacuccagucccaggccuugggccugaacuacuggaaaaggucuggcggcugg

SEQ ID NO: 132028 - RNA, 64 nt, Homo Sapiens
aggguucccuggcaggggaagcugagagccauggcugaacuaucagggacaaaggcccaugucc

SEQ ID NO: 132029 - RNA, 64 nt, Homo Sapiens
cugcagugcaaacccucuuccgcugagcagcugucugaacuauaggccccagugcugaagacca

SEQ ID NO: 132030 - RNA, 64 nt, Homo Sapiens
agagagggaguauuguauugggaagaaaauguuacugaacuauugacugaaaguaaauuuagau

SEQ ID NO: 132031 - RNA, 64 nt, Homo Sapiens
caauaccugucaccaugcagccgcugauaguucucugaacuaaaaggacuaauuguacuuugag

SEQ ID NO: 132032 - RNA, 64 nt, Homo Sapiens
auauuagaagcaauuauaauuacaucugugauuucugaacuaauggugcuaauucagagaaaug

SEQ ID NO: 132033 - RNA, 64 nt, Homo Sapiens
aacagaaagaacucaggacauauuaaaaaauaaacugaacuaaaacaacuuuugcccccugacu

SEQ ID NO: 132034 - RNA, 64 nt, Homo Sapiens
uaagcugaauuagucauguccauucagacauaaccugaacuacugaaaagaucaauuuccagaa

SEQ ID NO: 132035 - RNA, 64 nt, Homo Sapiens
ggcgguggcagugggugccuguagugugaugugucugaacuaauaaaguggcugaagaggcagg

SEQ ID NO: 132036 - RNA, 64 nt, Homo Sapiens
agcccauuuauacuguuccauauuugcucaguaucugaacuauauaguaaaaaguaguauugug

SEQ ID NO: 132037 - RNA, 64 nt, Homo Sapiens
cgagcacuucucaccaaacugugccagauguugucugaacuaaugagggaaggacagacaucaa

SEQ ID NO: 132038 - RNA, 64 nt, Homo Sapiens
augugcuagaggagggcacaggcagaacauaccacugaacuaguugagggccuccacacugccu

SEQ ID NO: 132039 - RNA, 64 nt, Homo Sapiens
uaacuuccuacguauccugccgccuucagcaugccugaacuacauuuugccccuugcaguggga

SEQ ID NO: 132040 - RNA, 64 nt, Homo Sapiens
uggaggucuagaugaggugccacagauugaacugcugaacuagugcaguccuguggcugagggg

SEQ ID NO: 132041 - RNA, 64 nt, Homo Sapiens
aauuagacaucaguuagcaaaugauugaagcauccugaacuaugccacucuaaucauuggccuc

SEQ ID NO: 132042 - RNA, 55 nt, Homo Sapiens; identical to SEQ ID NO: 116681

SEQ ID NO: 132043 - RNA, 64 nt, Homo Sapiens
cgucugacaugaaaacuucucaccgccucagcagcugaacuaaaaaccugaauagccaugacaa

SEQ ID NO: 132044 - RNA, 64 nt, Homo Sapiens
cauugaugauuguuaaguuugagcagacuuuggucugaacuagccaugggaauauucagucaag

SEQ ID NO: 132045 - RNA, 64 nt, Homo Sapiens
agauaauucauaagaauuugguguaacuccaaaacugaacuauaauauuguaugcaaucuuuau

SEQ ID NO: 132046 - RNA, 64 nt, Homo Sapiens
agcuuuugaaaacagacugaacgaagacaacaggcugaacuagagcugcucuugaagaagaaaa

SEQ ID NO: 132047 - RNA, 64 nt, Homo Sapiens
cccagaaucauguucaaaaaacuaauuguaaaaacugaacuauucauaugacaaagccucaauu

SEQ ID NO: 132048 - RNA, 64 nt, Homo Sapiens
acacaggcuguagaaacaguaaucagugugucuccugaacuagcauauucucaaguccuuuuac

SEQ ID NO: 132049 - RNA, 64 nt, Homo Sapiens
gccucauaguuauuauccagaggacccaacugaacugaacuaauccuucuggcagauucaaauc

SEQ ID NO: 132050 - RNA, 64 nt, Homo Sapiens
gacuucaucugaaugugcucugccgccuucuuaucugaacuagaugaauuggccauaauuauga

SEQ ID NO: 132051 - RNA, 64 nt, Homo Sapiens
uccauuuuaguagggauucacugacuagauuuuacugaacuaugaaaauaaauacacauaauuu

SEQ ID NO: 132052 - RNA, 64 nt, Homo Sapiens
uguaacuguaaaacauugaaugaaacuauuuuaccugaacuagauuuuaucugaaaguagguag

SEQ ID NO: 132053 - RNA, 64 nt, Homo Sapiens
aaggagccccagauaaacaugauggggaaaagcacugaacuaagagucccaugguuucucuucu

SEQ ID NO: 132054 - RNA, 64 nt, Homo Sapiens
guguagcuggucagggacuuuuuuuucuuuucuccugaacuacaugauucuaauuggaauguuc

SEQ ID NO: 132055 - RNA, 64 nt, Homo Sapiens
auuuuuauacuauauauugucugucauugcuaaucugaacuauugucauauucacaaaccaaua

SEQ ID NO: 132056 - RNA, 64 nt, Homo Sapiens
acaugagccuuauagauuguagaucuuuuuggugcugaacuauguugguuaaacaguuuugugu

SEQ ID NO: 132057 - RNA, 64 nt, Homo Sapiens
uuuauaacuucuugugagucuaccugggaucucucugaacuauuaaaggaagcuaagcaguggg

SEQ ID NO: 132058 - RNA, 64 nt, Homo Sapiens
uugugcuguguauaucacugcuccugcccccucccugaacuauuauuuuaauuauuacaaguug

SEQ ID NO: 132059 - RNA, 64 nt, Homo Sapiens
uuguucuuauuuuuugccacugcaaaucgauaaccugaacuaauaauuuuguucauuuuuaauu

SEQ ID NO: 132060 - RNA, 64 nt, Homo Sapiens
agaaccuggggguggauuuguucacagcuuuucucugaacuagggaucccuuccuucuuccacu

SEQ ID NO: 132061 - RNA, 64 nt, Homo Sapiens
aaaaacucuucuuuguaaucuuugcauucugaggcugaacuaauuguuuauuuauuuauuuauu

SEQ ID NO: 132062 - RNA, 64 nt, Homo Sapiens
uuggggaaacaauuucuagggacgagacucucaucugaacuaacuugcuacauuacaaacuuug

SEQ ID NO: 132063 - RNA, 64 nt, Homo Sapiens
uaaugauugcuuuacuuuuaugcuuuucuuuuaucugaacuacuauggguaacucagguaaaga

SEQ ID NO: 132064 - RNA, 64 nt, Homo Sapiens
ccaauuguuauuaagccacugaaaguacauugggcugaacuaaucacuaucauguuauggaaug

SEQ ID NO: 132065 - RNA, 64 nt, Homo Sapiens
uaccaucugauccccucagaucccauccucagcccugaacuagcgaaaaguaacaucaacacug

SEQ ID NO: 132066 - RNA, 64 nt, Homo Sapiens
acaugucaauauucuuuuuuuuauaguuauucuucugaacuaagcauaaaagcaaaucaacacu

SEQ ID NO: 132067 - RNA, 64 nt, Homo Sapiens
uccuuaguuuucagucuacuguucacucuaaaagcugaacuacauuaaaccuuuuuuaaaaaag

SEQ ID NO: 132068 - RNA, 64 nt, Homo Sapiens
uuuggugcuuaaaguugucacaugaaaaauauugcugaacuacuagccauuaugauaaauuaag

SEQ ID NO: 132069 - RNA, 64 nt, Homo Sapiens
uucuuguucagauuaagaguugccaaaauaccuucugaacuacacugcauuguugugccgagaa

SEQ ID NO: 132070 - RNA, 64 nt, Homo Sapiens
ggcauaagccuuuuauggcccucuugcagaucuucugaacuaugcacauuugugcuuuuuuugu

SEQ ID NO: 132071 - RNA, 64 nt, Homo Sapiens
gaaaaugucauguuaagcaauuucagaacauuaacugaacuauuuucaaagcagaaaaauugac

SEQ ID NO: 132072 - RNA, 64 nt, Homo Sapiens
auaaguaaauauuuauuuaggaauacugugaacacugaacuaauuauuccugugucagucuaug

SEQ ID NO: 132073 - RNA, 64 nt, Homo Sapiens
auuuugugccugaaaauaauagagcuugagcugucugaacuauuuuacauuuuauggugucuca

SEQ ID NO: 132074 - RNA, 64 nt, Homo Sapiens
guguaagaaagggagaauauaguuuuagaggaagcugaacuaugacgaugcugggcgaagcggu

SEQ ID NO: 132075 - RNA, 64 nt, Homo Sapiens
uguagagagacaggggaguugucaacuugggcuacugaacuacaugcauaaacuaaaaacuaac

SEQ ID NO: 132076 - RNA, 64 nt, Homo Sapiens
guuuugaauguuuaaagaagauuuagcuggauuucugaacuaugaauauuuaaaacaaaguuca

SEQ ID NO: 132077 - RNA, 64 nt, Homo Sapiens
ucagugucaacuauucagaaagacuguaacacagcugaacuauuugcuuuucucuugugaggga

SEQ ID NO: 132078 - RNA, 64 nt, Homo Sapiens
auauggagacauccucauugacuuuauuacaucacugaacuaaaguuaaaaaucaguaaucagu

SEQ ID NO: 132079 - RNA, 64 nt, Homo Sapiens
uugcucuuuuuuggcagggauaaaaauccgacagcugaacuaggcacauaaagagaguguuaua

SEQ ID NO: 132080 - RNA, 64 nt, Homo Sapiens
gcuuggccuuggggagggcuaggcucuccucagucugaacuaaguccacaagcgaggguagcag

SEQ ID NO: 132081 - RNA, 60 nt, Homo Sapiens; identical to SEQ ID NO: 116720

SEQ ID NO: 132082 - RNA, 64 nt, Homo Sapiens
aagggccuauacuuuuauuuuucaacucuauuaacugaacuaugcuuggagagagcccugaauc

SEQ ID NO: 132083 - RNA, 64 nt, Homo Sapiens
caauccacuguuagaauaccuaugguuagggcuucugaacuaaaauaauggaaaauuuuaacaa

SEQ ID NO: 132084 - RNA, 64 nt, Homo Sapiens
cuggaauugagcuucccucccauuuuccuuguuccugaacuaauacuacuguaccuguuaugga

SEQ ID NO: 132085 - RNA, 64 nt, Homo Sapiens
uuguaucuuaaaauucauacaacuugaauuuuaucugaacuaaaagugucaaaagguuuaugua

SEQ ID NO: 132086 - RNA, 64 nt, Homo Sapiens
cauugagaaaucaaucaaaaaaacuggcauuauacugaacuauaaaccaaauuuuugccauuaa

SEQ ID NO: 132087 - RNA, 64 nt, Homo Sapiens
aaaguuuuacagaaaguaguuagaacugguaucacugaacuacuuggaauucaccaagauuggg

SEQ ID NO: 132088 - RNA, 64 nt, Homo Sapiens
acacaugaauaugugggcuaacugacuuguguuccugaacuauggaauuaccuagaaguuuguc

SEQ ID NO: 132089 - RNA, 64 nt, Homo Sapiens
ggcuaaugucaggagcugauuucauuuguagauacugaacuaagcugucauagaauucccaaau

SEQ ID NO: 132090 - RNA, 64 nt, Homo Sapiens
gagcaguggcagaagguggggcccuucacccggccugaacuaagugccguguucugccagcacc

SEQ ID NO: 132091 - RNA, 64 nt, Homo Sapiens
caccccugcucaacagagguuuaguuuacagucucugaacuaaaguaguaaccucccaaauugu

SEQ ID NO: 132092 - RNA, 64 nt, Homo Sapiens
uucaggacuacauaugacccagagagcaagguggcugaacuauagucuggaagcccucagguaa

SEQ ID NO: 132093 - RNA, 64 nt, Homo Sapiens
uucucgacaauaaagauauuccgugucuuuaccccugaacuaagacacagggaguauuucagag

SEQ ID NO: 132094 - RNA, 64 nt, Homo Sapiens
ugacuguuguacuguagcucguuuuagacaaccacugaacuagaaaagauguggacagcuugau

SEQ ID NO: 132095 - RNA, 64 nt, Homo Sapiens
agagcaguuacugucuguucgaucuuucccuccucugaacuauuccucgcccccagccugaggu

SEQ ID NO: 132096 - RNA, 64 nt, Homo Sapiens; identical to SEQ ID NO: 132063

SEQ ID NO: 132097 - RNA, 64 nt, Homo Sapiens
auaggguuuuucuucagguggguugcauuauuuucugaacuauaaucuagauuaaauuaaaauu

SEQ ID NO: 132098 - RNA, 61 nt, Homo Sapiens; identical to SEQ ID NO: 116737

SEQ ID NO: 132099 - RNA, 64 nt, Homo Sapiens
augauaugcauuugacuuguuaaacagccuauuccugaacuauaacaccugccaccacuauaaa

SEQ ID NO: 132100 - RNA, 64 nt, Homo Sapiens
aagcacaauaucuucacacugugcuguauugcugcugaacuaaaugcacuuuuccccacauaug

SEQ ID NO: 132101 - RNA, 64 nt, Homo Sapiens
cuccuuaucguucuauguaccagguauuuuauuacugaacuagcaacuagccuuuuccaccuuu

SEQ ID NO: 132102 - RNA, 64 nt, Homo Sapiens
guggugcauuuuuguaaguuccauuuuuccuccacugaacuaggacagcacuauguaggaaaga

SEQ ID NO: 132103 - RNA, 64 nt, Homo Sapiens
aguccugggagagcugugguggacuggugggaaccugaacuaggucuucaguccuguggucccu

SEQ ID NO: 132104 - RNA, 64 nt, Homo Sapiens
cucugguaggauugcagggggaaagcaaaagggacugaacuagcuuguaaauauguuuuaggaa

SEQ ID NO: 132105 - RNA, 64 nt, Homo Sapiens
gucuauauuuaaaauuagauuugguuguuguucccugaacuacuuuaauaauuuugugaauuuu

SEQ ID NO: 132106 - RNA, 64 nt, Homo Sapiens
ugaucucaguucucuuucaauuucccguuagucucugaacuagggagccauaaaugaccuaacg

SEQ ID NO: 132107 - RNA, 64 nt, Homo Sapiens
cucccuuguucuuggagggaccauuauuacaucucugaacuaccuuuguauccaacauguuuua

SEQ ID NO: 132108 - RNA, 64 nt, Homo Sapiens
acccccagccaaucaggacuuuccagacuuggcccugaacuacugacguuccuaccucuuauuu

SEQ ID NO: 132109 - RNA, 64 nt, Homo Sapiens
aaauuuugccuuagcuacugcaguggaaagagcacugaacuaggaguuggaagacaaggaugug

SEQ ID NO: 132110 - RNA, 64 nt, Homo Sapiens
gucagggugucuggggcaggaggaggccaacucacugaacuagugcaggguauguggguggcac

SEQ ID NO: 132111 - RNA, 64 nt, Homo Sapiens
gcuaacagaucccccugaggugcugccaacagaucugaacuaauuagcucgcauuaguuucugu

SEQ ID NO: 132112 - RNA, 63 nt, Homo Sapiens
aaaacaaaugugcuaugcucauaaggguuggcuucugaacuaccuuguacacauuuuaauaaa

SEQ ID NO: 132113 - RNA, 64 nt, Homo Sapiens
agccacaucuuguucaucaccuaauauggaggggcugaacuaguuucauuuagaauuagcagag

SEQ ID NO: 132114 - RNA, 64 nt, Homo Sapiens
gacaaauuggaccucaauguguauuggacuaauucugaacuacaccuaguuggucuaagggucu

SEQ ID NO: 132115 - RNA, 64 nt, Homo Sapiens
ucugaaucuuaauauuucaaagccaggugaaaaucugaacuagauauucuuuguuggaauaugc

SEQ ID NO: 132116 - RNA, 64 nt, Homo Sapiens
uuuccuggcuguugugaaagaauuuuucuacauccugaacuauuuuuccuauuucuuuucaccu

SEQ ID NO: 132117 - RNA, 64 nt, Homo Sapiens
ccaaauuaaguuuuggguaaguguguuguuuaaucugaacuauaguaacuuaauacucuaaaca

SEQ ID NO: 132118 - RNA, 64 nt, Homo Sapiens
gucagcagagcugagauuaauaucugggcuuuuccugaacuauucugguuauugagcccuuccu

SEQ ID NO: 132119 - RNA, 64 nt, Homo Sapiens
ucacauaacuaacuuucgaggcacuggaacauaccugaacuaagaauuaaaucuuuuacuuuau

SEQ ID NO: 132120 - RNA, 64 nt, Homo Sapiens
auguuaaugaagauggacaucccacuauuuauuacugaacuauuuucuucggcuugugaggcuu

SEQ ID NO: 132121 - RNA, 64 nt, Homo Sapiens
ucacagacaaggaaacuucuaaauaaacaggugccugaacuaguuaauaguuuuaucuggguac

SEQ ID NO: 132122 - RNA, 64 nt, Homo Sapiens
auaaauacaugcuuaauccuuauguuuguuuuaacugaacuaaaaccguuucaaugaaacaaug

SEQ ID NO: 132123 - RNA, 64 nt, Homo Sapiens
cuccccuaccuuagacuggugaagcuacccagaacugaacuagauuuuaaguaccugagcucuc

SEQ ID NO: 132124 - RNA, 60 nt, Homo Sapiens; identical to SEQ ID NO: 116763

SEQ ID NO: 132125 - RNA, 64 nt, Homo Sapiens
acugauggguucccuaucaaaugguuaaaugacccugaacuaaauucuaaccaucaacaauugc

SEQ ID NO: 132126 - RNA, 64 nt, Homo Sapiens
guacaguuaguauucuaaugaaaggaugaagagucugaacuagaagguagguuuaagccaucac

SEQ ID NO: 132127 - RNA, 64 nt, Homo Sapiens
ugcuuucucuucaagauaagcaugucucccugaucugaacuauuuuucuuuauuaaaaccucag

SEQ ID NO: 132128 - RNA, 64 nt, Homo Sapiens
uggaaauuacugcuuucucuauuaaugaggaacacugaacuagugguguguagguagauuccau

SEQ ID NO: 132129 - RNA, 64 nt, Homo Sapiens
cguacugcauagcaucaaguuucaucugcuucuacugaacuauguguauguauuuuaaagaaau

SEQ ID NO: 132130 - RNA, 64 nt, Homo Sapiens
aauuguuagcgggguuuugauguauaauagaaaacugaacuaggaggaauuuaacuuuuugauu

SEQ ID NO: 132131 - RNA, 64 nt, Homo Sapiens
ugguaauaaagugcuuauuuuucuuguucugaugcugaacuauuaaacccuuuuggaauuagaa

SEQ ID NO: 132132 - RNA, 64 nt, Homo Sapiens
cauaugggauuuguggacacagcuguuucuguuccugaacuagaagucuuccccagcucugacg

SEQ ID NO: 132133 - RNA, 64 nt, Homo Sapiens
aaguguuucuucauaucuaggagauuuggaaauucugaacuaaggucuuauaagaacaagaaau

SEQ ID NO: 132134 - RNA, 64 nt, Homo Sapiens
auuaaauaagugaauacaaaugagauagcuucuucugaacuauuugaauuacuucuuguacagc

SEQ ID NO: 132135 - RNA, 64 nt, Homo Sapiens
caauggaaauaaugcugcaucaccuguucuccaucugaacuagaaguuuacagaucaauaaaag

SEQ ID NO: 132136 - RNA, 64 nt, Homo Sapiens
guagggccucucuaagaauuuguaaacugucuuccugaacuacuaagaacucagggaacaauac

SEQ ID NO: 132137 - RNA, 64 nt, Homo Sapiens
augaugaacuauuuuauguaaaaaaugucauaaacugaacuaaaacagcauuaauacuagucca

SEQ ID NO: 132138 - RNA, 64 nt, Homo Sapiens
gcuaccaaauacauucccugcaauuaaacuuuaacugaacuaaguuuuacaaauugaggauuac

SEQ ID NO: 132139 - RNA, 64 nt, Homo Sapiens
caauauauauguuuaacccaaagucacucaauuccugaacuaauagugucugauaagcaucuua

SEQ ID NO: 132140 - RNA, 64 nt, Homo Sapiens
cuggggacauccuggacuugagagcacuuaguuucugaacuagucaccuuuuuaaggggaggag

SEQ ID NO: 132141 - RNA, 64 nt, Homo Sapiens
auugccuuuguuuugaaauuauaucaccuguguucugaacuaaaaugaugggaguucauuuugu

SEQ ID NO: 132142 - RNA, 64 nt, Homo Sapiens
aaauucuuucacaagguacaaaaucuugcauaagcugaacuaaaauaaaaaugaaaaggagaga

SEQ ID NO: 132143 - RNA, 64 nt, Homo Sapiens
agauauacucuugggagagagcaugaaugguauucugaacuaucaccugauucaaggacuuugc

SEQ ID NO: 132144 - RNA, 64 nt, Homo Sapiens
auuuuucuuuaaaaagcaaacacaugacuuggaacugaacuaacccuugccucugccugguacc

SEQ ID NO: 132145 - RNA, 64 nt, Homo Sapiens
cuaaucuggaauuuguuuuuagauaaaugaaacgcugaacuauguguuugccuugauaaaggua

SEQ ID NO: 132146 - RNA, 64 nt, Homo Sapiens
ucacaacuguccaggcugagauaaaucccgggaccugaacuauuagcacgucacuagagacugg

SEQ ID NO: 132147 - RNA, 64 nt, Homo Sapiens
uggcccacguggaggcccaccugccucugucucacugaacuagaagccgagccuagaaacuaac

SEQ ID NO: 132148 - RNA, 64 nt, Homo Sapiens
ugaacugugacugacagguagaguuuuguuauaucugaacuaguaaccaauacuccaaguccuu

SEQ ID NO: 132149 - RNA, 64 nt, Homo Sapiens
ucagggugggcaauucacagccuuucugaacugacugaacuagagcuugcagugaaguguucug

SEQ ID NO: 132150 - RNA, 64 nt, Homo Sapiens
cucuucguaauucuaauguguacugcugguauagcugaacuacugaccuggaucuuaguccuag

SEQ ID NO: 132151 - RNA, 64 nt, Homo Sapiens
uuucuuaguuucuguaaauucaugacuugucuuacugaacuacagccugguuuguagacuucca

SEQ ID NO: 132152 - RNA, 64 nt, Homo Sapiens
cccucccucaggccgaaggaggagucagggagagcugaacuauuagagcugccugugccuuuug

SEQ ID NO: 132153 - RNA, 64 nt, Homo Sapiens
aaccuaacauaaaacacagcaagaaucugguugucugaacuauuuuaaauuaaggagccagaug

SEQ ID NO: 132154 - RNA, 64 nt, Homo Sapiens
gauuguauuggugauuucuagaaaacuguauuugcugaacuaagucauguuuauaaacuauaca

SEQ ID NO: 132155 - RNA, 64 nt, Homo Sapiens
cacauuucaacugcucaguaauucaauuccucggcugaacuagcaaaauagaaugaaacacaaa

SEQ ID NO: 132156 - RNA, 64 nt, Homo Sapiens
uuaaauaaaauauuggcaaagaaaagaacuaggacugaacuauuguuguuuuacgcuaaagaug

SEQ ID NO: 132157 - RNA, 64 nt, Homo Sapiens
cauuaacagcccccgugggcgccuuucccauccucugaacuaggcuuccuucgucucuccaacu

SEQ ID NO: 132158 - RNA, 64 nt, Homo Sapiens
gaauaaaaaaaaaacaacgcgacaauugagauggcugaacuacuacuuauauacaguuuuaggg

SEQ ID NO: 132159 - RNA, 64 nt, Homo Sapiens
cagauuggauuuccaaaccaagcagggucauggucugaacuacuuucuccugcaucccaugcua

SEQ ID NO: 132160 - RNA, 64 nt, Homo Sapiens
ucuucucucacgcucaagucacaugaacacuguacugaacuacaccgagaagagaauaaaagug

SEQ ID NO: 132161 - RNA, 64 nt, Homo Sapiens
gcccaauuugcuugcauuuuaaccaggggaaccacugaacuaaacacagagggacugucaucua

SEQ ID NO: 132162 - RNA, 64 nt, Homo Sapiens
aaaucuacccaaugagacuuuugauaccguuuuccugaacuaaucaguuaaccugauuucaauu

SEQ ID NO: 132163 - RNA, 64 nt, Homo Sapiens
uauuaaaaacaugaccacucgagauaagaaaagccugaacuauuucaugagcuggguacugacu

SEQ ID NO: 132164 - RNA, 64 nt, Homo Sapiens
uuuuguguguauauauuuaaaucaugaagccuugcugaacuaaguuauuuuggaauugguguau

SEQ ID NO: 132165 - RNA, 64 nt, Homo Sapiens
uagugcagcuuuucauugugucuuaacuaacauucugaacuaguaguuauucacaccagcauca

SEQ ID NO: 132166 - RNA, 64 nt, Homo Sapiens
gagaacugccagggaaucuuacacuucgggaaugcugaacuaauccucugccuccaaacagggg

SEQ ID NO: 132167 - RNA, 64 nt, Homo Sapiens
caugauuaaacuagauagaccugguauacagucacugaacuaguagaugucaauaauuauuauu

SEQ ID NO: 132168 - RNA, 64 nt, Homo Sapiens
cuuugaagaaaccccuauagaauuuuuaaaaggccugaacuauaguguuuuggaauuugaagcu

SEQ ID NO: 132169 - RNA, 64 nt, Homo Sapiens
gagcaugauguuuaaucuaagaucccuguguaugcugaacuacagucagauuuauuuuuaugug

SEQ ID NO: 132170 - RNA, 64 nt, Homo Sapiens
ggacuuccuagaggaagggacaucgaacuaagaccugaacuaugagaaauaggcaggaagaagu

SEQ ID NO: 132171 - RNA, 64 nt, Homo Sapiens
guccccucuacuuuaacuuuuacaaaaaaguaaccugaacuaaucugauguuaaccaauguauu

SEQ ID NO: 132172 - RNA, 64 nt, Homo Sapiens
gcaacuguaugugaaggggagccagggaacguuucugaacuaagcaaggacaaauucagagacc

SEQ ID NO: 132173 - RNA, 64 nt, Homo Sapiens
ugcagaccugagcuggcuuggacccauuugaggacugaacuaggcaggcaauggcuccagugcc

SEQ ID NO: 132174 - RNA, 64 nt, Homo Sapiens
cccggagcaccccacccccacagaacaccucccucugaacuaauucccgcuccacggagucuuc

SEQ ID NO: 132175 - RNA, 64 nt, Homo Sapiens
gaucuguggcuauuuugcauuugugacuuucaaccugaacuauguuucucaaaaaggcuacugu

SEQ ID NO: 132176 - RNA, 64 nt, Homo Sapiens
aagguugcauucuccaccaagggaguuaaccuaccugaacuaaguagaaaugccagucuuccac

SEQ ID NO: 132177 - RNA, 64 nt, Homo Sapiens
aaaauagaacacuucuuggaggcuuucuucagaacugaacuagaaacaagguuuccaggcuccc

SEQ ID NO: 132178 - RNA, 64 nt, Homo Sapiens
auuguaaguauuuacuuagagcuuuuucuuaaaucugaacuaacuugcuuuuagaagucuuuuu

SEQ ID NO: 132179 - RNA, 64 nt, Homo Sapiens
gaccagaggcugccagaugucauggauguuguaucugaacuaagcuccucacaccuggcagcuu

SEQ ID NO: 132180 - RNA, 64 nt, Homo Sapiens
agaggaaaaaaauggcaauuaaaaaaguuguuuucugaacuagauuagaagaggccuauuaaaa

SEQ ID NO: 132181 - RNA, 64 nt, Homo Sapiens
uacauuucucccuaauguucuuacccaaauguaccugaacuaaaaaauguuagauguuggugau

SEQ ID NO: 132182 - RNA, 64 nt, Homo Sapiens
aauugguuguuuaacacuucucaugaggaaacuacugaacuagcuuuuugcuuaacauuagaug

SEQ ID NO: 132183 - RNA, 64 nt, Homo Sapiens
gugcugcacucaaaugauggauggcacagagauucugaacuaaacuuccuguuuaaaaaaccac

SEQ ID NO: 132184 - RNA, 64 nt, Homo Sapiens
guuuggugucugaucuugagccugcgacaccuagcugaacuauggcacuuaauaaguauucccc

SEQ ID NO: 132185 - RNA, 64 nt, Homo Sapiens
caaucagaucaacucugucucagguaggcugggccugaacuagcggcaccaagcucuguccaau

SEQ ID NO: 132186 - RNA, 64 nt, Homo Sapiens
gccuuuauguacauaaucuugauggagcuauuagcugaacuauaaaauaugcucuugguaaaua

SEQ ID NO: 132187 - RNA, 64 nt, Homo Sapiens
auaaacaucuaugccuuuucucagaaaugauuugcugaacuauguccauauuuuacagcuuaga

SEQ ID NO: 132188 - RNA, 64 nt, Homo Sapiens
gugaguguuagaaaaaacuggaaacaucugauuucugaacuaucagggcaagcucauagcacau

SEQ ID NO: 132189 - RNA, 64 nt, Homo Sapiens
agugaaauuuuaaaugcacaguucuauuugcuaucugaacuaauucauuuauuaaguauauuug

SEQ ID NO: 132190 - RNA, 64 nt, Homo Sapiens
gcaugguuuggccuggggaucuuagaugucugaccugaacuauuguagaacagcgcuggcuuuu

SEQ ID NO: 132191 - RNA, 64 nt, Homo Sapiens
uuuaagagacuuuguaaaaagguguuuugccagccugaacuauauguacgguucugugcaaaga

SEQ ID NO: 132192 - RNA, 64 nt, Homo Sapiens
auauucuagaucuuguuuuauugagcccaguauacugaacuagauuucaaaaggaaaguugguu

SEQ ID NO: 132193 - RNA, 64 nt, Homo Sapiens
aggaagguuuagccuucuaaaaguccuugacuaacugaacuagaccauguaacugaccuuagua

SEQ ID NO: 132194 - RNA, 64 nt, Homo Sapiens
uguaggguucuguggaaggagguauucugccagccugaacuauauuuaagaaacuuuguaaaaa

SEQ ID NO: 132195 - RNA, 64 nt, Homo Sapiens
cugugcaaaugugcagggaagcaguguuggguuuuguccugaaugaggaagacugucuggcucc

SEQ ID NO: 132196 - RNA, 64 nt, Homo Sapiens
cucaauggguagaugccuucggaggaaccugggauguccugaugaaaggugggugacguuuuca

SEQ ID NO: 132197 - RNA, 64 nt, Homo Sapiens
ucucuuuccuuagguugaauuuauuaaugaaauuuguccugagucuggagggguuaguucagag

SEQ ID NO: 132198 - RNA, 64 nt, Homo Sapiens
aagaggcauacagaaaauggaaauaguauuucgcuguccugaaacuuucagugaaagagaucac

SEQ ID NO: 132199 - RNA, 64 nt, Homo Sapiens
guuuuuguuauuuuuuguuugggcuggcccacuguguccugaauucuccaugauguucacccug

SEQ ID NO: 132200 - RNA, 64 nt, Homo Sapiens
uuggcugguguaucucacaagcugugggggcaucuguccugagcuccagcugaaccauacccug

SEQ ID NO: 132201 - RNA, 64 nt, Homo Sapiens
gucauacugcuggguuuucauggguaggaaagcuuguccugaccccagcagcaaagagguggca

SEQ ID NO: 132202 - RNA, 64 nt, Homo Sapiens
uaugcucuguucagucugugucaggcaguaugcuuguccugaagagagguuuggcuauccccac

SEQ ID NO: 132203 - RNA, 64 nt, Homo Sapiens
aguucagaaggcaggaaagacagucacaccgacguguccugaagguguaggcucuccacuuagg

SEQ ID NO: 132204 - RNA, 64 nt, Homo Sapiens
cugguugauuagaaucucagguuucagcuccugcuguccugagcgaacuugccugaugcagggc

SEQ ID NO: 132205 - RNA, 64 nt, Homo Sapiens
ccuggcaggaugccaauccuguuuguuguccguauguccugaaaacaugagggacuggcagaug

SEQ ID NO: 132206 - RNA, 64 nt, Homo Sapiens
gacacccuuucccaccuggugccuaugcuaggcuuguccugagaacaucccucaguaacuugau

SEQ ID NO: 132207 - RNA, 64 nt, Homo Sapiens
ucaccacccccagguucccugcagaugucguguguguccugaguguuucuuugguucuuugcac

SEQ ID NO: 132208 - RNA, 64 nt, Homo Sapiens
cucuccuccagcccuucccagggcucagcccugcuguccugagcgucuccugggccagagagag

SEQ ID NO: 132209 - RNA, 64 nt, Homo Sapiens
cugcacaugaggaaauaggcugucacuaucacauuguccugaaaacagcaucugcuuuccucuu

SEQ ID NO: 132210 - RNA, 64 nt, Homo Sapiens
aaggagcccugcuccuuuaguuuccugacaccuguguccugagugagccgcaggaguucuuagc

SEQ ID NO: 132211 - RNA, 64 nt, Homo Sapiens
ggagcccccagccugucagauccaggagcuccaguguccugagcucagcguggagggguagggg

SEQ ID NO: 132212 - RNA, 64 nt, Homo Sapiens
ugcaaggcagccgugggccccacccucggggauguguccugacacugcaauuggcaccgaagcc

SEQ ID NO: 132213 - RNA, 64 nt, Homo Sapiens
aacaguugguuauagaaaggaaagcacuucauuauguccugaggcuuaguguccccacaugagg

SEQ ID NO: 132214 - RNA, 64 nt, Homo Sapiens
gcaaagugugccagaacugcgugcagguuggcaauguccugaguagcgguuacuccauuaaaac

SEQ ID NO: 132215 - RNA, 64 nt, Homo Sapiens; identical to SEQ ID NO: 46653

SEQ ID NO: 132216 - RNA, 64 nt, Homo Sapiens; identical to SEQ ID NO: 46654

SEQ ID NO: 132217 - RNA, 64 nt, Homo Sapiens; identical to SEQ ID NO: 46655

SEQ ID NO: 132218 - RNA, 64 nt, Homo Sapiens; identical to SEQ ID NO: 46656

SEQ ID NO: 132219 - RNA, 64 nt, Homo Sapiens; identical to SEQ ID NO: 46657

SEQ ID NO: 132220 - RNA, 64 nt, Homo Sapiens; identical to SEQ ID NO: 46658

SEQ ID NO: 132221 - RNA, 64 nt, Homo Sapiens; identical to SEQ ID NO: 46659

SEQ ID NO: 132222 - RNA, 64 nt, Homo Sapiens; identical to SEQ ID NO: 46660

SEQ ID NO: 132223 - RNA, 64 nt, Homo Sapiens; identical to SEQ ID NO: 46661

SEQ ID NO: 132224 - RNA, 64 nt, Homo Sapiens; identical to SEQ ID NO: 46662

SEQ ID NO: 132225 - RNA, 64 nt, Homo Sapiens; identical to SEQ ID NO: 46663

SEQ ID NO: 132226 - RNA, 64 nt, Homo Sapiens; identical to SEQ ID NO: 46664

SEQ ID NO: 132227 - RNA, 64 nt, Homo Sapiens; identical to SEQ ID NO: 46665

SEQ ID NO: 132228 - RNA, 64 nt, Homo Sapiens; identical to SEQ ID NO: 46666

SEQ ID NO: 132229 - RNA, 64 nt, Homo Sapiens; identical to SEQ ID NO: 46667

SEQ ID NO: 132230 - RNA, 64 nt, Homo Sapiens; identical to SEQ ID NO: 46668

SEQ ID NO: 132231 - RNA, 64 nt, Homo Sapiens
aagagccagcuggcgugucgggaaggauccaggaucugcaaacacaacugcucaggccuucuca

SEQ ID NO: 132232 - RNA, 64 nt, Homo Sapiens
ggcguccucugccuuccccgcuuccccaugagcgucugcaaaacacuugccugaauacauauca

SEQ ID NO: 132233 - RNA, 64 nt, Homo Sapiens
uggccagugaacaccaucccagaagcauuuucccucugcaaaaugacguuucuucccacgucug

SEQ ID NO: 132234 - RNA, 64 nt, Homo Sapiens
cgucuauauaagggaaugucuuccuuccuaucuaucugcaaaauggaaaucuagaccuccuucu

SEQ ID NO: 132235 - RNA, 64 nt, Homo Sapiens
uuaaaggaaugaaacaaugaauuacuaaucuaugucugcaaacaacauuacuaaucuagguccu

SEQ ID NO: 132236 - RNA, 64 nt, Homo Sapiens
uuacuaaucuagguccuauuuacuaaggucuaugucugcaaacauggucagaugugcagaccau

SEQ ID NO: 132237 - RNA, 64 nt, Homo Sapiens
ccuaaauuaaagagaaaaaauauaaugaaaauuaucugcaaacauacacacauacagcuacgga

SEQ ID NO: 132238 - RNA, 64 nt, Homo Sapiens
ucaugaauuugugaugucuuuguuguuguuguugucugcaaauuccugacuugaggagcuguuu

SEQ ID NO: 132239 - RNA, 64 nt, Homo Sapiens
aaaagaaagcauacaugcuuaugcaugaaacaauucugcaaaaaaaggaugaauuuccuccauc

SEQ ID NO: 132240 - RNA, 64 nt, Homo Sapiens
cugcgucaauuaagucaagcugaagcuacugacuucugcaaaguauuagugguacaguaaaaag

SEQ ID NO: 132241 - RNA, 64 nt, Homo Sapiens
ugagauguacagauuucgguugccugccuacuuuucugcaaaaacuuuuauguauaauucuuuc

SEQ ID NO: 132242 - RNA, 64 nt, Homo Sapiens
cuuggauucacaaaugucccagcaggcuccagcuucugcaaaaagaaaaugaaggccaaacaga

SEQ ID NO: 132243 - RNA, 64 nt, Homo Sapiens
gugucucauguuucgcaacuuuucaucugcaaacucugcaaaaugcccuauccaugagaugccu

SEQ ID NO: 132244 - RNA, 64 nt, Homo Sapiens
cugcaaaaugugucucaugugagaugccuuuucaucugcaaacucugaaagaugcccuauccau

SEQ ID NO: 132245 - RNA, 64 nt, Homo Sapiens
aaaccauucgugucccuucacucucugaacauagucugcaaaucucucccucucugguauguuu

SEQ ID NO: 132246 - RNA, 64 nt, Homo Sapiens
ugccaauacugugcuggcuccagugggauuccucucugcaaagcugcuggcuuagcuugacugu

SEQ ID NO: 132247 - RNA, 64 nt, Homo Sapiens
gauuaaaaauuguacaugaaucucaguuuauuuuucugcaaaaaaauaaaacaauuuuagccuu

SEQ ID NO: 132248 - RNA, 64 nt, Homo Sapiens
caugaaugguugaacucccauaccuguguuaguaucugcaaauggaggauuguucacucacugu

SEQ ID NO: 132249 - RNA, 64 nt, Homo Sapiens
uuuaagguucaaauaaaguucaauaauguuccacucugcaaauuucuauugccauuagaucuua

SEQ ID NO: 132250 - RNA, 64 nt, Homo Sapiens
cuuuggauuuagaagcgucaaauucuucugcuugucugcaaauguuucuccugcagaaaaggaa

SEQ ID NO: 132251 - RNA, 64 nt, Homo Sapiens
uugguaaaggaaccagucagcaaacacaaccuacucugcaaaccacagacccacagaagguguu

SEQ ID NO: 132252 - RNA, 64 nt, Homo Sapiens
gcuuagcuacuuguguuuuuugacauuuuuccucucugcaaaugagagauuuuucauuuuucca

SEQ ID NO: 132253 - RNA, 64 nt, Homo Sapiens
ucagagcaggugagcauccaaagaugucuugagcucugcaaagacucagaauucuuuuuaauug

SEQ ID NO: 132254 - RNA, 64 nt, Homo Sapiens
uguuagcauaauuccaagguuagcuuucuuuauuucugcaaaucggaucgugcccagcuuugcu

SEQ ID NO: 132255 - RNA, 64 nt, Homo Sapiens
guggaugaauguucuuuaaauuuguguaaauacuucugcaaagguacugaugcuguaaagucaa

SEQ ID NO: 132256 - RNA, 64 nt, Homo Sapiens
uguaauggaauuaaagugcuuuugcacaauaaguucugcaaaacccucucauucaugaaaaggu

SEQ ID NO: 132257 - RNA, 64 nt, Homo Sapiens
cgguuuuucuaccugauugcaucuauuaaaccauucugcaaauaccaccauguuccugacaccu

SEQ ID NO: 132258 - RNA, 64 nt, Homo Sapiens
gcacugaauugcugaaaguuuaauuuagauccuuucugcaaaguaaacaacagaacuuuaugcu

SEQ ID NO: 132259 - RNA, 64 nt, Homo Sapiens
uguuaaaggacaaaugcccacucuucuauucugaucugcaaauagcuuaaaugucucuugcaaa

SEQ ID NO: 132260 - RNA, 64 nt, Homo Sapiens
gagacaggcuuuguucucuuguucauaacauuucucugcaaagaauucucuauggagugaagcg

SEQ ID NO: 132261 - RNA, 64 nt, Homo Sapiens
uauucaaagaagaaccuccuuugcuacauugcccucugcaaauguguaucaaaauucccagguc

SEQ ID NO: 132262 - RNA, 64 nt, Homo Sapiens
uugaaagcaaaugggagaugacagacugccagugucugcaaaaggcaucccuuugaaugaguuu

SEQ ID NO: 132263 - RNA, 64 nt, Homo Sapiens
uaugugucauagaauacuuaguucugcuagauauucugcaaauauauuugggaauuacuuccug

SEQ ID NO: 132264 - RNA, 64 nt, Homo Sapiens
ucauauacccaauaauaagcuacagaacuaauauucugcaaaugucucuuggaacacacugccu

SEQ ID NO: 132265 - RNA, 64 nt, Homo Sapiens
agguggcuuuggcccagaggcucaggccgggacugagauggacagacccagggugggguggggu

SEQ ID NO: 132266 - RNA, 64 nt, Homo Sapiens
uuucuuuucuuuucuuuuuuuuuuuuuuuuuuuugagauggagucucgcucugucgcccaggcu

SEQ ID NO: 132267 - RNA, 64 nt, Homo Sapiens
ccaugcccggcuaauuuuguuuguauuuuuaguagagauggaguuucaccauguuggccagggu

SEQ ID NO: 132268 - RNA, 64 nt, Homo Sapiens
agacaaauauccccaagugaaauauguugcgguagagauggaauguauaaaauccgccaguagu

SEQ ID NO: 132269 - RNA, 64 nt, Homo Sapiens
uuaggccugcuguucccuuugcucuugauuaggagagauggaaggagaugagcucccauaacug

SEQ ID NO: 132270 - RNA, 64 nt, Homo Sapiens
cuugcuauauugcccaggcuuuuuuuuuuugguagagauggaguccuggcuaauuuuuacuuuu

SEQ ID NO: 132271 - RNA, 64 nt, Homo Sapiens
acauauuuuauuaagaacucuggauggguuuuaugagauggaucguagccacaguauggauggg

SEQ ID NO: 132272 - RNA, 64 nt, Homo Sapiens
ggggauaucagauugguuucaagcaggaaggagggagauggaaagcaggacacauuggcaaguc

SEQ ID NO: 132273 - RNA, 64 nt, Homo Sapiens
cugccucuggagccagccugcuagaggugaagaggagauggacaguggcuaucuuaugugagga

SEQ ID NO: 132274 - RNA, 64 nt, Homo Sapiens
uuugccauguuggccaggcuuuguauuuuuaguagagauggaauccaccaugcccagcuaauuu

SEQ ID NO: 132275 - RNA, 64 nt, Homo Sapiens
uucacucuuguugcccaggcuuauuuuauuuuuugagauggaguuuuauuuauuuauuuuuauu

SEQ ID NO: 132276 - RNA, 64 nt, Homo Sapiens
uauguucaaagaaugagauaccaacugaaaaccugagauggagagcuucagaaguaagagccaa

SEQ ID NO: 132277 - RNA, 64 nt, Homo Sapiens
ccagcccugccaaaggauggucucuaacugaagagagauggaagugcugaacuuuuaaaagagg

SEQ ID NO: 132278 - RNA, 64 nt, Homo Sapiens
ccaccaugcccagcuaauuuuuguguuuuuaguagagauggagucucaccacauaggccaggca

SEQ ID NO: 132279 - RNA, 64 nt, Homo Sapiens
uguucauaauggcucauguauuauuauuauuuuugagauggaguuuugcucuuaaugauauuau

SEQ ID NO: 132280 - RNA, 64 nt, Homo Sapiens
ucaccugcucuaggugcaaaggcauguugggaaagagauggauguuggggaggaagagaggaga

SEQ ID NO: 132281 - RNA, 64 nt, Homo Sapiens
uugggaaagagauggauguuggggaggaagagaggagauggauuucaguugggaguuaggagga

SEQ ID NO: 132282 - RNA, 64 nt, Homo Sapiens
uaaacuauguugcccaggcuuggaucuugcauuggagauggaguaaaugaaacaaaauaagcag

SEQ ID NO: 132283 - RNA, 64 nt, Homo Sapiens
uucacucgacuaauucuuuuuuguguuuuuuguagagauggagaccaccacaccuggcuaauuu

SEQ ID NO: 132284 - RNA, 64 nt, Homo Sapiens
cucucucugucgccaggcuguuuuuuuuuuucuugagauggaguaccacgcccagcuaauuuuu

SEQ ID NO: 132285 - RNA, 64 nt, Homo Sapiens
cuuacucuuuugccaggcuaugugggguuuuuuugagauggaguaaaggaaguaauauaaauuu

SEQ ID NO: 132286 - RNA, 64 nt, Homo Sapiens
gggacaaccgcaguuuuacucagauaauuauacagagauggaaucaccguaucuuggugcagaa

SEQ ID NO: 132287 - RNA, 64 nt, Homo Sapiens
ugccagauuucuggaaggagcacuuuaagaaagugagauggaacgauacagaaacacuccuuag

SEQ ID NO: 132288 - RNA, 64 nt, Homo Sapiens
uggacauuaugugauuuacuauauaaggaggucagagauggacuguggccaggcuuccacauuc

SEQ ID NO: 132289 - RNA, 64 nt, Homo Sapiens
uuaacauauaaaguuauaaaugaaggacaaggaggagauggaaaauguguauuuauuguuaauu

SEQ ID NO: 132290 - RNA, 64 nt, Homo Sapiens
gggcaguaugucucagcuggaauggaaagaaugugagauggaaccucaagucacuguuuuuacc

SEQ ID NO: 132291 - RNA, 64 nt, Homo Sapiens
ggaacagggagcagagagacccaacugggagccagagauggaacuucaggucuuaagugcaaau

SEQ ID NO: 132292 - RNA, 64 nt, Homo Sapiens
auaaguaaaugagcagugugaaaauguuuagucugagauggaucgacugauauuuaaacuaaga

SEQ ID NO: 132293 - RNA, 64 nt, Homo Sapiens
cucacucugucaccuaggcuuguuuuuuuuguuugagauggaguuuuuuguuuguuuuguuuuu

SEQ ID NO: 132294 - RNA, 64 nt, Homo Sapiens
uccuuuuugguucaguauuagugagagggagagggagauggauggugggguagguuuucuaguc

SEQ ID NO: 132295 - RNA, 64 nt, Homo Sapiens
aaguggccagaacuccuauuccuaaaaggauuuugagauggaggaacacauauuuaauuccccu

SEQ ID NO: 132296 - RNA, 64 nt, Homo Sapiens
aguuaauuauaaaaauuaaaagauuuuuuuuuuugagauggaauauugcucuguugcccaggcu

SEQ ID NO: 132297 - RNA, 64 nt, Homo Sapiens
ucagaugugucuugugcccaccucuuccugagaagagauggaaguggagcugugacuaguacaa

SEQ ID NO: 132298 - RNA, 64 nt, Homo Sapiens
aggaggcaauugggauggcgaggggacgcugguagagauggagggacugccccgugcagacugg

SEQ ID NO: 132299 - RNA, 64 nt, Homo Sapiens
uucucucggaguaucugggaggaaacuguugccagagauggaggucccugauuccuguuguuau

SEQ ID NO: 132300 - RNA, 64 nt, Homo Sapiens
uucaccauguuggccaggcucuguauuuuuaguagagauggaguccaccauacccagcuaauuu

SEQ ID NO: 132301 - RNA, 64 nt, Homo Sapiens
cucacucugucucccaggcuuuuuuuguuuguuugagauggagucccucuccugauccaaaucu

SEQ ID NO: 132302 - RNA, 64 nt, Homo Sapiens
gugcacggagacacgcaccuuggagaaaugaggggagauggaccaagaaagacguggaccugga

SEQ ID NO: 132303 - RNA, 64 nt, Homo Sapiens
aaugauugacaacucacuuuuuuuuuuuuuuuuugagauggagucucgcucugucgcccaggcu

SEQ ID NO: 132304 - RNA, 64 nt, Homo Sapiens
uuuucuuuuucuuuucuuuucuuuuuuuuuuuuugagauggagucucgcucugucgcccaggcu

SEQ ID NO: 132305 - RNA, 64 nt, Homo Sapiens
cagcuaguuuuuuuuuuuuuuuguauuuuuaguagagauggaguuucaccauguuagccaggau

SEQ ID NO: 132306 - RNA, 64 nt, Homo Sapiens
ccacgcagcccugaucgcagcugcggccacaccugagauggaccccagggccugccggcaucac

SEQ ID NO: 132307 - RNA, 64 nt, Homo Sapiens
uucauucuuguuacccaggcuuuuuucuuuuuuugagauggagucauguuuuuggauuuuuuuu

SEQ ID NO: 132308 - RNA, 64 nt, Homo Sapiens
ucacaaaaugcaagauaugugacaaugcacacuggagauggaccucaagcuuucgaagacacau

SEQ ID NO: 132309 - RNA, 64 nt, Homo Sapiens
ucauaaauguaagauauguggauaaggcacacuagagauggaccggaagcuuccaaagacacau

SEQ ID NO: 132310 - RNA, 64 nt, Homo Sapiens
uuauaaauguaaguugugugggcagugcagcauggagauggaccggaaaccuucaaagacacau

SEQ ID NO: 132311 - RNA, 64 nt, Homo Sapiens
ugcucugccuuccagcggggcucucacccacccagagauggagcauagugagcccaugcagcac

SEQ ID NO: 132312 - RNA, 64 nt, Homo Sapiens
agaaaaaaaugcccccuucacuuuguacagggcugagauggaggcucaaucuagaaagaacuug

SEQ ID NO: 132313 - RNA, 64 nt, Homo Sapiens
uaguuuuuuauauaaaugacuuuuuuuuuuuuuugagauggaguuucacccuuguugcccaggc

SEQ ID NO: 132314 - RNA, 64 nt, Homo Sapiens
cauuagcugcgccccugaagugucuccagcagaagagauggaugaauggaaggacacacagaug

SEQ ID NO: 132315 - RNA, 64 nt, Homo Sapiens
ugcccuuucuuuuuuuuuuuuuuuuuuuuuuuccgagauggagucucucucugucacccaggug

SEQ ID NO: 132316 - RNA, 64 nt, Homo Sapiens
uuuuuuuuucuguuucuguuucuguuuuuuuuuugagauggagucucgcucugucgcccaggcu

SEQ ID NO: 132317 - RNA, 64 nt, Homo Sapiens
cucgcucuguugcccaggguguuuuguuuuguuugagauggagugaaugacauuuuguuuguuu

SEQ ID NO: 132318 - RNA, 64 nt, Homo Sapiens
uuugcucuuguugcccaggcuuuuguauuuuuucgagauggaguuggucucuuuauuuuuuuau

SEQ ID NO: 132319 - RNA, 64 nt, Homo Sapiens
uucgcucuguuguccaggcuuuuuuuuuuuuuuugagauggaguauagguugaucuuugggguu

SEQ ID NO: 132320 - RNA, 64 nt, Homo Sapiens
cuugcuccuguugugcaggcuuuuuuguuuuuuugagauggaguguuuuuguuuuuguuuuuug

SEQ ID NO: 132321 - RNA, 64 nt, Homo Sapiens
cuugcuccuguugugcaggccuuuuuuuuuuuuugagauggaguaaaaauugggaauaagcucg

SEQ ID NO: 132322 - RNA, 64 nt, Homo Sapiens
uaagaucuaaaguuaguugcacugucauuuauuugagauggaaaaauugucauuuaauucuuaa

SEQ ID NO: 132323 - RNA, 64 nt, Homo Sapiens
acuccagauucuaucauugauuccucauuuucuugagauggauguggcaguuuucaacuuccuc

SEQ ID NO: 132324 - RNA, 64 nt, Homo Sapiens
uaguagccucagaagaaauagugguuugcagaaagagauggauaccuucuaauaacccugccau

SEQ ID NO: 132325 - RNA, 64 nt, Homo Sapiens
uuucagugagccaagaucacucacuugaacucaggagauggaggaggaggcugaggcacgagaa

SEQ ID NO: 132326 - RNA, 64 nt, Homo Sapiens
cuccagggcgcagccuccugaguagcugggaggacaggcauaugccaccacaucacugagaaga

SEQ ID NO: 132327 - RNA, 64 nt, Homo Sapiens
acaccccgucucuacuaaaaauacaaaaauuacccaggcauaguggcacacgccuguaguccca

SEQ ID NO: 132328 - RNA, 64 nt, Homo Sapiens
ucaagaaagauguggccaaucagauugagucauccaggcauaccuuuuuagcuucuguuugugg

SEQ ID NO: 132329 - RNA, 64 nt, Homo Sapiens
ucuccugccucagccucccaaguagcugggauuacaggcauacaccaccacgccccacuaauuu

SEQ ID NO: 132330 - RNA, 64 nt, Homo Sapiens
ccaccacgccuggcuauguuaaguagcuggauuacaggcauacauucuccugccucagccuccc

SEQ ID NO: 132331 - RNA, 64 nt, Homo Sapiens
ccgccacacccagcuaauuuaauagcuggaacuacaggcauauaucucccaccucaggcaccca

SEQ ID NO: 132332 - RNA, 64 nt, Homo Sapiens
aucugaacccaguguggggggggaaggagggaggcaggcauagcuggaugccuuagaagggaga

SEQ ID NO: 132333 - RNA, 64 nt, Homo Sapiens
agguuauagcuccaaguuccagauuaugauugcucaggcauaccgagaauagaagggccuggac

SEQ ID NO: 132334 - RNA, 64 nt, Homo Sapiens
aaauuauaaaaguauuaauugauugcaguaaagacaggcauaagcuuuacaauuuauguuuaga

SEQ ID NO: 132335 - RNA, 64 nt, Homo Sapiens
aaaucacaaggguauugacugauuaaaguaaagacaggcauaggcucagcugacaggauugaga

SEQ ID NO: 132336 - RNA, 64 nt, Homo Sapiens
ccucuugaagagaaaacacacagcuucacacauccaggcauagggggcaagcucuuggggcauc

SEQ ID NO: 132337 - RNA, 64 nt, Homo Sapiens
accugcuccucccgagacucucucugacugcagccaggcauaguaccuuugccuguguuugcuc

SEQ ID NO: 132338 - RNA, 64 nt, Homo Sapiens
aauuuaacagguaaugauacaagagacguuaagaauggcagauaucaaauuagccagaaggaag

SEQ ID NO: 132339 - RNA, 64 nt, Homo Sapiens
caggaguuggaccuagguuuguugcuagcaggaaauggcagagcuuauaccaguguuguccaag

SEQ ID NO: 132340 - RNA, 64 nt, Homo Sapiens
aaaucuaaaguguuuauuaaagguggcuucagaaauggcagaauuccuauguauaaauuaaaug

SEQ ID NO: 132341 - RNA, 64 nt, Homo Sapiens
uguugcccacaagcgccuuugcccauguguauugauggcagagcggcuggauucggaaacaucu

SEQ ID NO: 132342 - RNA, 64 nt, Homo Sapiens
augguucagauauuuuuucauuaaaaaacaagguauggcagauggacuuuuccaugggucaaau

SEQ ID NO: 132343 - RNA, 64 nt, Homo Sapiens
caccucuuaagugcauuugcauuuuauuuugguaauggcagagaccucauguggccaguuugau

SEQ ID NO: 132344 - RNA, 64 nt, Homo Sapiens
gccagggcagagagagacuguguaugucaccaggauggcagagagugacaaugucccccauauc

SEQ ID NO: 132345 - RNA, 64 nt, Homo Sapiens
auccucucugcccugggugagacaucuuagaccuauggcagagcgcacucuuggugcaucaccg

SEQ ID NO: 132346 - RNA, 64 nt, Homo Sapiens
cauauugugucugguuauauacaaaaacaaaaacauggcagauguuuuaguuuuuuuaaaaaaa

SEQ ID NO: 132347 - RNA, 64 nt, Homo Sapiens
ugggcuggagaagaaccuucaagguaggaggaaaauggcagaccaggcuggggguaaggccaag

SEQ ID NO: 132348 - RNA, 64 nt, Homo Sapiens
guuuuggagguccccccagagagcagagugggccauggcagaaguaggggguugguuggaccug

SEQ ID NO: 132349 - RNA, 64 nt, Homo Sapiens
cacuuuaccugcaguuucuucccagcucgggcagauggcagaagggaccccuuggacuuuuucu

SEQ ID NO: 132350 - RNA, 64 nt, Homo Sapiens
uguaaauuuuuccuccuuuaccuuugcuaauaucauggcagaauuuuucuuaucccuugugagg

SEQ ID NO: 132351 - RNA, 64 nt, Homo Sapiens
gcauuaauagcuaaucacugggacuugaauucugauggcagauagucucuugcuuagugagaug

SEQ ID NO: 132352 - RNA, 64 nt, Homo Sapiens
ccagaaaauauccaucuucuuuuuguggcugcuaauggcagaagugccugugcuagaguuccaa

SEQ ID NO: 132353 - RNA, 64 nt, Homo Sapiens
acgggaugcuaagcagugcaccugcagugguuuaauggcagauaagcuccgucugcaguuccag

SEQ ID NO: 132354 - RNA, 64 nt, Homo Sapiens
cauuuuugagaugaugauacggagucaacucaacauggcagaacaaacauuguuuuugacuaug

SEQ ID NO: 132355 - RNA, 64 nt, Homo Sapiens
cauugcugacuuuagguucauaaacaacaucaaaauggcagaacuagguucacacccuguuuua

SEQ ID NO: 132356 - RNA, 64 nt, Homo Sapiens; identical to SEQ ID NO: 86065

SEQ ID NO: 132357 - RNA, 64 nt, Homo Sapiens; identical to SEQ ID NO: 86066

SEQ ID NO: 132358 - RNA, 64 nt, Homo Sapiens; identical to SEQ ID NO: 86067

SEQ ID NO: 132359 - RNA, 64 nt, Homo Sapiens; identical to SEQ ID NO: 86068

SEQ ID NO: 132360 - RNA, 64 nt, Homo Sapiens; identical to SEQ ID NO: 86069

SEQ ID NO: 132361 - RNA, 64 nt, Homo Sapiens; identical to SEQ ID NO: 86070

SEQ ID NO: 132362 - RNA, 64 nt, Homo Sapiens; identical to SEQ ID NO: 86071

SEQ ID NO: 132363 - RNA, 64 nt, Homo Sapiens; identical to SEQ ID NO: 86072

SEQ ID NO: 132364 - RNA, 64 nt, Homo Sapiens; identical to SEQ ID NO: 86073

SEQ ID NO: 132365 - RNA, 64 nt, Homo Sapiens; identical to SEQ ID NO: 86074

SEQ ID NO: 132366 - RNA, 64 nt, Homo Sapiens; identical to SEQ ID NO: 86075

SEQ ID NO: 132367 - RNA, 64 nt, Homo Sapiens; identical to SEQ ID NO: 86076

SEQ ID NO: 132368 - RNA, 64 nt, Homo Sapiens; identical to SEQ ID NO: 86077

SEQ ID NO: 132369 - RNA, 64 nt, Homo Sapiens; identical to SEQ ID NO: 86078

SEQ ID NO: 132370 - RNA, 64 nt, Homo Sapiens; identical to SEQ ID NO: 86079

SEQ ID NO: 132371 - RNA, 64 nt, Homo Sapiens; identical to SEQ ID NO: 86080

SEQ ID NO: 132372 - RNA, 64 nt, Homo Sapiens; identical to SEQ ID NO: 86081

SEQ ID NO: 132373 - RNA, 64 nt, Homo Sapiens; identical to SEQ ID NO: 86082

SEQ ID NO: 132374 - RNA, 64 nt, Homo Sapiens; identical to SEQ ID NO: 86083

SEQ ID NO: 132375 - RNA, 64 nt, Homo Sapiens; identical to SEQ ID NO: 86084

SEQ ID NO: 132376 - RNA, 64 nt, Homo Sapiens; identical to SEQ ID NO: 86085

SEQ ID NO: 132377 - RNA, 64 nt, Homo Sapiens; identical to SEQ ID NO: 86086

SEQ ID NO: 132378 - RNA, 64 nt, Homo Sapiens; identical to SEQ ID NO: 86087

SEQ ID NO: 132379 - RNA, 64 nt, Homo Sapiens; identical to SEQ ID NO: 86088

SEQ ID NO: 132380 - RNA, 64 nt, Homo Sapiens; identical to SEQ ID NO: 86089

SEQ ID NO: 132381 - RNA, 64 nt, Homo Sapiens; identical to SEQ ID NO: 86090

SEQ ID NO: 132382 - RNA, 64 nt, Homo Sapiens; identical to SEQ ID NO: 86091

SEQ ID NO: 132383 - RNA, 64 nt, Homo Sapiens; identical to SEQ ID NO: 86092

SEQ ID NO: 132384 - RNA, 64 nt, Homo Sapiens; identical to SEQ ID NO: 86093

SEQ ID NO: 132385 - RNA, 64 nt, Homo Sapiens; identical to SEQ ID NO: 86094

SEQ ID NO: 132386 - RNA, 64 nt, Homo Sapiens; identical to SEQ ID NO: 86095

SEQ ID NO: 132387 - RNA, 64 nt, Homo Sapiens; identical to SEQ ID NO: 86096

SEQ ID NO: 132388 - RNA, 64 nt, Homo Sapiens; identical to SEQ ID NO: 86097

SEQ ID NO: 132389 - RNA, 64 nt, Homo Sapiens; identical to SEQ ID NO: 86098

SEQ ID NO: 132390 - RNA, 64 nt, Homo Sapiens; identical to SEQ ID NO: 86099

SEQ ID NO: 132391 - RNA, 64 nt, Homo Sapiens; identical to SEQ ID NO: 86100

SEQ ID NO: 132392 - RNA, 64 nt, Homo Sapiens; identical to SEQ ID NO: 86101

SEQ ID NO: 132393 - RNA, 64 nt, Homo Sapiens; identical to SEQ ID NO: 86102

SEQ ID NO: 132394 - RNA, 64 nt, Homo Sapiens; identical to SEQ ID NO: 86103

SEQ ID NO: 132395 - RNA, 64 nt, Homo Sapiens; identical to SEQ ID NO: 86104

SEQ ID NO: 132396 - RNA, 64 nt, Homo Sapiens; identical to SEQ ID NO: 86105

SEQ ID NO: 132397 - RNA, 64 nt, Homo Sapiens; identical to SEQ ID NO: 86106

SEQ ID NO: 132398 - RNA, 64 nt, Homo Sapiens; identical to SEQ ID NO: 86107

SEQ ID NO: 132399 - RNA, 64 nt, Homo Sapiens; identical to SEQ ID NO: 86108

SEQ ID NO: 132400 - RNA, 64 nt, Homo Sapiens; identical to SEQ ID NO: 86109

SEQ ID NO: 132401 - RNA, 64 nt, Homo Sapiens; identical to SEQ ID NO: 86110

SEQ ID NO: 132402 - RNA, 64 nt, Homo Sapiens; identical to SEQ ID NO: 86111

SEQ ID NO: 132403 - RNA, 64 nt, Homo Sapiens; identical to SEQ ID NO: 86112

SEQ ID NO: 132404 - RNA, 64 nt, Homo Sapiens; identical to SEQ ID NO: 86113

SEQ ID NO: 132405 - RNA, 64 nt, Homo Sapiens; identical to SEQ ID NO: 86114

SEQ ID NO: 132406 - RNA, 64 nt, Homo Sapiens; identical to SEQ ID NO: 86115

SEQ ID NO: 132407 - RNA, 64 nt, Homo Sapiens; identical to SEQ ID NO: 86116

SEQ ID NO: 132408 - RNA, 64 nt, Homo Sapiens; identical to SEQ ID NO: 86117

SEQ ID NO: 132409 - RNA, 64 nt, Homo Sapiens; identical to SEQ ID NO: 86118

SEQ ID NO: 132410 - RNA, 64 nt, Homo Sapiens; identical to SEQ ID NO: 86119

SEQ ID NO: 132411 - RNA, 64 nt, Homo Sapiens; identical to SEQ ID NO: 86120

SEQ ID NO: 132412 - RNA, 64 nt, Homo Sapiens; identical to SEQ ID NO: 86121

SEQ ID NO: 132413 - RNA, 64 nt, Homo Sapiens; identical to SEQ ID NO: 86122

SEQ ID NO: 132414 - RNA, 64 nt, Homo Sapiens; identical to SEQ ID NO: 86123

SEQ ID NO: 132415 - RNA, 64 nt, Homo Sapiens; identical to SEQ ID NO: 86124

SEQ ID NO: 132416 - RNA, 64 nt, Homo Sapiens
aguauuuucuuauagaagcaaauuaugacuaaaauuuaacaaauucuaugaugagaaacaauga

SEQ ID NO: 132417 - RNA, 64 nt, Homo Sapiens
cgaguucuauauuuauuaugguauacuguagauuuuuaacaaagaguuuagccuuuacuugaau

SEQ ID NO: 132418 - RNA, 64 nt, Homo Sapiens
gagaauaaauaggcauaugauacccacuuggacuuuuaacaaaaguaaaggaauaaauuugcau

SEQ ID NO: 132419 - RNA, 64 nt, Homo Sapiens
acagauguauuuugcacagugcacuuaugucuauuuuaacaauccuccugcaucuguauuuuau

SEQ ID NO: 132420 - RNA, 64 nt, Homo Sapiens
uaauucauugugguaagaaugauugaaaugcagauuuaacaaucuuauaaucuauugaaugcca

SEQ ID NO: 132421 - RNA, 64 nt, Homo Sapiens
ugaagaaaguauuuaaauccaacuuuugaacagauuuaacaaacaugaggaacuuuuuuauuua

SEQ ID NO: 132422 - RNA, 64 nt, Homo Sapiens
cuuuauacagagaauucuacaaguuugcaaauauuuuaacaauauuaaaugugcaauagaacuu

SEQ ID NO: 132423 - RNA, 64 nt, Homo Sapiens
ugcauuccaaugcuaaauagaaguuaugaguggguuuaacaauuuuagaugauucagcuuuugu

SEQ ID NO: 132424 - RNA, 64 nt, Homo Sapiens
aauucuuuucacuguauuuuuuucacugacaguuuuuaacaauaagccagauguguaucagaug

SEQ ID NO: 132425 - RNA, 64 nt, Homo Sapiens
ggacaaccacagagggauauaaaccagaacaaauuuuaacaaaaaaguacaaaaggaacuauga

SEQ ID NO: 132426 - RNA, 64 nt, Homo Sapiens
uuauuuuaaucuguuuuaaguaagaaaaauguuuuuuaacaauauuauauuguauuuucucaga

SEQ ID NO: 132427 - RNA, 64 nt, Homo Sapiens
aaaacccucaguccuauuuagguguccucauaacuuuaacaaagcuaauauagaagauaaaauu

SEQ ID NO: 132428 - RNA, 64 nt, Homo Sapiens
aaauaauaauuuuaagaaugacuacauaguacuuuuuaacaacaaacuugucaggugcuuuaca

SEQ ID NO: 132429 - RNA, 64 nt, Homo Sapiens
acuguuuaaccuuucuuuauuuacauaaauaugguuuaacaaacuguccuaauuuaacaucuug

SEQ ID NO: 132430 - RNA, 64 nt, Homo Sapiens
guauaagugcccaaguaauuguccauucauauuuuuuaacaauuugaaaacaacaacaacaaaa

SEQ ID NO: 132431 - RNA, 64 nt, Homo Sapiens
ugauguacaaacuaaggacuugacaucaaacauuuuuaacaaaagucgcagcacuaaaaaugga

SEQ ID NO: 132432 - RNA, 64 nt, Homo Sapiens
uccauaggucuccuuucuauaaaucaucuugauguuuaacaacucuuauuauauuaaaaucuca

SEQ ID NO: 132433 - RNA, 64 nt, Homo Sapiens
ucagaagcucugagaguaaggccuaccaaucugguuuaacaagcccgucaggugauucugauuu

SEQ ID NO: 132434 - RNA, 64 nt, Homo Sapiens
auuuuucccucacagucaguagcuuuguuugauauuuaacaauaaguauauggugauauacuug

SEQ ID NO: 132435 - RNA, 64 nt, Homo Sapiens
uugaaguuucugggaacacauaauauguagccaguuuaacaaagaagcugucaggugcacagcc

SEQ ID NO: 132436 - RNA, 64 nt, Homo Sapiens
uuuacucaaaucaaaguuaaguacagaguuuauuuuuaacaaaugucauagcuaugucaccuua

SEQ ID NO: 132437 - RNA, 64 nt, Homo Sapiens
aaggggaaggggaagauuucuuaaguuugaaaacuuuaacaaugcaaaucucuuuagcacuauu

SEQ ID NO: 132438 - RNA, 64 nt, Homo Sapiens
uaguaaaaguugaaaugaccacacaucugacauuuuuaacaacuuuuuaaauguuuuuuaaaag

SEQ ID NO: 132439 - RNA, 64 nt, Homo Sapiens
gagaugggaaggaauguugacuugcuaacauuccuuuaacaaguuaagaaaacuuguuaaaugu

SEQ ID NO: 132440 - RNA, 64 nt, Homo Sapiens
aguauuuaagccucaacaauccaaaucuacaaacuuuaacaaugcaagucuuacucuaauuuuu

SEQ ID NO: 132441 - RNA, 64 nt, Homo Sapiens
auuaagugaaaaucuucccuuuguuaaggagcuuuuuaacaagagugucuuugcugggugguga

SEQ ID NO: 132442 - RNA, 64 nt, Homo Sapiens
uaguacauggcagauugccuguaagucuguucauuuuaacaacauacagggcugggcacggugg

SEQ ID NO: 132443 - RNA, 64 nt, Homo Sapiens
aauaagccugcuacauguaauauuguuuuuguaauuuaacaauauuaaucuguuguaauuguag

SEQ ID NO: 132444 - RNA, 64 nt, Homo Sapiens
gaaaggguuaaauuaacucuaacgaguguaaaauuuuaacaacgauauauuuguugaauaacag

SEQ ID NO: 132445 - RNA, 64 nt, Homo Sapiens
uauaaaacuguuucaagcccaggauaagaauuauuuuaacaacauuuuuaacaaaaauaaucuu

SEQ ID NO: 132446 - RNA, 64 nt, Homo Sapiens
auaaucuuaggauaagaauuaaaccuauucucuuuuuaacaaaauacagcugagugggaaccgg

SEQ ID NO: 132447 - RNA, 64 nt, Homo Sapiens
aaauggcaacaauggauaaaccaaggauuuuguguuuaacaauccauuuccagugucuucgcca

SEQ ID NO: 132448 - RNA, 64 nt, Homo Sapiens
cccaccuacauuucuguuuggugacauugcucauuuuaacaaauaugaccgagucuaguuuuuc

SEQ ID NO: 132449 - RNA, 64 nt, Homo Sapiens
agauggaguaccaugaggguugcuauuuguuguuuuuaacaacuaaucaagagugagugaacaa

SEQ ID NO: 132450 - RNA, 64 nt, Homo Sapiens
ucucacagagccaacucacucuuaugaaaugggcuuuaacaaaacaagaaagaaacguacuuaa

SEQ ID NO: 132451 - RNA, 64 nt, Homo Sapiens
uuguacaaccuuaaggcucuagguuaucauauaauuuaacaaaauaaaugcauccuaccauuca

SEQ ID NO: 132452 - RNA, 64 nt, Homo Sapiens
auuuucuucauugauaacugaugauauaaucuucuuuaacaaauaugcacugcuuucauguaaa

SEQ ID NO: 132453 - RNA, 64 nt, Homo Sapiens
aucugagcaaaagguauauguaaaugagguaaaauuuaacaauaagaaagagcaauugauaaag

SEQ ID NO: 132454 - RNA, 64 nt, Homo Sapiens
aucugauacacauaaauagacaaauaagguaacauuuaacaauaaaagagagcaauugauaagg

SEQ ID NO: 132455 - RNA, 64 nt, Homo Sapiens
uaacuuuuuguuuaaccuagaagguaacuuuuuguuuaacaagguugucucuuuuuuguuuaac

SEQ ID NO: 132456 - RNA, 64 nt, Homo Sapiens
uaacuuuuuguuuaacaagguugucucuuuuuuguuuaacaagguaagaugccccugcuugucu

SEQ ID NO: 132457 - RNA, 64 nt, Homo Sapiens
uuuauccaugaaggacugagugaccuuuguuguauuuaacaaaauccaggugcaucaauuucug

SEQ ID NO: 132458 - RNA, 64 nt, Homo Sapiens
uauguuccauggcugaauuuuaaagcuguuuagguuuaacaaugaagggauuuauucuuuaguc

SEQ ID NO: 132459 - RNA, 64 nt, Homo Sapiens
gccuugauaaauauauaugaucauugaaauacuuuuuaacaaaaaacagauucuauauuauuau

SEQ ID NO: 132460 - RNA, 64 nt, Homo Sapiens
auauccuauauaggaaacuaagcauuguauuuuuuuuaacaaaucuaaaaaagcacuaugaacu

SEQ ID NO: 132461 - RNA, 64 nt, Homo Sapiens
aagaaguguauauuuucaaacaauuuuuuaaugauuuaacaauuuuuguaaaucauuuucaggc

SEQ ID NO: 132462 - RNA, 64 nt, Homo Sapiens
caaggccuaauuugcaguaacuauugcuguuuuauuuaacaaugccuuguugcuuuguaugcau

SEQ ID NO: 132463 - RNA, 64 nt, Homo Sapiens
gauuuguuuuuguagagauuugaacuuugaaugguuuaacaaaaagugguuaauuaccuuuaug

SEQ ID NO: 132464 - RNA, 64 nt, Homo Sapiens
auaaaaaauucucauaggaaauaauugaaaagauuuuaacaagucaugcuacuaaauuuuuaua

SEQ ID NO: 132465 - RNA, 64 nt, Homo Sapiens
ugaccucucuccaaaacagacugcaaauaguucuuuuaacaauuuuuuuaauagccaaguaguu

SEQ ID NO: 132466 - RNA, 64 nt, Homo Sapiens
agccgucuaugggauuaaaaacauaauuaaucccuuuaacaaaagucaaaucaguuuccuuuua

SEQ ID NO: 132467 - RNA, 64 nt, Homo Sapiens
gaaacccuacaaaugugaagaacguggccuggcuuuuaacaaauccucaacauuuacuaagcau

SEQ ID NO: 132468 - RNA, 64 nt, Homo Sapiens
gcgaaacuacaauccugaaugaugucacagugcuuuuaacaauaccucaaacuuuucuaaacau

SEQ ID NO: 132469 - RNA, 64 nt, Homo Sapiens
aauuuucaaaaacucaaucaauguaauucaguauuuuaacaaaaggaaugaaaaauuaucaucu

SEQ ID NO: 132470 - RNA, 64 nt, Homo Sapiens
cuguguccauguguucucauuguuauacgaacauuuuaacaauguuaauucuugcagaccauga

SEQ ID NO: 132471 - RNA, 64 nt, Homo Sapiens
gguuuucagggcccaguccacaagauuccugaaauuuaacaauuacaguuaaacaaccagauug

SEQ ID NO: 132472 - RNA, 64 nt, Homo Sapiens
gacuuucugaaagggaaaaaugagaugguaaauguuuaacaaugaaugcauguguccacuuaca

SEQ ID NO: 132473 - RNA, 64 nt, Homo Sapiens
auuuaaagacaaaaaaaucaguauaacaucaagcuuuaacaaaucuauauaauauguacuuuga

SEQ ID NO: 132474 - RNA, 64 nt, Homo Sapiens
cccaguacuaucaguauuguaugaggaauguacuuuuaacaauuauugcugacuuuagguucac

SEQ ID NO: 132475 - RNA, 64 nt, Homo Sapiens
gauaugaaauaaaguuuaaacugauuuuguguaauuuaacaauaguagcuuuacaaaccauuca

SEQ ID NO: 132476 - RNA, 64 nt, Homo Sapiens
aaucuauuuaaauagaauaauauuuucuucugauuuuaacaaggaaaugaaacauaaaaccuuu

SEQ ID NO: 132477 - RNA, 64 nt, Homo Sapiens
accuguaaagguuuuaaaguugaaaaaccuucucuucagaaaagaagaaaaauucagaaaucag

SEQ ID NO: 132478 - RNA, 64 nt, Homo Sapiens
guugaaaaaccuucucuucagaaaagaagaaaaauucagaaaucaguagaucuuggcaauucag

SEQ ID NO: 132479 - RNA, 64 nt, Homo Sapiens
uuauggcaggucuaaucaaaaggcuaaauacaauuucagaaaagguucugauacucuuguuuuu

SEQ ID NO: 132480 - RNA, 64 nt, Homo Sapiens
ugaaagcuguuucuguuuucauuuuacauuauuauucagaaaugguagcuauucuauaccuaug

SEQ ID NO: 132481 - RNA, 64 nt, Homo Sapiens
ucaauuacaaacuccugggcuuucuggggagggguucagaaaacaucaaaacacugcagcaguu

SEQ ID NO: 132482 - RNA, 64 nt, Homo Sapiens
acguccugcuucuugguugagacuacugggauccuucagaaaagaaacacugggucccauagcu

SEQ ID NO: 132483 - RNA, 64 nt, Homo Sapiens
ucgaaggagccaaaaauauacuaaauuaaucuuuuucagaaauauuuagacacuccccaaauuu

SEQ ID NO: 132484 - RNA, 64 nt, Homo Sapiens
uuaaauggaagaaaucaauauuuaaacgcuauauuucagaaauaauuuuuauuguguaaugauc

SEQ ID NO: 132485 - RNA, 64 nt, Homo Sapiens
aagaggcauucaugaaggcugguagaaguuccuuuucagaaauacuggaaaugggaaagggagg

SEQ ID NO: 132486 - RNA, 64 nt, Homo Sapiens
caggaaucugauaucaacauuuguggucugugcuuucagaaauagacucucucugauggucacu

SEQ ID NO: 132487 - RNA, 64 nt, Homo Sapiens
gccuggcaaggcccuguugaaggaagcccagccuuucagaaagaugaaugguggcccagccaac

SEQ ID NO: 132488 - RNA, 64 nt, Homo Sapiens
ucuaccugggagacuaguuacugucaacugcaccuucagaaaaggagagggaacaagaugccau

SEQ ID NO: 132489 - RNA, 64 nt, Homo Sapiens
uuucacaugcaaaguguuugcuacugcuuaauaauucagaaaaucaagucucacugagaucacc

SEQ ID NO: 132490 - RNA, 64 nt, Homo Sapiens
gagcaguuucuaacuuagcucagugucauuuucauucagaaacuaguagaguaaaaauaaaaaa

SEQ ID NO: 132491 - RNA, 64 nt, Homo Sapiens
agugagaggccuuccugcaggucucucauuuuguuucagaaauguggccagagcuugaagucug

SEQ ID NO: 132492 - RNA, 64 nt, Homo Sapiens
ccauguagugcuaauaaccuaacucuuggagccuuucagaaauuuugagcauaguagcucccua

SEQ ID NO: 132493 - RNA, 64 nt, Homo Sapiens
ccuaguuacaaauaacuccauugaacagcaucuauucagaaacuaugccgaauaaaaagauugg

SEQ ID NO: 132494 - RNA, 64 nt, Homo Sapiens
gacacucaguuacaaacauuaucuccuuuaguuuuucagaaaaugcaucccugauuucauucau

SEQ ID NO: 132495 - RNA, 64 nt, Homo Sapiens
gaguggacugugcuugucaacggauguguagcuuuucagaaacuuaauuggggaugaauagaaa

SEQ ID NO: 132496 - RNA, 64 nt, Homo Sapiens
cugguuacuucuaguaaauuccugucaaaaucaauucagaaauucuaacuuggagaauuuaaca

SEQ ID NO: 132497 - RNA, 64 nt, Homo Sapiens
aauuaauaagaagcacaacuuguucacaaacucauucagaaaugauucucccaacaaugcguau

SEQ ID NO: 132498 - RNA, 64 nt, Homo Sapiens
auauggaaagcagagcaguacauauucaaauguauucagaaagucaaaagauuaccuaucguuc

SEQ ID NO: 132499 - RNA, 64 nt, Homo Sapiens
auuccagcagguuuauauguauagaguguagaguuucagaaaggacucaguugugcugagguca

SEQ ID NO: 132500 - RNA, 64 nt, Homo Sapiens
aaugucuuuauacaaaagacuagacagcacgcaguucagaaagaucagaugacguggcuuuguc

SEQ ID NO: 132501 - RNA, 64 nt, Homo Sapiens
ugcugggccugcucacagagccacaggaagaucauucagaaacuaggaaaggaggcccccacag

SEQ ID NO: 132502 - RNA, 64 nt, Homo Sapiens
caguuugcaaaagugcuuuuauacauuuucuaauuucagaaacaggauaauuuguuaagugggu

SEQ ID NO: 132503 - RNA, 64 nt, Homo Sapiens
ccucuuccaauuccuccucuucuucagaaucaucuucagaaagugaacuugaacaugagagaag

SEQ ID NO: 132504 - RNA, 64 nt, Homo Sapiens
aucagagcacuuauucaaaauacagugauagaaguucagaaagcucaccaaggucaaggagcag

SEQ ID NO: 132505 - RNA, 64 nt, Homo Sapiens
acuugucuuugauacaaaagagugcugacaguauuucagaaagcugagagaguuuuauacaugg

SEQ ID NO: 132506 - RNA, 64 nt, Homo Sapiens
aaaacauugccucuuugcaucacauaccucguuuuucagaaacuuuccaaacugcuuuacauag

SEQ ID NO: 132507 - RNA, 64 nt, Homo Sapiens
uaauguucauuuugauuuauuuuaaaucuuuacauucagaaaugagauacuguauuaucagacc

SEQ ID NO: 132508 - RNA, 64 nt, Homo Sapiens
uugauaccuauuuugggguauaaacaugguguuuuucagaaauaaaaauuauuucauuaaccuu

SEQ ID NO: 132509 - RNA, 64 nt, Homo Sapiens
acugucuauuaauauucaggguaaauaggaaucauucagaaauguugagucuguacuaaacagu

SEQ ID NO: 132510 - RNA, 64 nt, Homo Sapiens
ugggaaaacauguuaaugacaauauuccagaucuuucagaaauauaacacauuuuuuugcaugc

SEQ ID NO: 132511 - RNA, 64 nt, Homo Sapiens
accuaguuccuuuuggcuuuggcugcaagggcucuucagaaagcccugccugggcguucuacuu

SEQ ID NO: 132512 - RNA, 64 nt, Homo Sapiens
caaaggcaacccuucgugcaccuuggggguauuuuucagaaaucguacaccccuccguucaguu

SEQ ID NO: 132513 - RNA, 64 nt, Homo Sapiens
uaguauguucacugguauauuuaauucuuucuuuuucagaaagauggaucucuuaguuggucac

SEQ ID NO: 132514 - RNA, 64 nt, Homo Sapiens
gaguuuaugguagguagacuugaauaaggacugauucagaaaaccuggguuuugggucuaauua

SEQ ID NO: 132515 - RNA, 64 nt, Homo Sapiens
gacuuucuagugaauuauuaccauaaauaacaauuucagaaacuuaguuuuuagaauaaauauu

SEQ ID NO: 132516 - RNA, 64 nt, Homo Sapiens
auucagauagauaauaugaaucauuauggguugauucagaaauaaaauuugugaggugauuuug

SEQ ID NO: 132517 - RNA, 64 nt, Homo Sapiens
caccuaagagaaaaagaucgaauuuuucagaugauucagaaauuuucauucagguauuuguaau

SEQ ID NO: 132518 - RNA, 64 nt, Homo Sapiens
guuucuuucauaugaaaaaaaugcauuuuauaaauucagaaagucauagauuucugaaggcguc

SEQ ID NO: 132519 - RNA, 64 nt, Homo Sapiens
guaaaccuuccugaaagauaaacguuuuccugaauucagaaacuaguagcuaacauugcuucug

SEQ ID NO: 132520 - RNA, 64 nt, Homo Sapiens
gggucuuuaaaucuuuuagauauauacuggucauuucagaaaauucuucauagugguauuggcc

SEQ ID NO: 132521 - RNA, 64 nt, Homo Sapiens
uauuuuaaaagaugaaagagaaaaagccuaaauguucagaaaauuuauugugacaaaaggaaau

SEQ ID NO: 132522 - RNA, 64 nt, Homo Sapiens
acucagaaaaaagaagcugcacauaaucaauggauucagaaaugggacucucaagagaacugaa

SEQ ID NO: 132523 - RNA, 64 nt, Homo Sapiens
uucuaagagcacaugacauguggcugccuccccuuucagaaacaagcugaguaacccagccugc

SEQ ID NO: 132524 - RNA, 64 nt, Homo Sapiens
guggaacccaaacuguauggggauauuugauguuuucagaaagaggaagaaaauaugguccaaa

SEQ ID NO: 132525 - RNA, 64 nt, Homo Sapiens
caggggaacuaugucacaguuuaccucuuccugauucagaaauguguaugguuugcagcuuuua

SEQ ID NO: 132526 - RNA, 64 nt, Homo Sapiens
ucugaaaauaaaaauuauacaguaguaaagauaauucagaaagaaaaagcuaccuguuagaauu

SEQ ID NO: 132527 - RNA, 64 nt, Homo Sapiens
cauagcaauucagugauuuuaauuuuuuggauauuucagaaaccuuuucccccugcuucagguu

SEQ ID NO: 132528 - RNA, 63 nt, Homo Sapiens
guaguuuacaagaauaaagaugcaggaauuuauuucagaaaauauuuccuccaaacaaaauaa

SEQ ID NO: 132529 - RNA, 54 nt, Homo Sapiens
uugaaccaauggauccuuaagauuuucagaaaacacuuauuuuguuucuuaagu

SEQ ID NO: 132530 - RNA, 64 nt, Homo Sapiens
gauaauccuucauaauuuauuauacaauuuaucauucagaaagcaauaauuaaaaaaguuuaca

SEQ ID NO: 132531 - RNA, 64 nt, Homo Sapiens
cauguuugcaaaaggucacugugaggcugcauauuucagaaagauguccuuaauaagggaaguc

SEQ ID NO: 132532 - RNA, 64 nt, Homo Sapiens
caagucacugcugccauguguguacuguauuauuuucagaaaaaaauauaauagucugagucca

SEQ ID NO: 132533 - RNA, 64 nt, Homo Sapiens
cacuuaagcaagacccuucuaauaacgagaagaauucagaaaacuuuauaaagcacauauucau

SEQ ID NO: 132534 - RNA, 64 nt, Homo Sapiens
acuucgcuuuuuucuuuuuauuauagggcccaacuucagaaaauaaaauuguuuuucuaauacu

SEQ ID NO: 132535 - RNA, 64 nt, Homo Sapiens
auauaugcaagcacaacuuggcuggcagcaaagcuucagaaaauuggucuuuuccuguuaacaa

SEQ ID NO: 132536 - RNA, 64 nt, Homo Sapiens
acgguuacauagcuauuuauuagcuaggugauuauucagaaaaugaguguuuacucacucugga

SEQ ID NO: 132537 - RNA, 64 nt, Homo Sapiens
uucaaacucauaaacucaguuauuguguuaacacuucagaaagauuuaugcaguacagugggcu

SEQ ID NO: 132538 - RNA, 64 nt, Homo Sapiens
gcuaguaauauuacuuauaacuguaauauauagauucagaaauacauuuucauuauccaaaauc

SEQ ID NO: 132539 - RNA, 64 nt, Homo Sapiens
cccauaauuuagaaaaggaugucgacuugcuaauuucagaaauaauuauucauuuuuaaaaagc

SEQ ID NO: 132540 - RNA, 64 nt, Homo Sapiens
gcucaccccuuauugcacaggaaagcauuuauacuucagaaagauuguacaaauacaaggaaug

SEQ ID NO: 132541 - RNA, 64 nt, Homo Sapiens
aagcauuauaaaugcaauuuuugucaagagaucuuucagaaaauauaagccuuuaaagugaaga

SEQ ID NO: 132542 - RNA, 64 nt, Homo Sapiens
uggcaaggccacuagcagaguccucuucuggggcuucagaaagcuuuccuucuuucagaaacau

SEQ ID NO: 132543 - RNA, 64 nt, Homo Sapiens
uuccucuucuggggcuucaguagcguuuccuucuuucagaaacacacacacaguuggcagcaca

SEQ ID NO: 132544 - RNA, 64 nt, Homo Sapiens
aggaaauaggggaaaaaaagcagggauauauaccuucagaaauauuuaaaaaggacauuucuau

SEQ ID NO: 132545 - RNA, 64 nt, Homo Sapiens
uuauuauuuaacccagaagugccugguuuucaaauucagaaaucggcgugagccaccaggcccu

SEQ ID NO: 132546 - RNA, 64 nt, Homo Sapiens
aaacuguagaacuguguauuucuuuaaacagccauucagaaacauaaguuauaauuuaggauug

SEQ ID NO: 132547 - RNA, 64 nt, Homo Sapiens
acuuguaugcuguuuuucuccauaacuuaguugauucagaaagguauuaauaagaaaauuugca

SEQ ID NO: 132548 - RNA, 64 nt, Homo Sapiens
uguagaaauaaaaauguugcuacauacuauguguuucagaaauauggacuugugaauuuuugag

SEQ ID NO: 132549 - RNA, 64 nt, Homo Sapiens
cauaaugucauauguuaaaaaguguuuaucuuaguucagaaauaaugaguaacaacuuugcuua

SEQ ID NO: 132550 - RNA, 64 nt, Homo Sapiens
ucccaugaaacuaaaaauagaugcaauuuauuauuucagaaauuaguucaauguaacauuuuaa

SEQ ID NO: 132551 - RNA, 64 nt, Homo Sapiens
ugauguaguagaacaugcccauaggaagaagggauucagaaauauuuuuucagagagugaccga

SEQ ID NO: 132552 - RNA, 64 nt, Homo Sapiens
cuauuauuuccuaaccaugaaaaagcaccugcuuuucagaaagaggauauggaguuguaguaga

SEQ ID NO: 132553 - RNA, 64 nt, Homo Sapiens
uaauucuuacauugugauugcauggggccagaaauucagaaacgcucagaaaggaagaccaugc

SEQ ID NO: 132554 - RNA, 64 nt, Homo Sapiens
ugaaguuuccagaaacuaagauaugugcccaaaguucagaaagaaucagacugaacacagugaa

SEQ ID NO: 132555 - RNA, 64 nt, Homo Sapiens
agugaugaauucuguaguccuuuaauuauauuuuuucagaaaacgugucauaauuccauuaagg

SEQ ID NO: 132556 - RNA, 64 nt, Homo Sapiens
cagguuuuucuuccucucuucuaaaguacugccauucagaaaagaggaccacaaugcccccggc

SEQ ID NO: 132557 - RNA, 64 nt, Homo Sapiens
acuacagcccuuuuugucuuaagacuugaguuauuucagaaaaaaauauaaaagcuauauuuug

SEQ ID NO: 132558 - RNA, 64 nt, Homo Sapiens
uccaggauccaaaauguggcuuucaaucaugauauucagaaaaauucauuuuuuguuuuguuuu

SEQ ID NO: 132559 - RNA, 64 nt, Homo Sapiens
ucagggcaaaaguaugggcauuuuucuugcuauguucagaaaguacaguucucuccaacuugca

SEQ ID NO: 132560 - RNA, 64 nt, Homo Sapiens
gaaccucgggaucccaaagaaugaggggaauuucuucagaaagacaaucucggcaugcauuauu

SEQ ID NO: 132561 - RNA, 64 nt, Homo Sapiens
cuguagggucgauugaauuggaccuuuucaguuguucagaaaaauaaaaauaauuucucauauu

SEQ ID NO: 132562 - RNA, 64 nt, Homo Sapiens
uagaaucaguucauaucaccauuaaaaucauccauucagaaaccaaggccuugucugcagaaau

SEQ ID NO: 132563 - RNA, 64 nt, Homo Sapiens
gaagacagcuguauuugggagaagucaugucagauucagaaauuugccauuauguauuuuuaug

SEQ ID NO: 132564 - RNA, 64 nt, Homo Sapiens
uagcacuuggucuccucccuugucucuagugucuuucagaaaguuggcaauaccuuaacaaaug

SEQ ID NO: 132565 - RNA, 64 nt, Homo Sapiens
cucaaaauacguguucaaaaguaccuaugugaguuucagaaauucuguauauucccuguggaau

SEQ ID NO: 132566 - RNA, 64 nt, Homo Sapiens
uugaagcaccauggugugucuuagugccaaguuuuucagaaagucaaugagugugccagaguua

SEQ ID NO: 132567 - RNA, 64 nt, Homo Sapiens
uauauauuaauuuaauucugucuaaguaaguuuauucagaaaaauaggaaagaaaaugauauuu

SEQ ID NO: 132568 - RNA, 64 nt, Homo Sapiens
uucgguggaaggucacuauuagaucagaauagacuucagaaagcuagagucagcugccgaacgg

SEQ ID NO: 132569 - RNA, 64 nt, Homo Sapiens
uagagaguugccccuaggacagcaugcacuuauuuucagaaacuuucugauuguuuugaacugg

SEQ ID NO: 132570 - RNA, 64 nt, Homo Sapiens
acacugaaucccuguguugauaagcaaggacacguucagaaaugaauacacuaaaugggaaaaa

SEQ ID NO: 132571 - RNA, 64 nt, Homo Sapiens
uuguagagaaacccaacaaacaguugcuuaaacuuucagaaaauacuagauggaagacuugcau

SEQ ID NO: 132572 - RNA, 64 nt, Homo Sapiens
uacguggauaggacuuuagagggaagacaacagauucagaaauucuuaaggagaugugacauau

SEQ ID NO: 132573 - RNA, 64 nt, Homo Sapiens
aucccagaucucagcuagaaugaacacuucugaauucagaaacuaauacaugcaauguggcugg

SEQ ID NO: 132574 - RNA, 64 nt, Homo Sapiens
uagcaaugacauaaaaacugaguuucucaguuguuucagaaacacucagcuuucuccaccuuuc

SEQ ID NO: 132575 - RNA, 64 nt, Homo Sapiens
agcagagcugucaacucuucacucucccaaguuuuucagaaaccgugcauaugugugcauugcc

SEQ ID NO: 132576 - RNA, 64 nt, Homo Sapiens
ggcuuucuuccauuguuguuuuuguagcauuuauuucagaaauguguauuuccauaauccagag

SEQ ID NO: 132577 - RNA, 64 nt, Homo Sapiens
guuuucuuaaugccagugugaauuugcagauguuuucagaaaaucaagucacaguaacaauuug

SEQ ID NO: 132578 - RNA, 64 nt, Homo Sapiens
guguuuuuaugggaauguaauuugaaaucacuacuucagaaauuugacuuaaaauucuugagca

SEQ ID NO: 132579 - RNA, 64 nt, Homo Sapiens
augggaucguugauguuuaucagaacuguucacuuucagaaaugauuuuuuaaagcauuuuguu

SEQ ID NO: 132580 - RNA, 64 nt, Homo Sapiens
gcagccaggacccgguaggccugagccucaacucuucagaaaauaguguuuuuaauauuccucu

SEQ ID NO: 132581 - RNA, 64 nt, Homo Sapiens
aacucuucagaaaauaguguuuuuaauauuccucuucagaaaauaguguuuuuaauauuccgag

SEQ ID NO: 132582 - RNA, 64 nt, Homo Sapiens
auggauuuuaaaaauauuuuaagagaaaaacucauucagaaaucuucaacuaaaguuauaaaua

SEQ ID NO: 132583 - RNA, 64 nt, Homo Sapiens
ggaacagaauguuuuacugucuuuauauggaugauucagaaauuucuguucuugcuacccauga

SEQ ID NO: 132584 - RNA, 64 nt, Homo Sapiens
uuuucauugcacuucuaaaauucagccuuguucauucagaaaauaaggauggauuuugugaaua

SEQ ID NO: 132585 - RNA, 64 nt, Homo Sapiens
ugugauuucucacauuuuuauuugcugagaaacauucagaaaauuauuccaaaaaugaagguac

SEQ ID NO: 132586 - RNA, 64 nt, Homo Sapiens
ccuggagcaacuuaaaugucagccugugucuuuuuucagaaaucuagggcuggcucuaggaaga

SEQ ID NO: 132587 - RNA, 64 nt, Homo Sapiens
uacucuaguguuaaguguauuaaaaaguuuuuucuucagaaaggauaacaugucauugaaguca

SEQ ID NO: 132588 - RNA, 64 nt, Homo Sapiens
auacauuugagaauaagaaauuacucucaagaacuucagaaaucugcaacauaauuuuauaaau

SEQ ID NO: 132589 - RNA, 64 nt, Homo Sapiens
acauguauguaugucaaaacacuacauauacacuuucagaaagaauaaacuuucucaagucauu

SEQ ID NO: 132590 - RNA, 64 nt, Homo Sapiens
uaauaauuuuuuuuaaaacauuaaggaauuggaauucagaaagguuacccccuuccucuguguc

SEQ ID NO: 132591 - RNA, 64 nt, Homo Sapiens
cuuuguaaggauacauuuggaagaacauacaguauucagaaacuaaccuauauaaaauguaaac

SEQ ID NO: 132592 - RNA, 64 nt, Homo Sapiens
uguaauaaaugucagcuuuuugcuuaugaaggauuucagaaauuuuuuuguuuaaucaaauacu

SEQ ID NO: 132593 - RNA, 64 nt, Homo Sapiens
gaaaacuacauuuuggcagguaucuccaaaaaacuucagaaauauuaucccuuuguaagcuacu

SEQ ID NO: 132594 - RNA, 64 nt, Homo Sapiens
ucagcucuggauuugcagucaguuugggauucucuucagaaagauggcaucuaagugucugugu

SEQ ID NO: 132595 - RNA, 64 nt, Homo Sapiens
cagcuggaaggcacaaggggaggacauuguggcauucagaaacugcaggagacaagaugaauuu

SEQ ID NO: 132596 - RNA, 64 nt, Homo Sapiens
agugacagcuucuggcugaagacuuuugguucuauucagaaaccugugucguuuuuuugguguu

SEQ ID NO: 132597 - RNA, 64 nt, Homo Sapiens
ugcucaguguagucugugaugaauaguuuaaguguucagaaauugguaaaccaacacacgggau

SEQ ID NO: 132598 - RNA, 64 nt, Homo Sapiens
gcuuucucuuugguaaagaacacuauagauaguauucagaaauugucaguucacauuaguuuag

SEQ ID NO: 132599 - RNA, 64 nt, Homo Sapiens
gacugaaaauggagagcuauuaugcgauaugaauuucagaaaugaguagaaaaaggcuaaaggc

SEQ ID NO: 132600 - RNA, 64 nt, Homo Sapiens
ugaggcaggaggauuacuuggauaaucccagcaauucagaaagcugggcacaguggcucaugcc

SEQ ID NO: 132601 - RNA, 64 nt, Homo Sapiens
gccaggggccucauacagggugggacgaaacggguucagaaacuucacuucuagacuuucacgg

SEQ ID NO: 132602 - RNA, 64 nt, Homo Sapiens
auugaaacugugaguuguuuguucugauuuuugguucagaaaaucccuuugacacaaaccaugu

SEQ ID NO: 132603 - RNA, 64 nt, Homo Sapiens
gcuuaagaaaugcgauaugagaccuguuaaaccauucagaaaaagugcaauuaacacugaaaga

SEQ ID NO: 132604 - RNA, 64 nt, Homo Sapiens
gccugugugcaacucaaauucaaguuuaaucugcuucagaaagcgcucugaagugucacaagga

SEQ ID NO: 132605 - RNA, 64 nt, Homo Sapiens
gcagcauagaauuuuggaauuuuggggcuuucuuuucagaaauugcuaccauaguaauuaaugu

SEQ ID NO: 132606 - RNA, 64 nt, Homo Sapiens
ggaauauucucaccaucugaugccauguacccacuucagaaauaagcaauacuuguuccucugu

SEQ ID NO: 132607 - RNA, 64 nt, Homo Sapiens
agccuucaaaagaauuggcacugggauaagauuuuucagaaaaagaaaaacaucggcaaacugu

SEQ ID NO: 132608 - RNA, 64 nt, Homo Sapiens
aucgcugagcaaauggagcuugcuauguuuuaauuucagaaaauuuccucauauacguagugug

SEQ ID NO: 132609 - RNA, 64 nt, Homo Sapiens
gauauuuuuaaaauccaagagcuucucuauacuuuucagaaauauccagaugcagugaacugcc

SEQ ID NO: 132610 - RNA, 64 nt, Homo Sapiens
cuuacuuuuaaauuccaacuuaaaauuaugagguuucagaaauauauugaaaguuuaacaaugu

SEQ ID NO: 132611 - RNA, 64 nt, Homo Sapiens
aauacugcugaccaucaagcuacaagcaccucucuucagaaaacacaguguagaaucugaaguu

SEQ ID NO: 132612 - RNA, 64 nt, Homo Sapiens
uaggagauagcucuguagaaagccaaaaacuuguuucagaaagagcagaaagccagaggacuag

SEQ ID NO: 132613 - RNA, 64 nt, Homo Sapiens
ugagagagaacucuguggauauccaaagacuuguuucagaaagaacagaaagccagaggacuag

SEQ ID NO: 132614 - RNA, 64 nt, Homo Sapiens
uggaagagaguucuuuggaaaggccaagacuuguuucagaaagagcagaaagccagaggacuag

SEQ ID NO: 132615 - RNA, 64 nt, Homo Sapiens
cagauaaaugauucaaaaaguaauugugugauauuucagaaauauuuucucuagaguagaggua

SEQ ID NO: 132616 - RNA, 64 nt, Homo Sapiens
cuuucauuuugcuuuaauuuucaguaguuugcauuucagaaagcguugcugauuuuauucuuga

SEQ ID NO: 132617 - RNA, 64 nt, Homo Sapiens
caaacugagcaguuucuguguauauauagaagguagaaaugaaaagugagaaaauauuugaaag

SEQ ID NO: 132618 - RNA, 64 nt, Homo Sapiens
uaaaacagagauaugugcaugaaaucaagaaaaaagaaaugaacaaaagcaaagcauuaguggc

SEQ ID NO: 132619 - RNA, 64 nt, Homo Sapiens
ggaaaagaaaaaucaugucaucuucuauuuguacagaaaugaaaauaaaauaugaaaauaauga

SEQ ID NO: 132620 - RNA, 64 nt, Homo Sapiens
uacagaaaugaaaauaaaauaugaaaauaaugaaagaaaugaaaagauagcuuuuaauuguggu

SEQ ID NO: 132621 - RNA, 64 nt, Homo Sapiens
accaacaggaaggaauggaauauuaaaaguuagaagaaaugaguauguauuauaccuaaauguu

SEQ ID NO: 132622 - RNA, 64 nt, Homo Sapiens
cagugaguguucagaaauuagcaacaggaggaauagaaaugaagaggagaagaaauuacucccu

SEQ ID NO: 132623 - RNA, 64 nt, Homo Sapiens
guauuaagauuugugaauaauguaaacaauccaaagaaaugauugguuaccucucugaauauua

SEQ ID NO: 132624 - RNA, 64 nt, Homo Sapiens
uuugacgucuuuuuacuugauuuauaaaccagagagaaaugagugaaaacaguuuuuauucugu

SEQ ID NO: 132625 - RNA, 64 nt, Homo Sapiens
uuuuucucaucuuaaaugagcuaauagaggucuaagaaaugauaguuuuugaaaguguuccuuc

SEQ ID NO: 132626 - RNA, 64 nt, Homo Sapiens
acuguuuuugaaaguguucccuauaauucuuuaaagaaaugaugaaaagccauuguuuauuauc

SEQ ID NO: 132627 - RNA, 64 nt, Homo Sapiens
aaauaaauaaggauggugauagagagguugaagaagaaaugaagaagcaugaaaguaauaaugu

SEQ ID NO: 132628 - RNA, 64 nt, Homo Sapiens
guauuuuccagcuagaaaauuuuauggcuaucgaagaaaugaagaagcacggaaguacucaugu

SEQ ID NO: 132629 - RNA, 64 nt, Homo Sapiens
uaauaagaagcacaacuuguucacaaacucauucagaaaugauucucccaacaaugcguaucag

SEQ ID NO: 132630 - RNA, 64 nt, Homo Sapiens
uauaugauuguauuagaaaugcucagacuuccccagaaaugaaccauaaauuuuggaacuuccu

SEQ ID NO: 132631 - RNA, 64 nt, Homo Sapiens
gaaguaauaauuuguuuacuuguaaauugaugggagaaaugaggaaaagaaaaucuuuuuaaaa

SEQ ID NO: 132632 - RNA, 64 nt, Homo Sapiens
uaaaaaagaacuuuagcaugguauugaaggaauuagaaaugaauuuggagugcuuuuuauguau

SEQ ID NO: 132633 - RNA, 64 nt, Homo Sapiens
aaucaaucuuucuuaccaccuguaucacaagauaagaaaugaaaugguguuuacugcugcagca

SEQ ID NO: 132634 - RNA, 64 nt, Homo Sapiens
uugccuccuuguggauacugauuuuugauuuuacagaaaugauuaacguuuuucuucauguucu

SEQ ID NO: 132635 - RNA, 64 nt, Homo Sapiens
acugaagauucauucugauuaguauuuguuuuucagaaaugaccuuaacuuuuuaacuaaaguu

SEQ ID NO: 132636 - RNA, 64 nt, Homo Sapiens
gggaggaaaaaaccccauagaaggcaacgugaaaagaaaugauguacaaauuacucugucucca

SEQ ID NO: 132637 - RNA, 64 nt, Homo Sapiens
uugacucuucugagcaguucaaaaauauguauaaagaaaugaggugccuaugcauugaugccug

SEQ ID NO: 132638 - RNA, 64 nt, Homo Sapiens
gccggucauuugaaugagacacuguggggcuuacagaaaugacuuuggugcacagauugcugaa

SEQ ID NO: 132639 - RNA, 64 nt, Homo Sapiens
aaaaaaaacaauaucugcagcccucugaaauuaaagaaaugaaacuuuuuuuacuucgucuucg

SEQ ID NO: 132640 - RNA, 64 nt, Homo Sapiens
cuccuugcugaugcuguguuaugugucaucuaacagaaaugacuccuuugaaauaaguaaaucu

SEQ ID NO: 132641 - RNA, 64 nt, Homo Sapiens
uguuauaugcacauugccaagaauuacugucaagagaaaugauaaguaaaagucauuuaugaaa

SEQ ID NO: 132642 - RNA, 64 nt, Homo Sapiens
uacucacacaugccacaacaauuagacucuaaaaagaaaugaaguguccacgcaauggaacauu

SEQ ID NO: 132643 - RNA, 64 nt, Homo Sapiens
acguacauacacacaaaaacgguauuuacccaagagaaaugaaaacccaggaaugccacuccua

SEQ ID NO: 132644 - RNA, 64 nt, Homo Sapiens
aagagucugugggugggccucucauccuaaacagagaaaugagaugcaacagaccaacagauaa

SEQ ID NO: 132645 - RNA, 64 nt, Homo Sapiens
gagcaggggcaccccccuagucacuuacuggggaagaaaugagaucugcccuaaggauaaauga

SEQ ID NO: 132646 - RNA, 64 nt, Homo Sapiens
ucuagagaacacgucuucuaaaauacagaguuuuagaaaugagauuaaguuuuagaaaugagaa

SEQ ID NO: 132647 - RNA, 64 nt, Homo Sapiens
aaaauacagaguuuuagaaagauacuuaaguuuuagaaaugagauaguaaggucaguuugauug

SEQ ID NO: 132648 - RNA, 64 nt, Homo Sapiens
cuugucaccuguauggggaauacuuuuacuacucagaaaugaauuuaugugcugccauuugcua

SEQ ID NO: 132649 - RNA, 64 nt, Homo Sapiens
uugcuauaaaguugaacuuuguauggcuugaaaaagaaaugacaauauggaacaucccaaggcu

SEQ ID NO: 132650 - RNA, 64 nt, Homo Sapiens
uuuuuucuuaccuuuacauaguaaagagauaaaaagaaaugauuuucuacaaaucuuacagagu

SEQ ID NO: 132651 - RNA, 64 nt, Homo Sapiens
accuugcagacaaaaucucugggaacauauugauagaaaugaccaauguguucuggguguuuua

SEQ ID NO: 132652 - RNA, 64 nt, Homo Sapiens
acauuaaauacucaauaaauauuagcaaagauuaagaaaugauaauaaauacacauuuuggccu

SEQ ID NO: 132653 - RNA, 64 nt, Homo Sapiens
cagaaaaaagaagcugccaguaaucaauggauucagaaaugacucucucaagagaacugaaaca

SEQ ID NO: 132654 - RNA, 64 nt, Homo Sapiens
acguaccuaugugcauacacuuauuuuauauguuagaaaugacguguuuuaaugagaggccucc

SEQ ID NO: 132655 - RNA, 64 nt, Homo Sapiens
agucccuaagccacccccuccaaagauggaguguagaaaugaugacagcacuuaguaaguucaa

SEQ ID NO: 132656 - RNA, 64 nt, Homo Sapiens
aacugcuuuguuucauuucaaauauuuuauaguaagaaaugacagaguuucgcacuugauuuuc

SEQ ID NO: 132657 - RNA, 64 nt, Homo Sapiens
ggauaccauuaguguguauacauuccagauuuaaagaaaugaaaagaugccacacaaggaacua

SEQ ID NO: 132658 - RNA, 64 nt, Homo Sapiens
uaauuugauaugcucuaaauuuauuaacagggaaagaaaugaauauucugugaauguaccuuuu

SEQ ID NO: 132659 - RNA, 64 nt, Homo Sapiens
gcuccuggccuuaaacaucauugauacaagguugagaaaugaaucuaguccgauggauccugga

SEQ ID NO: 132660 - RNA, 64 nt, Homo Sapiens
uccaccagccaucaugggugccagccagggucccagaaaugaggccauggcucacuguuucugg

SEQ ID NO: 132661 - RNA, 64 nt, Homo Sapiens
uacaguuccaguaucaaauauuuauaaucuuaugagaaaugaaugaauguuucuauuuacaacu

SEQ ID NO: 132662 - RNA, 64 nt, Homo Sapiens
gggucuucacaauccuucacccuuucuauucuguagaaaugacaaauugcaguaacuagccuug

SEQ ID NO: 132663 - RNA, 64 nt, Homo Sapiens
uuuacuaaucaaguuaauccaauggauuuucaguagaaaugauuaucgccucuucuauauuuua

SEQ ID NO: 132664 - RNA, 64 nt, Homo Sapiens
ucugacugucuuccaguuacuguggugaaaaagaagaaaugaacuuaaauccacucccuuucua

SEQ ID NO: 132665 - RNA, 64 nt, Homo Sapiens
agccccaagggcuuaaugaccccauuuguaacugagaaaugauucuuguuuuaguaaucauucu

SEQ ID NO: 132666 - RNA, 64 nt, Homo Sapiens
agguuucucuuuugcaauagagauagauagauagagaaaugagaagauagauagauagauagau

SEQ ID NO: 132667 - RNA, 64 nt, Homo Sapiens
auaccuagcacucagaucuuaaaaacaccucagcagaaaugaauugccaaaauggcuuagacac

SEQ ID NO: 132668 - RNA, 64 nt, Homo Sapiens
caagcuaggagaaugggcuaggggaaggagcaucagaaaugaggacaggggccagaggagauau

SEQ ID NO: 132669 - RNA, 64 nt, Homo Sapiens
gcauuggaagaucauucgaauaaucagaaaaaucagaaaugauucugacuaugagaaguagaaa

SEQ ID NO: 132670 - RNA, 64 nt, Homo Sapiens
acaaacugauucaguucuaauuguaaauguagguagaaaugagugauuaaucucaacauguuga

SEQ ID NO: 132671 - RNA, 64 nt, Homo Sapiens
uauuguuuccaauuauuuauguugucuggguuugagaaaugaaaagcaugauauuuacuguuuu

SEQ ID NO: 132672 - RNA, 64 nt, Homo Sapiens
auaaucaaguaaggauguaucaguuuucagaaaaagaaaugaaccauuacucugauuuuugaua

SEQ ID NO: 132673 - RNA, 64 nt, Homo Sapiens
guccuuagucuguuucugacuucccccacuaaauagaaaugaggguuuuguuuuuuuuuuuguu

SEQ ID NO: 132674 - RNA, 64 nt, Homo Sapiens
ugguucacuugacuacugaggagaauggcagucaagaaaugagagcgaggguuaaucuucucuu

SEQ ID NO: 132675 - RNA, 64 nt, Homo Sapiens
cuguuacccauuaggggugauaacauuaaugggaagaaaugauggcaacuuugaaugcuaggug

SEQ ID NO: 132676 - RNA, 64 nt, Homo Sapiens
cuuuggaaaguaugguugaguucagauacuuauaagaaaugacuuaaacaaauccuugccuugg

SEQ ID NO: 132677 - RNA, 64 nt, Homo Sapiens
acuaaggaagauuacucaguuuuaucugaguuacagaaaugauuaacucuuauaaauuucuauu

SEQ ID NO: 132678 - RNA, 57 nt, Homo Sapiens
agacacaccugaggcugguuaugagacagaaaugagggccuggaagcugaaguuuag

SEQ ID NO: 132679 - RNA, 64 nt, Homo Sapiens
caaucaguauugcaaugaaagaaaaacuaaaaacagaaaugauauucucaauuuugggcaaugu

SEQ ID NO: 132680 - RNA, 64 nt, Homo Sapiens
uuuuaguauaaaaucuaaacuuuuuccauuuaucagaaaugauaaaauccaguuaccacauauc

SEQ ID NO: 132681 - RNA, 64 nt, Homo Sapiens
gugaguuguugagcgagaaccccuucauuugaaaagaaaugaguaugcuacuauagggagaguu

SEQ ID NO: 132682 - RNA, 64 nt, Homo Sapiens
augcuacuauagggagaguuguugcugagaauuaagaaaugauacaguuaaugcaacaaaagau

SEQ ID NO: 132683 - RNA, 64 nt, Homo Sapiens
cagagaucuugaucucucucugaggaaaaaaccuagaaaugaugguuagaaucaggagacuuga

SEQ ID NO: 132684 - RNA, 64 nt, Homo Sapiens
ugcacuccaugagugcagcugcuugaccuuuaagagaaaugagccagacaguuaagagaaauga

SEQ ID NO: 132685 - RNA, 64 nt, Homo Sapiens
uugaccuuuaagagaaaugaagcagacaguuaagagaaaugagcacugauuacaacugcuacag

SEQ ID NO: 132686 - RNA, 64 nt, Homo Sapiens
cauacuggcauggagagugaguucuaugggaucuagaaaugagaguuauuacuuucaauugaaa

SEQ ID NO: 132687 - RNA, 64 nt, Homo Sapiens
auaggacugggaauuguuuuucucagaagaagggagaaaugaucaagugccauauauaauuagu

SEQ ID NO: 132688 - RNA, 64 nt, Homo Sapiens
ugacagauaaacaguaacucuuuuggggggugggagaaaugaacucugccagacugagggugcu

SEQ ID NO: 132689 - RNA, 64 nt, Homo Sapiens
aagucugcuaccucuucaucauucaccuuacaauagaaaugaacacaaugcuguugacagugga

SEQ ID NO: 132690 - RNA, 64 nt, Homo Sapiens
gucuguaugauucuggaacaaauggggaguguagagaaaugagaaugaucugaagaaaugaugg

SEQ ID NO: 132691 - RNA, 55 nt, Homo Sapiens
gaauggggaguguagagaaaucugaagaaaugaugagcaaauucaguuuucauga

SEQ ID NO: 132692 - RNA, 64 nt, Homo Sapiens
uccaaugauguuguagcugggauacuuuuuggcgagaaaugacuccaccagaauuugcugugga

SEQ ID NO: 132693 - RNA, 64 nt, Homo Sapiens
uggauaauccacauaaacaaggcuuugucuaccaagaaaugaaugucuuuuauucaaaauaaca

SEQ ID NO: 132694 - RNA, 64 nt, Homo Sapiens
cuuggagucaagagaucuggcuguaagaaaugaaagaaaugacugaaaucuggaagugugagau

SEQ ID NO: 132695 - RNA, 64 nt, Homo Sapiens
gaaaugacucuuggagucaagugugagaucuguaagaaaugaaaugcuaaagagaaaucuggaa

SEQ ID NO: 132696 - RNA, 64 nt, Homo Sapiens
cagaggaaggaaacauagaagguuagcccaauggagaaaugaaggugcagacaauucucccuga

SEQ ID NO: 132697 - RNA, 64 nt, Homo Sapiens
uugacaagcuaggaaagagggagagugguaaaaaagaaaugaaauuaauuucuaggcaggugga

SEQ ID NO: 132698 - RNA, 64 nt, Homo Sapiens
uuagagaaucagacaggcgaagccuccaccaccaagaaaugaaccagugacuccagaagaaaug

SEQ ID NO: 132699 - RNA, 64 nt, Homo Sapiens
cuccaccaccaagaaaugaaucagugacuccagaagaaaugagccgaaagauaucccaaaaauu

SEQ ID NO: 132700 - RNA, 64 nt, Homo Sapiens
aaagaaaaugaugaaaagaggaucccucuaagaaagaaaugaaggaaccuuucagguaaaaggu

SEQ ID NO: 132701 - RNA, 64 nt, Homo Sapiens
uguuuucuauuuucuuuucaaggucacuaaagggagaaaugacaccagguaauugaaugaagaa

SEQ ID NO: 132702 - RNA, 64 nt, Homo Sapiens
uuagaaugacuaguguucuucuuacugaagaauaagaaaugagcggcuuauauuuaauuaaagc

SEQ ID NO: 132703 - RNA, 64 nt, Homo Sapiens
guaaauacauauaugcagugcuuguuguccaaauagaaaugaaaauaaguggaagagagaggaa

SEQ ID NO: 132704 - RNA, 64 nt, Homo Sapiens
uggggguuucauuuuccauuccucagcacagagcagaaaugauagauuuuuauuguuuggagua

SEQ ID NO: 132705 - RNA, 64 nt, Homo Sapiens
cuuucacugagauuugugugugaguuuuuuuuuaagaaaugagguuuaaguuguuaagcaaaug

SEQ ID NO: 132706 - RNA, 64 nt, Homo Sapiens
gauaagcaucgcacauguccgaaauguuuucagcagaaaugaagugacucugagggcgauuucg

SEQ ID NO: 132707 - RNA, 64 nt, Homo Sapiens
agcaagacuccaucucaaaaaaaaaaaaagaaaaagaaaugaauggguucaaagaccauaauca

SEQ ID NO: 132708 - RNA, 64 nt, Homo Sapiens
ugucacauacccaugugacccgauaggaggcaaaagaaaugagacuucugggauuaguuuagcc

SEQ ID NO: 132709 - RNA, 64 nt, Homo Sapiens
gugcugaugagauucaugcuaccuaaaaauuaacagaaaugacacugugaacaauguaguugga

SEQ ID NO: 132710 - RNA, 64 nt, Homo Sapiens
ggaagccuggucuaagaagauacugucuuucaauagaaaugauuucuaaacugcuacagauuaa

SEQ ID NO: 132711 - RNA, 64 nt, Homo Sapiens
cacugguggugagaggcggaauccaaaaaaauucagaaaugacuuggccucauuuuggauuuca

SEQ ID NO: 132712 - RNA, 64 nt, Homo Sapiens
auguuugguuuuaugugcagcaccuugacuucuaagaaaugaaucaugucccuuugccccuuau

SEQ ID NO: 132713 - RNA, 64 nt, Homo Sapiens; identical to SEQ ID NO: 44480

SEQ ID NO: 132714 - RNA, 64 nt, Homo Sapiens; identical to SEQ ID NO: 44481

SEQ ID NO: 132715 - RNA, 64 nt, Homo Sapiens; identical to SEQ ID NO: 44482

SEQ ID NO: 132716 - RNA, 64 nt, Homo Sapiens; identical to SEQ ID NO: 44483

SEQ ID NO: 132717 - RNA, 64 nt, Homo Sapiens; identical to SEQ ID NO: 44484

SEQ ID NO: 132718 - RNA, 64 nt, Homo Sapiens; identical to SEQ ID NO: 44485

SEQ ID NO: 132719 - RNA, 64 nt, Homo Sapiens; identical to SEQ ID NO: 44486

SEQ ID NO: 132720 - RNA, 64 nt, Homo Sapiens; identical to SEQ ID NO: 44487

SEQ ID NO: 132721 - RNA, 64 nt, Homo Sapiens; identical to SEQ ID NO: 44488

SEQ ID NO: 132722 - RNA, 64 nt, Homo Sapiens; identical to SEQ ID NO: 44489

SEQ ID NO: 132723 - RNA, 64 nt, Homo Sapiens; identical to SEQ ID NO: 44490

SEQ ID NO: 132724 - RNA, 64 nt, Homo Sapiens; identical to SEQ ID NO: 44491

SEQ ID NO: 132725 - RNA, 64 nt, Homo Sapiens; identical to SEQ ID NO: 44492

SEQ ID NO: 132726 - RNA, 64 nt, Homo Sapiens; identical to SEQ ID NO: 44493

SEQ ID NO: 132727 - RNA, 64 nt, Homo Sapiens; identical to SEQ ID NO: 44494

SEQ ID NO: 132728 - RNA, 64 nt, Homo Sapiens; identical to SEQ ID NO: 44495

SEQ ID NO: 132729 - RNA, 64 nt, Homo Sapiens; identical to SEQ ID NO: 44496

SEQ ID NO: 132730 - RNA, 64 nt, Homo Sapiens; identical to SEQ ID NO: 44497

SEQ ID NO: 132731 - RNA, 64 nt, Homo Sapiens; identical to SEQ ID NO: 44498

SEQ ID NO: 132732 - RNA, 64 nt, Homo Sapiens; identical to SEQ ID NO: 44499

SEQ ID NO: 132733 - RNA, 64 nt, Homo Sapiens
gcaaauucgcaaacuuucuuggauggcuuugaaugcggcccaaccgaggcccgcaugcggccca

SEQ ID NO: 132734 - RNA, 64 nt, Homo Sapiens
auggcuuugaaugcggcccacccgaggcccgcaugcggcccaggauuagaccaagcuuguccaa

SEQ ID NO: 132735 - RNA, 64 nt, Homo Sapiens
cuuagccaacuugaccccucucaucccacucccggcggcccaggcacagaagggcagggccaua

SEQ ID NO: 132736 - RNA, 64 nt, Homo Sapiens
cuuuccauccacucaccuuaccccauagcaucuugcggcccagaaaccagagccauuugucuca

SEQ ID NO: 132737 - RNA, 64 nt, Homo Sapiens
cuggggcagggggugaagaacugaaugucaaacagugccaaaugugguccucccauuucuaaag

SEQ ID NO: 132738 - RNA, 64 nt, Homo Sapiens
caggccucugcugccgcccuggccacacgcacuggugccaaaacccagugggaugggacaggga

SEQ ID NO: 132739 - RNA, 64 nt, Homo Sapiens
accaaucgcaugguucuccuggcaggccugcugugugccaaaaacucccacccaaggucccuca

SEQ ID NO: 132740 - RNA, 64 nt, Homo Sapiens
uuucucuuucccauauuccuuuucuuuuucucuugugccaaacugacagaaaccgucaccacac

SEQ ID NO: 132741 - RNA, 64 nt, Homo Sapiens
uauaaugcaucuaaaccaccuguccccaguuaaugugccaaaaugucaauuuuuaacuuaucuc

SEQ ID NO: 132742 - RNA, 64 nt, Homo Sapiens
aaccugugcuuucauguuuaagaaaugagaaauugugccaaagauagcagaagaguagauaagu

SEQ ID NO: 132743 - RNA, 64 nt, Homo Sapiens
aaaugaaacaagccgucuuaucuuacuuuacuucgugccaaaucgucuuccauggcauauuuac

SEQ ID NO: 132744 - RNA, 64 nt, Homo Sapiens
auucggauacuaagaugcauuggauacuaaggaugugccaaauguauuucuacugauuuuauuu

SEQ ID NO: 132745 - RNA, 64 nt, Homo Sapiens
ccuaagugccguucgggggcgaggaguccuuuuugugccaaaucugugguagcaaaaggaggga

SEQ ID NO: 132746 - RNA, 64 nt, Homo Sapiens
gcaggccggccagggcugggaaguucaccugcaggugccaaagagaugucaggucaggagcugg

SEQ ID NO: 132747 - RNA, 64 nt, Homo Sapiens
uuagucccaugaucugucccgagaauguuuccaugugccaaauccagcuuuggccauauuucag

SEQ ID NO: 132748 - RNA, 64 nt, Homo Sapiens
acuuguguacuaauuucuauuguaacugaacuuggugccaaaguuaagcacagccucccgggua

SEQ ID NO: 132749 - RNA, 64 nt, Homo Sapiens
cacuacaccauauaauugcauucauuacaaugaagugccaaacuaggacugugccauuggaaau

SEQ ID NO: 132750 - RNA, 64 nt, Homo Sapiens
gccuuuuccccaggccucagagcauugcucauccgugccaaacuggguagguggauuugagcgg

SEQ ID NO: 132751 - RNA, 64 nt, Homo Sapiens
gaguccucaucugcuggcauuuugugggguguuagugccaaacuugaauaggggcuggggugcu

SEQ ID NO: 132752 - RNA, 64 nt, Homo Sapiens
ccccguggcucccggucuccugugggccugcugugugccaaaccugagcuaccugcacccgagc

SEQ ID NO: 132753 - RNA, 64 nt, Homo Sapiens
caagcaaucauguuugcguccccguccgucacaugugccaaaucccuggcaggcagauggcucc

SEQ ID NO: 132754 - RNA, 64 nt, Homo Sapiens
gccucugagucccguggggccccggcucccaccggugccaaacccagccccugcggccgucacc

SEQ ID NO: 132755 - RNA, 64 nt, Homo Sapiens
cagccaggagugcggacaccauguucccagcucagugccaaagaggggucaccagggggagcug

SEQ ID NO: 132756 - RNA, 64 nt, Homo Sapiens
cugaggaaauguuuucuuucuuuguacuuacauugugccaaagguuugguaaaaggccuacagc

SEQ ID NO: 132757 - RNA, 64 nt, Homo Sapiens
ccccaugggagugggagggacgggccacaccucagugccaaagaauguggccgggcugcagagc

SEQ ID NO: 132758 - RNA, 64 nt, Homo Sapiens
gcaacaccacgucuaaagcaguucauuuacucuugugccaaaugcugagguccacaucauggca

SEQ ID NO: 132759 - RNA, 64 nt, Homo Sapiens
guauaggaacaacuguacuugguaaaaaacuagugugccaaauguucaaaggguauauauaaaa

SEQ ID NO: 132760 - RNA, 64 nt, Homo Sapiens
auuuucaguuguacuguagaaguauuauagguuggugccaaaaugcuuuauauuaaauucuuuu

SEQ ID NO: 132761 - RNA, 64 nt, Homo Sapiens
ucaggaugcucauaacuuuguaugucugacccaagugccaaaggcagacgugcuuuauagcuaa

SEQ ID NO: 132762 - RNA, 64 nt, Homo Sapiens
augauguagagcuauuaagggaguauuuucacuugugccaaagaggguaagcguuuauuagccu

SEQ ID NO: 132763 - RNA, 64 nt, Homo Sapiens
ugucuuauuuuaggaugcaguuuucuacuugccagcagaguaucuaaaaaaugaaauuagucua

SEQ ID NO: 132764 - RNA, 64 nt, Homo Sapiens
ggaaaguauguaccaaaacaaaaaaauacacauagcagaguaucauaccauguauucacacuuu

SEQ ID NO: 132765 - RNA, 64 nt, Homo Sapiens
ugcagaggcagaccauuccuuaguaucucacaaagcagaguaauacuggaggcagaguaggggg

SEQ ID NO: 132766 - RNA, 64 nt, Homo Sapiens
ccuuaguaucucacaaagcagaguaauacuggaggcagaguagggggugguuggagagcaguua

SEQ ID NO: 132767 - RNA, 64 nt, Homo Sapiens
gaggcuugcugaacauggauaucuacauuauaccgcagaguauuugaagucacacuguaaccuc

SEQ ID NO: 132768 - RNA, 64 nt, Homo Sapiens
uucugggaugugguauuggugcuuugugucuagggcagaguauguucuugaagaaaggcaaauc

SEQ ID NO: 132769 - RNA, 64 nt, Homo Sapiens
uuuucuacaacacagaguacugacucugccugguuccugagagaggcuccuaagucacagaccu

SEQ ID NO: 132770 - RNA, 64 nt, Homo Sapiens
ugaagacagcguccuggcuccaguuggaacacuuuccugagaugcacuuacuucucagcuucug

SEQ ID NO: 132771 - RNA, 64 nt, Homo Sapiens
gaaaucaccuucucaagggagccuugucuaauguuccugagacuauuucacacucuccaugcuu

SEQ ID NO: 132772 - RNA, 64 nt, Homo Sapiens
uguguggcauacaguuccuaguuaagaucccaaauccugagauauugcugauuugcuauggcag

SEQ ID NO: 132773 - RNA, 64 nt, Homo Sapiens
uaggaaauauauguguguggugacacagcaccauuccugagaaauccgauuuugugcauaguaa

SEQ ID NO: 132774 - RNA, 64 nt, Homo Sapiens
uaguggauaccauguauccuaacuacuucugaacuccugagaucaaacucugaguuuauaaaau

SEQ ID NO: 132775 - RNA, 64 nt, Homo Sapiens
ucuucuuaaacucugaguuuuguugccugacacguccugagaaagggguucugugcguguacca

SEQ ID NO: 132776 - RNA, 64 nt, Homo Sapiens
cugcaaagucucugaagagaugagaauggcuuaguccugagaauuuccauuuuugauucauucc

SEQ ID NO: 132777 - RNA, 64 nt, Homo Sapiens
ggcuuaguccugagaaucugcauuuuugauucauuccugagaauccccagagagccaucucuuc

SEQ ID NO: 132778 - RNA, 64 nt, Homo Sapiens
gacuuugucuuagaacuuagauuagucugaaauuuccugagaguuaccagggaacauagcauaa

SEQ ID NO: 132779 - RNA, 64 nt, Homo Sapiens
gauggaccagacugccacagauuuaaaaacacaguccugagaggcuauuuguauuauuuuaugc

SEQ ID NO: 132780 - RNA, 64 nt, Homo Sapiens
acgguucucuccuagccucaacaagcagugggacuccugagaacuaacuuccccacuccacccu

SEQ ID NO: 132781 - RNA, 64 nt, Homo Sapiens
ggagaggcagggaucagaggucagacucugggacuccugagaugacauggagccccucccuugg

SEQ ID NO: 132782 - RNA, 64 nt, Homo Sapiens
gaguaggaagacucaaacacgauauuacccaaguuccugagacuagagaaguguauaagucuga

SEQ ID NO: 132783 - RNA, 64 nt, Homo Sapiens
uauccaguccaauauaaguaugaaggauucucucuccugagauuguagcaggcagccaaacauu

SEQ ID NO: 132784 - RNA, 64 nt, Homo Sapiens
gacuugucauuuuuuuuccuucaucuaugagggguccugagaaaccuggggagcagaauucuug

SEQ ID NO: 132785 - RNA, 64 nt, Homo Sapiens
cuuugaccuugaagggcuucucgacagccacaaguccugagaagguccaucagcucagcagagc

SEQ ID NO: 132786 - RNA, 64 nt, Homo Sapiens
uugucuucagaugagaauggagucugaauggccuuccugagagcgagugcgacccguuccuuug

SEQ ID NO: 132787 - RNA, 64 nt, Homo Sapiens
cacccuuucccaccuggugccuaugcuaggcuuguccugagaacaucccucaguaacuugauau

SEQ ID NO: 132788 - RNA, 64 nt, Homo Sapiens
caguguguucuaaugggauugcagcuuuuucucuuccugagaaacugagaacuuuucuuguaau

SEQ ID NO: 132789 - RNA, 64 nt, Homo Sapiens
uuuucuuguaaugcagcuuuaagaacuccuaaaguccugagaacagcucugaaauaacaguccu

SEQ ID NO: 132790 - RNA, 64 nt, Homo Sapiens
ccugcagacaccagcucuccuuccugccuuuagauccugagaaggagggaaaugaggggugcug

SEQ ID NO: 132791 - RNA, 64 nt, Homo Sapiens
cccugucuucucugauucuuuucccucaaaauaguccugagaacuaauugucacacuggcucau

SEQ ID NO: 132792 - RNA, 64 nt, Homo Sapiens
uccuuguacuugauccuccugaaaugagagauuuuccugagaugacugaguauggagauuacca

SEQ ID NO: 132793 - RNA, 64 nt, Homo Sapiens
caacaaguucuuguugacucagggcauaaugaguuccugagacaugcucuuuugggggcugggg

SEQ ID NO: 132794 - RNA, 64 nt, Homo Sapiens
gaaauuccacgaagaaaauccugauuccaagauguccugagaucuugugguuccaugagaauua

SEQ ID NO: 132795 - RNA, 64 nt, Homo Sapiens
gagaguacugucuuaggaauuauuaggaguugauuccugagaaacaacacauuuuuccccauga

SEQ ID NO: 132796 - RNA, 64 nt, Homo Sapiens
ccuggcacccaguccacuggcaguggaauugcuuuccugagaaucauucugaggcugggcuauu

SEQ ID NO: 132797 - RNA, 64 nt, Homo Sapiens
cagaucaccaggucaagcaccuaggccuggcuucuccugagacagaggacucagaaguggccuu

SEQ ID NO: 132798 - RNA, 64 nt, Homo Sapiens
ugcuuauuuccugggugccuggcucuaggcuauguccugagacauacaguggacagggucucua

SEQ ID NO: 132799 - RNA, 64 nt, Homo Sapiens
ugucuuuuaucaauacaaugauaagacaccuuaauccugagagagaaaauuaaguacuguauau

SEQ ID NO: 132800 - RNA, 64 nt, Homo Sapiens
gccaagcugcacaauuuaauauauucaagaguggggggaggaagcagaggucuucagggcucuu

SEQ ID NO: 132801 - RNA, 64 nt, Homo Sapiens
uccugucuggcuucuagagaugugccugugggagggggaggaaguuggcugagccauugagugc

SEQ ID NO: 132802 - RNA, 64 nt, Homo Sapiens
uucucuggcuuccuuggcuugccuggugggggaaggggaggaggggaagaaggaaagggaagag

SEQ ID NO: 132803 - RNA, 64 nt, Homo Sapiens
gcaacugugaacagagaggucgggauuugcccugggggaggaagagaggccaaguucagagcuc

SEQ ID NO: 132804 - RNA, 64 nt, Homo Sapiens
gccaggaaucuaaagcuuuggguuuucugaggggggggaggagggaacuggagguuauuggggu

SEQ ID NO: 132805 - RNA, 64 nt, Homo Sapiens
gacaggauaaagggcagaugagugugacagcacuggggaggagaccaccacucugcuuugccca

SEQ ID NO: 132806 - RNA, 64 nt, Homo Sapiens
cacagcuagcugcacaguucacaacugcagcaguggggaggaggccacgggcacagggagaggg

SEQ ID NO: 132807 - RNA, 64 nt, Homo Sapiens
uagaccccggguacugcgggaggggagggcugcuggggaggauggggggauguuauauaaauau

SEQ ID NO: 132808 - RNA, 64 nt, Homo Sapiens
uccaaccccuggggaagacauuugcaacugacuuggggaggacacagcuucagcacagccucuc

SEQ ID NO: 132809 - RNA, 64 nt, Homo Sapiens
agguugcccuguucaggggacagaugcaagcuguggggaggacucugccuguguccuguguucc

SEQ ID NO: 132810 - RNA, 64 nt, Homo Sapiens
gugcccugggcuugccaccagcucugcccuggcuggggaggacacucggugccccacacccagu

SEQ ID NO: 132811 - RNA, 64 nt, Homo Sapiens
gcaggcgcacgagguccaggcacuggccccaugaggggaggaaguagacagacaggccugggga

SEQ ID NO: 132812 - RNA, 64 nt, Homo Sapiens
agacuggaaccuuucuuugaaaagcagggcacauggggaggaagccugcccugacccaccuggc

SEQ ID NO: 132813 - RNA, 64 nt, Homo Sapiens
agagggcugaagggagaggggccagagucgauguggggaggaaccaguaagauggaugguuccg

SEQ ID NO: 132814 - RNA, 64 nt, Homo Sapiens
ggcugaaaaaaaaaagugggcagcagccucugugggggaggauaaauucaauuuguaaguagcg

SEQ ID NO: 132815 - RNA, 64 nt, Homo Sapiens
cauguucuggcagcaacuucacuuuuccuaaggaggggaggaggcagcagggaagcaacccugg

SEQ ID NO: 132816 - RNA, 64 nt, Homo Sapiens
gguuuucagaagguccuucugauggcuaggcuaaggggaggaagaauuccugccaugccccagc

SEQ ID NO: 132817 - RNA, 64 nt, Homo Sapiens
uuauuuaaacagugguucuagaguaccuuugggaggggaggacucugcuguaguuggggagcag

SEQ ID NO: 132818 - RNA, 64 nt, Homo Sapiens
aggcuggaggccaggacacuggaaaagguuuucuggggaggaggugaugacugagaacaggcuu

SEQ ID NO: 132819 - RNA, 64 nt, Homo Sapiens
gagugcagagcuccaggaaagaggggauuaaagaggggaggagaagcagaagggaggggagaca

SEQ ID NO: 132820 - RNA, 64 nt, Homo Sapiens
aggacuaaaugaaaaguugucuggggagcacagaggggaggagggccaucaccaguuucucagg

SEQ ID NO: 132821 - RNA, 64 nt, Homo Sapiens
cccacuuuucuaccaguaaaagacauagaccaauggggaggaggggaggagagauggauauuuc

SEQ ID NO: 132822 - RNA, 64 nt, Homo Sapiens
ucuaccaguaaaagacauagaccaauggggaggaggggaggagagauggauauuucagcccucu

SEQ ID NO: 132823 - RNA, 64 nt, Homo Sapiens
auacaaauggggcagugugcaugcaacacacuuaggggaggaguggccccagaauucagcacgc

SEQ ID NO: 132824 - RNA, 64 nt, Homo Sapiens
cugcuuccuuucaaugugucagugccuggggggaggggaggagcacccccucagccccccugaa

SEQ ID NO: 132825 - RNA, 64 nt, Homo Sapiens
uugcccccucugcagccggaggaggagauguugaggggaggaggccagccagugugaccggcgc

SEQ ID NO: 132826 - RNA, 64 nt, Homo Sapiens
caguguccacccuccggcccccgucuuguaaaaaggggaggagaauuagccaaacacuguaagc

SEQ ID NO: 132827 - RNA, 64 nt, Homo Sapiens
ucuccccugugccguaguuugucuccugggacugggggaggaguccgaggugggguugguuacc

SEQ ID NO: 132828 - RNA, 64 nt, Homo Sapiens
cggccugauggcucugugcaguaccugguugaguggggaggagggggcaucuucugaacagccu

SEQ ID NO: 132829 - RNA, 64 nt, Homo Sapiens
uuacacacacguugacgggccgcaggagggaggcggggaggaggaacgggcagccacaggacug

SEQ ID NO: 132830 - RNA, 64 nt, Homo Sapiens
ccaucacucacucacuccccacucccccacccauggggaggagaccuuugaugaauucuuccuc

SEQ ID NO: 132831 - RNA, 64 nt, Homo Sapiens
ucccggcugggaugaagucuggaggacucgggugggggaggacgcaaaguaggagaagaaaugg

SEQ ID NO: 132832 - RNA, 64 nt, Homo Sapiens
cgggugggggaggacgucccguaggagaagaaauggggaggacuacaccuggaacugcggcaaa

SEQ ID NO: 132833 - RNA, 64 nt, Homo Sapiens
cucugucuccaccccaugggcccacacccaggugggggaggaggaagccacugcaucuguuggc

SEQ ID NO: 132834 - RNA, 64 nt, Homo Sapiens
ggagaggcaagaacugggggaacacaggaaccuaggggaggaggggagcgcugggcauccucag

SEQ ID NO: 132835 - RNA, 64 nt, Homo Sapiens
gaggaagcugcuccaauggaugggggagaagccuggggaggagggggaggaagacaagaaggaa

SEQ ID NO: 132836 - RNA, 64 nt, Homo Sapiens
gcuccaauggaugggggagaagccuggggaggagggggaggaagacaagaaggaagaggaggag

SEQ ID NO: 132837 - RNA, 64 nt, Homo Sapiens
ccaaguucacugggcuccacccccaccuccaggaggggaggagaggaccugacaucuguaggug

SEQ ID NO: 132838 - RNA, 64 nt, Homo Sapiens
ugucaccuccaucucagucuuggccuggcuaugaggggaggaggaaugggagagggggcucagg

SEQ ID NO: 132839 - RNA, 64 nt, Homo Sapiens
gagggucuccaguguuccccgcagguaucaacuaggggaggagaaacagacagggagaaguuga

SEQ ID NO: 132840 - RNA, 64 nt, Homo Sapiens
uucgggauucccuggugggcaagccugcagguccggggaggagggcucucucuccuggagucug

SEQ ID NO: 132841 - RNA, 64 nt, Homo Sapiens
gcagucugcccuugggagcgcucuguugggggauggggaggagaagugcuuagagcacaggccc

SEQ ID NO: 132842 - RNA, 64 nt, Homo Sapiens
caaggaauucuguggcuguguggggauuucaacaggggaggagccggguguucgacaccagacg

SEQ ID NO: 132843 - RNA, 64 nt, Homo Sapiens
caaggagcuggagacuucagggagccccucucauggggaggaaagagcuuccagggggcgaacg

SEQ ID NO: 132844 - RNA, 64 nt, Homo Sapiens
aaaaggaugugucauuggucaugauauuugaaaaggggaggaggccgaaguuguucccauuuau

SEQ ID NO: 132845 - RNA, 58 nt, Homo Sapiens
agggcaaggccaagaagugaaggccggcggggaggauacuguccccaggagcacccuc

SEQ ID NO: 132846 - RNA, 64 nt, Homo Sapiens
gguuuuugcgagugcuuuguuuacuaaggacuuuggggaggaaccaugcuaagccaugaccagu

SEQ ID NO: 132847 - RNA, 64 nt, Homo Sapiens
ggagggggcagaggcaaaucaccgggcagagggaggggaggagaggaggccgcacucucccugu

SEQ ID NO: 132848 - RNA, 64 nt, Homo Sapiens
agagggcuccagguucugggccccuggcugagaaggggaggauccuguccuggcuguagccuuc

SEQ ID NO: 132849 - RNA, 64 nt, Homo Sapiens
cgggccacgaaaggaaagaaugacacccgcgcguggggaggacugggaucacggcccaggcugc

SEQ ID NO: 132850 - RNA, 64 nt, Homo Sapiens
ccagggagaggcgggaucacgagggagagggggaggggaggaguggagggcgagcgagggagag

SEQ ID NO: 132851 - RNA, 64 nt, Homo Sapiens
aguccugaaacugcaggaccaguuucucugccaaggggaggaguuggagagcacaguugccccg

SEQ ID NO: 132852 - RNA, 64 nt, Homo Sapiens
ucacuuuucugugccuuccugaggggguugggccggggaggaaacccaacccucuccugugugu

SEQ ID NO: 132853 - RNA, 64 nt, Homo Sapiens
guauguuucuuauuguaugucuauauauguauguggggaggacaggagugaauguucacacacu

SEQ ID NO: 132854 - RNA, 64 nt, Homo Sapiens
aucucucagccugcuuucucaucuguaaaaaaggggggaggauaacuuucacaggguaauuggu

SEQ ID NO: 132855 - RNA, 64 nt, Homo Sapiens
ggcuuuggguuccuguguuuguggggaggauuguggggaggaggcauuucuucccauaauguga

SEQ ID NO: 132856 - RNA, 64 nt, Homo Sapiens
guggggaggaggggcuuuggcccauaaugugaguggggaggauuuccauuuagugacauuucuu

SEQ ID NO: 132857 - RNA, 64 nt, Homo Sapiens
gagaauggauuuauagcuaccuagggaagguaugggggaggaaaccugcccuucuaucugggag

SEQ ID NO: 132858 - RNA, 64 nt, Homo Sapiens
gacagguccucggcaauaaagugccaaaagcuugggggaggaggagaagcuuauucagggcuga

SEQ ID NO: 132859 - RNA, 64 nt, Homo Sapiens
caaucgcuguagcugccaggggcuggauguucugggggaggagggaggugugauugggcccucc

SEQ ID NO: 132860 - RNA, 64 nt, Homo Sapiens
gaccccuuagguauacccuggaagagcuggggugggggaggagggagcgugaagguagugacuc

SEQ ID NO: 132861 - RNA, 64 nt, Homo Sapiens
ugacuccugaacacacccagguggaaccaucuuuggggaggagaggcccgugugaggggucuga

SEQ ID NO: 132862 - RNA, 64 nt, Homo Sapiens
ccggcacugaggaugcuguucucaguuugacuguggggaggagagagaaugggguacuagcacc

SEQ ID NO: 132863 - RNA, 64 nt, Homo Sapiens
ggcagagagaggagacgaagaguuugggacagugggggaggagaugggaagggaugggauuucu

SEQ ID NO: 132864 - RNA, 64 nt, Homo Sapiens
gcacaugccacgcuggguguccacaggcugaacgggggaggaaugucaggcugcugaggaaaca

SEQ ID NO: 132865 - RNA, 64 nt, Homo Sapiens
cggucaggcugcugaggaaagucaggagagaaugggggaggagggcuaucgagauagccagagg

SEQ ID NO: 132866 - RNA, 64 nt, Homo Sapiens
agcagugccuucccucucgucauggggaggauugggggaggagaacacucuagguugcuggguc

SEQ ID NO: 132867 - RNA, 64 nt, Homo Sapiens
gggggaggagaagcagugccguugcuggguccauggggaggauuugccuacugggacacucuag

SEQ ID NO: 132868 - RNA, 64 nt, Homo Sapiens
uggugguaucggugucgagggagaggaggggguuggggaggacccaccucuccagaauggcgac

SEQ ID NO: 132869 - RNA, 64 nt, Homo Sapiens
agcacuaagggcugaggucaauaccgcagaccuuggggaggaagcugagcaucccccgggaugu

SEQ ID NO: 132870 - RNA, 64 nt, Homo Sapiens
uccagagggucuucagaagccccccugggagggaggggaggaugagcacgcccagcuccccucc

SEQ ID NO: 132871 - RNA, 64 nt, Homo Sapiens
uggcggagggagggaagaggagggagugacgggaggggaggaggucagcgaccuggggccguag

SEQ ID NO: 132872 - RNA, 64 nt, Homo Sapiens
agcccauggucgggacagugcccuggccuuugccggggaggaggaugcucugagauucagggug

SEQ ID NO: 132873 - RNA, 64 nt, Homo Sapiens
gcauuguccccgucuuucccaucgccuagcguuuggggaggaacagggagagagcuucggggcg

SEQ ID NO: 132874 - RNA, 64 nt, Homo Sapiens
agaccugugaagcuacagacugacagccagggcaggggaggagggaggggcgccagcaccugau

SEQ ID NO: 132875 - RNA, 64 nt, Homo Sapiens
aaccacccugggcccagaaacagaggccugccgaggggaggagccuggccucuguccacccguc

SEQ ID NO: 132876 - RNA, 64 nt, Homo Sapiens
ccgggaaucaaagcgaguccugagaaccagcuuuggggaggagggcagcagacucccucagcca

SEQ ID NO: 132877 - RNA, 64 nt, Homo Sapiens
gggugggugugcgcgcaaggcgcucagccccggcggggaggagcccccagcccucagggagcuc

SEQ ID NO: 132878 - RNA, 64 nt, Homo Sapiens
uguagggugaaauggcaauuauucucuccaugcuggggaggaggggaggagggucucagacagc

SEQ ID NO: 132879 - RNA, 64 nt, Homo Sapiens
gaaauggcaauuauucucuccaugcuggggaggaggggaggagggucucagacagcuuucgugc

SEQ ID NO: 132880 - RNA, 64 nt, Homo Sapiens
cggggggacgccugucacccgaaaggucacagcuggggaggaagagcuucgguaugccuucagg

SEQ ID NO: 132881 - RNA, 64 nt, Homo Sapiens
gacccacacaagcccccucgccacccugccugcuggggaggaggaccagccagagcacaggaag

SEQ ID NO: 132882 - RNA, 64 nt, Homo Sapiens
gcuaccaaggaagagagcacacagauaagacagaggggaggaggugggcauuuccuacauuccu

SEQ ID NO: 132883 - RNA, 64 nt, Homo Sapiens
aguauuuauugcaauguaaauguauccugaagguggggaggaauguuuaaucuaccauguccgu

SEQ ID NO: 132884 - RNA, 64 nt, Homo Sapiens
ggagaaagggaggaagcuggucagagcagugcagggggaggagagcagggcugcuccaggcagg

SEQ ID NO: 132885 - RNA, 64 nt, Homo Sapiens
cagaggccaucugcagggccagggcagggggcuaggggaggacugggugucggguagagggaag

SEQ ID NO: 132886 - RNA, 64 nt, Homo Sapiens
uuaugaucccugggcgcuucaccccaggaagugcggggaggaggccaaacaucuuggcaucccc

SEQ ID NO: 132887 - RNA, 64 nt, Homo Sapiens
gucucaagugaacagugggaguccccaccugaguggggaggagcgcccugcgaguguguccccu

SEQ ID NO: 132888 - RNA, 64 nt, Homo Sapiens
ugguggcgauccgcaaccuggggccaugcggccuggggaggacugagcagcaguggaagaccuc

SEQ ID NO: 132889 - RNA, 64 nt, Homo Sapiens
agugggagggagggcuggggcugggaagggaguuggggaggaagacuccccucuccacugaugg

SEQ ID NO: 132890 - RNA, 64 nt, Homo Sapiens
guuuuguuucacugugcagagauuucucuguaagggcaacgaacgugcuggcaucaaagaauau

SEQ ID NO: 132891 - RNA, 64 nt, Homo Sapiens
ucccaaacagcccggaguauuugcagaaggcucaggcaacgagugggccacaucucacuucugc

SEQ ID NO: 132892 - RNA, 64 nt, Homo Sapiens
gugagcugagauggcaccacugcacuccggccuaggcaacgagagcaaaacuccaauacaaaca

SEQ ID NO: 132893 - RNA, 64 nt, Homo Sapiens
aaaaaaaauaacacagagaggucgggggcugaggggcaacgaagaaacauuuugaagagagacc

SEQ ID NO: 132894 - RNA, 61 nt, Homo Sapiens
gauggggccuuaaauuggaugaaugaagaauggcaacgaaauccaaguucguccuuuguag

SEQ ID NO: 132895 - RNA, 64 nt, Homo Sapiens
uccuuagcacuggcagcuccguggagagaggagaggcaacgaagacucugacugcggagaguga

SEQ ID NO: 132896 - RNA, 52 nt, Homo Sapiens
acggccgaggggagcagugaggggcaacgaggcggcugggaugccgcccuca

SEQ ID NO: 132897 - RNA, 64 nt, Homo Sapiens
gaaacuccgucucaaaaaaaugcacuccagccugggcaacgagugugagccgagauugcgccau

SEQ ID NO: 132898 - RNA, 64 nt, Homo Sapiens
uauauaauaauagcauuuuauguaauaaaauaugggcaacgauuaucuuggaaauuaaagaguc

SEQ ID NO: 132899 - RNA, 64 nt, Homo Sapiens
gugagccaagauugugccauugcacuccagccugggcaacgagcgaaacuacaucucaaaaaaa

SEQ ID NO: 132900 - RNA, 64 nt, Homo Sapiens
aguuccugaauggugcuaaggaucugcagcaguuggcaacgagcuggggcugggggcggccucc

SEQ ID NO: 132901 - RNA, 64 nt, Homo Sapiens
ucaaauguaauuuauuuuaauguauguacauacuggcaacgauguguccuggcaucgcgcacac

SEQ ID NO: 132902 - RNA, 64 nt, Homo Sapiens
cccccaucagcugcccggaccugcuugcuacacaggcaacgauuaacaaaagucaucaccuuuu

SEQ ID NO: 132903 - RNA, 64 nt, Homo Sapiens
agaaagaaacugaaaagugagguguggaacuccaggcaacgacccaagcacuuauuuuuuaaga

SEQ ID NO: 132904 - RNA, 64 nt, Homo Sapiens
auaaacaguuuauguaaaauuaguaaugaaugauggcaacgagggcacuguuaucuucguuugu

SEQ ID NO: 132905 - RNA, 64 nt, Homo Sapiens
aggaaggccucgcggugaggcacccagaagacccggcaacgagggaacacgagacuuucuuuga

SEQ ID NO: 132906 - RNA, 64 nt, Homo Sapiens
aaaaaacucugucucaaaaauguacuccagccugggcaacgagcgugagccgagauugcaccuu

SEQ ID NO: 132907 - RNA, 64 nt, Homo Sapiens
gugaaacuccguccccacccugcacuccagccugggcaacgagaaugagcugagaucaugccau

SEQ ID NO: 132908 - RNA, 64 nt, Homo Sapiens
guagaauguaaaacucgcaggauacagaaaccauggcaacgaaaccgcaucgccucucuccuag

SEQ ID NO: 132909 - RNA, 64 nt, Homo Sapiens
cacagccuccgcggacuggguccccgagggcgggggcaacgauugcggccccgcccguagauca

SEQ ID NO: 132910 - RNA, 64 nt, Homo Sapiens
acccuccacagccaccuggucagccaccagcuggggcaacgaggguggaggucccacugagccu

SEQ ID NO: 132911 - RNA, 64 nt, Homo Sapiens
agcucugagucauucagcccuggggacaccccuaggcaacgauuccgacagcgccauccaggcc

SEQ ID NO: 132912 - RNA, 64 nt, Homo Sapiens
ucuucccaccucaagaugagcacuggacuggcagggcaacgacuggcuggauucauguucaaac

SEQ ID NO: 132913 - RNA, 64 nt, Homo Sapiens
ccucagguuugccaaguacuacagagaccuggcuggcaacgagcagcgcacgcucaucaaggcc

SEQ ID NO: 132914 - RNA, 64 nt, Homo Sapiens
gugagccaagaccaugccauuacacucaagcuugggcaacgagagcaaaacucugucucaaaaa

SEQ ID NO: 132915 - RNA, 63 nt, Homo Sapiens
uuuuuaauaaagaaaagaagauguguauauuuuuggcaacgacagaaacguagugcagauaua

SEQ ID NO: 132916 - RNA, 64 nt, Homo Sapiens
gucuccaagggaccuggccuuagaaucccaaacuggcaacgauaaaagugauagaauuuuuguc

SEQ ID NO: 132917 - RNA, 64 nt, Homo Sapiens
cuggacucauuacuccaaaucaucucaguucagaggcaacgaaaaggcucuagguuuugucuau

SEQ ID NO: 132918 - RNA, 64 nt, Homo Sapiens
gggcgguggccaggacaacgggcuggagggucugggcaacgacagccgagacauguacauggag

SEQ ID NO: 132919 - RNA, 64 nt, Homo Sapiens
guuucaaaccaggauuuuguugcugcuccuuuggggcaacgacggggcaagggguuuccacagu

SEQ ID NO: 132920 - RNA, 64 nt, Homo Sapiens
gugagcuaagaucacgccauugcacuccagccugggcaacgagagggaaacucuguuucaaaaa

SEQ ID NO: 132921 - RNA, 64 nt, Homo Sapiens
gcaaugcugcucccugagucagaagccucuggaaggcaacgaaguccguggggcuccaccagcc

SEQ ID NO: 132922 - RNA, 53 nt, Homo Sapiens
ccacgcucaaaggggcacccccuggcaacgauuucgauagcagggagccauga

SEQ ID NO: 132923 - RNA, 64 nt, Homo Sapiens
gcgaaacucugucucaaaaaugcauucuagccugggcaacgagagugagccgagaucacgccau

SEQ ID NO: 132924 - RNA, 64 nt, Homo Sapiens
uauuuuauucacaaaggucaauaacauggcaagauaaaauuauuuguauaguuuugucugaaug

SEQ ID NO: 132925 - RNA, 64 nt, Homo Sapiens
ugaauucccaagugccaggaguaggauuucauuauaaaauuaauagcuaaucuuauucuaucuc

SEQ ID NO: 132926 - RNA, 64 nt, Homo Sapiens
caggaagauuuuuaaagauagauugagguugguuuaaaauuauuccuguaaaccaacaauaaag

SEQ ID NO: 132927 - RNA, 64 nt, Homo Sapiens
caugcauaguuuuagacaaaaaaagauguuucaauaaaauuacugucuuguaauauaaauguug

SEQ ID NO: 132928 - RNA, 64 nt, Homo Sapiens
uaauuauggucugggguaaaauugaguuucagaauaaaauuaggaacaguaaaauccaaagaac

SEQ ID NO: 132929 - RNA, 64 nt, Homo Sapiens
acuucaugucauuaaucaauuucucaauaguucuuaaaauuagugagauuaaaaaucuaaaaau

SEQ ID NO: 132930 - RNA, 64 nt, Homo Sapiens
uuuuuaauuuuagccauucuucugccucauuucuuaaaauuagagaauuaaggucccgaaggug

SEQ ID NO: 132931 - RNA, 64 nt, Homo Sapiens
cagccuggccaauaugcugaaacccugucucuacuaaaauuacaaaaauuagccggccauggug

SEQ ID NO: 132932 - RNA, 64 nt, Homo Sapiens
acaaauucuaugguagcuuuguuguauauuauuguaaaauuauuuuaauaagucauggggauga

SEQ ID NO: 132933 - RNA, 64 nt, Homo Sapiens
auaagaaguaaguagcauaaaucaguauuuaaccuaaaauuacauauuugaaacagaagauauu

SEQ ID NO: 132934 - RNA, 64 nt, Homo Sapiens
agggcaucuuucuucuuaucucugacaguguucuuaaaauuauuugaauaucauaagagccuug

SEQ ID NO: 132935 - RNA, 64 nt, Homo Sapiens
agaguuuuugagcauuugacuauuuuuagaaucauaaaauuaguuacuaaguauuuugaucaaa

SEQ ID NO: 132936 - RNA, 64 nt, Homo Sapiens
cauuuucuauauaauaucuugauggacucuuuuauaaaauuauuuuauaaaaaacaauguuaca

SEQ ID NO: 132937 - RNA, 64 nt, Homo Sapiens
uuaaugcaauaagguuauacauaguuaugaacuguaaaauuaaagucaguaugaacuauaauaa

SEQ ID NO: 132938 - RNA, 64 nt, Homo Sapiens
ugugauguagcuuucuucuguaacaguuauguuuuaaaauuaagugaguuuuuuuuuugccuua

SEQ ID NO: 132939 - RNA, 64 nt, Homo Sapiens
uuguacuuguuuuaaauuguauacaagcuguacauaaaauuagccaaaugaaucauuucuuaua

SEQ ID NO: 132940 - RNA, 64 nt, Homo Sapiens
cuuuccuauucuagcauuuaaauuuaaauuuuauuaaaauuaaauaauuuaaaucuagcauuua

SEQ ID NO: 132941 - RNA, 64 nt, Homo Sapiens
ugggguuuuguaacaauauauugcaaauugagauuaaaauuauuuauguaaaauguggauuaug

SEQ ID NO: 132942 - RNA, 64 nt, Homo Sapiens
gaaccaaaaugaauucuuuccuuuauccuggcuauaaaauuauuauuauaaauuauaaauauga

SEQ ID NO: 132943 - RNA, 64 nt, Homo Sapiens
ccuagaaaagauuuaaguaaaacaaguuagaagauaaaauuauuaauaauuaauagaaaugggg

SEQ ID NO: 132944 - RNA, 64 nt, Homo Sapiens
aagcaaauuucaaagaauauauuuaagaaaaguuuaaaauuaaaauauguguuauugcaguuuc

SEQ ID NO: 132945 - RNA, 64 nt, Homo Sapiens
ccuucuuacacauaaugguguuguaauuuuaugguaaaauuaauugucaagacauggagggugu

SEQ ID NO: 132946 - RNA, 64 nt, Homo Sapiens
ugugagguaaaauaaguuuaaaaguguaggauuuuaaaauuaaaauuuucucuaacccuuaacu

SEQ ID NO: 132947 - RNA, 64 nt, Homo Sapiens
acauguuuucucuuugaaauaaaguuacacuuacuaaaauuagguucacgauucuuaaaaacac

SEQ ID NO: 132948 - RNA, 64 nt, Homo Sapiens
uauauauauauaaagauauagucugggauuauuuuaaaauuauaagggggguuaauggaacugg

SEQ ID NO: 132949 - RNA, 64 nt, Homo Sapiens
acacacaugaacugcacaccaaagaaggcacuuuuaaaauuaacuuaaaauuaaguaauuuuuu

SEQ ID NO: 132950 - RNA, 64 nt, Homo Sapiens
uaauuuuuuaaagaaggcacccacuuuuauuuuuuaaaauuaagagucaccugaggaaguuucc

SEQ ID NO: 132951 - RNA, 64 nt, Homo Sapiens
uguuuucaaaucaacaagugccauugcuuuuaauuaaaauuaucuuuuauuuuuaggucucugu

SEQ ID NO: 132952 - RNA, 64 nt, Homo Sapiens
cugcuaauauaccuagauuuauaacauaaacuauuaaaauuauuauuccuuccaaugagagauu

SEQ ID NO: 132953 - RNA, 64 nt, Homo Sapiens
ugucuuuuuccuccaaauaaggcuagagcaaauauaaaauuaaaguuguuaugcauugauuaag

SEQ ID NO: 132954 - RNA, 64 nt, Homo Sapiens
uuuuacuuuaagcuugaauaucauuuuucuuaacuaaaauuacuguuacaguuuaucugguacu

SEQ ID NO: 132955 - RNA, 64 nt, Homo Sapiens
cguauuuuaauggcuugggaacuucuguuuaacuuaaaauuaguuggugaauuuggagcagacg

SEQ ID NO: 132956 - RNA, 64 nt, Homo Sapiens
uauuaacagcugagguagcuaaaguuauuuaaaauaaaauuaaauuuaugauccaaguagcuua

SEQ ID NO: 132957 - RNA, 64 nt, Homo Sapiens
auaauugcacuguuuguuuuauguauguacagauuaaaauuauugcuacauuugaggaaaauaa

SEQ ID NO: 132958 - RNA, 64 nt, Homo Sapiens
cuuaucugugugucugacgugccaucuuuaauguuaaaauuaagguguuaaaauuaagccuagu

SEQ ID NO: 132959 - RNA, 64 nt, Homo Sapiens
ugacgugccaucuuuaauguuaaaauuaagguguuaaaauuaagccuaguuauauagacgaaau

SEQ ID NO: 132960 - RNA, 64 nt, Homo Sapiens
ugcauuugauacauuuuuguacuaacuagcauuguaaaauuauuucaugauuagaaauuaccug

SEQ ID NO: 132961 - RNA, 64 nt, Homo Sapiens
ucguaacacagcauuguauaugugaagcaaacucuaaaauuauaaaugacaaccugaauuaucu

SEQ ID NO: 132962 - RNA, 64 nt, Homo Sapiens
aagucuuuauccaagucaccucuuagaacaaaguuaaaauuaaauuugaaaucaugacaagcag

SEQ ID NO: 132963 - RNA, 64 nt, Homo Sapiens
acuuuauaauaaaacacuuuuaaguauagaacauuaaaauuaauuugagaccagugguucccac

SEQ ID NO: 132964 - RNA, 64 nt, Homo Sapiens
aauuugcaugaacacagaugaaauuaaaaauauguaaaauuaaugaugagaauuuugaggaaaa

SEQ ID NO: 132965 - RNA, 64 nt, Homo Sapiens
aacaacguauuccuuuguagaccuuugaauuuguuaaaauuaaacaaugcugcugauaugacac

SEQ ID NO: 132966 - RNA, 64 nt, Homo Sapiens
uaggugugguggcacgcaucaaugaaauuaaaaauaaaauuaccacaaaaaguaaaaauuaaaa

SEQ ID NO: 132967 - RNA, 58 nt, Homo Sapiens
uugaaaaaggaaauauucuuguguuccuuaaaauuaaguacuuagccaaaaugauuaa

SEQ ID NO: 132968 - RNA, 64 nt, Homo Sapiens
auuacuuguuuuuuaaaaacuacaugguuuuguuuaaaauuaccauauuuccacuuagauauuu

SEQ ID NO: 132969 - RNA, 64 nt, Homo Sapiens
acccagcaccuuguuugacagaggcaacuaaaaauaaaauuagggaugggcuugagcgauucaa

SEQ ID NO: 132970 - RNA, 64 nt, Homo Sapiens
gcgauagguaacauguuuguuaaaaggggauuaguaaaauuaauaaagaaauauggaggaaggu

SEQ ID NO: 132971 - RNA, 64 nt, Homo Sapiens
agcaaguuauaucagugaaguauauacuggguauuaaaauuaaaauuugaacaucucaaaguua

SEQ ID NO: 132972 - RNA, 64 nt, Homo Sapiens
cacauacuggagauauauauauaauagauauauauaaaauuauuuuaaugcauuguaguguaau

SEQ ID NO: 132973 - RNA, 64 nt, Homo Sapiens
uguaaucacaacuuacuuucugcuuguaguugcuuaaaauuauguauuuugucuugggcugcaa

SEQ ID NO: 132974 - RNA, 64 nt, Homo Sapiens
acucauuguccuugauaguuuuuauuuuucauuauaaaauuauaccaggagauuucuuuuaaga

SEQ ID NO: 132975 - RNA, 64 nt, Homo Sapiens
uuauuauuuagauauuucucaacacuuaaauucauaaaauuaagaccauguaaggguauguuuu

SEQ ID NO: 132976 - RNA, 64 nt, Homo Sapiens
acuucauuaaauguuuccacaaagcugaaucuuguaaaauuauaaaguuaaagcaaaagaggaa

SEQ ID NO: 132977 - RNA, 64 nt, Homo Sapiens
aaaaaccuugggaauaaucugcaaauuuuaaguuuaaaauuagcaagaaugacauauuuauaag

SEQ ID NO: 132978 - RNA, 64 nt, Homo Sapiens
uauauauauauauauacacaccauucucaaaaguuaaaauuauaaucucaaaaguuaaaauuau

SEQ ID NO: 132979 - RNA, 64 nt, Homo Sapiens
cauucucaaaaguuaaaauuuuuaucucaaaaguuaaaauuaucuguuuuaugcaggcugaaug

SEQ ID NO: 132980 - RNA, 64 nt, Homo Sapiens
uucuauucauuaauuuuucugcugacagaucagauaaaauuacugaauuaguaauuuuuuuuug

SEQ ID NO: 132981 - RNA, 64 nt, Homo Sapiens
gguuuuucuccugaaauguucugaugguuaucuuuaaaauuaauugugcuaggauaccugaaac

SEQ ID NO: 132982 - RNA, 64 nt, Homo Sapiens
auggagcagaaaaucuauugcaauaguggucccauaaaauuauaguacugcauaaugacauaua

SEQ ID NO: 132983 - RNA, 64 nt, Homo Sapiens
ucaacuuuguguuuuuaaauaacaaaauauuauuuaaaauuacuucuucacugaaguuauacug

SEQ ID NO: 132984 - RNA, 64 nt, Homo Sapiens
aaggauuaaacaguuacaagccuccaaauucaaauaaaauuaaaucacaguucagaugaaacug

SEQ ID NO: 132985 - RNA, 64 nt, Homo Sapiens
gauuugggggguuaaaaaagaaaacuuaacuuuauaaaauuauuuauucuauuuuaagccuucu

SEQ ID NO: 132986 - RNA, 64 nt, Homo Sapiens
guguuacuccaaaggacaugaaaaagcucaagaguaaaauuaaaauucucaaaaaaaaacccca

SEQ ID NO: 132987 - RNA, 64 nt, Homo Sapiens
uuccaaaaccaaaaaaagugccuguggauguauauaaaauuaagaugauaagaaagugcuccug

SEQ ID NO: 132988 - RNA, 64 nt, Homo Sapiens
uguauuuucuccaaguuauuuuuauauguaaaguuaaaauuagauaugagaauguuuugcguag

SEQ ID NO: 132989 - RNA, 64 nt, Homo Sapiens
uggagaaggggaaauauacagauggcuaguugcauaaaauuaaauuuuaccuuuauaagacaau

SEQ ID NO: 132990 - RNA, 64 nt, Homo Sapiens
uauaugugaaaaguuggacauuucuguaaguuuuuaaaauuauccauuuguuacuuuaacauuu

SEQ ID NO: 132991 - RNA, 64 nt, Homo Sapiens
uuuuuaaaauuauccauuuguuacuuuaacauuuuaaaauuaugguguuuuccugauuuuaaaa

SEQ ID NO: 132992 - RNA, 64 nt, Homo Sapiens
uguguauguuuuaacaucucugaugcuguguuacuaaaauuacaaggaccugcuuuuuaaaagg

SEQ ID NO: 132993 - RNA, 64 nt, Homo Sapiens
aaacaaauuauuuuuuacaaaaaaacaaaauaaauaaaauuagacuuccuucccucacuauaua

SEQ ID NO: 132994 - RNA, 64 nt, Homo Sapiens
caggaaucauuaauuucaaaauuuaaagccaugcuaaaauuaaaaagaaaauauuaaauuacac

SEQ ID NO: 132995 - RNA, 64 nt, Homo Sapiens
uuauuuuaaguaacuagaaccaccaaauaucaaauaaaauuauuugguuaugguuauguucauc

SEQ ID NO: 132996 - RNA, 64 nt, Homo Sapiens
uauguaaaacccaaacaaguagaacccaagcaaauaaaauuauuuaaaauaauuuuaaaguggc

SEQ ID NO: 132997 - RNA, 64 nt, Homo Sapiens
aauauagguguucucuggaccuauucuaaccacuuaaaauuaucuuaaguaugcauacauaaaa

SEQ ID NO: 132998 - RNA, 64 nt, Homo Sapiens
uccaguaacaccuguauauaaaaauugauucuaguaaaauuaggcagucccaaccccccaauuu

SEQ ID NO: 132999 - RNA, 64 nt, Homo Sapiens
agagcagcaaaugaaaggaguaaggggaauauuuuaaaauuaaguuuuuuuaagguuuaauaac

SEQ ID NO: 133000 - RNA, 64 nt, Homo Sapiens
uauggcuguuuuaaauuguccagauuuuacauuuuaaaauuauccuauaaaagcuuuuugccua

SEQ ID NO: 133001 - RNA, 64 nt, Homo Sapiens
gaauaucagaaaaaauguuauauuuucagaacaguaaaauuacuagcuguuuuaaauacuggug

SEQ ID NO: 133002 - RNA, 64 nt, Homo Sapiens
augcaagcuguuuacuuuuaugauauaauuauaguaaaauuacuaugucuauauauuuuuaguu

SEQ ID NO: 133003 - RNA, 64 nt, Homo Sapiens
ugcuccuuuuuuguuuuuuuuagaaaaguaaauauaaaauuaugaauuugcauauuuuagauug

SEQ ID NO: 133004 - RNA, 64 nt, Homo Sapiens
uucauguguauaugguggaagagucaaaacagauuaaaauuaauaaugaucaguuagugucaag

SEQ ID NO: 133005 - RNA, 64 nt, Homo Sapiens
cuugaaggcccagaacacucuguuucuccuugguuaaaauuauauucuaaccucuuacccaacc

SEQ ID NO: 133006 - RNA, 64 nt, Homo Sapiens
acuuuucagaaugccaaaugaguccauuuuuguuuaaaauuagaugcugagaaauuuuucagaa

SEQ ID NO: 133007 - RNA, 64 nt, Homo Sapiens
uuuaaaauacuauauuaaauaaugacuuacaggcuaaaauuagucaaaaguuacuauugcucau

SEQ ID NO: 133008 - RNA, 64 nt, Homo Sapiens
uaccccacaggcuguguacuauauaaacuuaaaauaaaauuauaauguugcuauccugcaggaa

SEQ ID NO: 133009 - RNA, 64 nt, Homo Sapiens
cuucacagugaaaaaaagaaaaaucuuucauuuuuaaaauuaggagauguuacguaacuuggca

SEQ ID NO: 133010 - RNA, 64 nt, Homo Sapiens
auuuaggcgucuagaaaaucucaguucccaccaguaaaauuauccugaguagcuaaugcaccuu

SEQ ID NO: 133011 - RNA, 64 nt, Homo Sapiens
gcuucggcuugaccucuguguuuuccaggauuuauaaaauuagaucuguacuuuucuggccagc

SEQ ID NO: 133012 - RNA, 64 nt, Homo Sapiens
uaguuucaugcucagaugucuuaaauggccauuuuaaaauuagcagauuucuuacaugcaugua

SEQ ID NO: 133013 - RNA, 64 nt, Homo Sapiens
uacuuuuuccccaaaggcauuauuuauugugcauuaaaauuaaaauauuuuguaagcuauaaca

SEQ ID NO: 133014 - RNA, 64 nt, Homo Sapiens
uaaauuuuaauuaaaaaaucuuggaaagaacauuuaaaauuaaaaaauauaccuaccucuuccg

SEQ ID NO: 133015 - RNA, 64 nt, Homo Sapiens
auucggaugcuuuauuuauaguuaccauuagcucuaaaauuaagaauuuaggaauuauuuaaaa

SEQ ID NO: 133016 - RNA, 64 nt, Homo Sapiens
auguauuuuaccacguuucuauuuauaaugaagguaaaauuaaauuuucuuacgccucauuuua

SEQ ID NO: 133017 - RNA, 64 nt, Homo Sapiens
auccaguuccuuguugcauguauauuaaauuuauuaaaauuaaauaaguaucaguuuaaaaauu

SEQ ID NO: 133018 - RNA, 64 nt, Homo Sapiens
agagccuuuccaucaauugugggguaaucuacucuaaaauuaauacaaugcugauggggaguag

SEQ ID NO: 133019 - RNA, 64 nt, Homo Sapiens
ccauuuucaggaaaaucagauugcauuuacaucauaaaauuaaaaaaguuuuuacuucuaagau

SEQ ID NO: 133020 - RNA, 64 nt, Homo Sapiens
guuagagcugagaaaaaaaacuucuuauguugacuaaaauuauaagugggacacauuuuaacgu

SEQ ID NO: 133021 - RNA, 64 nt, Homo Sapiens
agauaacaaacuaaguuacuucuaaucuuuuccuuaaaauuaauuuuauuauuuuuuuccuuuu

SEQ ID NO: 133022 - RNA, 64 nt, Homo Sapiens
ccacaguucugucaccuaaaaauauagggaagaauaaaauuaacaaaauuuggaaaauacagaa

SEQ ID NO: 133023 - RNA, 64 nt, Homo Sapiens
ugcaaagaaguauuaauaauagaaaaauuaaagcuaaaauuagcgauauguuuuuagaugagag

SEQ ID NO: 133024 - RNA, 64 nt, Homo Sapiens
aauuugccaucaagccauuucccccuuuuguuucuaaaauuauuucagagaugugugcuccugg

SEQ ID NO: 133025 - RNA, 64 nt, Homo Sapiens
cagccuggccaacaugguaaaaucccgucucuacuaaaauuauaaaaauuagccgggcaugaug

SEQ ID NO: 133026 - RNA, 64 nt, Homo Sapiens
ggaaacagguuucaaaugaauauauauacauggguaaaauuacucugugcuaguguagucuuac

SEQ ID NO: 133027 - RNA, 64 nt, Homo Sapiens
uaagaaaguaugguucuguauggcaauagguuuuuaaaauuauuagcuauucaucauguguggg

SEQ ID NO: 133028 - RNA, 64 nt, Homo Sapiens
accaaaucaaucuggcuaacuaggaauuuauguguaaaauuaucugauuaaaacagcucaaguu

SEQ ID NO: 133029 - RNA, 64 nt, Homo Sapiens
uaaauacuuagaauguuugugaguuuuuucuaucuaaaauuagugcaauuccauacauauuuua

SEQ ID NO: 133030 - RNA, 64 nt, Homo Sapiens
aaggcagauaagacauaaaucuguaucugaauuuuaaaauuaaaaaagaaagcaggauuuucuc

SEQ ID NO: 133031 - RNA, 64 nt, Homo Sapiens
uaauuuuuuaaauaaaugcaggauaaacuuuacauaaaauuaacuucuacauacucauuugacu

SEQ ID NO: 133032 - RNA, 64 nt, Homo Sapiens
uugacccaaauagaauaaaaaucauggagcauaauaaaauuaauuguugcacugguggcaauuc

SEQ ID NO: 133033 - RNA, 64 nt, Homo Sapiens
guuucuuugccucucuacacacuaaaugguguguuaaaauuaggccugcacauuuguuaugcau

SEQ ID NO: 133034 - RNA, 64 nt, Homo Sapiens
auguaaauguucuaccaauugucuguggauucuguaaaauuaucaauacuaaacacuacuuucu

SEQ ID NO: 133035 - RNA, 64 nt, Homo Sapiens
gugaaauaggagauacauaguaguauuuuauuuuuaaaauuaauuucucauuugguuuugaaga

SEQ ID NO: 133036 - RNA, 64 nt, Homo Sapiens
uuugugcuagaauaguuguaucuaaaucauauuuuaaaauuauuuuuauuuuuaaaaaauuaug

SEQ ID NO: 133037 - RNA, 64 nt, Homo Sapiens
auucaggaaauaaugcagacuagugauuuugcuauaaaauuauuuuugaaggaagcagacacag

SEQ ID NO: 133038 - RNA, 64 nt, Homo Sapiens
uaaauuuaccagauuaauaaaaauuuaugaauauuaaaauuaucauuaauaauauaaaacacuu

SEQ ID NO: 133039 - RNA, 64 nt, Homo Sapiens
uuacuguauuuuucagaaauauuuuaguaguuacuaaaauuaugugauagggaguuuuaaagaa

SEQ ID NO: 133040 - RNA, 64 nt, Homo Sapiens
auaucauuaucuuugcuguuguucuaacugcuguuaaaauuaauauaacagccuuuuccuucug

SEQ ID NO: 133041 - RNA, 64 nt, Homo Sapiens
aguguauuuucaguggaagaacugucuugcauuauaaaauuagagggcuccuauuuuuuccccu

SEQ ID NO: 133042 - RNA, 64 nt, Homo Sapiens
acuguuuuauugagagaauuuucaguuuaaaacuuaaaauuagucagugugguaaaagggugau

SEQ ID NO: 133043 - RNA, 64 nt, Homo Sapiens
aauuuuuuuguuuguaauuuuucuauauauacuguaaaauuauagaauauuuuuuuaaaaaaaa

SEQ ID NO: 133044 - RNA, 64 nt, Homo Sapiens
cauaaaaugcuuuauuuagacuuacuuuaaugcuuaaaauuauaagaaauggcaucccuaucua

SEQ ID NO: 133045 - RNA, 64 nt, Homo Sapiens
uuuuuauuuuauaaggcccauuguaauguuacuuuaaaauuaucgagacacuaguaguauaugu

SEQ ID NO: 133046 - RNA, 64 nt, Homo Sapiens
gcauuucuagagggggaauacccuguuuaguaaauaaaauuaauuugagaccugugaacugcug

SEQ ID NO: 133047 - RNA, 64 nt, Homo Sapiens
ugucuauauucuaaauugagaacugaaaauauuuuaaaauuauuaaaauugugugccauuuaaa

SEQ ID NO: 133048 - RNA, 64 nt, Homo Sapiens
agucuugcaacaaaaugucuuuuaaguuuccuguuaaaauuauaaaaagauuuucauggugaga

SEQ ID NO: 133049 - RNA, 64 nt, Homo Sapiens
cuuugguuauuucuauugcacagaaaaggauuuuuaaaauuagauuaguauaauaucuggccau

SEQ ID NO: 133050 - RNA, 64 nt, Homo Sapiens; identical to SEQ ID NO: 132958

SEQ ID NO: 133051 - RNA, 64 nt, Homo Sapiens; identical to SEQ ID NO: 132959

SEQ ID NO: 133052 - RNA, 64 nt, Homo Sapiens
auuuguaacucacauccuuugagcuaaacuaaauuaaaauuacaguauuuaauaauucuuuggg

SEQ ID NO: 133053 - RNA, 64 nt, Homo Sapiens
aggauuucuucuuacuggcguucuuaaaggucucuaaaauuaaagaacaagaugugguuuuuug

SEQ ID NO: 133054 - RNA, 64 nt, Homo Sapiens
ccuaguuauauagacgaaauuaaaauuaagguguuaaaauuaagugacgugccaucuuuaaugu

SEQ ID NO: 133055 - RNA, 64 nt, Homo Sapiens
guguuaaaauuaagccuagugccaucuuuaauguuaaaauuaagcuuaucugugugucugacgu

SEQ ID NO: 133056 - RNA, 64 nt, Homo Sapiens
uuuuaaaguuaaacaguauacuuuucuauaauucuaaaauuauuauucuauacucuuuuugaaa

SEQ ID NO: 133057 - RNA, 64 nt, Homo Sapiens
acacuacuguaauguuaauuauuaauuacauguguaaaauuaaaggguagcuuucauuucuucc

SEQ ID NO: 133058 - RNA, 64 nt, Homo Sapiens
accaagggcuugaaacauauaaauauggaaauuuuaaaauuaugacccugcaaugugcacauua

SEQ ID NO: 133059 - RNA, 64 nt, Homo Sapiens
uggacauuaguguacagcccagcuacacccacucuaaaauuaacugaacacuuacuuaguucuu

SEQ ID NO: 133060 - RNA, 64 nt, Homo Sapiens
gaaucuagaugcaauuaauuuuauuccuuccaacuaaaauuacaauauuuuuagguuaaaauua

SEQ ID NO: 133061 - RNA, 64 nt, Homo Sapiens
auuccuuccaacuaaaauuacaauauuuuuagguuaaaauuauugagauauaaagcagccauug

SEQ ID NO: 133062 - RNA, 64 nt, Homo Sapiens
gugauuuaauucuccauuccuccaauguaacucuuaaaauuauuauguauguguguguguuuua

SEQ ID NO: 133063 - RNA, 64 nt, Homo Sapiens
cugauggacaugugaaaaguaaguauaaauggaauaaaauuaauuaggcuaauaggcuuaaccc

SEQ ID NO: 133064 - RNA, 64 nt, Homo Sapiens
auguucagcaaccugaaugguuauuuuuguuaauuaaaauuaaauuuuuaagagauauuuucaa

SEQ ID NO: 133065 - RNA, 64 nt, Homo Sapiens
ccauuacaugauuaugaaaugacugugaagaauauaaaauuaaacuuagugacuuaauuaguca

SEQ ID NO: 133066 - RNA, 64 nt, Homo Sapiens
gaagaauaucuaagcuuuuucugagaugggcuuuuaaaauuauaauaagggaaguuuauuuucu

SEQ ID NO: 133067 - RNA, 64 nt, Homo Sapiens
gcccauggaauuuaauuuuucauugugaucagauuaaaauuacuauuugugcaaaacaaauucc

SEQ ID NO: 133068 - RNA, 64 nt, Homo Sapiens
caaaaacaaacauuauuggaguuucaguguaaaauaaaauuaaaauuggaggguugguuagauu

SEQ ID NO: 133069 - RNA, 64 nt, Homo Sapiens
acuguauuguguacuggcuaauggcagcacgcuguaaaauuauuagaaauccuuagcuaguaga

SEQ ID NO: 133070 - RNA, 64 nt, Homo Sapiens
aaaucuacaacagcucgccuucacagagaaacacuaaaauuacuaaggagauggaaugaucaaa

SEQ ID NO: 133071 - RNA, 64 nt, Homo Sapiens
uuaguuauauuuuauuuuaaguaaaugauacccguaaaauuaaaauacuuuuaaaaacauauug

SEQ ID NO: 133072 - RNA, 64 nt, Homo Sapiens
uggaauccaaagauacacggcuacugucuauauuuaaaauuagauuugguuguuguucccugaa

SEQ ID NO: 133073 - RNA, 64 nt, Homo Sapiens
auaaaauuugcucugguguccguguauacuuaaauaaaauuaaugagaugaaacuuuuauauga

SEQ ID NO: 133074 - RNA, 64 nt, Homo Sapiens
agaugaaacuuuuauaugacuaauuaugugucuuuaaaauuaugugaagcauuauauauauaag

SEQ ID NO: 133075 - RNA, 64 nt, Homo Sapiens
cacugcaauuuacaaagaucucuuuacgguuuuauaaaauuaucuuccaguuuguacauuuaua

SEQ ID NO: 133076 - RNA, 64 nt, Homo Sapiens
caucauuauguaaaagaaaauauauuuuagccccuaaaauuaggaagaauguaaucucagaaua

SEQ ID NO: 133077 - RNA, 64 nt, Homo Sapiens
aaguugucagggaaugucauuacacucugauuuuuaaaauuaugcaguauuuuccaguucucag

SEQ ID NO: 133078 - RNA, 64 nt, Homo Sapiens
ugugcccagggaaguguguugcauuaacuaaagcuaaaauuaucagaauccuauuuacauaaag

SEQ ID NO: 133079 - RNA, 64 nt, Homo Sapiens
uguuuuucuauaaccuggauuuuuuaaaucauauuaaaauuacagaugugaaaauaaagcagaa

SEQ ID NO: 133080 - RNA, 64 nt, Homo Sapiens
gauuucaggauguccucauaucuauuuauaggucuaaaauuauaucuuaagguauguuguagaa

SEQ ID NO: 133081 - RNA, 64 nt, Homo Sapiens
augagagaaaauauuuuuugaagaagcauuucuguaaaauuagaaauuacuuuuuuuaaucuau

SEQ ID NO: 133082 - RNA, 64 nt, Homo Sapiens
uuaguaauauauuaaagugaauguaaauggugguuaaaauuacauuacugugaaauucaucuuc

SEQ ID NO: 133083 - RNA, 64 nt, Homo Sapiens
augcugugcagaauucugauuuauuuuuguuuccuaaaauuaagauagcuugaauauuauuuca

SEQ ID NO: 133084 - RNA, 64 nt, Homo Sapiens
uggagauuauauuaggaaguuucaucagauuguauaaaauuaugauuuuguaucaaaaguauuc

SEQ ID NO: 133085 - RNA, 64 nt, Homo Sapiens
uuuuaacauuggcaucuaaaguguuauuugaaaauaaaauuauuuuccuguucauugauuuuaa

SEQ ID NO: 133086 - RNA, 64 nt, Homo Sapiens
uuaaaguccugguacuuaaccaaauacucagauuuaaaauuacuuguucuuuaucacuuccgag

SEQ ID NO: 133087 - RNA, 64 nt, Homo Sapiens
guuauagaagacucaugauucuucuguguguuuuuaaaauuaauuuggaaaauagcacuuuuca

SEQ ID NO: 133088 - RNA, 64 nt, Homo Sapiens
uaugcagauaccguaauuuacauuuguguauguuuaaaauuacucuuauacaauaaaaaggaca

SEQ ID NO: 133089 - RNA, 64 nt, Homo Sapiens
uuaaugagcuguuucugacaauucucaccaaaucuaaaauuaguggcugucauuauuuaaacac

SEQ ID NO: 133090 - RNA, 64 nt, Homo Sapiens
uuaaagauuaauauuuguucucagauacugucucuaaaauuauuaagcacuuggucuuugauua

SEQ ID NO: 133091 - RNA, 64 nt, Homo Sapiens
auuuuuuugguaaaacauuauuugcuguauuuauuaaaauuauuaccuagcuagauuucuagca

SEQ ID NO: 133092 - RNA, 64 nt, Homo Sapiens
ugucaggauuuauucuauuuauaucuuauuacaauaaaauuaguggcacuuuauucauaaauau

SEQ ID NO: 133093 - RNA, 64 nt, Homo Sapiens
ucuuacuauagauuauguacaaguaacaucuaaauaaaauuacacuuuuaacccuaagagguuu

SEQ ID NO: 133094 - RNA, 64 nt, Homo Sapiens
auauaaucuggacagaaaauuucacaaaauucaauaaaauuacaacuguugucuaaauaaguga

SEQ ID NO: 133095 - RNA, 64 nt, Homo Sapiens
aauuucuaguuuucacucaugguuaacacgcauuuaaaauuauuucaugagucuaguaguucuu

SEQ ID NO: 133096 - RNA, 64 nt, Homo Sapiens
uuaauauuguaauuuaauguagacuuacuuugaauaaaauuaguuuaauuggccuuaaaauuac

SEQ ID NO: 133097 - RNA, 64 nt, Homo Sapiens
gacuuacuuugaauaaaauuaguuuaauuggccuuaaaauuacauuaauaaaacuuugugauau

SEQ ID NO: 133098 - RNA, 64 nt, Homo Sapiens
uacugaaaacaccaaaaauuauaaaaaguagcaguaaaauuauaguacaauaugaaaaaaaaga

SEQ ID NO: 133099 - RNA, 64 nt, Homo Sapiens
aaaaaacuccauaguacuaauucagaugaauucuuaaaauuaaagucaugcuuacuccuuagag

SEQ ID NO: 133100 - RNA, 64 nt, Homo Sapiens
aaaugauauauaguuauguugucuuuuauaguguuaaaauuaguauuuauaugaaagucaagau

SEQ ID NO: 133101 - RNA, 64 nt, Homo Sapiens
agaggauggagcuaagagaaauaagaucaaauauuaaaauuaggaauuuaggcauuaccucagg

SEQ ID NO: 133102 - RNA, 64 nt, Homo Sapiens
aauggucauugaaaacacuuguuuagcauuagaauaaaauuauauauguccuugggaaauauua

SEQ ID NO: 133103 - RNA, 64 nt, Homo Sapiens
gucauacuguacacuguauuguaaaaauaaaaaguaaaauuauauuucaaauuuuaaaagccac

SEQ ID NO: 133104 - RNA, 64 nt, Homo Sapiens
aaaacccccuuuaaaacaaaacaaaaaaaugaaauaaaauuaggcaaauugacagacagugaga

SEQ ID NO: 133105 - RNA, 64 nt, Homo Sapiens
uuucuucguuguagaucagaauuucaccagggaguaaaauuaccugaaaacguaagaaguuuua

SEQ ID NO: 133106 - RNA, 64 nt, Homo Sapiens
cuugcucugucuaccuugacagaaauuggaguuuuaaaauuauguguuaauauuuuuauuugca

SEQ ID NO: 133107 - RNA, 64 nt, Homo Sapiens
acauuguugcccuucaacaaggcucuugaauuaauaaaauuauagucucuaagaauuccacauu

SEQ ID NO: 133108 - RNA, 64 nt, Homo Sapiens
aauaguucacuuguuauuuggccaaaaaaagagauaaaauuaauaauacaucuuugugcguaga

SEQ ID NO: 133109 - RNA, 64 nt, Homo Sapiens
ugaaugguuugggaucuuuuucuaggcuuccauuuaaaauuauauuaaaaauagggauuaaaug

SEQ ID NO: 133110 - RNA, 64 nt, Homo Sapiens
aauuaaauuguuaauuuuuacuuuaaaugaugguuaaaauuacauuucuuuacagcugaaauug

SEQ ID NO: 133111 - RNA, 64 nt, Homo Sapiens
uucuaugaguguauaccauuggucacauaacacauaaaauuaguccauggucaugucauucuga

SEQ ID NO: 133112 - RNA, 64 nt, Homo Sapiens
uugcuaaagaacuacuguuuaguugguaaugguguaaaauuacauucagcuccuucuugucaua

SEQ ID NO: 133113 - RNA, 64 nt, Homo Sapiens
uuaaaauuuuauuccaccuguacauuugucacuuuaaaauuaaaauugagcugguaugagagau

SEQ ID NO: 133114 - RNA, 64 nt, Homo Sapiens
aauacuagccuagaaauauagagcauuaacaaaguaaaauuaauauauuaaguuauaauuggaa

SEQ ID NO: 133115 - RNA, 64 nt, Homo Sapiens
aaagaaaacacccuuaugaauugaugacuauauauaaaauuauauucacuacuuuugaacacau

SEQ ID NO: 133116 - RNA, 64 nt, Homo Sapiens
accguggagguacauuucucguccuacagggaaauaaaauuauaaagauauaaaacugguuagg

SEQ ID NO: 133117 - RNA, 64 nt, Homo Sapiens
ugcuuuugauacucagcuguagguuuagauuguuuaaaauuaguuaauuacuauuuaaaaacuc

SEQ ID NO: 133118 - RNA, 64 nt, Homo Sapiens
ugaacucguauguacuaucaaauacauaaagguguaaaauuacaacaaaaggcauuauaauuuu

SEQ ID NO: 133119 - RNA, 64 nt, Homo Sapiens
acuugcuuuuugcugagcuuaauucagauaucaguaaaauuaagucauaaaauaaucauguguc

SEQ ID NO: 133120 - RNA, 64 nt, Homo Sapiens
guacagcacuuuacacacaagagguuuauugauguaaaauuaucggcuagggaagcagcagcgg

SEQ ID NO: 133121 - RNA, 64 nt, Homo Sapiens
ugcauccacaagcuggaucugaguuuugucacucuaaaauuaaacaagaaaaaaagugggaaaa

SEQ ID NO: 133122 - RNA, 64 nt, Homo Sapiens
ggaaucaacaaugaguuuauuguucaugguagauuaaaauuaagcuugcauaaagguugggcua

SEQ ID NO: 133123 - RNA, 64 nt, Homo Sapiens
ugcugaugcaagaauucuacauuuuaaugaguuauaaaauuauucugcaucucaucacgucaca

SEQ ID NO: 133124 - RNA, 64 nt, Homo Sapiens
uaccauuuugaggggauuuauacauauuuuuagauaaaauuaaaugcucuuauuuuuccaacag

SEQ ID NO: 133125 - RNA, 64 nt, Homo Sapiens
caccagcaguuaaccuucaagacauuccacuugcuaaaauuauuuauuuuguaaggagagguuu

SEQ ID NO: 133126 - RNA, 64 nt, Homo Sapiens
cuuccucucaaacauaggggaaauacauaaauuuuaaaauuauuauuuuguaaauuuaguuaac

SEQ ID NO: 133127 - RNA, 64 nt, Homo Sapiens
aucagguauauuuuguaaauuuuuaaagaucauuuaaaauuaacauaauuaauaguauguuuaa

SEQ ID NO: 133128 - RNA, 64 nt, Homo Sapiens
aaacucuuaaucuguguguauauugagaaucccuuaaaauuaccagacaaaaaaauuuaaaauu

SEQ ID NO: 133129 - RNA, 64 nt, Homo Sapiens
ugagaaucccuuaaaauuaccagacaaaaaaauuuaaaauuacguuuguuauuccuaguggaug

SEQ ID NO: 133130 - RNA, 64 nt, Homo Sapiens
cugacaguauacaaacaacagaaucguacauuauuaaaauuauuauucccuguuuaaaauuacu

SEQ ID NO: 133131 - RNA, 64 nt, Homo Sapiens
gaaucguacauuauuaaaauccagauucccuguuuaaaauuacuuuuaccugcauuuaauucag

SEQ ID NO: 133132 - RNA, 64 nt, Homo Sapiens
uccuaaaguccagguaugauuggauuaauauuuauaaaauuauuauuaggaauuauuuaagugg

SEQ ID NO: 133133 - RNA, 64 nt, Homo Sapiens
uguaucuuauuaaaauaggaugauuugcauuuuguaaaauuauccugcacaucaagcugcaugc

SEQ ID NO: 133134 - RNA, 64 nt, Homo Sapiens
aacaaauaauccugccuuuuaaaaaaauuaaaauuaaaauuaaacgacagagcaagacugucuc

SEQ ID NO: 133135 - RNA, 64 nt, Homo Sapiens
auuaaaaacaaauaauccugugucucaaaaaaauuaaaauuaaaccugggcgacagagcaagac

SEQ ID NO: 133136 - RNA, 64 nt, Homo Sapiens
uuguuauugauuacaguguuguuauuuuaaaauguaaaauuaaaaacccaguuuuauacuuuua

SEQ ID NO: 133137 - RNA, 64 nt, Homo Sapiens
auauuuuacuaauacuuuuaauuuauaaguaaauuaaaauuaguuuaugagaaaacuuaauuuc

SEQ ID NO: 133138 - RNA, 64 nt, Homo Sapiens
aacuucaggcaauaauauuuucuguguaagcuuuuaaaauuauuuuuggggaucauagcuuguu

SEQ ID NO: 133139 - RNA, 64 nt, Homo Sapiens
uuuuggggaucauagcuuguuuuauuuugugcuauaaaauuaacaguauuaaaugacuuauauu

SEQ ID NO: 133140 - RNA, 64 nt, Homo Sapiens
gccugaauccuuucuuuaguuuaagacacuuugcuaaaauuacauuucaguuacguugcuuggg

SEQ ID NO: 133141 - RNA, 64 nt, Homo Sapiens
agaauggugccugguacuagaggugaaauagcaauaaaauuaaucgucauguaucauugguuug

SEQ ID NO: 133142 - RNA, 64 nt, Homo Sapiens
aguaaauacccauuacuccuuuacucauagcugguaaaauuauucccacuguuuuauugccuuu

SEQ ID NO: 133143 - RNA, 64 nt, Homo Sapiens
ucugguuuuauaaacugaguuucuuagcauucguuaaaauuaagggguuuguuuggaauaauau

SEQ ID NO: 133144 - RNA, 64 nt, Homo Sapiens
auggaaaagauguucaugguacauuguaaaaaaauaaaauuaaaauuaaaaaaaguuugcagaa

SEQ ID NO: 133145 - RNA, 64 nt, Homo Sapiens
aagauguucaugguacauuguaaaaaaauaaaauuaaaauuaaaaaaaguuugcagaaccgcau

SEQ ID NO: 133146 - RNA, 64 nt, Homo Sapiens
acuuuuagaaacuuaucuuacaaaguguauuuuauaaaauuaaagaaaauaaaauuaagaaugu

SEQ ID NO: 133147 - RNA, 64 nt, Homo Sapiens
ucuuacaaaguguauuuuauaaaauuaaagaaaauaaaauuaagaauguucucaaucaaacauc

SEQ ID NO: 133148 - RNA, 64 nt, Homo Sapiens
aagcaaaauauucauuuuuacuuuuucuuauuuuuaaaauuaggcugaauguacuucaugugau

SEQ ID NO: 133149 - RNA, 64 nt, Homo Sapiens
uucaugaauuagucuacagaaaaaaaauguucuguaaaauuagucuguugaaaauguuuuccaa

SEQ ID NO: 133150 - RNA, 64 nt, Homo Sapiens
uugaaaauugaguuuauguuugaccuaaaugggcuaaaauuacauuagauaaacuaaaauucug

SEQ ID NO: 133151 - RNA, 64 nt, Homo Sapiens
auuagagugugggaauagggaucuaaauuuuaaauaaaauuauauauauauauaaauuggugcu

SEQ ID NO: 133152 - RNA, 64 nt, Homo Sapiens
uuguuuaguuuuuucuuacuuuuaaauuccaacuuaaaauuaugagguuucagaaauauauuga

SEQ ID NO: 133153 - RNA, 64 nt, Homo Sapiens
gcuucauucacuugccuuuuuaagaguaaugaaauaaaauuauaggaaauaguuguggauguac

SEQ ID NO: 133154 - RNA, 64 nt, Homo Sapiens
uacaauucugcugacccuacuuuuucaauaaugcuaaaauuagccugagccaaucagaaauaua

SEQ ID NO: 133155 - RNA, 64 nt, Homo Sapiens
cugacaaaauacuugucuguuuuaaaaaccuguucaagucuaccaaccuguucaagucuaccaa

SEQ ID NO: 133156 - RNA, 64 nt, Homo Sapiens
guuuuaaaaaccuguucaagucuaccaaccuguucaagucuaccaauuauaagggcaaauugga

SEQ ID NO: 133157 - RNA, 64 nt, Homo Sapiens
guuucuugcucucucucccugccuuuaaaugaaacaagucuagucuucugguuuucuagccccu

SEQ ID NO: 133158 - RNA, 64 nt, Homo Sapiens
gauaauggagaauguaucagccagccuuccccaccaagucuaaaaagaccuggccuuucacuuu

SEQ ID NO: 133159 - RNA, 64 nt, Homo Sapiens
cccccauguggcugaagacaacaucccggccucuuccacccauugcugcucuagcuggcaggac

SEQ ID NO: 133160 - RNA, 64 nt, Homo Sapiens
cugcacugcagugauggcgccuuggcuuccuccguccacccaggucugagcccaggccguuccc

SEQ ID NO: 133161 - RNA, 64 nt, Homo Sapiens
gcugccaugccacugccaggcugccccuugggcauccacccagucaggguccgcaccagcugcu

SEQ ID NO: 133162 - RNA, 64 nt, Homo Sapiens
cccucugaagaacugggcauaagccaaauucgccuccacccacucuuaaugucuucuuccucuc

SEQ ID NO: 133163 - RNA, 64 nt, Homo Sapiens
uauguccacuuagucacccacagggaccucugcuuccacccacaucugccaaggucucucccuc

SEQ ID NO: 133164 - RNA, 64 nt, Homo Sapiens
cauguaaaggcaggagaccuggcagauugggguauccacccaguaacuauuaaccuggggcccu

SEQ ID NO: 133165 - RNA, 64 nt, Homo Sapiens
aggcaccuggggcuucucagagggugggcuucuauccacccaugucugaagaccucacccuggc

SEQ ID NO: 133166 - RNA, 64 nt, Homo Sapiens
ucggccucccaaagugcuggcugaccucaagcgauccacccaccgccaggcuggucucgaacuc

SEQ ID NO: 133167 - RNA, 64 nt, Homo Sapiens
caagcccacaucacaucucccccagacaucugcuuccacccagcguuuucuuccguuggaacca

SEQ ID NO: 133168 - RNA, 64 nt, Homo Sapiens
ccuucgccuuugcugaagucuccccgcagcccucuccacccagaggucucccuauaccgagacc

SEQ ID NO: 133169 - RNA, 64 nt, Homo Sapiens
cgcugacagccuccuaggcucccugagguaccuuuccacccagacccuccuuccccaccccaua

SEQ ID NO: 133170 - RNA, 64 nt, Homo Sapiens
gccacacuugauaaaucauggggaacagauguguuccacccaacaaaugugauaagugaucaug

SEQ ID NO: 133171 - RNA, 64 nt, Homo Sapiens
uggccaggauggucucgaucucuugaccucaugauccacccaccucggucucccaaagugcugg

SEQ ID NO: 133172 - RNA, 64 nt, Homo Sapiens
ccagccccugggcagccggguguaaauacucccuuccacccaucaaaccugccuguaaacgcuc

SEQ ID NO: 133173 - RNA, 64 nt, Homo Sapiens
uaucugccuauuuucuugcuauuuuugucccuccuccacccaggcuccuguuuuuugcaaguac

SEQ ID NO: 133174 - RNA, 64 nt, Homo Sapiens
ccuacagaugcagaaccagaaugagggggacaauuccacccacucgagggcugcccccucuucc

SEQ ID NO: 133175 - RNA, 64 nt, Homo Sapiens
uagccaggauggucucgaucuccugaccucgugauccacccaccucggccucccaaagugcugg

SEQ ID NO: 133176 - RNA, 64 nt, Homo Sapiens
cucuaucccccaccgcuccaguauccugcauuccuccacccacccaaccucucuccccgccccu

SEQ ID NO: 133177 - RNA, 64 nt, Homo Sapiens
ccucucccaaccucucucccuguauccccaccccuccacccaccaccccuguaccucccacccc

SEQ ID NO: 133178 - RNA, 64 nt, Homo Sapiens
gagugcaguggcaugaucucagcucacugcaaccuccacccacuggguucaagcgauucuucug

SEQ ID NO: 133179 - RNA, 64 nt, Homo Sapiens
ugcaggacaggacuauucuagcauaccugcuucguccacccaggcaggguuugggguggucucu

SEQ ID NO: 133180 - RNA, 64 nt, Homo Sapiens
accuccuccaacaaaggagugcauauccccacccuccacccacucaaacuaccagccguaucua

SEQ ID NO: 133181 - RNA, 64 nt, Homo Sapiens
uuaguuaggagcuacuuccaguaauggccaugccuccacccacccccagcugugauuuuuauca

SEQ ID NO: 133182 - RNA, 64 nt, Homo Sapiens
uaguuuguccuccuuuaauuguuugcccaaaucuuccacccaucuuuuuucuucccucauuuuc

SEQ ID NO: 133183 - RNA, 64 nt, Homo Sapiens
gagagggacaaaaggaguaauuauuugguauagauccacccaucccaaccuuucucuccucagu

SEQ ID NO: 133184 - RNA, 64 nt, Homo Sapiens
agaacagcgugagcugguggucuuccccucaccuuccacccauggugcugguaagguccuagca

SEQ ID NO: 133185 - RNA, 64 nt, Homo Sapiens
acucacuacaaccuugugcuauggcagccuugucuccacccaugcuccuccugagcauaaaacc

SEQ ID NO: 133186 - RNA, 64 nt, Homo Sapiens
gcccaguuggguggaugccugguggcagcugcgguccacccaggagccccgaggccuucucuga

SEQ ID NO: 133187 - RNA, 64 nt, Homo Sapiens
gccaggcuggucucaaacucuugaccucaggugauccacccaccucagccucccaaagugcugg

SEQ ID NO: 133188 - RNA, 64 nt, Homo Sapiens
ggaagcaacuaauucuggugcucaggcugggcucuccacccaaguuaggccugcucuggccuaa

SEQ ID NO: 133189 - RNA, 64 nt, Homo Sapiens
acagugaggcagucucccuuccugaccauucuucuccacccagucacagauaagggaauaaccu

SEQ ID NO: 133190 - RNA, 64 nt, Homo Sapiens
uccuuggcagagaugacagggaagcagagccaaguccacccaugguuggagaucauggagcuaa

SEQ ID NO: 133191 - RNA, 64 nt, Homo Sapiens
ucggccucccaaagugcugguccugaccucgugauccacccaacuagccaggauggucucgauc

SEQ ID NO: 133192 - RNA, 64 nt, Homo Sapiens
aguguccuggggagaaggaaacuaccaacccagcuccacccagccagggggccucgggcacucc

SEQ ID NO: 133193 - RNA, 64 nt, Homo Sapiens
ccuucuccccacagccucugcugaccuucucaccuccacccauagccuuccaccggagagacua

SEQ ID NO: 133194 - RNA, 64 nt, Homo Sapiens
ucggucuccccaaagugcuguccugaccuugugauccacccaccugaccaggauggucucaauc

SEQ ID NO: 133195 - RNA, 64 nt, Homo Sapiens
uuggccucccaaauuguucguugaccucaaaugauccacccaccaccaggcugaucuuaaacuc

SEQ ID NO: 133196 - RNA, 64 nt, Homo Sapiens
uccaccucccaaagugcuagcugggcucaagugauccacccauccccaggcuggucucgaacuc

SEQ ID NO: 133197 - RNA, 64 nt, Homo Sapiens
ucagccucucaaagugcuggcugcccucaggugauccacccacccccaggcuggucucaaacuc

SEQ ID NO: 133198 - RNA, 64 nt, Homo Sapiens
uccuccccuggggacagccccaccuccgggucccuccacccacaucccccugguccuaccccug

SEQ ID NO: 133199 - RNA, 64 nt, Homo Sapiens
agguaugggagagcgcugggggcccaucccccuguccacccaguguccacuggccuguccuuca

SEQ ID NO: 133200 - RNA, 64 nt, Homo Sapiens
uccgcaucuguguguaucauccgacuuaaccucuuccacccaagcugcucuucugucuauugua

SEQ ID NO: 133201 - RNA, 64 nt, Homo Sapiens
acgcgcuugguuugcagaugacaaugggacggaauccacccacacauaaacggcccucucgaac

SEQ ID NO: 133202 - RNA, 64 nt, Homo Sapiens
aaccuaauacagccccuuuuaucucagugggaaauccacccagcagccacaugcugcugcccug

SEQ ID NO: 133203 - RNA, 64 nt, Homo Sapiens
gucucacuuuaggucucauugaacccccaaugacuccacccauaugauuuuaaacuucaggcca

SEQ ID NO: 133204 - RNA, 63 nt, Homo Sapiens
uagagacaaaacaagcagacaccugaaacaaucaacgcccaauaaaacaaaguaggaugaaaa

SEQ ID NO: 133205 - RNA, 63 nt, Homo Sapiens
aaaaccaacuaaggacucucuuucuuacuaccuaacgcccaaguggcugggguuccuggugga

SEQ ID NO: 133206 - RNA, 63 nt, Homo Sapiens
uuuccaccaacucaguaaacggcaguucucuagaacgcccacauuagcuguagucuauauuag

SEQ ID NO: 133207 - RNA, 63 nt, Homo Sapiens
cucuggaaauggugaggcgaggggcuugagaggaacgcccacccacgaaggcccagggcgcca

SEQ ID NO: 133208 - RNA, 51 nt, Homo Sapiens
auaauuaguaggaguucaucaaacgcccaaaugaagcgcaaagcugaauga

SEQ ID NO: 133209 - RNA, 63 nt, Homo Sapiens
cguguucaagacuguucaaguaaagaguacuuuaacgcccauguguagguagcaauguacaga

SEQ ID NO: 133210 - RNA, 63 nt, Homo Sapiens
cgcauggaugcacccccuaccccaaacgccgcuaacgcccagaaggagacuccacccuggggu

SEQ ID NO: 133211 - RNA, 63 nt, Homo Sapiens
ucuugaaguccauugcugaagaaagaaaaaaaaaacgcccaaccuuaaauguagauaugugcu

SEQ ID NO: 133212 - RNA, 63 nt, Homo Sapiens
ggucugggcugccaagcuucuuccccccugacaaacgcccaccugaccugaggccccagcuuc

SEQ ID NO: 133213 - RNA, 63 nt, Homo Sapiens
aaauucuagacaucaguucuuuaagucucagaaaacgcccagugaauugguaaacuuaguucu

SEQ ID NO: 133214 - RNA, 63 nt, Homo Sapiens
aauagggggcacucauuuuguuucaacgguccaaacgcccaaccuucagaaagaggaagucag

SEQ ID NO: 133215 - RNA, 63 nt, Homo Sapiens
acugggcucuguccugcagacaccucuuucagaaacgcccaagcccagccccuaggagggggu

SEQ ID NO: 133216 - RNA, 63 nt, Homo Sapiens
uucccuucauaaggacuuuuuuugucuuucuuuaacgcccaggcuucgucuuauuucuacugu

SEQ ID NO: 133217 - RNA, 63 nt, Homo Sapiens
guggacacaggugccaguucaacucugacacagaacgcccaacucucacgucauauuauagga

SEQ ID NO: 133218 - RNA, 63 nt, Homo Sapiens
uuauuuuuuguaagugucauuuguauaacucuaaacgcccaugauaguagcuucaaacuggaa

SEQ ID NO: 133219 - RNA, 63 nt, Homo Sapiens
uggcagucucagccucccuccacggucaccuucaacgcccagacacucccuucucccaccuua

SEQ ID NO: 133220 - RNA, 63 nt, Homo Sapiens
uguucuauacauugugaaucuucccgucugaagaacgcccagccugcccagacaaagccccgc

SEQ ID NO: 133221 - RNA, 63 nt, Homo Sapiens
ggaaauaaaauccuaucuaaucaauaaaugcacaacgcccaaaauguauucucuauaaggcau

SEQ ID NO: 133222 - RNA, 63 nt, Homo Sapiens
ucuuggccuuggccaguggcggcccucucccccaacgcccaggggugccgcgccgugccgccu

SEQ ID NO: 133223 - RNA, 63 nt, Homo Sapiens
gcacugcgccccgcaacugagccgggagggucgaacgcccaggcaggggcuguuggugucuga

SEQ ID NO: 133224 - RNA, 63 nt, Homo Sapiens
ucccgugaccccaacugcagcccugggacaccuaacgcccaguucagcaugaacaccaggcac

SEQ ID NO: 133225 - RNA, 63 nt, Homo Sapiens
uugccuugcuguuuaaaaguaaugcaauaugugaacgcccagagaacaagcacuguggaacug

SEQ ID NO: 133226 - RNA, 63 nt, Homo Sapiens
acgggggcuccuuguuacacggagcccacuggaaacgcccaccccuggcugccaggcucgcca

SEQ ID NO: 133227 - RNA, 63 nt, Homo Sapiens
ucauucugauuaaaaauucuggugagucuagaaaacgcccacuugagaauauuuuauuuucau

SEQ ID NO: 133228 - RNA, 63 nt, Homo Sapiens
cgguuugcaucgacugauagaacgacugaugaaaacgcccaugacucggucaugugcucagac

SEQ ID NO: 133229 - RNA, 63 nt, Homo Sapiens
gcaagccccagguugugacaggugcagguagacaacgcccauaaacagagaugguccugaacu

SEQ ID NO: 133230 - RNA, 63 nt, Homo Sapiens
gggggucccacccuucuuaccccacccgggaggaacgcccagggccccgggcuuguuucuccu

SEQ ID NO: 133231 - RNA, 63 nt, Homo Sapiens
gcccugaugaccugguucuucagcucccaggccaacgcccaaaccacgggauuuguagccagc

SEQ ID NO: 133232 - RNA, 63 nt, Homo Sapiens
cauaggaccugccacacaagcagccguggacacaacgcccacuaccaccucccacauggaaau

SEQ ID NO: 133233 - RNA, 63 nt, Homo Sapiens
uggcuagaggucccugccccugucuggaggcacaacgcccauccuuaggccaaacaguaccca

SEQ ID NO: 133234 - RNA, 63 nt, Homo Sapiens
ccauuuccccagggcacgugguugaguggggggaacgcccacuucccuggguuagacugccag

SEQ ID NO: 133235 - RNA, 63 nt, Homo Sapiens
gucgccucugccacugucagggaccagccggccaacgcccacccgcaaaggugucuaaaaacu

SEQ ID NO: 133236 - RNA, 63 nt, Homo Sapiens
gauggcccagagguggugguuguucaaacagcaaacgcccacacucuuuccugagacuggauc

SEQ ID NO: 133237 - RNA, 63 nt, Homo Sapiens
ucccaaagugcugggauuacagguaugagccacaacgcccagccaucauuuaucuuuuucacu

SEQ ID NO: 133238 - RNA, 63 nt, Homo Sapiens
cuggagugcaauggcacuauggagucuugcugcaacgcccagguuuuuuggggggggggggac

SEQ ID NO: 133239 - RNA, 63 nt, Homo Sapiens
gaacaaugaagaggauaagacuauucaagggauaacgcccagguaagcacuucucagagaaug

SEQ ID NO: 133240 - RNA, 63 nt, Homo Sapiens
ugauguagaucauagguaguaggaauuccuugaaacgcccacguucguuaugaacaagaaaaa

SEQ ID NO: 133241 - RNA, 63 nt, Homo Sapiens
ccaccggcaccagugccucgcuccauuggcaccaacgcccagcuccaccgguacuggcucccu

SEQ ID NO: 133242 - RNA, 63 nt, Homo Sapiens
gcuuugcuuuucuccuccucacuggacccucccaacgcccaauucucggugauaaaggcgccc

SEQ ID NO: 133243 - RNA, 63 nt, Homo Sapiens
caccccagucuacuugcugggguagguccacccaacgcccagggagggaaugaggaagcuaca

SEQ ID NO: 133244 - RNA, 63 nt, Homo Sapiens
auuaaaauaaaauauaaucuaaaauaaaauucaaacgcccaggauacuaaaugcagcuaugua

SEQ ID NO: 133245 - RNA, 63 nt, Homo Sapiens
gugugugugugcacaagugagugagagauuucgaacgcccaccccucgacuuugaaaucugag

SEQ ID NO: 133246 - RNA, 63 nt, Homo Sapiens
ggagauaaucaacacucaggaccuucagccuugaacgcccauuagugcuauguuauagaaccu

SEQ ID NO: 133247 - RNA, 63 nt, Homo Sapiens
ccagcccacccccgcucacgcuggcggccagagaacgcccagcgcccagagcagcgggaugag

SEQ ID NO: 133248 - RNA, 63 nt, Homo Sapiens
uguuuuggaacauuuauguaaguacaacgagauaacgcccauggccuuagccagcuagugacg

SEQ ID NO: 133249 - RNA, 63 nt, Homo Sapiens
uaugcacauagaccuuagaguguauaguuaacaaacgcccaucugcucacccaugcccaccca

SEQ ID NO: 133250 - RNA, 63 nt, Homo Sapiens
ggccccuggugacggcacagcccucacagcucaaacgcccacccccacucccaccaucugcag

SEQ ID NO: 133251 - RNA, 63 nt, Homo Sapiens
gcuuuggaaaccacauccgcaagcucagagacgaacgcccagccacaucuccagcaaguucuc

SEQ ID NO: 133252 - RNA, 64 nt, Homo Sapiens
agcugucuuuucaguuaugguaaacucuuaaaguucagaacacucaacagauuccuucagugau

SEQ ID NO: 133253 - RNA, 64 nt, Homo Sapiens
augaccaguuaucucgaguagauuuucuuggauuucagaacaucuagcaugacucugaaggaua

SEQ ID NO: 133254 - RNA, 64 nt, Homo Sapiens
acuccuugggagauccccaugaugagcuggucccucagaacaugcugcuuccucagccuucuuu

SEQ ID NO: 133255 - RNA, 64 nt, Homo Sapiens
agccagcaagcuuuacugcacuacugaauuacugucagaacaagaggccuugggaucaggaaau

SEQ ID NO: 133256 - RNA, 64 nt, Homo Sapiens
aagacuugaaggugccuugcaggugucuggacauucagaacaccccagagacaagacuucggga

SEQ ID NO: 133257 - RNA, 64 nt, Homo Sapiens
aauccacauugccagugacacagaaacaccuagaucagaacagggguagagcccuguaucaacc

SEQ ID NO: 133258 - RNA, 64 nt, Homo Sapiens
uucuuucccccccucccccuggaccuauguuugcucagaacacaguaagcugcuuuugacggaa

SEQ ID NO: 133259 - RNA, 64 nt, Homo Sapiens
cuuggucacugcagaauuuuaaaaggcaaacuucucagaacagaugugcacaucuuaauuuggu

SEQ ID NO: 133260 - RNA, 64 nt, Homo Sapiens
agcauuuuguuuuuagagaacuauucugguacuaucagaacaaauacauaaaauaacuucccau

SEQ ID NO: 133261 - RNA, 64 nt, Homo Sapiens
gcauuucauguggccauggguaccuagaaagacaucagaacaagucggucaaauuaaaaguaga

SEQ ID NO: 133262 - RNA, 64 nt, Homo Sapiens
gccaucuuaguaaaaauuuugaaaggaugaccacucagaacaacucucuugaugaccauucugu

SEQ ID NO: 133263 - RNA, 57 nt, Homo Sapiens
ccaucuaugaauuccggugacaacgguucagaacagcaaccaaauaaaacugaacuu

SEQ ID NO: 133264 - RNA, 64 nt, Homo Sapiens
uuaaagggaaaaauaauucauucccagagaugagucagaacagucuccucaauccugaaauuca

SEQ ID NO: 133265 - RNA, 64 nt, Homo Sapiens
uuauuagaggacaagaucaggacugcuuucagcuucagaacacuuuugguucagaacagcgauu

SEQ ID NO: 133266 - RNA, 64 nt, Homo Sapiens
uguuuuuaaauuguagcuucagaacacuuuugguucagaacagcgauugaccaguaacugugag

SEQ ID NO: 133267 - RNA, 64 nt, Homo Sapiens
uuuuaugacaaaaauuggguuuuggaaaucggguucagaacacuucauauauuaccguuauguc

SEQ ID NO: 133268 - RNA, 64 nt, Homo Sapiens
agacuguaaaacaaaaacaaacuuaugacuuuccucagaacaugucuuguguuugagaaccaug

SEQ ID NO: 133269 - RNA, 64 nt, Homo Sapiens
agaagguccaguucuucccccccaguaccaaauuucagaacacagcagauagcacauaccccca

SEQ ID NO: 133270 - RNA, 64 nt, Homo Sapiens
guuugauuuuuauuuuauaauugaaagcaggacuucagaacaguaggucaacucugaagaguau

SEQ ID NO: 133271 - RNA, 64 nt, Homo Sapiens
ccgagagggccggcgccuaccugagggccccugugucccgaacccggagcggaggcgcccaacc

SEQ ID NO: 133272 - RNA, 64 nt, Homo Sapiens
cccccaugggccgcccaguaccaugcacacuccugucccgaacucccugaggccuccccucccu

SEQ ID NO: 133273 - RNA, 64 nt, Homo Sapiens
ccccacgcugcagugggcuugugugugaugugcagucccgaagccacacccucccuuuuccuca

SEQ ID NO: 133274 - RNA, 64 nt, Homo Sapiens
cuucugccucauuucuuaaaauuagagaauuaaggucccgaagguggaacaugcuucaugguca

SEQ ID NO: 133275 - RNA, 64 nt, Homo Sapiens
cagagaaggaggcugggggaucaccagccccaaggucccgaagggcaggucagagggagagagg

SEQ ID NO: 133276 - RNA, 64 nt, Homo Sapiens
cugagacccggaaggcccugggguggcuccccaggucccgaagcggacgaguggucaccaaaca

SEQ ID NO: 133277 - RNA, 64 nt, Homo Sapiens
ucuaagauaaauaaacaagauuuuagauuucucagucccgaagaggaaucugagugguuuuauu

SEQ ID NO: 133278 - RNA, 64 nt, Homo Sapiens
gaggcagccccccauaggcuuccgccaagcucuggucccgaagaggcugugcgagcccuucccg

SEQ ID NO: 133279 - RNA, 64 nt, Homo Sapiens
aaccgagaacacauuuggugacuguucaucugcugucccgaagauucuucagucagccuguggc

SEQ ID NO: 133280 - RNA, 64 nt, Homo Sapiens
augcagugacuuuuugucgugcagcaaggcccaggucccgaaaggucgccaccuuccaugugaa

SEQ ID NO: 133281 - RNA, 64 nt, Homo Sapiens
gcccccaaaaucugucacuacaauuuaaacaccagucccgaaauuuggaucuucuuucuuuuug

SEQ ID NO: 133282 - RNA, 64 nt, Homo Sapiens
gccacagauggucaucaggggaagccaccagggagucccgaagcccuucugagaucaggaaauc

SEQ ID NO: 133283 - RNA, 64 nt, Homo Sapiens
cccaggagugaaggggguucccccacgcuguagagucccgaaaguucgaugucugagaaagagg

SEQ ID NO: 133284 - RNA, 64 nt, Homo Sapiens
ucugcgccucuagugccuuuaucucuucccucuugucccgaagagcagcccuggucucuggcgc

SEQ ID NO: 133285 - RNA, 64 nt, Homo Sapiens
ccugaccucaggugauccgcuguugaccaggcuggucccgaacuguagagacgggguuucacca

SEQ ID NO: 133286 - RNA, 64 nt, Homo Sapiens
gggaaguacauauuggggcacccagagcuugguggucccgaaacccacugccugcauuccaguc

SEQ ID NO: 133287 - RNA, 64 nt, Homo Sapiens
gaucuccuggaagacaaguggucaggccugcccugucccgaaguguugaaggugccaucgcagg

SEQ ID NO: 133288 - RNA, 64 nt, Homo Sapiens
cccuggcaccagggucugccucucacucgcccaggucccgaaggacacugccacagggacgccu

SEQ ID NO: 133289 - RNA, 64 nt, Homo Sapiens
ugaacuccugaccuccugauccacccaccucagcgucccgaagugcugggauuacaggugugag

SEQ ID NO: 133290 - RNA, 64 nt, Homo Sapiens
ccugaccucaagugaucugcugucggucaggguagucccgaacuguagagacaggguuucucca

SEQ ID NO: 133291 - RNA, 58 nt, Homo Sapiens
acggagguucaagcagagugauccuugcgucccgaaggcaggaaaggaagcucccuga

SEQ ID NO: 133292 - RNA, 64 nt, Homo Sapiens
ucuuuugauuuuagcuuuauaaaaucauccacuugucccgaaugacugcagcuuuuuuucaugc

SEQ ID NO: 133293 - RNA, 64 nt, Homo Sapiens
aaggucaacaaaagacugguugugaguugcagcugucccgaaggccccaguugggaagccaugg

SEQ ID NO: 133294 - RNA, 64 nt, Homo Sapiens
uuucuuucaugggcaccaaccugcauuuguaugugucccgaauccacagucguacugauucuaa

SEQ ID NO: 133295 - RNA, 64 nt, Homo Sapiens
aaagccgaagccccuuuccuuaaggcccugguuugucccgaaggggccuaguguucccagcacu

SEQ ID NO: 133296 - RNA, 64 nt, Homo Sapiens
ggacccuugccugccuccuaggcuggaagccauggucccgaaguguagggcaagggugccucag

SEQ ID NO: 133297 - RNA, 64 nt, Homo Sapiens
aucacugccuauaccccucaucacacgucacaaugucccgaauucccagccucaccaccccuuc

SEQ ID NO: 133298 - RNA, 64 nt, Homo Sapiens
ccugccccccacucugcacagccuagacauccaggucccgaaaggggcacugguggccguggug

SEQ ID NO: 133299 - RNA, 64 nt, Homo Sapiens
agacccuuggagagaaaccguugcuagcuugcuggucccgaaagauugcaacuuuggcugcuac

SEQ ID NO: 133300 - RNA, 64 nt, Homo Sapiens
ccggaccccgccuucuugggcgccccggcuuuuagucccgaacuggggcgcacaagcucggccc

SEQ ID NO: 133301 - RNA, 64 nt, Homo Sapiens
cccaagaaaaaucagaaugaggggccccuuaguugucccgaaacggcugcacaucugaggcuuu

SEQ ID NO: 133302 - RNA, 64 nt, Homo Sapiens
ucaccuagccauuucccaacccuaguccuccaccgucccgaagccaacuucacccaugucccca

SEQ ID NO: 133303 - RNA, 64 nt, Homo Sapiens
cuugccugcaggaguacuggcgugggagaccccagucccgaaguauggacaaggccaucccggc

SEQ ID NO: 133304 - RNA, 64 nt, Homo Sapiens
gaguccagaccugggcccugccggagcugggaaggucccgaauguacuucuguguugugauucc

SEQ ID NO: 133305 - RNA, 64 nt, Homo Sapiens
gugagcccagaaaggaagacagcagccaccgucugucccgaagaggcaggccguccuguagguc

SEQ ID NO: 133306 - RNA, 64 nt, Homo Sapiens
cggcucagauagggcucaaaaucucaccagaagugucccgaaauggcuucaugaguguaaugaa

SEQ ID NO: 133307 - RNA, 64 nt, Homo Sapiens; identical to SEQ ID NO: 60353

SEQ ID NO: 133308 - RNA, 64 nt, Homo Sapiens; identical to SEQ ID NO: 60354

SEQ ID NO: 133309 - RNA, 64 nt, Homo Sapiens; identical to SEQ ID NO: 60355

SEQ ID NO: 133310 - RNA, 64 nt, Homo Sapiens; identical to SEQ ID NO: 60356

SEQ ID NO: 133311 - RNA, 64 nt, Homo Sapiens; identical to SEQ ID NO: 60357

SEQ ID NO: 133312 - RNA, 64 nt, Homo Sapiens; identical to SEQ ID NO: 60358
